United States Patent 7,250,289 (METHODS OF GENETIC ANALYSIS OF MOUSE) - sequence listing, part 20

SEQ ID NO: 763573 - DNA, 25 bp, Mus musculus
taccgaattctggaccctgaaggcc

SEQ ID NO: 763574 - DNA, 25 bp, Mus musculus
taccgaatttgtcctatccctagag

SEQ ID NO: 763575 - DNA, 25 bp, Mus musculus
taccgaatttgtgctatccctagag

SEQ ID NO: 763576 - DNA, 25 bp, Mus musculus
taccgacagctccatctattttgaa

SEQ ID NO: 763577 - DNA, 25 bp, Mus musculus
taccgacagctcgatctattttgaa

SEQ ID NO: 763578 - DNA, 25 bp, Mus musculus
taccgacaggatactctaatagaag

SEQ ID NO: 763579 - DNA, 25 bp, Mus musculus
taccgacaggattctctaatagaag

SEQ ID NO: 763580 - DNA, 25 bp, Mus musculus
taccgacagtcgacagggccgcaga

SEQ ID NO: 763581 - DNA, 25 bp, Mus musculus
taccgacagtcgtcagggccgcaga

SEQ ID NO: 763582 - DNA, 25 bp, Mus musculus
taccgaccaagaagtctatctctcc

SEQ ID NO: 763583 - DNA, 25 bp, Mus musculus
taccgaccaagatgtctatctctcc

SEQ ID NO: 763584 - DNA, 25 bp, Mus musculus
taccgaccacagaaagacagcctca

SEQ ID NO: 763585 - DNA, 25 bp, Mus musculus
taccgaccacagtaagacagcctca

SEQ ID NO: 763586 - DNA, 25 bp, Mus musculus
taccgactcaccaactatggctatg

SEQ ID NO: 763587 - DNA, 25 bp, Mus musculus
taccgactcacctactatggctatg

SEQ ID NO: 763588 - DNA, 25 bp, Mus musculus
taccgactctcactccagcagaaga

SEQ ID NO: 763589 - DNA, 25 bp, Mus musculus
taccgactctcagtccagcagaaga

SEQ ID NO: 763590 - DNA, 25 bp, Mus musculus
taccgagaggcaatggaagcagatt

SEQ ID NO: 763591 - DNA, 25 bp, Mus musculus
taccgagaggcattggaagcagatt

SEQ ID NO: 763592 - DNA, 25 bp, Mus musculus
taccgagatgaaccctgtagccttt

SEQ ID NO: 763593 - DNA, 25 bp, Mus musculus
taccgagatgaagcctgtagccttt

SEQ ID NO: 763594 - DNA, 25 bp, Mus musculus
taccgagcccttcgccaggagaatg

SEQ ID NO: 763595 - DNA, 25 bp, Mus musculus
taccgagcccttggccaggagaatg

SEQ ID NO: 763596 - DNA, 25 bp, Mus musculus
taccgagcctctaaagggttcagat

SEQ ID NO: 763597 - DNA, 25 bp, Mus musculus
taccgagcctcttaagggttcagat

SEQ ID NO: 763598 - DNA, 25 bp, Mus musculus
taccgagcctttaaagatttcagat

SEQ ID NO: 763599 - DNA, 25 bp, Mus musculus
taccgagccttttaagatttcagat

SEQ ID NO: 763600 - DNA, 25 bp, Mus musculus
taccgagcggagagccgtgcgtccc

SEQ ID NO: 763601 - DNA, 25 bp, Mus musculus
taccgagcggagtgccgtgcgtccc

SEQ ID NO: 763602 - DNA, 25 bp, Mus musculus
taccgaggactgattgctcagctca

SEQ ID NO: 763603 - DNA, 25 bp, Mus musculus
taccgaggactgtttgctcagctca

SEQ ID NO: 763604 - DNA, 25 bp, Mus musculus
taccgagggaataacgcaatacttt

SEQ ID NO: 763605 - DNA, 25 bp, Mus musculus
taccgagggaattacgcaatacttt

SEQ ID NO: 763606 - DNA, 25 bp, Mus musculus
taccgaggtggtcttgaccttgcat

SEQ ID NO: 763607 - DNA, 25 bp, Mus musculus
taccgaggtggtgttgaccttgcat

SEQ ID NO: 763608 - DNA, 25 bp, Mus musculus
taccgagtcagcagttggagtccag

SEQ ID NO: 763609 - DNA, 25 bp, Mus musculus
taccgagtcagctgttggagtccag

SEQ ID NO: 763610 - DNA, 25 bp, Mus musculus
taccgagttcagatttccttacatt

SEQ ID NO: 763611 - DNA, 25 bp, Mus musculus
taccgagttcagttttccttacatt

SEQ ID NO: 763612 - DNA, 25 bp, Mus musculus
taccgagttcttcgcaaaccggagc

SEQ ID NO: 763613 - DNA, 25 bp, Mus musculus
taccgagttcttggcaaaccggagc

SEQ ID NO: 763614 - DNA, 25 bp, Mus musculus
taccgatccatcatcagctgactga

SEQ ID NO: 763615 - DNA, 25 bp, Mus musculus
taccgatccatcttcagctgactga

SEQ ID NO: 763616 - DNA, 25 bp, Mus musculus
taccgatgatgactacaccgatcta

SEQ ID NO: 763617 - DNA, 25 bp, Mus musculus
taccgatgatgagtacaccgatcta

SEQ ID NO: 763618 - DNA, 25 bp, Mus musculus
taccgcaacagacggccttaacaat

SEQ ID NO: 763619 - DNA, 25 bp, Mus musculus
taccgcaacagagggccttaacaat

SEQ ID NO: 763620 - DNA, 25 bp, Mus musculus
taccgcaagggcatcattctgtttg

SEQ ID NO: 763621 - DNA, 25 bp, Mus musculus
taccgcaagggcttcattctgtttg

SEQ ID NO: 763622 - DNA, 25 bp, Mus musculus
taccgcaaggtcctgcttattgatg

SEQ ID NO: 763623 - DNA, 25 bp, Mus musculus
taccgcaaggtcgtgcttattgatg

SEQ ID NO: 763624 - DNA, 25 bp, Mus musculus
taccgcactgtaagggaacgcctgg

SEQ ID NO: 763625 - DNA, 25 bp, Mus musculus
taccgcactgtatgggaacgcctgg

SEQ ID NO: 763626 - DNA, 25 bp, Mus musculus
taccgcagaccaaaacaacttccag

SEQ ID NO: 763627 - DNA, 25 bp, Mus musculus
taccgcagaccataacaacttccag

SEQ ID NO: 763628 - DNA, 25 bp, Mus musculus
taccgcatcctacagccagatgtca

SEQ ID NO: 763629 - DNA, 25 bp, Mus musculus
taccgcatcctagagccagatgtca

SEQ ID NO: 763630 - DNA, 25 bp, Mus musculus
taccgcatcggtatctgttactcag

SEQ ID NO: 763631 - DNA, 25 bp, Mus musculus
taccgcatcggtttctgttactcag

SEQ ID NO: 763632 - DNA, 25 bp, Mus musculus
taccgccaacctagagaactcaaat

SEQ ID NO: 763633 - DNA, 25 bp, Mus musculus
taccgccaaccttgagaactcaaat

SEQ ID NO: 763634 - DNA, 25 bp, Mus musculus
taccgccaaggcaatagcagtgact

SEQ ID NO: 763635 - DNA, 25 bp, Mus musculus
taccgccaaggctatagcagtgact

SEQ ID NO: 763636 - DNA, 25 bp, Mus musculus
taccgccacagacggagcctggtga

SEQ ID NO: 763637 - DNA, 25 bp, Mus musculus
taccgccacagagggagcctggtga

SEQ ID NO: 763638 - DNA, 25 bp, Mus musculus
taccgccacatgctggatctgcaga

SEQ ID NO: 763639 - DNA, 25 bp, Mus musculus
taccgccacatggtggatctgcaga

SEQ ID NO: 763640 - DNA, 25 bp, Mus musculus
taccgccactttcactttggagtct

SEQ ID NO: 763641 - DNA, 25 bp, Mus musculus
taccgccactttgactttggagtct

SEQ ID NO: 763642 - DNA, 25 bp, Mus musculus
taccgccagcgtaaagatagaaagt

SEQ ID NO: 763643 - DNA, 25 bp, Mus musculus
taccgccagcgttaagatagaaagt

SEQ ID NO: 763644 - DNA, 25 bp, Mus musculus
taccgcccagcgagctctagtggtt

SEQ ID NO: 763645 - DNA, 25 bp, Mus musculus
taccgcccagcgtgctctagtggtt

SEQ ID NO: 763646 - DNA, 25 bp, Mus musculus
taccgcctaaatcttgcaggtatca

SEQ ID NO: 763647 - DNA, 25 bp, Mus musculus
taccgcctaaatgttgcaggtatca

SEQ ID NO: 763648 - DNA, 25 bp, Mus musculus
taccgcctacagcaggtgcaggtaa

SEQ ID NO: 763649 - DNA, 25 bp, Mus musculus
taccgcctacaggaggtgcaggtaa

SEQ ID NO: 763650 - DNA, 25 bp, Mus musculus
taccgcctcatactcagatggcttt

SEQ ID NO: 763651 - DNA, 25 bp, Mus musculus
taccgcctcatagtcagatggcttt

SEQ ID NO: 763652 - DNA, 25 bp, Mus musculus
taccgcctgccacatttcagggatt

SEQ ID NO: 763653 - DNA, 25 bp, Mus musculus
taccgcctgccagatttcagggatt

SEQ ID NO: 763654 - DNA, 25 bp, Mus musculus
taccgcctgcctctagggtcctttt

SEQ ID NO: 763655 - DNA, 25 bp, Mus musculus
taccgcctgcctgtagggtcctttt

SEQ ID NO: 763656 - DNA, 25 bp, Mus musculus
taccgcctgctcatttactacatga

SEQ ID NO: 763657 - DNA, 25 bp, Mus musculus
taccgcctgctcttttactacatga

SEQ ID NO: 763658 - DNA, 25 bp, Mus musculus
taccgcctggttcgacctgggcagt

SEQ ID NO: 763659 - DNA, 25 bp, Mus musculus
taccgcctggttggacctgggcagt

SEQ ID NO: 763660 - DNA, 25 bp, Mus musculus
taccgccttcatcttccaggtttca

SEQ ID NO: 763661 - DNA, 25 bp, Mus musculus
taccgccttcatgttccaggtttca

SEQ ID NO: 763662 - DNA, 25 bp, Mus musculus
taccgccttgccaggaggctggaag

SEQ ID NO: 763663 - DNA, 25 bp, Mus musculus
taccgccttgcctggaggctggaag

SEQ ID NO: 763664 - DNA, 25 bp, Mus musculus
taccgccttgctcccctgaggtagt

SEQ ID NO: 763665 - DNA, 25 bp, Mus musculus
taccgccttgctgccctgaggtagt

SEQ ID NO: 763666 - DNA, 25 bp, Mus musculus
taccgcgaggcacccattgataaga

SEQ ID NO: 763667 - DNA, 25 bp, Mus musculus
taccgcgaggcagccattgataaga

SEQ ID NO: 763668 - DNA, 25 bp, Mus musculus
taccgcgatgccagactttttaaat

SEQ ID NO: 763669 - DNA, 25 bp, Mus musculus
taccgcgatgcctgactttttaaat

SEQ ID NO: 763670 - DNA, 25 bp, Mus musculus
taccgcggacttcagggagcagatt

SEQ ID NO: 763671 - DNA, 25 bp, Mus musculus
taccgcggacttgagggagcagatt

SEQ ID NO: 763672 - DNA, 25 bp, Mus musculus
taccgcggatgcatgactctggagg

SEQ ID NO: 763673 - DNA, 25 bp, Mus musculus
taccgcggatgcttgactctggagg

SEQ ID NO: 763674 - DNA, 25 bp, Mus musculus
taccgcgtagctctccgggagaaaa

SEQ ID NO: 763675 - DNA, 25 bp, Mus musculus
taccgcgtagctgtccgggagaaaa

SEQ ID NO: 763676 - DNA, 25 bp, Mus musculus
taccgcgtgctgagcctggaattag

SEQ ID NO: 763677 - DNA, 25 bp, Mus musculus
taccgcgtgctgtgcctggaattag

SEQ ID NO: 763678 - DNA, 25 bp, Mus musculus
taccgcgttaacatcaccgatttca

SEQ ID NO: 763679 - DNA, 25 bp, Mus musculus
taccgcgttaacttcaccgatttca

SEQ ID NO: 763680 - DNA, 25 bp, Mus musculus
taccgcgtttgcctagcagggagcc

SEQ ID NO: 763681 - DNA, 25 bp, Mus musculus
taccgcgtttgcgtagcagggagcc

SEQ ID NO: 763682 - DNA, 25 bp, Mus musculus
taccgctcacttccattgcaggatc

SEQ ID NO: 763683 - DNA, 25 bp, Mus musculus
taccgctcacttgcattgcaggatc

SEQ ID NO: 763684 - DNA, 25 bp, Mus musculus
taccgctcatatatcccaaagatct

SEQ ID NO: 763685 - DNA, 25 bp, Mus musculus
taccgctcatatttcccaaagatct

SEQ ID NO: 763686 - DNA, 25 bp, Mus musculus
taccgctcccatccagtgagtgctg

SEQ ID NO: 763687 - DNA, 25 bp, Mus musculus
taccgctcccatgcagtgagtgctg

SEQ ID NO: 763688 - DNA, 25 bp, Mus musculus
taccgctctgtgcttacggcgcaag

SEQ ID NO: 763689 - DNA, 25 bp, Mus musculus
taccgctctgtggttacggcgcaag

SEQ ID NO: 763690 - DNA, 25 bp, Mus musculus
taccgctgacaaattgtatcatgat

SEQ ID NO: 763691 - DNA, 25 bp, Mus musculus
taccgctgacaatttgtatcatgat

SEQ ID NO: 763692 - DNA, 25 bp, Mus musculus
taccgctgattgaaatgctgagtct

SEQ ID NO: 763693 - DNA, 25 bp, Mus musculus
taccgctgattgtaatgctgagtct

SEQ ID NO: 763694 - DNA, 25 bp, Mus musculus
taccgctgcgagaatgactttgtca

SEQ ID NO: 763695 - DNA, 25 bp, Mus musculus
taccgctgcgagtatgactttgtca

SEQ ID NO: 763696 - DNA, 25 bp, Mus musculus
taccgctgtcccaagaattggtgct

SEQ ID NO: 763697 - DNA, 25 bp, Mus musculus
taccgctgtccctagaattggtgct

SEQ ID NO: 763698 - DNA, 25 bp, Mus musculus
taccgctgtcgtcctgcgaaggtga

SEQ ID NO: 763699 - DNA, 25 bp, Mus musculus
taccgctgtcgtgctgcgaaggtga

SEQ ID NO: 763700 - DNA, 25 bp, Mus musculus
taccgcttgctgctttttgcgacaa

SEQ ID NO: 763701 - DNA, 25 bp, Mus musculus
taccgcttgctggtttttgcgacaa

SEQ ID NO: 763702 - DNA, 25 bp, Mus musculus
taccgcttggcccaggagttaatgg

SEQ ID NO: 763703 - DNA, 25 bp, Mus musculus
taccgcttggccgaggagttaatgg

SEQ ID NO: 763704 - DNA, 25 bp, Mus musculus
taccgcttgtctatccttaaattgg

SEQ ID NO: 763705 - DNA, 25 bp, Mus musculus
taccgcttgtctttccttaaattgg

SEQ ID NO: 763706 - DNA, 25 bp, Mus musculus
taccgctttgttatgatgcccagct

SEQ ID NO: 763707 - DNA, 25 bp, Mus musculus
taccgctttgttttgatgcccagct

SEQ ID NO: 763708 - DNA, 25 bp, Mus musculus
taccggaactgtacgaccctttgtg

SEQ ID NO: 763709 - DNA, 25 bp, Mus musculus
taccggaactgttcgaccctttgtg

SEQ ID NO: 763710 - DNA, 25 bp, Mus musculus
taccggaagagcctcctgaaaagta

SEQ ID NO: 763711 - DNA, 25 bp, Mus musculus
taccggaagagcgtcctgaaaagta

SEQ ID NO: 763712 - DNA, 25 bp, Mus musculus
taccggaccctgaacagaatcctca

SEQ ID NO: 763713 - DNA, 25 bp, Mus musculus
taccggaccctgtacagaatcctca

SEQ ID NO: 763714 - DNA, 25 bp, Mus musculus
taccggactggcagcatgacatcat

SEQ ID NO: 763715 - DNA, 25 bp, Mus musculus
taccggactggctgcatgacatcat

SEQ ID NO: 763716 - DNA, 25 bp, Mus musculus
taccggagccccataggcttgtgaa

SEQ ID NO: 763717 - DNA, 25 bp, Mus musculus
taccggagccccttaggcttgtgaa

SEQ ID NO: 763718 - DNA, 25 bp, Mus musculus
taccggatacgactttttagtgatc

SEQ ID NO: 763719 - DNA, 25 bp, Mus musculus
taccggatacgagtttttagtgatc

SEQ ID NO: 763720 - DNA, 25 bp, Mus musculus
taccggatgaggatcgcctgctatt

SEQ ID NO: 763721 - DNA, 25 bp, Mus musculus
taccggatgaggttcgcctgctatt

SEQ ID NO: 763722 - DNA, 25 bp, Mus musculus
taccggcaagtaacaccataatcaa

SEQ ID NO: 763723 - DNA, 25 bp, Mus musculus
taccggcaagtatcaccataatcaa

SEQ ID NO: 763724 - DNA, 25 bp, Mus musculus
taccggcacatacttgagaatctgg

SEQ ID NO: 763725 - DNA, 25 bp, Mus musculus
taccggcacatagttgagaatctgg

SEQ ID NO: 763726 - DNA, 25 bp, Mus musculus
taccggcacattaggtaactttaca

SEQ ID NO: 763727 - DNA, 25 bp, Mus musculus
taccggcacatttggtaactttaca

SEQ ID NO: 763728 - DNA, 25 bp, Mus musculus
taccggcagaaaagcaaataccgaa

SEQ ID NO: 763729 - DNA, 25 bp, Mus musculus
taccggcagaaatgcaaataccgaa

SEQ ID NO: 763730 - DNA, 25 bp, Mus musculus
taccggcaggtgatcagctgtgaca

SEQ ID NO: 763731 - DNA, 25 bp, Mus musculus
taccggcaggtgttcagctgtgaca

SEQ ID NO: 763732 - DNA, 25 bp, Mus musculus
taccggcagtggacagtgccccggc

SEQ ID NO: 763733 - DNA, 25 bp, Mus musculus
taccggcagtggtcagtgccccggc

SEQ ID NO: 763734 - DNA, 25 bp, Mus musculus
taccggccaggtctatgatgaaaaa

SEQ ID NO: 763735 - DNA, 25 bp, Mus musculus
taccggccaggtgtatgatgaaaaa

SEQ ID NO: 763736 - DNA, 25 bp, Mus musculus
taccggcccaggctacagtgccgat

SEQ ID NO: 763737 - DNA, 25 bp, Mus musculus
taccggcccagggtacagtgccgat

SEQ ID NO: 763738 - DNA, 25 bp, Mus musculus
taccggccgcccatttgtgagtgtt

SEQ ID NO: 763739 - DNA, 25 bp, Mus musculus
taccggccgcccttttgtgagtgtt

SEQ ID NO: 763740 - DNA, 25 bp, Mus musculus
taccggcctcttccagatagaaagg

SEQ ID NO: 763741 - DNA, 25 bp, Mus musculus
taccggcctcttgcagatagaaagg

SEQ ID NO: 763742 - DNA, 25 bp, Mus musculus
taccggcgaccacgcaagcgtcagt

SEQ ID NO: 763743 - DNA, 25 bp, Mus musculus
taccggcgaccaggcaagcgtcagt

SEQ ID NO: 763744 - DNA, 25 bp, Mus musculus
taccggctggccatttgtgaatttt

SEQ ID NO: 763745 - DNA, 25 bp, Mus musculus
taccggctggccttttgtgaatttt

SEQ ID NO: 763746 - DNA, 25 bp, Mus musculus
taccggctggtccaagagtggtttc

SEQ ID NO: 763747 - DNA, 25 bp, Mus musculus
taccggctggtcgaagagtggtttc

SEQ ID NO: 763748 - DNA, 25 bp, Mus musculus
taccggcttgacagtgagtacacac

SEQ ID NO: 763749 - DNA, 25 bp, Mus musculus
taccggcttgactgtgagtacacac

SEQ ID NO: 763750 - DNA, 25 bp, Mus musculus
taccgggaacggctacataaagcat

SEQ ID NO: 763751 - DNA, 25 bp, Mus musculus
taccgggaacgggtacataaagcat

SEQ ID NO: 763752 - DNA, 25 bp, Mus musculus
taccgggactagcgccaaacaggat

SEQ ID NO: 763753 - DNA, 25 bp, Mus musculus
taccgggactagggccaaacaggat

SEQ ID NO: 763754 - DNA, 25 bp, Mus musculus
taccgggagcacatcgagcagcaga

SEQ ID NO: 763755 - DNA, 25 bp, Mus musculus
taccgggagcacttcgagcagcaga

SEQ ID NO: 763756 - DNA, 25 bp, Mus musculus
taccgggagccacctgaacgggact

SEQ ID NO: 763757 - DNA, 25 bp, Mus musculus
taccgggagccagctgaacgggact

SEQ ID NO: 763758 - DNA, 25 bp, Mus musculus
taccgggagcccaagagcactgtag

SEQ ID NO: 763759 - DNA, 25 bp, Mus musculus
taccgggagccctagagcactgtag

SEQ ID NO: 763760 - DNA, 25 bp, Mus musculus
taccgggagcgtccacctgactgaa

SEQ ID NO: 763761 - DNA, 25 bp, Mus musculus
taccgggagcgtgcacctgactgaa

SEQ ID NO: 763762 - DNA, 25 bp, Mus musculus
taccgggaggcaaataaggacttct

SEQ ID NO: 763763 - DNA, 25 bp, Mus musculus
taccgggaggcatataaggacttct

SEQ ID NO: 763764 - DNA, 25 bp, Mus musculus
taccgggcacctcaacttttttctg

SEQ ID NO: 763765 - DNA, 25 bp, Mus musculus
taccgggcacctgaacttttttctg

SEQ ID NO: 763766 - DNA, 25 bp, Mus musculus
taccgggccatgctagaggctcttg

SEQ ID NO: 763767 - DNA, 25 bp, Mus musculus
taccgggccatggtagaggctcttg

SEQ ID NO: 763768 - DNA, 25 bp, Mus musculus
taccgggctcttcttcggaaagatg

SEQ ID NO: 763769 - DNA, 25 bp, Mus musculus
taccgggctcttgttcggaaagatg

SEQ ID NO: 763770 - DNA, 25 bp, Mus musculus
taccgggtactcatcatctgcggac

SEQ ID NO: 763771 - DNA, 25 bp, Mus musculus
taccgggtactcttcatctgcggac

SEQ ID NO: 763772 - DNA, 25 bp, Mus musculus
taccgggttagcatgtggccagcat

SEQ ID NO: 763773 - DNA, 25 bp, Mus musculus
taccgggttagcttgtggccagcat

SEQ ID NO: 763774 - DNA, 25 bp, Mus musculus
taccgggttggacgcacttgtacta

SEQ ID NO: 763775 - DNA, 25 bp, Mus musculus
taccgggttggaggcacttgtacta

SEQ ID NO: 763776 - DNA, 25 bp, Mus musculus
taccggtacccgcattgggcaattg

SEQ ID NO: 763777 - DNA, 25 bp, Mus musculus
taccggtacccggattgggcaattg

SEQ ID NO: 763778 - DNA, 25 bp, Mus musculus
taccggtcaagcatctctcagcctg

SEQ ID NO: 763779 - DNA, 25 bp, Mus musculus
taccggtcaagcttctctcagcctg

SEQ ID NO: 763780 - DNA, 25 bp, Mus musculus
taccggtcacggaaatactccagtt

SEQ ID NO: 763781 - DNA, 25 bp, Mus musculus
taccggtcacggtaatactccagtt

SEQ ID NO: 763782 - DNA, 25 bp, Mus musculus
taccggtcaggcacttgcggcttac

SEQ ID NO: 763783 - DNA, 25 bp, Mus musculus
taccggtcaggctcttgcggcttac

SEQ ID NO: 763784 - DNA, 25 bp, Mus musculus
taccggtcgatgcaacgagtgatga

SEQ ID NO: 763785 - DNA, 25 bp, Mus musculus
taccggtcgatggaacgagtgatga

SEQ ID NO: 763786 - DNA, 25 bp, Mus musculus
taccggtcgggtagtcagcgatggg

SEQ ID NO: 763787 - DNA, 25 bp, Mus musculus
taccggtcgggttgtcagcgatggg

SEQ ID NO: 763788 - DNA, 25 bp, Mus musculus
taccggtctgtaactgggaaaacga

SEQ ID NO: 763789 - DNA, 25 bp, Mus musculus
taccggtctgtatctgggaaaacga

SEQ ID NO: 763790 - DNA, 25 bp, Mus musculus
taccggtcttgtattgttcttcctg

SEQ ID NO: 763791 - DNA, 25 bp, Mus musculus
taccggtcttgttttgttcttcctg

SEQ ID NO: 763792 - DNA, 25 bp, Mus musculus
taccggtgccttatcaaagacaacg

SEQ ID NO: 763793 - DNA, 25 bp, Mus musculus
taccggtgccttttcaaagacaacg

SEQ ID NO: 763794 - DNA, 25 bp, Mus musculus
taccggtgctggataccaaacccag

SEQ ID NO: 763795 - DNA, 25 bp, Mus musculus
taccggtgctggttaccaaacccag

SEQ ID NO: 763796 - DNA, 25 bp, Mus musculus
taccggtgcttacctttgtcctgct

SEQ ID NO: 763797 - DNA, 25 bp, Mus musculus
taccggtgcttagctttgtcctgct

SEQ ID NO: 763798 - DNA, 25 bp, Mus musculus
taccggtttatcaacatggctgtcc

SEQ ID NO: 763799 - DNA, 25 bp, Mus musculus
taccggtttatctacatggctgtcc

SEQ ID NO: 763800 - DNA, 25 bp, Mus musculus
taccgtaaagttccggctgcctcat

SEQ ID NO: 763801 - DNA, 25 bp, Mus musculus
taccgtaaagttgcggctgcctcat

SEQ ID NO: 763802 - DNA, 25 bp, Mus musculus
taccgtaccaccagagatgcactat

SEQ ID NO: 763803 - DNA, 25 bp, Mus musculus
taccgtaccacctgagatgcactat

SEQ ID NO: 763804 - DNA, 25 bp, Mus musculus
taccgtagagaaaatttacagccct

SEQ ID NO: 763805 - DNA, 25 bp, Mus musculus
taccgtagagaatatttacagccct

SEQ ID NO: 763806 - DNA, 25 bp, Mus musculus
taccgtatcctacagcctgggtttg

SEQ ID NO: 763807 - DNA, 25 bp, Mus musculus
taccgtatcctagagcctgggtttg

SEQ ID NO: 763808 - DNA, 25 bp, Mus musculus
taccgtcaccctcgtgggagttctg

SEQ ID NO: 763809 - DNA, 25 bp, Mus musculus
taccgtcaccctggtgggagttctg

SEQ ID NO: 763810 - DNA, 25 bp, Mus musculus
taccgtcagaagaccacgtgagggt

SEQ ID NO: 763811 - DNA, 25 bp, Mus musculus
taccgtcagaagtccacgtgagggt

SEQ ID NO: 763812 - DNA, 25 bp, Mus musculus
taccgtcatgctagtgccatcacta

SEQ ID NO: 763813 - DNA, 25 bp, Mus musculus
taccgtcatgcttgtgccatcacta

SEQ ID NO: 763814 - DNA, 25 bp, Mus musculus
taccgtcatgtgctgtcatgtctag

SEQ ID NO: 763815 - DNA, 25 bp, Mus musculus
taccgtcatgtggtgtcatgtctag

SEQ ID NO: 763816 - DNA, 25 bp, Mus musculus
taccgtccaagtcccaattggcttt

SEQ ID NO: 763817 - DNA, 25 bp, Mus musculus
taccgtccaagtgccaattggcttt

SEQ ID NO: 763818 - DNA, 25 bp, Mus musculus
taccgtccaggaaacttttcttcta

SEQ ID NO: 763819 - DNA, 25 bp, Mus musculus
taccgtccaggatacttttcttcta

SEQ ID NO: 763820 - DNA, 25 bp, Mus musculus
taccgtccatcccaggttgatttat

SEQ ID NO: 763821 - DNA, 25 bp, Mus musculus
taccgtccatccgaggttgatttat

SEQ ID NO: 763822 - DNA, 25 bp, Mus musculus
taccgtcccctaagttctgctagat

SEQ ID NO: 763823 - DNA, 25 bp, Mus musculus
taccgtcccctatgttctgctagat

SEQ ID NO: 763824 - DNA, 25 bp, Mus musculus
taccgtcctgacattctgagatcat

SEQ ID NO: 763825 - DNA, 25 bp, Mus musculus
taccgtcctgactttctgagatcat

SEQ ID NO: 763826 - DNA, 25 bp, Mus musculus
taccgtcctggtctagctgatgggc

SEQ ID NO: 763827 - DNA, 25 bp, Mus musculus
taccgtcctggtgtagctgatgggc

SEQ ID NO: 763828 - DNA, 25 bp, Mus musculus
taccgtcctgtactgcagcatttga

SEQ ID NO: 763829 - DNA, 25 bp, Mus musculus
taccgtcctgtagtgcagcatttga

SEQ ID NO: 763830 - DNA, 25 bp, Mus musculus
taccgtctgaagcacttctgtgtaa

SEQ ID NO: 763831 - DNA, 25 bp, Mus musculus
taccgtctgaaggacttctgtgtaa

SEQ ID NO: 763832 - DNA, 25 bp, Mus musculus
taccgtcttcatctgactcgctcat

SEQ ID NO: 763833 - DNA, 25 bp, Mus musculus
taccgtcttcatgtgactcgctcat

SEQ ID NO: 763834 - DNA, 25 bp, Mus musculus
taccgtgaccacaaggttaaggtag

SEQ ID NO: 763835 - DNA, 25 bp, Mus musculus
taccgtgaccactaggttaaggtag

SEQ ID NO: 763836 - DNA, 25 bp, Mus musculus
taccgtgacctgcacaatgacctca

SEQ ID NO: 763837 - DNA, 25 bp, Mus musculus
taccgtgacctggacaatgacctca

SEQ ID NO: 763838 - DNA, 25 bp, Mus musculus
taccgtgagaccacagatgccggat

SEQ ID NO: 763839 - DNA, 25 bp, Mus musculus
taccgtgagacctcagatgccggat

SEQ ID NO: 763840 - DNA, 25 bp, Mus musculus
taccgtgagcaaacttgccctttta

SEQ ID NO: 763841 - DNA, 25 bp, Mus musculus
taccgtgagcaatcttgccctttta

SEQ ID NO: 763842 - DNA, 25 bp, Mus musculus
taccgtgaggacatgttagcgcatc

SEQ ID NO: 763843 - DNA, 25 bp, Mus musculus
taccgtgaggacttgttagcgcatc

SEQ ID NO: 763844 - DNA, 25 bp, Mus musculus
taccgtgcagttcacgcggccaaac

SEQ ID NO: 763845 - DNA, 25 bp, Mus musculus
taccgtgcagttgacgcggccaaac

SEQ ID NO: 763846 - DNA, 25 bp, Mus musculus
taccgtgccctgagattggatgtgg

SEQ ID NO: 763847 - DNA, 25 bp, Mus musculus
taccgtgccctgtgattggatgtgg

SEQ ID NO: 763848 - DNA, 25 bp, Mus musculus
taccgtgctccactgactaagctga

SEQ ID NO: 763849 - DNA, 25 bp, Mus musculus
taccgtgctccagtgactaagctga

SEQ ID NO: 763850 - DNA, 25 bp, Mus musculus
taccgtgctttcaggctctttagac

SEQ ID NO: 763851 - DNA, 25 bp, Mus musculus
taccgtgctttctggctctttagac

SEQ ID NO: 763852 - DNA, 25 bp, Mus musculus
taccgtggaacacctctggagtact

SEQ ID NO: 763853 - DNA, 25 bp, Mus musculus
taccgtggaacagctctggagtact

SEQ ID NO: 763854 - DNA, 25 bp, Mus musculus
taccgtggaatacgtccagggacat

SEQ ID NO: 763855 - DNA, 25 bp, Mus musculus
taccgtggaataggtccagggacat

SEQ ID NO: 763856 - DNA, 25 bp, Mus musculus
taccgtggatggcttttcagactgc

SEQ ID NO: 763857 - DNA, 25 bp, Mus musculus
taccgtggatgggttttcagactgc

SEQ ID NO: 763858 - DNA, 25 bp, Mus musculus
taccgtgggtacctgctggcagaaa

SEQ ID NO: 763859 - DNA, 25 bp, Mus musculus
taccgtgggtacgtgctggcagaaa

SEQ ID NO: 763860 - DNA, 25 bp, Mus musculus
taccgtgtctttccaagcgaaggag

SEQ ID NO: 763861 - DNA, 25 bp, Mus musculus
taccgtgtctttgcaagcgaaggag

SEQ ID NO: 763862 - DNA, 25 bp, Mus musculus
taccgtgttattcagatcccttact

SEQ ID NO: 763863 - DNA, 25 bp, Mus musculus
taccgtgttattgagatcccttact

SEQ ID NO: 763864 - DNA, 25 bp, Mus musculus
taccgtgttcagaacgcaaccctgg

SEQ ID NO: 763865 - DNA, 25 bp, Mus musculus
taccgtgttcagtacgcaaccctgg

SEQ ID NO: 763866 - DNA, 25 bp, Mus musculus
taccgtgttctacaagtacttgcaa

SEQ ID NO: 763867 - DNA, 25 bp, Mus musculus
taccgtgttctagaagtacttgcaa

SEQ ID NO: 763868 - DNA, 25 bp, Mus musculus
taccgtgttggtactaggactcaaa

SEQ ID NO: 763869 - DNA, 25 bp, Mus musculus
taccgtgttggttctaggactcaaa

SEQ ID NO: 763870 - DNA, 25 bp, Mus musculus
taccgttaaataccaggtatgtttt

SEQ ID NO: 763871 - DNA, 25 bp, Mus musculus
taccgttaaatagcaggtatgtttt

SEQ ID NO: 763872 - DNA, 25 bp, Mus musculus
taccgttataaaaccagtaattcat

SEQ ID NO: 763873 - DNA, 25 bp, Mus musculus
taccgttataaatccagtaattcat

SEQ ID NO: 763874 - DNA, 25 bp, Mus musculus
taccgttcacgtattagatcagacg

SEQ ID NO: 763875 - DNA, 25 bp, Mus musculus
taccgttcacgttttagatcagacg

SEQ ID NO: 763876 - DNA, 25 bp, Mus musculus
taccgttcccacaatgacatgcaaa

SEQ ID NO: 763877 - DNA, 25 bp, Mus musculus
taccgttcccacaatgatgcactga

SEQ ID NO: 763878 - DNA, 25 bp, Mus musculus
taccgttcccactatgacatgcaaa

SEQ ID NO: 763879 - DNA, 25 bp, Mus musculus
taccgttcccactatgatgcactga

SEQ ID NO: 763880 - DNA, 25 bp, Mus musculus
taccgttctcctcaacctctgggtt

SEQ ID NO: 763881 - DNA, 25 bp, Mus musculus
taccgttctcctgaacctctgggtt

SEQ ID NO: 763882 - DNA, 25 bp, Mus musculus
taccgttgcatcacagtaattgaag

SEQ ID NO: 763883 - DNA, 25 bp, Mus musculus
taccgttgcatctcagtaattgaag

SEQ ID NO: 763884 - DNA, 25 bp, Mus musculus
taccgttgcttgatgtttgtgcttt

SEQ ID NO: 763885 - DNA, 25 bp, Mus musculus
taccgttgcttgttgtttgtgcttt

SEQ ID NO: 763886 - DNA, 25 bp, Mus musculus
taccgttgtcagctctgtggcaaag

SEQ ID NO: 763887 - DNA, 25 bp, Mus musculus
taccgttgtcaggtctgtggcaaag

SEQ ID NO: 763888 - DNA, 25 bp, Mus musculus
taccgtttaggtcagtcacactcca

SEQ ID NO: 763889 - DNA, 25 bp, Mus musculus
taccgtttaggtgagtcacactcca

SEQ ID NO: 763890 - DNA, 25 bp, Mus musculus
taccgtttcaagcaatggtctctga

SEQ ID NO: 763891 - DNA, 25 bp, Mus musculus
taccgtttcaaggaatggtctctga

SEQ ID NO: 763892 - DNA, 25 bp, Mus musculus
taccgtttgggcactatagggccca

SEQ ID NO: 763893 - DNA, 25 bp, Mus musculus
taccgtttgggctctatagggccca

SEQ ID NO: 763894 - DNA, 25 bp, Mus musculus
taccgttttcctagtggttatccag

SEQ ID NO: 763895 - DNA, 25 bp, Mus musculus
taccgttttccttgtggttatccag

SEQ ID NO: 763896 - DNA, 25 bp, Mus musculus
taccgttttgctcttcaatcttaag

SEQ ID NO: 763897 - DNA, 25 bp, Mus musculus
taccgttttgctgttcaatcttaag

SEQ ID NO: 763898 - DNA, 25 bp, Mus musculus
tacctaaaacctactgtgcagcttg

SEQ ID NO: 763899 - DNA, 25 bp, Mus musculus
tacctaaaaccttctgtgcagcttg

SEQ ID NO: 763900 - DNA, 25 bp, Mus musculus
tacctaaataagacattggctgtgg

SEQ ID NO: 763901 - DNA, 25 bp, Mus musculus
tacctaaataagtcattggctgtgg

SEQ ID NO: 763902 - DNA, 25 bp, Mus musculus
tacctaaatctgaaagcccatctct

SEQ ID NO: 763903 - DNA, 25 bp, Mus musculus
tacctaaatctgtaagcccatctct

SEQ ID NO: 763904 - DNA, 25 bp, Mus musculus
tacctaacaatgcaatgctctgcct

SEQ ID NO: 763905 - DNA, 25 bp, Mus musculus
tacctaacaatggaatgctctgcct

SEQ ID NO: 763906 - DNA, 25 bp, Mus musculus
tacctaacctgacctcttggtgctg

SEQ ID NO: 763907 - DNA, 25 bp, Mus musculus
tacctaacctgagctcttggtgctg

SEQ ID NO: 763908 - DNA, 25 bp, Mus musculus
tacctaagaggccaacccggtgctc

SEQ ID NO: 763909 - DNA, 25 bp, Mus musculus
tacctaagaggcgaacccggtgctc

SEQ ID NO: 763910 - DNA, 25 bp, Mus musculus
tacctaagataacacataccatttg

SEQ ID NO: 763911 - DNA, 25 bp, Mus musculus
tacctaagataagacataccatttg

SEQ ID NO: 763912 - DNA, 25 bp, Mus musculus
tacctaaggctgcacgggacagtct

SEQ ID NO: 763913 - DNA, 25 bp, Mus musculus
tacctaaggctgcatctgatcacca

SEQ ID NO: 763914 - DNA, 25 bp, Mus musculus
tacctaaggctggacgggacagtct

SEQ ID NO: 763915 - DNA, 25 bp, Mus musculus
tacctaaggctggatctgatcacca

SEQ ID NO: 763916 - DNA, 25 bp, Mus musculus
tacctaagttccagtgacggttctt

SEQ ID NO: 763917 - DNA, 25 bp, Mus musculus
tacctaagttcctgtgacggttctt

SEQ ID NO: 763918 - DNA, 25 bp, Mus musculus
tacctaatgtttactgagccgacct

SEQ ID NO: 763919 - DNA, 25 bp, Mus musculus
tacctaatgttttctgagccgacct

SEQ ID NO: 763920 - DNA, 25 bp, Mus musculus
tacctaattgctacttccaaaaccg

SEQ ID NO: 763921 - DNA, 25 bp, Mus musculus
tacctaattgcttcttccaaaaccg

SEQ ID NO: 763922 - DNA, 25 bp, Mus musculus
tacctacaaattaaagtctccggat

SEQ ID NO: 763923 - DNA, 25 bp, Mus musculus
tacctacaaatttaagtctccggat

SEQ ID NO: 763924 - DNA, 25 bp, Mus musculus
tacctacactgcaggtttgggatgc

SEQ ID NO: 763925 - DNA, 25 bp, Mus musculus
tacctacactgctggtttgggatgc

SEQ ID NO: 763926 - DNA, 25 bp, Mus musculus
tacctacagtcgctcaaaatccaga

SEQ ID NO: 763927 - DNA, 25 bp, Mus musculus
tacctacagtcggtcaaaatccaga

SEQ ID NO: 763928 - DNA, 25 bp, Mus musculus
tacctacatacacactaaatgtgca

SEQ ID NO: 763929 - DNA, 25 bp, Mus musculus
tacctacatacagactaaatgtgca

SEQ ID NO: 763930 - DNA, 25 bp, Mus musculus
tacctacatagtaatttccctggcc

SEQ ID NO: 763931 - DNA, 25 bp, Mus musculus
tacctacatagttatttccctggcc

SEQ ID NO: 763932 - DNA, 25 bp, Mus musculus
tacctacatccccagcaaagataat

SEQ ID NO: 763933 - DNA, 25 bp, Mus musculus
tacctacatcccgagcaaagataat

SEQ ID NO: 763934 - DNA, 25 bp, Mus musculus
tacctaccacataattgcctttact

SEQ ID NO: 763935 - DNA, 25 bp, Mus musculus
tacctaccacattattgcctttact

SEQ ID NO: 763936 - DNA, 25 bp, Mus musculus
tacctaccatgaccaattggatgcc

SEQ ID NO: 763937 - DNA, 25 bp, Mus musculus
tacctaccatgagcaattggatgcc

SEQ ID NO: 763938 - DNA, 25 bp, Mus musculus
tacctacccgcgctcaatgtgctgg

SEQ ID NO: 763939 - DNA, 25 bp, Mus musculus
tacctacccgcggtcaatgtgctgg

SEQ ID NO: 763940 - DNA, 25 bp, Mus musculus
tacctaccctcgcactacgagaggg

SEQ ID NO: 763941 - DNA, 25 bp, Mus musculus
tacctaccctcggactacgagaggg

SEQ ID NO: 763942 - DNA, 25 bp, Mus musculus
tacctaccgtctactgtgggctgta

SEQ ID NO: 763943 - DNA, 25 bp, Mus musculus
tacctaccgtcttctgtgggctgta

SEQ ID NO: 763944 - DNA, 25 bp, Mus musculus
tacctacctccactgagaccaaaaa

SEQ ID NO: 763945 - DNA, 25 bp, Mus musculus
tacctacctccagtgagaccaaaaa

SEQ ID NO: 763946 - DNA, 25 bp, Mus musculus
tacctacctcccagcagaaagagga

SEQ ID NO: 763947 - DNA, 25 bp, Mus musculus
tacctacctccctgcagaaagagga

SEQ ID NO: 763948 - DNA, 25 bp, Mus musculus
tacctacctcggagggttgggacat

SEQ ID NO: 763949 - DNA, 25 bp, Mus musculus
tacctacctcggtgggttgggacat

SEQ ID NO: 763950 - DNA, 25 bp, Mus musculus
tacctacctgttatcactagcttaa

SEQ ID NO: 763951 - DNA, 25 bp, Mus musculus
tacctacctgttttcactagcttaa

SEQ ID NO: 763952 - DNA, 25 bp, Mus musculus
tacctacgtttgctagcagggccca

SEQ ID NO: 763953 - DNA, 25 bp, Mus musculus
tacctacgtttggtagcagggccca

SEQ ID NO: 763954 - DNA, 25 bp, Mus musculus
tacctactacccagttttagacgag

SEQ ID NO: 763955 - DNA, 25 bp, Mus musculus
tacctactaccctgttttagacgag

SEQ ID NO: 763956 - DNA, 25 bp, Mus musculus
tacctactatgaacacaaacttttg

SEQ ID NO: 763957 - DNA, 25 bp, Mus musculus
tacctactatgatcacaaacttttg

SEQ ID NO: 763958 - DNA, 25 bp, Mus musculus
tacctactcaagaaaatcaacagct

SEQ ID NO: 763959 - DNA, 25 bp, Mus musculus
tacctactcaagtaaatcaacagct

SEQ ID NO: 763960 - DNA, 25 bp, Mus musculus
tacctactgcttcgctgtaaaggtg

SEQ ID NO: 763961 - DNA, 25 bp, Mus musculus
tacctactgcttggctgtaaaggtg

SEQ ID NO: 763962 - DNA, 25 bp, Mus musculus
tacctacttaccattcttttaccat

SEQ ID NO: 763963 - DNA, 25 bp, Mus musculus
tacctacttacctttcttttaccat

SEQ ID NO: 763964 - DNA, 25 bp, Mus musculus
tacctacttccgatacaatggctca

SEQ ID NO: 763965 - DNA, 25 bp, Mus musculus
tacctacttccgttacaatggctca

SEQ ID NO: 763966 - DNA, 25 bp, Mus musculus
tacctagaagttcctgcacagagca

SEQ ID NO: 763967 - DNA, 25 bp, Mus musculus
tacctagaagttgctgcacagagca

SEQ ID NO: 763968 - DNA, 25 bp, Mus musculus
tacctagacttcagtgttcgcgcag

SEQ ID NO: 763969 - DNA, 25 bp, Mus musculus
tacctagacttctgtgttcgcgcag

SEQ ID NO: 763970 - DNA, 25 bp, Mus musculus
tacctagccactaaatgattgaccc

SEQ ID NO: 763971 - DNA, 25 bp, Mus musculus
tacctagccacttaatgattgaccc

SEQ ID NO: 763972 - DNA, 25 bp, Mus musculus
tacctagctggtagtttccgaggac

SEQ ID NO: 763973 - DNA, 25 bp, Mus musculus
tacctagctggttgtttccgaggac

SEQ ID NO: 763974 - DNA, 25 bp, Mus musculus
tacctagctgtacacgtcctttatt

SEQ ID NO: 763975 - DNA, 25 bp, Mus musculus
tacctagctgtagacgtcctttatt

SEQ ID NO: 763976 - DNA, 25 bp, Mus musculus
tacctagcttgtctctcactgtgta

SEQ ID NO: 763977 - DNA, 25 bp, Mus musculus
tacctagcttgtgtctcactgtgta

SEQ ID NO: 763978 - DNA, 25 bp, Mus musculus
tacctaggaagtcaagctgctgtct

SEQ ID NO: 763979 - DNA, 25 bp, Mus musculus
tacctaggaagtgaagctgctgtct

SEQ ID NO: 763980 - DNA, 25 bp, Mus musculus
tacctaggactcagctgtggcattt

SEQ ID NO: 763981 - DNA, 25 bp, Mus musculus
tacctaggactctgctgtggcattt

SEQ ID NO: 763982 - DNA, 25 bp, Mus musculus
tacctaggtcagaagactccatcca

SEQ ID NO: 763983 - DNA, 25 bp, Mus musculus
tacctaggtcagtagactccatcca

SEQ ID NO: 763984 - DNA, 25 bp, Mus musculus
tacctaggttgtcaatccagttcct

SEQ ID NO: 763985 - DNA, 25 bp, Mus musculus
tacctaggttgtgaatccagttcct

SEQ ID NO: 763986 - DNA, 25 bp, Mus musculus
tacctaggttttatgtggctggctt

SEQ ID NO: 763987 - DNA, 25 bp, Mus musculus
tacctaggttttttgtggctggctt

SEQ ID NO: 763988 - DNA, 25 bp, Mus musculus
tacctagtactcaggctcactgcag

SEQ ID NO: 763989 - DNA, 25 bp, Mus musculus
tacctagtactctggctcactgcag

SEQ ID NO: 763990 - DNA, 25 bp, Mus musculus
tacctagtatgtctcttctcggctt

SEQ ID NO: 763991 - DNA, 25 bp, Mus musculus
tacctagtatgtgtcttctcggctt

SEQ ID NO: 763992 - DNA, 25 bp, Mus musculus
tacctagtattcatcaaatggcaaa

SEQ ID NO: 763993 - DNA, 25 bp, Mus musculus
tacctagtattcttcaaatggcaaa

SEQ ID NO: 763994 - DNA, 25 bp, Mus musculus
tacctagtcctcaggtctttggatt

SEQ ID NO: 763995 - DNA, 25 bp, Mus musculus
tacctagtcctctggtctttggatt

SEQ ID NO: 763996 - DNA, 25 bp, Mus musculus
tacctagtggtacatcttaagattc

SEQ ID NO: 763997 - DNA, 25 bp, Mus musculus
tacctagtggtagatcttaagattc

SEQ ID NO: 763998 - DNA, 25 bp, Mus musculus
tacctagtgtttcagcccctaaagg

SEQ ID NO: 763999 - DNA, 25 bp, Mus musculus
tacctagtgtttgagcccctaaagg

SEQ ID NO: 764000 - DNA, 25 bp, Mus musculus
tacctagttgtaatcccaggagcta

SEQ ID NO: 764001 - DNA, 25 bp, Mus musculus
tacctagttgtattcccaggagcta

SEQ ID NO: 764002 - DNA, 25 bp, Mus musculus
tacctagtttgtatcttctgagaca

SEQ ID NO: 764003 - DNA, 25 bp, Mus musculus
tacctagtttgtttcttctgagaca

SEQ ID NO: 764004 - DNA, 25 bp, Mus musculus
tacctatcaatcacaccacaatttc

SEQ ID NO: 764005 - DNA, 25 bp, Mus musculus
tacctatcaatctcaccacaatttc

SEQ ID NO: 764006 - DNA, 25 bp, Mus musculus
tacctatcacaactctgtctcagag

SEQ ID NO: 764007 - DNA, 25 bp, Mus musculus
tacctatcacaagtctgtctcagag

SEQ ID NO: 764008 - DNA, 25 bp, Mus musculus
tacctatcagaaccttgggtgctaa

SEQ ID NO: 764009 - DNA, 25 bp, Mus musculus
tacctatcagaagcttgggtgctaa

SEQ ID NO: 764010 - DNA, 25 bp, Mus musculus
tacctatcattccaccagttctttg

SEQ ID NO: 764011 - DNA, 25 bp, Mus musculus
tacctatcattcgaccagttctttg

SEQ ID NO: 764012 - DNA, 25 bp, Mus musculus
tacctatcgactctgtgacggacat

SEQ ID NO: 764013 - DNA, 25 bp, Mus musculus
tacctatcgactgtgtgacggacat

SEQ ID NO: 764014 - DNA, 25 bp, Mus musculus
tacctatcgtaacttgcacctattg

SEQ ID NO: 764015 - DNA, 25 bp, Mus musculus
tacctatcgtaagttgcacctattg

SEQ ID NO: 764016 - DNA, 25 bp, Mus musculus
tacctatcgtctacttcgtgggaaa

SEQ ID NO: 764017 - DNA, 25 bp, Mus musculus
tacctatcgtcttcttcgtgggaaa

SEQ ID NO: 764018 - DNA, 25 bp, Mus musculus
tacctatctcctccgagatcaaatg

SEQ ID NO: 764019 - DNA, 25 bp, Mus musculus
tacctatctcctcgtctggttagtc

SEQ ID NO: 764020 - DNA, 25 bp, Mus musculus
tacctatctcctgcgagatcaaatg

SEQ ID NO: 764021 - DNA, 25 bp, Mus musculus
tacctatctcctggtctggttagtc

SEQ ID NO: 764022 - DNA, 25 bp, Mus musculus
tacctatgacctcagactccagtga

SEQ ID NO: 764023 - DNA, 25 bp, Mus musculus
tacctatgacctgagactccagtga

SEQ ID NO: 764024 - DNA, 25 bp, Mus musculus
tacctatgattcaactgtttccaaa

SEQ ID NO: 764025 - DNA, 25 bp, Mus musculus
tacctatgattctactgtttccaaa

SEQ ID NO: 764026 - DNA, 25 bp, Mus musculus
tacctatgtagtctcttgccccaaa

SEQ ID NO: 764027 - DNA, 25 bp, Mus musculus
tacctatgtagtgtcttgccccaaa

SEQ ID NO: 764028 - DNA, 25 bp, Mus musculus
tacctatgtatcaggtggcaccacc

SEQ ID NO: 764029 - DNA, 25 bp, Mus musculus
tacctatgtatctggtggcaccacc

SEQ ID NO: 764030 - DNA, 25 bp, Mus musculus
tacctatgtggccgaggagattcca

SEQ ID NO: 764031 - DNA, 25 bp, Mus musculus
tacctatgtggcggaggagattcca

SEQ ID NO: 764032 - DNA, 25 bp, Mus musculus
tacctattcctaattgtttcttgga

SEQ ID NO: 764033 - DNA, 25 bp, Mus musculus
tacctattcctatttgtttcttgga

SEQ ID NO: 764034 - DNA, 25 bp, Mus musculus
tacctattcctgaaagtcttgggcc

SEQ ID NO: 764035 - DNA, 25 bp, Mus musculus
tacctattcctgtaagtcttgggcc

SEQ ID NO: 764036 - DNA, 25 bp, Mus musculus
tacctatttcataacagagtccagt

SEQ ID NO: 764037 - DNA, 25 bp, Mus musculus
tacctatttcattacagagtccagt

SEQ ID NO: 764038 - DNA, 25 bp, Mus musculus
tacctattttggcagcataattggc

SEQ ID NO: 764039 - DNA, 25 bp, Mus musculus
tacctattttgggagcataattggc

SEQ ID NO: 764040 - DNA, 25 bp, Mus musculus
tacctcaacaccacgaagcttattt

SEQ ID NO: 764041 - DNA, 25 bp, Mus musculus
tacctcaacacctcgaagcttattt

SEQ ID NO: 764042 - DNA, 25 bp, Mus musculus
tacctcaacctgagtgactccaaac

SEQ ID NO: 764043 - DNA, 25 bp, Mus musculus
tacctcaacctgtgtgactccaaac

SEQ ID NO: 764044 - DNA, 25 bp, Mus musculus
tacctcaagggaaccagcctgctga

SEQ ID NO: 764045 - DNA, 25 bp, Mus musculus
tacctcaagggatccagcctgctga

SEQ ID NO: 764046 - DNA, 25 bp, Mus musculus
tacctcaatcagcacttgtttaccg

SEQ ID NO: 764047 - DNA, 25 bp, Mus musculus
tacctcaatcaggacttgtttaccg

SEQ ID NO: 764048 - DNA, 25 bp, Mus musculus
tacctcaatctgactgtactcttgg

SEQ ID NO: 764049 - DNA, 25 bp, Mus musculus
tacctcaatctgtctgtactcttgg

SEQ ID NO: 764050 - DNA, 25 bp, Mus musculus
tacctcacacacataccagtttctt

SEQ ID NO: 764051 - DNA, 25 bp, Mus musculus
tacctcacacacttaccagtttctt

SEQ ID NO: 764052 - DNA, 25 bp, Mus musculus
tacctcacagttaggacttcaaggt

SEQ ID NO: 764053 - DNA, 25 bp, Mus musculus
tacctcacagtttggacttcaaggt

SEQ ID NO: 764054 - DNA, 25 bp, Mus musculus
tacctcacccctattgctgatgtgc

SEQ ID NO: 764055 - DNA, 25 bp, Mus musculus
tacctcaccccttttgctgatgtgc

SEQ ID NO: 764056 - DNA, 25 bp, Mus musculus
tacctcacgcgcagaattcaacaaa

SEQ ID NO: 764057 - DNA, 25 bp, Mus musculus
tacctcacgcgctgaattcaacaaa

SEQ ID NO: 764058 - DNA, 25 bp, Mus musculus
tacctcactactacttccatatatg

SEQ ID NO: 764059 - DNA, 25 bp, Mus musculus
tacctcactacttcttccatatatg

SEQ ID NO: 764060 - DNA, 25 bp, Mus musculus
tacctcactcaacatgatatttctt

SEQ ID NO: 764061 - DNA, 25 bp, Mus musculus
tacctcactcaagatgatatttctt

SEQ ID NO: 764062 - DNA, 25 bp, Mus musculus
tacctcactttcattttggccttta

SEQ ID NO: 764063 - DNA, 25 bp, Mus musculus
tacctcactttctttttggccttta

SEQ ID NO: 764064 - DNA, 25 bp, Mus musculus
tacctcagaaggatcccctggcaaa

SEQ ID NO: 764065 - DNA, 25 bp, Mus musculus
tacctcagaaggttcccctggcaaa

SEQ ID NO: 764066 - DNA, 25 bp, Mus musculus
tacctcaggctgcagcaccatggca

SEQ ID NO: 764067 - DNA, 25 bp, Mus musculus
tacctcaggctggagcaccatggca

SEQ ID NO: 764068 - DNA, 25 bp, Mus musculus
tacctcagtgcccaaaacagtgctt

SEQ ID NO: 764069 - DNA, 25 bp, Mus musculus
tacctcagtgccgaaaacagtgctt

SEQ ID NO: 764070 - DNA, 25 bp, Mus musculus
tacctcagtgtaaagccagcttccg

SEQ ID NO: 764071 - DNA, 25 bp, Mus musculus
tacctcagtgtatagccagcttccg

SEQ ID NO: 764072 - DNA, 25 bp, Mus musculus
tacctcagttccagccatgaagaga

SEQ ID NO: 764073 - DNA, 25 bp, Mus musculus
tacctcagttcctgccatgaagaga

SEQ ID NO: 764074 - DNA, 25 bp, Mus musculus
tacctcatagagactgtgcgacaga

SEQ ID NO: 764075 - DNA, 25 bp, Mus musculus
tacctcatagagtctgtgcgacaga

SEQ ID NO: 764076 - DNA, 25 bp, Mus musculus
tacctcatgaggctttcctgggaaa

SEQ ID NO: 764077 - DNA, 25 bp, Mus musculus
tacctcatgagggtttcctgggaaa

SEQ ID NO: 764078 - DNA, 25 bp, Mus musculus
tacctcatgagtacaggtgtctttg

SEQ ID NO: 764079 - DNA, 25 bp, Mus musculus
tacctcatgagttcaggtgtctttg

SEQ ID NO: 764080 - DNA, 25 bp, Mus musculus
tacctcatggcgcatctcaagagag

SEQ ID NO: 764081 - DNA, 25 bp, Mus musculus
tacctcatggcggatctcaagagag

SEQ ID NO: 764082 - DNA, 25 bp, Mus musculus
tacctcattaccactttgaaagcat

SEQ ID NO: 764083 - DNA, 25 bp, Mus musculus
tacctcattacctctttgaaagcat

SEQ ID NO: 764084 - DNA, 25 bp, Mus musculus
tacctcattcatctgcagcttttta

SEQ ID NO: 764085 - DNA, 25 bp, Mus musculus
tacctcattcatgtgcagcttttta

SEQ ID NO: 764086 - DNA, 25 bp, Mus musculus
tacctcatttgtagtgtgactgagt

SEQ ID NO: 764087 - DNA, 25 bp, Mus musculus
tacctcatttgttgtgtgactgagt

SEQ ID NO: 764088 - DNA, 25 bp, Mus musculus
tacctcattttcctgcgtgcttaag

SEQ ID NO: 764089 - DNA, 25 bp, Mus musculus
tacctcattttcgtgcgtgcttaag

SEQ ID NO: 764090 - DNA, 25 bp, Mus musculus
tacctccacccaagagtgcaataga

SEQ ID NO: 764091 - DNA, 25 bp, Mus musculus
tacctccacccatgagtgcaataga

SEQ ID NO: 764092 - DNA, 25 bp, Mus musculus
tacctccaccgtactaagtttctat

SEQ ID NO: 764093 - DNA, 25 bp, Mus musculus
tacctccaccgttctaagtttctat

SEQ ID NO: 764094 - DNA, 25 bp, Mus musculus
tacctccacgggaaggtgtgagcat

SEQ ID NO: 764095 - DNA, 25 bp, Mus musculus
tacctccacgggtaggtgtgagcat

SEQ ID NO: 764096 - DNA, 25 bp, Mus musculus
tacctccagctccagaaactgtatt

SEQ ID NO: 764097 - DNA, 25 bp, Mus musculus
tacctccagctcctcaccatgaact

SEQ ID NO: 764098 - DNA, 25 bp, Mus musculus
tacctccagctcgagaaactgtatt

SEQ ID NO: 764099 - DNA, 25 bp, Mus musculus
tacctccagctcgtcaccatgaact

SEQ ID NO: 764100 - DNA, 25 bp, Mus musculus
tacctccagcttcagactactatga

SEQ ID NO: 764101 - DNA, 25 bp, Mus musculus
tacctccagcttgagactactatga

SEQ ID NO: 764102 - DNA, 25 bp, Mus musculus
tacctccaggcgaatcccgatggga

SEQ ID NO: 764103 - DNA, 25 bp, Mus musculus
tacctccaggcgtatcccgatggga

SEQ ID NO: 764104 - DNA, 25 bp, Mus musculus
tacctccagggcaacttcatgatat

SEQ ID NO: 764105 - DNA, 25 bp, Mus musculus
tacctccagggctacttcatgatat

SEQ ID NO: 764106 - DNA, 25 bp, Mus musculus
tacctccagtgtcttatttaactta

SEQ ID NO: 764107 - DNA, 25 bp, Mus musculus
tacctccagtgtgttatttaactta

SEQ ID NO: 764108 - DNA, 25 bp, Mus musculus
tacctccatcacatgtacactaaga

SEQ ID NO: 764109 - DNA, 25 bp, Mus musculus
tacctccatcacttgtacactaaga

SEQ ID NO: 764110 - DNA, 25 bp, Mus musculus
tacctccatctaacagttgctggga

SEQ ID NO: 764111 - DNA, 25 bp, Mus musculus
tacctccatctatcagttgctggga

SEQ ID NO: 764112 - DNA, 25 bp, Mus musculus
tacctccatggtcaaaaagccgcac

SEQ ID NO: 764113 - DNA, 25 bp, Mus musculus
tacctccatggtgaaaaagccgcac

SEQ ID NO: 764114 - DNA, 25 bp, Mus musculus
tacctccattccctgttgctgtttg

SEQ ID NO: 764115 - DNA, 25 bp, Mus musculus
tacctccattccgtgttgctgtttg

SEQ ID NO: 764116 - DNA, 25 bp, Mus musculus
tacctccattgccatgttgtggcat

SEQ ID NO: 764117 - DNA, 25 bp, Mus musculus
tacctccattgcgatgttgtggcat

SEQ ID NO: 764118 - DNA, 25 bp, Mus musculus
tacctcccaaccagggtagagatga

SEQ ID NO: 764119 - DNA, 25 bp, Mus musculus
tacctcccaacctgggtagagatga

SEQ ID NO: 764120 - DNA, 25 bp, Mus musculus
tacctcccaactacatatgcgtttt

SEQ ID NO: 764121 - DNA, 25 bp, Mus musculus
tacctcccaacttcatatgcgtttt

SEQ ID NO: 764122 - DNA, 25 bp, Mus musculus
tacctcccacggaagactggcttgg

SEQ ID NO: 764123 - DNA, 25 bp, Mus musculus
tacctcccacggtagactggcttgg

SEQ ID NO: 764124 - DNA, 25 bp, Mus musculus
tacctcccactgactctgaaatatg

SEQ ID NO: 764125 - DNA, 25 bp, Mus musculus
tacctcccactgtctctgaaatatg

SEQ ID NO: 764126 - DNA, 25 bp, Mus musculus
tacctcccaggaagactgtgtgagc

SEQ ID NO: 764127 - DNA, 25 bp, Mus musculus
tacctcccaggatgactgtgtgagc

SEQ ID NO: 764128 - DNA, 25 bp, Mus musculus
tacctcccaggcattaaaatttcat

SEQ ID NO: 764129 - DNA, 25 bp, Mus musculus
tacctcccaggctttaaaatttcat

SEQ ID NO: 764130 - DNA, 25 bp, Mus musculus
tacctcccatagaagtgtattctta

SEQ ID NO: 764131 - DNA, 25 bp, Mus musculus
tacctcccatagtagtgtattctta

SEQ ID NO: 764132 - DNA, 25 bp, Mus musculus
tacctcccatttagtctctttgtta

SEQ ID NO: 764133 - DNA, 25 bp, Mus musculus
tacctcccattttgtctctttgtta

SEQ ID NO: 764134 - DNA, 25 bp, Mus musculus
tacctccccaggagggttctggaag

SEQ ID NO: 764135 - DNA, 25 bp, Mus musculus
tacctccccaggtgggttctggaag

SEQ ID NO: 764136 - DNA, 25 bp, Mus musculus
tacctcccctgtcatggtatttgag

SEQ ID NO: 764137 - DNA, 25 bp, Mus musculus
tacctcccctgtgatggtatttgag

SEQ ID NO: 764138 - DNA, 25 bp, Mus musculus
tacctcccgaagatgtagcagaccc

SEQ ID NO: 764139 - DNA, 25 bp, Mus musculus
tacctcccgaagttgtagcagaccc

SEQ ID NO: 764140 - DNA, 25 bp, Mus musculus
tacctccgatgacagaaacgtgctt

SEQ ID NO: 764141 - DNA, 25 bp, Mus musculus
tacctccgatgagagaaacgtgctt

SEQ ID NO: 764142 - DNA, 25 bp, Mus musculus
tacctccggcttatacaactgttaa

SEQ ID NO: 764143 - DNA, 25 bp, Mus musculus
tacctccggcttttacaactgttaa

SEQ ID NO: 764144 - DNA, 25 bp, Mus musculus
tacctccgggctactgcacagactt

SEQ ID NO: 764145 - DNA, 25 bp, Mus musculus
tacctccgggcttctgcacagactt

SEQ ID NO: 764146 - DNA, 25 bp, Mus musculus
tacctcctaaggaaaaactcatagg

SEQ ID NO: 764147 - DNA, 25 bp, Mus musculus
tacctcctaaggtaaaactcatagg

SEQ ID NO: 764148 - DNA, 25 bp, Mus musculus
tacctcctaccacattgctgacatt

SEQ ID NO: 764149 - DNA, 25 bp, Mus musculus
tacctcctaccagattgctgacatt

SEQ ID NO: 764150 - DNA, 25 bp, Mus musculus
tacctcctctgcagttagtttcaag

SEQ ID NO: 764151 - DNA, 25 bp, Mus musculus
tacctcctctgctgttagtttcaag

SEQ ID NO: 764152 - DNA, 25 bp, Mus musculus
tacctcctgcgtcttgagatgacag

SEQ ID NO: 764153 - DNA, 25 bp, Mus musculus
tacctcctgcgtgttgagatgacag

SEQ ID NO: 764154 - DNA, 25 bp, Mus musculus
tacctcctgcttcgtttatttgtta

SEQ ID NO: 764155 - DNA, 25 bp, Mus musculus
tacctcctgcttggtttatttgtta

SEQ ID NO: 764156 - DNA, 25 bp, Mus musculus
tacctcctgttcataggtttccagt

SEQ ID NO: 764157 - DNA, 25 bp, Mus musculus
tacctcctgttcttaggtttccagt

SEQ ID NO: 764158 - DNA, 25 bp, Mus musculus
tacctcctgtttccatcattttgat

SEQ ID NO: 764159 - DNA, 25 bp, Mus musculus
tacctcctgtttgcatcattttgat

SEQ ID NO: 764160 - DNA, 25 bp, Mus musculus
tacctccttaaacagccttcaaggc

SEQ ID NO: 764161 - DNA, 25 bp, Mus musculus
tacctccttaaagagccttcaaggc

SEQ ID NO: 764162 - DNA, 25 bp, Mus musculus
tacctcgccttgagcctggaatgtg

SEQ ID NO: 764163 - DNA, 25 bp, Mus musculus
tacctcgccttgtgcctggaatgtg

SEQ ID NO: 764164 - DNA, 25 bp, Mus musculus
tacctcggaggccacatgctgtgtg

SEQ ID NO: 764165 - DNA, 25 bp, Mus musculus
tacctcggaggcgacatgctgtgtg

SEQ ID NO: 764166 - DNA, 25 bp, Mus musculus
tacctcggagtccacctgagaagga

SEQ ID NO: 764167 - DNA, 25 bp, Mus musculus
tacctcggagtcgacctgagaagga

SEQ ID NO: 764168 - DNA, 25 bp, Mus musculus
tacctcggctcacagtgggacctgg

SEQ ID NO: 764169 - DNA, 25 bp, Mus musculus
tacctcggctcagagtgggacctgg

SEQ ID NO: 764170 - DNA, 25 bp, Mus musculus
tacctcgggaagcagctcagtcagt

SEQ ID NO: 764171 - DNA, 25 bp, Mus musculus
tacctcgggaaggagctcagtcagt

SEQ ID NO: 764172 - DNA, 25 bp, Mus musculus
tacctcgggaatactacggacaatt

SEQ ID NO: 764173 - DNA, 25 bp, Mus musculus
tacctcgggaattctacggacaatt

SEQ ID NO: 764174 - DNA, 25 bp, Mus musculus
tacctcgggacgacattcattcatt

SEQ ID NO: 764175 - DNA, 25 bp, Mus musculus
tacctcgggacgtcattcattcatt

SEQ ID NO: 764176 - DNA, 25 bp, Mus musculus
tacctcgggatcataccgggattgt

SEQ ID NO: 764177 - DNA, 25 bp, Mus musculus
tacctcgggatcttaccgggattgt

SEQ ID NO: 764178 - DNA, 25 bp, Mus musculus
tacctcgggcaaactcttcatccta

SEQ ID NO: 764179 - DNA, 25 bp, Mus musculus
tacctcgggcaatctcttcatccta

SEQ ID NO: 764180 - DNA, 25 bp, Mus musculus
tacctcggtgccatttgcataaagc

SEQ ID NO: 764181 - DNA, 25 bp, Mus musculus
tacctcggtgccttttgcataaagc

SEQ ID NO: 764182 - DNA, 25 bp, Mus musculus
tacctcgtaggtatctgagcgaaac

SEQ ID NO: 764183 - DNA, 25 bp, Mus musculus
tacctcgtaggtttctgagcgaaac

SEQ ID NO: 764184 - DNA, 25 bp, Mus musculus
tacctcgtcagtctgcattgtgtct

SEQ ID NO: 764185 - DNA, 25 bp, Mus musculus
tacctcgtcagtgtgcattgtgtct

SEQ ID NO: 764186 - DNA, 25 bp, Mus musculus
tacctcgtgaggaggagggcattcc

SEQ ID NO: 764187 - DNA, 25 bp, Mus musculus
tacctcgtgaggtggagggcattcc

SEQ ID NO: 764188 - DNA, 25 bp, Mus musculus
tacctcgtttgtcgtgtaactgggc

SEQ ID NO: 764189 - DNA, 25 bp, Mus musculus
tacctcgtttgtggtgtaactgggc

SEQ ID NO: 764190 - DNA, 25 bp, Mus musculus
tacctctaaattagtggatttttct

SEQ ID NO: 764191 - DNA, 25 bp, Mus musculus
tacctctaaatttgtggatttttct

SEQ ID NO: 764192 - DNA, 25 bp, Mus musculus
tacctctacaagatctcctttcaga

SEQ ID NO: 764193 - DNA, 25 bp, Mus musculus
tacctctacaagttctcctttcaga

SEQ ID NO: 764194 - DNA, 25 bp, Mus musculus
tacctctacacacgacggtgctctt

SEQ ID NO: 764195 - DNA, 25 bp, Mus musculus
tacctctacacaggacggtgctctt

SEQ ID NO: 764196 - DNA, 25 bp, Mus musculus
tacctctacaccaagaaggttggga

SEQ ID NO: 764197 - DNA, 25 bp, Mus musculus
tacctctacacctagaaggttggga

SEQ ID NO: 764198 - DNA, 25 bp, Mus musculus
tacctctatggactccacatctggg

SEQ ID NO: 764199 - DNA, 25 bp, Mus musculus
tacctctatggagtccacatctggg

SEQ ID NO: 764200 - DNA, 25 bp, Mus musculus
tacctctattttcctcggtgggatt

SEQ ID NO: 764201 - DNA, 25 bp, Mus musculus
tacctctattttgctcggtgggatt

SEQ ID NO: 764202 - DNA, 25 bp, Mus musculus
tacctctcacgtctggtttttacta

SEQ ID NO: 764203 - DNA, 25 bp, Mus musculus
tacctctcacgtgtggtttttacta

SEQ ID NO: 764204 - DNA, 25 bp, Mus musculus
tacctctcactcaagtcccaataga

SEQ ID NO: 764205 - DNA, 25 bp, Mus musculus
tacctctcactctagtcccaataga

SEQ ID NO: 764206 - DNA, 25 bp, Mus musculus
tacctctcagagaatccagatgcgg

SEQ ID NO: 764207 - DNA, 25 bp, Mus musculus
tacctctcagagtatccagatgcgg

SEQ ID NO: 764208 - DNA, 25 bp, Mus musculus
tacctctcagtaatatttgcacatt

SEQ ID NO: 764209 - DNA, 25 bp, Mus musculus
tacctctcagtattatttgcacatt

SEQ ID NO: 764210 - DNA, 25 bp, Mus musculus
tacctctcatgcctgttttacctgt

SEQ ID NO: 764211 - DNA, 25 bp, Mus musculus
tacctctcatgcgtgttttacctgt

SEQ ID NO: 764212 - DNA, 25 bp, Mus musculus
tacctctcccaacaggttgttttgt

SEQ ID NO: 764213 - DNA, 25 bp, Mus musculus
tacctctcccaagaggttgttttgt

SEQ ID NO: 764214 - DNA, 25 bp, Mus musculus
tacctctcgagtacatggtttcttt

SEQ ID NO: 764215 - DNA, 25 bp, Mus musculus
tacctctcgagttcatggtttcttt

SEQ ID NO: 764216 - DNA, 25 bp, Mus musculus
tacctctctaggacaagtgcacaca

SEQ ID NO: 764217 - DNA, 25 bp, Mus musculus
tacctctctaggtcaagtgcacaca

SEQ ID NO: 764218 - DNA, 25 bp, Mus musculus
tacctctctatcatatctatctgtc

SEQ ID NO: 764219 - DNA, 25 bp, Mus musculus
tacctctctatcttatctatctgtc

SEQ ID NO: 764220 - DNA, 25 bp, Mus musculus
tacctctctggccaatcaaaactta

SEQ ID NO: 764221 - DNA, 25 bp, Mus musculus
tacctctctggcgaatcaaaactta

SEQ ID NO: 764222 - DNA, 25 bp, Mus musculus
tacctctgacaaacgtgctaccaaa

SEQ ID NO: 764223 - DNA, 25 bp, Mus musculus
tacctctgacaatcgtgctaccaaa

SEQ ID NO: 764224 - DNA, 25 bp, Mus musculus
tacctctgacagataggctggtctt

SEQ ID NO: 764225 - DNA, 25 bp, Mus musculus
tacctctgacagttaggctggtctt

SEQ ID NO: 764226 - DNA, 25 bp, Mus musculus
tacctctgcaggcttccttgggaag

SEQ ID NO: 764227 - DNA, 25 bp, Mus musculus
tacctctgcagggttccttgggaag

SEQ ID NO: 764228 - DNA, 25 bp, Mus musculus
tacctctgccatccttagatacgtg

SEQ ID NO: 764229 - DNA, 25 bp, Mus musculus
tacctctgccatgcttagatacgtg

SEQ ID NO: 764230 - DNA, 25 bp, Mus musculus
tacctctgcctcattccagaactga

SEQ ID NO: 764231 - DNA, 25 bp, Mus musculus
tacctctgcctctttccagaactga

SEQ ID NO: 764232 - DNA, 25 bp, Mus musculus
tacctctggagcctggtggacacca

SEQ ID NO: 764233 - DNA, 25 bp, Mus musculus
tacctctggagcgtggtggacacca

SEQ ID NO: 764234 - DNA, 25 bp, Mus musculus
tacctctggcctatgtgacattgac

SEQ ID NO: 764235 - DNA, 25 bp, Mus musculus
tacctctggcctttgtgacattgac

SEQ ID NO: 764236 - DNA, 25 bp, Mus musculus
tacctctggtgcatccaagtcttag

SEQ ID NO: 764237 - DNA, 25 bp, Mus musculus
tacctctggtgcttccaagtcttag

SEQ ID NO: 764238 - DNA, 25 bp, Mus musculus
tacctctgtacaaaaaagtggctcc

SEQ ID NO: 764239 - DNA, 25 bp, Mus musculus
tacctctgtacataaaagtggctcc

SEQ ID NO: 764240 - DNA, 25 bp, Mus musculus
tacctctgtcccctttagatgacta

SEQ ID NO: 764241 - DNA, 25 bp, Mus musculus
tacctctgtcccgtttagatgacta

SEQ ID NO: 764242 - DNA, 25 bp, Mus musculus
tacctctgtccgctggtgtgtgaca

SEQ ID NO: 764243 - DNA, 25 bp, Mus musculus
tacctctgtccggtggtgtgtgaca

SEQ ID NO: 764244 - DNA, 25 bp, Mus musculus
tacctctgtctcagaggctgcctgt

SEQ ID NO: 764245 - DNA, 25 bp, Mus musculus
tacctctgtctctgaggctgcctgt

SEQ ID NO: 764246 - DNA, 25 bp, Mus musculus
tacctctgtggcactggagaagcac

SEQ ID NO: 764247 - DNA, 25 bp, Mus musculus
tacctctgtggctctggagaagcac

SEQ ID NO: 764248 - DNA, 25 bp, Mus musculus
tacctctgttctctgtgagcacaaa

SEQ ID NO: 764249 - DNA, 25 bp, Mus musculus
tacctctgttctgtgtgagcacaaa

SEQ ID NO: 764250 - DNA, 25 bp, Mus musculus
tacctcttacagatcatgtacacag

SEQ ID NO: 764251 - DNA, 25 bp, Mus musculus
tacctcttacagttcatgtacacag

SEQ ID NO: 764252 - DNA, 25 bp, Mus musculus
tacctcttcaaaacaggaactcaga

SEQ ID NO: 764253 - DNA, 25 bp, Mus musculus
tacctcttcaaatcaggaactcaga

SEQ ID NO: 764254 - DNA, 25 bp, Mus musculus
tacctcttcaacacttctaatggac

SEQ ID NO: 764255 - DNA, 25 bp, Mus musculus
tacctcttcaactcttctaatggac

SEQ ID NO: 764256 - DNA, 25 bp, Mus musculus
tacctcttcattccagcgctgttgg

SEQ ID NO: 764257 - DNA, 25 bp, Mus musculus
tacctcttcattgcagcgctgttgg

SEQ ID NO: 764258 - DNA, 25 bp, Mus musculus
tacctcttcccaaagggcagggagt

SEQ ID NO: 764259 - DNA, 25 bp, Mus musculus
tacctcttcccatagggcagggagt

SEQ ID NO: 764260 - DNA, 25 bp, Mus musculus
tacctcttccctagactccaagaat

SEQ ID NO: 764261 - DNA, 25 bp, Mus musculus
tacctcttcccttgactccaagaat

SEQ ID NO: 764262 - DNA, 25 bp, Mus musculus
tacctcttccggaacatcacagtgg

SEQ ID NO: 764263 - DNA, 25 bp, Mus musculus
tacctcttccggtacatcacagtgg

SEQ ID NO: 764264 - DNA, 25 bp, Mus musculus
tacctcttctggatttcaggactca

SEQ ID NO: 764265 - DNA, 25 bp, Mus musculus
tacctcttctggttttcaggactca

SEQ ID NO: 764266 - DNA, 25 bp, Mus musculus
tacctcttctgtctcgatgtggata

SEQ ID NO: 764267 - DNA, 25 bp, Mus musculus
tacctcttctgtgtcgatgtggata

SEQ ID NO: 764268 - DNA, 25 bp, Mus musculus
tacctcttgagcaataatcctggcc

SEQ ID NO: 764269 - DNA, 25 bp, Mus musculus
tacctcttgagctataatcctggcc

SEQ ID NO: 764270 - DNA, 25 bp, Mus musculus
tacctctttaaaactctgaataaac

SEQ ID NO: 764271 - DNA, 25 bp, Mus musculus
tacctctttaaatctctgaataaac

SEQ ID NO: 764272 - DNA, 25 bp, Mus musculus
tacctctttctcctctgtgacgtgt

SEQ ID NO: 764273 - DNA, 25 bp, Mus musculus
tacctctttctcgtctgtgacgtgt

SEQ ID NO: 764274 - DNA, 25 bp, Mus musculus
tacctctttcttccctgagtgtaaa

SEQ ID NO: 764275 - DNA, 25 bp, Mus musculus
tacctctttcttgcctgagtgtaaa

SEQ ID NO: 764276 - DNA, 25 bp, Mus musculus
tacctctttgagcaactttgatgtt

SEQ ID NO: 764277 - DNA, 25 bp, Mus musculus
tacctctttgaggaactttgatgtt

SEQ ID NO: 764278 - DNA, 25 bp, Mus musculus
tacctctttgtaaaagtacctgtgt

SEQ ID NO: 764279 - DNA, 25 bp, Mus musculus
tacctctttgtactcctgaaggcat

SEQ ID NO: 764280 - DNA, 25 bp, Mus musculus
tacctctttgtagtcctgaaggcat

SEQ ID NO: 764281 - DNA, 25 bp, Mus musculus
tacctctttgtataagtacctgtgt

SEQ ID NO: 764282 - DNA, 25 bp, Mus musculus
tacctctttttgctaatcaaggcat

SEQ ID NO: 764283 - DNA, 25 bp, Mus musculus
tacctctttttggtaatcaaggcat

SEQ ID NO: 764284 - DNA, 25 bp, Mus musculus
tacctgaaacctcacgtggcttttc

SEQ ID NO: 764285 - DNA, 25 bp, Mus musculus
tacctgaaacctgacgtggcttttc

SEQ ID NO: 764286 - DNA, 25 bp, Mus musculus
tacctgaaactgagggcagctccga

SEQ ID NO: 764287 - DNA, 25 bp, Mus musculus
tacctgaaactgtgggcagctccga

SEQ ID NO: 764288 - DNA, 25 bp, Mus musculus
tacctgaactgaccctaccacaaag

SEQ ID NO: 764289 - DNA, 25 bp, Mus musculus
tacctgaactgagcctaccacaaag

SEQ ID NO: 764290 - DNA, 25 bp, Mus musculus
tacctgaagacaacggccttggttt

SEQ ID NO: 764291 - DNA, 25 bp, Mus musculus
tacctgaagacatcggccttggttt

SEQ ID NO: 764292 - DNA, 25 bp, Mus musculus
tacctgaagactacattcttggact

SEQ ID NO: 764293 - DNA, 25 bp, Mus musculus
tacctgaagacttcattcttggact

SEQ ID NO: 764294 - DNA, 25 bp, Mus musculus
tacctgaagcttatcggcaccctta

SEQ ID NO: 764295 - DNA, 25 bp, Mus musculus
tacctgaagcttttcggcaccctta

SEQ ID NO: 764296 - DNA, 25 bp, Mus musculus
tacctgaaggagctctgtctctgtc

SEQ ID NO: 764297 - DNA, 25 bp, Mus musculus
tacctgaaggaggtctgtctctgtc

SEQ ID NO: 764298 - DNA, 25 bp, Mus musculus
tacctgaagggtatgagcaatgctt

SEQ ID NO: 764299 - DNA, 25 bp, Mus musculus
tacctgaagggtttgagcaatgctt

SEQ ID NO: 764300 - DNA, 25 bp, Mus musculus
tacctgaaggtcaaggcctgtgagt

SEQ ID NO: 764301 - DNA, 25 bp, Mus musculus
tacctgaaggtctaggcctgtgagt

SEQ ID NO: 764302 - DNA, 25 bp, Mus musculus
tacctgaatggtaatgtatttgaaa

SEQ ID NO: 764303 - DNA, 25 bp, Mus musculus
tacctgaatggttatgtatttgaaa

SEQ ID NO: 764304 - DNA, 25 bp, Mus musculus
tacctgacatgccttctagtttctg

SEQ ID NO: 764305 - DNA, 25 bp, Mus musculus
tacctgacatgcgttctagtttctg

SEQ ID NO: 764306 - DNA, 25 bp, Mus musculus
tacctgacctggctacgctttatct

SEQ ID NO: 764307 - DNA, 25 bp, Mus musculus
tacctgacctgggtacgctttatct

SEQ ID NO: 764308 - DNA, 25 bp, Mus musculus
tacctgaccttacttctttcagaga

SEQ ID NO: 764309 - DNA, 25 bp, Mus musculus
tacctgaccttagttctttcagaga

SEQ ID NO: 764310 - DNA, 25 bp, Mus musculus
tacctgactgagaagacgcgggcgt

SEQ ID NO: 764311 - DNA, 25 bp, Mus musculus
tacctgactgagtagacgcgggcgt

SEQ ID NO: 764312 - DNA, 25 bp, Mus musculus
tacctgactgtgcacaattttaaga

SEQ ID NO: 764313 - DNA, 25 bp, Mus musculus
tacctgactgtggacaattttaaga

SEQ ID NO: 764314 - DNA, 25 bp, Mus musculus
tacctgagactcagtagtaacaaac

SEQ ID NO: 764315 - DNA, 25 bp, Mus musculus
tacctgagactctgtagtaacaaac

SEQ ID NO: 764316 - DNA, 25 bp, Mus musculus
tacctgagctacagctacaaggttt

SEQ ID NO: 764317 - DNA, 25 bp, Mus musculus
tacctgagctactgctacaaggttt

SEQ ID NO: 764318 - DNA, 25 bp, Mus musculus
tacctgagggacaacctttgaccta

SEQ ID NO: 764319 - DNA, 25 bp, Mus musculus
tacctgagggactacctttgaccta

SEQ ID NO: 764320 - DNA, 25 bp, Mus musculus
tacctgaggtatccagttcacacag

SEQ ID NO: 764321 - DNA, 25 bp, Mus musculus
tacctgaggtatgcagttcacacag

SEQ ID NO: 764322 - DNA, 25 bp, Mus musculus
tacctgagtcagagcgtggaatcgg

SEQ ID NO: 764323 - DNA, 25 bp, Mus musculus
tacctgagtcagtgcgtggaatcgg

SEQ ID NO: 764324 - DNA, 25 bp, Mus musculus
tacctgagtgtgagtggtttcaagg

SEQ ID NO: 764325 - DNA, 25 bp, Mus musculus
tacctgagtgtgtgtggtttcaagg

SEQ ID NO: 764326 - DNA, 25 bp, Mus musculus
tacctgataatgatgggactttgat

SEQ ID NO: 764327 - DNA, 25 bp, Mus musculus
tacctgataatgttgggactttgat

SEQ ID NO: 764328 - DNA, 25 bp, Mus musculus
tacctgatactcaacttgaacttgg

SEQ ID NO: 764329 - DNA, 25 bp, Mus musculus
tacctgatactctacttgaacttgg

SEQ ID NO: 764330 - DNA, 25 bp, Mus musculus
tacctgatcgcgctgggtagccaga

SEQ ID NO: 764331 - DNA, 25 bp, Mus musculus
tacctgatcgcggtgggtagccaga

SEQ ID NO: 764332 - DNA, 25 bp, Mus musculus
tacctgatgacactggcagccttaa

SEQ ID NO: 764333 - DNA, 25 bp, Mus musculus
tacctgatgacagtggcagccttaa

SEQ ID NO: 764334 - DNA, 25 bp, Mus musculus
tacctgatgaggctggagttcaaaa

SEQ ID NO: 764335 - DNA, 25 bp, Mus musculus
tacctgatgagggtggagttcaaaa

SEQ ID NO: 764336 - DNA, 25 bp, Mus musculus
tacctgatgcccatgaagcccttgc

SEQ ID NO: 764337 - DNA, 25 bp, Mus musculus
tacctgatgcccttgaagcccttgc

SEQ ID NO: 764338 - DNA, 25 bp, Mus musculus
tacctgatggcgactgtccgtccat

SEQ ID NO: 764339 - DNA, 25 bp, Mus musculus
tacctgatggcgtctgtccgtccat

SEQ ID NO: 764340 - DNA, 25 bp, Mus musculus
tacctgatgggcaagtgtcttttga

SEQ ID NO: 764341 - DNA, 25 bp, Mus musculus
tacctgatgggctagtgtcttttga

SEQ ID NO: 764342 - DNA, 25 bp, Mus musculus
tacctgattactatagcccagcaat

SEQ ID NO: 764343 - DNA, 25 bp, Mus musculus
tacctgattactttagcccagcaat

SEQ ID NO: 764344 - DNA, 25 bp, Mus musculus
tacctgcaaataaacgtgcctcctc

SEQ ID NO: 764345 - DNA, 25 bp, Mus musculus
tacctgcaaatatacgtgcctcctc

SEQ ID NO: 764346 - DNA, 25 bp, Mus musculus
tacctgcacagcaagcgcaatgggc

SEQ ID NO: 764347 - DNA, 25 bp, Mus musculus
tacctgcacagctagcgcaatgggc

SEQ ID NO: 764348 - DNA, 25 bp, Mus musculus
tacctgcacaggaacagcgtgagca

SEQ ID NO: 764349 - DNA, 25 bp, Mus musculus
tacctgcacaggcattgtggtcatt

SEQ ID NO: 764350 - DNA, 25 bp, Mus musculus
tacctgcacagggattgtggtcatt

SEQ ID NO: 764351 - DNA, 25 bp, Mus musculus
tacctgcacaggtacagcgtgagca

SEQ ID NO: 764352 - DNA, 25 bp, Mus musculus
tacctgcacattccagacatcatca

SEQ ID NO: 764353 - DNA, 25 bp, Mus musculus
tacctgcacattgcagacatcatca

SEQ ID NO: 764354 - DNA, 25 bp, Mus musculus
tacctgcaccagcagaacgagcggc

SEQ ID NO: 764355 - DNA, 25 bp, Mus musculus
tacctgcaccaggagaacgagcggc

SEQ ID NO: 764356 - DNA, 25 bp, Mus musculus
tacctgcaccgtagggtagatccca

SEQ ID NO: 764357 - DNA, 25 bp, Mus musculus
tacctgcaccgttgggtagatccca

SEQ ID NO: 764358 - DNA, 25 bp, Mus musculus
tacctgcactcaaaatccagcacat

SEQ ID NO: 764359 - DNA, 25 bp, Mus musculus
tacctgcactcataatccagcacat

SEQ ID NO: 764360 - DNA, 25 bp, Mus musculus
tacctgcagaatctgctggctgagc

SEQ ID NO: 764361 - DNA, 25 bp, Mus musculus
tacctgcagaatgtgctggctgagc

SEQ ID NO: 764362 - DNA, 25 bp, Mus musculus
tacctgcagctgatagagatcccat

SEQ ID NO: 764363 - DNA, 25 bp, Mus musculus
tacctgcagctgttagagatcccat

SEQ ID NO: 764364 - DNA, 25 bp, Mus musculus
tacctgcagttcctcagtatcttgt

SEQ ID NO: 764365 - DNA, 25 bp, Mus musculus
tacctgcagttcgtcagtatcttgt

SEQ ID NO: 764366 - DNA, 25 bp, Mus musculus
tacctgcatcgtcttcatagagccg

SEQ ID NO: 764367 - DNA, 25 bp, Mus musculus
tacctgcatcgtgttcatagagccg

SEQ ID NO: 764368 - DNA, 25 bp, Mus musculus
tacctgcatggtatccttcattttt

SEQ ID NO: 764369 - DNA, 25 bp, Mus musculus
tacctgcatggtttccttcattttt

SEQ ID NO: 764370 - DNA, 25 bp, Mus musculus
tacctgccaaggaaagctgctaatg

SEQ ID NO: 764371 - DNA, 25 bp, Mus musculus
tacctgccaaggtaagctgctaatg

SEQ ID NO: 764372 - DNA, 25 bp, Mus musculus
tacctgccagttatgtggactacat

SEQ ID NO: 764373 - DNA, 25 bp, Mus musculus
tacctgccagttttgtggactacat

SEQ ID NO: 764374 - DNA, 25 bp, Mus musculus
tacctgcccaggaagactactacag

SEQ ID NO: 764375 - DNA, 25 bp, Mus musculus
tacctgcccaggtagactactacag

SEQ ID NO: 764376 - DNA, 25 bp, Mus musculus
tacctgcccggacagtgcttaaaat

SEQ ID NO: 764377 - DNA, 25 bp, Mus musculus
tacctgcccggagagtgcttaaaat

SEQ ID NO: 764378 - DNA, 25 bp, Mus musculus
tacctgccctctagagtccaaataa

SEQ ID NO: 764379 - DNA, 25 bp, Mus musculus
tacctgccctcttgagtccaaataa

SEQ ID NO: 764380 - DNA, 25 bp, Mus musculus
tacctgccctgaaagatgaccaaag

SEQ ID NO: 764381 - DNA, 25 bp, Mus musculus
tacctgccctgatagatgaccaaag

SEQ ID NO: 764382 - DNA, 25 bp, Mus musculus
tacctgccgggcaaaggagctcagc

SEQ ID NO: 764383 - DNA, 25 bp, Mus musculus
tacctgccgggctaaggagctcagc

SEQ ID NO: 764384 - DNA, 25 bp, Mus musculus
tacctgcctaaacgctgctatgtga

SEQ ID NO: 764385 - DNA, 25 bp, Mus musculus
tacctgcctaaaggctgctatgtga

SEQ ID NO: 764386 - DNA, 25 bp, Mus musculus
tacctgcctaatatgtatttgaggg

SEQ ID NO: 764387 - DNA, 25 bp, Mus musculus
tacctgcctaatttgtatttgaggg

SEQ ID NO: 764388 - DNA, 25 bp, Mus musculus
tacctgcctggtcgactcactgtgt

SEQ ID NO: 764389 - DNA, 25 bp, Mus musculus
tacctgcctggtggactcactgtgt

SEQ ID NO: 764390 - DNA, 25 bp, Mus musculus
tacctgcctgttaggactgagaatt

SEQ ID NO: 764391 - DNA, 25 bp, Mus musculus
tacctgcctgtttggactgagaatt

SEQ ID NO: 764392 - DNA, 25 bp, Mus musculus
tacctgcgacagagctggctatact

SEQ ID NO: 764393 - DNA, 25 bp, Mus musculus
tacctgcgacagtgctggctatact

SEQ ID NO: 764394 - DNA, 25 bp, Mus musculus
tacctgcggctgcttgtcaagctgt

SEQ ID NO: 764395 - DNA, 25 bp, Mus musculus
tacctgcggctggttgtcaagctgt

SEQ ID NO: 764396 - DNA, 25 bp, Mus musculus
tacctgcgggtcatgaagtttcgcc

SEQ ID NO: 764397 - DNA, 25 bp, Mus musculus
tacctgcgggtcttgaagtttcgcc

SEQ ID NO: 764398 - DNA, 25 bp, Mus musculus
tacctgcgggtgaacaggcttcaca

SEQ ID NO: 764399 - DNA, 25 bp, Mus musculus
tacctgcgggtgtacaggcttcaca

SEQ ID NO: 764400 - DNA, 25 bp, Mus musculus
tacctgcgttctctctgaggttgag

SEQ ID NO: 764401 - DNA, 25 bp, Mus musculus
tacctgcgttctgtctgaggttgag

SEQ ID NO: 764402 - DNA, 25 bp, Mus musculus
tacctgctaagtatacattgctcaa

SEQ ID NO: 764403 - DNA, 25 bp, Mus musculus
tacctgctaagtttacattgctcaa

SEQ ID NO: 764404 - DNA, 25 bp, Mus musculus
tacctgctatctccaatttgttgtt

SEQ ID NO: 764405 - DNA, 25 bp, Mus musculus
tacctgctatctgcaatttgttgtt

SEQ ID NO: 764406 - DNA, 25 bp, Mus musculus
tacctgctcccacagggctgggtat

SEQ ID NO: 764407 - DNA, 25 bp, Mus musculus
tacctgctcccagagggctgggtat

SEQ ID NO: 764408 - DNA, 25 bp, Mus musculus
tacctgctccgtcgtgcatgaggct

SEQ ID NO: 764409 - DNA, 25 bp, Mus musculus
tacctgctccgtggtgcatgaggct

SEQ ID NO: 764410 - DNA, 25 bp, Mus musculus
tacctgctgagcaagtcctaaactt

SEQ ID NO: 764411 - DNA, 25 bp, Mus musculus
tacctgctgagctagtcctaaactt

SEQ ID NO: 764412 - DNA, 25 bp, Mus musculus
tacctgctggctagcctaaaggtga

SEQ ID NO: 764413 - DNA, 25 bp, Mus musculus
tacctgctggcttgcctaaaggtga

SEQ ID NO: 764414 - DNA, 25 bp, Mus musculus
tacctgctgtacaacttccccatga

SEQ ID NO: 764415 - DNA, 25 bp, Mus musculus
tacctgctgtactacttccccatga

SEQ ID NO: 764416 - DNA, 25 bp, Mus musculus
tacctgcttaagatccttcctttag

SEQ ID NO: 764417 - DNA, 25 bp, Mus musculus
tacctgcttaagttccttcctttag

SEQ ID NO: 764418 - DNA, 25 bp, Mus musculus
tacctgcttaccacgtgtgcgttga

SEQ ID NO: 764419 - DNA, 25 bp, Mus musculus
tacctgcttacctcgtgtgcgttga

SEQ ID NO: 764420 - DNA, 25 bp, Mus musculus
tacctgcttattcttttcaaaccct

SEQ ID NO: 764421 - DNA, 25 bp, Mus musculus
tacctgcttattgttttcaaaccct

SEQ ID NO: 764422 - DNA, 25 bp, Mus musculus
tacctgcttgacacaaccctttttg

SEQ ID NO: 764423 - DNA, 25 bp, Mus musculus
tacctgcttgactcaaccctttttg

SEQ ID NO: 764424 - DNA, 25 bp, Mus musculus
tacctgcttttactgcctcagtgct

SEQ ID NO: 764425 - DNA, 25 bp, Mus musculus
tacctgcttttagtgcctcagtgct

SEQ ID NO: 764426 - DNA, 25 bp, Mus musculus
tacctggaacatcccaagacccagg

SEQ ID NO: 764427 - DNA, 25 bp, Mus musculus
tacctggaacatgccaagacccagg

SEQ ID NO: 764428 - DNA, 25 bp, Mus musculus
tacctggaaccaacctggagcacag

SEQ ID NO: 764429 - DNA, 25 bp, Mus musculus
tacctggaaccatcctggagcacag

SEQ ID NO: 764430 - DNA, 25 bp, Mus musculus
tacctggaagcaaactattagaaag

SEQ ID NO: 764431 - DNA, 25 bp, Mus musculus
tacctggaagcatactattagaaag

SEQ ID NO: 764432 - DNA, 25 bp, Mus musculus
tacctggacaacctgagcgcgcgcg

SEQ ID NO: 764433 - DNA, 25 bp, Mus musculus
tacctggacaacgtgagcgcgcgcg

SEQ ID NO: 764434 - DNA, 25 bp, Mus musculus
tacctggactgtacacatcggaagt

SEQ ID NO: 764435 - DNA, 25 bp, Mus musculus
tacctggactgttcacatcggaagt

SEQ ID NO: 764436 - DNA, 25 bp, Mus musculus
tacctggacttgcttttgggaaact

SEQ ID NO: 764437 - DNA, 25 bp, Mus musculus
tacctggacttggttttgggaaact

SEQ ID NO: 764438 - DNA, 25 bp, Mus musculus
tacctggagaagaggtcagttgcta

SEQ ID NO: 764439 - DNA, 25 bp, Mus musculus
tacctggagaagtggtcagttgcta

SEQ ID NO: 764440 - DNA, 25 bp, Mus musculus
tacctggagcagcttctacacctac

SEQ ID NO: 764441 - DNA, 25 bp, Mus musculus
tacctggagcaggttctacacctac

SEQ ID NO: 764442 - DNA, 25 bp, Mus musculus
tacctggagccactctgcgtgatga

SEQ ID NO: 764443 - DNA, 25 bp, Mus musculus
tacctggagccagtctgcgtgatga

SEQ ID NO: 764444 - DNA, 25 bp, Mus musculus
tacctggagcggctctccgacagac

SEQ ID NO: 764445 - DNA, 25 bp, Mus musculus
tacctggagcgggtctccgacagac

SEQ ID NO: 764446 - DNA, 25 bp, Mus musculus
tacctggagctgaactgagtgtgtc

SEQ ID NO: 764447 - DNA, 25 bp, Mus musculus
tacctggagctgtactgagtgtgtc

SEQ ID NO: 764448 - DNA, 25 bp, Mus musculus
tacctggaggaacccaccatcgagg

SEQ ID NO: 764449 - DNA, 25 bp, Mus musculus
tacctggaggaactcccattggagt

SEQ ID NO: 764450 - DNA, 25 bp, Mus musculus
tacctggaggaagccaccatcgagg

SEQ ID NO: 764451 - DNA, 25 bp, Mus musculus
tacctggaggaagtcccattggagt

SEQ ID NO: 764452 - DNA, 25 bp, Mus musculus
tacctggaggcgatcttggtgaaga

SEQ ID NO: 764453 - DNA, 25 bp, Mus musculus
tacctggaggcgttcttggtgaaga

SEQ ID NO: 764454 - DNA, 25 bp, Mus musculus
tacctggagtttccagacactggga

SEQ ID NO: 764455 - DNA, 25 bp, Mus musculus
tacctggagtttgcagacactggga

SEQ ID NO: 764456 - DNA, 25 bp, Mus musculus
tacctggattcaattaaagtctagt

SEQ ID NO: 764457 - DNA, 25 bp, Mus musculus
tacctggattcatttaaagtctagt

SEQ ID NO: 764458 - DNA, 25 bp, Mus musculus
tacctggcatccatgttgtgactga

SEQ ID NO: 764459 - DNA, 25 bp, Mus musculus
tacctggcatccttgttgtgactga

SEQ ID NO: 764460 - DNA, 25 bp, Mus musculus
tacctggcattaacgcatgctggga

SEQ ID NO: 764461 - DNA, 25 bp, Mus musculus
tacctggcattatcgcatgctggga

SEQ ID NO: 764462 - DNA, 25 bp, Mus musculus
tacctggccataactttgacttaaa

SEQ ID NO: 764463 - DNA, 25 bp, Mus musculus
tacctggccatatctttgacttaaa

SEQ ID NO: 764464 - DNA, 25 bp, Mus musculus
tacctggccatgcaacgtctcggtt

SEQ ID NO: 764465 - DNA, 25 bp, Mus musculus
tacctggccatggaacgtctcggtt

SEQ ID NO: 764466 - DNA, 25 bp, Mus musculus
tacctggcctcacctcagaaaaaga

SEQ ID NO: 764467 - DNA, 25 bp, Mus musculus
tacctggcctcagctcagaaaaaga

SEQ ID NO: 764468 - DNA, 25 bp, Mus musculus
tacctggcggtaatttctgttatgt

SEQ ID NO: 764469 - DNA, 25 bp, Mus musculus
tacctggcggtattttctgttatgt

SEQ ID NO: 764470 - DNA, 25 bp, Mus musculus
tacctggctctgcttaatagctgca

SEQ ID NO: 764471 - DNA, 25 bp, Mus musculus
tacctggctctggttaatagctgca

SEQ ID NO: 764472 - DNA, 25 bp, Mus musculus
tacctggcttacaagaagttctacg

SEQ ID NO: 764473 - DNA, 25 bp, Mus musculus
tacctggcttactagaagttctacg

SEQ ID NO: 764474 - DNA, 25 bp, Mus musculus
tacctggcttccatttcagtgtttt

SEQ ID NO: 764475 - DNA, 25 bp, Mus musculus
tacctggcttccttttcagtgtttt

SEQ ID NO: 764476 - DNA, 25 bp, Mus musculus
tacctggctttacctcttgtcacta

SEQ ID NO: 764477 - DNA, 25 bp, Mus musculus
tacctggctttagctcttgtcacta

SEQ ID NO: 764478 - DNA, 25 bp, Mus musculus
tacctgggaagaccacagtatgacc

SEQ ID NO: 764479 - DNA, 25 bp, Mus musculus
tacctgggaagagcacagtatgacc

SEQ ID NO: 764480 - DNA, 25 bp, Mus musculus
tacctgggagacactggcctggatg

SEQ ID NO: 764481 - DNA, 25 bp, Mus musculus
tacctgggagactctggcctggatg

SEQ ID NO: 764482 - DNA, 25 bp, Mus musculus
tacctgggtaggagtcgcatggtcc

SEQ ID NO: 764483 - DNA, 25 bp, Mus musculus
tacctgggtaggtgtcgcatggtcc

SEQ ID NO: 764484 - DNA, 25 bp, Mus musculus
tacctgggtgtcagtcgctgtgaaa

SEQ ID NO: 764485 - DNA, 25 bp, Mus musculus
tacctgggtgtctgtcgctgtgaaa

SEQ ID NO: 764486 - DNA, 25 bp, Mus musculus
tacctgggttccaccactattaggg

SEQ ID NO: 764487 - DNA, 25 bp, Mus musculus
tacctgggttcctccactattaggg

SEQ ID NO: 764488 - DNA, 25 bp, Mus musculus
tacctggtaccaaatctgtggattt

SEQ ID NO: 764489 - DNA, 25 bp, Mus musculus
tacctggtaccatatctgtggattt

SEQ ID NO: 764490 - DNA, 25 bp, Mus musculus
tacctggtacctcaggaggccaaaa

SEQ ID NO: 764491 - DNA, 25 bp, Mus musculus
tacctggtacctgaggaggccaaaa

SEQ ID NO: 764492 - DNA, 25 bp, Mus musculus
tacctggtattgaaaatggacacat

SEQ ID NO: 764493 - DNA, 25 bp, Mus musculus
tacctggtattgtaaatggacacat

SEQ ID NO: 764494 - DNA, 25 bp, Mus musculus
tacctggtcaataagcctacctttc

SEQ ID NO: 764495 - DNA, 25 bp, Mus musculus
tacctggtcaattagcctacctttc

SEQ ID NO: 764496 - DNA, 25 bp, Mus musculus
tacctggtcactcccggcactggaa

SEQ ID NO: 764497 - DNA, 25 bp, Mus musculus
tacctggtcactgccggcactggaa

SEQ ID NO: 764498 - DNA, 25 bp, Mus musculus
tacctggtccgcaaagggatgccat

SEQ ID NO: 764499 - DNA, 25 bp, Mus musculus
tacctggtccgctaagggatgccat

SEQ ID NO: 764500 - DNA, 25 bp, Mus musculus
tacctggtcctgagcatgcagtcaa

SEQ ID NO: 764501 - DNA, 25 bp, Mus musculus
tacctggtcctgtgcatgcagtcaa

SEQ ID NO: 764502 - DNA, 25 bp, Mus musculus
tacctggttaaaagtttttctagct

SEQ ID NO: 764503 - DNA, 25 bp, Mus musculus
tacctggttaaatgtttttctagct

SEQ ID NO: 764504 - DNA, 25 bp, Mus musculus
tacctggttcacagagctcatgcaa

SEQ ID NO: 764505 - DNA, 25 bp, Mus musculus
tacctggttcactgagctcatgcaa

SEQ ID NO: 764506 - DNA, 25 bp, Mus musculus
tacctggttcctcagaacaccttat

SEQ ID NO: 764507 - DNA, 25 bp, Mus musculus
tacctggttcctgagaacaccttat

SEQ ID NO: 764508 - DNA, 25 bp, Mus musculus
tacctggttgctatgtttgacttga

SEQ ID NO: 764509 - DNA, 25 bp, Mus musculus
tacctggttgctttgtttgacttga

SEQ ID NO: 764510 - DNA, 25 bp, Mus musculus
tacctggtttatctagccttgtgga

SEQ ID NO: 764511 - DNA, 25 bp, Mus musculus
tacctggtttatgtagccttgtgga

SEQ ID NO: 764512 - DNA, 25 bp, Mus musculus
tacctgtaaaatcttgtacggttgt

SEQ ID NO: 764513 - DNA, 25 bp, Mus musculus
tacctgtaaaatgttgtacggttgt

SEQ ID NO: 764514 - DNA, 25 bp, Mus musculus
tacctgtaattaagtcatcacccat

SEQ ID NO: 764515 - DNA, 25 bp, Mus musculus
tacctgtaattatgtcatcacccat

SEQ ID NO: 764516 - DNA, 25 bp, Mus musculus
tacctgtaccggagaccagaccact

SEQ ID NO: 764517 - DNA, 25 bp, Mus musculus
tacctgtaccggtgaccagaccact

SEQ ID NO: 764518 - DNA, 25 bp, Mus musculus
tacctgtagctcatagtagtgccta

SEQ ID NO: 764519 - DNA, 25 bp, Mus musculus
tacctgtagctcttagtagtgccta

SEQ ID NO: 764520 - DNA, 25 bp, Mus musculus
tacctgtatctaatggcgaacgccg

SEQ ID NO: 764521 - DNA, 25 bp, Mus musculus
tacctgtatctattggcgaacgccg

SEQ ID NO: 764522 - DNA, 25 bp, Mus musculus
tacctgtatggtacatgtgtgggag

SEQ ID NO: 764523 - DNA, 25 bp, Mus musculus
tacctgtatggttcatgtgtgggag

SEQ ID NO: 764524 - DNA, 25 bp, Mus musculus
tacctgtatttaccaatggtgattg

SEQ ID NO: 764525 - DNA, 25 bp, Mus musculus
tacctgtatttagcaatggtgattg

SEQ ID NO: 764526 - DNA, 25 bp, Mus musculus
tacctgtcagggaaaggcttccact

SEQ ID NO: 764527 - DNA, 25 bp, Mus musculus
tacctgtcagggtaaggcttccact

SEQ ID NO: 764528 - DNA, 25 bp, Mus musculus
tacctgtcatagcaatcccgggaat

SEQ ID NO: 764529 - DNA, 25 bp, Mus musculus
tacctgtcataggaatcccgggaat

SEQ ID NO: 764530 - DNA, 25 bp, Mus musculus
tacctgtccagtcagtattgtagac

SEQ ID NO: 764531 - DNA, 25 bp, Mus musculus
tacctgtccagtgagtattgtagac

SEQ ID NO: 764532 - DNA, 25 bp, Mus musculus
tacctgtccatcaaggcctcgctgg

SEQ ID NO: 764533 - DNA, 25 bp, Mus musculus
tacctgtccatctaggcctcgctgg

SEQ ID NO: 764534 - DNA, 25 bp, Mus musculus
tacctgtccgctatctgactgctga

SEQ ID NO: 764535 - DNA, 25 bp, Mus musculus
tacctgtccgctttctgactgctga

SEQ ID NO: 764536 - DNA, 25 bp, Mus musculus
tacctgtcctcaccagagcaatcaa

SEQ ID NO: 764537 - DNA, 25 bp, Mus musculus
tacctgtcctcactaggccaaggaa

SEQ ID NO: 764538 - DNA, 25 bp, Mus musculus
tacctgtcctcagcagagcaatcaa

SEQ ID NO: 764539 - DNA, 25 bp, Mus musculus
tacctgtcctcagtaggccaaggaa

SEQ ID NO: 764540 - DNA, 25 bp, Mus musculus
tacctgtcgggcaccaagcataata

SEQ ID NO: 764541 - DNA, 25 bp, Mus musculus
tacctgtcgggctccaagcataata

SEQ ID NO: 764542 - DNA, 25 bp, Mus musculus
tacctgtctgggaatggctgtcttc

SEQ ID NO: 764543 - DNA, 25 bp, Mus musculus
tacctgtctgggagggcaacaccag

SEQ ID NO: 764544 - DNA, 25 bp, Mus musculus
tacctgtctgggtatggctgtcttc

SEQ ID NO: 764545 - DNA, 25 bp, Mus musculus
tacctgtctgggtgggcaacaccag

SEQ ID NO: 764546 - DNA, 25 bp, Mus musculus
tacctgtctgtcaccaagtactggg

SEQ ID NO: 764547 - DNA, 25 bp, Mus musculus
tacctgtctgtctccaagtactggg

SEQ ID NO: 764548 - DNA, 25 bp, Mus musculus
tacctgtcttccattcctaaaaaca

SEQ ID NO: 764549 - DNA, 25 bp, Mus musculus
tacctgtcttcctttcctaaaaaca

SEQ ID NO: 764550 - DNA, 25 bp, Mus musculus
tacctgtgaggtcccatcgtgagtc

SEQ ID NO: 764551 - DNA, 25 bp, Mus musculus
tacctgtgaggtgccatcgtgagtc

SEQ ID NO: 764552 - DNA, 25 bp, Mus musculus
tacctgtgagtgaagccccggagtg

SEQ ID NO: 764553 - DNA, 25 bp, Mus musculus
tacctgtgagtgtagccccggagtg

SEQ ID NO: 764554 - DNA, 25 bp, Mus musculus
tacctgtgcccaattcctcatgtat

SEQ ID NO: 764555 - DNA, 25 bp, Mus musculus
tacctgtgcccatttcctcatgtat

SEQ ID NO: 764556 - DNA, 25 bp, Mus musculus
tacctgtgctgtatggagtggctca

SEQ ID NO: 764557 - DNA, 25 bp, Mus musculus
tacctgtgctgtttggagtggctca

SEQ ID NO: 764558 - DNA, 25 bp, Mus musculus
tacctgtggacacctgggtttgggt

SEQ ID NO: 764559 - DNA, 25 bp, Mus musculus
tacctgtggacagctgggtttgggt

SEQ ID NO: 764560 - DNA, 25 bp, Mus musculus
tacctgtggcccatgtggttaaatg

SEQ ID NO: 764561 - DNA, 25 bp, Mus musculus
tacctgtggcccttgtggttaaatg

SEQ ID NO: 764562 - DNA, 25 bp, Mus musculus
tacctgtgggtgattttgactgact

SEQ ID NO: 764563 - DNA, 25 bp, Mus musculus
tacctgtgggtgtttttgactgact

SEQ ID NO: 764564 - DNA, 25 bp, Mus musculus
tacctgtgtcctagttttcctaaag

SEQ ID NO: 764565 - DNA, 25 bp, Mus musculus
tacctgtgtccttgttttcctaaag

SEQ ID NO: 764566 - DNA, 25 bp, Mus musculus
tacctgttacttatttactacttgc

SEQ ID NO: 764567 - DNA, 25 bp, Mus musculus
tacctgttacttttttactacttgc

SEQ ID NO: 764568 - DNA, 25 bp, Mus musculus
tacctgttatgtaccagctatctaa

SEQ ID NO: 764569 - DNA, 25 bp, Mus musculus
tacctgttatgttccagctatctaa

SEQ ID NO: 764570 - DNA, 25 bp, Mus musculus
tacctgttcacgactgagttgtacc

SEQ ID NO: 764571 - DNA, 25 bp, Mus musculus
tacctgttcacgtctgagttgtacc

SEQ ID NO: 764572 - DNA, 25 bp, Mus musculus
tacctgttcgacatcagttatggga

SEQ ID NO: 764573 - DNA, 25 bp, Mus musculus
tacctgttcgacttcagttatggga

SEQ ID NO: 764574 - DNA, 25 bp, Mus musculus
tacctgttctgtagctgtaactgtg

SEQ ID NO: 764575 - DNA, 25 bp, Mus musculus
tacctgttctgtcgcgataccatcc

SEQ ID NO: 764576 - DNA, 25 bp, Mus musculus
tacctgttctgtggcgataccatcc

SEQ ID NO: 764577 - DNA, 25 bp, Mus musculus
tacctgttctgttgctgtaactgtg

SEQ ID NO: 764578 - DNA, 25 bp, Mus musculus
tacctgttctttctgtctcttaaac

SEQ ID NO: 764579 - DNA, 25 bp, Mus musculus
tacctgttctttgtgtctcttaaac

SEQ ID NO: 764580 - DNA, 25 bp, Mus musculus
tacctgttgctgacagggttaccta

SEQ ID NO: 764581 - DNA, 25 bp, Mus musculus
tacctgttgctgtcagggttaccta

SEQ ID NO: 764582 - DNA, 25 bp, Mus musculus
tacctgtttcccatatgtgctgaag

SEQ ID NO: 764583 - DNA, 25 bp, Mus musculus
tacctgtttcccttatgtgctgaag

SEQ ID NO: 764584 - DNA, 25 bp, Mus musculus
tacctgtttgccattcttagatcac

SEQ ID NO: 764585 - DNA, 25 bp, Mus musculus
tacctgtttgcctttcttagatcac

SEQ ID NO: 764586 - DNA, 25 bp, Mus musculus
taccttaaacctctgcaactgccaa

SEQ ID NO: 764587 - DNA, 25 bp, Mus musculus
taccttaaacctgtgcaactgccaa

SEQ ID NO: 764588 - DNA, 25 bp, Mus musculus
taccttaacagactttccttgggag

SEQ ID NO: 764589 - DNA, 25 bp, Mus musculus
taccttaacagagtttccttgggag

SEQ ID NO: 764590 - DNA, 25 bp, Mus musculus
taccttaatgctcatcagtcgccgt

SEQ ID NO: 764591 - DNA, 25 bp, Mus musculus
taccttaatgctgatcagtcgccgt

SEQ ID NO: 764592 - DNA, 25 bp, Mus musculus
taccttaatgtacgtgtgtgccttg

SEQ ID NO: 764593 - DNA, 25 bp, Mus musculus
taccttaatgtaggtgtgtgccttg

SEQ ID NO: 764594 - DNA, 25 bp, Mus musculus
taccttaatgttcttacttactgta

SEQ ID NO: 764595 - DNA, 25 bp, Mus musculus
taccttaatgttgttacttactgta

SEQ ID NO: 764596 - DNA, 25 bp, Mus musculus
taccttaattgaaacctttccctgc

SEQ ID NO: 764597 - DNA, 25 bp, Mus musculus
taccttaattgatacctttccctgc

SEQ ID NO: 764598 - DNA, 25 bp, Mus musculus
taccttacaagcattcctagtggaa

SEQ ID NO: 764599 - DNA, 25 bp, Mus musculus
taccttacaagctttcctagtggaa

SEQ ID NO: 764600 - DNA, 25 bp, Mus musculus
taccttacacaaaggcagtgctcca

SEQ ID NO: 764601 - DNA, 25 bp, Mus musculus
taccttacacaatggcagtgctcca

SEQ ID NO: 764602 - DNA, 25 bp, Mus musculus
taccttacagatcccaaatcttggg

SEQ ID NO: 764603 - DNA, 25 bp, Mus musculus
taccttacagatgccaaatcttggg

SEQ ID NO: 764604 - DNA, 25 bp, Mus musculus
taccttactacacagatgaaatatg

SEQ ID NO: 764605 - DNA, 25 bp, Mus musculus
taccttactacagagatgaaatatg

SEQ ID NO: 764606 - DNA, 25 bp, Mus musculus
taccttactcggagccggtggtcag

SEQ ID NO: 764607 - DNA, 25 bp, Mus musculus
taccttactcggtgccggtggtcag

SEQ ID NO: 764608 - DNA, 25 bp, Mus musculus
taccttactgcgatgcatgggtgct

SEQ ID NO: 764609 - DNA, 25 bp, Mus musculus
taccttactgcgttgcatgggtgct

SEQ ID NO: 764610 - DNA, 25 bp, Mus musculus
taccttactggcagggatgaatctc

SEQ ID NO: 764611 - DNA, 25 bp, Mus musculus
taccttactggctgggatgaatctc

SEQ ID NO: 764612 - DNA, 25 bp, Mus musculus
taccttactgttctgtacttgttgg

SEQ ID NO: 764613 - DNA, 25 bp, Mus musculus
taccttactgttgtgtacttgttgg

SEQ ID NO: 764614 - DNA, 25 bp, Mus musculus
taccttacttataactccatggagc

SEQ ID NO: 764615 - DNA, 25 bp, Mus musculus
taccttacttattactccatggagc

SEQ ID NO: 764616 - DNA, 25 bp, Mus musculus
taccttagatctcactcagcaacaa

SEQ ID NO: 764617 - DNA, 25 bp, Mus musculus
taccttagatctgactcagcaacaa

SEQ ID NO: 764618 - DNA, 25 bp, Mus musculus
taccttagccgtatacgcagtcagg

SEQ ID NO: 764619 - DNA, 25 bp, Mus musculus
taccttagccgtttacgcagtcagg

SEQ ID NO: 764620 - DNA, 25 bp, Mus musculus
taccttagcttaacatggcttcttg

SEQ ID NO: 764621 - DNA, 25 bp, Mus musculus
taccttagcttatcatggcttcttg

SEQ ID NO: 764622 - DNA, 25 bp, Mus musculus
taccttagctttacttcagatagca

SEQ ID NO: 764623 - DNA, 25 bp, Mus musculus
taccttagcttttcttcagatagca

SEQ ID NO: 764624 - DNA, 25 bp, Mus musculus
taccttatagatagttacctttcct

SEQ ID NO: 764625 - DNA, 25 bp, Mus musculus
taccttatagattgttacctttcct

SEQ ID NO: 764626 - DNA, 25 bp, Mus musculus
taccttatatcccttctacaacctg

SEQ ID NO: 764627 - DNA, 25 bp, Mus musculus
taccttatatccgttctacaacctg

SEQ ID NO: 764628 - DNA, 25 bp, Mus musculus
taccttatcccacccactgtaatta

SEQ ID NO: 764629 - DNA, 25 bp, Mus musculus
taccttatcccagccactgtaatta

SEQ ID NO: 764630 - DNA, 25 bp, Mus musculus
taccttatggctaatatgatactgt

SEQ ID NO: 764631 - DNA, 25 bp, Mus musculus
taccttatggcttatatgatactgt

SEQ ID NO: 764632 - DNA, 25 bp, Mus musculus
taccttatggtcaccgtgtctgtga

SEQ ID NO: 764633 - DNA, 25 bp, Mus musculus
taccttatggtctccgtgtctgtga

SEQ ID NO: 764634 - DNA, 25 bp, Mus musculus
taccttatgttgactgggatcccag

SEQ ID NO: 764635 - DNA, 25 bp, Mus musculus
taccttatgttgtctgggatcccag

SEQ ID NO: 764636 - DNA, 25 bp, Mus musculus
taccttcaaaccctgaccactatcg

SEQ ID NO: 764637 - DNA, 25 bp, Mus musculus
taccttcaaaccgtgaccactatcg

SEQ ID NO: 764638 - DNA, 25 bp, Mus musculus
taccttcaaagccaccgagttctga

SEQ ID NO: 764639 - DNA, 25 bp, Mus musculus
taccttcaaagcgaccgagttctga

SEQ ID NO: 764640 - DNA, 25 bp, Mus musculus
taccttcaagctacctatatcctga

SEQ ID NO: 764641 - DNA, 25 bp, Mus musculus
taccttcaagcttcctatatcctga

SEQ ID NO: 764642 - DNA, 25 bp, Mus musculus
taccttcaagtaagtattcaattag

SEQ ID NO: 764643 - DNA, 25 bp, Mus musculus
taccttcaagtatgtattcaattag

SEQ ID NO: 764644 - DNA, 25 bp, Mus musculus
taccttcaagtgcaggtgttgctaa

SEQ ID NO: 764645 - DNA, 25 bp, Mus musculus
taccttcaagtggaggtgttgctaa

SEQ ID NO: 764646 - DNA, 25 bp, Mus musculus
taccttcaccacagcctaaggtgag

SEQ ID NO: 764647 - DNA, 25 bp, Mus musculus
taccttcaccactgcctaaggtgag

SEQ ID NO: 764648 - DNA, 25 bp, Mus musculus
taccttcaggagaaccttggatcgc

SEQ ID NO: 764649 - DNA, 25 bp, Mus musculus
taccttcaggagtaccttggatcgc

SEQ ID NO: 764650 - DNA, 25 bp, Mus musculus
taccttcagtttaccactatacctt

SEQ ID NO: 764651 - DNA, 25 bp, Mus musculus
taccttcagttttccactatacctt

SEQ ID NO: 764652 - DNA, 25 bp, Mus musculus
taccttcatctgagatcacccacag

SEQ ID NO: 764653 - DNA, 25 bp, Mus musculus
taccttcatctgtgatcacccacag

SEQ ID NO: 764654 - DNA, 25 bp, Mus musculus
taccttcattgcagtttcatttctt

SEQ ID NO: 764655 - DNA, 25 bp, Mus musculus
taccttcattgctgtttcatttctt

SEQ ID NO: 764656 - DNA, 25 bp, Mus musculus
taccttccaaagctgttggcccttg

SEQ ID NO: 764657 - DNA, 25 bp, Mus musculus
taccttccaaaggtgttggcccttg

SEQ ID NO: 764658 - DNA, 25 bp, Mus musculus
taccttccagctcttaagtgtcaga

SEQ ID NO: 764659 - DNA, 25 bp, Mus musculus
taccttccagctgttaagtgtcaga

SEQ ID NO: 764660 - DNA, 25 bp, Mus musculus
taccttccagtccaaagtaactcag

SEQ ID NO: 764661 - DNA, 25 bp, Mus musculus
taccttccagtcgaaagtaactcag

SEQ ID NO: 764662 - DNA, 25 bp, Mus musculus
taccttccatgtcttatttcactca

SEQ ID NO: 764663 - DNA, 25 bp, Mus musculus
taccttccatgtgttatttcactca

SEQ ID NO: 764664 - DNA, 25 bp, Mus musculus
taccttcccaggaatattggcaggt

SEQ ID NO: 764665 - DNA, 25 bp, Mus musculus
taccttcccaggtatattggcaggt

SEQ ID NO: 764666 - DNA, 25 bp, Mus musculus
taccttcccagtcctatgaaaaatt

SEQ ID NO: 764667 - DNA, 25 bp, Mus musculus
taccttcccagtgctatgaaaaatt

SEQ ID NO: 764668 - DNA, 25 bp, Mus musculus
taccttccctttaggcaaggctttg

SEQ ID NO: 764669 - DNA, 25 bp, Mus musculus
taccttcccttttggcaaggctttg

SEQ ID NO: 764670 - DNA, 25 bp, Mus musculus
taccttccgcctagtttgaggcaaa

SEQ ID NO: 764671 - DNA, 25 bp, Mus musculus
taccttccgccttgtttgaggcaaa

SEQ ID NO: 764672 - DNA, 25 bp, Mus musculus
taccttcctaggatgttgggagctg

SEQ ID NO: 764673 - DNA, 25 bp, Mus musculus
taccttcctaggttgttgggagctg

SEQ ID NO: 764674 - DNA, 25 bp, Mus musculus
taccttcctggccaagatgtacatc

SEQ ID NO: 764675 - DNA, 25 bp, Mus musculus
taccttcctggcgaagatgtacatc

SEQ ID NO: 764676 - DNA, 25 bp, Mus musculus
taccttcctgtacttagttcctaag

SEQ ID NO: 764677 - DNA, 25 bp, Mus musculus
taccttcctgtagttagttcctaag

SEQ ID NO: 764678 - DNA, 25 bp, Mus musculus
taccttcctgtccatggtgaatgtg

SEQ ID NO: 764679 - DNA, 25 bp, Mus musculus
taccttcctgtcgatggtgaatgtg

SEQ ID NO: 764680 - DNA, 25 bp, Mus musculus
taccttcgttctaacccttctgata

SEQ ID NO: 764681 - DNA, 25 bp, Mus musculus
taccttcgttcttacccttctgata

SEQ ID NO: 764682 - DNA, 25 bp, Mus musculus
taccttctactgagccgattctgag

SEQ ID NO: 764683 - DNA, 25 bp, Mus musculus
taccttctactgtgccgattctgag

SEQ ID NO: 764684 - DNA, 25 bp, Mus musculus
taccttctaggtcaaccctcagaga

SEQ ID NO: 764685 - DNA, 25 bp, Mus musculus
taccttctaggtgaaccctcagaga

SEQ ID NO: 764686 - DNA, 25 bp, Mus musculus
taccttctatggcaactggatgtcc

SEQ ID NO: 764687 - DNA, 25 bp, Mus musculus
taccttctatgggaactggatgtcc

SEQ ID NO: 764688 - DNA, 25 bp, Mus musculus
taccttctcagaatgttgtcttgaa

SEQ ID NO: 764689 - DNA, 25 bp, Mus musculus
taccttctcagactagtgctttggg

SEQ ID NO: 764690 - DNA, 25 bp, Mus musculus
taccttctcagagtagtgctttggg

SEQ ID NO: 764691 - DNA, 25 bp, Mus musculus
taccttctcagattgttgtcttgaa

SEQ ID NO: 764692 - DNA, 25 bp, Mus musculus
taccttctcagcatatatttttata

SEQ ID NO: 764693 - DNA, 25 bp, Mus musculus
taccttctcagcttatatttttata

SEQ ID NO: 764694 - DNA, 25 bp, Mus musculus
taccttctcatcactacagtactgg

SEQ ID NO: 764695 - DNA, 25 bp, Mus musculus
taccttctcatctctacagtactgg

SEQ ID NO: 764696 - DNA, 25 bp, Mus musculus
taccttctcccacatgtacatactt

SEQ ID NO: 764697 - DNA, 25 bp, Mus musculus
taccttctcccagatgtacatactt

SEQ ID NO: 764698 - DNA, 25 bp, Mus musculus
taccttctgactcgtccctgggaca

SEQ ID NO: 764699 - DNA, 25 bp, Mus musculus
taccttctgactggtccctgggaca

SEQ ID NO: 764700 - DNA, 25 bp, Mus musculus
taccttctgagtcggcggctgcacg

SEQ ID NO: 764701 - DNA, 25 bp, Mus musculus
taccttctgagtgggcggctgcacg

SEQ ID NO: 764702 - DNA, 25 bp, Mus musculus
taccttctgctaatctttaacttat

SEQ ID NO: 764703 - DNA, 25 bp, Mus musculus
taccttctgctattctttaacttat

SEQ ID NO: 764704 - DNA, 25 bp, Mus musculus
taccttctggcgacagagttctgga

SEQ ID NO: 764705 - DNA, 25 bp, Mus musculus
taccttctggcgtcagagttctgga

SEQ ID NO: 764706 - DNA, 25 bp, Mus musculus
taccttctgtaaattaaactccaag

SEQ ID NO: 764707 - DNA, 25 bp, Mus musculus
taccttctgtaatttaaactccaag

SEQ ID NO: 764708 - DNA, 25 bp, Mus musculus
taccttcttaccctttgggctctat

SEQ ID NO: 764709 - DNA, 25 bp, Mus musculus
taccttcttaccgtttgggctctat

SEQ ID NO: 764710 - DNA, 25 bp, Mus musculus
taccttcttagcaaaccctggacta

SEQ ID NO: 764711 - DNA, 25 bp, Mus musculus
taccttcttagctaaccctggacta

SEQ ID NO: 764712 - DNA, 25 bp, Mus musculus
taccttcttcccatggcagctgact

SEQ ID NO: 764713 - DNA, 25 bp, Mus musculus
taccttcttcccttggcagctgact

SEQ ID NO: 764714 - DNA, 25 bp, Mus musculus
taccttcttgaactcgattgtgcag

SEQ ID NO: 764715 - DNA, 25 bp, Mus musculus
taccttcttgaagtcgattgtgcag

SEQ ID NO: 764716 - DNA, 25 bp, Mus musculus
taccttcttgctatgtttaccagtg

SEQ ID NO: 764717 - DNA, 25 bp, Mus musculus
taccttcttgctttgtttaccagtg

SEQ ID NO: 764718 - DNA, 25 bp, Mus musculus
taccttgaagctcggttcttgttcc

SEQ ID NO: 764719 - DNA, 25 bp, Mus musculus
taccttgaagctgggttcttgttcc

SEQ ID NO: 764720 - DNA, 25 bp, Mus musculus
taccttgaatgaatcttcttacact

SEQ ID NO: 764721 - DNA, 25 bp, Mus musculus
taccttgaatgattcttcttacact

SEQ ID NO: 764722 - DNA, 25 bp, Mus musculus
taccttgactagatggctgttccac

SEQ ID NO: 764723 - DNA, 25 bp, Mus musculus
taccttgactagttggctgttccac

SEQ ID NO: 764724 - DNA, 25 bp, Mus musculus
taccttgactcccatagcttaggac

SEQ ID NO: 764725 - DNA, 25 bp, Mus musculus
taccttgactccgatagcttaggac

SEQ ID NO: 764726 - DNA, 25 bp, Mus musculus
taccttgagttgagttcccaccctt

SEQ ID NO: 764727 - DNA, 25 bp, Mus musculus
taccttgagttgtgttcccaccctt

SEQ ID NO: 764728 - DNA, 25 bp, Mus musculus
taccttgagtttaccactcgagcca

SEQ ID NO: 764729 - DNA, 25 bp, Mus musculus
taccttgagttttccactcgagcca

SEQ ID NO: 764730 - DNA, 25 bp, Mus musculus
taccttgataacattttgaccttta

SEQ ID NO: 764731 - DNA, 25 bp, Mus musculus
taccttgataactttttgaccttta

SEQ ID NO: 764732 - DNA, 25 bp, Mus musculus
taccttgatcttattcccctgactt

SEQ ID NO: 764733 - DNA, 25 bp, Mus musculus
taccttgatctttttcccctgactt

SEQ ID NO: 764734 - DNA, 25 bp, Mus musculus
taccttgatgggactgtcttggcta

SEQ ID NO: 764735 - DNA, 25 bp, Mus musculus
taccttgatgggtctgtcttggcta

SEQ ID NO: 764736 - DNA, 25 bp, Mus musculus
taccttgatgtgaatatggacatgt

SEQ ID NO: 764737 - DNA, 25 bp, Mus musculus
taccttgatgtgtatatggacatgt

SEQ ID NO: 764738 - DNA, 25 bp, Mus musculus
taccttgccaacatcgagtgacttt

SEQ ID NO: 764739 - DNA, 25 bp, Mus musculus
taccttgccaacttcgagtgacttt

SEQ ID NO: 764740 - DNA, 25 bp, Mus musculus
taccttgccactagcctgattaaag

SEQ ID NO: 764741 - DNA, 25 bp, Mus musculus
taccttgccacttgcctgattaaag

SEQ ID NO: 764742 - DNA, 25 bp, Mus musculus
taccttgccagtcatagctcagtca

SEQ ID NO: 764743 - DNA, 25 bp, Mus musculus
taccttgccagtgatagctcagtca

SEQ ID NO: 764744 - DNA, 25 bp, Mus musculus
taccttgctagcatgggaattttgc

SEQ ID NO: 764745 - DNA, 25 bp, Mus musculus
taccttgctagcttgggaattttgc

SEQ ID NO: 764746 - DNA, 25 bp, Mus musculus
taccttgctggccaagttgccacag

SEQ ID NO: 764747 - DNA, 25 bp, Mus musculus
taccttgctggcgaagttgccacag

SEQ ID NO: 764748 - DNA, 25 bp, Mus musculus
taccttggaactcaatttattaaat

SEQ ID NO: 764749 - DNA, 25 bp, Mus musculus
taccttggaactgaatttattaaat

SEQ ID NO: 764750 - DNA, 25 bp, Mus musculus
taccttggagccctgaagtactcag

SEQ ID NO: 764751 - DNA, 25 bp, Mus musculus
taccttggagccgtgaagtactcag

SEQ ID NO: 764752 - DNA, 25 bp, Mus musculus
taccttggcactcaggtgctggtat

SEQ ID NO: 764753 - DNA, 25 bp, Mus musculus
taccttggcactgaggtgctggtat

SEQ ID NO: 764754 - DNA, 25 bp, Mus musculus
taccttggccatctaagacccattt

SEQ ID NO: 764755 - DNA, 25 bp, Mus musculus
taccttggccatgtaagacccattt

SEQ ID NO: 764756 - DNA, 25 bp, Mus musculus
taccttggctctatgtggtgtttgc

SEQ ID NO: 764757 - DNA, 25 bp, Mus musculus
taccttggctctttgtggtgtttgc

SEQ ID NO: 764758 - DNA, 25 bp, Mus musculus
taccttgggcagataataggtcctt

SEQ ID NO: 764759 - DNA, 25 bp, Mus musculus
taccttgggcagttaataggtcctt

SEQ ID NO: 764760 - DNA, 25 bp, Mus musculus
taccttgggtacaaggatttcaaca

SEQ ID NO: 764761 - DNA, 25 bp, Mus musculus
taccttgggtactaggatttcaaca

SEQ ID NO: 764762 - DNA, 25 bp, Mus musculus
taccttggtaatcgtgtcacttcgc

SEQ ID NO: 764763 - DNA, 25 bp, Mus musculus
taccttggtaatggtgtcacttcgc

SEQ ID NO: 764764 - DNA, 25 bp, Mus musculus
taccttggtagtcgtgcttcatcac

SEQ ID NO: 764765 - DNA, 25 bp, Mus musculus
taccttggtagtggtgcttcatcac

SEQ ID NO: 764766 - DNA, 25 bp, Mus musculus
taccttgtaagaacctgcatttgaa

SEQ ID NO: 764767 - DNA, 25 bp, Mus musculus
taccttgtaagatcctgcatttgaa

SEQ ID NO: 764768 - DNA, 25 bp, Mus musculus
taccttgtacgtaacctctgtagtt

SEQ ID NO: 764769 - DNA, 25 bp, Mus musculus
taccttgtacgttacctctgtagtt

SEQ ID NO: 764770 - DNA, 25 bp, Mus musculus
taccttgtactacgcaccgcgttga

SEQ ID NO: 764771 - DNA, 25 bp, Mus musculus
taccttgtactaggcaccgcgttga

SEQ ID NO: 764772 - DNA, 25 bp, Mus musculus
taccttgtagaaaccttgcagattg

SEQ ID NO: 764773 - DNA, 25 bp, Mus musculus
taccttgtagaatccttgcagattg

SEQ ID NO: 764774 - DNA, 25 bp, Mus musculus
taccttgtagttcatcagccacagg

SEQ ID NO: 764775 - DNA, 25 bp, Mus musculus
taccttgtagttgatcagccacagg

SEQ ID NO: 764776 - DNA, 25 bp, Mus musculus
taccttgtcagtcgtgtgtgcagat

SEQ ID NO: 764777 - DNA, 25 bp, Mus musculus
taccttgtcagtggtgtgtgcagat

SEQ ID NO: 764778 - DNA, 25 bp, Mus musculus
taccttgtccccaagcagagataag

SEQ ID NO: 764779 - DNA, 25 bp, Mus musculus
taccttgtcccctagcagagataag

SEQ ID NO: 764780 - DNA, 25 bp, Mus musculus
taccttgtccctaaaatatgctttt

SEQ ID NO: 764781 - DNA, 25 bp, Mus musculus
taccttgtcccttaaatatgctttt

SEQ ID NO: 764782 - DNA, 25 bp, Mus musculus
taccttgtctgaaattgtcctttcc

SEQ ID NO: 764783 - DNA, 25 bp, Mus musculus
taccttgtctgatattgtcctttcc

SEQ ID NO: 764784 - DNA, 25 bp, Mus musculus
taccttgtgagcaggaacacactga

SEQ ID NO: 764785 - DNA, 25 bp, Mus musculus
taccttgtgagctggaacacactga

SEQ ID NO: 764786 - DNA, 25 bp, Mus musculus
taccttgtgcaaaagcctggctcaa

SEQ ID NO: 764787 - DNA, 25 bp, Mus musculus
taccttgtgcaatagcctggctcaa

SEQ ID NO: 764788 - DNA, 25 bp, Mus musculus
taccttgtgtaaactcagtactgaa

SEQ ID NO: 764789 - DNA, 25 bp, Mus musculus
taccttgtgtaatctcagtactgaa

SEQ ID NO: 764790 - DNA, 25 bp, Mus musculus
taccttgtgtctacagtggctgata

SEQ ID NO: 764791 - DNA, 25 bp, Mus musculus
taccttgtgtcttcagtggctgata

SEQ ID NO: 764792 - DNA, 25 bp, Mus musculus
taccttgtgtggagagcccagtatg

SEQ ID NO: 764793 - DNA, 25 bp, Mus musculus
taccttgtgtggtgagcccagtatg

SEQ ID NO: 764794 - DNA, 25 bp, Mus musculus
taccttgttcatccgaagatcatgt

SEQ ID NO: 764795 - DNA, 25 bp, Mus musculus
taccttgttcatgcgaagatcatgt

SEQ ID NO: 764796 - DNA, 25 bp, Mus musculus
taccttgttggaaccttcagtcttc

SEQ ID NO: 764797 - DNA, 25 bp, Mus musculus
taccttgttggatccttcagtcttc

SEQ ID NO: 764798 - DNA, 25 bp, Mus musculus
taccttgtttcaacagcttctggaa

SEQ ID NO: 764799 - DNA, 25 bp, Mus musculus
taccttgtttcatcagcttctggaa

SEQ ID NO: 764800 - DNA, 25 bp, Mus musculus
taccttgtttgtacccgccagcggg

SEQ ID NO: 764801 - DNA, 25 bp, Mus musculus
taccttgtttgttcccgccagcggg

SEQ ID NO: 764802 - DNA, 25 bp, Mus musculus
taccttgttttcagtctagtgagcc

SEQ ID NO: 764803 - DNA, 25 bp, Mus musculus
taccttgttttctgtctagtgagcc

SEQ ID NO: 764804 - DNA, 25 bp, Mus musculus
tacctttacaccctggttatcacag

SEQ ID NO: 764805 - DNA, 25 bp, Mus musculus
tacctttacaccgtggttatcacag

SEQ ID NO: 764806 - DNA, 25 bp, Mus musculus
tacctttacctactaagccagctta

SEQ ID NO: 764807 - DNA, 25 bp, Mus musculus
tacctttacctagtaagccagctta

SEQ ID NO: 764808 - DNA, 25 bp, Mus musculus
tacctttagataatgggattttact

SEQ ID NO: 764809 - DNA, 25 bp, Mus musculus
tacctttagatattgggattttact

SEQ ID NO: 764810 - DNA, 25 bp, Mus musculus
tacctttatttacagaagcctaggc

SEQ ID NO: 764811 - DNA, 25 bp, Mus musculus
tacctttatttactcaaaccttgct

SEQ ID NO: 764812 - DNA, 25 bp, Mus musculus
tacctttatttagagaagcctaggc

SEQ ID NO: 764813 - DNA, 25 bp, Mus musculus
tacctttatttagtcaaaccttgct

SEQ ID NO: 764814 - DNA, 25 bp, Mus musculus
tacctttcagctcaccttggcttat

SEQ ID NO: 764815 - DNA, 25 bp, Mus musculus
tacctttcagctgaccttggcttat

SEQ ID NO: 764816 - DNA, 25 bp, Mus musculus
tacctttcagtaagatgggccatgg

SEQ ID NO: 764817 - DNA, 25 bp, Mus musculus
tacctttcagtatgatgggccatgg

SEQ ID NO: 764818 - DNA, 25 bp, Mus musculus
tacctttcctacaactgagctgcag

SEQ ID NO: 764819 - DNA, 25 bp, Mus musculus
tacctttcctactactgagctgcag

SEQ ID NO: 764820 - DNA, 25 bp, Mus musculus
tacctttcctctccttgacttttag

SEQ ID NO: 764821 - DNA, 25 bp, Mus musculus
tacctttcctctgcttgacttttag

SEQ ID NO: 764822 - DNA, 25 bp, Mus musculus
tacctttctccaagccatttggata

SEQ ID NO: 764823 - DNA, 25 bp, Mus musculus
tacctttctccatgccatttggata

SEQ ID NO: 764824 - DNA, 25 bp, Mus musculus
tacctttctcctcagtggtaagatc

SEQ ID NO: 764825 - DNA, 25 bp, Mus musculus
tacctttctcctgagtggtaagatc

SEQ ID NO: 764826 - DNA, 25 bp, Mus musculus
tacctttctctaaatgatgtgcatg

SEQ ID NO: 764827 - DNA, 25 bp, Mus musculus
tacctttctctatatgatgtgcatg

SEQ ID NO: 764828 - DNA, 25 bp, Mus musculus
tacctttctgccctctggctgaggc

SEQ ID NO: 764829 - DNA, 25 bp, Mus musculus
tacctttctgccgtctggctgaggc

SEQ ID NO: 764830 - DNA, 25 bp, Mus musculus
tacctttctttaaatgcctctttct

SEQ ID NO: 764831 - DNA, 25 bp, Mus musculus
tacctttctttatatgcctctttct

SEQ ID NO: 764832 - DNA, 25 bp, Mus musculus
tacctttgaataccttagacagctg

SEQ ID NO: 764833 - DNA, 25 bp, Mus musculus
tacctttgaatagcttagacagctg

SEQ ID NO: 764834 - DNA, 25 bp, Mus musculus
tacctttgaattacctatcccaagc

SEQ ID NO: 764835 - DNA, 25 bp, Mus musculus
tacctttgaatttcctatcccaagc

SEQ ID NO: 764836 - DNA, 25 bp, Mus musculus
tacctttgacaaatgctttgctgaa

SEQ ID NO: 764837 - DNA, 25 bp, Mus musculus
tacctttgacaattgctttgctgaa

SEQ ID NO: 764838 - DNA, 25 bp, Mus musculus
tacctttgagggagggatgcagtaa

SEQ ID NO: 764839 - DNA, 25 bp, Mus musculus
tacctttgagggtgggatgcagtaa

SEQ ID NO: 764840 - DNA, 25 bp, Mus musculus
tacctttgatgacaggagcttcaga

SEQ ID NO: 764841 - DNA, 25 bp, Mus musculus
tacctttgatgagaggagcttcaga

SEQ ID NO: 764842 - DNA, 25 bp, Mus musculus
tacctttgctaaaatcatggcagaa

SEQ ID NO: 764843 - DNA, 25 bp, Mus musculus
tacctttgctaatatcatggcagaa

SEQ ID NO: 764844 - DNA, 25 bp, Mus musculus
tacctttgctctacagcctccagtt

SEQ ID NO: 764845 - DNA, 25 bp, Mus musculus
tacctttgctcttcagcctccagtt

SEQ ID NO: 764846 - DNA, 25 bp, Mus musculus
tacctttgctggacaatgcttctgg

SEQ ID NO: 764847 - DNA, 25 bp, Mus musculus
tacctttgctggcatccggaatagt

SEQ ID NO: 764848 - DNA, 25 bp, Mus musculus
tacctttgctgggatccggaatagt

SEQ ID NO: 764849 - DNA, 25 bp, Mus musculus
tacctttgctggtcaatgcttctgg

SEQ ID NO: 764850 - DNA, 25 bp, Mus musculus
tacctttgctgtacagtctgcagtt

SEQ ID NO: 764851 - DNA, 25 bp, Mus musculus
tacctttgctgttcagtctgcagtt

SEQ ID NO: 764852 - DNA, 25 bp, Mus musculus
tacctttggatgctctgtggcagca

SEQ ID NO: 764853 - DNA, 25 bp, Mus musculus
tacctttggatggtctgtggcagca

SEQ ID NO: 764854 - DNA, 25 bp, Mus musculus
tacctttgtgacacttagcagctta

SEQ ID NO: 764855 - DNA, 25 bp, Mus musculus
tacctttgtgactcttagcagctta

SEQ ID NO: 764856 - DNA, 25 bp, Mus musculus
taccttttaagactctcctcctact

SEQ ID NO: 764857 - DNA, 25 bp, Mus musculus
taccttttaagagtctcctcctact

SEQ ID NO: 764858 - DNA, 25 bp, Mus musculus
taccttttatgacatttccctttat

SEQ ID NO: 764859 - DNA, 25 bp, Mus musculus
taccttttatgagatttccctttat

SEQ ID NO: 764860 - DNA, 25 bp, Mus musculus
taccttttatttcaaccctctctat

SEQ ID NO: 764861 - DNA, 25 bp, Mus musculus
taccttttatttgaaccctctctat

SEQ ID NO: 764862 - DNA, 25 bp, Mus musculus
taccttttccacattttctcagcag

SEQ ID NO: 764863 - DNA, 25 bp, Mus musculus
taccttttccactttttctcagcag

SEQ ID NO: 764864 - DNA, 25 bp, Mus musculus
taccttttcctaaactgtgcctgga

SEQ ID NO: 764865 - DNA, 25 bp, Mus musculus
taccttttcctatactgtgcctgga

SEQ ID NO: 764866 - DNA, 25 bp, Mus musculus
taccttttctctcttctgatctagc

SEQ ID NO: 764867 - DNA, 25 bp, Mus musculus
taccttttctctgttctgatctagc

SEQ ID NO: 764868 - DNA, 25 bp, Mus musculus
taccttttggcaacttctaccgaat

SEQ ID NO: 764869 - DNA, 25 bp, Mus musculus
taccttttggcatcttctaccgaat

SEQ ID NO: 764870 - DNA, 25 bp, Mus musculus
tacgaaagataaacacgctggagat

SEQ ID NO: 764871 - DNA, 25 bp, Mus musculus
tacgaaagataatcacgctggagat

SEQ ID NO: 764872 - DNA, 25 bp, Mus musculus
tacgaaatggctattctcatgttcc

SEQ ID NO: 764873 - DNA, 25 bp, Mus musculus
tacgaaatggcttttctcatgttcc

SEQ ID NO: 764874 - DNA, 25 bp, Mus musculus
tacgaacccgcacatgatctccagt

SEQ ID NO: 764875 - DNA, 25 bp, Mus musculus
tacgaacccgcagatgatctccagt

SEQ ID NO: 764876 - DNA, 25 bp, Mus musculus
tacgaacgtggtaccgcacacgcag

SEQ ID NO: 764877 - DNA, 25 bp, Mus musculus
tacgaacgtggttccgcacacgcag

SEQ ID NO: 764878 - DNA, 25 bp, Mus musculus
tacgaactgcacatatcctcggaag

SEQ ID NO: 764879 - DNA, 25 bp, Mus musculus
tacgaactgcacttatcctcggaag

SEQ ID NO: 764880 - DNA, 25 bp, Mus musculus
tacgaagagaggaggcgctccttcc

SEQ ID NO: 764881 - DNA, 25 bp, Mus musculus
tacgaagagaggtggcgctccttcc

SEQ ID NO: 764882 - DNA, 25 bp, Mus musculus
tacgaagatggacgcccgggatgct

SEQ ID NO: 764883 - DNA, 25 bp, Mus musculus
tacgaagatggaggcccgggatgct

SEQ ID NO: 764884 - DNA, 25 bp, Mus musculus
tacgaagcagggaacagatcggcgt

SEQ ID NO: 764885 - DNA, 25 bp, Mus musculus
tacgaagcagggtacagatcggcgt

SEQ ID NO: 764886 - DNA, 25 bp, Mus musculus
tacgaagcatggaatcctcagagct

SEQ ID NO: 764887 - DNA, 25 bp, Mus musculus
tacgaagcatggtatcctcagagct

SEQ ID NO: 764888 - DNA, 25 bp, Mus musculus
tacgaagccatgaagggtgccggaa

SEQ ID NO: 764889 - DNA, 25 bp, Mus musculus
tacgaagccatgtagggtgccggaa

SEQ ID NO: 764890 - DNA, 25 bp, Mus musculus
tacgaagcctgtagtgtggtcctgt

SEQ ID NO: 764891 - DNA, 25 bp, Mus musculus
tacgaagcctgttgtgtggtcctgt

SEQ ID NO: 764892 - DNA, 25 bp, Mus musculus
tacgaagctctccagaagcacgcct

SEQ ID NO: 764893 - DNA, 25 bp, Mus musculus
tacgaagctctcgagaagcacgcct

SEQ ID NO: 764894 - DNA, 25 bp, Mus musculus
tacgaagtgactagcagctgagtga

SEQ ID NO: 764895 - DNA, 25 bp, Mus musculus
tacgaagtgacttgcagctgagtga

SEQ ID NO: 764896 - DNA, 25 bp, Mus musculus
tacgaatacccaacgtagtgggcca

SEQ ID NO: 764897 - DNA, 25 bp, Mus musculus
tacgaatacccatcgtagtgggcca

SEQ ID NO: 764898 - DNA, 25 bp, Mus musculus
tacgaatcctttcacgaactctggg

SEQ ID NO: 764899 - DNA, 25 bp, Mus musculus
tacgaatcctttgacgaactctggg

SEQ ID NO: 764900 - DNA, 25 bp, Mus musculus
tacgaatgggcgaccgttttgcagc

SEQ ID NO: 764901 - DNA, 25 bp, Mus musculus
tacgaatgggcgtccgttttgcagc

SEQ ID NO: 764902 - DNA, 25 bp, Mus musculus
tacgaattagcactggagtccctct

SEQ ID NO: 764903 - DNA, 25 bp, Mus musculus
tacgaattagcagtggagtccctct

SEQ ID NO: 764904 - DNA, 25 bp, Mus musculus
tacgaattcgggaaagtcccttcag

SEQ ID NO: 764905 - DNA, 25 bp, Mus musculus
tacgaattcgggtaagtcccttcag

SEQ ID NO: 764906 - DNA, 25 bp, Mus musculus
tacgaatttttcattactgggcatt

SEQ ID NO: 764907 - DNA, 25 bp, Mus musculus
tacgaatttttctttactgggcatt

SEQ ID NO: 764908 - DNA, 25 bp, Mus musculus
tacgacacagctctcatctatgact

SEQ ID NO: 764909 - DNA, 25 bp, Mus musculus
tacgacacagctgtcatctatgact

SEQ ID NO: 764910 - DNA, 25 bp, Mus musculus
tacgacactaatctggtctttcaag

SEQ ID NO: 764911 - DNA, 25 bp, Mus musculus
tacgacactaatgtggtctttcaag

SEQ ID NO: 764912 - DNA, 25 bp, Mus musculus
tacgacagacctacgaggcagccat

SEQ ID NO: 764913 - DNA, 25 bp, Mus musculus
tacgacagaccttcgaggcagccat

SEQ ID NO: 764914 - DNA, 25 bp, Mus musculus
tacgacagggtaagcggccttctgc

SEQ ID NO: 764915 - DNA, 25 bp, Mus musculus
tacgacagggtatgcggccttctgc

SEQ ID NO: 764916 - DNA, 25 bp, Mus musculus
tacgacatgaccaactaccggggaa

SEQ ID NO: 764917 - DNA, 25 bp, Mus musculus
tacgacatgacctactaccggggaa

SEQ ID NO: 764918 - DNA, 25 bp, Mus musculus
tacgacattgctcaggtgaatctca

SEQ ID NO: 764919 - DNA, 25 bp, Mus musculus
tacgacattgctgaggtgaatctca

SEQ ID NO: 764920 - DNA, 25 bp, Mus musculus
tacgaccagcatatccgaggcagcc

SEQ ID NO: 764921 - DNA, 25 bp, Mus musculus
tacgaccagcatttccgaggcagcc

SEQ ID NO: 764922 - DNA, 25 bp, Mus musculus
tacgacccatgcaccagtttgggct

SEQ ID NO: 764923 - DNA, 25 bp, Mus musculus
tacgacccatgctccagtttgggct

SEQ ID NO: 764924 - DNA, 25 bp, Mus musculus
tacgacccgggcattatggccactt

SEQ ID NO: 764925 - DNA, 25 bp, Mus musculus
tacgacccgggctttatggccactt

SEQ ID NO: 764926 - DNA, 25 bp, Mus musculus
tacgaccctgatactcacggttgta

SEQ ID NO: 764927 - DNA, 25 bp, Mus musculus
tacgaccctgattctcacggttgta

SEQ ID NO: 764928 - DNA, 25 bp, Mus musculus
tacgaccgacggcagtacaggcgct

SEQ ID NO: 764929 - DNA, 25 bp, Mus musculus
tacgaccgacgggagtacaggcgct

SEQ ID NO: 764930 - DNA, 25 bp, Mus musculus
tacgaccgcaagcactacgtctgag

SEQ ID NO: 764931 - DNA, 25 bp, Mus musculus
tacgaccgcaaggactacgtctgag

SEQ ID NO: 764932 - DNA, 25 bp, Mus musculus
tacgaccgctaacttatccacagac

SEQ ID NO: 764933 - DNA, 25 bp, Mus musculus
tacgaccgctaagttatccacagac

SEQ ID NO: 764934 - DNA, 25 bp, Mus musculus
tacgaccgggcacgctgtgacagat

SEQ ID NO: 764935 - DNA, 25 bp, Mus musculus
tacgaccgggcaggctgtgacagat

SEQ ID NO: 764936 - DNA, 25 bp, Mus musculus
tacgacctccaaatcattttccttt

SEQ ID NO: 764937 - DNA, 25 bp, Mus musculus
tacgacctccaattcattttccttt

SEQ ID NO: 764938 - DNA, 25 bp, Mus musculus
tacgacctgaacaccagaagcaaat

SEQ ID NO: 764939 - DNA, 25 bp, Mus musculus
tacgacctgaactccagaagcaaat

SEQ ID NO: 764940 - DNA, 25 bp, Mus musculus
tacgacctgtacctctcaacttttg

SEQ ID NO: 764941 - DNA, 25 bp, Mus musculus
tacgacctgtacgtctcaacttttg

SEQ ID NO: 764942 - DNA, 25 bp, Mus musculus
tacgacctgtgtataggacattttt

SEQ ID NO: 764943 - DNA, 25 bp, Mus musculus
tacgacctgtgtttaggacattttt

SEQ ID NO: 764944 - DNA, 25 bp, Mus musculus
tacgacgagagaagcccatcatcat

SEQ ID NO: 764945 - DNA, 25 bp, Mus musculus
tacgacgagagatgcccatcatcat

SEQ ID NO: 764946 - DNA, 25 bp, Mus musculus
tacgacgatgtcaccagcttccgag

SEQ ID NO: 764947 - DNA, 25 bp, Mus musculus
tacgacgatgtctccagcttccgag

SEQ ID NO: 764948 - DNA, 25 bp, Mus musculus
tacgacgggagactggttatcaaca

SEQ ID NO: 764949 - DNA, 25 bp, Mus musculus
tacgacgggagagtggttatcaaca

SEQ ID NO: 764950 - DNA, 25 bp, Mus musculus
tacgacgggcctctgcatgaagtga

SEQ ID NO: 764951 - DNA, 25 bp, Mus musculus
tacgacgggcctgtgcatgaagtga

SEQ ID NO: 764952 - DNA, 25 bp, Mus musculus
tacgacgtatggaactatgctatgg

SEQ ID NO: 764953 - DNA, 25 bp, Mus musculus
tacgacgtatggtactatgctatgg

SEQ ID NO: 764954 - DNA, 25 bp, Mus musculus
tacgacgtgtctacctttagtttct

SEQ ID NO: 764955 - DNA, 25 bp, Mus musculus
tacgacgtgtcttcctttagtttct

SEQ ID NO: 764956 - DNA, 25 bp, Mus musculus
tacgactcattcatatgatttctgc

SEQ ID NO: 764957 - DNA, 25 bp, Mus musculus
tacgactcattcttatgatttctgc

SEQ ID NO: 764958 - DNA, 25 bp, Mus musculus
tacgactgtgtacccaaaagtgtct

SEQ ID NO: 764959 - DNA, 25 bp, Mus musculus
tacgactgtgtagccaaaagtgtct

SEQ ID NO: 764960 - DNA, 25 bp, Mus musculus
tacgacttctgtccccgggacaggt

SEQ ID NO: 764961 - DNA, 25 bp, Mus musculus
tacgacttctgtgcccgggacaggt

SEQ ID NO: 764962 - DNA, 25 bp, Mus musculus
tacgactttgtacaggccatgattg

SEQ ID NO: 764963 - DNA, 25 bp, Mus musculus
tacgactttgtagaggccatgattg

SEQ ID NO: 764964 - DNA, 25 bp, Mus musculus
tacgacttttgcctcataccttgaa

SEQ ID NO: 764965 - DNA, 25 bp, Mus musculus
tacgacttttgcgtcataccttgaa

SEQ ID NO: 764966 - DNA, 25 bp, Mus musculus
tacgagaaacgcagcaaacccctag

SEQ ID NO: 764967 - DNA, 25 bp, Mus musculus
tacgagaaacgctgcaaacccctag

SEQ ID NO: 764968 - DNA, 25 bp, Mus musculus
tacgagaactctactccagtgtcct

SEQ ID NO: 764969 - DNA, 25 bp, Mus musculus
tacgagaactcttctccagtgtcct

SEQ ID NO: 764970 - DNA, 25 bp, Mus musculus
tacgagaagctcagccgggctatga

SEQ ID NO: 764971 - DNA, 25 bp, Mus musculus
tacgagaagctctgccgggctatga

SEQ ID NO: 764972 - DNA, 25 bp, Mus musculus
tacgagaatgctaacaaggcactgg

SEQ ID NO: 764973 - DNA, 25 bp, Mus musculus
tacgagaatgcttacaaggcactgg

SEQ ID NO: 764974 - DNA, 25 bp, Mus musculus
tacgagacagacagtccaggtcgcc

SEQ ID NO: 764975 - DNA, 25 bp, Mus musculus
tacgagacagactgtccaggtcgcc

SEQ ID NO: 764976 - DNA, 25 bp, Mus musculus
tacgagagctgacgatttacacatc

SEQ ID NO: 764977 - DNA, 25 bp, Mus musculus
tacgagagctgaggatttacacatc

SEQ ID NO: 764978 - DNA, 25 bp, Mus musculus
tacgagagctttcctgatcgggacc

SEQ ID NO: 764979 - DNA, 25 bp, Mus musculus
tacgagagctttgctgatcgggacc

SEQ ID NO: 764980 - DNA, 25 bp, Mus musculus
tacgagatgctacccgggcagcctc

SEQ ID NO: 764981 - DNA, 25 bp, Mus musculus
tacgagatgctagccgggcagcctc

SEQ ID NO: 764982 - DNA, 25 bp, Mus musculus
tacgagatgtacaggaaggcagaac

SEQ ID NO: 764983 - DNA, 25 bp, Mus musculus
tacgagatgtactggaaggcagaac

SEQ ID NO: 764984 - DNA, 25 bp, Mus musculus
tacgagcatgcaatgctgttccaga

SEQ ID NO: 764985 - DNA, 25 bp, Mus musculus
tacgagcatgcattgctgttccaga

SEQ ID NO: 764986 - DNA, 25 bp, Mus musculus
tacgagccaaggcagccagtatttg

SEQ ID NO: 764987 - DNA, 25 bp, Mus musculus
tacgagccaagggagccagtatttg

SEQ ID NO: 764988 - DNA, 25 bp, Mus musculus
tacgagccccgaacctctggaagaa

SEQ ID NO: 764989 - DNA, 25 bp, Mus musculus
tacgagccccgatcctctggaagaa

SEQ ID NO: 764990 - DNA, 25 bp, Mus musculus
tacgagccgccactcctgtttcgga

SEQ ID NO: 764991 - DNA, 25 bp, Mus musculus
tacgagccgccagtcctgtttcgga

SEQ ID NO: 764992 - DNA, 25 bp, Mus musculus
tacgagcctctgctggcaagttcta

SEQ ID NO: 764993 - DNA, 25 bp, Mus musculus
tacgagcctctggtggcaagttcta

SEQ ID NO: 764994 - DNA, 25 bp, Mus musculus
tacgagctcgatcggcgaatgccct

SEQ ID NO: 764995 - DNA, 25 bp, Mus musculus
tacgagctcgatgggcgaatgccct

SEQ ID NO: 764996 - DNA, 25 bp, Mus musculus
tacgagcttaagaacccaccagtga

SEQ ID NO: 764997 - DNA, 25 bp, Mus musculus
tacgagcttaagtacccaccagtga

SEQ ID NO: 764998 - DNA, 25 bp, Mus musculus
tacgaggaccagaacactgcctact

SEQ ID NO: 764999 - DNA, 25 bp, Mus musculus
tacgaggaccagtacactgcctact

SEQ ID NO: 765000 - DNA, 25 bp, Mus musculus
tacgaggccaaaccgtgactacgaa

SEQ ID NO: 765001 - DNA, 25 bp, Mus musculus
tacgaggccaaagcgtgactacgaa

SEQ ID NO: 765002 - DNA, 25 bp, Mus musculus
tacgagggtaaccttccacaatggg

SEQ ID NO: 765003 - DNA, 25 bp, Mus musculus
tacgagggtaacgttccacaatggg

SEQ ID NO: 765004 - DNA, 25 bp, Mus musculus
tacgaggtgcacctgtcgttagcat

SEQ ID NO: 765005 - DNA, 25 bp, Mus musculus
tacgaggtgcacgtgtcgttagcat

SEQ ID NO: 765006 - DNA, 25 bp, Mus musculus
tacgaggtggagcacactctgtcct

SEQ ID NO: 765007 - DNA, 25 bp, Mus musculus
tacgaggtggaggacactctgtcct

SEQ ID NO: 765008 - DNA, 25 bp, Mus musculus
tacgagtatcccagtctggcaggca

SEQ ID NO: 765009 - DNA, 25 bp, Mus musculus
tacgagtatccctgtctggcaggca

SEQ ID NO: 765010 - DNA, 25 bp, Mus musculus
tacgagtcctgcctgacacgatgag

SEQ ID NO: 765011 - DNA, 25 bp, Mus musculus
tacgagtcctgcgtgacacgatgag

SEQ ID NO: 765012 - DNA, 25 bp, Mus musculus
tacgagtgagtaagtccctgcccag

SEQ ID NO: 765013 - DNA, 25 bp, Mus musculus
tacgagtgagtatgtccctgcccag

SEQ ID NO: 765014 - DNA, 25 bp, Mus musculus
tacgagtgccctctttacaaaacca

SEQ ID NO: 765015 - DNA, 25 bp, Mus musculus
tacgagtgccctgtttacaaaacca

SEQ ID NO: 765016 - DNA, 25 bp, Mus musculus
tacgagtgcctcacgtgcggcgaga

SEQ ID NO: 765017 - DNA, 25 bp, Mus musculus
tacgagtgcctctcgtgcggcgaga

SEQ ID NO: 765018 - DNA, 25 bp, Mus musculus
tacgagtgtgtgctttcctgtgaca

SEQ ID NO: 765019 - DNA, 25 bp, Mus musculus
tacgagtgtgtggtttcctgtgaca

SEQ ID NO: 765020 - DNA, 25 bp, Mus musculus
tacgagttagaacccggtcctgaca

SEQ ID NO: 765021 - DNA, 25 bp, Mus musculus
tacgagttagaagccggtcctgaca

SEQ ID NO: 765022 - DNA, 25 bp, Mus musculus
tacgagttgtttctgcgcttctcca

SEQ ID NO: 765023 - DNA, 25 bp, Mus musculus
tacgagttgtttgtgcgcttctcca

SEQ ID NO: 765024 - DNA, 25 bp, Mus musculus
tacgagtttctcaaactttgctttt

SEQ ID NO: 765025 - DNA, 25 bp, Mus musculus
tacgagtttctctaactttgctttt

SEQ ID NO: 765026 - DNA, 25 bp, Mus musculus
tacgatatcagccagttgtttgatt

SEQ ID NO: 765027 - DNA, 25 bp, Mus musculus
tacgatatcagcgagttgtttgatt

SEQ ID NO: 765028 - DNA, 25 bp, Mus musculus
tacgatatccctaagagtgaccatt

SEQ ID NO: 765029 - DNA, 25 bp, Mus musculus
tacgatatcccttagagtgaccatt

SEQ ID NO: 765030 - DNA, 25 bp, Mus musculus
tacgatcccattagataaacggctg

SEQ ID NO: 765031 - DNA, 25 bp, Mus musculus
tacgatcccatttgataaacggctg

SEQ ID NO: 765032 - DNA, 25 bp, Mus musculus
tacgatccctccagatgtcttcaca

SEQ ID NO: 765033 - DNA, 25 bp, Mus musculus
tacgatccctcctgatgtcttcaca

SEQ ID NO: 765034 - DNA, 25 bp, Mus musculus
tacgatccgatcctaaggttcttcc

SEQ ID NO: 765035 - DNA, 25 bp, Mus musculus
tacgatccgatcgtaaggttcttcc

SEQ ID NO: 765036 - DNA, 25 bp, Mus musculus
tacgatctcaacctgtgcgggctga

SEQ ID NO: 765037 - DNA, 25 bp, Mus musculus
tacgatctcaacgtgtgcgggctga

SEQ ID NO: 765038 - DNA, 25 bp, Mus musculus
tacgatctggcacctatcaggaagt

SEQ ID NO: 765039 - DNA, 25 bp, Mus musculus
tacgatctggcagctatcaggaagt

SEQ ID NO: 765040 - DNA, 25 bp, Mus musculus
tacgatgagcccatttcaaacttcc

SEQ ID NO: 765041 - DNA, 25 bp, Mus musculus
tacgatgagcccttttcaaacttcc

SEQ ID NO: 765042 - DNA, 25 bp, Mus musculus
tacgatgataaaccacagagcctgt

SEQ ID NO: 765043 - DNA, 25 bp, Mus musculus
tacgatgataaagcacagagcctgt

SEQ ID NO: 765044 - DNA, 25 bp, Mus musculus
tacgatgattgcactgtcagttcct

SEQ ID NO: 765045 - DNA, 25 bp, Mus musculus
tacgatgattgctctgtcagttcct

SEQ ID NO: 765046 - DNA, 25 bp, Mus musculus
tacgatgcctttatggcctctgagt

SEQ ID NO: 765047 - DNA, 25 bp, Mus musculus
tacgatgcctttttggcctctgagt

SEQ ID NO: 765048 - DNA, 25 bp, Mus musculus
tacgatgctgagaacgccacgtgga

SEQ ID NO: 765049 - DNA, 25 bp, Mus musculus
tacgatgctgagtacgccacgtgga

SEQ ID NO: 765050 - DNA, 25 bp, Mus musculus
tacgatgctggtcatcacagcttca

SEQ ID NO: 765051 - DNA, 25 bp, Mus musculus
tacgatgctggtgatcacagcttca

SEQ ID NO: 765052 - DNA, 25 bp, Mus musculus
tacgatggcaggaagtgtcaacttt

SEQ ID NO: 765053 - DNA, 25 bp, Mus musculus
tacgatggcaggtagtgtcaacttt

SEQ ID NO: 765054 - DNA, 25 bp, Mus musculus
tacgatggccccaaggtgacaggca

SEQ ID NO: 765055 - DNA, 25 bp, Mus musculus
tacgatggcccctaggtgacaggca

SEQ ID NO: 765056 - DNA, 25 bp, Mus musculus
tacgatgggatcaagcggctctata

SEQ ID NO: 765057 - DNA, 25 bp, Mus musculus
tacgatgggatctagcggctctata

SEQ ID NO: 765058 - DNA, 25 bp, Mus musculus
tacgatgggcctcagcagcgattct

SEQ ID NO: 765059 - DNA, 25 bp, Mus musculus
tacgatgggcctgagcagcgattct

SEQ ID NO: 765060 - DNA, 25 bp, Mus musculus
tacgatggtcagaatcctcctaaaa

SEQ ID NO: 765061 - DNA, 25 bp, Mus musculus
tacgatggtcagtatcctcctaaaa

SEQ ID NO: 765062 - DNA, 25 bp, Mus musculus
tacgatgtcatactgcagacttaaa

SEQ ID NO: 765063 - DNA, 25 bp, Mus musculus
tacgatgtcatagtgcagacttaaa

SEQ ID NO: 765064 - DNA, 25 bp, Mus musculus
tacgatgtctttccaagtgtcctga

SEQ ID NO: 765065 - DNA, 25 bp, Mus musculus
tacgatgtctttgcaagtgtcctga

SEQ ID NO: 765066 - DNA, 25 bp, Mus musculus
tacgatgtgggtcagagctgcctta

SEQ ID NO: 765067 - DNA, 25 bp, Mus musculus
tacgatgtgggtgagagctgcctta

SEQ ID NO: 765068 - DNA, 25 bp, Mus musculus
tacgattaccctattattcatatat

SEQ ID NO: 765069 - DNA, 25 bp, Mus musculus
tacgattacccttttattcatatat

SEQ ID NO: 765070 - DNA, 25 bp, Mus musculus
tacgattacctgaacgacccgttat

SEQ ID NO: 765071 - DNA, 25 bp, Mus musculus
tacgattacctgtacgacccgttat

SEQ ID NO: 765072 - DNA, 25 bp, Mus musculus
tacgattatcagaaacagaattcct

SEQ ID NO: 765073 - DNA, 25 bp, Mus musculus
tacgattatcagtaacagaattcct

SEQ ID NO: 765074 - DNA, 25 bp, Mus musculus
tacgattcccagaagcgaggcaaaa

SEQ ID NO: 765075 - DNA, 25 bp, Mus musculus
tacgattcccagtagcgaggcaaaa

SEQ ID NO: 765076 - DNA, 25 bp, Mus musculus
tacgattgagttaagggcacgccca

SEQ ID NO: 765077 - DNA, 25 bp, Mus musculus
tacgattgagtttagggcacgccca

SEQ ID NO: 765078 - DNA, 25 bp, Mus musculus
tacgatttagctagacgggtgtctc

SEQ ID NO: 765079 - DNA, 25 bp, Mus musculus
tacgatttagcttgacgggtgtctc

SEQ ID NO: 765080 - DNA, 25 bp, Mus musculus
tacgatttcgggaagggatgaactc

SEQ ID NO: 765081 - DNA, 25 bp, Mus musculus
tacgatttcgggtagggatgaactc

SEQ ID NO: 765082 - DNA, 25 bp, Mus musculus
tacgatttctcaataatggcacagt

SEQ ID NO: 765083 - DNA, 25 bp, Mus musculus
tacgatttctcattaatggcacagt

SEQ ID NO: 765084 - DNA, 25 bp, Mus musculus
tacgcaaccggacgctgggtccaag

SEQ ID NO: 765085 - DNA, 25 bp, Mus musculus
tacgcaaccggaggctgggtccaag

SEQ ID NO: 765086 - DNA, 25 bp, Mus musculus
tacgcaacctcgcagtggccatgtg

SEQ ID NO: 765087 - DNA, 25 bp, Mus musculus
tacgcaacctcggagtggccatgtg

SEQ ID NO: 765088 - DNA, 25 bp, Mus musculus
tacgcaaggctgcatatctaacggc

SEQ ID NO: 765089 - DNA, 25 bp, Mus musculus
tacgcaaggctggatatctaacggc

SEQ ID NO: 765090 - DNA, 25 bp, Mus musculus
tacgcaatcctgagcatatgggcat

SEQ ID NO: 765091 - DNA, 25 bp, Mus musculus
tacgcaatcctgtgcatatgggcat

SEQ ID NO: 765092 - DNA, 25 bp, Mus musculus
tacgcaatctgacctgccgaacaaa

SEQ ID NO: 765093 - DNA, 25 bp, Mus musculus
tacgcaatctgagctgccgaacaaa

SEQ ID NO: 765094 - DNA, 25 bp, Mus musculus
tacgcacagggtacacggtgcagca

SEQ ID NO: 765095 - DNA, 25 bp, Mus musculus
tacgcacagggttcacggtgcagca

SEQ ID NO: 765096 - DNA, 25 bp, Mus musculus
tacgcacgcacaaggagcgcactta

SEQ ID NO: 765097 - DNA, 25 bp, Mus musculus
tacgcacgcacatggagcgcactta

SEQ ID NO: 765098 - DNA, 25 bp, Mus musculus
tacgcacggtctctaatgttcctat

SEQ ID NO: 765099 - DNA, 25 bp, Mus musculus
tacgcacggtctgtaatgttcctat

SEQ ID NO: 765100 - DNA, 25 bp, Mus musculus
tacgcactacatctggtctctagag

SEQ ID NO: 765101 - DNA, 25 bp, Mus musculus
tacgcactacatgtggtctctagag

SEQ ID NO: 765102 - DNA, 25 bp, Mus musculus
tacgcactcaagagggtctccctgg

SEQ ID NO: 765103 - DNA, 25 bp, Mus musculus
tacgcactcaagtgggtctccctgg

SEQ ID NO: 765104 - DNA, 25 bp, Mus musculus
tacgcagcacacctggcggcactag

SEQ ID NO: 765105 - DNA, 25 bp, Mus musculus
tacgcagcacacgtggcggcactag

SEQ ID NO: 765106 - DNA, 25 bp, Mus musculus
tacgcagcagtcaacaactcagaga

SEQ ID NO: 765107 - DNA, 25 bp, Mus musculus
tacgcagcagtctacaactcagaga

SEQ ID NO: 765108 - DNA, 25 bp, Mus musculus
tacgcagcatgcacacgtgggtctt

SEQ ID NO: 765109 - DNA, 25 bp, Mus musculus
tacgcagcatgctcacgtgggtctt

SEQ ID NO: 765110 - DNA, 25 bp, Mus musculus
tacgcagccagcatggctaaagcca

SEQ ID NO: 765111 - DNA, 25 bp, Mus musculus
tacgcagccagcttggctaaagcca

SEQ ID NO: 765112 - DNA, 25 bp, Mus musculus
tacgcagccccacgtaaatggccat

SEQ ID NO: 765113 - DNA, 25 bp, Mus musculus
tacgcagccccaggtaaatggccat

SEQ ID NO: 765114 - DNA, 25 bp, Mus musculus
tacgcaggcaatcacgtcatctgga

SEQ ID NO: 765115 - DNA, 25 bp, Mus musculus
tacgcaggcaatgacgtcatctgga

SEQ ID NO: 765116 - DNA, 25 bp, Mus musculus
tacgcagggtttaaagcttggagac

SEQ ID NO: 765117 - DNA, 25 bp, Mus musculus
tacgcagggttttaagcttggagac

SEQ ID NO: 765118 - DNA, 25 bp, Mus musculus
tacgcaggttatcttttcaaggcaa

SEQ ID NO: 765119 - DNA, 25 bp, Mus musculus
tacgcaggttatgttttcaaggcaa

SEQ ID NO: 765120 - DNA, 25 bp, Mus musculus
tacgcagtgtaaagtctcctccagg

SEQ ID NO: 765121 - DNA, 25 bp, Mus musculus
tacgcagtgtaatgtctcctccagg

SEQ ID NO: 765122 - DNA, 25 bp, Mus musculus
tacgcatcaaaaatactaagtttgc

SEQ ID NO: 765123 - DNA, 25 bp, Mus musculus
tacgcatcaaaattactaagtttgc

SEQ ID NO: 765124 - DNA, 25 bp, Mus musculus
tacgcatcaccgcaacagctggagg

SEQ ID NO: 765125 - DNA, 25 bp, Mus musculus
tacgcatcaccggaacagctggagg

SEQ ID NO: 765126 - DNA, 25 bp, Mus musculus
tacgcatccagaaatgttgccttcc

SEQ ID NO: 765127 - DNA, 25 bp, Mus musculus
tacgcatccagatatgttgccttcc

SEQ ID NO: 765128 - DNA, 25 bp, Mus musculus
tacgcatcccttcacttcattgttt

SEQ ID NO: 765129 - DNA, 25 bp, Mus musculus
tacgcatcccttgacttcattgttt

SEQ ID NO: 765130 - DNA, 25 bp, Mus musculus
tacgcatccgtaccttgcatggaac

SEQ ID NO: 765131 - DNA, 25 bp, Mus musculus
tacgcatccgtagcttgcatggaac

SEQ ID NO: 765132 - DNA, 25 bp, Mus musculus
tacgcatccttcagatattttgtat

SEQ ID NO: 765133 - DNA, 25 bp, Mus musculus
tacgcatccttctgatattttgtat

SEQ ID NO: 765134 - DNA, 25 bp, Mus musculus
tacgcatgactacattacaacgggc

SEQ ID NO: 765135 - DNA, 25 bp, Mus musculus
tacgcatgactagattacaacgggc

SEQ ID NO: 765136 - DNA, 25 bp, Mus musculus
tacgcatgagaaagcgggcagacgt

SEQ ID NO: 765137 - DNA, 25 bp, Mus musculus
tacgcatgagaaccgagagccccga

SEQ ID NO: 765138 - DNA, 25 bp, Mus musculus
tacgcatgagaagcgagagccccga

SEQ ID NO: 765139 - DNA, 25 bp, Mus musculus
tacgcatgagaatgcgggcagacgt

SEQ ID NO: 765140 - DNA, 25 bp, Mus musculus
tacgcatgctcactattgggacact

SEQ ID NO: 765141 - DNA, 25 bp, Mus musculus
tacgcatgctcagtattgggacact

SEQ ID NO: 765142 - DNA, 25 bp, Mus musculus
tacgcatgtccaatttctaaattcc

SEQ ID NO: 765143 - DNA, 25 bp, Mus musculus
tacgcatgtccattttctaaattcc

SEQ ID NO: 765144 - DNA, 25 bp, Mus musculus
tacgcattcagtagctcctggatga

SEQ ID NO: 765145 - DNA, 25 bp, Mus musculus
tacgcattcagttgctcctggatga

SEQ ID NO: 765146 - DNA, 25 bp, Mus musculus
tacgcattcctgagattttcttaag

SEQ ID NO: 765147 - DNA, 25 bp, Mus musculus
tacgcattcctgtgattttcttaag

SEQ ID NO: 765148 - DNA, 25 bp, Mus musculus
tacgcattctagaaggctggccagc

SEQ ID NO: 765149 - DNA, 25 bp, Mus musculus
tacgcattctagtaggctggccagc

SEQ ID NO: 765150 - DNA, 25 bp, Mus musculus
tacgcattgatgatttcaccctgtt

SEQ ID NO: 765151 - DNA, 25 bp, Mus musculus
tacgcattgatgttttcaccctgtt

SEQ ID NO: 765152 - DNA, 25 bp, Mus musculus
tacgcattgcatagaggtctctact

SEQ ID NO: 765153 - DNA, 25 bp, Mus musculus
tacgcattgcattgaggtctctact

SEQ ID NO: 765154 - DNA, 25 bp, Mus musculus
tacgcattggtgatacataaacgag

SEQ ID NO: 765155 - DNA, 25 bp, Mus musculus
tacgcattggtgttacataaacgag

SEQ ID NO: 765156 - DNA, 25 bp, Mus musculus
tacgcatttagtcctagtgctcagg

SEQ ID NO: 765157 - DNA, 25 bp, Mus musculus
tacgcatttagtgctagtgctcagg

SEQ ID NO: 765158 - DNA, 25 bp, Mus musculus
tacgcattttgtaccagtgggattt

SEQ ID NO: 765159 - DNA, 25 bp, Mus musculus
tacgcattttgttccagtgggattt

SEQ ID NO: 765160 - DNA, 25 bp, Mus musculus
tacgccacgtatatctgcttcaaat

SEQ ID NO: 765161 - DNA, 25 bp, Mus musculus
tacgccacgtatttctgcttcaaat

SEQ ID NO: 765162 - DNA, 25 bp, Mus musculus
tacgccagacccagaatgtgctcaa

SEQ ID NO: 765163 - DNA, 25 bp, Mus musculus
tacgccagaccctgaatgtgctcaa

SEQ ID NO: 765164 - DNA, 25 bp, Mus musculus
tacgccagcaggcatgtgcaccttg

SEQ ID NO: 765165 - DNA, 25 bp, Mus musculus
tacgccagcagggatgtgcaccttg

SEQ ID NO: 765166 - DNA, 25 bp, Mus musculus
tacgccagccgtactgacactgcta

SEQ ID NO: 765167 - DNA, 25 bp, Mus musculus
tacgccagccgttctgacactgcta

SEQ ID NO: 765168 - DNA, 25 bp, Mus musculus
tacgccatctctaaaggataaattc

SEQ ID NO: 765169 - DNA, 25 bp, Mus musculus
tacgccatctcttaaggataaattc

SEQ ID NO: 765170 - DNA, 25 bp, Mus musculus
tacgccatggctaacgtgtggaggt

SEQ ID NO: 765171 - DNA, 25 bp, Mus musculus
tacgccatggcttacgtgtggaggt

SEQ ID NO: 765172 - DNA, 25 bp, Mus musculus
tacgccatgggaacacacaaggtcg

SEQ ID NO: 765173 - DNA, 25 bp, Mus musculus
tacgccatgggatcacacaaggtcg

SEQ ID NO: 765174 - DNA, 25 bp, Mus musculus
tacgccattgccacttgctggtgga

SEQ ID NO: 765175 - DNA, 25 bp, Mus musculus
tacgccattgcctcttgctggtgga

SEQ ID NO: 765176 - DNA, 25 bp, Mus musculus
tacgcccagattatacacagtgctg

SEQ ID NO: 765177 - DNA, 25 bp, Mus musculus
tacgcccagattttacacagtgctg

SEQ ID NO: 765178 - DNA, 25 bp, Mus musculus
tacgcccattctactgtctgtggaa

SEQ ID NO: 765179 - DNA, 25 bp, Mus musculus
tacgcccattcttctgtctgtggaa

SEQ ID NO: 765180 - DNA, 25 bp, Mus musculus
tacgcccgcctcaagattagtgatg

SEQ ID NO: 765181 - DNA, 25 bp, Mus musculus
tacgcccgcctctagattagtgatg

SEQ ID NO: 765182 - DNA, 25 bp, Mus musculus
tacgccctgcttcattctgtaaagg

SEQ ID NO: 765183 - DNA, 25 bp, Mus musculus
tacgccctgcttgattctgtaaagg

SEQ ID NO: 765184 - DNA, 25 bp, Mus musculus
tacgccctggtgacttcacgttgga

SEQ ID NO: 765185 - DNA, 25 bp, Mus musculus
tacgccctggtgtcttcacgttgga

SEQ ID NO: 765186 - DNA, 25 bp, Mus musculus
tacgccctgtggattctgtgtaggt

SEQ ID NO: 765187 - DNA, 25 bp, Mus musculus
tacgccctgtggtttctgtgtaggt

SEQ ID NO: 765188 - DNA, 25 bp, Mus musculus
tacgccgacttcaggagagcacatg

SEQ ID NO: 765189 - DNA, 25 bp, Mus musculus
tacgccgacttctggagagcacatg

SEQ ID NO: 765190 - DNA, 25 bp, Mus musculus
tacgccgccgcaataagggtactgg

SEQ ID NO: 765191 - DNA, 25 bp, Mus musculus
tacgccgccgcattaagggtactgg

SEQ ID NO: 765192 - DNA, 25 bp, Mus musculus
tacgcctaaagactctcttctcata

SEQ ID NO: 765193 - DNA, 25 bp, Mus musculus
tacgcctaaagagtctcttctcata

SEQ ID NO: 765194 - DNA, 25 bp, Mus musculus
tacgcctaccctatggtaaaagctg

SEQ ID NO: 765195 - DNA, 25 bp, Mus musculus
tacgcctaccctttggtaaaagctg

SEQ ID NO: 765196 - DNA, 25 bp, Mus musculus
tacgcctcacatactggaggtgctg

SEQ ID NO: 765197 - DNA, 25 bp, Mus musculus
tacgcctcacattctggaggtgctg

SEQ ID NO: 765198 - DNA, 25 bp, Mus musculus
tacgcctccaaaactcgcaagtaag

SEQ ID NO: 765199 - DNA, 25 bp, Mus musculus
tacgcctccaaatctcgcaagtaag

SEQ ID NO: 765200 - DNA, 25 bp, Mus musculus
tacgcctccgagctcagggttatct

SEQ ID NO: 765201 - DNA, 25 bp, Mus musculus
tacgcctccgaggtcagggttatct

SEQ ID NO: 765202 - DNA, 25 bp, Mus musculus
tacgcctcgcatcgtggaaccagat

SEQ ID NO: 765203 - DNA, 25 bp, Mus musculus
tacgcctcgcatggtggaaccagat

SEQ ID NO: 765204 - DNA, 25 bp, Mus musculus
tacgcctgggacacatctacttgga

SEQ ID NO: 765205 - DNA, 25 bp, Mus musculus
tacgcctgggactcatctacttgga

SEQ ID NO: 765206 - DNA, 25 bp, Mus musculus
tacgcctgtcgtctggcttcgcact

SEQ ID NO: 765207 - DNA, 25 bp, Mus musculus
tacgcctgtcgtgtggcttcgcact

SEQ ID NO: 765208 - DNA, 25 bp, Mus musculus
tacgccttcattaagggaggcttgg

SEQ ID NO: 765209 - DNA, 25 bp, Mus musculus
tacgccttcatttagggaggcttgg

SEQ ID NO: 765210 - DNA, 25 bp, Mus musculus
tacgcctttgtcatagtggctgaaa

SEQ ID NO: 765211 - DNA, 25 bp, Mus musculus
tacgcctttgtcttagtggctgaaa

SEQ ID NO: 765212 - DNA, 25 bp, Mus musculus
tacgcgaacttaccttgactgcaga

SEQ ID NO: 765213 - DNA, 25 bp, Mus musculus
tacgcgaacttagcttgactgcaga

SEQ ID NO: 765214 - DNA, 25 bp, Mus musculus
tacgcgacagagaggaaccggccca

SEQ ID NO: 765215 - DNA, 25 bp, Mus musculus
tacgcgacagagtggaaccggccca

SEQ ID NO: 765216 - DNA, 25 bp, Mus musculus
tacgcgaccttacaggtttcttcat

SEQ ID NO: 765217 - DNA, 25 bp, Mus musculus
tacgcgaccttagaggtttcttcat

SEQ ID NO: 765218 - DNA, 25 bp, Mus musculus
tacgcgatttctaaagagcattttc

SEQ ID NO: 765219 - DNA, 25 bp, Mus musculus
tacgcgatttcttaagagcattttc

SEQ ID NO: 765220 - DNA, 25 bp, Mus musculus
tacgcgccactgctggacgccatgg

SEQ ID NO: 765221 - DNA, 25 bp, Mus musculus
tacgcgccactggtggacgccatgg

SEQ ID NO: 765222 - DNA, 25 bp, Mus musculus
tacgcggaggtgacagatgcccagc

SEQ ID NO: 765223 - DNA, 25 bp, Mus musculus
tacgcggaggtgtcagatgcccagc

SEQ ID NO: 765224 - DNA, 25 bp, Mus musculus
tacgcggtcaagatctgggctcact

SEQ ID NO: 765225 - DNA, 25 bp, Mus musculus
tacgcggtcaagttctgggctcact

SEQ ID NO: 765226 - DNA, 25 bp, Mus musculus
tacgcggtgcaacccgagctcgagt

SEQ ID NO: 765227 - DNA, 25 bp, Mus musculus
tacgcggtgcaagccgagctcgagt

SEQ ID NO: 765228 - DNA, 25 bp, Mus musculus
tacgcggtgttaacaaccagttggc

SEQ ID NO: 765229 - DNA, 25 bp, Mus musculus
tacgcggtgttatcaaccagttggc

SEQ ID NO: 765230 - DNA, 25 bp, Mus musculus
tacgcgtccttcagagagctttaga

SEQ ID NO: 765231 - DNA, 25 bp, Mus musculus
tacgcgtccttctgagagctttaga

SEQ ID NO: 765232 - DNA, 25 bp, Mus musculus
tacgcgtgttcacggtcgttaactc

SEQ ID NO: 765233 - DNA, 25 bp, Mus musculus
tacgcgtgttcagggtcgttaactc

SEQ ID NO: 765234 - DNA, 25 bp, Mus musculus
tacgcgtgttcccactgcaggaaga

SEQ ID NO: 765235 - DNA, 25 bp, Mus musculus
tacgcgtgttccgactgcaggaaga

SEQ ID NO: 765236 - DNA, 25 bp, Mus musculus
tacgctaaatatcggctgggtgctt

SEQ ID NO: 765237 - DNA, 25 bp, Mus musculus
tacgctaaatatgggctgggtgctt

SEQ ID NO: 765238 - DNA, 25 bp, Mus musculus
tacgctaataaaatggccttccggt

SEQ ID NO: 765239 - DNA, 25 bp, Mus musculus
tacgctaataaattggccttccggt

SEQ ID NO: 765240 - DNA, 25 bp, Mus musculus
tacgctacgctaatgaaggccactg

SEQ ID NO: 765241 - DNA, 25 bp, Mus musculus
tacgctacgctattgaaggccactg

SEQ ID NO: 765242 - DNA, 25 bp, Mus musculus
tacgctactaacaacatgctgaatg

SEQ ID NO: 765243 - DNA, 25 bp, Mus musculus
tacgctactaactacatgctgaatg

SEQ ID NO: 765244 - DNA, 25 bp, Mus musculus
tacgctagaccacaatcccttgatg

SEQ ID NO: 765245 - DNA, 25 bp, Mus musculus
tacgctagaccagaatcccttgatg

SEQ ID NO: 765246 - DNA, 25 bp, Mus musculus
tacgctaggacaatgggttttcagg

SEQ ID NO: 765247 - DNA, 25 bp, Mus musculus
tacgctaggacattgggttttcagg

SEQ ID NO: 765248 - DNA, 25 bp, Mus musculus
tacgctatccctatattgtcaacca

SEQ ID NO: 765249 - DNA, 25 bp, Mus musculus
tacgctatccctttattgtcaacca

SEQ ID NO: 765250 - DNA, 25 bp, Mus musculus
tacgctatggcgcaccggaaacatt

SEQ ID NO: 765251 - DNA, 25 bp, Mus musculus
tacgctatggcggaccggaaacatt

SEQ ID NO: 765252 - DNA, 25 bp, Mus musculus
tacgctcaccaacgagttggcgggc

SEQ ID NO: 765253 - DNA, 25 bp, Mus musculus
tacgctcaccaaggagttggcgggc

SEQ ID NO: 765254 - DNA, 25 bp, Mus musculus
tacgctcactggcagagtttctgca

SEQ ID NO: 765255 - DNA, 25 bp, Mus musculus
tacgctcactgggagagtttctgca

SEQ ID NO: 765256 - DNA, 25 bp, Mus musculus
tacgctcaggctacagagccctggg

SEQ ID NO: 765257 - DNA, 25 bp, Mus musculus
tacgctcaggcttcagagccctggg

SEQ ID NO: 765258 - DNA, 25 bp, Mus musculus
tacgctccagtcacggactatgcag

SEQ ID NO: 765259 - DNA, 25 bp, Mus musculus
tacgctccagtctcggactatgcag

SEQ ID NO: 765260 - DNA, 25 bp, Mus musculus
tacgctcctgttagggttcttttct

SEQ ID NO: 765261 - DNA, 25 bp, Mus musculus
tacgctcctgtttgggttcttttct

SEQ ID NO: 765262 - DNA, 25 bp, Mus musculus
tacgctctcactatgaacgcattgt

SEQ ID NO: 765263 - DNA, 25 bp, Mus musculus
tacgctctcactttgaacgcattgt

SEQ ID NO: 765264 - DNA, 25 bp, Mus musculus
tacgctctctttaagagctccagga

SEQ ID NO: 765265 - DNA, 25 bp, Mus musculus
tacgctctcttttagagctccagga

SEQ ID NO: 765266 - DNA, 25 bp, Mus musculus
tacgctgagatcctggtttggtcac

SEQ ID NO: 765267 - DNA, 25 bp, Mus musculus
tacgctgagatcgtggtttggtcac

SEQ ID NO: 765268 - DNA, 25 bp, Mus musculus
tacgctgagatgattcactgacttc

SEQ ID NO: 765269 - DNA, 25 bp, Mus musculus
tacgctgagatgtttcactgacttc

SEQ ID NO: 765270 - DNA, 25 bp, Mus musculus
tacgctgagtccatcgtggataatg

SEQ ID NO: 765271 - DNA, 25 bp, Mus musculus
tacgctgagtccttcgtggataatg

SEQ ID NO: 765272 - DNA, 25 bp, Mus musculus
tacgctgatctgcaccatgacaatg

SEQ ID NO: 765273 - DNA, 25 bp, Mus musculus
tacgctgatctggaccatgacaatg

SEQ ID NO: 765274 - DNA, 25 bp, Mus musculus
tacgctgcctgtacgggatgctaga

SEQ ID NO: 765275 - DNA, 25 bp, Mus musculus
tacgctgcctgttcgggatgctaga

SEQ ID NO: 765276 - DNA, 25 bp, Mus musculus
tacgctggagtgaccgagggcaaat

SEQ ID NO: 765277 - DNA, 25 bp, Mus musculus
tacgctggagtgtccgagggcaaat

SEQ ID NO: 765278 - DNA, 25 bp, Mus musculus
tacgctggtcttcagtttgtgtctg

SEQ ID NO: 765279 - DNA, 25 bp, Mus musculus
tacgctggtcttgagtttgtgtctg

SEQ ID NO: 765280 - DNA, 25 bp, Mus musculus
tacgctggttccagtgagcctctgg

SEQ ID NO: 765281 - DNA, 25 bp, Mus musculus
tacgctggttcctgtgagcctctgg

SEQ ID NO: 765282 - DNA, 25 bp, Mus musculus
tacgctgtcgtgcaaattgtgccca

SEQ ID NO: 765283 - DNA, 25 bp, Mus musculus
tacgctgtcgtggaaattgtgccca

SEQ ID NO: 765284 - DNA, 25 bp, Mus musculus
tacgctgtctctcattatctcacct

SEQ ID NO: 765285 - DNA, 25 bp, Mus musculus
tacgctgtctctgattatctcacct

SEQ ID NO: 765286 - DNA, 25 bp, Mus musculus
tacgctgtgatgagtgtgtacaccc

SEQ ID NO: 765287 - DNA, 25 bp, Mus musculus
tacgctgtgatgtgtgtgtacaccc

SEQ ID NO: 765288 - DNA, 25 bp, Mus musculus
tacgcttaggagaagggcctgccct

SEQ ID NO: 765289 - DNA, 25 bp, Mus musculus
tacgcttaggagtagggcctgccct

SEQ ID NO: 765290 - DNA, 25 bp, Mus musculus
tacgcttcaaaaagtatcggcctga

SEQ ID NO: 765291 - DNA, 25 bp, Mus musculus
tacgcttcaaaatgtatcggcctga

SEQ ID NO: 765292 - DNA, 25 bp, Mus musculus
tacgcttcatacagtggtcctgttt

SEQ ID NO: 765293 - DNA, 25 bp, Mus musculus
tacgcttcatactgtggtcctgttt

SEQ ID NO: 765294 - DNA, 25 bp, Mus musculus
tacgcttcatagcatggacataatg

SEQ ID NO: 765295 - DNA, 25 bp, Mus musculus
tacgcttcataggatggacataatg

SEQ ID NO: 765296 - DNA, 25 bp, Mus musculus
tacgcttccctcatttaatggcagg

SEQ ID NO: 765297 - DNA, 25 bp, Mus musculus
tacgcttccctcttttaatggcagg

SEQ ID NO: 765298 - DNA, 25 bp, Mus musculus
tacgcttccgttcacgttcggaggg

SEQ ID NO: 765299 - DNA, 25 bp, Mus musculus
tacgcttccgttgacgttcggaggg

SEQ ID NO: 765300 - DNA, 25 bp, Mus musculus
tacgcttcttctcctacgagggctt

SEQ ID NO: 765301 - DNA, 25 bp, Mus musculus
tacgcttcttctgctacgagggctt

SEQ ID NO: 765302 - DNA, 25 bp, Mus musculus
tacgcttcttgccacatgatggaat

SEQ ID NO: 765303 - DNA, 25 bp, Mus musculus
tacgcttcttgcgacatgatggaat

SEQ ID NO: 765304 - DNA, 25 bp, Mus musculus
tacgcttgccgacagcagatgacgc

SEQ ID NO: 765305 - DNA, 25 bp, Mus musculus
tacgcttgccgagagcagatgacgc

SEQ ID NO: 765306 - DNA, 25 bp, Mus musculus
tacgcttgctccacggcatgaagga

SEQ ID NO: 765307 - DNA, 25 bp, Mus musculus
tacgcttgctcctcggcatgaagga

SEQ ID NO: 765308 - DNA, 25 bp, Mus musculus
tacgcttggcgaaggccagagcttt

SEQ ID NO: 765309 - DNA, 25 bp, Mus musculus
tacgcttggcgatggccagagcttt

SEQ ID NO: 765310 - DNA, 25 bp, Mus musculus
tacgcttgtctgagcctgggctgag

SEQ ID NO: 765311 - DNA, 25 bp, Mus musculus
tacgcttgtctgtgcctgggctgag

SEQ ID NO: 765312 - DNA, 25 bp, Mus musculus
tacgctttcaagctgtgtggcccat

SEQ ID NO: 765313 - DNA, 25 bp, Mus musculus
tacgctttcaaggtgtgtggcccat

SEQ ID NO: 765314 - DNA, 25 bp, Mus musculus
tacgctttgcacaccactttcgttt

SEQ ID NO: 765315 - DNA, 25 bp, Mus musculus
tacgctttgcactccactttcgttt

SEQ ID NO: 765316 - DNA, 25 bp, Mus musculus
tacggaaaccctattggcgtgcata

SEQ ID NO: 765317 - DNA, 25 bp, Mus musculus
tacggaaacccttttggcgtgcata

SEQ ID NO: 765318 - DNA, 25 bp, Mus musculus
tacggaaagcctccttcatcctagg

SEQ ID NO: 765319 - DNA, 25 bp, Mus musculus
tacggaaagcctgcttcatcctagg

SEQ ID NO: 765320 - DNA, 25 bp, Mus musculus
tacggaaccaacacccggagagaag

SEQ ID NO: 765321 - DNA, 25 bp, Mus musculus
tacggaaccaactcccggagagaag

SEQ ID NO: 765322 - DNA, 25 bp, Mus musculus
tacggaagcctgatggaccatgttt

SEQ ID NO: 765323 - DNA, 25 bp, Mus musculus
tacggaagcctgttggaccatgttt

SEQ ID NO: 765324 - DNA, 25 bp, Mus musculus
tacggacaaatgaagctggcaccat

SEQ ID NO: 765325 - DNA, 25 bp, Mus musculus
tacggacaaatgtagctggcaccat

SEQ ID NO: 765326 - DNA, 25 bp, Mus musculus
tacggacacaggatcttatggtcat

SEQ ID NO: 765327 - DNA, 25 bp, Mus musculus
tacggacacaggttcttatggtcat

SEQ ID NO: 765328 - DNA, 25 bp, Mus musculus
tacggacacatgagctgaagctgaa

SEQ ID NO: 765329 - DNA, 25 bp, Mus musculus
tacggacacatgtgctgaagctgaa

SEQ ID NO: 765330 - DNA, 25 bp, Mus musculus
tacggacaccatcaacctgaaggct

SEQ ID NO: 765331 - DNA, 25 bp, Mus musculus
tacggacaccatgaacctgaaggct

SEQ ID NO: 765332 - DNA, 25 bp, Mus musculus
tacggacataccagagtaacctcaa

SEQ ID NO: 765333 - DNA, 25 bp, Mus musculus
tacggacatacctgagtaacctcaa

SEQ ID NO: 765334 - DNA, 25 bp, Mus musculus
tacggacctgaccaccttatagaag

SEQ ID NO: 765335 - DNA, 25 bp, Mus musculus
tacggacctgacgaccttatagaag

SEQ ID NO: 765336 - DNA, 25 bp, Mus musculus
tacggacgactgaccaatattgctt

SEQ ID NO: 765337 - DNA, 25 bp, Mus musculus
tacggacgactgtccaatattgctt

SEQ ID NO: 765338 - DNA, 25 bp, Mus musculus
tacggacgagttaatgctgccgacc

SEQ ID NO: 765339 - DNA, 25 bp, Mus musculus
tacggacgagtttatgctgccgacc

SEQ ID NO: 765340 - DNA, 25 bp, Mus musculus
tacggacggcacaggacaagataga

SEQ ID NO: 765341 - DNA, 25 bp, Mus musculus
tacggacggcactggacaagataga

SEQ ID NO: 765342 - DNA, 25 bp, Mus musculus
tacggactcaaacagtgaaagcgac

SEQ ID NO: 765343 - DNA, 25 bp, Mus musculus
tacggactcaaagagtgaaagcgac

SEQ ID NO: 765344 - DNA, 25 bp, Mus musculus
tacggactccagctcaatgagattg

SEQ ID NO: 765345 - DNA, 25 bp, Mus musculus
tacggactccaggtcaatgagattg

SEQ ID NO: 765346 - DNA, 25 bp, Mus musculus
tacggactcggacagaagcgtgctt

SEQ ID NO: 765347 - DNA, 25 bp, Mus musculus
tacggactcggagagaagcgtgctt

SEQ ID NO: 765348 - DNA, 25 bp, Mus musculus
tacggactgtacaccatctatcagg

SEQ ID NO: 765349 - DNA, 25 bp, Mus musculus
tacggactgtactccatctatcagg

SEQ ID NO: 765350 - DNA, 25 bp, Mus musculus
tacggagagaaaatccttgtctttc

SEQ ID NO: 765351 - DNA, 25 bp, Mus musculus
tacggagagaaattccttgtctttc

SEQ ID NO: 765352 - DNA, 25 bp, Mus musculus
tacggagcaagtctacaccaacaac

SEQ ID NO: 765353 - DNA, 25 bp, Mus musculus
tacggagcaagtgtacaccaacaac

SEQ ID NO: 765354 - DNA, 25 bp, Mus musculus
tacggagcagcgaccttgagggacc

SEQ ID NO: 765355 - DNA, 25 bp, Mus musculus
tacggagcagcgtccttgagggacc

SEQ ID NO: 765356 - DNA, 25 bp, Mus musculus
tacggagccatgctgcgccactgca

SEQ ID NO: 765357 - DNA, 25 bp, Mus musculus
tacggagccatggtgcgccactgca

SEQ ID NO: 765358 - DNA, 25 bp, Mus musculus
tacggagctgccaacgggtatcata

SEQ ID NO: 765359 - DNA, 25 bp, Mus musculus
tacggagctgcctacgggtatcata

SEQ ID NO: 765360 - DNA, 25 bp, Mus musculus
tacggaggaccgactccatctatga

SEQ ID NO: 765361 - DNA, 25 bp, Mus musculus
tacggaggaccgtctccatctatga

SEQ ID NO: 765362 - DNA, 25 bp, Mus musculus
tacggaggacctatgccagacacct

SEQ ID NO: 765363 - DNA, 25 bp, Mus musculus
tacggaggacctttgccagacacct

SEQ ID NO: 765364 - DNA, 25 bp, Mus musculus
tacggaggctttacctggtccagga

SEQ ID NO: 765365 - DNA, 25 bp, Mus musculus
tacggaggcttttcctggtccagga

SEQ ID NO: 765366 - DNA, 25 bp, Mus musculus
tacggagtacctcctacatgccatg

SEQ ID NO: 765367 - DNA, 25 bp, Mus musculus
tacggagtacctgctacatgccatg

SEQ ID NO: 765368 - DNA, 25 bp, Mus musculus
tacggagtcactatcctgggcctgc

SEQ ID NO: 765369 - DNA, 25 bp, Mus musculus
tacggagtcactttcctgggcctgc

SEQ ID NO: 765370 - DNA, 25 bp, Mus musculus
tacggagtcatcatcacagccctgt

SEQ ID NO: 765371 - DNA, 25 bp, Mus musculus
tacggagtcatcttcacagccctgt

SEQ ID NO: 765372 - DNA, 25 bp, Mus musculus
tacggagtgccaatcaaagacctgt

SEQ ID NO: 765373 - DNA, 25 bp, Mus musculus
tacggagtgccacaccgcagagaca

SEQ ID NO: 765374 - DNA, 25 bp, Mus musculus
tacggagtgccagaccgcagagaca

SEQ ID NO: 765375 - DNA, 25 bp, Mus musculus
tacggagtgccattcaaagacctgt

SEQ ID NO: 765376 - DNA, 25 bp, Mus musculus
tacggatatcgtatggactaccatg

SEQ ID NO: 765377 - DNA, 25 bp, Mus musculus
tacggatatcgtttggactaccatg

SEQ ID NO: 765378 - DNA, 25 bp, Mus musculus
tacggatcaaaaccctgtcaggccg

SEQ ID NO: 765379 - DNA, 25 bp, Mus musculus
tacggatcaaaagcctgtcaggccg

SEQ ID NO: 765380 - DNA, 25 bp, Mus musculus
tacggatccccaaaagctgcctttt

SEQ ID NO: 765381 - DNA, 25 bp, Mus musculus
tacggatccccataagctgcctttt

SEQ ID NO: 765382 - DNA, 25 bp, Mus musculus
tacggatcccgaaacgatacgggat

SEQ ID NO: 765383 - DNA, 25 bp, Mus musculus
tacggatcccgatacgatacgggat

SEQ ID NO: 765384 - DNA, 25 bp, Mus musculus
tacggatctccaatttctgccagta

SEQ ID NO: 765385 - DNA, 25 bp, Mus musculus
tacggatctccattttctgccagta

SEQ ID NO: 765386 - DNA, 25 bp, Mus musculus
tacggatgacgtactgttttctgtt

SEQ ID NO: 765387 - DNA, 25 bp, Mus musculus
tacggatgacgttctgttttctgtt

SEQ ID NO: 765388 - DNA, 25 bp, Mus musculus
tacggattcgagaccttgaaggagc

SEQ ID NO: 765389 - DNA, 25 bp, Mus musculus
tacggattcgagtccttgaaggagc

SEQ ID NO: 765390 - DNA, 25 bp, Mus musculus
tacggattcggaagccccttggtgc

SEQ ID NO: 765391 - DNA, 25 bp, Mus musculus
tacggattcggatgccccttggtgc

SEQ ID NO: 765392 - DNA, 25 bp, Mus musculus
tacggatttgttatgtgcgggctaa

SEQ ID NO: 765393 - DNA, 25 bp, Mus musculus
tacggatttgttttgtgcgggctaa

SEQ ID NO: 765394 - DNA, 25 bp, Mus musculus
tacggcaaatacaggtaacccaggg

SEQ ID NO: 765395 - DNA, 25 bp, Mus musculus
tacggcaaatactggtaacccaggg

SEQ ID NO: 765396 - DNA, 25 bp, Mus musculus
tacggcaagcatcagctcgtcaaca

SEQ ID NO: 765397 - DNA, 25 bp, Mus musculus
tacggcaagcatgagctcgtcaaca

SEQ ID NO: 765398 - DNA, 25 bp, Mus musculus
tacggcacagtgaacgagacatgag

SEQ ID NO: 765399 - DNA, 25 bp, Mus musculus
tacggcacagtgtacgagacatgag

SEQ ID NO: 765400 - DNA, 25 bp, Mus musculus
tacggcagccatagctacttttgct

SEQ ID NO: 765401 - DNA, 25 bp, Mus musculus
tacggcagccattgctacttttgct

SEQ ID NO: 765402 - DNA, 25 bp, Mus musculus
tacggcaggagtatgcagagcagct

SEQ ID NO: 765403 - DNA, 25 bp, Mus musculus
tacggcaggagtttgcagagcagct

SEQ ID NO: 765404 - DNA, 25 bp, Mus musculus
tacggcagggtgaacacagctgacc

SEQ ID NO: 765405 - DNA, 25 bp, Mus musculus
tacggcagggtgtacacagctgacc

SEQ ID NO: 765406 - DNA, 25 bp, Mus musculus
tacggccaactcaaccaggcgtgga

SEQ ID NO: 765407 - DNA, 25 bp, Mus musculus
tacggccaactctaccaggcgtgga

SEQ ID NO: 765408 - DNA, 25 bp, Mus musculus
tacggccaatccaagctgacagctt

SEQ ID NO: 765409 - DNA, 25 bp, Mus musculus
tacggccaatcctagctgacagctt

SEQ ID NO: 765410 - DNA, 25 bp, Mus musculus
tacggccacataattatgtcaggct

SEQ ID NO: 765411 - DNA, 25 bp, Mus musculus
tacggccacatatttatgtcaggct

SEQ ID NO: 765412 - DNA, 25 bp, Mus musculus
tacggcccaatcctgttcaagatag

SEQ ID NO: 765413 - DNA, 25 bp, Mus musculus
tacggcccaatcgtgttcaagatag

SEQ ID NO: 765414 - DNA, 25 bp, Mus musculus
tacggcccagatacaaggtctcaaa

SEQ ID NO: 765415 - DNA, 25 bp, Mus musculus
tacggcccagattcaaggtctcaaa

SEQ ID NO: 765416 - DNA, 25 bp, Mus musculus
tacggcccatatctcggaacttgcg

SEQ ID NO: 765417 - DNA, 25 bp, Mus musculus
tacggcccatatgtcggaacttgcg

SEQ ID NO: 765418 - DNA, 25 bp, Mus musculus
tacggccctacaatgcaagtgctta

SEQ ID NO: 765419 - DNA, 25 bp, Mus musculus
tacggccctacattgcaagtgctta

SEQ ID NO: 765420 - DNA, 25 bp, Mus musculus
tacggccctctgctactgaagacat

SEQ ID NO: 765421 - DNA, 25 bp, Mus musculus
tacggccctctggtactgaagacat

SEQ ID NO: 765422 - DNA, 25 bp, Mus musculus
tacggccgcttcaggtactaacaaa

SEQ ID NO: 765423 - DNA, 25 bp, Mus musculus
tacggccgcttctggtactaacaaa

SEQ ID NO: 765424 - DNA, 25 bp, Mus musculus
tacggcctacgaccctcggcgattg

SEQ ID NO: 765425 - DNA, 25 bp, Mus musculus
tacggcctacgagcctcggcgattg

SEQ ID NO: 765426 - DNA, 25 bp, Mus musculus
tacggcctccttctaatttcaggtt

SEQ ID NO: 765427 - DNA, 25 bp, Mus musculus
tacggcctccttgtaatttcaggtt

SEQ ID NO: 765428 - DNA, 25 bp, Mus musculus
tacggcctcgtacaagcacagtgac

SEQ ID NO: 765429 - DNA, 25 bp, Mus musculus
tacggcctcgtagaagcacagtgac

SEQ ID NO: 765430 - DNA, 25 bp, Mus musculus
tacggcctgccaatttttaagactg

SEQ ID NO: 765431 - DNA, 25 bp, Mus musculus
tacggcctgccattttttaagactg

SEQ ID NO: 765432 - DNA, 25 bp, Mus musculus
tacggcctggaacattagataagat

SEQ ID NO: 765433 - DNA, 25 bp, Mus musculus
tacggcctggaagattagataagat

SEQ ID NO: 765434 - DNA, 25 bp, Mus musculus
tacggccttggcatttacatcactg

SEQ ID NO: 765435 - DNA, 25 bp, Mus musculus
tacggccttggcttttacatcactg

SEQ ID NO: 765436 - DNA, 25 bp, Mus musculus
tacggcgaaggacacatagaagaac

SEQ ID NO: 765437 - DNA, 25 bp, Mus musculus
tacggcgaaggagacatagaagaac

SEQ ID NO: 765438 - DNA, 25 bp, Mus musculus
tacggcgacagcctttccgaatggc

SEQ ID NO: 765439 - DNA, 25 bp, Mus musculus
tacggcgacagcgtttccgaatggc

SEQ ID NO: 765440 - DNA, 25 bp, Mus musculus
tacggcgacgctatagtgactttga

SEQ ID NO: 765441 - DNA, 25 bp, Mus musculus
tacggcgacgctttagtgactttga

SEQ ID NO: 765442 - DNA, 25 bp, Mus musculus
tacggcgagagaaatacttggtcca

SEQ ID NO: 765443 - DNA, 25 bp, Mus musculus
tacggcgagagatatacttggtcca

SEQ ID NO: 765444 - DNA, 25 bp, Mus musculus
tacggcgcagcgaggccatcttagg

SEQ ID NO: 765445 - DNA, 25 bp, Mus musculus
tacggcgcagcgtggccatcttagg

SEQ ID NO: 765446 - DNA, 25 bp, Mus musculus
tacggcgcctctctgagcgagagac

SEQ ID NO: 765447 - DNA, 25 bp, Mus musculus
tacggcgcctctgtgagcgagagac

SEQ ID NO: 765448 - DNA, 25 bp, Mus musculus
tacggcggattaagagcagcatcaa

SEQ ID NO: 765449 - DNA, 25 bp, Mus musculus
tacggcggattatgagcagcatcaa

SEQ ID NO: 765450 - DNA, 25 bp, Mus musculus
tacggcggtgtaaacttatcccatt

SEQ ID NO: 765451 - DNA, 25 bp, Mus musculus
tacggcggtgtatacttatcccatt

SEQ ID NO: 765452 - DNA, 25 bp, Mus musculus
tacggctatggtagcctgggttatg

SEQ ID NO: 765453 - DNA, 25 bp, Mus musculus
tacggctatggttgcctgggttatg

SEQ ID NO: 765454 - DNA, 25 bp, Mus musculus
tacggctcagcacagtcgacatgac

SEQ ID NO: 765455 - DNA, 25 bp, Mus musculus
tacggctcagcagagtcgacatgac

SEQ ID NO: 765456 - DNA, 25 bp, Mus musculus
tacggctcattgcttctgatttgcc

SEQ ID NO: 765457 - DNA, 25 bp, Mus musculus
tacggctcattggttctgatttgcc

SEQ ID NO: 765458 - DNA, 25 bp, Mus musculus
tacggctcctcacagccatggttta

SEQ ID NO: 765459 - DNA, 25 bp, Mus musculus
tacggctcctcagagccatggttta

SEQ ID NO: 765460 - DNA, 25 bp, Mus musculus
tacggctctacaactgtcagctggg

SEQ ID NO: 765461 - DNA, 25 bp, Mus musculus
tacggctctacatctgtcagctggg

SEQ ID NO: 765462 - DNA, 25 bp, Mus musculus
tacggctctgaaatgatgtggcaaa

SEQ ID NO: 765463 - DNA, 25 bp, Mus musculus
tacggctctgaattgatgtggcaaa

SEQ ID NO: 765464 - DNA, 25 bp, Mus musculus
tacggctgaaacaccggaagctccg

SEQ ID NO: 765465 - DNA, 25 bp, Mus musculus
tacggctgaaactccggaagctccg

SEQ ID NO: 765466 - DNA, 25 bp, Mus musculus
tacggctgacgcattacaacatctg

SEQ ID NO: 765467 - DNA, 25 bp, Mus musculus
tacggctgacgctttacaacatctg

SEQ ID NO: 765468 - DNA, 25 bp, Mus musculus
tacggctgagttctgggtcccacca

SEQ ID NO: 765469 - DNA, 25 bp, Mus musculus
tacggctgagttgtgggtcccacca

SEQ ID NO: 765470 - DNA, 25 bp, Mus musculus
tacggctggcctatcgaccggtggc

SEQ ID NO: 765471 - DNA, 25 bp, Mus musculus
tacggctggcctttcgaccggtggc

SEQ ID NO: 765472 - DNA, 25 bp, Mus musculus
tacggctgtagaattttgttttgag

SEQ ID NO: 765473 - DNA, 25 bp, Mus musculus
tacggctgtagatttttgttttgag

SEQ ID NO: 765474 - DNA, 25 bp, Mus musculus
tacggcttccacaacatgattgttg

SEQ ID NO: 765475 - DNA, 25 bp, Mus musculus
tacggcttccactacatgattgttg

SEQ ID NO: 765476 - DNA, 25 bp, Mus musculus
tacggcttcccaacaagtacaatgt

SEQ ID NO: 765477 - DNA, 25 bp, Mus musculus
tacggcttcccatcaagtacaatgt

SEQ ID NO: 765478 - DNA, 25 bp, Mus musculus
tacggcttccctctgcagtattatc

SEQ ID NO: 765479 - DNA, 25 bp, Mus musculus
tacggcttccctgtgcagtattatc

SEQ ID NO: 765480 - DNA, 25 bp, Mus musculus
tacggcttccgcattgtgaggcgag

SEQ ID NO: 765481 - DNA, 25 bp, Mus musculus
tacggcttccgctttgtgaggcgag

SEQ ID NO: 765482 - DNA, 25 bp, Mus musculus
tacggctttgggaatctgcccagaa

SEQ ID NO: 765483 - DNA, 25 bp, Mus musculus
tacggctttgggtatctgcccagaa

SEQ ID NO: 765484 - DNA, 25 bp, Mus musculus
tacgggaacaagaaggtgaccaata

SEQ ID NO: 765485 - DNA, 25 bp, Mus musculus
tacgggaacaagtaggtgaccaata

SEQ ID NO: 765486 - DNA, 25 bp, Mus musculus
tacgggaagagaaaggatgaagccc

SEQ ID NO: 765487 - DNA, 25 bp, Mus musculus
tacgggaagagataggatgaagccc

SEQ ID NO: 765488 - DNA, 25 bp, Mus musculus
tacgggaagccgcagtcaccattat

SEQ ID NO: 765489 - DNA, 25 bp, Mus musculus
tacgggaagccggagtcaccattat

SEQ ID NO: 765490 - DNA, 25 bp, Mus musculus
tacgggaccataactattggaaaga

SEQ ID NO: 765491 - DNA, 25 bp, Mus musculus
tacgggaccatatctattggaaaga

SEQ ID NO: 765492 - DNA, 25 bp, Mus musculus
tacgggaccctgagcaacagctgga

SEQ ID NO: 765493 - DNA, 25 bp, Mus musculus
tacgggaccctgtgcaacagctgga

SEQ ID NO: 765494 - DNA, 25 bp, Mus musculus
tacgggaccgtacctgattctctcc

SEQ ID NO: 765495 - DNA, 25 bp, Mus musculus
tacgggaccgtagctgattctctcc

SEQ ID NO: 765496 - DNA, 25 bp, Mus musculus
tacgggacctgcacgcaatggaggc

SEQ ID NO: 765497 - DNA, 25 bp, Mus musculus
tacgggacctgctcgcaatggaggc

SEQ ID NO: 765498 - DNA, 25 bp, Mus musculus
tacgggatacggctcatataacaat

SEQ ID NO: 765499 - DNA, 25 bp, Mus musculus
tacgggatacgggtcatataacaat

SEQ ID NO: 765500 - DNA, 25 bp, Mus musculus
tacgggatcctcatcggaaccctgg

SEQ ID NO: 765501 - DNA, 25 bp, Mus musculus
tacgggatcctcttcggaaccctgg

SEQ ID NO: 765502 - DNA, 25 bp, Mus musculus
tacgggcaatcccttatgtaaaggg

SEQ ID NO: 765503 - DNA, 25 bp, Mus musculus
tacgggcaatccgttatgtaaaggg

SEQ ID NO: 765504 - DNA, 25 bp, Mus musculus
tacgggcacctgaacacgtatacag

SEQ ID NO: 765505 - DNA, 25 bp, Mus musculus
tacgggcacctgtacacgtatacag

SEQ ID NO: 765506 - DNA, 25 bp, Mus musculus
tacgggcatcgccatcggctgccga

SEQ ID NO: 765507 - DNA, 25 bp, Mus musculus
tacgggcatcgcgatcggctgccga

SEQ ID NO: 765508 - DNA, 25 bp, Mus musculus
tacgggccgtccaggccaacgagac

SEQ ID NO: 765509 - DNA, 25 bp, Mus musculus
tacgggccgtcctggccaacgagac

SEQ ID NO: 765510 - DNA, 25 bp, Mus musculus
tacgggcctgagcaaggattggctt

SEQ ID NO: 765511 - DNA, 25 bp, Mus musculus
tacgggcctgaggaaggattggctt

SEQ ID NO: 765512 - DNA, 25 bp, Mus musculus
tacgggctaattcccctcactgtat

SEQ ID NO: 765513 - DNA, 25 bp, Mus musculus
tacgggctaattgccctcactgtat

SEQ ID NO: 765514 - DNA, 25 bp, Mus musculus
tacgggctcaatctgaggaactgtg

SEQ ID NO: 765515 - DNA, 25 bp, Mus musculus
tacgggctcaatgtgaggaactgtg

SEQ ID NO: 765516 - DNA, 25 bp, Mus musculus
tacgggctcccacaaagaacgcttt

SEQ ID NO: 765517 - DNA, 25 bp, Mus musculus
tacgggctcccagaaagaacgcttt

SEQ ID NO: 765518 - DNA, 25 bp, Mus musculus
tacgggctcggcagctgtgtcaaga

SEQ ID NO: 765519 - DNA, 25 bp, Mus musculus
tacgggctcggctgctgtgtcaaga

SEQ ID NO: 765520 - DNA, 25 bp, Mus musculus
tacgggctctccacacatagatgag

SEQ ID NO: 765521 - DNA, 25 bp, Mus musculus
tacgggctctcctcacatagatgag

SEQ ID NO: 765522 - DNA, 25 bp, Mus musculus
tacgggctgcttagcggacacttct

SEQ ID NO: 765523 - DNA, 25 bp, Mus musculus
tacgggctgctttgcggacacttct

SEQ ID NO: 765524 - DNA, 25 bp, Mus musculus
tacgggctggtccaggagggcctga

SEQ ID NO: 765525 - DNA, 25 bp, Mus musculus
tacgggctggtcgaggagggcctga

SEQ ID NO: 765526 - DNA, 25 bp, Mus musculus
tacgggtactttcttcacccgagct

SEQ ID NO: 765527 - DNA, 25 bp, Mus musculus
tacgggtactttgttcacccgagct

SEQ ID NO: 765528 - DNA, 25 bp, Mus musculus
tacgggtatcgtaattccattcttt

SEQ ID NO: 765529 - DNA, 25 bp, Mus musculus
tacgggtatcgttattccattcttt

SEQ ID NO: 765530 - DNA, 25 bp, Mus musculus
tacgggtatctgctgacacctgcaa

SEQ ID NO: 765531 - DNA, 25 bp, Mus musculus
tacgggtatctggtgacacctgcaa

SEQ ID NO: 765532 - DNA, 25 bp, Mus musculus
tacgggtcagttacagcaggtcagg

SEQ ID NO: 765533 - DNA, 25 bp, Mus musculus
tacgggtcagtttcagcaggtcagg

SEQ ID NO: 765534 - DNA, 25 bp, Mus musculus
tacgggtcatctcctgagtcttgac

SEQ ID NO: 765535 - DNA, 25 bp, Mus musculus
tacgggtcatctgctgagtcttgac

SEQ ID NO: 765536 - DNA, 25 bp, Mus musculus
tacgggtctaccaagtctacactgt

SEQ ID NO: 765537 - DNA, 25 bp, Mus musculus
tacgggtctacctagtctacactgt

SEQ ID NO: 765538 - DNA, 25 bp, Mus musculus
tacgggtgaacacagcttctcctga

SEQ ID NO: 765539 - DNA, 25 bp, Mus musculus
tacgggtgaacagagcttctcctga

SEQ ID NO: 765540 - DNA, 25 bp, Mus musculus
tacgggtgggcaccactgttcctgt

SEQ ID NO: 765541 - DNA, 25 bp, Mus musculus
tacgggtgggcagcactgttcctgt

SEQ ID NO: 765542 - DNA, 25 bp, Mus musculus
tacgggttccagaactccaatccac

SEQ ID NO: 765543 - DNA, 25 bp, Mus musculus
tacgggttccagtactccaatccac

SEQ ID NO: 765544 - DNA, 25 bp, Mus musculus
tacggtaaatacatgctttgagggt

SEQ ID NO: 765545 - DNA, 25 bp, Mus musculus
tacggtaaatacttgctttgagggt

SEQ ID NO: 765546 - DNA, 25 bp, Mus musculus
tacggtaagaatagcctcacttggt

SEQ ID NO: 765547 - DNA, 25 bp, Mus musculus
tacggtaagaattgcctcacttggt

SEQ ID NO: 765548 - DNA, 25 bp, Mus musculus
tacggtagccacagttttggtgcaa

SEQ ID NO: 765549 - DNA, 25 bp, Mus musculus
tacggtagccactgttttggtgcaa

SEQ ID NO: 765550 - DNA, 25 bp, Mus musculus
tacggtagccttatcctatccactt

SEQ ID NO: 765551 - DNA, 25 bp, Mus musculus
tacggtagccttttcctatccactt

SEQ ID NO: 765552 - DNA, 25 bp, Mus musculus
tacggtagtagcacgtttgcttact

SEQ ID NO: 765553 - DNA, 25 bp, Mus musculus
tacggtagtagctcgtttgcttact

SEQ ID NO: 765554 - DNA, 25 bp, Mus musculus
tacggtatctatcgctacccagtgt

SEQ ID NO: 765555 - DNA, 25 bp, Mus musculus
tacggtatctatggctacccagtgt

SEQ ID NO: 765556 - DNA, 25 bp, Mus musculus
tacggtcaggagactttctcattgt

SEQ ID NO: 765557 - DNA, 25 bp, Mus musculus
tacggtcaggagtctttctcattgt

SEQ ID NO: 765558 - DNA, 25 bp, Mus musculus
tacggtcatccactgccataacttt

SEQ ID NO: 765559 - DNA, 25 bp, Mus musculus
tacggtcatccagtgccataacttt

SEQ ID NO: 765560 - DNA, 25 bp, Mus musculus
tacggtccaaagatctctgaggcac

SEQ ID NO: 765561 - DNA, 25 bp, Mus musculus
tacggtccaaagttctctgaggcac

SEQ ID NO: 765562 - DNA, 25 bp, Mus musculus
tacggtcccttcatgacacaaggat

SEQ ID NO: 765563 - DNA, 25 bp, Mus musculus
tacggtcccttcttgacacaaggat

SEQ ID NO: 765564 - DNA, 25 bp, Mus musculus
tacggtcctaggaaccatgcctgcc

SEQ ID NO: 765565 - DNA, 25 bp, Mus musculus
tacggtcctaggtaccatgcctgcc

SEQ ID NO: 765566 - DNA, 25 bp, Mus musculus
tacggtccttgaatgcatcttctca

SEQ ID NO: 765567 - DNA, 25 bp, Mus musculus
tacggtccttgattgcatcttctca

SEQ ID NO: 765568 - DNA, 25 bp, Mus musculus
tacggtcggataaatcctggcacca

SEQ ID NO: 765569 - DNA, 25 bp, Mus musculus
tacggtcggatatatcctggcacca

SEQ ID NO: 765570 - DNA, 25 bp, Mus musculus
tacggtctgcagctaaacctggtat

SEQ ID NO: 765571 - DNA, 25 bp, Mus musculus
tacggtctgcaggtaaacctggtat

SEQ ID NO: 765572 - DNA, 25 bp, Mus musculus
tacggtctggcgacatcgtcgagtt

SEQ ID NO: 765573 - DNA, 25 bp, Mus musculus
tacggtctggcgtcatcgtcgagtt

SEQ ID NO: 765574 - DNA, 25 bp, Mus musculus
tacggtcttagtcttgtactcgggt

SEQ ID NO: 765575 - DNA, 25 bp, Mus musculus
tacggtcttagtgttgtactcgggt

SEQ ID NO: 765576 - DNA, 25 bp, Mus musculus
tacggtcttgccagtgtgcactggc

SEQ ID NO: 765577 - DNA, 25 bp, Mus musculus
tacggtcttgcctgtgtgcactggc

SEQ ID NO: 765578 - DNA, 25 bp, Mus musculus
tacggtgaatgcacgtgaacgtgca

SEQ ID NO: 765579 - DNA, 25 bp, Mus musculus
tacggtgaatgctcgtgaacgtgca

SEQ ID NO: 765580 - DNA, 25 bp, Mus musculus
tacggtgacagcacattaaatgttg

SEQ ID NO: 765581 - DNA, 25 bp, Mus musculus
tacggtgacagctcattaaatgttg

SEQ ID NO: 765582 - DNA, 25 bp, Mus musculus
tacggtgaccgaatctgggacatca

SEQ ID NO: 765583 - DNA, 25 bp, Mus musculus
tacggtgaccgattctgggacatca

SEQ ID NO: 765584 - DNA, 25 bp, Mus musculus
tacggtgatgttctttggcttctct

SEQ ID NO: 765585 - DNA, 25 bp, Mus musculus
tacggtgatgttgtttggcttctct

SEQ ID NO: 765586 - DNA, 25 bp, Mus musculus
tacggtgcagtcctaagtaccagtg

SEQ ID NO: 765587 - DNA, 25 bp, Mus musculus
tacggtgcagtcgtaagtaccagtg

SEQ ID NO: 765588 - DNA, 25 bp, Mus musculus
tacggtgctaagaaaagatgcttga

SEQ ID NO: 765589 - DNA, 25 bp, Mus musculus
tacggtgctaagtaaagatgcttga

SEQ ID NO: 765590 - DNA, 25 bp, Mus musculus
tacggtggtacacactgctaatccc

SEQ ID NO: 765591 - DNA, 25 bp, Mus musculus
tacggtggtacagactgctaatccc

SEQ ID NO: 765592 - DNA, 25 bp, Mus musculus
tacggtgtactaaataacgggattt

SEQ ID NO: 765593 - DNA, 25 bp, Mus musculus
tacggtgtactatataacgggattt

SEQ ID NO: 765594 - DNA, 25 bp, Mus musculus
tacggtgtaggcaactctatccatc

SEQ ID NO: 765595 - DNA, 25 bp, Mus musculus
tacggtgtaggctactctatccatc

SEQ ID NO: 765596 - DNA, 25 bp, Mus musculus
tacggtgtctgcaccacagagcata

SEQ ID NO: 765597 - DNA, 25 bp, Mus musculus
tacggtgtctgctccacagagcata

SEQ ID NO: 765598 - DNA, 25 bp, Mus musculus
tacggtgtggttcttctacagtaca

SEQ ID NO: 765599 - DNA, 25 bp, Mus musculus
tacggtgtggttgttctacagtaca

SEQ ID NO: 765600 - DNA, 25 bp, Mus musculus
tacggtgttccaaacgaccacgtga

SEQ ID NO: 765601 - DNA, 25 bp, Mus musculus
tacggtgttccatacgaccacgtga

SEQ ID NO: 765602 - DNA, 25 bp, Mus musculus
tacggttaacataaggcctgccaat

SEQ ID NO: 765603 - DNA, 25 bp, Mus musculus
tacggttaacattaggcctgccaat

SEQ ID NO: 765604 - DNA, 25 bp, Mus musculus
tacggttactagatgttgccattac

SEQ ID NO: 765605 - DNA, 25 bp, Mus musculus
tacggttactagttgttgccattac

SEQ ID NO: 765606 - DNA, 25 bp, Mus musculus
tacggttgacacagatgcttatctt

SEQ ID NO: 765607 - DNA, 25 bp, Mus musculus
tacggttgacactgatgcttatctt

SEQ ID NO: 765608 - DNA, 25 bp, Mus musculus
tacggttgcaaactgctgaccacgc

SEQ ID NO: 765609 - DNA, 25 bp, Mus musculus
tacggttgcaaagtgctgaccacgc

SEQ ID NO: 765610 - DNA, 25 bp, Mus musculus
tacggttgccttattcctgatttgc

SEQ ID NO: 765611 - DNA, 25 bp, Mus musculus
tacggttgcctttttcctgatttgc

SEQ ID NO: 765612 - DNA, 25 bp, Mus musculus
tacggttgctgtattctttctccaa

SEQ ID NO: 765613 - DNA, 25 bp, Mus musculus
tacggttgctgttttctttctccaa

SEQ ID NO: 765614 - DNA, 25 bp, Mus musculus
tacggttgctttaccatatgggctc

SEQ ID NO: 765615 - DNA, 25 bp, Mus musculus
tacggttgcttttccatatgggctc

SEQ ID NO: 765616 - DNA, 25 bp, Mus musculus
tacggttgtcgccatgtcacctggc

SEQ ID NO: 765617 - DNA, 25 bp, Mus musculus
tacggttgtcgcgatgtcacctggc

SEQ ID NO: 765618 - DNA, 25 bp, Mus musculus
tacggtttgcttcgctctcaacagt

SEQ ID NO: 765619 - DNA, 25 bp, Mus musculus
tacggtttgcttggctctcaacagt

SEQ ID NO: 765620 - DNA, 25 bp, Mus musculus
tacggttttgtaagctcagcatatt

SEQ ID NO: 765621 - DNA, 25 bp, Mus musculus
tacggttttgtatgctcagcatatt

SEQ ID NO: 765622 - DNA, 25 bp, Mus musculus
tacgtaaacgtcaaggtcagcctga

SEQ ID NO: 765623 - DNA, 25 bp, Mus musculus
tacgtaaacgtctaggtcagcctga

SEQ ID NO: 765624 - DNA, 25 bp, Mus musculus
tacgtaacagaaaactgagaccctg

SEQ ID NO: 765625 - DNA, 25 bp, Mus musculus
tacgtaacagaatactgagaccctg

SEQ ID NO: 765626 - DNA, 25 bp, Mus musculus
tacgtaatgagacctctcagaaaca

SEQ ID NO: 765627 - DNA, 25 bp, Mus musculus
tacgtaatgagagctctcagaaaca

SEQ ID NO: 765628 - DNA, 25 bp, Mus musculus
tacgtaatgtttagtgcccttgcct

SEQ ID NO: 765629 - DNA, 25 bp, Mus musculus
tacgtaatgttttgtgcccttgcct

SEQ ID NO: 765630 - DNA, 25 bp, Mus musculus
tacgtacaaaatctcccctgtctgt

SEQ ID NO: 765631 - DNA, 25 bp, Mus musculus
tacgtacaaaatgtcccctgtctgt

SEQ ID NO: 765632 - DNA, 25 bp, Mus musculus
tacgtacacggcaggcccggtctca

SEQ ID NO: 765633 - DNA, 25 bp, Mus musculus
tacgtacacggctggcccggtctca

SEQ ID NO: 765634 - DNA, 25 bp, Mus musculus
tacgtaccagcaccaaaactctggg

SEQ ID NO: 765635 - DNA, 25 bp, Mus musculus
tacgtaccagcagcaaaactctggg

SEQ ID NO: 765636 - DNA, 25 bp, Mus musculus
tacgtaccagtccactttgatgcta

SEQ ID NO: 765637 - DNA, 25 bp, Mus musculus
tacgtaccagtcgactttgatgcta

SEQ ID NO: 765638 - DNA, 25 bp, Mus musculus
tacgtacccataaaatagctcacaa

SEQ ID NO: 765639 - DNA, 25 bp, Mus musculus
tacgtacccatataatagctcacaa

SEQ ID NO: 765640 - DNA, 25 bp, Mus musculus
tacgtacctacgatttcatgcgtca

SEQ ID NO: 765641 - DNA, 25 bp, Mus musculus
tacgtacctacgttttcatgcgtca

SEQ ID NO: 765642 - DNA, 25 bp, Mus musculus
tacgtacctcctcttgtcctgtgac

SEQ ID NO: 765643 - DNA, 25 bp, Mus musculus
tacgtacctcctgttgtcctgtgac

SEQ ID NO: 765644 - DNA, 25 bp, Mus musculus
tacgtaccttgactgaacattgaaa

SEQ ID NO: 765645 - DNA, 25 bp, Mus musculus
tacgtaccttgagtgaacattgaaa

SEQ ID NO: 765646 - DNA, 25 bp, Mus musculus
tacgtacggaatcatttaacaaagt

SEQ ID NO: 765647 - DNA, 25 bp, Mus musculus
tacgtacggaatgatttaacaaagt

SEQ ID NO: 765648 - DNA, 25 bp, Mus musculus
tacgtactagagcttcggcactttc

SEQ ID NO: 765649 - DNA, 25 bp, Mus musculus
tacgtactagaggttcggcactttc

SEQ ID NO: 765650 - DNA, 25 bp, Mus musculus
tacgtactcgtgatctcccaggagt

SEQ ID NO: 765651 - DNA, 25 bp, Mus musculus
tacgtactcgtgttctcccaggagt

SEQ ID NO: 765652 - DNA, 25 bp, Mus musculus
tacgtagcatgtctgtgggcccaag

SEQ ID NO: 765653 - DNA, 25 bp, Mus musculus
tacgtagcatgtgtgtgggcccaag

SEQ ID NO: 765654 - DNA, 25 bp, Mus musculus
tacgtagtcactagttttcttattg

SEQ ID NO: 765655 - DNA, 25 bp, Mus musculus
tacgtagtcacttgttttcttattg

SEQ ID NO: 765656 - DNA, 25 bp, Mus musculus
tacgtagtggctagtcggtagttcc

SEQ ID NO: 765657 - DNA, 25 bp, Mus musculus
tacgtagtggcttgtcggtagttcc

SEQ ID NO: 765658 - DNA, 25 bp, Mus musculus
tacgtataatctccgcgcccagggc

SEQ ID NO: 765659 - DNA, 25 bp, Mus musculus
tacgtataatctgcgcgcccagggc

SEQ ID NO: 765660 - DNA, 25 bp, Mus musculus
tacgtataattcacagctactcttc

SEQ ID NO: 765661 - DNA, 25 bp, Mus musculus
tacgtataattctcagctactcttc

SEQ ID NO: 765662 - DNA, 25 bp, Mus musculus
tacgtatgggacctacacttaatct

SEQ ID NO: 765663 - DNA, 25 bp, Mus musculus
tacgtatgggacgtacacttaatct

SEQ ID NO: 765664 - DNA, 25 bp, Mus musculus
tacgtatgttacattgtggtttaaa

SEQ ID NO: 765665 - DNA, 25 bp, Mus musculus
tacgtatgttactttgtggtttaaa

SEQ ID NO: 765666 - DNA, 25 bp, Mus musculus
tacgtattttacaggcgggattact

SEQ ID NO: 765667 - DNA, 25 bp, Mus musculus
tacgtattttactggcgggattact

SEQ ID NO: 765668 - DNA, 25 bp, Mus musculus
tacgtcaaagagcagtgacttatgc

SEQ ID NO: 765669 - DNA, 25 bp, Mus musculus
tacgtcaaagaggagtgacttatgc

SEQ ID NO: 765670 - DNA, 25 bp, Mus musculus
tacgtcaagtcgcttccgcatgatg

SEQ ID NO: 765671 - DNA, 25 bp, Mus musculus
tacgtcaagtcggttccgcatgatg

SEQ ID NO: 765672 - DNA, 25 bp, Mus musculus
tacgtcaatcagcaagtgtgtctac

SEQ ID NO: 765673 - DNA, 25 bp, Mus musculus
tacgtcaatcaggaagtgtgtctac

SEQ ID NO: 765674 - DNA, 25 bp, Mus musculus
tacgtcactcccaacactttcagaa

SEQ ID NO: 765675 - DNA, 25 bp, Mus musculus
tacgtcactccctacactttcagaa

SEQ ID NO: 765676 - DNA, 25 bp, Mus musculus
tacgtcatcatgaagacacaatgga

SEQ ID NO: 765677 - DNA, 25 bp, Mus musculus
tacgtcatcatgtagacacaatgga

SEQ ID NO: 765678 - DNA, 25 bp, Mus musculus
tacgtcatgtacaaatgattgtctt

SEQ ID NO: 765679 - DNA, 25 bp, Mus musculus
tacgtcatgtactaatgattgtctt

SEQ ID NO: 765680 - DNA, 25 bp, Mus musculus
tacgtcattcgacgtatggcacccc

SEQ ID NO: 765681 - DNA, 25 bp, Mus musculus
tacgtcattcgaggtatggcacccc

SEQ ID NO: 765682 - DNA, 25 bp, Mus musculus
tacgtccaagccaaccctaggatat

SEQ ID NO: 765683 - DNA, 25 bp, Mus musculus
tacgtccaagcctaccctaggatat

SEQ ID NO: 765684 - DNA, 25 bp, Mus musculus
tacgtccacctaaaagccaggcagt

SEQ ID NO: 765685 - DNA, 25 bp, Mus musculus
tacgtccacctataagccaggcagt

SEQ ID NO: 765686 - DNA, 25 bp, Mus musculus
tacgtccacgtgaacgctacttatg

SEQ ID NO: 765687 - DNA, 25 bp, Mus musculus
tacgtccacgtgtacgctacttatg

SEQ ID NO: 765688 - DNA, 25 bp, Mus musculus
tacgtccatcacaggagatgttccc

SEQ ID NO: 765689 - DNA, 25 bp, Mus musculus
tacgtccatcactggagatgttccc

SEQ ID NO: 765690 - DNA, 25 bp, Mus musculus
tacgtccccgggaagctacacgatg

SEQ ID NO: 765691 - DNA, 25 bp, Mus musculus
tacgtccccgggtagctacacgatg

SEQ ID NO: 765692 - DNA, 25 bp, Mus musculus
tacgtcccgggccagtagatctgaa

SEQ ID NO: 765693 - DNA, 25 bp, Mus musculus
tacgtcccgggcgagtagatctgaa

SEQ ID NO: 765694 - DNA, 25 bp, Mus musculus
tacgtcccttttccggcccaggctt

SEQ ID NO: 765695 - DNA, 25 bp, Mus musculus
tacgtcccttttgcggcccaggctt

SEQ ID NO: 765696 - DNA, 25 bp, Mus musculus
tacgtccgctgcaggaggtgtgaaa

SEQ ID NO: 765697 - DNA, 25 bp, Mus musculus
tacgtccgctgcatcaggcaagatg

SEQ ID NO: 765698 - DNA, 25 bp, Mus musculus
tacgtccgctgctggaggtgtgaaa

SEQ ID NO: 765699 - DNA, 25 bp, Mus musculus
tacgtccgctgcttcaggcaagatg

SEQ ID NO: 765700 - DNA, 25 bp, Mus musculus
tacgtcctcaaccagcttcacgaag

SEQ ID NO: 765701 - DNA, 25 bp, Mus musculus
tacgtcctcaacgagcttcacgaag

SEQ ID NO: 765702 - DNA, 25 bp, Mus musculus
tacgtcctggtactgtgtcctctga

SEQ ID NO: 765703 - DNA, 25 bp, Mus musculus
tacgtcctggtagtgtgtcctctga

SEQ ID NO: 765704 - DNA, 25 bp, Mus musculus
tacgtcgccgagaacaagaactgga

SEQ ID NO: 765705 - DNA, 25 bp, Mus musculus
tacgtcgccgagtacaagaactgga

SEQ ID NO: 765706 - DNA, 25 bp, Mus musculus
tacgtcgggactagggctccggcca

SEQ ID NO: 765707 - DNA, 25 bp, Mus musculus
tacgtcgggacttgggctccggcca

SEQ ID NO: 765708 - DNA, 25 bp, Mus musculus
tacgtcggtcgcagttgcacgcagc

SEQ ID NO: 765709 - DNA, 25 bp, Mus musculus
tacgtcggtcgctgttgcacgcagc

SEQ ID NO: 765710 - DNA, 25 bp, Mus musculus
tacgtctagcaaacactgcaggcgg

SEQ ID NO: 765711 - DNA, 25 bp, Mus musculus
tacgtctagcaatcactgcaggcgg

SEQ ID NO: 765712 - DNA, 25 bp, Mus musculus
tacgtctatcacattacctaacctt

SEQ ID NO: 765713 - DNA, 25 bp, Mus musculus
tacgtctatcactttacctaacctt

SEQ ID NO: 765714 - DNA, 25 bp, Mus musculus
tacgtctattagagtctgcctacat

SEQ ID NO: 765715 - DNA, 25 bp, Mus musculus
tacgtctattagtgtctgcctacat

SEQ ID NO: 765716 - DNA, 25 bp, Mus musculus
tacgtctcatacatcatttcagcat

SEQ ID NO: 765717 - DNA, 25 bp, Mus musculus
tacgtctcatacttcatttcagcat

SEQ ID NO: 765718 - DNA, 25 bp, Mus musculus
tacgtctccattacaaacattttat

SEQ ID NO: 765719 - DNA, 25 bp, Mus musculus
tacgtctccatttcaaacattttat

SEQ ID NO: 765720 - DNA, 25 bp, Mus musculus
tacgtctctgggatgcccggactgg

SEQ ID NO: 765721 - DNA, 25 bp, Mus musculus
tacgtctctgggttgcccggactgg

SEQ ID NO: 765722 - DNA, 25 bp, Mus musculus
tacgtctcttgccaggctatgcagg

SEQ ID NO: 765723 - DNA, 25 bp, Mus musculus
tacgtctcttgcgaggctatgcagg

SEQ ID NO: 765724 - DNA, 25 bp, Mus musculus
tacgtctgacaaccataggccgaga

SEQ ID NO: 765725 - DNA, 25 bp, Mus musculus
tacgtctgacaagcataggccgaga

SEQ ID NO: 765726 - DNA, 25 bp, Mus musculus
tacgtctgagctcctagtgacttca

SEQ ID NO: 765727 - DNA, 25 bp, Mus musculus
tacgtctgagctgctagtgacttca

SEQ ID NO: 765728 - DNA, 25 bp, Mus musculus
tacgtctggtgcatttgagtgtcct

SEQ ID NO: 765729 - DNA, 25 bp, Mus musculus
tacgtctggtgcttttgagtgtcct

SEQ ID NO: 765730 - DNA, 25 bp, Mus musculus
tacgtctgtcagaatcctcggacct

SEQ ID NO: 765731 - DNA, 25 bp, Mus musculus
tacgtctgtcagtatcctcggacct

SEQ ID NO: 765732 - DNA, 25 bp, Mus musculus
tacgtcttcgctattggcctggatg

SEQ ID NO: 765733 - DNA, 25 bp, Mus musculus
tacgtcttcgcttttggcctggatg

SEQ ID NO: 765734 - DNA, 25 bp, Mus musculus
tacgtcttgagtattttcttcccca

SEQ ID NO: 765735 - DNA, 25 bp, Mus musculus
tacgtcttgagttttttcttcccca

SEQ ID NO: 765736 - DNA, 25 bp, Mus musculus
tacgtgaataccatccacaacattg

SEQ ID NO: 765737 - DNA, 25 bp, Mus musculus
tacgtgaataccttccacaacattg

SEQ ID NO: 765738 - DNA, 25 bp, Mus musculus
tacgtgacagtgacattgtgctgaa

SEQ ID NO: 765739 - DNA, 25 bp, Mus musculus
tacgtgacagtgtcattgtgctgaa

SEQ ID NO: 765740 - DNA, 25 bp, Mus musculus
tacgtgactcccattgaagactccc

SEQ ID NO: 765741 - DNA, 25 bp, Mus musculus
tacgtgactccctttgaagactccc

SEQ ID NO: 765742 - DNA, 25 bp, Mus musculus
tacgtgagcactcggttcatatact

SEQ ID NO: 765743 - DNA, 25 bp, Mus musculus
tacgtgagcactgggttcatatact

SEQ ID NO: 765744 - DNA, 25 bp, Mus musculus
tacgtgagcatcatgaacaagctgc

SEQ ID NO: 765745 - DNA, 25 bp, Mus musculus
tacgtgagcatcttgaacaagctgc

SEQ ID NO: 765746 - DNA, 25 bp, Mus musculus
tacgtgatcgagacgctggagccgc

SEQ ID NO: 765747 - DNA, 25 bp, Mus musculus
tacgtgatcgagtcgctggagccgc

SEQ ID NO: 765748 - DNA, 25 bp, Mus musculus
tacgtgatgtctaccgtaaagggcg

SEQ ID NO: 765749 - DNA, 25 bp, Mus musculus
tacgtgatgtcttccgtaaagggcg

SEQ ID NO: 765750 - DNA, 25 bp, Mus musculus
tacgtgattactcccctgttgttta

SEQ ID NO: 765751 - DNA, 25 bp, Mus musculus
tacgtgattactgccctgttgttta

SEQ ID NO: 765752 - DNA, 25 bp, Mus musculus
tacgtgcaactaactgttgttccaa

SEQ ID NO: 765753 - DNA, 25 bp, Mus musculus
tacgtgcaactatctgttgttccaa

SEQ ID NO: 765754 - DNA, 25 bp, Mus musculus
tacgtgcacgccctacaggccaacg

SEQ ID NO: 765755 - DNA, 25 bp, Mus musculus
tacgtgcacgccgtacaggccaacg

SEQ ID NO: 765756 - DNA, 25 bp, Mus musculus
tacgtgcagcgcatgcatgcagtag

SEQ ID NO: 765757 - DNA, 25 bp, Mus musculus
tacgtgcagcgcttgcatgcagtag

SEQ ID NO: 765758 - DNA, 25 bp, Mus musculus
tacgtgcatctcactactgccaatg

SEQ ID NO: 765759 - DNA, 25 bp, Mus musculus
tacgtgcatctctctactgccaatg

SEQ ID NO: 765760 - DNA, 25 bp, Mus musculus
tacgtgccaccgagcgctgggatta

SEQ ID NO: 765761 - DNA, 25 bp, Mus musculus
tacgtgccaccgtgcgctgggatta

SEQ ID NO: 765762 - DNA, 25 bp, Mus musculus
tacgtgccccttacttgaacttcat

SEQ ID NO: 765763 - DNA, 25 bp, Mus musculus
tacgtgcccctttcttgaacttcat

SEQ ID NO: 765764 - DNA, 25 bp, Mus musculus
tacgtgcctggtacataagatccac

SEQ ID NO: 765765 - DNA, 25 bp, Mus musculus
tacgtgcctggttcataagatccac

SEQ ID NO: 765766 - DNA, 25 bp, Mus musculus
tacgtgcgggaccacagccctgaaa

SEQ ID NO: 765767 - DNA, 25 bp, Mus musculus
tacgtgcgggacgacagccctgaaa

SEQ ID NO: 765768 - DNA, 25 bp, Mus musculus
tacgtgctacagaatcccaacagga

SEQ ID NO: 765769 - DNA, 25 bp, Mus musculus
tacgtgctacagtatcccaacagga

SEQ ID NO: 765770 - DNA, 25 bp, Mus musculus
tacgtgctactgaagccttcaacaa

SEQ ID NO: 765771 - DNA, 25 bp, Mus musculus
tacgtgctactgtagccttcaacaa

SEQ ID NO: 765772 - DNA, 25 bp, Mus musculus
tacgtgctgttcaaccaattgatgc

SEQ ID NO: 765773 - DNA, 25 bp, Mus musculus
tacgtgctgttctaccaattgatgc

SEQ ID NO: 765774 - DNA, 25 bp, Mus musculus
tacgtgcttcccaagctctatgtca

SEQ ID NO: 765775 - DNA, 25 bp, Mus musculus
tacgtgcttccctagctctatgtca

SEQ ID NO: 765776 - DNA, 25 bp, Mus musculus
tacgtgcttgtcattgtgccagtgc

SEQ ID NO: 765777 - DNA, 25 bp, Mus musculus
tacgtgcttgtctttgtgccagtgc

SEQ ID NO: 765778 - DNA, 25 bp, Mus musculus
tacgtggacatccacccctttgaga

SEQ ID NO: 765779 - DNA, 25 bp, Mus musculus
tacgtggacatcgacccctttgaga

SEQ ID NO: 765780 - DNA, 25 bp, Mus musculus
tacgtggaccaaaaccctcagagtg

SEQ ID NO: 765781 - DNA, 25 bp, Mus musculus
tacgtggaccaataccctcagagtg

SEQ ID NO: 765782 - DNA, 25 bp, Mus musculus
tacgtggaccacctgggttacctgg

SEQ ID NO: 765783 - DNA, 25 bp, Mus musculus
tacgtggaccacgtgggttacctgg

SEQ ID NO: 765784 - DNA, 25 bp, Mus musculus
tacgtggaccagagtgtgccatggc

SEQ ID NO: 765785 - DNA, 25 bp, Mus musculus
tacgtggaccagtgtgtgccatggc

SEQ ID NO: 765786 - DNA, 25 bp, Mus musculus
tacgtggagaggaacttgagaccat

SEQ ID NO: 765787 - DNA, 25 bp, Mus musculus
tacgtggagaggtacttgagaccat

SEQ ID NO: 765788 - DNA, 25 bp, Mus musculus
tacgtggcagtaaacaaccccaaga

SEQ ID NO: 765789 - DNA, 25 bp, Mus musculus
tacgtggcagtatacaaccccaaga

SEQ ID NO: 765790 - DNA, 25 bp, Mus musculus
tacgtggccaggagcttctgagcaa

SEQ ID NO: 765791 - DNA, 25 bp, Mus musculus
tacgtggccaggtgcttctgagcaa

SEQ ID NO: 765792 - DNA, 25 bp, Mus musculus
tacgtggcgctcatcgccatggcga

SEQ ID NO: 765793 - DNA, 25 bp, Mus musculus
tacgtggcgctcttcgccatggcga

SEQ ID NO: 765794 - DNA, 25 bp, Mus musculus
tacgtggctctgcatgtttgtatcg

SEQ ID NO: 765795 - DNA, 25 bp, Mus musculus
tacgtggctctggatgtttgtatcg

SEQ ID NO: 765796 - DNA, 25 bp, Mus musculus
tacgtgggaccccagaccatcacga

SEQ ID NO: 765797 - DNA, 25 bp, Mus musculus
tacgtgggacccgagaccatcacga

SEQ ID NO: 765798 - DNA, 25 bp, Mus musculus
tacgtgggaggcagcacaattgcac

SEQ ID NO: 765799 - DNA, 25 bp, Mus musculus
tacgtgggaggctgcacaattgcac

SEQ ID NO: 765800 - DNA, 25 bp, Mus musculus
tacgtgggcaggacgggctttctaa

SEQ ID NO: 765801 - DNA, 25 bp, Mus musculus
tacgtgggcaggtcgggctttctaa

SEQ ID NO: 765802 - DNA, 25 bp, Mus musculus
tacgtggtcaagcatgagcacgcca

SEQ ID NO: 765803 - DNA, 25 bp, Mus musculus
tacgtggtcaaggatgagcacgcca

SEQ ID NO: 765804 - DNA, 25 bp, Mus musculus
tacgtggtcagcctgctcacagaag

SEQ ID NO: 765805 - DNA, 25 bp, Mus musculus
tacgtggtcagcgtgctcacagaag

SEQ ID NO: 765806 - DNA, 25 bp, Mus musculus
tacgtggtcgagaatgggttcccgt

SEQ ID NO: 765807 - DNA, 25 bp, Mus musculus
tacgtggtcgagtatgggttcccgt

SEQ ID NO: 765808 - DNA, 25 bp, Mus musculus
tacgtggtgcccagtaactgtaccg

SEQ ID NO: 765809 - DNA, 25 bp, Mus musculus
tacgtggtgccctgtaactgtaccg

SEQ ID NO: 765810 - DNA, 25 bp, Mus musculus
tacgtggtggtaccccgtgactgcc

SEQ ID NO: 765811 - DNA, 25 bp, Mus musculus
tacgtggtggtagcccgtgactgcc

SEQ ID NO: 765812 - DNA, 25 bp, Mus musculus
tacgtggttcttactgatacagtca

SEQ ID NO: 765813 - DNA, 25 bp, Mus musculus
tacgtggttctttctgatacagtca

SEQ ID NO: 765814 - DNA, 25 bp, Mus musculus
tacgtgtaaatcctgtaggctctgg

SEQ ID NO: 765815 - DNA, 25 bp, Mus musculus
tacgtgtaaatcgtgtaggctctgg

SEQ ID NO: 765816 - DNA, 25 bp, Mus musculus
tacgtgtaagggaagctgaagtttt

SEQ ID NO: 765817 - DNA, 25 bp, Mus musculus
tacgtgtaagggtagctgaagtttt

SEQ ID NO: 765818 - DNA, 25 bp, Mus musculus
tacgtgtagtcccagagcccgtcac

SEQ ID NO: 765819 - DNA, 25 bp, Mus musculus
tacgtgtagtccgagagcccgtcac

SEQ ID NO: 765820 - DNA, 25 bp, Mus musculus
tacgtgtcaaacagttccatttgtt

SEQ ID NO: 765821 - DNA, 25 bp, Mus musculus
tacgtgtcaaactgttccatttgtt

SEQ ID NO: 765822 - DNA, 25 bp, Mus musculus
tacgtgtcagacaataaccgccttc

SEQ ID NO: 765823 - DNA, 25 bp, Mus musculus
tacgtgtcagactataaccgccttc

SEQ ID NO: 765824 - DNA, 25 bp, Mus musculus
tacgtgtccagcacttaggttttac

SEQ ID NO: 765825 - DNA, 25 bp, Mus musculus
tacgtgtccagctcttaggttttac

SEQ ID NO: 765826 - DNA, 25 bp, Mus musculus
tacgtgtccctgaaccaggagggca

SEQ ID NO: 765827 - DNA, 25 bp, Mus musculus
tacgtgtccctgtaccaggagggca

SEQ ID NO: 765828 - DNA, 25 bp, Mus musculus
tacgtgtcgtctctgacctggatga

SEQ ID NO: 765829 - DNA, 25 bp, Mus musculus
tacgtgtcgtctgtgacctggatga

SEQ ID NO: 765830 - DNA, 25 bp, Mus musculus
tacgtgtctcgacctttcgctgaca

SEQ ID NO: 765831 - DNA, 25 bp, Mus musculus
tacgtgtctcgagctttcgctgaca

SEQ ID NO: 765832 - DNA, 25 bp, Mus musculus
tacgtgtctcttaactctttcaaca

SEQ ID NO: 765833 - DNA, 25 bp, Mus musculus
tacgtgtctctttactctttcaaca

SEQ ID NO: 765834 - DNA, 25 bp, Mus musculus
tacgtgtctgtgattttgttgtttg

SEQ ID NO: 765835 - DNA, 25 bp, Mus musculus
tacgtgtctgtgtttttgttgtttg

SEQ ID NO: 765836 - DNA, 25 bp, Mus musculus
tacgtgtgacccaacgatatagaca

SEQ ID NO: 765837 - DNA, 25 bp, Mus musculus
tacgtgtgaccctacgatatagaca

SEQ ID NO: 765838 - DNA, 25 bp, Mus musculus
tacgtgtgatgaactgagctcccat

SEQ ID NO: 765839 - DNA, 25 bp, Mus musculus
tacgtgtgatgatctgagctcccat

SEQ ID NO: 765840 - DNA, 25 bp, Mus musculus
tacgtgtgccacacagcatcatagt

SEQ ID NO: 765841 - DNA, 25 bp, Mus musculus
tacgtgtgccactcagcatcatagt

SEQ ID NO: 765842 - DNA, 25 bp, Mus musculus
tacgtgtgggacaaaggcagcagct

SEQ ID NO: 765843 - DNA, 25 bp, Mus musculus
tacgtgtgggactaaggcagcagct

SEQ ID NO: 765844 - DNA, 25 bp, Mus musculus
tacgtgtgggatattataatgctca

SEQ ID NO: 765845 - DNA, 25 bp, Mus musculus
tacgtgtgggattttataatgctca

SEQ ID NO: 765846 - DNA, 25 bp, Mus musculus
tacgtgtgggtgaatgtgcctgtac

SEQ ID NO: 765847 - DNA, 25 bp, Mus musculus
tacgtgtgggtgtatgtgcctgtac

SEQ ID NO: 765848 - DNA, 25 bp, Mus musculus
tacgtgtgtacacccatctcaagag

SEQ ID NO: 765849 - DNA, 25 bp, Mus musculus
tacgtgtgtacagccatctcaagag

SEQ ID NO: 765850 - DNA, 25 bp, Mus musculus
tacgtgtgtcttattgctgagggca

SEQ ID NO: 765851 - DNA, 25 bp, Mus musculus
tacgtgtgtctttttgctgagggca

SEQ ID NO: 765852 - DNA, 25 bp, Mus musculus
tacgtgtgtgtgagtcatccttatg

SEQ ID NO: 765853 - DNA, 25 bp, Mus musculus
tacgtgtgtgtgtgtcatccttatg

SEQ ID NO: 765854 - DNA, 25 bp, Mus musculus
tacgtgttataaaccaatgttccat

SEQ ID NO: 765855 - DNA, 25 bp, Mus musculus
tacgtgttataatccaatgttccat

SEQ ID NO: 765856 - DNA, 25 bp, Mus musculus
tacgtgttggacagcagccacccag

SEQ ID NO: 765857 - DNA, 25 bp, Mus musculus
tacgtgttggactgcagccacccag

SEQ ID NO: 765858 - DNA, 25 bp, Mus musculus
tacgtgttgtgtaatgacttcattt

SEQ ID NO: 765859 - DNA, 25 bp, Mus musculus
tacgtgttgtgttatgacttcattt

SEQ ID NO: 765860 - DNA, 25 bp, Mus musculus
tacgttaatttaatgctccttaagg

SEQ ID NO: 765861 - DNA, 25 bp, Mus musculus
tacgttaatttattgctccttaagg

SEQ ID NO: 765862 - DNA, 25 bp, Mus musculus
tacgttacacttatacaccctcttg

SEQ ID NO: 765863 - DNA, 25 bp, Mus musculus
tacgttacacttttacaccctcttg

SEQ ID NO: 765864 - DNA, 25 bp, Mus musculus
tacgttacccatcgcccacatataa

SEQ ID NO: 765865 - DNA, 25 bp, Mus musculus
tacgttacccatggcccacatataa

SEQ ID NO: 765866 - DNA, 25 bp, Mus musculus
tacgttatctcaccaatacttgctg

SEQ ID NO: 765867 - DNA, 25 bp, Mus musculus
tacgttatctcagcaatacttgctg

SEQ ID NO: 765868 - DNA, 25 bp, Mus musculus
tacgttatgattcaccggactgcgg

SEQ ID NO: 765869 - DNA, 25 bp, Mus musculus
tacgttatgattgaccggactgcgg

SEQ ID NO: 765870 - DNA, 25 bp, Mus musculus
tacgttatgcctattggactcggaa

SEQ ID NO: 765871 - DNA, 25 bp, Mus musculus
tacgttatgccttttggactcggaa

SEQ ID NO: 765872 - DNA, 25 bp, Mus musculus
tacgttatggttactggcttttaca

SEQ ID NO: 765873 - DNA, 25 bp, Mus musculus
tacgttatggtttctggcttttaca

SEQ ID NO: 765874 - DNA, 25 bp, Mus musculus
tacgttattattaccgccgcgacat

SEQ ID NO: 765875 - DNA, 25 bp, Mus musculus
tacgttattatttccgccgcgacat

SEQ ID NO: 765876 - DNA, 25 bp, Mus musculus
tacgttattcctagtttgttcattc

SEQ ID NO: 765877 - DNA, 25 bp, Mus musculus
tacgttattccttgtttgttcattc

SEQ ID NO: 765878 - DNA, 25 bp, Mus musculus
tacgttcaccggcacttagcagcaa

SEQ ID NO: 765879 - DNA, 25 bp, Mus musculus
tacgttcaccgggacttagcagcaa

SEQ ID NO: 765880 - DNA, 25 bp, Mus musculus
tacgttccaagtaacctgtctgatg

SEQ ID NO: 765881 - DNA, 25 bp, Mus musculus
tacgttccaagttacctgtctgatg

SEQ ID NO: 765882 - DNA, 25 bp, Mus musculus
tacgttccacgaatccaaccagtgt

SEQ ID NO: 765883 - DNA, 25 bp, Mus musculus
tacgttccacgattccaaccagtgt

SEQ ID NO: 765884 - DNA, 25 bp, Mus musculus
tacgttccggctccggagaagtcca

SEQ ID NO: 765885 - DNA, 25 bp, Mus musculus
tacgttccggctgcggagaagtcca

SEQ ID NO: 765886 - DNA, 25 bp, Mus musculus
tacgttcctacgagatgcccaatgc

SEQ ID NO: 765887 - DNA, 25 bp, Mus musculus
tacgttcctacgtgatgcccaatgc

SEQ ID NO: 765888 - DNA, 25 bp, Mus musculus
tacgttcctattacacatgtttttt

SEQ ID NO: 765889 - DNA, 25 bp, Mus musculus
tacgttcctatttcacatgtttttt

SEQ ID NO: 765890 - DNA, 25 bp, Mus musculus
tacgttctagataagacaattcatt

SEQ ID NO: 765891 - DNA, 25 bp, Mus musculus
tacgttctagattagacaattcatt

SEQ ID NO: 765892 - DNA, 25 bp, Mus musculus
tacgttctccagaaggaaggccact

SEQ ID NO: 765893 - DNA, 25 bp, Mus musculus
tacgttctccagtaggaaggccact

SEQ ID NO: 765894 - DNA, 25 bp, Mus musculus
tacgttctgtgtcctagttttagac

SEQ ID NO: 765895 - DNA, 25 bp, Mus musculus
tacgttctgtgtgctagttttagac

SEQ ID NO: 765896 - DNA, 25 bp, Mus musculus
tacgttgaatacacctttcacctgg

SEQ ID NO: 765897 - DNA, 25 bp, Mus musculus
tacgttgaatactcctttcacctgg

SEQ ID NO: 765898 - DNA, 25 bp, Mus musculus
tacgttgcattgatgcggtgtcacc

SEQ ID NO: 765899 - DNA, 25 bp, Mus musculus
tacgttgcattgttgcggtgtcacc

SEQ ID NO: 765900 - DNA, 25 bp, Mus musculus
tacgttgccgaaacaagccatcgct

SEQ ID NO: 765901 - DNA, 25 bp, Mus musculus
tacgttgccgaatcaagccatcgct

SEQ ID NO: 765902 - DNA, 25 bp, Mus musculus
tacgttgcttatatctgatcacttt

SEQ ID NO: 765903 - DNA, 25 bp, Mus musculus
tacgttgcttatttctgatcacttt

SEQ ID NO: 765904 - DNA, 25 bp, Mus musculus
tacgttggaacgagccccggaatgt

SEQ ID NO: 765905 - DNA, 25 bp, Mus musculus
tacgttggaacgtgccccggaatgt

SEQ ID NO: 765906 - DNA, 25 bp, Mus musculus
tacgttgggttcatattcctcattc

SEQ ID NO: 765907 - DNA, 25 bp, Mus musculus
tacgttgggttcttattcctcattc

SEQ ID NO: 765908 - DNA, 25 bp, Mus musculus
tacgttgtcaaacgcccaagggcta

SEQ ID NO: 765909 - DNA, 25 bp, Mus musculus
tacgttgtcaaaggcccaagggcta

SEQ ID NO: 765910 - DNA, 25 bp, Mus musculus
tacgttgtcggtatgttattaaatg

SEQ ID NO: 765911 - DNA, 25 bp, Mus musculus
tacgttgtcggtttgttattaaatg

SEQ ID NO: 765912 - DNA, 25 bp, Mus musculus
tacgttgtgatccttgtcctgattg

SEQ ID NO: 765913 - DNA, 25 bp, Mus musculus
tacgttgtgatcgttgtcctgattg

SEQ ID NO: 765914 - DNA, 25 bp, Mus musculus
tacgttgttgtaactcggtatttca

SEQ ID NO: 765915 - DNA, 25 bp, Mus musculus
tacgttgttgtatctcggtatttca

SEQ ID NO: 765916 - DNA, 25 bp, Mus musculus
tacgtttaagttctaatttcacatt

SEQ ID NO: 765917 - DNA, 25 bp, Mus musculus
tacgtttaagttgtaatttcacatt

SEQ ID NO: 765918 - DNA, 25 bp, Mus musculus
tacgtttagtctcggtggaatcggc

SEQ ID NO: 765919 - DNA, 25 bp, Mus musculus
tacgtttagtctgggtggaatcggc

SEQ ID NO: 765920 - DNA, 25 bp, Mus musculus
tacgtttataacactgcagagacct

SEQ ID NO: 765921 - DNA, 25 bp, Mus musculus
tacgtttataactctgcagagacct

SEQ ID NO: 765922 - DNA, 25 bp, Mus musculus
tacgtttcatcaaagctacttccct

SEQ ID NO: 765923 - DNA, 25 bp, Mus musculus
tacgtttcatcatagctacttccct

SEQ ID NO: 765924 - DNA, 25 bp, Mus musculus
tacgtttccagccattccaaagtat

SEQ ID NO: 765925 - DNA, 25 bp, Mus musculus
tacgtttccagcgattccaaagtat

SEQ ID NO: 765926 - DNA, 25 bp, Mus musculus
tacgtttctctgattggcaaggatc

SEQ ID NO: 765927 - DNA, 25 bp, Mus musculus
tacgtttctctgtttggcaaggatc

SEQ ID NO: 765928 - DNA, 25 bp, Mus musculus
tacgttttaaagagaattatgcatg

SEQ ID NO: 765929 - DNA, 25 bp, Mus musculus
tacgttttaaagtgaattatgcatg

SEQ ID NO: 765930 - DNA, 25 bp, Mus musculus
tacgttttctcaacaactgttggaa

SEQ ID NO: 765931 - DNA, 25 bp, Mus musculus
tacgttttctcatcaactgttggaa

SEQ ID NO: 765932 - DNA, 25 bp, Mus musculus
tactaaaacatccttgctgtgtctg

SEQ ID NO: 765933 - DNA, 25 bp, Mus musculus
tactaaaacatcgttgctgtgtctg

SEQ ID NO: 765934 - DNA, 25 bp, Mus musculus
tactaaaaccccagttgtactgatt

SEQ ID NO: 765935 - DNA, 25 bp, Mus musculus
tactaaaacccctgttgtactgatt

SEQ ID NO: 765936 - DNA, 25 bp, Mus musculus
tactaaacacacacaaggcactcct

SEQ ID NO: 765937 - DNA, 25 bp, Mus musculus
tactaaacacactcaaggcactcct

SEQ ID NO: 765938 - DNA, 25 bp, Mus musculus
tactaaacatgaagactccgccctg

SEQ ID NO: 765939 - DNA, 25 bp, Mus musculus
tactaaacatgatgactccgccctg

SEQ ID NO: 765940 - DNA, 25 bp, Mus musculus
tactaaaccagtcttgccagctctc

SEQ ID NO: 765941 - DNA, 25 bp, Mus musculus
tactaaaccagtgttgccagctctc

SEQ ID NO: 765942 - DNA, 25 bp, Mus musculus
tactaaaggcaccaggaaaggaaat

SEQ ID NO: 765943 - DNA, 25 bp, Mus musculus
tactaaaggcacgaggaaaggaaat

SEQ ID NO: 765944 - DNA, 25 bp, Mus musculus
tactaaaggccacgtgagtactgat

SEQ ID NO: 765945 - DNA, 25 bp, Mus musculus
tactaaaggccaggtgagtactgat

SEQ ID NO: 765946 - DNA, 25 bp, Mus musculus
tactaaagggctagtcacgccaagg

SEQ ID NO: 765947 - DNA, 25 bp, Mus musculus
tactaaagggcttgtcacgccaagg

SEQ ID NO: 765948 - DNA, 25 bp, Mus musculus
tactaaagttccactgggctcagat

SEQ ID NO: 765949 - DNA, 25 bp, Mus musculus
tactaaagttcctctgggctcagat

SEQ ID NO: 765950 - DNA, 25 bp, Mus musculus
tactaaatacccctacagtcgcgat

SEQ ID NO: 765951 - DNA, 25 bp, Mus musculus
tactaaatacccgtacagtcgcgat

SEQ ID NO: 765952 - DNA, 25 bp, Mus musculus
tactaaatctgccatgtccgacact

SEQ ID NO: 765953 - DNA, 25 bp, Mus musculus
tactaaatctgcgatgtccgacact

SEQ ID NO: 765954 - DNA, 25 bp, Mus musculus
tactaaatgcttaccgtgtgaccct

SEQ ID NO: 765955 - DNA, 25 bp, Mus musculus
tactaaatgctttccgtgtgaccct

SEQ ID NO: 765956 - DNA, 25 bp, Mus musculus
tactaaatgtgtcatccggaagcag

SEQ ID NO: 765957 - DNA, 25 bp, Mus musculus
tactaaatgtgtgatccggaagcag

SEQ ID NO: 765958 - DNA, 25 bp, Mus musculus
tactaaatgttacctcgtgcaccct

SEQ ID NO: 765959 - DNA, 25 bp, Mus musculus
tactaaatgttagctcgtgcaccct

SEQ ID NO: 765960 - DNA, 25 bp, Mus musculus
tactaacaagctcgaggccatcgcc

SEQ ID NO: 765961 - DNA, 25 bp, Mus musculus
tactaacaagctggaggccatcgcc

SEQ ID NO: 765962 - DNA, 25 bp, Mus musculus
tactaacaagttcaccaggatcctg

SEQ ID NO: 765963 - DNA, 25 bp, Mus musculus
tactaacaagttgaccaggatcctg

SEQ ID NO: 765964 - DNA, 25 bp, Mus musculus
tactaacagctgacatcactggtga

SEQ ID NO: 765965 - DNA, 25 bp, Mus musculus
tactaacagctgtcatcactggtga

SEQ ID NO: 765966 - DNA, 25 bp, Mus musculus
tactaacaggatatagggcaaggtg

SEQ ID NO: 765967 - DNA, 25 bp, Mus musculus
tactaacaggatttagggcaaggtg

SEQ ID NO: 765968 - DNA, 25 bp, Mus musculus
tactaacagtgtcccttctccttaa

SEQ ID NO: 765969 - DNA, 25 bp, Mus musculus
tactaacagtgtgccttctccttaa

SEQ ID NO: 765970 - DNA, 25 bp, Mus musculus
tactaacattctactccactgaaac

SEQ ID NO: 765971 - DNA, 25 bp, Mus musculus
tactaacattcttctccactgaaac

SEQ ID NO: 765972 - DNA, 25 bp, Mus musculus
tactaacctcctcttcagaccttgt

SEQ ID NO: 765973 - DNA, 25 bp, Mus musculus
tactaacctcctgttcagaccttgt

SEQ ID NO: 765974 - DNA, 25 bp, Mus musculus
tactaacctcgtaaaaaccatggct

SEQ ID NO: 765975 - DNA, 25 bp, Mus musculus
tactaacctcgttaaaaccatggct

SEQ ID NO: 765976 - DNA, 25 bp, Mus musculus
tactaacggctgcaggccctagcag

SEQ ID NO: 765977 - DNA, 25 bp, Mus musculus
tactaacggctggaggccctagcag

SEQ ID NO: 765978 - DNA, 25 bp, Mus musculus
tactaactaattctcaagcactgat

SEQ ID NO: 765979 - DNA, 25 bp, Mus musculus
tactaactaattgtcaagcactgat

SEQ ID NO: 765980 - DNA, 25 bp, Mus musculus
tactaactacacacacatggttccc

SEQ ID NO: 765981 - DNA, 25 bp, Mus musculus
tactaactacactcacatggttccc

SEQ ID NO: 765982 - DNA, 25 bp, Mus musculus
tactaactagatattccacatctgt

SEQ ID NO: 765983 - DNA, 25 bp, Mus musculus
tactaactagattttccacatctgt

SEQ ID NO: 765984 - DNA, 25 bp, Mus musculus
tactaactcatacatgcttcccatg

SEQ ID NO: 765985 - DNA, 25 bp, Mus musculus
tactaactcatagatgcttcccatg

SEQ ID NO: 765986 - DNA, 25 bp, Mus musculus
tactaactctctatctatcactttg

SEQ ID NO: 765987 - DNA, 25 bp, Mus musculus
tactaactctctttctatcactttg

SEQ ID NO: 765988 - DNA, 25 bp, Mus musculus
tactaactcttcagacatctgatat

SEQ ID NO: 765989 - DNA, 25 bp, Mus musculus
tactaactcttctgacatctgatat

SEQ ID NO: 765990 - DNA, 25 bp, Mus musculus
tactaactgccaaggccaggctatg

SEQ ID NO: 765991 - DNA, 25 bp, Mus musculus
tactaactgccatggccaggctatg

SEQ ID NO: 765992 - DNA, 25 bp, Mus musculus
tactaactgtatcctaatcatgatt

SEQ ID NO: 765993 - DNA, 25 bp, Mus musculus
tactaactgtatgctaatcatgatt

SEQ ID NO: 765994 - DNA, 25 bp, Mus musculus
tactaacttaacagttgtcaaggag

SEQ ID NO: 765995 - DNA, 25 bp, Mus musculus
tactaacttaactgttgtcaaggag

SEQ ID NO: 765996 - DNA, 25 bp, Mus musculus
tactaacttaatctcttcacattgt

SEQ ID NO: 765997 - DNA, 25 bp, Mus musculus
tactaacttaatgtcttcacattgt

SEQ ID NO: 765998 - DNA, 25 bp, Mus musculus
tactaacttaggctgctagagaggt

SEQ ID NO: 765999 - DNA, 25 bp, Mus musculus
tactaacttagggtgctagagaggt

SEQ ID NO: 766000 - DNA, 25 bp, Mus musculus
tactaacttgacaggttttactgca

SEQ ID NO: 766001 - DNA, 25 bp, Mus musculus
tactaacttgactggttttactgca

SEQ ID NO: 766002 - DNA, 25 bp, Mus musculus
tactaagaccctagtccagagacaa

SEQ ID NO: 766003 - DNA, 25 bp, Mus musculus
tactaagacccttgtccagagacaa

SEQ ID NO: 766004 - DNA, 25 bp, Mus musculus
tactaagactctacctcctgaaaaa

SEQ ID NO: 766005 - DNA, 25 bp, Mus musculus
tactaagactcttcctcctgaaaaa

SEQ ID NO: 766006 - DNA, 25 bp, Mus musculus
tactaagatggcactctcaagtggt

SEQ ID NO: 766007 - DNA, 25 bp, Mus musculus
tactaagatggctctctcaagtggt

SEQ ID NO: 766008 - DNA, 25 bp, Mus musculus
tactaagcacctattgcctgtcagg

SEQ ID NO: 766009 - DNA, 25 bp, Mus musculus
tactaagcaccttttgcctgtcagg

SEQ ID NO: 766010 - DNA, 25 bp, Mus musculus
tactaagcactacctgcagcacatt

SEQ ID NO: 766011 - DNA, 25 bp, Mus musculus
tactaagcactagctgcagcacatt

SEQ ID NO: 766012 - DNA, 25 bp, Mus musculus
tactaagcctagaatatgtatttta

SEQ ID NO: 766013 - DNA, 25 bp, Mus musculus
tactaagcctagtatatgtatttta

SEQ ID NO: 766014 - DNA, 25 bp, Mus musculus
tactaagcgagccagatgtgcccaa

SEQ ID NO: 766015 - DNA, 25 bp, Mus musculus
tactaagcgagcgagatgtgcccaa

SEQ ID NO: 766016 - DNA, 25 bp, Mus musculus
tactaaggacagcagtcacaggaac

SEQ ID NO: 766017 - DNA, 25 bp, Mus musculus
tactaaggacaggagtcacaggaac

SEQ ID NO: 766018 - DNA, 25 bp, Mus musculus
tactaaggagtaagatcagcgagga

SEQ ID NO: 766019 - DNA, 25 bp, Mus musculus
tactaaggagtatgatcagcgagga

SEQ ID NO: 766020 - DNA, 25 bp, Mus musculus
tactaaggattcatgctgtatcatt

SEQ ID NO: 766021 - DNA, 25 bp, Mus musculus
tactaaggattcttgctgtatcatt

SEQ ID NO: 766022 - DNA, 25 bp, Mus musculus
tactaaggtaacagcctggcgtctc

SEQ ID NO: 766023 - DNA, 25 bp, Mus musculus
tactaaggtaactgcctggcgtctc

SEQ ID NO: 766024 - DNA, 25 bp, Mus musculus
tactaagtattcattctatcccata

SEQ ID NO: 766025 - DNA, 25 bp, Mus musculus
tactaagtattctttctatcccata

SEQ ID NO: 766026 - DNA, 25 bp, Mus musculus
tactaagtgactattaaatcccagt

SEQ ID NO: 766027 - DNA, 25 bp, Mus musculus
tactaagtgacttttaaatcccagt

SEQ ID NO: 766028 - DNA, 25 bp, Mus musculus
tactaagtgcctagggttgccggct

SEQ ID NO: 766029 - DNA, 25 bp, Mus musculus
tactaagtgccttgggttgccggct

SEQ ID NO: 766030 - DNA, 25 bp, Mus musculus
tactaagtgcttactgtatactcag

SEQ ID NO: 766031 - DNA, 25 bp, Mus musculus
tactaagtgctttctgtatactcag

SEQ ID NO: 766032 - DNA, 25 bp, Mus musculus
tactaataccaaattaccaccaagg

SEQ ID NO: 766033 - DNA, 25 bp, Mus musculus
tactaataccaatttaccaccaagg

SEQ ID NO: 766034 - DNA, 25 bp, Mus musculus
tactaatatctgaagtatcttagtt

SEQ ID NO: 766035 - DNA, 25 bp, Mus musculus
tactaatatctgtagtatcttagtt

SEQ ID NO: 766036 - DNA, 25 bp, Mus musculus
tactaatcaccaaaaggccctttcc

SEQ ID NO: 766037 - DNA, 25 bp, Mus musculus
tactaatcaccataaggccctttcc

SEQ ID NO: 766038 - DNA, 25 bp, Mus musculus
tactaatccctaatttttccagtgt

SEQ ID NO: 766039 - DNA, 25 bp, Mus musculus
tactaatccctattttttccagtgt

SEQ ID NO: 766040 - DNA, 25 bp, Mus musculus
tactaatgaactctctgttttcctc

SEQ ID NO: 766041 - DNA, 25 bp, Mus musculus
tactaatgaactgtctgttttcctc

SEQ ID NO: 766042 - DNA, 25 bp, Mus musculus
tactaatgacatcgatgacagagaa

SEQ ID NO: 766043 - DNA, 25 bp, Mus musculus
tactaatgacatggatgacagagaa

SEQ ID NO: 766044 - DNA, 25 bp, Mus musculus
tactaattcaacagtgggaaggtgc

SEQ ID NO: 766045 - DNA, 25 bp, Mus musculus
tactaattcaactgtgggaaggtgc

SEQ ID NO: 766046 - DNA, 25 bp, Mus musculus
tactaattgaaaaccacccgccgtt

SEQ ID NO: 766047 - DNA, 25 bp, Mus musculus
tactaattgaaatccacccgccgtt

SEQ ID NO: 766048 - DNA, 25 bp, Mus musculus
tactaattttttcgagcttgctgtg

SEQ ID NO: 766049 - DNA, 25 bp, Mus musculus
tactaattttttggagcttgctgtg

SEQ ID NO: 766050 - DNA, 25 bp, Mus musculus
tactacaaagttcagccccttaatt

SEQ ID NO: 766051 - DNA, 25 bp, Mus musculus
tactacaaagttgagccccttaatt

SEQ ID NO: 766052 - DNA, 25 bp, Mus musculus
tactacaacagcagagatcacaaat

SEQ ID NO: 766053 - DNA, 25 bp, Mus musculus
tactacaacagctgagatcacaaat

SEQ ID NO: 766054 - DNA, 25 bp, Mus musculus
tactacaagataccttcagagttcc

SEQ ID NO: 766055 - DNA, 25 bp, Mus musculus
tactacaagatagcttcagagttcc

SEQ ID NO: 766056 - DNA, 25 bp, Mus musculus
tactacaagcacaccagtaacaagt

SEQ ID NO: 766057 - DNA, 25 bp, Mus musculus
tactacaagcactccagtaacaagt

SEQ ID NO: 766058 - DNA, 25 bp, Mus musculus
tactacaagggccagtatatcctaa

SEQ ID NO: 766059 - DNA, 25 bp, Mus musculus
tactacaagggcgagtatatcctaa

SEQ ID NO: 766060 - DNA, 25 bp, Mus musculus
tactacacaactagctacttttggg

SEQ ID NO: 766061 - DNA, 25 bp, Mus musculus
tactacacaacttgctacttttggg

SEQ ID NO: 766062 - DNA, 25 bp, Mus musculus
tactacacacatcgctgaaaccagg

SEQ ID NO: 766063 - DNA, 25 bp, Mus musculus
tactacacacatggctgaaaccagg

SEQ ID NO: 766064 - DNA, 25 bp, Mus musculus
tactacacagctacgcggcatatat

SEQ ID NO: 766065 - DNA, 25 bp, Mus musculus
tactacacagcttcgcggcatatat

SEQ ID NO: 766066 - DNA, 25 bp, Mus musculus
tactacacctacctttccaaggatt

SEQ ID NO: 766067 - DNA, 25 bp, Mus musculus
tactacacctacgtttccaaggatt

SEQ ID NO: 766068 - DNA, 25 bp, Mus musculus
tactacacgcgtctgggtaatgact

SEQ ID NO: 766069 - DNA, 25 bp, Mus musculus
tactacacgcgtgtgggtaatgact

SEQ ID NO: 766070 - DNA, 25 bp, Mus musculus
tactacactctacgaacacttgatt

SEQ ID NO: 766071 - DNA, 25 bp, Mus musculus
tactacactctaggaacacttgatt

SEQ ID NO: 766072 - DNA, 25 bp, Mus musculus
tactacagatttagctgctgtggaa

SEQ ID NO: 766073 - DNA, 25 bp, Mus musculus
tactacagattttgctgctgtggaa

SEQ ID NO: 766074 - DNA, 25 bp, Mus musculus
tactacagccatataacgttctcta

SEQ ID NO: 766075 - DNA, 25 bp, Mus musculus
tactacagccatttaacgttctcta

SEQ ID NO: 766076 - DNA, 25 bp, Mus musculus
tactacaggttaagggtctatttta

SEQ ID NO: 766077 - DNA, 25 bp, Mus musculus
tactacaggttatgggtctatttta

SEQ ID NO: 766078 - DNA, 25 bp, Mus musculus
tactacagtatgattttggagccct

SEQ ID NO: 766079 - DNA, 25 bp, Mus musculus
tactacagtatgtttttggagccct

SEQ ID NO: 766080 - DNA, 25 bp, Mus musculus
tactacatatcaagatggcacggcc

SEQ ID NO: 766081 - DNA, 25 bp, Mus musculus
tactacatatcatgatggcacggcc

SEQ ID NO: 766082 - DNA, 25 bp, Mus musculus
tactacattatcatccaaggattga

SEQ ID NO: 766083 - DNA, 25 bp, Mus musculus
tactacattatcttccaaggattga

SEQ ID NO: 766084 - DNA, 25 bp, Mus musculus
tactacattgcacagggcagggaat

SEQ ID NO: 766085 - DNA, 25 bp, Mus musculus
tactacattgcagagggcagggaat

SEQ ID NO: 766086 - DNA, 25 bp, Mus musculus
tactaccaacctactagagaacgtg

SEQ ID NO: 766087 - DNA, 25 bp, Mus musculus
tactaccaaccttctagagaacgtg

SEQ ID NO: 766088 - DNA, 25 bp, Mus musculus
tactaccaagatccctgagtttaac

SEQ ID NO: 766089 - DNA, 25 bp, Mus musculus
tactaccaagatgcctgagtttaac

SEQ ID NO: 766090 - DNA, 25 bp, Mus musculus
tactaccaccaccaatgtctttatg

SEQ ID NO: 766091 - DNA, 25 bp, Mus musculus
tactaccaccacgaatgtctttatg

SEQ ID NO: 766092 - DNA, 25 bp, Mus musculus
tactaccagcagagctttggtcccc

SEQ ID NO: 766093 - DNA, 25 bp, Mus musculus
tactaccagcagctgactcacttga

SEQ ID NO: 766094 - DNA, 25 bp, Mus musculus
tactaccagcaggtgactcacttga

SEQ ID NO: 766095 - DNA, 25 bp, Mus musculus
tactaccagcagtgctttggtcccc

SEQ ID NO: 766096 - DNA, 25 bp, Mus musculus
tactaccagccaagtatagagatat

SEQ ID NO: 766097 - DNA, 25 bp, Mus musculus
tactaccagccatgtatagagatat

SEQ ID NO: 766098 - DNA, 25 bp, Mus musculus
tactaccagggtcgaaaatttcagt

SEQ ID NO: 766099 - DNA, 25 bp, Mus musculus
tactaccagggtggaaaatttcagt

SEQ ID NO: 766100 - DNA, 25 bp, Mus musculus
tactaccaggtaactcgaacatctg

SEQ ID NO: 766101 - DNA, 25 bp, Mus musculus
tactaccaggtatctcgaacatctg

SEQ ID NO: 766102 - DNA, 25 bp, Mus musculus
tactacccaagcaactcaaccaatg

SEQ ID NO: 766103 - DNA, 25 bp, Mus musculus
tactacccaagctactcaaccaatg

SEQ ID NO: 766104 - DNA, 25 bp, Mus musculus
tactacccacaaatgagactgcatg

SEQ ID NO: 766105 - DNA, 25 bp, Mus musculus
tactacccacaattgagactgcatg

SEQ ID NO: 766106 - DNA, 25 bp, Mus musculus
tactacccacagaagctggacctgg

SEQ ID NO: 766107 - DNA, 25 bp, Mus musculus
tactacccacagtagctggacctgg

SEQ ID NO: 766108 - DNA, 25 bp, Mus musculus
tactacccagagaaagccctgaaaa

SEQ ID NO: 766109 - DNA, 25 bp, Mus musculus
tactacccagagtaagccctgaaaa

SEQ ID NO: 766110 - DNA, 25 bp, Mus musculus
tactacccagggagtagaagctcct

SEQ ID NO: 766111 - DNA, 25 bp, Mus musculus
tactacccagggtgtagaagctcct

SEQ ID NO: 766112 - DNA, 25 bp, Mus musculus
tactacccatagctcttttgtttgt

SEQ ID NO: 766113 - DNA, 25 bp, Mus musculus
tactacccataggtcttttgtttgt

SEQ ID NO: 766114 - DNA, 25 bp, Mus musculus
tactaccctggtaaatgtcgtcgtc

SEQ ID NO: 766115 - DNA, 25 bp, Mus musculus
tactaccctggttaatgtcgtcgtc

SEQ ID NO: 766116 - DNA, 25 bp, Mus musculus
tactaccgaccgactgaagtggact

SEQ ID NO: 766117 - DNA, 25 bp, Mus musculus
tactaccgaccgtctgaagtggact

SEQ ID NO: 766118 - DNA, 25 bp, Mus musculus
tactaccgatacactgggtctctga

SEQ ID NO: 766119 - DNA, 25 bp, Mus musculus
tactaccgatactctgggtctctga

SEQ ID NO: 766120 - DNA, 25 bp, Mus musculus
tactacctacttattggtctcttca

SEQ ID NO: 766121 - DNA, 25 bp, Mus musculus
tactacctactttttggtctcttca

SEQ ID NO: 766122 - DNA, 25 bp, Mus musculus
tactacctagtcactgctgggtcac

SEQ ID NO: 766123 - DNA, 25 bp, Mus musculus
tactacctagtctctgctgggtcac

SEQ ID NO: 766124 - DNA, 25 bp, Mus musculus
tactacctcaccaagactctttatt

SEQ ID NO: 766125 - DNA, 25 bp, Mus musculus
tactacctcacctagactctttatt

SEQ ID NO: 766126 - DNA, 25 bp, Mus musculus
tactacctcatgcagataaagcact

SEQ ID NO: 766127 - DNA, 25 bp, Mus musculus
tactacctcatggagataaagcact

SEQ ID NO: 766128 - DNA, 25 bp, Mus musculus
tactacctcccaatcgatttgtaag

SEQ ID NO: 766129 - DNA, 25 bp, Mus musculus
tactacctcccattcgatttgtaag

SEQ ID NO: 766130 - DNA, 25 bp, Mus musculus
tactacctgagtctttttaatccct

SEQ ID NO: 766131 - DNA, 25 bp, Mus musculus
tactacctgagtgtttttaatccct

SEQ ID NO: 766132 - DNA, 25 bp, Mus musculus
tactaccttataccacaaaaattcg

SEQ ID NO: 766133 - DNA, 25 bp, Mus musculus
tactaccttatagcacaaaaattcg

SEQ ID NO: 766134 - DNA, 25 bp, Mus musculus
tactacctttcaccattatcccaaa

SEQ ID NO: 766135 - DNA, 25 bp, Mus musculus
tactacctttcagcattatcccaaa

SEQ ID NO: 766136 - DNA, 25 bp, Mus musculus
tactacgaagacaacaagcaatttt

SEQ ID NO: 766137 - DNA, 25 bp, Mus musculus
tactacgaagactacaagcaatttt

SEQ ID NO: 766138 - DNA, 25 bp, Mus musculus
tactacgaggtaattctgggcataa

SEQ ID NO: 766139 - DNA, 25 bp, Mus musculus
tactacgaggtatttctgggcataa

SEQ ID NO: 766140 - DNA, 25 bp, Mus musculus
tactacgatgtgaggcgggcgaatg

SEQ ID NO: 766141 - DNA, 25 bp, Mus musculus
tactacgatgtgtggcgggcgaatg

SEQ ID NO: 766142 - DNA, 25 bp, Mus musculus
tactacgccaagcacaagacgtgct

SEQ ID NO: 766143 - DNA, 25 bp, Mus musculus
tactacgccaaggacaagacgtgct

SEQ ID NO: 766144 - DNA, 25 bp, Mus musculus
tactacggaaacacctgtggaggct

SEQ ID NO: 766145 - DNA, 25 bp, Mus musculus
tactacggaaactcctgtggaggct

SEQ ID NO: 766146 - DNA, 25 bp, Mus musculus
tactacggacggagggtttatgaca

SEQ ID NO: 766147 - DNA, 25 bp, Mus musculus
tactacggacggtgggtttatgaca

SEQ ID NO: 766148 - DNA, 25 bp, Mus musculus
tactacggaggaaattatggaggcc

SEQ ID NO: 766149 - DNA, 25 bp, Mus musculus
tactacggaggatattatggaggcc

SEQ ID NO: 766150 - DNA, 25 bp, Mus musculus
tactacggcatgagggagatgaatt

SEQ ID NO: 766151 - DNA, 25 bp, Mus musculus
tactacggcatgtgggagatgaatt

SEQ ID NO: 766152 - DNA, 25 bp, Mus musculus
tactacggttgccttactgtttaca

SEQ ID NO: 766153 - DNA, 25 bp, Mus musculus
tactacggttgcgttactgtttaca

SEQ ID NO: 766154 - DNA, 25 bp, Mus musculus
tactacgtgtatacatgctcttgga

SEQ ID NO: 766155 - DNA, 25 bp, Mus musculus
tactacgtgtattcatgctcttgga

SEQ ID NO: 766156 - DNA, 25 bp, Mus musculus
tactacgttctaaactacccacttc

SEQ ID NO: 766157 - DNA, 25 bp, Mus musculus
tactacgttctatactacccacttc

SEQ ID NO: 766158 - DNA, 25 bp, Mus musculus
tactactacatcaactggtacctct

SEQ ID NO: 766159 - DNA, 25 bp, Mus musculus
tactactacatctactggtacctct

SEQ ID NO: 766160 - DNA, 25 bp, Mus musculus
tactactatactacagtttgtccag

SEQ ID NO: 766161 - DNA, 25 bp, Mus musculus
tactactatacttcagtttgtccag

SEQ ID NO: 766162 - DNA, 25 bp, Mus musculus
tactactcgaggcacggaggactga

SEQ ID NO: 766163 - DNA, 25 bp, Mus musculus
tactactcgagggacggaggactga

SEQ ID NO: 766164 - DNA, 25 bp, Mus musculus
tactactgacgcaagcaccttagtg

SEQ ID NO: 766165 - DNA, 25 bp, Mus musculus
tactactgacgctagcaccttagtg

SEQ ID NO: 766166 - DNA, 25 bp, Mus musculus
tactactgccgtctgggactggaaa

SEQ ID NO: 766167 - DNA, 25 bp, Mus musculus
tactactgccgtgtgggactggaaa

SEQ ID NO: 766168 - DNA, 25 bp, Mus musculus
tactactgctaacagaggcccaaag

SEQ ID NO: 766169 - DNA, 25 bp, Mus musculus
tactactgctaagagaggcccaaag

SEQ ID NO: 766170 - DNA, 25 bp, Mus musculus
tactactgctagacgttccaacact

SEQ ID NO: 766171 - DNA, 25 bp, Mus musculus
tactactgctagtcgttccaacact

SEQ ID NO: 766172 - DNA, 25 bp, Mus musculus
tactactggcacctgtgacttgcaa

SEQ ID NO: 766173 - DNA, 25 bp, Mus musculus
tactactggcacgtgtgacttgcaa

SEQ ID NO: 766174 - DNA, 25 bp, Mus musculus
tactactgggctattcaacttgcca

SEQ ID NO: 766175 - DNA, 25 bp, Mus musculus
tactactgggcttttcaacttgcca

SEQ ID NO: 766176 - DNA, 25 bp, Mus musculus
tactactggtcaccctgttctctag

SEQ ID NO: 766177 - DNA, 25 bp, Mus musculus
tactactggtcagcctgttctctag

SEQ ID NO: 766178 - DNA, 25 bp, Mus musculus
tactactgtcagagtctcttacagt

SEQ ID NO: 766179 - DNA, 25 bp, Mus musculus
tactactgtcagtgtctcttacagt

SEQ ID NO: 766180 - DNA, 25 bp, Mus musculus
tactactgtcatctggtaacgtttc

SEQ ID NO: 766181 - DNA, 25 bp, Mus musculus
tactactgtcatgtggtaacgtttc

SEQ ID NO: 766182 - DNA, 25 bp, Mus musculus
tactacttaggacctctagccttcc

SEQ ID NO: 766183 - DNA, 25 bp, Mus musculus
tactacttaggagctctagccttcc

SEQ ID NO: 766184 - DNA, 25 bp, Mus musculus
tactacttcacaaatgacccacgga

SEQ ID NO: 766185 - DNA, 25 bp, Mus musculus
tactacttcacatatgacccacgga

SEQ ID NO: 766186 - DNA, 25 bp, Mus musculus
tactacttcatgacccctatgctta

SEQ ID NO: 766187 - DNA, 25 bp, Mus musculus
tactacttcatgtcccctatgctta

SEQ ID NO: 766188 - DNA, 25 bp, Mus musculus
tactacttcgtcaactacacatcgc

SEQ ID NO: 766189 - DNA, 25 bp, Mus musculus
tactacttcgtctactacacatcgc

SEQ ID NO: 766190 - DNA, 25 bp, Mus musculus
tactacttctagaccatgtgcagtg

SEQ ID NO: 766191 - DNA, 25 bp, Mus musculus
tactacttctagtccatgtgcagtg

SEQ ID NO: 766192 - DNA, 25 bp, Mus musculus
tactacttctctcatcactacttat

SEQ ID NO: 766193 - DNA, 25 bp, Mus musculus
tactacttctctgatcactacttat

SEQ ID NO: 766194 - DNA, 25 bp, Mus musculus
tactactttagtctggtgccttttc

SEQ ID NO: 766195 - DNA, 25 bp, Mus musculus
tactactttagtgtggtgccttttc

SEQ ID NO: 766196 - DNA, 25 bp, Mus musculus
tactagaaaatgcaggcagtgtttt

SEQ ID NO: 766197 - DNA, 25 bp, Mus musculus
tactagaaaatggaggcagtgtttt

SEQ ID NO: 766198 - DNA, 25 bp, Mus musculus
tactagacacatcttggaggtagat

SEQ ID NO: 766199 - DNA, 25 bp, Mus musculus
tactagacacatgttggaggtagat

SEQ ID NO: 766200 - DNA, 25 bp, Mus musculus
tactagacacggactgactcagatt

SEQ ID NO: 766201 - DNA, 25 bp, Mus musculus
tactagacacggtctgactcagatt

SEQ ID NO: 766202 - DNA, 25 bp, Mus musculus
tactagacagttatataagcatatt

SEQ ID NO: 766203 - DNA, 25 bp, Mus musculus
tactagacagttatcagctcacagg

SEQ ID NO: 766204 - DNA, 25 bp, Mus musculus
tactagacagttttataagcatatt

SEQ ID NO: 766205 - DNA, 25 bp, Mus musculus
tactagacagttttcagctcacagg

SEQ ID NO: 766206 - DNA, 25 bp, Mus musculus
tactagaccgtcactgcacaaaagt

SEQ ID NO: 766207 - DNA, 25 bp, Mus musculus
tactagaccgtctctgcacaaaagt

SEQ ID NO: 766208 - DNA, 25 bp, Mus musculus
tactagacggcgagtcccagtttac

SEQ ID NO: 766209 - DNA, 25 bp, Mus musculus
tactagacggcgtgtcccagtttac

SEQ ID NO: 766210 - DNA, 25 bp, Mus musculus
tactagactagacgctgctgtccgt

SEQ ID NO: 766211 - DNA, 25 bp, Mus musculus
tactagactagaggctgctgtccgt

SEQ ID NO: 766212 - DNA, 25 bp, Mus musculus
tactagactgggacttcctggtttt

SEQ ID NO: 766213 - DNA, 25 bp, Mus musculus
tactagactgggtcttcctggtttt

SEQ ID NO: 766214 - DNA, 25 bp, Mus musculus
tactagagactcaagctcacggctt

SEQ ID NO: 766215 - DNA, 25 bp, Mus musculus
tactagagactctagctcacggctt

SEQ ID NO: 766216 - DNA, 25 bp, Mus musculus
tactagaggagcattgtcggaggaa

SEQ ID NO: 766217 - DNA, 25 bp, Mus musculus
tactagaggagctttgtcggaggaa

SEQ ID NO: 766218 - DNA, 25 bp, Mus musculus
tactagaggatgatcgtgcaagctg

SEQ ID NO: 766219 - DNA, 25 bp, Mus musculus
tactagaggatgttcgtgcaagctg

SEQ ID NO: 766220 - DNA, 25 bp, Mus musculus
tactagaggtatcccatatggttgg

SEQ ID NO: 766221 - DNA, 25 bp, Mus musculus
tactagaggtatctgtcggtttgca

SEQ ID NO: 766222 - DNA, 25 bp, Mus musculus
tactagaggtatgccatatggttgg

SEQ ID NO: 766223 - DNA, 25 bp, Mus musculus
tactagaggtatgtgtcggtttgca

SEQ ID NO: 766224 - DNA, 25 bp, Mus musculus
tactagatagaaaggaacacatttc

SEQ ID NO: 766225 - DNA, 25 bp, Mus musculus
tactagatagaatggaacacatttc

SEQ ID NO: 766226 - DNA, 25 bp, Mus musculus
tactagattaggaacctttttgttg

SEQ ID NO: 766227 - DNA, 25 bp, Mus musculus
tactagattaggtacctttttgttg

SEQ ID NO: 766228 - DNA, 25 bp, Mus musculus
tactagcacatacgctttagggaaa

SEQ ID NO: 766229 - DNA, 25 bp, Mus musculus
tactagcacataggctttagggaaa

SEQ ID NO: 766230 - DNA, 25 bp, Mus musculus
tactagcacattctcttgcaacact

SEQ ID NO: 766231 - DNA, 25 bp, Mus musculus
tactagcacattgtcttgcaacact

SEQ ID NO: 766232 - DNA, 25 bp, Mus musculus
tactagcatagtcgctctcaaccct

SEQ ID NO: 766233 - DNA, 25 bp, Mus musculus
tactagcatagtggctctcaaccct

SEQ ID NO: 766234 - DNA, 25 bp, Mus musculus
tactagcatttcctcggtgccagtc

SEQ ID NO: 766235 - DNA, 25 bp, Mus musculus
tactagcatttcgtcggtgccagtc

SEQ ID NO: 766236 - DNA, 25 bp, Mus musculus
tactagcatttgatgtagaccagga

SEQ ID NO: 766237 - DNA, 25 bp, Mus musculus
tactagcatttgttgtagaccagga

SEQ ID NO: 766238 - DNA, 25 bp, Mus musculus
tactagccacgaccaggtttttgaa

SEQ ID NO: 766239 - DNA, 25 bp, Mus musculus
tactagccacgagcaggtttttgaa

SEQ ID NO: 766240 - DNA, 25 bp, Mus musculus
tactagcccttcacagtttagcctt

SEQ ID NO: 766241 - DNA, 25 bp, Mus musculus
tactagcccttctcagtttagcctt

SEQ ID NO: 766242 - DNA, 25 bp, Mus musculus
tactagccgttccttattctatgcc

SEQ ID NO: 766243 - DNA, 25 bp, Mus musculus
tactagccgttcgttattctatgcc

SEQ ID NO: 766244 - DNA, 25 bp, Mus musculus
tactagcctctgattgacttcctat

SEQ ID NO: 766245 - DNA, 25 bp, Mus musculus
tactagcctctgtttgacttcctat

SEQ ID NO: 766246 - DNA, 25 bp, Mus musculus
tactagcgacctactgtgagacatt

SEQ ID NO: 766247 - DNA, 25 bp, Mus musculus
tactagcgaccttctgtgagacatt

SEQ ID NO: 766248 - DNA, 25 bp, Mus musculus
tactagcggaagattgtctccctcc

SEQ ID NO: 766249 - DNA, 25 bp, Mus musculus
tactagcggaagtttgtctccctcc

SEQ ID NO: 766250 - DNA, 25 bp, Mus musculus
tactagctacctcaggtgtccactg

SEQ ID NO: 766251 - DNA, 25 bp, Mus musculus
tactagctacctgaggtgtccactg

SEQ ID NO: 766252 - DNA, 25 bp, Mus musculus
tactagctagctacctttaaaggga

SEQ ID NO: 766253 - DNA, 25 bp, Mus musculus
tactagctagcttcctttaaaggga

SEQ ID NO: 766254 - DNA, 25 bp, Mus musculus
tactagctagtgattggaagataat

SEQ ID NO: 766255 - DNA, 25 bp, Mus musculus
tactagctagtgtttggaagataat

SEQ ID NO: 766256 - DNA, 25 bp, Mus musculus
tactagctccaactctacttcggaa

SEQ ID NO: 766257 - DNA, 25 bp, Mus musculus
tactagctccaagtctacttcggaa

SEQ ID NO: 766258 - DNA, 25 bp, Mus musculus
tactagctccttcagaaatgcattc

SEQ ID NO: 766259 - DNA, 25 bp, Mus musculus
tactagctccttgagaaatgcattc

SEQ ID NO: 766260 - DNA, 25 bp, Mus musculus
tactagctcgggagtctgccatttt

SEQ ID NO: 766261 - DNA, 25 bp, Mus musculus
tactagctcgggtgtctgccatttt

SEQ ID NO: 766262 - DNA, 25 bp, Mus musculus
tactagctgctcaagccacacaaga

SEQ ID NO: 766263 - DNA, 25 bp, Mus musculus
tactagctgctctagccacacaaga

SEQ ID NO: 766264 - DNA, 25 bp, Mus musculus
tactagctggtcactagggctgact

SEQ ID NO: 766265 - DNA, 25 bp, Mus musculus
tactagctggtctctagggctgact

SEQ ID NO: 766266 - DNA, 25 bp, Mus musculus
tactagctgtgacctcttggctata

SEQ ID NO: 766267 - DNA, 25 bp, Mus musculus
tactagctgtgagctcttggctata

SEQ ID NO: 766268 - DNA, 25 bp, Mus musculus
tactagctttcaattacactttact

SEQ ID NO: 766269 - DNA, 25 bp, Mus musculus
tactagctttcatttacactttact

SEQ ID NO: 766270 - DNA, 25 bp, Mus musculus
tactagctttgcattcttgtagaac

SEQ ID NO: 766271 - DNA, 25 bp, Mus musculus
tactagctttgctttcttgtagaac

SEQ ID NO: 766272 - DNA, 25 bp, Mus musculus
tactaggaagttatccactcctcac

SEQ ID NO: 766273 - DNA, 25 bp, Mus musculus
tactaggaagttttccactcctcac

SEQ ID NO: 766274 - DNA, 25 bp, Mus musculus
tactaggaccacaagggaccaaggg

SEQ ID NO: 766275 - DNA, 25 bp, Mus musculus
tactaggaccactagggaccaaggg

SEQ ID NO: 766276 - DNA, 25 bp, Mus musculus
tactaggaccctatggctttgccaa

SEQ ID NO: 766277 - DNA, 25 bp, Mus musculus
tactaggaccctttggctttgccaa

SEQ ID NO: 766278 - DNA, 25 bp, Mus musculus
tactaggacgatattcccagcaagc

SEQ ID NO: 766279 - DNA, 25 bp, Mus musculus
tactaggacgattttcccagcaagc

SEQ ID NO: 766280 - DNA, 25 bp, Mus musculus
tactaggactgcaatattcaggaat

SEQ ID NO: 766281 - DNA, 25 bp, Mus musculus
tactaggactgctatattcaggaat

SEQ ID NO: 766282 - DNA, 25 bp, Mus musculus
tactaggagtgcagagctctggctg

SEQ ID NO: 766283 - DNA, 25 bp, Mus musculus
tactaggagtgctgagctctggctg

SEQ ID NO: 766284 - DNA, 25 bp, Mus musculus
tactaggatttaaggcaagcatcac

SEQ ID NO: 766285 - DNA, 25 bp, Mus musculus
tactaggatttatggcaagcatcac

SEQ ID NO: 766286 - DNA, 25 bp, Mus musculus
tactaggcaaccattacatgtttac

SEQ ID NO: 766287 - DNA, 25 bp, Mus musculus
tactaggcaacctttacatgtttac

SEQ ID NO: 766288 - DNA, 25 bp, Mus musculus
tactagggatgcatctgttctggtt

SEQ ID NO: 766289 - DNA, 25 bp, Mus musculus
tactagggatgcttctgttctggtt

SEQ ID NO: 766290 - DNA, 25 bp, Mus musculus
tactaggtactgacccaagggctct

SEQ ID NO: 766291 - DNA, 25 bp, Mus musculus
tactaggtactgtcccaagggctct

SEQ ID NO: 766292 - DNA, 25 bp, Mus musculus
tactaggtcagccacttagcatttc

SEQ ID NO: 766293 - DNA, 25 bp, Mus musculus
tactaggtcagcgacttagcatttc

SEQ ID NO: 766294 - DNA, 25 bp, Mus musculus
tactaggtccatcaacttcccattc

SEQ ID NO: 766295 - DNA, 25 bp, Mus musculus
tactaggtccatgaacttcccattc

SEQ ID NO: 766296 - DNA, 25 bp, Mus musculus
tactaggttaccagtgaccgtggcc

SEQ ID NO: 766297 - DNA, 25 bp, Mus musculus
tactaggttacctgtgaccgtggcc

SEQ ID NO: 766298 - DNA, 25 bp, Mus musculus
tactaggtttctcaccgtatcttgt

SEQ ID NO: 766299 - DNA, 25 bp, Mus musculus
tactaggtttctgaccgtatcttgt

SEQ ID NO: 766300 - DNA, 25 bp, Mus musculus
tactagtaacagcagactgcagcag

SEQ ID NO: 766301 - DNA, 25 bp, Mus musculus
tactagtaacaggagactgcagcag

SEQ ID NO: 766302 - DNA, 25 bp, Mus musculus
tactagtaccgtagggctggaccac

SEQ ID NO: 766303 - DNA, 25 bp, Mus musculus
tactagtaccgttgggctggaccac

SEQ ID NO: 766304 - DNA, 25 bp, Mus musculus
tactagtgttaaccatgatgcgaag

SEQ ID NO: 766305 - DNA, 25 bp, Mus musculus
tactagtgttaagcatgatgcgaag

SEQ ID NO: 766306 - DNA, 25 bp, Mus musculus
tactagttgactaggagtatgccat

SEQ ID NO: 766307 - DNA, 25 bp, Mus musculus
tactagttgacttggagtatgccat

SEQ ID NO: 766308 - DNA, 25 bp, Mus musculus
tactagttggcacgctttaatagat

SEQ ID NO: 766309 - DNA, 25 bp, Mus musculus
tactagttggcaggctttaatagat

SEQ ID NO: 766310 - DNA, 25 bp, Mus musculus
tactataacttaagccttcctcaac

SEQ ID NO: 766311 - DNA, 25 bp, Mus musculus
tactataacttatgccttcctcaac

SEQ ID NO: 766312 - DNA, 25 bp, Mus musculus
tactatacaaggctgctggtgcaga

SEQ ID NO: 766313 - DNA, 25 bp, Mus musculus
tactatacaagggtgctggtgcaga

SEQ ID NO: 766314 - DNA, 25 bp, Mus musculus
tactatacagtacattcagaccaca

SEQ ID NO: 766315 - DNA, 25 bp, Mus musculus
tactatacagtagattcagaccaca

SEQ ID NO: 766316 - DNA, 25 bp, Mus musculus
tactatacatgccagaagctattct

SEQ ID NO: 766317 - DNA, 25 bp, Mus musculus
tactatacatgcgagaagctattct

SEQ ID NO: 766318 - DNA, 25 bp, Mus musculus
tactatactctaatccaggcaacaa

SEQ ID NO: 766319 - DNA, 25 bp, Mus musculus
tactatactctattccaggcaacaa

SEQ ID NO: 766320 - DNA, 25 bp, Mus musculus
tactatactgctcacttgaaggaca

SEQ ID NO: 766321 - DNA, 25 bp, Mus musculus
tactatactgctgacttgaaggaca

SEQ ID NO: 766322 - DNA, 25 bp, Mus musculus
tactatacttaaattatgctctatg

SEQ ID NO: 766323 - DNA, 25 bp, Mus musculus
tactatacttaatttatgctctatg

SEQ ID NO: 766324 - DNA, 25 bp, Mus musculus
tactatacttggcaggtagaggcag

SEQ ID NO: 766325 - DNA, 25 bp, Mus musculus
tactatacttgggaggtagaggcag

SEQ ID NO: 766326 - DNA, 25 bp, Mus musculus
tactatagagccaaatctccagtaa

SEQ ID NO: 766327 - DNA, 25 bp, Mus musculus
tactatagagcctaatctccagtaa

SEQ ID NO: 766328 - DNA, 25 bp, Mus musculus
tactatagggtcaagttgtccccat

SEQ ID NO: 766329 - DNA, 25 bp, Mus musculus
tactatagggtctagttgtccccat

SEQ ID NO: 766330 - DNA, 25 bp, Mus musculus
tactatagtttgcattactacccag

SEQ ID NO: 766331 - DNA, 25 bp, Mus musculus
tactatagtttggattactacccag

SEQ ID NO: 766332 - DNA, 25 bp, Mus musculus
tactatagttttcccggtattgtag

SEQ ID NO: 766333 - DNA, 25 bp, Mus musculus
tactatagttttgccggtattgtag

SEQ ID NO: 766334 - DNA, 25 bp, Mus musculus
tactatatagatcaggccggtccca

SEQ ID NO: 766335 - DNA, 25 bp, Mus musculus
tactatatagatgaggccggtccca

SEQ ID NO: 766336 - DNA, 25 bp, Mus musculus
tactatatcaacaagatgacacact

SEQ ID NO: 766337 - DNA, 25 bp, Mus musculus
tactatatcaactagatgacacact

SEQ ID NO: 766338 - DNA, 25 bp, Mus musculus
tactatatgtaccttctctgtcaaa

SEQ ID NO: 766339 - DNA, 25 bp, Mus musculus
tactatatgtacgttctctgtcaaa

SEQ ID NO: 766340 - DNA, 25 bp, Mus musculus
tactatatgtggaccttcaagttat

SEQ ID NO: 766341 - DNA, 25 bp, Mus musculus
tactatatgtggtccttcaagttat

SEQ ID NO: 766342 - DNA, 25 bp, Mus musculus
tactatattgccatgtgttgtgata

SEQ ID NO: 766343 - DNA, 25 bp, Mus musculus
tactatattgccttgtgttgtgata

SEQ ID NO: 766344 - DNA, 25 bp, Mus musculus
tactatcaagacactcgaagaggct

SEQ ID NO: 766345 - DNA, 25 bp, Mus musculus
tactatcaagactctcgaagaggct

SEQ ID NO: 766346 - DNA, 25 bp, Mus musculus
tactatcaatccacctatgcagaat

SEQ ID NO: 766347 - DNA, 25 bp, Mus musculus
tactatcaatcctcctatgcagaat

SEQ ID NO: 766348 - DNA, 25 bp, Mus musculus
tactatcacaaaacaccactcctgg

SEQ ID NO: 766349 - DNA, 25 bp, Mus musculus
tactatcacaaatcaccactcctgg

SEQ ID NO: 766350 - DNA, 25 bp, Mus musculus
tactatcactgcagatcttaaaagg

SEQ ID NO: 766351 - DNA, 25 bp, Mus musculus
tactatcactgctgatcttaaaagg

SEQ ID NO: 766352 - DNA, 25 bp, Mus musculus
tactatccagggaggtgcctgagct

SEQ ID NO: 766353 - DNA, 25 bp, Mus musculus
tactatccagggtggtgcctgagct

SEQ ID NO: 766354 - DNA, 25 bp, Mus musculus
tactatcccgggatatcccaacact

SEQ ID NO: 766355 - DNA, 25 bp, Mus musculus
tactatcccgggttatcccaacact

SEQ ID NO: 766356 - DNA, 25 bp, Mus musculus
tactatccgatgatgcagcctctaa

SEQ ID NO: 766357 - DNA, 25 bp, Mus musculus
tactatccgatgttgcagcctctaa

SEQ ID NO: 766358 - DNA, 25 bp, Mus musculus
tactatcgagcccttctttatttgc

SEQ ID NO: 766359 - DNA, 25 bp, Mus musculus
tactatcgagccgttctttatttgc

SEQ ID NO: 766360 - DNA, 25 bp, Mus musculus
tactatcgcaatcgctccgcagagc

SEQ ID NO: 766361 - DNA, 25 bp, Mus musculus
tactatcgcaatggctccgcagagc

SEQ ID NO: 766362 - DNA, 25 bp, Mus musculus
tactatctaggtaaacagaccagga

SEQ ID NO: 766363 - DNA, 25 bp, Mus musculus
tactatctaggttaacagaccagga

SEQ ID NO: 766364 - DNA, 25 bp, Mus musculus
tactatctagtcaacttgctttgtg

SEQ ID NO: 766365 - DNA, 25 bp, Mus musculus
tactatctagtctacttgctttgtg

SEQ ID NO: 766366 - DNA, 25 bp, Mus musculus
tactatctcctacgaccatccaagg

SEQ ID NO: 766367 - DNA, 25 bp, Mus musculus
tactatctcctaggaccatccaagg

SEQ ID NO: 766368 - DNA, 25 bp, Mus musculus
tactatctccttagaatgctaccta

SEQ ID NO: 766369 - DNA, 25 bp, Mus musculus
tactatctcctttgaatgctaccta

SEQ ID NO: 766370 - DNA, 25 bp, Mus musculus
tactatctcgctctattgcttataa

SEQ ID NO: 766371 - DNA, 25 bp, Mus musculus
tactatctcgctgtattgcttataa

SEQ ID NO: 766372 - DNA, 25 bp, Mus musculus
tactatctggagattcctcgagctt

SEQ ID NO: 766373 - DNA, 25 bp, Mus musculus
tactatctggagtttcctcgagctt

SEQ ID NO: 766374 - DNA, 25 bp, Mus musculus
tactatctggctccaccccgaggag

SEQ ID NO: 766375 - DNA, 25 bp, Mus musculus
tactatctggctgcaccccgaggag

SEQ ID NO: 766376 - DNA, 25 bp, Mus musculus
tactatcttctacagtgacatcatg

SEQ ID NO: 766377 - DNA, 25 bp, Mus musculus
tactatcttctagagtgacatcatg

SEQ ID NO: 766378 - DNA, 25 bp, Mus musculus
tactatcttgaaaacaggactgaac

SEQ ID NO: 766379 - DNA, 25 bp, Mus musculus
tactatcttgaatacaggactgaac

SEQ ID NO: 766380 - DNA, 25 bp, Mus musculus
tactatgacaagacacattgggcca

SEQ ID NO: 766381 - DNA, 25 bp, Mus musculus
tactatgacaagtcacattgggcca

SEQ ID NO: 766382 - DNA, 25 bp, Mus musculus
tactatgacggactcatggcctttg

SEQ ID NO: 766383 - DNA, 25 bp, Mus musculus
tactatgacggagtcatggcctttg

SEQ ID NO: 766384 - DNA, 25 bp, Mus musculus
tactatgactccctttcctaggaag

SEQ ID NO: 766385 - DNA, 25 bp, Mus musculus
tactatgactccgtttcctaggaag

SEQ ID NO: 766386 - DNA, 25 bp, Mus musculus
tactatgatacgaagcccggtcttt

SEQ ID NO: 766387 - DNA, 25 bp, Mus musculus
tactatgatacgtagcccggtcttt

SEQ ID NO: 766388 - DNA, 25 bp, Mus musculus
tactatgatcttagtgtgtatcaca

SEQ ID NO: 766389 - DNA, 25 bp, Mus musculus
tactatgatctttgtgtgtatcaca

SEQ ID NO: 766390 - DNA, 25 bp, Mus musculus
tactatgattgaccacggtgacacg

SEQ ID NO: 766391 - DNA, 25 bp, Mus musculus
tactatgattgagcacggtgacacg

SEQ ID NO: 766392 - DNA, 25 bp, Mus musculus
tactatgcccgactgagaagacagc

SEQ ID NO: 766393 - DNA, 25 bp, Mus musculus
tactatgcccgagtgagaagacagc

SEQ ID NO: 766394 - DNA, 25 bp, Mus musculus
tactatgccctaatatcacagtccc

SEQ ID NO: 766395 - DNA, 25 bp, Mus musculus
tactatgccctattatcacagtccc

SEQ ID NO: 766396 - DNA, 25 bp, Mus musculus
tactatgcctcaagttgcctacctt

SEQ ID NO: 766397 - DNA, 25 bp, Mus musculus
tactatgcctcatgttgcctacctt

SEQ ID NO: 766398 - DNA, 25 bp, Mus musculus
tactatgctacgctgttaacatctg

SEQ ID NO: 766399 - DNA, 25 bp, Mus musculus
tactatgctacggtgttaacatctg

SEQ ID NO: 766400 - DNA, 25 bp, Mus musculus
tactatgctctgaattagagttgga

SEQ ID NO: 766401 - DNA, 25 bp, Mus musculus
tactatgctctgtattagagttgga

SEQ ID NO: 766402 - DNA, 25 bp, Mus musculus
tactatgctgcactaagctggtagc

SEQ ID NO: 766403 - DNA, 25 bp, Mus musculus
tactatgctgcagtaagctggtagc

SEQ ID NO: 766404 - DNA, 25 bp, Mus musculus
tactatgctggccaagtacgcacct

SEQ ID NO: 766405 - DNA, 25 bp, Mus musculus
tactatgctggcgaagtacgcacct

SEQ ID NO: 766406 - DNA, 25 bp, Mus musculus
tactatggacccctcaattggatca

SEQ ID NO: 766407 - DNA, 25 bp, Mus musculus
tactatggacccgtcaattggatca

SEQ ID NO: 766408 - DNA, 25 bp, Mus musculus
tactatggactaaggctactactga

SEQ ID NO: 766409 - DNA, 25 bp, Mus musculus
tactatggactatggctactactga

SEQ ID NO: 766410 - DNA, 25 bp, Mus musculus
tactatggagccctggaagccagct

SEQ ID NO: 766411 - DNA, 25 bp, Mus musculus
tactatggagccgtggaagccagct

SEQ ID NO: 766412 - DNA, 25 bp, Mus musculus
tactatggagcgctcaatgtcagta

SEQ ID NO: 766413 - DNA, 25 bp, Mus musculus
tactatggagcggtcaatgtcagta

SEQ ID NO: 766414 - DNA, 25 bp, Mus musculus
tactatggagctccacttttggctc

SEQ ID NO: 766415 - DNA, 25 bp, Mus musculus
tactatggagctgcacttttggctc

SEQ ID NO: 766416 - DNA, 25 bp, Mus musculus
tactatggcatgatcactggtcctc

SEQ ID NO: 766417 - DNA, 25 bp, Mus musculus
tactatggcatgttcactggtcctc

SEQ ID NO: 766418 - DNA, 25 bp, Mus musculus
tactatggcttaatcccctgaccag

SEQ ID NO: 766419 - DNA, 25 bp, Mus musculus
tactatggcttattcccctgaccag

SEQ ID NO: 766420 - DNA, 25 bp, Mus musculus
tactatgggccacgaggatcccctg

SEQ ID NO: 766421 - DNA, 25 bp, Mus musculus
tactatgggccaggaggatcccctg

SEQ ID NO: 766422 - DNA, 25 bp, Mus musculus
tactatggtcacactgcttactggg

SEQ ID NO: 766423 - DNA, 25 bp, Mus musculus
tactatggtcactctgcttactggg

SEQ ID NO: 766424 - DNA, 25 bp, Mus musculus
tactatggtcagagttctggcctaa

SEQ ID NO: 766425 - DNA, 25 bp, Mus musculus
tactatggtcagtgttctggcctaa

SEQ ID NO: 766426 - DNA, 25 bp, Mus musculus
tactatgtaataaccgcctccagca

SEQ ID NO: 766427 - DNA, 25 bp, Mus musculus
tactatgtaatatccgcctccagca

SEQ ID NO: 766428 - DNA, 25 bp, Mus musculus
tactatgtcaaacgtactatgtctt

SEQ ID NO: 766429 - DNA, 25 bp, Mus musculus
tactatgtcaaaggtactatgtctt

SEQ ID NO: 766430 - DNA, 25 bp, Mus musculus
tactatgtgcatagaactgctggaa

SEQ ID NO: 766431 - DNA, 25 bp, Mus musculus
tactatgtgcatcgcctctcacgct

SEQ ID NO: 766432 - DNA, 25 bp, Mus musculus
tactatgtgcatggcctctcacgct

SEQ ID NO: 766433 - DNA, 25 bp, Mus musculus
tactatgtgcattgaactgctggaa

SEQ ID NO: 766434 - DNA, 25 bp, Mus musculus
tactatgtgctaagttccttctgag

SEQ ID NO: 766435 - DNA, 25 bp, Mus musculus
tactatgtgctactttctttgggaa

SEQ ID NO: 766436 - DNA, 25 bp, Mus musculus
tactatgtgctagtttctttgggaa

SEQ ID NO: 766437 - DNA, 25 bp, Mus musculus
tactatgtgctatgttccttctgag

SEQ ID NO: 766438 - DNA, 25 bp, Mus musculus
tactatgtgtcactggagatcccca

SEQ ID NO: 766439 - DNA, 25 bp, Mus musculus
tactatgtgtcagtggagatcccca

SEQ ID NO: 766440 - DNA, 25 bp, Mus musculus
tactatgttagtactgtcgagctag

SEQ ID NO: 766441 - DNA, 25 bp, Mus musculus
tactatgttagttctgtcgagctag

SEQ ID NO: 766442 - DNA, 25 bp, Mus musculus
tactattaccccagcagagaacatg

SEQ ID NO: 766443 - DNA, 25 bp, Mus musculus
tactattacccctgcagagaacatg

SEQ ID NO: 766444 - DNA, 25 bp, Mus musculus
tactattatgtgctagctttctaat

SEQ ID NO: 766445 - DNA, 25 bp, Mus musculus
tactattatgtggtagctttctaat

SEQ ID NO: 766446 - DNA, 25 bp, Mus musculus
tactattcattcatttgcatcccct

SEQ ID NO: 766447 - DNA, 25 bp, Mus musculus
tactattcattcttttgcatcccct

SEQ ID NO: 766448 - DNA, 25 bp, Mus musculus
tactattcccttctgttagaagatt

SEQ ID NO: 766449 - DNA, 25 bp, Mus musculus
tactattcccttgtgttagaagatt

SEQ ID NO: 766450 - DNA, 25 bp, Mus musculus
tactattctcccatattgccaaaat

SEQ ID NO: 766451 - DNA, 25 bp, Mus musculus
tactattctcccttattgccaaaat

SEQ ID NO: 766452 - DNA, 25 bp, Mus musculus
tactattcttcccagtagggcgttt

SEQ ID NO: 766453 - DNA, 25 bp, Mus musculus
tactattcttccgagtagggcgttt

SEQ ID NO: 766454 - DNA, 25 bp, Mus musculus
tactattgaactcctgacctctggc

SEQ ID NO: 766455 - DNA, 25 bp, Mus musculus
tactattgaactgctgacctctggc

SEQ ID NO: 766456 - DNA, 25 bp, Mus musculus
tactattgatttatgtcttcagttg

SEQ ID NO: 766457 - DNA, 25 bp, Mus musculus
tactattgatttttgtcttcagttg

SEQ ID NO: 766458 - DNA, 25 bp, Mus musculus
tactattgctccaacctctttgaag

SEQ ID NO: 766459 - DNA, 25 bp, Mus musculus
tactattgctcctacctctttgaag

SEQ ID NO: 766460 - DNA, 25 bp, Mus musculus
tactattggtgcatattttccccgc

SEQ ID NO: 766461 - DNA, 25 bp, Mus musculus
tactattggtgcttattttccccgc

SEQ ID NO: 766462 - DNA, 25 bp, Mus musculus
tactattgtctcacctgatgctggt

SEQ ID NO: 766463 - DNA, 25 bp, Mus musculus
tactattgtctctcctgatgctggt

SEQ ID NO: 766464 - DNA, 25 bp, Mus musculus
tactatttcagtaacctgcctccta

SEQ ID NO: 766465 - DNA, 25 bp, Mus musculus
tactatttcagttacctgcctccta

SEQ ID NO: 766466 - DNA, 25 bp, Mus musculus
tactatttccttaactgatttcacc

SEQ ID NO: 766467 - DNA, 25 bp, Mus musculus
tactatttcctttactgatttcacc

SEQ ID NO: 766468 - DNA, 25 bp, Mus musculus
tactattttatgacacccctccaat

SEQ ID NO: 766469 - DNA, 25 bp, Mus musculus
tactattttatgtcacccctccaat

SEQ ID NO: 766470 - DNA, 25 bp, Mus musculus
tactattttcagacttcccattcac

SEQ ID NO: 766471 - DNA, 25 bp, Mus musculus
tactattttcagtcttcccattcac

SEQ ID NO: 766472 - DNA, 25 bp, Mus musculus
tactattttgtcatgaatggtctca

SEQ ID NO: 766473 - DNA, 25 bp, Mus musculus
tactattttgtcttgaatggtctca

SEQ ID NO: 766474 - DNA, 25 bp, Mus musculus
tactatttttctcatgaccattctg

SEQ ID NO: 766475 - DNA, 25 bp, Mus musculus
tactatttttctgatgaccattctg

SEQ ID NO: 766476 - DNA, 25 bp, Mus musculus
tactcaaaacaccacgtagctctgc

SEQ ID NO: 766477 - DNA, 25 bp, Mus musculus
tactcaaaacacgacgtagctctgc

SEQ ID NO: 766478 - DNA, 25 bp, Mus musculus
tactcaaaacatatctttctctctg

SEQ ID NO: 766479 - DNA, 25 bp, Mus musculus
tactcaaaacatttctttctctctg

SEQ ID NO: 766480 - DNA, 25 bp, Mus musculus
tactcaaaatgtacctgtacccacc

SEQ ID NO: 766481 - DNA, 25 bp, Mus musculus
tactcaaaatgttcctgtacccacc

SEQ ID NO: 766482 - DNA, 25 bp, Mus musculus
tactcaaagcacaacttgcacggtg

SEQ ID NO: 766483 - DNA, 25 bp, Mus musculus
tactcaaagcactacttgcacggtg

SEQ ID NO: 766484 - DNA, 25 bp, Mus musculus
tactcaaagcataggcagcattctg

SEQ ID NO: 766485 - DNA, 25 bp, Mus musculus
tactcaaagcattggcagcattctg

SEQ ID NO: 766486 - DNA, 25 bp, Mus musculus
tactcaaagggaccgtaacggtgaa

SEQ ID NO: 766487 - DNA, 25 bp, Mus musculus
tactcaaagggagcgtaacggtgaa

SEQ ID NO: 766488 - DNA, 25 bp, Mus musculus
tactcaaagtgacaaagcctttcac

SEQ ID NO: 766489 - DNA, 25 bp, Mus musculus
tactcaaagtgagaaagcctttcac

SEQ ID NO: 766490 - DNA, 25 bp, Mus musculus
tactcaaataacctgttccctggcc

SEQ ID NO: 766491 - DNA, 25 bp, Mus musculus
tactcaaataacgtgttccctggcc

SEQ ID NO: 766492 - DNA, 25 bp, Mus musculus
tactcaaatctcctgtcagacgtcg

SEQ ID NO: 766493 - DNA, 25 bp, Mus musculus
tactcaaatctcgtgtcagacgtcg

SEQ ID NO: 766494 - DNA, 25 bp, Mus musculus
tactcaacagacatgcttcctttct

SEQ ID NO: 766495 - DNA, 25 bp, Mus musculus
tactcaacagacttgcttcctttct

SEQ ID NO: 766496 - DNA, 25 bp, Mus musculus
tactcaacctctcggtccacgaagg

SEQ ID NO: 766497 - DNA, 25 bp, Mus musculus
tactcaacctctgggtccacgaagg

SEQ ID NO: 766498 - DNA, 25 bp, Mus musculus
tactcaacgcatatactgttctcct

SEQ ID NO: 766499 - DNA, 25 bp, Mus musculus
tactcaacgcatttactgttctcct

SEQ ID NO: 766500 - DNA, 25 bp, Mus musculus
tactcaactgccaaccttcaaaaag

SEQ ID NO: 766501 - DNA, 25 bp, Mus musculus
tactcaactgcctaccttcaaaaag

SEQ ID NO: 766502 - DNA, 25 bp, Mus musculus
tactcaagaaccacatgagccctgg

SEQ ID NO: 766503 - DNA, 25 bp, Mus musculus
tactcaagaacctcatgagccctgg

SEQ ID NO: 766504 - DNA, 25 bp, Mus musculus
tactcaagagttccagtcctcagca

SEQ ID NO: 766505 - DNA, 25 bp, Mus musculus
tactcaagagttgcagtcctcagca

SEQ ID NO: 766506 - DNA, 25 bp, Mus musculus
tactcaagcacccagtggcgttcta

SEQ ID NO: 766507 - DNA, 25 bp, Mus musculus
tactcaagcaccgagtggcgttcta

SEQ ID NO: 766508 - DNA, 25 bp, Mus musculus
tactcaagttgaaacctctactcga

SEQ ID NO: 766509 - DNA, 25 bp, Mus musculus
tactcaagttgatacctctactcga

SEQ ID NO: 766510 - DNA, 25 bp, Mus musculus
tactcaataaccacacttaagactt

SEQ ID NO: 766511 - DNA, 25 bp, Mus musculus
tactcaataacctcacttaagactt

SEQ ID NO: 766512 - DNA, 25 bp, Mus musculus
tactcaatgatgcatttacctctta

SEQ ID NO: 766513 - DNA, 25 bp, Mus musculus
tactcaatgatggatttacctctta

SEQ ID NO: 766514 - DNA, 25 bp, Mus musculus
tactcaatggacagctaccccttaa

SEQ ID NO: 766515 - DNA, 25 bp, Mus musculus
tactcaatggactgctaccccttaa

SEQ ID NO: 766516 - DNA, 25 bp, Mus musculus
tactcaattactaggaaatcttttc

SEQ ID NO: 766517 - DNA, 25 bp, Mus musculus
tactcaattacttggaaatcttttc

SEQ ID NO: 766518 - DNA, 25 bp, Mus musculus
tactcaattctcctcctaaaactgt

SEQ ID NO: 766519 - DNA, 25 bp, Mus musculus
tactcaattctcgtcctaaaactgt

SEQ ID NO: 766520 - DNA, 25 bp, Mus musculus
tactcacaactgcacgctctgtgca

SEQ ID NO: 766521 - DNA, 25 bp, Mus musculus
tactcacaactggacgctctgtgca

SEQ ID NO: 766522 - DNA, 25 bp, Mus musculus
tactcacaatatcaaaggctaggtt

SEQ ID NO: 766523 - DNA, 25 bp, Mus musculus
tactcacaatatgaaaggctaggtt

SEQ ID NO: 766524 - DNA, 25 bp, Mus musculus
tactcacacgtacatgagacactca

SEQ ID NO: 766525 - DNA, 25 bp, Mus musculus
tactcacacgtagatgagacactca

SEQ ID NO: 766526 - DNA, 25 bp, Mus musculus
tactcacactagctagggctcttgg

SEQ ID NO: 766527 - DNA, 25 bp, Mus musculus
tactcacactaggtagggctcttgg

SEQ ID NO: 766528 - DNA, 25 bp, Mus musculus
tactcacacttcagctgggtcacat

SEQ ID NO: 766529 - DNA, 25 bp, Mus musculus
tactcacacttctgctgggtcacat

SEQ ID NO: 766530 - DNA, 25 bp, Mus musculus
tactcacagagccagaacttcttcg

SEQ ID NO: 766531 - DNA, 25 bp, Mus musculus
tactcacagagcgagaacttcttcg

SEQ ID NO: 766532 - DNA, 25 bp, Mus musculus
tactcacagaggacatttttaccat

SEQ ID NO: 766533 - DNA, 25 bp, Mus musculus
tactcacagaggtcatttttaccat

SEQ ID NO: 766534 - DNA, 25 bp, Mus musculus
tactcacaggataaccagcagtttt

SEQ ID NO: 766535 - DNA, 25 bp, Mus musculus
tactcacaggattaccagcagtttt

SEQ ID NO: 766536 - DNA, 25 bp, Mus musculus
tactcacaggtacgcatatggatta

SEQ ID NO: 766537 - DNA, 25 bp, Mus musculus
tactcacaggtaggcatatggatta

SEQ ID NO: 766538 - DNA, 25 bp, Mus musculus
tactcacattcaacttacagggcag

SEQ ID NO: 766539 - DNA, 25 bp, Mus musculus
tactcacattcatcttacagggcag

SEQ ID NO: 766540 - DNA, 25 bp, Mus musculus
tactcacattgtacaacactctctg

SEQ ID NO: 766541 - DNA, 25 bp, Mus musculus
tactcacattgttcaacactctctg

SEQ ID NO: 766542 - DNA, 25 bp, Mus musculus
tactcacatttgattcctgcaataa

SEQ ID NO: 766543 - DNA, 25 bp, Mus musculus
tactcacatttgtttcctgcaataa

SEQ ID NO: 766544 - DNA, 25 bp, Mus musculus
tactcaccaggactcacagggtctg

SEQ ID NO: 766545 - DNA, 25 bp, Mus musculus
tactcaccaggagtcacagggtctg

SEQ ID NO: 766546 - DNA, 25 bp, Mus musculus
tactcaccctccagacaagaagctg

SEQ ID NO: 766547 - DNA, 25 bp, Mus musculus
tactcaccctcctgacaagaagctg

SEQ ID NO: 766548 - DNA, 25 bp, Mus musculus
tactcaccgggtacagtacttttca

SEQ ID NO: 766549 - DNA, 25 bp, Mus musculus
tactcaccgggttcagtacttttca

SEQ ID NO: 766550 - DNA, 25 bp, Mus musculus
tactcacctacaagccctaaatatt

SEQ ID NO: 766551 - DNA, 25 bp, Mus musculus
tactcacctacatgccctaaatatt

SEQ ID NO: 766552 - DNA, 25 bp, Mus musculus
tactcacctagtagaatccgcagaa

SEQ ID NO: 766553 - DNA, 25 bp, Mus musculus
tactcacctagttgaatccgcagaa

SEQ ID NO: 766554 - DNA, 25 bp, Mus musculus
tactcacctatgatttagcaagcag

SEQ ID NO: 766555 - DNA, 25 bp, Mus musculus
tactcacctatgttttagcaagcag

SEQ ID NO: 766556 - DNA, 25 bp, Mus musculus
tactcacgggctcggaccagtgctg

SEQ ID NO: 766557 - DNA, 25 bp, Mus musculus
tactcacgggctgggaccagtgctg

SEQ ID NO: 766558 - DNA, 25 bp, Mus musculus
tactcacggtgcatgtttctttcct

SEQ ID NO: 766559 - DNA, 25 bp, Mus musculus
tactcacggtgcttgtttctttcct

SEQ ID NO: 766560 - DNA, 25 bp, Mus musculus
tactcacgtcatccccaagtggaga

SEQ ID NO: 766561 - DNA, 25 bp, Mus musculus
tactcacgtcatgcccaagtggaga

SEQ ID NO: 766562 - DNA, 25 bp, Mus musculus
tactcactcctacggcgtttctttg

SEQ ID NO: 766563 - DNA, 25 bp, Mus musculus
tactcactcctagggcgtttctttg

SEQ ID NO: 766564 - DNA, 25 bp, Mus musculus
tactcactgggcaaccatggttatt

SEQ ID NO: 766565 - DNA, 25 bp, Mus musculus
tactcactgggctaccatggttatt

SEQ ID NO: 766566 - DNA, 25 bp, Mus musculus
tactcactgtttacctaccagagat

SEQ ID NO: 766567 - DNA, 25 bp, Mus musculus
tactcactgttttcctaccagagat

SEQ ID NO: 766568 - DNA, 25 bp, Mus musculus
tactcacttctcaagcatcccgaag

SEQ ID NO: 766569 - DNA, 25 bp, Mus musculus
tactcacttctctagcatcccgaag

SEQ ID NO: 766570 - DNA, 25 bp, Mus musculus
tactcacttgtaaagggcacagatc

SEQ ID NO: 766571 - DNA, 25 bp, Mus musculus
tactcacttgtatagggcacagatc

SEQ ID NO: 766572 - DNA, 25 bp, Mus musculus
tactcagaaaccatttattcttgga

SEQ ID NO: 766573 - DNA, 25 bp, Mus musculus
tactcagaaaccttttattcttgga

SEQ ID NO: 766574 - DNA, 25 bp, Mus musculus
tactcagaagatacattcggtgcta

SEQ ID NO: 766575 - DNA, 25 bp, Mus musculus
tactcagaagattcattcggtgcta

SEQ ID NO: 766576 - DNA, 25 bp, Mus musculus
tactcagaagtccacactgcacgat

SEQ ID NO: 766577 - DNA, 25 bp, Mus musculus
tactcagaagtcgacactgcacgat

SEQ ID NO: 766578 - DNA, 25 bp, Mus musculus
tactcagacattagaaattcagggc

SEQ ID NO: 766579 - DNA, 25 bp, Mus musculus
tactcagacatttgaaattcagggc

SEQ ID NO: 766580 - DNA, 25 bp, Mus musculus
tactcagacctgcaatttaatcctc

SEQ ID NO: 766581 - DNA, 25 bp, Mus musculus
tactcagacctggaatttaatcctc

SEQ ID NO: 766582 - DNA, 25 bp, Mus musculus
tactcagagttgaaggtacccaaac

SEQ ID NO: 766583 - DNA, 25 bp, Mus musculus
tactcagagttgtaggtacccaaac

SEQ ID NO: 766584 - DNA, 25 bp, Mus musculus
tactcagatctccttgcttatgtct

SEQ ID NO: 766585 - DNA, 25 bp, Mus musculus
tactcagatctcgttgcttatgtct

SEQ ID NO: 766586 - DNA, 25 bp, Mus musculus
tactcagattcactacacagcctgg

SEQ ID NO: 766587 - DNA, 25 bp, Mus musculus
tactcagattcagtacacagcctgg

SEQ ID NO: 766588 - DNA, 25 bp, Mus musculus
tactcagcagttcccttccgagagg

SEQ ID NO: 766589 - DNA, 25 bp, Mus musculus
tactcagcagttgccttccgagagg

SEQ ID NO: 766590 - DNA, 25 bp, Mus musculus
tactcagccacccatgactgtaatg

SEQ ID NO: 766591 - DNA, 25 bp, Mus musculus
tactcagccaccgatgactgtaatg

SEQ ID NO: 766592 - DNA, 25 bp, Mus musculus
tactcagcccctaagtggtagctca

SEQ ID NO: 766593 - DNA, 25 bp, Mus musculus
tactcagccccttagtggtagctca

SEQ ID NO: 766594 - DNA, 25 bp, Mus musculus
tactcagcctccaagacaggcttag

SEQ ID NO: 766595 - DNA, 25 bp, Mus musculus
tactcagcctcctagacaggcttag

SEQ ID NO: 766596 - DNA, 25 bp, Mus musculus
tactcagcctctaactaaccttaaa

SEQ ID NO: 766597 - DNA, 25 bp, Mus musculus
tactcagcctcttactaaccttaaa

SEQ ID NO: 766598 - DNA, 25 bp, Mus musculus
tactcagctctaaagacagccactc

SEQ ID NO: 766599 - DNA, 25 bp, Mus musculus
tactcagctctaactctccagaaaa

SEQ ID NO: 766600 - DNA, 25 bp, Mus musculus
tactcagctctatagacagccactc

SEQ ID NO: 766601 - DNA, 25 bp, Mus musculus
tactcagctctatctctccagaaaa

SEQ ID NO: 766602 - DNA, 25 bp, Mus musculus
tactcagctcttacttgttttgact

SEQ ID NO: 766603 - DNA, 25 bp, Mus musculus
tactcagctctttcttgttttgact

SEQ ID NO: 766604 - DNA, 25 bp, Mus musculus
tactcagctgagactccgtgcagaa

SEQ ID NO: 766605 - DNA, 25 bp, Mus musculus
tactcagctgagtctccgtgcagaa

SEQ ID NO: 766606 - DNA, 25 bp, Mus musculus
tactcaggaagtcgtgactcccaat

SEQ ID NO: 766607 - DNA, 25 bp, Mus musculus
tactcaggaagtggtgactcccaat

SEQ ID NO: 766608 - DNA, 25 bp, Mus musculus
tactcaggacataatgtagcatttc

SEQ ID NO: 766609 - DNA, 25 bp, Mus musculus
tactcaggacattatgtagcatttc

SEQ ID NO: 766610 - DNA, 25 bp, Mus musculus
tactcaggacccacaatgtcatctt

SEQ ID NO: 766611 - DNA, 25 bp, Mus musculus
tactcaggaccctcaatgtcatctt

SEQ ID NO: 766612 - DNA, 25 bp, Mus musculus
tactcaggacgcaatgcccgagagt

SEQ ID NO: 766613 - DNA, 25 bp, Mus musculus
tactcaggacgctatgcccgagagt

SEQ ID NO: 766614 - DNA, 25 bp, Mus musculus
tactcaggatccacccagtatggaa

SEQ ID NO: 766615 - DNA, 25 bp, Mus musculus
tactcaggatcctcccagtatggaa

SEQ ID NO: 766616 - DNA, 25 bp, Mus musculus
tactcaggccctcggttgtacattt

SEQ ID NO: 766617 - DNA, 25 bp, Mus musculus
tactcaggccctgggttgtacattt

SEQ ID NO: 766618 - DNA, 25 bp, Mus musculus
tactcaggcctgattgttaaaatgc

SEQ ID NO: 766619 - DNA, 25 bp, Mus musculus
tactcaggcctgtttgttaaaatgc

SEQ ID NO: 766620 - DNA, 25 bp, Mus musculus
tactcagggagtaggaagttcatca

SEQ ID NO: 766621 - DNA, 25 bp, Mus musculus
tactcagggagttggaagttcatca

SEQ ID NO: 766622 - DNA, 25 bp, Mus musculus
tactcagggattatacggtgtttct

SEQ ID NO: 766623 - DNA, 25 bp, Mus musculus
tactcagggattttacggtgtttct

SEQ ID NO: 766624 - DNA, 25 bp, Mus musculus
tactcagggccacgtggtgactaag

SEQ ID NO: 766625 - DNA, 25 bp, Mus musculus
tactcagggccaggtggtgactaag

SEQ ID NO: 766626 - DNA, 25 bp, Mus musculus
tactcaggtagtccaccatgtcttg

SEQ ID NO: 766627 - DNA, 25 bp, Mus musculus
tactcaggtagtgcaccatgtcttg

SEQ ID NO: 766628 - DNA, 25 bp, Mus musculus
tactcagtaacacgtcccaggccaa

SEQ ID NO: 766629 - DNA, 25 bp, Mus musculus
tactcagtaacaggtcccaggccaa

SEQ ID NO: 766630 - DNA, 25 bp, Mus musculus
tactcagtagttagggtaccctgtg

SEQ ID NO: 766631 - DNA, 25 bp, Mus musculus
tactcagtagtttgggtaccctgtg

SEQ ID NO: 766632 - DNA, 25 bp, Mus musculus
tactcagtatgaatgtcttggatat

SEQ ID NO: 766633 - DNA, 25 bp, Mus musculus
tactcagtatgattgtcttggatat

SEQ ID NO: 766634 - DNA, 25 bp, Mus musculus
tactcagtatgtaaaactccctaga

SEQ ID NO: 766635 - DNA, 25 bp, Mus musculus
tactcagtatgttaaactccctaga

SEQ ID NO: 766636 - DNA, 25 bp, Mus musculus
tactcagtcctcctcttaagaggtt

SEQ ID NO: 766637 - DNA, 25 bp, Mus musculus
tactcagtcctcgtcttaagaggtt

SEQ ID NO: 766638 - DNA, 25 bp, Mus musculus
tactcagtgatgatttccttagatg

SEQ ID NO: 766639 - DNA, 25 bp, Mus musculus
tactcagtgatgttttccttagatg

SEQ ID NO: 766640 - DNA, 25 bp, Mus musculus
tactcagtgctcacgggtgctgggc

SEQ ID NO: 766641 - DNA, 25 bp, Mus musculus
tactcagtgctctcgggtgctgggc

SEQ ID NO: 766642 - DNA, 25 bp, Mus musculus
tactcagttcaactggttggaccaa

SEQ ID NO: 766643 - DNA, 25 bp, Mus musculus
tactcagttcaagtggttggaccaa

SEQ ID NO: 766644 - DNA, 25 bp, Mus musculus
tactcagtttatcatacggacacag

SEQ ID NO: 766645 - DNA, 25 bp, Mus musculus
tactcagtttatgatacggacacag

SEQ ID NO: 766646 - DNA, 25 bp, Mus musculus
tactcagttttcaactatgcccggc

SEQ ID NO: 766647 - DNA, 25 bp, Mus musculus
tactcagttttctactatgcccggc

SEQ ID NO: 766648 - DNA, 25 bp, Mus musculus
tactcagtttttctacttaccactc

SEQ ID NO: 766649 - DNA, 25 bp, Mus musculus
tactcagtttttgtacttaccactc

SEQ ID NO: 766650 - DNA, 25 bp, Mus musculus
tactcatacagtcaaggaatttaat

SEQ ID NO: 766651 - DNA, 25 bp, Mus musculus
tactcatacagtgaaggaatttaat

SEQ ID NO: 766652 - DNA, 25 bp, Mus musculus
tactcatagagtagcccatgtctcg

SEQ ID NO: 766653 - DNA, 25 bp, Mus musculus
tactcatagagttgcccatgtctcg

SEQ ID NO: 766654 - DNA, 25 bp, Mus musculus
tactcatcaggacttgggatccctc

SEQ ID NO: 766655 - DNA, 25 bp, Mus musculus
tactcatcaggagttgggatccctc

SEQ ID NO: 766656 - DNA, 25 bp, Mus musculus
tactcatccgtgagtccatacatct

SEQ ID NO: 766657 - DNA, 25 bp, Mus musculus
tactcatccgtgtgtccatacatct

SEQ ID NO: 766658 - DNA, 25 bp, Mus musculus
tactcatcctgtcttcatattctgt

SEQ ID NO: 766659 - DNA, 25 bp, Mus musculus
tactcatcctgtgttcatattctgt

SEQ ID NO: 766660 - DNA, 25 bp, Mus musculus
tactcatcgaggacctgacgggttc

SEQ ID NO: 766661 - DNA, 25 bp, Mus musculus
tactcatcgaggtcctgacgggttc

SEQ ID NO: 766662 - DNA, 25 bp, Mus musculus
tactcatcgcaacctttcttggcat

SEQ ID NO: 766663 - DNA, 25 bp, Mus musculus
tactcatcgcaagctttcttggcat

SEQ ID NO: 766664 - DNA, 25 bp, Mus musculus
tactcatctcaaatctggagttgaa

SEQ ID NO: 766665 - DNA, 25 bp, Mus musculus
tactcatctcaattctggagttgaa

SEQ ID NO: 766666 - DNA, 25 bp, Mus musculus
tactcatctgaaaaatgtctccggt

SEQ ID NO: 766667 - DNA, 25 bp, Mus musculus
tactcatctgaataatgtctccggt

SEQ ID NO: 766668 - DNA, 25 bp, Mus musculus
tactcatctgagcttgtgtttgttc

SEQ ID NO: 766669 - DNA, 25 bp, Mus musculus
tactcatctgaggttgtgtttgttc

SEQ ID NO: 766670 - DNA, 25 bp, Mus musculus
tactcatctgtgaatttagaggtat

SEQ ID NO: 766671 - DNA, 25 bp, Mus musculus
tactcatctgtgtatttagaggtat

SEQ ID NO: 766672 - DNA, 25 bp, Mus musculus
tactcatctttgagtgctggagcat

SEQ ID NO: 766673 - DNA, 25 bp, Mus musculus
tactcatctttgtgtgctggagcat

SEQ ID NO: 766674 - DNA, 25 bp, Mus musculus
tactcatgactgactaccaagtttg

SEQ ID NO: 766675 - DNA, 25 bp, Mus musculus
tactcatgactgtctaccaagtttg

SEQ ID NO: 766676 - DNA, 25 bp, Mus musculus
tactcatgcaagattttctctgatt

SEQ ID NO: 766677 - DNA, 25 bp, Mus musculus
tactcatgcaagtttttctctgatt

SEQ ID NO: 766678 - DNA, 25 bp, Mus musculus
tactcatgcctgaccgtgattaatg

SEQ ID NO: 766679 - DNA, 25 bp, Mus musculus
tactcatgcctgtccgtgattaatg

SEQ ID NO: 766680 - DNA, 25 bp, Mus musculus
tactcatggaccctgtcttcagaaa

SEQ ID NO: 766681 - DNA, 25 bp, Mus musculus
tactcatggaccgtgtcttcagaaa

SEQ ID NO: 766682 - DNA, 25 bp, Mus musculus
tactcatgggatatcaggttcttgt

SEQ ID NO: 766683 - DNA, 25 bp, Mus musculus
tactcatgggatttcaggttcttgt

SEQ ID NO: 766684 - DNA, 25 bp, Mus musculus
tactcatgtccaacgatctgcgaca

SEQ ID NO: 766685 - DNA, 25 bp, Mus musculus
tactcatgtccatcgatctgcgaca

SEQ ID NO: 766686 - DNA, 25 bp, Mus musculus
tactcattatagaggtggctcacac

SEQ ID NO: 766687 - DNA, 25 bp, Mus musculus
tactcattatagtggtggctcacac

SEQ ID NO: 766688 - DNA, 25 bp, Mus musculus
tactcattcactcacttcaacatgt

SEQ ID NO: 766689 - DNA, 25 bp, Mus musculus
tactcattcactgacttcaacatgt

SEQ ID NO: 766690 - DNA, 25 bp, Mus musculus
tactcattccctacatggcatagaa

SEQ ID NO: 766691 - DNA, 25 bp, Mus musculus
tactcattcccttcatggcatagaa

SEQ ID NO: 766692 - DNA, 25 bp, Mus musculus
tactcattcctcagtgggccaccag

SEQ ID NO: 766693 - DNA, 25 bp, Mus musculus
tactcattcctctgtgggccaccag

SEQ ID NO: 766694 - DNA, 25 bp, Mus musculus
tactcattccttagattgaacccca

SEQ ID NO: 766695 - DNA, 25 bp, Mus musculus
tactcattcctttgattgaacccca

SEQ ID NO: 766696 - DNA, 25 bp, Mus musculus
tactcattctttactatactcggat

SEQ ID NO: 766697 - DNA, 25 bp, Mus musculus
tactcattcttttctatactcggat

SEQ ID NO: 766698 - DNA, 25 bp, Mus musculus
tactcattgcagctaccccaggaat

SEQ ID NO: 766699 - DNA, 25 bp, Mus musculus
tactcattgcaggtaccccaggaat

SEQ ID NO: 766700 - DNA, 25 bp, Mus musculus
tactcatttggcaggcatagggtgt

SEQ ID NO: 766701 - DNA, 25 bp, Mus musculus
tactcatttggctggcatagggtgt

SEQ ID NO: 766702 - DNA, 25 bp, Mus musculus
tactcatttgtaatctaagcttctg

SEQ ID NO: 766703 - DNA, 25 bp, Mus musculus
tactcatttgtattctaagcttctg

SEQ ID NO: 766704 - DNA, 25 bp, Mus musculus
tactccaaacttcctgccggctgaa

SEQ ID NO: 766705 - DNA, 25 bp, Mus musculus
tactccaaacttgctgccggctgaa

SEQ ID NO: 766706 - DNA, 25 bp, Mus musculus
tactccaaccatagtgtagtgaatt

SEQ ID NO: 766707 - DNA, 25 bp, Mus musculus
tactccaaccattgtgtagtgaatt

SEQ ID NO: 766708 - DNA, 25 bp, Mus musculus
tactccaagactacaaaatgaacct

SEQ ID NO: 766709 - DNA, 25 bp, Mus musculus
tactccaagacttcaaaatgaacct

SEQ ID NO: 766710 - DNA, 25 bp, Mus musculus
tactccaagctgaggtgtcaccatg

SEQ ID NO: 766711 - DNA, 25 bp, Mus musculus
tactccaagctgtggtgtcaccatg

SEQ ID NO: 766712 - DNA, 25 bp, Mus musculus
tactccaaggtgacctcacatttga

SEQ ID NO: 766713 - DNA, 25 bp, Mus musculus
tactccaaggtgtcctcacatttga

SEQ ID NO: 766714 - DNA, 25 bp, Mus musculus
tactccaccaatctgcagacactgg

SEQ ID NO: 766715 - DNA, 25 bp, Mus musculus
tactccaccaatgtgcagacactgg

SEQ ID NO: 766716 - DNA, 25 bp, Mus musculus
tactccacccttcatcttttagttt

SEQ ID NO: 766717 - DNA, 25 bp, Mus musculus
tactccacccttcctggtcaaaaga

SEQ ID NO: 766718 - DNA, 25 bp, Mus musculus
tactccacccttgatcttttagttt

SEQ ID NO: 766719 - DNA, 25 bp, Mus musculus
tactccacccttgctggtcaaaaga

SEQ ID NO: 766720 - DNA, 25 bp, Mus musculus
tactccacctgccttcaaaagataa

SEQ ID NO: 766721 - DNA, 25 bp, Mus musculus
tactccacctgcgttcaaaagataa

SEQ ID NO: 766722 - DNA, 25 bp, Mus musculus
tactccacgctgatcagaccataga

SEQ ID NO: 766723 - DNA, 25 bp, Mus musculus
tactccacgctgttcagaccataga

SEQ ID NO: 766724 - DNA, 25 bp, Mus musculus
tactccactccgcttgacatctgga

SEQ ID NO: 766725 - DNA, 25 bp, Mus musculus
tactccactccggttgacatctgga

SEQ ID NO: 766726 - DNA, 25 bp, Mus musculus
tactccactgtgattctttcggatt

SEQ ID NO: 766727 - DNA, 25 bp, Mus musculus
tactccactgtgtttctttcggatt

SEQ ID NO: 766728 - DNA, 25 bp, Mus musculus
tactccacttctatcagttttcaag

SEQ ID NO: 766729 - DNA, 25 bp, Mus musculus
tactccacttctttcagttttcaag

SEQ ID NO: 766730 - DNA, 25 bp, Mus musculus
tactccagaagtctcgtgaaattga

SEQ ID NO: 766731 - DNA, 25 bp, Mus musculus
tactccagaagtgtcgtgaaattga

SEQ ID NO: 766732 - DNA, 25 bp, Mus musculus
tactccagaccaagtatcctctggt

SEQ ID NO: 766733 - DNA, 25 bp, Mus musculus
tactccagaccatgtatcctctggt

SEQ ID NO: 766734 - DNA, 25 bp, Mus musculus
tactccagcacacagtttgactctg

SEQ ID NO: 766735 - DNA, 25 bp, Mus musculus
tactccagcacagagtttgactctg

SEQ ID NO: 766736 - DNA, 25 bp, Mus musculus
tactccagcgaaacttccagatcta

SEQ ID NO: 766737 - DNA, 25 bp, Mus musculus
tactccagcgaatcttccagatcta

SEQ ID NO: 766738 - DNA, 25 bp, Mus musculus
tactccagctataagctttctgggc

SEQ ID NO: 766739 - DNA, 25 bp, Mus musculus
tactccagctattagctttctgggc

SEQ ID NO: 766740 - DNA, 25 bp, Mus musculus
tactccagctgcagcatatccgagg

SEQ ID NO: 766741 - DNA, 25 bp, Mus musculus
tactccagctgctgcatatccgagg

SEQ ID NO: 766742 - DNA, 25 bp, Mus musculus
tactccaggttaccttgtccacaaa

SEQ ID NO: 766743 - DNA, 25 bp, Mus musculus
tactccaggttagcttgtccacaaa

SEQ ID NO: 766744 - DNA, 25 bp, Mus musculus
tactccagtctaactgggcctataa

SEQ ID NO: 766745 - DNA, 25 bp, Mus musculus
tactccagtctatctgggcctataa

SEQ ID NO: 766746 - DNA, 25 bp, Mus musculus
tactccagtgttaaaagttgactaa

SEQ ID NO: 766747 - DNA, 25 bp, Mus musculus
tactccagtgtttaaagttgactaa

SEQ ID NO: 766748 - DNA, 25 bp, Mus musculus
tactccatcactatccggcaggaga

SEQ ID NO: 766749 - DNA, 25 bp, Mus musculus
tactccatcactttccggcaggaga

SEQ ID NO: 766750 - DNA, 25 bp, Mus musculus
tactccatcagcatacctaacaaat

SEQ ID NO: 766751 - DNA, 25 bp, Mus musculus
tactccatcagcttacctaacaaat

SEQ ID NO: 766752 - DNA, 25 bp, Mus musculus
tactccatctctacaccgaaataaa

SEQ ID NO: 766753 - DNA, 25 bp, Mus musculus
tactccatctctaccagcagaaagt

SEQ ID NO: 766754 - DNA, 25 bp, Mus musculus
tactccatctcttcaccgaaataaa

SEQ ID NO: 766755 - DNA, 25 bp, Mus musculus
tactccatctcttccagcagaaagt

SEQ ID NO: 766756 - DNA, 25 bp, Mus musculus
tactccatgatgagggtgagtggct

SEQ ID NO: 766757 - DNA, 25 bp, Mus musculus
tactccatgatgtgggtgagtggct

SEQ ID NO: 766758 - DNA, 25 bp, Mus musculus
tactccatgcacctgctggagggct

SEQ ID NO: 766759 - DNA, 25 bp, Mus musculus
tactccatgcacgtgctggagggct

SEQ ID NO: 766760 - DNA, 25 bp, Mus musculus
tactccatgcagagctcctactttg

SEQ ID NO: 766761 - DNA, 25 bp, Mus musculus
tactccatgcagtgctcctactttg

SEQ ID NO: 766762 - DNA, 25 bp, Mus musculus
tactccatggagcacttccgctggg

SEQ ID NO: 766763 - DNA, 25 bp, Mus musculus
tactccatggaggacttccgctggg

SEQ ID NO: 766764 - DNA, 25 bp, Mus musculus
tactccattgaaacagtcatcatgc

SEQ ID NO: 766765 - DNA, 25 bp, Mus musculus
tactccattgaatcagtcatcatgc

SEQ ID NO: 766766 - DNA, 25 bp, Mus musculus
tactcccaaactcacaattttttct

SEQ ID NO: 766767 - DNA, 25 bp, Mus musculus
tactcccaaactgacaattttttct

SEQ ID NO: 766768 - DNA, 25 bp, Mus musculus
tactcccaagccctacaattggtct

SEQ ID NO: 766769 - DNA, 25 bp, Mus musculus
tactcccaagccgtacaattggtct

SEQ ID NO: 766770 - DNA, 25 bp, Mus musculus
tactcccaagtcagtgaggttccga

SEQ ID NO: 766771 - DNA, 25 bp, Mus musculus
tactcccaagtctgtgaggttccga

SEQ ID NO: 766772 - DNA, 25 bp, Mus musculus
tactcccacaaaatcacgctgcatg

SEQ ID NO: 766773 - DNA, 25 bp, Mus musculus
tactcccacaaattcacgctgcatg

SEQ ID NO: 766774 - DNA, 25 bp, Mus musculus
tactcccacggacaagaacaggcaa

SEQ ID NO: 766775 - DNA, 25 bp, Mus musculus
tactcccacggagaagaacaggcaa

SEQ ID NO: 766776 - DNA, 25 bp, Mus musculus
tactcccactggagagcatctttgt

SEQ ID NO: 766777 - DNA, 25 bp, Mus musculus
tactcccactggtgagcatctttgt

SEQ ID NO: 766778 - DNA, 25 bp, Mus musculus
tactcccactttagcctgcaggaaa

SEQ ID NO: 766779 - DNA, 25 bp, Mus musculus
tactcccacttttgcctgcaggaaa

SEQ ID NO: 766780 - DNA, 25 bp, Mus musculus
tactcccagatgagaggcctataca

SEQ ID NO: 766781 - DNA, 25 bp, Mus musculus
tactcccagatgtgaggcctataca

SEQ ID NO: 766782 - DNA, 25 bp, Mus musculus
tactcccatcagcaggctgtttcta

SEQ ID NO: 766783 - DNA, 25 bp, Mus musculus
tactcccatcaggaggctgtttcta

SEQ ID NO: 766784 - DNA, 25 bp, Mus musculus
tactcccattcaaacttcctaaaag

SEQ ID NO: 766785 - DNA, 25 bp, Mus musculus
tactcccattcatacttcctaaaag

SEQ ID NO: 766786 - DNA, 25 bp, Mus musculus
tactccccgaatacatgaggctagg

SEQ ID NO: 766787 - DNA, 25 bp, Mus musculus
tactccccgaattcatgaggctagg

SEQ ID NO: 766788 - DNA, 25 bp, Mus musculus
tactcccctcggaggcgggtgaagc

SEQ ID NO: 766789 - DNA, 25 bp, Mus musculus
tactcccctcggtggcgggtgaagc

SEQ ID NO: 766790 - DNA, 25 bp, Mus musculus
tactcccctcttcgaactcgaggaa

SEQ ID NO: 766791 - DNA, 25 bp, Mus musculus
tactcccctcttggaactcgaggaa

SEQ ID NO: 766792 - DNA, 25 bp, Mus musculus
tactccccttagagagtgagctgta

SEQ ID NO: 766793 - DNA, 25 bp, Mus musculus
tactccccttagtgagtgagctgta

SEQ ID NO: 766794 - DNA, 25 bp, Mus musculus
tactcccgaggacgctactgtatga

SEQ ID NO: 766795 - DNA, 25 bp, Mus musculus
tactcccgaggaggctactgtatga

SEQ ID NO: 766796 - DNA, 25 bp, Mus musculus
tactcccggaccaacaataaagaag

SEQ ID NO: 766797 - DNA, 25 bp, Mus musculus
tactcccggacctacaataaagaag

SEQ ID NO: 766798 - DNA, 25 bp, Mus musculus
tactcccgttcccaatgctgggaga

SEQ ID NO: 766799 - DNA, 25 bp, Mus musculus
tactcccgttccgaatgctgggaga

SEQ ID NO: 766800 - DNA, 25 bp, Mus musculus
tactccctagaacccacacagaaga

SEQ ID NO: 766801 - DNA, 25 bp, Mus musculus
tactccctagaagccacacagaaga

SEQ ID NO: 766802 - DNA, 25 bp, Mus musculus
tactccctcaatctgctagagggct

SEQ ID NO: 766803 - DNA, 25 bp, Mus musculus
tactccctcaatgtgctagagggct

SEQ ID NO: 766804 - DNA, 25 bp, Mus musculus
tactccctcgacatctccctatttt

SEQ ID NO: 766805 - DNA, 25 bp, Mus musculus
tactccctcgacttctccctatttt

SEQ ID NO: 766806 - DNA, 25 bp, Mus musculus
tactccctcgcaattgaggtgcata

SEQ ID NO: 766807 - DNA, 25 bp, Mus musculus
tactccctcgcatttgaggtgcata

SEQ ID NO: 766808 - DNA, 25 bp, Mus musculus
tactccctcgccatgcgctgctggg

SEQ ID NO: 766809 - DNA, 25 bp, Mus musculus
tactccctcgccttgcgctgctggg

SEQ ID NO: 766810 - DNA, 25 bp, Mus musculus
tactccctctaccatcttgaaatag

SEQ ID NO: 766811 - DNA, 25 bp, Mus musculus
tactccctctacgatcttgaaatag

SEQ ID NO: 766812 - DNA, 25 bp, Mus musculus
tactccctctctaaataaatgtgct

SEQ ID NO: 766813 - DNA, 25 bp, Mus musculus
tactccctctcttaataaatgtgct

SEQ ID NO: 766814 - DNA, 25 bp, Mus musculus
tactccctgacaaactgccaaataa

SEQ ID NO: 766815 - DNA, 25 bp, Mus musculus
tactccctgacatactgccaaataa

SEQ ID NO: 766816 - DNA, 25 bp, Mus musculus
tactccctgatgaggcttgccagtg

SEQ ID NO: 766817 - DNA, 25 bp, Mus musculus
tactccctgatgcacattcctgaga

SEQ ID NO: 766818 - DNA, 25 bp, Mus musculus
tactccctgatggacattcctgaga

SEQ ID NO: 766819 - DNA, 25 bp, Mus musculus
tactccctgatgtggcttgccagtg

SEQ ID NO: 766820 - DNA, 25 bp, Mus musculus
tactccctggcaatatgtttccttt

SEQ ID NO: 766821 - DNA, 25 bp, Mus musculus
tactccctggcattatgtttccttt

SEQ ID NO: 766822 - DNA, 25 bp, Mus musculus
tactccctgtatctaggccgaatgt

SEQ ID NO: 766823 - DNA, 25 bp, Mus musculus
tactccctgtatgtaggccgaatgt

SEQ ID NO: 766824 - DNA, 25 bp, Mus musculus
tactcccttcttatacagcttacca

SEQ ID NO: 766825 - DNA, 25 bp, Mus musculus
tactcccttcttttacagcttacca

SEQ ID NO: 766826 - DNA, 25 bp, Mus musculus
tactccctttccagatttcatgtaa

SEQ ID NO: 766827 - DNA, 25 bp, Mus musculus
tactccctttcctgatttcatgtaa

SEQ ID NO: 766828 - DNA, 25 bp, Mus musculus
tactcccttttgcagagcccagagg

SEQ ID NO: 766829 - DNA, 25 bp, Mus musculus
tactcccttttggagagcccagagg

SEQ ID NO: 766830 - DNA, 25 bp, Mus musculus
tactccgaagctataacgtttgatt

SEQ ID NO: 766831 - DNA, 25 bp, Mus musculus
tactccgaagctttaacgtttgatt

SEQ ID NO: 766832 - DNA, 25 bp, Mus musculus
tactccgactgccaagagaccagaa

SEQ ID NO: 766833 - DNA, 25 bp, Mus musculus
tactccgactgcgaagagaccagaa

SEQ ID NO: 766834 - DNA, 25 bp, Mus musculus
tactccgagagccttttaggtgtcc

SEQ ID NO: 766835 - DNA, 25 bp, Mus musculus
tactccgagagcgttttaggtgtcc

SEQ ID NO: 766836 - DNA, 25 bp, Mus musculus
tactccgatgatcctctagccagag

SEQ ID NO: 766837 - DNA, 25 bp, Mus musculus
tactccgatgatgctctagccagag

SEQ ID NO: 766838 - DNA, 25 bp, Mus musculus
tactccgatttcagtgcgatttcat

SEQ ID NO: 766839 - DNA, 25 bp, Mus musculus
tactccgatttctgtgcgatttcat

SEQ ID NO: 766840 - DNA, 25 bp, Mus musculus
tactccgcaccactaaattttagtg

SEQ ID NO: 766841 - DNA, 25 bp, Mus musculus
tactccgcaccagtaaattttagtg

SEQ ID NO: 766842 - DNA, 25 bp, Mus musculus
tactccggcattcagtgacctggat

SEQ ID NO: 766843 - DNA, 25 bp, Mus musculus
tactccggcattgagtgacctggat

SEQ ID NO: 766844 - DNA, 25 bp, Mus musculus
tactccggtttgaacgtggtgttat

SEQ ID NO: 766845 - DNA, 25 bp, Mus musculus
tactccggtttgtacgtggtgttat

SEQ ID NO: 766846 - DNA, 25 bp, Mus musculus
tactccgtgactacctgagttcctt

SEQ ID NO: 766847 - DNA, 25 bp, Mus musculus
tactccgtgacttcctgagttcctt

SEQ ID NO: 766848 - DNA, 25 bp, Mus musculus
tactccgtggtaaatttcattgtct

SEQ ID NO: 766849 - DNA, 25 bp, Mus musculus
tactccgtggtatatttcattgtct

SEQ ID NO: 766850 - DNA, 25 bp, Mus musculus
tactccgtgtccactaagactgctc

SEQ ID NO: 766851 - DNA, 25 bp, Mus musculus
tactccgtgtcctctaagactgctc

SEQ ID NO: 766852 - DNA, 25 bp, Mus musculus
tactcctaacctcgttgtgcaaaga

SEQ ID NO: 766853 - DNA, 25 bp, Mus musculus
tactcctaacctggttgtgcaaaga

SEQ ID NO: 766854 - DNA, 25 bp, Mus musculus
tactcctaatctccttccagaattt

SEQ ID NO: 766855 - DNA, 25 bp, Mus musculus
tactcctaatctgcttccagaattt

SEQ ID NO: 766856 - DNA, 25 bp, Mus musculus
tactcctaccagaacacagtggcca

SEQ ID NO: 766857 - DNA, 25 bp, Mus musculus
tactcctaccagtacacagtggcca

SEQ ID NO: 766858 - DNA, 25 bp, Mus musculus
tactcctacttacccattctttact

SEQ ID NO: 766859 - DNA, 25 bp, Mus musculus
tactcctacttagccattctttact

SEQ ID NO: 766860 - DNA, 25 bp, Mus musculus
tactcctagccccttgatgattcag

SEQ ID NO: 766861 - DNA, 25 bp, Mus musculus
tactcctagcccgttgatgattcag

SEQ ID NO: 766862 - DNA, 25 bp, Mus musculus
tactcctagggcacgagctacagag

SEQ ID NO: 766863 - DNA, 25 bp, Mus musculus
tactcctagggctcgagctacagag

SEQ ID NO: 766864 - DNA, 25 bp, Mus musculus
tactcctatgaacttcagcgcttgg

SEQ ID NO: 766865 - DNA, 25 bp, Mus musculus
tactcctatgaagttcagcgcttgg

SEQ ID NO: 766866 - DNA, 25 bp, Mus musculus
tactcctcacgacctttcagggaga

SEQ ID NO: 766867 - DNA, 25 bp, Mus musculus
tactcctcacgagctttcagggaga

SEQ ID NO: 766868 - DNA, 25 bp, Mus musculus
tactcctcagttactaggcttccaa

SEQ ID NO: 766869 - DNA, 25 bp, Mus musculus
tactcctcagtttctaggcttccaa

SEQ ID NO: 766870 - DNA, 25 bp, Mus musculus
tactcctccagaaaattacttcggg

SEQ ID NO: 766871 - DNA, 25 bp, Mus musculus
tactcctccagataattacttcggg

SEQ ID NO: 766872 - DNA, 25 bp, Mus musculus
tactcctccctcctatgagcagtgt

SEQ ID NO: 766873 - DNA, 25 bp, Mus musculus
tactcctccctcgtatgagcagtgt

SEQ ID NO: 766874 - DNA, 25 bp, Mus musculus
tactcctccctgaaaagctgaggtg

SEQ ID NO: 766875 - DNA, 25 bp, Mus musculus
tactcctccctgtaaagctgaggtg

SEQ ID NO: 766876 - DNA, 25 bp, Mus musculus
tactcctcgagacgctctaggttta

SEQ ID NO: 766877 - DNA, 25 bp, Mus musculus
tactcctcgagaggctctaggttta

SEQ ID NO: 766878 - DNA, 25 bp, Mus musculus
tactcctcgtgtcctgcaacacaaa

SEQ ID NO: 766879 - DNA, 25 bp, Mus musculus
tactcctcgtgtgctgcaacacaaa

SEQ ID NO: 766880 - DNA, 25 bp, Mus musculus
tactcctctatgattacttttgaga

SEQ ID NO: 766881 - DNA, 25 bp, Mus musculus
tactcctctatgtttacttttgaga

SEQ ID NO: 766882 - DNA, 25 bp, Mus musculus
tactcctctcacatcttttcattct

SEQ ID NO: 766883 - DNA, 25 bp, Mus musculus
tactcctctcacttcttttcattct

SEQ ID NO: 766884 - DNA, 25 bp, Mus musculus
tactcctcttgcatgggttcttgga

SEQ ID NO: 766885 - DNA, 25 bp, Mus musculus
tactcctcttgcttgggttcttgga

SEQ ID NO: 766886 - DNA, 25 bp, Mus musculus
tactcctgacaaacctgggcatgat

SEQ ID NO: 766887 - DNA, 25 bp, Mus musculus
tactcctgacaatcctgggcatgat

SEQ ID NO: 766888 - DNA, 25 bp, Mus musculus
tactcctgcatcctagtcactggga

SEQ ID NO: 766889 - DNA, 25 bp, Mus musculus
tactcctgcatcgtagtcactggga

SEQ ID NO: 766890 - DNA, 25 bp, Mus musculus
tactcctgccagctttacttaaagg

SEQ ID NO: 766891 - DNA, 25 bp, Mus musculus
tactcctgccaggtttacttaaagg

SEQ ID NO: 766892 - DNA, 25 bp, Mus musculus
tactcctggaccatgatgtgcctga

SEQ ID NO: 766893 - DNA, 25 bp, Mus musculus
tactcctggaccttgatgtgcctga

SEQ ID NO: 766894 - DNA, 25 bp, Mus musculus
tactcctggcatagattccagccat

SEQ ID NO: 766895 - DNA, 25 bp, Mus musculus
tactcctggcattgattccagccat

SEQ ID NO: 766896 - DNA, 25 bp, Mus musculus
tactcctggctcaccttccgaggga

SEQ ID NO: 766897 - DNA, 25 bp, Mus musculus
tactcctggctcattttgaaaccgt

SEQ ID NO: 766898 - DNA, 25 bp, Mus musculus
tactcctggctctccttccgaggga

SEQ ID NO: 766899 - DNA, 25 bp, Mus musculus
tactcctggctctttttgaaaccgt

SEQ ID NO: 766900 - DNA, 25 bp, Mus musculus
tactcctgggatacatttacttctt

SEQ ID NO: 766901 - DNA, 25 bp, Mus musculus
tactcctgggattcatttacttctt

SEQ ID NO: 766902 - DNA, 25 bp, Mus musculus
tactcctgggctactttctagcaga

SEQ ID NO: 766903 - DNA, 25 bp, Mus musculus
tactcctgggcttctttctagcaga

SEQ ID NO: 766904 - DNA, 25 bp, Mus musculus
tactcctgtattacacgactctaga

SEQ ID NO: 766905 - DNA, 25 bp, Mus musculus
tactcctgtatttcacgactctaga

SEQ ID NO: 766906 - DNA, 25 bp, Mus musculus
tactcctgtcggaacccacgttcta

SEQ ID NO: 766907 - DNA, 25 bp, Mus musculus
tactcctgtcggtacccacgttcta

SEQ ID NO: 766908 - DNA, 25 bp, Mus musculus
tactcctgtggtatgagctgggaac

SEQ ID NO: 766909 - DNA, 25 bp, Mus musculus
tactcctgtggtttgagctgggaac

SEQ ID NO: 766910 - DNA, 25 bp, Mus musculus
tactccttaacaccagcactcagga

SEQ ID NO: 766911 - DNA, 25 bp, Mus musculus
tactccttaacagcagcactcagga

SEQ ID NO: 766912 - DNA, 25 bp, Mus musculus
tactccttattcagttgtcttacct

SEQ ID NO: 766913 - DNA, 25 bp, Mus musculus
tactccttattctgttgtcttacct

SEQ ID NO: 766914 - DNA, 25 bp, Mus musculus
tactccttcaggaatgatgtccagt

SEQ ID NO: 766915 - DNA, 25 bp, Mus musculus
tactccttcaggtatgatgtccagt

SEQ ID NO: 766916 - DNA, 25 bp, Mus musculus
tactccttccagaagcagccgagga

SEQ ID NO: 766917 - DNA, 25 bp, Mus musculus
tactccttccagtagcagccgagga

SEQ ID NO: 766918 - DNA, 25 bp, Mus musculus
tactccttccccagaaagtatgagc

SEQ ID NO: 766919 - DNA, 25 bp, Mus musculus
tactccttcccctgaaagtatgagc

SEQ ID NO: 766920 - DNA, 25 bp, Mus musculus
tactccttccttcttgttatagttg

SEQ ID NO: 766921 - DNA, 25 bp, Mus musculus
tactccttccttgttgttatagttg

SEQ ID NO: 766922 - DNA, 25 bp, Mus musculus
tactccttgctgactccaataaagt

SEQ ID NO: 766923 - DNA, 25 bp, Mus musculus
tactccttgctgatccgcagaactt

SEQ ID NO: 766924 - DNA, 25 bp, Mus musculus
tactccttgctgtctccaataaagt

SEQ ID NO: 766925 - DNA, 25 bp, Mus musculus
tactccttgctgttccgcagaactt

SEQ ID NO: 766926 - DNA, 25 bp, Mus musculus
tactcctttgttacggtgacaccca

SEQ ID NO: 766927 - DNA, 25 bp, Mus musculus
tactcctttgtttcggtgacaccca

SEQ ID NO: 766928 - DNA, 25 bp, Mus musculus
tactccttttaaacttcctgtgtga

SEQ ID NO: 766929 - DNA, 25 bp, Mus musculus
tactccttttaatcttcctgtgtga

SEQ ID NO: 766930 - DNA, 25 bp, Mus musculus
tactccttttatcttttccctcaga

SEQ ID NO: 766931 - DNA, 25 bp, Mus musculus
tactccttttatgttttccctcaga

SEQ ID NO: 766932 - DNA, 25 bp, Mus musculus
tactcgaagagcagaggcacgccag

SEQ ID NO: 766933 - DNA, 25 bp, Mus musculus
tactcgaagagctgaggcacgccag

SEQ ID NO: 766934 - DNA, 25 bp, Mus musculus
tactcgaggaggattctggacttct

SEQ ID NO: 766935 - DNA, 25 bp, Mus musculus
tactcgaggaggtttctggacttct

SEQ ID NO: 766936 - DNA, 25 bp, Mus musculus
tactcgagggaaaagcagcggttct

SEQ ID NO: 766937 - DNA, 25 bp, Mus musculus
tactcgagggaatagcagcggttct

SEQ ID NO: 766938 - DNA, 25 bp, Mus musculus
tactcgatagcccaaagccagcttt

SEQ ID NO: 766939 - DNA, 25 bp, Mus musculus
tactcgatagccgaaagccagcttt

SEQ ID NO: 766940 - DNA, 25 bp, Mus musculus
tactcgatggacatgttccacacac

SEQ ID NO: 766941 - DNA, 25 bp, Mus musculus
tactcgatggacttgttccacacac

SEQ ID NO: 766942 - DNA, 25 bp, Mus musculus
tactcgatttccatgatggcctgag

SEQ ID NO: 766943 - DNA, 25 bp, Mus musculus
tactcgatttccttgatggcctgag

SEQ ID NO: 766944 - DNA, 25 bp, Mus musculus
tactcgcagtgcattgaaggaccca

SEQ ID NO: 766945 - DNA, 25 bp, Mus musculus
tactcgcagtgctttgaaggaccca

SEQ ID NO: 766946 - DNA, 25 bp, Mus musculus
tactcgccctccacaaagaataatt

SEQ ID NO: 766947 - DNA, 25 bp, Mus musculus
tactcgccctcctcaaagaataatt

SEQ ID NO: 766948 - DNA, 25 bp, Mus musculus
tactcgcgagtgcatcctgcgagtg

SEQ ID NO: 766949 - DNA, 25 bp, Mus musculus
tactcgcgagtggatcctgcgagtg

SEQ ID NO: 766950 - DNA, 25 bp, Mus musculus
tactcgctcatactaggagctgaaa

SEQ ID NO: 766951 - DNA, 25 bp, Mus musculus
tactcgctcatagtaggagctgaaa

SEQ ID NO: 766952 - DNA, 25 bp, Mus musculus
tactcgctgcgacaggtggactcat

SEQ ID NO: 766953 - DNA, 25 bp, Mus musculus
tactcgctgcgagaggtggactcat

SEQ ID NO: 766954 - DNA, 25 bp, Mus musculus
tactcgcttctacctcagttactag

SEQ ID NO: 766955 - DNA, 25 bp, Mus musculus
tactcgcttctagctcagttactag

SEQ ID NO: 766956 - DNA, 25 bp, Mus musculus
tactcggaacatcccttacctttaa

SEQ ID NO: 766957 - DNA, 25 bp, Mus musculus
tactcggaacatgccttacctttaa

SEQ ID NO: 766958 - DNA, 25 bp, Mus musculus
tactcggaaccgcagttgatttttt

SEQ ID NO: 766959 - DNA, 25 bp, Mus musculus
tactcggaaccggagttgatttttt

SEQ ID NO: 766960 - DNA, 25 bp, Mus musculus
tactcggaagggatgagcgtccaca

SEQ ID NO: 766961 - DNA, 25 bp, Mus musculus
tactcggaagggttgagcgtccaca

SEQ ID NO: 766962 - DNA, 25 bp, Mus musculus
tactcggcaaagattgtttccgcgc

SEQ ID NO: 766963 - DNA, 25 bp, Mus musculus
tactcggcaaagtttgtttccgcgc

SEQ ID NO: 766964 - DNA, 25 bp, Mus musculus
tactcggcacagaagtagatcttcc

SEQ ID NO: 766965 - DNA, 25 bp, Mus musculus
tactcggcacagtagtagatcttcc

SEQ ID NO: 766966 - DNA, 25 bp, Mus musculus
tactcggcagtgagtggacccctat

SEQ ID NO: 766967 - DNA, 25 bp, Mus musculus
tactcggcagtgtgtggacccctat

SEQ ID NO: 766968 - DNA, 25 bp, Mus musculus
tactcggctatcacggaggctgtga

SEQ ID NO: 766969 - DNA, 25 bp, Mus musculus
tactcggctatctcggaggctgtga

SEQ ID NO: 766970 - DNA, 25 bp, Mus musculus
tactcgggtgacagtgatcctgatc

SEQ ID NO: 766971 - DNA, 25 bp, Mus musculus
tactcgggtgactgtgatcctgatc

SEQ ID NO: 766972 - DNA, 25 bp, Mus musculus
tactcggtagagaggatctggtgct

SEQ ID NO: 766973 - DNA, 25 bp, Mus musculus
tactcggtagagtggatctggtgct

SEQ ID NO: 766974 - DNA, 25 bp, Mus musculus
tactcggttcccaagtggagcccaa

SEQ ID NO: 766975 - DNA, 25 bp, Mus musculus
tactcggttccctagtggagcccaa

SEQ ID NO: 766976 - DNA, 25 bp, Mus musculus
tactcgtaataaaacccaagaagga

SEQ ID NO: 766977 - DNA, 25 bp, Mus musculus
tactcgtaataatacccaagaagga

SEQ ID NO: 766978 - DNA, 25 bp, Mus musculus
tactcgtgcaacaaaagccgacgca

SEQ ID NO: 766979 - DNA, 25 bp, Mus musculus
tactcgtgcaactaaagccgacgca

SEQ ID NO: 766980 - DNA, 25 bp, Mus musculus
tactcgtgctcgcatatgctgtgac

SEQ ID NO: 766981 - DNA, 25 bp, Mus musculus
tactcgtgctcggatatgctgtgac

SEQ ID NO: 766982 - DNA, 25 bp, Mus musculus
tactctaacaaaacccccaaataag

SEQ ID NO: 766983 - DNA, 25 bp, Mus musculus
tactctaacaaatcccccaaataag

SEQ ID NO: 766984 - DNA, 25 bp, Mus musculus
tactctaaccttaccaaacaccaga

SEQ ID NO: 766985 - DNA, 25 bp, Mus musculus
tactctaacctttccaaacaccaga

SEQ ID NO: 766986 - DNA, 25 bp, Mus musculus
tactctaagaatctcactattaaac

SEQ ID NO: 766987 - DNA, 25 bp, Mus musculus
tactctaagaatgtcactattaaac

SEQ ID NO: 766988 - DNA, 25 bp, Mus musculus
tactctaagtagcaaaggttcatcg

SEQ ID NO: 766989 - DNA, 25 bp, Mus musculus
tactctaagtaggaaaggttcatcg

SEQ ID NO: 766990 - DNA, 25 bp, Mus musculus
tactctaagtgaaaccgtccagctg

SEQ ID NO: 766991 - DNA, 25 bp, Mus musculus
tactctaagtgataccgtccagctg

SEQ ID NO: 766992 - DNA, 25 bp, Mus musculus
tactctaatccacgcaacaaatttg

SEQ ID NO: 766993 - DNA, 25 bp, Mus musculus
tactctaatccaggcaacaaatttg

SEQ ID NO: 766994 - DNA, 25 bp, Mus musculus
tactctaatggacagaccatacata

SEQ ID NO: 766995 - DNA, 25 bp, Mus musculus
tactctaatggagagaccatacata

SEQ ID NO: 766996 - DNA, 25 bp, Mus musculus
tactctaatgtaaggtctgtgtgat

SEQ ID NO: 766997 - DNA, 25 bp, Mus musculus
tactctaatgtatggtctgtgtgat

SEQ ID NO: 766998 - DNA, 25 bp, Mus musculus
tactctacagctctgggcgtctaaa

SEQ ID NO: 766999 - DNA, 25 bp, Mus musculus
tactctacagctgtgggcgtctaaa

SEQ ID NO: 767000 - DNA, 25 bp, Mus musculus
tactctacatcccttctataactga

SEQ ID NO: 767001 - DNA, 25 bp, Mus musculus
tactctacatccgttctataactga

SEQ ID NO: 767002 - DNA, 25 bp, Mus musculus
tactctaccccgatcactaatctta

SEQ ID NO: 767003 - DNA, 25 bp, Mus musculus
tactctaccccgttcactaatctta

SEQ ID NO: 767004 - DNA, 25 bp, Mus musculus
tactctacctggaaccatatctgtg

SEQ ID NO: 767005 - DNA, 25 bp, Mus musculus
tactctacctggtaccatatctgtg

SEQ ID NO: 767006 - DNA, 25 bp, Mus musculus
tactctacgagcacaagcaggcctg

SEQ ID NO: 767007 - DNA, 25 bp, Mus musculus
tactctacgagctcaagcaggcctg

SEQ ID NO: 767008 - DNA, 25 bp, Mus musculus
tactctactaccacagtttacttga

SEQ ID NO: 767009 - DNA, 25 bp, Mus musculus
tactctactacctcagtttacttga

SEQ ID NO: 767010 - DNA, 25 bp, Mus musculus
tactctactatgacccttgatttgt

SEQ ID NO: 767011 - DNA, 25 bp, Mus musculus
tactctactatgtcccttgatttgt

SEQ ID NO: 767012 - DNA, 25 bp, Mus musculus
tactctactcctaagcattatatta

SEQ ID NO: 767013 - DNA, 25 bp, Mus musculus
tactctactccttagcattatatta

SEQ ID NO: 767014 - DNA, 25 bp, Mus musculus
tactctactgtccactcaagatcca

SEQ ID NO: 767015 - DNA, 25 bp, Mus musculus
tactctactgtcgactcaagatcca

SEQ ID NO: 767016 - DNA, 25 bp, Mus musculus
tactctagacagatcagttttgatg

SEQ ID NO: 767017 - DNA, 25 bp, Mus musculus
tactctagacagttcagttttgatg

SEQ ID NO: 767018 - DNA, 25 bp, Mus musculus
tactctagatggagtatgtgtgaac

SEQ ID NO: 767019 - DNA, 25 bp, Mus musculus
tactctagatggtgtatgtgtgaac

SEQ ID NO: 767020 - DNA, 25 bp, Mus musculus
tactctagggacaccagggtaaatg

SEQ ID NO: 767021 - DNA, 25 bp, Mus musculus
tactctagggactccagggtaaatg

SEQ ID NO: 767022 - DNA, 25 bp, Mus musculus
tactctagtgtgatggtgggactgc

SEQ ID NO: 767023 - DNA, 25 bp, Mus musculus
tactctagtgtgttggtgggactgc

SEQ ID NO: 767024 - DNA, 25 bp, Mus musculus
tactctatacatccttaccgggtta

SEQ ID NO: 767025 - DNA, 25 bp, Mus musculus
tactctatacatgcttaccgggtta

SEQ ID NO: 767026 - DNA, 25 bp, Mus musculus
tactctataccacttattgctaaag

SEQ ID NO: 767027 - DNA, 25 bp, Mus musculus
tactctataccagttattgctaaag

SEQ ID NO: 767028 - DNA, 25 bp, Mus musculus
tactctatacttcccaacgtggaga

SEQ ID NO: 767029 - DNA, 25 bp, Mus musculus
tactctatacttgccaacgtggaga

SEQ ID NO: 767030 - DNA, 25 bp, Mus musculus
tactctatagagaccccaggagcaa

SEQ ID NO: 767031 - DNA, 25 bp, Mus musculus
tactctatagagtccccaggagcaa

SEQ ID NO: 767032 - DNA, 25 bp, Mus musculus
tactctatcaataggagcgctcgct

SEQ ID NO: 767033 - DNA, 25 bp, Mus musculus
tactctatcaattggagcgctcgct

SEQ ID NO: 767034 - DNA, 25 bp, Mus musculus
tactctatcccacacacgaccattt

SEQ ID NO: 767035 - DNA, 25 bp, Mus musculus
tactctatcccagacacgaccattt

SEQ ID NO: 767036 - DNA, 25 bp, Mus musculus
tactctatcgctccaggtgtgctca

SEQ ID NO: 767037 - DNA, 25 bp, Mus musculus
tactctatcgctgcaggtgtgctca

SEQ ID NO: 767038 - DNA, 25 bp, Mus musculus
tactctatgctactctctacttctg

SEQ ID NO: 767039 - DNA, 25 bp, Mus musculus
tactctatgctagtctctacttctg

SEQ ID NO: 767040 - DNA, 25 bp, Mus musculus
tactctcaacataaaagcgtccggg

SEQ ID NO: 767041 - DNA, 25 bp, Mus musculus
tactctcaacattaaagcgtccggg

SEQ ID NO: 767042 - DNA, 25 bp, Mus musculus
tactctcaccagcatgcccaaggtt

SEQ ID NO: 767043 - DNA, 25 bp, Mus musculus
tactctcaccaggatgcccaaggtt

SEQ ID NO: 767044 - DNA, 25 bp, Mus musculus
tactctcacggtccttaccagctaa

SEQ ID NO: 767045 - DNA, 25 bp, Mus musculus
tactctcacggtgcttaccagctaa

SEQ ID NO: 767046 - DNA, 25 bp, Mus musculus
tactctcatgatcgtgccttcctgg

SEQ ID NO: 767047 - DNA, 25 bp, Mus musculus
tactctcatgatctgctgctgttca

SEQ ID NO: 767048 - DNA, 25 bp, Mus musculus
tactctcatgatggtgccttcctgg

SEQ ID NO: 767049 - DNA, 25 bp, Mus musculus
tactctcatgatgtgctgctgttca

SEQ ID NO: 767050 - DNA, 25 bp, Mus musculus
tactctcatgtcacacgtcaggaaa

SEQ ID NO: 767051 - DNA, 25 bp, Mus musculus
tactctcatgtctcacgtcaggaaa

SEQ ID NO: 767052 - DNA, 25 bp, Mus musculus
tactctccaaacagacgatccagaa

SEQ ID NO: 767053 - DNA, 25 bp, Mus musculus
tactctccaaactgacgatccagaa

SEQ ID NO: 767054 - DNA, 25 bp, Mus musculus
tactctccaaatatcttaagaacgt

SEQ ID NO: 767055 - DNA, 25 bp, Mus musculus
tactctccaaatttcttaagaacgt

SEQ ID NO: 767056 - DNA, 25 bp, Mus musculus
tactctccaatgaacgaacaggcca

SEQ ID NO: 767057 - DNA, 25 bp, Mus musculus
tactctccaatgtacgaacaggcca

SEQ ID NO: 767058 - DNA, 25 bp, Mus musculus
tactctccagaaaatgtcgtgtgtc

SEQ ID NO: 767059 - DNA, 25 bp, Mus musculus
tactctccagaatatgtcgtgtgtc

SEQ ID NO: 767060 - DNA, 25 bp, Mus musculus
tactctccagagagttgcacggagt

SEQ ID NO: 767061 - DNA, 25 bp, Mus musculus
tactctccagagtgttgcacggagt

SEQ ID NO: 767062 - DNA, 25 bp, Mus musculus
tactctcccactacaggtacgaaaa

SEQ ID NO: 767063 - DNA, 25 bp, Mus musculus
tactctcccacttcaggtacgaaaa

SEQ ID NO: 767064 - DNA, 25 bp, Mus musculus
tactctccgcagataatctttttgg

SEQ ID NO: 767065 - DNA, 25 bp, Mus musculus
tactctccgcagttaatctttttgg

SEQ ID NO: 767066 - DNA, 25 bp, Mus musculus
tactctcctagaaaactacccaaca

SEQ ID NO: 767067 - DNA, 25 bp, Mus musculus
tactctcctagataactacccaaca

SEQ ID NO: 767068 - DNA, 25 bp, Mus musculus
tactctcctgggactgagcagtgag

SEQ ID NO: 767069 - DNA, 25 bp, Mus musculus
tactctcctgggtctgagcagtgag

SEQ ID NO: 767070 - DNA, 25 bp, Mus musculus
tactctcgctcgcagggtcctggga

SEQ ID NO: 767071 - DNA, 25 bp, Mus musculus
tactctcgctcggagggtcctggga

SEQ ID NO: 767072 - DNA, 25 bp, Mus musculus
tactctcggactctggactctcgga

SEQ ID NO: 767073 - DNA, 25 bp, Mus musculus
tactctcggactgtggactctcgga

SEQ ID NO: 767074 - DNA, 25 bp, Mus musculus
tactctctactgattccttgcctgt

SEQ ID NO: 767075 - DNA, 25 bp, Mus musculus
tactctctactgtttccttgcctgt

SEQ ID NO: 767076 - DNA, 25 bp, Mus musculus
tactctctccttcagtggcaggcag

SEQ ID NO: 767077 - DNA, 25 bp, Mus musculus
tactctctccttgagtggcaggcag

SEQ ID NO: 767078 - DNA, 25 bp, Mus musculus
tactctctgactcagccaatctctg

SEQ ID NO: 767079 - DNA, 25 bp, Mus musculus
tactctctgactgagccaatctctg

SEQ ID NO: 767080 - DNA, 25 bp, Mus musculus
tactctctgaggctttagcaatgga

SEQ ID NO: 767081 - DNA, 25 bp, Mus musculus
tactctctgagggtttagcaatgga

SEQ ID NO: 767082 - DNA, 25 bp, Mus musculus
tactctctgagtcaggtcttctgaa

SEQ ID NO: 767083 - DNA, 25 bp, Mus musculus
tactctctgagtgaggtcttctgaa

SEQ ID NO: 767084 - DNA, 25 bp, Mus musculus
tactctctgcctcagatactgcggc

SEQ ID NO: 767085 - DNA, 25 bp, Mus musculus
tactctctgcctgagatactgcggc

SEQ ID NO: 767086 - DNA, 25 bp, Mus musculus
tactctctggagaggatggcttgga

SEQ ID NO: 767087 - DNA, 25 bp, Mus musculus
tactctctggagtggatggcttgga

SEQ ID NO: 767088 - DNA, 25 bp, Mus musculus
tactctctggtacgcttgggttttt

SEQ ID NO: 767089 - DNA, 25 bp, Mus musculus
tactctctggtaggcttgggttttt

SEQ ID NO: 767090 - DNA, 25 bp, Mus musculus
tactctctgtggctcctttctgaga

SEQ ID NO: 767091 - DNA, 25 bp, Mus musculus
tactctctgtgggtcctttctgaga

SEQ ID NO: 767092 - DNA, 25 bp, Mus musculus
tactctctgtgtcggatgtggcctc

SEQ ID NO: 767093 - DNA, 25 bp, Mus musculus
tactctctgtgtgggatgtggcctc

SEQ ID NO: 767094 - DNA, 25 bp, Mus musculus
tactctcttacaatcagcagcatgg

SEQ ID NO: 767095 - DNA, 25 bp, Mus musculus
tactctcttacattcagcagcatgg

SEQ ID NO: 767096 - DNA, 25 bp, Mus musculus
tactctcttcagacgccaatggagg

SEQ ID NO: 767097 - DNA, 25 bp, Mus musculus
tactctcttcagtcgccaatggagg

SEQ ID NO: 767098 - DNA, 25 bp, Mus musculus
tactctcttgagagcttaaggccaa

SEQ ID NO: 767099 - DNA, 25 bp, Mus musculus
tactctcttgagtgcttaaggccaa

SEQ ID NO: 767100 - DNA, 25 bp, Mus musculus
tactctcttgtaattgtgcctcaga

SEQ ID NO: 767101 - DNA, 25 bp, Mus musculus
tactctcttgtacacgtgctcataa

SEQ ID NO: 767102 - DNA, 25 bp, Mus musculus
tactctcttgtagacgtgctcataa

SEQ ID NO: 767103 - DNA, 25 bp, Mus musculus
tactctcttgtatttgtgcctcaga

SEQ ID NO: 767104 - DNA, 25 bp, Mus musculus
tactctgaacccatattgagaatct

SEQ ID NO: 767105 - DNA, 25 bp, Mus musculus
tactctgaacccttattgagaatct

SEQ ID NO: 767106 - DNA, 25 bp, Mus musculus
tactctgaagatcctttcggcgtgc

SEQ ID NO: 767107 - DNA, 25 bp, Mus musculus
tactctgaagatgctttcggcgtgc

SEQ ID NO: 767108 - DNA, 25 bp, Mus musculus
tactctgaagcaagtaggccacttt

SEQ ID NO: 767109 - DNA, 25 bp, Mus musculus
tactctgaagcatgtaggccacttt

SEQ ID NO: 767110 - DNA, 25 bp, Mus musculus
tactctgaccagacccatgacaaaa

SEQ ID NO: 767111 - DNA, 25 bp, Mus musculus
tactctgaccagtcccatgacaaaa

SEQ ID NO: 767112 - DNA, 25 bp, Mus musculus
tactctgaccatagcttcttggcct

SEQ ID NO: 767113 - DNA, 25 bp, Mus musculus
tactctgaccattgcttcttggcct

SEQ ID NO: 767114 - DNA, 25 bp, Mus musculus
tactctgagctaccagatggcatct

SEQ ID NO: 767115 - DNA, 25 bp, Mus musculus
tactctgagctagcagatggcatct

SEQ ID NO: 767116 - DNA, 25 bp, Mus musculus
tactctgatactcggctgctgggcg

SEQ ID NO: 767117 - DNA, 25 bp, Mus musculus
tactctgatactgggctgctgggcg

SEQ ID NO: 767118 - DNA, 25 bp, Mus musculus
tactctgattttcctagcccatggt

SEQ ID NO: 767119 - DNA, 25 bp, Mus musculus
tactctgattttgctagcccatggt

SEQ ID NO: 767120 - DNA, 25 bp, Mus musculus
tactctgcaactcaccatctggaat

SEQ ID NO: 767121 - DNA, 25 bp, Mus musculus
tactctgcaactgaccatctggaat

SEQ ID NO: 767122 - DNA, 25 bp, Mus musculus
tactctgcaagcaaggtggctgtca

SEQ ID NO: 767123 - DNA, 25 bp, Mus musculus
tactctgcaagctaggtggctgtca

SEQ ID NO: 767124 - DNA, 25 bp, Mus musculus
tactctgcagacacaggtcctctgt

SEQ ID NO: 767125 - DNA, 25 bp, Mus musculus
tactctgcagactcaggtcctctgt

SEQ ID NO: 767126 - DNA, 25 bp, Mus musculus
tactctgccaatattatccatgttc

SEQ ID NO: 767127 - DNA, 25 bp, Mus musculus
tactctgccaattttatccatgttc

SEQ ID NO: 767128 - DNA, 25 bp, Mus musculus
tactctgcccagataattagaagtg

SEQ ID NO: 767129 - DNA, 25 bp, Mus musculus
tactctgcccagttaattagaagtg

SEQ ID NO: 767130 - DNA, 25 bp, Mus musculus
tactctgcccatacagtagaagcca

SEQ ID NO: 767131 - DNA, 25 bp, Mus musculus
tactctgcccattcagtagaagcca

SEQ ID NO: 767132 - DNA, 25 bp, Mus musculus
tactctgcctagctgctggcaaggc

SEQ ID NO: 767133 - DNA, 25 bp, Mus musculus
tactctgcctaggtgctggcaaggc

SEQ ID NO: 767134 - DNA, 25 bp, Mus musculus
tactctgcctgtatcttagaccaaa

SEQ ID NO: 767135 - DNA, 25 bp, Mus musculus
tactctgcctgtttcttagaccaaa

SEQ ID NO: 767136 - DNA, 25 bp, Mus musculus
tactctgcgcatagaatagttgtgg

SEQ ID NO: 767137 - DNA, 25 bp, Mus musculus
tactctgcgcattgaatagttgtgg

SEQ ID NO: 767138 - DNA, 25 bp, Mus musculus
tactctgcggctactagataaagac

SEQ ID NO: 767139 - DNA, 25 bp, Mus musculus
tactctgcggcttctagataaagac

SEQ ID NO: 767140 - DNA, 25 bp, Mus musculus
tactctgctaacacagatggcattc

SEQ ID NO: 767141 - DNA, 25 bp, Mus musculus
tactctgctaactcagatggcattc

SEQ ID NO: 767142 - DNA, 25 bp, Mus musculus
tactctgctagaatatggactgttg

SEQ ID NO: 767143 - DNA, 25 bp, Mus musculus
tactctgctagattatggactgttg

SEQ ID NO: 767144 - DNA, 25 bp, Mus musculus
tactctgctattagacaattccgta

SEQ ID NO: 767145 - DNA, 25 bp, Mus musculus
tactctgctatttgacaattccgta

SEQ ID NO: 767146 - DNA, 25 bp, Mus musculus
tactctgctctccacttaagtgtct

SEQ ID NO: 767147 - DNA, 25 bp, Mus musculus
tactctgctctcgacttaagtgtct

SEQ ID NO: 767148 - DNA, 25 bp, Mus musculus
tactctgcttcccttagctctggta

SEQ ID NO: 767149 - DNA, 25 bp, Mus musculus
tactctgcttccgttagctctggta

SEQ ID NO: 767150 - DNA, 25 bp, Mus musculus
tactctgctttgaggaaaaccgaaa

SEQ ID NO: 767151 - DNA, 25 bp, Mus musculus
tactctgctttgtggaaaaccgaaa

SEQ ID NO: 767152 - DNA, 25 bp, Mus musculus
tactctgcttttaagccccttggct

SEQ ID NO: 767153 - DNA, 25 bp, Mus musculus
tactctgctttttagccccttggct

SEQ ID NO: 767154 - DNA, 25 bp, Mus musculus
tactctggaagtcatctgaccgctt

SEQ ID NO: 767155 - DNA, 25 bp, Mus musculus
tactctggaagtgatctgaccgctt

SEQ ID NO: 767156 - DNA, 25 bp, Mus musculus
tactctggccctaggactttggaaa

SEQ ID NO: 767157 - DNA, 25 bp, Mus musculus
tactctggcccttggactttggaaa

SEQ ID NO: 767158 - DNA, 25 bp, Mus musculus
tactctggcctcagatacattgctg

SEQ ID NO: 767159 - DNA, 25 bp, Mus musculus
tactctggcctctgatacattgctg

SEQ ID NO: 767160 - DNA, 25 bp, Mus musculus
tactctgggaaaagacgtcccgctg

SEQ ID NO: 767161 - DNA, 25 bp, Mus musculus
tactctgggaaatgacgtcccgctg

SEQ ID NO: 767162 - DNA, 25 bp, Mus musculus
tactctgggaagaaggagttaccct

SEQ ID NO: 767163 - DNA, 25 bp, Mus musculus
tactctgggaagtaggagttaccct

SEQ ID NO: 767164 - DNA, 25 bp, Mus musculus
tactctgggatgcaaccgacatgtt

SEQ ID NO: 767165 - DNA, 25 bp, Mus musculus
tactctgggatggaaccgacatgtt

SEQ ID NO: 767166 - DNA, 25 bp, Mus musculus
tactctgggccacgaggtctgacag

SEQ ID NO: 767167 - DNA, 25 bp, Mus musculus
tactctgggccaggaggtctgacag

SEQ ID NO: 767168 - DNA, 25 bp, Mus musculus
tactctgggcccatataggtcaaga

SEQ ID NO: 767169 - DNA, 25 bp, Mus musculus
tactctgggcccttataggtcaaga

SEQ ID NO: 767170 - DNA, 25 bp, Mus musculus
tactctgggtagagctccctcgggt

SEQ ID NO: 767171 - DNA, 25 bp, Mus musculus
tactctgggtagtgctccctcgggt

SEQ ID NO: 767172 - DNA, 25 bp, Mus musculus
tactctgggtccactcttagcttgg

SEQ ID NO: 767173 - DNA, 25 bp, Mus musculus
tactctgggtcctctcttagcttgg

SEQ ID NO: 767174 - DNA, 25 bp, Mus musculus
tactctgggtttaacaacatctgac

SEQ ID NO: 767175 - DNA, 25 bp, Mus musculus
tactctgggttttacaacatctgac

SEQ ID NO: 767176 - DNA, 25 bp, Mus musculus
tactctggtaagaattattgcctct

SEQ ID NO: 767177 - DNA, 25 bp, Mus musculus
tactctggtaagtattattgcctct

SEQ ID NO: 767178 - DNA, 25 bp, Mus musculus
tactctggtagtagcctggaagact

SEQ ID NO: 767179 - DNA, 25 bp, Mus musculus
tactctggtagttgcctggaagact

SEQ ID NO: 767180 - DNA, 25 bp, Mus musculus
tactctggtgagagtgcatgcccat

SEQ ID NO: 767181 - DNA, 25 bp, Mus musculus
tactctggtgagtgtgcatgcccat

SEQ ID NO: 767182 - DNA, 25 bp, Mus musculus
tactctggtgccacagctttctttc

SEQ ID NO: 767183 - DNA, 25 bp, Mus musculus
tactctggtgcctcagctttctttc

SEQ ID NO: 767184 - DNA, 25 bp, Mus musculus
tactctggttccaccttaggtcact

SEQ ID NO: 767185 - DNA, 25 bp, Mus musculus
tactctggttcctccttaggtcact

SEQ ID NO: 767186 - DNA, 25 bp, Mus musculus
tactctggtttcacatatgggtaga

SEQ ID NO: 767187 - DNA, 25 bp, Mus musculus
tactctggtttcaccttagtctcaa

SEQ ID NO: 767188 - DNA, 25 bp, Mus musculus
tactctggtttctcatatgggtaga

SEQ ID NO: 767189 - DNA, 25 bp, Mus musculus
tactctggtttctccttagtctcaa

SEQ ID NO: 767190 - DNA, 25 bp, Mus musculus
tactctgtaatcagaagcctgcaaa

SEQ ID NO: 767191 - DNA, 25 bp, Mus musculus
tactctgtaatctgaagcctgcaaa

SEQ ID NO: 767192 - DNA, 25 bp, Mus musculus
tactctgtacttatacctgtagact

SEQ ID NO: 767193 - DNA, 25 bp, Mus musculus
tactctgtacttttacctgtagact

SEQ ID NO: 767194 - DNA, 25 bp, Mus musculus
tactctgtagtgattaggcagctcc

SEQ ID NO: 767195 - DNA, 25 bp, Mus musculus
tactctgtagtgtttaggcagctcc

SEQ ID NO: 767196 - DNA, 25 bp, Mus musculus
tactctgtcatgattatagtgtgct

SEQ ID NO: 767197 - DNA, 25 bp, Mus musculus
tactctgtcatgtttatagtgtgct

SEQ ID NO: 767198 - DNA, 25 bp, Mus musculus
tactctgtccctatgctgagtgtca

SEQ ID NO: 767199 - DNA, 25 bp, Mus musculus
tactctgtccctttgctgagtgtca

SEQ ID NO: 767200 - DNA, 25 bp, Mus musculus
tactctgtctcccaccaataaataa

SEQ ID NO: 767201 - DNA, 25 bp, Mus musculus
tactctgtctccgaccaataaataa

SEQ ID NO: 767202 - DNA, 25 bp, Mus musculus
tactctgtctgccatctagatattg

SEQ ID NO: 767203 - DNA, 25 bp, Mus musculus
tactctgtctgcgatctagatattg

SEQ ID NO: 767204 - DNA, 25 bp, Mus musculus
tactctgtgaccacggtacatccat

SEQ ID NO: 767205 - DNA, 25 bp, Mus musculus
tactctgtgacctcggtacatccat

SEQ ID NO: 767206 - DNA, 25 bp, Mus musculus
tactctgtggagcacctttgaccca

SEQ ID NO: 767207 - DNA, 25 bp, Mus musculus
tactctgtggaggacctttgaccca

SEQ ID NO: 767208 - DNA, 25 bp, Mus musculus
tactctgtggccatttcctttcctg

SEQ ID NO: 767209 - DNA, 25 bp, Mus musculus
tactctgtggccttttcctttcctg

SEQ ID NO: 767210 - DNA, 25 bp, Mus musculus
tactctgtggcgctgttggaacccc

SEQ ID NO: 767211 - DNA, 25 bp, Mus musculus
tactctgtggcggtgttggaacccc

SEQ ID NO: 767212 - DNA, 25 bp, Mus musculus
tactctgtgggcaaattcagtgtga

SEQ ID NO: 767213 - DNA, 25 bp, Mus musculus
tactctgtgggctaattcagtgtga

SEQ ID NO: 767214 - DNA, 25 bp, Mus musculus
tactctgtgtacaccaggcatctat

SEQ ID NO: 767215 - DNA, 25 bp, Mus musculus
tactctgtgtactccaggcatctat

SEQ ID NO: 767216 - DNA, 25 bp, Mus musculus
tactctgtgttgcataatactgtgg

SEQ ID NO: 767217 - DNA, 25 bp, Mus musculus
tactctgtgttggataatactgtgg

SEQ ID NO: 767218 - DNA, 25 bp, Mus musculus
tactctgttcctccattctgtttac

SEQ ID NO: 767219 - DNA, 25 bp, Mus musculus
tactctgttcctgcattctgtttac

SEQ ID NO: 767220 - DNA, 25 bp, Mus musculus
tactcttaaagactgcgacctgccg

SEQ ID NO: 767221 - DNA, 25 bp, Mus musculus
tactcttaaagagtgcgacctgccg

SEQ ID NO: 767222 - DNA, 25 bp, Mus musculus
tactcttaaggtaatctttttcctg

SEQ ID NO: 767223 - DNA, 25 bp, Mus musculus
tactcttaaggttatctttttcctg

SEQ ID NO: 767224 - DNA, 25 bp, Mus musculus
tactcttacagacgcaagttccagg

SEQ ID NO: 767225 - DNA, 25 bp, Mus musculus
tactcttacagaggcaagttccagg

SEQ ID NO: 767226 - DNA, 25 bp, Mus musculus
tactcttacccaccctgggatggaa

SEQ ID NO: 767227 - DNA, 25 bp, Mus musculus
tactcttacccagcctgggatggaa

SEQ ID NO: 767228 - DNA, 25 bp, Mus musculus
tactcttagctgcagtcttgccaga

SEQ ID NO: 767229 - DNA, 25 bp, Mus musculus
tactcttagctggagtcttgccaga

SEQ ID NO: 767230 - DNA, 25 bp, Mus musculus
tactcttagggtaattgttccatgc

SEQ ID NO: 767231 - DNA, 25 bp, Mus musculus
tactcttagggttattgttccatgc

SEQ ID NO: 767232 - DNA, 25 bp, Mus musculus
tactcttagtcactctggctttcag

SEQ ID NO: 767233 - DNA, 25 bp, Mus musculus
tactcttagtcagtctggctttcag

SEQ ID NO: 767234 - DNA, 25 bp, Mus musculus
tactcttattcccagatagcccatt

SEQ ID NO: 767235 - DNA, 25 bp, Mus musculus
tactcttattccgagatagcccatt

SEQ ID NO: 767236 - DNA, 25 bp, Mus musculus
tactcttcaaagaagcaggcaagct

SEQ ID NO: 767237 - DNA, 25 bp, Mus musculus
tactcttcaaagtagcaggcaagct

SEQ ID NO: 767238 - DNA, 25 bp, Mus musculus
tactcttcagccaatcttaatgtga

SEQ ID NO: 767239 - DNA, 25 bp, Mus musculus
tactcttcagcctatcttaatgtga

SEQ ID NO: 767240 - DNA, 25 bp, Mus musculus
tactcttcatctatacatgaccgag

SEQ ID NO: 767241 - DNA, 25 bp, Mus musculus
tactcttcatctttacatgaccgag

SEQ ID NO: 767242 - DNA, 25 bp, Mus musculus
tactcttccactctgtttgcagcag

SEQ ID NO: 767243 - DNA, 25 bp, Mus musculus
tactcttccactgtgtttgcagcag

SEQ ID NO: 767244 - DNA, 25 bp, Mus musculus
tactcttccccaaagcactatattt

SEQ ID NO: 767245 - DNA, 25 bp, Mus musculus
tactcttccccatagcactatattt

SEQ ID NO: 767246 - DNA, 25 bp, Mus musculus
tactcttccgtccaaggaaactatc

SEQ ID NO: 767247 - DNA, 25 bp, Mus musculus
tactcttccgtcgaaggaaactatc

SEQ ID NO: 767248 - DNA, 25 bp, Mus musculus
tactcttccgttacactacacaata

SEQ ID NO: 767249 - DNA, 25 bp, Mus musculus
tactcttccgtttcactacacaata

SEQ ID NO: 767250 - DNA, 25 bp, Mus musculus
tactcttcctgaacaccagtatctg

SEQ ID NO: 767251 - DNA, 25 bp, Mus musculus
tactcttcctgatcaccagtatctg

SEQ ID NO: 767252 - DNA, 25 bp, Mus musculus
tactcttcggctacagggatcccta

SEQ ID NO: 767253 - DNA, 25 bp, Mus musculus
tactcttcggcttcagggatcccta

SEQ ID NO: 767254 - DNA, 25 bp, Mus musculus
tactcttctagaattcatcataacc

SEQ ID NO: 767255 - DNA, 25 bp, Mus musculus
tactcttctagatttcatcataacc

SEQ ID NO: 767256 - DNA, 25 bp, Mus musculus
tactcttctcatatatagctcaaag

SEQ ID NO: 767257 - DNA, 25 bp, Mus musculus
tactcttctcatttatagctcaaag

SEQ ID NO: 767258 - DNA, 25 bp, Mus musculus
tactcttctgagctggtgacttctt

SEQ ID NO: 767259 - DNA, 25 bp, Mus musculus
tactcttctgaggtggtgacttctt

SEQ ID NO: 767260 - DNA, 25 bp, Mus musculus
tactcttcttaccaatgtaatcttg

SEQ ID NO: 767261 - DNA, 25 bp, Mus musculus
tactcttcttacgaatgtaatcttg

SEQ ID NO: 767262 - DNA, 25 bp, Mus musculus
tactcttcttttctcttagactaaa

SEQ ID NO: 767263 - DNA, 25 bp, Mus musculus
tactcttcttttgtcttagactaaa

SEQ ID NO: 767264 - DNA, 25 bp, Mus musculus
tactcttgaggtccattcaaccaca

SEQ ID NO: 767265 - DNA, 25 bp, Mus musculus
tactcttgaggtgcattcaaccaca

SEQ ID NO: 767266 - DNA, 25 bp, Mus musculus
tactcttgagtaccccaaatttgtg

SEQ ID NO: 767267 - DNA, 25 bp, Mus musculus
tactcttgagtagcccaaatttgtg

SEQ ID NO: 767268 - DNA, 25 bp, Mus musculus
tactcttgccataacgccccgtgtt

SEQ ID NO: 767269 - DNA, 25 bp, Mus musculus
tactcttgccattacgccccgtgtt

SEQ ID NO: 767270 - DNA, 25 bp, Mus musculus
tactcttgcctgcatagtgctgagg

SEQ ID NO: 767271 - DNA, 25 bp, Mus musculus
tactcttgcctggatagtgctgagg

SEQ ID NO: 767272 - DNA, 25 bp, Mus musculus
tactcttggaaaagtagattcactt

SEQ ID NO: 767273 - DNA, 25 bp, Mus musculus
tactcttggaaatgtagattcactt

SEQ ID NO: 767274 - DNA, 25 bp, Mus musculus
tactcttgggttatgagggtgccat

SEQ ID NO: 767275 - DNA, 25 bp, Mus musculus
tactcttgggttttgagggtgccat

SEQ ID NO: 767276 - DNA, 25 bp, Mus musculus
tactcttggtctcttgtatgctttc

SEQ ID NO: 767277 - DNA, 25 bp, Mus musculus
tactcttggtctgttgtatgctttc

SEQ ID NO: 767278 - DNA, 25 bp, Mus musculus
tactcttgtggcctgcccactggtg

SEQ ID NO: 767279 - DNA, 25 bp, Mus musculus
tactcttgtggcgtgcccactggtg

SEQ ID NO: 767280 - DNA, 25 bp, Mus musculus
tactctttaaacctggacctgtcca

SEQ ID NO: 767281 - DNA, 25 bp, Mus musculus
tactctttaaacgtggacctgtcca

SEQ ID NO: 767282 - DNA, 25 bp, Mus musculus
tactctttagcacacacactcaaaa

SEQ ID NO: 767283 - DNA, 25 bp, Mus musculus
tactctttagcagacacactcaaaa

SEQ ID NO: 767284 - DNA, 25 bp, Mus musculus
tactctttctggagagtgagtgact

SEQ ID NO: 767285 - DNA, 25 bp, Mus musculus
tactctttctggtgagtgagtgact

SEQ ID NO: 767286 - DNA, 25 bp, Mus musculus
tactctttcttactgtgaatagaag

SEQ ID NO: 767287 - DNA, 25 bp, Mus musculus
tactctttcttagtgtgaatagaag

SEQ ID NO: 767288 - DNA, 25 bp, Mus musculus
tactctttgaccctaactgtgtctt

SEQ ID NO: 767289 - DNA, 25 bp, Mus musculus
tactctttgaccgtaactgtgtctt

SEQ ID NO: 767290 - DNA, 25 bp, Mus musculus
tactctttgagcatccttctgggct

SEQ ID NO: 767291 - DNA, 25 bp, Mus musculus
tactctttgagcttccttctgggct

SEQ ID NO: 767292 - DNA, 25 bp, Mus musculus
tactctttgatgactcgttcctgca

SEQ ID NO: 767293 - DNA, 25 bp, Mus musculus
tactctttgatgatatattaccgaa

SEQ ID NO: 767294 - DNA, 25 bp, Mus musculus
tactctttgatgtctcgttcctgca

SEQ ID NO: 767295 - DNA, 25 bp, Mus musculus
tactctttgatgttatattaccgaa

SEQ ID NO: 767296 - DNA, 25 bp, Mus musculus
tactctttgattcctcgtactccag

SEQ ID NO: 767297 - DNA, 25 bp, Mus musculus
tactctttgattctcacttgataca

SEQ ID NO: 767298 - DNA, 25 bp, Mus musculus
tactctttgattgctcgtactccag

SEQ ID NO: 767299 - DNA, 25 bp, Mus musculus
tactctttgattgtcacttgataca

SEQ ID NO: 767300 - DNA, 25 bp, Mus musculus
tactctttggagacctcctgattgc

SEQ ID NO: 767301 - DNA, 25 bp, Mus musculus
tactctttggagtcctcctgattgc

SEQ ID NO: 767302 - DNA, 25 bp, Mus musculus
tactctttggtcctatttacttcct

SEQ ID NO: 767303 - DNA, 25 bp, Mus musculus
tactctttggtcgtatttacttcct

SEQ ID NO: 767304 - DNA, 25 bp, Mus musculus
tactcttttagacaaaaacactgga

SEQ ID NO: 767305 - DNA, 25 bp, Mus musculus
tactcttttagagaaaaacactgga

SEQ ID NO: 767306 - DNA, 25 bp, Mus musculus
tactcttttgtaagtgaactttcct

SEQ ID NO: 767307 - DNA, 25 bp, Mus musculus
tactcttttgtacatactcaggcag

SEQ ID NO: 767308 - DNA, 25 bp, Mus musculus
tactcttttgtagatactcaggcag

SEQ ID NO: 767309 - DNA, 25 bp, Mus musculus
tactcttttgtatgtgaactttcct

SEQ ID NO: 767310 - DNA, 25 bp, Mus musculus
tactgaaaactgctaccacccgtga

SEQ ID NO: 767311 - DNA, 25 bp, Mus musculus
tactgaaaactggtaccacccgtga

SEQ ID NO: 767312 - DNA, 25 bp, Mus musculus
tactgaaactagatgtccttttcta

SEQ ID NO: 767313 - DNA, 25 bp, Mus musculus
tactgaaactagttgtccttttcta

SEQ ID NO: 767314 - DNA, 25 bp, Mus musculus
tactgaaactggagatcaagactga

SEQ ID NO: 767315 - DNA, 25 bp, Mus musculus
tactgaaactggtgatcaagactga

SEQ ID NO: 767316 - DNA, 25 bp, Mus musculus
tactgaaagcaaagcgctgattcca

SEQ ID NO: 767317 - DNA, 25 bp, Mus musculus
tactgaaagcaatgcgctgattcca

SEQ ID NO: 767318 - DNA, 25 bp, Mus musculus
tactgaaatcctctttcagcggcag

SEQ ID NO: 767319 - DNA, 25 bp, Mus musculus
tactgaaatcctgtttcagcggcag

SEQ ID NO: 767320 - DNA, 25 bp, Mus musculus
tactgaaatgtgaacctctgcctgg

SEQ ID NO: 767321 - DNA, 25 bp, Mus musculus
tactgaaatgtgtacctctgcctgg

SEQ ID NO: 767322 - DNA, 25 bp, Mus musculus
tactgaacacacagccttttatcca

SEQ ID NO: 767323 - DNA, 25 bp, Mus musculus
tactgaacacactgccttttatcca

SEQ ID NO: 767324 - DNA, 25 bp, Mus musculus
tactgaaccaccaaacagcttgggc

SEQ ID NO: 767325 - DNA, 25 bp, Mus musculus
tactgaaccacctaacagcttgggc

SEQ ID NO: 767326 - DNA, 25 bp, Mus musculus
tactgaaccatcaagttggcccatg

SEQ ID NO: 767327 - DNA, 25 bp, Mus musculus
tactgaaccatctagttggcccatg

SEQ ID NO: 767328 - DNA, 25 bp, Mus musculus
tactgaagaacaagacctcacctta

SEQ ID NO: 767329 - DNA, 25 bp, Mus musculus
tactgaagaacatgacctcacctta

SEQ ID NO: 767330 - DNA, 25 bp, Mus musculus
tactgaagacaactgccccttctgc

SEQ ID NO: 767331 - DNA, 25 bp, Mus musculus
tactgaagacaagtgccccttctgc

SEQ ID NO: 767332 - DNA, 25 bp, Mus musculus
tactgaagagacaccctgatgatgc

SEQ ID NO: 767333 - DNA, 25 bp, Mus musculus
tactgaagagactccctgatgatgc

SEQ ID NO: 767334 - DNA, 25 bp, Mus musculus
tactgaagataacccaacattgaat

SEQ ID NO: 767335 - DNA, 25 bp, Mus musculus
tactgaagataagccaacattgaat

SEQ ID NO: 767336 - DNA, 25 bp, Mus musculus
tactgaagatccaaactagagtttt

SEQ ID NO: 767337 - DNA, 25 bp, Mus musculus
tactgaagatcctaactagagtttt

SEQ ID NO: 767338 - DNA, 25 bp, Mus musculus
tactgaagatgcctgggaccctgat

SEQ ID NO: 767339 - DNA, 25 bp, Mus musculus
tactgaagatgcgtgggaccctgat

SEQ ID NO: 767340 - DNA, 25 bp, Mus musculus
tactgaagcctcagagcatctctca

SEQ ID NO: 767341 - DNA, 25 bp, Mus musculus
tactgaagcctctgagcatctctca

SEQ ID NO: 767342 - DNA, 25 bp, Mus musculus
tactgaaggagaacgctgtgcccac

SEQ ID NO: 767343 - DNA, 25 bp, Mus musculus
tactgaaggagatcgctgtgcccac

SEQ ID NO: 767344 - DNA, 25 bp, Mus musculus
tactgaagtggccttcaacccagca

SEQ ID NO: 767345 - DNA, 25 bp, Mus musculus
tactgaagtggcgttcaacccagca

SEQ ID NO: 767346 - DNA, 25 bp, Mus musculus
tactgaagtgtaatccttaccgtca

SEQ ID NO: 767347 - DNA, 25 bp, Mus musculus
tactgaagtgtattccttaccgtca

SEQ ID NO: 767348 - DNA, 25 bp, Mus musculus
tactgaagttttatcctcctacctg

SEQ ID NO: 767349 - DNA, 25 bp, Mus musculus
tactgaagttttttcctcctacctg

SEQ ID NO: 767350 - DNA, 25 bp, Mus musculus
tactgaataccgaatcaccccaagg

SEQ ID NO: 767351 - DNA, 25 bp, Mus musculus
tactgaataccgtatcaccccaagg

SEQ ID NO: 767352 - DNA, 25 bp, Mus musculus
tactgaatctgacccaaacagctgc

SEQ ID NO: 767353 - DNA, 25 bp, Mus musculus
tactgaatctgagccaaacagctgc

SEQ ID NO: 767354 - DNA, 25 bp, Mus musculus
tactgaatctttcccattgagaagg

SEQ ID NO: 767355 - DNA, 25 bp, Mus musculus
tactgaatctttgccattgagaagg

SEQ ID NO: 767356 - DNA, 25 bp, Mus musculus
tactgaatgcagagtgacaccttga

SEQ ID NO: 767357 - DNA, 25 bp, Mus musculus
tactgaatgcagtgtgacaccttga

SEQ ID NO: 767358 - DNA, 25 bp, Mus musculus
tactgaatgcatacactttttaagc

SEQ ID NO: 767359 - DNA, 25 bp, Mus musculus
tactgaatgcattcactttttaagc

SEQ ID NO: 767360 - DNA, 25 bp, Mus musculus
tactgaattatgatgactggatcaa

SEQ ID NO: 767361 - DNA, 25 bp, Mus musculus
tactgaattatgttgactggatcaa

SEQ ID NO: 767362 - DNA, 25 bp, Mus musculus
tactgaatttaacaggtgtggctaa

SEQ ID NO: 767363 - DNA, 25 bp, Mus musculus
tactgaatttaagaggtgtggctaa

SEQ ID NO: 767364 - DNA, 25 bp, Mus musculus
tactgaatttggacttcacactgac

SEQ ID NO: 767365 - DNA, 25 bp, Mus musculus
tactgaatttggtcttcacactgac

SEQ ID NO: 767366 - DNA, 25 bp, Mus musculus
tactgacaatctctgctttccaggg

SEQ ID NO: 767367 - DNA, 25 bp, Mus musculus
tactgacaatctgtgctttccaggg

SEQ ID NO: 767368 - DNA, 25 bp, Mus musculus
tactgacacactagaccctgcaaaa

SEQ ID NO: 767369 - DNA, 25 bp, Mus musculus
tactgacacacttgaccctgcaaaa

SEQ ID NO: 767370 - DNA, 25 bp, Mus musculus
tactgacacaggcttacagactcaa

SEQ ID NO: 767371 - DNA, 25 bp, Mus musculus
tactgacacagggttacagactcaa

SEQ ID NO: 767372 - DNA, 25 bp, Mus musculus
tactgacaccacaattgccaacaac

SEQ ID NO: 767373 - DNA, 25 bp, Mus musculus
tactgacaccactattgccaacaac

SEQ ID NO: 767374 - DNA, 25 bp, Mus musculus
tactgacacctcatggtctcatttt

SEQ ID NO: 767375 - DNA, 25 bp, Mus musculus
tactgacacctcttggtctcatttt

SEQ ID NO: 767376 - DNA, 25 bp, Mus musculus
tactgacacttcactgcacttggac

SEQ ID NO: 767377 - DNA, 25 bp, Mus musculus
tactgacacttctctgcacttggac

SEQ ID NO: 767378 - DNA, 25 bp, Mus musculus
tactgacagctcctccaagacactt

SEQ ID NO: 767379 - DNA, 25 bp, Mus musculus
tactgacagctcgtccaagacactt

SEQ ID NO: 767380 - DNA, 25 bp, Mus musculus
tactgacagcttatccggatgccgc

SEQ ID NO: 767381 - DNA, 25 bp, Mus musculus
tactgacagcttttccggatgccgc

SEQ ID NO: 767382 - DNA, 25 bp, Mus musculus
tactgacaggttagggtccccaact

SEQ ID NO: 767383 - DNA, 25 bp, Mus musculus
tactgacaggtttgggtccccaact

SEQ ID NO: 767384 - DNA, 25 bp, Mus musculus
tactgacagtatcacctctttgagt

SEQ ID NO: 767385 - DNA, 25 bp, Mus musculus
tactgacagtatgacctctttgagt

SEQ ID NO: 767386 - DNA, 25 bp, Mus musculus
tactgacatagtagcccactgttca

SEQ ID NO: 767387 - DNA, 25 bp, Mus musculus
tactgacatagttgcccactgttca

SEQ ID NO: 767388 - DNA, 25 bp, Mus musculus
tactgacatgagacgagcatacact

SEQ ID NO: 767389 - DNA, 25 bp, Mus musculus
tactgacatgagtcgagcatacact

SEQ ID NO: 767390 - DNA, 25 bp, Mus musculus
tactgacattacacactgggacctg

SEQ ID NO: 767391 - DNA, 25 bp, Mus musculus
tactgacattactcactgggacctg

SEQ ID NO: 767392 - DNA, 25 bp, Mus musculus
tactgaccaccgagtgatttctgtg

SEQ ID NO: 767393 - DNA, 25 bp, Mus musculus
tactgaccaccgtgtgatttctgtg

SEQ ID NO: 767394 - DNA, 25 bp, Mus musculus
tactgacccatcactacagaccttc

SEQ ID NO: 767395 - DNA, 25 bp, Mus musculus
tactgacccatctctacagaccttc

SEQ ID NO: 767396 - DNA, 25 bp, Mus musculus
tactgacccttcacagtaactctgt

SEQ ID NO: 767397 - DNA, 25 bp, Mus musculus
tactgacccttctcagtaactctgt

SEQ ID NO: 767398 - DNA, 25 bp, Mus musculus
tactgacccttgaggtcaaaccttt

SEQ ID NO: 767399 - DNA, 25 bp, Mus musculus
tactgacccttgtggtcaaaccttt

SEQ ID NO: 767400 - DNA, 25 bp, Mus musculus
tactgaccgtatagtcaaccgagcc

SEQ ID NO: 767401 - DNA, 25 bp, Mus musculus
tactgaccgtattgtcaaccgagcc

SEQ ID NO: 767402 - DNA, 25 bp, Mus musculus
tactgacctgccacatgaggtttgg

SEQ ID NO: 767403 - DNA, 25 bp, Mus musculus
tactgacctgcctcatgaggtttgg

SEQ ID NO: 767404 - DNA, 25 bp, Mus musculus
tactgacctggtatgcatgcaatat

SEQ ID NO: 767405 - DNA, 25 bp, Mus musculus
tactgacctggtttgcatgcaatat

SEQ ID NO: 767406 - DNA, 25 bp, Mus musculus
tactgaccttccatgatgctgtggg

SEQ ID NO: 767407 - DNA, 25 bp, Mus musculus
tactgaccttccttgatgctgtggg

SEQ ID NO: 767408 - DNA, 25 bp, Mus musculus
tactgacgccctaacagttgagaag

SEQ ID NO: 767409 - DNA, 25 bp, Mus musculus
tactgacgcccttacagttgagaag

SEQ ID NO: 767410 - DNA, 25 bp, Mus musculus
tactgactcagaattggcaacaaac

SEQ ID NO: 767411 - DNA, 25 bp, Mus musculus
tactgactcagatttggcaacaaac

SEQ ID NO: 767412 - DNA, 25 bp, Mus musculus
tactgactccctcagaagagggcta

SEQ ID NO: 767413 - DNA, 25 bp, Mus musculus
tactgactccctgagaagagggcta

SEQ ID NO: 767414 - DNA, 25 bp, Mus musculus
tactgactccttagttccgggagat

SEQ ID NO: 767415 - DNA, 25 bp, Mus musculus
tactgactcctttgttccgggagat

SEQ ID NO: 767416 - DNA, 25 bp, Mus musculus
tactgactctaaacacttctcaagc

SEQ ID NO: 767417 - DNA, 25 bp, Mus musculus
tactgactctaatcacttctcaagc

SEQ ID NO: 767418 - DNA, 25 bp, Mus musculus
tactgactctacatccaatgtggtg

SEQ ID NO: 767419 - DNA, 25 bp, Mus musculus
tactgactctacttccaatgtggtg

SEQ ID NO: 767420 - DNA, 25 bp, Mus musculus
tactgactgaggctactctctgttt

SEQ ID NO: 767421 - DNA, 25 bp, Mus musculus
tactgactgagggtactctctgttt

SEQ ID NO: 767422 - DNA, 25 bp, Mus musculus
tactgactgatgaactgcgctgacc

SEQ ID NO: 767423 - DNA, 25 bp, Mus musculus
tactgactgatgatgctccgttgaa

SEQ ID NO: 767424 - DNA, 25 bp, Mus musculus
tactgactgatgtactgcgctgacc

SEQ ID NO: 767425 - DNA, 25 bp, Mus musculus
tactgactgatgttgctccgttgaa

SEQ ID NO: 767426 - DNA, 25 bp, Mus musculus
tactgactgcgcaaaacactgagca

SEQ ID NO: 767427 - DNA, 25 bp, Mus musculus
tactgactgcgctaaacactgagca

SEQ ID NO: 767428 - DNA, 25 bp, Mus musculus
tactgactgcttccggtttctaatc

SEQ ID NO: 767429 - DNA, 25 bp, Mus musculus
tactgactgcttgcggtttctaatc

SEQ ID NO: 767430 - DNA, 25 bp, Mus musculus
tactgactggctcaggagatgagct

SEQ ID NO: 767431 - DNA, 25 bp, Mus musculus
tactgactggctgaggagatgagct

SEQ ID NO: 767432 - DNA, 25 bp, Mus musculus
tactgactgtcaagctctgcaggag

SEQ ID NO: 767433 - DNA, 25 bp, Mus musculus
tactgactgtcatgctctgcaggag

SEQ ID NO: 767434 - DNA, 25 bp, Mus musculus
tactgactgtccctaatctgttgaa

SEQ ID NO: 767435 - DNA, 25 bp, Mus musculus
tactgactgtccgtaatctgttgaa

SEQ ID NO: 767436 - DNA, 25 bp, Mus musculus
tactgacttagcaatgtggccttgg

SEQ ID NO: 767437 - DNA, 25 bp, Mus musculus
tactgacttagctatgtggccttgg

SEQ ID NO: 767438 - DNA, 25 bp, Mus musculus
tactgacttctaatgctgtgttccc

SEQ ID NO: 767439 - DNA, 25 bp, Mus musculus
tactgacttctattgctgtgttccc

SEQ ID NO: 767440 - DNA, 25 bp, Mus musculus
tactgacttgctaggcagagcttcc

SEQ ID NO: 767441 - DNA, 25 bp, Mus musculus
tactgacttgcttggcagagcttcc

SEQ ID NO: 767442 - DNA, 25 bp, Mus musculus
tactgactttccatgtactgggctg

SEQ ID NO: 767443 - DNA, 25 bp, Mus musculus
tactgactttccttgtactgggctg

SEQ ID NO: 767444 - DNA, 25 bp, Mus musculus
tactgacttttgaagccttgtgtgc

SEQ ID NO: 767445 - DNA, 25 bp, Mus musculus
tactgacttttgtagccttgtgtgc

SEQ ID NO: 767446 - DNA, 25 bp, Mus musculus
tactgagaaaaaccgccacacacac

SEQ ID NO: 767447 - DNA, 25 bp, Mus musculus
tactgagaaaaagcgccacacacac

SEQ ID NO: 767448 - DNA, 25 bp, Mus musculus
tactgagaagcccacttccgaatca

SEQ ID NO: 767449 - DNA, 25 bp, Mus musculus
tactgagaagccgacttccgaatca

SEQ ID NO: 767450 - DNA, 25 bp, Mus musculus
tactgagaatttacgcttgctggct

SEQ ID NO: 767451 - DNA, 25 bp, Mus musculus
tactgagaattttcgcttgctggct

SEQ ID NO: 767452 - DNA, 25 bp, Mus musculus
tactgagaccctagagtgtatttca

SEQ ID NO: 767453 - DNA, 25 bp, Mus musculus
tactgagacccttgagtgtatttca

SEQ ID NO: 767454 - DNA, 25 bp, Mus musculus
tactgagactaaaacctggcctcct

SEQ ID NO: 767455 - DNA, 25 bp, Mus musculus
tactgagactaatacctggcctcct

SEQ ID NO: 767456 - DNA, 25 bp, Mus musculus
tactgagactttaagcaggtgtact

SEQ ID NO: 767457 - DNA, 25 bp, Mus musculus
tactgagacttttagcaggtgtact

SEQ ID NO: 767458 - DNA, 25 bp, Mus musculus
tactgagagccaaagcgcggtgcct

SEQ ID NO: 767459 - DNA, 25 bp, Mus musculus
tactgagagccatagcgcggtgcct

SEQ ID NO: 767460 - DNA, 25 bp, Mus musculus
tactgagaggtaccacttcccattt

SEQ ID NO: 767461 - DNA, 25 bp, Mus musculus
tactgagaggtagcacttcccattt

SEQ ID NO: 767462 - DNA, 25 bp, Mus musculus
tactgagcaatcattcaagccccgt

SEQ ID NO: 767463 - DNA, 25 bp, Mus musculus
tactgagcaatctttcaagccccgt

SEQ ID NO: 767464 - DNA, 25 bp, Mus musculus
tactgagcagctcctattcttttgt

SEQ ID NO: 767465 - DNA, 25 bp, Mus musculus
tactgagcagctgctattcttttgt

SEQ ID NO: 767466 - DNA, 25 bp, Mus musculus
tactgagcagtactgccatgttggc

SEQ ID NO: 767467 - DNA, 25 bp, Mus musculus
tactgagcagtagtgccatgttggc

SEQ ID NO: 767468 - DNA, 25 bp, Mus musculus
tactgagcatggagcggaaggccaa

SEQ ID NO: 767469 - DNA, 25 bp, Mus musculus
tactgagcatggtgcggaaggccaa

SEQ ID NO: 767470 - DNA, 25 bp, Mus musculus
tactgagcctgcaagcaacagcttt

SEQ ID NO: 767471 - DNA, 25 bp, Mus musculus
tactgagcctgctagcaacagcttt

SEQ ID NO: 767472 - DNA, 25 bp, Mus musculus
tactgagctgacaatcttgtgtgtg

SEQ ID NO: 767473 - DNA, 25 bp, Mus musculus
tactgagctgactatcttgtgtgtg

SEQ ID NO: 767474 - DNA, 25 bp, Mus musculus
tactgagctgagaacaactcatttc

SEQ ID NO: 767475 - DNA, 25 bp, Mus musculus
tactgagctgagtacaactcatttc

SEQ ID NO: 767476 - DNA, 25 bp, Mus musculus
tactgagctgtgctaatgtagctga

SEQ ID NO: 767477 - DNA, 25 bp, Mus musculus
tactgagctgtggtaatgtagctga

SEQ ID NO: 767478 - DNA, 25 bp, Mus musculus
tactgaggaaccagccgggagtctg

SEQ ID NO: 767479 - DNA, 25 bp, Mus musculus
tactgaggaacctgccgggagtctg

SEQ ID NO: 767480 - DNA, 25 bp, Mus musculus
tactgaggaaggcttcgtcccagcg

SEQ ID NO: 767481 - DNA, 25 bp, Mus musculus
tactgaggaagggttcgtcccagcg

SEQ ID NO: 767482 - DNA, 25 bp, Mus musculus
tactgaggacctcgtgagctggaaa

SEQ ID NO: 767483 - DNA, 25 bp, Mus musculus
tactgaggacctggtgagctggaaa

SEQ ID NO: 767484 - DNA, 25 bp, Mus musculus
tactgaggagcgagggcccctttcc

SEQ ID NO: 767485 - DNA, 25 bp, Mus musculus
tactgaggagcgtgggcccctttcc

SEQ ID NO: 767486 - DNA, 25 bp, Mus musculus
tactgaggagttcccaccccagtag

SEQ ID NO: 767487 - DNA, 25 bp, Mus musculus
tactgaggagttgccaccccagtag

SEQ ID NO: 767488 - DNA, 25 bp, Mus musculus
tactgaggcgagactagctaagcaa

SEQ ID NO: 767489 - DNA, 25 bp, Mus musculus
tactgaggcgagtctagctaagcaa

SEQ ID NO: 767490 - DNA, 25 bp, Mus musculus
tactgaggctgtccattttcccgaa

SEQ ID NO: 767491 - DNA, 25 bp, Mus musculus
tactgaggctgtgcattttcccgaa

SEQ ID NO: 767492 - DNA, 25 bp, Mus musculus
tactgagggcccagagtagtctggc

SEQ ID NO: 767493 - DNA, 25 bp, Mus musculus
tactgagggccctgagtagtctggc

SEQ ID NO: 767494 - DNA, 25 bp, Mus musculus
tactgagggcctagccagcccaagc

SEQ ID NO: 767495 - DNA, 25 bp, Mus musculus
tactgagggccttgccagcccaagc

SEQ ID NO: 767496 - DNA, 25 bp, Mus musculus
tactgagggcttacgacatctgctc

SEQ ID NO: 767497 - DNA, 25 bp, Mus musculus
tactgagggctttcgacatctgctc

SEQ ID NO: 767498 - DNA, 25 bp, Mus musculus
tactgaggtagcacagactcccatg

SEQ ID NO: 767499 - DNA, 25 bp, Mus musculus
tactgaggtagctcagactcccatg

SEQ ID NO: 767500 - DNA, 25 bp, Mus musculus
tactgaggtctcacattaccacatt

SEQ ID NO: 767501 - DNA, 25 bp, Mus musculus
tactgaggtctctcattaccacatt

SEQ ID NO: 767502 - DNA, 25 bp, Mus musculus
tactgagtcaaaatgttctgctaat

SEQ ID NO: 767503 - DNA, 25 bp, Mus musculus
tactgagtcaaattgttctgctaat

SEQ ID NO: 767504 - DNA, 25 bp, Mus musculus
tactgagtccagacctgtgacagga

SEQ ID NO: 767505 - DNA, 25 bp, Mus musculus
tactgagtccagtcctgtgacagga

SEQ ID NO: 767506 - DNA, 25 bp, Mus musculus
tactgagtctctccaggtgtacaaa

SEQ ID NO: 767507 - DNA, 25 bp, Mus musculus
tactgagtctctgcaggtgtacaaa

SEQ ID NO: 767508 - DNA, 25 bp, Mus musculus
tactgagtctgtaagccttttaaag

SEQ ID NO: 767509 - DNA, 25 bp, Mus musculus
tactgagtctgttagccttttaaag

SEQ ID NO: 767510 - DNA, 25 bp, Mus musculus
tactgagtgactacgccttgcaaag

SEQ ID NO: 767511 - DNA, 25 bp, Mus musculus
tactgagtgacttcgccttgcaaag

SEQ ID NO: 767512 - DNA, 25 bp, Mus musculus
tactgagtgcctccaatgcaagact

SEQ ID NO: 767513 - DNA, 25 bp, Mus musculus
tactgagtgcctgcaatgcaagact

SEQ ID NO: 767514 - DNA, 25 bp, Mus musculus
tactgagtggttccttgggtttctc

SEQ ID NO: 767515 - DNA, 25 bp, Mus musculus
tactgagtggttctggcacctttgc

SEQ ID NO: 767516 - DNA, 25 bp, Mus musculus
tactgagtggttgcttgggtttctc

SEQ ID NO: 767517 - DNA, 25 bp, Mus musculus
tactgagtggttgtggcacctttgc

SEQ ID NO: 767518 - DNA, 25 bp, Mus musculus
tactgagttggaaggtgccttgatc

SEQ ID NO: 767519 - DNA, 25 bp, Mus musculus
tactgagttggatggtgccttgatc

SEQ ID NO: 767520 - DNA, 25 bp, Mus musculus
tactgagttgtaccatcaatccttg

SEQ ID NO: 767521 - DNA, 25 bp, Mus musculus
tactgagttgtagcatcaatccttg

SEQ ID NO: 767522 - DNA, 25 bp, Mus musculus
tactgagtttagagacagcctggat

SEQ ID NO: 767523 - DNA, 25 bp, Mus musculus
tactgagtttagtgacagcctggat

SEQ ID NO: 767524 - DNA, 25 bp, Mus musculus
tactgatactgcagagtgggcctga

SEQ ID NO: 767525 - DNA, 25 bp, Mus musculus
tactgatactgctgagtgggcctga

SEQ ID NO: 767526 - DNA, 25 bp, Mus musculus
tactgatagcagaaggcatgcccta

SEQ ID NO: 767527 - DNA, 25 bp, Mus musculus
tactgatagcagtaggcatgcccta

SEQ ID NO: 767528 - DNA, 25 bp, Mus musculus
tactgatcaggtatggtggcagcgt

SEQ ID NO: 767529 - DNA, 25 bp, Mus musculus
tactgatcaggtttggtggcagcgt

SEQ ID NO: 767530 - DNA, 25 bp, Mus musculus
tactgatccgcaacgaggactcaga

SEQ ID NO: 767531 - DNA, 25 bp, Mus musculus
tactgatccgcatcgaggactcaga

SEQ ID NO: 767532 - DNA, 25 bp, Mus musculus
tactgatcctaaaaccaagggaatt

SEQ ID NO: 767533 - DNA, 25 bp, Mus musculus
tactgatcctaataccaagggaatt

SEQ ID NO: 767534 - DNA, 25 bp, Mus musculus
tactgatcttttaaggtagttcctg

SEQ ID NO: 767535 - DNA, 25 bp, Mus musculus
tactgatctttttaggtagttcctg

SEQ ID NO: 767536 - DNA, 25 bp, Mus musculus
tactgatgattgctctgtgaccctt

SEQ ID NO: 767537 - DNA, 25 bp, Mus musculus
tactgatgattggtctgtgaccctt

SEQ ID NO: 767538 - DNA, 25 bp, Mus musculus
tactgatgatttcgatttgagagaa

SEQ ID NO: 767539 - DNA, 25 bp, Mus musculus
tactgatgatttggatttgagagaa

SEQ ID NO: 767540 - DNA, 25 bp, Mus musculus
tactgatgcaggctcttgagatctt

SEQ ID NO: 767541 - DNA, 25 bp, Mus musculus
tactgatgcagggtcttgagatctt

SEQ ID NO: 767542 - DNA, 25 bp, Mus musculus
tactgatgctatcaggagcaagcaa

SEQ ID NO: 767543 - DNA, 25 bp, Mus musculus
tactgatgctatgaggagcaagcaa

SEQ ID NO: 767544 - DNA, 25 bp, Mus musculus
tactgatgtaataccggctctggtc

SEQ ID NO: 767545 - DNA, 25 bp, Mus musculus
tactgatgtaattccggctctggtc

SEQ ID NO: 767546 - DNA, 25 bp, Mus musculus
tactgatgtagccaccttagggtcc

SEQ ID NO: 767547 - DNA, 25 bp, Mus musculus
tactgatgtagcgaccttagggtcc

SEQ ID NO: 767548 - DNA, 25 bp, Mus musculus
tactgatgtgagctgttctacgaca

SEQ ID NO: 767549 - DNA, 25 bp, Mus musculus
tactgatgtgaggtgttctacgaca

SEQ ID NO: 767550 - DNA, 25 bp, Mus musculus
tactgattaactcaccagcttccgt

SEQ ID NO: 767551 - DNA, 25 bp, Mus musculus
tactgattaactgaccagcttccgt

SEQ ID NO: 767552 - DNA, 25 bp, Mus musculus
tactgattcctgatcctaaatgaga

SEQ ID NO: 767553 - DNA, 25 bp, Mus musculus
tactgattcctgttcctaaatgaga

SEQ ID NO: 767554 - DNA, 25 bp, Mus musculus
tactgattggttagctgggtcccag

SEQ ID NO: 767555 - DNA, 25 bp, Mus musculus
tactgattggtttgctgggtcccag

SEQ ID NO: 767556 - DNA, 25 bp, Mus musculus
tactgatttcacataagtctcaagg

SEQ ID NO: 767557 - DNA, 25 bp, Mus musculus
tactgatttcacttaagtctcaagg

SEQ ID NO: 767558 - DNA, 25 bp, Mus musculus
tactgatttgtaagcacccgcttag

SEQ ID NO: 767559 - DNA, 25 bp, Mus musculus
tactgatttgtatgcacccgcttag

SEQ ID NO: 767560 - DNA, 25 bp, Mus musculus
tactgattttacacatattatgcca

SEQ ID NO: 767561 - DNA, 25 bp, Mus musculus
tactgattttactcatattatgcca

SEQ ID NO: 767562 - DNA, 25 bp, Mus musculus
tactgcaaacgtcaagcacaccctt

SEQ ID NO: 767563 - DNA, 25 bp, Mus musculus
tactgcaaacgtgaagcacaccctt

SEQ ID NO: 767564 - DNA, 25 bp, Mus musculus
tactgcaaagggactgccacaatgt

SEQ ID NO: 767565 - DNA, 25 bp, Mus musculus
tactgcaaagggtctgccacaatgt

SEQ ID NO: 767566 - DNA, 25 bp, Mus musculus
tactgcaactagacgcagcccgcag

SEQ ID NO: 767567 - DNA, 25 bp, Mus musculus
tactgcaactagtcgcagcccgcag

SEQ ID NO: 767568 - DNA, 25 bp, Mus musculus
tactgcaagacacgtcacacaccaa

SEQ ID NO: 767569 - DNA, 25 bp, Mus musculus
tactgcaagacaggtcacacaccaa

SEQ ID NO: 767570 - DNA, 25 bp, Mus musculus
tactgcaagtctatgccacatccga

SEQ ID NO: 767571 - DNA, 25 bp, Mus musculus
tactgcaagtctttgccacatccga

SEQ ID NO: 767572 - DNA, 25 bp, Mus musculus
tactgcaagtgcaattgatgccttg

SEQ ID NO: 767573 - DNA, 25 bp, Mus musculus
tactgcaagtgctattgatgccttg

SEQ ID NO: 767574 - DNA, 25 bp, Mus musculus
tactgcaccaaacctctcgatttta

SEQ ID NO: 767575 - DNA, 25 bp, Mus musculus
tactgcaccaaagctctcgatttta

SEQ ID NO: 767576 - DNA, 25 bp, Mus musculus
tactgcacccacaagggtaatgtta

SEQ ID NO: 767577 - DNA, 25 bp, Mus musculus
tactgcacccactagggtaatgtta

SEQ ID NO: 767578 - DNA, 25 bp, Mus musculus
tactgcaccgaaatgggacataatg

SEQ ID NO: 767579 - DNA, 25 bp, Mus musculus
tactgcaccgaattgggacataatg

SEQ ID NO: 767580 - DNA, 25 bp, Mus musculus
tactgcaccgtgagcgaggagccat

SEQ ID NO: 767581 - DNA, 25 bp, Mus musculus
tactgcaccgtgtgcgaggagccat

SEQ ID NO: 767582 - DNA, 25 bp, Mus musculus
tactgcacctggcttatcagagtat

SEQ ID NO: 767583 - DNA, 25 bp, Mus musculus
tactgcacctgggttatcagagtat

SEQ ID NO: 767584 - DNA, 25 bp, Mus musculus
tactgcacgggcctgatggacaaca

SEQ ID NO: 767585 - DNA, 25 bp, Mus musculus
tactgcacgggcgtgatggacaaca

SEQ ID NO: 767586 - DNA, 25 bp, Mus musculus
tactgcactacacaaggcttcttac

SEQ ID NO: 767587 - DNA, 25 bp, Mus musculus
tactgcactacagaaggcttcttac

SEQ ID NO: 767588 - DNA, 25 bp, Mus musculus
tactgcactgtaccctttgcatgtg

SEQ ID NO: 767589 - DNA, 25 bp, Mus musculus
tactgcactgtagcctttgcatgtg

SEQ ID NO: 767590 - DNA, 25 bp, Mus musculus
tactgcactgtgagatgccatggtg

SEQ ID NO: 767591 - DNA, 25 bp, Mus musculus
tactgcactgtgtgatgccatggtg

SEQ ID NO: 767592 - DNA, 25 bp, Mus musculus
tactgcacttccaggaggtccgaac

SEQ ID NO: 767593 - DNA, 25 bp, Mus musculus
tactgcacttcctggaggtccgaac

SEQ ID NO: 767594 - DNA, 25 bp, Mus musculus
tactgcacttggctttttcttggac

SEQ ID NO: 767595 - DNA, 25 bp, Mus musculus
tactgcacttgggtttttcttggac

SEQ ID NO: 767596 - DNA, 25 bp, Mus musculus
tactgcagagtgcagccagacaggc

SEQ ID NO: 767597 - DNA, 25 bp, Mus musculus
tactgcagagtggagccagacaggc

SEQ ID NO: 767598 - DNA, 25 bp, Mus musculus
tactgcagatgaagcgtgttgacat

SEQ ID NO: 767599 - DNA, 25 bp, Mus musculus
tactgcagatgatgcgtgttgacat

SEQ ID NO: 767600 - DNA, 25 bp, Mus musculus
tactgcagatgtctgttctctgggc

SEQ ID NO: 767601 - DNA, 25 bp, Mus musculus
tactgcagatgtgtgttctctgggc

SEQ ID NO: 767602 - DNA, 25 bp, Mus musculus
tactgcagattcatctccatgtgtt

SEQ ID NO: 767603 - DNA, 25 bp, Mus musculus
tactgcagattcttctccatgtgtt

SEQ ID NO: 767604 - DNA, 25 bp, Mus musculus
tactgcagccagacttttgaaaagt

SEQ ID NO: 767605 - DNA, 25 bp, Mus musculus
tactgcagccagtcttttgaaaagt

SEQ ID NO: 767606 - DNA, 25 bp, Mus musculus
tactgcagccatctttggcggagtc

SEQ ID NO: 767607 - DNA, 25 bp, Mus musculus
tactgcagccatgtttggcggagtc

SEQ ID NO: 767608 - DNA, 25 bp, Mus musculus
tactgcagcttgaaatcactaaggt

SEQ ID NO: 767609 - DNA, 25 bp, Mus musculus
tactgcagcttgtaatcactaaggt

SEQ ID NO: 767610 - DNA, 25 bp, Mus musculus
tactgcaggaccagcttttccaaaa

SEQ ID NO: 767611 - DNA, 25 bp, Mus musculus
tactgcaggacctgcttttccaaaa

SEQ ID NO: 767612 - DNA, 25 bp, Mus musculus
tactgcaggcaacgacagcttctgt

SEQ ID NO: 767613 - DNA, 25 bp, Mus musculus
tactgcaggcaaggacagcttctgt

SEQ ID NO: 767614 - DNA, 25 bp, Mus musculus
tactgcagggatcctgtcactgtgt

SEQ ID NO: 767615 - DNA, 25 bp, Mus musculus
tactgcagggatgctgtcactgtgt

SEQ ID NO: 767616 - DNA, 25 bp, Mus musculus
tactgcagggctaggtggctcctgt

SEQ ID NO: 767617 - DNA, 25 bp, Mus musculus
tactgcagggcttggtggctcctgt

SEQ ID NO: 767618 - DNA, 25 bp, Mus musculus
tactgcagtctgattgctgtgttac

SEQ ID NO: 767619 - DNA, 25 bp, Mus musculus
tactgcagtctgtttgctgtgttac

SEQ ID NO: 767620 - DNA, 25 bp, Mus musculus
tactgcagtcttaattttttcccat

SEQ ID NO: 767621 - DNA, 25 bp, Mus musculus
tactgcagtctttattttttcccat

SEQ ID NO: 767622 - DNA, 25 bp, Mus musculus
tactgcagtgtgatgaagacgtttt

SEQ ID NO: 767623 - DNA, 25 bp, Mus musculus
tactgcagtgtgttgaagacgtttt

SEQ ID NO: 767624 - DNA, 25 bp, Mus musculus
tactgcagttacaccttattccatt

SEQ ID NO: 767625 - DNA, 25 bp, Mus musculus
tactgcagttactccttattccatt

SEQ ID NO: 767626 - DNA, 25 bp, Mus musculus
tactgcagttttacaggagcgcaag

SEQ ID NO: 767627 - DNA, 25 bp, Mus musculus
tactgcagtttttcaggagcgcaag

SEQ ID NO: 767628 - DNA, 25 bp, Mus musculus
tactgcatacttcatctctcaccga

SEQ ID NO: 767629 - DNA, 25 bp, Mus musculus
tactgcatacttgatctctcaccga

SEQ ID NO: 767630 - DNA, 25 bp, Mus musculus
tactgcatcctgatagttttctctg

SEQ ID NO: 767631 - DNA, 25 bp, Mus musculus
tactgcatcctgttagttttctctg

SEQ ID NO: 767632 - DNA, 25 bp, Mus musculus
tactgcatctggctgatttttcccc

SEQ ID NO: 767633 - DNA, 25 bp, Mus musculus
tactgcatctgggtgatttttcccc

SEQ ID NO: 767634 - DNA, 25 bp, Mus musculus
tactgcatctgtaccataagcctgt

SEQ ID NO: 767635 - DNA, 25 bp, Mus musculus
tactgcatctgtcgcaaaccggaca

SEQ ID NO: 767636 - DNA, 25 bp, Mus musculus
tactgcatctgtggcaaaccggaca

SEQ ID NO: 767637 - DNA, 25 bp, Mus musculus
tactgcatctgttccataagcctgt

SEQ ID NO: 767638 - DNA, 25 bp, Mus musculus
tactgcatgctgaatatggcgttag

SEQ ID NO: 767639 - DNA, 25 bp, Mus musculus
tactgcatgctgtatatggcgttag

SEQ ID NO: 767640 - DNA, 25 bp, Mus musculus
tactgcatggacctgactcagctta

SEQ ID NO: 767641 - DNA, 25 bp, Mus musculus
tactgcatggacgtgactcagctta

SEQ ID NO: 767642 - DNA, 25 bp, Mus musculus
tactgcattgatccccgttactatg

SEQ ID NO: 767643 - DNA, 25 bp, Mus musculus
tactgcattgatgcccgttactatg

SEQ ID NO: 767644 - DNA, 25 bp, Mus musculus
tactgccaagtacgagacaaacctt

SEQ ID NO: 767645 - DNA, 25 bp, Mus musculus
tactgccaagtaggagacaaacctt

SEQ ID NO: 767646 - DNA, 25 bp, Mus musculus
tactgccacactaacgcccagttag

SEQ ID NO: 767647 - DNA, 25 bp, Mus musculus
tactgccacacttacgcccagttag

SEQ ID NO: 767648 - DNA, 25 bp, Mus musculus
tactgccacgttctcaggtactagt

SEQ ID NO: 767649 - DNA, 25 bp, Mus musculus
tactgccacgttgtcaggtactagt

SEQ ID NO: 767650 - DNA, 25 bp, Mus musculus
tactgccacttcacaacatttttga

SEQ ID NO: 767651 - DNA, 25 bp, Mus musculus
tactgccacttccaaatactgggat

SEQ ID NO: 767652 - DNA, 25 bp, Mus musculus
tactgccacttcgaaatactgggat

SEQ ID NO: 767653 - DNA, 25 bp, Mus musculus
tactgccacttctcaacatttttga

SEQ ID NO: 767654 - DNA, 25 bp, Mus musculus
tactgccagagcagcttcgtgaagc

SEQ ID NO: 767655 - DNA, 25 bp, Mus musculus
tactgccagagctgcttcgtgaagc

SEQ ID NO: 767656 - DNA, 25 bp, Mus musculus
tactgccagcaacaagtgttccgct

SEQ ID NO: 767657 - DNA, 25 bp, Mus musculus
tactgccagcaagaagtgttccgct

SEQ ID NO: 767658 - DNA, 25 bp, Mus musculus
tactgccagtataggttgacctatc

SEQ ID NO: 767659 - DNA, 25 bp, Mus musculus
tactgccagtattggttgacctatc

SEQ ID NO: 767660 - DNA, 25 bp, Mus musculus
tactgccagtcccaagctttgtgaa

SEQ ID NO: 767661 - DNA, 25 bp, Mus musculus
tactgccagtccgaagctttgtgaa

SEQ ID NO: 767662 - DNA, 25 bp, Mus musculus
tactgccatcttctagagtctggtg

SEQ ID NO: 767663 - DNA, 25 bp, Mus musculus
tactgccatcttgtagagtctggtg

SEQ ID NO: 767664 - DNA, 25 bp, Mus musculus
tactgccatggtagctgcgggatgc

SEQ ID NO: 767665 - DNA, 25 bp, Mus musculus
tactgccatggttgctgcgggatgc

SEQ ID NO: 767666 - DNA, 25 bp, Mus musculus
tactgcccacacatgtggcaagtgt

SEQ ID NO: 767667 - DNA, 25 bp, Mus musculus
tactgcccacacttgtggcaagtgt

SEQ ID NO: 767668 - DNA, 25 bp, Mus musculus
tactgcccagaaccgattcactcat

SEQ ID NO: 767669 - DNA, 25 bp, Mus musculus
tactgcccagaagcgattcactcat

SEQ ID NO: 767670 - DNA, 25 bp, Mus musculus
tactgcccagcacttccgaaatgca

SEQ ID NO: 767671 - DNA, 25 bp, Mus musculus
tactgcccagcagttccgaaatgca

SEQ ID NO: 767672 - DNA, 25 bp, Mus musculus
tactgcccatttctcctggaggaca

SEQ ID NO: 767673 - DNA, 25 bp, Mus musculus
tactgcccatttgtcctggaggaca

SEQ ID NO: 767674 - DNA, 25 bp, Mus musculus
tactgccccaccatgatgcgggtgc

SEQ ID NO: 767675 - DNA, 25 bp, Mus musculus
tactgccccaccttgatgcgggtgc

SEQ ID NO: 767676 - DNA, 25 bp, Mus musculus
tactgcccctcactggagagttatg

SEQ ID NO: 767677 - DNA, 25 bp, Mus musculus
tactgcccctcagtggagagttatg

SEQ ID NO: 767678 - DNA, 25 bp, Mus musculus
tactgccctggtcgagcttgaatgt

SEQ ID NO: 767679 - DNA, 25 bp, Mus musculus
tactgccctggtggagcttgaatgt

SEQ ID NO: 767680 - DNA, 25 bp, Mus musculus
tactgccctgtgcagcaattcacag

SEQ ID NO: 767681 - DNA, 25 bp, Mus musculus
tactgccctgtggagcaattcacag

SEQ ID NO: 767682 - DNA, 25 bp, Mus musculus
tactgccgatccaggtgttgagtga

SEQ ID NO: 767683 - DNA, 25 bp, Mus musculus
tactgccgatcctggtgttgagtga

SEQ ID NO: 767684 - DNA, 25 bp, Mus musculus
tactgccgcatgattcttcagagag

SEQ ID NO: 767685 - DNA, 25 bp, Mus musculus
tactgccgcatgtttcttcagagag

SEQ ID NO: 767686 - DNA, 25 bp, Mus musculus
tactgccggtgacgctgaaacgctg

SEQ ID NO: 767687 - DNA, 25 bp, Mus musculus
tactgccggtgaggctgaaacgctg

SEQ ID NO: 767688 - DNA, 25 bp, Mus musculus
tactgccgttctaggtctgcacctt

SEQ ID NO: 767689 - DNA, 25 bp, Mus musculus
tactgccgttcttggtctgcacctt

SEQ ID NO: 767690 - DNA, 25 bp, Mus musculus
tactgcctaatgctaccaagaacgg

SEQ ID NO: 767691 - DNA, 25 bp, Mus musculus
tactgcctaatggtaccaagaacgg

SEQ ID NO: 767692 - DNA, 25 bp, Mus musculus
tactgcctacagacaatctcaggcc

SEQ ID NO: 767693 - DNA, 25 bp, Mus musculus
tactgcctacagtcaatctcaggcc

SEQ ID NO: 767694 - DNA, 25 bp, Mus musculus
tactgcctatcccaaatctcaatga

SEQ ID NO: 767695 - DNA, 25 bp, Mus musculus
tactgcctatccgaaatctcaatga

SEQ ID NO: 767696 - DNA, 25 bp, Mus musculus
tactgcctatgactctagttccagg

SEQ ID NO: 767697 - DNA, 25 bp, Mus musculus
tactgcctatgagtctagttccagg

SEQ ID NO: 767698 - DNA, 25 bp, Mus musculus
tactgcctcaagagctggcttcatg

SEQ ID NO: 767699 - DNA, 25 bp, Mus musculus
tactgcctcaagtgctggcttcatg

SEQ ID NO: 767700 - DNA, 25 bp, Mus musculus
tactgcctcagtaattgaatttttt

SEQ ID NO: 767701 - DNA, 25 bp, Mus musculus
tactgcctcagttattgaatttttt

SEQ ID NO: 767702 - DNA, 25 bp, Mus musculus
tactgcctcccaaagaatggaagct

SEQ ID NO: 767703 - DNA, 25 bp, Mus musculus
tactgcctcccatagaatggaagct

SEQ ID NO: 767704 - DNA, 25 bp, Mus musculus
tactgcctcgtgactgaggatgatg

SEQ ID NO: 767705 - DNA, 25 bp, Mus musculus
tactgcctcgtgtctgaggatgatg

SEQ ID NO: 767706 - DNA, 25 bp, Mus musculus
tactgcctctcgaggttcagaacaa

SEQ ID NO: 767707 - DNA, 25 bp, Mus musculus
tactgcctctcgtggttcagaacaa

SEQ ID NO: 767708 - DNA, 25 bp, Mus musculus
tactgcctctgaaggctcagaactc

SEQ ID NO: 767709 - DNA, 25 bp, Mus musculus
tactgcctctgatggctcagaactc

SEQ ID NO: 767710 - DNA, 25 bp, Mus musculus
tactgcctctgcacttaagatatca

SEQ ID NO: 767711 - DNA, 25 bp, Mus musculus
tactgcctctgctcttaagatatca

SEQ ID NO: 767712 - DNA, 25 bp, Mus musculus
tactgcctgcaccaagtgaatcatt

SEQ ID NO: 767713 - DNA, 25 bp, Mus musculus
tactgcctgcacgaagtgaatcatt

SEQ ID NO: 767714 - DNA, 25 bp, Mus musculus
tactgcctgcagagggcttctcaat

SEQ ID NO: 767715 - DNA, 25 bp, Mus musculus
tactgcctgcagtgggcttctcaat

SEQ ID NO: 767716 - DNA, 25 bp, Mus musculus
tactgcctggcaccagactggagac

SEQ ID NO: 767717 - DNA, 25 bp, Mus musculus
tactgcctggcagcagactggagac

SEQ ID NO: 767718 - DNA, 25 bp, Mus musculus
tactgcctggctaatgttgacttct

SEQ ID NO: 767719 - DNA, 25 bp, Mus musculus
tactgcctggcttatgttgacttct

SEQ ID NO: 767720 - DNA, 25 bp, Mus musculus
tactgcctgggcagcagagactttg

SEQ ID NO: 767721 - DNA, 25 bp, Mus musculus
tactgcctgggctgcagagactttg

SEQ ID NO: 767722 - DNA, 25 bp, Mus musculus
tactgcctggtcaacgagggtgccc

SEQ ID NO: 767723 - DNA, 25 bp, Mus musculus
tactgcctggtctacgagggtgccc

SEQ ID NO: 767724 - DNA, 25 bp, Mus musculus
tactgcctgtggacagggcttgaga

SEQ ID NO: 767725 - DNA, 25 bp, Mus musculus
tactgcctgtggtcagggcttgaga

SEQ ID NO: 767726 - DNA, 25 bp, Mus musculus
tactgccttgaccttcacaagatgg

SEQ ID NO: 767727 - DNA, 25 bp, Mus musculus
tactgccttgacgttcacaagatgg

SEQ ID NO: 767728 - DNA, 25 bp, Mus musculus
tactgccttggacagtcaccaggag

SEQ ID NO: 767729 - DNA, 25 bp, Mus musculus
tactgccttggagagtcaccaggag

SEQ ID NO: 767730 - DNA, 25 bp, Mus musculus
tactgccttgggaatctaacaccta

SEQ ID NO: 767731 - DNA, 25 bp, Mus musculus
tactgccttgggtatctaacaccta

SEQ ID NO: 767732 - DNA, 25 bp, Mus musculus
tactgccttgttctatgtcttaata

SEQ ID NO: 767733 - DNA, 25 bp, Mus musculus
tactgccttgttgtatgtcttaata

SEQ ID NO: 767734 - DNA, 25 bp, Mus musculus
tactgcctttagcaacgtgggtgaa

SEQ ID NO: 767735 - DNA, 25 bp, Mus musculus
tactgcctttaggaacgtgggtgaa

SEQ ID NO: 767736 - DNA, 25 bp, Mus musculus
tactgccttttcaatagaccctagt

SEQ ID NO: 767737 - DNA, 25 bp, Mus musculus
tactgccttttctatagaccctagt

SEQ ID NO: 767738 - DNA, 25 bp, Mus musculus
tactgcctttttctaatcctgtaca

SEQ ID NO: 767739 - DNA, 25 bp, Mus musculus
tactgcctttttgtaatcctgtaca

SEQ ID NO: 767740 - DNA, 25 bp, Mus musculus
tactgcgaagaaactgggtgagatg

SEQ ID NO: 767741 - DNA, 25 bp, Mus musculus
tactgcgaagaatctgggtgagatg

SEQ ID NO: 767742 - DNA, 25 bp, Mus musculus
tactgcgacagaaagccaatacatc

SEQ ID NO: 767743 - DNA, 25 bp, Mus musculus
tactgcgacagatagccaatacatc

SEQ ID NO: 767744 - DNA, 25 bp, Mus musculus
tactgcgagactcccaatgcttcaa

SEQ ID NO: 767745 - DNA, 25 bp, Mus musculus
tactgcgagactgccaatgcttcaa

SEQ ID NO: 767746 - DNA, 25 bp, Mus musculus
tactgcgaggttatcctgcacgcgg

SEQ ID NO: 767747 - DNA, 25 bp, Mus musculus
tactgcgaggttttcctgcacgcgg

SEQ ID NO: 767748 - DNA, 25 bp, Mus musculus
tactgcgcaagtagaacctgctcag

SEQ ID NO: 767749 - DNA, 25 bp, Mus musculus
tactgcgcaagttgaacctgctcag

SEQ ID NO: 767750 - DNA, 25 bp, Mus musculus
tactgcgccctgctaacacattggt

SEQ ID NO: 767751 - DNA, 25 bp, Mus musculus
tactgcgccctggtaacacattggt

SEQ ID NO: 767752 - DNA, 25 bp, Mus musculus
tactgcgccttcacttttaaaaact

SEQ ID NO: 767753 - DNA, 25 bp, Mus musculus
tactgcgccttctcttttaaaaact

SEQ ID NO: 767754 - DNA, 25 bp, Mus musculus
tactgcggatccagcaggctctggg

SEQ ID NO: 767755 - DNA, 25 bp, Mus musculus
tactgcggatcctgcaggctctggg

SEQ ID NO: 767756 - DNA, 25 bp, Mus musculus
tactgcggatgccaccctgggtgaa

SEQ ID NO: 767757 - DNA, 25 bp, Mus musculus
tactgcggatgcgaccctgggtgaa

SEQ ID NO: 767758 - DNA, 25 bp, Mus musculus
tactgcggcctgcagttcaagcagc

SEQ ID NO: 767759 - DNA, 25 bp, Mus musculus
tactgcggcctggagttcaagcagc

SEQ ID NO: 767760 - DNA, 25 bp, Mus musculus
tactgcgggccaccagaatggactg

SEQ ID NO: 767761 - DNA, 25 bp, Mus musculus
tactgcgggccagcagaatggactg

SEQ ID NO: 767762 - DNA, 25 bp, Mus musculus
tactgcggtgctagacattctgttt

SEQ ID NO: 767763 - DNA, 25 bp, Mus musculus
tactgcggtgctcactgataggaac

SEQ ID NO: 767764 - DNA, 25 bp, Mus musculus
tactgcggtgctgactgataggaac

SEQ ID NO: 767765 - DNA, 25 bp, Mus musculus
tactgcggtgcttgacattctgttt

SEQ ID NO: 767766 - DNA, 25 bp, Mus musculus
tactgcgtatttatggctgttattc

SEQ ID NO: 767767 - DNA, 25 bp, Mus musculus
tactgcgtatttttggctgttattc

SEQ ID NO: 767768 - DNA, 25 bp, Mus musculus
tactgcgtctacctggactggaggc

SEQ ID NO: 767769 - DNA, 25 bp, Mus musculus
tactgcgtctacgtggactggaggc

SEQ ID NO: 767770 - DNA, 25 bp, Mus musculus
tactgcgtgtcaccctttcagaaca

SEQ ID NO: 767771 - DNA, 25 bp, Mus musculus
tactgcgtgtcagcctttcagaaca

SEQ ID NO: 767772 - DNA, 25 bp, Mus musculus
tactgctaacctatagaggctctct

SEQ ID NO: 767773 - DNA, 25 bp, Mus musculus
tactgctaacctttagaggctctct

SEQ ID NO: 767774 - DNA, 25 bp, Mus musculus
tactgctaactcaacttacttctgt

SEQ ID NO: 767775 - DNA, 25 bp, Mus musculus
tactgctaactctacttacttctgt

SEQ ID NO: 767776 - DNA, 25 bp, Mus musculus
tactgctaagggacctcaggcacgt

SEQ ID NO: 767777 - DNA, 25 bp, Mus musculus
tactgctaagggtcctcaggcacgt

SEQ ID NO: 767778 - DNA, 25 bp, Mus musculus
tactgctactctagcttaccgatag

SEQ ID NO: 767779 - DNA, 25 bp, Mus musculus
tactgctactcttgcttaccgatag

SEQ ID NO: 767780 - DNA, 25 bp, Mus musculus
tactgctagagcctatcatcttcaa

SEQ ID NO: 767781 - DNA, 25 bp, Mus musculus
tactgctagagcgtatcatcttcaa

SEQ ID NO: 767782 - DNA, 25 bp, Mus musculus
tactgctagcccagggatgacgcca

SEQ ID NO: 767783 - DNA, 25 bp, Mus musculus
tactgctagccctgggatgacgcca

SEQ ID NO: 767784 - DNA, 25 bp, Mus musculus
tactgctatgcaacatccacgggtt

SEQ ID NO: 767785 - DNA, 25 bp, Mus musculus
tactgctatgcatcatccacgggtt

SEQ ID NO: 767786 - DNA, 25 bp, Mus musculus
tactgctattttaggtctgtgttca

SEQ ID NO: 767787 - DNA, 25 bp, Mus musculus
tactgctatttttggtctgtgttca

SEQ ID NO: 767788 - DNA, 25 bp, Mus musculus
tactgctcagaaacaccccaggaat

SEQ ID NO: 767789 - DNA, 25 bp, Mus musculus
tactgctcagaatcaccccaggaat

SEQ ID NO: 767790 - DNA, 25 bp, Mus musculus
tactgctcagggaatgtggacagca

SEQ ID NO: 767791 - DNA, 25 bp, Mus musculus
tactgctcagggtatgtggacagca

SEQ ID NO: 767792 - DNA, 25 bp, Mus musculus
tactgctcatgaaatgactttgctg

SEQ ID NO: 767793 - DNA, 25 bp, Mus musculus
tactgctcatgatatgactttgctg

SEQ ID NO: 767794 - DNA, 25 bp, Mus musculus
tactgctccctgacaaaaatgtgat

SEQ ID NO: 767795 - DNA, 25 bp, Mus musculus
tactgctccctgtcaaaaatgtgat

SEQ ID NO: 767796 - DNA, 25 bp, Mus musculus
tactgctcctaaaagtaggcacttc

SEQ ID NO: 767797 - DNA, 25 bp, Mus musculus
tactgctcctaatagtaggcacttc

SEQ ID NO: 767798 - DNA, 25 bp, Mus musculus
tactgctcgggaccacgggctgata

SEQ ID NO: 767799 - DNA, 25 bp, Mus musculus
tactgctcgggagcacgggctgata

SEQ ID NO: 767800 - DNA, 25 bp, Mus musculus
tactgctcggtgctgggatctctaa

SEQ ID NO: 767801 - DNA, 25 bp, Mus musculus
tactgctcggtggtgggatctctaa

SEQ ID NO: 767802 - DNA, 25 bp, Mus musculus
tactgctctgctaagaatatgaaca

SEQ ID NO: 767803 - DNA, 25 bp, Mus musculus
tactgctctgcttagaatatgaaca

SEQ ID NO: 767804 - DNA, 25 bp, Mus musculus
tactgctctgggacattctctgctg

SEQ ID NO: 767805 - DNA, 25 bp, Mus musculus
tactgctctgggtcattctctgctg

SEQ ID NO: 767806 - DNA, 25 bp, Mus musculus
tactgctctggtagctaagaacagg

SEQ ID NO: 767807 - DNA, 25 bp, Mus musculus
tactgctctggttgctaagaacagg

SEQ ID NO: 767808 - DNA, 25 bp, Mus musculus
tactgctgaccccaagaacgtttag

SEQ ID NO: 767809 - DNA, 25 bp, Mus musculus
tactgctgacccgaagaacgtttag

SEQ ID NO: 767810 - DNA, 25 bp, Mus musculus
tactgctgactcatttcgacctgga

SEQ ID NO: 767811 - DNA, 25 bp, Mus musculus
tactgctgactcttttcgacctgga

SEQ ID NO: 767812 - DNA, 25 bp, Mus musculus
tactgctgacttcaaggacagagaa

SEQ ID NO: 767813 - DNA, 25 bp, Mus musculus
tactgctgacttgaaggacagagaa

SEQ ID NO: 767814 - DNA, 25 bp, Mus musculus
tactgctgagtgctgcttctgtttc

SEQ ID NO: 767815 - DNA, 25 bp, Mus musculus
tactgctgagtggtgcttctgtttc

SEQ ID NO: 767816 - DNA, 25 bp, Mus musculus
tactgctgccagaccgtagaagaag

SEQ ID NO: 767817 - DNA, 25 bp, Mus musculus
tactgctgccagtccgtagaagaag

SEQ ID NO: 767818 - DNA, 25 bp, Mus musculus
tactgctgccggaaatgcccttgat

SEQ ID NO: 767819 - DNA, 25 bp, Mus musculus
tactgctgccggtaatgcccttgat

SEQ ID NO: 767820 - DNA, 25 bp, Mus musculus
tactgctgcctcatcaatgtgtcct

SEQ ID NO: 767821 - DNA, 25 bp, Mus musculus
tactgctgcctcttcaatgtgtcct

SEQ ID NO: 767822 - DNA, 25 bp, Mus musculus
tactgctgctgacagatcccaggtt

SEQ ID NO: 767823 - DNA, 25 bp, Mus musculus
tactgctgctgagagatcccaggtt

SEQ ID NO: 767824 - DNA, 25 bp, Mus musculus
tactgctgggatcgcttacactggt

SEQ ID NO: 767825 - DNA, 25 bp, Mus musculus
tactgctgggatggcttacactggt

SEQ ID NO: 767826 - DNA, 25 bp, Mus musculus
tactgctgggcacgcatgtgtagaa

SEQ ID NO: 767827 - DNA, 25 bp, Mus musculus
tactgctgggcaggcatgtgtagaa

SEQ ID NO: 767828 - DNA, 25 bp, Mus musculus
tactgctgggccataactcagaggg

SEQ ID NO: 767829 - DNA, 25 bp, Mus musculus
tactgctgggccttaactcagaggg

SEQ ID NO: 767830 - DNA, 25 bp, Mus musculus
tactgctgggcgactgtggctacta

SEQ ID NO: 767831 - DNA, 25 bp, Mus musculus
tactgctgggcgtctgtggctacta

SEQ ID NO: 767832 - DNA, 25 bp, Mus musculus
tactgctggtatatatagccataaa

SEQ ID NO: 767833 - DNA, 25 bp, Mus musculus
tactgctggtatttatagccataaa

SEQ ID NO: 767834 - DNA, 25 bp, Mus musculus
tactgctgtcagagaaggttttcat

SEQ ID NO: 767835 - DNA, 25 bp, Mus musculus
tactgctgtcagtgaaggttttcat

SEQ ID NO: 767836 - DNA, 25 bp, Mus musculus
tactgcttaattctcttaccaatgg

SEQ ID NO: 767837 - DNA, 25 bp, Mus musculus
tactgcttaattgtcttaccaatgg

SEQ ID NO: 767838 - DNA, 25 bp, Mus musculus
tactgcttacagaaaccatagccag

SEQ ID NO: 767839 - DNA, 25 bp, Mus musculus
tactgcttacagtaaccatagccag

SEQ ID NO: 767840 - DNA, 25 bp, Mus musculus
tactgcttaccaacacacggaaggg

SEQ ID NO: 767841 - DNA, 25 bp, Mus musculus
tactgcttaccacgagctttttctg

SEQ ID NO: 767842 - DNA, 25 bp, Mus musculus
tactgcttaccaggagctttttctg

SEQ ID NO: 767843 - DNA, 25 bp, Mus musculus
tactgcttaccatcacacggaaggg

SEQ ID NO: 767844 - DNA, 25 bp, Mus musculus
tactgcttagacatcagccaacaag

SEQ ID NO: 767845 - DNA, 25 bp, Mus musculus
tactgcttagacttcagccaacaag

SEQ ID NO: 767846 - DNA, 25 bp, Mus musculus
tactgcttataaattcatgtctctg

SEQ ID NO: 767847 - DNA, 25 bp, Mus musculus
tactgcttataatttcatgtctctg

SEQ ID NO: 767848 - DNA, 25 bp, Mus musculus
tactgcttatacagcttgggctggg

SEQ ID NO: 767849 - DNA, 25 bp, Mus musculus
tactgcttatactgcttgggctggg

SEQ ID NO: 767850 - DNA, 25 bp, Mus musculus
tactgcttattcaaagcccctattt

SEQ ID NO: 767851 - DNA, 25 bp, Mus musculus
tactgcttattctaagcccctattt

SEQ ID NO: 767852 - DNA, 25 bp, Mus musculus
tactgcttcagaacactttacttta

SEQ ID NO: 767853 - DNA, 25 bp, Mus musculus
tactgcttcagatcactttacttta

SEQ ID NO: 767854 - DNA, 25 bp, Mus musculus
tactgcttcagcaaactggtgatgc

SEQ ID NO: 767855 - DNA, 25 bp, Mus musculus
tactgcttcagctaactggtgatgc

SEQ ID NO: 767856 - DNA, 25 bp, Mus musculus
tactgcttcaggataagcaccccgc

SEQ ID NO: 767857 - DNA, 25 bp, Mus musculus
tactgcttcaggcttagggatcgct

SEQ ID NO: 767858 - DNA, 25 bp, Mus musculus
tactgcttcagggttagggatcgct

SEQ ID NO: 767859 - DNA, 25 bp, Mus musculus
tactgcttcaggttaagcaccccgc

SEQ ID NO: 767860 - DNA, 25 bp, Mus musculus
tactgcttcatgagtggtctttatt

SEQ ID NO: 767861 - DNA, 25 bp, Mus musculus
tactgcttcatgtgtggtctttatt

SEQ ID NO: 767862 - DNA, 25 bp, Mus musculus
tactgcttcctgagtaattcattgc

SEQ ID NO: 767863 - DNA, 25 bp, Mus musculus
tactgcttcctgtgtaattcattgc

SEQ ID NO: 767864 - DNA, 25 bp, Mus musculus
tactgcttcgagctgacaacatcat

SEQ ID NO: 767865 - DNA, 25 bp, Mus musculus
tactgcttcgaggtgacaacatcat

SEQ ID NO: 767866 - DNA, 25 bp, Mus musculus
tactgcttctatctctgcaaaggtc

SEQ ID NO: 767867 - DNA, 25 bp, Mus musculus
tactgcttctatgtctgcaaaggtc

SEQ ID NO: 767868 - DNA, 25 bp, Mus musculus
tactgcttctgaaatattggtgcca

SEQ ID NO: 767869 - DNA, 25 bp, Mus musculus
tactgcttctgatatattggtgcca

SEQ ID NO: 767870 - DNA, 25 bp, Mus musculus
tactgcttcttcatggcatcctgga

SEQ ID NO: 767871 - DNA, 25 bp, Mus musculus
tactgcttcttcttggcatcctgga

SEQ ID NO: 767872 - DNA, 25 bp, Mus musculus
tactgcttgctgacaggctgaagcg

SEQ ID NO: 767873 - DNA, 25 bp, Mus musculus
tactgcttgctgtcaggctgaagcg

SEQ ID NO: 767874 - DNA, 25 bp, Mus musculus
tactgcttggctctaaaggtgtagc

SEQ ID NO: 767875 - DNA, 25 bp, Mus musculus
tactgcttggctgtaaaggtgtagc

SEQ ID NO: 767876 - DNA, 25 bp, Mus musculus
tactgcttgttcagttgctgaatca

SEQ ID NO: 767877 - DNA, 25 bp, Mus musculus
tactgcttgttctgttgctgaatca

SEQ ID NO: 767878 - DNA, 25 bp, Mus musculus
tactgctttctaaaccttggtgcca

SEQ ID NO: 767879 - DNA, 25 bp, Mus musculus
tactgctttctataccttggtgcca

SEQ ID NO: 767880 - DNA, 25 bp, Mus musculus
tactgctttcttatcgtcttggaat

SEQ ID NO: 767881 - DNA, 25 bp, Mus musculus
tactgctttcttttcgtcttggaat

SEQ ID NO: 767882 - DNA, 25 bp, Mus musculus
tactgctttgaaattactatgagca

SEQ ID NO: 767883 - DNA, 25 bp, Mus musculus
tactgctttgaatttactatgagca

SEQ ID NO: 767884 - DNA, 25 bp, Mus musculus
tactgctttgtcattataactttag

SEQ ID NO: 767885 - DNA, 25 bp, Mus musculus
tactgctttgtctttataactttag

SEQ ID NO: 767886 - DNA, 25 bp, Mus musculus
tactgcttttacagttaagtgggca

SEQ ID NO: 767887 - DNA, 25 bp, Mus musculus
tactgcttttactgttaagtgggca

SEQ ID NO: 767888 - DNA, 25 bp, Mus musculus
tactgcttttgcactgcagcatata

SEQ ID NO: 767889 - DNA, 25 bp, Mus musculus
tactgcttttgctctgcagcatata

SEQ ID NO: 767890 - DNA, 25 bp, Mus musculus
tactgcttttgtagtcttcccaaca

SEQ ID NO: 767891 - DNA, 25 bp, Mus musculus
tactgcttttgttgtcttcccaaca

SEQ ID NO: 767892 - DNA, 25 bp, Mus musculus
tactggaacactacctggctgcgga

SEQ ID NO: 767893 - DNA, 25 bp, Mus musculus
tactggaacacttcctggctgcgga

SEQ ID NO: 767894 - DNA, 25 bp, Mus musculus
tactggaacctgctttagagctagg

SEQ ID NO: 767895 - DNA, 25 bp, Mus musculus
tactggaacctggtttagagctagg

SEQ ID NO: 767896 - DNA, 25 bp, Mus musculus
tactggacacacattgatgccttca

SEQ ID NO: 767897 - DNA, 25 bp, Mus musculus
tactggacacactttgatgccttca

SEQ ID NO: 767898 - DNA, 25 bp, Mus musculus
tactggaccaagcacatggtatttt

SEQ ID NO: 767899 - DNA, 25 bp, Mus musculus
tactggaccaaggacatggtatttt

SEQ ID NO: 767900 - DNA, 25 bp, Mus musculus
tactggaccattcctgaagtctcaa

SEQ ID NO: 767901 - DNA, 25 bp, Mus musculus
tactggaccattgctgaagtctcaa

SEQ ID NO: 767902 - DNA, 25 bp, Mus musculus
tactggacccggagatctcccagga

SEQ ID NO: 767903 - DNA, 25 bp, Mus musculus
tactggacccggtgatctcccagga

SEQ ID NO: 767904 - DNA, 25 bp, Mus musculus
tactggaccgtcaggatgacagctc

SEQ ID NO: 767905 - DNA, 25 bp, Mus musculus
tactggaccgtctggatgacagctc

SEQ ID NO: 767906 - DNA, 25 bp, Mus musculus
tactggacctacattggctctctga

SEQ ID NO: 767907 - DNA, 25 bp, Mus musculus
tactggacctactttggctctctga

SEQ ID NO: 767908 - DNA, 25 bp, Mus musculus
tactggacctcgctccttgaggaag

SEQ ID NO: 767909 - DNA, 25 bp, Mus musculus
tactggacctcggtccttgaggaag

SEQ ID NO: 767910 - DNA, 25 bp, Mus musculus
tactggacgtttcaagattagattc

SEQ ID NO: 767911 - DNA, 25 bp, Mus musculus
tactggacgtttgaagattagattc

SEQ ID NO: 767912 - DNA, 25 bp, Mus musculus
tactggactctgaagcaggcccagc

SEQ ID NO: 767913 - DNA, 25 bp, Mus musculus
tactggactctgtagcaggcccagc

SEQ ID NO: 767914 - DNA, 25 bp, Mus musculus
tactggagaaggagcaaaacatgtc

SEQ ID NO: 767915 - DNA, 25 bp, Mus musculus
tactggagaaggtgcaaaacatgtc

SEQ ID NO: 767916 - DNA, 25 bp, Mus musculus
tactggagacacagagcctctttac

SEQ ID NO: 767917 - DNA, 25 bp, Mus musculus
tactggagacactgagcctctttac

SEQ ID NO: 767918 - DNA, 25 bp, Mus musculus
tactggagccagagtttcaccgact

SEQ ID NO: 767919 - DNA, 25 bp, Mus musculus
tactggagccagtgtttcaccgact

SEQ ID NO: 767920 - DNA, 25 bp, Mus musculus
tactggagccggaggtacaagaaca

SEQ ID NO: 767921 - DNA, 25 bp, Mus musculus
tactggagccggtggtacaagaaca

SEQ ID NO: 767922 - DNA, 25 bp, Mus musculus
tactggagcgccaggctagacgaga

SEQ ID NO: 767923 - DNA, 25 bp, Mus musculus
tactggagcgcctggctagacgaga

SEQ ID NO: 767924 - DNA, 25 bp, Mus musculus
tactggaggaagaccctgtcaatca

SEQ ID NO: 767925 - DNA, 25 bp, Mus musculus
tactggaggaagtccctgtcaatca

SEQ ID NO: 767926 - DNA, 25 bp, Mus musculus
tactggagggatatcattttttatt

SEQ ID NO: 767927 - DNA, 25 bp, Mus musculus
tactggagggatttcattttttatt

SEQ ID NO: 767928 - DNA, 25 bp, Mus musculus
tactggagggcaacaggtcccctag

SEQ ID NO: 767929 - DNA, 25 bp, Mus musculus
tactggagggcatcaggtcccctag

SEQ ID NO: 767930 - DNA, 25 bp, Mus musculus
tactggagtcatacgctactggagg

SEQ ID NO: 767931 - DNA, 25 bp, Mus musculus
tactggagtcattcgctactggagg

SEQ ID NO: 767932 - DNA, 25 bp, Mus musculus
tactggagtccaccaggcacgtgcc

SEQ ID NO: 767933 - DNA, 25 bp, Mus musculus
tactggagtccagcaggcacgtgcc

SEQ ID NO: 767934 - DNA, 25 bp, Mus musculus
tactggagtgaaacataccttttta

SEQ ID NO: 767935 - DNA, 25 bp, Mus musculus
tactggagtgaatcataccttttta

SEQ ID NO: 767936 - DNA, 25 bp, Mus musculus
tactggagttagatgctggagagct

SEQ ID NO: 767937 - DNA, 25 bp, Mus musculus
tactggagttagttgctggagagct

SEQ ID NO: 767938 - DNA, 25 bp, Mus musculus
tactggagttataagcgtcttagca

SEQ ID NO: 767939 - DNA, 25 bp, Mus musculus
tactggagttattagcgtcttagca

SEQ ID NO: 767940 - DNA, 25 bp, Mus musculus
tactggatactgaaactatgagaat

SEQ ID NO: 767941 - DNA, 25 bp, Mus musculus
tactggatactgtaactatgagaat

SEQ ID NO: 767942 - DNA, 25 bp, Mus musculus
tactggatcacaattgctttgtgtt

SEQ ID NO: 767943 - DNA, 25 bp, Mus musculus
tactggatcacatttgctttgtgtt

SEQ ID NO: 767944 - DNA, 25 bp, Mus musculus
tactggatggctactttccctcaga

SEQ ID NO: 767945 - DNA, 25 bp, Mus musculus
tactggatggcttctttccctcaga

SEQ ID NO: 767946 - DNA, 25 bp, Mus musculus
tactggatgtcactgcaagctctac

SEQ ID NO: 767947 - DNA, 25 bp, Mus musculus
tactggatgtcagtgcaagctctac

SEQ ID NO: 767948 - DNA, 25 bp, Mus musculus
tactggattctacgactgtgtggct

SEQ ID NO: 767949 - DNA, 25 bp, Mus musculus
tactggattctaggactgtgtggct

SEQ ID NO: 767950 - DNA, 25 bp, Mus musculus
tactggattcttaggccattgttgg

SEQ ID NO: 767951 - DNA, 25 bp, Mus musculus
tactggattctttggccattgttgg

SEQ ID NO: 767952 - DNA, 25 bp, Mus musculus
tactggcaaccacgtatacttgaca

SEQ ID NO: 767953 - DNA, 25 bp, Mus musculus
tactggcaaccaggtatacttgaca

SEQ ID NO: 767954 - DNA, 25 bp, Mus musculus
tactggcaatacatagactactctc

SEQ ID NO: 767955 - DNA, 25 bp, Mus musculus
tactggcaatacttagactactctc

SEQ ID NO: 767956 - DNA, 25 bp, Mus musculus
tactggcaatctcatggctctcagc

SEQ ID NO: 767957 - DNA, 25 bp, Mus musculus
tactggcaatctgatggctctcagc

SEQ ID NO: 767958 - DNA, 25 bp, Mus musculus
tactggcaatgcatccacagcgtaa

SEQ ID NO: 767959 - DNA, 25 bp, Mus musculus
tactggcaatgcttccacagcgtaa

SEQ ID NO: 767960 - DNA, 25 bp, Mus musculus
tactggcacagacttattacctagg

SEQ ID NO: 767961 - DNA, 25 bp, Mus musculus
tactggcacagagttattacctagg

SEQ ID NO: 767962 - DNA, 25 bp, Mus musculus
tactggcacggaccgttaaccacac

SEQ ID NO: 767963 - DNA, 25 bp, Mus musculus
tactggcacggagcgttaaccacac

SEQ ID NO: 767964 - DNA, 25 bp, Mus musculus
tactggcactctagacttataattt

SEQ ID NO: 767965 - DNA, 25 bp, Mus musculus
tactggcactcttgacttataattt

SEQ ID NO: 767966 - DNA, 25 bp, Mus musculus
tactggcacttacgttgactggaca

SEQ ID NO: 767967 - DNA, 25 bp, Mus musculus
tactggcacttaggttgactggaca

SEQ ID NO: 767968 - DNA, 25 bp, Mus musculus
tactggcagcaacccactgcactat

SEQ ID NO: 767969 - DNA, 25 bp, Mus musculus
tactggcagcaagccactgcactat

SEQ ID NO: 767970 - DNA, 25 bp, Mus musculus
tactggcaggctccaatttgcaatt

SEQ ID NO: 767971 - DNA, 25 bp, Mus musculus
tactggcaggctgcaatttgcaatt

SEQ ID NO: 767972 - DNA, 25 bp, Mus musculus
tactggcagggcatatatttgtttg

SEQ ID NO: 767973 - DNA, 25 bp, Mus musculus
tactggcagggcttatatttgtttg

SEQ ID NO: 767974 - DNA, 25 bp, Mus musculus
tactggcatatgaaacgtctacaat

SEQ ID NO: 767975 - DNA, 25 bp, Mus musculus
tactggcatatgtaacgtctacaat

SEQ ID NO: 767976 - DNA, 25 bp, Mus musculus
tactggcatcagacaatgttctgga

SEQ ID NO: 767977 - DNA, 25 bp, Mus musculus
tactggcatcagtcaatgttctgga

SEQ ID NO: 767978 - DNA, 25 bp, Mus musculus
tactggcattctatttggtcttaaa

SEQ ID NO: 767979 - DNA, 25 bp, Mus musculus
tactggcattctttttggtcttaaa

SEQ ID NO: 767980 - DNA, 25 bp, Mus musculus
tactggccaggaatcaaggatctct

SEQ ID NO: 767981 - DNA, 25 bp, Mus musculus
tactggccaggattcaaggatctct

SEQ ID NO: 767982 - DNA, 25 bp, Mus musculus
tactggccagtgcatacaagcttgc

SEQ ID NO: 767983 - DNA, 25 bp, Mus musculus
tactggccagtggatacaagcttgc

SEQ ID NO: 767984 - DNA, 25 bp, Mus musculus
tactggccctaaccatggactacgt

SEQ ID NO: 767985 - DNA, 25 bp, Mus musculus
tactggccctaagcatggactacgt

SEQ ID NO: 767986 - DNA, 25 bp, Mus musculus
tactggccgtccagaagactgactg

SEQ ID NO: 767987 - DNA, 25 bp, Mus musculus
tactggccgtcctgaagactgactg

SEQ ID NO: 767988 - DNA, 25 bp, Mus musculus
tactggcctacacggttctgcagct

SEQ ID NO: 767989 - DNA, 25 bp, Mus musculus
tactggcctacagggttctgcagct

SEQ ID NO: 767990 - DNA, 25 bp, Mus musculus
tactggcctcaaatagctgctttat

SEQ ID NO: 767991 - DNA, 25 bp, Mus musculus
tactggcctcaattagctgctttat

SEQ ID NO: 767992 - DNA, 25 bp, Mus musculus
tactggcctcagcttgtctgtcttc

SEQ ID NO: 767993 - DNA, 25 bp, Mus musculus
tactggcctcaggttgtctgtcttc

SEQ ID NO: 767994 - DNA, 25 bp, Mus musculus
tactggcctttgaggtgcttgttaa

SEQ ID NO: 767995 - DNA, 25 bp, Mus musculus
tactggcctttgtggtgcttgttaa

SEQ ID NO: 767996 - DNA, 25 bp, Mus musculus
tactggcgaccaagacaatgttctt

SEQ ID NO: 767997 - DNA, 25 bp, Mus musculus
tactggcgaccatgacaatgttctt

SEQ ID NO: 767998 - DNA, 25 bp, Mus musculus
tactggcggccccttaaaaagcatg

SEQ ID NO: 767999 - DNA, 25 bp, Mus musculus
tactggcggcccgttaaaaagcatg

SEQ ID NO: 768000 - DNA, 25 bp, Mus musculus
tactggcggcttcctaactacttgg

SEQ ID NO: 768001 - DNA, 25 bp, Mus musculus
tactggcggcttgctaactacttgg

SEQ ID NO: 768002 - DNA, 25 bp, Mus musculus
tactggcgtgggagacccctcagaa

SEQ ID NO: 768003 - DNA, 25 bp, Mus musculus
tactggcgtgggtgacccctcagaa

SEQ ID NO: 768004 - DNA, 25 bp, Mus musculus
tactggctactaaaattgtgtcatt

SEQ ID NO: 768005 - DNA, 25 bp, Mus musculus
tactggctactataattgtgtcatt

SEQ ID NO: 768006 - DNA, 25 bp, Mus musculus
tactggctacttcttcctgtttaga

SEQ ID NO: 768007 - DNA, 25 bp, Mus musculus
tactggctacttgttcctgtttaga

SEQ ID NO: 768008 - DNA, 25 bp, Mus musculus
tactggctagtaatggattgatgaa

SEQ ID NO: 768009 - DNA, 25 bp, Mus musculus
tactggctagtattggattgatgaa

SEQ ID NO: 768010 - DNA, 25 bp, Mus musculus
tactggctcagcatatacaagttag

SEQ ID NO: 768011 - DNA, 25 bp, Mus musculus
tactggctcagcatgccctacatga

SEQ ID NO: 768012 - DNA, 25 bp, Mus musculus
tactggctcagcttatacaagttag

SEQ ID NO: 768013 - DNA, 25 bp, Mus musculus
tactggctcagcttgccctacatga

SEQ ID NO: 768014 - DNA, 25 bp, Mus musculus
tactggctcccaagctaatagaaga

SEQ ID NO: 768015 - DNA, 25 bp, Mus musculus
tactggctcccatgctaatagaaga

SEQ ID NO: 768016 - DNA, 25 bp, Mus musculus
tactggctccgcacatggtttgtgc

SEQ ID NO: 768017 - DNA, 25 bp, Mus musculus
tactggctccgctcatggtttgtgc

SEQ ID NO: 768018 - DNA, 25 bp, Mus musculus
tactggctcgtgaccttcgaggtca

SEQ ID NO: 768019 - DNA, 25 bp, Mus musculus
tactggctcgtgtccttcgaggtca

SEQ ID NO: 768020 - DNA, 25 bp, Mus musculus
tactggctctcaaagtcatccactg

SEQ ID NO: 768021 - DNA, 25 bp, Mus musculus
tactggctctcatagtcatccactg

SEQ ID NO: 768022 - DNA, 25 bp, Mus musculus
tactggctctgacctcggcctgcta

SEQ ID NO: 768023 - DNA, 25 bp, Mus musculus
tactggctctgagctcggcctgcta

SEQ ID NO: 768024 - DNA, 25 bp, Mus musculus
tactggctcttgcttttctctttaa

SEQ ID NO: 768025 - DNA, 25 bp, Mus musculus
tactggctcttggttttctctttaa

SEQ ID NO: 768026 - DNA, 25 bp, Mus musculus
tactggctgcagcaaaggtaattct

SEQ ID NO: 768027 - DNA, 25 bp, Mus musculus
tactggctgcaggaaaggtaattct

SEQ ID NO: 768028 - DNA, 25 bp, Mus musculus
tactggctggtcctgtatggctgca

SEQ ID NO: 768029 - DNA, 25 bp, Mus musculus
tactggctggtcgtgtatggctgca

SEQ ID NO: 768030 - DNA, 25 bp, Mus musculus
tactggctggttacaccatcaggaa

SEQ ID NO: 768031 - DNA, 25 bp, Mus musculus
tactggctggttatatgttgtcaac

SEQ ID NO: 768032 - DNA, 25 bp, Mus musculus
tactggctggtttcaccatcaggaa

SEQ ID NO: 768033 - DNA, 25 bp, Mus musculus
tactggctggttttatgttgtcaac

SEQ ID NO: 768034 - DNA, 25 bp, Mus musculus
tactggcttctgagtctacttttat

SEQ ID NO: 768035 - DNA, 25 bp, Mus musculus
tactggcttctgtgtctacttttat

SEQ ID NO: 768036 - DNA, 25 bp, Mus musculus
tactggcttgctatggtactagaac

SEQ ID NO: 768037 - DNA, 25 bp, Mus musculus
tactggcttgctttggtactagaac

SEQ ID NO: 768038 - DNA, 25 bp, Mus musculus
tactggctttctcgattaccggttt

SEQ ID NO: 768039 - DNA, 25 bp, Mus musculus
tactggctttctggattaccggttt

SEQ ID NO: 768040 - DNA, 25 bp, Mus musculus
tactgggaacaaaaccaactccgcg

SEQ ID NO: 768041 - DNA, 25 bp, Mus musculus
tactgggaacaataccaactccgcg

SEQ ID NO: 768042 - DNA, 25 bp, Mus musculus
tactgggaattgacccatgcttcca

SEQ ID NO: 768043 - DNA, 25 bp, Mus musculus
tactgggaattgtcccatgcttcca

SEQ ID NO: 768044 - DNA, 25 bp, Mus musculus
tactgggacagtaggcaggccatca

SEQ ID NO: 768045 - DNA, 25 bp, Mus musculus
tactgggacagttggcaggccatca

SEQ ID NO: 768046 - DNA, 25 bp, Mus musculus
tactgggaccatagcagaaggattt

SEQ ID NO: 768047 - DNA, 25 bp, Mus musculus
tactgggaccattgcagaaggattt

SEQ ID NO: 768048 - DNA, 25 bp, Mus musculus
tactgggagacgagcgctccttgca

SEQ ID NO: 768049 - DNA, 25 bp, Mus musculus
tactgggagacgtgcgctccttgca

SEQ ID NO: 768050 - DNA, 25 bp, Mus musculus
tactgggaggctcaggtgtccaact

SEQ ID NO: 768051 - DNA, 25 bp, Mus musculus
tactgggaggctgaggtgtccaact

SEQ ID NO: 768052 - DNA, 25 bp, Mus musculus
tactgggattctattgtatcttttt

SEQ ID NO: 768053 - DNA, 25 bp, Mus musculus
tactgggattcttttgtatcttttt

SEQ ID NO: 768054 - DNA, 25 bp, Mus musculus
tactgggattgtaggcgtatacttc

SEQ ID NO: 768055 - DNA, 25 bp, Mus musculus
tactgggattgttggcgtatacttc

SEQ ID NO: 768056 - DNA, 25 bp, Mus musculus
tactgggcacagctcagggacacct

SEQ ID NO: 768057 - DNA, 25 bp, Mus musculus
tactgggcacaggtcagggacacct

SEQ ID NO: 768058 - DNA, 25 bp, Mus musculus
tactgggcagcgcatgtccgttcgc

SEQ ID NO: 768059 - DNA, 25 bp, Mus musculus
tactgggcagcggatgtccgttcgc

SEQ ID NO: 768060 - DNA, 25 bp, Mus musculus
tactgggcatttctcgtaagtgaaa

SEQ ID NO: 768061 - DNA, 25 bp, Mus musculus
tactgggcatttgtcgtaagtgaaa

SEQ ID NO: 768062 - DNA, 25 bp, Mus musculus
tactgggcccttatctcataattaa

SEQ ID NO: 768063 - DNA, 25 bp, Mus musculus
tactgggcccttttctcataattaa

SEQ ID NO: 768064 - DNA, 25 bp, Mus musculus
tactgggccggcatggtgacacact

SEQ ID NO: 768065 - DNA, 25 bp, Mus musculus
tactgggccggcttggtgacacact

SEQ ID NO: 768066 - DNA, 25 bp, Mus musculus
tactgggcgttaaagtgggcgtctt

SEQ ID NO: 768067 - DNA, 25 bp, Mus musculus
tactgggcgttatagtgggcgtctt

SEQ ID NO: 768068 - DNA, 25 bp, Mus musculus
tactgggctctgaccctggaaggga

SEQ ID NO: 768069 - DNA, 25 bp, Mus musculus
tactgggctctgtccctggaaggga

SEQ ID NO: 768070 - DNA, 25 bp, Mus musculus
tactggggaagtctttggcctcctt

SEQ ID NO: 768071 - DNA, 25 bp, Mus musculus
tactggggaagtgtttggcctcctt

SEQ ID NO: 768072 - DNA, 25 bp, Mus musculus
tactgggtactgacagtggcctgta

SEQ ID NO: 768073 - DNA, 25 bp, Mus musculus
tactgggtactgtcagtggcctgta

SEQ ID NO: 768074 - DNA, 25 bp, Mus musculus
tactgggtagatctgctgtactgat

SEQ ID NO: 768075 - DNA, 25 bp, Mus musculus
tactgggtagatgtgctgtactgat

SEQ ID NO: 768076 - DNA, 25 bp, Mus musculus
tactgggtcaataaaacaaccgaat

SEQ ID NO: 768077 - DNA, 25 bp, Mus musculus
tactgggtcaattaaacaaccgaat

SEQ ID NO: 768078 - DNA, 25 bp, Mus musculus
tactgggtcactacagcactgagat

SEQ ID NO: 768079 - DNA, 25 bp, Mus musculus
tactgggtcacttcagcactgagat

SEQ ID NO: 768080 - DNA, 25 bp, Mus musculus
tactgggtcagtatctcctggagtc

SEQ ID NO: 768081 - DNA, 25 bp, Mus musculus
tactgggtcagtttctcctggagtc

SEQ ID NO: 768082 - DNA, 25 bp, Mus musculus
tactgggtcatactgtacaactgtg

SEQ ID NO: 768083 - DNA, 25 bp, Mus musculus
tactgggtcatagtgtacaactgtg

SEQ ID NO: 768084 - DNA, 25 bp, Mus musculus
tactgggtgaatagcacaggtccta

SEQ ID NO: 768085 - DNA, 25 bp, Mus musculus
tactgggtgaattgcacaggtccta

SEQ ID NO: 768086 - DNA, 25 bp, Mus musculus
tactgggtgaccagatgtggacctt

SEQ ID NO: 768087 - DNA, 25 bp, Mus musculus
tactgggtgacctgatgtggacctt

SEQ ID NO: 768088 - DNA, 25 bp, Mus musculus
tactgggtggaaataggctagctct

SEQ ID NO: 768089 - DNA, 25 bp, Mus musculus
tactgggtggaattaggctagctct

SEQ ID NO: 768090 - DNA, 25 bp, Mus musculus
tactgggtgtgaaggtctgaagcaa

SEQ ID NO: 768091 - DNA, 25 bp, Mus musculus
tactgggtgtgatggtctgaagcaa

SEQ ID NO: 768092 - DNA, 25 bp, Mus musculus
tactgggtgtgcatgtggctttgcc

SEQ ID NO: 768093 - DNA, 25 bp, Mus musculus
tactgggtgtgcttgtggctttgcc

SEQ ID NO: 768094 - DNA, 25 bp, Mus musculus
tactgggttcagctgacgctggttc

SEQ ID NO: 768095 - DNA, 25 bp, Mus musculus
tactgggttcaggtgacgctggttc

SEQ ID NO: 768096 - DNA, 25 bp, Mus musculus
tactgggttcttatgtacctgtcaa

SEQ ID NO: 768097 - DNA, 25 bp, Mus musculus
tactgggttcttttgtacctgtcaa

SEQ ID NO: 768098 - DNA, 25 bp, Mus musculus
tactgggtttgaagtcactgccaac

SEQ ID NO: 768099 - DNA, 25 bp, Mus musculus
tactgggtttgatgtcactgccaac

SEQ ID NO: 768100 - DNA, 25 bp, Mus musculus
tactggtacctgcacatatcttccg

SEQ ID NO: 768101 - DNA, 25 bp, Mus musculus
tactggtacctggacatatcttccg

SEQ ID NO: 768102 - DNA, 25 bp, Mus musculus
tactggtaccttacgaacgagggca

SEQ ID NO: 768103 - DNA, 25 bp, Mus musculus
tactggtacctttcgaacgagggca

SEQ ID NO: 768104 - DNA, 25 bp, Mus musculus
tactggtactcaacacgtgcctgat

SEQ ID NO: 768105 - DNA, 25 bp, Mus musculus
tactggtactcatcacgtgcctgat

SEQ ID NO: 768106 - DNA, 25 bp, Mus musculus
tactggtagaccacactgggcttgc

SEQ ID NO: 768107 - DNA, 25 bp, Mus musculus
tactggtagacctcactgggcttgc

SEQ ID NO: 768108 - DNA, 25 bp, Mus musculus
tactggtagtcaagctctctagggc

SEQ ID NO: 768109 - DNA, 25 bp, Mus musculus
tactggtagtcatgctctctagggc

SEQ ID NO: 768110 - DNA, 25 bp, Mus musculus
tactggtagtttcccaggagctttg

SEQ ID NO: 768111 - DNA, 25 bp, Mus musculus
tactggtagtttgccaggagctttg

SEQ ID NO: 768112 - DNA, 25 bp, Mus musculus
tactggtatcaacgtatcttcccac

SEQ ID NO: 768113 - DNA, 25 bp, Mus musculus
tactggtatcaaggtatcttcccac

SEQ ID NO: 768114 - DNA, 25 bp, Mus musculus
tactggtatcggattctacccacaa

SEQ ID NO: 768115 - DNA, 25 bp, Mus musculus
tactggtatcggtttctacccacaa

SEQ ID NO: 768116 - DNA, 25 bp, Mus musculus
tactggtatttgacagatgcagata

SEQ ID NO: 768117 - DNA, 25 bp, Mus musculus
tactggtatttgtcagatgcagata

SEQ ID NO: 768118 - DNA, 25 bp, Mus musculus
tactggtcatggctcttgctggaga

SEQ ID NO: 768119 - DNA, 25 bp, Mus musculus
tactggtcatgggtcttgctggaga

SEQ ID NO: 768120 - DNA, 25 bp, Mus musculus
tactggtcatttctcacatgtcccg

SEQ ID NO: 768121 - DNA, 25 bp, Mus musculus
tactggtcatttgtcacatgtcccg

SEQ ID NO: 768122 - DNA, 25 bp, Mus musculus
tactggtcctggctgctgtgagaaa

SEQ ID NO: 768123 - DNA, 25 bp, Mus musculus
tactggtcctgggtgctgtgagaaa

SEQ ID NO: 768124 - DNA, 25 bp, Mus musculus
tactggtctattctggtagcttttg

SEQ ID NO: 768125 - DNA, 25 bp, Mus musculus
tactggtctattgtggtagcttttg

SEQ ID NO: 768126 - DNA, 25 bp, Mus musculus
tactggtgactactgtttttcatca

SEQ ID NO: 768127 - DNA, 25 bp, Mus musculus
tactggtgactagtgtttttcatca

SEQ ID NO: 768128 - DNA, 25 bp, Mus musculus
tactggtgcactaagcggtttgttt

SEQ ID NO: 768129 - DNA, 25 bp, Mus musculus
tactggtgcacttagcggtttgttt

SEQ ID NO: 768130 - DNA, 25 bp, Mus musculus
tactggtgcagaaggatggcttagc

SEQ ID NO: 768131 - DNA, 25 bp, Mus musculus
tactggtgcagatggatggcttagc

SEQ ID NO: 768132 - DNA, 25 bp, Mus musculus
tactggtgcagtagtgctccctcaa

SEQ ID NO: 768133 - DNA, 25 bp, Mus musculus
tactggtgcagttgtgctccctcaa

SEQ ID NO: 768134 - DNA, 25 bp, Mus musculus
tactggtgctggattctgcaagaga

SEQ ID NO: 768135 - DNA, 25 bp, Mus musculus
tactggtgctggtttctgcaagaga

SEQ ID NO: 768136 - DNA, 25 bp, Mus musculus
tactggtggacaaatccccactgaa

SEQ ID NO: 768137 - DNA, 25 bp, Mus musculus
tactggtggacatatccccactgaa

SEQ ID NO: 768138 - DNA, 25 bp, Mus musculus
tactggtgtcctcccagagctggag

SEQ ID NO: 768139 - DNA, 25 bp, Mus musculus
tactggtgtcctgccagagctggag

SEQ ID NO: 768140 - DNA, 25 bp, Mus musculus
tactggttaatactggttccctggg

SEQ ID NO: 768141 - DNA, 25 bp, Mus musculus
tactggttaatagtggttccctggg

SEQ ID NO: 768142 - DNA, 25 bp, Mus musculus
tactggttaatgctatttctcacaa

SEQ ID NO: 768143 - DNA, 25 bp, Mus musculus
tactggttaatggtatttctcacaa

SEQ ID NO: 768144 - DNA, 25 bp, Mus musculus
tactggttaattctattgaaggctt

SEQ ID NO: 768145 - DNA, 25 bp, Mus musculus
tactggttaattgtattgaaggctt

SEQ ID NO: 768146 - DNA, 25 bp, Mus musculus
tactggttacagcaagcctgcacct

SEQ ID NO: 768147 - DNA, 25 bp, Mus musculus
tactggttacaggaagcctgcacct

SEQ ID NO: 768148 - DNA, 25 bp, Mus musculus
tactggttcagacctcttaggcaca

SEQ ID NO: 768149 - DNA, 25 bp, Mus musculus
tactggttcagagctcttaggcaca

SEQ ID NO: 768150 - DNA, 25 bp, Mus musculus
tactggttcataacccggcttcaag

SEQ ID NO: 768151 - DNA, 25 bp, Mus musculus
tactggttcatatcccggcttcaag

SEQ ID NO: 768152 - DNA, 25 bp, Mus musculus
tactggttgcagcaccctcctggta

SEQ ID NO: 768153 - DNA, 25 bp, Mus musculus
tactggttgcaggaccctcctggta

SEQ ID NO: 768154 - DNA, 25 bp, Mus musculus
tactggttgctaagtctctccgaga

SEQ ID NO: 768155 - DNA, 25 bp, Mus musculus
tactggttgctatgtctctccgaga

SEQ ID NO: 768156 - DNA, 25 bp, Mus musculus
tactggttgcttagtatgtatccga

SEQ ID NO: 768157 - DNA, 25 bp, Mus musculus
tactggttgctttgtatgtatccga

SEQ ID NO: 768158 - DNA, 25 bp, Mus musculus
tactggtttcatagtagggcccaac

SEQ ID NO: 768159 - DNA, 25 bp, Mus musculus
tactggtttcattgtagggcccaac

SEQ ID NO: 768160 - DNA, 25 bp, Mus musculus
tactggtttccaactactgcaaaga

SEQ ID NO: 768161 - DNA, 25 bp, Mus musculus
tactggtttccatctactgcaaaga

SEQ ID NO: 768162 - DNA, 25 bp, Mus musculus
tactggtttgtaatctgcttctcca

SEQ ID NO: 768163 - DNA, 25 bp, Mus musculus
tactggtttgtattctgcttctcca

SEQ ID NO: 768164 - DNA, 25 bp, Mus musculus
tactggttttagacctgtggcagat

SEQ ID NO: 768165 - DNA, 25 bp, Mus musculus
tactggttttagtcctgtggcagat

SEQ ID NO: 768166 - DNA, 25 bp, Mus musculus
tactgtaaaatcctgcagactgtta

SEQ ID NO: 768167 - DNA, 25 bp, Mus musculus
tactgtaaaatcgtgcagactgtta

SEQ ID NO: 768168 - DNA, 25 bp, Mus musculus
tactgtaaatctctattcagagcat

SEQ ID NO: 768169 - DNA, 25 bp, Mus musculus
tactgtaaatctgtattcagagcat

SEQ ID NO: 768170 - DNA, 25 bp, Mus musculus
tactgtaacggtacttttgttgtct

SEQ ID NO: 768171 - DNA, 25 bp, Mus musculus
tactgtaacggttcttttgttgtct

SEQ ID NO: 768172 - DNA, 25 bp, Mus musculus
tactgtaactagcatgagatcattt

SEQ ID NO: 768173 - DNA, 25 bp, Mus musculus
tactgtaactaggatgagatcattt

SEQ ID NO: 768174 - DNA, 25 bp, Mus musculus
tactgtaatgaacactgtaaccgaa

SEQ ID NO: 768175 - DNA, 25 bp, Mus musculus
tactgtaatgaagactgtaaccgaa

SEQ ID NO: 768176 - DNA, 25 bp, Mus musculus
tactgtaattgcaactggactcctt

SEQ ID NO: 768177 - DNA, 25 bp, Mus musculus
tactgtaattgctactggactcctt

SEQ ID NO: 768178 - DNA, 25 bp, Mus musculus
tactgtacaaaactgcaagaaacgg

SEQ ID NO: 768179 - DNA, 25 bp, Mus musculus
tactgtacaaaagtgcaagaaacgg

SEQ ID NO: 768180 - DNA, 25 bp, Mus musculus
tactgtacaacaagaaggactgcca

SEQ ID NO: 768181 - DNA, 25 bp, Mus musculus
tactgtacaacatgaaggactgcca

SEQ ID NO: 768182 - DNA, 25 bp, Mus musculus
tactgtacattgcagcacttattca

SEQ ID NO: 768183 - DNA, 25 bp, Mus musculus
tactgtacattggagcacttattca

SEQ ID NO: 768184 - DNA, 25 bp, Mus musculus
tactgtaccacaatcctgctcagaa

SEQ ID NO: 768185 - DNA, 25 bp, Mus musculus
tactgtaccacattcctgctcagaa

SEQ ID NO: 768186 - DNA, 25 bp, Mus musculus
tactgtaccccgatgatgatcacac

SEQ ID NO: 768187 - DNA, 25 bp, Mus musculus
tactgtaccccgttgatgatcacac

SEQ ID NO: 768188 - DNA, 25 bp, Mus musculus
tactgtacgcctccgctttggcgag

SEQ ID NO: 768189 - DNA, 25 bp, Mus musculus
tactgtacgcctgcgctttggcgag

SEQ ID NO: 768190 - DNA, 25 bp, Mus musculus
tactgtactaagcagcccaaggctg

SEQ ID NO: 768191 - DNA, 25 bp, Mus musculus
tactgtactaaggagcccaaggctg

SEQ ID NO: 768192 - DNA, 25 bp, Mus musculus
tactgtactgctatactacatggat

SEQ ID NO: 768193 - DNA, 25 bp, Mus musculus
tactgtactgctttactacatggat

SEQ ID NO: 768194 - DNA, 25 bp, Mus musculus
tactgtactgggatccgtgtgtcac

SEQ ID NO: 768195 - DNA, 25 bp, Mus musculus
tactgtactgggttccgtgtgtcac

SEQ ID NO: 768196 - DNA, 25 bp, Mus musculus
tactgtactgtcctcagggccaggg

SEQ ID NO: 768197 - DNA, 25 bp, Mus musculus
tactgtactgtcgtcagggccaggg

SEQ ID NO: 768198 - DNA, 25 bp, Mus musculus
tactgtagactaacactctcaaaca

SEQ ID NO: 768199 - DNA, 25 bp, Mus musculus
tactgtagactatcactctcaaaca

SEQ ID NO: 768200 - DNA, 25 bp, Mus musculus
tactgtagcagcctttcagcacgtc

SEQ ID NO: 768201 - DNA, 25 bp, Mus musculus
tactgtagcagcgtttcagcacgtc

SEQ ID NO: 768202 - DNA, 25 bp, Mus musculus
tactgtagcaggatggagatgccct

SEQ ID NO: 768203 - DNA, 25 bp, Mus musculus
tactgtagcaggttggagatgccct

SEQ ID NO: 768204 - DNA, 25 bp, Mus musculus
tactgtagctatatcctgacaccac

SEQ ID NO: 768205 - DNA, 25 bp, Mus musculus
tactgtagctatttcctgacaccac

SEQ ID NO: 768206 - DNA, 25 bp, Mus musculus
tactgtagctccatggatagcccaa

SEQ ID NO: 768207 - DNA, 25 bp, Mus musculus
tactgtagctccttggatagcccaa

SEQ ID NO: 768208 - DNA, 25 bp, Mus musculus
tactgtagctgtaagttcgaagcca

SEQ ID NO: 768209 - DNA, 25 bp, Mus musculus
tactgtagctgtattaaatccacca

SEQ ID NO: 768210 - DNA, 25 bp, Mus musculus
tactgtagctgttagttcgaagcca

SEQ ID NO: 768211 - DNA, 25 bp, Mus musculus
tactgtagctgttttaaatccacca

SEQ ID NO: 768212 - DNA, 25 bp, Mus musculus
tactgtaggccaccttgcctatgaa

SEQ ID NO: 768213 - DNA, 25 bp, Mus musculus
tactgtaggccagcttgcctatgaa

SEQ ID NO: 768214 - DNA, 25 bp, Mus musculus
tactgtaggcctacttcagtctcca

SEQ ID NO: 768215 - DNA, 25 bp, Mus musculus
tactgtaggccttcttcagtctcca

SEQ ID NO: 768216 - DNA, 25 bp, Mus musculus
tactgtaggtacatggactggtgca

SEQ ID NO: 768217 - DNA, 25 bp, Mus musculus
tactgtaggtacttggactggtgca

SEQ ID NO: 768218 - DNA, 25 bp, Mus musculus
tactgtaggtagagagttcttggcc

SEQ ID NO: 768219 - DNA, 25 bp, Mus musculus
tactgtaggtagtgagttcttggcc

SEQ ID NO: 768220 - DNA, 25 bp, Mus musculus
tactgtaggttgcacacgaactctt

SEQ ID NO: 768221 - DNA, 25 bp, Mus musculus
tactgtaggttggacacgaactctt

SEQ ID NO: 768222 - DNA, 25 bp, Mus musculus
tactgtagtctacacccaggcatct

SEQ ID NO: 768223 - DNA, 25 bp, Mus musculus
tactgtagtctagacccaggcatct

SEQ ID NO: 768224 - DNA, 25 bp, Mus musculus
tactgtagtggtagagatcgtctct

SEQ ID NO: 768225 - DNA, 25 bp, Mus musculus
tactgtagtggttgagatcgtctct

SEQ ID NO: 768226 - DNA, 25 bp, Mus musculus
tactgtagtgtcagttttccctcat

SEQ ID NO: 768227 - DNA, 25 bp, Mus musculus
tactgtagtgtctgttttccctcat

SEQ ID NO: 768228 - DNA, 25 bp, Mus musculus
tactgtatacctctgggcgatgaga

SEQ ID NO: 768229 - DNA, 25 bp, Mus musculus
tactgtatacctgtgggcgatgaga

SEQ ID NO: 768230 - DNA, 25 bp, Mus musculus
tactgtatcaagaggctattttaaa

SEQ ID NO: 768231 - DNA, 25 bp, Mus musculus
tactgtatcaagtggctattttaaa

SEQ ID NO: 768232 - DNA, 25 bp, Mus musculus
tactgtatcttgcaatctagccgat

SEQ ID NO: 768233 - DNA, 25 bp, Mus musculus
tactgtatcttggaatctagccgat

SEQ ID NO: 768234 - DNA, 25 bp, Mus musculus
tactgtatgctgatgacacacccat

SEQ ID NO: 768235 - DNA, 25 bp, Mus musculus
tactgtatgctgttgacacacccat

SEQ ID NO: 768236 - DNA, 25 bp, Mus musculus
tactgtattcaactcgctcgagtgc

SEQ ID NO: 768237 - DNA, 25 bp, Mus musculus
tactgtattcaagtcgctcgagtgc

SEQ ID NO: 768238 - DNA, 25 bp, Mus musculus
tactgtattcctcggagaggcctaa

SEQ ID NO: 768239 - DNA, 25 bp, Mus musculus
tactgtattcctgggagaggcctaa

SEQ ID NO: 768240 - DNA, 25 bp, Mus musculus
tactgtattcgtaacatatgtgata

SEQ ID NO: 768241 - DNA, 25 bp, Mus musculus
tactgtattcgttacatatgtgata

SEQ ID NO: 768242 - DNA, 25 bp, Mus musculus
tactgtattgtaagtgtggcccaca

SEQ ID NO: 768243 - DNA, 25 bp, Mus musculus
tactgtattgtatgtgtggcccaca

SEQ ID NO: 768244 - DNA, 25 bp, Mus musculus
tactgtatttgcacccttctgactt

SEQ ID NO: 768245 - DNA, 25 bp, Mus musculus
tactgtatttgctcccttctgactt

SEQ ID NO: 768246 - DNA, 25 bp, Mus musculus
tactgtcaaggcctcctgtggcttc

SEQ ID NO: 768247 - DNA, 25 bp, Mus musculus
tactgtcaaggcgtcctgtggcttc

SEQ ID NO: 768248 - DNA, 25 bp, Mus musculus
tactgtcacaccacctctagttgga

SEQ ID NO: 768249 - DNA, 25 bp, Mus musculus
tactgtcacacctcctctagttgga

SEQ ID NO: 768250 - DNA, 25 bp, Mus musculus
tactgtcaccgtcatcctgaggcct

SEQ ID NO: 768251 - DNA, 25 bp, Mus musculus
tactgtcaccgtgatcctgaggcct

SEQ ID NO: 768252 - DNA, 25 bp, Mus musculus
tactgtcacggtagctgggtgtgct

SEQ ID NO: 768253 - DNA, 25 bp, Mus musculus
tactgtcacggttgctgggtgtgct

SEQ ID NO: 768254 - DNA, 25 bp, Mus musculus
tactgtcactagatactgtttgatt

SEQ ID NO: 768255 - DNA, 25 bp, Mus musculus
tactgtcactagttactgtttgatt

SEQ ID NO: 768256 - DNA, 25 bp, Mus musculus
tactgtcagtaaaagcaattatttt

SEQ ID NO: 768257 - DNA, 25 bp, Mus musculus
tactgtcagtaatagcaattatttt

SEQ ID NO: 768258 - DNA, 25 bp, Mus musculus
tactgtcatgtaacatttcccatat

SEQ ID NO: 768259 - DNA, 25 bp, Mus musculus
tactgtcatgtatcatttcccatat

SEQ ID NO: 768260 - DNA, 25 bp, Mus musculus
tactgtcattacatcacgccttaag

SEQ ID NO: 768261 - DNA, 25 bp, Mus musculus
tactgtcattacttcacgccttaag

SEQ ID NO: 768262 - DNA, 25 bp, Mus musculus
tactgtcattttacatcctggcgtt

SEQ ID NO: 768263 - DNA, 25 bp, Mus musculus
tactgtcatttttcatcctggcgtt

SEQ ID NO: 768264 - DNA, 25 bp, Mus musculus
tactgtccatacatgtctctacgag

SEQ ID NO: 768265 - DNA, 25 bp, Mus musculus
tactgtccatacttgtctctacgag

SEQ ID NO: 768266 - DNA, 25 bp, Mus musculus
tactgtcccatgatttcttcaggtg

SEQ ID NO: 768267 - DNA, 25 bp, Mus musculus
tactgtcccatgttttcttcaggtg

SEQ ID NO: 768268 - DNA, 25 bp, Mus musculus
tactgtccctgccagaacattaagc

SEQ ID NO: 768269 - DNA, 25 bp, Mus musculus
tactgtccctgcgagaacattaagc

SEQ ID NO: 768270 - DNA, 25 bp, Mus musculus
tactgtccctgtagtcctgacttgt

SEQ ID NO: 768271 - DNA, 25 bp, Mus musculus
tactgtccctgttgtcctgacttgt

SEQ ID NO: 768272 - DNA, 25 bp, Mus musculus
tactgtcctagcatggtccgagtac

SEQ ID NO: 768273 - DNA, 25 bp, Mus musculus
tactgtcctagcttggtccgagtac

SEQ ID NO: 768274 - DNA, 25 bp, Mus musculus
tactgtcctctactggagccaaaca

SEQ ID NO: 768275 - DNA, 25 bp, Mus musculus
tactgtcctctagtggagccaaaca

SEQ ID NO: 768276 - DNA, 25 bp, Mus musculus
tactgtcctttcatcaaccggaagc

SEQ ID NO: 768277 - DNA, 25 bp, Mus musculus
tactgtcctttcttcaaccggaagc

SEQ ID NO: 768278 - DNA, 25 bp, Mus musculus
tactgtccttttccaatacctatct

SEQ ID NO: 768279 - DNA, 25 bp, Mus musculus
tactgtccttttgcaatacctatct

SEQ ID NO: 768280 - DNA, 25 bp, Mus musculus
tactgtcgaggcacgtgggctgcac

SEQ ID NO: 768281 - DNA, 25 bp, Mus musculus
tactgtcgaggctcgtgggctgcac

SEQ ID NO: 768282 - DNA, 25 bp, Mus musculus
tactgtcgcagtattaccgagcatt

SEQ ID NO: 768283 - DNA, 25 bp, Mus musculus
tactgtcgcagttttaccgagcatt

SEQ ID NO: 768284 - DNA, 25 bp, Mus musculus
tactgtcggcgcctgattgcaaggt

SEQ ID NO: 768285 - DNA, 25 bp, Mus musculus
tactgtcggcgcgtgattgcaaggt

SEQ ID NO: 768286 - DNA, 25 bp, Mus musculus
tactgtcgtcgacgcaaccgttact

SEQ ID NO: 768287 - DNA, 25 bp, Mus musculus
tactgtcgtcgaggcaaccgttact

SEQ ID NO: 768288 - DNA, 25 bp, Mus musculus
tactgtctaaacctttgggcatctt

SEQ ID NO: 768289 - DNA, 25 bp, Mus musculus
tactgtctaaacgtttgggcatctt

SEQ ID NO: 768290 - DNA, 25 bp, Mus musculus
tactgtctagcaaatatatcagaag

SEQ ID NO: 768291 - DNA, 25 bp, Mus musculus
tactgtctagcaatgagttagcccc

SEQ ID NO: 768292 - DNA, 25 bp, Mus musculus
tactgtctagcatatatatcagaag

SEQ ID NO: 768293 - DNA, 25 bp, Mus musculus
tactgtctagcattgagttagcccc

SEQ ID NO: 768294 - DNA, 25 bp, Mus musculus
tactgtctagttatgcctaaaccaa

SEQ ID NO: 768295 - DNA, 25 bp, Mus musculus
tactgtctagttttgcctaaaccaa

SEQ ID NO: 768296 - DNA, 25 bp, Mus musculus
tactgtctcaatatgtgttcttgca

SEQ ID NO: 768297 - DNA, 25 bp, Mus musculus
tactgtctcaatttgtgttcttgca

SEQ ID NO: 768298 - DNA, 25 bp, Mus musculus
tactgtctcctcagtgaacctccta

SEQ ID NO: 768299 - DNA, 25 bp, Mus musculus
tactgtctcctctgtgaacctccta

SEQ ID NO: 768300 - DNA, 25 bp, Mus musculus
tactgtctcttcaaatggctcatgg

SEQ ID NO: 768301 - DNA, 25 bp, Mus musculus
tactgtctcttctaatggctcatgg

SEQ ID NO: 768302 - DNA, 25 bp, Mus musculus
tactgtctgactctgctccacaggg

SEQ ID NO: 768303 - DNA, 25 bp, Mus musculus
tactgtctgactgtgctccacaggg

SEQ ID NO: 768304 - DNA, 25 bp, Mus musculus
tactgtctgagaacaaggaggctgt

SEQ ID NO: 768305 - DNA, 25 bp, Mus musculus
tactgtctgagatcaaggaggctgt

SEQ ID NO: 768306 - DNA, 25 bp, Mus musculus
tactgtctgagcaacattgcaaaca

SEQ ID NO: 768307 - DNA, 25 bp, Mus musculus
tactgtctgagctacattgcaaaca

SEQ ID NO: 768308 - DNA, 25 bp, Mus musculus
tactgtctgctacccaggtggcaag

SEQ ID NO: 768309 - DNA, 25 bp, Mus musculus
tactgtctgctagccaggtggcaag

SEQ ID NO: 768310 - DNA, 25 bp, Mus musculus
tactgtctggaaaaccgctgcaacc

SEQ ID NO: 768311 - DNA, 25 bp, Mus musculus
tactgtctggaataccgctgcaacc

SEQ ID NO: 768312 - DNA, 25 bp, Mus musculus
tactgtctggccctatagcctcagg

SEQ ID NO: 768313 - DNA, 25 bp, Mus musculus
tactgtctggccgtatagcctcagg

SEQ ID NO: 768314 - DNA, 25 bp, Mus musculus
tactgtctggtaattaaactgaaac

SEQ ID NO: 768315 - DNA, 25 bp, Mus musculus
tactgtctggtatttaaactgaaac

SEQ ID NO: 768316 - DNA, 25 bp, Mus musculus
tactgtctgtcacagggagcaccca

SEQ ID NO: 768317 - DNA, 25 bp, Mus musculus
tactgtctgtcagagggagcaccca

SEQ ID NO: 768318 - DNA, 25 bp, Mus musculus
tactgtctgtcgatgattcctttca

SEQ ID NO: 768319 - DNA, 25 bp, Mus musculus
tactgtctgtcgttgattcctttca

SEQ ID NO: 768320 - DNA, 25 bp, Mus musculus
tactgtctgttcaggccagccttga

SEQ ID NO: 768321 - DNA, 25 bp, Mus musculus
tactgtctgttctggccagccttga

SEQ ID NO: 768322 - DNA, 25 bp, Mus musculus
tactgtcttcagagggatcccctct

SEQ ID NO: 768323 - DNA, 25 bp, Mus musculus
tactgtcttcagtgggatcccctct

SEQ ID NO: 768324 - DNA, 25 bp, Mus musculus
tactgtcttgctattatctggctgt

SEQ ID NO: 768325 - DNA, 25 bp, Mus musculus
tactgtcttgcttttatctggctgt

SEQ ID NO: 768326 - DNA, 25 bp, Mus musculus
tactgtcttgttactcccgaccatt

SEQ ID NO: 768327 - DNA, 25 bp, Mus musculus
tactgtcttgtttctcccgaccatt

SEQ ID NO: 768328 - DNA, 25 bp, Mus musculus
tactgtcttttcaggagagctgcag

SEQ ID NO: 768329 - DNA, 25 bp, Mus musculus
tactgtcttttctggagagctgcag

SEQ ID NO: 768330 - DNA, 25 bp, Mus musculus
tactgtgaaacactgtgaactctta

SEQ ID NO: 768331 - DNA, 25 bp, Mus musculus
tactgtgaaacagtgtgaactctta

SEQ ID NO: 768332 - DNA, 25 bp, Mus musculus
tactgtgaaactaaccttccagctg

SEQ ID NO: 768333 - DNA, 25 bp, Mus musculus
tactgtgaaacttaccttccagctg

SEQ ID NO: 768334 - DNA, 25 bp, Mus musculus
tactgtgaaagtccttctgctgtcc

SEQ ID NO: 768335 - DNA, 25 bp, Mus musculus
tactgtgaaagtgcttctgctgtcc

SEQ ID NO: 768336 - DNA, 25 bp, Mus musculus
tactgtgaaccccagagcctcgctg

SEQ ID NO: 768337 - DNA, 25 bp, Mus musculus
tactgtgaacccgagagcctcgctg

SEQ ID NO: 768338 - DNA, 25 bp, Mus musculus
tactgtgaaggaagtagccgcatcc

SEQ ID NO: 768339 - DNA, 25 bp, Mus musculus
tactgtgaaggatgtagccgcatcc

SEQ ID NO: 768340 - DNA, 25 bp, Mus musculus
tactgtgaatagaagaaaacctgaa

SEQ ID NO: 768341 - DNA, 25 bp, Mus musculus
tactgtgaatagtagaaaacctgaa

SEQ ID NO: 768342 - DNA, 25 bp, Mus musculus
tactgtgacagaaagctgattgcag

SEQ ID NO: 768343 - DNA, 25 bp, Mus musculus
tactgtgacagatagctgattgcag

SEQ ID NO: 768344 - DNA, 25 bp, Mus musculus
tactgtgactccagcaaagcccaaa

SEQ ID NO: 768345 - DNA, 25 bp, Mus musculus
tactgtgactcctgcaaagcccaaa

SEQ ID NO: 768346 - DNA, 25 bp, Mus musculus
tactgtgactctccttgtctttata

SEQ ID NO: 768347 - DNA, 25 bp, Mus musculus
tactgtgactctgcttgtctttata

SEQ ID NO: 768348 - DNA, 25 bp, Mus musculus
tactgtgagaagagtgccgcgctga

SEQ ID NO: 768349 - DNA, 25 bp, Mus musculus
tactgtgagaagtgtgccgcgctga

SEQ ID NO: 768350 - DNA, 25 bp, Mus musculus
tactgtgagagaatcttcctggact

SEQ ID NO: 768351 - DNA, 25 bp, Mus musculus
tactgtgagagattcttcctggact

SEQ ID NO: 768352 - DNA, 25 bp, Mus musculus
tactgtgagcgacctttgtatgcct

SEQ ID NO: 768353 - DNA, 25 bp, Mus musculus
tactgtgagcgagctttgtatgcct

SEQ ID NO: 768354 - DNA, 25 bp, Mus musculus
tactgtgagcttatggaccaccctg

SEQ ID NO: 768355 - DNA, 25 bp, Mus musculus
tactgtgagcttttggaccaccctg

SEQ ID NO: 768356 - DNA, 25 bp, Mus musculus
tactgtgagggtctcgtgtgtaaac

SEQ ID NO: 768357 - DNA, 25 bp, Mus musculus
tactgtgagggtgtcgtgtgtaaac

SEQ ID NO: 768358 - DNA, 25 bp, Mus musculus
tactgtgaggtgaccatgggctctc

SEQ ID NO: 768359 - DNA, 25 bp, Mus musculus
tactgtgaggtgtccatgggctctc

SEQ ID NO: 768360 - DNA, 25 bp, Mus musculus
tactgtgagtggcactgtgtctcca

SEQ ID NO: 768361 - DNA, 25 bp, Mus musculus
tactgtgagtgggactgtgtctcca

SEQ ID NO: 768362 - DNA, 25 bp, Mus musculus
tactgtgagtgtcatgtcatcctgg

SEQ ID NO: 768363 - DNA, 25 bp, Mus musculus
tactgtgagtgtctttttaaactgg

SEQ ID NO: 768364 - DNA, 25 bp, Mus musculus
tactgtgagtgtgatgtcatcctgg

SEQ ID NO: 768365 - DNA, 25 bp, Mus musculus
tactgtgagtgtgtttttaaactgg

SEQ ID NO: 768366 - DNA, 25 bp, Mus musculus
tactgtgatactataggtttaactc

SEQ ID NO: 768367 - DNA, 25 bp, Mus musculus
tactgtgatactttaggtttaactc

SEQ ID NO: 768368 - DNA, 25 bp, Mus musculus
tactgtgatcaaacattaatctgta

SEQ ID NO: 768369 - DNA, 25 bp, Mus musculus
tactgtgatcaatcattaatctgta

SEQ ID NO: 768370 - DNA, 25 bp, Mus musculus
tactgtgatcctaatgcgtgccccg

SEQ ID NO: 768371 - DNA, 25 bp, Mus musculus
tactgtgatccttatgcgtgccccg

SEQ ID NO: 768372 - DNA, 25 bp, Mus musculus
tactgtgatttccttttgggtgtat

SEQ ID NO: 768373 - DNA, 25 bp, Mus musculus
tactgtgatttcgttttgggtgtat

SEQ ID NO: 768374 - DNA, 25 bp, Mus musculus
tactgtgcaagaccctcctactatg

SEQ ID NO: 768375 - DNA, 25 bp, Mus musculus
tactgtgcaagagcctcctactatg

SEQ ID NO: 768376 - DNA, 25 bp, Mus musculus
tactgtgcaattaacttttggacat

SEQ ID NO: 768377 - DNA, 25 bp, Mus musculus
tactgtgcaatttacttttggacat

SEQ ID NO: 768378 - DNA, 25 bp, Mus musculus
tactgtgcacagaggaaccccaagg

SEQ ID NO: 768379 - DNA, 25 bp, Mus musculus
tactgtgcacagtggaaccccaagg

SEQ ID NO: 768380 - DNA, 25 bp, Mus musculus
tactgtgcacccagtgatgcatgaa

SEQ ID NO: 768381 - DNA, 25 bp, Mus musculus
tactgtgcaccctgtgatgcatgaa

SEQ ID NO: 768382 - DNA, 25 bp, Mus musculus
tactgtgcactgctctgtagatctg

SEQ ID NO: 768383 - DNA, 25 bp, Mus musculus
tactgtgcactggtctgtagatctg

SEQ ID NO: 768384 - DNA, 25 bp, Mus musculus
tactgtgcagctagtttagacgtga

SEQ ID NO: 768385 - DNA, 25 bp, Mus musculus
tactgtgcagcttgtttagacgtga

SEQ ID NO: 768386 - DNA, 25 bp, Mus musculus
tactgtgcatatcatttgagggcat

SEQ ID NO: 768387 - DNA, 25 bp, Mus musculus
tactgtgcatatgatttgagggcat

SEQ ID NO: 768388 - DNA, 25 bp, Mus musculus
tactgtgcatttatatgcctcctct

SEQ ID NO: 768389 - DNA, 25 bp, Mus musculus
tactgtgcatttatctcttgtcgtt

SEQ ID NO: 768390 - DNA, 25 bp, Mus musculus
tactgtgcatttttatgcctcctct

SEQ ID NO: 768391 - DNA, 25 bp, Mus musculus
tactgtgcatttttctcttgtcgtt

SEQ ID NO: 768392 - DNA, 25 bp, Mus musculus
tactgtgccatcactagccaagcaa

SEQ ID NO: 768393 - DNA, 25 bp, Mus musculus
tactgtgccatctctagccaagcaa

SEQ ID NO: 768394 - DNA, 25 bp, Mus musculus
tactgtgccatgagtaactaacaaa

SEQ ID NO: 768395 - DNA, 25 bp, Mus musculus
tactgtgccatgagtctggtgcctg

SEQ ID NO: 768396 - DNA, 25 bp, Mus musculus
tactgtgccatgtgtaactaacaaa

SEQ ID NO: 768397 - DNA, 25 bp, Mus musculus
tactgtgccatgtgtctggtgcctg

SEQ ID NO: 768398 - DNA, 25 bp, Mus musculus
tactgtgcccaccatcaatgggagt

SEQ ID NO: 768399 - DNA, 25 bp, Mus musculus
tactgtgcccacgatcaatgggagt

SEQ ID NO: 768400 - DNA, 25 bp, Mus musculus
tactgtgcccagaggtggacaactt

SEQ ID NO: 768401 - DNA, 25 bp, Mus musculus
tactgtgcccagtggtggacaactt

SEQ ID NO: 768402 - DNA, 25 bp, Mus musculus
tactgtgcccgaagcgccaggatat

SEQ ID NO: 768403 - DNA, 25 bp, Mus musculus
tactgtgcccgatgcgccaggatat

SEQ ID NO: 768404 - DNA, 25 bp, Mus musculus
tactgtgccctcataaatgtatata

SEQ ID NO: 768405 - DNA, 25 bp, Mus musculus
tactgtgccctcttaaatgtatata

SEQ ID NO: 768406 - DNA, 25 bp, Mus musculus
tactgtgcctccatatgagggcatc

SEQ ID NO: 768407 - DNA, 25 bp, Mus musculus
tactgtgcctccttatgagggcatc

SEQ ID NO: 768408 - DNA, 25 bp, Mus musculus
tactgtgcctgcagagtcagcctgc

SEQ ID NO: 768409 - DNA, 25 bp, Mus musculus
tactgtgcctgctgagtcagcctgc

SEQ ID NO: 768410 - DNA, 25 bp, Mus musculus
tactgtgccttcaacaggatttgcc

SEQ ID NO: 768411 - DNA, 25 bp, Mus musculus
tactgtgccttccacgctgggcgag

SEQ ID NO: 768412 - DNA, 25 bp, Mus musculus
tactgtgccttcgacgctgggcgag

SEQ ID NO: 768413 - DNA, 25 bp, Mus musculus
tactgtgccttctacaggatttgcc

SEQ ID NO: 768414 - DNA, 25 bp, Mus musculus
tactgtgcgcgtacatgtgggagtc

SEQ ID NO: 768415 - DNA, 25 bp, Mus musculus
tactgtgcgcgttcatgtgggagtc

SEQ ID NO: 768416 - DNA, 25 bp, Mus musculus
tactgtgcgtaaaatcaccttggag

SEQ ID NO: 768417 - DNA, 25 bp, Mus musculus
tactgtgcgtaatatcaccttggag

SEQ ID NO: 768418 - DNA, 25 bp, Mus musculus
tactgtgcgtgcatggcacaccagg

SEQ ID NO: 768419 - DNA, 25 bp, Mus musculus
tactgtgcgtgcttggcacaccagg

SEQ ID NO: 768420 - DNA, 25 bp, Mus musculus
tactgtgctaagagtgttttcaaac

SEQ ID NO: 768421 - DNA, 25 bp, Mus musculus
tactgtgctaagtgtgttttcaaac

SEQ ID NO: 768422 - DNA, 25 bp, Mus musculus
tactgtgctcaccattgctcatcgg

SEQ ID NO: 768423 - DNA, 25 bp, Mus musculus
tactgtgctcacgattgctcatcgg

SEQ ID NO: 768424 - DNA, 25 bp, Mus musculus
tactgtgctctcacattccaggaga

SEQ ID NO: 768425 - DNA, 25 bp, Mus musculus
tactgtgctctccagatgtctgtta

SEQ ID NO: 768426 - DNA, 25 bp, Mus musculus
tactgtgctctcgagatgtctgtta

SEQ ID NO: 768427 - DNA, 25 bp, Mus musculus
tactgtgctctctcattccaggaga

SEQ ID NO: 768428 - DNA, 25 bp, Mus musculus
tactgtgctctgactgaaacactcc

SEQ ID NO: 768429 - DNA, 25 bp, Mus musculus
tactgtgctctgtctgaaacactcc

SEQ ID NO: 768430 - DNA, 25 bp, Mus musculus
tactgtgctggtctctatcattatc

SEQ ID NO: 768431 - DNA, 25 bp, Mus musculus
tactgtgctggtgtctatcattatc

SEQ ID NO: 768432 - DNA, 25 bp, Mus musculus
tactgtgctgtaactgtgtctgtgt

SEQ ID NO: 768433 - DNA, 25 bp, Mus musculus
tactgtgctgtatctgtgtctgtgt

SEQ ID NO: 768434 - DNA, 25 bp, Mus musculus
tactgtgctttcatgataacttcat

SEQ ID NO: 768435 - DNA, 25 bp, Mus musculus
tactgtgctttcttgataacttcat

SEQ ID NO: 768436 - DNA, 25 bp, Mus musculus
tactgtggagtgcagcatggctctc

SEQ ID NO: 768437 - DNA, 25 bp, Mus musculus
tactgtggagtggagcatggctctc

SEQ ID NO: 768438 - DNA, 25 bp, Mus musculus
tactgtggcagcagtgtcactgtca

SEQ ID NO: 768439 - DNA, 25 bp, Mus musculus
tactgtggcagctgtgtcactgtca

SEQ ID NO: 768440 - DNA, 25 bp, Mus musculus
tactgtggccctccgtgaaatcaga

SEQ ID NO: 768441 - DNA, 25 bp, Mus musculus
tactgtggccctgcgtgaaatcaga

SEQ ID NO: 768442 - DNA, 25 bp, Mus musculus
tactgtggcgttaaaacatggctca

SEQ ID NO: 768443 - DNA, 25 bp, Mus musculus
tactgtggcgtttaaacatggctca

SEQ ID NO: 768444 - DNA, 25 bp, Mus musculus
tactgtggctagatctcccgtcagt

SEQ ID NO: 768445 - DNA, 25 bp, Mus musculus
tactgtggctagttctcccgtcagt

SEQ ID NO: 768446 - DNA, 25 bp, Mus musculus
tactgtggctcaagaacatacttgt

SEQ ID NO: 768447 - DNA, 25 bp, Mus musculus
tactgtggctcatgaacatacttgt

SEQ ID NO: 768448 - DNA, 25 bp, Mus musculus
tactgtggcttgatcgtgtcttccc

SEQ ID NO: 768449 - DNA, 25 bp, Mus musculus
tactgtggcttgttcgtgtcttccc

SEQ ID NO: 768450 - DNA, 25 bp, Mus musculus
tactgtgggactaggatgctgacat

SEQ ID NO: 768451 - DNA, 25 bp, Mus musculus
tactgtgggacttggatgctgacat

SEQ ID NO: 768452 - DNA, 25 bp, Mus musculus
tactgtgggcatacacatcctttat

SEQ ID NO: 768453 - DNA, 25 bp, Mus musculus
tactgtgggcattcacatcctttat

SEQ ID NO: 768454 - DNA, 25 bp, Mus musculus
tactgtgggttactacatgccttct

SEQ ID NO: 768455 - DNA, 25 bp, Mus musculus
tactgtgggttagtacatgccttct

SEQ ID NO: 768456 - DNA, 25 bp, Mus musculus
tactgtggtgagcacaaatgccaac

SEQ ID NO: 768457 - DNA, 25 bp, Mus musculus
tactgtggtgaggacaaatgccaac

SEQ ID NO: 768458 - DNA, 25 bp, Mus musculus
tactgtggtgccatgcatggacaga

SEQ ID NO: 768459 - DNA, 25 bp, Mus musculus
tactgtggtgccttgcatggacaga

SEQ ID NO: 768460 - DNA, 25 bp, Mus musculus
tactgtggttagatgcttctgggac

SEQ ID NO: 768461 - DNA, 25 bp, Mus musculus
tactgtggttagttgcttctgggac

SEQ ID NO: 768462 - DNA, 25 bp, Mus musculus
tactgtggttggctgccttagcatt

SEQ ID NO: 768463 - DNA, 25 bp, Mus musculus
tactgtggttgggtgccttagcatt

SEQ ID NO: 768464 - DNA, 25 bp, Mus musculus
tactgtgtaagccatcccttcataa

SEQ ID NO: 768465 - DNA, 25 bp, Mus musculus
tactgtgtaagcgatcccttcataa

SEQ ID NO: 768466 - DNA, 25 bp, Mus musculus
tactgtgtaatgactcatcgcaggc

SEQ ID NO: 768467 - DNA, 25 bp, Mus musculus
tactgtgtaatgtctcatcgcaggc

SEQ ID NO: 768468 - DNA, 25 bp, Mus musculus
tactgtgtacctaactccaagaact

SEQ ID NO: 768469 - DNA, 25 bp, Mus musculus
tactgtgtaccttactccaagaact

SEQ ID NO: 768470 - DNA, 25 bp, Mus musculus
tactgtgtagctaaggtaggcctcc

SEQ ID NO: 768471 - DNA, 25 bp, Mus musculus
tactgtgtagcttaggtaggcctcc

SEQ ID NO: 768472 - DNA, 25 bp, Mus musculus
tactgtgtatccatttatgggtaaa

SEQ ID NO: 768473 - DNA, 25 bp, Mus musculus
tactgtgtatccttttatgggtaaa

SEQ ID NO: 768474 - DNA, 25 bp, Mus musculus
tactgtgtattcatagacttgccat

SEQ ID NO: 768475 - DNA, 25 bp, Mus musculus
tactgtgtattcttagacttgccat

SEQ ID NO: 768476 - DNA, 25 bp, Mus musculus
tactgtgtcccaagccagcaagcat

SEQ ID NO: 768477 - DNA, 25 bp, Mus musculus
tactgtgtcccatgccagcaagcat

SEQ ID NO: 768478 - DNA, 25 bp, Mus musculus
tactgtgtctccagtcagtgggaac

SEQ ID NO: 768479 - DNA, 25 bp, Mus musculus
tactgtgtctcctgtcagtgggaac

SEQ ID NO: 768480 - DNA, 25 bp, Mus musculus
tactgtgtgaccacaagcaaatgat

SEQ ID NO: 768481 - DNA, 25 bp, Mus musculus
tactgtgtgacctcaagcaaatgat

SEQ ID NO: 768482 - DNA, 25 bp, Mus musculus
tactgtgtgccaaaccaagactgtt

SEQ ID NO: 768483 - DNA, 25 bp, Mus musculus
tactgtgtgccaatgtatctgtgtg

SEQ ID NO: 768484 - DNA, 25 bp, Mus musculus
tactgtgtgccataccaagactgtt

SEQ ID NO: 768485 - DNA, 25 bp, Mus musculus
tactgtgtgccattgtatctgtgtg

SEQ ID NO: 768486 - DNA, 25 bp, Mus musculus
tactgtgtgccccacgaggaagcga

SEQ ID NO: 768487 - DNA, 25 bp, Mus musculus
tactgtgtgcccgacgaggaagcga

SEQ ID NO: 768488 - DNA, 25 bp, Mus musculus
tactgtgtgcgtcgtaaagatctcc

SEQ ID NO: 768489 - DNA, 25 bp, Mus musculus
tactgtgtgcgtggtaaagatctcc

SEQ ID NO: 768490 - DNA, 25 bp, Mus musculus
tactgtgtgctgatctgggtagtgc

SEQ ID NO: 768491 - DNA, 25 bp, Mus musculus
tactgtgtgctgttctgggtagtgc

SEQ ID NO: 768492 - DNA, 25 bp, Mus musculus
tactgtgtgcttcctatgggctgac

SEQ ID NO: 768493 - DNA, 25 bp, Mus musculus
tactgtgtgcttcttccggggcttg

SEQ ID NO: 768494 - DNA, 25 bp, Mus musculus
tactgtgtgcttgctatgggctgac

SEQ ID NO: 768495 - DNA, 25 bp, Mus musculus
tactgtgtgcttgttccggggcttg

SEQ ID NO: 768496 - DNA, 25 bp, Mus musculus
tactgtgtgtacaggtagtgcctct

SEQ ID NO: 768497 - DNA, 25 bp, Mus musculus
tactgtgtgtactggtagtgcctct

SEQ ID NO: 768498 - DNA, 25 bp, Mus musculus
tactgtgtgtctctgtgagattttt

SEQ ID NO: 768499 - DNA, 25 bp, Mus musculus
tactgtgtgtctgtgtgagattttt

SEQ ID NO: 768500 - DNA, 25 bp, Mus musculus
tactgtgttcccacataaaggatga

SEQ ID NO: 768501 - DNA, 25 bp, Mus musculus
tactgtgttccctcataaaggatga

SEQ ID NO: 768502 - DNA, 25 bp, Mus musculus
tactgtgttgccaagggcactcatt

SEQ ID NO: 768503 - DNA, 25 bp, Mus musculus
tactgtgttgcctagggcactcatt

SEQ ID NO: 768504 - DNA, 25 bp, Mus musculus
tactgtgttgctaaactctctttaa

SEQ ID NO: 768505 - DNA, 25 bp, Mus musculus
tactgtgttgcttaactctctttaa

SEQ ID NO: 768506 - DNA, 25 bp, Mus musculus
tactgtgtttgactgccagcaccat

SEQ ID NO: 768507 - DNA, 25 bp, Mus musculus
tactgtgtttgagtgccagcaccat

SEQ ID NO: 768508 - DNA, 25 bp, Mus musculus
tactgtgtttggaaccagcatttgt

SEQ ID NO: 768509 - DNA, 25 bp, Mus musculus
tactgtgtttggtaccagcatttgt

SEQ ID NO: 768510 - DNA, 25 bp, Mus musculus
tactgtgttttaaaattcccatgga

SEQ ID NO: 768511 - DNA, 25 bp, Mus musculus
tactgtgttttataattcccatgga

SEQ ID NO: 768512 - DNA, 25 bp, Mus musculus
tactgttaacggattctgttgtcat

SEQ ID NO: 768513 - DNA, 25 bp, Mus musculus
tactgttaacggtttctgttgtcat

SEQ ID NO: 768514 - DNA, 25 bp, Mus musculus
tactgttaactaaaccctgctttgc

SEQ ID NO: 768515 - DNA, 25 bp, Mus musculus
tactgttaactataccctgctttgc

SEQ ID NO: 768516 - DNA, 25 bp, Mus musculus
tactgttactatatagactcataga

SEQ ID NO: 768517 - DNA, 25 bp, Mus musculus
tactgttactatttagactcataga

SEQ ID NO: 768518 - DNA, 25 bp, Mus musculus
tactgttactctctcttgtcctctt

SEQ ID NO: 768519 - DNA, 25 bp, Mus musculus
tactgttactctgtcttgtcctctt

SEQ ID NO: 768520 - DNA, 25 bp, Mus musculus
tactgttactttagtaaacatcaac

SEQ ID NO: 768521 - DNA, 25 bp, Mus musculus
tactgttacttttgtaaacatcaac

SEQ ID NO: 768522 - DNA, 25 bp, Mus musculus
tactgttaggtgactatggaaacac

SEQ ID NO: 768523 - DNA, 25 bp, Mus musculus
tactgttaggtgtctatggaaacac

SEQ ID NO: 768524 - DNA, 25 bp, Mus musculus
tactgttatgaaactgtgttctctg

SEQ ID NO: 768525 - DNA, 25 bp, Mus musculus
tactgttatgaatctgtgttctctg

SEQ ID NO: 768526 - DNA, 25 bp, Mus musculus
tactgttattgcaaaggatgtactt

SEQ ID NO: 768527 - DNA, 25 bp, Mus musculus
tactgttattgctaaggatgtactt

SEQ ID NO: 768528 - DNA, 25 bp, Mus musculus
tactgttatttaattacattcggtt

SEQ ID NO: 768529 - DNA, 25 bp, Mus musculus
tactgttatttatttacattcggtt

SEQ ID NO: 768530 - DNA, 25 bp, Mus musculus
tactgttcaactagggaccttcatt

SEQ ID NO: 768531 - DNA, 25 bp, Mus musculus
tactgttcaacttgggaccttcatt

SEQ ID NO: 768532 - DNA, 25 bp, Mus musculus
tactgttcaattacactgtgtggat

SEQ ID NO: 768533 - DNA, 25 bp, Mus musculus
tactgttcaatttcactgtgtggat

SEQ ID NO: 768534 - DNA, 25 bp, Mus musculus
tactgttcagctaaccctatgggtc

SEQ ID NO: 768535 - DNA, 25 bp, Mus musculus
tactgttcagcttaccctatgggtc

SEQ ID NO: 768536 - DNA, 25 bp, Mus musculus
tactgttcaggtctcttagagcttt

SEQ ID NO: 768537 - DNA, 25 bp, Mus musculus
tactgttcaggtgtcttagagcttt

SEQ ID NO: 768538 - DNA, 25 bp, Mus musculus
tactgttcatagacttaccctctga

SEQ ID NO: 768539 - DNA, 25 bp, Mus musculus
tactgttcatagtcttaccctctga

SEQ ID NO: 768540 - DNA, 25 bp, Mus musculus
tactgttccacaaatctcctgtgtg

SEQ ID NO: 768541 - DNA, 25 bp, Mus musculus
tactgttccacatatctcctgtgtg

SEQ ID NO: 768542 - DNA, 25 bp, Mus musculus
tactgttccattattcccttgtagt

SEQ ID NO: 768543 - DNA, 25 bp, Mus musculus
tactgttccatttttcccttgtagt

SEQ ID NO: 768544 - DNA, 25 bp, Mus musculus
tactgttcctgcctgtggtctcact

SEQ ID NO: 768545 - DNA, 25 bp, Mus musculus
tactgttcctgcgtgtggtctcact

SEQ ID NO: 768546 - DNA, 25 bp, Mus musculus
tactgttccttcacgggacacaaga

SEQ ID NO: 768547 - DNA, 25 bp, Mus musculus
tactgttccttctcgggacacaaga

SEQ ID NO: 768548 - DNA, 25 bp, Mus musculus
tactgttcgggcagtgacctggcct

SEQ ID NO: 768549 - DNA, 25 bp, Mus musculus
tactgttcgggctgtgacctggcct

SEQ ID NO: 768550 - DNA, 25 bp, Mus musculus
tactgttctaatccccagtcttctt

SEQ ID NO: 768551 - DNA, 25 bp, Mus musculus
tactgttctaatgcccagtcttctt

SEQ ID NO: 768552 - DNA, 25 bp, Mus musculus
tactgttctctgatttaggccttgg

SEQ ID NO: 768553 - DNA, 25 bp, Mus musculus
tactgttctctgttttaggccttgg

SEQ ID NO: 768554 - DNA, 25 bp, Mus musculus
tactgttcttccaccgagttgtgtg

SEQ ID NO: 768555 - DNA, 25 bp, Mus musculus
tactgttcttcctccgagttgtgtg

SEQ ID NO: 768556 - DNA, 25 bp, Mus musculus
tactgttcttgcaatatttctttat

SEQ ID NO: 768557 - DNA, 25 bp, Mus musculus
tactgttcttgctatatttctttat

SEQ ID NO: 768558 - DNA, 25 bp, Mus musculus
tactgttctttcaagttggcttcaa

SEQ ID NO: 768559 - DNA, 25 bp, Mus musculus
tactgttctttctagttggcttcaa

SEQ ID NO: 768560 - DNA, 25 bp, Mus musculus
tactgttgacagctaccatctctat

SEQ ID NO: 768561 - DNA, 25 bp, Mus musculus
tactgttgacaggtaccatctctat

SEQ ID NO: 768562 - DNA, 25 bp, Mus musculus
tactgttgagtgattgagattgaaa

SEQ ID NO: 768563 - DNA, 25 bp, Mus musculus
tactgttgagtgtttgagattgaaa

SEQ ID NO: 768564 - DNA, 25 bp, Mus musculus
tactgttgataaacctgtcagctcc

SEQ ID NO: 768565 - DNA, 25 bp, Mus musculus
tactgttgataatcctgtcagctcc

SEQ ID NO: 768566 - DNA, 25 bp, Mus musculus
tactgttgatctacatagtccccga

SEQ ID NO: 768567 - DNA, 25 bp, Mus musculus
tactgttgatcttcatagtccccga

SEQ ID NO: 768568 - DNA, 25 bp, Mus musculus
tactgttgccagatgctgcacaaag

SEQ ID NO: 768569 - DNA, 25 bp, Mus musculus
tactgttgccagttgctgcacaaag

SEQ ID NO: 768570 - DNA, 25 bp, Mus musculus
tactgttggcttctgataagcttga

SEQ ID NO: 768571 - DNA, 25 bp, Mus musculus
tactgttggcttgtgataagcttga

SEQ ID NO: 768572 - DNA, 25 bp, Mus musculus
tactgttgtgatcaagcacccgatt

SEQ ID NO: 768573 - DNA, 25 bp, Mus musculus
tactgttgtgatgaagcacccgatt

SEQ ID NO: 768574 - DNA, 25 bp, Mus musculus
tactgttgttccctaaacctgaggt

SEQ ID NO: 768575 - DNA, 25 bp, Mus musculus
tactgttgttccgtaaacctgaggt

SEQ ID NO: 768576 - DNA, 25 bp, Mus musculus
tactgttgtttaactgtgtacccat

SEQ ID NO: 768577 - DNA, 25 bp, Mus musculus
tactgttgtttatctgtgtacccat

SEQ ID NO: 768578 - DNA, 25 bp, Mus musculus
tactgttgtttcactggcatctact

SEQ ID NO: 768579 - DNA, 25 bp, Mus musculus
tactgttgtttctctggcatctact

SEQ ID NO: 768580 - DNA, 25 bp, Mus musculus
tactgttgtttgattgcatattctt

SEQ ID NO: 768581 - DNA, 25 bp, Mus musculus
tactgttgtttgtttgcatattctt

SEQ ID NO: 768582 - DNA, 25 bp, Mus musculus
tactgtttaagtagatatctcatgg

SEQ ID NO: 768583 - DNA, 25 bp, Mus musculus
tactgtttaagttgatatctcatgg

SEQ ID NO: 768584 - DNA, 25 bp, Mus musculus
tactgtttacagaggacctttggag

SEQ ID NO: 768585 - DNA, 25 bp, Mus musculus
tactgtttacagattgacggaattg

SEQ ID NO: 768586 - DNA, 25 bp, Mus musculus
tactgtttacagtggacctttggag

SEQ ID NO: 768587 - DNA, 25 bp, Mus musculus
tactgtttacagtttgacggaattg

SEQ ID NO: 768588 - DNA, 25 bp, Mus musculus
tactgtttaccacaaattctggatg

SEQ ID NO: 768589 - DNA, 25 bp, Mus musculus
tactgtttaccagaaattctggatg

SEQ ID NO: 768590 - DNA, 25 bp, Mus musculus
tactgtttagaaatgtctgctgcaa

SEQ ID NO: 768591 - DNA, 25 bp, Mus musculus
tactgtttagaattgtctgctgcaa

SEQ ID NO: 768592 - DNA, 25 bp, Mus musculus
tactgtttaggtctagtcttccttc

SEQ ID NO: 768593 - DNA, 25 bp, Mus musculus
tactgtttaggtgtagtcttccttc

SEQ ID NO: 768594 - DNA, 25 bp, Mus musculus
tactgtttatagaacccaactgctt

SEQ ID NO: 768595 - DNA, 25 bp, Mus musculus
tactgtttatagtacccaactgctt

SEQ ID NO: 768596 - DNA, 25 bp, Mus musculus
tactgtttatggaattttcgtgcat

SEQ ID NO: 768597 - DNA, 25 bp, Mus musculus
tactgtttatggtattttcgtgcat

SEQ ID NO: 768598 - DNA, 25 bp, Mus musculus
tactgtttcataaagcctgtccttc

SEQ ID NO: 768599 - DNA, 25 bp, Mus musculus
tactgtttcatatagcctgtccttc

SEQ ID NO: 768600 - DNA, 25 bp, Mus musculus
tactgtttcattagaatatggagcc

SEQ ID NO: 768601 - DNA, 25 bp, Mus musculus
tactgtttcatttgaatatggagcc

SEQ ID NO: 768602 - DNA, 25 bp, Mus musculus
tactgtttctcaactcttctccagc

SEQ ID NO: 768603 - DNA, 25 bp, Mus musculus
tactgtttctcatctcttctccagc

SEQ ID NO: 768604 - DNA, 25 bp, Mus musculus
tactgtttctgcacggtttatttgt

SEQ ID NO: 768605 - DNA, 25 bp, Mus musculus
tactgtttctgctcggtttatttgt

SEQ ID NO: 768606 - DNA, 25 bp, Mus musculus
tactgtttcttccaatgtctgctaa

SEQ ID NO: 768607 - DNA, 25 bp, Mus musculus
tactgtttcttcgaatgtctgctaa

SEQ ID NO: 768608 - DNA, 25 bp, Mus musculus
tactgtttgcctcacactaagttac

SEQ ID NO: 768609 - DNA, 25 bp, Mus musculus
tactgtttgcctgacactaagttac

SEQ ID NO: 768610 - DNA, 25 bp, Mus musculus
tactgtttgggcatttctgaaagga

SEQ ID NO: 768611 - DNA, 25 bp, Mus musculus
tactgtttgggcttttctgaaagga

SEQ ID NO: 768612 - DNA, 25 bp, Mus musculus
tactgtttggtcaacatactttccc

SEQ ID NO: 768613 - DNA, 25 bp, Mus musculus
tactgtttggtctacatactttccc

SEQ ID NO: 768614 - DNA, 25 bp, Mus musculus
tactgtttgtgtcgtttggttgccc

SEQ ID NO: 768615 - DNA, 25 bp, Mus musculus
tactgtttgtgtggtttggttgccc

SEQ ID NO: 768616 - DNA, 25 bp, Mus musculus
tactgtttgtttataaaggtctctg

SEQ ID NO: 768617 - DNA, 25 bp, Mus musculus
tactgtttgtttttaaaggtctctg

SEQ ID NO: 768618 - DNA, 25 bp, Mus musculus
tactgttttaagacttgctggcaca

SEQ ID NO: 768619 - DNA, 25 bp, Mus musculus
tactgttttaagtcttgctggcaca

SEQ ID NO: 768620 - DNA, 25 bp, Mus musculus
tactgttttagcaaaccaggctgtt

SEQ ID NO: 768621 - DNA, 25 bp, Mus musculus
tactgttttagctaaccaggctgtt

SEQ ID NO: 768622 - DNA, 25 bp, Mus musculus
tactgtttttgacgtagaatctccc

SEQ ID NO: 768623 - DNA, 25 bp, Mus musculus
tactgtttttgaggtagaatctccc

SEQ ID NO: 768624 - DNA, 25 bp, Mus musculus
tactgtttttgtcgtgaagtcacta

SEQ ID NO: 768625 - DNA, 25 bp, Mus musculus
tactgtttttgtggtgaagtcacta

SEQ ID NO: 768626 - DNA, 25 bp, Mus musculus
tactgttttttacctaagatagatg

SEQ ID NO: 768627 - DNA, 25 bp, Mus musculus
tactgttttttagctaagatagatg

SEQ ID NO: 768628 - DNA, 25 bp, Mus musculus
tacttaaaaaatacctcatccgcaa

SEQ ID NO: 768629 - DNA, 25 bp, Mus musculus
tacttaaaaaattcctcatccgcaa

SEQ ID NO: 768630 - DNA, 25 bp, Mus musculus
tacttaaacaacctccgtgttcaag

SEQ ID NO: 768631 - DNA, 25 bp, Mus musculus
tacttaaacaacgtccgtgttcaag

SEQ ID NO: 768632 - DNA, 25 bp, Mus musculus
tacttaaacctaccctcatggcaga

SEQ ID NO: 768633 - DNA, 25 bp, Mus musculus
tacttaaacctagcctcatggcaga

SEQ ID NO: 768634 - DNA, 25 bp, Mus musculus
tacttaaagacactggttgtactag

SEQ ID NO: 768635 - DNA, 25 bp, Mus musculus
tacttaaagacagtggttgtactag

SEQ ID NO: 768636 - DNA, 25 bp, Mus musculus
tacttaaagcacagttggcgcggcc

SEQ ID NO: 768637 - DNA, 25 bp, Mus musculus
tacttaaagcaccttccccagcgag

SEQ ID NO: 768638 - DNA, 25 bp, Mus musculus
tacttaaagcacgttccccagcgag

SEQ ID NO: 768639 - DNA, 25 bp, Mus musculus
tacttaaagcactgttggcgcggcc

SEQ ID NO: 768640 - DNA, 25 bp, Mus musculus
tacttaaatattaccaggcaataat

SEQ ID NO: 768641 - DNA, 25 bp, Mus musculus
tacttaaatatttccaggcaataat

SEQ ID NO: 768642 - DNA, 25 bp, Mus musculus
tacttaaatgccatatgccttccct

SEQ ID NO: 768643 - DNA, 25 bp, Mus musculus
tacttaaatgccttatgccttccct

SEQ ID NO: 768644 - DNA, 25 bp, Mus musculus
tacttaaatttgctgttaacactaa

SEQ ID NO: 768645 - DNA, 25 bp, Mus musculus
tacttaaatttggtgttaacactaa

SEQ ID NO: 768646 - DNA, 25 bp, Mus musculus
tacttaacaaaacccattcccgatg

SEQ ID NO: 768647 - DNA, 25 bp, Mus musculus
tacttaacaaaagccattcccgatg

SEQ ID NO: 768648 - DNA, 25 bp, Mus musculus
tacttaaccctcagtgcatgtgact

SEQ ID NO: 768649 - DNA, 25 bp, Mus musculus
tacttaaccctctgtgcatgtgact

SEQ ID NO: 768650 - DNA, 25 bp, Mus musculus
tacttaagctctagccctaagaaaa

SEQ ID NO: 768651 - DNA, 25 bp, Mus musculus
tacttaagctcttgccctaagaaaa

SEQ ID NO: 768652 - DNA, 25 bp, Mus musculus
tacttaaggaggattgccttcacac

SEQ ID NO: 768653 - DNA, 25 bp, Mus musculus
tacttaaggaggtttgccttcacac

SEQ ID NO: 768654 - DNA, 25 bp, Mus musculus
tacttaaggcacagccagtggtgag

SEQ ID NO: 768655 - DNA, 25 bp, Mus musculus
tacttaaggcactgccagtggtgag

SEQ ID NO: 768656 - DNA, 25 bp, Mus musculus
tacttaattgagatacccttcccat

SEQ ID NO: 768657 - DNA, 25 bp, Mus musculus
tacttaattgagttacccttcccat

SEQ ID NO: 768658 - DNA, 25 bp, Mus musculus
tacttaatttagagctgctgtgatg

SEQ ID NO: 768659 - DNA, 25 bp, Mus musculus
tacttaatttagtgctgctgtgatg

SEQ ID NO: 768660 - DNA, 25 bp, Mus musculus
tacttacacaaccagccagaggctc

SEQ ID NO: 768661 - DNA, 25 bp, Mus musculus
tacttacacaacgagccagaggctc

SEQ ID NO: 768662 - DNA, 25 bp, Mus musculus
tacttacactctcctctctaggtaa

SEQ ID NO: 768663 - DNA, 25 bp, Mus musculus
tacttacactctgctctctaggtaa

SEQ ID NO: 768664 - DNA, 25 bp, Mus musculus
tacttacatttacttcctgacatta

SEQ ID NO: 768665 - DNA, 25 bp, Mus musculus
tacttacatttagttcctgacatta

SEQ ID NO: 768666 - DNA, 25 bp, Mus musculus
tacttaccagcaagtcctgtttctt

SEQ ID NO: 768667 - DNA, 25 bp, Mus musculus
tacttaccagcatgtcctgtttctt

SEQ ID NO: 768668 - DNA, 25 bp, Mus musculus
tacttaccagctcggtttgaccttg

SEQ ID NO: 768669 - DNA, 25 bp, Mus musculus
tacttaccagctgggtttgaccttg

SEQ ID NO: 768670 - DNA, 25 bp, Mus musculus
tacttacccatcataatcttcattg

SEQ ID NO: 768671 - DNA, 25 bp, Mus musculus
tacttacccatcttaatcttcattg

SEQ ID NO: 768672 - DNA, 25 bp, Mus musculus
tacttacctcctattatccacaaga

SEQ ID NO: 768673 - DNA, 25 bp, Mus musculus
tacttacctccttttatccacaaga

SEQ ID NO: 768674 - DNA, 25 bp, Mus musculus
tacttacctgttaatttctctacta

SEQ ID NO: 768675 - DNA, 25 bp, Mus musculus
tacttacctgtttatttctctacta

SEQ ID NO: 768676 - DNA, 25 bp, Mus musculus
tacttaccttgaatatattgtaccc

SEQ ID NO: 768677 - DNA, 25 bp, Mus musculus
tacttaccttgattatattgtaccc

SEQ ID NO: 768678 - DNA, 25 bp, Mus musculus
tacttacggaggctctcatcctacc

SEQ ID NO: 768679 - DNA, 25 bp, Mus musculus
tacttacggagggtctcatcctacc

SEQ ID NO: 768680 - DNA, 25 bp, Mus musculus
tacttacgtacccatctaaccattc

SEQ ID NO: 768681 - DNA, 25 bp, Mus musculus
tacttacgtaccgatctaaccattc

SEQ ID NO: 768682 - DNA, 25 bp, Mus musculus
tacttacgttggagccttgttcaat

SEQ ID NO: 768683 - DNA, 25 bp, Mus musculus
tacttacgttggtgccttgttcaat

SEQ ID NO: 768684 - DNA, 25 bp, Mus musculus
tacttactaaaactcttggtcttga

SEQ ID NO: 768685 - DNA, 25 bp, Mus musculus
tacttactaaaagtcttggtcttga

SEQ ID NO: 768686 - DNA, 25 bp, Mus musculus
tacttactgactagtccctacctaa

SEQ ID NO: 768687 - DNA, 25 bp, Mus musculus
tacttactgacttgtccctacctaa

SEQ ID NO: 768688 - DNA, 25 bp, Mus musculus
tacttactgcttatatagaggacca

SEQ ID NO: 768689 - DNA, 25 bp, Mus musculus
tacttactgcttttatagaggacca

SEQ ID NO: 768690 - DNA, 25 bp, Mus musculus
tacttactggccaggtctggctgaa

SEQ ID NO: 768691 - DNA, 25 bp, Mus musculus
tacttactggccctggtttccctgt

SEQ ID NO: 768692 - DNA, 25 bp, Mus musculus
tacttactggccgtggtttccctgt

SEQ ID NO: 768693 - DNA, 25 bp, Mus musculus
tacttactggcctggtctggctgaa

SEQ ID NO: 768694 - DNA, 25 bp, Mus musculus
tacttactggctcgttgcccatgtt

SEQ ID NO: 768695 - DNA, 25 bp, Mus musculus
tacttactggctggttgcccatgtt

SEQ ID NO: 768696 - DNA, 25 bp, Mus musculus
tacttactgtgcacaggcttcctgg

SEQ ID NO: 768697 - DNA, 25 bp, Mus musculus
tacttactgtgctcaggcttcctgg

SEQ ID NO: 768698 - DNA, 25 bp, Mus musculus
tacttagaacccctgatgccagcag

SEQ ID NO: 768699 - DNA, 25 bp, Mus musculus
tacttagaacccgtgatgccagcag

SEQ ID NO: 768700 - DNA, 25 bp, Mus musculus
tacttagaagccagcatggcgtctt

SEQ ID NO: 768701 - DNA, 25 bp, Mus musculus
tacttagaagcctgcatggcgtctt

SEQ ID NO: 768702 - DNA, 25 bp, Mus musculus
tacttagaagtgaggcccctcctct

SEQ ID NO: 768703 - DNA, 25 bp, Mus musculus
tacttagaagtgtggcccctcctct

SEQ ID NO: 768704 - DNA, 25 bp, Mus musculus
tacttagaatgtctgggcgcctgag

SEQ ID NO: 768705 - DNA, 25 bp, Mus musculus
tacttagaatgtgtgggcgcctgag

SEQ ID NO: 768706 - DNA, 25 bp, Mus musculus
tacttagacaccagtgtacgatggg

SEQ ID NO: 768707 - DNA, 25 bp, Mus musculus
tacttagacacctgtgtacgatggg

SEQ ID NO: 768708 - DNA, 25 bp, Mus musculus
tacttagactctctcttgaacccca

SEQ ID NO: 768709 - DNA, 25 bp, Mus musculus
tacttagactctgtcttgaacccca

SEQ ID NO: 768710 - DNA, 25 bp, Mus musculus
tacttagactttagcaaattcatct

SEQ ID NO: 768711 - DNA, 25 bp, Mus musculus
tacttagacttttgcaaattcatct

SEQ ID NO: 768712 - DNA, 25 bp, Mus musculus
tacttagccccgagtgcttcagact

SEQ ID NO: 768713 - DNA, 25 bp, Mus musculus
tacttagccccgtgtgcttcagact

SEQ ID NO: 768714 - DNA, 25 bp, Mus musculus
tacttagctcttatttgggaactct

SEQ ID NO: 768715 - DNA, 25 bp, Mus musculus
tacttagctcttttttgggaactct

SEQ ID NO: 768716 - DNA, 25 bp, Mus musculus
tacttagcttcaaggcagataactt

SEQ ID NO: 768717 - DNA, 25 bp, Mus musculus
tacttagcttcatggcagataactt

SEQ ID NO: 768718 - DNA, 25 bp, Mus musculus
tacttagctttcacactataccact

SEQ ID NO: 768719 - DNA, 25 bp, Mus musculus
tacttagctttctcactataccact

SEQ ID NO: 768720 - DNA, 25 bp, Mus musculus
tacttaggacagagtaacttctgac

SEQ ID NO: 768721 - DNA, 25 bp, Mus musculus
tacttaggacagtgtaacttctgac

SEQ ID NO: 768722 - DNA, 25 bp, Mus musculus
tacttaggacatccttctgctctgt

SEQ ID NO: 768723 - DNA, 25 bp, Mus musculus
tacttaggacatgcttctgctctgt

SEQ ID NO: 768724 - DNA, 25 bp, Mus musculus
tacttaggactgaaaccatcattgg

SEQ ID NO: 768725 - DNA, 25 bp, Mus musculus
tacttaggactgtaaccatcattgg

SEQ ID NO: 768726 - DNA, 25 bp, Mus musculus
tacttaggagttaacagatgcagct

SEQ ID NO: 768727 - DNA, 25 bp, Mus musculus
tacttaggagtttacagatgcagct

SEQ ID NO: 768728 - DNA, 25 bp, Mus musculus
tacttaggatgcacccacactttaa

SEQ ID NO: 768729 - DNA, 25 bp, Mus musculus
tacttaggatgctcccacactttaa

SEQ ID NO: 768730 - DNA, 25 bp, Mus musculus
tacttaggatttagtggcccgggtg

SEQ ID NO: 768731 - DNA, 25 bp, Mus musculus
tacttaggattttgtggcccgggtg

SEQ ID NO: 768732 - DNA, 25 bp, Mus musculus
tacttaggcccacgaaataaatgct

SEQ ID NO: 768733 - DNA, 25 bp, Mus musculus
tacttaggcccaggaaataaatgct

SEQ ID NO: 768734 - DNA, 25 bp, Mus musculus
tacttaggccggagacatggaggat

SEQ ID NO: 768735 - DNA, 25 bp, Mus musculus
tacttaggccggtgacatggaggat

SEQ ID NO: 768736 - DNA, 25 bp, Mus musculus
tacttaggtagtacagccccagtgc

SEQ ID NO: 768737 - DNA, 25 bp, Mus musculus
tacttaggtagttcagccccagtgc

SEQ ID NO: 768738 - DNA, 25 bp, Mus musculus
tacttaggtcacatggctggtccca

SEQ ID NO: 768739 - DNA, 25 bp, Mus musculus
tacttaggtcacttggctggtccca

SEQ ID NO: 768740 - DNA, 25 bp, Mus musculus
tacttaggtgctaggtacttccctg

SEQ ID NO: 768741 - DNA, 25 bp, Mus musculus
tacttaggtgcttggtacttccctg

SEQ ID NO: 768742 - DNA, 25 bp, Mus musculus
tacttaggtgttactcctcggtcaa

SEQ ID NO: 768743 - DNA, 25 bp, Mus musculus
tacttaggtgtttctcctcggtcaa

SEQ ID NO: 768744 - DNA, 25 bp, Mus musculus
tacttagtaacgagaacctcactga

SEQ ID NO: 768745 - DNA, 25 bp, Mus musculus
tacttagtaacgtgaacctcactga

SEQ ID NO: 768746 - DNA, 25 bp, Mus musculus
tacttagtaactctgaatccttgaa

SEQ ID NO: 768747 - DNA, 25 bp, Mus musculus
tacttagtaactgtgaatccttgaa

SEQ ID NO: 768748 - DNA, 25 bp, Mus musculus
tacttagtcaagactttccattttg

SEQ ID NO: 768749 - DNA, 25 bp, Mus musculus
tacttagtcaagtctttccattttg

SEQ ID NO: 768750 - DNA, 25 bp, Mus musculus
tacttagtgctaactgcctcatctg

SEQ ID NO: 768751 - DNA, 25 bp, Mus musculus
tacttagtgctatctgcctcatctg

SEQ ID NO: 768752 - DNA, 25 bp, Mus musculus
tacttagtggatccttgtgcctacc

SEQ ID NO: 768753 - DNA, 25 bp, Mus musculus
tacttagtggatgcttgtgcctacc

SEQ ID NO: 768754 - DNA, 25 bp, Mus musculus
tacttagtgtggactgttgctttgt

SEQ ID NO: 768755 - DNA, 25 bp, Mus musculus
tacttagtgtggtctgttgctttgt

SEQ ID NO: 768756 - DNA, 25 bp, Mus musculus
tacttagttagcagcaggactttcc

SEQ ID NO: 768757 - DNA, 25 bp, Mus musculus
tacttagttagctgcaggactttcc

SEQ ID NO: 768758 - DNA, 25 bp, Mus musculus
tacttagttttacttccttgtggat

SEQ ID NO: 768759 - DNA, 25 bp, Mus musculus
tacttagttttagttccttgtggat

SEQ ID NO: 768760 - DNA, 25 bp, Mus musculus
tacttataccagaggagatccaact

SEQ ID NO: 768761 - DNA, 25 bp, Mus musculus
tacttataccagtggagatccaact

SEQ ID NO: 768762 - DNA, 25 bp, Mus musculus
tacttatactttcttaggatttact

SEQ ID NO: 768763 - DNA, 25 bp, Mus musculus
tacttatactttgttaggatttact

SEQ ID NO: 768764 - DNA, 25 bp, Mus musculus
tacttatagtatcccctccgaaggg

SEQ ID NO: 768765 - DNA, 25 bp, Mus musculus
tacttatagtatgccctccgaaggg

SEQ ID NO: 768766 - DNA, 25 bp, Mus musculus
tacttatatatacttggaggtcata

SEQ ID NO: 768767 - DNA, 25 bp, Mus musculus
tacttatatatagttggaggtcata

SEQ ID NO: 768768 - DNA, 25 bp, Mus musculus
tacttatattctacaccctttactc

SEQ ID NO: 768769 - DNA, 25 bp, Mus musculus
tacttatattcttcaccctttactc

SEQ ID NO: 768770 - DNA, 25 bp, Mus musculus
tacttatcacctatagacatcccct

SEQ ID NO: 768771 - DNA, 25 bp, Mus musculus
tacttatcacctttagacatcccct

SEQ ID NO: 768772 - DNA, 25 bp, Mus musculus
tacttatctagtaactcccaaagag

SEQ ID NO: 768773 - DNA, 25 bp, Mus musculus
tacttatctagttactcccaaagag

SEQ ID NO: 768774 - DNA, 25 bp, Mus musculus
tacttatgccagcttcattcaaatg

SEQ ID NO: 768775 - DNA, 25 bp, Mus musculus
tacttatgccaggttcattcaaatg

SEQ ID NO: 768776 - DNA, 25 bp, Mus musculus
tacttatgccgtaagttttatgaac

SEQ ID NO: 768777 - DNA, 25 bp, Mus musculus
tacttatgccgttagttttatgaac

SEQ ID NO: 768778 - DNA, 25 bp, Mus musculus
tacttatggcacaggtatctcatta

SEQ ID NO: 768779 - DNA, 25 bp, Mus musculus
tacttatggcactggtatctcatta

SEQ ID NO: 768780 - DNA, 25 bp, Mus musculus
tacttatgtgaacccggacttcgtg

SEQ ID NO: 768781 - DNA, 25 bp, Mus musculus
tacttatgtgaagccggacttcgtg

SEQ ID NO: 768782 - DNA, 25 bp, Mus musculus
tacttattaaataagcagtgcctgt

SEQ ID NO: 768783 - DNA, 25 bp, Mus musculus
tacttattaaattagcagtgcctgt

SEQ ID NO: 768784 - DNA, 25 bp, Mus musculus
tacttattgagtaggcctgcgggct

SEQ ID NO: 768785 - DNA, 25 bp, Mus musculus
tacttattgagttggcctgcgggct

SEQ ID NO: 768786 - DNA, 25 bp, Mus musculus
tacttattgcccagacggaatgtcg

SEQ ID NO: 768787 - DNA, 25 bp, Mus musculus
tacttattgcccatacgttttgaga

SEQ ID NO: 768788 - DNA, 25 bp, Mus musculus
tacttattgccctgacggaatgtcg

SEQ ID NO: 768789 - DNA, 25 bp, Mus musculus
tacttattgcccttacgttttgaga

SEQ ID NO: 768790 - DNA, 25 bp, Mus musculus
tacttattgtggcaaggttacctaa

SEQ ID NO: 768791 - DNA, 25 bp, Mus musculus
tacttattgtgggaaggttacctaa

SEQ ID NO: 768792 - DNA, 25 bp, Mus musculus
tacttatttagaacttacagaaaat

SEQ ID NO: 768793 - DNA, 25 bp, Mus musculus
tacttatttagacacaggacagagc

SEQ ID NO: 768794 - DNA, 25 bp, Mus musculus
tacttatttagagacaggacagagc

SEQ ID NO: 768795 - DNA, 25 bp, Mus musculus
tacttatttagatcttacagaaaat

SEQ ID NO: 768796 - DNA, 25 bp, Mus musculus
tacttatttctgaacctttgctaac

SEQ ID NO: 768797 - DNA, 25 bp, Mus musculus
tacttatttctgtacctttgctaac

SEQ ID NO: 768798 - DNA, 25 bp, Mus musculus
tacttatttggcacctacgcctttt

SEQ ID NO: 768799 - DNA, 25 bp, Mus musculus
tacttatttggctcctacgcctttt

SEQ ID NO: 768800 - DNA, 25 bp, Mus musculus
tacttattttagatcatgacttcaa

SEQ ID NO: 768801 - DNA, 25 bp, Mus musculus
tacttattttagttcatgacttcaa

SEQ ID NO: 768802 - DNA, 25 bp, Mus musculus
tacttcaaagtgctcctctaggttg

SEQ ID NO: 768803 - DNA, 25 bp, Mus musculus
tacttcaaagtggtcctctaggttg

SEQ ID NO: 768804 - DNA, 25 bp, Mus musculus
tacttcaacaaaaatgtccgcccca

SEQ ID NO: 768805 - DNA, 25 bp, Mus musculus
tacttcaacaaatatgtccgcccca

SEQ ID NO: 768806 - DNA, 25 bp, Mus musculus
tacttcaatcctagggactgtccag

SEQ ID NO: 768807 - DNA, 25 bp, Mus musculus
tacttcaatccttgggactgtccag

SEQ ID NO: 768808 - DNA, 25 bp, Mus musculus
tacttcacacagatcaaggctgagt

SEQ ID NO: 768809 - DNA, 25 bp, Mus musculus
tacttcacacagttcaaggctgagt

SEQ ID NO: 768810 - DNA, 25 bp, Mus musculus
tacttcacagccaaatcatctctaa

SEQ ID NO: 768811 - DNA, 25 bp, Mus musculus
tacttcacagcctaatcatctctaa

SEQ ID NO: 768812 - DNA, 25 bp, Mus musculus
tacttcaccaccaatcacaggcatt

SEQ ID NO: 768813 - DNA, 25 bp, Mus musculus
tacttcaccacctatcacaggcatt

SEQ ID NO: 768814 - DNA, 25 bp, Mus musculus
tacttcacctccagcagacattgag

SEQ ID NO: 768815 - DNA, 25 bp, Mus musculus
tacttcacctcctgcagacattgag

SEQ ID NO: 768816 - DNA, 25 bp, Mus musculus
tacttcacggagacagcaggcacct

SEQ ID NO: 768817 - DNA, 25 bp, Mus musculus
tacttcacggagtcagcaggcacct

SEQ ID NO: 768818 - DNA, 25 bp, Mus musculus
tacttcacgtggaaggagcagattc

SEQ ID NO: 768819 - DNA, 25 bp, Mus musculus
tacttcacgtggtaggagcagattc

SEQ ID NO: 768820 - DNA, 25 bp, Mus musculus
tacttcacttgaaaggacattggag

SEQ ID NO: 768821 - DNA, 25 bp, Mus musculus
tacttcacttgataggacattggag

SEQ ID NO: 768822 - DNA, 25 bp, Mus musculus
tacttcagagatcacaatgcctctt

SEQ ID NO: 768823 - DNA, 25 bp, Mus musculus
tacttcagagatgacaatgcctctt

SEQ ID NO: 768824 - DNA, 25 bp, Mus musculus
tacttcagaggactaccccacgaag

SEQ ID NO: 768825 - DNA, 25 bp, Mus musculus
tacttcagaggagtaccccacgaag

SEQ ID NO: 768826 - DNA, 25 bp, Mus musculus
tacttcagcagaatgcctggaccca

SEQ ID NO: 768827 - DNA, 25 bp, Mus musculus
tacttcagcagattgcctggaccca

SEQ ID NO: 768828 - DNA, 25 bp, Mus musculus
tacttcagcagcacagaaggcactg

SEQ ID NO: 768829 - DNA, 25 bp, Mus musculus
tacttcagcagctcagaaggcactg

SEQ ID NO: 768830 - DNA, 25 bp, Mus musculus
tacttcagcattccgtgttctgact

SEQ ID NO: 768831 - DNA, 25 bp, Mus musculus
tacttcagcattgcgtgttctgact

SEQ ID NO: 768832 - DNA, 25 bp, Mus musculus
tacttcagcctaagctactcgggag

SEQ ID NO: 768833 - DNA, 25 bp, Mus musculus
tacttcagcctatgctactcgggag

SEQ ID NO: 768834 - DNA, 25 bp, Mus musculus
tacttcagcctcatgaactgcaacc

SEQ ID NO: 768835 - DNA, 25 bp, Mus musculus
tacttcagcctcttgaactgcaacc

SEQ ID NO: 768836 - DNA, 25 bp, Mus musculus
tacttcaggcctcgacaaccatgga

SEQ ID NO: 768837 - DNA, 25 bp, Mus musculus
tacttcaggcctggacaaccatgga

SEQ ID NO: 768838 - DNA, 25 bp, Mus musculus
tacttcagttacaagcagtgaccta

SEQ ID NO: 768839 - DNA, 25 bp, Mus musculus
tacttcagttactagcagtgaccta

SEQ ID NO: 768840 - DNA, 25 bp, Mus musculus
tacttcagttctatctggccagtgt

SEQ ID NO: 768841 - DNA, 25 bp, Mus musculus
tacttcagttctttctggccagtgt

SEQ ID NO: 768842 - DNA, 25 bp, Mus musculus
tacttcagttttaatgttcccactc

SEQ ID NO: 768843 - DNA, 25 bp, Mus musculus
tacttcagtttttatgttcccactc

SEQ ID NO: 768844 - DNA, 25 bp, Mus musculus
tacttcataacacctacctgatcgt

SEQ ID NO: 768845 - DNA, 25 bp, Mus musculus
tacttcataacagctacctgatcgt

SEQ ID NO: 768846 - DNA, 25 bp, Mus musculus
tacttcataggcacactgcactggg

SEQ ID NO: 768847 - DNA, 25 bp, Mus musculus
tacttcataggctcactgcactggg

SEQ ID NO: 768848 - DNA, 25 bp, Mus musculus
tacttcatagtacctctccaggacg

SEQ ID NO: 768849 - DNA, 25 bp, Mus musculus
tacttcatagtagctctccaggacg

SEQ ID NO: 768850 - DNA, 25 bp, Mus musculus
tacttcatcatacccgatccaggga

SEQ ID NO: 768851 - DNA, 25 bp, Mus musculus
tacttcatcatagccgatccaggga

SEQ ID NO: 768852 - DNA, 25 bp, Mus musculus
tacttcatcatgatgagtttcccaa

SEQ ID NO: 768853 - DNA, 25 bp, Mus musculus
tacttcatcatgttgagtttcccaa

SEQ ID NO: 768854 - DNA, 25 bp, Mus musculus
tacttcatgagaatcacctgcccag

SEQ ID NO: 768855 - DNA, 25 bp, Mus musculus
tacttcatgagattcacctgcccag

SEQ ID NO: 768856 - DNA, 25 bp, Mus musculus
tacttcatgatgacagagtgtcttg

SEQ ID NO: 768857 - DNA, 25 bp, Mus musculus
tacttcatgatgtcagagtgtcttg

SEQ ID NO: 768858 - DNA, 25 bp, Mus musculus
tacttcatgcagatgatgtctccgc

SEQ ID NO: 768859 - DNA, 25 bp, Mus musculus
tacttcatgcagcttcagacgcgtt

SEQ ID NO: 768860 - DNA, 25 bp, Mus musculus
tacttcatgcaggttcagacgcgtt

SEQ ID NO: 768861 - DNA, 25 bp, Mus musculus
tacttcatgcagttgatgtctccgc

SEQ ID NO: 768862 - DNA, 25 bp, Mus musculus
tacttcatgcttcccacggtgataa

SEQ ID NO: 768863 - DNA, 25 bp, Mus musculus
tacttcatgcttgccacggtgataa

SEQ ID NO: 768864 - DNA, 25 bp, Mus musculus
tacttcatgggtaccttaccctgag

SEQ ID NO: 768865 - DNA, 25 bp, Mus musculus
tacttcatgggttccttaccctgag

SEQ ID NO: 768866 - DNA, 25 bp, Mus musculus
tacttcatggtactcacggcagcca

SEQ ID NO: 768867 - DNA, 25 bp, Mus musculus
tacttcatggtagtcacggcagcca

SEQ ID NO: 768868 - DNA, 25 bp, Mus musculus
tacttcattatcagaatctgctttg

SEQ ID NO: 768869 - DNA, 25 bp, Mus musculus
tacttcattatctgaatctgctttg

SEQ ID NO: 768870 - DNA, 25 bp, Mus musculus
tacttcatttaacaggacgcctgtc

SEQ ID NO: 768871 - DNA, 25 bp, Mus musculus
tacttcatttaagaggacgcctgtc

SEQ ID NO: 768872 - DNA, 25 bp, Mus musculus
tacttccaaacaaggttcattgtag

SEQ ID NO: 768873 - DNA, 25 bp, Mus musculus
tacttccaaacatggttcattgtag

SEQ ID NO: 768874 - DNA, 25 bp, Mus musculus
tacttccaatagatccttagcctaa

SEQ ID NO: 768875 - DNA, 25 bp, Mus musculus
tacttccaatagttccttagcctaa

SEQ ID NO: 768876 - DNA, 25 bp, Mus musculus
tacttccaatctctaaacttctctg

SEQ ID NO: 768877 - DNA, 25 bp, Mus musculus
tacttccaatctgtaaacttctctg

SEQ ID NO: 768878 - DNA, 25 bp, Mus musculus
tacttccagctgctaactgtctaat

SEQ ID NO: 768879 - DNA, 25 bp, Mus musculus
tacttccagctggtaactgtctaat

SEQ ID NO: 768880 - DNA, 25 bp, Mus musculus
tacttccaggctcaacccagtgctg

SEQ ID NO: 768881 - DNA, 25 bp, Mus musculus
tacttccaggctgaacccagtgctg

SEQ ID NO: 768882 - DNA, 25 bp, Mus musculus
tacttccatcagaattgagccggga

SEQ ID NO: 768883 - DNA, 25 bp, Mus musculus
tacttccatcagtattgagccggga

SEQ ID NO: 768884 - DNA, 25 bp, Mus musculus
tacttccatccaccaaaggaattca

SEQ ID NO: 768885 - DNA, 25 bp, Mus musculus
tacttccatccagcaaaggaattca

SEQ ID NO: 768886 - DNA, 25 bp, Mus musculus
tacttcccactaagcatccattttg

SEQ ID NO: 768887 - DNA, 25 bp, Mus musculus
tacttcccactatgcatccattttg

SEQ ID NO: 768888 - DNA, 25 bp, Mus musculus
tacttcccactccataaagacgcat

SEQ ID NO: 768889 - DNA, 25 bp, Mus musculus
tacttcccactcgataaagacgcat

SEQ ID NO: 768890 - DNA, 25 bp, Mus musculus
tacttcccagctcgtgacacagggt

SEQ ID NO: 768891 - DNA, 25 bp, Mus musculus
tacttcccagctggtgacacagggt

SEQ ID NO: 768892 - DNA, 25 bp, Mus musculus
tacttcccatttcgctgtggatgga

SEQ ID NO: 768893 - DNA, 25 bp, Mus musculus
tacttcccatttggctgtggatgga

SEQ ID NO: 768894 - DNA, 25 bp, Mus musculus
tacttccccgacatgctgcagataa

SEQ ID NO: 768895 - DNA, 25 bp, Mus musculus
tacttccccgacttgctgcagataa

SEQ ID NO: 768896 - DNA, 25 bp, Mus musculus
tacttccccttacacaatctgatgt

SEQ ID NO: 768897 - DNA, 25 bp, Mus musculus
tacttccccttagacaatctgatgt

SEQ ID NO: 768898 - DNA, 25 bp, Mus musculus
tacttcccgtggcactaattactgt

SEQ ID NO: 768899 - DNA, 25 bp, Mus musculus
tacttcccgtgggactaattactgt

SEQ ID NO: 768900 - DNA, 25 bp, Mus musculus
tacttccctaagatttccaccttga

SEQ ID NO: 768901 - DNA, 25 bp, Mus musculus
tacttccctaagttttccaccttga

SEQ ID NO: 768902 - DNA, 25 bp, Mus musculus
tacttccctcacattgatgtaagcc

SEQ ID NO: 768903 - DNA, 25 bp, Mus musculus
tacttccctcactttgatgtaagcc

SEQ ID NO: 768904 - DNA, 25 bp, Mus musculus
tacttccctccaatgctattttgat

SEQ ID NO: 768905 - DNA, 25 bp, Mus musculus
tacttccctccattgctattttgat

SEQ ID NO: 768906 - DNA, 25 bp, Mus musculus
tacttccctcttcctttatgaccaa

SEQ ID NO: 768907 - DNA, 25 bp, Mus musculus
tacttccctcttgctttatgaccaa

SEQ ID NO: 768908 - DNA, 25 bp, Mus musculus
tacttccctgctaaccaggagatcc

SEQ ID NO: 768909 - DNA, 25 bp, Mus musculus
tacttccctgctctttatttgctaa

SEQ ID NO: 768910 - DNA, 25 bp, Mus musculus
tacttccctgctgtttatttgctaa

SEQ ID NO: 768911 - DNA, 25 bp, Mus musculus
tacttccctgcttaccaggagatcc

SEQ ID NO: 768912 - DNA, 25 bp, Mus musculus
tacttccctgggatcctaaggacca

SEQ ID NO: 768913 - DNA, 25 bp, Mus musculus
tacttccctgggttcctaaggacca

SEQ ID NO: 768914 - DNA, 25 bp, Mus musculus
tacttccctgtcctacatagacggg

SEQ ID NO: 768915 - DNA, 25 bp, Mus musculus
tacttccctgtcgtacatagacggg

SEQ ID NO: 768916 - DNA, 25 bp, Mus musculus
tacttccctgttacctatttcatat

SEQ ID NO: 768917 - DNA, 25 bp, Mus musculus
tacttccctgtttcctatttcatat

SEQ ID NO: 768918 - DNA, 25 bp, Mus musculus
tacttccgcaagcacggtcgcaagc

SEQ ID NO: 768919 - DNA, 25 bp, Mus musculus
tacttccgcaaggacggtcgcaagc

SEQ ID NO: 768920 - DNA, 25 bp, Mus musculus
tacttccgctgtatctgagtgggac

SEQ ID NO: 768921 - DNA, 25 bp, Mus musculus
tacttccgctgtttctgagtgggac

SEQ ID NO: 768922 - DNA, 25 bp, Mus musculus
tacttccgggttaaggcctcagcga

SEQ ID NO: 768923 - DNA, 25 bp, Mus musculus
tacttccgggtttaggcctcagcga

SEQ ID NO: 768924 - DNA, 25 bp, Mus musculus
tacttccggtttcactcctagtgga

SEQ ID NO: 768925 - DNA, 25 bp, Mus musculus
tacttccggtttgactcctagtgga

SEQ ID NO: 768926 - DNA, 25 bp, Mus musculus
tacttccgtgctacttctagactaa

SEQ ID NO: 768927 - DNA, 25 bp, Mus musculus
tacttccgtgcttcttctagactaa

SEQ ID NO: 768928 - DNA, 25 bp, Mus musculus
tacttccgttacaatggctcactaa

SEQ ID NO: 768929 - DNA, 25 bp, Mus musculus
tacttccgttactatggctcactaa

SEQ ID NO: 768930 - DNA, 25 bp, Mus musculus
tacttcctacagccaagacctttgc

SEQ ID NO: 768931 - DNA, 25 bp, Mus musculus
tacttcctacaggcaagacctttgc

SEQ ID NO: 768932 - DNA, 25 bp, Mus musculus
tacttcctcctactgcactgtttat

SEQ ID NO: 768933 - DNA, 25 bp, Mus musculus
tacttcctcctagtgcactgtttat

SEQ ID NO: 768934 - DNA, 25 bp, Mus musculus
tacttcctcgagcagtagctacaca

SEQ ID NO: 768935 - DNA, 25 bp, Mus musculus
tacttcctcgaggagtagctacaca

SEQ ID NO: 768936 - DNA, 25 bp, Mus musculus
tacttcctctaaaggaacctggcct

SEQ ID NO: 768937 - DNA, 25 bp, Mus musculus
tacttcctctaatggaacctggcct

SEQ ID NO: 768938 - DNA, 25 bp, Mus musculus
tacttcctgaccctgccgtatgagg

SEQ ID NO: 768939 - DNA, 25 bp, Mus musculus
tacttcctgaccgtgccgtatgagg

SEQ ID NO: 768940 - DNA, 25 bp, Mus musculus
tacttcctgagacgtggagagtacc

SEQ ID NO: 768941 - DNA, 25 bp, Mus musculus
tacttcctgagaggtggagagtacc

SEQ ID NO: 768942 - DNA, 25 bp, Mus musculus
tacttcctgagcagccctgctgtgc

SEQ ID NO: 768943 - DNA, 25 bp, Mus musculus
tacttcctgagctgccctgctgtgc

SEQ ID NO: 768944 - DNA, 25 bp, Mus musculus
tacttcctgattatgtgcactgaac

SEQ ID NO: 768945 - DNA, 25 bp, Mus musculus
tacttcctgattttgtgcactgaac

SEQ ID NO: 768946 - DNA, 25 bp, Mus musculus
tacttcctgcctcctatgatgaatt

SEQ ID NO: 768947 - DNA, 25 bp, Mus musculus
tacttcctgcctctaatgagctcag

SEQ ID NO: 768948 - DNA, 25 bp, Mus musculus
tacttcctgcctgctatgatgaatt

SEQ ID NO: 768949 - DNA, 25 bp, Mus musculus
tacttcctgcctgtaatgagctcag

SEQ ID NO: 768950 - DNA, 25 bp, Mus musculus
tacttcctgcggcagtgccccagaa

SEQ ID NO: 768951 - DNA, 25 bp, Mus musculus
tacttcctgcgggagtgccccagaa

SEQ ID NO: 768952 - DNA, 25 bp, Mus musculus
tacttcctgcttcactttgggtttc

SEQ ID NO: 768953 - DNA, 25 bp, Mus musculus
tacttcctgcttctttaaaataata

SEQ ID NO: 768954 - DNA, 25 bp, Mus musculus
tacttcctgcttgactttgggtttc

SEQ ID NO: 768955 - DNA, 25 bp, Mus musculus
tacttcctgcttgtttaaaataata

SEQ ID NO: 768956 - DNA, 25 bp, Mus musculus
tacttcctgggaagaccctgaggtc

SEQ ID NO: 768957 - DNA, 25 bp, Mus musculus
tacttcctgggatgaccctgaggtc

SEQ ID NO: 768958 - DNA, 25 bp, Mus musculus
tacttcctgggcaaactcaattaga

SEQ ID NO: 768959 - DNA, 25 bp, Mus musculus
tacttcctgggctaactcaattaga

SEQ ID NO: 768960 - DNA, 25 bp, Mus musculus
tacttcctgtacataagcctaagat

SEQ ID NO: 768961 - DNA, 25 bp, Mus musculus
tacttcctgtacttaagcctaagat

SEQ ID NO: 768962 - DNA, 25 bp, Mus musculus
tacttcctgtccataggaaatccag

SEQ ID NO: 768963 - DNA, 25 bp, Mus musculus
tacttcctgtccttaggaaatccag

SEQ ID NO: 768964 - DNA, 25 bp, Mus musculus
tacttcctttctaggtgatgagaat

SEQ ID NO: 768965 - DNA, 25 bp, Mus musculus
tacttcctttcttggtgatgagaat

SEQ ID NO: 768966 - DNA, 25 bp, Mus musculus
tacttcgagcgcagcctgaaatagg

SEQ ID NO: 768967 - DNA, 25 bp, Mus musculus
tacttcgagcgctgcctgaaatagg

SEQ ID NO: 768968 - DNA, 25 bp, Mus musculus
tacttcgagggcactgttctttacc

SEQ ID NO: 768969 - DNA, 25 bp, Mus musculus
tacttcgagggcatctttgatctca

SEQ ID NO: 768970 - DNA, 25 bp, Mus musculus
tacttcgagggctctgttctttacc

SEQ ID NO: 768971 - DNA, 25 bp, Mus musculus
tacttcgagggcttctttgatctca

SEQ ID NO: 768972 - DNA, 25 bp, Mus musculus
tacttcgatgaaccaaagttggctc

SEQ ID NO: 768973 - DNA, 25 bp, Mus musculus
tacttcgatgaagcaaagttggctc

SEQ ID NO: 768974 - DNA, 25 bp, Mus musculus
tacttcgccatgatctgcccttgca

SEQ ID NO: 768975 - DNA, 25 bp, Mus musculus
tacttcgccatgttctgcccttgca

SEQ ID NO: 768976 - DNA, 25 bp, Mus musculus
tacttcgccattcccgagaacgaga

SEQ ID NO: 768977 - DNA, 25 bp, Mus musculus
tacttcgccattgccgagaacgaga

SEQ ID NO: 768978 - DNA, 25 bp, Mus musculus
tacttcggtgatcacactgctgttt

SEQ ID NO: 768979 - DNA, 25 bp, Mus musculus
tacttcggtgatgacactgctgttt

SEQ ID NO: 768980 - DNA, 25 bp, Mus musculus
tacttcgtagctctgtctgttgtta

SEQ ID NO: 768981 - DNA, 25 bp, Mus musculus
tacttcgtagctgtgtctgttgtta

SEQ ID NO: 768982 - DNA, 25 bp, Mus musculus
tacttcgtatagcatttctctcttg

SEQ ID NO: 768983 - DNA, 25 bp, Mus musculus
tacttcgtataggatttctctcttg

SEQ ID NO: 768984 - DNA, 25 bp, Mus musculus
tacttcgtcatcaagtcacgtccaa

SEQ ID NO: 768985 - DNA, 25 bp, Mus musculus
tacttcgtcatctagtcacgtccaa

SEQ ID NO: 768986 - DNA, 25 bp, Mus musculus
tacttcgtctctattaatgcctgtg

SEQ ID NO: 768987 - DNA, 25 bp, Mus musculus
tacttcgtctcttttaatgcctgtg

SEQ ID NO: 768988 - DNA, 25 bp, Mus musculus
tacttcgtgccactgtatgaggaat

SEQ ID NO: 768989 - DNA, 25 bp, Mus musculus
tacttcgtgccagtgtatgaggaat

SEQ ID NO: 768990 - DNA, 25 bp, Mus musculus
tacttcgtggtcagagtgagcccct

SEQ ID NO: 768991 - DNA, 25 bp, Mus musculus
tacttcgtggtctgagtgagcccct

SEQ ID NO: 768992 - DNA, 25 bp, Mus musculus
tacttctaagatcggatctccctgg

SEQ ID NO: 768993 - DNA, 25 bp, Mus musculus
tacttctaagatgggatctccctgg

SEQ ID NO: 768994 - DNA, 25 bp, Mus musculus
tacttctaccagaatcgagctcgca

SEQ ID NO: 768995 - DNA, 25 bp, Mus musculus
tacttctaccagtatcgagctcgca

SEQ ID NO: 768996 - DNA, 25 bp, Mus musculus
tacttctactacagtcttactcttc

SEQ ID NO: 768997 - DNA, 25 bp, Mus musculus
tacttctactactgtcttactcttc

SEQ ID NO: 768998 - DNA, 25 bp, Mus musculus
tacttctagccgagataacacccga

SEQ ID NO: 768999 - DNA, 25 bp, Mus musculus
tacttctagccgtgataacacccga

SEQ ID NO: 769000 - DNA, 25 bp, Mus musculus
tacttctagtatacacctcagggct

SEQ ID NO: 769001 - DNA, 25 bp, Mus musculus
tacttctagtattcacctcagggct

SEQ ID NO: 769002 - DNA, 25 bp, Mus musculus
tacttctatgaacaggcctttcggg

SEQ ID NO: 769003 - DNA, 25 bp, Mus musculus
tacttctatgaagaggcctttcggg

SEQ ID NO: 769004 - DNA, 25 bp, Mus musculus
tacttctcagagaccttaaaaacaa

SEQ ID NO: 769005 - DNA, 25 bp, Mus musculus
tacttctcagagtccttaaaaacaa

SEQ ID NO: 769006 - DNA, 25 bp, Mus musculus
tacttctcaggacggcacaagtgcc

SEQ ID NO: 769007 - DNA, 25 bp, Mus musculus
tacttctcaggagggcacaagtgcc

SEQ ID NO: 769008 - DNA, 25 bp, Mus musculus
tacttctccagcacttattagggtt

SEQ ID NO: 769009 - DNA, 25 bp, Mus musculus
tacttctccagctcttattagggtt

SEQ ID NO: 769010 - DNA, 25 bp, Mus musculus
tacttctccatcatcggaatgctgc

SEQ ID NO: 769011 - DNA, 25 bp, Mus musculus
tacttctccatcttcggaatgctgc

SEQ ID NO: 769012 - DNA, 25 bp, Mus musculus
tacttctccctacaggtgatctctg

SEQ ID NO: 769013 - DNA, 25 bp, Mus musculus
tacttctccctagaggtgatctctg

SEQ ID NO: 769014 - DNA, 25 bp, Mus musculus
tacttctctaacaatgacaattgct

SEQ ID NO: 769015 - DNA, 25 bp, Mus musculus
tacttctctaactatgacaattgct

SEQ ID NO: 769016 - DNA, 25 bp, Mus musculus
tacttctctaagatcctggctctcg

SEQ ID NO: 769017 - DNA, 25 bp, Mus musculus
tacttctctaagttcctggctctcg

SEQ ID NO: 769018 - DNA, 25 bp, Mus musculus
tacttctctgacaatattctctgcc

SEQ ID NO: 769019 - DNA, 25 bp, Mus musculus
tacttctctgactatattctctgcc

SEQ ID NO: 769020 - DNA, 25 bp, Mus musculus
tacttctgaaataccagctattgac

SEQ ID NO: 769021 - DNA, 25 bp, Mus musculus
tacttctgaaattccagctattgac

SEQ ID NO: 769022 - DNA, 25 bp, Mus musculus
tacttctgcatcagcgtggatgtca

SEQ ID NO: 769023 - DNA, 25 bp, Mus musculus
tacttctgcatctgcgtggatgtca

SEQ ID NO: 769024 - DNA, 25 bp, Mus musculus
tacttctgctaccacagggttctca

SEQ ID NO: 769025 - DNA, 25 bp, Mus musculus
tacttctgctacgacagggttctca

SEQ ID NO: 769026 - DNA, 25 bp, Mus musculus
tacttctggaccctgctagttcatg

SEQ ID NO: 769027 - DNA, 25 bp, Mus musculus
tacttctggaccgtgctagttcatg

SEQ ID NO: 769028 - DNA, 25 bp, Mus musculus
tacttctgtaatctcacactcttcc

SEQ ID NO: 769029 - DNA, 25 bp, Mus musculus
tacttctgtaatgtcacactcttcc

SEQ ID NO: 769030 - DNA, 25 bp, Mus musculus
tacttctgtgtgctggctctagtca

SEQ ID NO: 769031 - DNA, 25 bp, Mus musculus
tacttctgtgtggtggctctagtca

SEQ ID NO: 769032 - DNA, 25 bp, Mus musculus
tacttcttaggaacctagggcagga

SEQ ID NO: 769033 - DNA, 25 bp, Mus musculus
tacttcttaggatcctagggcagga

SEQ ID NO: 769034 - DNA, 25 bp, Mus musculus
tacttcttagggaaacacaacaact

SEQ ID NO: 769035 - DNA, 25 bp, Mus musculus
tacttcttagggtaacacaacaact

SEQ ID NO: 769036 - DNA, 25 bp, Mus musculus
tacttcttcagtcgatcttcgcagt

SEQ ID NO: 769037 - DNA, 25 bp, Mus musculus
tacttcttcagtggatcttcgcagt

SEQ ID NO: 769038 - DNA, 25 bp, Mus musculus
tacttcttccccagtattggactta

SEQ ID NO: 769039 - DNA, 25 bp, Mus musculus
tacttcttcccctgtattggactta

SEQ ID NO: 769040 - DNA, 25 bp, Mus musculus
tacttcttctccaaactgcagatca

SEQ ID NO: 769041 - DNA, 25 bp, Mus musculus
tacttcttctcctaactgcagatca

SEQ ID NO: 769042 - DNA, 25 bp, Mus musculus
tacttcttgtatactgctatcccat

SEQ ID NO: 769043 - DNA, 25 bp, Mus musculus
tacttcttgtattctgctatcccat

SEQ ID NO: 769044 - DNA, 25 bp, Mus musculus
tacttctttcccagacaggaaataa

SEQ ID NO: 769045 - DNA, 25 bp, Mus musculus
tacttctttccctgacaggaaataa

SEQ ID NO: 769046 - DNA, 25 bp, Mus musculus
tacttctttcctacttgctggtttg

SEQ ID NO: 769047 - DNA, 25 bp, Mus musculus
tacttctttccttcttgctggtttg

SEQ ID NO: 769048 - DNA, 25 bp, Mus musculus
tacttctttggccttttagtccaca

SEQ ID NO: 769049 - DNA, 25 bp, Mus musculus
tacttctttggcgttttagtccaca

SEQ ID NO: 769050 - DNA, 25 bp, Mus musculus
tacttctttgggattcatgttacag

SEQ ID NO: 769051 - DNA, 25 bp, Mus musculus
tacttctttgggtttcatgttacag

SEQ ID NO: 769052 - DNA, 25 bp, Mus musculus
tacttcttttgtagcaccctgagac

SEQ ID NO: 769053 - DNA, 25 bp, Mus musculus
tacttcttttgttgcaccctgagac

SEQ ID NO: 769054 - DNA, 25 bp, Mus musculus
tacttgaaattcactgagccctgag

SEQ ID NO: 769055 - DNA, 25 bp, Mus musculus
tacttgaaattctctgagccctgag

SEQ ID NO: 769056 - DNA, 25 bp, Mus musculus
tacttgaagaatcgttcaggcctgt

SEQ ID NO: 769057 - DNA, 25 bp, Mus musculus
tacttgaagaatggttcaggcctgt

SEQ ID NO: 769058 - DNA, 25 bp, Mus musculus
tacttgaagccgcaggtgacccaga

SEQ ID NO: 769059 - DNA, 25 bp, Mus musculus
tacttgaagccggaggtgacccaga

SEQ ID NO: 769060 - DNA, 25 bp, Mus musculus
tacttgacctgaaccaaaccccgag

SEQ ID NO: 769061 - DNA, 25 bp, Mus musculus
tacttgacctgatccaaaccccgag

SEQ ID NO: 769062 - DNA, 25 bp, Mus musculus
tacttgaccttgactcctagaattc

SEQ ID NO: 769063 - DNA, 25 bp, Mus musculus
tacttgaccttgtctcctagaattc

SEQ ID NO: 769064 - DNA, 25 bp, Mus musculus
tacttgactctcacagatatgctga

SEQ ID NO: 769065 - DNA, 25 bp, Mus musculus
tacttgactctctcagatatgctga

SEQ ID NO: 769066 - DNA, 25 bp, Mus musculus
tacttgactggaccatctgcccaat

SEQ ID NO: 769067 - DNA, 25 bp, Mus musculus
tacttgactggagcatctgcccaat

SEQ ID NO: 769068 - DNA, 25 bp, Mus musculus
tacttgactgttcgagccggagctc

SEQ ID NO: 769069 - DNA, 25 bp, Mus musculus
tacttgactgttggagccggagctc

SEQ ID NO: 769070 - DNA, 25 bp, Mus musculus
tacttgagacacaatttgccaacct

SEQ ID NO: 769071 - DNA, 25 bp, Mus musculus
tacttgagacactatttgccaacct

SEQ ID NO: 769072 - DNA, 25 bp, Mus musculus
tacttgagactcatatgcttgacaa

SEQ ID NO: 769073 - DNA, 25 bp, Mus musculus
tacttgagactcttatgcttgacaa

SEQ ID NO: 769074 - DNA, 25 bp, Mus musculus
tacttgagagtccaacaggtccggt

SEQ ID NO: 769075 - DNA, 25 bp, Mus musculus
tacttgagagtcgaacaggtccggt

SEQ ID NO: 769076 - DNA, 25 bp, Mus musculus
tacttgagcaagctggagaaatcac

SEQ ID NO: 769077 - DNA, 25 bp, Mus musculus
tacttgagcaaggtggagaaatcac

SEQ ID NO: 769078 - DNA, 25 bp, Mus musculus
tacttgagctgcctgcgcgcggatt

SEQ ID NO: 769079 - DNA, 25 bp, Mus musculus
tacttgagctgcgtgcgcgcggatt

SEQ ID NO: 769080 - DNA, 25 bp, Mus musculus
tacttgaggacaatccctggtggca

SEQ ID NO: 769081 - DNA, 25 bp, Mus musculus
tacttgaggacattccctggtggca

SEQ ID NO: 769082 - DNA, 25 bp, Mus musculus
tacttgaggattccgcagattccag

SEQ ID NO: 769083 - DNA, 25 bp, Mus musculus
tacttgaggattgcgcagattccag

SEQ ID NO: 769084 - DNA, 25 bp, Mus musculus
tacttgaggctgatcggtttcctga

SEQ ID NO: 769085 - DNA, 25 bp, Mus musculus
tacttgaggctgttcggtttcctga

SEQ ID NO: 769086 - DNA, 25 bp, Mus musculus
tacttgataactactggtggctcct

SEQ ID NO: 769087 - DNA, 25 bp, Mus musculus
tacttgataacttctggtggctcct

SEQ ID NO: 769088 - DNA, 25 bp, Mus musculus
tacttgatacacaactatagggcta

SEQ ID NO: 769089 - DNA, 25 bp, Mus musculus
tacttgatacactactatagggcta

SEQ ID NO: 769090 - DNA, 25 bp, Mus musculus
tacttgatctatacctggcttgtag

SEQ ID NO: 769091 - DNA, 25 bp, Mus musculus
tacttgatctattcctggcttgtag

SEQ ID NO: 769092 - DNA, 25 bp, Mus musculus
tacttgatgaagcatttctggcatg

SEQ ID NO: 769093 - DNA, 25 bp, Mus musculus
tacttgatgaaggatttctggcatg

SEQ ID NO: 769094 - DNA, 25 bp, Mus musculus
tacttgatgtgtcggcttccagtgg

SEQ ID NO: 769095 - DNA, 25 bp, Mus musculus
tacttgatgtgtgggcttccagtgg

SEQ ID NO: 769096 - DNA, 25 bp, Mus musculus
tacttgattgaaacagttgcctgga

SEQ ID NO: 769097 - DNA, 25 bp, Mus musculus
tacttgattgaatcagttgcctgga

SEQ ID NO: 769098 - DNA, 25 bp, Mus musculus
tacttgcagaatccagaccctagtg

SEQ ID NO: 769099 - DNA, 25 bp, Mus musculus
tacttgcagaatgcagaccctagtg

SEQ ID NO: 769100 - DNA, 25 bp, Mus musculus
tacttgcagatgatggcggtcagct

SEQ ID NO: 769101 - DNA, 25 bp, Mus musculus
tacttgcagatgttggcggtcagct

SEQ ID NO: 769102 - DNA, 25 bp, Mus musculus
tacttgccagtcacctgtgtaaatt

SEQ ID NO: 769103 - DNA, 25 bp, Mus musculus
tacttgccagtctcctgtgtaaatt

SEQ ID NO: 769104 - DNA, 25 bp, Mus musculus
tacttgccatagcaaaatgctgtga

SEQ ID NO: 769105 - DNA, 25 bp, Mus musculus
tacttgccataggaaaatgctgtga

SEQ ID NO: 769106 - DNA, 25 bp, Mus musculus
tacttgcccaatcatcttactggac

SEQ ID NO: 769107 - DNA, 25 bp, Mus musculus
tacttgcccaatgatcttactggac

SEQ ID NO: 769108 - DNA, 25 bp, Mus musculus
tacttgccctccatgctgggaccag

SEQ ID NO: 769109 - DNA, 25 bp, Mus musculus
tacttgccctccttgctgggaccag

SEQ ID NO: 769110 - DNA, 25 bp, Mus musculus
tacttgccttgtacttcgttgaatg

SEQ ID NO: 769111 - DNA, 25 bp, Mus musculus
tacttgccttgttcttcgttgaatg

SEQ ID NO: 769112 - DNA, 25 bp, Mus musculus
tacttgcctttgctagagctctctg

SEQ ID NO: 769113 - DNA, 25 bp, Mus musculus
tacttgcctttggtagagctctctg

SEQ ID NO: 769114 - DNA, 25 bp, Mus musculus
tacttgcgaagacctggcgcgccag

SEQ ID NO: 769115 - DNA, 25 bp, Mus musculus
tacttgcgaagagctggcgcgccag

SEQ ID NO: 769116 - DNA, 25 bp, Mus musculus
tacttgcgacctatcatgagtcaca

SEQ ID NO: 769117 - DNA, 25 bp, Mus musculus
tacttgcgacctttcatgagtcaca

SEQ ID NO: 769118 - DNA, 25 bp, Mus musculus
tacttgcgcataaaggaacctcact

SEQ ID NO: 769119 - DNA, 25 bp, Mus musculus
tacttgcgcatataggaacctcact

SEQ ID NO: 769120 - DNA, 25 bp, Mus musculus
tacttgcgctaaccatttgcttctc

SEQ ID NO: 769121 - DNA, 25 bp, Mus musculus
tacttgcgctaagcatttgcttctc

SEQ ID NO: 769122 - DNA, 25 bp, Mus musculus
tacttgctaagtctgtggctctacc

SEQ ID NO: 769123 - DNA, 25 bp, Mus musculus
tacttgctaagtgtgtggctctacc

SEQ ID NO: 769124 - DNA, 25 bp, Mus musculus
tacttgctacttattcagtgctaac

SEQ ID NO: 769125 - DNA, 25 bp, Mus musculus
tacttgctactttttcagtgctaac

SEQ ID NO: 769126 - DNA, 25 bp, Mus musculus
tacttgctagatctgcgaaatacta

SEQ ID NO: 769127 - DNA, 25 bp, Mus musculus
tacttgctagatgtgcgaaatacta

SEQ ID NO: 769128 - DNA, 25 bp, Mus musculus
tacttgctatgcaaaggctctacca

SEQ ID NO: 769129 - DNA, 25 bp, Mus musculus
tacttgctatgctaaggctctacca

SEQ ID NO: 769130 - DNA, 25 bp, Mus musculus
tacttgctatggctggctgcggtca

SEQ ID NO: 769131 - DNA, 25 bp, Mus musculus
tacttgctatgggtggctgcggtca

SEQ ID NO: 769132 - DNA, 25 bp, Mus musculus
tacttgctgaaaatggtcgcctagg

SEQ ID NO: 769133 - DNA, 25 bp, Mus musculus
tacttgctgaaattggtcgcctagg

SEQ ID NO: 769134 - DNA, 25 bp, Mus musculus
tacttgctgacaatggatgacacat

SEQ ID NO: 769135 - DNA, 25 bp, Mus musculus
tacttgctgacattggatgacacat

SEQ ID NO: 769136 - DNA, 25 bp, Mus musculus
tacttgctgttaaacatccaggtat

SEQ ID NO: 769137 - DNA, 25 bp, Mus musculus
tacttgctgttaacccctttgaggg

SEQ ID NO: 769138 - DNA, 25 bp, Mus musculus
tacttgctgttatacatccaggtat

SEQ ID NO: 769139 - DNA, 25 bp, Mus musculus
tacttgctgttatcccctttgaggg

SEQ ID NO: 769140 - DNA, 25 bp, Mus musculus
tacttgcttagtcactccaggctgc

SEQ ID NO: 769141 - DNA, 25 bp, Mus musculus
tacttgcttagtgactccaggctgc

SEQ ID NO: 769142 - DNA, 25 bp, Mus musculus
tacttggaagacatctctgcttcgc

SEQ ID NO: 769143 - DNA, 25 bp, Mus musculus
tacttggaagacttctctgcttcgc

SEQ ID NO: 769144 - DNA, 25 bp, Mus musculus
tacttggaagtactgtcacctcaac

SEQ ID NO: 769145 - DNA, 25 bp, Mus musculus
tacttggaagtagtgtcacctcaac

SEQ ID NO: 769146 - DNA, 25 bp, Mus musculus
tacttggaatgcatccttgcagatg

SEQ ID NO: 769147 - DNA, 25 bp, Mus musculus
tacttggaatgcttccttgcagatg

SEQ ID NO: 769148 - DNA, 25 bp, Mus musculus
tacttggaccaccatttttcttagc

SEQ ID NO: 769149 - DNA, 25 bp, Mus musculus
tacttggaccacgatttttcttagc

SEQ ID NO: 769150 - DNA, 25 bp, Mus musculus
tacttggaccccatcaataggcaca

SEQ ID NO: 769151 - DNA, 25 bp, Mus musculus
tacttggaccccttcaataggcaca

SEQ ID NO: 769152 - DNA, 25 bp, Mus musculus
tacttggactatacagggagtcgca

SEQ ID NO: 769153 - DNA, 25 bp, Mus musculus
tacttggactattcagggagtcgca

SEQ ID NO: 769154 - DNA, 25 bp, Mus musculus
tacttggactcaacagagaggtttt

SEQ ID NO: 769155 - DNA, 25 bp, Mus musculus
tacttggactcatcagagaggtttt

SEQ ID NO: 769156 - DNA, 25 bp, Mus musculus
tacttggagtgaacacagtgtcctc

SEQ ID NO: 769157 - DNA, 25 bp, Mus musculus
tacttggagtgatcacagtgtcctc

SEQ ID NO: 769158 - DNA, 25 bp, Mus musculus
tacttggatgcacggttgcgccgac

SEQ ID NO: 769159 - DNA, 25 bp, Mus musculus
tacttggatgcagggttgcgccgac

SEQ ID NO: 769160 - DNA, 25 bp, Mus musculus
tacttggatgtaaccttggaggaca

SEQ ID NO: 769161 - DNA, 25 bp, Mus musculus
tacttggatgtatccttggaggaca

SEQ ID NO: 769162 - DNA, 25 bp, Mus musculus
tacttggatttcaaggtttgaagac

SEQ ID NO: 769163 - DNA, 25 bp, Mus musculus
tacttggatttctaggtttgaagac

SEQ ID NO: 769164 - DNA, 25 bp, Mus musculus
tacttggcagtactctgtacctggg

SEQ ID NO: 769165 - DNA, 25 bp, Mus musculus
tacttggcagtagtctgtacctggg

SEQ ID NO: 769166 - DNA, 25 bp, Mus musculus
tacttggcatttaactaggcagttg

SEQ ID NO: 769167 - DNA, 25 bp, Mus musculus
tacttggcattttactaggcagttg

SEQ ID NO: 769168 - DNA, 25 bp, Mus musculus
tacttggccaatacagacctttaca

SEQ ID NO: 769169 - DNA, 25 bp, Mus musculus
tacttggccaattcagacctttaca

SEQ ID NO: 769170 - DNA, 25 bp, Mus musculus
tacttggcctccagctttcaaagca

SEQ ID NO: 769171 - DNA, 25 bp, Mus musculus
tacttggcctcccaaactgtgctca

SEQ ID NO: 769172 - DNA, 25 bp, Mus musculus
tacttggcctccgaaactgtgctca

SEQ ID NO: 769173 - DNA, 25 bp, Mus musculus
tacttggcctcctgctttcaaagca

SEQ ID NO: 769174 - DNA, 25 bp, Mus musculus
tacttggcctctacttaaggtcaaa

SEQ ID NO: 769175 - DNA, 25 bp, Mus musculus
tacttggcctcttcttaaggtcaaa

SEQ ID NO: 769176 - DNA, 25 bp, Mus musculus
tacttggctagaactgtccctggaa

SEQ ID NO: 769177 - DNA, 25 bp, Mus musculus
tacttggctagatctgtccctggaa

SEQ ID NO: 769178 - DNA, 25 bp, Mus musculus
tacttggctccaatcaactgcagat

SEQ ID NO: 769179 - DNA, 25 bp, Mus musculus
tacttggctccattcaactgcagat

SEQ ID NO: 769180 - DNA, 25 bp, Mus musculus
tacttggctctacagctgagctcac

SEQ ID NO: 769181 - DNA, 25 bp, Mus musculus
tacttggctctagagctgagctcac

SEQ ID NO: 769182 - DNA, 25 bp, Mus musculus
tacttggctggactcactgaaatag

SEQ ID NO: 769183 - DNA, 25 bp, Mus musculus
tacttggctggagtcactgaaatag

SEQ ID NO: 769184 - DNA, 25 bp, Mus musculus
tacttggcttagacaccatctcggg

SEQ ID NO: 769185 - DNA, 25 bp, Mus musculus
tacttggcttagtcaccatctcggg

SEQ ID NO: 769186 - DNA, 25 bp, Mus musculus
tacttggcttccactagcgaggatg

SEQ ID NO: 769187 - DNA, 25 bp, Mus musculus
tacttggcttcctctagcgaggatg

SEQ ID NO: 769188 - DNA, 25 bp, Mus musculus
tacttgggacacagcagagaataaa

SEQ ID NO: 769189 - DNA, 25 bp, Mus musculus
tacttgggacactgcagagaataaa

SEQ ID NO: 769190 - DNA, 25 bp, Mus musculus
tacttgggacgactaaggtggctca

SEQ ID NO: 769191 - DNA, 25 bp, Mus musculus
tacttgggacgagtaaggtggctca

SEQ ID NO: 769192 - DNA, 25 bp, Mus musculus
tacttgggagttctcagcctcggtc

SEQ ID NO: 769193 - DNA, 25 bp, Mus musculus
tacttgggagttcttaggcttggca

SEQ ID NO: 769194 - DNA, 25 bp, Mus musculus
tacttgggagttgtcagcctcggtc

SEQ ID NO: 769195 - DNA, 25 bp, Mus musculus
tacttgggagttgttaggcttggca

SEQ ID NO: 769196 - DNA, 25 bp, Mus musculus
tacttgggcagaccctcagagagta

SEQ ID NO: 769197 - DNA, 25 bp, Mus musculus
tacttgggcagactcaggcatatct

SEQ ID NO: 769198 - DNA, 25 bp, Mus musculus
tacttgggcagagcctcagagagta

SEQ ID NO: 769199 - DNA, 25 bp, Mus musculus
tacttgggcagagtcaggcatatct

SEQ ID NO: 769200 - DNA, 25 bp, Mus musculus
tacttgggcccacgaggttatgacc

SEQ ID NO: 769201 - DNA, 25 bp, Mus musculus
tacttgggcccaggaggttatgacc

SEQ ID NO: 769202 - DNA, 25 bp, Mus musculus
tacttggtaaggcactgcatgacac

SEQ ID NO: 769203 - DNA, 25 bp, Mus musculus
tacttggtaagggactgcatgacac

SEQ ID NO: 769204 - DNA, 25 bp, Mus musculus
tacttggtacatacctcaaagcacc

SEQ ID NO: 769205 - DNA, 25 bp, Mus musculus
tacttggtacattcctcaaagcacc

SEQ ID NO: 769206 - DNA, 25 bp, Mus musculus
tacttggtatcccatggcagcagcc

SEQ ID NO: 769207 - DNA, 25 bp, Mus musculus
tacttggtatccgatggcagcagcc

SEQ ID NO: 769208 - DNA, 25 bp, Mus musculus
tacttggtattaatgcccctcttgg

SEQ ID NO: 769209 - DNA, 25 bp, Mus musculus
tacttggtattattgcccctcttgg

SEQ ID NO: 769210 - DNA, 25 bp, Mus musculus
tacttggtattcaggtctcagctcc

SEQ ID NO: 769211 - DNA, 25 bp, Mus musculus
tacttggtattctggtctcagctcc

SEQ ID NO: 769212 - DNA, 25 bp, Mus musculus
tacttggtcaaacatggccttttcc

SEQ ID NO: 769213 - DNA, 25 bp, Mus musculus
tacttggtcaaagatggccttttcc

SEQ ID NO: 769214 - DNA, 25 bp, Mus musculus
tacttggtcaagactatgggtgcca

SEQ ID NO: 769215 - DNA, 25 bp, Mus musculus
tacttggtcaagtctatgggtgcca

SEQ ID NO: 769216 - DNA, 25 bp, Mus musculus
tacttggtcattatctttatactgg

SEQ ID NO: 769217 - DNA, 25 bp, Mus musculus
tacttggtcattttctttatactgg

SEQ ID NO: 769218 - DNA, 25 bp, Mus musculus
tacttggtctgaagattccctgagg

SEQ ID NO: 769219 - DNA, 25 bp, Mus musculus
tacttggtctgatgattccctgagg

SEQ ID NO: 769220 - DNA, 25 bp, Mus musculus
tacttggtgttcagggcattcctac

SEQ ID NO: 769221 - DNA, 25 bp, Mus musculus
tacttggtgttctgggcattcctac

SEQ ID NO: 769222 - DNA, 25 bp, Mus musculus
tacttggttactatgtatgctgaaa

SEQ ID NO: 769223 - DNA, 25 bp, Mus musculus
tacttggttactttgtatgctgaaa

SEQ ID NO: 769224 - DNA, 25 bp, Mus musculus
tacttggttcacatccccttatgtc

SEQ ID NO: 769225 - DNA, 25 bp, Mus musculus
tacttggttcacttccccttatgtc

SEQ ID NO: 769226 - DNA, 25 bp, Mus musculus
tacttggtttgacgcctagaggctc

SEQ ID NO: 769227 - DNA, 25 bp, Mus musculus
tacttggtttgaggcctagaggctc

SEQ ID NO: 769228 - DNA, 25 bp, Mus musculus
tacttggttttcagaagctaacact

SEQ ID NO: 769229 - DNA, 25 bp, Mus musculus
tacttggttttctgaagctaacact

SEQ ID NO: 769230 - DNA, 25 bp, Mus musculus
tacttgtaaccccaacacctgggag

SEQ ID NO: 769231 - DNA, 25 bp, Mus musculus
tacttgtaacccgaacacctgggag

SEQ ID NO: 769232 - DNA, 25 bp, Mus musculus
tacttgtacacacagctcggaaact

SEQ ID NO: 769233 - DNA, 25 bp, Mus musculus
tacttgtacacagagctcggaaact

SEQ ID NO: 769234 - DNA, 25 bp, Mus musculus
tacttgtaccccagcttagcaatat

SEQ ID NO: 769235 - DNA, 25 bp, Mus musculus
tacttgtacccctgcttagcaatat

SEQ ID NO: 769236 - DNA, 25 bp, Mus musculus
tacttgtaccgtcgatctggagcct

SEQ ID NO: 769237 - DNA, 25 bp, Mus musculus
tacttgtaccgtggatctggagcct

SEQ ID NO: 769238 - DNA, 25 bp, Mus musculus
tacttgtacgatcaaggatgccttt

SEQ ID NO: 769239 - DNA, 25 bp, Mus musculus
tacttgtacgatgaaggatgccttt

SEQ ID NO: 769240 - DNA, 25 bp, Mus musculus
tacttgtagaccacatcaattccct

SEQ ID NO: 769241 - DNA, 25 bp, Mus musculus
tacttgtagacctcatcaattccct

SEQ ID NO: 769242 - DNA, 25 bp, Mus musculus
tacttgtagcttactgaggtgcaca

SEQ ID NO: 769243 - DNA, 25 bp, Mus musculus
tacttgtagctttctgaggtgcaca

SEQ ID NO: 769244 - DNA, 25 bp, Mus musculus
tacttgtatatgaatgccaatttgg

SEQ ID NO: 769245 - DNA, 25 bp, Mus musculus
tacttgtatatgtatgccaatttgg

SEQ ID NO: 769246 - DNA, 25 bp, Mus musculus
tacttgtatcagatcttcccggaag

SEQ ID NO: 769247 - DNA, 25 bp, Mus musculus
tacttgtatcagttcttcccggaag

SEQ ID NO: 769248 - DNA, 25 bp, Mus musculus
tacttgtatctaacaataaacattg

SEQ ID NO: 769249 - DNA, 25 bp, Mus musculus
tacttgtatctatcaataaacattg

SEQ ID NO: 769250 - DNA, 25 bp, Mus musculus
tacttgtatctgaagtccatactga

SEQ ID NO: 769251 - DNA, 25 bp, Mus musculus
tacttgtatctgtagtccatactga

SEQ ID NO: 769252 - DNA, 25 bp, Mus musculus
tacttgtatgtgctggccaatctct

SEQ ID NO: 769253 - DNA, 25 bp, Mus musculus
tacttgtatgtggtggccaatctct

SEQ ID NO: 769254 - DNA, 25 bp, Mus musculus
tacttgtattaaaagcaggcgtgct

SEQ ID NO: 769255 - DNA, 25 bp, Mus musculus
tacttgtattaatagcaggcgtgct

SEQ ID NO: 769256 - DNA, 25 bp, Mus musculus
tacttgtcccttcaatgctcggcat

SEQ ID NO: 769257 - DNA, 25 bp, Mus musculus
tacttgtcccttgaatgctcggcat

SEQ ID NO: 769258 - DNA, 25 bp, Mus musculus
tacttgtcgcggctttgagttactc

SEQ ID NO: 769259 - DNA, 25 bp, Mus musculus
tacttgtcgcgggtttgagttactc

SEQ ID NO: 769260 - DNA, 25 bp, Mus musculus
tacttgtcggtcacagcttcattta

SEQ ID NO: 769261 - DNA, 25 bp, Mus musculus
tacttgtcggtctcagcttcattta

SEQ ID NO: 769262 - DNA, 25 bp, Mus musculus
tacttgtctctacttagctgacccc

SEQ ID NO: 769263 - DNA, 25 bp, Mus musculus
tacttgtctctagttagctgacccc

SEQ ID NO: 769264 - DNA, 25 bp, Mus musculus
tacttgtctcttctccttgtgtttg

SEQ ID NO: 769265 - DNA, 25 bp, Mus musculus
tacttgtctcttgtccttgtgtttg

SEQ ID NO: 769266 - DNA, 25 bp, Mus musculus
tacttgtgaatgacaatcctcagca

SEQ ID NO: 769267 - DNA, 25 bp, Mus musculus
tacttgtgaatgtcaatcctcagca

SEQ ID NO: 769268 - DNA, 25 bp, Mus musculus
tacttgtgacgccagcacttgggaa

SEQ ID NO: 769269 - DNA, 25 bp, Mus musculus
tacttgtgacgcgagcacttgggaa

SEQ ID NO: 769270 - DNA, 25 bp, Mus musculus
tacttgtgatccatctagatgctcc

SEQ ID NO: 769271 - DNA, 25 bp, Mus musculus
tacttgtgatccttctagatgctcc

SEQ ID NO: 769272 - DNA, 25 bp, Mus musculus
tacttgtgatggcaggcgctcttat

SEQ ID NO: 769273 - DNA, 25 bp, Mus musculus
tacttgtgatgggaggcgctcttat

SEQ ID NO: 769274 - DNA, 25 bp, Mus musculus
tacttgtgatttatcttacgtataa

SEQ ID NO: 769275 - DNA, 25 bp, Mus musculus
tacttgtgatttttcttacgtataa

SEQ ID NO: 769276 - DNA, 25 bp, Mus musculus
tacttgtgcattatgggaatctttc

SEQ ID NO: 769277 - DNA, 25 bp, Mus musculus
tacttgtgcattttgggaatctttc

SEQ ID NO: 769278 - DNA, 25 bp, Mus musculus
tacttgtgtaaccaaggttgcctca

SEQ ID NO: 769279 - DNA, 25 bp, Mus musculus
tacttgtgtaacgaaggttgcctca

SEQ ID NO: 769280 - DNA, 25 bp, Mus musculus
tacttgtgtagactgaaaggactgt

SEQ ID NO: 769281 - DNA, 25 bp, Mus musculus
tacttgtgtagagtgaaaggactgt

SEQ ID NO: 769282 - DNA, 25 bp, Mus musculus
tacttgtgtgctagcttctgttatt

SEQ ID NO: 769283 - DNA, 25 bp, Mus musculus
tacttgtgtgcttgcttctgttatt

SEQ ID NO: 769284 - DNA, 25 bp, Mus musculus
tacttgtgtgtaaaagttcctttcc

SEQ ID NO: 769285 - DNA, 25 bp, Mus musculus
tacttgtgtgtataagttcctttcc

SEQ ID NO: 769286 - DNA, 25 bp, Mus musculus
tacttgttactcatgctgaggacct

SEQ ID NO: 769287 - DNA, 25 bp, Mus musculus
tacttgttactcttgctgaggacct

SEQ ID NO: 769288 - DNA, 25 bp, Mus musculus
tacttgttcctaaatgaaaaccagg

SEQ ID NO: 769289 - DNA, 25 bp, Mus musculus
tacttgttcctatatgaaaaccagg

SEQ ID NO: 769290 - DNA, 25 bp, Mus musculus
tacttgttctctcagtgcatgtcac

SEQ ID NO: 769291 - DNA, 25 bp, Mus musculus
tacttgttctctgagtgcatgtcac

SEQ ID NO: 769292 - DNA, 25 bp, Mus musculus
tacttgttgttgctctgtttggagg

SEQ ID NO: 769293 - DNA, 25 bp, Mus musculus
tacttgttgttggtctgtttggagg

SEQ ID NO: 769294 - DNA, 25 bp, Mus musculus
tacttgtttactccaaaatttaccg

SEQ ID NO: 769295 - DNA, 25 bp, Mus musculus
tacttgtttactgcaaaatttaccg

SEQ ID NO: 769296 - DNA, 25 bp, Mus musculus
tacttgtttattcctcttgtgagat

SEQ ID NO: 769297 - DNA, 25 bp, Mus musculus
tacttgtttattgctcttgtgagat

SEQ ID NO: 769298 - DNA, 25 bp, Mus musculus
tacttgtttgggattcgttgtgctt

SEQ ID NO: 769299 - DNA, 25 bp, Mus musculus
tacttgtttgggtttcgttgtgctt

SEQ ID NO: 769300 - DNA, 25 bp, Mus musculus
tactttaaaaccatccgtctgtctg

SEQ ID NO: 769301 - DNA, 25 bp, Mus musculus
tactttaaaaccttccgtctgtctg

SEQ ID NO: 769302 - DNA, 25 bp, Mus musculus
tactttaaaggcatgtgcagtccag

SEQ ID NO: 769303 - DNA, 25 bp, Mus musculus
tactttaaaggcttgtgcagtccag

SEQ ID NO: 769304 - DNA, 25 bp, Mus musculus
tactttaagaagcagggcctccctc

SEQ ID NO: 769305 - DNA, 25 bp, Mus musculus
tactttaagaaggagggcctccctc

SEQ ID NO: 769306 - DNA, 25 bp, Mus musculus
tactttaagtcaaatgtgtgcacac

SEQ ID NO: 769307 - DNA, 25 bp, Mus musculus
tactttaagtcatatgtgtgcacac

SEQ ID NO: 769308 - DNA, 25 bp, Mus musculus
tactttaatgtcaacctgtgtgtat

SEQ ID NO: 769309 - DNA, 25 bp, Mus musculus
tactttaatgtctacctgtgtgtat

SEQ ID NO: 769310 - DNA, 25 bp, Mus musculus
tactttaattggctacctcagctgg

SEQ ID NO: 769311 - DNA, 25 bp, Mus musculus
tactttaattgggtacctcagctgg

SEQ ID NO: 769312 - DNA, 25 bp, Mus musculus
tactttacccaaagtcaggactgtt

SEQ ID NO: 769313 - DNA, 25 bp, Mus musculus
tactttacccaatgtcaggactgtt

SEQ ID NO: 769314 - DNA, 25 bp, Mus musculus
tactttactattagcgccaaggttt

SEQ ID NO: 769315 - DNA, 25 bp, Mus musculus
tactttactatttgcgccaaggttt

SEQ ID NO: 769316 - DNA, 25 bp, Mus musculus
tactttactgatctacaaattcttg

SEQ ID NO: 769317 - DNA, 25 bp, Mus musculus
tactttactgatgtacaaattcttg

SEQ ID NO: 769318 - DNA, 25 bp, Mus musculus
tactttagacacagcttccgtttga

SEQ ID NO: 769319 - DNA, 25 bp, Mus musculus
tactttagacactgcttccgtttga

SEQ ID NO: 769320 - DNA, 25 bp, Mus musculus
tactttagaggtctttgtggctcct

SEQ ID NO: 769321 - DNA, 25 bp, Mus musculus
tactttagaggtgtttgtggctcct

SEQ ID NO: 769322 - DNA, 25 bp, Mus musculus
tactttagattcaagcatacaccct

SEQ ID NO: 769323 - DNA, 25 bp, Mus musculus
tactttagattctagcatacaccct

SEQ ID NO: 769324 - DNA, 25 bp, Mus musculus
tactttagctatatcctctgtgccc

SEQ ID NO: 769325 - DNA, 25 bp, Mus musculus
tactttagctatttcctctgtgccc

SEQ ID NO: 769326 - DNA, 25 bp, Mus musculus
tactttaggaaacactgctaccatc

SEQ ID NO: 769327 - DNA, 25 bp, Mus musculus
tactttaggaaagactgctaccatc

SEQ ID NO: 769328 - DNA, 25 bp, Mus musculus
tactttagtacgactccggaacact

SEQ ID NO: 769329 - DNA, 25 bp, Mus musculus
tactttagtacgtctccggaacact

SEQ ID NO: 769330 - DNA, 25 bp, Mus musculus
tactttatattcacccaggctgtac

SEQ ID NO: 769331 - DNA, 25 bp, Mus musculus
tactttatattctcccaggctgtac

SEQ ID NO: 769332 - DNA, 25 bp, Mus musculus
tactttatgagcatatttactttct

SEQ ID NO: 769333 - DNA, 25 bp, Mus musculus
tactttatgagcttatttactttct

SEQ ID NO: 769334 - DNA, 25 bp, Mus musculus
tactttattcctcttaccatttact

SEQ ID NO: 769335 - DNA, 25 bp, Mus musculus
tactttattcctgttaccatttact

SEQ ID NO: 769336 - DNA, 25 bp, Mus musculus
tactttattctgaggtattccacca

SEQ ID NO: 769337 - DNA, 25 bp, Mus musculus
tactttattctgtggtattccacca

SEQ ID NO: 769338 - DNA, 25 bp, Mus musculus
tactttatttataggccctccccat

SEQ ID NO: 769339 - DNA, 25 bp, Mus musculus
tactttatttattggccctccccat

SEQ ID NO: 769340 - DNA, 25 bp, Mus musculus
tactttatttgcactatgactctgt

SEQ ID NO: 769341 - DNA, 25 bp, Mus musculus
tactttatttgctctatgactctgt

SEQ ID NO: 769342 - DNA, 25 bp, Mus musculus
tactttatttggatgtgatgtcatc

SEQ ID NO: 769343 - DNA, 25 bp, Mus musculus
tactttatttggttgtgatgtcatc

SEQ ID NO: 769344 - DNA, 25 bp, Mus musculus
tactttcaaataccaggactttgtt

SEQ ID NO: 769345 - DNA, 25 bp, Mus musculus
tactttcaaatagcaggactttgtt

SEQ ID NO: 769346 - DNA, 25 bp, Mus musculus
tactttcaacccagttctacctact

SEQ ID NO: 769347 - DNA, 25 bp, Mus musculus
tactttcaaccctgttctacctact

SEQ ID NO: 769348 - DNA, 25 bp, Mus musculus
tactttcaacctcagcaagctcagg

SEQ ID NO: 769349 - DNA, 25 bp, Mus musculus
tactttcaacctgagcaagctcagg

SEQ ID NO: 769350 - DNA, 25 bp, Mus musculus
tactttcacctgatctcatatttaa

SEQ ID NO: 769351 - DNA, 25 bp, Mus musculus
tactttcacctgctctgtgttacat

SEQ ID NO: 769352 - DNA, 25 bp, Mus musculus
tactttcacctggtctgtgttacat

SEQ ID NO: 769353 - DNA, 25 bp, Mus musculus
tactttcacctgttctcatatttaa

SEQ ID NO: 769354 - DNA, 25 bp, Mus musculus
tactttcactataccaactgccatg

SEQ ID NO: 769355 - DNA, 25 bp, Mus musculus
tactttcactatcgctacgggtggt

SEQ ID NO: 769356 - DNA, 25 bp, Mus musculus
tactttcactatggctacgggtggt

SEQ ID NO: 769357 - DNA, 25 bp, Mus musculus
tactttcactattccaactgccatg

SEQ ID NO: 769358 - DNA, 25 bp, Mus musculus
tactttcagcatctgtatccgtttc

SEQ ID NO: 769359 - DNA, 25 bp, Mus musculus
tactttcagcatgtgtatccgtttc

SEQ ID NO: 769360 - DNA, 25 bp, Mus musculus
tactttcagccacctaaaccaggag

SEQ ID NO: 769361 - DNA, 25 bp, Mus musculus
tactttcagccagctaaaccaggag

SEQ ID NO: 769362 - DNA, 25 bp, Mus musculus
tactttcagcgcaggattcttgtgc

SEQ ID NO: 769363 - DNA, 25 bp, Mus musculus
tactttcagcgctggattcttgtgc

SEQ ID NO: 769364 - DNA, 25 bp, Mus musculus
tactttcagctgctcttgtacagtc

SEQ ID NO: 769365 - DNA, 25 bp, Mus musculus
tactttcagctggtcttgtacagtc

SEQ ID NO: 769366 - DNA, 25 bp, Mus musculus
tactttcagtgaccttttgttacta

SEQ ID NO: 769367 - DNA, 25 bp, Mus musculus
tactttcagtgagcttttgttacta

SEQ ID NO: 769368 - DNA, 25 bp, Mus musculus
tactttcatccaccacgtatctgca

SEQ ID NO: 769369 - DNA, 25 bp, Mus musculus
tactttcatccagcacgtatctgca

SEQ ID NO: 769370 - DNA, 25 bp, Mus musculus
tactttcatgaaccgtttcctgtgt

SEQ ID NO: 769371 - DNA, 25 bp, Mus musculus
tactttcatgaagcgtttcctgtgt

SEQ ID NO: 769372 - DNA, 25 bp, Mus musculus
tactttcatgtcaatatcccactgc

SEQ ID NO: 769373 - DNA, 25 bp, Mus musculus
tactttcatgtctatatcccactgc

SEQ ID NO: 769374 - DNA, 25 bp, Mus musculus
tactttcattctctccaaggaggga

SEQ ID NO: 769375 - DNA, 25 bp, Mus musculus
tactttcattctgtccaaggaggga

SEQ ID NO: 769376 - DNA, 25 bp, Mus musculus
tactttcattgactctccatactgt

SEQ ID NO: 769377 - DNA, 25 bp, Mus musculus
tactttcattgagtctccatactgt

SEQ ID NO: 769378 - DNA, 25 bp, Mus musculus
tactttccaaaacctgtaggaattc

SEQ ID NO: 769379 - DNA, 25 bp, Mus musculus
tactttccaaaagctgtaggaattc

SEQ ID NO: 769380 - DNA, 25 bp, Mus musculus
tactttccaatacagcagttccaaa

SEQ ID NO: 769381 - DNA, 25 bp, Mus musculus
tactttccaatagagcagttccaaa

SEQ ID NO: 769382 - DNA, 25 bp, Mus musculus
tactttccacacaggacacactgct

SEQ ID NO: 769383 - DNA, 25 bp, Mus musculus
tactttccacactggacacactgct

SEQ ID NO: 769384 - DNA, 25 bp, Mus musculus
tactttccacgtcttattaaagagg

SEQ ID NO: 769385 - DNA, 25 bp, Mus musculus
tactttccacgtgttattaaagagg

SEQ ID NO: 769386 - DNA, 25 bp, Mus musculus
tactttccccctctgaagttactct

SEQ ID NO: 769387 - DNA, 25 bp, Mus musculus
tactttccccctgtgaagttactct

SEQ ID NO: 769388 - DNA, 25 bp, Mus musculus
tactttcccttgagtaggaactcgt

SEQ ID NO: 769389 - DNA, 25 bp, Mus musculus
tactttcccttgtgtaggaactcgt

SEQ ID NO: 769390 - DNA, 25 bp, Mus musculus
tactttccgtagaagctgtcactca

SEQ ID NO: 769391 - DNA, 25 bp, Mus musculus
tactttccgtagtagctgtcactca

SEQ ID NO: 769392 - DNA, 25 bp, Mus musculus
tactttcctatgactaagggctcta

SEQ ID NO: 769393 - DNA, 25 bp, Mus musculus
tactttcctatgtctaagggctcta

SEQ ID NO: 769394 - DNA, 25 bp, Mus musculus
tactttcctccaaatgaatataaat

SEQ ID NO: 769395 - DNA, 25 bp, Mus musculus
tactttcctccatatgaatataaat

SEQ ID NO: 769396 - DNA, 25 bp, Mus musculus
tactttcctgagacgggcattgcac

SEQ ID NO: 769397 - DNA, 25 bp, Mus musculus
tactttcctgagtcgggcattgcac

SEQ ID NO: 769398 - DNA, 25 bp, Mus musculus
tactttcctggaaagtgtgggccat

SEQ ID NO: 769399 - DNA, 25 bp, Mus musculus
tactttcctggatagtgtgggccat

SEQ ID NO: 769400 - DNA, 25 bp, Mus musculus
tactttcctgggaataaaatcacat

SEQ ID NO: 769401 - DNA, 25 bp, Mus musculus
tactttcctgggtataaaatcacat

SEQ ID NO: 769402 - DNA, 25 bp, Mus musculus
tactttcctgtcagtatgcctaaga

SEQ ID NO: 769403 - DNA, 25 bp, Mus musculus
tactttcctgtctgtatgcctaaga

SEQ ID NO: 769404 - DNA, 25 bp, Mus musculus
tactttcctgtgctgggagcaggct

SEQ ID NO: 769405 - DNA, 25 bp, Mus musculus
tactttcctgtggtgggagcaggct

SEQ ID NO: 769406 - DNA, 25 bp, Mus musculus
tactttccttccattttgcaaagcc

SEQ ID NO: 769407 - DNA, 25 bp, Mus musculus
tactttccttcctttttgcaaagcc

SEQ ID NO: 769408 - DNA, 25 bp, Mus musculus
tactttccttttaaggctgacctgg

SEQ ID NO: 769409 - DNA, 25 bp, Mus musculus
tactttcctttttaggctgacctgg

SEQ ID NO: 769410 - DNA, 25 bp, Mus musculus
tactttcggtatagtcatcattgac

SEQ ID NO: 769411 - DNA, 25 bp, Mus musculus
tactttcggtattgtcatcattgac

SEQ ID NO: 769412 - DNA, 25 bp, Mus musculus
tactttctacataacgctacaaccc

SEQ ID NO: 769413 - DNA, 25 bp, Mus musculus
tactttctacattacgctacaaccc

SEQ ID NO: 769414 - DNA, 25 bp, Mus musculus
tactttctaccaagtctggacgcgg

SEQ ID NO: 769415 - DNA, 25 bp, Mus musculus
tactttctaccatgtctggacgcgg

SEQ ID NO: 769416 - DNA, 25 bp, Mus musculus
tactttctagacaccctgtattcgt

SEQ ID NO: 769417 - DNA, 25 bp, Mus musculus
tactttctagactccctgtattcgt

SEQ ID NO: 769418 - DNA, 25 bp, Mus musculus
tactttctaggaagctcaacagccc

SEQ ID NO: 769419 - DNA, 25 bp, Mus musculus
tactttctaggatgctcaacagccc

SEQ ID NO: 769420 - DNA, 25 bp, Mus musculus
tactttctatttaagctcgtcttta

SEQ ID NO: 769421 - DNA, 25 bp, Mus musculus
tactttctattttagctcgtcttta

SEQ ID NO: 769422 - DNA, 25 bp, Mus musculus
tactttctcagtcctggctgttcgg

SEQ ID NO: 769423 - DNA, 25 bp, Mus musculus
tactttctcagtgctggctgttcgg

SEQ ID NO: 769424 - DNA, 25 bp, Mus musculus
tactttctcatgcagcctgcccagg

SEQ ID NO: 769425 - DNA, 25 bp, Mus musculus
tactttctcatggagcctgcccagg

SEQ ID NO: 769426 - DNA, 25 bp, Mus musculus
tactttctctacatagtgtcttgtt

SEQ ID NO: 769427 - DNA, 25 bp, Mus musculus
tactttctctacttagtgtcttgtt

SEQ ID NO: 769428 - DNA, 25 bp, Mus musculus
tactttctcttcaccatagagtggt

SEQ ID NO: 769429 - DNA, 25 bp, Mus musculus
tactttctcttctccatagagtggt

SEQ ID NO: 769430 - DNA, 25 bp, Mus musculus
tactttctgacaaactgagtacctg

SEQ ID NO: 769431 - DNA, 25 bp, Mus musculus
tactttctgacatactgagtacctg

SEQ ID NO: 769432 - DNA, 25 bp, Mus musculus
tactttctggcccaacagggttgtc

SEQ ID NO: 769433 - DNA, 25 bp, Mus musculus
tactttctggccgaacagggttgtc

SEQ ID NO: 769434 - DNA, 25 bp, Mus musculus
tactttctggtaactcatcatgagt

SEQ ID NO: 769435 - DNA, 25 bp, Mus musculus
tactttctggtatctcatcatgagt

SEQ ID NO: 769436 - DNA, 25 bp, Mus musculus
tactttctgtagattgcattcggaa

SEQ ID NO: 769437 - DNA, 25 bp, Mus musculus
tactttctgtagtttgcattcggaa

SEQ ID NO: 769438 - DNA, 25 bp, Mus musculus
tactttcttaatagaaggtctttct

SEQ ID NO: 769439 - DNA, 25 bp, Mus musculus
tactttcttaattgaaggtctttct

SEQ ID NO: 769440 - DNA, 25 bp, Mus musculus
tactttcttgtaatcacgaggcagt

SEQ ID NO: 769441 - DNA, 25 bp, Mus musculus
tactttcttgtattcacgaggcagt

SEQ ID NO: 769442 - DNA, 25 bp, Mus musculus
tactttctttttaacagagtgagag

SEQ ID NO: 769443 - DNA, 25 bp, Mus musculus
tactttcttttttacagagtgagag

SEQ ID NO: 769444 - DNA, 25 bp, Mus musculus
tactttgaaagaaacgcctcttccg

SEQ ID NO: 769445 - DNA, 25 bp, Mus musculus
tactttgaaagatacgcctcttccg

SEQ ID NO: 769446 - DNA, 25 bp, Mus musculus
tactttgaaatgctgtcatcctgag

SEQ ID NO: 769447 - DNA, 25 bp, Mus musculus
tactttgaaatggtgtcatcctgag

SEQ ID NO: 769448 - DNA, 25 bp, Mus musculus
tactttgaaccaaggctagctcatg

SEQ ID NO: 769449 - DNA, 25 bp, Mus musculus
tactttgaaccatggctagctcatg

SEQ ID NO: 769450 - DNA, 25 bp, Mus musculus
tactttgaataacaatcctccaggc

SEQ ID NO: 769451 - DNA, 25 bp, Mus musculus
tactttgaataagaatcctccaggc

SEQ ID NO: 769452 - DNA, 25 bp, Mus musculus
tactttgaattcactgacgttagaa

SEQ ID NO: 769453 - DNA, 25 bp, Mus musculus
tactttgaattctctgacgttagaa

SEQ ID NO: 769454 - DNA, 25 bp, Mus musculus
tactttgacagcaggatgcatttcc

SEQ ID NO: 769455 - DNA, 25 bp, Mus musculus
tactttgacagctggatgcatttcc

SEQ ID NO: 769456 - DNA, 25 bp, Mus musculus
tactttgatggcaagctgttccaga

SEQ ID NO: 769457 - DNA, 25 bp, Mus musculus
tactttgatggctagctgttccaga

SEQ ID NO: 769458 - DNA, 25 bp, Mus musculus
tactttgcaagtacctgggacaaaa

SEQ ID NO: 769459 - DNA, 25 bp, Mus musculus
tactttgcaagttcctgggacaaaa

SEQ ID NO: 769460 - DNA, 25 bp, Mus musculus
tactttgcacaactcgactgcagag

SEQ ID NO: 769461 - DNA, 25 bp, Mus musculus
tactttgcacaagtcgactgcagag

SEQ ID NO: 769462 - DNA, 25 bp, Mus musculus
tactttgcaccgcagctgttgaagt

SEQ ID NO: 769463 - DNA, 25 bp, Mus musculus
tactttgcaccggagctgttgaagt

SEQ ID NO: 769464 - DNA, 25 bp, Mus musculus
tactttgcagctattgaggactgat

SEQ ID NO: 769465 - DNA, 25 bp, Mus musculus
tactttgcagcttttgaggactgat

SEQ ID NO: 769466 - DNA, 25 bp, Mus musculus
tactttgccaacaggatagtaagca

SEQ ID NO: 769467 - DNA, 25 bp, Mus musculus
tactttgccaactggatagtaagca

SEQ ID NO: 769468 - DNA, 25 bp, Mus musculus
tactttgccatcatactcttctttg

SEQ ID NO: 769469 - DNA, 25 bp, Mus musculus
tactttgccatcttactcttctttg

SEQ ID NO: 769470 - DNA, 25 bp, Mus musculus
tactttgcccaaactagtttactct

SEQ ID NO: 769471 - DNA, 25 bp, Mus musculus
tactttgcccaatctagtttactct

SEQ ID NO: 769472 - DNA, 25 bp, Mus musculus
tactttgcccggcatgtccggaaca

SEQ ID NO: 769473 - DNA, 25 bp, Mus musculus
tactttgcccgggatgtccggaaca

SEQ ID NO: 769474 - DNA, 25 bp, Mus musculus
tactttgctctcaccagtgaactca

SEQ ID NO: 769475 - DNA, 25 bp, Mus musculus
tactttgctctctccagtgaactca

SEQ ID NO: 769476 - DNA, 25 bp, Mus musculus
tactttgctgctatggtttctccaa

SEQ ID NO: 769477 - DNA, 25 bp, Mus musculus
tactttgctgctttggtttctccaa

SEQ ID NO: 769478 - DNA, 25 bp, Mus musculus
tactttgctggccttgggagatcat

SEQ ID NO: 769479 - DNA, 25 bp, Mus musculus
tactttgctggcgttgggagatcat

SEQ ID NO: 769480 - DNA, 25 bp, Mus musculus
tactttgctgggatggtgtttgctc

SEQ ID NO: 769481 - DNA, 25 bp, Mus musculus
tactttgctgggttggtgtttgctc

SEQ ID NO: 769482 - DNA, 25 bp, Mus musculus
tactttgctgtgaattctgtggcct

SEQ ID NO: 769483 - DNA, 25 bp, Mus musculus
tactttgctgtgtattctgtggcct

SEQ ID NO: 769484 - DNA, 25 bp, Mus musculus
tactttgcttacattgccttgggta

SEQ ID NO: 769485 - DNA, 25 bp, Mus musculus
tactttgcttactttgccttgggta

SEQ ID NO: 769486 - DNA, 25 bp, Mus musculus
tactttgctttgactaatagcctct

SEQ ID NO: 769487 - DNA, 25 bp, Mus musculus
tactttgctttgtctaatagcctct

SEQ ID NO: 769488 - DNA, 25 bp, Mus musculus
tactttggaaccaaaaaacatctcg

SEQ ID NO: 769489 - DNA, 25 bp, Mus musculus
tactttggaacctaaaaacatctcg

SEQ ID NO: 769490 - DNA, 25 bp, Mus musculus
tactttggccctaacaatcctaaag

SEQ ID NO: 769491 - DNA, 25 bp, Mus musculus
tactttggcccttacaatcctaaag

SEQ ID NO: 769492 - DNA, 25 bp, Mus musculus
tactttgggtccctgggagaggtgt

SEQ ID NO: 769493 - DNA, 25 bp, Mus musculus
tactttgggtccgtgggagaggtgt

SEQ ID NO: 769494 - DNA, 25 bp, Mus musculus
tactttgggtctccatagtgggttc

SEQ ID NO: 769495 - DNA, 25 bp, Mus musculus
tactttgggtctgcatagtgggttc

SEQ ID NO: 769496 - DNA, 25 bp, Mus musculus
tactttggtcacactactgggtgac

SEQ ID NO: 769497 - DNA, 25 bp, Mus musculus
tactttggtcactctactgggtgac

SEQ ID NO: 769498 - DNA, 25 bp, Mus musculus
tactttggtcatccttctcttttaa

SEQ ID NO: 769499 - DNA, 25 bp, Mus musculus
tactttggtcatgcttctcttttaa

SEQ ID NO: 769500 - DNA, 25 bp, Mus musculus
tactttggtctacttgcagcgcaac

SEQ ID NO: 769501 - DNA, 25 bp, Mus musculus
tactttggtctagttgcagcgcaac

SEQ ID NO: 769502 - DNA, 25 bp, Mus musculus
tactttggtgtcctgtgatcttgct

SEQ ID NO: 769503 - DNA, 25 bp, Mus musculus
tactttggtgtcgtgtgatcttgct

SEQ ID NO: 769504 - DNA, 25 bp, Mus musculus
tactttgtacagcttgatcactttt

SEQ ID NO: 769505 - DNA, 25 bp, Mus musculus
tactttgtacaggttgatcactttt

SEQ ID NO: 769506 - DNA, 25 bp, Mus musculus
tactttgtacatcttaaccaaccac

SEQ ID NO: 769507 - DNA, 25 bp, Mus musculus
tactttgtacatgttaaccaaccac

SEQ ID NO: 769508 - DNA, 25 bp, Mus musculus
tactttgtacttctgtttgcttaaa

SEQ ID NO: 769509 - DNA, 25 bp, Mus musculus
tactttgtacttgtgtttgcttaaa

SEQ ID NO: 769510 - DNA, 25 bp, Mus musculus
tactttgtagctatccatcaggctt

SEQ ID NO: 769511 - DNA, 25 bp, Mus musculus
tactttgtagctttccatcaggctt

SEQ ID NO: 769512 - DNA, 25 bp, Mus musculus
tactttgtagtgattgagccgccag

SEQ ID NO: 769513 - DNA, 25 bp, Mus musculus
tactttgtagtgtttgagccgccag

SEQ ID NO: 769514 - DNA, 25 bp, Mus musculus
tactttgtatccatgacttctccga

SEQ ID NO: 769515 - DNA, 25 bp, Mus musculus
tactttgtatccttgacttctccga

SEQ ID NO: 769516 - DNA, 25 bp, Mus musculus
tactttgtatgacattccaatgcag

SEQ ID NO: 769517 - DNA, 25 bp, Mus musculus
tactttgtatgagattccaatgcag

SEQ ID NO: 769518 - DNA, 25 bp, Mus musculus
tactttgtattcaggaaccgtaaat

SEQ ID NO: 769519 - DNA, 25 bp, Mus musculus
tactttgtattctggaaccgtaaat

SEQ ID NO: 769520 - DNA, 25 bp, Mus musculus
tactttgtggtcatttcagttcctt

SEQ ID NO: 769521 - DNA, 25 bp, Mus musculus
tactttgtggtcttttcagttcctt

SEQ ID NO: 769522 - DNA, 25 bp, Mus musculus
tactttgtggtgaccaatctctacc

SEQ ID NO: 769523 - DNA, 25 bp, Mus musculus
tactttgtggtgtccaatctctacc

SEQ ID NO: 769524 - DNA, 25 bp, Mus musculus
tactttgtggttcgctatctttttt

SEQ ID NO: 769525 - DNA, 25 bp, Mus musculus
tactttgtggttggctatctttttt

SEQ ID NO: 769526 - DNA, 25 bp, Mus musculus
tactttgtgtatagcacgtgggctt

SEQ ID NO: 769527 - DNA, 25 bp, Mus musculus
tactttgtgtattgcacgtgggctt

SEQ ID NO: 769528 - DNA, 25 bp, Mus musculus
tactttgttatgatggaggaccctg

SEQ ID NO: 769529 - DNA, 25 bp, Mus musculus
tactttgttatgttggaggaccctg

SEQ ID NO: 769530 - DNA, 25 bp, Mus musculus
tactttgttgtgaagtttgttggct

SEQ ID NO: 769531 - DNA, 25 bp, Mus musculus
tactttgttgtgtagtttgttggct

SEQ ID NO: 769532 - DNA, 25 bp, Mus musculus
tactttgtttatacagtcctgttgg

SEQ ID NO: 769533 - DNA, 25 bp, Mus musculus
tactttgtttattcagtcctgttgg

SEQ ID NO: 769534 - DNA, 25 bp, Mus musculus
tacttttaagatatatacatccgtt

SEQ ID NO: 769535 - DNA, 25 bp, Mus musculus
tacttttaagatttatacatccgtt

SEQ ID NO: 769536 - DNA, 25 bp, Mus musculus
tacttttacataaatctgccgtgga

SEQ ID NO: 769537 - DNA, 25 bp, Mus musculus
tacttttacatatatctgccgtgga

SEQ ID NO: 769538 - DNA, 25 bp, Mus musculus
tacttttaccttataactgcataat

SEQ ID NO: 769539 - DNA, 25 bp, Mus musculus
tacttttaccttttaactgcataat

SEQ ID NO: 769540 - DNA, 25 bp, Mus musculus
tacttttacgatattcaggccccat

SEQ ID NO: 769541 - DNA, 25 bp, Mus musculus
tacttttacgattttcaggccccat

SEQ ID NO: 769542 - DNA, 25 bp, Mus musculus
tacttttagactacctgatcgtttg

SEQ ID NO: 769543 - DNA, 25 bp, Mus musculus
tacttttagacttcctgatcgtttg

SEQ ID NO: 769544 - DNA, 25 bp, Mus musculus
tacttttagcacattacttccaggg

SEQ ID NO: 769545 - DNA, 25 bp, Mus musculus
tacttttagcactttacttccaggg

SEQ ID NO: 769546 - DNA, 25 bp, Mus musculus
tacttttagcttcacttttgtctcc

SEQ ID NO: 769547 - DNA, 25 bp, Mus musculus
tacttttagcttgacttttgtctcc

SEQ ID NO: 769548 - DNA, 25 bp, Mus musculus
tacttttaggagacaattctttcaa

SEQ ID NO: 769549 - DNA, 25 bp, Mus musculus
tacttttaggagtcaattctttcaa

SEQ ID NO: 769550 - DNA, 25 bp, Mus musculus
tacttttatcacaagctccatagtc

SEQ ID NO: 769551 - DNA, 25 bp, Mus musculus
tacttttatcactagctccatagtc

SEQ ID NO: 769552 - DNA, 25 bp, Mus musculus
tacttttatggccaagaatatccga

SEQ ID NO: 769553 - DNA, 25 bp, Mus musculus
tacttttatggcgaagaatatccga

SEQ ID NO: 769554 - DNA, 25 bp, Mus musculus
tacttttcaagtatgggagactctg

SEQ ID NO: 769555 - DNA, 25 bp, Mus musculus
tacttttcaagtttgggagactctg

SEQ ID NO: 769556 - DNA, 25 bp, Mus musculus
tacttttcaatacgtgctgctccct

SEQ ID NO: 769557 - DNA, 25 bp, Mus musculus
tacttttcaataggtgctgctccct

SEQ ID NO: 769558 - DNA, 25 bp, Mus musculus
tacttttcagtaacaggtcctcaaa

SEQ ID NO: 769559 - DNA, 25 bp, Mus musculus
tacttttcagtaatcgagagccaat

SEQ ID NO: 769560 - DNA, 25 bp, Mus musculus
tacttttcagtatcaggtcctcaaa

SEQ ID NO: 769561 - DNA, 25 bp, Mus musculus
tacttttcagtattcgagagccaat

SEQ ID NO: 769562 - DNA, 25 bp, Mus musculus
tacttttcatagatccacccagtga

SEQ ID NO: 769563 - DNA, 25 bp, Mus musculus
tacttttcatagttccacccagtga

SEQ ID NO: 769564 - DNA, 25 bp, Mus musculus
tacttttcattcacattatggcttg

SEQ ID NO: 769565 - DNA, 25 bp, Mus musculus
tacttttcattctcattatggcttg

SEQ ID NO: 769566 - DNA, 25 bp, Mus musculus
tacttttcccctcgtaggtctgaga

SEQ ID NO: 769567 - DNA, 25 bp, Mus musculus
tacttttcccctggtaggtctgaga

SEQ ID NO: 769568 - DNA, 25 bp, Mus musculus
tacttttccctgagcaggaggcaag

SEQ ID NO: 769569 - DNA, 25 bp, Mus musculus
tacttttccctgtgcaggaggcaag

SEQ ID NO: 769570 - DNA, 25 bp, Mus musculus
tacttttccgttcctcacattgata

SEQ ID NO: 769571 - DNA, 25 bp, Mus musculus
tacttttccgttgctcacattgata

SEQ ID NO: 769572 - DNA, 25 bp, Mus musculus
tacttttcctacatatccccaggat

SEQ ID NO: 769573 - DNA, 25 bp, Mus musculus
tacttttcctacttatccccaggat

SEQ ID NO: 769574 - DNA, 25 bp, Mus musculus
tacttttcgggtcacatcttgggat

SEQ ID NO: 769575 - DNA, 25 bp, Mus musculus
tacttttcgggtgacatcttgggat

SEQ ID NO: 769576 - DNA, 25 bp, Mus musculus
tacttttctactacccagttgctaa

SEQ ID NO: 769577 - DNA, 25 bp, Mus musculus
tacttttctacttcccagttgctaa

SEQ ID NO: 769578 - DNA, 25 bp, Mus musculus
tacttttctcctaagtctacccagg

SEQ ID NO: 769579 - DNA, 25 bp, Mus musculus
tacttttctccttagtctacccagg

SEQ ID NO: 769580 - DNA, 25 bp, Mus musculus
tacttttctttaactgtgggcttct

SEQ ID NO: 769581 - DNA, 25 bp, Mus musculus
tacttttctttatctgtgggcttct

SEQ ID NO: 769582 - DNA, 25 bp, Mus musculus
tacttttgaaggctggacatctaca

SEQ ID NO: 769583 - DNA, 25 bp, Mus musculus
tacttttgaagggtggacatctaca

SEQ ID NO: 769584 - DNA, 25 bp, Mus musculus
tacttttgacatcgatgccaatggc

SEQ ID NO: 769585 - DNA, 25 bp, Mus musculus
tacttttgacatggatgccaatggc

SEQ ID NO: 769586 - DNA, 25 bp, Mus musculus
tacttttgatgcatttcctggagag

SEQ ID NO: 769587 - DNA, 25 bp, Mus musculus
tacttttgatgcttttcctggagag

SEQ ID NO: 769588 - DNA, 25 bp, Mus musculus
tacttttgatttcagttcactagac

SEQ ID NO: 769589 - DNA, 25 bp, Mus musculus
tacttttgatttgagttcactagac

SEQ ID NO: 769590 - DNA, 25 bp, Mus musculus
tacttttgccaacaggattttacgc

SEQ ID NO: 769591 - DNA, 25 bp, Mus musculus
tacttttgccaagaggattttacgc

SEQ ID NO: 769592 - DNA, 25 bp, Mus musculus
tacttttggagaccgtgggcttgct

SEQ ID NO: 769593 - DNA, 25 bp, Mus musculus
tacttttggagagcgtgggcttgct

SEQ ID NO: 769594 - DNA, 25 bp, Mus musculus
tacttttggctcattttcttcactg

SEQ ID NO: 769595 - DNA, 25 bp, Mus musculus
tacttttggctctttttcttcactg

SEQ ID NO: 769596 - DNA, 25 bp, Mus musculus
tacttttggcttctgtttcatgtgg

SEQ ID NO: 769597 - DNA, 25 bp, Mus musculus
tacttttggcttgtgtttcatgtgg

SEQ ID NO: 769598 - DNA, 25 bp, Mus musculus
tacttttgtaacatccagactttgt

SEQ ID NO: 769599 - DNA, 25 bp, Mus musculus
tacttttgtaacttccagactttgt

SEQ ID NO: 769600 - DNA, 25 bp, Mus musculus
tacttttgtctcatgataaacccag

SEQ ID NO: 769601 - DNA, 25 bp, Mus musculus
tacttttgtctcttgataaacccag

SEQ ID NO: 769602 - DNA, 25 bp, Mus musculus
tacttttgtggaaatggcttgtgct

SEQ ID NO: 769603 - DNA, 25 bp, Mus musculus
tacttttgtggatatggcttgtgct

SEQ ID NO: 769604 - DNA, 25 bp, Mus musculus
tacttttgttcccaatgtcagccac

SEQ ID NO: 769605 - DNA, 25 bp, Mus musculus
tacttttgttccgaatgtcagccac

SEQ ID NO: 769606 - DNA, 25 bp, Mus musculus
tacttttgttgtcgctgttttctca

SEQ ID NO: 769607 - DNA, 25 bp, Mus musculus
tacttttgttgtggctgttttctca

SEQ ID NO: 769608 - DNA, 25 bp, Mus musculus
tactttttaattcagggcaccctga

SEQ ID NO: 769609 - DNA, 25 bp, Mus musculus
tactttttaattgagggcaccctga

SEQ ID NO: 769610 - DNA, 25 bp, Mus musculus
tactttttagtcagggcttcagggt

SEQ ID NO: 769611 - DNA, 25 bp, Mus musculus
tactttttagtctgggcttcagggt

SEQ ID NO: 769612 - DNA, 25 bp, Mus musculus
tactttttatacaacactgatgctg

SEQ ID NO: 769613 - DNA, 25 bp, Mus musculus
tactttttatactacactgatgctg

SEQ ID NO: 769614 - DNA, 25 bp, Mus musculus
tactttttatcccttgtaggcagaa

SEQ ID NO: 769615 - DNA, 25 bp, Mus musculus
tactttttatccgttgtaggcagaa

SEQ ID NO: 769616 - DNA, 25 bp, Mus musculus
tactttttattcaggccacgcaacg

SEQ ID NO: 769617 - DNA, 25 bp, Mus musculus
tactttttattctggccacgcaacg

SEQ ID NO: 769618 - DNA, 25 bp, Mus musculus
tactttttcaacctagcttctggat

SEQ ID NO: 769619 - DNA, 25 bp, Mus musculus
tactttttcaacgtagcttctggat

SEQ ID NO: 769620 - DNA, 25 bp, Mus musculus
tactttttcagtcgcagttcccatt

SEQ ID NO: 769621 - DNA, 25 bp, Mus musculus
tactttttcagtggcagttcccatt

SEQ ID NO: 769622 - DNA, 25 bp, Mus musculus
tactttttccacagttcttcctgaa

SEQ ID NO: 769623 - DNA, 25 bp, Mus musculus
tactttttccactgttcttcctgaa

SEQ ID NO: 769624 - DNA, 25 bp, Mus musculus
tactttttccatagtctgtgtgtgt

SEQ ID NO: 769625 - DNA, 25 bp, Mus musculus
tactttttccattgtctgtgtgtgt

SEQ ID NO: 769626 - DNA, 25 bp, Mus musculus
tactttttccctccagaaccgatga

SEQ ID NO: 769627 - DNA, 25 bp, Mus musculus
tactttttccctgcagaaccgatga

SEQ ID NO: 769628 - DNA, 25 bp, Mus musculus
tactttttcggtacagttttcacat

SEQ ID NO: 769629 - DNA, 25 bp, Mus musculus
tactttttcggttcagttttcacat

SEQ ID NO: 769630 - DNA, 25 bp, Mus musculus
tactttttcttccatgtctggaaaa

SEQ ID NO: 769631 - DNA, 25 bp, Mus musculus
tactttttcttcgatgtctggaaaa

SEQ ID NO: 769632 - DNA, 25 bp, Mus musculus
tactttttgactcaggattctcact

SEQ ID NO: 769633 - DNA, 25 bp, Mus musculus
tactttttgactgaggattctcact

SEQ ID NO: 769634 - DNA, 25 bp, Mus musculus
tactttttgttgctctttatatcct

SEQ ID NO: 769635 - DNA, 25 bp, Mus musculus
tactttttgttggtctttatatcct

SEQ ID NO: 769636 - DNA, 25 bp, Mus musculus
tacttttttctcatcccacttgcaa

SEQ ID NO: 769637 - DNA, 25 bp, Mus musculus
tacttttttctcttcccacttgcaa

SEQ ID NO: 769638 - DNA, 25 bp, Mus musculus
tacttttttgttactgctcagtaag

SEQ ID NO: 769639 - DNA, 25 bp, Mus musculus
tacttttttgtttctgctcagtaag

SEQ ID NO: 769640 - DNA, 25 bp, Mus musculus
tagaaaaaacttaattggatgcaat

SEQ ID NO: 769641 - DNA, 25 bp, Mus musculus
tagaaaaaactttattggatgcaat

SEQ ID NO: 769642 - DNA, 25 bp, Mus musculus
tagaaaaacacaaacctaagagaaa

SEQ ID NO: 769643 - DNA, 25 bp, Mus musculus
tagaaaaacacatacctaagagaaa

SEQ ID NO: 769644 - DNA, 25 bp, Mus musculus
tagaaaaaccgcaacttcctggctc

SEQ ID NO: 769645 - DNA, 25 bp, Mus musculus
tagaaaaaccgctacttcctggctc

SEQ ID NO: 769646 - DNA, 25 bp, Mus musculus
tagaaaaacctgctccccaaatagt

SEQ ID NO: 769647 - DNA, 25 bp, Mus musculus
tagaaaaacctggtccccaaatagt

SEQ ID NO: 769648 - DNA, 25 bp, Mus musculus
tagaaaaacttgcagcttccacaga

SEQ ID NO: 769649 - DNA, 25 bp, Mus musculus
tagaaaaacttggagcttccacaga

SEQ ID NO: 769650 - DNA, 25 bp, Mus musculus
tagaaaaactttctctttcaggctg

SEQ ID NO: 769651 - DNA, 25 bp, Mus musculus
tagaaaaactttgtctttcaggctg

SEQ ID NO: 769652 - DNA, 25 bp, Mus musculus
tagaaaaagcaccaacctccaacac

SEQ ID NO: 769653 - DNA, 25 bp, Mus musculus
tagaaaaagcacgaacctccaacac

SEQ ID NO: 769654 - DNA, 25 bp, Mus musculus
tagaaaacaacacccagatgccacc

SEQ ID NO: 769655 - DNA, 25 bp, Mus musculus
tagaaaacaacagccagatgccacc

SEQ ID NO: 769656 - DNA, 25 bp, Mus musculus
tagaaaacagaacttcccctctgca

SEQ ID NO: 769657 - DNA, 25 bp, Mus musculus
tagaaaacagaagttcccctctgca

SEQ ID NO: 769658 - DNA, 25 bp, Mus musculus
tagaaaacccccagtgaggactgcc

SEQ ID NO: 769659 - DNA, 25 bp, Mus musculus
tagaaaaccccctgtgaggactgcc

SEQ ID NO: 769660 - DNA, 25 bp, Mus musculus
tagaaaacgctgacttttccagaat

SEQ ID NO: 769661 - DNA, 25 bp, Mus musculus
tagaaaacgctgtcttttccagaat

SEQ ID NO: 769662 - DNA, 25 bp, Mus musculus
tagaaaacgtttaccatttgccagg

SEQ ID NO: 769663 - DNA, 25 bp, Mus musculus
tagaaaacgttttccatttgccagg

SEQ ID NO: 769664 - DNA, 25 bp, Mus musculus
tagaaaactaggctgcaagctcaac

SEQ ID NO: 769665 - DNA, 25 bp, Mus musculus
tagaaaactagggtgcaagctcaac

SEQ ID NO: 769666 - DNA, 25 bp, Mus musculus
tagaaaactgagagcctctcaccat

SEQ ID NO: 769667 - DNA, 25 bp, Mus musculus
tagaaaactgagtgcctctcaccat

SEQ ID NO: 769668 - DNA, 25 bp, Mus musculus
tagaaaactggcctgtattatttat

SEQ ID NO: 769669 - DNA, 25 bp, Mus musculus
tagaaaactggcgtgtattatttat

SEQ ID NO: 769670 - DNA, 25 bp, Mus musculus
tagaaaagcacaaccggcagctgcc

SEQ ID NO: 769671 - DNA, 25 bp, Mus musculus
tagaaaagcacatccggcagctgcc

SEQ ID NO: 769672 - DNA, 25 bp, Mus musculus
tagaaaagcacccagtcccgaaagt

SEQ ID NO: 769673 - DNA, 25 bp, Mus musculus
tagaaaagcaccgagtcccgaaagt

SEQ ID NO: 769674 - DNA, 25 bp, Mus musculus
tagaaaagccatccacttctcttcc

SEQ ID NO: 769675 - DNA, 25 bp, Mus musculus
tagaaaagccatgcacttctcttcc

SEQ ID NO: 769676 - DNA, 25 bp, Mus musculus
tagaaaagcctcaccagggcattat

SEQ ID NO: 769677 - DNA, 25 bp, Mus musculus
tagaaaagcctctccagggcattat

SEQ ID NO: 769678 - DNA, 25 bp, Mus musculus
tagaaaaggctcctgggaacatctg

SEQ ID NO: 769679 - DNA, 25 bp, Mus musculus
tagaaaaggctcgtgggaacatctg

SEQ ID NO: 769680 - DNA, 25 bp, Mus musculus
tagaaaagtgctccagcgctgactt

SEQ ID NO: 769681 - DNA, 25 bp, Mus musculus
tagaaaagtgctgcagcgctgactt

SEQ ID NO: 769682 - DNA, 25 bp, Mus musculus
tagaaaagttggcatccgttttgtt

SEQ ID NO: 769683 - DNA, 25 bp, Mus musculus
tagaaaagttgggatccgttttgtt

SEQ ID NO: 769684 - DNA, 25 bp, Mus musculus
tagaaaataacgctcttcctccacc

SEQ ID NO: 769685 - DNA, 25 bp, Mus musculus
tagaaaataacggtcttcctccacc

SEQ ID NO: 769686 - DNA, 25 bp, Mus musculus
tagaaaataggtacggtagcccgag

SEQ ID NO: 769687 - DNA, 25 bp, Mus musculus
tagaaaataggttcggtagcccgag

SEQ ID NO: 769688 - DNA, 25 bp, Mus musculus
tagaaaatcccaactggtccttcgt

SEQ ID NO: 769689 - DNA, 25 bp, Mus musculus
tagaaaatcccatctggtccttcgt

SEQ ID NO: 769690 - DNA, 25 bp, Mus musculus
tagaaaatccttcattgaccctctc

SEQ ID NO: 769691 - DNA, 25 bp, Mus musculus
tagaaaatccttgattgaccctctc

SEQ ID NO: 769692 - DNA, 25 bp, Mus musculus
tagaaaatgaagcctacgacctgaa

SEQ ID NO: 769693 - DNA, 25 bp, Mus musculus
tagaaaatgaaggctacgacctgaa

SEQ ID NO: 769694 - DNA, 25 bp, Mus musculus
tagaaaatgctgcacatggtggtgc

SEQ ID NO: 769695 - DNA, 25 bp, Mus musculus
tagaaaatgctggacatggtggtgc

SEQ ID NO: 769696 - DNA, 25 bp, Mus musculus
tagaaaatgggcattctctcttttt

SEQ ID NO: 769697 - DNA, 25 bp, Mus musculus
tagaaaatgggctttctctcttttt

SEQ ID NO: 769698 - DNA, 25 bp, Mus musculus
tagaaaatgtgtacgctggcctccc

SEQ ID NO: 769699 - DNA, 25 bp, Mus musculus
tagaaaatgtgttcgctggcctccc

SEQ ID NO: 769700 - DNA, 25 bp, Mus musculus
tagaaaatttcaccaggttcctgga

SEQ ID NO: 769701 - DNA, 25 bp, Mus musculus
tagaaaatttcagcaggttcctgga

SEQ ID NO: 769702 - DNA, 25 bp, Mus musculus
tagaaacaaccacgtaagcccactc

SEQ ID NO: 769703 - DNA, 25 bp, Mus musculus
tagaaacaaccaggtaagcccactc

SEQ ID NO: 769704 - DNA, 25 bp, Mus musculus
tagaaacaccatccaggccttgaag

SEQ ID NO: 769705 - DNA, 25 bp, Mus musculus
tagaaacaccatgcaggccttgaag

SEQ ID NO: 769706 - DNA, 25 bp, Mus musculus
tagaaacactggatctcctggaccc

SEQ ID NO: 769707 - DNA, 25 bp, Mus musculus
tagaaacactggttctcctggaccc

SEQ ID NO: 769708 - DNA, 25 bp, Mus musculus
tagaaacagaatacaacttgccata

SEQ ID NO: 769709 - DNA, 25 bp, Mus musculus
tagaaacagaattcaacttgccata

SEQ ID NO: 769710 - DNA, 25 bp, Mus musculus
tagaaacaggtgcttgccgggcagt

SEQ ID NO: 769711 - DNA, 25 bp, Mus musculus
tagaaacaggtggttgccgggcagt

SEQ ID NO: 769712 - DNA, 25 bp, Mus musculus
tagaaacagtggaaccggctgtgcg

SEQ ID NO: 769713 - DNA, 25 bp, Mus musculus
tagaaacagtggtaccggctgtgcg

SEQ ID NO: 769714 - DNA, 25 bp, Mus musculus
tagaaacatcatctctgccctggag

SEQ ID NO: 769715 - DNA, 25 bp, Mus musculus
tagaaacatcatgtctgccctggag

SEQ ID NO: 769716 - DNA, 25 bp, Mus musculus
tagaaacatcttccctatttgcact

SEQ ID NO: 769717 - DNA, 25 bp, Mus musculus
tagaaacatcttgcctatttgcact

SEQ ID NO: 769718 - DNA, 25 bp, Mus musculus
tagaaaccaaaaccatgccctcgaa

SEQ ID NO: 769719 - DNA, 25 bp, Mus musculus
tagaaaccaaaagcatgccctcgaa

SEQ ID NO: 769720 - DNA, 25 bp, Mus musculus
tagaaaccaagcctacctgtagatt

SEQ ID NO: 769721 - DNA, 25 bp, Mus musculus
tagaaaccaagcgtacctgtagatt

SEQ ID NO: 769722 - DNA, 25 bp, Mus musculus
tagaaaccaaggacagggcctcctc

SEQ ID NO: 769723 - DNA, 25 bp, Mus musculus
tagaaaccaaggtcagggcctcctc

SEQ ID NO: 769724 - DNA, 25 bp, Mus musculus
tagaaaccagtgactggcaccccag

SEQ ID NO: 769725 - DNA, 25 bp, Mus musculus
tagaaaccagtgtctggcaccccag

SEQ ID NO: 769726 - DNA, 25 bp, Mus musculus
tagaaacccaccattgcctaatgac

SEQ ID NO: 769727 - DNA, 25 bp, Mus musculus
tagaaacccacctttgcctaatgac

SEQ ID NO: 769728 - DNA, 25 bp, Mus musculus
tagaaaccccgacctgcatttcaaa

SEQ ID NO: 769729 - DNA, 25 bp, Mus musculus
tagaaaccccgagctgcatttcaaa

SEQ ID NO: 769730 - DNA, 25 bp, Mus musculus
tagaaaccgcagctccgctcggtct

SEQ ID NO: 769731 - DNA, 25 bp, Mus musculus
tagaaaccgcaggtccgctcggtct

SEQ ID NO: 769732 - DNA, 25 bp, Mus musculus
tagaaacctcaaacgtcagcctgtc

SEQ ID NO: 769733 - DNA, 25 bp, Mus musculus
tagaaacctcaatcgtcagcctgtc

SEQ ID NO: 769734 - DNA, 25 bp, Mus musculus
tagaaacctgccaactgatgccaac

SEQ ID NO: 769735 - DNA, 25 bp, Mus musculus
tagaaacctgcctactgatgccaac

SEQ ID NO: 769736 - DNA, 25 bp, Mus musculus
tagaaacctggacgccgccgcagga

SEQ ID NO: 769737 - DNA, 25 bp, Mus musculus
tagaaacctggaggccgccgcagga

SEQ ID NO: 769738 - DNA, 25 bp, Mus musculus
tagaaacctggtattagctccggct

SEQ ID NO: 769739 - DNA, 25 bp, Mus musculus
tagaaacctggttttagctccggct

SEQ ID NO: 769740 - DNA, 25 bp, Mus musculus
tagaaacctgtcatcatccagacca

SEQ ID NO: 769741 - DNA, 25 bp, Mus musculus
tagaaacctgtcttcatccagacca

SEQ ID NO: 769742 - DNA, 25 bp, Mus musculus
tagaaaccttaacctctcacggtgg

SEQ ID NO: 769743 - DNA, 25 bp, Mus musculus
tagaaaccttaagctctcacggtgg

SEQ ID NO: 769744 - DNA, 25 bp, Mus musculus
tagaaaccttgtaggtacacttggt

SEQ ID NO: 769745 - DNA, 25 bp, Mus musculus
tagaaaccttgtcactttgttcttt

SEQ ID NO: 769746 - DNA, 25 bp, Mus musculus
tagaaaccttgtgactttgttcttt

SEQ ID NO: 769747 - DNA, 25 bp, Mus musculus
tagaaaccttgttggtacacttggt

SEQ ID NO: 769748 - DNA, 25 bp, Mus musculus
tagaaacgagccctgccacatcatt

SEQ ID NO: 769749 - DNA, 25 bp, Mus musculus
tagaaacgagccgtgccacatcatt

SEQ ID NO: 769750 - DNA, 25 bp, Mus musculus
tagaaacggcatcgtttcctcgtct

SEQ ID NO: 769751 - DNA, 25 bp, Mus musculus
tagaaacggcatggtttcctcgtct

SEQ ID NO: 769752 - DNA, 25 bp, Mus musculus
tagaaactaatacgctgtacccacg

SEQ ID NO: 769753 - DNA, 25 bp, Mus musculus
tagaaactaataggctgtacccacg

SEQ ID NO: 769754 - DNA, 25 bp, Mus musculus
tagaaactattccttgggctgcaat

SEQ ID NO: 769755 - DNA, 25 bp, Mus musculus
tagaaactattcgttgggctgcaat

SEQ ID NO: 769756 - DNA, 25 bp, Mus musculus
tagaaactccctcaaatgctctttt

SEQ ID NO: 769757 - DNA, 25 bp, Mus musculus
tagaaactccctgaaatgctctttt

SEQ ID NO: 769758 - DNA, 25 bp, Mus musculus
tagaaactcgccatggaagccaacc

SEQ ID NO: 769759 - DNA, 25 bp, Mus musculus
tagaaactcgccttggaagccaacc

SEQ ID NO: 769760 - DNA, 25 bp, Mus musculus
tagaaactgctgaccgagcaagcca

SEQ ID NO: 769761 - DNA, 25 bp, Mus musculus
tagaaactgctgtccgagcaagcca

SEQ ID NO: 769762 - DNA, 25 bp, Mus musculus
tagaaactggttctgggttctggtt

SEQ ID NO: 769763 - DNA, 25 bp, Mus musculus
tagaaactggttgtgggttctggtt

SEQ ID NO: 769764 - DNA, 25 bp, Mus musculus
tagaaactgtgcaatgtgactcggg

SEQ ID NO: 769765 - DNA, 25 bp, Mus musculus
tagaaactgtgctatgtgactcggg

SEQ ID NO: 769766 - DNA, 25 bp, Mus musculus
tagaaacttgaaccctcctttggag

SEQ ID NO: 769767 - DNA, 25 bp, Mus musculus
tagaaacttgaagcctcctttggag

SEQ ID NO: 769768 - DNA, 25 bp, Mus musculus
tagaaacttgatccctaagcccaac

SEQ ID NO: 769769 - DNA, 25 bp, Mus musculus
tagaaacttgatgcctaagcccaac

SEQ ID NO: 769770 - DNA, 25 bp, Mus musculus
tagaaacttgtaacgctcagaagag

SEQ ID NO: 769771 - DNA, 25 bp, Mus musculus
tagaaacttgtatcgctcagaagag

SEQ ID NO: 769772 - DNA, 25 bp, Mus musculus
tagaaagaaatccaaggcttacaca

SEQ ID NO: 769773 - DNA, 25 bp, Mus musculus
tagaaagaaatcgaaggcttacaca

SEQ ID NO: 769774 - DNA, 25 bp, Mus musculus
tagaaagaatgcatcgcctcagttt

SEQ ID NO: 769775 - DNA, 25 bp, Mus musculus
tagaaagaatgcttcgcctcagttt

SEQ ID NO: 769776 - DNA, 25 bp, Mus musculus
tagaaagacagcctttgcttttggt

SEQ ID NO: 769777 - DNA, 25 bp, Mus musculus
tagaaagacagcgtttgcttttggt

SEQ ID NO: 769778 - DNA, 25 bp, Mus musculus
tagaaagactcactggttaccagta

SEQ ID NO: 769779 - DNA, 25 bp, Mus musculus
tagaaagactcagtggttaccagta

SEQ ID NO: 769780 - DNA, 25 bp, Mus musculus
tagaaagagcataccccacttgcag

SEQ ID NO: 769781 - DNA, 25 bp, Mus musculus
tagaaagagcattccccacttgcag

SEQ ID NO: 769782 - DNA, 25 bp, Mus musculus
tagaaagaggagatttgctttttca

SEQ ID NO: 769783 - DNA, 25 bp, Mus musculus
tagaaagaggagttttgctttttca

SEQ ID NO: 769784 - DNA, 25 bp, Mus musculus
tagaaagatcccaggactctgctgt

SEQ ID NO: 769785 - DNA, 25 bp, Mus musculus
tagaaagatccctggactctgctgt

SEQ ID NO: 769786 - DNA, 25 bp, Mus musculus
tagaaagatcgcagaggtcaccact

SEQ ID NO: 769787 - DNA, 25 bp, Mus musculus
tagaaagatcgctgaggtcaccact

SEQ ID NO: 769788 - DNA, 25 bp, Mus musculus
tagaaagatgtcagatgtcaacctc

SEQ ID NO: 769789 - DNA, 25 bp, Mus musculus
tagaaagatgtctgatgtcaacctc

SEQ ID NO: 769790 - DNA, 25 bp, Mus musculus
tagaaagcaccactacgtttaagtt

SEQ ID NO: 769791 - DNA, 25 bp, Mus musculus
tagaaagcaccagtacgtttaagtt

SEQ ID NO: 769792 - DNA, 25 bp, Mus musculus
tagaaagcactaaaatcccctgtta

SEQ ID NO: 769793 - DNA, 25 bp, Mus musculus
tagaaagcactataatcccctgtta

SEQ ID NO: 769794 - DNA, 25 bp, Mus musculus
tagaaagcagacaattaagcccggg

SEQ ID NO: 769795 - DNA, 25 bp, Mus musculus
tagaaagcagactattaagcccggg

SEQ ID NO: 769796 - DNA, 25 bp, Mus musculus
tagaaagcatacatcctgcccaaac

SEQ ID NO: 769797 - DNA, 25 bp, Mus musculus
tagaaagcatacttcctgcccaaac

SEQ ID NO: 769798 - DNA, 25 bp, Mus musculus
tagaaagccgctaaccagcatctgt

SEQ ID NO: 769799 - DNA, 25 bp, Mus musculus
tagaaagccgcttaccagcatctgt

SEQ ID NO: 769800 - DNA, 25 bp, Mus musculus
tagaaagcctacctgaacagctccc

SEQ ID NO: 769801 - DNA, 25 bp, Mus musculus
tagaaagcctacgtgaacagctccc

SEQ ID NO: 769802 - DNA, 25 bp, Mus musculus
tagaaagcgctgaacactgagcctg

SEQ ID NO: 769803 - DNA, 25 bp, Mus musculus
tagaaagcgctgtacactgagcctg

SEQ ID NO: 769804 - DNA, 25 bp, Mus musculus
tagaaagctcaactgcaattgggca

SEQ ID NO: 769805 - DNA, 25 bp, Mus musculus
tagaaagctcaagtgcaattgggca

SEQ ID NO: 769806 - DNA, 25 bp, Mus musculus
tagaaagctccaagtgttctttaaa

SEQ ID NO: 769807 - DNA, 25 bp, Mus musculus
tagaaagctccatgtgttctttaaa

SEQ ID NO: 769808 - DNA, 25 bp, Mus musculus
tagaaagctgctatccctcaagctt

SEQ ID NO: 769809 - DNA, 25 bp, Mus musculus
tagaaagctgctttccctcaagctt

SEQ ID NO: 769810 - DNA, 25 bp, Mus musculus
tagaaagctggtacccttgcttcct

SEQ ID NO: 769811 - DNA, 25 bp, Mus musculus
tagaaagctggttcccttgcttcct

SEQ ID NO: 769812 - DNA, 25 bp, Mus musculus
tagaaagcttttcttcatgcaggct

SEQ ID NO: 769813 - DNA, 25 bp, Mus musculus
tagaaagcttttgttcatgcaggct

SEQ ID NO: 769814 - DNA, 25 bp, Mus musculus
tagaaaggacgcatgccttagccaa

SEQ ID NO: 769815 - DNA, 25 bp, Mus musculus
tagaaaggacgcttgccttagccaa

SEQ ID NO: 769816 - DNA, 25 bp, Mus musculus
tagaaaggatcaaggtcaggacgac

SEQ ID NO: 769817 - DNA, 25 bp, Mus musculus
tagaaaggatcatggtcaggacgac

SEQ ID NO: 769818 - DNA, 25 bp, Mus musculus
tagaaaggcccaatcagtttgcgct

SEQ ID NO: 769819 - DNA, 25 bp, Mus musculus
tagaaaggcccattcagtttgcgct

SEQ ID NO: 769820 - DNA, 25 bp, Mus musculus
tagaaaggcctcctccttgaaggga

SEQ ID NO: 769821 - DNA, 25 bp, Mus musculus
tagaaaggcctcgtccttgaaggga

SEQ ID NO: 769822 - DNA, 25 bp, Mus musculus
tagaaaggctacacacaatggctac

SEQ ID NO: 769823 - DNA, 25 bp, Mus musculus
tagaaaggctactcacaatggctac

SEQ ID NO: 769824 - DNA, 25 bp, Mus musculus
tagaaaggctggctgtcctgcccct

SEQ ID NO: 769825 - DNA, 25 bp, Mus musculus
tagaaaggctgggtgtcctgcccct

SEQ ID NO: 769826 - DNA, 25 bp, Mus musculus
tagaaaggctttcggtggctgtcca

SEQ ID NO: 769827 - DNA, 25 bp, Mus musculus
tagaaaggctttgggtggctgtcca

SEQ ID NO: 769828 - DNA, 25 bp, Mus musculus
tagaaagtccccattcaaggccagg

SEQ ID NO: 769829 - DNA, 25 bp, Mus musculus
tagaaagtcccctttcaaggccagg

SEQ ID NO: 769830 - DNA, 25 bp, Mus musculus
tagaaagtccttccatgggcttttt

SEQ ID NO: 769831 - DNA, 25 bp, Mus musculus
tagaaagtccttgcatgggcttttt

SEQ ID NO: 769832 - DNA, 25 bp, Mus musculus
tagaaagtcgagctctcagttccaa

SEQ ID NO: 769833 - DNA, 25 bp, Mus musculus
tagaaagtcgaggtctcagttccaa

SEQ ID NO: 769834 - DNA, 25 bp, Mus musculus
tagaaagtctatctcctacgttacc

SEQ ID NO: 769835 - DNA, 25 bp, Mus musculus
tagaaagtctatgtcctacgttacc

SEQ ID NO: 769836 - DNA, 25 bp, Mus musculus
tagaaagttttgctgcccaagaaaa

SEQ ID NO: 769837 - DNA, 25 bp, Mus musculus
tagaaagttttggtgcccaagaaaa

SEQ ID NO: 769838 - DNA, 25 bp, Mus musculus
tagaaatacaagctcctcctggtgt

SEQ ID NO: 769839 - DNA, 25 bp, Mus musculus
tagaaatacaaggtcctcctggtgt

SEQ ID NO: 769840 - DNA, 25 bp, Mus musculus
tagaaataccgacaacccaatgaga

SEQ ID NO: 769841 - DNA, 25 bp, Mus musculus
tagaaataccgagaacccaatgaga

SEQ ID NO: 769842 - DNA, 25 bp, Mus musculus
tagaaatagcttatctctctctcac

SEQ ID NO: 769843 - DNA, 25 bp, Mus musculus
tagaaatagcttttctctctctcac

SEQ ID NO: 769844 - DNA, 25 bp, Mus musculus
tagaaatagtcacggcactctgctc

SEQ ID NO: 769845 - DNA, 25 bp, Mus musculus
tagaaatagtcagggcactctgctc

SEQ ID NO: 769846 - DNA, 25 bp, Mus musculus
tagaaatagtttcttctgaagactg

SEQ ID NO: 769847 - DNA, 25 bp, Mus musculus
tagaaatagtttgttctgaagactg

SEQ ID NO: 769848 - DNA, 25 bp, Mus musculus
tagaaatatcttagaggctcccagt

SEQ ID NO: 769849 - DNA, 25 bp, Mus musculus
tagaaatatctttgaggctcccagt

SEQ ID NO: 769850 - DNA, 25 bp, Mus musculus
tagaaatcatttcatggccgggcag

SEQ ID NO: 769851 - DNA, 25 bp, Mus musculus
tagaaatcatttgatggccgggcag

SEQ ID NO: 769852 - DNA, 25 bp, Mus musculus
tagaaatccaacagaggttgtcact

SEQ ID NO: 769853 - DNA, 25 bp, Mus musculus
tagaaatccaactgaggttgtcact

SEQ ID NO: 769854 - DNA, 25 bp, Mus musculus
tagaaatcctgaaagcccatctcgg

SEQ ID NO: 769855 - DNA, 25 bp, Mus musculus
tagaaatcctgatagcccatctcgg

SEQ ID NO: 769856 - DNA, 25 bp, Mus musculus
tagaaatccttaactgtaccctctc

SEQ ID NO: 769857 - DNA, 25 bp, Mus musculus
tagaaatccttatctgtaccctctc

SEQ ID NO: 769858 - DNA, 25 bp, Mus musculus
tagaaatcggagctgtggatgctct

SEQ ID NO: 769859 - DNA, 25 bp, Mus musculus
tagaaatcggaggtgtggatgctct

SEQ ID NO: 769860 - DNA, 25 bp, Mus musculus
tagaaatcggtgctgagctctgact

SEQ ID NO: 769861 - DNA, 25 bp, Mus musculus
tagaaatcggtggtgagctctgact

SEQ ID NO: 769862 - DNA, 25 bp, Mus musculus
tagaaatctccaaagcccttaggta

SEQ ID NO: 769863 - DNA, 25 bp, Mus musculus
tagaaatctccatagcccttaggta

SEQ ID NO: 769864 - DNA, 25 bp, Mus musculus
tagaaatctcttcccctgaacagtc

SEQ ID NO: 769865 - DNA, 25 bp, Mus musculus
tagaaatctcttgccctgaacagtc

SEQ ID NO: 769866 - DNA, 25 bp, Mus musculus
tagaaatgaaggcagtcccagcccc

SEQ ID NO: 769867 - DNA, 25 bp, Mus musculus
tagaaatgaagggagtcccagcccc

SEQ ID NO: 769868 - DNA, 25 bp, Mus musculus
tagaaatgacaaaccctagagctgg

SEQ ID NO: 769869 - DNA, 25 bp, Mus musculus
tagaaatgacaatccctagagctgg

SEQ ID NO: 769870 - DNA, 25 bp, Mus musculus
tagaaatgcccacaagctcggcctg

SEQ ID NO: 769871 - DNA, 25 bp, Mus musculus
tagaaatgcccagaagctcggcctg

SEQ ID NO: 769872 - DNA, 25 bp, Mus musculus
tagaaatgctaactcccagccattg

SEQ ID NO: 769873 - DNA, 25 bp, Mus musculus
tagaaatgctaagtcccagccattg

SEQ ID NO: 769874 - DNA, 25 bp, Mus musculus
tagaaatgctcgatcctcacatgga

SEQ ID NO: 769875 - DNA, 25 bp, Mus musculus
tagaaatgctcgttcctcacatgga

SEQ ID NO: 769876 - DNA, 25 bp, Mus musculus
tagaaatggccgagatgcgcaagca

SEQ ID NO: 769877 - DNA, 25 bp, Mus musculus
tagaaatggccgtgatgcgcaagca

SEQ ID NO: 769878 - DNA, 25 bp, Mus musculus
tagaaatgtcagatgctgcgtcccc

SEQ ID NO: 769879 - DNA, 25 bp, Mus musculus
tagaaatgtcagttgctgcgtcccc

SEQ ID NO: 769880 - DNA, 25 bp, Mus musculus
tagaaatgtgctaatcgggctggtg

SEQ ID NO: 769881 - DNA, 25 bp, Mus musculus
tagaaatgtgcttatcgggctggtg

SEQ ID NO: 769882 - DNA, 25 bp, Mus musculus
tagaaattcagtcccttgcactatc

SEQ ID NO: 769883 - DNA, 25 bp, Mus musculus
tagaaattcagtcctctgaggcagg

SEQ ID NO: 769884 - DNA, 25 bp, Mus musculus
tagaaattcagtgccttgcactatc

SEQ ID NO: 769885 - DNA, 25 bp, Mus musculus
tagaaattcagtgctctgaggcagg

SEQ ID NO: 769886 - DNA, 25 bp, Mus musculus
tagaaattcattaagggtccagttg

SEQ ID NO: 769887 - DNA, 25 bp, Mus musculus
tagaaattcatttagggtccagttg

SEQ ID NO: 769888 - DNA, 25 bp, Mus musculus
tagaaattcccaatccctctgcagt

SEQ ID NO: 769889 - DNA, 25 bp, Mus musculus
tagaaattcccattccctctgcagt

SEQ ID NO: 769890 - DNA, 25 bp, Mus musculus
tagaaattgatcctttattctaggc

SEQ ID NO: 769891 - DNA, 25 bp, Mus musculus
tagaaattgatcgtttattctaggc

SEQ ID NO: 769892 - DNA, 25 bp, Mus musculus
tagaaatttcccagcacggcgctga

SEQ ID NO: 769893 - DNA, 25 bp, Mus musculus
tagaaatttccctgcacggcgctga

SEQ ID NO: 769894 - DNA, 25 bp, Mus musculus
tagaaatttctcatacccgttgcag

SEQ ID NO: 769895 - DNA, 25 bp, Mus musculus
tagaaatttctcttacccgttgcag

SEQ ID NO: 769896 - DNA, 25 bp, Mus musculus
tagaacaaatgtatttcgtggttgt

SEQ ID NO: 769897 - DNA, 25 bp, Mus musculus
tagaacaaatgtttttcgtggttgt

SEQ ID NO: 769898 - DNA, 25 bp, Mus musculus
tagaacaagccaagccagagaattt

SEQ ID NO: 769899 - DNA, 25 bp, Mus musculus
tagaacaagccatgccagagaattt

SEQ ID NO: 769900 - DNA, 25 bp, Mus musculus
tagaacacagctccgagccaccgga

SEQ ID NO: 769901 - DNA, 25 bp, Mus musculus
tagaacacagctgcgagccaccgga

SEQ ID NO: 769902 - DNA, 25 bp, Mus musculus
tagaacacaggcaccctcatattta

SEQ ID NO: 769903 - DNA, 25 bp, Mus musculus
tagaacacaggctccctcatattta

SEQ ID NO: 769904 - DNA, 25 bp, Mus musculus
tagaacacatgaactctctacagag

SEQ ID NO: 769905 - DNA, 25 bp, Mus musculus
tagaacacatgatctctctacagag

SEQ ID NO: 769906 - DNA, 25 bp, Mus musculus
tagaacaccagcaaaggaaccaaga

SEQ ID NO: 769907 - DNA, 25 bp, Mus musculus
tagaacaccagctaaggaaccaaga

SEQ ID NO: 769908 - DNA, 25 bp, Mus musculus
tagaacacttcgcaggacctcaagg

SEQ ID NO: 769909 - DNA, 25 bp, Mus musculus
tagaacacttcggaggacctcaagg

SEQ ID NO: 769910 - DNA, 25 bp, Mus musculus
tagaacacttggagctgcgcttgat

SEQ ID NO: 769911 - DNA, 25 bp, Mus musculus
tagaacacttggtgctgcgcttgat

SEQ ID NO: 769912 - DNA, 25 bp, Mus musculus
tagaacagaaccaagctgtcaacgt

SEQ ID NO: 769913 - DNA, 25 bp, Mus musculus
tagaacagaacctagctgtcaacgt

SEQ ID NO: 769914 - DNA, 25 bp, Mus musculus
tagaacaggctactcgctgcactaa

SEQ ID NO: 769915 - DNA, 25 bp, Mus musculus
tagaacaggctagtcgctgcactaa

SEQ ID NO: 769916 - DNA, 25 bp, Mus musculus
tagaacaggtctctagtcacagtac

SEQ ID NO: 769917 - DNA, 25 bp, Mus musculus
tagaacaggtctgtagtcacagtac

SEQ ID NO: 769918 - DNA, 25 bp, Mus musculus
tagaacagtcagaatcacctcttga

SEQ ID NO: 769919 - DNA, 25 bp, Mus musculus
tagaacagtcagtatcacctcttga

SEQ ID NO: 769920 - DNA, 25 bp, Mus musculus
tagaacagttttctcttctcagcct

SEQ ID NO: 769921 - DNA, 25 bp, Mus musculus
tagaacagttttgtcttctcagcct

SEQ ID NO: 769922 - DNA, 25 bp, Mus musculus
tagaacataaagaccctgaccccaa

SEQ ID NO: 769923 - DNA, 25 bp, Mus musculus
tagaacataaagtccctgaccccaa

SEQ ID NO: 769924 - DNA, 25 bp, Mus musculus
tagaacatacatctcctggttggaa

SEQ ID NO: 769925 - DNA, 25 bp, Mus musculus
tagaacatacatgtcctggttggaa

SEQ ID NO: 769926 - DNA, 25 bp, Mus musculus
tagaacatagcaatcctcctgggct

SEQ ID NO: 769927 - DNA, 25 bp, Mus musculus
tagaacatagcattcctcctgggct

SEQ ID NO: 769928 - DNA, 25 bp, Mus musculus
tagaacatctttaacccaagagcag

SEQ ID NO: 769929 - DNA, 25 bp, Mus musculus
tagaacatcttttacccaagagcag

SEQ ID NO: 769930 - DNA, 25 bp, Mus musculus
tagaacatgagaccgtcacctgctt

SEQ ID NO: 769931 - DNA, 25 bp, Mus musculus
tagaacatgagagcgtcacctgctt

SEQ ID NO: 769932 - DNA, 25 bp, Mus musculus
tagaacatgagcaagcttcccagcc

SEQ ID NO: 769933 - DNA, 25 bp, Mus musculus
tagaacatgagctagcttcccagcc

SEQ ID NO: 769934 - DNA, 25 bp, Mus musculus
tagaacattctaatctgagatcaga

SEQ ID NO: 769935 - DNA, 25 bp, Mus musculus
tagaacattctattctgagatcaga

SEQ ID NO: 769936 - DNA, 25 bp, Mus musculus
tagaacattgcccataccctagaca

SEQ ID NO: 769937 - DNA, 25 bp, Mus musculus
tagaacattgccgataccctagaca

SEQ ID NO: 769938 - DNA, 25 bp, Mus musculus
tagaacattgctagccatactggcc

SEQ ID NO: 769939 - DNA, 25 bp, Mus musculus
tagaacattgcttgccatactggcc

SEQ ID NO: 769940 - DNA, 25 bp, Mus musculus
tagaaccaacctcggtgtgtaccta

SEQ ID NO: 769941 - DNA, 25 bp, Mus musculus
tagaaccaacctgggtgtgtaccta

SEQ ID NO: 769942 - DNA, 25 bp, Mus musculus
tagaaccaactcaagcatcatgctt

SEQ ID NO: 769943 - DNA, 25 bp, Mus musculus
tagaaccaactctagcatcatgctt

SEQ ID NO: 769944 - DNA, 25 bp, Mus musculus
tagaaccaagacattcctatgtatg

SEQ ID NO: 769945 - DNA, 25 bp, Mus musculus
tagaaccaagacctcggcatggcac

SEQ ID NO: 769946 - DNA, 25 bp, Mus musculus
tagaaccaagacgtcggcatggcac

SEQ ID NO: 769947 - DNA, 25 bp, Mus musculus
tagaaccaagactttcctatgtatg

SEQ ID NO: 769948 - DNA, 25 bp, Mus musculus
tagaaccactccagttcccgaagaa

SEQ ID NO: 769949 - DNA, 25 bp, Mus musculus
tagaaccactcctgttcccgaagaa

SEQ ID NO: 769950 - DNA, 25 bp, Mus musculus
tagaaccactttcgtttaccctctg

SEQ ID NO: 769951 - DNA, 25 bp, Mus musculus
tagaaccactttggtttaccctctg

SEQ ID NO: 769952 - DNA, 25 bp, Mus musculus
tagaaccagactaacctatagcccc

SEQ ID NO: 769953 - DNA, 25 bp, Mus musculus
tagaaccagacttacctatagcccc

SEQ ID NO: 769954 - DNA, 25 bp, Mus musculus
tagaaccagccaagcaagccatgtc

SEQ ID NO: 769955 - DNA, 25 bp, Mus musculus
tagaaccagccatgcaagccatgtc

SEQ ID NO: 769956 - DNA, 25 bp, Mus musculus
tagaaccagcttaggagtcagacct

SEQ ID NO: 769957 - DNA, 25 bp, Mus musculus
tagaaccagctttggagtcagacct

SEQ ID NO: 769958 - DNA, 25 bp, Mus musculus
tagaaccaggttctggtcctgtcgt

SEQ ID NO: 769959 - DNA, 25 bp, Mus musculus
tagaaccaggttgtggtcctgtcgt

SEQ ID NO: 769960 - DNA, 25 bp, Mus musculus
tagaaccagttccagccggcagtga

SEQ ID NO: 769961 - DNA, 25 bp, Mus musculus
tagaaccagttcgagccggcagtga

SEQ ID NO: 769962 - DNA, 25 bp, Mus musculus
tagaaccatgcgaaccctcatagtt

SEQ ID NO: 769963 - DNA, 25 bp, Mus musculus
tagaaccatgcgtaccctcatagtt

SEQ ID NO: 769964 - DNA, 25 bp, Mus musculus
tagaaccatggaagtcctcaacctc

SEQ ID NO: 769965 - DNA, 25 bp, Mus musculus
tagaaccatggatgtcctcaacctc

SEQ ID NO: 769966 - DNA, 25 bp, Mus musculus
tagaaccatgttcactgcttcacag

SEQ ID NO: 769967 - DNA, 25 bp, Mus musculus
tagaaccatgttgactgcttcacag

SEQ ID NO: 769968 - DNA, 25 bp, Mus musculus
tagaacccaggaacaccatcacagg

SEQ ID NO: 769969 - DNA, 25 bp, Mus musculus
tagaacccaggatcaccatcacagg

SEQ ID NO: 769970 - DNA, 25 bp, Mus musculus
tagaacccggacatacctccaggcg

SEQ ID NO: 769971 - DNA, 25 bp, Mus musculus
tagaacccggacttacctccaggcg

SEQ ID NO: 769972 - DNA, 25 bp, Mus musculus
tagaaccctcccactggtggagttc

SEQ ID NO: 769973 - DNA, 25 bp, Mus musculus
tagaaccctccctctggtggagttc

SEQ ID NO: 769974 - DNA, 25 bp, Mus musculus
tagaaccctttgaaagaactccctg

SEQ ID NO: 769975 - DNA, 25 bp, Mus musculus
tagaaccctttgtaagaactccctg

SEQ ID NO: 769976 - DNA, 25 bp, Mus musculus
tagaaccgctgcagacaggtgtctg

SEQ ID NO: 769977 - DNA, 25 bp, Mus musculus
tagaaccgctgctgacaggtgtctg

SEQ ID NO: 769978 - DNA, 25 bp, Mus musculus
tagaaccgggacactgaggcctggt

SEQ ID NO: 769979 - DNA, 25 bp, Mus musculus
tagaaccgggactctgaggcctggt

SEQ ID NO: 769980 - DNA, 25 bp, Mus musculus
tagaaccgtgaacccgagcaccagg

SEQ ID NO: 769981 - DNA, 25 bp, Mus musculus
tagaaccgtgaagccgagcaccagg

SEQ ID NO: 769982 - DNA, 25 bp, Mus musculus
tagaacctcagcaattatccacatc

SEQ ID NO: 769983 - DNA, 25 bp, Mus musculus
tagaacctcagctattatccacatc

SEQ ID NO: 769984 - DNA, 25 bp, Mus musculus
tagaacctgccgagttatcgagctt

SEQ ID NO: 769985 - DNA, 25 bp, Mus musculus
tagaacctgccgtgttatcgagctt

SEQ ID NO: 769986 - DNA, 25 bp, Mus musculus
tagaacctgctccttggttagcttt

SEQ ID NO: 769987 - DNA, 25 bp, Mus musculus
tagaacctgctcgttggttagcttt

SEQ ID NO: 769988 - DNA, 25 bp, Mus musculus
tagaacctgtggattcgaggccgct

SEQ ID NO: 769989 - DNA, 25 bp, Mus musculus
tagaacctgtggtttcgaggccgct

SEQ ID NO: 769990 - DNA, 25 bp, Mus musculus
tagaacctgttgaggctgcgtttcc

SEQ ID NO: 769991 - DNA, 25 bp, Mus musculus
tagaacctgttgtggctgcgtttcc

SEQ ID NO: 769992 - DNA, 25 bp, Mus musculus
tagaaccttaaacctcaaccaatga

SEQ ID NO: 769993 - DNA, 25 bp, Mus musculus
tagaaccttaaagctcaaccaatga

SEQ ID NO: 769994 - DNA, 25 bp, Mus musculus
tagaaccttgagcagtgagcaactc

SEQ ID NO: 769995 - DNA, 25 bp, Mus musculus
tagaaccttgaggagtgagcaactc

SEQ ID NO: 769996 - DNA, 25 bp, Mus musculus
tagaacctttctagagtgcactctt

SEQ ID NO: 769997 - DNA, 25 bp, Mus musculus
tagaacctttcttgagtgcactctt

SEQ ID NO: 769998 - DNA, 25 bp, Mus musculus
tagaacctttgcaaaacactcatgt

SEQ ID NO: 769999 - DNA, 25 bp, Mus musculus
tagaacctttgctaaacactcatgt

SEQ ID NO: 770000 - DNA, 25 bp, Mus musculus
tagaacgaaaggactcctgccctgc

SEQ ID NO: 770001 - DNA, 25 bp, Mus musculus
tagaacgaaaggtctcctgccctgc

SEQ ID NO: 770002 - DNA, 25 bp, Mus musculus
tagaacgaaggcacagcaggtttag

SEQ ID NO: 770003 - DNA, 25 bp, Mus musculus
tagaacgaaggctcagcaggtttag

SEQ ID NO: 770004 - DNA, 25 bp, Mus musculus
tagaacgacttcctgtgtcctcaga

SEQ ID NO: 770005 - DNA, 25 bp, Mus musculus
tagaacgacttcgtgtgtcctcaga

SEQ ID NO: 770006 - DNA, 25 bp, Mus musculus
tagaacgaggcacagatcgcacatt

SEQ ID NO: 770007 - DNA, 25 bp, Mus musculus
tagaacgaggcagagatcgcacatt

SEQ ID NO: 770008 - DNA, 25 bp, Mus musculus
tagaacgcttttagtgaccagtcac

SEQ ID NO: 770009 - DNA, 25 bp, Mus musculus
tagaacgctttttgtgaccagtcac

SEQ ID NO: 770010 - DNA, 25 bp, Mus musculus
tagaacggatcaccttcccgataca

SEQ ID NO: 770011 - DNA, 25 bp, Mus musculus
tagaacggatcagcttcccgataca

SEQ ID NO: 770012 - DNA, 25 bp, Mus musculus
tagaacggatgaagccagagagcca

SEQ ID NO: 770013 - DNA, 25 bp, Mus musculus
tagaacggatgatgccagagagcca

SEQ ID NO: 770014 - DNA, 25 bp, Mus musculus
tagaacgtgaacacgatgagggccg

SEQ ID NO: 770015 - DNA, 25 bp, Mus musculus
tagaacgtgaactcgatgagggccg

SEQ ID NO: 770016 - DNA, 25 bp, Mus musculus
tagaactaaaggacccatggccggg

SEQ ID NO: 770017 - DNA, 25 bp, Mus musculus
tagaactaaaggtcccatggccggg

SEQ ID NO: 770018 - DNA, 25 bp, Mus musculus
tagaactaaggcagcaggatctcca

SEQ ID NO: 770019 - DNA, 25 bp, Mus musculus
tagaactaaggctgcaggatctcca

SEQ ID NO: 770020 - DNA, 25 bp, Mus musculus
tagaactaccaaagcagctactttc

SEQ ID NO: 770021 - DNA, 25 bp, Mus musculus
tagaactaccaatgcagctactttc

SEQ ID NO: 770022 - DNA, 25 bp, Mus musculus
tagaactaccctactgagcactaag

SEQ ID NO: 770023 - DNA, 25 bp, Mus musculus
tagaactacccttctgagcactaag

SEQ ID NO: 770024 - DNA, 25 bp, Mus musculus
tagaactatattagctttgtgtcat

SEQ ID NO: 770025 - DNA, 25 bp, Mus musculus
tagaactatatttgctttgtgtcat

SEQ ID NO: 770026 - DNA, 25 bp, Mus musculus
tagaactatcaaagtccacactccc

SEQ ID NO: 770027 - DNA, 25 bp, Mus musculus
tagaactatcaatgtccacactccc

SEQ ID NO: 770028 - DNA, 25 bp, Mus musculus
tagaactatgtcactctgcttttcc

SEQ ID NO: 770029 - DNA, 25 bp, Mus musculus
tagaactatgtctctctgcttttcc

SEQ ID NO: 770030 - DNA, 25 bp, Mus musculus
tagaactcaataacacttctgtgaa

SEQ ID NO: 770031 - DNA, 25 bp, Mus musculus
tagaactcaatatcacttctgtgaa

SEQ ID NO: 770032 - DNA, 25 bp, Mus musculus
tagaactcacggaacgcagtctcct

SEQ ID NO: 770033 - DNA, 25 bp, Mus musculus
tagaactcacggtacgcagtctcct

SEQ ID NO: 770034 - DNA, 25 bp, Mus musculus
tagaactcactacggtgaccaggat

SEQ ID NO: 770035 - DNA, 25 bp, Mus musculus
tagaactcactagggtgaccaggat

SEQ ID NO: 770036 - DNA, 25 bp, Mus musculus
tagaactcagggaagcagcagggca

SEQ ID NO: 770037 - DNA, 25 bp, Mus musculus
tagaactcagggtagcagcagggca

SEQ ID NO: 770038 - DNA, 25 bp, Mus musculus
tagaactcaggtatcctgcctccca

SEQ ID NO: 770039 - DNA, 25 bp, Mus musculus
tagaactcaggtttcctgcctccca

SEQ ID NO: 770040 - DNA, 25 bp, Mus musculus
tagaactcagtgaggtgttcttctc

SEQ ID NO: 770041 - DNA, 25 bp, Mus musculus
tagaactcagtgtggtgttcttctc

SEQ ID NO: 770042 - DNA, 25 bp, Mus musculus
tagaactcatataatcagcccaccc

SEQ ID NO: 770043 - DNA, 25 bp, Mus musculus
tagaactcatattatcagcccaccc

SEQ ID NO: 770044 - DNA, 25 bp, Mus musculus
tagaactccgtcatttcagttggtt

SEQ ID NO: 770045 - DNA, 25 bp, Mus musculus
tagaactccgtcttttcagttggtt

SEQ ID NO: 770046 - DNA, 25 bp, Mus musculus
tagaactctaaacttaagctaatag

SEQ ID NO: 770047 - DNA, 25 bp, Mus musculus
tagaactctaaagttaagctaatag

SEQ ID NO: 770048 - DNA, 25 bp, Mus musculus
tagaactctaggctcctccatggtg

SEQ ID NO: 770049 - DNA, 25 bp, Mus musculus
tagaactctagggtcctccatggtg

SEQ ID NO: 770050 - DNA, 25 bp, Mus musculus
tagaactcttacctcctttggcacc

SEQ ID NO: 770051 - DNA, 25 bp, Mus musculus
tagaactcttacgtcctttggcacc

SEQ ID NO: 770052 - DNA, 25 bp, Mus musculus
tagaactgactgaccctttgggccc

SEQ ID NO: 770053 - DNA, 25 bp, Mus musculus
tagaactgactgtccctttgggccc

SEQ ID NO: 770054 - DNA, 25 bp, Mus musculus
tagaactgatgtccacacagcctca

SEQ ID NO: 770055 - DNA, 25 bp, Mus musculus
tagaactgatgtgcacacagcctca

SEQ ID NO: 770056 - DNA, 25 bp, Mus musculus
tagaactgccaaacatcgccagatc

SEQ ID NO: 770057 - DNA, 25 bp, Mus musculus
tagaactgccaaacccataccgtgc

SEQ ID NO: 770058 - DNA, 25 bp, Mus musculus
tagaactgccaatcatcgccagatc

SEQ ID NO: 770059 - DNA, 25 bp, Mus musculus
tagaactgccaatcccataccgtgc

SEQ ID NO: 770060 - DNA, 25 bp, Mus musculus
tagaactgctggacagtcggcggtc

SEQ ID NO: 770061 - DNA, 25 bp, Mus musculus
tagaactgctggtcagtcggcggtc

SEQ ID NO: 770062 - DNA, 25 bp, Mus musculus
tagaactggaacagcagcttcgaga

SEQ ID NO: 770063 - DNA, 25 bp, Mus musculus
tagaactggaactgcagcttcgaga

SEQ ID NO: 770064 - DNA, 25 bp, Mus musculus
tagaactggagacgcctgttgtgac

SEQ ID NO: 770065 - DNA, 25 bp, Mus musculus
tagaactggagaggcctgttgtgac

SEQ ID NO: 770066 - DNA, 25 bp, Mus musculus
tagaactgtggaagggccccagcac

SEQ ID NO: 770067 - DNA, 25 bp, Mus musculus
tagaactgtggatgggccccagcac

SEQ ID NO: 770068 - DNA, 25 bp, Mus musculus
tagaacttacacattgccgtgcacg

SEQ ID NO: 770069 - DNA, 25 bp, Mus musculus
tagaacttacactttgccgtgcacg

SEQ ID NO: 770070 - DNA, 25 bp, Mus musculus
tagaacttactgagtgtccctttgc

SEQ ID NO: 770071 - DNA, 25 bp, Mus musculus
tagaacttactgtgtgtccctttgc

SEQ ID NO: 770072 - DNA, 25 bp, Mus musculus
tagaacttagaacgtcagccctcgg

SEQ ID NO: 770073 - DNA, 25 bp, Mus musculus
tagaacttagaaggtcagccctcgg

SEQ ID NO: 770074 - DNA, 25 bp, Mus musculus
tagaacttatagaatgcaggcccat

SEQ ID NO: 770075 - DNA, 25 bp, Mus musculus
tagaacttatagtatgcaggcccat

SEQ ID NO: 770076 - DNA, 25 bp, Mus musculus
tagaacttcaaaaccctatcaaagg

SEQ ID NO: 770077 - DNA, 25 bp, Mus musculus
tagaacttcaaatccctatcaaagg

SEQ ID NO: 770078 - DNA, 25 bp, Mus musculus
tagaacttcaccctgggagtctatt

SEQ ID NO: 770079 - DNA, 25 bp, Mus musculus
tagaacttcaccgtgggagtctatt

SEQ ID NO: 770080 - DNA, 25 bp, Mus musculus
tagaacttccaactccatctcccgg

SEQ ID NO: 770081 - DNA, 25 bp, Mus musculus
tagaacttccaagtccatctcccgg

SEQ ID NO: 770082 - DNA, 25 bp, Mus musculus
tagaacttctagcagtgttcctcta

SEQ ID NO: 770083 - DNA, 25 bp, Mus musculus
tagaacttctaggagtgttcctcta

SEQ ID NO: 770084 - DNA, 25 bp, Mus musculus
tagaacttgcggagtctttcagaat

SEQ ID NO: 770085 - DNA, 25 bp, Mus musculus
tagaacttgcggtgtctttcagaat

SEQ ID NO: 770086 - DNA, 25 bp, Mus musculus
tagaactttccgctagccaagctgg

SEQ ID NO: 770087 - DNA, 25 bp, Mus musculus
tagaactttccggtagccaagctgg

SEQ ID NO: 770088 - DNA, 25 bp, Mus musculus
tagaactttgcccaccaggaacatg

SEQ ID NO: 770089 - DNA, 25 bp, Mus musculus
tagaactttgccgaccaggaacatg

SEQ ID NO: 770090 - DNA, 25 bp, Mus musculus
tagaactttggcaacctgataaaat

SEQ ID NO: 770091 - DNA, 25 bp, Mus musculus
tagaactttggctacctgataaaat

SEQ ID NO: 770092 - DNA, 25 bp, Mus musculus
tagaactttgttaccaacctcacag

SEQ ID NO: 770093 - DNA, 25 bp, Mus musculus
tagaactttgtttccaacctcacag

SEQ ID NO: 770094 - DNA, 25 bp, Mus musculus
tagaagaaaaccatgcccgaagcgc

SEQ ID NO: 770095 - DNA, 25 bp, Mus musculus
tagaagaaaaccttgcccgaagcgc

SEQ ID NO: 770096 - DNA, 25 bp, Mus musculus
tagaagaaacccagagacacactct

SEQ ID NO: 770097 - DNA, 25 bp, Mus musculus
tagaagaaaccctgagacacactct

SEQ ID NO: 770098 - DNA, 25 bp, Mus musculus
tagaagaaatttactctaacctatc

SEQ ID NO: 770099 - DNA, 25 bp, Mus musculus
tagaagaaattttctctaacctatc

SEQ ID NO: 770100 - DNA, 25 bp, Mus musculus
tagaagaacactacatcggtattct

SEQ ID NO: 770101 - DNA, 25 bp, Mus musculus
tagaagaacacttcatcggtattct

SEQ ID NO: 770102 - DNA, 25 bp, Mus musculus
tagaagaacatcagtctgtggcaat

SEQ ID NO: 770103 - DNA, 25 bp, Mus musculus
tagaagaacatctgtctgtggcaat

SEQ ID NO: 770104 - DNA, 25 bp, Mus musculus
tagaagaacatgaaagggcttaaat

SEQ ID NO: 770105 - DNA, 25 bp, Mus musculus
tagaagaacatgtaagggcttaaat

SEQ ID NO: 770106 - DNA, 25 bp, Mus musculus
tagaagaaccaaacagttaccgcca

SEQ ID NO: 770107 - DNA, 25 bp, Mus musculus
tagaagaaccaatcagttaccgcca

SEQ ID NO: 770108 - DNA, 25 bp, Mus musculus
tagaagacaactccgtacctcaggt

SEQ ID NO: 770109 - DNA, 25 bp, Mus musculus
tagaagacaactgcgtacctcaggt

SEQ ID NO: 770110 - DNA, 25 bp, Mus musculus
tagaagacaataagacattttgggt

SEQ ID NO: 770111 - DNA, 25 bp, Mus musculus
tagaagacaatatgacattttgggt

SEQ ID NO: 770112 - DNA, 25 bp, Mus musculus
tagaagacagcgacgtgtgcagatg

SEQ ID NO: 770113 - DNA, 25 bp, Mus musculus
tagaagacagcgtcgtgtgcagatg

SEQ ID NO: 770114 - DNA, 25 bp, Mus musculus
tagaagaccaccagtcccagacaaa

SEQ ID NO: 770115 - DNA, 25 bp, Mus musculus
tagaagaccacctgtcccagacaaa

SEQ ID NO: 770116 - DNA, 25 bp, Mus musculus
tagaagaccatgagagaggccaaaa

SEQ ID NO: 770117 - DNA, 25 bp, Mus musculus
tagaagaccatgtgagaggccaaaa

SEQ ID NO: 770118 - DNA, 25 bp, Mus musculus
tagaagacgaccacagggcagagct

SEQ ID NO: 770119 - DNA, 25 bp, Mus musculus
tagaagacgacctcagggcagagct

SEQ ID NO: 770120 - DNA, 25 bp, Mus musculus
tagaagacgcacctaaaccctgtgt

SEQ ID NO: 770121 - DNA, 25 bp, Mus musculus
tagaagacgcacgtaaaccctgtgt

SEQ ID NO: 770122 - DNA, 25 bp, Mus musculus
tagaagactggactctgcccagggt

SEQ ID NO: 770123 - DNA, 25 bp, Mus musculus
tagaagactggagtctgcccagggt

SEQ ID NO: 770124 - DNA, 25 bp, Mus musculus
tagaagacttgaccggtcttaccct

SEQ ID NO: 770125 - DNA, 25 bp, Mus musculus
tagaagacttgagcggtcttaccct

SEQ ID NO: 770126 - DNA, 25 bp, Mus musculus
tagaagacttgtacctgacctctac

SEQ ID NO: 770127 - DNA, 25 bp, Mus musculus
tagaagacttgttcctgacctctac

SEQ ID NO: 770128 - DNA, 25 bp, Mus musculus
tagaagagagaactaggtcccctag

SEQ ID NO: 770129 - DNA, 25 bp, Mus musculus
tagaagagagaagtaggtcccctag

SEQ ID NO: 770130 - DNA, 25 bp, Mus musculus
tagaagagccatcctgacgtctgaa

SEQ ID NO: 770131 - DNA, 25 bp, Mus musculus
tagaagagccatgctgacgtctgaa

SEQ ID NO: 770132 - DNA, 25 bp, Mus musculus
tagaagagcccaactgtggacctat

SEQ ID NO: 770133 - DNA, 25 bp, Mus musculus
tagaagagcccatctgtggacctat

SEQ ID NO: 770134 - DNA, 25 bp, Mus musculus
tagaagagctttcgctggcccagac

SEQ ID NO: 770135 - DNA, 25 bp, Mus musculus
tagaagagctttggctggcccagac

SEQ ID NO: 770136 - DNA, 25 bp, Mus musculus
tagaagaggataccatggacattac

SEQ ID NO: 770137 - DNA, 25 bp, Mus musculus
tagaagaggatagcatggacattac

SEQ ID NO: 770138 - DNA, 25 bp, Mus musculus
tagaagaggattctttccggacaaa

SEQ ID NO: 770139 - DNA, 25 bp, Mus musculus
tagaagaggattgtttccggacaaa

SEQ ID NO: 770140 - DNA, 25 bp, Mus musculus
tagaagaggcaccacacacagggct

SEQ ID NO: 770141 - DNA, 25 bp, Mus musculus
tagaagaggcacgacacacagggct

SEQ ID NO: 770142 - DNA, 25 bp, Mus musculus
tagaagataaccagacttgtcatat

SEQ ID NO: 770143 - DNA, 25 bp, Mus musculus
tagaagataacctgacttgtcatat

SEQ ID NO: 770144 - DNA, 25 bp, Mus musculus
tagaagataagtcccatgtgctgtg

SEQ ID NO: 770145 - DNA, 25 bp, Mus musculus
tagaagataagtgccatgtgctgtg

SEQ ID NO: 770146 - DNA, 25 bp, Mus musculus
tagaagatacaaactgcccctcagg

SEQ ID NO: 770147 - DNA, 25 bp, Mus musculus
tagaagatacaatctgcccctcagg

SEQ ID NO: 770148 - DNA, 25 bp, Mus musculus
tagaagatagcactgcccaaccttt

SEQ ID NO: 770149 - DNA, 25 bp, Mus musculus
tagaagatagcagtgcccaaccttt

SEQ ID NO: 770150 - DNA, 25 bp, Mus musculus
tagaagatagctcctgccgagactt

SEQ ID NO: 770151 - DNA, 25 bp, Mus musculus
tagaagatagctgctgccgagactt

SEQ ID NO: 770152 - DNA, 25 bp, Mus musculus
tagaagatgggcatccctcgggcga

SEQ ID NO: 770153 - DNA, 25 bp, Mus musculus
tagaagatgggcttccctcgggcga

SEQ ID NO: 770154 - DNA, 25 bp, Mus musculus
tagaagatgtgccactgaccatgca

SEQ ID NO: 770155 - DNA, 25 bp, Mus musculus
tagaagatgtgcgactgaccatgca

SEQ ID NO: 770156 - DNA, 25 bp, Mus musculus
tagaagattccgaggccgctacaga

SEQ ID NO: 770157 - DNA, 25 bp, Mus musculus
tagaagattccgtggccgctacaga

SEQ ID NO: 770158 - DNA, 25 bp, Mus musculus
tagaagattgtaaatcacgtgaata

SEQ ID NO: 770159 - DNA, 25 bp, Mus musculus
tagaagattgtatatcacgtgaata

SEQ ID NO: 770160 - DNA, 25 bp, Mus musculus
tagaagatttttcgctgtgtcagaa

SEQ ID NO: 770161 - DNA, 25 bp, Mus musculus
tagaagatttttggctgtgtcagaa

SEQ ID NO: 770162 - DNA, 25 bp, Mus musculus
tagaagcaagttcatgtatcacaaa

SEQ ID NO: 770163 - DNA, 25 bp, Mus musculus
tagaagcaagttgatgtatcacaaa

SEQ ID NO: 770164 - DNA, 25 bp, Mus musculus
tagaagcaggcaacatccgggccaa

SEQ ID NO: 770165 - DNA, 25 bp, Mus musculus
tagaagcaggcatcatccgggccaa

SEQ ID NO: 770166 - DNA, 25 bp, Mus musculus
tagaagcatcacaaaaactgctgca

SEQ ID NO: 770167 - DNA, 25 bp, Mus musculus
tagaagcatcacactaactgatttc

SEQ ID NO: 770168 - DNA, 25 bp, Mus musculus
tagaagcatcactaaaactgctgca

SEQ ID NO: 770169 - DNA, 25 bp, Mus musculus
tagaagcatcactctaactgatttc

SEQ ID NO: 770170 - DNA, 25 bp, Mus musculus
tagaagccaatcacagaccttacca

SEQ ID NO: 770171 - DNA, 25 bp, Mus musculus
tagaagccaatctcagaccttacca

SEQ ID NO: 770172 - DNA, 25 bp, Mus musculus
tagaagccacgtatagactccttgt

SEQ ID NO: 770173 - DNA, 25 bp, Mus musculus
tagaagccacgtttagactccttgt

SEQ ID NO: 770174 - DNA, 25 bp, Mus musculus
tagaagccactcaaagtctcctgaa

SEQ ID NO: 770175 - DNA, 25 bp, Mus musculus
tagaagccactctaagtctcctgaa

SEQ ID NO: 770176 - DNA, 25 bp, Mus musculus
tagaagccagtcacacacccaagag

SEQ ID NO: 770177 - DNA, 25 bp, Mus musculus
tagaagccagtctcacacccaagag

SEQ ID NO: 770178 - DNA, 25 bp, Mus musculus
tagaagcccacaccattaaggccag

SEQ ID NO: 770179 - DNA, 25 bp, Mus musculus
tagaagcccacagcattaaggccag

SEQ ID NO: 770180 - DNA, 25 bp, Mus musculus
tagaagcccctgaaagatgctgaag

SEQ ID NO: 770181 - DNA, 25 bp, Mus musculus
tagaagcccctgtaagatgctgaag

SEQ ID NO: 770182 - DNA, 25 bp, Mus musculus
tagaagccgagcaccttcagataga

SEQ ID NO: 770183 - DNA, 25 bp, Mus musculus
tagaagccgagctccttcagataga

SEQ ID NO: 770184 - DNA, 25 bp, Mus musculus
tagaagccgcaaagacgtgccactt

SEQ ID NO: 770185 - DNA, 25 bp, Mus musculus
tagaagccgcaatgacgtgccactt

SEQ ID NO: 770186 - DNA, 25 bp, Mus musculus
tagaagccgggaatcttgttgggaa

SEQ ID NO: 770187 - DNA, 25 bp, Mus musculus
tagaagccgggattcttgttgggaa

SEQ ID NO: 770188 - DNA, 25 bp, Mus musculus
tagaagcctctgcttggataccaga

SEQ ID NO: 770189 - DNA, 25 bp, Mus musculus
tagaagcctctggttggataccaga

SEQ ID NO: 770190 - DNA, 25 bp, Mus musculus
tagaagcctgccatggctgctgcca

SEQ ID NO: 770191 - DNA, 25 bp, Mus musculus
tagaagcctgccttggctgctgcca

SEQ ID NO: 770192 - DNA, 25 bp, Mus musculus
tagaagcctgttctatcgcctgcaa

SEQ ID NO: 770193 - DNA, 25 bp, Mus musculus
tagaagcctgttgtatcgcctgcaa

SEQ ID NO: 770194 - DNA, 25 bp, Mus musculus
tagaagccttccaagctcttacgaa

SEQ ID NO: 770195 - DNA, 25 bp, Mus musculus
tagaagccttcctagctcttacgaa

SEQ ID NO: 770196 - DNA, 25 bp, Mus musculus
tagaagcgcatacgcatgactacat

SEQ ID NO: 770197 - DNA, 25 bp, Mus musculus
tagaagcgcataggcatgactacat

SEQ ID NO: 770198 - DNA, 25 bp, Mus musculus
tagaagctaattctcctctcagcag

SEQ ID NO: 770199 - DNA, 25 bp, Mus musculus
tagaagctaattgtcctctcagcag

SEQ ID NO: 770200 - DNA, 25 bp, Mus musculus
tagaagctcacactcagtctgaaag

SEQ ID NO: 770201 - DNA, 25 bp, Mus musculus
tagaagctcacagtcagtctgaaag

SEQ ID NO: 770202 - DNA, 25 bp, Mus musculus
tagaagctccatctacggttcctat

SEQ ID NO: 770203 - DNA, 25 bp, Mus musculus
tagaagctccatgtacggttcctat

SEQ ID NO: 770204 - DNA, 25 bp, Mus musculus
tagaagctctacaggattgctccca

SEQ ID NO: 770205 - DNA, 25 bp, Mus musculus
tagaagctctactggattgctccca

SEQ ID NO: 770206 - DNA, 25 bp, Mus musculus
tagaagctcttgattgccagcctaa

SEQ ID NO: 770207 - DNA, 25 bp, Mus musculus
tagaagctcttgtttgccagcctaa

SEQ ID NO: 770208 - DNA, 25 bp, Mus musculus
tagaagctgaggatcacccttccag

SEQ ID NO: 770209 - DNA, 25 bp, Mus musculus
tagaagctgaggttcacccttccag

SEQ ID NO: 770210 - DNA, 25 bp, Mus musculus
tagaagctgcccagctattgggaag

SEQ ID NO: 770211 - DNA, 25 bp, Mus musculus
tagaagctgccctgctattgggaag

SEQ ID NO: 770212 - DNA, 25 bp, Mus musculus
tagaagctgctaaagtgcgaataat

SEQ ID NO: 770213 - DNA, 25 bp, Mus musculus
tagaagctgctatagtgcgaataat

SEQ ID NO: 770214 - DNA, 25 bp, Mus musculus
tagaagcttctacctgtacatcagc

SEQ ID NO: 770215 - DNA, 25 bp, Mus musculus
tagaagcttctagctgtacatcagc

SEQ ID NO: 770216 - DNA, 25 bp, Mus musculus
tagaagcttctgaccaaaacaaact

SEQ ID NO: 770217 - DNA, 25 bp, Mus musculus
tagaagcttctgtccaaaacaaact

SEQ ID NO: 770218 - DNA, 25 bp, Mus musculus
tagaagcttgcacgcctagggtcaa

SEQ ID NO: 770219 - DNA, 25 bp, Mus musculus
tagaagcttgcaggcctagggtcaa

SEQ ID NO: 770220 - DNA, 25 bp, Mus musculus
tagaaggaagccaccctgttcgaaa

SEQ ID NO: 770221 - DNA, 25 bp, Mus musculus
tagaaggaagcctccctgttcgaaa

SEQ ID NO: 770222 - DNA, 25 bp, Mus musculus
tagaaggagcccagccttcctgttt

SEQ ID NO: 770223 - DNA, 25 bp, Mus musculus
tagaaggagccctgccttcctgttt

SEQ ID NO: 770224 - DNA, 25 bp, Mus musculus
tagaaggcacatacagcggacagga

SEQ ID NO: 770225 - DNA, 25 bp, Mus musculus
tagaaggcacattcagcggacagga

SEQ ID NO: 770226 - DNA, 25 bp, Mus musculus
tagaaggcagtcattctcccaagct

SEQ ID NO: 770227 - DNA, 25 bp, Mus musculus
tagaaggcagtctttctcccaagct

SEQ ID NO: 770228 - DNA, 25 bp, Mus musculus
tagaaggccagcacttgcttctcac

SEQ ID NO: 770229 - DNA, 25 bp, Mus musculus
tagaaggccagctcttgcttctcac

SEQ ID NO: 770230 - DNA, 25 bp, Mus musculus
tagaaggccaggcatctccttgaca

SEQ ID NO: 770231 - DNA, 25 bp, Mus musculus
tagaaggccagggatctccttgaca

SEQ ID NO: 770232 - DNA, 25 bp, Mus musculus
tagaaggccgcacctatgccgatta

SEQ ID NO: 770233 - DNA, 25 bp, Mus musculus
tagaaggccgcagctatgccgatta

SEQ ID NO: 770234 - DNA, 25 bp, Mus musculus
tagaaggctcatactattttgataa

SEQ ID NO: 770235 - DNA, 25 bp, Mus musculus
tagaaggctcattctattttgataa

SEQ ID NO: 770236 - DNA, 25 bp, Mus musculus
tagaaggctgccattgtcaagactt

SEQ ID NO: 770237 - DNA, 25 bp, Mus musculus
tagaaggctgcctttgtcaagactt

SEQ ID NO: 770238 - DNA, 25 bp, Mus musculus
tagaaggctggaccccaggcacaaa

SEQ ID NO: 770239 - DNA, 25 bp, Mus musculus
tagaaggctggagcccaggcacaaa

SEQ ID NO: 770240 - DNA, 25 bp, Mus musculus
tagaagggaccaccggccgaggcca

SEQ ID NO: 770241 - DNA, 25 bp, Mus musculus
tagaagggaccagcggccgaggcca

SEQ ID NO: 770242 - DNA, 25 bp, Mus musculus
tagaagggcccaatgtcactcagat

SEQ ID NO: 770243 - DNA, 25 bp, Mus musculus
tagaagggcccattgtcactcagat

SEQ ID NO: 770244 - DNA, 25 bp, Mus musculus
tagaaggtcaggaggtcacacggct

SEQ ID NO: 770245 - DNA, 25 bp, Mus musculus
tagaaggtcaggtggtcacacggct

SEQ ID NO: 770246 - DNA, 25 bp, Mus musculus
tagaaggtccgaatccgggactccg

SEQ ID NO: 770247 - DNA, 25 bp, Mus musculus
tagaaggtccgattccgggactccg

SEQ ID NO: 770248 - DNA, 25 bp, Mus musculus
tagaaggtcctgagctctcctcctt

SEQ ID NO: 770249 - DNA, 25 bp, Mus musculus
tagaaggtcctgtgctctcctcctt

SEQ ID NO: 770250 - DNA, 25 bp, Mus musculus
tagaaggtctaactagccagctctc

SEQ ID NO: 770251 - DNA, 25 bp, Mus musculus
tagaaggtctaagtagccagctctc

SEQ ID NO: 770252 - DNA, 25 bp, Mus musculus
tagaaggtctttcctcttttagcct

SEQ ID NO: 770253 - DNA, 25 bp, Mus musculus
tagaaggtctttgctcttttagcct

SEQ ID NO: 770254 - DNA, 25 bp, Mus musculus
tagaaggtgcaaccccatgacgtta

SEQ ID NO: 770255 - DNA, 25 bp, Mus musculus
tagaaggtgcaagcccatgacgtta

SEQ ID NO: 770256 - DNA, 25 bp, Mus musculus
tagaaggtgcatcaggcctttcctc

SEQ ID NO: 770257 - DNA, 25 bp, Mus musculus
tagaaggtgcatgaggcctttcctc

SEQ ID NO: 770258 - DNA, 25 bp, Mus musculus
tagaaggtgcccagacttccatcta

SEQ ID NO: 770259 - DNA, 25 bp, Mus musculus
tagaaggtgccctgacttccatcta

SEQ ID NO: 770260 - DNA, 25 bp, Mus musculus
tagaaggtgcctctgggtttagcca

SEQ ID NO: 770261 - DNA, 25 bp, Mus musculus
tagaaggtgcctgtgggtttagcca

SEQ ID NO: 770262 - DNA, 25 bp, Mus musculus
tagaagtaacttactcctgctgctc

SEQ ID NO: 770263 - DNA, 25 bp, Mus musculus
tagaagtaactttctcctgctgctc

SEQ ID NO: 770264 - DNA, 25 bp, Mus musculus
tagaagtaattgacccatttgcaga

SEQ ID NO: 770265 - DNA, 25 bp, Mus musculus
tagaagtaattgtcccatttgcaga

SEQ ID NO: 770266 - DNA, 25 bp, Mus musculus
tagaagtactgacgtgtgccatcac

SEQ ID NO: 770267 - DNA, 25 bp, Mus musculus
tagaagtactgaggtgtgccatcac

SEQ ID NO: 770268 - DNA, 25 bp, Mus musculus
tagaagtagcctcgtccacttccca

SEQ ID NO: 770269 - DNA, 25 bp, Mus musculus
tagaagtagcctggtccacttccca

SEQ ID NO: 770270 - DNA, 25 bp, Mus musculus
tagaagtagctcctgaataccccaa

SEQ ID NO: 770271 - DNA, 25 bp, Mus musculus
tagaagtagctcgtgaataccccaa

SEQ ID NO: 770272 - DNA, 25 bp, Mus musculus
tagaagtatacgcttgtctttaata

SEQ ID NO: 770273 - DNA, 25 bp, Mus musculus
tagaagtatacggttgtctttaata

SEQ ID NO: 770274 - DNA, 25 bp, Mus musculus
tagaagtcataacaggattacagct

SEQ ID NO: 770275 - DNA, 25 bp, Mus musculus
tagaagtcataagaggattacagct

SEQ ID NO: 770276 - DNA, 25 bp, Mus musculus
tagaagtccagccttacctgtgaga

SEQ ID NO: 770277 - DNA, 25 bp, Mus musculus
tagaagtccagcgttacctgtgaga

SEQ ID NO: 770278 - DNA, 25 bp, Mus musculus
tagaagtctatactggctggccatt

SEQ ID NO: 770279 - DNA, 25 bp, Mus musculus
tagaagtctatagtggctggccatt

SEQ ID NO: 770280 - DNA, 25 bp, Mus musculus
tagaagtcttagcaccaacgcagaa

SEQ ID NO: 770281 - DNA, 25 bp, Mus musculus
tagaagtcttaggaccaacgcagaa

SEQ ID NO: 770282 - DNA, 25 bp, Mus musculus
tagaagtcttccacgggatgggcat

SEQ ID NO: 770283 - DNA, 25 bp, Mus musculus
tagaagtcttcctcgggatgggcat

SEQ ID NO: 770284 - DNA, 25 bp, Mus musculus
tagaagtgaattacctagcgttttt

SEQ ID NO: 770285 - DNA, 25 bp, Mus musculus
tagaagtgaatttcctagcgttttt

SEQ ID NO: 770286 - DNA, 25 bp, Mus musculus
tagaagtgacaaccgggtaccctgg

SEQ ID NO: 770287 - DNA, 25 bp, Mus musculus
tagaagtgacaagcgggtaccctgg

SEQ ID NO: 770288 - DNA, 25 bp, Mus musculus
tagaagtgacatacagttggctgct

SEQ ID NO: 770289 - DNA, 25 bp, Mus musculus
tagaagtgacattcagttggctgct

SEQ ID NO: 770290 - DNA, 25 bp, Mus musculus
tagaagtgctgcagtccttgacaca

SEQ ID NO: 770291 - DNA, 25 bp, Mus musculus
tagaagtgctgctgtccttgacaca

SEQ ID NO: 770292 - DNA, 25 bp, Mus musculus
tagaagtgcttcagggtctgagcct

SEQ ID NO: 770293 - DNA, 25 bp, Mus musculus
tagaagtgcttctgggtctgagcct

SEQ ID NO: 770294 - DNA, 25 bp, Mus musculus
tagaagtggagtacagccctctatc

SEQ ID NO: 770295 - DNA, 25 bp, Mus musculus
tagaagtggagttcagccctctatc

SEQ ID NO: 770296 - DNA, 25 bp, Mus musculus
tagaagtggcttctgctctccacca

SEQ ID NO: 770297 - DNA, 25 bp, Mus musculus
tagaagtggcttgtgctctccacca

SEQ ID NO: 770298 - DNA, 25 bp, Mus musculus
tagaagtgtcacattccacagtgga

SEQ ID NO: 770299 - DNA, 25 bp, Mus musculus
tagaagtgtcactttccacagtgga

SEQ ID NO: 770300 - DNA, 25 bp, Mus musculus
tagaagtgtggactggcttagctca

SEQ ID NO: 770301 - DNA, 25 bp, Mus musculus
tagaagtgtggagtggcttagctca

SEQ ID NO: 770302 - DNA, 25 bp, Mus musculus
tagaagttctctccaccaagtgtcg

SEQ ID NO: 770303 - DNA, 25 bp, Mus musculus
tagaagttctctgcaccaagtgtcg

SEQ ID NO: 770304 - DNA, 25 bp, Mus musculus
tagaagttgctaatgtgctgctaat

SEQ ID NO: 770305 - DNA, 25 bp, Mus musculus
tagaagttgctattgtgctgctaat

SEQ ID NO: 770306 - DNA, 25 bp, Mus musculus
tagaagtttccaccaaggtctcggt

SEQ ID NO: 770307 - DNA, 25 bp, Mus musculus
tagaagtttccacggaggccacggt

SEQ ID NO: 770308 - DNA, 25 bp, Mus musculus
tagaagtttccagcaaggtctcggt

SEQ ID NO: 770309 - DNA, 25 bp, Mus musculus
tagaagtttccagggaggccacggt

SEQ ID NO: 770310 - DNA, 25 bp, Mus musculus
tagaagtttcttctttactttctag

SEQ ID NO: 770311 - DNA, 25 bp, Mus musculus
tagaagtttcttgtttactttctag

SEQ ID NO: 770312 - DNA, 25 bp, Mus musculus
tagaagttttctacatggagatggg

SEQ ID NO: 770313 - DNA, 25 bp, Mus musculus
tagaagttttcttcatggagatggg

SEQ ID NO: 770314 - DNA, 25 bp, Mus musculus
tagaataaatctcccaacagcctcc

SEQ ID NO: 770315 - DNA, 25 bp, Mus musculus
tagaataaatctgccaacagcctcc

SEQ ID NO: 770316 - DNA, 25 bp, Mus musculus
tagaataacctgatatcccctcgac

SEQ ID NO: 770317 - DNA, 25 bp, Mus musculus
tagaataacctgttatcccctcgac

SEQ ID NO: 770318 - DNA, 25 bp, Mus musculus
tagaataatcctcagtatttttcca

SEQ ID NO: 770319 - DNA, 25 bp, Mus musculus
tagaataatcctgagtatttttcca

SEQ ID NO: 770320 - DNA, 25 bp, Mus musculus
tagaatacactgctgcgactggctt

SEQ ID NO: 770321 - DNA, 25 bp, Mus musculus
tagaatacactggtgcgactggctt

SEQ ID NO: 770322 - DNA, 25 bp, Mus musculus
tagaataccctgatgaaccgtgaga

SEQ ID NO: 770323 - DNA, 25 bp, Mus musculus
tagaataccctgttgaaccgtgaga

SEQ ID NO: 770324 - DNA, 25 bp, Mus musculus
tagaatacctggctcatgtcacctg

SEQ ID NO: 770325 - DNA, 25 bp, Mus musculus
tagaatacctgggtcatgtcacctg

SEQ ID NO: 770326 - DNA, 25 bp, Mus musculus
tagaatactgtaaccttgctgccgt

SEQ ID NO: 770327 - DNA, 25 bp, Mus musculus
tagaatactgtatccttgctgccgt

SEQ ID NO: 770328 - DNA, 25 bp, Mus musculus
tagaatagaccaatcttggcttccc

SEQ ID NO: 770329 - DNA, 25 bp, Mus musculus
tagaatagaccattcttggcttccc

SEQ ID NO: 770330 - DNA, 25 bp, Mus musculus
tagaatagcccaagtgttacctgtc

SEQ ID NO: 770331 - DNA, 25 bp, Mus musculus
tagaatagcccatgtgttacctgtc

SEQ ID NO: 770332 - DNA, 25 bp, Mus musculus
tagaatagcgatatcctctggatat

SEQ ID NO: 770333 - DNA, 25 bp, Mus musculus
tagaatagcgatttcctctggatat

SEQ ID NO: 770334 - DNA, 25 bp, Mus musculus
tagaatatatgaaacactgcttcag

SEQ ID NO: 770335 - DNA, 25 bp, Mus musculus
tagaatatatgatacactgcttcag

SEQ ID NO: 770336 - DNA, 25 bp, Mus musculus
tagaatatctcacaaccgccgggcg

SEQ ID NO: 770337 - DNA, 25 bp, Mus musculus
tagaatatctcagaaccgccgggcg

SEQ ID NO: 770338 - DNA, 25 bp, Mus musculus
tagaatattccaacttttccgctct

SEQ ID NO: 770339 - DNA, 25 bp, Mus musculus
tagaatattccatcttttccgctct

SEQ ID NO: 770340 - DNA, 25 bp, Mus musculus
tagaatcacataattattttccatt

SEQ ID NO: 770341 - DNA, 25 bp, Mus musculus
tagaatcacatatttattttccatt

SEQ ID NO: 770342 - DNA, 25 bp, Mus musculus
tagaatcacggtacattgttgtcac

SEQ ID NO: 770343 - DNA, 25 bp, Mus musculus
tagaatcacggttcattgttgtcac

SEQ ID NO: 770344 - DNA, 25 bp, Mus musculus
tagaatcactacaagatagttcatc

SEQ ID NO: 770345 - DNA, 25 bp, Mus musculus
tagaatcactactagatagttcatc

SEQ ID NO: 770346 - DNA, 25 bp, Mus musculus
tagaatcactctctactgtcactgt

SEQ ID NO: 770347 - DNA, 25 bp, Mus musculus
tagaatcactctgtactgtcactgt

SEQ ID NO: 770348 - DNA, 25 bp, Mus musculus
tagaatcatcacagtcagaccccag

SEQ ID NO: 770349 - DNA, 25 bp, Mus musculus
tagaatcatcactgtcagaccccag

SEQ ID NO: 770350 - DNA, 25 bp, Mus musculus
tagaatcatcctcacatccatgtag

SEQ ID NO: 770351 - DNA, 25 bp, Mus musculus
tagaatcatcctcactagacacaga

SEQ ID NO: 770352 - DNA, 25 bp, Mus musculus
tagaatcatcctgacatccatgtag

SEQ ID NO: 770353 - DNA, 25 bp, Mus musculus
tagaatcatcctgactagacacaga

SEQ ID NO: 770354 - DNA, 25 bp, Mus musculus
tagaatcatcttcgaggatgggtcc

SEQ ID NO: 770355 - DNA, 25 bp, Mus musculus
tagaatcatcttggaggatgggtcc

SEQ ID NO: 770356 - DNA, 25 bp, Mus musculus
tagaatccacacaaggtctcatctc

SEQ ID NO: 770357 - DNA, 25 bp, Mus musculus
tagaatccacactaggtctcatctc

SEQ ID NO: 770358 - DNA, 25 bp, Mus musculus
tagaatccacgtcgaacttctgcct

SEQ ID NO: 770359 - DNA, 25 bp, Mus musculus
tagaatccacgtggaacttctgcct

SEQ ID NO: 770360 - DNA, 25 bp, Mus musculus
tagaatccagaaatccctcctggac

SEQ ID NO: 770361 - DNA, 25 bp, Mus musculus
tagaatccagaattccctcctggac

SEQ ID NO: 770362 - DNA, 25 bp, Mus musculus
tagaatccagctactagcctttcaa

SEQ ID NO: 770363 - DNA, 25 bp, Mus musculus
tagaatccagcttctagcctttcaa

SEQ ID NO: 770364 - DNA, 25 bp, Mus musculus
tagaatccaggacccactcaactat

SEQ ID NO: 770365 - DNA, 25 bp, Mus musculus
tagaatccaggagccactcaactat

SEQ ID NO: 770366 - DNA, 25 bp, Mus musculus
tagaatcccagccaggatgactagt

SEQ ID NO: 770367 - DNA, 25 bp, Mus musculus
tagaatcccagcgaggatgactagt

SEQ ID NO: 770368 - DNA, 25 bp, Mus musculus
tagaatcccatgctgacagctgcgg

SEQ ID NO: 770369 - DNA, 25 bp, Mus musculus
tagaatcccatggtgacagctgcgg

SEQ ID NO: 770370 - DNA, 25 bp, Mus musculus
tagaatccctgtagggcatgcgccc

SEQ ID NO: 770371 - DNA, 25 bp, Mus musculus
tagaatccctgttgggcatgcgccc

SEQ ID NO: 770372 - DNA, 25 bp, Mus musculus
tagaatccgcatcgtttccctgtga

SEQ ID NO: 770373 - DNA, 25 bp, Mus musculus
tagaatccgcatggtttccctgtga

SEQ ID NO: 770374 - DNA, 25 bp, Mus musculus
tagaatcctgacatgtagtgcacat

SEQ ID NO: 770375 - DNA, 25 bp, Mus musculus
tagaatcctgacttgtagtgcacat

SEQ ID NO: 770376 - DNA, 25 bp, Mus musculus
tagaatcgtggcacgagctgacgtt

SEQ ID NO: 770377 - DNA, 25 bp, Mus musculus
tagaatcgtggctcgagctgacgtt

SEQ ID NO: 770378 - DNA, 25 bp, Mus musculus
tagaatcgttagatccgttgttgat

SEQ ID NO: 770379 - DNA, 25 bp, Mus musculus
tagaatcgttagttccgttgttgat

SEQ ID NO: 770380 - DNA, 25 bp, Mus musculus
tagaatctcccaaggctgctagact

SEQ ID NO: 770381 - DNA, 25 bp, Mus musculus
tagaatctcccatggctgctagact

SEQ ID NO: 770382 - DNA, 25 bp, Mus musculus
tagaatctgattctgggccttctgt

SEQ ID NO: 770383 - DNA, 25 bp, Mus musculus
tagaatctgattgtgggccttctgt

SEQ ID NO: 770384 - DNA, 25 bp, Mus musculus
tagaatctgctcctgtgggactttt

SEQ ID NO: 770385 - DNA, 25 bp, Mus musculus
tagaatctgctcgtgtgggactttt

SEQ ID NO: 770386 - DNA, 25 bp, Mus musculus
tagaatcttcttagcagagtactgt

SEQ ID NO: 770387 - DNA, 25 bp, Mus musculus
tagaatcttctttgcagagtactgt

SEQ ID NO: 770388 - DNA, 25 bp, Mus musculus
tagaatctttccatatcgctgccgg

SEQ ID NO: 770389 - DNA, 25 bp, Mus musculus
tagaatctttccttatcgctgccgg

SEQ ID NO: 770390 - DNA, 25 bp, Mus musculus
tagaatgacacaactgacactgctc

SEQ ID NO: 770391 - DNA, 25 bp, Mus musculus
tagaatgacacatctgacactgctc

SEQ ID NO: 770392 - DNA, 25 bp, Mus musculus
tagaatgagctcatccaactccaca

SEQ ID NO: 770393 - DNA, 25 bp, Mus musculus
tagaatgagctcttccaactccaca

SEQ ID NO: 770394 - DNA, 25 bp, Mus musculus
tagaatgatctcatcagtggcccct

SEQ ID NO: 770395 - DNA, 25 bp, Mus musculus
tagaatgatctcttcagtggcccct

SEQ ID NO: 770396 - DNA, 25 bp, Mus musculus
tagaatgcactaattggaccaaaat

SEQ ID NO: 770397 - DNA, 25 bp, Mus musculus
tagaatgcactatttggaccaaaat

SEQ ID NO: 770398 - DNA, 25 bp, Mus musculus
tagaatgctacaatgttaccactgt

SEQ ID NO: 770399 - DNA, 25 bp, Mus musculus
tagaatgctacattgttaccactgt

SEQ ID NO: 770400 - DNA, 25 bp, Mus musculus
tagaatgctcatctgattcctccca

SEQ ID NO: 770401 - DNA, 25 bp, Mus musculus
tagaatgctcatgtgattcctccca

SEQ ID NO: 770402 - DNA, 25 bp, Mus musculus
tagaatgctcctactgtgctggcta

SEQ ID NO: 770403 - DNA, 25 bp, Mus musculus
tagaatgctccttctgtgctggcta

SEQ ID NO: 770404 - DNA, 25 bp, Mus musculus
tagaatgctctcacgttcgcaattt

SEQ ID NO: 770405 - DNA, 25 bp, Mus musculus
tagaatgctctctcgttcgcaattt

SEQ ID NO: 770406 - DNA, 25 bp, Mus musculus
tagaatgctttcatacacaactcag

SEQ ID NO: 770407 - DNA, 25 bp, Mus musculus
tagaatgctttcttacacaactcag

SEQ ID NO: 770408 - DNA, 25 bp, Mus musculus
tagaatgggcagcagtaagcctctg

SEQ ID NO: 770409 - DNA, 25 bp, Mus musculus
tagaatgggcaggagtaagcctctg

SEQ ID NO: 770410 - DNA, 25 bp, Mus musculus
tagaatgggctcacatctggacaat

SEQ ID NO: 770411 - DNA, 25 bp, Mus musculus
tagaatgggctctcatctggacaat

SEQ ID NO: 770412 - DNA, 25 bp, Mus musculus
tagaatgtcctgatcagtaaaaagg

SEQ ID NO: 770413 - DNA, 25 bp, Mus musculus
tagaatgtcctgttcagtaaaaagg

SEQ ID NO: 770414 - DNA, 25 bp, Mus musculus
tagaatgtctgcctagcacttggga

SEQ ID NO: 770415 - DNA, 25 bp, Mus musculus
tagaatgtctgcgtagcacttggga

SEQ ID NO: 770416 - DNA, 25 bp, Mus musculus
tagaatgtgagacgccctgggttta

SEQ ID NO: 770417 - DNA, 25 bp, Mus musculus
tagaatgtgagaggccctgggttta

SEQ ID NO: 770418 - DNA, 25 bp, Mus musculus
tagaatgtttcacactggcttccct

SEQ ID NO: 770419 - DNA, 25 bp, Mus musculus
tagaatgtttcagactggcttccct

SEQ ID NO: 770420 - DNA, 25 bp, Mus musculus
tagaatgtttcgaggcgtttaacat

SEQ ID NO: 770421 - DNA, 25 bp, Mus musculus
tagaatgtttcgtggcgtttaacat

SEQ ID NO: 770422 - DNA, 25 bp, Mus musculus
tagaattaacgacatgggccaccac

SEQ ID NO: 770423 - DNA, 25 bp, Mus musculus
tagaattaacgagatgggccaccac

SEQ ID NO: 770424 - DNA, 25 bp, Mus musculus
tagaattaccagcttgattcggctt

SEQ ID NO: 770425 - DNA, 25 bp, Mus musculus
tagaattaccaggttgattcggctt

SEQ ID NO: 770426 - DNA, 25 bp, Mus musculus
tagaattaccatctcctgttggctg

SEQ ID NO: 770427 - DNA, 25 bp, Mus musculus
tagaattaccatgtcctgttggctg

SEQ ID NO: 770428 - DNA, 25 bp, Mus musculus
tagaattactgtactacctcccatt

SEQ ID NO: 770429 - DNA, 25 bp, Mus musculus
tagaattactgttctacctcccatt

SEQ ID NO: 770430 - DNA, 25 bp, Mus musculus
tagaattagggcatgcccgtgcact

SEQ ID NO: 770431 - DNA, 25 bp, Mus musculus
tagaattagggcttgcccgtgcact

SEQ ID NO: 770432 - DNA, 25 bp, Mus musculus
tagaattcactacccctaatgtcat

SEQ ID NO: 770433 - DNA, 25 bp, Mus musculus
tagaattcactacttccaagtcccg

SEQ ID NO: 770434 - DNA, 25 bp, Mus musculus
tagaattcactagccctaatgtcat

SEQ ID NO: 770435 - DNA, 25 bp, Mus musculus
tagaattcactagttccaagtcccg

SEQ ID NO: 770436 - DNA, 25 bp, Mus musculus
tagaattcactgaagtttcttcccc

SEQ ID NO: 770437 - DNA, 25 bp, Mus musculus
tagaattcactgtagtttcttcccc

SEQ ID NO: 770438 - DNA, 25 bp, Mus musculus
tagaattcaggtcccctgtgcctta

SEQ ID NO: 770439 - DNA, 25 bp, Mus musculus
tagaattcaggtgccctgtgcctta

SEQ ID NO: 770440 - DNA, 25 bp, Mus musculus
tagaattcatatacttttttttgct

SEQ ID NO: 770441 - DNA, 25 bp, Mus musculus
tagaattcatattcttttttttgct

SEQ ID NO: 770442 - DNA, 25 bp, Mus musculus
tagaattcatttagtggatggtgtt

SEQ ID NO: 770443 - DNA, 25 bp, Mus musculus
tagaattcattttgtggatggtgtt

SEQ ID NO: 770444 - DNA, 25 bp, Mus musculus
tagaattccctacatcaaggatgtt

SEQ ID NO: 770445 - DNA, 25 bp, Mus musculus
tagaattccctagatcaaggatgtt

SEQ ID NO: 770446 - DNA, 25 bp, Mus musculus
tagaattccctccttttccaaaatg

SEQ ID NO: 770447 - DNA, 25 bp, Mus musculus
tagaattccctcgttttccaaaatg

SEQ ID NO: 770448 - DNA, 25 bp, Mus musculus
tagaattccgttacatctcgggcat

SEQ ID NO: 770449 - DNA, 25 bp, Mus musculus
tagaattccgtttcatctcgggcat

SEQ ID NO: 770450 - DNA, 25 bp, Mus musculus
tagaattcgcctaacactgtgtgag

SEQ ID NO: 770451 - DNA, 25 bp, Mus musculus
tagaattcgccttacactgtgtgag

SEQ ID NO: 770452 - DNA, 25 bp, Mus musculus
tagaattctcctaaaccatctcaac

SEQ ID NO: 770453 - DNA, 25 bp, Mus musculus
tagaattctccttaaccatctcaac

SEQ ID NO: 770454 - DNA, 25 bp, Mus musculus
tagaattctgcaagtgagccacaat

SEQ ID NO: 770455 - DNA, 25 bp, Mus musculus
tagaattctgcatgtgagccacaat

SEQ ID NO: 770456 - DNA, 25 bp, Mus musculus
tagaattctggcacttcagggtcag

SEQ ID NO: 770457 - DNA, 25 bp, Mus musculus
tagaattctggctcttcagggtcag

SEQ ID NO: 770458 - DNA, 25 bp, Mus musculus
tagaattctttaataacctaagtat

SEQ ID NO: 770459 - DNA, 25 bp, Mus musculus
tagaattctttattaacctaagtat

SEQ ID NO: 770460 - DNA, 25 bp, Mus musculus
tagaattctttgatttggccaggtc

SEQ ID NO: 770461 - DNA, 25 bp, Mus musculus
tagaattctttgttttggccaggtc

SEQ ID NO: 770462 - DNA, 25 bp, Mus musculus
tagaattcttttcgcccatatttta

SEQ ID NO: 770463 - DNA, 25 bp, Mus musculus
tagaattcttttggcccatatttta

SEQ ID NO: 770464 - DNA, 25 bp, Mus musculus
tagaattgaaacaagggccttgcac

SEQ ID NO: 770465 - DNA, 25 bp, Mus musculus
tagaattgaaactagggccttgcac

SEQ ID NO: 770466 - DNA, 25 bp, Mus musculus
tagaattgagtcacagctcacctcc

SEQ ID NO: 770467 - DNA, 25 bp, Mus musculus
tagaattgagtctcagctcacctcc

SEQ ID NO: 770468 - DNA, 25 bp, Mus musculus
tagaattgcaaaaagctccccagag

SEQ ID NO: 770469 - DNA, 25 bp, Mus musculus
tagaattgcaaatagctccccagag

SEQ ID NO: 770470 - DNA, 25 bp, Mus musculus
tagaattgctctactgttctgccag

SEQ ID NO: 770471 - DNA, 25 bp, Mus musculus
tagaattgctcttctgttctgccag

SEQ ID NO: 770472 - DNA, 25 bp, Mus musculus
tagaattgctgaatccttccacgtc

SEQ ID NO: 770473 - DNA, 25 bp, Mus musculus
tagaattgctgattccttccacgtc

SEQ ID NO: 770474 - DNA, 25 bp, Mus musculus
tagaattggtcaccttcgtatccca

SEQ ID NO: 770475 - DNA, 25 bp, Mus musculus
tagaattggtcagcttcgtatccca

SEQ ID NO: 770476 - DNA, 25 bp, Mus musculus
tagaattgtctcaacttttcaagta

SEQ ID NO: 770477 - DNA, 25 bp, Mus musculus
tagaattgtctctacttttcaagta

SEQ ID NO: 770478 - DNA, 25 bp, Mus musculus
tagaattgttatcttgggcatcaca

SEQ ID NO: 770479 - DNA, 25 bp, Mus musculus
tagaattgttatgttgggcatcaca

SEQ ID NO: 770480 - DNA, 25 bp, Mus musculus
tagaatttacctagttcaacctact

SEQ ID NO: 770481 - DNA, 25 bp, Mus musculus
tagaatttaccttgttcaacctact

SEQ ID NO: 770482 - DNA, 25 bp, Mus musculus
tagaatttacttaactttacagctt

SEQ ID NO: 770483 - DNA, 25 bp, Mus musculus
tagaatttactttactttacagctt

SEQ ID NO: 770484 - DNA, 25 bp, Mus musculus
tagaatttagcacaatcaggtcatc

SEQ ID NO: 770485 - DNA, 25 bp, Mus musculus
tagaatttagcagaatcaggtcatc

SEQ ID NO: 770486 - DNA, 25 bp, Mus musculus
tagaatttccaacactcaggctctg

SEQ ID NO: 770487 - DNA, 25 bp, Mus musculus
tagaatttccaagactcaggctctg

SEQ ID NO: 770488 - DNA, 25 bp, Mus musculus
tagaatttggcgctgagtaggtcat

SEQ ID NO: 770489 - DNA, 25 bp, Mus musculus
tagaatttggcggtgagtaggtcat

SEQ ID NO: 770490 - DNA, 25 bp, Mus musculus
tagaattttatcattcttcccctcc

SEQ ID NO: 770491 - DNA, 25 bp, Mus musculus
tagaattttatctttcttcccctcc

SEQ ID NO: 770492 - DNA, 25 bp, Mus musculus
tagaattttgtgaccatccctgaag

SEQ ID NO: 770493 - DNA, 25 bp, Mus musculus
tagaattttgtgtccatccctgaag

SEQ ID NO: 770494 - DNA, 25 bp, Mus musculus
tagacaaactgcagctgttgaccct

SEQ ID NO: 770495 - DNA, 25 bp, Mus musculus
tagacaaactgctgctgttgaccct

SEQ ID NO: 770496 - DNA, 25 bp, Mus musculus
tagacaaagcgcacagcagtcctat

SEQ ID NO: 770497 - DNA, 25 bp, Mus musculus
tagacaaagcgctcagcagtcctat

SEQ ID NO: 770498 - DNA, 25 bp, Mus musculus
tagacaaaggttacctggccccagt

SEQ ID NO: 770499 - DNA, 25 bp, Mus musculus
tagacaaaggtttcctggccccagt

SEQ ID NO: 770500 - DNA, 25 bp, Mus musculus
tagacaaatgacactgaagcagatt

SEQ ID NO: 770501 - DNA, 25 bp, Mus musculus
tagacaaatgactctgaagcagatt

SEQ ID NO: 770502 - DNA, 25 bp, Mus musculus
tagacaaatgttagtgggctccctc

SEQ ID NO: 770503 - DNA, 25 bp, Mus musculus
tagacaaatgtttgtgggctccctc

SEQ ID NO: 770504 - DNA, 25 bp, Mus musculus
tagacaacaatcagctcggagacga

SEQ ID NO: 770505 - DNA, 25 bp, Mus musculus
tagacaacaatctgctcggagacga

SEQ ID NO: 770506 - DNA, 25 bp, Mus musculus
tagacaacaccactgggcttcactt

SEQ ID NO: 770507 - DNA, 25 bp, Mus musculus
tagacaacaccagtgggcttcactt

SEQ ID NO: 770508 - DNA, 25 bp, Mus musculus
tagacaacaggaagtccgggagact

SEQ ID NO: 770509 - DNA, 25 bp, Mus musculus
tagacaacaggatgtccgggagact

SEQ ID NO: 770510 - DNA, 25 bp, Mus musculus
tagacaacatttacgcatttataat

SEQ ID NO: 770511 - DNA, 25 bp, Mus musculus
tagacaacattttcgcatttataat

SEQ ID NO: 770512 - DNA, 25 bp, Mus musculus
tagacaacctcaagtctgccttggc

SEQ ID NO: 770513 - DNA, 25 bp, Mus musculus
tagacaacctcatgtctgccttggc

SEQ ID NO: 770514 - DNA, 25 bp, Mus musculus
tagacaaccttgacttgttcccagt

SEQ ID NO: 770515 - DNA, 25 bp, Mus musculus
tagacaaccttgtcttgttcccagt

SEQ ID NO: 770516 - DNA, 25 bp, Mus musculus
tagacaacgtgaaggctttgggttt

SEQ ID NO: 770517 - DNA, 25 bp, Mus musculus
tagacaacgtgatggctttgggttt

SEQ ID NO: 770518 - DNA, 25 bp, Mus musculus
tagacaactacaagagccaggtgat

SEQ ID NO: 770519 - DNA, 25 bp, Mus musculus
tagacaactacatgagccaggtgat

SEQ ID NO: 770520 - DNA, 25 bp, Mus musculus
tagacaactggactttttgctggtt

SEQ ID NO: 770521 - DNA, 25 bp, Mus musculus
tagacaactggagtttttgctggtt

SEQ ID NO: 770522 - DNA, 25 bp, Mus musculus
tagacaagaggcagcttcaaggtgt

SEQ ID NO: 770523 - DNA, 25 bp, Mus musculus
tagacaagaggctgcttcaaggtgt

SEQ ID NO: 770524 - DNA, 25 bp, Mus musculus
tagacaagcgttccatcactacact

SEQ ID NO: 770525 - DNA, 25 bp, Mus musculus
tagacaagcgttgcatcactacact

SEQ ID NO: 770526 - DNA, 25 bp, Mus musculus
tagacaaggcagacctgagacagga

SEQ ID NO: 770527 - DNA, 25 bp, Mus musculus
tagacaaggcagtcctgagacagga

SEQ ID NO: 770528 - DNA, 25 bp, Mus musculus
tagacaaggcatagctggaatcccc

SEQ ID NO: 770529 - DNA, 25 bp, Mus musculus
tagacaaggcattgctggaatcccc

SEQ ID NO: 770530 - DNA, 25 bp, Mus musculus
tagacaagtgctattcaggtgacat

SEQ ID NO: 770531 - DNA, 25 bp, Mus musculus
tagacaagtgcttttcaggtgacat

SEQ ID NO: 770532 - DNA, 25 bp, Mus musculus
tagacaatacttccctgtgcgtgcc

SEQ ID NO: 770533 - DNA, 25 bp, Mus musculus
tagacaatacttgcctgtgcgtgcc

SEQ ID NO: 770534 - DNA, 25 bp, Mus musculus
tagacaatccaactgaaggcaaatt

SEQ ID NO: 770535 - DNA, 25 bp, Mus musculus
tagacaatccaagtgaaggcaaatt

SEQ ID NO: 770536 - DNA, 25 bp, Mus musculus
tagacaatccataggctttcaagag

SEQ ID NO: 770537 - DNA, 25 bp, Mus musculus
tagacaatccattggctttcaagag

SEQ ID NO: 770538 - DNA, 25 bp, Mus musculus
tagacaatcctaattccactacatt

SEQ ID NO: 770539 - DNA, 25 bp, Mus musculus
tagacaatcctatttccactacatt

SEQ ID NO: 770540 - DNA, 25 bp, Mus musculus
tagacaatgaatcaagtgtgcccat

SEQ ID NO: 770541 - DNA, 25 bp, Mus musculus
tagacaatgaatgaagtgtgcccat

SEQ ID NO: 770542 - DNA, 25 bp, Mus musculus
tagacaatgattctgaggccctcct

SEQ ID NO: 770543 - DNA, 25 bp, Mus musculus
tagacaatgattgtgaggccctcct

SEQ ID NO: 770544 - DNA, 25 bp, Mus musculus
tagacaatgtgaccccactagcaag

SEQ ID NO: 770545 - DNA, 25 bp, Mus musculus
tagacaatgtgagcccactagcaag

SEQ ID NO: 770546 - DNA, 25 bp, Mus musculus
tagacaattctacgccaagttcagg

SEQ ID NO: 770547 - DNA, 25 bp, Mus musculus
tagacaattctaggccaagttcagg

SEQ ID NO: 770548 - DNA, 25 bp, Mus musculus
tagacaattgtccaccaggctttgg

SEQ ID NO: 770549 - DNA, 25 bp, Mus musculus
tagacaattgtcgaccaggctttgg

SEQ ID NO: 770550 - DNA, 25 bp, Mus musculus
tagacacacagacccaaagctcatg

SEQ ID NO: 770551 - DNA, 25 bp, Mus musculus
tagacacacagagccaaagctcatg

SEQ ID NO: 770552 - DNA, 25 bp, Mus musculus
tagacacacaggacatgcatactca

SEQ ID NO: 770553 - DNA, 25 bp, Mus musculus
tagacacacaggtcatgcatactca

SEQ ID NO: 770554 - DNA, 25 bp, Mus musculus
tagacacactggcaccacggtaaga

SEQ ID NO: 770555 - DNA, 25 bp, Mus musculus
tagacacactgggaccacggtaaga

SEQ ID NO: 770556 - DNA, 25 bp, Mus musculus
tagacacactgtccaagatctccga

SEQ ID NO: 770557 - DNA, 25 bp, Mus musculus
tagacacactgtgcaagatctccga

SEQ ID NO: 770558 - DNA, 25 bp, Mus musculus
tagacacagatgactatgctcgcat

SEQ ID NO: 770559 - DNA, 25 bp, Mus musculus
tagacacagatgtctatgctcgcat

SEQ ID NO: 770560 - DNA, 25 bp, Mus musculus
tagacacaggagacaagttccgctt

SEQ ID NO: 770561 - DNA, 25 bp, Mus musculus
tagacacaggagtcaagttccgctt

SEQ ID NO: 770562 - DNA, 25 bp, Mus musculus
tagacacagttcagccagcaagcct

SEQ ID NO: 770563 - DNA, 25 bp, Mus musculus
tagacacagttctgccagcaagcct

SEQ ID NO: 770564 - DNA, 25 bp, Mus musculus
tagacacatcagaccatcttggcac

SEQ ID NO: 770565 - DNA, 25 bp, Mus musculus
tagacacatcagtccatcttggcac

SEQ ID NO: 770566 - DNA, 25 bp, Mus musculus
tagacacatgcccatagaccaacat

SEQ ID NO: 770567 - DNA, 25 bp, Mus musculus
tagacacatgccgatagaccaacat

SEQ ID NO: 770568 - DNA, 25 bp, Mus musculus
tagacacatgtcagccaggtaccat

SEQ ID NO: 770569 - DNA, 25 bp, Mus musculus
tagacacatgtctgccaggtaccat

SEQ ID NO: 770570 - DNA, 25 bp, Mus musculus
tagacaccaatcaaattgctgggaa

SEQ ID NO: 770571 - DNA, 25 bp, Mus musculus
tagacaccaatctaattgctgggaa

SEQ ID NO: 770572 - DNA, 25 bp, Mus musculus
tagacaccagaacactcactcaggg

SEQ ID NO: 770573 - DNA, 25 bp, Mus musculus
tagacaccagaagactcactcaggg

SEQ ID NO: 770574 - DNA, 25 bp, Mus musculus
tagacaccagcgacctacagaggat

SEQ ID NO: 770575 - DNA, 25 bp, Mus musculus
tagacaccagcgtcctacagaggat

SEQ ID NO: 770576 - DNA, 25 bp, Mus musculus
tagacaccataaagggtcccctttt

SEQ ID NO: 770577 - DNA, 25 bp, Mus musculus
tagacaccataatgggtcccctttt

SEQ ID NO: 770578 - DNA, 25 bp, Mus musculus
tagacaccatgcatgaggtacacaa

SEQ ID NO: 770579 - DNA, 25 bp, Mus musculus
tagacaccatgcttgaggtacacaa

SEQ ID NO: 770580 - DNA, 25 bp, Mus musculus
tagacacccgtgaaggaccgtctat

SEQ ID NO: 770581 - DNA, 25 bp, Mus musculus
tagacacccgtgtaggaccgtctat

SEQ ID NO: 770582 - DNA, 25 bp, Mus musculus
tagacaccctagcaaccagacatct

SEQ ID NO: 770583 - DNA, 25 bp, Mus musculus
tagacaccctaggaaccagacatct

SEQ ID NO: 770584 - DNA, 25 bp, Mus musculus
tagacaccgcggctcagacatgtgg

SEQ ID NO: 770585 - DNA, 25 bp, Mus musculus
tagacaccgcgggtcagacatgtgg

SEQ ID NO: 770586 - DNA, 25 bp, Mus musculus
tagacaccttagctgtgtttccggg

SEQ ID NO: 770587 - DNA, 25 bp, Mus musculus
tagacaccttaggtgtgtttccggg

SEQ ID NO: 770588 - DNA, 25 bp, Mus musculus
tagacacgcagtactttattcccat

SEQ ID NO: 770589 - DNA, 25 bp, Mus musculus
tagacacgcagttctttattcccat

SEQ ID NO: 770590 - DNA, 25 bp, Mus musculus
tagacacggcgcatcctttacagaa

SEQ ID NO: 770591 - DNA, 25 bp, Mus musculus
tagacacggcgcttcctttacagaa

SEQ ID NO: 770592 - DNA, 25 bp, Mus musculus
tagacacggtgccatttctgctttg

SEQ ID NO: 770593 - DNA, 25 bp, Mus musculus
tagacacggtgcgatttctgctttg

SEQ ID NO: 770594 - DNA, 25 bp, Mus musculus
tagacacgtacgaaaagcaggactt

SEQ ID NO: 770595 - DNA, 25 bp, Mus musculus
tagacacgtacgtaaagcaggactt

SEQ ID NO: 770596 - DNA, 25 bp, Mus musculus
tagacacgtgtgagctgggattctg

SEQ ID NO: 770597 - DNA, 25 bp, Mus musculus
tagacacgtgtgtgctgggattctg

SEQ ID NO: 770598 - DNA, 25 bp, Mus musculus
tagacactaagcagttagccataac

SEQ ID NO: 770599 - DNA, 25 bp, Mus musculus
tagacactaagctgttagccataac

SEQ ID NO: 770600 - DNA, 25 bp, Mus musculus
tagacactagaaatcagacctctgc

SEQ ID NO: 770601 - DNA, 25 bp, Mus musculus
tagacactagaattcagacctctgc

SEQ ID NO: 770602 - DNA, 25 bp, Mus musculus
tagacactcagtaggcagcctggta

SEQ ID NO: 770603 - DNA, 25 bp, Mus musculus
tagacactcagttggcagcctggta

SEQ ID NO: 770604 - DNA, 25 bp, Mus musculus
tagacactcccacaggctgctagct

SEQ ID NO: 770605 - DNA, 25 bp, Mus musculus
tagacactcccagaggctgctagct

SEQ ID NO: 770606 - DNA, 25 bp, Mus musculus
tagacactcccgaggaatgatattc

SEQ ID NO: 770607 - DNA, 25 bp, Mus musculus
tagacactcccgtggaatgatattc

SEQ ID NO: 770608 - DNA, 25 bp, Mus musculus
tagacactgattacatcgacgagga

SEQ ID NO: 770609 - DNA, 25 bp, Mus musculus
tagacactgatttcatcgacgagga

SEQ ID NO: 770610 - DNA, 25 bp, Mus musculus
tagacactggacattgcctaggagg

SEQ ID NO: 770611 - DNA, 25 bp, Mus musculus
tagacactggactttgcctaggagg

SEQ ID NO: 770612 - DNA, 25 bp, Mus musculus
tagacactggatatcattgtaataa

SEQ ID NO: 770613 - DNA, 25 bp, Mus musculus
tagacactggatttcattgtaataa

SEQ ID NO: 770614 - DNA, 25 bp, Mus musculus
tagacactgggaattgggagaaatc

SEQ ID NO: 770615 - DNA, 25 bp, Mus musculus
tagacactgggatttgggagaaatc

SEQ ID NO: 770616 - DNA, 25 bp, Mus musculus
tagacactgggtatcctccctagaa

SEQ ID NO: 770617 - DNA, 25 bp, Mus musculus
tagacactgggtttcctccctagaa

SEQ ID NO: 770618 - DNA, 25 bp, Mus musculus
tagacactgtccctgacggtaatta

SEQ ID NO: 770619 - DNA, 25 bp, Mus musculus
tagacactgtccgtgacggtaatta

SEQ ID NO: 770620 - DNA, 25 bp, Mus musculus
tagacactgtgcaccccttctttta

SEQ ID NO: 770621 - DNA, 25 bp, Mus musculus
tagacactgtgctccccttctttta

SEQ ID NO: 770622 - DNA, 25 bp, Mus musculus
tagacacttaaccaggtttcatcga

SEQ ID NO: 770623 - DNA, 25 bp, Mus musculus
tagacacttaacgaggtttcatcga

SEQ ID NO: 770624 - DNA, 25 bp, Mus musculus
tagacacttaggactgacaagtagt

SEQ ID NO: 770625 - DNA, 25 bp, Mus musculus
tagacacttaggtctgacaagtagt

SEQ ID NO: 770626 - DNA, 25 bp, Mus musculus
tagacacttccgcatcaactatgcg

SEQ ID NO: 770627 - DNA, 25 bp, Mus musculus
tagacacttccggatcaactatgcg

SEQ ID NO: 770628 - DNA, 25 bp, Mus musculus
tagacacttctccacccaaattctt

SEQ ID NO: 770629 - DNA, 25 bp, Mus musculus
tagacacttctcgacccaaattctt

SEQ ID NO: 770630 - DNA, 25 bp, Mus musculus
tagacacttggcagtgggatctgtg

SEQ ID NO: 770631 - DNA, 25 bp, Mus musculus
tagacacttggctgtgggatctgtg

SEQ ID NO: 770632 - DNA, 25 bp, Mus musculus
tagacagacaagataggagcccagc

SEQ ID NO: 770633 - DNA, 25 bp, Mus musculus
tagacagacaagttaggagcccagc

SEQ ID NO: 770634 - DNA, 25 bp, Mus musculus
tagacagacagtagtaactcaagat

SEQ ID NO: 770635 - DNA, 25 bp, Mus musculus
tagacagacagttgtaactcaagat

SEQ ID NO: 770636 - DNA, 25 bp, Mus musculus
tagacagaccccagaggcctaggtg

SEQ ID NO: 770637 - DNA, 25 bp, Mus musculus
tagacagacccctgaggcctaggtg

SEQ ID NO: 770638 - DNA, 25 bp, Mus musculus
tagacagacgtcctacccaacatca

SEQ ID NO: 770639 - DNA, 25 bp, Mus musculus
tagacagacgtcgtacccaacatca

SEQ ID NO: 770640 - DNA, 25 bp, Mus musculus
tagacagacttgcttagtgcagcta

SEQ ID NO: 770641 - DNA, 25 bp, Mus musculus
tagacagacttggttagtgcagcta

SEQ ID NO: 770642 - DNA, 25 bp, Mus musculus
tagacagactttatggtgtgacatc

SEQ ID NO: 770643 - DNA, 25 bp, Mus musculus
tagacagactttttggtgtgacatc

SEQ ID NO: 770644 - DNA, 25 bp, Mus musculus
tagacagatgcgcaaaagacctctt

SEQ ID NO: 770645 - DNA, 25 bp, Mus musculus
tagacagatgcggaaaagacctctt

SEQ ID NO: 770646 - DNA, 25 bp, Mus musculus
tagacagcaacacagaaacccagag

SEQ ID NO: 770647 - DNA, 25 bp, Mus musculus
tagacagcaacagagaaacccagag

SEQ ID NO: 770648 - DNA, 25 bp, Mus musculus
tagacagcaatgcacttccctagtc

SEQ ID NO: 770649 - DNA, 25 bp, Mus musculus
tagacagcaatggacttccctagtc

SEQ ID NO: 770650 - DNA, 25 bp, Mus musculus
tagacagcatcaattccaacatggt

SEQ ID NO: 770651 - DNA, 25 bp, Mus musculus
tagacagcatcatttccaacatggt

SEQ ID NO: 770652 - DNA, 25 bp, Mus musculus
tagacagccacaagcagacagccac

SEQ ID NO: 770653 - DNA, 25 bp, Mus musculus
tagacagccacatgcagacagccac

SEQ ID NO: 770654 - DNA, 25 bp, Mus musculus
tagacagccattatctcatgggctc

SEQ ID NO: 770655 - DNA, 25 bp, Mus musculus
tagacagccattttctcatgggctc

SEQ ID NO: 770656 - DNA, 25 bp, Mus musculus
tagacagccggaaccacactaagct

SEQ ID NO: 770657 - DNA, 25 bp, Mus musculus
tagacagccggatccacactaagct

SEQ ID NO: 770658 - DNA, 25 bp, Mus musculus
tagacagcctagactctcttcagat

SEQ ID NO: 770659 - DNA, 25 bp, Mus musculus
tagacagcctagtctctcttcagat

SEQ ID NO: 770660 - DNA, 25 bp, Mus musculus
tagacagcgcgaaagagttgtggtt

SEQ ID NO: 770661 - DNA, 25 bp, Mus musculus
tagacagcgcgatagagttgtggtt

SEQ ID NO: 770662 - DNA, 25 bp, Mus musculus
tagacagcgcttcgcccgtggcatc

SEQ ID NO: 770663 - DNA, 25 bp, Mus musculus
tagacagcgcttggcccgtggcatc

SEQ ID NO: 770664 - DNA, 25 bp, Mus musculus
tagacagcgtggacccagacagtgg

SEQ ID NO: 770665 - DNA, 25 bp, Mus musculus
tagacagcgtggtcccagacagtgg

SEQ ID NO: 770666 - DNA, 25 bp, Mus musculus
tagacagctgcacctagaagttcca

SEQ ID NO: 770667 - DNA, 25 bp, Mus musculus
tagacagctgcagctagaagttcca

SEQ ID NO: 770668 - DNA, 25 bp, Mus musculus
tagacagctgctcacttatccaggg

SEQ ID NO: 770669 - DNA, 25 bp, Mus musculus
tagacagctgctgacttatccaggg

SEQ ID NO: 770670 - DNA, 25 bp, Mus musculus
tagacagctggtcactttttggcac

SEQ ID NO: 770671 - DNA, 25 bp, Mus musculus
tagacagctggtgactttttggcac

SEQ ID NO: 770672 - DNA, 25 bp, Mus musculus
tagacagctgtgaaccaccctatgg

SEQ ID NO: 770673 - DNA, 25 bp, Mus musculus
tagacagctgtgtaccaccctatgg

SEQ ID NO: 770674 - DNA, 25 bp, Mus musculus
tagacaggaaggcaaggctacccca

SEQ ID NO: 770675 - DNA, 25 bp, Mus musculus
tagacaggaagggaaggctacccca

SEQ ID NO: 770676 - DNA, 25 bp, Mus musculus
tagacaggaatcaccagccactatc

SEQ ID NO: 770677 - DNA, 25 bp, Mus musculus
tagacaggaatctccagccactatc

SEQ ID NO: 770678 - DNA, 25 bp, Mus musculus
tagacaggactgagctgctcccgtt

SEQ ID NO: 770679 - DNA, 25 bp, Mus musculus
tagacaggactgtgctgctcccgtt

SEQ ID NO: 770680 - DNA, 25 bp, Mus musculus
tagacaggaggtccagcttccagct

SEQ ID NO: 770681 - DNA, 25 bp, Mus musculus
tagacaggaggtgcagcttccagct

SEQ ID NO: 770682 - DNA, 25 bp, Mus musculus
tagacaggcagcattcacctcagtg

SEQ ID NO: 770683 - DNA, 25 bp, Mus musculus
tagacaggcagctttcacctcagtg

SEQ ID NO: 770684 - DNA, 25 bp, Mus musculus
tagacaggctggctttgggacttca

SEQ ID NO: 770685 - DNA, 25 bp, Mus musculus
tagacaggctgggtttgggacttca

SEQ ID NO: 770686 - DNA, 25 bp, Mus musculus
tagacagggcccaaagtgtgccctt

SEQ ID NO: 770687 - DNA, 25 bp, Mus musculus
tagacagggccctaagtgtgccctt

SEQ ID NO: 770688 - DNA, 25 bp, Mus musculus
tagacagggctcaatttcctgttcc

SEQ ID NO: 770689 - DNA, 25 bp, Mus musculus
tagacagggctctatttcctgttcc

SEQ ID NO: 770690 - DNA, 25 bp, Mus musculus
tagacaggtctacagtttggatgag

SEQ ID NO: 770691 - DNA, 25 bp, Mus musculus
tagacaggtctagagtttggatgag

SEQ ID NO: 770692 - DNA, 25 bp, Mus musculus
tagacaggttagagattgcatcaca

SEQ ID NO: 770693 - DNA, 25 bp, Mus musculus
tagacaggttagtgattgcatcaca

SEQ ID NO: 770694 - DNA, 25 bp, Mus musculus
tagacagtcaggctggactggccct

SEQ ID NO: 770695 - DNA, 25 bp, Mus musculus
tagacagtcagggtggactggccct

SEQ ID NO: 770696 - DNA, 25 bp, Mus musculus
tagacagtccaacttttgccggcca

SEQ ID NO: 770697 - DNA, 25 bp, Mus musculus
tagacagtccaagttttgccggcca

SEQ ID NO: 770698 - DNA, 25 bp, Mus musculus
tagacagtcctaaccattcaggcaa

SEQ ID NO: 770699 - DNA, 25 bp, Mus musculus
tagacagtcctatccattcaggcaa

SEQ ID NO: 770700 - DNA, 25 bp, Mus musculus
tagacagtccttaagtttccagaaa

SEQ ID NO: 770701 - DNA, 25 bp, Mus musculus
tagacagtcctttagtttccagaaa

SEQ ID NO: 770702 - DNA, 25 bp, Mus musculus
tagacagtcgagagtggcaggcctc

SEQ ID NO: 770703 - DNA, 25 bp, Mus musculus
tagacagtcgagtgtggcaggcctc

SEQ ID NO: 770704 - DNA, 25 bp, Mus musculus
tagacagtctagatacactcttctc

SEQ ID NO: 770705 - DNA, 25 bp, Mus musculus
tagacagtctagttacactcttctc

SEQ ID NO: 770706 - DNA, 25 bp, Mus musculus
tagacagtgatgctggagaagcaat

SEQ ID NO: 770707 - DNA, 25 bp, Mus musculus
tagacagtgatggtggagaagcaat

SEQ ID NO: 770708 - DNA, 25 bp, Mus musculus
tagacagttaagagctgccctgtgg

SEQ ID NO: 770709 - DNA, 25 bp, Mus musculus
tagacagttaagtgctgccctgtgg

SEQ ID NO: 770710 - DNA, 25 bp, Mus musculus
tagacagttacaatgtggaatccac

SEQ ID NO: 770711 - DNA, 25 bp, Mus musculus
tagacagttacattgtggaatccac

SEQ ID NO: 770712 - DNA, 25 bp, Mus musculus
tagacagttgtcacagcacaccagt

SEQ ID NO: 770713 - DNA, 25 bp, Mus musculus
tagacagttgtctcagcacaccagt

SEQ ID NO: 770714 - DNA, 25 bp, Mus musculus
tagacagtttataatggcacatcag

SEQ ID NO: 770715 - DNA, 25 bp, Mus musculus
tagacagtttattatggcacatcag

SEQ ID NO: 770716 - DNA, 25 bp, Mus musculus
tagacataacttctagcaagcttag

SEQ ID NO: 770717 - DNA, 25 bp, Mus musculus
tagacataacttgtagcaagcttag

SEQ ID NO: 770718 - DNA, 25 bp, Mus musculus
tagacataaggccatctcctactgg

SEQ ID NO: 770719 - DNA, 25 bp, Mus musculus
tagacataaggcgatctcctactgg

SEQ ID NO: 770720 - DNA, 25 bp, Mus musculus
tagacatagagtaagccaggcagtg

SEQ ID NO: 770721 - DNA, 25 bp, Mus musculus
tagacatagagttagccaggcagtg

SEQ ID NO: 770722 - DNA, 25 bp, Mus musculus
tagacatagatactgcagcctgccc

SEQ ID NO: 770723 - DNA, 25 bp, Mus musculus
tagacatagatagtgcagcctgccc

SEQ ID NO: 770724 - DNA, 25 bp, Mus musculus
tagacatagcatatggttctgattt

SEQ ID NO: 770725 - DNA, 25 bp, Mus musculus
tagacatagcatttggttctgattt

SEQ ID NO: 770726 - DNA, 25 bp, Mus musculus
tagacatattctagctcccatcagc

SEQ ID NO: 770727 - DNA, 25 bp, Mus musculus
tagacatattcttgctcccatcagc

SEQ ID NO: 770728 - DNA, 25 bp, Mus musculus
tagacatcacccatcttaacttcat

SEQ ID NO: 770729 - DNA, 25 bp, Mus musculus
tagacatcacccttcttaacttcat

SEQ ID NO: 770730 - DNA, 25 bp, Mus musculus
tagacatcactactcactgaataca

SEQ ID NO: 770731 - DNA, 25 bp, Mus musculus
tagacatcactagtcactgaataca

SEQ ID NO: 770732 - DNA, 25 bp, Mus musculus
tagacatcaggcagcacttctaacc

SEQ ID NO: 770733 - DNA, 25 bp, Mus musculus
tagacatcaggcagcaggacactca

SEQ ID NO: 770734 - DNA, 25 bp, Mus musculus
tagacatcaggctgcacttctaacc

SEQ ID NO: 770735 - DNA, 25 bp, Mus musculus
tagacatcaggctgcaggacactca

SEQ ID NO: 770736 - DNA, 25 bp, Mus musculus
tagacatcgctgatcgaagccaagt

SEQ ID NO: 770737 - DNA, 25 bp, Mus musculus
tagacatcgctgttcgaagccaagt

SEQ ID NO: 770738 - DNA, 25 bp, Mus musculus
tagacatctccgactgtagactctg

SEQ ID NO: 770739 - DNA, 25 bp, Mus musculus
tagacatctccgtctgtagactctg

SEQ ID NO: 770740 - DNA, 25 bp, Mus musculus
tagacatctctacattccccaatgt

SEQ ID NO: 770741 - DNA, 25 bp, Mus musculus
tagacatctctagattccccaatgt

SEQ ID NO: 770742 - DNA, 25 bp, Mus musculus
tagacatctgccaacatcctggaat

SEQ ID NO: 770743 - DNA, 25 bp, Mus musculus
tagacatctgcctacatcctggaat

SEQ ID NO: 770744 - DNA, 25 bp, Mus musculus
tagacatcttcgagggctgcaactt

SEQ ID NO: 770745 - DNA, 25 bp, Mus musculus
tagacatcttcgtgggctgcaactt

SEQ ID NO: 770746 - DNA, 25 bp, Mus musculus
tagacatgaaatcaccccacagggt

SEQ ID NO: 770747 - DNA, 25 bp, Mus musculus
tagacatgaaatgaccccacagggt

SEQ ID NO: 770748 - DNA, 25 bp, Mus musculus
tagacatgacacagaaagacggaca

SEQ ID NO: 770749 - DNA, 25 bp, Mus musculus
tagacatgacactgaaagacggaca

SEQ ID NO: 770750 - DNA, 25 bp, Mus musculus
tagacatgagcccttaatccctgcg

SEQ ID NO: 770751 - DNA, 25 bp, Mus musculus
tagacatgagccgttaatccctgcg

SEQ ID NO: 770752 - DNA, 25 bp, Mus musculus
tagacatgagtcctcactctgtgtc

SEQ ID NO: 770753 - DNA, 25 bp, Mus musculus
tagacatgagtcgtcactctgtgtc

SEQ ID NO: 770754 - DNA, 25 bp, Mus musculus
tagacatgatcccttcttttttggc

SEQ ID NO: 770755 - DNA, 25 bp, Mus musculus
tagacatgatccgttcttttttggc

SEQ ID NO: 770756 - DNA, 25 bp, Mus musculus
tagacatgcagaagctctgtcttct

SEQ ID NO: 770757 - DNA, 25 bp, Mus musculus
tagacatgcagatgctctgtcttct

SEQ ID NO: 770758 - DNA, 25 bp, Mus musculus
tagacatgccatactgttgacaaca

SEQ ID NO: 770759 - DNA, 25 bp, Mus musculus
tagacatgccatctaacgctactca

SEQ ID NO: 770760 - DNA, 25 bp, Mus musculus
tagacatgccatgtaacgctactca

SEQ ID NO: 770761 - DNA, 25 bp, Mus musculus
tagacatgccattctgttgacaaca

SEQ ID NO: 770762 - DNA, 25 bp, Mus musculus
tagacatggtgtcggggctccccac

SEQ ID NO: 770763 - DNA, 25 bp, Mus musculus
tagacatggtgtgggggctccccac

SEQ ID NO: 770764 - DNA, 25 bp, Mus musculus
tagacatgtacaaacttttccctgt

SEQ ID NO: 770765 - DNA, 25 bp, Mus musculus
tagacatgtacatacttttccctgt

SEQ ID NO: 770766 - DNA, 25 bp, Mus musculus
tagacatgtatgatccagggatcat

SEQ ID NO: 770767 - DNA, 25 bp, Mus musculus
tagacatgtatgttccagggatcat

SEQ ID NO: 770768 - DNA, 25 bp, Mus musculus
tagacattcagaccattccaccagt

SEQ ID NO: 770769 - DNA, 25 bp, Mus musculus
tagacattcagagcattccaccagt

SEQ ID NO: 770770 - DNA, 25 bp, Mus musculus
tagacattctatattaaacactaat

SEQ ID NO: 770771 - DNA, 25 bp, Mus musculus
tagacattctattttaaacactaat

SEQ ID NO: 770772 - DNA, 25 bp, Mus musculus
tagacattctgtatggttccttcct

SEQ ID NO: 770773 - DNA, 25 bp, Mus musculus
tagacattctgtttggttccttcct

SEQ ID NO: 770774 - DNA, 25 bp, Mus musculus
tagacattgctccaaggtatgccag

SEQ ID NO: 770775 - DNA, 25 bp, Mus musculus
tagacattgctcgaaggtatgccag

SEQ ID NO: 770776 - DNA, 25 bp, Mus musculus
tagacattggtacacacagcgcttc

SEQ ID NO: 770777 - DNA, 25 bp, Mus musculus
tagacattggtagacacagcgcttc

SEQ ID NO: 770778 - DNA, 25 bp, Mus musculus
tagacatttagacgctcccttttgc

SEQ ID NO: 770779 - DNA, 25 bp, Mus musculus
tagacatttagaggctcccttttgc

SEQ ID NO: 770780 - DNA, 25 bp, Mus musculus
tagacatttcccactttgatgctag

SEQ ID NO: 770781 - DNA, 25 bp, Mus musculus
tagacatttccctctttgatgctag

SEQ ID NO: 770782 - DNA, 25 bp, Mus musculus
tagacatttctcagcctcctgatgt

SEQ ID NO: 770783 - DNA, 25 bp, Mus musculus
tagacatttctctgcctcctgatgt

SEQ ID NO: 770784 - DNA, 25 bp, Mus musculus
tagacatttctgaattaagtcccag

SEQ ID NO: 770785 - DNA, 25 bp, Mus musculus
tagacatttctgtattaagtcccag

SEQ ID NO: 770786 - DNA, 25 bp, Mus musculus
tagacatttgaaacttccttccagg

SEQ ID NO: 770787 - DNA, 25 bp, Mus musculus
tagacatttgaatcttccttccagg

SEQ ID NO: 770788 - DNA, 25 bp, Mus musculus
tagacattttatagcatttctgccg

SEQ ID NO: 770789 - DNA, 25 bp, Mus musculus
tagacattttattgcatttctgccg

SEQ ID NO: 770790 - DNA, 25 bp, Mus musculus
tagaccaaactcatccgcaactatg

SEQ ID NO: 770791 - DNA, 25 bp, Mus musculus
tagaccaaactcttccgcaactatg

SEQ ID NO: 770792 - DNA, 25 bp, Mus musculus
tagaccaaagagcaaccagcataga

SEQ ID NO: 770793 - DNA, 25 bp, Mus musculus
tagaccaaagaggaaccagcataga

SEQ ID NO: 770794 - DNA, 25 bp, Mus musculus
tagaccaaagtcagctgtagaacaa

SEQ ID NO: 770795 - DNA, 25 bp, Mus musculus
tagaccaaagtctgctgtagaacaa

SEQ ID NO: 770796 - DNA, 25 bp, Mus musculus
tagaccaattctatcctcaggaaat

SEQ ID NO: 770797 - DNA, 25 bp, Mus musculus
tagaccaattctttcctcaggaaat

SEQ ID NO: 770798 - DNA, 25 bp, Mus musculus
tagaccacaattcgcctgtttggga

SEQ ID NO: 770799 - DNA, 25 bp, Mus musculus
tagaccacaattggcctgtttggga

SEQ ID NO: 770800 - DNA, 25 bp, Mus musculus
tagaccacagagacgtcagatgtca

SEQ ID NO: 770801 - DNA, 25 bp, Mus musculus
tagaccacagagtcgtcagatgtca

SEQ ID NO: 770802 - DNA, 25 bp, Mus musculus
tagaccaccaccaaatcgtacagat

SEQ ID NO: 770803 - DNA, 25 bp, Mus musculus
tagaccaccacctaatcgtacagat

SEQ ID NO: 770804 - DNA, 25 bp, Mus musculus
tagaccacccgcatctcaaaagtgg

SEQ ID NO: 770805 - DNA, 25 bp, Mus musculus
tagaccacccgcttctcaaaagtgg

SEQ ID NO: 770806 - DNA, 25 bp, Mus musculus
tagaccacccggagtttatactctt

SEQ ID NO: 770807 - DNA, 25 bp, Mus musculus
tagaccacccggtgtttatactctt

SEQ ID NO: 770808 - DNA, 25 bp, Mus musculus
tagaccaccgagcagttcccaagaa

SEQ ID NO: 770809 - DNA, 25 bp, Mus musculus
tagaccaccgaggagttcccaagaa

SEQ ID NO: 770810 - DNA, 25 bp, Mus musculus
tagaccacgactccagggctgacgg

SEQ ID NO: 770811 - DNA, 25 bp, Mus musculus
tagaccacgactgcagggctgacgg

SEQ ID NO: 770812 - DNA, 25 bp, Mus musculus
tagaccacgcccatgttctcagaag

SEQ ID NO: 770813 - DNA, 25 bp, Mus musculus
tagaccacgcccttgttctcagaag

SEQ ID NO: 770814 - DNA, 25 bp, Mus musculus
tagaccacggccagttactgacctt

SEQ ID NO: 770815 - DNA, 25 bp, Mus musculus
tagaccacggcctgttactgacctt

SEQ ID NO: 770816 - DNA, 25 bp, Mus musculus
tagaccacgtatactatacgtttta

SEQ ID NO: 770817 - DNA, 25 bp, Mus musculus
tagaccacgtattctatacgtttta

SEQ ID NO: 770818 - DNA, 25 bp, Mus musculus
tagaccagacagacagagtccagct

SEQ ID NO: 770819 - DNA, 25 bp, Mus musculus
tagaccagacagtcagagtccagct

SEQ ID NO: 770820 - DNA, 25 bp, Mus musculus
tagaccagatttctatttgcacagt

SEQ ID NO: 770821 - DNA, 25 bp, Mus musculus
tagaccagatttgtatttgcacagt

SEQ ID NO: 770822 - DNA, 25 bp, Mus musculus
tagaccagcacacagttttgactta

SEQ ID NO: 770823 - DNA, 25 bp, Mus musculus
tagaccagcacagagttttgactta

SEQ ID NO: 770824 - DNA, 25 bp, Mus musculus
tagaccagcatgcccagtacccagt

SEQ ID NO: 770825 - DNA, 25 bp, Mus musculus
tagaccagcatggccagtacccagt

SEQ ID NO: 770826 - DNA, 25 bp, Mus musculus
tagaccagccgtataactgtgtgat

SEQ ID NO: 770827 - DNA, 25 bp, Mus musculus
tagaccagccgtttaactgtgtgat

SEQ ID NO: 770828 - DNA, 25 bp, Mus musculus
tagaccagccttcgtattgtcattc

SEQ ID NO: 770829 - DNA, 25 bp, Mus musculus
tagaccagccttggtattgtcattc

SEQ ID NO: 770830 - DNA, 25 bp, Mus musculus
tagaccagctgcaccaaatgagtaa

SEQ ID NO: 770831 - DNA, 25 bp, Mus musculus
tagaccagctgctccaaatgagtaa

SEQ ID NO: 770832 - DNA, 25 bp, Mus musculus
tagaccaggactctctgaggtctgc

SEQ ID NO: 770833 - DNA, 25 bp, Mus musculus
tagaccaggactgtctgaggtctgc

SEQ ID NO: 770834 - DNA, 25 bp, Mus musculus
tagaccaggatcaggccattgtaat

SEQ ID NO: 770835 - DNA, 25 bp, Mus musculus
tagaccaggatctggccattgtaat

SEQ ID NO: 770836 - DNA, 25 bp, Mus musculus
tagaccaggcgcattgcggtgacag

SEQ ID NO: 770837 - DNA, 25 bp, Mus musculus
tagaccaggcgctttgcggtgacag

SEQ ID NO: 770838 - DNA, 25 bp, Mus musculus
tagaccaggctacctgaggctacat

SEQ ID NO: 770839 - DNA, 25 bp, Mus musculus
tagaccaggctagctgaggctacat

SEQ ID NO: 770840 - DNA, 25 bp, Mus musculus
tagaccagggttcctagaccattgg

SEQ ID NO: 770841 - DNA, 25 bp, Mus musculus
tagaccagggttgctagaccattgg

SEQ ID NO: 770842 - DNA, 25 bp, Mus musculus
tagaccaggtagctatcgtcctttt

SEQ ID NO: 770843 - DNA, 25 bp, Mus musculus
tagaccaggtaggtatcgtcctttt

SEQ ID NO: 770844 - DNA, 25 bp, Mus musculus
tagaccaggttgacccagagatata

SEQ ID NO: 770845 - DNA, 25 bp, Mus musculus
tagaccaggttgtcccagagatata

SEQ ID NO: 770846 - DNA, 25 bp, Mus musculus
tagaccagtatgcataactcagctg

SEQ ID NO: 770847 - DNA, 25 bp, Mus musculus
tagaccagtatggataactcagctg

SEQ ID NO: 770848 - DNA, 25 bp, Mus musculus
tagaccagtgtaagctttttatact

SEQ ID NO: 770849 - DNA, 25 bp, Mus musculus
tagaccagtgtatgctttttatact

SEQ ID NO: 770850 - DNA, 25 bp, Mus musculus
tagaccataacaccacgactgagag

SEQ ID NO: 770851 - DNA, 25 bp, Mus musculus
tagaccataacagcacgactgagag

SEQ ID NO: 770852 - DNA, 25 bp, Mus musculus
tagaccataggacgcaatgcagctg

SEQ ID NO: 770853 - DNA, 25 bp, Mus musculus
tagaccataggaggcaatgcagctg

SEQ ID NO: 770854 - DNA, 25 bp, Mus musculus
tagaccatcagaaatatgcgtgcgt

SEQ ID NO: 770855 - DNA, 25 bp, Mus musculus
tagaccatcagatatatgcgtgcgt

SEQ ID NO: 770856 - DNA, 25 bp, Mus musculus
tagaccatggtcacacacccagtgt

SEQ ID NO: 770857 - DNA, 25 bp, Mus musculus
tagaccatggtctcacacccagtgt

SEQ ID NO: 770858 - DNA, 25 bp, Mus musculus
tagaccatgtctctggcccattttc

SEQ ID NO: 770859 - DNA, 25 bp, Mus musculus
tagaccatgtctgtggcccattttc

SEQ ID NO: 770860 - DNA, 25 bp, Mus musculus
tagaccattggtagccttggctctt

SEQ ID NO: 770861 - DNA, 25 bp, Mus musculus
tagaccattggttgccttggctctt

SEQ ID NO: 770862 - DNA, 25 bp, Mus musculus
tagaccatttttaatgttcgtcagg

SEQ ID NO: 770863 - DNA, 25 bp, Mus musculus
tagaccattttttatgttcgtcagg

SEQ ID NO: 770864 - DNA, 25 bp, Mus musculus
tagacccacgttaactgctatctca

SEQ ID NO: 770865 - DNA, 25 bp, Mus musculus
tagacccacgtttactgctatctca

SEQ ID NO: 770866 - DNA, 25 bp, Mus musculus
tagacccagatcataggagacagag

SEQ ID NO: 770867 - DNA, 25 bp, Mus musculus
tagacccagatcttaggagacagag

SEQ ID NO: 770868 - DNA, 25 bp, Mus musculus
tagacccaggatcgacccttcagtt

SEQ ID NO: 770869 - DNA, 25 bp, Mus musculus
tagacccaggatggacccttcagtt

SEQ ID NO: 770870 - DNA, 25 bp, Mus musculus
tagacccaggtacccgagccctgat

SEQ ID NO: 770871 - DNA, 25 bp, Mus musculus
tagacccaggtagccgagccctgat

SEQ ID NO: 770872 - DNA, 25 bp, Mus musculus
tagacccagttccatatacacttct

SEQ ID NO: 770873 - DNA, 25 bp, Mus musculus
tagacccagttcgatatacacttct

SEQ ID NO: 770874 - DNA, 25 bp, Mus musculus
tagacccattccaaaaacccaggag

SEQ ID NO: 770875 - DNA, 25 bp, Mus musculus
tagacccattcctaaaacccaggag

SEQ ID NO: 770876 - DNA, 25 bp, Mus musculus
tagacccattggaaggtgctgccct

SEQ ID NO: 770877 - DNA, 25 bp, Mus musculus
tagacccattggtaggtgctgccct

SEQ ID NO: 770878 - DNA, 25 bp, Mus musculus
tagaccccaaatacatcgctgatgc

SEQ ID NO: 770879 - DNA, 25 bp, Mus musculus
tagaccccaaattcatcgctgatgc

SEQ ID NO: 770880 - DNA, 25 bp, Mus musculus
tagaccccaagtcacagtggcgaag

SEQ ID NO: 770881 - DNA, 25 bp, Mus musculus
tagaccccaagtgacagtggcgaag

SEQ ID NO: 770882 - DNA, 25 bp, Mus musculus
tagaccccagcaaagtgttcaagag

SEQ ID NO: 770883 - DNA, 25 bp, Mus musculus
tagaccccagcatagtgttcaagag

SEQ ID NO: 770884 - DNA, 25 bp, Mus musculus
tagaccccgagtcgccgcagaatcg

SEQ ID NO: 770885 - DNA, 25 bp, Mus musculus
tagaccccgagtggccgcagaatcg

SEQ ID NO: 770886 - DNA, 25 bp, Mus musculus
tagaccccggatagagaccttacag

SEQ ID NO: 770887 - DNA, 25 bp, Mus musculus
tagaccccggattgagaccttacag

SEQ ID NO: 770888 - DNA, 25 bp, Mus musculus
tagaccccggtaacatttctgcaag

SEQ ID NO: 770889 - DNA, 25 bp, Mus musculus
tagaccccggtatcatttctgcaag

SEQ ID NO: 770890 - DNA, 25 bp, Mus musculus
tagaccccgttgaccactgggaaga

SEQ ID NO: 770891 - DNA, 25 bp, Mus musculus
tagaccccgttgtccactgggaaga

SEQ ID NO: 770892 - DNA, 25 bp, Mus musculus
tagacccgagggagaccagggtcct

SEQ ID NO: 770893 - DNA, 25 bp, Mus musculus
tagacccgagggtgaccagggtcct

SEQ ID NO: 770894 - DNA, 25 bp, Mus musculus
tagacccggacgaagtcatcaaagt

SEQ ID NO: 770895 - DNA, 25 bp, Mus musculus
tagacccggacgtagtcatcaaagt

SEQ ID NO: 770896 - DNA, 25 bp, Mus musculus
tagacccggctgcacagcgctgtgt

SEQ ID NO: 770897 - DNA, 25 bp, Mus musculus
tagacccggctggacagcgctgtgt

SEQ ID NO: 770898 - DNA, 25 bp, Mus musculus
tagaccctattgagtgtgagcagca

SEQ ID NO: 770899 - DNA, 25 bp, Mus musculus
tagaccctattgtgtgtgagcagca

SEQ ID NO: 770900 - DNA, 25 bp, Mus musculus
tagaccctcactcttcagcagacag

SEQ ID NO: 770901 - DNA, 25 bp, Mus musculus
tagaccctcactgttcagcagacag

SEQ ID NO: 770902 - DNA, 25 bp, Mus musculus
tagaccctcctaatgcttctgtact

SEQ ID NO: 770903 - DNA, 25 bp, Mus musculus
tagaccctcctattgcttctgtact

SEQ ID NO: 770904 - DNA, 25 bp, Mus musculus
tagaccctcctgctactgtgtgtat

SEQ ID NO: 770905 - DNA, 25 bp, Mus musculus
tagaccctcctggtactgtgtgtat

SEQ ID NO: 770906 - DNA, 25 bp, Mus musculus
tagaccctgaaaatctccacttcaa

SEQ ID NO: 770907 - DNA, 25 bp, Mus musculus
tagaccctgaaattctccacttcaa

SEQ ID NO: 770908 - DNA, 25 bp, Mus musculus
tagaccctgaaccagcaagtggaga

SEQ ID NO: 770909 - DNA, 25 bp, Mus musculus
tagaccctgaacgagcaagtggaga

SEQ ID NO: 770910 - DNA, 25 bp, Mus musculus
tagaccctgacacgtggatgttctt

SEQ ID NO: 770911 - DNA, 25 bp, Mus musculus
tagaccctgacaggtggatgttctt

SEQ ID NO: 770912 - DNA, 25 bp, Mus musculus
tagaccctgaggacacttgtgacgt

SEQ ID NO: 770913 - DNA, 25 bp, Mus musculus
tagaccctgaggtcacttgtgacgt

SEQ ID NO: 770914 - DNA, 25 bp, Mus musculus
tagaccctgccacttctaggagcca

SEQ ID NO: 770915 - DNA, 25 bp, Mus musculus
tagaccctgccagttctaggagcca

SEQ ID NO: 770916 - DNA, 25 bp, Mus musculus
tagaccctgtgtactcccttagagt

SEQ ID NO: 770917 - DNA, 25 bp, Mus musculus
tagaccctgtgttctcccttagagt

SEQ ID NO: 770918 - DNA, 25 bp, Mus musculus
tagacccttatgaacagacctgtgt

SEQ ID NO: 770919 - DNA, 25 bp, Mus musculus
tagacccttatgtacagacctgtgt

SEQ ID NO: 770920 - DNA, 25 bp, Mus musculus
tagacccttgggactagcgagttcc

SEQ ID NO: 770921 - DNA, 25 bp, Mus musculus
tagacccttgggtctagcgagttcc

SEQ ID NO: 770922 - DNA, 25 bp, Mus musculus
tagacccttgtcagaaaaacagtat

SEQ ID NO: 770923 - DNA, 25 bp, Mus musculus
tagacccttgtctgaaaaacagtat

SEQ ID NO: 770924 - DNA, 25 bp, Mus musculus
tagaccctttctcctttatacgtgt

SEQ ID NO: 770925 - DNA, 25 bp, Mus musculus
tagaccctttctgctttatacgtgt

SEQ ID NO: 770926 - DNA, 25 bp, Mus musculus
tagaccgatctgaagaagaggacct

SEQ ID NO: 770927 - DNA, 25 bp, Mus musculus
tagaccgatctgtagaagaggacct

SEQ ID NO: 770928 - DNA, 25 bp, Mus musculus
tagaccgatgcaacttacctttttc

SEQ ID NO: 770929 - DNA, 25 bp, Mus musculus
tagaccgatgcatcttacctttttc

SEQ ID NO: 770930 - DNA, 25 bp, Mus musculus
tagaccgctacccatggaagtgcat

SEQ ID NO: 770931 - DNA, 25 bp, Mus musculus
tagaccgctaccgatggaagtgcat

SEQ ID NO: 770932 - DNA, 25 bp, Mus musculus
tagaccgctactaggagcctgttca

SEQ ID NO: 770933 - DNA, 25 bp, Mus musculus
tagaccgctacttggagcctgttca

SEQ ID NO: 770934 - DNA, 25 bp, Mus musculus
tagaccggaagcaacagtttaccca

SEQ ID NO: 770935 - DNA, 25 bp, Mus musculus
tagaccggaagctacagtttaccca

SEQ ID NO: 770936 - DNA, 25 bp, Mus musculus
tagaccggcagaagctcaccgatgt

SEQ ID NO: 770937 - DNA, 25 bp, Mus musculus
tagaccggcagatgctcaccgatgt

SEQ ID NO: 770938 - DNA, 25 bp, Mus musculus
tagaccggtatcagtgcaccaaatg

SEQ ID NO: 770939 - DNA, 25 bp, Mus musculus
tagaccggtatctgtgcaccaaatg

SEQ ID NO: 770940 - DNA, 25 bp, Mus musculus
tagaccgtctttctcatttccacag

SEQ ID NO: 770941 - DNA, 25 bp, Mus musculus
tagaccgtctttgtcatttccacag

SEQ ID NO: 770942 - DNA, 25 bp, Mus musculus
tagaccgtgcttactgtggcagctt

SEQ ID NO: 770943 - DNA, 25 bp, Mus musculus
tagaccgtgctttctgtggcagctt

SEQ ID NO: 770944 - DNA, 25 bp, Mus musculus
tagaccgtggggctcccactactgg

SEQ ID NO: 770945 - DNA, 25 bp, Mus musculus
tagaccgtgggggtcccactactgg

SEQ ID NO: 770946 - DNA, 25 bp, Mus musculus
tagaccgtgtgaacatcgagctgga

SEQ ID NO: 770947 - DNA, 25 bp, Mus musculus
tagaccgtgtgatcatcgagctgga

SEQ ID NO: 770948 - DNA, 25 bp, Mus musculus
tagaccgtttctatccatgataata

SEQ ID NO: 770949 - DNA, 25 bp, Mus musculus
tagaccgtttctttccatgataata

SEQ ID NO: 770950 - DNA, 25 bp, Mus musculus
tagacctagagactcttctcggcct

SEQ ID NO: 770951 - DNA, 25 bp, Mus musculus
tagacctagagagtcttctcggcct

SEQ ID NO: 770952 - DNA, 25 bp, Mus musculus
tagacctagatacttgtttctcaca

SEQ ID NO: 770953 - DNA, 25 bp, Mus musculus
tagacctagatagttgtttctcaca

SEQ ID NO: 770954 - DNA, 25 bp, Mus musculus
tagacctagtaactgagcccagtgt

SEQ ID NO: 770955 - DNA, 25 bp, Mus musculus
tagacctagtaagtgagcccagtgt

SEQ ID NO: 770956 - DNA, 25 bp, Mus musculus
tagacctatctcaacacgacactgt

SEQ ID NO: 770957 - DNA, 25 bp, Mus musculus
tagacctatctctacacgacactgt

SEQ ID NO: 770958 - DNA, 25 bp, Mus musculus
tagacctcaccaagaaagcaggatt

SEQ ID NO: 770959 - DNA, 25 bp, Mus musculus
tagacctcaccatgaaagcaggatt

SEQ ID NO: 770960 - DNA, 25 bp, Mus musculus
tagacctcacttaatacaaaactta

SEQ ID NO: 770961 - DNA, 25 bp, Mus musculus
tagacctcactttatacaaaactta

SEQ ID NO: 770962 - DNA, 25 bp, Mus musculus
tagacctcagcccactcaatggagg

SEQ ID NO: 770963 - DNA, 25 bp, Mus musculus
tagacctcagccgactcaatggagg

SEQ ID NO: 770964 - DNA, 25 bp, Mus musculus
tagacctcatctagcatttgcctgg

SEQ ID NO: 770965 - DNA, 25 bp, Mus musculus
tagacctcatcttgcatttgcctgg

SEQ ID NO: 770966 - DNA, 25 bp, Mus musculus
tagacctccagacaccggctagcaa

SEQ ID NO: 770967 - DNA, 25 bp, Mus musculus
tagacctccagacatgccatgtatt

SEQ ID NO: 770968 - DNA, 25 bp, Mus musculus
tagacctccagactacctgtatgac

SEQ ID NO: 770969 - DNA, 25 bp, Mus musculus
tagacctccagagaccggctagcaa

SEQ ID NO: 770970 - DNA, 25 bp, Mus musculus
tagacctccagagatgccatgtatt

SEQ ID NO: 770971 - DNA, 25 bp, Mus musculus
tagacctccagagtacctgtatgac

SEQ ID NO: 770972 - DNA, 25 bp, Mus musculus
tagacctccattacctagagattaa

SEQ ID NO: 770973 - DNA, 25 bp, Mus musculus
tagacctccatttcctagagattaa

SEQ ID NO: 770974 - DNA, 25 bp, Mus musculus
tagacctccgtaaaagtgcttcatc

SEQ ID NO: 770975 - DNA, 25 bp, Mus musculus
tagacctccgtataagtgcttcatc

SEQ ID NO: 770976 - DNA, 25 bp, Mus musculus
tagacctcgatcaaactcaactgag

SEQ ID NO: 770977 - DNA, 25 bp, Mus musculus
tagacctcgatctaactcaactgag

SEQ ID NO: 770978 - DNA, 25 bp, Mus musculus
tagacctcgctgcatgataacccat

SEQ ID NO: 770979 - DNA, 25 bp, Mus musculus
tagacctcgctggatgataacccat

SEQ ID NO: 770980 - DNA, 25 bp, Mus musculus
tagacctgaacaacagtcacatggt

SEQ ID NO: 770981 - DNA, 25 bp, Mus musculus
tagacctgaacatcagtcacatggt

SEQ ID NO: 770982 - DNA, 25 bp, Mus musculus
tagacctgaagtaagactgggctac

SEQ ID NO: 770983 - DNA, 25 bp, Mus musculus
tagacctgaagttagactgggctac

SEQ ID NO: 770984 - DNA, 25 bp, Mus musculus
tagacctgacagcattagctgtagt

SEQ ID NO: 770985 - DNA, 25 bp, Mus musculus
tagacctgacaggattagctgtagt

SEQ ID NO: 770986 - DNA, 25 bp, Mus musculus
tagacctgagccagtcggacccggg

SEQ ID NO: 770987 - DNA, 25 bp, Mus musculus
tagacctgagcctgtcggacccggg

SEQ ID NO: 770988 - DNA, 25 bp, Mus musculus
tagacctgcaacagctagtgcccca

SEQ ID NO: 770989 - DNA, 25 bp, Mus musculus
tagacctgcaactgctagtgcccca

SEQ ID NO: 770990 - DNA, 25 bp, Mus musculus
tagacctgccacatgagttaaggtt

SEQ ID NO: 770991 - DNA, 25 bp, Mus musculus
tagacctgccacttgagttaaggtt

SEQ ID NO: 770992 - DNA, 25 bp, Mus musculus
tagacctgccttagcctgtcagcat

SEQ ID NO: 770993 - DNA, 25 bp, Mus musculus
tagacctgcctttgcctgtcagcat

SEQ ID NO: 770994 - DNA, 25 bp, Mus musculus
tagacctggagaagggccgtacgct

SEQ ID NO: 770995 - DNA, 25 bp, Mus musculus
tagacctggagatgggccgtacgct

SEQ ID NO: 770996 - DNA, 25 bp, Mus musculus
tagacctggcataactgccccaatg

SEQ ID NO: 770997 - DNA, 25 bp, Mus musculus
tagacctggcattactgccccaatg

SEQ ID NO: 770998 - DNA, 25 bp, Mus musculus
tagacctggctgaccatttccaaaa

SEQ ID NO: 770999 - DNA, 25 bp, Mus musculus
tagacctggctgtccatttccaaaa

SEQ ID NO: 771000 - DNA, 25 bp, Mus musculus
tagacctgggatacctgccgtgctg

SEQ ID NO: 771001 - DNA, 25 bp, Mus musculus
tagacctgggattcctgccgtgctg

SEQ ID NO: 771002 - DNA, 25 bp, Mus musculus
tagacctgggctccatgcaaggcca

SEQ ID NO: 771003 - DNA, 25 bp, Mus musculus
tagacctgggctgcatgcaaggcca

SEQ ID NO: 771004 - DNA, 25 bp, Mus musculus
tagacctgtctcctcttgtaggaca

SEQ ID NO: 771005 - DNA, 25 bp, Mus musculus
tagacctgtctcgtcttgtaggaca

SEQ ID NO: 771006 - DNA, 25 bp, Mus musculus
tagacctgttgtcaatgcactaccc

SEQ ID NO: 771007 - DNA, 25 bp, Mus musculus
tagacctgttgtgaatgcactaccc

SEQ ID NO: 771008 - DNA, 25 bp, Mus musculus
tagaccttcaggagccaacaacgat

SEQ ID NO: 771009 - DNA, 25 bp, Mus musculus
tagaccttcaggtgccaacaacgat

SEQ ID NO: 771010 - DNA, 25 bp, Mus musculus
tagaccttcatcacagagcccagag

SEQ ID NO: 771011 - DNA, 25 bp, Mus musculus
tagaccttcatctcagagcccagag

SEQ ID NO: 771012 - DNA, 25 bp, Mus musculus
tagaccttccacaccaatctagcag

SEQ ID NO: 771013 - DNA, 25 bp, Mus musculus
tagaccttccactccaatctagcag

SEQ ID NO: 771014 - DNA, 25 bp, Mus musculus
tagaccttcttcactgggcattaga

SEQ ID NO: 771015 - DNA, 25 bp, Mus musculus
tagaccttcttctctgggcattaga

SEQ ID NO: 771016 - DNA, 25 bp, Mus musculus
tagaccttgccactttttctccaaa

SEQ ID NO: 771017 - DNA, 25 bp, Mus musculus
tagaccttgccagtttttctccaaa

SEQ ID NO: 771018 - DNA, 25 bp, Mus musculus
tagaccttgtgacccttaacctgag

SEQ ID NO: 771019 - DNA, 25 bp, Mus musculus
tagaccttgtgagccttaacctgag

SEQ ID NO: 771020 - DNA, 25 bp, Mus musculus
tagaccttgttgctaggtgtggcat

SEQ ID NO: 771021 - DNA, 25 bp, Mus musculus
tagaccttgttggtaggtgtggcat

SEQ ID NO: 771022 - DNA, 25 bp, Mus musculus
tagacctttcctacaccgcaaatag

SEQ ID NO: 771023 - DNA, 25 bp, Mus musculus
tagacctttccttcaccgcaaatag

SEQ ID NO: 771024 - DNA, 25 bp, Mus musculus
tagacctttgtgagaaataaatcca

SEQ ID NO: 771025 - DNA, 25 bp, Mus musculus
tagacctttgtgtgaaataaatcca

SEQ ID NO: 771026 - DNA, 25 bp, Mus musculus
tagaccttttgtatttcctgccagt

SEQ ID NO: 771027 - DNA, 25 bp, Mus musculus
tagaccttttgtttttcctgccagt

SEQ ID NO: 771028 - DNA, 25 bp, Mus musculus
tagacgaagcccagagccacaaagt

SEQ ID NO: 771029 - DNA, 25 bp, Mus musculus
tagacgaagccctgagccacaaagt

SEQ ID NO: 771030 - DNA, 25 bp, Mus musculus
tagacgaccgctagttgatgacatt

SEQ ID NO: 771031 - DNA, 25 bp, Mus musculus
tagacgaccgcttgttgatgacatt

SEQ ID NO: 771032 - DNA, 25 bp, Mus musculus
tagacgacgactcgctggccaagct

SEQ ID NO: 771033 - DNA, 25 bp, Mus musculus
tagacgacgactggctggccaagct

SEQ ID NO: 771034 - DNA, 25 bp, Mus musculus
tagacgacgcagaggacgatccgag

SEQ ID NO: 771035 - DNA, 25 bp, Mus musculus
tagacgacgcagtggacgatccgag

SEQ ID NO: 771036 - DNA, 25 bp, Mus musculus
tagacgagcgccagtcccctgcgat

SEQ ID NO: 771037 - DNA, 25 bp, Mus musculus
tagacgagcgcctgtcccctgcgat

SEQ ID NO: 771038 - DNA, 25 bp, Mus musculus
tagacgatagaaacattggaaaccc

SEQ ID NO: 771039 - DNA, 25 bp, Mus musculus
tagacgatagaatcattggaaaccc

SEQ ID NO: 771040 - DNA, 25 bp, Mus musculus
tagacgatgactaaactggacaaat

SEQ ID NO: 771041 - DNA, 25 bp, Mus musculus
tagacgatgacttaactggacaaat

SEQ ID NO: 771042 - DNA, 25 bp, Mus musculus
tagacgattttgaaaccttaggttg

SEQ ID NO: 771043 - DNA, 25 bp, Mus musculus
tagacgattttgtaaccttaggttg

SEQ ID NO: 771044 - DNA, 25 bp, Mus musculus
tagacgcacagaagaggtccagttt

SEQ ID NO: 771045 - DNA, 25 bp, Mus musculus
tagacgcacagatgaggtccagttt

SEQ ID NO: 771046 - DNA, 25 bp, Mus musculus
tagacgcccagaatgctaccttcat

SEQ ID NO: 771047 - DNA, 25 bp, Mus musculus
tagacgcccagattgctaccttcat

SEQ ID NO: 771048 - DNA, 25 bp, Mus musculus
tagacgccggtgattcgctttagaa

SEQ ID NO: 771049 - DNA, 25 bp, Mus musculus
tagacgccggtgtttcgctttagaa

SEQ ID NO: 771050 - DNA, 25 bp, Mus musculus
tagacgcctcatagataatctctct

SEQ ID NO: 771051 - DNA, 25 bp, Mus musculus
tagacgcctcattgataatctctct

SEQ ID NO: 771052 - DNA, 25 bp, Mus musculus
tagacgcctccaaacatacttgttc

SEQ ID NO: 771053 - DNA, 25 bp, Mus musculus
tagacgcctccatacatacttgttc

SEQ ID NO: 771054 - DNA, 25 bp, Mus musculus
tagacgcctgagctcttctgctcct

SEQ ID NO: 771055 - DNA, 25 bp, Mus musculus
tagacgcctgaggtcttctgctcct

SEQ ID NO: 771056 - DNA, 25 bp, Mus musculus
tagacgcctggtcagttatcagcca

SEQ ID NO: 771057 - DNA, 25 bp, Mus musculus
tagacgcctggtgagttatcagcca

SEQ ID NO: 771058 - DNA, 25 bp, Mus musculus
tagacgcctttcaggtcgctttgaa

SEQ ID NO: 771059 - DNA, 25 bp, Mus musculus
tagacgcctttctggtcgctttgaa

SEQ ID NO: 771060 - DNA, 25 bp, Mus musculus
tagacgcgttacaccaagcgaggcg

SEQ ID NO: 771061 - DNA, 25 bp, Mus musculus
tagacgcgttactccaagcgaggcg

SEQ ID NO: 771062 - DNA, 25 bp, Mus musculus
tagacgctatagactgtggcttttc

SEQ ID NO: 771063 - DNA, 25 bp, Mus musculus
tagacgctatagtctgtggcttttc

SEQ ID NO: 771064 - DNA, 25 bp, Mus musculus
tagacgctatgaatgtatgctctgc

SEQ ID NO: 771065 - DNA, 25 bp, Mus musculus
tagacgctatgattgtatgctctgc

SEQ ID NO: 771066 - DNA, 25 bp, Mus musculus
tagacgctctagagggcatcgggac

SEQ ID NO: 771067 - DNA, 25 bp, Mus musculus
tagacgctctagtgggcatcgggac

SEQ ID NO: 771068 - DNA, 25 bp, Mus musculus
tagacgcttcgtaagcgctggcttg

SEQ ID NO: 771069 - DNA, 25 bp, Mus musculus
tagacgcttcgttagcgctggcttg

SEQ ID NO: 771070 - DNA, 25 bp, Mus musculus
tagacgcttgagaataaaacccttc

SEQ ID NO: 771071 - DNA, 25 bp, Mus musculus
tagacgcttgagtataaaacccttc

SEQ ID NO: 771072 - DNA, 25 bp, Mus musculus
tagacgcttgctagagacacattct

SEQ ID NO: 771073 - DNA, 25 bp, Mus musculus
tagacgcttgcttgagacacattct

SEQ ID NO: 771074 - DNA, 25 bp, Mus musculus
tagacggctgtcaccctgtcagtga

SEQ ID NO: 771075 - DNA, 25 bp, Mus musculus
tagacggctgtctccctgtcagtga

SEQ ID NO: 771076 - DNA, 25 bp, Mus musculus
tagacgggcgcaagctgcagtcctg

SEQ ID NO: 771077 - DNA, 25 bp, Mus musculus
tagacgggcgcatgctgcagtcctg

SEQ ID NO: 771078 - DNA, 25 bp, Mus musculus
tagacgggtgggactgctgcatcca

SEQ ID NO: 771079 - DNA, 25 bp, Mus musculus
tagacgggtgggtctgctgcatcca

SEQ ID NO: 771080 - DNA, 25 bp, Mus musculus
tagacggtggctcgtgggcgcctcc

SEQ ID NO: 771081 - DNA, 25 bp, Mus musculus
tagacggtggctggtgggcgcctcc

SEQ ID NO: 771082 - DNA, 25 bp, Mus musculus
tagacggtgttcctaacgagacatg

SEQ ID NO: 771083 - DNA, 25 bp, Mus musculus
tagacggtgttcgtaacgagacatg

SEQ ID NO: 771084 - DNA, 25 bp, Mus musculus
tagacggttgctctagacgagacaa

SEQ ID NO: 771085 - DNA, 25 bp, Mus musculus
tagacggttgctgtagacgagacaa

SEQ ID NO: 771086 - DNA, 25 bp, Mus musculus
tagacggtttgtactgggacagtcc

SEQ ID NO: 771087 - DNA, 25 bp, Mus musculus
tagacggtttgttctgggacagtcc

SEQ ID NO: 771088 - DNA, 25 bp, Mus musculus
tagacgtacagccactccgtgtcat

SEQ ID NO: 771089 - DNA, 25 bp, Mus musculus
tagacgtacagcgactccgtgtcat

SEQ ID NO: 771090 - DNA, 25 bp, Mus musculus
tagacgtcctctccagaactcttct

SEQ ID NO: 771091 - DNA, 25 bp, Mus musculus
tagacgtcctctgcagaactcttct

SEQ ID NO: 771092 - DNA, 25 bp, Mus musculus
tagacgtctttgagtcagagcatgg

SEQ ID NO: 771093 - DNA, 25 bp, Mus musculus
tagacgtctttgtgtcagagcatgg

SEQ ID NO: 771094 - DNA, 25 bp, Mus musculus
tagacgtggacaccaggattgctgt

SEQ ID NO: 771095 - DNA, 25 bp, Mus musculus
tagacgtggacagcaggattgctgt

SEQ ID NO: 771096 - DNA, 25 bp, Mus musculus
tagacgtggcatctctattctcacg

SEQ ID NO: 771097 - DNA, 25 bp, Mus musculus
tagacgtggcatgtctattctcacg

SEQ ID NO: 771098 - DNA, 25 bp, Mus musculus
tagacgtgggacacagtgcctgttc

SEQ ID NO: 771099 - DNA, 25 bp, Mus musculus
tagacgtgggactcagtgcctgttc

SEQ ID NO: 771100 - DNA, 25 bp, Mus musculus
tagacgttacttctcattacccaat

SEQ ID NO: 771101 - DNA, 25 bp, Mus musculus
tagacgttacttgtcattacccaat

SEQ ID NO: 771102 - DNA, 25 bp, Mus musculus
tagacgttatcaccctctgtctcat

SEQ ID NO: 771103 - DNA, 25 bp, Mus musculus
tagacgttatcagcctctgtctcat

SEQ ID NO: 771104 - DNA, 25 bp, Mus musculus
tagacgttctggatcagggcacctg

SEQ ID NO: 771105 - DNA, 25 bp, Mus musculus
tagacgttctggttcagggcacctg

SEQ ID NO: 771106 - DNA, 25 bp, Mus musculus
tagacgttgcctatacagttgcctt

SEQ ID NO: 771107 - DNA, 25 bp, Mus musculus
tagacgttgcctttacagttgcctt

SEQ ID NO: 771108 - DNA, 25 bp, Mus musculus
tagacgtttcaaactaccgtgtcat

SEQ ID NO: 771109 - DNA, 25 bp, Mus musculus
tagacgtttcaatctaccgtgtcat

SEQ ID NO: 771110 - DNA, 25 bp, Mus musculus
tagacgtttcttatttactcagcct

SEQ ID NO: 771111 - DNA, 25 bp, Mus musculus
tagacgtttcttttttactcagcct

SEQ ID NO: 771112 - DNA, 25 bp, Mus musculus
tagactaaacttcaaccttgcctct

SEQ ID NO: 771113 - DNA, 25 bp, Mus musculus
tagactaaacttgaaccttgcctct

SEQ ID NO: 771114 - DNA, 25 bp, Mus musculus
tagactaaattaatcagtttccttc

SEQ ID NO: 771115 - DNA, 25 bp, Mus musculus
tagactaaattattcagtttccttc

SEQ ID NO: 771116 - DNA, 25 bp, Mus musculus
tagactaacattcggtgctaggatc

SEQ ID NO: 771117 - DNA, 25 bp, Mus musculus
tagactaacattgggtgctaggatc

SEQ ID NO: 771118 - DNA, 25 bp, Mus musculus
tagactaacgcgaccaggaaccact

SEQ ID NO: 771119 - DNA, 25 bp, Mus musculus
tagactaacgcgtccaggaaccact

SEQ ID NO: 771120 - DNA, 25 bp, Mus musculus
tagactaagctcaatattttactat

SEQ ID NO: 771121 - DNA, 25 bp, Mus musculus
tagactaagctctatattttactat

SEQ ID NO: 771122 - DNA, 25 bp, Mus musculus
tagactaaggcgaccaccttcataa

SEQ ID NO: 771123 - DNA, 25 bp, Mus musculus
tagactaaggcgtccaccttcataa

SEQ ID NO: 771124 - DNA, 25 bp, Mus musculus
tagactacacacagttgccccagaa

SEQ ID NO: 771125 - DNA, 25 bp, Mus musculus
tagactacacactgttgccccagaa

SEQ ID NO: 771126 - DNA, 25 bp, Mus musculus
tagactacactcaccaataccacca

SEQ ID NO: 771127 - DNA, 25 bp, Mus musculus
tagactacactctccaataccacca

SEQ ID NO: 771128 - DNA, 25 bp, Mus musculus
tagactaccccgcttgcagcggtgg

SEQ ID NO: 771129 - DNA, 25 bp, Mus musculus
tagactaccccggttgcagcggtgg

SEQ ID NO: 771130 - DNA, 25 bp, Mus musculus
tagactaccggtacccgctgtgtgc

SEQ ID NO: 771131 - DNA, 25 bp, Mus musculus
tagactaccggttcccgctgtgtgc

SEQ ID NO: 771132 - DNA, 25 bp, Mus musculus
tagactactaacacacagcacaaga

SEQ ID NO: 771133 - DNA, 25 bp, Mus musculus
tagactactaactcacagcacaaga

SEQ ID NO: 771134 - DNA, 25 bp, Mus musculus
tagactactgcaacagctcttggtc

SEQ ID NO: 771135 - DNA, 25 bp, Mus musculus
tagactactgcatcagctcttggtc

SEQ ID NO: 771136 - DNA, 25 bp, Mus musculus
tagactagaaccctggagccaccca

SEQ ID NO: 771137 - DNA, 25 bp, Mus musculus
tagactagaaccgtggagccaccca

SEQ ID NO: 771138 - DNA, 25 bp, Mus musculus
tagactagcctgaatttgatgcctt

SEQ ID NO: 771139 - DNA, 25 bp, Mus musculus
tagactagcctgccggtcaataact

SEQ ID NO: 771140 - DNA, 25 bp, Mus musculus
tagactagcctggcggtcaataact

SEQ ID NO: 771141 - DNA, 25 bp, Mus musculus
tagactagcctgtatttgatgcctt

SEQ ID NO: 771142 - DNA, 25 bp, Mus musculus
tagactagccttctcacgaggtcat

SEQ ID NO: 771143 - DNA, 25 bp, Mus musculus
tagactagccttgtcacgaggtcat

SEQ ID NO: 771144 - DNA, 25 bp, Mus musculus
tagactaggatacactgaccaggat

SEQ ID NO: 771145 - DNA, 25 bp, Mus musculus
tagactaggatagactgaccaggat

SEQ ID NO: 771146 - DNA, 25 bp, Mus musculus
tagactagtattccctcatgtgttg

SEQ ID NO: 771147 - DNA, 25 bp, Mus musculus
tagactagtattgcctcatgtgttg

SEQ ID NO: 771148 - DNA, 25 bp, Mus musculus
tagactagtcatagagcgtcccacc

SEQ ID NO: 771149 - DNA, 25 bp, Mus musculus
tagactagtcattgagcgtcccacc

SEQ ID NO: 771150 - DNA, 25 bp, Mus musculus
tagactagtctcaagctcactatgt

SEQ ID NO: 771151 - DNA, 25 bp, Mus musculus
tagactagtctctagctcactatgt

SEQ ID NO: 771152 - DNA, 25 bp, Mus musculus
tagactataataccttttctgaggc

SEQ ID NO: 771153 - DNA, 25 bp, Mus musculus
tagactataatagcttttctgaggc

SEQ ID NO: 771154 - DNA, 25 bp, Mus musculus
tagactataccgagtgctcagaaac

SEQ ID NO: 771155 - DNA, 25 bp, Mus musculus
tagactataccgtgtgctcagaaac

SEQ ID NO: 771156 - DNA, 25 bp, Mus musculus
tagactatataaaatgtccccgaga

SEQ ID NO: 771157 - DNA, 25 bp, Mus musculus
tagactatataatatgtccccgaga

SEQ ID NO: 771158 - DNA, 25 bp, Mus musculus
tagactatgaagcaggagacatccc

SEQ ID NO: 771159 - DNA, 25 bp, Mus musculus
tagactatgaaggaggagacatccc

SEQ ID NO: 771160 - DNA, 25 bp, Mus musculus
tagactatggagcagtgcagagaac

SEQ ID NO: 771161 - DNA, 25 bp, Mus musculus
tagactatggaggagtgcagagaac

SEQ ID NO: 771162 - DNA, 25 bp, Mus musculus
tagactcaaagacaccacagatgcc

SEQ ID NO: 771163 - DNA, 25 bp, Mus musculus
tagactcaaagagaccacagatgcc

SEQ ID NO: 771164 - DNA, 25 bp, Mus musculus
tagactcaagagcacggacttcctt

SEQ ID NO: 771165 - DNA, 25 bp, Mus musculus
tagactcaagaggacggacttcctt

SEQ ID NO: 771166 - DNA, 25 bp, Mus musculus
tagactcaatacacaggctgctggc

SEQ ID NO: 771167 - DNA, 25 bp, Mus musculus
tagactcaatactcaggctgctggc

SEQ ID NO: 771168 - DNA, 25 bp, Mus musculus
tagactcactggctggagacggtcc

SEQ ID NO: 771169 - DNA, 25 bp, Mus musculus
tagactcactgggtggagacggtcc

SEQ ID NO: 771170 - DNA, 25 bp, Mus musculus
tagactcagtcgcaagggcttcttc

SEQ ID NO: 771171 - DNA, 25 bp, Mus musculus
tagactcagtcggaagggcttcttc

SEQ ID NO: 771172 - DNA, 25 bp, Mus musculus
tagactcatctactgtcactcttgt

SEQ ID NO: 771173 - DNA, 25 bp, Mus musculus
tagactcatctagtgtcactcttgt

SEQ ID NO: 771174 - DNA, 25 bp, Mus musculus
tagactcatttcctgcttccggaaa

SEQ ID NO: 771175 - DNA, 25 bp, Mus musculus
tagactcatttcgtgcttccggaaa

SEQ ID NO: 771176 - DNA, 25 bp, Mus musculus
tagactccatttccacaacaaaagg

SEQ ID NO: 771177 - DNA, 25 bp, Mus musculus
tagactccatttgcacaacaaaagg

SEQ ID NO: 771178 - DNA, 25 bp, Mus musculus
tagactcccaacagaggacccagtg

SEQ ID NO: 771179 - DNA, 25 bp, Mus musculus
tagactcccaactgaggacccagtg

SEQ ID NO: 771180 - DNA, 25 bp, Mus musculus
tagactcccaatcctgttgattaaa

SEQ ID NO: 771181 - DNA, 25 bp, Mus musculus
tagactcccaatgctgttgattaaa

SEQ ID NO: 771182 - DNA, 25 bp, Mus musculus
tagactccccatccttcaaaggtgt

SEQ ID NO: 771183 - DNA, 25 bp, Mus musculus
tagactccccatgcttcaaaggtgt

SEQ ID NO: 771184 - DNA, 25 bp, Mus musculus
tagactccctgtattcatattttta

SEQ ID NO: 771185 - DNA, 25 bp, Mus musculus
tagactccctgttttcatattttta

SEQ ID NO: 771186 - DNA, 25 bp, Mus musculus
tagactccgacaacatacaactcag

SEQ ID NO: 771187 - DNA, 25 bp, Mus musculus
tagactccgacatcatacaactcag

SEQ ID NO: 771188 - DNA, 25 bp, Mus musculus
tagactcgattgatgacctctctct

SEQ ID NO: 771189 - DNA, 25 bp, Mus musculus
tagactcgattgttgacctctctct

SEQ ID NO: 771190 - DNA, 25 bp, Mus musculus
tagactcgcttacagcacatgcttc

SEQ ID NO: 771191 - DNA, 25 bp, Mus musculus
tagactcgcttagagcacatgcttc

SEQ ID NO: 771192 - DNA, 25 bp, Mus musculus
tagactcggacgacgacagaacgtt

SEQ ID NO: 771193 - DNA, 25 bp, Mus musculus
tagactcggacgtcgacagaacgtt

SEQ ID NO: 771194 - DNA, 25 bp, Mus musculus
tagactcggagacctacctcagatt

SEQ ID NO: 771195 - DNA, 25 bp, Mus musculus
tagactcggagagctacctcagatt

SEQ ID NO: 771196 - DNA, 25 bp, Mus musculus
tagactctaatacttttgtctcctt

SEQ ID NO: 771197 - DNA, 25 bp, Mus musculus
tagactctaatagttttgtctcctt

SEQ ID NO: 771198 - DNA, 25 bp, Mus musculus
tagactctactacttccttcatggc

SEQ ID NO: 771199 - DNA, 25 bp, Mus musculus
tagactctactagttccttcatggc

SEQ ID NO: 771200 - DNA, 25 bp, Mus musculus
tagactctcgtgacactgcaaacag

SEQ ID NO: 771201 - DNA, 25 bp, Mus musculus
tagactctcgtgtcactgcaaacag

SEQ ID NO: 771202 - DNA, 25 bp, Mus musculus
tagactctgatgacctgattagcat

SEQ ID NO: 771203 - DNA, 25 bp, Mus musculus
tagactctgatgtcctgattagcat

SEQ ID NO: 771204 - DNA, 25 bp, Mus musculus
tagactctgccccagcaaccaaagg

SEQ ID NO: 771205 - DNA, 25 bp, Mus musculus
tagactctgcccgagcaaccaaagg

SEQ ID NO: 771206 - DNA, 25 bp, Mus musculus
tagactctgctcattagttacctag

SEQ ID NO: 771207 - DNA, 25 bp, Mus musculus
tagactctgctctttagttacctag

SEQ ID NO: 771208 - DNA, 25 bp, Mus musculus
tagactctggttatgtctcccttca

SEQ ID NO: 771209 - DNA, 25 bp, Mus musculus
tagactctggttttgtctcccttca

SEQ ID NO: 771210 - DNA, 25 bp, Mus musculus
tagactcttcaccaaaccaacggca

SEQ ID NO: 771211 - DNA, 25 bp, Mus musculus
tagactcttcacgaaaccaacggca

SEQ ID NO: 771212 - DNA, 25 bp, Mus musculus
tagactcttcttaacatcgtgccaa

SEQ ID NO: 771213 - DNA, 25 bp, Mus musculus
tagactcttctttacatcgtgccaa

SEQ ID NO: 771214 - DNA, 25 bp, Mus musculus
tagactcttgaaactctcccaggaa

SEQ ID NO: 771215 - DNA, 25 bp, Mus musculus
tagactcttgaatctctcccaggaa

SEQ ID NO: 771216 - DNA, 25 bp, Mus musculus
tagactcttgatcccgatctggtat

SEQ ID NO: 771217 - DNA, 25 bp, Mus musculus
tagactcttgatgccgatctggtat

SEQ ID NO: 771218 - DNA, 25 bp, Mus musculus
tagactcttggtacaccagcacaca

SEQ ID NO: 771219 - DNA, 25 bp, Mus musculus
tagactcttggttcaccagcacaca

SEQ ID NO: 771220 - DNA, 25 bp, Mus musculus
tagactctttaacgtgatttcacag

SEQ ID NO: 771221 - DNA, 25 bp, Mus musculus
tagactctttaaggtgatttcacag

SEQ ID NO: 771222 - DNA, 25 bp, Mus musculus
tagactgaccagcatggtttacagt

SEQ ID NO: 771223 - DNA, 25 bp, Mus musculus
tagactgaccaggatggtttacagt

SEQ ID NO: 771224 - DNA, 25 bp, Mus musculus
tagactgacgcacttgtaagctccg

SEQ ID NO: 771225 - DNA, 25 bp, Mus musculus
tagactgacgcagttgtaagctccg

SEQ ID NO: 771226 - DNA, 25 bp, Mus musculus
tagactgactgaccgacagacacac

SEQ ID NO: 771227 - DNA, 25 bp, Mus musculus
tagactgactgagcgacagacacac

SEQ ID NO: 771228 - DNA, 25 bp, Mus musculus
tagactgagcagagggcacacaaca

SEQ ID NO: 771229 - DNA, 25 bp, Mus musculus
tagactgagcagtgggcacacaaca

SEQ ID NO: 771230 - DNA, 25 bp, Mus musculus
tagactgatagcagcacctgactgt

SEQ ID NO: 771231 - DNA, 25 bp, Mus musculus
tagactgatagctgcacctgactgt

SEQ ID NO: 771232 - DNA, 25 bp, Mus musculus
tagactgcaaacagggtgggcctat

SEQ ID NO: 771233 - DNA, 25 bp, Mus musculus
tagactgcaaactgggtgggcctat

SEQ ID NO: 771234 - DNA, 25 bp, Mus musculus
tagactgccccaatacccttattac

SEQ ID NO: 771235 - DNA, 25 bp, Mus musculus
tagactgccccattacccttattac

SEQ ID NO: 771236 - DNA, 25 bp, Mus musculus
tagactgctcaaacctgaaggctaa

SEQ ID NO: 771237 - DNA, 25 bp, Mus musculus
tagactgctcaatcctgaaggctaa

SEQ ID NO: 771238 - DNA, 25 bp, Mus musculus
tagactgctctcatgtcaacttgac

SEQ ID NO: 771239 - DNA, 25 bp, Mus musculus
tagactgctctccaggcataggctc

SEQ ID NO: 771240 - DNA, 25 bp, Mus musculus
tagactgctctcgaggcataggctc

SEQ ID NO: 771241 - DNA, 25 bp, Mus musculus
tagactgctctcttgtcaacttgac

SEQ ID NO: 771242 - DNA, 25 bp, Mus musculus
tagactgctgaacgcgtgctgtatt

SEQ ID NO: 771243 - DNA, 25 bp, Mus musculus
tagactgctgaaggcgtgctgtatt

SEQ ID NO: 771244 - DNA, 25 bp, Mus musculus
tagactgcttcaagtcacctctgga

SEQ ID NO: 771245 - DNA, 25 bp, Mus musculus
tagactgcttcatgtcacctctgga

SEQ ID NO: 771246 - DNA, 25 bp, Mus musculus
tagactgcttgcagatcccagcctg

SEQ ID NO: 771247 - DNA, 25 bp, Mus musculus
tagactgcttgcctactacacggga

SEQ ID NO: 771248 - DNA, 25 bp, Mus musculus
tagactgcttgcgtactacacggga

SEQ ID NO: 771249 - DNA, 25 bp, Mus musculus
tagactgcttgctgatcccagcctg

SEQ ID NO: 771250 - DNA, 25 bp, Mus musculus
tagactggaaaccttaacacctttg

SEQ ID NO: 771251 - DNA, 25 bp, Mus musculus
tagactggaaacgttaacacctttg

SEQ ID NO: 771252 - DNA, 25 bp, Mus musculus
tagactggaagcatactgatagcca

SEQ ID NO: 771253 - DNA, 25 bp, Mus musculus
tagactggaagcttactgatagcca

SEQ ID NO: 771254 - DNA, 25 bp, Mus musculus
tagactggaatacgcctgaccttgc

SEQ ID NO: 771255 - DNA, 25 bp, Mus musculus
tagactggaataggcctgaccttgc

SEQ ID NO: 771256 - DNA, 25 bp, Mus musculus
tagactggacagcttgtggcaagta

SEQ ID NO: 771257 - DNA, 25 bp, Mus musculus
tagactggacaggttgtggcaagta

SEQ ID NO: 771258 - DNA, 25 bp, Mus musculus
tagactggagatactggagggctca

SEQ ID NO: 771259 - DNA, 25 bp, Mus musculus
tagactggagattctggagggctca

SEQ ID NO: 771260 - DNA, 25 bp, Mus musculus
tagactggcactactcccttagaga

SEQ ID NO: 771261 - DNA, 25 bp, Mus musculus
tagactggcactctaagcgctgctg

SEQ ID NO: 771262 - DNA, 25 bp, Mus musculus
tagactggcactgtaagcgctgctg

SEQ ID NO: 771263 - DNA, 25 bp, Mus musculus
tagactggcacttctcccttagaga

SEQ ID NO: 771264 - DNA, 25 bp, Mus musculus
tagactggccaaacagggatgccca

SEQ ID NO: 771265 - DNA, 25 bp, Mus musculus
tagactggccaatcagggatgccca

SEQ ID NO: 771266 - DNA, 25 bp, Mus musculus
tagactggccctataggttggacta

SEQ ID NO: 771267 - DNA, 25 bp, Mus musculus
tagactggccctttaggttggacta

SEQ ID NO: 771268 - DNA, 25 bp, Mus musculus
tagactggcttgagcagacctccat

SEQ ID NO: 771269 - DNA, 25 bp, Mus musculus
tagactggcttgtgcagacctccat

SEQ ID NO: 771270 - DNA, 25 bp, Mus musculus
tagactgggcacacatcttgggcta

SEQ ID NO: 771271 - DNA, 25 bp, Mus musculus
tagactgggcactcatcttgggcta

SEQ ID NO: 771272 - DNA, 25 bp, Mus musculus
tagactgggctcagacttgctgtag

SEQ ID NO: 771273 - DNA, 25 bp, Mus musculus
tagactgggctctgacttgctgtag

SEQ ID NO: 771274 - DNA, 25 bp, Mus musculus
tagactggtctgaacgcctttccta

SEQ ID NO: 771275 - DNA, 25 bp, Mus musculus
tagactggtctgtacgcctttccta

SEQ ID NO: 771276 - DNA, 25 bp, Mus musculus
tagactgtagaaattccaaaggata

SEQ ID NO: 771277 - DNA, 25 bp, Mus musculus
tagactgtagaatttccaaaggata

SEQ ID NO: 771278 - DNA, 25 bp, Mus musculus
tagactgtatgtagctgctcacatc

SEQ ID NO: 771279 - DNA, 25 bp, Mus musculus
tagactgtatgttgctgctcacatc

SEQ ID NO: 771280 - DNA, 25 bp, Mus musculus
tagactgtctgtactctgatgccaa

SEQ ID NO: 771281 - DNA, 25 bp, Mus musculus
tagactgtctgttctctgatgccaa

SEQ ID NO: 771282 - DNA, 25 bp, Mus musculus
tagactgtgactctaggctccacct

SEQ ID NO: 771283 - DNA, 25 bp, Mus musculus
tagactgtgactgtaggctccacct

SEQ ID NO: 771284 - DNA, 25 bp, Mus musculus
tagactgtgagtagcttgagggcag

SEQ ID NO: 771285 - DNA, 25 bp, Mus musculus
tagactgtgagttgcttgagggcag

SEQ ID NO: 771286 - DNA, 25 bp, Mus musculus
tagactgtgcgtcagggactgccca

SEQ ID NO: 771287 - DNA, 25 bp, Mus musculus
tagactgtgcgtgagggactgccca

SEQ ID NO: 771288 - DNA, 25 bp, Mus musculus
tagactgtgctgaactttaaaacct

SEQ ID NO: 771289 - DNA, 25 bp, Mus musculus
tagactgtgctgtactttaaaacct

SEQ ID NO: 771290 - DNA, 25 bp, Mus musculus
tagactgtgtcccaagctgcggata

SEQ ID NO: 771291 - DNA, 25 bp, Mus musculus
tagactgtgtccgaagctgcggata

SEQ ID NO: 771292 - DNA, 25 bp, Mus musculus
tagactgtgtggaacctgtggcacc

SEQ ID NO: 771293 - DNA, 25 bp, Mus musculus
tagactgtgtggtacctgtggcacc

SEQ ID NO: 771294 - DNA, 25 bp, Mus musculus
tagactgttcagacctgcggtcctg

SEQ ID NO: 771295 - DNA, 25 bp, Mus musculus
tagactgttcagtcctgcggtcctg

SEQ ID NO: 771296 - DNA, 25 bp, Mus musculus
tagactgttggactcctctgggcct

SEQ ID NO: 771297 - DNA, 25 bp, Mus musculus
tagactgttggagtcctctgggcct

SEQ ID NO: 771298 - DNA, 25 bp, Mus musculus
tagactgttgtcaccatttccagac

SEQ ID NO: 771299 - DNA, 25 bp, Mus musculus
tagactgttgtctccatttccagac

SEQ ID NO: 771300 - DNA, 25 bp, Mus musculus
tagactgttgttccacctacttagc

SEQ ID NO: 771301 - DNA, 25 bp, Mus musculus
tagactgttgttgcacctacttagc

SEQ ID NO: 771302 - DNA, 25 bp, Mus musculus
tagactgtttttacaaccccagaag

SEQ ID NO: 771303 - DNA, 25 bp, Mus musculus
tagactgttttttcaaccccagaag

SEQ ID NO: 771304 - DNA, 25 bp, Mus musculus
tagacttaacggacttttgtgacct

SEQ ID NO: 771305 - DNA, 25 bp, Mus musculus
tagacttaacggtcttttgtgacct

SEQ ID NO: 771306 - DNA, 25 bp, Mus musculus
tagacttaactcctcttgcacagat

SEQ ID NO: 771307 - DNA, 25 bp, Mus musculus
tagacttaactcgtcttgcacagat

SEQ ID NO: 771308 - DNA, 25 bp, Mus musculus
tagacttaacttacagacttacttg

SEQ ID NO: 771309 - DNA, 25 bp, Mus musculus
tagacttaactttcagacttacttg

SEQ ID NO: 771310 - DNA, 25 bp, Mus musculus
tagacttaagggattcagataaaag

SEQ ID NO: 771311 - DNA, 25 bp, Mus musculus
tagacttaagggtttcagataaaag

SEQ ID NO: 771312 - DNA, 25 bp, Mus musculus
tagacttagttcattgccattatgt

SEQ ID NO: 771313 - DNA, 25 bp, Mus musculus
tagacttagttctttgccattatgt

SEQ ID NO: 771314 - DNA, 25 bp, Mus musculus
tagacttatcccactgtatataccc

SEQ ID NO: 771315 - DNA, 25 bp, Mus musculus
tagacttatccctctgtatataccc

SEQ ID NO: 771316 - DNA, 25 bp, Mus musculus
tagacttcagtcacacagcggcaga

SEQ ID NO: 771317 - DNA, 25 bp, Mus musculus
tagacttcagtctcacagcggcaga

SEQ ID NO: 771318 - DNA, 25 bp, Mus musculus
tagacttcattcaccttaaaaacaa

SEQ ID NO: 771319 - DNA, 25 bp, Mus musculus
tagacttcattctccttaaaaacaa

SEQ ID NO: 771320 - DNA, 25 bp, Mus musculus
tagacttcgggtattgcgtacagcc

SEQ ID NO: 771321 - DNA, 25 bp, Mus musculus
tagacttcgggttttgcgtacagcc

SEQ ID NO: 771322 - DNA, 25 bp, Mus musculus
tagacttctaacagctccaagatgg

SEQ ID NO: 771323 - DNA, 25 bp, Mus musculus
tagacttctaactgctccaagatgg

SEQ ID NO: 771324 - DNA, 25 bp, Mus musculus
tagacttctactagtgtgcttaaac

SEQ ID NO: 771325 - DNA, 25 bp, Mus musculus
tagacttctacttgtgtgcttaaac

SEQ ID NO: 771326 - DNA, 25 bp, Mus musculus
tagacttctggcaaaatctggacgt

SEQ ID NO: 771327 - DNA, 25 bp, Mus musculus
tagacttctggctaaatctggacgt

SEQ ID NO: 771328 - DNA, 25 bp, Mus musculus
tagacttctgtacaccataatttga

SEQ ID NO: 771329 - DNA, 25 bp, Mus musculus
tagacttctgtagaccataatttga

SEQ ID NO: 771330 - DNA, 25 bp, Mus musculus
tagacttgaccaacacaaacctgct

SEQ ID NO: 771331 - DNA, 25 bp, Mus musculus
tagacttgaccatcacaaacctgct

SEQ ID NO: 771332 - DNA, 25 bp, Mus musculus
tagacttgagctcagaggtgacccc

SEQ ID NO: 771333 - DNA, 25 bp, Mus musculus
tagacttgagctgagaggtgacccc

SEQ ID NO: 771334 - DNA, 25 bp, Mus musculus
tagacttgagtcctcaaacgaccaa

SEQ ID NO: 771335 - DNA, 25 bp, Mus musculus
tagacttgagtcgtcaaacgaccaa

SEQ ID NO: 771336 - DNA, 25 bp, Mus musculus
tagacttgatttaaccatcctgaag

SEQ ID NO: 771337 - DNA, 25 bp, Mus musculus
tagacttgattttaccatcctgaag

SEQ ID NO: 771338 - DNA, 25 bp, Mus musculus
tagacttgccaaactgcccacagtg

SEQ ID NO: 771339 - DNA, 25 bp, Mus musculus
tagacttgccaacagcaggtttaat

SEQ ID NO: 771340 - DNA, 25 bp, Mus musculus
tagacttgccaacttcttgatgtgc

SEQ ID NO: 771341 - DNA, 25 bp, Mus musculus
tagacttgccaagagcaggtttaat

SEQ ID NO: 771342 - DNA, 25 bp, Mus musculus
tagacttgccaagttcttgatgtgc

SEQ ID NO: 771343 - DNA, 25 bp, Mus musculus
tagacttgccaatctgcccacagtg

SEQ ID NO: 771344 - DNA, 25 bp, Mus musculus
tagacttgctggctagctgttgctc

SEQ ID NO: 771345 - DNA, 25 bp, Mus musculus
tagacttgctgggtagctgttgctc

SEQ ID NO: 771346 - DNA, 25 bp, Mus musculus
tagacttggactaaccctggcatta

SEQ ID NO: 771347 - DNA, 25 bp, Mus musculus
tagacttggacttaccctggcatta

SEQ ID NO: 771348 - DNA, 25 bp, Mus musculus
tagacttggagtaggtgacttttgc

SEQ ID NO: 771349 - DNA, 25 bp, Mus musculus
tagacttggagttggtgacttttgc

SEQ ID NO: 771350 - DNA, 25 bp, Mus musculus
tagacttggcttccttaaacattgt

SEQ ID NO: 771351 - DNA, 25 bp, Mus musculus
tagacttggcttgcttaaacattgt

SEQ ID NO: 771352 - DNA, 25 bp, Mus musculus
tagacttgggtaacacaggcccaga

SEQ ID NO: 771353 - DNA, 25 bp, Mus musculus
tagacttgggtatcacaggcccaga

SEQ ID NO: 771354 - DNA, 25 bp, Mus musculus
tagacttggtctagccctgggcctg

SEQ ID NO: 771355 - DNA, 25 bp, Mus musculus
tagacttggtcttgccctgggcctg

SEQ ID NO: 771356 - DNA, 25 bp, Mus musculus
tagacttgtcaccagcagtctcaag

SEQ ID NO: 771357 - DNA, 25 bp, Mus musculus
tagacttgtcacgagcagtctcaag

SEQ ID NO: 771358 - DNA, 25 bp, Mus musculus
tagacttgttccagaatccctcaat

SEQ ID NO: 771359 - DNA, 25 bp, Mus musculus
tagacttgttcctgaatccctcaat

SEQ ID NO: 771360 - DNA, 25 bp, Mus musculus
tagactttacctaacccttgattat

SEQ ID NO: 771361 - DNA, 25 bp, Mus musculus
tagactttaccttacccttgattat

SEQ ID NO: 771362 - DNA, 25 bp, Mus musculus
tagactttcaacactttggctgttt

SEQ ID NO: 771363 - DNA, 25 bp, Mus musculus
tagactttcaactctttggctgttt

SEQ ID NO: 771364 - DNA, 25 bp, Mus musculus
tagactttcagaacccatgacagag

SEQ ID NO: 771365 - DNA, 25 bp, Mus musculus
tagactttcagatcccatgacagag

SEQ ID NO: 771366 - DNA, 25 bp, Mus musculus
tagactttcagtcatctgtgtgcat

SEQ ID NO: 771367 - DNA, 25 bp, Mus musculus
tagactttcagtgatctgtgtgcat

SEQ ID NO: 771368 - DNA, 25 bp, Mus musculus
tagactttcattctgcttggctggt

SEQ ID NO: 771369 - DNA, 25 bp, Mus musculus
tagactttcattgtgcttggctggt

SEQ ID NO: 771370 - DNA, 25 bp, Mus musculus
tagactttcctgacatctgcaaata

SEQ ID NO: 771371 - DNA, 25 bp, Mus musculus
tagactttcctgtcatctgcaaata

SEQ ID NO: 771372 - DNA, 25 bp, Mus musculus
tagactttctctatgccccaagaat

SEQ ID NO: 771373 - DNA, 25 bp, Mus musculus
tagactttctctttgccccaagaat

SEQ ID NO: 771374 - DNA, 25 bp, Mus musculus
tagactttgaacagagcctctgttt

SEQ ID NO: 771375 - DNA, 25 bp, Mus musculus
tagactttgaactgagcctctgttt

SEQ ID NO: 771376 - DNA, 25 bp, Mus musculus
tagactttgcagaatgcccagaagc

SEQ ID NO: 771377 - DNA, 25 bp, Mus musculus
tagactttgcagtatgcccagaagc

SEQ ID NO: 771378 - DNA, 25 bp, Mus musculus
tagactttggctctttcttcgtaaa

SEQ ID NO: 771379 - DNA, 25 bp, Mus musculus
tagactttggctgtttcttcgtaaa

SEQ ID NO: 771380 - DNA, 25 bp, Mus musculus
tagacttttgcccaacattgagagc

SEQ ID NO: 771381 - DNA, 25 bp, Mus musculus
tagacttttgccgaacattgagagc

SEQ ID NO: 771382 - DNA, 25 bp, Mus musculus
tagacttttggtagtgctggctgaa

SEQ ID NO: 771383 - DNA, 25 bp, Mus musculus
tagacttttggttgtgctggctgaa

SEQ ID NO: 771384 - DNA, 25 bp, Mus musculus
tagacttttgtcactttgcttccag

SEQ ID NO: 771385 - DNA, 25 bp, Mus musculus
tagacttttgtctctttgcttccag

SEQ ID NO: 771386 - DNA, 25 bp, Mus musculus
tagacttttgtgacccactaattgt

SEQ ID NO: 771387 - DNA, 25 bp, Mus musculus
tagacttttgtgtcccactaattgt

SEQ ID NO: 771388 - DNA, 25 bp, Mus musculus
tagagaaaacaaaaccaagggctgg

SEQ ID NO: 771389 - DNA, 25 bp, Mus musculus
tagagaaaacaataccaagggctgg

SEQ ID NO: 771390 - DNA, 25 bp, Mus musculus
tagagaaaatccagagggactccat

SEQ ID NO: 771391 - DNA, 25 bp, Mus musculus
tagagaaaatcctgagggactccat

SEQ ID NO: 771392 - DNA, 25 bp, Mus musculus
tagagaaaatgcacccaccgacata

SEQ ID NO: 771393 - DNA, 25 bp, Mus musculus
tagagaaaatgctcccaccgacata

SEQ ID NO: 771394 - DNA, 25 bp, Mus musculus
tagagaaacactctaacccttccta

SEQ ID NO: 771395 - DNA, 25 bp, Mus musculus
tagagaaacactgtaacccttccta

SEQ ID NO: 771396 - DNA, 25 bp, Mus musculus
tagagaaaccataacgtcccagaca

SEQ ID NO: 771397 - DNA, 25 bp, Mus musculus
tagagaaaccattacgtcccagaca

SEQ ID NO: 771398 - DNA, 25 bp, Mus musculus
tagagaaactgaaggctggtcaaga

SEQ ID NO: 771399 - DNA, 25 bp, Mus musculus
tagagaaactgatggctggtcaaga

SEQ ID NO: 771400 - DNA, 25 bp, Mus musculus
tagagaaagcccaagatgcccgtgt

SEQ ID NO: 771401 - DNA, 25 bp, Mus musculus
tagagaaagccctagatgcccgtgt

SEQ ID NO: 771402 - DNA, 25 bp, Mus musculus
tagagaaagcgccactaccctgcat

SEQ ID NO: 771403 - DNA, 25 bp, Mus musculus
tagagaaagcgcgactaccctgcat

SEQ ID NO: 771404 - DNA, 25 bp, Mus musculus
tagagaaaggccagggttgtagttt

SEQ ID NO: 771405 - DNA, 25 bp, Mus musculus
tagagaaaggcctgggttgtagttt

SEQ ID NO: 771406 - DNA, 25 bp, Mus musculus
tagagaaaggtgattccatgacctg

SEQ ID NO: 771407 - DNA, 25 bp, Mus musculus
tagagaaaggtgtttccatgacctg

SEQ ID NO: 771408 - DNA, 25 bp, Mus musculus
tagagaaatcctagcctgaataagc

SEQ ID NO: 771409 - DNA, 25 bp, Mus musculus
tagagaaatccttgcctgaataagc

SEQ ID NO: 771410 - DNA, 25 bp, Mus musculus
tagagaaatctgctcagcgtgacaa

SEQ ID NO: 771411 - DNA, 25 bp, Mus musculus
tagagaaatctggtcagcgtgacaa

SEQ ID NO: 771412 - DNA, 25 bp, Mus musculus
tagagaacacgcagagccgcaagct

SEQ ID NO: 771413 - DNA, 25 bp, Mus musculus
tagagaacacgctgagccgcaagct

SEQ ID NO: 771414 - DNA, 25 bp, Mus musculus
tagagaacacgtccctccagaactc

SEQ ID NO: 771415 - DNA, 25 bp, Mus musculus
tagagaacacgtgcctccagaactc

SEQ ID NO: 771416 - DNA, 25 bp, Mus musculus
tagagaacagtcctaaagctagccc

SEQ ID NO: 771417 - DNA, 25 bp, Mus musculus
tagagaacagtcgtaaagctagccc

SEQ ID NO: 771418 - DNA, 25 bp, Mus musculus
tagagaaccccgagcggcctgagga

SEQ ID NO: 771419 - DNA, 25 bp, Mus musculus
tagagaaccccgtgcggcctgagga

SEQ ID NO: 771420 - DNA, 25 bp, Mus musculus
tagagaaccctactctctcttcaat

SEQ ID NO: 771421 - DNA, 25 bp, Mus musculus
tagagaaccctagtctctcttcaat

SEQ ID NO: 771422 - DNA, 25 bp, Mus musculus
tagagaaccggtctctgcccaggag

SEQ ID NO: 771423 - DNA, 25 bp, Mus musculus
tagagaaccggtgtctgcccaggag

SEQ ID NO: 771424 - DNA, 25 bp, Mus musculus
tagagaaccttcacttcaccattga

SEQ ID NO: 771425 - DNA, 25 bp, Mus musculus
tagagaaccttctcttcaccattga

SEQ ID NO: 771426 - DNA, 25 bp, Mus musculus
tagagaacgtccagcatcctagggc

SEQ ID NO: 771427 - DNA, 25 bp, Mus musculus
tagagaacgtcctgcatcctagggc

SEQ ID NO: 771428 - DNA, 25 bp, Mus musculus
tagagaactcagctctccatcaggg

SEQ ID NO: 771429 - DNA, 25 bp, Mus musculus
tagagaactcaggtctccatcaggg

SEQ ID NO: 771430 - DNA, 25 bp, Mus musculus
tagagaactttcatagcatgcataa

SEQ ID NO: 771431 - DNA, 25 bp, Mus musculus
tagagaactttcttagcatgcataa

SEQ ID NO: 771432 - DNA, 25 bp, Mus musculus
tagagaactttgagaactgctgtgt

SEQ ID NO: 771433 - DNA, 25 bp, Mus musculus
tagagaactttgtgaactgctgtgt

SEQ ID NO: 771434 - DNA, 25 bp, Mus musculus
tagagaagagttaccccagtcctga

SEQ ID NO: 771435 - DNA, 25 bp, Mus musculus
tagagaagagtttccccagtcctga

SEQ ID NO: 771436 - DNA, 25 bp, Mus musculus
tagagaagattgaagcagccctgca

SEQ ID NO: 771437 - DNA, 25 bp, Mus musculus
tagagaagattgtagcagccctgca

SEQ ID NO: 771438 - DNA, 25 bp, Mus musculus
tagagaagcagcagatggatccccg

SEQ ID NO: 771439 - DNA, 25 bp, Mus musculus
tagagaagcagctgatggatccccg

SEQ ID NO: 771440 - DNA, 25 bp, Mus musculus
tagagaagccctcccaataagtctt

SEQ ID NO: 771441 - DNA, 25 bp, Mus musculus
tagagaagccctgccaataagtctt

SEQ ID NO: 771442 - DNA, 25 bp, Mus musculus
tagagaaggcgtctgtctgctgccc

SEQ ID NO: 771443 - DNA, 25 bp, Mus musculus
tagagaaggcgtgtgtctgctgccc

SEQ ID NO: 771444 - DNA, 25 bp, Mus musculus
tagagaaggtccaggcagtgtccca

SEQ ID NO: 771445 - DNA, 25 bp, Mus musculus
tagagaaggtcctggcagtgtccca

SEQ ID NO: 771446 - DNA, 25 bp, Mus musculus
tagagaagtctcactccgcaaaagt

SEQ ID NO: 771447 - DNA, 25 bp, Mus musculus
tagagaagtctctctccgcaaaagt

SEQ ID NO: 771448 - DNA, 25 bp, Mus musculus
tagagaatactgactcctctgaaag

SEQ ID NO: 771449 - DNA, 25 bp, Mus musculus
tagagaatactgtctcctctgaaag

SEQ ID NO: 771450 - DNA, 25 bp, Mus musculus
tagagaatcatgacggtcaacaaat

SEQ ID NO: 771451 - DNA, 25 bp, Mus musculus
tagagaatcatgctactgccaagga

SEQ ID NO: 771452 - DNA, 25 bp, Mus musculus
tagagaatcatggtactgccaagga

SEQ ID NO: 771453 - DNA, 25 bp, Mus musculus
tagagaatcatgtcggtcaacaaat

SEQ ID NO: 771454 - DNA, 25 bp, Mus musculus
tagagaatccaaaatctggcagcat

SEQ ID NO: 771455 - DNA, 25 bp, Mus musculus
tagagaatccaatatctggcagcat

SEQ ID NO: 771456 - DNA, 25 bp, Mus musculus
tagagaatgaccatggctgccttgt

SEQ ID NO: 771457 - DNA, 25 bp, Mus musculus
tagagaatgaccttggctgccttgt

SEQ ID NO: 771458 - DNA, 25 bp, Mus musculus
tagagaatggccctgtcaagcacct

SEQ ID NO: 771459 - DNA, 25 bp, Mus musculus
tagagaatggccgtgtcaagcacct

SEQ ID NO: 771460 - DNA, 25 bp, Mus musculus
tagagaatggctagcctccacctgc

SEQ ID NO: 771461 - DNA, 25 bp, Mus musculus
tagagaatggctattagggtttggt

SEQ ID NO: 771462 - DNA, 25 bp, Mus musculus
tagagaatggcttgcctccacctgc

SEQ ID NO: 771463 - DNA, 25 bp, Mus musculus
tagagaatggcttttagggtttggt

SEQ ID NO: 771464 - DNA, 25 bp, Mus musculus
tagagaatgtttccctttacccact

SEQ ID NO: 771465 - DNA, 25 bp, Mus musculus
tagagaatgtttgcctttacccact

SEQ ID NO: 771466 - DNA, 25 bp, Mus musculus
tagagacacaacctgctgcctgtct

SEQ ID NO: 771467 - DNA, 25 bp, Mus musculus
tagagacacaacgtgctgcctgtct

SEQ ID NO: 771468 - DNA, 25 bp, Mus musculus
tagagacacctgagggactcgccct

SEQ ID NO: 771469 - DNA, 25 bp, Mus musculus
tagagacacctgtgggactcgccct

SEQ ID NO: 771470 - DNA, 25 bp, Mus musculus
tagagacactaacggcttgagggaa

SEQ ID NO: 771471 - DNA, 25 bp, Mus musculus
tagagacactaagggcttgagggaa

SEQ ID NO: 771472 - DNA, 25 bp, Mus musculus
tagagacactcgagcttactcatcc

SEQ ID NO: 771473 - DNA, 25 bp, Mus musculus
tagagacactcgtgcttactcatcc

SEQ ID NO: 771474 - DNA, 25 bp, Mus musculus
tagagacagacacattctcctctca

SEQ ID NO: 771475 - DNA, 25 bp, Mus musculus
tagagacagacagattctcctctca

SEQ ID NO: 771476 - DNA, 25 bp, Mus musculus
tagagacagacgacacaggtcccgc

SEQ ID NO: 771477 - DNA, 25 bp, Mus musculus
tagagacagacgtcacaggtcccgc

SEQ ID NO: 771478 - DNA, 25 bp, Mus musculus
tagagacagactacatcacgtttgc

SEQ ID NO: 771479 - DNA, 25 bp, Mus musculus
tagagacagacttcatcacgtttgc

SEQ ID NO: 771480 - DNA, 25 bp, Mus musculus
tagagacatgaaaatcccacttctt

SEQ ID NO: 771481 - DNA, 25 bp, Mus musculus
tagagacatgaatatcccacttctt

SEQ ID NO: 771482 - DNA, 25 bp, Mus musculus
tagagaccaagcagcgctaacggga

SEQ ID NO: 771483 - DNA, 25 bp, Mus musculus
tagagaccaagctgcgctaacggga

SEQ ID NO: 771484 - DNA, 25 bp, Mus musculus
tagagaccaggtccacatggctcaa

SEQ ID NO: 771485 - DNA, 25 bp, Mus musculus
tagagaccaggtgcacatggctcaa

SEQ ID NO: 771486 - DNA, 25 bp, Mus musculus
tagagaccgtaacacccagctagct

SEQ ID NO: 771487 - DNA, 25 bp, Mus musculus
tagagaccgtaagacccagctagct

SEQ ID NO: 771488 - DNA, 25 bp, Mus musculus
tagagaccgtgtcgttttgttcgcc

SEQ ID NO: 771489 - DNA, 25 bp, Mus musculus
tagagaccgtgtggttttgttcgcc

SEQ ID NO: 771490 - DNA, 25 bp, Mus musculus
tagagacctagaatcctctagtgag

SEQ ID NO: 771491 - DNA, 25 bp, Mus musculus
tagagacctagattcctctagtgag

SEQ ID NO: 771492 - DNA, 25 bp, Mus musculus
tagagacctccgctaatcgatcttt

SEQ ID NO: 771493 - DNA, 25 bp, Mus musculus
tagagacctccggtaatcgatcttt

SEQ ID NO: 771494 - DNA, 25 bp, Mus musculus
tagagacctctcatcaattttacag

SEQ ID NO: 771495 - DNA, 25 bp, Mus musculus
tagagacctctcttcaattttacag

SEQ ID NO: 771496 - DNA, 25 bp, Mus musculus
tagagacctcttagtgggccaagtc

SEQ ID NO: 771497 - DNA, 25 bp, Mus musculus
tagagacctctttgtgggccaagtc

SEQ ID NO: 771498 - DNA, 25 bp, Mus musculus
tagagacctggcacccaggcttggc

SEQ ID NO: 771499 - DNA, 25 bp, Mus musculus
tagagacctggctcccaggcttggc

SEQ ID NO: 771500 - DNA, 25 bp, Mus musculus
tagagaccttataaccctgggcagt

SEQ ID NO: 771501 - DNA, 25 bp, Mus musculus
tagagaccttattaccctgggcagt

SEQ ID NO: 771502 - DNA, 25 bp, Mus musculus
tagagaccttggcacagtggcacct

SEQ ID NO: 771503 - DNA, 25 bp, Mus musculus
tagagaccttgggacagtggcacct

SEQ ID NO: 771504 - DNA, 25 bp, Mus musculus
tagagacgacagctgcagcttgagt

SEQ ID NO: 771505 - DNA, 25 bp, Mus musculus
tagagacgacaggtgcagcttgagt

SEQ ID NO: 771506 - DNA, 25 bp, Mus musculus
tagagacgatgtcgctttcctgagc

SEQ ID NO: 771507 - DNA, 25 bp, Mus musculus
tagagacgatgtggctttcctgagc

SEQ ID NO: 771508 - DNA, 25 bp, Mus musculus
tagagacgctcgctacactaatcct

SEQ ID NO: 771509 - DNA, 25 bp, Mus musculus
tagagacgctcggtacactaatcct

SEQ ID NO: 771510 - DNA, 25 bp, Mus musculus
tagagacggacgagccctgggcacc

SEQ ID NO: 771511 - DNA, 25 bp, Mus musculus
tagagacggacgtgccctgggcacc

SEQ ID NO: 771512 - DNA, 25 bp, Mus musculus
tagagacggcaacgagcctttccct

SEQ ID NO: 771513 - DNA, 25 bp, Mus musculus
tagagacggcaaggagcctttccct

SEQ ID NO: 771514 - DNA, 25 bp, Mus musculus
tagagacggcagcagacccttactc

SEQ ID NO: 771515 - DNA, 25 bp, Mus musculus
tagagacggcaggagacccttactc

SEQ ID NO: 771516 - DNA, 25 bp, Mus musculus
tagagacgtgctagctgggacagtt

SEQ ID NO: 771517 - DNA, 25 bp, Mus musculus
tagagacgtgcttgctgggacagtt

SEQ ID NO: 771518 - DNA, 25 bp, Mus musculus
tagagactacagattccagccgacc

SEQ ID NO: 771519 - DNA, 25 bp, Mus musculus
tagagactacagtttccagccgacc

SEQ ID NO: 771520 - DNA, 25 bp, Mus musculus
tagagactatccagaacatgtgaaa

SEQ ID NO: 771521 - DNA, 25 bp, Mus musculus
tagagactatcctgaacatgtgaaa

SEQ ID NO: 771522 - DNA, 25 bp, Mus musculus
tagagactcacgcatcccagaggag

SEQ ID NO: 771523 - DNA, 25 bp, Mus musculus
tagagactcacggatcccagaggag

SEQ ID NO: 771524 - DNA, 25 bp, Mus musculus
tagagactctcgcatagacagcggt

SEQ ID NO: 771525 - DNA, 25 bp, Mus musculus
tagagactctcggatagacagcggt

SEQ ID NO: 771526 - DNA, 25 bp, Mus musculus
tagagactggataattgtatgcaca

SEQ ID NO: 771527 - DNA, 25 bp, Mus musculus
tagagactggattattgtatgcaca

SEQ ID NO: 771528 - DNA, 25 bp, Mus musculus
tagagactggtgactttgcatctct

SEQ ID NO: 771529 - DNA, 25 bp, Mus musculus
tagagactggtgtctttgcatctct

SEQ ID NO: 771530 - DNA, 25 bp, Mus musculus
tagagactgtaacctcttctcaaag

SEQ ID NO: 771531 - DNA, 25 bp, Mus musculus
tagagactgtaagctcttctcaaag

SEQ ID NO: 771532 - DNA, 25 bp, Mus musculus
tagagacttcataaccaaccttcag

SEQ ID NO: 771533 - DNA, 25 bp, Mus musculus
tagagacttcattaccaaccttcag

SEQ ID NO: 771534 - DNA, 25 bp, Mus musculus
tagagacttcgcactccactaatgg

SEQ ID NO: 771535 - DNA, 25 bp, Mus musculus
tagagacttcgctctccactaatgg

SEQ ID NO: 771536 - DNA, 25 bp, Mus musculus
tagagacttgaccattagcagcaca

SEQ ID NO: 771537 - DNA, 25 bp, Mus musculus
tagagacttgacgattagcagcaca

SEQ ID NO: 771538 - DNA, 25 bp, Mus musculus
tagagacttgccacattcccgagat

SEQ ID NO: 771539 - DNA, 25 bp, Mus musculus
tagagacttgcctcattcccgagat

SEQ ID NO: 771540 - DNA, 25 bp, Mus musculus
tagagactttctacttttattggac

SEQ ID NO: 771541 - DNA, 25 bp, Mus musculus
tagagactttcttcttttattggac

SEQ ID NO: 771542 - DNA, 25 bp, Mus musculus
tagagactttgcacaccagcagtcc

SEQ ID NO: 771543 - DNA, 25 bp, Mus musculus
tagagactttgctcaccagcagtcc

SEQ ID NO: 771544 - DNA, 25 bp, Mus musculus
tagagagaatccacaacaagccagg

SEQ ID NO: 771545 - DNA, 25 bp, Mus musculus
tagagagaatcctcaacaagccagg

SEQ ID NO: 771546 - DNA, 25 bp, Mus musculus
tagagagaccatctcacaaccactc

SEQ ID NO: 771547 - DNA, 25 bp, Mus musculus
tagagagaccatgtcacaaccactc

SEQ ID NO: 771548 - DNA, 25 bp, Mus musculus
tagagagaccgcagacaccgacacg

SEQ ID NO: 771549 - DNA, 25 bp, Mus musculus
tagagagaccgctgacaccgacacg

SEQ ID NO: 771550 - DNA, 25 bp, Mus musculus
tagagagacctccacggccattctc

SEQ ID NO: 771551 - DNA, 25 bp, Mus musculus
tagagagacctcgacggccattctc

SEQ ID NO: 771552 - DNA, 25 bp, Mus musculus
tagagagactcaaggcttcagctgc

SEQ ID NO: 771553 - DNA, 25 bp, Mus musculus
tagagagactcatggcttcagctgc

SEQ ID NO: 771554 - DNA, 25 bp, Mus musculus
tagagagagagcatcccggagtcgc

SEQ ID NO: 771555 - DNA, 25 bp, Mus musculus
tagagagagagcttcccggagtcgc

SEQ ID NO: 771556 - DNA, 25 bp, Mus musculus
tagagagagggcattacaaattaaa

SEQ ID NO: 771557 - DNA, 25 bp, Mus musculus
tagagagagggctttacaaattaaa

SEQ ID NO: 771558 - DNA, 25 bp, Mus musculus
tagagagatagaataacatcacgga

SEQ ID NO: 771559 - DNA, 25 bp, Mus musculus
tagagagatagattaacatcacgga

SEQ ID NO: 771560 - DNA, 25 bp, Mus musculus
tagagagatcacacagcgctaggat

SEQ ID NO: 771561 - DNA, 25 bp, Mus musculus
tagagagatcactcagcgctaggat

SEQ ID NO: 771562 - DNA, 25 bp, Mus musculus
tagagagatgctcgctcagcccttt

SEQ ID NO: 771563 - DNA, 25 bp, Mus musculus
tagagagatgctggctcagcccttt

SEQ ID NO: 771564 - DNA, 25 bp, Mus musculus
tagagagatggaaccctgttgggca

SEQ ID NO: 771565 - DNA, 25 bp, Mus musculus
tagagagatggatccctgttgggca

SEQ ID NO: 771566 - DNA, 25 bp, Mus musculus
tagagagattacaccagcccctaca

SEQ ID NO: 771567 - DNA, 25 bp, Mus musculus
tagagagattactccagcccctaca

SEQ ID NO: 771568 - DNA, 25 bp, Mus musculus
tagagagattctacattcagcaagt

SEQ ID NO: 771569 - DNA, 25 bp, Mus musculus
tagagagattcttcattcagcaagt

SEQ ID NO: 771570 - DNA, 25 bp, Mus musculus
tagagagcaaagaccagtgtcaaaa

SEQ ID NO: 771571 - DNA, 25 bp, Mus musculus
tagagagcaaagtccagtgtcaaaa

SEQ ID NO: 771572 - DNA, 25 bp, Mus musculus
tagagagcaacaatccttcatcctt

SEQ ID NO: 771573 - DNA, 25 bp, Mus musculus
tagagagcaacattccttcatcctt

SEQ ID NO: 771574 - DNA, 25 bp, Mus musculus
tagagagcaactacagttcccttcg

SEQ ID NO: 771575 - DNA, 25 bp, Mus musculus
tagagagcaacttcagttcccttcg

SEQ ID NO: 771576 - DNA, 25 bp, Mus musculus
tagagagcacccaagacagcctgga

SEQ ID NO: 771577 - DNA, 25 bp, Mus musculus
tagagagcaccctagacagcctgga

SEQ ID NO: 771578 - DNA, 25 bp, Mus musculus
tagagagcacgcaaccagtttcggt

SEQ ID NO: 771579 - DNA, 25 bp, Mus musculus
tagagagcacgctaccagtttcggt

SEQ ID NO: 771580 - DNA, 25 bp, Mus musculus
tagagagcagctccccaggtgtctc

SEQ ID NO: 771581 - DNA, 25 bp, Mus musculus
tagagagcagctgcccaggtgtctc

SEQ ID NO: 771582 - DNA, 25 bp, Mus musculus
tagagagccacgcaagctcatcact

SEQ ID NO: 771583 - DNA, 25 bp, Mus musculus
tagagagccacggaagctcatcact

SEQ ID NO: 771584 - DNA, 25 bp, Mus musculus
tagagagcccataaagaacaccaag

SEQ ID NO: 771585 - DNA, 25 bp, Mus musculus
tagagagcccattaagaacaccaag

SEQ ID NO: 771586 - DNA, 25 bp, Mus musculus
tagagagccgtgagtcctgagtgtt

SEQ ID NO: 771587 - DNA, 25 bp, Mus musculus
tagagagccgtgtgtcctgagtgtt

SEQ ID NO: 771588 - DNA, 25 bp, Mus musculus
tagagagcctagcatctgtctccct

SEQ ID NO: 771589 - DNA, 25 bp, Mus musculus
tagagagcctaggatctgtctccct

SEQ ID NO: 771590 - DNA, 25 bp, Mus musculus
tagagagcctctctcctaggtctta

SEQ ID NO: 771591 - DNA, 25 bp, Mus musculus
tagagagcctctgtcctaggtctta

SEQ ID NO: 771592 - DNA, 25 bp, Mus musculus
tagagagctacacagactcagccat

SEQ ID NO: 771593 - DNA, 25 bp, Mus musculus
tagagagctacagagactcagccat

SEQ ID NO: 771594 - DNA, 25 bp, Mus musculus
tagagagctattccctactttccat

SEQ ID NO: 771595 - DNA, 25 bp, Mus musculus
tagagagctattgcctactttccat

SEQ ID NO: 771596 - DNA, 25 bp, Mus musculus
tagagagctgacagcgcaccacctg

SEQ ID NO: 771597 - DNA, 25 bp, Mus musculus
tagagagctgactgcgcaccacctg

SEQ ID NO: 771598 - DNA, 25 bp, Mus musculus
tagagagctgctcatggttccgttt

SEQ ID NO: 771599 - DNA, 25 bp, Mus musculus
tagagagctgctgatggttccgttt

SEQ ID NO: 771600 - DNA, 25 bp, Mus musculus
tagagagctgtactctttacacggg

SEQ ID NO: 771601 - DNA, 25 bp, Mus musculus
tagagagctgtagtctttacacggg

SEQ ID NO: 771602 - DNA, 25 bp, Mus musculus
tagagaggacccagctctcttgcca

SEQ ID NO: 771603 - DNA, 25 bp, Mus musculus
tagagaggaccctgctctcttgcca

SEQ ID NO: 771604 - DNA, 25 bp, Mus musculus
tagagaggacttcggtggacaaacc

SEQ ID NO: 771605 - DNA, 25 bp, Mus musculus
tagagaggacttgggtggacaaacc

SEQ ID NO: 771606 - DNA, 25 bp, Mus musculus
tagagaggagacacgctctgtgttt

SEQ ID NO: 771607 - DNA, 25 bp, Mus musculus
tagagaggagactcgctctgtgttt

SEQ ID NO: 771608 - DNA, 25 bp, Mus musculus
tagagaggctaaagcatggtgctta

SEQ ID NO: 771609 - DNA, 25 bp, Mus musculus
tagagaggctaatgcatggtgctta

SEQ ID NO: 771610 - DNA, 25 bp, Mus musculus
tagagagggcccagactgaggactc

SEQ ID NO: 771611 - DNA, 25 bp, Mus musculus
tagagagggccctgactgaggactc

SEQ ID NO: 771612 - DNA, 25 bp, Mus musculus
tagagagggctccagtcagaccaga

SEQ ID NO: 771613 - DNA, 25 bp, Mus musculus
tagagagggctcgagtcagaccaga

SEQ ID NO: 771614 - DNA, 25 bp, Mus musculus
tagagaggttctctccatcagcagt

SEQ ID NO: 771615 - DNA, 25 bp, Mus musculus
tagagaggttctgtccatcagcagt

SEQ ID NO: 771616 - DNA, 25 bp, Mus musculus
tagagagtaacaacagcttccctgc

SEQ ID NO: 771617 - DNA, 25 bp, Mus musculus
tagagagtaacatcagcttccctgc

SEQ ID NO: 771618 - DNA, 25 bp, Mus musculus
tagagagtcaccagtgggcccaccg

SEQ ID NO: 771619 - DNA, 25 bp, Mus musculus
tagagagtcacctgtgggcccaccg

SEQ ID NO: 771620 - DNA, 25 bp, Mus musculus
tagagagtgattaccgcaccaccac

SEQ ID NO: 771621 - DNA, 25 bp, Mus musculus
tagagagtgatttccgcaccaccac

SEQ ID NO: 771622 - DNA, 25 bp, Mus musculus
tagagagtggcccagagcttctcag

SEQ ID NO: 771623 - DNA, 25 bp, Mus musculus
tagagagtggccctgtgtcgtacca

SEQ ID NO: 771624 - DNA, 25 bp, Mus musculus
tagagagtggccgagagcttctcag

SEQ ID NO: 771625 - DNA, 25 bp, Mus musculus
tagagagtggccgtgtgtcgtacca

SEQ ID NO: 771626 - DNA, 25 bp, Mus musculus
tagagagtgtgtatttcttccgtct

SEQ ID NO: 771627 - DNA, 25 bp, Mus musculus
tagagagtgtgtttttcttccgtct

SEQ ID NO: 771628 - DNA, 25 bp, Mus musculus
tagagagttagcacagcgtttaaga

SEQ ID NO: 771629 - DNA, 25 bp, Mus musculus
tagagagttagctcagcgtttaaga

SEQ ID NO: 771630 - DNA, 25 bp, Mus musculus
tagagagttcggctctttgttcttc

SEQ ID NO: 771631 - DNA, 25 bp, Mus musculus
tagagagttcgggtctttgttcttc

SEQ ID NO: 771632 - DNA, 25 bp, Mus musculus
tagagagtttaccacctcccagatt

SEQ ID NO: 771633 - DNA, 25 bp, Mus musculus
tagagagtttacgacctcccagatt

SEQ ID NO: 771634 - DNA, 25 bp, Mus musculus
tagagagtttagactgggctgctca

SEQ ID NO: 771635 - DNA, 25 bp, Mus musculus
tagagagtttagtctgggctgctca

SEQ ID NO: 771636 - DNA, 25 bp, Mus musculus
tagagagtttctcaatttgtatttg

SEQ ID NO: 771637 - DNA, 25 bp, Mus musculus
tagagagtttctgaatttgtatttg

SEQ ID NO: 771638 - DNA, 25 bp, Mus musculus
tagagagttttacagtccgtgggaa

SEQ ID NO: 771639 - DNA, 25 bp, Mus musculus
tagagagttttagagtccgtgggaa

SEQ ID NO: 771640 - DNA, 25 bp, Mus musculus
tagagatacaacacattcacccatg

SEQ ID NO: 771641 - DNA, 25 bp, Mus musculus
tagagatacaactcattcacccatg

SEQ ID NO: 771642 - DNA, 25 bp, Mus musculus
tagagatagagactcccgtagagag

SEQ ID NO: 771643 - DNA, 25 bp, Mus musculus
tagagatagagagtcccgtagagag

SEQ ID NO: 771644 - DNA, 25 bp, Mus musculus
tagagatcaactataggtattccac

SEQ ID NO: 771645 - DNA, 25 bp, Mus musculus
tagagatcaactttaggtattccac

SEQ ID NO: 771646 - DNA, 25 bp, Mus musculus
tagagatcaatgaacatactttctt

SEQ ID NO: 771647 - DNA, 25 bp, Mus musculus
tagagatcaatgtacatactttctt

SEQ ID NO: 771648 - DNA, 25 bp, Mus musculus
tagagatcactaatctggactggtg

SEQ ID NO: 771649 - DNA, 25 bp, Mus musculus
tagagatcactattctggactggtg

SEQ ID NO: 771650 - DNA, 25 bp, Mus musculus
tagagatccaacaccagtcagtcac

SEQ ID NO: 771651 - DNA, 25 bp, Mus musculus
tagagatccaactccagtcagtcac

SEQ ID NO: 771652 - DNA, 25 bp, Mus musculus
tagagatcctagagtggaccctgcg

SEQ ID NO: 771653 - DNA, 25 bp, Mus musculus
tagagatcctagtgtggaccctgcg

SEQ ID NO: 771654 - DNA, 25 bp, Mus musculus
tagagatcggagctgagctgcccac

SEQ ID NO: 771655 - DNA, 25 bp, Mus musculus
tagagatcggaggtgagctgcccac

SEQ ID NO: 771656 - DNA, 25 bp, Mus musculus
tagagatctattaccttctgctacc

SEQ ID NO: 771657 - DNA, 25 bp, Mus musculus
tagagatctatttccttctgctacc

SEQ ID NO: 771658 - DNA, 25 bp, Mus musculus
tagagatctggaagcctgcaggaga

SEQ ID NO: 771659 - DNA, 25 bp, Mus musculus
tagagatctggatgcctgcaggaga

SEQ ID NO: 771660 - DNA, 25 bp, Mus musculus
tagagatctgtaccaccatcttaaa

SEQ ID NO: 771661 - DNA, 25 bp, Mus musculus
tagagatctgtagcaccatcttaaa

SEQ ID NO: 771662 - DNA, 25 bp, Mus musculus
tagagatctgttacacccttccttg

SEQ ID NO: 771663 - DNA, 25 bp, Mus musculus
tagagatctgtttcacccttccttg

SEQ ID NO: 771664 - DNA, 25 bp, Mus musculus
tagagatcttaacggcaaggttttt

SEQ ID NO: 771665 - DNA, 25 bp, Mus musculus
tagagatcttaagggcaaggttttt

SEQ ID NO: 771666 - DNA, 25 bp, Mus musculus
tagagatcttgcatcctggaggaaa

SEQ ID NO: 771667 - DNA, 25 bp, Mus musculus
tagagatcttgcttcctggaggaaa

SEQ ID NO: 771668 - DNA, 25 bp, Mus musculus
tagagatgacctactgtggtacggt

SEQ ID NO: 771669 - DNA, 25 bp, Mus musculus
tagagatgaccttctgtggtacggt

SEQ ID NO: 771670 - DNA, 25 bp, Mus musculus
tagagatgactgatgatctacccag

SEQ ID NO: 771671 - DNA, 25 bp, Mus musculus
tagagatgactgttgatctacccag

SEQ ID NO: 771672 - DNA, 25 bp, Mus musculus
tagagatgatctctacggcccaggg

SEQ ID NO: 771673 - DNA, 25 bp, Mus musculus
tagagatgatctgtacggcccaggg

SEQ ID NO: 771674 - DNA, 25 bp, Mus musculus
tagagatgcactagagggacacagc

SEQ ID NO: 771675 - DNA, 25 bp, Mus musculus
tagagatgcacttgagggacacagc

SEQ ID NO: 771676 - DNA, 25 bp, Mus musculus
tagagatgcagaaggcttcacccct

SEQ ID NO: 771677 - DNA, 25 bp, Mus musculus
tagagatgcagatggcttcacccct

SEQ ID NO: 771678 - DNA, 25 bp, Mus musculus
tagagatgccagactatcacgtcta

SEQ ID NO: 771679 - DNA, 25 bp, Mus musculus
tagagatgccagtctatcacgtcta

SEQ ID NO: 771680 - DNA, 25 bp, Mus musculus
tagagatgcccgcagtgctataccc

SEQ ID NO: 771681 - DNA, 25 bp, Mus musculus
tagagatgcccggagtgctataccc

SEQ ID NO: 771682 - DNA, 25 bp, Mus musculus
tagagatggacgacactgttgcccc

SEQ ID NO: 771683 - DNA, 25 bp, Mus musculus
tagagatggacgtcactgttgcccc

SEQ ID NO: 771684 - DNA, 25 bp, Mus musculus
tagagatggcgtagctcccaagcac

SEQ ID NO: 771685 - DNA, 25 bp, Mus musculus
tagagatggcgttgctcccaagcac

SEQ ID NO: 771686 - DNA, 25 bp, Mus musculus
tagagatgggaactctgggccaaca

SEQ ID NO: 771687 - DNA, 25 bp, Mus musculus
tagagatgggaagtctgggccaaca

SEQ ID NO: 771688 - DNA, 25 bp, Mus musculus
tagagatgtcttagtgtccctacac

SEQ ID NO: 771689 - DNA, 25 bp, Mus musculus
tagagatgtctttgtgtccctacac

SEQ ID NO: 771690 - DNA, 25 bp, Mus musculus
tagagattaggcaccatccttgtgg

SEQ ID NO: 771691 - DNA, 25 bp, Mus musculus
tagagattaggctccatccttgtgg

SEQ ID NO: 771692 - DNA, 25 bp, Mus musculus
tagagattccaacaaattcctcccc

SEQ ID NO: 771693 - DNA, 25 bp, Mus musculus
tagagattccaagaaattcctcccc

SEQ ID NO: 771694 - DNA, 25 bp, Mus musculus
tagagattcctcatgtgcagagccc

SEQ ID NO: 771695 - DNA, 25 bp, Mus musculus
tagagattcctcttgtgcagagccc

SEQ ID NO: 771696 - DNA, 25 bp, Mus musculus
tagagattcgtgcatcacaccccaa

SEQ ID NO: 771697 - DNA, 25 bp, Mus musculus
tagagattcgtggatcacaccccaa

SEQ ID NO: 771698 - DNA, 25 bp, Mus musculus
tagagattctacctgcagtctgttc

SEQ ID NO: 771699 - DNA, 25 bp, Mus musculus
tagagattctacgtgcagtctgttc

SEQ ID NO: 771700 - DNA, 25 bp, Mus musculus
tagagattgccaacaacttgtgtct

SEQ ID NO: 771701 - DNA, 25 bp, Mus musculus
tagagattgccatcaacttgtgtct

SEQ ID NO: 771702 - DNA, 25 bp, Mus musculus
tagagatttaccaccgctgcttttt

SEQ ID NO: 771703 - DNA, 25 bp, Mus musculus
tagagatttacctccgctgcttttt

SEQ ID NO: 771704 - DNA, 25 bp, Mus musculus
tagagatttccactcacccacgtca

SEQ ID NO: 771705 - DNA, 25 bp, Mus musculus
tagagatttccagtcacccacgtca

SEQ ID NO: 771706 - DNA, 25 bp, Mus musculus
tagagattttgacacccgcctgagc

SEQ ID NO: 771707 - DNA, 25 bp, Mus musculus
tagagattttgagacccgcctgagc

SEQ ID NO: 771708 - DNA, 25 bp, Mus musculus
tagagcaaagctctggcgccccaga

SEQ ID NO: 771709 - DNA, 25 bp, Mus musculus
tagagcaaagctgtggcgccccaga

SEQ ID NO: 771710 - DNA, 25 bp, Mus musculus
tagagcaagaggctgcaaaggaaga

SEQ ID NO: 771711 - DNA, 25 bp, Mus musculus
tagagcaagagggtgcaaaggaaga

SEQ ID NO: 771712 - DNA, 25 bp, Mus musculus
tagagcaaggccactttgatgacct

SEQ ID NO: 771713 - DNA, 25 bp, Mus musculus
tagagcaaggcctctttgatgacct

SEQ ID NO: 771714 - DNA, 25 bp, Mus musculus
tagagcaaggctactagggtgccaa

SEQ ID NO: 771715 - DNA, 25 bp, Mus musculus
tagagcaaggcttctagggtgccaa

SEQ ID NO: 771716 - DNA, 25 bp, Mus musculus
tagagcaatggcatcatggaaccca

SEQ ID NO: 771717 - DNA, 25 bp, Mus musculus
tagagcaatggcttcatggaaccca

SEQ ID NO: 771718 - DNA, 25 bp, Mus musculus
tagagcaattctagcccagtggcta

SEQ ID NO: 771719 - DNA, 25 bp, Mus musculus
tagagcaattcttgcccagtggcta

SEQ ID NO: 771720 - DNA, 25 bp, Mus musculus
tagagcaattgtatttcgtccgttt

SEQ ID NO: 771721 - DNA, 25 bp, Mus musculus
tagagcaattgtttttcgtccgttt

SEQ ID NO: 771722 - DNA, 25 bp, Mus musculus
tagagcacacagaaggcactcaaaa

SEQ ID NO: 771723 - DNA, 25 bp, Mus musculus
tagagcacacagtaggcactcaaaa

SEQ ID NO: 771724 - DNA, 25 bp, Mus musculus
tagagcacagatccaggtctcactc

SEQ ID NO: 771725 - DNA, 25 bp, Mus musculus
tagagcacagatgcaggtctcactc

SEQ ID NO: 771726 - DNA, 25 bp, Mus musculus
tagagcacagctaagagcggactgt

SEQ ID NO: 771727 - DNA, 25 bp, Mus musculus
tagagcacagcttagagcggactgt

SEQ ID NO: 771728 - DNA, 25 bp, Mus musculus
tagagcacagtcctttgaccacgat

SEQ ID NO: 771729 - DNA, 25 bp, Mus musculus
tagagcacagtcgtttgaccacgat

SEQ ID NO: 771730 - DNA, 25 bp, Mus musculus
tagagcacatgcatctctttgcctt

SEQ ID NO: 771731 - DNA, 25 bp, Mus musculus
tagagcacatgcttctctttgcctt

SEQ ID NO: 771732 - DNA, 25 bp, Mus musculus
tagagcacatgtacaatcccagatc

SEQ ID NO: 771733 - DNA, 25 bp, Mus musculus
tagagcacatgttcaatcccagatc

SEQ ID NO: 771734 - DNA, 25 bp, Mus musculus
tagagcaccagacggaccgccaaaa

SEQ ID NO: 771735 - DNA, 25 bp, Mus musculus
tagagcaccagagggaccgccaaaa

SEQ ID NO: 771736 - DNA, 25 bp, Mus musculus
tagagcaccatgacccataggcaaa

SEQ ID NO: 771737 - DNA, 25 bp, Mus musculus
tagagcaccatgtcccataggcaaa

SEQ ID NO: 771738 - DNA, 25 bp, Mus musculus
tagagcacccttaggagcgacagtt

SEQ ID NO: 771739 - DNA, 25 bp, Mus musculus
tagagcaccctttggagcgacagtt

SEQ ID NO: 771740 - DNA, 25 bp, Mus musculus
tagagcacctgccacagaggactgt

SEQ ID NO: 771741 - DNA, 25 bp, Mus musculus
tagagcacctgcgacagaggactgt

SEQ ID NO: 771742 - DNA, 25 bp, Mus musculus
tagagcacttgacacgcacacacca

SEQ ID NO: 771743 - DNA, 25 bp, Mus musculus
tagagcacttgagacgcacacacca

SEQ ID NO: 771744 - DNA, 25 bp, Mus musculus
tagagcactttcaggagttcatgaa

SEQ ID NO: 771745 - DNA, 25 bp, Mus musculus
tagagcactttctggagttcatgaa

SEQ ID NO: 771746 - DNA, 25 bp, Mus musculus
tagagcagagtacaacctttgttta

SEQ ID NO: 771747 - DNA, 25 bp, Mus musculus
tagagcagagtagaacctttgttta

SEQ ID NO: 771748 - DNA, 25 bp, Mus musculus
tagagcagatggcacccactgttgt

SEQ ID NO: 771749 - DNA, 25 bp, Mus musculus
tagagcagatgggacccactgttgt

SEQ ID NO: 771750 - DNA, 25 bp, Mus musculus
tagagcagcacgctccctccaggag

SEQ ID NO: 771751 - DNA, 25 bp, Mus musculus
tagagcagcacggtccctccaggag

SEQ ID NO: 771752 - DNA, 25 bp, Mus musculus
tagagcagctctaaccaggagtttt

SEQ ID NO: 771753 - DNA, 25 bp, Mus musculus
tagagcagctcttaccaggagtttt

SEQ ID NO: 771754 - DNA, 25 bp, Mus musculus
tagagcagggacaatgttttctgta

SEQ ID NO: 771755 - DNA, 25 bp, Mus musculus
tagagcagggactatgttttctgta

SEQ ID NO: 771756 - DNA, 25 bp, Mus musculus
tagagcagggagatgccttgctgaa

SEQ ID NO: 771757 - DNA, 25 bp, Mus musculus
tagagcagggagttgccttgctgaa

SEQ ID NO: 771758 - DNA, 25 bp, Mus musculus
tagagcaggttaatacagaattttc

SEQ ID NO: 771759 - DNA, 25 bp, Mus musculus
tagagcaggttattacagaattttc

SEQ ID NO: 771760 - DNA, 25 bp, Mus musculus
tagagcagtattactctgccttcag

SEQ ID NO: 771761 - DNA, 25 bp, Mus musculus
tagagcagtatttctctgccttcag

SEQ ID NO: 771762 - DNA, 25 bp, Mus musculus
tagagcagtgtgctgctatcccctc

SEQ ID NO: 771763 - DNA, 25 bp, Mus musculus
tagagcagtgtggtgctatcccctc

SEQ ID NO: 771764 - DNA, 25 bp, Mus musculus
tagagcatcatccaattcacactgg

SEQ ID NO: 771765 - DNA, 25 bp, Mus musculus
tagagcatcatcgaattcacactgg

SEQ ID NO: 771766 - DNA, 25 bp, Mus musculus
tagagcatcatgactggactccccg

SEQ ID NO: 771767 - DNA, 25 bp, Mus musculus
tagagcatcatgcttgtccactgct

SEQ ID NO: 771768 - DNA, 25 bp, Mus musculus
tagagcatcatggttgtccactgct

SEQ ID NO: 771769 - DNA, 25 bp, Mus musculus
tagagcatcatgtctggactccccg

SEQ ID NO: 771770 - DNA, 25 bp, Mus musculus
tagagcattcaaagcccggctatct

SEQ ID NO: 771771 - DNA, 25 bp, Mus musculus
tagagcattcaatgcccggctatct

SEQ ID NO: 771772 - DNA, 25 bp, Mus musculus
tagagcattctgacacttggtgccc

SEQ ID NO: 771773 - DNA, 25 bp, Mus musculus
tagagcattctgtcacttggtgccc

SEQ ID NO: 771774 - DNA, 25 bp, Mus musculus
tagagcatttctccctggaaggtga

SEQ ID NO: 771775 - DNA, 25 bp, Mus musculus
tagagcatttctgcctggaaggtga

SEQ ID NO: 771776 - DNA, 25 bp, Mus musculus
tagagcatttgcaaggataccctat

SEQ ID NO: 771777 - DNA, 25 bp, Mus musculus
tagagcatttgctaggataccctat

SEQ ID NO: 771778 - DNA, 25 bp, Mus musculus
tagagccaacctcttggtggccaga

SEQ ID NO: 771779 - DNA, 25 bp, Mus musculus
tagagccaacctgttggtggccaga

SEQ ID NO: 771780 - DNA, 25 bp, Mus musculus
tagagccaaggaaggtcaccacact

SEQ ID NO: 771781 - DNA, 25 bp, Mus musculus
tagagccaaggatggtcaccacact

SEQ ID NO: 771782 - DNA, 25 bp, Mus musculus
tagagccaatcaccatcacacagaa

SEQ ID NO: 771783 - DNA, 25 bp, Mus musculus
tagagccaatcagcatcacacagaa

SEQ ID NO: 771784 - DNA, 25 bp, Mus musculus
tagagccaatgaccaacgaccctgt

SEQ ID NO: 771785 - DNA, 25 bp, Mus musculus
tagagccaatgagcaacgaccctgt

SEQ ID NO: 771786 - DNA, 25 bp, Mus musculus
tagagccaccctatctcaggagtca

SEQ ID NO: 771787 - DNA, 25 bp, Mus musculus
tagagccaccctttctcaggagtca

SEQ ID NO: 771788 - DNA, 25 bp, Mus musculus
tagagccacctcagggatcatttgc

SEQ ID NO: 771789 - DNA, 25 bp, Mus musculus
tagagccacctctgggatcatttgc

SEQ ID NO: 771790 - DNA, 25 bp, Mus musculus
tagagccacgacagaggcattcctc

SEQ ID NO: 771791 - DNA, 25 bp, Mus musculus
tagagccacgactgaggcattcctc

SEQ ID NO: 771792 - DNA, 25 bp, Mus musculus
tagagccagattatctagcccttca

SEQ ID NO: 771793 - DNA, 25 bp, Mus musculus
tagagccagattttctagcccttca

SEQ ID NO: 771794 - DNA, 25 bp, Mus musculus
tagagccagcctagctgcagcgcta

SEQ ID NO: 771795 - DNA, 25 bp, Mus musculus
tagagccagccttgctgcagcgcta

SEQ ID NO: 771796 - DNA, 25 bp, Mus musculus
tagagccaggctcgtccttgtgcac

SEQ ID NO: 771797 - DNA, 25 bp, Mus musculus
tagagccaggctggtccttgtgcac

SEQ ID NO: 771798 - DNA, 25 bp, Mus musculus
tagagccagtaaaggcagcaccaag

SEQ ID NO: 771799 - DNA, 25 bp, Mus musculus
tagagccagtaatggcagcaccaag

SEQ ID NO: 771800 - DNA, 25 bp, Mus musculus
tagagccatcgaaggaactgctccc

SEQ ID NO: 771801 - DNA, 25 bp, Mus musculus
tagagccatcgatggaactgctccc

SEQ ID NO: 771802 - DNA, 25 bp, Mus musculus
tagagccatctaccacaaaagaccc

SEQ ID NO: 771803 - DNA, 25 bp, Mus musculus
tagagccatctagcacaaaagaccc

SEQ ID NO: 771804 - DNA, 25 bp, Mus musculus
tagagccatctcagaacacctaatt

SEQ ID NO: 771805 - DNA, 25 bp, Mus musculus
tagagccatctctgaacacctaatt

SEQ ID NO: 771806 - DNA, 25 bp, Mus musculus
tagagccatgcacgctgagcatcct

SEQ ID NO: 771807 - DNA, 25 bp, Mus musculus
tagagccatgcaggctgagcatcct

SEQ ID NO: 771808 - DNA, 25 bp, Mus musculus
tagagccattcgaacaccttcctgc

SEQ ID NO: 771809 - DNA, 25 bp, Mus musculus
tagagccattcgtacaccttcctgc

SEQ ID NO: 771810 - DNA, 25 bp, Mus musculus
tagagccatttcactaatcccagca

SEQ ID NO: 771811 - DNA, 25 bp, Mus musculus
tagagccatttctctaatcccagca

SEQ ID NO: 771812 - DNA, 25 bp, Mus musculus
tagagccattttacatgcggactcc

SEQ ID NO: 771813 - DNA, 25 bp, Mus musculus
tagagccatttttcatgcggactcc

SEQ ID NO: 771814 - DNA, 25 bp, Mus musculus
tagagcccaaatatgagaatccctg

SEQ ID NO: 771815 - DNA, 25 bp, Mus musculus
tagagcccaaatttgagaatccctg

SEQ ID NO: 771816 - DNA, 25 bp, Mus musculus
tagagcccacaaatataagacagaa

SEQ ID NO: 771817 - DNA, 25 bp, Mus musculus
tagagcccacaattataagacagaa

SEQ ID NO: 771818 - DNA, 25 bp, Mus musculus
tagagcccacagattgcactcatca

SEQ ID NO: 771819 - DNA, 25 bp, Mus musculus
tagagcccacagtttgcactcatca

SEQ ID NO: 771820 - DNA, 25 bp, Mus musculus
tagagcccacccatcaccgtttgga

SEQ ID NO: 771821 - DNA, 25 bp, Mus musculus
tagagcccacccttcaccgtttgga

SEQ ID NO: 771822 - DNA, 25 bp, Mus musculus
tagagcccaggtccatcagctgtgt

SEQ ID NO: 771823 - DNA, 25 bp, Mus musculus
tagagcccaggtgcatcagctgtgt

SEQ ID NO: 771824 - DNA, 25 bp, Mus musculus
tagagcccatgacctcttgatccat

SEQ ID NO: 771825 - DNA, 25 bp, Mus musculus
tagagcccatgagctcttgatccat

SEQ ID NO: 771826 - DNA, 25 bp, Mus musculus
tagagcccattgacacttgcgtgag

SEQ ID NO: 771827 - DNA, 25 bp, Mus musculus
tagagcccattgtcacttgcgtgag

SEQ ID NO: 771828 - DNA, 25 bp, Mus musculus
tagagccccaagatctgccgcagta

SEQ ID NO: 771829 - DNA, 25 bp, Mus musculus
tagagccccaagttctgccgcagta

SEQ ID NO: 771830 - DNA, 25 bp, Mus musculus
tagagccccgaacctctgttcaggt

SEQ ID NO: 771831 - DNA, 25 bp, Mus musculus
tagagccccgaagctctgttcaggt

SEQ ID NO: 771832 - DNA, 25 bp, Mus musculus
tagagcccctacaggcattgttggg

SEQ ID NO: 771833 - DNA, 25 bp, Mus musculus
tagagcccctactggcattgttggg

SEQ ID NO: 771834 - DNA, 25 bp, Mus musculus
tagagccccttacgactccttgagg

SEQ ID NO: 771835 - DNA, 25 bp, Mus musculus
tagagccccttaggactccttgagg

SEQ ID NO: 771836 - DNA, 25 bp, Mus musculus
tagagcccgtggatgtggacctgac

SEQ ID NO: 771837 - DNA, 25 bp, Mus musculus
tagagcccgtggttgtggacctgac

SEQ ID NO: 771838 - DNA, 25 bp, Mus musculus
tagagccctagaatcctctagtgag

SEQ ID NO: 771839 - DNA, 25 bp, Mus musculus
tagagccctagattcctctagtgag

SEQ ID NO: 771840 - DNA, 25 bp, Mus musculus
tagagccctgacactggtagtcaca

SEQ ID NO: 771841 - DNA, 25 bp, Mus musculus
tagagccctgactctggtagtcaca

SEQ ID NO: 771842 - DNA, 25 bp, Mus musculus
tagagcccttagagtggaagatgga

SEQ ID NO: 771843 - DNA, 25 bp, Mus musculus
tagagcccttagtgtggaagatgga

SEQ ID NO: 771844 - DNA, 25 bp, Mus musculus
tagagccgtgtgcatactaggcaag

SEQ ID NO: 771845 - DNA, 25 bp, Mus musculus
tagagccgtgtggatactaggcaag

SEQ ID NO: 771846 - DNA, 25 bp, Mus musculus
tagagccgtttaacctagaactcag

SEQ ID NO: 771847 - DNA, 25 bp, Mus musculus
tagagccgtttatcctagaactcag

SEQ ID NO: 771848 - DNA, 25 bp, Mus musculus
tagagcctactgatgcagctggtgt

SEQ ID NO: 771849 - DNA, 25 bp, Mus musculus
tagagcctactgttgcagctggtgt

SEQ ID NO: 771850 - DNA, 25 bp, Mus musculus
tagagcctagaacaacgtaccagat

SEQ ID NO: 771851 - DNA, 25 bp, Mus musculus
tagagcctagaagaacgtaccagat

SEQ ID NO: 771852 - DNA, 25 bp, Mus musculus
tagagcctagagactcatcccgttc

SEQ ID NO: 771853 - DNA, 25 bp, Mus musculus
tagagcctagagtctcatcccgttc

SEQ ID NO: 771854 - DNA, 25 bp, Mus musculus
tagagcctagatcctcgtgccatgg

SEQ ID NO: 771855 - DNA, 25 bp, Mus musculus
tagagcctagatgctcgtgccatgg

SEQ ID NO: 771856 - DNA, 25 bp, Mus musculus
tagagcctagcgatgtgggttaacc

SEQ ID NO: 771857 - DNA, 25 bp, Mus musculus
tagagcctagcgttgtgggttaacc

SEQ ID NO: 771858 - DNA, 25 bp, Mus musculus
tagagcctagtcattcccaggttcc

SEQ ID NO: 771859 - DNA, 25 bp, Mus musculus
tagagcctagtctttcccaggttcc

SEQ ID NO: 771860 - DNA, 25 bp, Mus musculus
tagagcctctttacctaaaccagac

SEQ ID NO: 771861 - DNA, 25 bp, Mus musculus
tagagcctcttttcctaaaccagac

SEQ ID NO: 771862 - DNA, 25 bp, Mus musculus
tagagcctgaacatctggcctaggg

SEQ ID NO: 771863 - DNA, 25 bp, Mus musculus
tagagcctgaacttctggcctaggg

SEQ ID NO: 771864 - DNA, 25 bp, Mus musculus
tagagcctgataaggcagcacacac

SEQ ID NO: 771865 - DNA, 25 bp, Mus musculus
tagagcctgatatggcagcacacac

SEQ ID NO: 771866 - DNA, 25 bp, Mus musculus
tagagcctgcaaatgaaccttggtg

SEQ ID NO: 771867 - DNA, 25 bp, Mus musculus
tagagcctgcaattgaaccttggtg

SEQ ID NO: 771868 - DNA, 25 bp, Mus musculus
tagagcctgcagaaaaagttataat

SEQ ID NO: 771869 - DNA, 25 bp, Mus musculus
tagagcctgcagtaaaagttataat

SEQ ID NO: 771870 - DNA, 25 bp, Mus musculus
tagagcctggatctgattgtctgtg

SEQ ID NO: 771871 - DNA, 25 bp, Mus musculus
tagagcctggatgtgattgtctgtg

SEQ ID NO: 771872 - DNA, 25 bp, Mus musculus
tagagcctggcgataccttcttgaa

SEQ ID NO: 771873 - DNA, 25 bp, Mus musculus
tagagcctggcgttaccttcttgaa

SEQ ID NO: 771874 - DNA, 25 bp, Mus musculus
tagagcctggtgaagtggcactcca

SEQ ID NO: 771875 - DNA, 25 bp, Mus musculus
tagagcctggtgtagtggcactcca

SEQ ID NO: 771876 - DNA, 25 bp, Mus musculus
tagagcctgtaaccctaccttgcaa

SEQ ID NO: 771877 - DNA, 25 bp, Mus musculus
tagagcctgtaagcctaccttgcaa

SEQ ID NO: 771878 - DNA, 25 bp, Mus musculus
tagagcctttacagggccgaagccc

SEQ ID NO: 771879 - DNA, 25 bp, Mus musculus
tagagcctttactgggccgaagccc

SEQ ID NO: 771880 - DNA, 25 bp, Mus musculus
tagagcctttatattcatgccttgt

SEQ ID NO: 771881 - DNA, 25 bp, Mus musculus
tagagcctttattttcatgccttgt

SEQ ID NO: 771882 - DNA, 25 bp, Mus musculus
tagagcgaactaagaaacctggaaa

SEQ ID NO: 771883 - DNA, 25 bp, Mus musculus
tagagcgaactatgaaacctggaaa

SEQ ID NO: 771884 - DNA, 25 bp, Mus musculus
tagagcgacatcatggtattcccct

SEQ ID NO: 771885 - DNA, 25 bp, Mus musculus
tagagcgacatcttggtattcccct

SEQ ID NO: 771886 - DNA, 25 bp, Mus musculus
tagagcgacttaaacctgcacccca

SEQ ID NO: 771887 - DNA, 25 bp, Mus musculus
tagagcgacttatacctgcacccca

SEQ ID NO: 771888 - DNA, 25 bp, Mus musculus
tagagcgatcacaaggatctcccca

SEQ ID NO: 771889 - DNA, 25 bp, Mus musculus
tagagcgatcactaggatctcccca

SEQ ID NO: 771890 - DNA, 25 bp, Mus musculus
tagagcgcaagtctgccatgctgga

SEQ ID NO: 771891 - DNA, 25 bp, Mus musculus
tagagcgcaagtgtgccatgctgga

SEQ ID NO: 771892 - DNA, 25 bp, Mus musculus
tagagcgcatgcctcacatggatga

SEQ ID NO: 771893 - DNA, 25 bp, Mus musculus
tagagcgcatgcgtcacatggatga

SEQ ID NO: 771894 - DNA, 25 bp, Mus musculus
tagagcgccaggcaagcggatctca

SEQ ID NO: 771895 - DNA, 25 bp, Mus musculus
tagagcgccagggaagcggatctca

SEQ ID NO: 771896 - DNA, 25 bp, Mus musculus
tagagcgccgccaggccgaagcaga

SEQ ID NO: 771897 - DNA, 25 bp, Mus musculus
tagagcgccgcctggccgaagcaga

SEQ ID NO: 771898 - DNA, 25 bp, Mus musculus
tagagcgcctgtctggaaattgtta

SEQ ID NO: 771899 - DNA, 25 bp, Mus musculus
tagagcgcctgtgtggaaattgtta

SEQ ID NO: 771900 - DNA, 25 bp, Mus musculus
tagagcggacagaccattcgcaaat

SEQ ID NO: 771901 - DNA, 25 bp, Mus musculus
tagagcggacagtccattcgcaaat

SEQ ID NO: 771902 - DNA, 25 bp, Mus musculus
tagagcgtttcacatcaacaccttt

SEQ ID NO: 771903 - DNA, 25 bp, Mus musculus
tagagcgtttcagatcaacaccttt

SEQ ID NO: 771904 - DNA, 25 bp, Mus musculus
tagagctacatgatgctgcaccctg

SEQ ID NO: 771905 - DNA, 25 bp, Mus musculus
tagagctacatgttgctgcaccctg

SEQ ID NO: 771906 - DNA, 25 bp, Mus musculus
tagagctagcatctgctctgtagct

SEQ ID NO: 771907 - DNA, 25 bp, Mus musculus
tagagctagcatgtgctctgtagct

SEQ ID NO: 771908 - DNA, 25 bp, Mus musculus
tagagctagcccaaagtcctggaaa

SEQ ID NO: 771909 - DNA, 25 bp, Mus musculus
tagagctagccctaagtcctggaaa

SEQ ID NO: 771910 - DNA, 25 bp, Mus musculus
tagagctaggtcatgacttccctaa

SEQ ID NO: 771911 - DNA, 25 bp, Mus musculus
tagagctaggtcttgacttccctaa

SEQ ID NO: 771912 - DNA, 25 bp, Mus musculus
tagagctattgaaaagacgcacttt

SEQ ID NO: 771913 - DNA, 25 bp, Mus musculus
tagagctattgataagacgcacttt

SEQ ID NO: 771914 - DNA, 25 bp, Mus musculus
tagagctatttgactttccctgtcc

SEQ ID NO: 771915 - DNA, 25 bp, Mus musculus
tagagctatttgtctttccctgtcc

SEQ ID NO: 771916 - DNA, 25 bp, Mus musculus
tagagctcaacccagacacctgtag

SEQ ID NO: 771917 - DNA, 25 bp, Mus musculus
tagagctcaaccgagacacctgtag

SEQ ID NO: 771918 - DNA, 25 bp, Mus musculus
tagagctcaactattcagttactgt

SEQ ID NO: 771919 - DNA, 25 bp, Mus musculus
tagagctcaacttttcagttactgt

SEQ ID NO: 771920 - DNA, 25 bp, Mus musculus
tagagctcaagcacgacgacattga

SEQ ID NO: 771921 - DNA, 25 bp, Mus musculus
tagagctcaagctcgacgacattga

SEQ ID NO: 771922 - DNA, 25 bp, Mus musculus
tagagctcacagacgacactaccaa

SEQ ID NO: 771923 - DNA, 25 bp, Mus musculus
tagagctcacagtcgacactaccaa

SEQ ID NO: 771924 - DNA, 25 bp, Mus musculus
tagagctccaatctaggcccatttc

SEQ ID NO: 771925 - DNA, 25 bp, Mus musculus
tagagctccaatgtaggcccatttc

SEQ ID NO: 771926 - DNA, 25 bp, Mus musculus
tagagctccctgatcatccagaaat

SEQ ID NO: 771927 - DNA, 25 bp, Mus musculus
tagagctccctgttcatccagaaat

SEQ ID NO: 771928 - DNA, 25 bp, Mus musculus
tagagctcctcaaaatcaatttatg

SEQ ID NO: 771929 - DNA, 25 bp, Mus musculus
tagagctcctcaattagccccctga

SEQ ID NO: 771930 - DNA, 25 bp, Mus musculus
tagagctcctcataatcaatttatg

SEQ ID NO: 771931 - DNA, 25 bp, Mus musculus
tagagctcctcatttagccccctga

SEQ ID NO: 771932 - DNA, 25 bp, Mus musculus
tagagctcctgcaataggccgggcg

SEQ ID NO: 771933 - DNA, 25 bp, Mus musculus
tagagctcctgccacatgtgaatgt

SEQ ID NO: 771934 - DNA, 25 bp, Mus musculus
tagagctcctgcgacatgtgaatgt

SEQ ID NO: 771935 - DNA, 25 bp, Mus musculus
tagagctcctgctataggccgggcg

SEQ ID NO: 771936 - DNA, 25 bp, Mus musculus
tagagctccttacatgacctgtgag

SEQ ID NO: 771937 - DNA, 25 bp, Mus musculus
tagagctccttagatgacctgtgag

SEQ ID NO: 771938 - DNA, 25 bp, Mus musculus
tagagctcctttctagcaggcgcct

SEQ ID NO: 771939 - DNA, 25 bp, Mus musculus
tagagctcctttgtagcaggcgcct

SEQ ID NO: 771940 - DNA, 25 bp, Mus musculus
tagagctcgacgaggtagtgcacac

SEQ ID NO: 771941 - DNA, 25 bp, Mus musculus
tagagctcgacgtggtagtgcacac

SEQ ID NO: 771942 - DNA, 25 bp, Mus musculus
tagagctctcacaagaacccttctt

SEQ ID NO: 771943 - DNA, 25 bp, Mus musculus
tagagctctcactagaacccttctt

SEQ ID NO: 771944 - DNA, 25 bp, Mus musculus
tagagctctggtcttctattctcca

SEQ ID NO: 771945 - DNA, 25 bp, Mus musculus
tagagctctggtgttctattctcca

SEQ ID NO: 771946 - DNA, 25 bp, Mus musculus
tagagctctgtacacatgattatga

SEQ ID NO: 771947 - DNA, 25 bp, Mus musculus
tagagctctgtagacatgattatga

SEQ ID NO: 771948 - DNA, 25 bp, Mus musculus
tagagctctttcaagcctcggagtc

SEQ ID NO: 771949 - DNA, 25 bp, Mus musculus
tagagctctttctagcctcggagtc

SEQ ID NO: 771950 - DNA, 25 bp, Mus musculus
tagagctgagcgcaacccctggtgt

SEQ ID NO: 771951 - DNA, 25 bp, Mus musculus
tagagctgagcggaacccctggtgt

SEQ ID NO: 771952 - DNA, 25 bp, Mus musculus
tagagctgagtcagtccttcctgag

SEQ ID NO: 771953 - DNA, 25 bp, Mus musculus
tagagctgagtctgtccttcctgag

SEQ ID NO: 771954 - DNA, 25 bp, Mus musculus
tagagctgcagaccggctgccgcta

SEQ ID NO: 771955 - DNA, 25 bp, Mus musculus
tagagctgcagagcggctgccgcta

SEQ ID NO: 771956 - DNA, 25 bp, Mus musculus
tagagctgcagcagcgcgtcccttc

SEQ ID NO: 771957 - DNA, 25 bp, Mus musculus
tagagctgcagctgcgcgtcccttc

SEQ ID NO: 771958 - DNA, 25 bp, Mus musculus
tagagctgccctcgttcaagagcac

SEQ ID NO: 771959 - DNA, 25 bp, Mus musculus
tagagctgccctggttcaagagcac

SEQ ID NO: 771960 - DNA, 25 bp, Mus musculus
tagagctgccttactggtgagtact

SEQ ID NO: 771961 - DNA, 25 bp, Mus musculus
tagagctgcctttctggtgagtact

SEQ ID NO: 771962 - DNA, 25 bp, Mus musculus
tagagctggagtctacaggcccaat

SEQ ID NO: 771963 - DNA, 25 bp, Mus musculus
tagagctggagtgtacaggcccaat

SEQ ID NO: 771964 - DNA, 25 bp, Mus musculus
tagagctggcagctgactgtcactt

SEQ ID NO: 771965 - DNA, 25 bp, Mus musculus
tagagctggcaggtgactgtcactt

SEQ ID NO: 771966 - DNA, 25 bp, Mus musculus
tagagctggccacgacgtttgagca

SEQ ID NO: 771967 - DNA, 25 bp, Mus musculus
tagagctggccaggacgtttgagca

SEQ ID NO: 771968 - DNA, 25 bp, Mus musculus
tagagctggcccacagactgacaga

SEQ ID NO: 771969 - DNA, 25 bp, Mus musculus
tagagctggccctcagactgacaga

SEQ ID NO: 771970 - DNA, 25 bp, Mus musculus
tagagctggttaacaattgcgcggt

SEQ ID NO: 771971 - DNA, 25 bp, Mus musculus
tagagctggttatcaattgcgcggt

SEQ ID NO: 771972 - DNA, 25 bp, Mus musculus
tagagctgtctccttttaagattct

SEQ ID NO: 771973 - DNA, 25 bp, Mus musculus
tagagctgtctcgttttaagattct

SEQ ID NO: 771974 - DNA, 25 bp, Mus musculus
tagagctgttaacgtccatgtccat

SEQ ID NO: 771975 - DNA, 25 bp, Mus musculus
tagagctgttaaggtccatgtccat

SEQ ID NO: 771976 - DNA, 25 bp, Mus musculus
tagagcttcctcagatttaatccaa

SEQ ID NO: 771977 - DNA, 25 bp, Mus musculus
tagagcttcctctgatttaatccaa

SEQ ID NO: 771978 - DNA, 25 bp, Mus musculus
tagagcttcgggagtctcaaacaat

SEQ ID NO: 771979 - DNA, 25 bp, Mus musculus
tagagcttcgggtgtctcaaacaat

SEQ ID NO: 771980 - DNA, 25 bp, Mus musculus
tagagcttctctcacatttgtagga

SEQ ID NO: 771981 - DNA, 25 bp, Mus musculus
tagagcttctctgacatttgtagga

SEQ ID NO: 771982 - DNA, 25 bp, Mus musculus
tagagctttaagagaggaccccagt

SEQ ID NO: 771983 - DNA, 25 bp, Mus musculus
tagagctttaagtgaggaccccagt

SEQ ID NO: 771984 - DNA, 25 bp, Mus musculus
tagagctttcttcggaacgggcttt

SEQ ID NO: 771985 - DNA, 25 bp, Mus musculus
tagagctttcttgggaacgggcttt

SEQ ID NO: 771986 - DNA, 25 bp, Mus musculus
tagagcttttacactaatctagcag

SEQ ID NO: 771987 - DNA, 25 bp, Mus musculus
tagagcttttactctaatctagcag

SEQ ID NO: 771988 - DNA, 25 bp, Mus musculus
tagagcttttccattatcaatcccc

SEQ ID NO: 771989 - DNA, 25 bp, Mus musculus
tagagcttttcctttatcaatcccc

SEQ ID NO: 771990 - DNA, 25 bp, Mus musculus
tagagcttttctctttaccgtgtgt

SEQ ID NO: 771991 - DNA, 25 bp, Mus musculus
tagagcttttctgtttaccgtgtgt

SEQ ID NO: 771992 - DNA, 25 bp, Mus musculus
tagaggaaaaacctggagctcctgg

SEQ ID NO: 771993 - DNA, 25 bp, Mus musculus
tagaggaaaaacgtggagctcctgg

SEQ ID NO: 771994 - DNA, 25 bp, Mus musculus
tagaggaaacctcagcattattttg

SEQ ID NO: 771995 - DNA, 25 bp, Mus musculus
tagaggaaacctgagcattattttg

SEQ ID NO: 771996 - DNA, 25 bp, Mus musculus
tagaggaaatgtctgcttccgtccc

SEQ ID NO: 771997 - DNA, 25 bp, Mus musculus
tagaggaaatgtgtgcttccgtccc

SEQ ID NO: 771998 - DNA, 25 bp, Mus musculus
tagaggaacagtactacacgctggt

SEQ ID NO: 771999 - DNA, 25 bp, Mus musculus
tagaggaacagttctacacgctggt

SEQ ID NO: 772000 - DNA, 25 bp, Mus musculus
tagaggaacttcagccatcttgtct

SEQ ID NO: 772001 - DNA, 25 bp, Mus musculus
tagaggaacttctgccatcttgtct

SEQ ID NO: 772002 - DNA, 25 bp, Mus musculus
tagaggaactttagcctgcacactc

SEQ ID NO: 772003 - DNA, 25 bp, Mus musculus
tagaggaacttttgcctgcacactc

SEQ ID NO: 772004 - DNA, 25 bp, Mus musculus
tagaggaaggctccagagcgttaac

SEQ ID NO: 772005 - DNA, 25 bp, Mus musculus
tagaggaaggctgcagagcgttaac

SEQ ID NO: 772006 - DNA, 25 bp, Mus musculus
tagaggaaggtccaggctcagccta

SEQ ID NO: 772007 - DNA, 25 bp, Mus musculus
tagaggaaggtcgaggctcagccta

SEQ ID NO: 772008 - DNA, 25 bp, Mus musculus
tagaggaattctacttctatctgct

SEQ ID NO: 772009 - DNA, 25 bp, Mus musculus
tagaggaattcttcttctatctgct

SEQ ID NO: 772010 - DNA, 25 bp, Mus musculus
tagaggaattgccaacattcctcca

SEQ ID NO: 772011 - DNA, 25 bp, Mus musculus
tagaggaattgcgaacattcctcca

SEQ ID NO: 772012 - DNA, 25 bp, Mus musculus
tagaggacacaaccaaacaagacag

SEQ ID NO: 772013 - DNA, 25 bp, Mus musculus
tagaggacacaagcaaacaagacag

SEQ ID NO: 772014 - DNA, 25 bp, Mus musculus
tagaggacccaaatccagctcacag

SEQ ID NO: 772015 - DNA, 25 bp, Mus musculus
tagaggacccaattccagctcacag

SEQ ID NO: 772016 - DNA, 25 bp, Mus musculus
tagaggacgtgtctcgtcatcttcc

SEQ ID NO: 772017 - DNA, 25 bp, Mus musculus
tagaggacgtgtgtcgtcatcttcc

SEQ ID NO: 772018 - DNA, 25 bp, Mus musculus
tagaggactacccaggcccattgtt

SEQ ID NO: 772019 - DNA, 25 bp, Mus musculus
tagaggactaccgaggcccattgtt

SEQ ID NO: 772020 - DNA, 25 bp, Mus musculus
tagaggactatgacagcgaggagac

SEQ ID NO: 772021 - DNA, 25 bp, Mus musculus
tagaggactatgtcagcgaggagac

SEQ ID NO: 772022 - DNA, 25 bp, Mus musculus
tagaggactgggactagccaccgag

SEQ ID NO: 772023 - DNA, 25 bp, Mus musculus
tagaggactgggtctagccaccgag

SEQ ID NO: 772024 - DNA, 25 bp, Mus musculus
tagaggactgtgacacactcccaat

SEQ ID NO: 772025 - DNA, 25 bp, Mus musculus
tagaggactgtgagtcccatctcct

SEQ ID NO: 772026 - DNA, 25 bp, Mus musculus
tagaggactgtgcacccaggtagct

SEQ ID NO: 772027 - DNA, 25 bp, Mus musculus
tagaggactgtggacccaggtagct

SEQ ID NO: 772028 - DNA, 25 bp, Mus musculus
tagaggactgtgtcacactcccaat

SEQ ID NO: 772029 - DNA, 25 bp, Mus musculus
tagaggactgtgtgtcccatctcct

SEQ ID NO: 772030 - DNA, 25 bp, Mus musculus
tagaggacttgtcgagccttggccc

SEQ ID NO: 772031 - DNA, 25 bp, Mus musculus
tagaggacttgtggagccttggccc

SEQ ID NO: 772032 - DNA, 25 bp, Mus musculus
tagaggagccggcaaccttcaggat

SEQ ID NO: 772033 - DNA, 25 bp, Mus musculus
tagaggagccgggaaccttcaggat

SEQ ID NO: 772034 - DNA, 25 bp, Mus musculus
tagaggaggacacatcccttcctga

SEQ ID NO: 772035 - DNA, 25 bp, Mus musculus
tagaggaggacagatcccttcctga

SEQ ID NO: 772036 - DNA, 25 bp, Mus musculus
tagaggagtcacactgcactgtcat

SEQ ID NO: 772037 - DNA, 25 bp, Mus musculus
tagaggagtcactctgcactgtcat

SEQ ID NO: 772038 - DNA, 25 bp, Mus musculus
tagaggagtgtcattcccattctgt

SEQ ID NO: 772039 - DNA, 25 bp, Mus musculus
tagaggagtgtctttcccattctgt

SEQ ID NO: 772040 - DNA, 25 bp, Mus musculus
tagaggatacagacatggtggattc

SEQ ID NO: 772041 - DNA, 25 bp, Mus musculus
tagaggatacagtcatggtggattc

SEQ ID NO: 772042 - DNA, 25 bp, Mus musculus
tagaggatagctacaacccacttca

SEQ ID NO: 772043 - DNA, 25 bp, Mus musculus
tagaggatagcttcaacccacttca

SEQ ID NO: 772044 - DNA, 25 bp, Mus musculus
tagaggatcactccgtgcacctgct

SEQ ID NO: 772045 - DNA, 25 bp, Mus musculus
tagaggatcactgcgtgcacctgct

SEQ ID NO: 772046 - DNA, 25 bp, Mus musculus
tagaggatcgcaagctccaggccgg

SEQ ID NO: 772047 - DNA, 25 bp, Mus musculus
tagaggatcgcatgctccaggccgg

SEQ ID NO: 772048 - DNA, 25 bp, Mus musculus
tagaggatctagctcggccggccat

SEQ ID NO: 772049 - DNA, 25 bp, Mus musculus
tagaggatctaggtcggccggccat

SEQ ID NO: 772050 - DNA, 25 bp, Mus musculus
tagaggatctgaccgactgctggcc

SEQ ID NO: 772051 - DNA, 25 bp, Mus musculus
tagaggatctgagcgactgctggcc

SEQ ID NO: 772052 - DNA, 25 bp, Mus musculus
tagaggatctttaccccacttggaa

SEQ ID NO: 772053 - DNA, 25 bp, Mus musculus
tagaggatcttttccccacttggaa

SEQ ID NO: 772054 - DNA, 25 bp, Mus musculus
tagaggatggccacaccctgtctga

SEQ ID NO: 772055 - DNA, 25 bp, Mus musculus
tagaggatggcctcaccctgtctga

SEQ ID NO: 772056 - DNA, 25 bp, Mus musculus
tagaggcaagagattcagttcaggg

SEQ ID NO: 772057 - DNA, 25 bp, Mus musculus
tagaggcaagagtttcagttcaggg

SEQ ID NO: 772058 - DNA, 25 bp, Mus musculus
tagaggcacgccaggctcaccaggt

SEQ ID NO: 772059 - DNA, 25 bp, Mus musculus
tagaggcacgcctggctcaccaggt

SEQ ID NO: 772060 - DNA, 25 bp, Mus musculus
tagaggcacggactccaatctggtg

SEQ ID NO: 772061 - DNA, 25 bp, Mus musculus
tagaggcacggagtccaatctggtg

SEQ ID NO: 772062 - DNA, 25 bp, Mus musculus
tagaggcataaccatcactacctcc

SEQ ID NO: 772063 - DNA, 25 bp, Mus musculus
tagaggcataacgatcactacctcc

SEQ ID NO: 772064 - DNA, 25 bp, Mus musculus
tagaggcatgtactttgtatggtgc

SEQ ID NO: 772065 - DNA, 25 bp, Mus musculus
tagaggcatgtagtttgtatggtgc

SEQ ID NO: 772066 - DNA, 25 bp, Mus musculus
tagaggccaagccagaattcggttt

SEQ ID NO: 772067 - DNA, 25 bp, Mus musculus
tagaggccaagcgagaattcggttt

SEQ ID NO: 772068 - DNA, 25 bp, Mus musculus
tagaggccacatatgcaccagcagt

SEQ ID NO: 772069 - DNA, 25 bp, Mus musculus
tagaggccacatttgcaccagcagt

SEQ ID NO: 772070 - DNA, 25 bp, Mus musculus
tagaggccagtcataggctcttggt

SEQ ID NO: 772071 - DNA, 25 bp, Mus musculus
tagaggccagtcttaggctcttggt

SEQ ID NO: 772072 - DNA, 25 bp, Mus musculus
tagaggccataaattctgatccagt

SEQ ID NO: 772073 - DNA, 25 bp, Mus musculus
tagaggccataatttctgatccagt

SEQ ID NO: 772074 - DNA, 25 bp, Mus musculus
tagaggccattgctcaggacccaaa

SEQ ID NO: 772075 - DNA, 25 bp, Mus musculus
tagaggccattggtcaggacccaaa

SEQ ID NO: 772076 - DNA, 25 bp, Mus musculus
tagaggcccacactgcctgtgtaaa

SEQ ID NO: 772077 - DNA, 25 bp, Mus musculus
tagaggcccacagtgcctgtgtaaa

SEQ ID NO: 772078 - DNA, 25 bp, Mus musculus
tagaggcccggcaatcagagcagat

SEQ ID NO: 772079 - DNA, 25 bp, Mus musculus
tagaggcccggctatcagagcagat

SEQ ID NO: 772080 - DNA, 25 bp, Mus musculus
tagaggccctctaaactagttacag

SEQ ID NO: 772081 - DNA, 25 bp, Mus musculus
tagaggccctcttaactagttacag

SEQ ID NO: 772082 - DNA, 25 bp, Mus musculus
tagaggccgggaccaaagctctagt

SEQ ID NO: 772083 - DNA, 25 bp, Mus musculus
tagaggccgggagcaaagctctagt

SEQ ID NO: 772084 - DNA, 25 bp, Mus musculus
tagaggcctataaactgtgatagct

SEQ ID NO: 772085 - DNA, 25 bp, Mus musculus
tagaggcctatatactgtgatagct

SEQ ID NO: 772086 - DNA, 25 bp, Mus musculus
tagaggcctcgcaagtgactgctgt

SEQ ID NO: 772087 - DNA, 25 bp, Mus musculus
tagaggcctcgctagtgactgctgt

SEQ ID NO: 772088 - DNA, 25 bp, Mus musculus
tagaggcggagtcccaggtttactc

SEQ ID NO: 772089 - DNA, 25 bp, Mus musculus
tagaggcggagtgccaggtttactc

SEQ ID NO: 772090 - DNA, 25 bp, Mus musculus
tagaggcggctcaccaggcgaaaaa

SEQ ID NO: 772091 - DNA, 25 bp, Mus musculus
tagaggcggctctccaggcgaaaaa

SEQ ID NO: 772092 - DNA, 25 bp, Mus musculus
tagaggcggctgatccagttctgga

SEQ ID NO: 772093 - DNA, 25 bp, Mus musculus
tagaggcggctgttccagttctgga

SEQ ID NO: 772094 - DNA, 25 bp, Mus musculus
tagaggcgtgacctagattccctgg

SEQ ID NO: 772095 - DNA, 25 bp, Mus musculus
tagaggcgtgacgtagattccctgg

SEQ ID NO: 772096 - DNA, 25 bp, Mus musculus
tagaggcgttacctacagactcact

SEQ ID NO: 772097 - DNA, 25 bp, Mus musculus
tagaggcgttacgtacagactcact

SEQ ID NO: 772098 - DNA, 25 bp, Mus musculus
tagaggctacatcaagctcgccaaa

SEQ ID NO: 772099 - DNA, 25 bp, Mus musculus
tagaggctacatgaagctcgccaaa

SEQ ID NO: 772100 - DNA, 25 bp, Mus musculus
tagaggctagctctgttcctgtccc

SEQ ID NO: 772101 - DNA, 25 bp, Mus musculus
tagaggctagctgtgttcctgtccc

SEQ ID NO: 772102 - DNA, 25 bp, Mus musculus
tagaggctcacaagcgcctgctgca

SEQ ID NO: 772103 - DNA, 25 bp, Mus musculus
tagaggctcacatgcgcctgctgca

SEQ ID NO: 772104 - DNA, 25 bp, Mus musculus
tagaggctcttaaaccaccgttgga

SEQ ID NO: 772105 - DNA, 25 bp, Mus musculus
tagaggctcttataccaccgttgga

SEQ ID NO: 772106 - DNA, 25 bp, Mus musculus
tagaggctgcatatactgatcttca

SEQ ID NO: 772107 - DNA, 25 bp, Mus musculus
tagaggctgcatttactgatcttca

SEQ ID NO: 772108 - DNA, 25 bp, Mus musculus
tagaggctggacatgcgtgtccaat

SEQ ID NO: 772109 - DNA, 25 bp, Mus musculus
tagaggctggacttgcgtgtccaat

SEQ ID NO: 772110 - DNA, 25 bp, Mus musculus
tagaggctgggcaattggccactgc

SEQ ID NO: 772111 - DNA, 25 bp, Mus musculus
tagaggctgggctattggccactgc

SEQ ID NO: 772112 - DNA, 25 bp, Mus musculus
tagaggctgtccctgttcagagata

SEQ ID NO: 772113 - DNA, 25 bp, Mus musculus
tagaggctgtccgtgttcagagata

SEQ ID NO: 772114 - DNA, 25 bp, Mus musculus
tagaggcttaagagacctccctctt

SEQ ID NO: 772115 - DNA, 25 bp, Mus musculus
tagaggcttaagtgacctccctctt

SEQ ID NO: 772116 - DNA, 25 bp, Mus musculus
tagaggcttccaccttaaaaccact

SEQ ID NO: 772117 - DNA, 25 bp, Mus musculus
tagaggcttccagcttaaaaccact

SEQ ID NO: 772118 - DNA, 25 bp, Mus musculus
tagagggaacgacttgtccagcatt

SEQ ID NO: 772119 - DNA, 25 bp, Mus musculus
tagagggaacgagttgtccagcatt

SEQ ID NO: 772120 - DNA, 25 bp, Mus musculus
tagagggaaggccttgctcccttgc

SEQ ID NO: 772121 - DNA, 25 bp, Mus musculus
tagagggaaggcgttgctcccttgc

SEQ ID NO: 772122 - DNA, 25 bp, Mus musculus
tagagggacaagaggcgttcagcca

SEQ ID NO: 772123 - DNA, 25 bp, Mus musculus
tagagggacaagtggcgttcagcca

SEQ ID NO: 772124 - DNA, 25 bp, Mus musculus
tagagggatccaatgctctgaccgc

SEQ ID NO: 772125 - DNA, 25 bp, Mus musculus
tagagggatccattgctctgaccgc

SEQ ID NO: 772126 - DNA, 25 bp, Mus musculus
tagagggatcccatctcctggaagg

SEQ ID NO: 772127 - DNA, 25 bp, Mus musculus
tagagggatcccttctcctggaagg

SEQ ID NO: 772128 - DNA, 25 bp, Mus musculus
tagagggcaaaaatccttaggctgt

SEQ ID NO: 772129 - DNA, 25 bp, Mus musculus
tagagggcaaaattccttaggctgt

SEQ ID NO: 772130 - DNA, 25 bp, Mus musculus
tagagggcagttagcattccctggc

SEQ ID NO: 772131 - DNA, 25 bp, Mus musculus
tagagggcagtttgcattccctggc

SEQ ID NO: 772132 - DNA, 25 bp, Mus musculus
tagagggccacgagctgcccgctga

SEQ ID NO: 772133 - DNA, 25 bp, Mus musculus
tagagggccacgtgctgcccgctga

SEQ ID NO: 772134 - DNA, 25 bp, Mus musculus
tagagggccgctctcgcttcggtgc

SEQ ID NO: 772135 - DNA, 25 bp, Mus musculus
tagagggccgctgtcgcttcggtgc

SEQ ID NO: 772136 - DNA, 25 bp, Mus musculus
tagagggcctacagttcctgatgct

SEQ ID NO: 772137 - DNA, 25 bp, Mus musculus
tagagggcctactgttcctgatgct

SEQ ID NO: 772138 - DNA, 25 bp, Mus musculus
tagagggcgggaaggtttccactac

SEQ ID NO: 772139 - DNA, 25 bp, Mus musculus
tagagggcgggatggtttccactac

SEQ ID NO: 772140 - DNA, 25 bp, Mus musculus
tagagggctaaccatggcagtttgt

SEQ ID NO: 772141 - DNA, 25 bp, Mus musculus
tagagggctaacgatggcagtttgt

SEQ ID NO: 772142 - DNA, 25 bp, Mus musculus
tagagggctacacttggcaaggcat

SEQ ID NO: 772143 - DNA, 25 bp, Mus musculus
tagagggctacagttggcaaggcat

SEQ ID NO: 772144 - DNA, 25 bp, Mus musculus
tagagggcttaaatcgcatccgcag

SEQ ID NO: 772145 - DNA, 25 bp, Mus musculus
tagagggcttaattcgcatccgcag

SEQ ID NO: 772146 - DNA, 25 bp, Mus musculus
tagagggcttgcctgtcattcacaa

SEQ ID NO: 772147 - DNA, 25 bp, Mus musculus
tagagggcttgcgtgtcattcacaa

SEQ ID NO: 772148 - DNA, 25 bp, Mus musculus
tagaggggtgtgaccgttccacgca

SEQ ID NO: 772149 - DNA, 25 bp, Mus musculus
tagaggggtgtgtccgttccacgca

SEQ ID NO: 772150 - DNA, 25 bp, Mus musculus
tagagggtccagctgcaatgctgac

SEQ ID NO: 772151 - DNA, 25 bp, Mus musculus
tagagggtccaggtgcaatgctgac

SEQ ID NO: 772152 - DNA, 25 bp, Mus musculus
tagagggtcctcagtgcttggcttt

SEQ ID NO: 772153 - DNA, 25 bp, Mus musculus
tagagggtcctctgtgcttggcttt

SEQ ID NO: 772154 - DNA, 25 bp, Mus musculus
tagagggtcgaaccaagccaaagtc

SEQ ID NO: 772155 - DNA, 25 bp, Mus musculus
tagagggtcgaagcaagccaaagtc

SEQ ID NO: 772156 - DNA, 25 bp, Mus musculus
tagagggtctgtaaccggcctgact

SEQ ID NO: 772157 - DNA, 25 bp, Mus musculus
tagagggtctgttaccggcctgact

SEQ ID NO: 772158 - DNA, 25 bp, Mus musculus
tagagggtgctcctcccatttttaa

SEQ ID NO: 772159 - DNA, 25 bp, Mus musculus
tagagggtgctcgtcccatttttaa

SEQ ID NO: 772160 - DNA, 25 bp, Mus musculus
tagagggtgcttacagctctgttcc

SEQ ID NO: 772161 - DNA, 25 bp, Mus musculus
tagagggtgctttcagctctgttcc

SEQ ID NO: 772162 - DNA, 25 bp, Mus musculus
tagaggtacgttatcccacttgaag

SEQ ID NO: 772163 - DNA, 25 bp, Mus musculus
tagaggtacgttttcccacttgaag

SEQ ID NO: 772164 - DNA, 25 bp, Mus musculus
tagaggtactccagcatctacatgc

SEQ ID NO: 772165 - DNA, 25 bp, Mus musculus
tagaggtactcctgcatctacatgc

SEQ ID NO: 772166 - DNA, 25 bp, Mus musculus
tagaggtaggcaatgtactccatct

SEQ ID NO: 772167 - DNA, 25 bp, Mus musculus
tagaggtaggcattgtactccatct

SEQ ID NO: 772168 - DNA, 25 bp, Mus musculus
tagaggtatctgacggtttgcaaaa

SEQ ID NO: 772169 - DNA, 25 bp, Mus musculus
tagaggtatctgtcggtttgcaaaa

SEQ ID NO: 772170 - DNA, 25 bp, Mus musculus
tagaggtcacaacctactctccaat

SEQ ID NO: 772171 - DNA, 25 bp, Mus musculus
tagaggtcacaagctactctccaat

SEQ ID NO: 772172 - DNA, 25 bp, Mus musculus
tagaggtcaccacgacacgaggaac

SEQ ID NO: 772173 - DNA, 25 bp, Mus musculus
tagaggtcaccaggacacgaggaac

SEQ ID NO: 772174 - DNA, 25 bp, Mus musculus
tagaggtcacgcctatagaacttaa

SEQ ID NO: 772175 - DNA, 25 bp, Mus musculus
tagaggtcacgcgtatagaacttaa

SEQ ID NO: 772176 - DNA, 25 bp, Mus musculus
tagaggtcaggtctgcctaacgccg

SEQ ID NO: 772177 - DNA, 25 bp, Mus musculus
tagaggtcaggtgtgcctaacgccg

SEQ ID NO: 772178 - DNA, 25 bp, Mus musculus
tagaggtctactctactgtgtcccc

SEQ ID NO: 772179 - DNA, 25 bp, Mus musculus
tagaggtctactgtactgtgtcccc

SEQ ID NO: 772180 - DNA, 25 bp, Mus musculus
tagaggtctttcatgggtgacatct

SEQ ID NO: 772181 - DNA, 25 bp, Mus musculus
tagaggtctttcttgggtgacatct

SEQ ID NO: 772182 - DNA, 25 bp, Mus musculus
tagaggtgacagctcttccgctgag

SEQ ID NO: 772183 - DNA, 25 bp, Mus musculus
tagaggtgacaggtcttccgctgag

SEQ ID NO: 772184 - DNA, 25 bp, Mus musculus
tagaggtgagtcagttctgtctatc

SEQ ID NO: 772185 - DNA, 25 bp, Mus musculus
tagaggtgagtctgttctgtctatc

SEQ ID NO: 772186 - DNA, 25 bp, Mus musculus
tagaggtgccagctgtaggtttctt

SEQ ID NO: 772187 - DNA, 25 bp, Mus musculus
tagaggtgccaggtgtaggtttctt

SEQ ID NO: 772188 - DNA, 25 bp, Mus musculus
tagaggtggcccctgatttccccaa

SEQ ID NO: 772189 - DNA, 25 bp, Mus musculus
tagaggtggcccgtgatttccccaa

SEQ ID NO: 772190 - DNA, 25 bp, Mus musculus
tagaggtgtgccagtcttcatcctg

SEQ ID NO: 772191 - DNA, 25 bp, Mus musculus
tagaggtgtgcctgtcttcatcctg

SEQ ID NO: 772192 - DNA, 25 bp, Mus musculus
tagaggttaaaccacctgcttgtcc

SEQ ID NO: 772193 - DNA, 25 bp, Mus musculus
tagaggttaaacgacctgcttgtcc

SEQ ID NO: 772194 - DNA, 25 bp, Mus musculus
tagaggttaaagcacagctaaggag

SEQ ID NO: 772195 - DNA, 25 bp, Mus musculus
tagaggttaaaggacagctaaggag

SEQ ID NO: 772196 - DNA, 25 bp, Mus musculus
tagaggttacttattagcacccaca

SEQ ID NO: 772197 - DNA, 25 bp, Mus musculus
tagaggttactttttagcacccaca

SEQ ID NO: 772198 - DNA, 25 bp, Mus musculus
tagaggttagtcaggtccttgtgag

SEQ ID NO: 772199 - DNA, 25 bp, Mus musculus
tagaggttagtctggtccttgtgag

SEQ ID NO: 772200 - DNA, 25 bp, Mus musculus
tagaggttatctagcccacatactc

SEQ ID NO: 772201 - DNA, 25 bp, Mus musculus
tagaggttatcttgcccacatactc

SEQ ID NO: 772202 - DNA, 25 bp, Mus musculus
tagaggttatttattcatgacagga

SEQ ID NO: 772203 - DNA, 25 bp, Mus musculus
tagaggttattttttcatgacagga

SEQ ID NO: 772204 - DNA, 25 bp, Mus musculus
tagaggttcgacagaaaactttcct

SEQ ID NO: 772205 - DNA, 25 bp, Mus musculus
tagaggttcgactgaaaactttcct

SEQ ID NO: 772206 - DNA, 25 bp, Mus musculus
tagaggttgctcctaggccagcccc

SEQ ID NO: 772207 - DNA, 25 bp, Mus musculus
tagaggttgctcgtaggccagcccc

SEQ ID NO: 772208 - DNA, 25 bp, Mus musculus
tagaggttggtcctggtgcttccac

SEQ ID NO: 772209 - DNA, 25 bp, Mus musculus
tagaggttggtcgtggtgcttccac

SEQ ID NO: 772210 - DNA, 25 bp, Mus musculus
tagaggttgtccaggtctacataat

SEQ ID NO: 772211 - DNA, 25 bp, Mus musculus
tagaggttgtcctggtctacataat

SEQ ID NO: 772212 - DNA, 25 bp, Mus musculus
tagaggttgtttagagccgccatgt

SEQ ID NO: 772213 - DNA, 25 bp, Mus musculus
tagaggttgttttgagccgccatgt

SEQ ID NO: 772214 - DNA, 25 bp, Mus musculus
tagaggttttccaagtgtctcaccc

SEQ ID NO: 772215 - DNA, 25 bp, Mus musculus
tagaggttttcctagtgtctcaccc

SEQ ID NO: 772216 - DNA, 25 bp, Mus musculus
tagagtaaccatccttatcctgaag

SEQ ID NO: 772217 - DNA, 25 bp, Mus musculus
tagagtaaccatgcttatcctgaag

SEQ ID NO: 772218 - DNA, 25 bp, Mus musculus
tagagtaacctgactcacaaaacca

SEQ ID NO: 772219 - DNA, 25 bp, Mus musculus
tagagtaacctgtctcacaaaacca

SEQ ID NO: 772220 - DNA, 25 bp, Mus musculus
tagagtaagtctcacatcctcctcc

SEQ ID NO: 772221 - DNA, 25 bp, Mus musculus
tagagtaagtctgacatcctcctcc

SEQ ID NO: 772222 - DNA, 25 bp, Mus musculus
tagagtaatctcctccatcttattc

SEQ ID NO: 772223 - DNA, 25 bp, Mus musculus
tagagtaatctcgtccatcttattc

SEQ ID NO: 772224 - DNA, 25 bp, Mus musculus
tagagtaatgtgagtttagcaaccc

SEQ ID NO: 772225 - DNA, 25 bp, Mus musculus
tagagtaatgtgtgtttagcaaccc

SEQ ID NO: 772226 - DNA, 25 bp, Mus musculus
tagagtaattgcacctactgaggaa

SEQ ID NO: 772227 - DNA, 25 bp, Mus musculus
tagagtaattgctcctactgaggaa

SEQ ID NO: 772228 - DNA, 25 bp, Mus musculus
tagagtacatctacaagccgtcctg

SEQ ID NO: 772229 - DNA, 25 bp, Mus musculus
tagagtacatcttcaagccgtcctg

SEQ ID NO: 772230 - DNA, 25 bp, Mus musculus
tagagtacattcctgcgctgcagcg

SEQ ID NO: 772231 - DNA, 25 bp, Mus musculus
tagagtacattcgtgcgctgcagcg

SEQ ID NO: 772232 - DNA, 25 bp, Mus musculus
tagagtacccaaagtcactcccctt

SEQ ID NO: 772233 - DNA, 25 bp, Mus musculus
tagagtacccaatgtcactcccctt

SEQ ID NO: 772234 - DNA, 25 bp, Mus musculus
tagagtacctcccttttctttgtga

SEQ ID NO: 772235 - DNA, 25 bp, Mus musculus
tagagtacctccgttttctttgtga

SEQ ID NO: 772236 - DNA, 25 bp, Mus musculus
tagagtagaggcacacggctcctga

SEQ ID NO: 772237 - DNA, 25 bp, Mus musculus
tagagtagaggctcacggctcctga

SEQ ID NO: 772238 - DNA, 25 bp, Mus musculus
tagagtagagggaggccccagacaa

SEQ ID NO: 772239 - DNA, 25 bp, Mus musculus
tagagtagagggtggccccagacaa

SEQ ID NO: 772240 - DNA, 25 bp, Mus musculus
tagagtaggaccacccaagggactt

SEQ ID NO: 772241 - DNA, 25 bp, Mus musculus
tagagtaggacctcccaagggactt

SEQ ID NO: 772242 - DNA, 25 bp, Mus musculus
tagagtaggatcctggtcagactta

SEQ ID NO: 772243 - DNA, 25 bp, Mus musculus
tagagtaggatcgtggtcagactta

SEQ ID NO: 772244 - DNA, 25 bp, Mus musculus
tagagtagggtaccttagattggta

SEQ ID NO: 772245 - DNA, 25 bp, Mus musculus
tagagtagggtagcttagattggta

SEQ ID NO: 772246 - DNA, 25 bp, Mus musculus
tagagtagggtgctgagacccttcc

SEQ ID NO: 772247 - DNA, 25 bp, Mus musculus
tagagtagggtggtgagacccttcc

SEQ ID NO: 772248 - DNA, 25 bp, Mus musculus
tagagtagggttactccagctccat

SEQ ID NO: 772249 - DNA, 25 bp, Mus musculus
tagagtagggtttctccagctccat

SEQ ID NO: 772250 - DNA, 25 bp, Mus musculus
tagagtagtaacactgtccacacag

SEQ ID NO: 772251 - DNA, 25 bp, Mus musculus
tagagtagtaactctgtccacacag

SEQ ID NO: 772252 - DNA, 25 bp, Mus musculus
tagagtagtgttactccatccttca

SEQ ID NO: 772253 - DNA, 25 bp, Mus musculus
tagagtagtgtttctccatccttca

SEQ ID NO: 772254 - DNA, 25 bp, Mus musculus
tagagtagttttcccacaccaaagt

SEQ ID NO: 772255 - DNA, 25 bp, Mus musculus
tagagtagttttgccacaccaaagt

SEQ ID NO: 772256 - DNA, 25 bp, Mus musculus
tagagtataccgcttgcctgctggc

SEQ ID NO: 772257 - DNA, 25 bp, Mus musculus
tagagtataccggttgcctgctggc

SEQ ID NO: 772258 - DNA, 25 bp, Mus musculus
tagagtatctggaggttcaccacct

SEQ ID NO: 772259 - DNA, 25 bp, Mus musculus
tagagtatctggtggttcaccacct

SEQ ID NO: 772260 - DNA, 25 bp, Mus musculus
tagagtatcttcaactttcccaggc

SEQ ID NO: 772261 - DNA, 25 bp, Mus musculus
tagagtatcttctactttcccaggc

SEQ ID NO: 772262 - DNA, 25 bp, Mus musculus
tagagtcaaagcacctctgtttcca

SEQ ID NO: 772263 - DNA, 25 bp, Mus musculus
tagagtcaaagctcctctgtttcca

SEQ ID NO: 772264 - DNA, 25 bp, Mus musculus
tagagtcacactcgctgctctcagc

SEQ ID NO: 772265 - DNA, 25 bp, Mus musculus
tagagtcacactggctgctctcagc

SEQ ID NO: 772266 - DNA, 25 bp, Mus musculus
tagagtcacctgcaaacctcaactg

SEQ ID NO: 772267 - DNA, 25 bp, Mus musculus
tagagtcacctggaaacctcaactg

SEQ ID NO: 772268 - DNA, 25 bp, Mus musculus
tagagtcacgcaacaagaccctgtc

SEQ ID NO: 772269 - DNA, 25 bp, Mus musculus
tagagtcacgcatcaagaccctgtc

SEQ ID NO: 772270 - DNA, 25 bp, Mus musculus
tagagtcactccctgtcacaagcat

SEQ ID NO: 772271 - DNA, 25 bp, Mus musculus
tagagtcactccgtgtcacaagcat

SEQ ID NO: 772272 - DNA, 25 bp, Mus musculus
tagagtcactgtcttatctgcatcc

SEQ ID NO: 772273 - DNA, 25 bp, Mus musculus
tagagtcactgtgttatctgcatcc

SEQ ID NO: 772274 - DNA, 25 bp, Mus musculus
tagagtcagaagcatcactgtgtgt

SEQ ID NO: 772275 - DNA, 25 bp, Mus musculus
tagagtcagaaggatcactgtgtgt

SEQ ID NO: 772276 - DNA, 25 bp, Mus musculus
tagagtcagcttcctccgatgagga

SEQ ID NO: 772277 - DNA, 25 bp, Mus musculus
tagagtcagcttgctccgatgagga

SEQ ID NO: 772278 - DNA, 25 bp, Mus musculus
tagagtcaggaacttgttaataaac

SEQ ID NO: 772279 - DNA, 25 bp, Mus musculus
tagagtcaggaagttgttaataaac

SEQ ID NO: 772280 - DNA, 25 bp, Mus musculus
tagagtcagtctccagccattttta

SEQ ID NO: 772281 - DNA, 25 bp, Mus musculus
tagagtcagtctgcagccattttta

SEQ ID NO: 772282 - DNA, 25 bp, Mus musculus
tagagtcatcatccttccgtggtca

SEQ ID NO: 772283 - DNA, 25 bp, Mus musculus
tagagtcatcatgcttccgtggtca

SEQ ID NO: 772284 - DNA, 25 bp, Mus musculus
tagagtcatccacaatgtccacttt

SEQ ID NO: 772285 - DNA, 25 bp, Mus musculus
tagagtcatccagaatgtccacttt

SEQ ID NO: 772286 - DNA, 25 bp, Mus musculus
tagagtcatcgtacagttagcattc

SEQ ID NO: 772287 - DNA, 25 bp, Mus musculus
tagagtcatcgttcagttagcattc

SEQ ID NO: 772288 - DNA, 25 bp, Mus musculus
tagagtcatgacacactatactgtg

SEQ ID NO: 772289 - DNA, 25 bp, Mus musculus
tagagtcatgactcactatactgtg

SEQ ID NO: 772290 - DNA, 25 bp, Mus musculus
tagagtcatgccaggatccacaact

SEQ ID NO: 772291 - DNA, 25 bp, Mus musculus
tagagtcatgcctggatccacaact

SEQ ID NO: 772292 - DNA, 25 bp, Mus musculus
tagagtcatgcgaagctatagaggt

SEQ ID NO: 772293 - DNA, 25 bp, Mus musculus
tagagtcatgcgtagctatagaggt

SEQ ID NO: 772294 - DNA, 25 bp, Mus musculus
tagagtccaaatcctgttgtaccag

SEQ ID NO: 772295 - DNA, 25 bp, Mus musculus
tagagtccaaatgctgttgtaccag

SEQ ID NO: 772296 - DNA, 25 bp, Mus musculus
tagagtccagcgacactcggttcca

SEQ ID NO: 772297 - DNA, 25 bp, Mus musculus
tagagtccagcgtcactcggttcca

SEQ ID NO: 772298 - DNA, 25 bp, Mus musculus
tagagtccagttacacccataagct

SEQ ID NO: 772299 - DNA, 25 bp, Mus musculus
tagagtccagttcgcctgtcaatgg

SEQ ID NO: 772300 - DNA, 25 bp, Mus musculus
tagagtccagttggcctgtcaatgg

SEQ ID NO: 772301 - DNA, 25 bp, Mus musculus
tagagtccagtttcacccataagct

SEQ ID NO: 772302 - DNA, 25 bp, Mus musculus
tagagtcccaaacttagcgctcctg

SEQ ID NO: 772303 - DNA, 25 bp, Mus musculus
tagagtcccaaagttagcgctcctg

SEQ ID NO: 772304 - DNA, 25 bp, Mus musculus
tagagtcccacacacacactgcagt

SEQ ID NO: 772305 - DNA, 25 bp, Mus musculus
tagagtcccacagacacactgcagt

SEQ ID NO: 772306 - DNA, 25 bp, Mus musculus
tagagtccccagaccctagaggaac

SEQ ID NO: 772307 - DNA, 25 bp, Mus musculus
tagagtccccagtccctagaggaac

SEQ ID NO: 772308 - DNA, 25 bp, Mus musculus
tagagtcccggtctgaagagtaccc

SEQ ID NO: 772309 - DNA, 25 bp, Mus musculus
tagagtcccggtgtgaagagtaccc

SEQ ID NO: 772310 - DNA, 25 bp, Mus musculus
tagagtccctctatactgccgaaaa

SEQ ID NO: 772311 - DNA, 25 bp, Mus musculus
tagagtccctctttactgccgaaaa

SEQ ID NO: 772312 - DNA, 25 bp, Mus musculus
tagagtccgaggaccatcttcttat

SEQ ID NO: 772313 - DNA, 25 bp, Mus musculus
tagagtccgaggtccatcttcttat

SEQ ID NO: 772314 - DNA, 25 bp, Mus musculus
tagagtcctatcctcagtctcaggg

SEQ ID NO: 772315 - DNA, 25 bp, Mus musculus
tagagtcctatcgtcagtctcaggg

SEQ ID NO: 772316 - DNA, 25 bp, Mus musculus
tagagtcctcttcgaaaatagggcc

SEQ ID NO: 772317 - DNA, 25 bp, Mus musculus
tagagtcctcttggaaaatagggcc

SEQ ID NO: 772318 - DNA, 25 bp, Mus musculus
tagagtccttgaattctcaggctcc

SEQ ID NO: 772319 - DNA, 25 bp, Mus musculus
tagagtccttgatttctcaggctcc

SEQ ID NO: 772320 - DNA, 25 bp, Mus musculus
tagagtcctttcagcaactcagtgt

SEQ ID NO: 772321 - DNA, 25 bp, Mus musculus
tagagtcctttctgcaactcagtgt

SEQ ID NO: 772322 - DNA, 25 bp, Mus musculus
tagagtccttttcgttactgcccct

SEQ ID NO: 772323 - DNA, 25 bp, Mus musculus
tagagtccttttggttactgcccct

SEQ ID NO: 772324 - DNA, 25 bp, Mus musculus
tagagtcgcctgcaacggagtccat

SEQ ID NO: 772325 - DNA, 25 bp, Mus musculus
tagagtcgcctggaacggagtccat

SEQ ID NO: 772326 - DNA, 25 bp, Mus musculus
tagagtcgctctcaaaacagaagat

SEQ ID NO: 772327 - DNA, 25 bp, Mus musculus
tagagtcgctctgaaaacagaagat

SEQ ID NO: 772328 - DNA, 25 bp, Mus musculus
tagagtcgcttccacgaaagtccta

SEQ ID NO: 772329 - DNA, 25 bp, Mus musculus
tagagtcgcttcgacgaaagtccta

SEQ ID NO: 772330 - DNA, 25 bp, Mus musculus
tagagtctactccattcattccttg

SEQ ID NO: 772331 - DNA, 25 bp, Mus musculus
tagagtctactcgattcattccttg

SEQ ID NO: 772332 - DNA, 25 bp, Mus musculus
tagagtctagctcttttcatataga

SEQ ID NO: 772333 - DNA, 25 bp, Mus musculus
tagagtctagctgttttcatataga

SEQ ID NO: 772334 - DNA, 25 bp, Mus musculus
tagagtctcaggaagaggccctcca

SEQ ID NO: 772335 - DNA, 25 bp, Mus musculus
tagagtctcaggtagaggccctcca

SEQ ID NO: 772336 - DNA, 25 bp, Mus musculus
tagagtctccttaactgcacactgt

SEQ ID NO: 772337 - DNA, 25 bp, Mus musculus
tagagtctccttaccacagtgaaga

SEQ ID NO: 772338 - DNA, 25 bp, Mus musculus
tagagtctcctttactgcacactgt

SEQ ID NO: 772339 - DNA, 25 bp, Mus musculus
tagagtctcctttccacagtgaaga

SEQ ID NO: 772340 - DNA, 25 bp, Mus musculus
tagagtctctgaaaactgtccaggt

SEQ ID NO: 772341 - DNA, 25 bp, Mus musculus
tagagtctctgataactgtccaggt

SEQ ID NO: 772342 - DNA, 25 bp, Mus musculus
tagagtctctggctcatgtggtagc

SEQ ID NO: 772343 - DNA, 25 bp, Mus musculus
tagagtctctgggtcatgtggtagc

SEQ ID NO: 772344 - DNA, 25 bp, Mus musculus
tagagtctgagcacagcacgtaagt

SEQ ID NO: 772345 - DNA, 25 bp, Mus musculus
tagagtctgagctcagcacgtaagt

SEQ ID NO: 772346 - DNA, 25 bp, Mus musculus
tagagtctgcccactagttgacaat

SEQ ID NO: 772347 - DNA, 25 bp, Mus musculus
tagagtctgccctctagttgacaat

SEQ ID NO: 772348 - DNA, 25 bp, Mus musculus
tagagtcttgctagtaccaatacat

SEQ ID NO: 772349 - DNA, 25 bp, Mus musculus
tagagtcttgcttgtaccaatacat

SEQ ID NO: 772350 - DNA, 25 bp, Mus musculus
tagagtctttccaagcctctttgaa

SEQ ID NO: 772351 - DNA, 25 bp, Mus musculus
tagagtctttcctagcctctttgaa

SEQ ID NO: 772352 - DNA, 25 bp, Mus musculus
tagagtgaaaacagcaccatctggt

SEQ ID NO: 772353 - DNA, 25 bp, Mus musculus
tagagtgaaaactgcaccatctggt

SEQ ID NO: 772354 - DNA, 25 bp, Mus musculus
tagagtgaaacaattgccccaggtc

SEQ ID NO: 772355 - DNA, 25 bp, Mus musculus
tagagtgaaacatttgccccaggtc

SEQ ID NO: 772356 - DNA, 25 bp, Mus musculus
tagagtgaccataaaacttgaccct

SEQ ID NO: 772357 - DNA, 25 bp, Mus musculus
tagagtgaccattaaacttgaccct

SEQ ID NO: 772358 - DNA, 25 bp, Mus musculus
tagagtgacctgcagtggctgataa

SEQ ID NO: 772359 - DNA, 25 bp, Mus musculus
tagagtgacctggagtggctgataa

SEQ ID NO: 772360 - DNA, 25 bp, Mus musculus
tagagtgacttactgtatgtgtgca

SEQ ID NO: 772361 - DNA, 25 bp, Mus musculus
tagagtgacttagtgtatgtgtgca

SEQ ID NO: 772362 - DNA, 25 bp, Mus musculus
tagagtgagagaccgccctgtccgt

SEQ ID NO: 772363 - DNA, 25 bp, Mus musculus
tagagtgagagagcgccctgtccgt

SEQ ID NO: 772364 - DNA, 25 bp, Mus musculus
tagagtgaggcacgcacactatccc

SEQ ID NO: 772365 - DNA, 25 bp, Mus musculus
tagagtgaggcaggcacactatccc

SEQ ID NO: 772366 - DNA, 25 bp, Mus musculus
tagagtgataaacgcgagcatcgct

SEQ ID NO: 772367 - DNA, 25 bp, Mus musculus
tagagtgataaaggcgagcatcgct

SEQ ID NO: 772368 - DNA, 25 bp, Mus musculus
tagagtgcagctcaccagtctcata

SEQ ID NO: 772369 - DNA, 25 bp, Mus musculus
tagagtgcagctgaccagtctcata

SEQ ID NO: 772370 - DNA, 25 bp, Mus musculus
tagagtgccaaaaggtccgccctga

SEQ ID NO: 772371 - DNA, 25 bp, Mus musculus
tagagtgccaaatggtccgccctga

SEQ ID NO: 772372 - DNA, 25 bp, Mus musculus
tagagtgccctgactcaatatgtgg

SEQ ID NO: 772373 - DNA, 25 bp, Mus musculus
tagagtgccctgtctcaatatgtgg

SEQ ID NO: 772374 - DNA, 25 bp, Mus musculus
tagagtgccggaccctggttctaca

SEQ ID NO: 772375 - DNA, 25 bp, Mus musculus
tagagtgccggagcctggttctaca

SEQ ID NO: 772376 - DNA, 25 bp, Mus musculus
tagagtgcctgtcctccagtattgc

SEQ ID NO: 772377 - DNA, 25 bp, Mus musculus
tagagtgcctgtgctccagtattgc

SEQ ID NO: 772378 - DNA, 25 bp, Mus musculus
tagagtgcgtacaagccctttggat

SEQ ID NO: 772379 - DNA, 25 bp, Mus musculus
tagagtgcgtactagccctttggat

SEQ ID NO: 772380 - DNA, 25 bp, Mus musculus
tagagtgcgtatctcctacctgtgt

SEQ ID NO: 772381 - DNA, 25 bp, Mus musculus
tagagtgcgtatgtcctacctgtgt

SEQ ID NO: 772382 - DNA, 25 bp, Mus musculus
tagagtgctggaaacatcgcctctc

SEQ ID NO: 772383 - DNA, 25 bp, Mus musculus
tagagtgctggatacatcgcctctc

SEQ ID NO: 772384 - DNA, 25 bp, Mus musculus
tagagtgctggccaaccgtgtacaa

SEQ ID NO: 772385 - DNA, 25 bp, Mus musculus
tagagtgctggcgaaccgtgtacaa

SEQ ID NO: 772386 - DNA, 25 bp, Mus musculus
tagagtgcttgcctgggaatcctta

SEQ ID NO: 772387 - DNA, 25 bp, Mus musculus
tagagtgcttgcgtgggaatcctta

SEQ ID NO: 772388 - DNA, 25 bp, Mus musculus
tagagtggatctcgtgctagacagc

SEQ ID NO: 772389 - DNA, 25 bp, Mus musculus
tagagtggatctggtgctagacagc

SEQ ID NO: 772390 - DNA, 25 bp, Mus musculus
tagagtggccacaagccacagcttc

SEQ ID NO: 772391 - DNA, 25 bp, Mus musculus
tagagtggccactagccacagcttc

SEQ ID NO: 772392 - DNA, 25 bp, Mus musculus
tagagtggcccacaaagtagagact

SEQ ID NO: 772393 - DNA, 25 bp, Mus musculus
tagagtggcccagaaagtagagact

SEQ ID NO: 772394 - DNA, 25 bp, Mus musculus
tagagtggcctcaaagggagactta

SEQ ID NO: 772395 - DNA, 25 bp, Mus musculus
tagagtggcctctaagggagactta

SEQ ID NO: 772396 - DNA, 25 bp, Mus musculus
tagagtggcgttatctttgcatcca

SEQ ID NO: 772397 - DNA, 25 bp, Mus musculus
tagagtggcgttttctttgcatcca

SEQ ID NO: 772398 - DNA, 25 bp, Mus musculus
tagagtggctccacttggtcctgga

SEQ ID NO: 772399 - DNA, 25 bp, Mus musculus
tagagtggctcctcttggtcctgga

SEQ ID NO: 772400 - DNA, 25 bp, Mus musculus
tagagtgggacgctttccccgctga

SEQ ID NO: 772401 - DNA, 25 bp, Mus musculus
tagagtgggacggtttccccgctga

SEQ ID NO: 772402 - DNA, 25 bp, Mus musculus
tagagtggtctcaagatgcctccca

SEQ ID NO: 772403 - DNA, 25 bp, Mus musculus
tagagtggtctctagatgcctccca

SEQ ID NO: 772404 - DNA, 25 bp, Mus musculus
tagagtggtcttccctgatccaggg

SEQ ID NO: 772405 - DNA, 25 bp, Mus musculus
tagagtggtcttgcctgatccaggg

SEQ ID NO: 772406 - DNA, 25 bp, Mus musculus
tagagtgtactcagcgactcgcagg

SEQ ID NO: 772407 - DNA, 25 bp, Mus musculus
tagagtgtactctgcgactcgcagg

SEQ ID NO: 772408 - DNA, 25 bp, Mus musculus
tagagtgtaggtcctcactgcttat

SEQ ID NO: 772409 - DNA, 25 bp, Mus musculus
tagagtgtaggtgctcactgcttat

SEQ ID NO: 772410 - DNA, 25 bp, Mus musculus
tagagtgtcacccttatctgaacca

SEQ ID NO: 772411 - DNA, 25 bp, Mus musculus
tagagtgtcaccgttatctgaacca

SEQ ID NO: 772412 - DNA, 25 bp, Mus musculus
tagagtgtcactaccggattacgaa

SEQ ID NO: 772413 - DNA, 25 bp, Mus musculus
tagagtgtcacttccggattacgaa

SEQ ID NO: 772414 - DNA, 25 bp, Mus musculus
tagagtgtccagacctctgtgggaa

SEQ ID NO: 772415 - DNA, 25 bp, Mus musculus
tagagtgtccagtcctctgtgggaa

SEQ ID NO: 772416 - DNA, 25 bp, Mus musculus
tagagtgtctcccttttcttgctgt

SEQ ID NO: 772417 - DNA, 25 bp, Mus musculus
tagagtgtctccgttttcttgctgt

SEQ ID NO: 772418 - DNA, 25 bp, Mus musculus
tagagtgtctgcctgccataaggat

SEQ ID NO: 772419 - DNA, 25 bp, Mus musculus
tagagtgtctgcgtgccataaggat

SEQ ID NO: 772420 - DNA, 25 bp, Mus musculus
tagagtgtgctcagccttacccaat

SEQ ID NO: 772421 - DNA, 25 bp, Mus musculus
tagagtgtgctctgccttacccaat

SEQ ID NO: 772422 - DNA, 25 bp, Mus musculus
tagagtgtgtgtcgtcaccctgagc

SEQ ID NO: 772423 - DNA, 25 bp, Mus musculus
tagagtgtgtgtggtcaccctgagc

SEQ ID NO: 772424 - DNA, 25 bp, Mus musculus
tagagtgttctacacaattttcaaa

SEQ ID NO: 772425 - DNA, 25 bp, Mus musculus
tagagtgttctagacaattttcaaa

SEQ ID NO: 772426 - DNA, 25 bp, Mus musculus
tagagtgttctgagcctccaaggac

SEQ ID NO: 772427 - DNA, 25 bp, Mus musculus
tagagtgttctgtgcctccaaggac

SEQ ID NO: 772428 - DNA, 25 bp, Mus musculus
tagagtgttggaattcccacccact

SEQ ID NO: 772429 - DNA, 25 bp, Mus musculus
tagagtgttggatttcccacccact

SEQ ID NO: 772430 - DNA, 25 bp, Mus musculus
tagagtgtttacatagtgtgcacaa

SEQ ID NO: 772431 - DNA, 25 bp, Mus musculus
tagagtgtttacctaccactcctga

SEQ ID NO: 772432 - DNA, 25 bp, Mus musculus
tagagtgtttacgtaccactcctga

SEQ ID NO: 772433 - DNA, 25 bp, Mus musculus
tagagtgtttacttagtgtgcacaa

SEQ ID NO: 772434 - DNA, 25 bp, Mus musculus
tagagttacattagattttgtcctg

SEQ ID NO: 772435 - DNA, 25 bp, Mus musculus
tagagttacatttgattttgtcctg

SEQ ID NO: 772436 - DNA, 25 bp, Mus musculus
tagagttacctgagttaggaaataa

SEQ ID NO: 772437 - DNA, 25 bp, Mus musculus
tagagttacctgtgttaggaaataa

SEQ ID NO: 772438 - DNA, 25 bp, Mus musculus
tagagttactgtatcttccacttgg

SEQ ID NO: 772439 - DNA, 25 bp, Mus musculus
tagagttactgtttcttccacttgg

SEQ ID NO: 772440 - DNA, 25 bp, Mus musculus
tagagttagcctcgacacgtgcttc

SEQ ID NO: 772441 - DNA, 25 bp, Mus musculus
tagagttagcctggacacgtgcttc

SEQ ID NO: 772442 - DNA, 25 bp, Mus musculus
tagagttaggacatcgacctgggat

SEQ ID NO: 772443 - DNA, 25 bp, Mus musculus
tagagttaggacttcgacctgggat

SEQ ID NO: 772444 - DNA, 25 bp, Mus musculus
tagagttatctactttccattacac

SEQ ID NO: 772445 - DNA, 25 bp, Mus musculus
tagagttatctagtttccattacac

SEQ ID NO: 772446 - DNA, 25 bp, Mus musculus
tagagttcccagatggctgctgtgc

SEQ ID NO: 772447 - DNA, 25 bp, Mus musculus
tagagttcccagttggctgctgtgc

SEQ ID NO: 772448 - DNA, 25 bp, Mus musculus
tagagttcctagcaaagtgggcgcc

SEQ ID NO: 772449 - DNA, 25 bp, Mus musculus
tagagttcctaggaaagtgggcgcc

SEQ ID NO: 772450 - DNA, 25 bp, Mus musculus
tagagttcctcaacacactggcctt

SEQ ID NO: 772451 - DNA, 25 bp, Mus musculus
tagagttcctcatcacactggcctt

SEQ ID NO: 772452 - DNA, 25 bp, Mus musculus
tagagttcgaccctgctcagcgcat

SEQ ID NO: 772453 - DNA, 25 bp, Mus musculus
tagagttcgaccgtgctcagcgcat

SEQ ID NO: 772454 - DNA, 25 bp, Mus musculus
tagagttctagaacctcttctgctg

SEQ ID NO: 772455 - DNA, 25 bp, Mus musculus
tagagttctagatcctcttctgctg

SEQ ID NO: 772456 - DNA, 25 bp, Mus musculus
tagagttctagtcacttgtaacaaa

SEQ ID NO: 772457 - DNA, 25 bp, Mus musculus
tagagttctagtgacttgtaacaaa

SEQ ID NO: 772458 - DNA, 25 bp, Mus musculus
tagagttctcacaccgttcaatttt

SEQ ID NO: 772459 - DNA, 25 bp, Mus musculus
tagagttctcactccgttcaatttt

SEQ ID NO: 772460 - DNA, 25 bp, Mus musculus
tagagttctctgaagtgtcctttgt

SEQ ID NO: 772461 - DNA, 25 bp, Mus musculus
tagagttctctgtagtgtcctttgt

SEQ ID NO: 772462 - DNA, 25 bp, Mus musculus
tagagttctgacactccctgatggt

SEQ ID NO: 772463 - DNA, 25 bp, Mus musculus
tagagttctgactctccctgatggt

SEQ ID NO: 772464 - DNA, 25 bp, Mus musculus
tagagttctgccatagcatacccaa

SEQ ID NO: 772465 - DNA, 25 bp, Mus musculus
tagagttctgccttagcatacccaa

SEQ ID NO: 772466 - DNA, 25 bp, Mus musculus
tagagttcttataaagaaaccctat

SEQ ID NO: 772467 - DNA, 25 bp, Mus musculus
tagagttcttattaagaaaccctat

SEQ ID NO: 772468 - DNA, 25 bp, Mus musculus
tagagttctttcatagacacttact

SEQ ID NO: 772469 - DNA, 25 bp, Mus musculus
tagagttctttcttagacacttact

SEQ ID NO: 772470 - DNA, 25 bp, Mus musculus
tagagttgatgccattcctacttcc

SEQ ID NO: 772471 - DNA, 25 bp, Mus musculus
tagagttgatgcgattcctacttcc

SEQ ID NO: 772472 - DNA, 25 bp, Mus musculus
tagagttgctacctccatgggccaa

SEQ ID NO: 772473 - DNA, 25 bp, Mus musculus
tagagttgctacgtccatgggccaa

SEQ ID NO: 772474 - DNA, 25 bp, Mus musculus
tagagttgctcacccgttgaacagc

SEQ ID NO: 772475 - DNA, 25 bp, Mus musculus
tagagttgctcagccgttgaacagc

SEQ ID NO: 772476 - DNA, 25 bp, Mus musculus
tagagttggcaaacttctccaagcg

SEQ ID NO: 772477 - DNA, 25 bp, Mus musculus
tagagttggcaatcttctccaagcg

SEQ ID NO: 772478 - DNA, 25 bp, Mus musculus
tagagttggtatctcgagtcagact

SEQ ID NO: 772479 - DNA, 25 bp, Mus musculus
tagagttggtatgtcgagtcagact

SEQ ID NO: 772480 - DNA, 25 bp, Mus musculus
tagagttgtaaccttcctcacagaa

SEQ ID NO: 772481 - DNA, 25 bp, Mus musculus
tagagttgtaacgttcctcacagaa

SEQ ID NO: 772482 - DNA, 25 bp, Mus musculus
tagagttgtcctccttgatttacaa

SEQ ID NO: 772483 - DNA, 25 bp, Mus musculus
tagagttgtcctgcttgatttacaa

SEQ ID NO: 772484 - DNA, 25 bp, Mus musculus
tagagttgttatcatcggaggccat

SEQ ID NO: 772485 - DNA, 25 bp, Mus musculus
tagagttgttatgatcggaggccat

SEQ ID NO: 772486 - DNA, 25 bp, Mus musculus
tagagtttaactccctcagagcacc

SEQ ID NO: 772487 - DNA, 25 bp, Mus musculus
tagagtttaactgcctcagagcacc

SEQ ID NO: 772488 - DNA, 25 bp, Mus musculus
tagagtttaaggaacatcacgctgt

SEQ ID NO: 772489 - DNA, 25 bp, Mus musculus
tagagtttaaggtacatcacgctgt

SEQ ID NO: 772490 - DNA, 25 bp, Mus musculus
tagagtttactaccaaatttgcgtg

SEQ ID NO: 772491 - DNA, 25 bp, Mus musculus
tagagtttactagcaaatttgcgtg

SEQ ID NO: 772492 - DNA, 25 bp, Mus musculus
tagagtttcaacacctgtgccctaa

SEQ ID NO: 772493 - DNA, 25 bp, Mus musculus
tagagtttcaactcctgtgccctaa

SEQ ID NO: 772494 - DNA, 25 bp, Mus musculus
tagagtttgatcagccttgtggaca

SEQ ID NO: 772495 - DNA, 25 bp, Mus musculus
tagagtttgatctgccttgtggaca

SEQ ID NO: 772496 - DNA, 25 bp, Mus musculus
tagagtttgcatccatagaccaaaa

SEQ ID NO: 772497 - DNA, 25 bp, Mus musculus
tagagtttgcatgcatagaccaaaa

SEQ ID NO: 772498 - DNA, 25 bp, Mus musculus
tagagtttgctcagcgtgtagtccc

SEQ ID NO: 772499 - DNA, 25 bp, Mus musculus
tagagtttgctctgcgtgtagtccc

SEQ ID NO: 772500 - DNA, 25 bp, Mus musculus
tagagtttgctgagctcaacttcct

SEQ ID NO: 772501 - DNA, 25 bp, Mus musculus
tagagtttgctgtgctcaacttcct

SEQ ID NO: 772502 - DNA, 25 bp, Mus musculus
tagagtttggtgctctctttctctc

SEQ ID NO: 772503 - DNA, 25 bp, Mus musculus
tagagtttggtggtctctttctctc

SEQ ID NO: 772504 - DNA, 25 bp, Mus musculus
tagagttttcttccacgactcagtc

SEQ ID NO: 772505 - DNA, 25 bp, Mus musculus
tagagttttcttgcacgactcagtc

SEQ ID NO: 772506 - DNA, 25 bp, Mus musculus
tagagttttgcaaccgagttcttgt

SEQ ID NO: 772507 - DNA, 25 bp, Mus musculus
tagagttttgcatccgagttcttgt

SEQ ID NO: 772508 - DNA, 25 bp, Mus musculus
tagagttttgtaagccagtcggcct

SEQ ID NO: 772509 - DNA, 25 bp, Mus musculus
tagagttttgtatgccagtcggcct

SEQ ID NO: 772510 - DNA, 25 bp, Mus musculus
tagagttttgtgaatcacccccctt

SEQ ID NO: 772511 - DNA, 25 bp, Mus musculus
tagagttttgtgtatcacccccctt

SEQ ID NO: 772512 - DNA, 25 bp, Mus musculus
tagagtttttgaaggacttcattgt

SEQ ID NO: 772513 - DNA, 25 bp, Mus musculus
tagagtttttgatggacttcattgt

SEQ ID NO: 772514 - DNA, 25 bp, Mus musculus
tagataaagtagctgccatgatgcc

SEQ ID NO: 772515 - DNA, 25 bp, Mus musculus
tagataaagtaggtgccatgatgcc

SEQ ID NO: 772516 - DNA, 25 bp, Mus musculus
tagataaccacacatttaccccgtc

SEQ ID NO: 772517 - DNA, 25 bp, Mus musculus
tagataaccacagatttaccccgtc

SEQ ID NO: 772518 - DNA, 25 bp, Mus musculus
tagataacctcgcgccgatcgcacg

SEQ ID NO: 772519 - DNA, 25 bp, Mus musculus
tagataacctcgggccgatcgcacg

SEQ ID NO: 772520 - DNA, 25 bp, Mus musculus
tagataacgagcctccggtcacagt

SEQ ID NO: 772521 - DNA, 25 bp, Mus musculus
tagataacgagcgtccggtcacagt

SEQ ID NO: 772522 - DNA, 25 bp, Mus musculus
tagataactatcactggctacccac

SEQ ID NO: 772523 - DNA, 25 bp, Mus musculus
tagataactatctctggctacccac

SEQ ID NO: 772524 - DNA, 25 bp, Mus musculus
tagataactgtaccctgtcattcct

SEQ ID NO: 772525 - DNA, 25 bp, Mus musculus
tagataactgtagcctgtcattcct

SEQ ID NO: 772526 - DNA, 25 bp, Mus musculus
tagataactgttattgtggcacgaa

SEQ ID NO: 772527 - DNA, 25 bp, Mus musculus
tagataactgtttttgtggcacgaa

SEQ ID NO: 772528 - DNA, 25 bp, Mus musculus
tagataaggactccaagattcccag

SEQ ID NO: 772529 - DNA, 25 bp, Mus musculus
tagataaggactgcaagattcccag

SEQ ID NO: 772530 - DNA, 25 bp, Mus musculus
tagataatctccctagtgccaggca

SEQ ID NO: 772531 - DNA, 25 bp, Mus musculus
tagataatctccgtagtgccaggca

SEQ ID NO: 772532 - DNA, 25 bp, Mus musculus
tagataatgcttcaactgagttgat

SEQ ID NO: 772533 - DNA, 25 bp, Mus musculus
tagataatgcttgaactgagttgat

SEQ ID NO: 772534 - DNA, 25 bp, Mus musculus
tagataatgtgtctcctttgccttc

SEQ ID NO: 772535 - DNA, 25 bp, Mus musculus
tagataatgtgtgtcctttgccttc

SEQ ID NO: 772536 - DNA, 25 bp, Mus musculus
tagatacagcccaggattcaagccc

SEQ ID NO: 772537 - DNA, 25 bp, Mus musculus
tagatacagccctggattcaagccc

SEQ ID NO: 772538 - DNA, 25 bp, Mus musculus
tagatacagctaaaaggcgtcaaag

SEQ ID NO: 772539 - DNA, 25 bp, Mus musculus
tagatacagctataaggcgtcaaag

SEQ ID NO: 772540 - DNA, 25 bp, Mus musculus
tagatacattagacgattttcccat

SEQ ID NO: 772541 - DNA, 25 bp, Mus musculus
tagatacattagtcgattttcccat

SEQ ID NO: 772542 - DNA, 25 bp, Mus musculus
tagatacattctaaagtgttcactt

SEQ ID NO: 772543 - DNA, 25 bp, Mus musculus
tagatacattcttaagtgttcactt

SEQ ID NO: 772544 - DNA, 25 bp, Mus musculus
tagataccactgatcccttgaggat

SEQ ID NO: 772545 - DNA, 25 bp, Mus musculus
tagataccactgttcccttgaggat

SEQ ID NO: 772546 - DNA, 25 bp, Mus musculus
tagatacccaggagtcactcagttc

SEQ ID NO: 772547 - DNA, 25 bp, Mus musculus
tagatacccaggtgtcactcagttc

SEQ ID NO: 772548 - DNA, 25 bp, Mus musculus
tagataccccagagcccaaaaccat

SEQ ID NO: 772549 - DNA, 25 bp, Mus musculus
tagataccccagtgcccaaaaccat

SEQ ID NO: 772550 - DNA, 25 bp, Mus musculus
tagataccctaacccctgaagagga

SEQ ID NO: 772551 - DNA, 25 bp, Mus musculus
tagataccctaagccctgaagagga

SEQ ID NO: 772552 - DNA, 25 bp, Mus musculus
tagataccgctgaaggatccttgga

SEQ ID NO: 772553 - DNA, 25 bp, Mus musculus
tagataccgctgtaggatccttgga

SEQ ID NO: 772554 - DNA, 25 bp, Mus musculus
tagataccttaaactcacactctcc

SEQ ID NO: 772555 - DNA, 25 bp, Mus musculus
tagataccttaatctcacactctcc

SEQ ID NO: 772556 - DNA, 25 bp, Mus musculus
tagatacgtgctctcacacctggat

SEQ ID NO: 772557 - DNA, 25 bp, Mus musculus
tagatacgtgctgtcacacctggat

SEQ ID NO: 772558 - DNA, 25 bp, Mus musculus
tagatactacttaaggaaaaccctg

SEQ ID NO: 772559 - DNA, 25 bp, Mus musculus
tagatactactttaggaaaaccctg

SEQ ID NO: 772560 - DNA, 25 bp, Mus musculus
tagatactctttcgacacccctcat

SEQ ID NO: 772561 - DNA, 25 bp, Mus musculus
tagatactctttggacacccctcat

SEQ ID NO: 772562 - DNA, 25 bp, Mus musculus
tagatactgaagagcacctcggaat

SEQ ID NO: 772563 - DNA, 25 bp, Mus musculus
tagatactgaagtgcacctcggaat

SEQ ID NO: 772564 - DNA, 25 bp, Mus musculus
tagatacttacaaaatgccccaccc

SEQ ID NO: 772565 - DNA, 25 bp, Mus musculus
tagatacttacataatgccccaccc

SEQ ID NO: 772566 - DNA, 25 bp, Mus musculus
tagatacttaggactcccaggacct

SEQ ID NO: 772567 - DNA, 25 bp, Mus musculus
tagatacttaggtctcccaggacct

SEQ ID NO: 772568 - DNA, 25 bp, Mus musculus
tagatagaaggcacctagctggcac

SEQ ID NO: 772569 - DNA, 25 bp, Mus musculus
tagatagaaggctcctagctggcac

SEQ ID NO: 772570 - DNA, 25 bp, Mus musculus
tagatagaatataagcagcatgcaa

SEQ ID NO: 772571 - DNA, 25 bp, Mus musculus
tagatagaatattagcagcatgcaa

SEQ ID NO: 772572 - DNA, 25 bp, Mus musculus
tagatagacattctgcctgtgcatc

SEQ ID NO: 772573 - DNA, 25 bp, Mus musculus
tagatagacattgtgcctgtgcatc

SEQ ID NO: 772574 - DNA, 25 bp, Mus musculus
tagatagaccacaagctccatttcc

SEQ ID NO: 772575 - DNA, 25 bp, Mus musculus
tagatagaccactagctccatttcc

SEQ ID NO: 772576 - DNA, 25 bp, Mus musculus
tagatagactcacgccattccgatc

SEQ ID NO: 772577 - DNA, 25 bp, Mus musculus
tagatagactcaggccattccgatc

SEQ ID NO: 772578 - DNA, 25 bp, Mus musculus
tagatagagataagtcttttctctc

SEQ ID NO: 772579 - DNA, 25 bp, Mus musculus
tagatagagatatgtcttttctctc

SEQ ID NO: 772580 - DNA, 25 bp, Mus musculus
tagatagagctgcacccaaacccag

SEQ ID NO: 772581 - DNA, 25 bp, Mus musculus
tagatagagctggacccaaacccag

SEQ ID NO: 772582 - DNA, 25 bp, Mus musculus
tagatagatataatggtgctgctcc

SEQ ID NO: 772583 - DNA, 25 bp, Mus musculus
tagatagatatattggtgctgctcc

SEQ ID NO: 772584 - DNA, 25 bp, Mus musculus
tagatagatgccaccacaagtcctc

SEQ ID NO: 772585 - DNA, 25 bp, Mus musculus
tagatagatgcctccacaagtcctc

SEQ ID NO: 772586 - DNA, 25 bp, Mus musculus
tagatagcacatcggccttgttagc

SEQ ID NO: 772587 - DNA, 25 bp, Mus musculus
tagatagcacatgggccttgttagc

SEQ ID NO: 772588 - DNA, 25 bp, Mus musculus
tagatagcaccaagcactgcccaag

SEQ ID NO: 772589 - DNA, 25 bp, Mus musculus
tagatagcaccatgcactgcccaag

SEQ ID NO: 772590 - DNA, 25 bp, Mus musculus
tagatagcagctagggcctggagta

SEQ ID NO: 772591 - DNA, 25 bp, Mus musculus
tagatagcagcttgggcctggagta

SEQ ID NO: 772592 - DNA, 25 bp, Mus musculus
tagatagcctgtaagtggtacccca

SEQ ID NO: 772593 - DNA, 25 bp, Mus musculus
tagatagcctgttagtggtacccca

SEQ ID NO: 772594 - DNA, 25 bp, Mus musculus
tagatagcggctcctagaccagcat

SEQ ID NO: 772595 - DNA, 25 bp, Mus musculus
tagatagcggctgctagaccagcat

SEQ ID NO: 772596 - DNA, 25 bp, Mus musculus
tagatagctcttcttctagagcccc

SEQ ID NO: 772597 - DNA, 25 bp, Mus musculus
tagatagctcttgttctagagcccc

SEQ ID NO: 772598 - DNA, 25 bp, Mus musculus
tagatagctgtgcagctcactgtca

SEQ ID NO: 772599 - DNA, 25 bp, Mus musculus
tagatagctgtggagctcactgtca

SEQ ID NO: 772600 - DNA, 25 bp, Mus musculus
tagatagcttggcaacgcttccttg

SEQ ID NO: 772601 - DNA, 25 bp, Mus musculus
tagatagcttgggaacgcttccttg

SEQ ID NO: 772602 - DNA, 25 bp, Mus musculus
tagataggacctcgcgcacacaaga

SEQ ID NO: 772603 - DNA, 25 bp, Mus musculus
tagataggacctggcgcacacaaga

SEQ ID NO: 772604 - DNA, 25 bp, Mus musculus
tagataggagtgatcacccctcagc

SEQ ID NO: 772605 - DNA, 25 bp, Mus musculus
tagataggagtgttcacccctcagc

SEQ ID NO: 772606 - DNA, 25 bp, Mus musculus
tagatagggcctcggacgataaaac

SEQ ID NO: 772607 - DNA, 25 bp, Mus musculus
tagatagggcctgggacgataaaac

SEQ ID NO: 772608 - DNA, 25 bp, Mus musculus
tagatagtagctctggtgggatttc

SEQ ID NO: 772609 - DNA, 25 bp, Mus musculus
tagatagtagctgtggtgggatttc

SEQ ID NO: 772610 - DNA, 25 bp, Mus musculus
tagatagtcataagctggctaacaa

SEQ ID NO: 772611 - DNA, 25 bp, Mus musculus
tagatagtcatatgctggctaacaa

SEQ ID NO: 772612 - DNA, 25 bp, Mus musculus
tagatagtccatcggcctcgggagt

SEQ ID NO: 772613 - DNA, 25 bp, Mus musculus
tagatagtccatgggcctcgggagt

SEQ ID NO: 772614 - DNA, 25 bp, Mus musculus
tagatagttcagcatggcaccattg

SEQ ID NO: 772615 - DNA, 25 bp, Mus musculus
tagatagttcaggatggcaccattg

SEQ ID NO: 772616 - DNA, 25 bp, Mus musculus
tagatagttgcccatggcctgggtc

SEQ ID NO: 772617 - DNA, 25 bp, Mus musculus
tagatagttgccgatggcctgggtc

SEQ ID NO: 772618 - DNA, 25 bp, Mus musculus
tagatagttggcaagctccagtaag

SEQ ID NO: 772619 - DNA, 25 bp, Mus musculus
tagatagttggctagctccagtaag

SEQ ID NO: 772620 - DNA, 25 bp, Mus musculus
tagatatacccgagtttcccacaat

SEQ ID NO: 772621 - DNA, 25 bp, Mus musculus
tagatatacccgtgtttcccacaat

SEQ ID NO: 772622 - DNA, 25 bp, Mus musculus
tagatatcacacagacacgcgcaca

SEQ ID NO: 772623 - DNA, 25 bp, Mus musculus
tagatatcacactgacacgcgcaca

SEQ ID NO: 772624 - DNA, 25 bp, Mus musculus
tagatatccttgacacagatccctc

SEQ ID NO: 772625 - DNA, 25 bp, Mus musculus
tagatatccttgtcacagatccctc

SEQ ID NO: 772626 - DNA, 25 bp, Mus musculus
tagatatgactaccctgagtctcct

SEQ ID NO: 772627 - DNA, 25 bp, Mus musculus
tagatatgactactgacctacctca

SEQ ID NO: 772628 - DNA, 25 bp, Mus musculus
tagatatgactagcctgagtctcct

SEQ ID NO: 772629 - DNA, 25 bp, Mus musculus
tagatatgactagtgacctacctca

SEQ ID NO: 772630 - DNA, 25 bp, Mus musculus
tagatatggatgctgttcacccctc

SEQ ID NO: 772631 - DNA, 25 bp, Mus musculus
tagatatggatggtgttcacccctc

SEQ ID NO: 772632 - DNA, 25 bp, Mus musculus
tagatatggcataccctcagcatac

SEQ ID NO: 772633 - DNA, 25 bp, Mus musculus
tagatatggcattccctcagcatac

SEQ ID NO: 772634 - DNA, 25 bp, Mus musculus
tagatatgttgcaagagtgttctcc

SEQ ID NO: 772635 - DNA, 25 bp, Mus musculus
tagatatgttgctagagtgttctcc

SEQ ID NO: 772636 - DNA, 25 bp, Mus musculus
tagatattacttcagttccggtgct

SEQ ID NO: 772637 - DNA, 25 bp, Mus musculus
tagatattacttgagttccggtgct

SEQ ID NO: 772638 - DNA, 25 bp, Mus musculus
tagatattccgcatctgttttactg

SEQ ID NO: 772639 - DNA, 25 bp, Mus musculus
tagatattccgcttctgttttactg

SEQ ID NO: 772640 - DNA, 25 bp, Mus musculus
tagatcaatggcatctaccgctcac

SEQ ID NO: 772641 - DNA, 25 bp, Mus musculus
tagatcaatggcttctaccgctcac

SEQ ID NO: 772642 - DNA, 25 bp, Mus musculus
tagatcaccaataatcccatgccca

SEQ ID NO: 772643 - DNA, 25 bp, Mus musculus
tagatcaccaattatcccatgccca

SEQ ID NO: 772644 - DNA, 25 bp, Mus musculus
tagatcacctgaacacttacttagc

SEQ ID NO: 772645 - DNA, 25 bp, Mus musculus
tagatcacctgatcacttacttagc

SEQ ID NO: 772646 - DNA, 25 bp, Mus musculus
tagatcacggttatctctgtaagaa

SEQ ID NO: 772647 - DNA, 25 bp, Mus musculus
tagatcacggttttctctgtaagaa

SEQ ID NO: 772648 - DNA, 25 bp, Mus musculus
tagatcactataagtatgactacat

SEQ ID NO: 772649 - DNA, 25 bp, Mus musculus
tagatcactatatgtatgactacat

SEQ ID NO: 772650 - DNA, 25 bp, Mus musculus
tagatcagacccaggctcttgccat

SEQ ID NO: 772651 - DNA, 25 bp, Mus musculus
tagatcagaccctggctcttgccat

SEQ ID NO: 772652 - DNA, 25 bp, Mus musculus
tagatcagagcgaccattcctttat

SEQ ID NO: 772653 - DNA, 25 bp, Mus musculus
tagatcagagcgtccattcctttat

SEQ ID NO: 772654 - DNA, 25 bp, Mus musculus
tagatcagccagaccctggagcagt

SEQ ID NO: 772655 - DNA, 25 bp, Mus musculus
tagatcagccagtccctggagcagt

SEQ ID NO: 772656 - DNA, 25 bp, Mus musculus
tagatcagctctagtggtgtgtcct

SEQ ID NO: 772657 - DNA, 25 bp, Mus musculus
tagatcagctcttgtggtgtgtcct

SEQ ID NO: 772658 - DNA, 25 bp, Mus musculus
tagatcagcttccctcgctggagat

SEQ ID NO: 772659 - DNA, 25 bp, Mus musculus
tagatcagcttcgctcgctggagat

SEQ ID NO: 772660 - DNA, 25 bp, Mus musculus
tagatcagggcccttcaggtaaatg

SEQ ID NO: 772661 - DNA, 25 bp, Mus musculus
tagatcagggccgttcaggtaaatg

SEQ ID NO: 772662 - DNA, 25 bp, Mus musculus
tagatcagtctgacaagtgcttgtc

SEQ ID NO: 772663 - DNA, 25 bp, Mus musculus
tagatcagtctgtcaagtgcttgtc

SEQ ID NO: 772664 - DNA, 25 bp, Mus musculus
tagatcagtgttactgcgaaggcaa

SEQ ID NO: 772665 - DNA, 25 bp, Mus musculus
tagatcagtgtttctgcgaaggcaa

SEQ ID NO: 772666 - DNA, 25 bp, Mus musculus
tagatcatatcacagtcccctacca

SEQ ID NO: 772667 - DNA, 25 bp, Mus musculus
tagatcatatcagagtcccctacca

SEQ ID NO: 772668 - DNA, 25 bp, Mus musculus
tagatcatcccacctagcaacactt

SEQ ID NO: 772669 - DNA, 25 bp, Mus musculus
tagatcatcccagctagcaacactt

SEQ ID NO: 772670 - DNA, 25 bp, Mus musculus
tagatcatggctcttacaaggatgg

SEQ ID NO: 772671 - DNA, 25 bp, Mus musculus
tagatcatggctgttacaaggatgg

SEQ ID NO: 772672 - DNA, 25 bp, Mus musculus
tagatcattctgaggttaggagcta

SEQ ID NO: 772673 - DNA, 25 bp, Mus musculus
tagatcattctgtggttaggagcta

SEQ ID NO: 772674 - DNA, 25 bp, Mus musculus
tagatcattggtccatgtggctcct

SEQ ID NO: 772675 - DNA, 25 bp, Mus musculus
tagatcattggtgcatgtggctcct

SEQ ID NO: 772676 - DNA, 25 bp, Mus musculus
tagatccacgctatgtgattcaaat

SEQ ID NO: 772677 - DNA, 25 bp, Mus musculus
tagatccacgctttgtgattcaaat

SEQ ID NO: 772678 - DNA, 25 bp, Mus musculus
tagatccagcgacggagctgccatc

SEQ ID NO: 772679 - DNA, 25 bp, Mus musculus
tagatccagcgagggagctgccatc

SEQ ID NO: 772680 - DNA, 25 bp, Mus musculus
tagatccataaaccctttgccaggg

SEQ ID NO: 772681 - DNA, 25 bp, Mus musculus
tagatccataaagcctttgccaggg

SEQ ID NO: 772682 - DNA, 25 bp, Mus musculus
tagatccatactacagctactgcaa

SEQ ID NO: 772683 - DNA, 25 bp, Mus musculus
tagatccatacttcagctactgcaa

SEQ ID NO: 772684 - DNA, 25 bp, Mus musculus
tagatccccaatcggcaattttgcc

SEQ ID NO: 772685 - DNA, 25 bp, Mus musculus
tagatccccaatgggcaattttgcc

SEQ ID NO: 772686 - DNA, 25 bp, Mus musculus
tagatccccactacctacagatgtg

SEQ ID NO: 772687 - DNA, 25 bp, Mus musculus
tagatccccacttcctacagatgtg

SEQ ID NO: 772688 - DNA, 25 bp, Mus musculus
tagatcccgtgcataagtgagccac

SEQ ID NO: 772689 - DNA, 25 bp, Mus musculus
tagatcccgtgcttaagtgagccac

SEQ ID NO: 772690 - DNA, 25 bp, Mus musculus
tagatccctagtacttcagggtcag

SEQ ID NO: 772691 - DNA, 25 bp, Mus musculus
tagatccctagttcttcagggtcag

SEQ ID NO: 772692 - DNA, 25 bp, Mus musculus
tagatccctataccctactctgaaa

SEQ ID NO: 772693 - DNA, 25 bp, Mus musculus
tagatccctatagcctactctgaaa

SEQ ID NO: 772694 - DNA, 25 bp, Mus musculus
tagatccctattactccaccagaaa

SEQ ID NO: 772695 - DNA, 25 bp, Mus musculus
tagatccctatttctccaccagaaa

SEQ ID NO: 772696 - DNA, 25 bp, Mus musculus
tagatccctctactaaagaaataag

SEQ ID NO: 772697 - DNA, 25 bp, Mus musculus
tagatccctctagtaaagaaataag

SEQ ID NO: 772698 - DNA, 25 bp, Mus musculus
tagatccctgtgaggcttagctctg

SEQ ID NO: 772699 - DNA, 25 bp, Mus musculus
tagatccctgtgtggcttagctctg

SEQ ID NO: 772700 - DNA, 25 bp, Mus musculus
tagatcctacagacacttcacagtt

SEQ ID NO: 772701 - DNA, 25 bp, Mus musculus
tagatcctacagtcacttcacagtt

SEQ ID NO: 772702 - DNA, 25 bp, Mus musculus
tagatcctacttcgaatctcctgcc

SEQ ID NO: 772703 - DNA, 25 bp, Mus musculus
tagatcctacttggaatctcctgcc

SEQ ID NO: 772704 - DNA, 25 bp, Mus musculus
tagatcctccagatcctgtccttcg

SEQ ID NO: 772705 - DNA, 25 bp, Mus musculus
tagatcctccagttcctgtccttcg

SEQ ID NO: 772706 - DNA, 25 bp, Mus musculus
tagatcctccatagtccagtaaagt

SEQ ID NO: 772707 - DNA, 25 bp, Mus musculus
tagatcctccattgtccagtaaagt

SEQ ID NO: 772708 - DNA, 25 bp, Mus musculus
tagatcctcgcacggcttgcggagc

SEQ ID NO: 772709 - DNA, 25 bp, Mus musculus
tagatcctcgcagggcttgcggagc

SEQ ID NO: 772710 - DNA, 25 bp, Mus musculus
tagatcctcggaaggtcatcaccat

SEQ ID NO: 772711 - DNA, 25 bp, Mus musculus
tagatcctcggatggtcatcaccat

SEQ ID NO: 772712 - DNA, 25 bp, Mus musculus
tagatcctgatgcaaggctggcctc

SEQ ID NO: 772713 - DNA, 25 bp, Mus musculus
tagatcctgatggaaggctggcctc

SEQ ID NO: 772714 - DNA, 25 bp, Mus musculus
tagatcctgttcaaatggactagca

SEQ ID NO: 772715 - DNA, 25 bp, Mus musculus
tagatcctgttctaatggactagca

SEQ ID NO: 772716 - DNA, 25 bp, Mus musculus
tagatccttcagacctcttagtgag

SEQ ID NO: 772717 - DNA, 25 bp, Mus musculus
tagatccttcagtcctcttagtgag

SEQ ID NO: 772718 - DNA, 25 bp, Mus musculus
tagatccttctaaaactgaaatttc

SEQ ID NO: 772719 - DNA, 25 bp, Mus musculus
tagatccttctataactgaaatttc

SEQ ID NO: 772720 - DNA, 25 bp, Mus musculus
tagatccttgtcctggtagtttcca

SEQ ID NO: 772721 - DNA, 25 bp, Mus musculus
tagatccttgtcgtggtagtttcca

SEQ ID NO: 772722 - DNA, 25 bp, Mus musculus
tagatccttgttcgctctgacctat

SEQ ID NO: 772723 - DNA, 25 bp, Mus musculus
tagatccttgttggctctgacctat

SEQ ID NO: 772724 - DNA, 25 bp, Mus musculus
tagatcgccacacatccctttgtgt

SEQ ID NO: 772725 - DNA, 25 bp, Mus musculus
tagatcgccacagatccctttgtgt

SEQ ID NO: 772726 - DNA, 25 bp, Mus musculus
tagatcggccatctgaaactaaggc

SEQ ID NO: 772727 - DNA, 25 bp, Mus musculus
tagatcggccatgtgaaactaaggc

SEQ ID NO: 772728 - DNA, 25 bp, Mus musculus
tagatcgtgcagatcgaacttacag

SEQ ID NO: 772729 - DNA, 25 bp, Mus musculus
tagatcgtgcagttcgaacttacag

SEQ ID NO: 772730 - DNA, 25 bp, Mus musculus
tagatcgtgggtactgtgtgtccat

SEQ ID NO: 772731 - DNA, 25 bp, Mus musculus
tagatcgtgggttctgtgtgtccat

SEQ ID NO: 772732 - DNA, 25 bp, Mus musculus
tagatcgttgaaatgcaccttgcca

SEQ ID NO: 772733 - DNA, 25 bp, Mus musculus
tagatcgttgaattgcaccttgcca

SEQ ID NO: 772734 - DNA, 25 bp, Mus musculus
tagatctaacacaagcacttgggag

SEQ ID NO: 772735 - DNA, 25 bp, Mus musculus
tagatctaacactagcacttgggag

SEQ ID NO: 772736 - DNA, 25 bp, Mus musculus
tagatctaagcccagaacctctcaa

SEQ ID NO: 772737 - DNA, 25 bp, Mus musculus
tagatctaagccgagaacctctcaa

SEQ ID NO: 772738 - DNA, 25 bp, Mus musculus
tagatctcacctaaacatgctgtcc

SEQ ID NO: 772739 - DNA, 25 bp, Mus musculus
tagatctcaccttaacatgctgtcc

SEQ ID NO: 772740 - DNA, 25 bp, Mus musculus
tagatctcactcagcaacaagtaca

SEQ ID NO: 772741 - DNA, 25 bp, Mus musculus
tagatctcactctgcaacaagtaca

SEQ ID NO: 772742 - DNA, 25 bp, Mus musculus
tagatctcaggaatagaactcaggt

SEQ ID NO: 772743 - DNA, 25 bp, Mus musculus
tagatctcaggattagaactcaggt

SEQ ID NO: 772744 - DNA, 25 bp, Mus musculus
tagatctcctcgctcatgcatgtga

SEQ ID NO: 772745 - DNA, 25 bp, Mus musculus
tagatctcctcggtcatgcatgtga

SEQ ID NO: 772746 - DNA, 25 bp, Mus musculus
tagatctcttgcactctgagcagag

SEQ ID NO: 772747 - DNA, 25 bp, Mus musculus
tagatctcttgctctctgagcagag

SEQ ID NO: 772748 - DNA, 25 bp, Mus musculus
tagatctgacacaacccaaggttga

SEQ ID NO: 772749 - DNA, 25 bp, Mus musculus
tagatctgacactacccaaggttga

SEQ ID NO: 772750 - DNA, 25 bp, Mus musculus
tagatctgccctaacattcttgagt

SEQ ID NO: 772751 - DNA, 25 bp, Mus musculus
tagatctgcccttacattcttgagt

SEQ ID NO: 772752 - DNA, 25 bp, Mus musculus
tagatctggaacatacccctctttg

SEQ ID NO: 772753 - DNA, 25 bp, Mus musculus
tagatctggaacttacccctctttg

SEQ ID NO: 772754 - DNA, 25 bp, Mus musculus
tagatctgggctacctgggtgaaat

SEQ ID NO: 772755 - DNA, 25 bp, Mus musculus
tagatctgggcttcctgggtgaaat

SEQ ID NO: 772756 - DNA, 25 bp, Mus musculus
tagatctgtctcaattgaagttaac

SEQ ID NO: 772757 - DNA, 25 bp, Mus musculus
tagatctgtctctattgaagttaac

SEQ ID NO: 772758 - DNA, 25 bp, Mus musculus
tagatctgtgcaatcatggaaagct

SEQ ID NO: 772759 - DNA, 25 bp, Mus musculus
tagatctgtgcattcatggaaagct

SEQ ID NO: 772760 - DNA, 25 bp, Mus musculus
tagatctgtgtaccatgtgaggctc

SEQ ID NO: 772761 - DNA, 25 bp, Mus musculus
tagatctgtgtagcatgtgaggctc

SEQ ID NO: 772762 - DNA, 25 bp, Mus musculus
tagatcttactcagtcttcctgttg

SEQ ID NO: 772763 - DNA, 25 bp, Mus musculus
tagatcttactctgtcttcctgttg

SEQ ID NO: 772764 - DNA, 25 bp, Mus musculus
tagatcttcactacggtggcgagtt

SEQ ID NO: 772765 - DNA, 25 bp, Mus musculus
tagatcttcacttcggtggcgagtt

SEQ ID NO: 772766 - DNA, 25 bp, Mus musculus
tagatcttctagactgctgttcatc

SEQ ID NO: 772767 - DNA, 25 bp, Mus musculus
tagatcttctagtctgctgttcatc

SEQ ID NO: 772768 - DNA, 25 bp, Mus musculus
tagatcttctctccagcaacgcttt

SEQ ID NO: 772769 - DNA, 25 bp, Mus musculus
tagatcttctctgcagcaacgcttt

SEQ ID NO: 772770 - DNA, 25 bp, Mus musculus
tagatcttgtcgattcccaatgcag

SEQ ID NO: 772771 - DNA, 25 bp, Mus musculus
tagatcttgtcgtttcccaatgcag

SEQ ID NO: 772772 - DNA, 25 bp, Mus musculus
tagatctttctgattgaggcaaact

SEQ ID NO: 772773 - DNA, 25 bp, Mus musculus
tagatctttctgtttgaggcaaact

SEQ ID NO: 772774 - DNA, 25 bp, Mus musculus
tagatctttcttcagcaggtttttt

SEQ ID NO: 772775 - DNA, 25 bp, Mus musculus
tagatctttcttgagcaggtttttt

SEQ ID NO: 772776 - DNA, 25 bp, Mus musculus
tagatctttggcaggtccatccaag

SEQ ID NO: 772777 - DNA, 25 bp, Mus musculus
tagatctttggctggtccatccaag

SEQ ID NO: 772778 - DNA, 25 bp, Mus musculus
tagatcttttaaccaccgtcaagcc

SEQ ID NO: 772779 - DNA, 25 bp, Mus musculus
tagatcttttaagcaccgtcaagcc

SEQ ID NO: 772780 - DNA, 25 bp, Mus musculus
tagatgaaattgactgtgtctgtga

SEQ ID NO: 772781 - DNA, 25 bp, Mus musculus
tagatgaaattgattcctgccctcc

SEQ ID NO: 772782 - DNA, 25 bp, Mus musculus
tagatgaaattgtctgtgtctgtga

SEQ ID NO: 772783 - DNA, 25 bp, Mus musculus
tagatgaaattgtttcctgccctcc

SEQ ID NO: 772784 - DNA, 25 bp, Mus musculus
tagatgaacctaactgtacctggaa

SEQ ID NO: 772785 - DNA, 25 bp, Mus musculus
tagatgaacctatctgtacctggaa

SEQ ID NO: 772786 - DNA, 25 bp, Mus musculus
tagatgaagctgaggttgccacagt

SEQ ID NO: 772787 - DNA, 25 bp, Mus musculus
tagatgaagctgtggttgccacagt

SEQ ID NO: 772788 - DNA, 25 bp, Mus musculus
tagatgacatcaaccggcctggctc

SEQ ID NO: 772789 - DNA, 25 bp, Mus musculus
tagatgacatcatccggcctggctc

SEQ ID NO: 772790 - DNA, 25 bp, Mus musculus
tagatgacattgacttagtgactta

SEQ ID NO: 772791 - DNA, 25 bp, Mus musculus
tagatgacattgtcttagtgactta

SEQ ID NO: 772792 - DNA, 25 bp, Mus musculus
tagatgaccaagaattactgtttta

SEQ ID NO: 772793 - DNA, 25 bp, Mus musculus
tagatgaccaagtattactgtttta

SEQ ID NO: 772794 - DNA, 25 bp, Mus musculus
tagatgactcaaaccatttatggct

SEQ ID NO: 772795 - DNA, 25 bp, Mus musculus
tagatgactcaatccatttatggct

SEQ ID NO: 772796 - DNA, 25 bp, Mus musculus
tagatgactcatctgtggccaggca

SEQ ID NO: 772797 - DNA, 25 bp, Mus musculus
tagatgactcatgtgtggccaggca

SEQ ID NO: 772798 - DNA, 25 bp, Mus musculus
tagatgactcttctgcctagggatt

SEQ ID NO: 772799 - DNA, 25 bp, Mus musculus
tagatgactcttgtgcctagggatt

SEQ ID NO: 772800 - DNA, 25 bp, Mus musculus
tagatgactgacaacccaagatcac

SEQ ID NO: 772801 - DNA, 25 bp, Mus musculus
tagatgactgactacccaagatcac

SEQ ID NO: 772802 - DNA, 25 bp, Mus musculus
tagatgagaaaaccccgtccgtggt

SEQ ID NO: 772803 - DNA, 25 bp, Mus musculus
tagatgagaaaagcccgtccgtggt

SEQ ID NO: 772804 - DNA, 25 bp, Mus musculus
tagatgagaagaccttcgacaccga

SEQ ID NO: 772805 - DNA, 25 bp, Mus musculus
tagatgagaagagcttcgacaccga

SEQ ID NO: 772806 - DNA, 25 bp, Mus musculus
tagatgagatccattactgacacct

SEQ ID NO: 772807 - DNA, 25 bp, Mus musculus
tagatgagatcctttactgacacct

SEQ ID NO: 772808 - DNA, 25 bp, Mus musculus
tagatgaggactatgagcaccccgt

SEQ ID NO: 772809 - DNA, 25 bp, Mus musculus
tagatgaggactttgagcaccccgt

SEQ ID NO: 772810 - DNA, 25 bp, Mus musculus
tagatgaggcccctgccattgtggc

SEQ ID NO: 772811 - DNA, 25 bp, Mus musculus
tagatgaggcccctggtagtgattc

SEQ ID NO: 772812 - DNA, 25 bp, Mus musculus
tagatgaggcccgtgccattgtggc

SEQ ID NO: 772813 - DNA, 25 bp, Mus musculus
tagatgaggcccgtggtagtgattc

SEQ ID NO: 772814 - DNA, 25 bp, Mus musculus
tagatgatagacagaactgggcttt

SEQ ID NO: 772815 - DNA, 25 bp, Mus musculus
tagatgatagactgaactgggcttt

SEQ ID NO: 772816 - DNA, 25 bp, Mus musculus
tagatgatagctattttgatacttc

SEQ ID NO: 772817 - DNA, 25 bp, Mus musculus
tagatgatagcttttttgatacttc

SEQ ID NO: 772818 - DNA, 25 bp, Mus musculus
tagatgatctatatttctcccatga

SEQ ID NO: 772819 - DNA, 25 bp, Mus musculus
tagatgatctatttttctcccatga

SEQ ID NO: 772820 - DNA, 25 bp, Mus musculus
tagatgatgaagctcccagtggtat

SEQ ID NO: 772821 - DNA, 25 bp, Mus musculus
tagatgatgaaggtcccagtggtat

SEQ ID NO: 772822 - DNA, 25 bp, Mus musculus
tagatgatgtatactgtttcccctt

SEQ ID NO: 772823 - DNA, 25 bp, Mus musculus
tagatgatgtattctgtttcccctt

SEQ ID NO: 772824 - DNA, 25 bp, Mus musculus
tagatgcaaagacgccttagcctaa

SEQ ID NO: 772825 - DNA, 25 bp, Mus musculus
tagatgcaaagaggccttagcctaa

SEQ ID NO: 772826 - DNA, 25 bp, Mus musculus
tagatgcaactccattccagaagtg

SEQ ID NO: 772827 - DNA, 25 bp, Mus musculus
tagatgcaactcgattccagaagtg

SEQ ID NO: 772828 - DNA, 25 bp, Mus musculus
tagatgcacttgaaactggttaatt

SEQ ID NO: 772829 - DNA, 25 bp, Mus musculus
tagatgcacttgtaactggttaatt

SEQ ID NO: 772830 - DNA, 25 bp, Mus musculus
tagatgcaggcacttgccaccgggt

SEQ ID NO: 772831 - DNA, 25 bp, Mus musculus
tagatgcaggcagttgccaccgggt

SEQ ID NO: 772832 - DNA, 25 bp, Mus musculus
tagatgcagtcgcatggctttcatg

SEQ ID NO: 772833 - DNA, 25 bp, Mus musculus
tagatgcagtcggatggctttcatg

SEQ ID NO: 772834 - DNA, 25 bp, Mus musculus
tagatgcagtctctgtccagtccac

SEQ ID NO: 772835 - DNA, 25 bp, Mus musculus
tagatgcagtctgtgtccagtccac

SEQ ID NO: 772836 - DNA, 25 bp, Mus musculus
tagatgccatctcggcctgaagatc

SEQ ID NO: 772837 - DNA, 25 bp, Mus musculus
tagatgccatctgggcctgaagatc

SEQ ID NO: 772838 - DNA, 25 bp, Mus musculus
tagatgcccagaactacgtcgtagt

SEQ ID NO: 772839 - DNA, 25 bp, Mus musculus
tagatgcccagacggactgctgtcc

SEQ ID NO: 772840 - DNA, 25 bp, Mus musculus
tagatgcccagagggactgctgtcc

SEQ ID NO: 772841 - DNA, 25 bp, Mus musculus
tagatgcccagatctacgtcgtagt

SEQ ID NO: 772842 - DNA, 25 bp, Mus musculus
tagatgcccgtcatgcccatcttgc

SEQ ID NO: 772843 - DNA, 25 bp, Mus musculus
tagatgcccgtcttgcccatcttgc

SEQ ID NO: 772844 - DNA, 25 bp, Mus musculus
tagatgcccttgctgaggcctttct

SEQ ID NO: 772845 - DNA, 25 bp, Mus musculus
tagatgcccttggtgaggcctttct

SEQ ID NO: 772846 - DNA, 25 bp, Mus musculus
tagatgcctagccagtcttcttgtc

SEQ ID NO: 772847 - DNA, 25 bp, Mus musculus
tagatgcctagcgagtcttcttgtc

SEQ ID NO: 772848 - DNA, 25 bp, Mus musculus
tagatgcctatgagaggcgcctcgt

SEQ ID NO: 772849 - DNA, 25 bp, Mus musculus
tagatgcctatgtgaggcgcctcgt

SEQ ID NO: 772850 - DNA, 25 bp, Mus musculus
tagatgccttttcagcctcttaact

SEQ ID NO: 772851 - DNA, 25 bp, Mus musculus
tagatgccttttgagcctcttaact

SEQ ID NO: 772852 - DNA, 25 bp, Mus musculus
tagatgcgagaccttggttttccca

SEQ ID NO: 772853 - DNA, 25 bp, Mus musculus
tagatgcgagacgttggttttccca

SEQ ID NO: 772854 - DNA, 25 bp, Mus musculus
tagatgctaactaagctctctgaga

SEQ ID NO: 772855 - DNA, 25 bp, Mus musculus
tagatgctaacttagctctctgaga

SEQ ID NO: 772856 - DNA, 25 bp, Mus musculus
tagatgctagcaatcacccattctc

SEQ ID NO: 772857 - DNA, 25 bp, Mus musculus
tagatgctagcattcacccattctc

SEQ ID NO: 772858 - DNA, 25 bp, Mus musculus
tagatgctatcactgctcaaagttc

SEQ ID NO: 772859 - DNA, 25 bp, Mus musculus
tagatgctatcagtgctcaaagttc

SEQ ID NO: 772860 - DNA, 25 bp, Mus musculus
tagatgctcaatccctagaacctgc

SEQ ID NO: 772861 - DNA, 25 bp, Mus musculus
tagatgctcaatgcctagaacctgc

SEQ ID NO: 772862 - DNA, 25 bp, Mus musculus
tagatgctcattccttcccattaga

SEQ ID NO: 772863 - DNA, 25 bp, Mus musculus
tagatgctcattgcttcccattaga

SEQ ID NO: 772864 - DNA, 25 bp, Mus musculus
tagatgctccataccagtttgttca

SEQ ID NO: 772865 - DNA, 25 bp, Mus musculus
tagatgctccattccagtttgttca

SEQ ID NO: 772866 - DNA, 25 bp, Mus musculus
tagatgctctgaacagcttcgtggt

SEQ ID NO: 772867 - DNA, 25 bp, Mus musculus
tagatgctctgatcagcttcgtggt

SEQ ID NO: 772868 - DNA, 25 bp, Mus musculus
tagatgctcttgaagcccttggcat

SEQ ID NO: 772869 - DNA, 25 bp, Mus musculus
tagatgctcttgtagcccttggcat

SEQ ID NO: 772870 - DNA, 25 bp, Mus musculus
tagatgctgggaattaagtgaacac

SEQ ID NO: 772871 - DNA, 25 bp, Mus musculus
tagatgctgggatttaagtgaacac

SEQ ID NO: 772872 - DNA, 25 bp, Mus musculus
tagatgctggtcatgcacggttgcc

SEQ ID NO: 772873 - DNA, 25 bp, Mus musculus
tagatgctggtcttgcacggttgcc

SEQ ID NO: 772874 - DNA, 25 bp, Mus musculus
tagatgctttaaacaccgaggatgc

SEQ ID NO: 772875 - DNA, 25 bp, Mus musculus
tagatgctttaatcaccgaggatgc

SEQ ID NO: 772876 - DNA, 25 bp, Mus musculus
tagatggacacaaagctcaaggaac

SEQ ID NO: 772877 - DNA, 25 bp, Mus musculus
tagatggacacatagctcaaggaac

SEQ ID NO: 772878 - DNA, 25 bp, Mus musculus
tagatggacactcatgctccccaga

SEQ ID NO: 772879 - DNA, 25 bp, Mus musculus
tagatggacactgatgctccccaga

SEQ ID NO: 772880 - DNA, 25 bp, Mus musculus
tagatggaccttccaggatttattg

SEQ ID NO: 772881 - DNA, 25 bp, Mus musculus
tagatggaccttgcaggatttattg

SEQ ID NO: 772882 - DNA, 25 bp, Mus musculus
tagatggagggacggtctctctctc

SEQ ID NO: 772883 - DNA, 25 bp, Mus musculus
tagatggagggagggtctctctctc

SEQ ID NO: 772884 - DNA, 25 bp, Mus musculus
tagatggatattaccttgccctgtt

SEQ ID NO: 772885 - DNA, 25 bp, Mus musculus
tagatggatattcgtcaccctcttg

SEQ ID NO: 772886 - DNA, 25 bp, Mus musculus
tagatggatattggtcaccctcttg

SEQ ID NO: 772887 - DNA, 25 bp, Mus musculus
tagatggatatttccttgccctgtt

SEQ ID NO: 772888 - DNA, 25 bp, Mus musculus
tagatggatggtcctttctgtggaa

SEQ ID NO: 772889 - DNA, 25 bp, Mus musculus
tagatggatggtgctttctgtggaa

SEQ ID NO: 772890 - DNA, 25 bp, Mus musculus
tagatggcccttctgccaagactct

SEQ ID NO: 772891 - DNA, 25 bp, Mus musculus
tagatggcccttgtgccaagactct

SEQ ID NO: 772892 - DNA, 25 bp, Mus musculus
tagatggcctgactcttgctgttgc

SEQ ID NO: 772893 - DNA, 25 bp, Mus musculus
tagatggcctgagtcttgctgttgc

SEQ ID NO: 772894 - DNA, 25 bp, Mus musculus
tagatggcctggatggctcacctgc

SEQ ID NO: 772895 - DNA, 25 bp, Mus musculus
tagatggcctggttggctcacctgc

SEQ ID NO: 772896 - DNA, 25 bp, Mus musculus
tagatggcgaataccagtcggcctc

SEQ ID NO: 772897 - DNA, 25 bp, Mus musculus
tagatggcgaattccagtcggcctc

SEQ ID NO: 772898 - DNA, 25 bp, Mus musculus
tagatggcgacaaatgtaccacatt

SEQ ID NO: 772899 - DNA, 25 bp, Mus musculus
tagatggcgacatatgtaccacatt

SEQ ID NO: 772900 - DNA, 25 bp, Mus musculus
tagatggcgccaagactcactcctg

SEQ ID NO: 772901 - DNA, 25 bp, Mus musculus
tagatggcgccatgactcactcctg

SEQ ID NO: 772902 - DNA, 25 bp, Mus musculus
tagatggcgccccaccaggtgagta

SEQ ID NO: 772903 - DNA, 25 bp, Mus musculus
tagatggcgcccgaccaggtgagta

SEQ ID NO: 772904 - DNA, 25 bp, Mus musculus
tagatggctgtgaagggacccgaac

SEQ ID NO: 772905 - DNA, 25 bp, Mus musculus
tagatggctgtgtagggacccgaac

SEQ ID NO: 772906 - DNA, 25 bp, Mus musculus
tagatggcttatattgcattcatgc

SEQ ID NO: 772907 - DNA, 25 bp, Mus musculus
tagatggcttattttgcattcatgc

SEQ ID NO: 772908 - DNA, 25 bp, Mus musculus
tagatgggaaacctcgtcacaaaga

SEQ ID NO: 772909 - DNA, 25 bp, Mus musculus
tagatgggaaacgtcgtcacaaaga

SEQ ID NO: 772910 - DNA, 25 bp, Mus musculus
tagatgggattgcatgttttcagtt

SEQ ID NO: 772911 - DNA, 25 bp, Mus musculus
tagatgggattggatgttttcagtt

SEQ ID NO: 772912 - DNA, 25 bp, Mus musculus
tagatgggctgcaaccgctggtgaa

SEQ ID NO: 772913 - DNA, 25 bp, Mus musculus
tagatgggctgctaccgctggtgaa

SEQ ID NO: 772914 - DNA, 25 bp, Mus musculus
tagatgggcttgcacctcagtcgat

SEQ ID NO: 772915 - DNA, 25 bp, Mus musculus
tagatgggcttggacctcagtcgat

SEQ ID NO: 772916 - DNA, 25 bp, Mus musculus
tagatgggtctgaatattggctccc

SEQ ID NO: 772917 - DNA, 25 bp, Mus musculus
tagatgggtctgtatattggctccc

SEQ ID NO: 772918 - DNA, 25 bp, Mus musculus
tagatgggtcttctaggccaggtct

SEQ ID NO: 772919 - DNA, 25 bp, Mus musculus
tagatgggtcttgtaggccaggtct

SEQ ID NO: 772920 - DNA, 25 bp, Mus musculus
tagatggtagtgcacttgcctagca

SEQ ID NO: 772921 - DNA, 25 bp, Mus musculus
tagatggtagtggacttgcctagca

SEQ ID NO: 772922 - DNA, 25 bp, Mus musculus
tagatggtccacacagacccttgag

SEQ ID NO: 772923 - DNA, 25 bp, Mus musculus
tagatggtccactcagacccttgag

SEQ ID NO: 772924 - DNA, 25 bp, Mus musculus
tagatggtgcccaggcccattgcca

SEQ ID NO: 772925 - DNA, 25 bp, Mus musculus
tagatggtgccctggcccattgcca

SEQ ID NO: 772926 - DNA, 25 bp, Mus musculus
tagatggtggccattcgccagcaga

SEQ ID NO: 772927 - DNA, 25 bp, Mus musculus
tagatggtggcctttcgccagcaga

SEQ ID NO: 772928 - DNA, 25 bp, Mus musculus
tagatgtacactctgtaaccgttag

SEQ ID NO: 772929 - DNA, 25 bp, Mus musculus
tagatgtacactgtgtaaccgttag

SEQ ID NO: 772930 - DNA, 25 bp, Mus musculus
tagatgtaccttatcaactcagtgg

SEQ ID NO: 772931 - DNA, 25 bp, Mus musculus
tagatgtaccttttcaactcagtgg

SEQ ID NO: 772932 - DNA, 25 bp, Mus musculus
tagatgtagactcacttcctgcatg

SEQ ID NO: 772933 - DNA, 25 bp, Mus musculus
tagatgtagactgacttcctgcatg

SEQ ID NO: 772934 - DNA, 25 bp, Mus musculus
tagatgtaggcacattccaacgact

SEQ ID NO: 772935 - DNA, 25 bp, Mus musculus
tagatgtaggcagattccaacgact

SEQ ID NO: 772936 - DNA, 25 bp, Mus musculus
tagatgtatctcagccttaacagaa

SEQ ID NO: 772937 - DNA, 25 bp, Mus musculus
tagatgtatctctgccttaacagaa

SEQ ID NO: 772938 - DNA, 25 bp, Mus musculus
tagatgtatgctctgcaggcctggt

SEQ ID NO: 772939 - DNA, 25 bp, Mus musculus
tagatgtatgctgtgcaggcctggt

SEQ ID NO: 772940 - DNA, 25 bp, Mus musculus
tagatgtatgtacatgccccgaccc

SEQ ID NO: 772941 - DNA, 25 bp, Mus musculus
tagatgtatgtagatgccccgaccc

SEQ ID NO: 772942 - DNA, 25 bp, Mus musculus
tagatgtcaagacttggctgccctc

SEQ ID NO: 772943 - DNA, 25 bp, Mus musculus
tagatgtcaagagttggctgccctc

SEQ ID NO: 772944 - DNA, 25 bp, Mus musculus
tagatgtcagcaatggtcctgtcct

SEQ ID NO: 772945 - DNA, 25 bp, Mus musculus
tagatgtcagcattggtcctgtcct

SEQ ID NO: 772946 - DNA, 25 bp, Mus musculus
tagatgtccagccttggccaagtca

SEQ ID NO: 772947 - DNA, 25 bp, Mus musculus
tagatgtccagcgttggccaagtca

SEQ ID NO: 772948 - DNA, 25 bp, Mus musculus
tagatgtcccctcaccaattccata

SEQ ID NO: 772949 - DNA, 25 bp, Mus musculus
tagatgtcccctgaccaattccata

SEQ ID NO: 772950 - DNA, 25 bp, Mus musculus
tagatgtgaaggcatgccctctgtt

SEQ ID NO: 772951 - DNA, 25 bp, Mus musculus
tagatgtgaagggatgccctctgtt

SEQ ID NO: 772952 - DNA, 25 bp, Mus musculus
tagatgtgcatcatctgcttcttcc

SEQ ID NO: 772953 - DNA, 25 bp, Mus musculus
tagatgtgcatcttctgcttcttcc

SEQ ID NO: 772954 - DNA, 25 bp, Mus musculus
tagatgtgccgaatgtgacaaatct

SEQ ID NO: 772955 - DNA, 25 bp, Mus musculus
tagatgtgccgattgtgacaaatct

SEQ ID NO: 772956 - DNA, 25 bp, Mus musculus
tagatgtgctgtctttcataagaac

SEQ ID NO: 772957 - DNA, 25 bp, Mus musculus
tagatgtgctgtgtttcataagaac

SEQ ID NO: 772958 - DNA, 25 bp, Mus musculus
tagatgtggccaactgggtcggcac

SEQ ID NO: 772959 - DNA, 25 bp, Mus musculus
tagatgtggccatctgggtcggcac

SEQ ID NO: 772960 - DNA, 25 bp, Mus musculus
tagatgtgggccattttcctgaaca

SEQ ID NO: 772961 - DNA, 25 bp, Mus musculus
tagatgtgggcctttttcctgaaca

SEQ ID NO: 772962 - DNA, 25 bp, Mus musculus
tagatgtgggtcatctgctgatctt

SEQ ID NO: 772963 - DNA, 25 bp, Mus musculus
tagatgtgggtcttctgctgatctt

SEQ ID NO: 772964 - DNA, 25 bp, Mus musculus
tagatgtggtgaacctcagaatggc

SEQ ID NO: 772965 - DNA, 25 bp, Mus musculus
tagatgtggtgatcctcagaatggc

SEQ ID NO: 772966 - DNA, 25 bp, Mus musculus
tagatgtgtacaatggatgctggtg

SEQ ID NO: 772967 - DNA, 25 bp, Mus musculus
tagatgtgtacattggatgctggtg

SEQ ID NO: 772968 - DNA, 25 bp, Mus musculus
tagatgttacacagcatccatcccc

SEQ ID NO: 772969 - DNA, 25 bp, Mus musculus
tagatgttacactgcatccatcccc

SEQ ID NO: 772970 - DNA, 25 bp, Mus musculus
tagatgttcacaccctctctgatgg

SEQ ID NO: 772971 - DNA, 25 bp, Mus musculus
tagatgttcacagcctctctgatgg

SEQ ID NO: 772972 - DNA, 25 bp, Mus musculus
tagatgttcagaacgcttccagtgt

SEQ ID NO: 772973 - DNA, 25 bp, Mus musculus
tagatgttcagatcgcttccagtgt

SEQ ID NO: 772974 - DNA, 25 bp, Mus musculus
tagatgttcattacacttgagttaa

SEQ ID NO: 772975 - DNA, 25 bp, Mus musculus
tagatgttcatttcacttgagttaa

SEQ ID NO: 772976 - DNA, 25 bp, Mus musculus
tagatgttgctacctctgccaactt

SEQ ID NO: 772977 - DNA, 25 bp, Mus musculus
tagatgttgctagctctgccaactt

SEQ ID NO: 772978 - DNA, 25 bp, Mus musculus
tagatgttggtaagacgactgggca

SEQ ID NO: 772979 - DNA, 25 bp, Mus musculus
tagatgttggtatgacgactgggca

SEQ ID NO: 772980 - DNA, 25 bp, Mus musculus
tagatgttgtccacggtgcggctcc

SEQ ID NO: 772981 - DNA, 25 bp, Mus musculus
tagatgttgtcctcggtgcggctcc

SEQ ID NO: 772982 - DNA, 25 bp, Mus musculus
tagatgtttctgattgctaatcctg

SEQ ID NO: 772983 - DNA, 25 bp, Mus musculus
tagatgtttctgctttctcttttaa

SEQ ID NO: 772984 - DNA, 25 bp, Mus musculus
tagatgtttctggtttctcttttaa

SEQ ID NO: 772985 - DNA, 25 bp, Mus musculus
tagatgtttctgtttgctaatcctg

SEQ ID NO: 772986 - DNA, 25 bp, Mus musculus
tagatgttttagacaccttaccgta

SEQ ID NO: 772987 - DNA, 25 bp, Mus musculus
tagatgttttagtcaccttaccgta

SEQ ID NO: 772988 - DNA, 25 bp, Mus musculus
tagattaaacctcaagtgctccctt

SEQ ID NO: 772989 - DNA, 25 bp, Mus musculus
tagattaaacctgaagtgctccctt

SEQ ID NO: 772990 - DNA, 25 bp, Mus musculus
tagattaaacgtatgttcttttctg

SEQ ID NO: 772991 - DNA, 25 bp, Mus musculus
tagattaaacgtttgttcttttctg

SEQ ID NO: 772992 - DNA, 25 bp, Mus musculus
tagattaagcccaactgtcgtctgc

SEQ ID NO: 772993 - DNA, 25 bp, Mus musculus
tagattaagccctactgtcgtctgc

SEQ ID NO: 772994 - DNA, 25 bp, Mus musculus
tagattacatatatacagcagggat

SEQ ID NO: 772995 - DNA, 25 bp, Mus musculus
tagattacatatttacagcagggat

SEQ ID NO: 772996 - DNA, 25 bp, Mus musculus
tagattaccttgagatccagctcct

SEQ ID NO: 772997 - DNA, 25 bp, Mus musculus
tagattaccttgtgatccagctcct

SEQ ID NO: 772998 - DNA, 25 bp, Mus musculus
tagattacgttaactctcaaacaga

SEQ ID NO: 772999 - DNA, 25 bp, Mus musculus
tagattacgttatctctcaaacaga

SEQ ID NO: 773000 - DNA, 25 bp, Mus musculus
tagattactgatctgcagccccaga

SEQ ID NO: 773001 - DNA, 25 bp, Mus musculus
tagattactgatgtgcagccccaga

SEQ ID NO: 773002 - DNA, 25 bp, Mus musculus
tagattagaggtactcctccaggcc

SEQ ID NO: 773003 - DNA, 25 bp, Mus musculus
tagattagaggttctcctccaggcc

SEQ ID NO: 773004 - DNA, 25 bp, Mus musculus
tagattagatccactacactgccct

SEQ ID NO: 773005 - DNA, 25 bp, Mus musculus
tagattagatcctctacactgccct

SEQ ID NO: 773006 - DNA, 25 bp, Mus musculus
tagattagctacataccaggactgt

SEQ ID NO: 773007 - DNA, 25 bp, Mus musculus
tagattagctacttaccaggactgt

SEQ ID NO: 773008 - DNA, 25 bp, Mus musculus
tagattatatttccagtgacccaga

SEQ ID NO: 773009 - DNA, 25 bp, Mus musculus
tagattatatttgcagtgacccaga

SEQ ID NO: 773010 - DNA, 25 bp, Mus musculus
tagattatggccatcatcttcctca

SEQ ID NO: 773011 - DNA, 25 bp, Mus musculus
tagattatggccttcatcttcctca

SEQ ID NO: 773012 - DNA, 25 bp, Mus musculus
tagattatgtaaaagctcaccaagc

SEQ ID NO: 773013 - DNA, 25 bp, Mus musculus
tagattatgtaatagctcaccaagc

SEQ ID NO: 773014 - DNA, 25 bp, Mus musculus
tagattatttatccggcttcccatt

SEQ ID NO: 773015 - DNA, 25 bp, Mus musculus
tagattatttatgcggcttcccatt

SEQ ID NO: 773016 - DNA, 25 bp, Mus musculus
tagattcaatgaaacctcagtgcaa

SEQ ID NO: 773017 - DNA, 25 bp, Mus musculus
tagattcaatgatacctcagtgcaa

SEQ ID NO: 773018 - DNA, 25 bp, Mus musculus
tagattcaatgcaattgccaacccc

SEQ ID NO: 773019 - DNA, 25 bp, Mus musculus
tagattcaatgctattgccaacccc

SEQ ID NO: 773020 - DNA, 25 bp, Mus musculus
tagattcacactctacacaccattt

SEQ ID NO: 773021 - DNA, 25 bp, Mus musculus
tagattcacactgtacacaccattt

SEQ ID NO: 773022 - DNA, 25 bp, Mus musculus
tagattcaccttctgttcttacaat

SEQ ID NO: 773023 - DNA, 25 bp, Mus musculus
tagattcaccttgtgttcttacaat

SEQ ID NO: 773024 - DNA, 25 bp, Mus musculus
tagattcactcactaactggaagga

SEQ ID NO: 773025 - DNA, 25 bp, Mus musculus
tagattcactcagtaactggaagga

SEQ ID NO: 773026 - DNA, 25 bp, Mus musculus
tagattcagaccctgaagtgctcac

SEQ ID NO: 773027 - DNA, 25 bp, Mus musculus
tagattcagaccgtgaagtgctcac

SEQ ID NO: 773028 - DNA, 25 bp, Mus musculus
tagattcaggacagcgccttacact

SEQ ID NO: 773029 - DNA, 25 bp, Mus musculus
tagattcaggactgcgccttacact

SEQ ID NO: 773030 - DNA, 25 bp, Mus musculus
tagattcataccagtgcatgaaaat

SEQ ID NO: 773031 - DNA, 25 bp, Mus musculus
tagattcatacctgtgcatgaaaat

SEQ ID NO: 773032 - DNA, 25 bp, Mus musculus
tagattcatggtactccagagtcat

SEQ ID NO: 773033 - DNA, 25 bp, Mus musculus
tagattcatggttctccagagtcat

SEQ ID NO: 773034 - DNA, 25 bp, Mus musculus
tagattccacccaagcactgcttaa

SEQ ID NO: 773035 - DNA, 25 bp, Mus musculus
tagattccaccctagcactgcttaa

SEQ ID NO: 773036 - DNA, 25 bp, Mus musculus
tagattccaggcctggaccaccact

SEQ ID NO: 773037 - DNA, 25 bp, Mus musculus
tagattccaggcgtggaccaccact

SEQ ID NO: 773038 - DNA, 25 bp, Mus musculus
tagattccatccaggctgctcctgt

SEQ ID NO: 773039 - DNA, 25 bp, Mus musculus
tagattccatcctggctgctcctgt

SEQ ID NO: 773040 - DNA, 25 bp, Mus musculus
tagattcccctaatgttactaacaa

SEQ ID NO: 773041 - DNA, 25 bp, Mus musculus
tagattcccctattgttactaacaa

SEQ ID NO: 773042 - DNA, 25 bp, Mus musculus
tagattccccttagctctgcagtac

SEQ ID NO: 773043 - DNA, 25 bp, Mus musculus
tagattcccctttgctctgcagtac

SEQ ID NO: 773044 - DNA, 25 bp, Mus musculus
tagattccctatctaacttctcacc

SEQ ID NO: 773045 - DNA, 25 bp, Mus musculus
tagattccctatgtaacttctcacc

SEQ ID NO: 773046 - DNA, 25 bp, Mus musculus
tagattcctacaactttggtttaag

SEQ ID NO: 773047 - DNA, 25 bp, Mus musculus
tagattcctacatctttggtttaag

SEQ ID NO: 773048 - DNA, 25 bp, Mus musculus
tagattcctatcaaacatactcatt

SEQ ID NO: 773049 - DNA, 25 bp, Mus musculus
tagattcctatctaacatactcatt

SEQ ID NO: 773050 - DNA, 25 bp, Mus musculus
tagattcctcctccttgatgtggga

SEQ ID NO: 773051 - DNA, 25 bp, Mus musculus
tagattcctcctgcttgatgtggga

SEQ ID NO: 773052 - DNA, 25 bp, Mus musculus
tagattcctttcactattatccggg

SEQ ID NO: 773053 - DNA, 25 bp, Mus musculus
tagattcctttctctattatccggg

SEQ ID NO: 773054 - DNA, 25 bp, Mus musculus
tagattcgtggtaggacatactgat

SEQ ID NO: 773055 - DNA, 25 bp, Mus musculus
tagattcgtggttggacatactgat

SEQ ID NO: 773056 - DNA, 25 bp, Mus musculus
tagattctacacaagccccagtctt

SEQ ID NO: 773057 - DNA, 25 bp, Mus musculus
tagattctacactagccccagtctt

SEQ ID NO: 773058 - DNA, 25 bp, Mus musculus
tagattctatccatactctctcagg

SEQ ID NO: 773059 - DNA, 25 bp, Mus musculus
tagattctatccttactctctcagg

SEQ ID NO: 773060 - DNA, 25 bp, Mus musculus
tagattctcctaccttggcagtgat

SEQ ID NO: 773061 - DNA, 25 bp, Mus musculus
tagattctcctagcttggcagtgat

SEQ ID NO: 773062 - DNA, 25 bp, Mus musculus
tagattctcttgcttacatcctgaa

SEQ ID NO: 773063 - DNA, 25 bp, Mus musculus
tagattctcttggttacatcctgaa

SEQ ID NO: 773064 - DNA, 25 bp, Mus musculus
tagattctgggcaaaccatcgtcca

SEQ ID NO: 773065 - DNA, 25 bp, Mus musculus
tagattctgggctaaccatcgtcca

SEQ ID NO: 773066 - DNA, 25 bp, Mus musculus
tagattctgtaacggttctcttgga

SEQ ID NO: 773067 - DNA, 25 bp, Mus musculus
tagattctgtaagggttctcttgga

SEQ ID NO: 773068 - DNA, 25 bp, Mus musculus
tagattctgtcacccaacctatgtg

SEQ ID NO: 773069 - DNA, 25 bp, Mus musculus
tagattctgtcagccaacctatgtg

SEQ ID NO: 773070 - DNA, 25 bp, Mus musculus
tagattctgtgcagtgtttgccatc

SEQ ID NO: 773071 - DNA, 25 bp, Mus musculus
tagattctgtgctgtgtttgccatc

SEQ ID NO: 773072 - DNA, 25 bp, Mus musculus
tagattgacaaaatgtggcttgctt

SEQ ID NO: 773073 - DNA, 25 bp, Mus musculus
tagattgacaaattgtggcttgctt

SEQ ID NO: 773074 - DNA, 25 bp, Mus musculus
tagattgagtggctcccatggtaga

SEQ ID NO: 773075 - DNA, 25 bp, Mus musculus
tagattgagtgggtcccatggtaga

SEQ ID NO: 773076 - DNA, 25 bp, Mus musculus
tagattgcagggagtctcggcactg

SEQ ID NO: 773077 - DNA, 25 bp, Mus musculus
tagattgcagggtgtctcggcactg

SEQ ID NO: 773078 - DNA, 25 bp, Mus musculus
tagattgcatttaaggctccaggag

SEQ ID NO: 773079 - DNA, 25 bp, Mus musculus
tagattgcattttaggctccaggag

SEQ ID NO: 773080 - DNA, 25 bp, Mus musculus
tagattgccaggctcatgcacgtgc

SEQ ID NO: 773081 - DNA, 25 bp, Mus musculus
tagattgccagggtcatgcacgtgc

SEQ ID NO: 773082 - DNA, 25 bp, Mus musculus
tagattgcctggagtggaatctggt

SEQ ID NO: 773083 - DNA, 25 bp, Mus musculus
tagattgcctggtgtggaatctggt

SEQ ID NO: 773084 - DNA, 25 bp, Mus musculus
tagattggacatatacggataatat

SEQ ID NO: 773085 - DNA, 25 bp, Mus musculus
tagattggacatttacggataatat

SEQ ID NO: 773086 - DNA, 25 bp, Mus musculus
tagattggagtgctgcccagccata

SEQ ID NO: 773087 - DNA, 25 bp, Mus musculus
tagattggagtggtgcccagccata

SEQ ID NO: 773088 - DNA, 25 bp, Mus musculus
tagattggatctattaaaactgaat

SEQ ID NO: 773089 - DNA, 25 bp, Mus musculus
tagattggatcttttaaaactgaat

SEQ ID NO: 773090 - DNA, 25 bp, Mus musculus
tagattggcctgagaggaccctcag

SEQ ID NO: 773091 - DNA, 25 bp, Mus musculus
tagattggcctgattgtatcaaaaa

SEQ ID NO: 773092 - DNA, 25 bp, Mus musculus
tagattggcctgtgaggaccctcag

SEQ ID NO: 773093 - DNA, 25 bp, Mus musculus
tagattggcctgtttgtatcaaaaa

SEQ ID NO: 773094 - DNA, 25 bp, Mus musculus
tagattgggcacacacattcctgtg

SEQ ID NO: 773095 - DNA, 25 bp, Mus musculus
tagattgggcactcacattcctgtg

SEQ ID NO: 773096 - DNA, 25 bp, Mus musculus
tagattggtaagatggccgccactc

SEQ ID NO: 773097 - DNA, 25 bp, Mus musculus
tagattggtaagttggccgccactc

SEQ ID NO: 773098 - DNA, 25 bp, Mus musculus
tagattggtcttacagtagccattt

SEQ ID NO: 773099 - DNA, 25 bp, Mus musculus
tagattggtctttcagtagccattt

SEQ ID NO: 773100 - DNA, 25 bp, Mus musculus
tagattgtagcacaaccctgagtct

SEQ ID NO: 773101 - DNA, 25 bp, Mus musculus
tagattgtagcagaaccctgagtct

SEQ ID NO: 773102 - DNA, 25 bp, Mus musculus
tagattgtcaccactgtgtgtgcgt

SEQ ID NO: 773103 - DNA, 25 bp, Mus musculus
tagattgtcacctctgtgtgtgcgt

SEQ ID NO: 773104 - DNA, 25 bp, Mus musculus
tagattgtctctctagctgctgcta

SEQ ID NO: 773105 - DNA, 25 bp, Mus musculus
tagattgtctctgtagctgctgcta

SEQ ID NO: 773106 - DNA, 25 bp, Mus musculus
tagattgtgatgacagtgctgccag

SEQ ID NO: 773107 - DNA, 25 bp, Mus musculus
tagattgtgatgtcagtgctgccag

SEQ ID NO: 773108 - DNA, 25 bp, Mus musculus
tagattgtgcctacgaagaccccgc

SEQ ID NO: 773109 - DNA, 25 bp, Mus musculus
tagattgtgccttcgaagaccccgc

SEQ ID NO: 773110 - DNA, 25 bp, Mus musculus
tagattgtgctcaggttatcaccct

SEQ ID NO: 773111 - DNA, 25 bp, Mus musculus
tagattgtgctctggttatcaccct

SEQ ID NO: 773112 - DNA, 25 bp, Mus musculus
tagattgttaccacaacgattgtcc

SEQ ID NO: 773113 - DNA, 25 bp, Mus musculus
tagattgttacctcaacgattgtcc

SEQ ID NO: 773114 - DNA, 25 bp, Mus musculus
tagattgttcatattgctttattat

SEQ ID NO: 773115 - DNA, 25 bp, Mus musculus
tagattgttcattttgctttattat

SEQ ID NO: 773116 - DNA, 25 bp, Mus musculus
tagattgttccaaatgtgatccata

SEQ ID NO: 773117 - DNA, 25 bp, Mus musculus
tagattgttccatatgtgatccata

SEQ ID NO: 773118 - DNA, 25 bp, Mus musculus
tagattgttgctccctaaatcctgt

SEQ ID NO: 773119 - DNA, 25 bp, Mus musculus
tagattgttgctgcctaaatcctgt

SEQ ID NO: 773120 - DNA, 25 bp, Mus musculus
tagatttacatcaccattcctttcg

SEQ ID NO: 773121 - DNA, 25 bp, Mus musculus
tagatttacatctccattcctttcg

SEQ ID NO: 773122 - DNA, 25 bp, Mus musculus
tagatttacattatccaaccccaca

SEQ ID NO: 773123 - DNA, 25 bp, Mus musculus
tagatttacattttccaaccccaca

SEQ ID NO: 773124 - DNA, 25 bp, Mus musculus
tagatttactcaatttggtactcag

SEQ ID NO: 773125 - DNA, 25 bp, Mus musculus
tagatttactcattttggtactcag

SEQ ID NO: 773126 - DNA, 25 bp, Mus musculus
tagatttatagcagtgacttttaca

SEQ ID NO: 773127 - DNA, 25 bp, Mus musculus
tagatttatagctgtgacttttaca

SEQ ID NO: 773128 - DNA, 25 bp, Mus musculus
tagatttatcttctagttgtttgga

SEQ ID NO: 773129 - DNA, 25 bp, Mus musculus
tagatttatcttgtagttgtttgga

SEQ ID NO: 773130 - DNA, 25 bp, Mus musculus
tagatttcacatacatgacctgatg

SEQ ID NO: 773131 - DNA, 25 bp, Mus musculus
tagatttcacattcatgacctgatg

SEQ ID NO: 773132 - DNA, 25 bp, Mus musculus
tagatttcaccgaactttctgatgg

SEQ ID NO: 773133 - DNA, 25 bp, Mus musculus
tagatttcaccgtactttctgatgg

SEQ ID NO: 773134 - DNA, 25 bp, Mus musculus
tagatttcccatacctatgacgttc

SEQ ID NO: 773135 - DNA, 25 bp, Mus musculus
tagatttcccattcctatgacgttc

SEQ ID NO: 773136 - DNA, 25 bp, Mus musculus
tagatttcctaaagcagccactggc

SEQ ID NO: 773137 - DNA, 25 bp, Mus musculus
tagatttcctaatgcagccactggc

SEQ ID NO: 773138 - DNA, 25 bp, Mus musculus
tagatttcctgtagacctacacgat

SEQ ID NO: 773139 - DNA, 25 bp, Mus musculus
tagatttcctgtatttagattcctg

SEQ ID NO: 773140 - DNA, 25 bp, Mus musculus
tagatttcctgttgacctacacgat

SEQ ID NO: 773141 - DNA, 25 bp, Mus musculus
tagatttcctgtttttagattcctg

SEQ ID NO: 773142 - DNA, 25 bp, Mus musculus
tagatttctcagagaagcaccctgt

SEQ ID NO: 773143 - DNA, 25 bp, Mus musculus
tagatttctcagtgaagcaccctgt

SEQ ID NO: 773144 - DNA, 25 bp, Mus musculus
tagatttctcttacctacccgttgc

SEQ ID NO: 773145 - DNA, 25 bp, Mus musculus
tagatttctcttcattactcccaga

SEQ ID NO: 773146 - DNA, 25 bp, Mus musculus
tagatttctcttgattactcccaga

SEQ ID NO: 773147 - DNA, 25 bp, Mus musculus
tagatttctctttcctacccgttgc

SEQ ID NO: 773148 - DNA, 25 bp, Mus musculus
tagatttctgggacacattttgtgt

SEQ ID NO: 773149 - DNA, 25 bp, Mus musculus
tagatttctgggtcacattttgtgt

SEQ ID NO: 773150 - DNA, 25 bp, Mus musculus
tagatttcttgcattcctttcttcc

SEQ ID NO: 773151 - DNA, 25 bp, Mus musculus
tagatttcttgctttcctttcttcc

SEQ ID NO: 773152 - DNA, 25 bp, Mus musculus
tagatttgagatccacagtaggctt

SEQ ID NO: 773153 - DNA, 25 bp, Mus musculus
tagatttgagatgcacagtaggctt

SEQ ID NO: 773154 - DNA, 25 bp, Mus musculus
tagatttgatgtcccatgctctgca

SEQ ID NO: 773155 - DNA, 25 bp, Mus musculus
tagatttgatgtgccatgctctgca

SEQ ID NO: 773156 - DNA, 25 bp, Mus musculus
tagatttgcgctctcaggactcaga

SEQ ID NO: 773157 - DNA, 25 bp, Mus musculus
tagatttgcgctgtcaggactcaga

SEQ ID NO: 773158 - DNA, 25 bp, Mus musculus
tagatttgctctacacgactactga

SEQ ID NO: 773159 - DNA, 25 bp, Mus musculus
tagatttgctctatccttggaagta

SEQ ID NO: 773160 - DNA, 25 bp, Mus musculus
tagatttgctcttcacgactactga

SEQ ID NO: 773161 - DNA, 25 bp, Mus musculus
tagatttgctctttccttggaagta

SEQ ID NO: 773162 - DNA, 25 bp, Mus musculus
tagatttgctggacctgatccccaa

SEQ ID NO: 773163 - DNA, 25 bp, Mus musculus
tagatttgctggtcctgatccccaa

SEQ ID NO: 773164 - DNA, 25 bp, Mus musculus
tagatttggcacagattaccttttt

SEQ ID NO: 773165 - DNA, 25 bp, Mus musculus
tagatttggcactgattaccttttt

SEQ ID NO: 773166 - DNA, 25 bp, Mus musculus
tagatttggcccagatttccacatt

SEQ ID NO: 773167 - DNA, 25 bp, Mus musculus
tagatttggccctgatttccacatt

SEQ ID NO: 773168 - DNA, 25 bp, Mus musculus
tagatttgggtgactctctctggca

SEQ ID NO: 773169 - DNA, 25 bp, Mus musculus
tagatttgggtgtctctctctggca

SEQ ID NO: 773170 - DNA, 25 bp, Mus musculus
tagatttgggttaacctcactctat

SEQ ID NO: 773171 - DNA, 25 bp, Mus musculus
tagatttgggtttacctcactctat

SEQ ID NO: 773172 - DNA, 25 bp, Mus musculus
tagatttggtagatgcacagctgga

SEQ ID NO: 773173 - DNA, 25 bp, Mus musculus
tagatttggtagttgcacagctgga

SEQ ID NO: 773174 - DNA, 25 bp, Mus musculus
tagatttggtctaacctcatacaga

SEQ ID NO: 773175 - DNA, 25 bp, Mus musculus
tagatttggtcttacctcatacaga

SEQ ID NO: 773176 - DNA, 25 bp, Mus musculus
tagattttcaacctcctataaactt

SEQ ID NO: 773177 - DNA, 25 bp, Mus musculus
tagattttcaacgtcctataaactt

SEQ ID NO: 773178 - DNA, 25 bp, Mus musculus
tagattttccctaggtatcttccag

SEQ ID NO: 773179 - DNA, 25 bp, Mus musculus
tagattttcccttggtatcttccag

SEQ ID NO: 773180 - DNA, 25 bp, Mus musculus
tagattttcctccactctctgaagg

SEQ ID NO: 773181 - DNA, 25 bp, Mus musculus
tagattttcctcgactctctgaagg

SEQ ID NO: 773182 - DNA, 25 bp, Mus musculus
tagattttctggcatcccctgaaat

SEQ ID NO: 773183 - DNA, 25 bp, Mus musculus
tagattttctgggatcccctgaaat

SEQ ID NO: 773184 - DNA, 25 bp, Mus musculus
tagattttggttcctatcttgccaa

SEQ ID NO: 773185 - DNA, 25 bp, Mus musculus
tagattttggttgctatcttgccaa

SEQ ID NO: 773186 - DNA, 25 bp, Mus musculus
tagatttttgtaaagtgaccgtttt

SEQ ID NO: 773187 - DNA, 25 bp, Mus musculus
tagatttttgtatagtgaccgtttt

SEQ ID NO: 773188 - DNA, 25 bp, Mus musculus
tagcaaaaagcgctccgggaccaca

SEQ ID NO: 773189 - DNA, 25 bp, Mus musculus
tagcaaaaagcggtccgggaccaca

SEQ ID NO: 773190 - DNA, 25 bp, Mus musculus
tagcaaaacatcctcccatgggtct

SEQ ID NO: 773191 - DNA, 25 bp, Mus musculus
tagcaaaacatcgtcccatgggtct

SEQ ID NO: 773192 - DNA, 25 bp, Mus musculus
tagcaaaaggatactgcatctcttg

SEQ ID NO: 773193 - DNA, 25 bp, Mus musculus
tagcaaaaggattctgcatctcttg

SEQ ID NO: 773194 - DNA, 25 bp, Mus musculus
tagcaaaatcttctcgctgccttgt

SEQ ID NO: 773195 - DNA, 25 bp, Mus musculus
tagcaaaatcttgtcgctgccttgt

SEQ ID NO: 773196 - DNA, 25 bp, Mus musculus
tagcaaacaaagcacgcctcacagc

SEQ ID NO: 773197 - DNA, 25 bp, Mus musculus
tagcaaacaaaggacgcctcacagc

SEQ ID NO: 773198 - DNA, 25 bp, Mus musculus
tagcaaacatctaattggcaacatg

SEQ ID NO: 773199 - DNA, 25 bp, Mus musculus
tagcaaacatctctcagtacggaaa

SEQ ID NO: 773200 - DNA, 25 bp, Mus musculus
tagcaaacatctgtcagtacggaaa

SEQ ID NO: 773201 - DNA, 25 bp, Mus musculus
tagcaaacatcttattggcaacatg

SEQ ID NO: 773202 - DNA, 25 bp, Mus musculus
tagcaaaccataagagcttgactct

SEQ ID NO: 773203 - DNA, 25 bp, Mus musculus
tagcaaaccatatgagcttgactct

SEQ ID NO: 773204 - DNA, 25 bp, Mus musculus
tagcaaacctgcatttctgcatctg

SEQ ID NO: 773205 - DNA, 25 bp, Mus musculus
tagcaaacctgcttttctgcatctg

SEQ ID NO: 773206 - DNA, 25 bp, Mus musculus
tagcaaaccttgacttttccaagag

SEQ ID NO: 773207 - DNA, 25 bp, Mus musculus
tagcaaaccttgtcttttccaagag

SEQ ID NO: 773208 - DNA, 25 bp, Mus musculus
tagcaaacgaagctttgcccgcaca

SEQ ID NO: 773209 - DNA, 25 bp, Mus musculus
tagcaaacgaaggtttgcccgcaca

SEQ ID NO: 773210 - DNA, 25 bp, Mus musculus
tagcaaactaacctagggcatctta

SEQ ID NO: 773211 - DNA, 25 bp, Mus musculus
tagcaaactaacgtagggcatctta

SEQ ID NO: 773212 - DNA, 25 bp, Mus musculus
tagcaaacttgtacccaaataacag

SEQ ID NO: 773213 - DNA, 25 bp, Mus musculus
tagcaaacttgttcccaaataacag

SEQ ID NO: 773214 - DNA, 25 bp, Mus musculus
tagcaaagatctagggctggagcat

SEQ ID NO: 773215 - DNA, 25 bp, Mus musculus
tagcaaagatcttgggctggagcat

SEQ ID NO: 773216 - DNA, 25 bp, Mus musculus
tagcaaagctcacggccagtgtgac

SEQ ID NO: 773217 - DNA, 25 bp, Mus musculus
tagcaaagctcagggccagtgtgac

SEQ ID NO: 773218 - DNA, 25 bp, Mus musculus
tagcaaaggtatctttttccagtaa

SEQ ID NO: 773219 - DNA, 25 bp, Mus musculus
tagcaaaggtatgtttttccagtaa

SEQ ID NO: 773220 - DNA, 25 bp, Mus musculus
tagcaaagtctcaatgtggatcccc

SEQ ID NO: 773221 - DNA, 25 bp, Mus musculus
tagcaaagtctctatgtggatcccc

SEQ ID NO: 773222 - DNA, 25 bp, Mus musculus
tagcaaagttaacatcctttttctt

SEQ ID NO: 773223 - DNA, 25 bp, Mus musculus
tagcaaagttaagatcctttttctt

SEQ ID NO: 773224 - DNA, 25 bp, Mus musculus
tagcaaatctttcgcaccagaccat

SEQ ID NO: 773225 - DNA, 25 bp, Mus musculus
tagcaaatctttggcaccagaccat

SEQ ID NO: 773226 - DNA, 25 bp, Mus musculus
tagcaaatgcaacctggactgagga

SEQ ID NO: 773227 - DNA, 25 bp, Mus musculus
tagcaaatgcaagctggactgagga

SEQ ID NO: 773228 - DNA, 25 bp, Mus musculus
tagcaaatgcttactatatctcttg

SEQ ID NO: 773229 - DNA, 25 bp, Mus musculus
tagcaaatgctttctatatctcttg

SEQ ID NO: 773230 - DNA, 25 bp, Mus musculus
tagcaaatggagaagtctccacata

SEQ ID NO: 773231 - DNA, 25 bp, Mus musculus
tagcaaatggagtagtctccacata

SEQ ID NO: 773232 - DNA, 25 bp, Mus musculus
tagcaaatttaaccacactccgaaa

SEQ ID NO: 773233 - DNA, 25 bp, Mus musculus
tagcaaatttaagcacactccgaaa

SEQ ID NO: 773234 - DNA, 25 bp, Mus musculus
tagcaacaacctcaacacttctcat

SEQ ID NO: 773235 - DNA, 25 bp, Mus musculus
tagcaacaacctgaacacttctcat

SEQ ID NO: 773236 - DNA, 25 bp, Mus musculus
tagcaacaagacacagggtgcccaa

SEQ ID NO: 773237 - DNA, 25 bp, Mus musculus
tagcaacaagactcagggtgcccaa

SEQ ID NO: 773238 - DNA, 25 bp, Mus musculus
tagcaacacttaacttcagagagac

SEQ ID NO: 773239 - DNA, 25 bp, Mus musculus
tagcaacacttatcttcagagagac

SEQ ID NO: 773240 - DNA, 25 bp, Mus musculus
tagcaacagcaactgtcctcatctg

SEQ ID NO: 773241 - DNA, 25 bp, Mus musculus
tagcaacagcaagtgtcctcatctg

SEQ ID NO: 773242 - DNA, 25 bp, Mus musculus
tagcaacagccaaagcaaagcttag

SEQ ID NO: 773243 - DNA, 25 bp, Mus musculus
tagcaacagccatagcaaagcttag

SEQ ID NO: 773244 - DNA, 25 bp, Mus musculus
tagcaacagtaaaatggacaacagt

SEQ ID NO: 773245 - DNA, 25 bp, Mus musculus
tagcaacagtaatatggacaacagt

SEQ ID NO: 773246 - DNA, 25 bp, Mus musculus
tagcaacatgcaatcggtcatcaag

SEQ ID NO: 773247 - DNA, 25 bp, Mus musculus
tagcaacatgcattcggtcatcaag

SEQ ID NO: 773248 - DNA, 25 bp, Mus musculus
tagcaacatggcagtccaactttcc

SEQ ID NO: 773249 - DNA, 25 bp, Mus musculus
tagcaacatggctgtccaactttcc

SEQ ID NO: 773250 - DNA, 25 bp, Mus musculus
tagcaaccaaggatgcccacatttc

SEQ ID NO: 773251 - DNA, 25 bp, Mus musculus
tagcaaccaaggttgcccacatttc

SEQ ID NO: 773252 - DNA, 25 bp, Mus musculus
tagcaaccatgtattacctaaagaa

SEQ ID NO: 773253 - DNA, 25 bp, Mus musculus
tagcaaccatgttttacctaaagaa

SEQ ID NO: 773254 - DNA, 25 bp, Mus musculus
tagcaacccaaaatagaatcccctt

SEQ ID NO: 773255 - DNA, 25 bp, Mus musculus
tagcaacccaaattagaatcccctt

SEQ ID NO: 773256 - DNA, 25 bp, Mus musculus
tagcaacccagaacaagtttacatg

SEQ ID NO: 773257 - DNA, 25 bp, Mus musculus
tagcaacccagatcaagtttacatg

SEQ ID NO: 773258 - DNA, 25 bp, Mus musculus
tagcaaccggaaagcatggtccatt

SEQ ID NO: 773259 - DNA, 25 bp, Mus musculus
tagcaaccggaatgcatggtccatt

SEQ ID NO: 773260 - DNA, 25 bp, Mus musculus
tagcaacctattcgtaaaccaggac

SEQ ID NO: 773261 - DNA, 25 bp, Mus musculus
tagcaacctattggtaaaccaggac

SEQ ID NO: 773262 - DNA, 25 bp, Mus musculus
tagcaacggaccccctactcaagat

SEQ ID NO: 773263 - DNA, 25 bp, Mus musculus
tagcaacggaccgcctactcaagat

SEQ ID NO: 773264 - DNA, 25 bp, Mus musculus
tagcaacggcttccctctctgacta

SEQ ID NO: 773265 - DNA, 25 bp, Mus musculus
tagcaacggcttgcctctctgacta

SEQ ID NO: 773266 - DNA, 25 bp, Mus musculus
tagcaactaaacatggccaccacag

SEQ ID NO: 773267 - DNA, 25 bp, Mus musculus
tagcaactaaacttggccaccacag

SEQ ID NO: 773268 - DNA, 25 bp, Mus musculus
tagcaactaccgagagcaacttcag

SEQ ID NO: 773269 - DNA, 25 bp, Mus musculus
tagcaactaccgtgagcaacttcag

SEQ ID NO: 773270 - DNA, 25 bp, Mus musculus
tagcaactcacactcaccagtaact

SEQ ID NO: 773271 - DNA, 25 bp, Mus musculus
tagcaactcacagtcaccagtaact

SEQ ID NO: 773272 - DNA, 25 bp, Mus musculus
tagcaactccttaccattagcaaaa

SEQ ID NO: 773273 - DNA, 25 bp, Mus musculus
tagcaactcctttccattagcaaaa

SEQ ID NO: 773274 - DNA, 25 bp, Mus musculus
tagcaactgcatacactcagcaagt

SEQ ID NO: 773275 - DNA, 25 bp, Mus musculus
tagcaactgcattcactcagcaagt

SEQ ID NO: 773276 - DNA, 25 bp, Mus musculus
tagcaactggagcactaaagcgaaa

SEQ ID NO: 773277 - DNA, 25 bp, Mus musculus
tagcaactggaggactaaagcgaaa

SEQ ID NO: 773278 - DNA, 25 bp, Mus musculus
tagcaactgtcgcatctcattctat

SEQ ID NO: 773279 - DNA, 25 bp, Mus musculus
tagcaactgtcggatctcattctat

SEQ ID NO: 773280 - DNA, 25 bp, Mus musculus
tagcaacttgtgaccttgctgggac

SEQ ID NO: 773281 - DNA, 25 bp, Mus musculus
tagcaacttgtgtccttgctgggac

SEQ ID NO: 773282 - DNA, 25 bp, Mus musculus
tagcaactttttacttctgtatttg

SEQ ID NO: 773283 - DNA, 25 bp, Mus musculus
tagcaacttttttcttctgtatttg

SEQ ID NO: 773284 - DNA, 25 bp, Mus musculus
tagcaagaagcgcaaagtgtccctg

SEQ ID NO: 773285 - DNA, 25 bp, Mus musculus
tagcaagaagcggaaagtgtccctg

SEQ ID NO: 773286 - DNA, 25 bp, Mus musculus
tagcaagacaacaccagcagtcggt

SEQ ID NO: 773287 - DNA, 25 bp, Mus musculus
tagcaagacaactccagcagtcggt

SEQ ID NO: 773288 - DNA, 25 bp, Mus musculus
tagcaagaccctagtcactcatcaa

SEQ ID NO: 773289 - DNA, 25 bp, Mus musculus
tagcaagacccttgtcactcatcaa

SEQ ID NO: 773290 - DNA, 25 bp, Mus musculus
tagcaagagattcaacagagaggat

SEQ ID NO: 773291 - DNA, 25 bp, Mus musculus
tagcaagagattgaacagagaggat

SEQ ID NO: 773292 - DNA, 25 bp, Mus musculus
tagcaagagcttaagttttctttaa

SEQ ID NO: 773293 - DNA, 25 bp, Mus musculus
tagcaagagctttagttttctttaa

SEQ ID NO: 773294 - DNA, 25 bp, Mus musculus
tagcaagaggtgagacaagcagcct

SEQ ID NO: 773295 - DNA, 25 bp, Mus musculus
tagcaagaggtgtgacaagcagcct

SEQ ID NO: 773296 - DNA, 25 bp, Mus musculus
tagcaagagttcagtcctttggctt

SEQ ID NO: 773297 - DNA, 25 bp, Mus musculus
tagcaagagttctgtcctttggctt

SEQ ID NO: 773298 - DNA, 25 bp, Mus musculus
tagcaagatggccaacacctctgac

SEQ ID NO: 773299 - DNA, 25 bp, Mus musculus
tagcaagatggcgaacacctctgac

SEQ ID NO: 773300 - DNA, 25 bp, Mus musculus
tagcaagattttctgcccactgagc

SEQ ID NO: 773301 - DNA, 25 bp, Mus musculus
tagcaagattttgtgcccactgagc

SEQ ID NO: 773302 - DNA, 25 bp, Mus musculus
tagcaagcacgtacacccagggaga

SEQ ID NO: 773303 - DNA, 25 bp, Mus musculus
tagcaagcacgttcacccagggaga

SEQ ID NO: 773304 - DNA, 25 bp, Mus musculus
tagcaagcagcccaggcgcttgaat

SEQ ID NO: 773305 - DNA, 25 bp, Mus musculus
tagcaagcagccgaggcgcttgaat

SEQ ID NO: 773306 - DNA, 25 bp, Mus musculus
tagcaagcatgacccctagattcca

SEQ ID NO: 773307 - DNA, 25 bp, Mus musculus
tagcaagcatgagccctagattcca

SEQ ID NO: 773308 - DNA, 25 bp, Mus musculus
tagcaagcattcagcccctgagcta

SEQ ID NO: 773309 - DNA, 25 bp, Mus musculus
tagcaagcattctgcccctgagcta

SEQ ID NO: 773310 - DNA, 25 bp, Mus musculus
tagcaagccattagagactctcctc

SEQ ID NO: 773311 - DNA, 25 bp, Mus musculus
tagcaagccatttgagactctcctc

SEQ ID NO: 773312 - DNA, 25 bp, Mus musculus
tagcaagccctgaatgtagtatttt

SEQ ID NO: 773313 - DNA, 25 bp, Mus musculus
tagcaagccctgtatgtagtatttt

SEQ ID NO: 773314 - DNA, 25 bp, Mus musculus
tagcaagcgcaacgccctgggttcg

SEQ ID NO: 773315 - DNA, 25 bp, Mus musculus
tagcaagcgcaaggccctgggttcg

SEQ ID NO: 773316 - DNA, 25 bp, Mus musculus
tagcaagcgcagctccaattcacag

SEQ ID NO: 773317 - DNA, 25 bp, Mus musculus
tagcaagcgcaggtccaattcacag

SEQ ID NO: 773318 - DNA, 25 bp, Mus musculus
tagcaagctctcacagctccgggag

SEQ ID NO: 773319 - DNA, 25 bp, Mus musculus
tagcaagctctctcagctccgggag

SEQ ID NO: 773320 - DNA, 25 bp, Mus musculus
tagcaagctgctactccaatcagag

SEQ ID NO: 773321 - DNA, 25 bp, Mus musculus
tagcaagctgcttctccaatcagag

SEQ ID NO: 773322 - DNA, 25 bp, Mus musculus
tagcaagcttgtacccagatgatcc

SEQ ID NO: 773323 - DNA, 25 bp, Mus musculus
tagcaagcttgttcccagatgatcc

SEQ ID NO: 773324 - DNA, 25 bp, Mus musculus
tagcaaggacatcgctgaatttttt

SEQ ID NO: 773325 - DNA, 25 bp, Mus musculus
tagcaaggacatggctgaatttttt

SEQ ID NO: 773326 - DNA, 25 bp, Mus musculus
tagcaaggcccgcttgagttctgat

SEQ ID NO: 773327 - DNA, 25 bp, Mus musculus
tagcaaggcccggttgagttctgat

SEQ ID NO: 773328 - DNA, 25 bp, Mus musculus
tagcaagggactctgactcatcttc

SEQ ID NO: 773329 - DNA, 25 bp, Mus musculus
tagcaagggactgtgactcatcttc

SEQ ID NO: 773330 - DNA, 25 bp, Mus musculus
tagcaagggtgtccttttgccagca

SEQ ID NO: 773331 - DNA, 25 bp, Mus musculus
tagcaagggtgtgcttttgccagca

SEQ ID NO: 773332 - DNA, 25 bp, Mus musculus
tagcaaggtcctaagagccctgcac

SEQ ID NO: 773333 - DNA, 25 bp, Mus musculus
tagcaaggtccttagagccctgcac

SEQ ID NO: 773334 - DNA, 25 bp, Mus musculus
tagcaagtacagactcacttccagc

SEQ ID NO: 773335 - DNA, 25 bp, Mus musculus
tagcaagtacagtctcacttccagc

SEQ ID NO: 773336 - DNA, 25 bp, Mus musculus
tagcaagtcctaactccagtttagc

SEQ ID NO: 773337 - DNA, 25 bp, Mus musculus
tagcaagtcctatctccagtttagc

SEQ ID NO: 773338 - DNA, 25 bp, Mus musculus
tagcaagtcctcagatgcttccatc

SEQ ID NO: 773339 - DNA, 25 bp, Mus musculus
tagcaagtcctctgatgcttccatc

SEQ ID NO: 773340 - DNA, 25 bp, Mus musculus
tagcaagtcggtcgctattccccag

SEQ ID NO: 773341 - DNA, 25 bp, Mus musculus
tagcaagtcggtggctattccccag

SEQ ID NO: 773342 - DNA, 25 bp, Mus musculus
tagcaagtgcccatggagcatctgg

SEQ ID NO: 773343 - DNA, 25 bp, Mus musculus
tagcaagtgcccttggagcatctgg

SEQ ID NO: 773344 - DNA, 25 bp, Mus musculus
tagcaagtgcctatacacaatgagc

SEQ ID NO: 773345 - DNA, 25 bp, Mus musculus
tagcaagtgcctttacacaatgagc

SEQ ID NO: 773346 - DNA, 25 bp, Mus musculus
tagcaagtggttaccgggttgttag

SEQ ID NO: 773347 - DNA, 25 bp, Mus musculus
tagcaagtggtttccgggttgttag

SEQ ID NO: 773348 - DNA, 25 bp, Mus musculus
tagcaagtgtatctgactcctccag

SEQ ID NO: 773349 - DNA, 25 bp, Mus musculus
tagcaagtgtatgtgactcctccag

SEQ ID NO: 773350 - DNA, 25 bp, Mus musculus
tagcaagtgtccctctacagcaagc

SEQ ID NO: 773351 - DNA, 25 bp, Mus musculus
tagcaagtgtccgtctacagcaagc

SEQ ID NO: 773352 - DNA, 25 bp, Mus musculus
tagcaagtgtttactgtggaacccc

SEQ ID NO: 773353 - DNA, 25 bp, Mus musculus
tagcaagtgttttctgtggaacccc

SEQ ID NO: 773354 - DNA, 25 bp, Mus musculus
tagcaagtttttccactcatgtgca

SEQ ID NO: 773355 - DNA, 25 bp, Mus musculus
tagcaagtttttgcactcatgtgca

SEQ ID NO: 773356 - DNA, 25 bp, Mus musculus
tagcaataaccaattcacatctccc

SEQ ID NO: 773357 - DNA, 25 bp, Mus musculus
tagcaataaccatttcacatctccc

SEQ ID NO: 773358 - DNA, 25 bp, Mus musculus
tagcaataggatcccactctttatg

SEQ ID NO: 773359 - DNA, 25 bp, Mus musculus
tagcaataggatgccactctttatg

SEQ ID NO: 773360 - DNA, 25 bp, Mus musculus
tagcaatatgctcgcagcttccctt

SEQ ID NO: 773361 - DNA, 25 bp, Mus musculus
tagcaatatgctggcagcttccctt

SEQ ID NO: 773362 - DNA, 25 bp, Mus musculus
tagcaatcaaaaacaatggccacag

SEQ ID NO: 773363 - DNA, 25 bp, Mus musculus
tagcaatcaaaatcaatggccacag

SEQ ID NO: 773364 - DNA, 25 bp, Mus musculus
tagcaatccaaaatgttctgaatat

SEQ ID NO: 773365 - DNA, 25 bp, Mus musculus
tagcaatccaaattgttctgaatat

SEQ ID NO: 773366 - DNA, 25 bp, Mus musculus
tagcaatgaccaccctgtatgttct

SEQ ID NO: 773367 - DNA, 25 bp, Mus musculus
tagcaatgaccagcctgtatgttct

SEQ ID NO: 773368 - DNA, 25 bp, Mus musculus
tagcaatgactgagcttgacccacc

SEQ ID NO: 773369 - DNA, 25 bp, Mus musculus
tagcaatgactgtgcttgacccacc

SEQ ID NO: 773370 - DNA, 25 bp, Mus musculus
tagcaatgcgctcagcccagtgggt

SEQ ID NO: 773371 - DNA, 25 bp, Mus musculus
tagcaatgcgctgagcccagtgggt

SEQ ID NO: 773372 - DNA, 25 bp, Mus musculus
tagcaatggcatccaatcaagtatt

SEQ ID NO: 773373 - DNA, 25 bp, Mus musculus
tagcaatggcatgcaatcaagtatt

SEQ ID NO: 773374 - DNA, 25 bp, Mus musculus
tagcaatgggacaagtgcccactgt

SEQ ID NO: 773375 - DNA, 25 bp, Mus musculus
tagcaatgggactagtgcccactgt

SEQ ID NO: 773376 - DNA, 25 bp, Mus musculus
tagcaatggtgccactgtttcctcc

SEQ ID NO: 773377 - DNA, 25 bp, Mus musculus
tagcaatggtgcgactgtttcctcc

SEQ ID NO: 773378 - DNA, 25 bp, Mus musculus
tagcaatggtttagtatcaggtact

SEQ ID NO: 773379 - DNA, 25 bp, Mus musculus
tagcaatggttttgtatcaggtact

SEQ ID NO: 773380 - DNA, 25 bp, Mus musculus
tagcaatgtcaactcctggatagtg

SEQ ID NO: 773381 - DNA, 25 bp, Mus musculus
tagcaatgtcaagtcctggatagtg

SEQ ID NO: 773382 - DNA, 25 bp, Mus musculus
tagcaatgttgcagttctctagttg

SEQ ID NO: 773383 - DNA, 25 bp, Mus musculus
tagcaatgttgcatgctcacataac

SEQ ID NO: 773384 - DNA, 25 bp, Mus musculus
tagcaatgttgctgttctctagttg

SEQ ID NO: 773385 - DNA, 25 bp, Mus musculus
tagcaatgttgcttgctcacataac

SEQ ID NO: 773386 - DNA, 25 bp, Mus musculus
tagcaattccatctgtgaaacactt

SEQ ID NO: 773387 - DNA, 25 bp, Mus musculus
tagcaattccatgtgtgaaacactt

SEQ ID NO: 773388 - DNA, 25 bp, Mus musculus
tagcaattccctattagcatccctc

SEQ ID NO: 773389 - DNA, 25 bp, Mus musculus
tagcaattcccttttagcatccctc

SEQ ID NO: 773390 - DNA, 25 bp, Mus musculus
tagcaattctacacctatccacaag

SEQ ID NO: 773391 - DNA, 25 bp, Mus musculus
tagcaattctactcctatccacaag

SEQ ID NO: 773392 - DNA, 25 bp, Mus musculus
tagcaattgctcagttctcttaaat

SEQ ID NO: 773393 - DNA, 25 bp, Mus musculus
tagcaattgctctgttctcttaaat

SEQ ID NO: 773394 - DNA, 25 bp, Mus musculus
tagcacaaactcatgggtgggtctc

SEQ ID NO: 773395 - DNA, 25 bp, Mus musculus
tagcacaaactcttgggtgggtctc

SEQ ID NO: 773396 - DNA, 25 bp, Mus musculus
tagcacaaacttacatttcatggag

SEQ ID NO: 773397 - DNA, 25 bp, Mus musculus
tagcacaaactttcatttcatggag

SEQ ID NO: 773398 - DNA, 25 bp, Mus musculus
tagcacaaagccacgggctccataa

SEQ ID NO: 773399 - DNA, 25 bp, Mus musculus
tagcacaaagcctcgggctccataa

SEQ ID NO: 773400 - DNA, 25 bp, Mus musculus
tagcacaagcttcgactcatgagga

SEQ ID NO: 773401 - DNA, 25 bp, Mus musculus
tagcacaagcttggactcatgagga

SEQ ID NO: 773402 - DNA, 25 bp, Mus musculus
tagcacaagtacagcatccagctct

SEQ ID NO: 773403 - DNA, 25 bp, Mus musculus
tagcacaagtactgcatccagctct

SEQ ID NO: 773404 - DNA, 25 bp, Mus musculus
tagcacaagtgaacctacacacagt

SEQ ID NO: 773405 - DNA, 25 bp, Mus musculus
tagcacaagtgatcctacacacagt

SEQ ID NO: 773406 - DNA, 25 bp, Mus musculus
tagcacaatagaccagcatcacctt

SEQ ID NO: 773407 - DNA, 25 bp, Mus musculus
tagcacaatagagcagcatcacctt

SEQ ID NO: 773408 - DNA, 25 bp, Mus musculus
tagcacaccagcatgggtaccggtg

SEQ ID NO: 773409 - DNA, 25 bp, Mus musculus
tagcacaccagcttgggtaccggtg

SEQ ID NO: 773410 - DNA, 25 bp, Mus musculus
tagcacaccatcatgatgtcagatg

SEQ ID NO: 773411 - DNA, 25 bp, Mus musculus
tagcacaccatcttgatgtcagatg

SEQ ID NO: 773412 - DNA, 25 bp, Mus musculus
tagcacacgctcactactcatagaa

SEQ ID NO: 773413 - DNA, 25 bp, Mus musculus
tagcacacgctctctactcatagaa

SEQ ID NO: 773414 - DNA, 25 bp, Mus musculus
tagcacacgtggacctgattgagaa

SEQ ID NO: 773415 - DNA, 25 bp, Mus musculus
tagcacacgtggtcctgattgagaa

SEQ ID NO: 773416 - DNA, 25 bp, Mus musculus
tagcacactagccatacactcttac

SEQ ID NO: 773417 - DNA, 25 bp, Mus musculus
tagcacactagcgatacactcttac

SEQ ID NO: 773418 - DNA, 25 bp, Mus musculus
tagcacactaggaactgggtggcaa

SEQ ID NO: 773419 - DNA, 25 bp, Mus musculus
tagcacactaggtactgggtggcaa

SEQ ID NO: 773420 - DNA, 25 bp, Mus musculus
tagcacagagatactccacttataa

SEQ ID NO: 773421 - DNA, 25 bp, Mus musculus
tagcacagagattctccacttataa

SEQ ID NO: 773422 - DNA, 25 bp, Mus musculus
tagcacagagttaaggcaagatcat

SEQ ID NO: 773423 - DNA, 25 bp, Mus musculus
tagcacagagtttaggcaagatcat

SEQ ID NO: 773424 - DNA, 25 bp, Mus musculus
tagcacagattcagctcatgacacc

SEQ ID NO: 773425 - DNA, 25 bp, Mus musculus
tagcacagattctgctcatgacacc

SEQ ID NO: 773426 - DNA, 25 bp, Mus musculus
tagcacagccccacgagaagaggtt

SEQ ID NO: 773427 - DNA, 25 bp, Mus musculus
tagcacagcccctcgagaagaggtt

SEQ ID NO: 773428 - DNA, 25 bp, Mus musculus
tagcacaggaatactacaaagtgtt

SEQ ID NO: 773429 - DNA, 25 bp, Mus musculus
tagcacaggaattctacaaagtgtt

SEQ ID NO: 773430 - DNA, 25 bp, Mus musculus
tagcacaggaggacattgtcatgcc

SEQ ID NO: 773431 - DNA, 25 bp, Mus musculus
tagcacaggaggtcattgtcatgcc

SEQ ID NO: 773432 - DNA, 25 bp, Mus musculus
tagcacagtaaaccgtcccgtgtct

SEQ ID NO: 773433 - DNA, 25 bp, Mus musculus
tagcacagtaaagcgtcccgtgtct

SEQ ID NO: 773434 - DNA, 25 bp, Mus musculus
tagcacagtatactgaactctgaga

SEQ ID NO: 773435 - DNA, 25 bp, Mus musculus
tagcacagtatagtgaactctgaga

SEQ ID NO: 773436 - DNA, 25 bp, Mus musculus
tagcacagtcaaaaatactctcaaa

SEQ ID NO: 773437 - DNA, 25 bp, Mus musculus
tagcacagtcaataatactctcaaa

SEQ ID NO: 773438 - DNA, 25 bp, Mus musculus
tagcacagtgcaatttccagtaatg

SEQ ID NO: 773439 - DNA, 25 bp, Mus musculus
tagcacagtgcattttccagtaatg

SEQ ID NO: 773440 - DNA, 25 bp, Mus musculus
tagcacatcataaagctcaaaggat

SEQ ID NO: 773441 - DNA, 25 bp, Mus musculus
tagcacatcatatagctcaaaggat

SEQ ID NO: 773442 - DNA, 25 bp, Mus musculus
tagcacatcattcctcctataggga

SEQ ID NO: 773443 - DNA, 25 bp, Mus musculus
tagcacatcattgctcctataggga

SEQ ID NO: 773444 - DNA, 25 bp, Mus musculus
tagcacatgcatacacagtgtcctg

SEQ ID NO: 773445 - DNA, 25 bp, Mus musculus
tagcacatgcattcacagtgtcctg

SEQ ID NO: 773446 - DNA, 25 bp, Mus musculus
tagcacatgcctatactcaggaggc

SEQ ID NO: 773447 - DNA, 25 bp, Mus musculus
tagcacatgcctttactcaggaggc

SEQ ID NO: 773448 - DNA, 25 bp, Mus musculus
tagcacatgtccacgtgaaacctgt

SEQ ID NO: 773449 - DNA, 25 bp, Mus musculus
tagcacatgtcctcgtgaaacctgt

SEQ ID NO: 773450 - DNA, 25 bp, Mus musculus
tagcacatgtgtcacaatcccacca

SEQ ID NO: 773451 - DNA, 25 bp, Mus musculus
tagcacatgtgtgacaatcccacca

SEQ ID NO: 773452 - DNA, 25 bp, Mus musculus
tagcacatttcaataccagggtctg

SEQ ID NO: 773453 - DNA, 25 bp, Mus musculus
tagcacatttcattaccagggtctg

SEQ ID NO: 773454 - DNA, 25 bp, Mus musculus
tagcacatttgcatggcgggttcca

SEQ ID NO: 773455 - DNA, 25 bp, Mus musculus
tagcacatttgcttggcgggttcca

SEQ ID NO: 773456 - DNA, 25 bp, Mus musculus
tagcaccaagctaaaccccattttt

SEQ ID NO: 773457 - DNA, 25 bp, Mus musculus
tagcaccaagcttaaccccattttt

SEQ ID NO: 773458 - DNA, 25 bp, Mus musculus
tagcaccacacaatgcatgtgcaag

SEQ ID NO: 773459 - DNA, 25 bp, Mus musculus
tagcaccacacattgcatgtgcaag

SEQ ID NO: 773460 - DNA, 25 bp, Mus musculus
tagcaccagaccatccttgatgtgg

SEQ ID NO: 773461 - DNA, 25 bp, Mus musculus
tagcaccagaccttccttgatgtgg

SEQ ID NO: 773462 - DNA, 25 bp, Mus musculus
tagcaccagacgaggaggtcactgt

SEQ ID NO: 773463 - DNA, 25 bp, Mus musculus
tagcaccagacgtggaggtcactgt

SEQ ID NO: 773464 - DNA, 25 bp, Mus musculus
tagcaccaggatactagatgagctg

SEQ ID NO: 773465 - DNA, 25 bp, Mus musculus
tagcaccaggattctagatgagctg

SEQ ID NO: 773466 - DNA, 25 bp, Mus musculus
tagcaccaggccctgtgggctacgt

SEQ ID NO: 773467 - DNA, 25 bp, Mus musculus
tagcaccaggccgtgtgggctacgt

SEQ ID NO: 773468 - DNA, 25 bp, Mus musculus
tagcaccagggccaaggcttcagaa

SEQ ID NO: 773469 - DNA, 25 bp, Mus musculus
tagcaccagggcgaaggcttcagaa

SEQ ID NO: 773470 - DNA, 25 bp, Mus musculus
tagcaccatccgcaagtttttagtg

SEQ ID NO: 773471 - DNA, 25 bp, Mus musculus
tagcaccatccggaagtttttagtg

SEQ ID NO: 773472 - DNA, 25 bp, Mus musculus
tagcaccatgaaccctatcatctat

SEQ ID NO: 773473 - DNA, 25 bp, Mus musculus
tagcaccatgaagcctatcatctat

SEQ ID NO: 773474 - DNA, 25 bp, Mus musculus
tagcaccattacatgctgggcaggt

SEQ ID NO: 773475 - DNA, 25 bp, Mus musculus
tagcaccattacttgctgggcaggt

SEQ ID NO: 773476 - DNA, 25 bp, Mus musculus
tagcacccagagctaatgttaagct

SEQ ID NO: 773477 - DNA, 25 bp, Mus musculus
tagcacccagagcttggcgaggaat

SEQ ID NO: 773478 - DNA, 25 bp, Mus musculus
tagcacccagaggtaatgttaagct

SEQ ID NO: 773479 - DNA, 25 bp, Mus musculus
tagcacccagaggttggcgaggaat

SEQ ID NO: 773480 - DNA, 25 bp, Mus musculus
tagcacccagttcaaatccgacagc

SEQ ID NO: 773481 - DNA, 25 bp, Mus musculus
tagcacccagttgaaatccgacagc

SEQ ID NO: 773482 - DNA, 25 bp, Mus musculus
tagcacccgccaaagagacagcagc

SEQ ID NO: 773483 - DNA, 25 bp, Mus musculus
tagcacccgccatagagacagcagc

SEQ ID NO: 773484 - DNA, 25 bp, Mus musculus
tagcacccgtagctgcccagggaaa

SEQ ID NO: 773485 - DNA, 25 bp, Mus musculus
tagcacccgtaggtgcccagggaaa

SEQ ID NO: 773486 - DNA, 25 bp, Mus musculus
tagcacccgtctctaactgttgttc

SEQ ID NO: 773487 - DNA, 25 bp, Mus musculus
tagcacccgtctgtaactgttgttc

SEQ ID NO: 773488 - DNA, 25 bp, Mus musculus
tagcacccgtgcacactgttgttgg

SEQ ID NO: 773489 - DNA, 25 bp, Mus musculus
tagcacccgtgctcactgttgttgg

SEQ ID NO: 773490 - DNA, 25 bp, Mus musculus
tagcaccgaggactagaactcttcg

SEQ ID NO: 773491 - DNA, 25 bp, Mus musculus
tagcaccgaggagtagaactcttcg

SEQ ID NO: 773492 - DNA, 25 bp, Mus musculus
tagcaccgatggatgttcacaatga

SEQ ID NO: 773493 - DNA, 25 bp, Mus musculus
tagcaccgatggttgttcacaatga

SEQ ID NO: 773494 - DNA, 25 bp, Mus musculus
tagcaccgggctattgatggacctg

SEQ ID NO: 773495 - DNA, 25 bp, Mus musculus
tagcaccgggcttttgatggacctg

SEQ ID NO: 773496 - DNA, 25 bp, Mus musculus
tagcaccgtctcagcagactcagga

SEQ ID NO: 773497 - DNA, 25 bp, Mus musculus
tagcaccgtctctgcagactcagga

SEQ ID NO: 773498 - DNA, 25 bp, Mus musculus
tagcaccttcatagggagcccatcc

SEQ ID NO: 773499 - DNA, 25 bp, Mus musculus
tagcaccttcattgggagcccatcc

SEQ ID NO: 773500 - DNA, 25 bp, Mus musculus
tagcaccttccacacttttcactgt

SEQ ID NO: 773501 - DNA, 25 bp, Mus musculus
tagcaccttccagacttttcactgt

SEQ ID NO: 773502 - DNA, 25 bp, Mus musculus
tagcaccttcggatttccttggaga

SEQ ID NO: 773503 - DNA, 25 bp, Mus musculus
tagcaccttcggttttccttggaga

SEQ ID NO: 773504 - DNA, 25 bp, Mus musculus
tagcacctttcaagccactgtagaa

SEQ ID NO: 773505 - DNA, 25 bp, Mus musculus
tagcacctttcatgccactgtagaa

SEQ ID NO: 773506 - DNA, 25 bp, Mus musculus
tagcacgatgaaaccccgagtttat

SEQ ID NO: 773507 - DNA, 25 bp, Mus musculus
tagcacgatgaatccccgagtttat

SEQ ID NO: 773508 - DNA, 25 bp, Mus musculus
tagcacgccgcaaacgcggagaacg

SEQ ID NO: 773509 - DNA, 25 bp, Mus musculus
tagcacgccgcatacgcggagaacg

SEQ ID NO: 773510 - DNA, 25 bp, Mus musculus
tagcacgcctgcaggcccgggttca

SEQ ID NO: 773511 - DNA, 25 bp, Mus musculus
tagcacgcctgctggcccgggttca

SEQ ID NO: 773512 - DNA, 25 bp, Mus musculus
tagcacggaagcactgctcactggt

SEQ ID NO: 773513 - DNA, 25 bp, Mus musculus
tagcacggaagctctgctcactggt

SEQ ID NO: 773514 - DNA, 25 bp, Mus musculus
tagcacggttaaataccaggtattc

SEQ ID NO: 773515 - DNA, 25 bp, Mus musculus
tagcacggttaattaccaggtattc

SEQ ID NO: 773516 - DNA, 25 bp, Mus musculus
tagcacgtaccacatatacacagcc

SEQ ID NO: 773517 - DNA, 25 bp, Mus musculus
tagcacgtaccagatatacacagcc

SEQ ID NO: 773518 - DNA, 25 bp, Mus musculus
tagcacgtcaccaagcctggagagc

SEQ ID NO: 773519 - DNA, 25 bp, Mus musculus
tagcacgtcacctagcctggagagc

SEQ ID NO: 773520 - DNA, 25 bp, Mus musculus
tagcacgtgcgacaccctaggctca

SEQ ID NO: 773521 - DNA, 25 bp, Mus musculus
tagcacgtgcgagaccctaggctca

SEQ ID NO: 773522 - DNA, 25 bp, Mus musculus
tagcacgttccaaagggtgcctggg

SEQ ID NO: 773523 - DNA, 25 bp, Mus musculus
tagcacgttccatagggtgcctggg

SEQ ID NO: 773524 - DNA, 25 bp, Mus musculus
tagcactacataagttcctgcaccc

SEQ ID NO: 773525 - DNA, 25 bp, Mus musculus
tagcactacatatgttcctgcaccc

SEQ ID NO: 773526 - DNA, 25 bp, Mus musculus
tagcactacctaattatttcttggg

SEQ ID NO: 773527 - DNA, 25 bp, Mus musculus
tagcactacctatttatttcttggg

SEQ ID NO: 773528 - DNA, 25 bp, Mus musculus
tagcactagatcaaggtcctaggga

SEQ ID NO: 773529 - DNA, 25 bp, Mus musculus
tagcactagatctaggtcctaggga

SEQ ID NO: 773530 - DNA, 25 bp, Mus musculus
tagcactaggatattgggttgaagc

SEQ ID NO: 773531 - DNA, 25 bp, Mus musculus
tagcactaggattttgggttgaagc

SEQ ID NO: 773532 - DNA, 25 bp, Mus musculus
tagcactataaacctctgagttcag

SEQ ID NO: 773533 - DNA, 25 bp, Mus musculus
tagcactataaagctctgagttcag

SEQ ID NO: 773534 - DNA, 25 bp, Mus musculus
tagcactatcatcttcatgtacatg

SEQ ID NO: 773535 - DNA, 25 bp, Mus musculus
tagcactatcatgttcatgtacatg

SEQ ID NO: 773536 - DNA, 25 bp, Mus musculus
tagcactatctcagggcccaaagaa

SEQ ID NO: 773537 - DNA, 25 bp, Mus musculus
tagcactatctctgggcccaaagaa

SEQ ID NO: 773538 - DNA, 25 bp, Mus musculus
tagcactattttatcgtggacccta

SEQ ID NO: 773539 - DNA, 25 bp, Mus musculus
tagcactattttttcgtggacccta

SEQ ID NO: 773540 - DNA, 25 bp, Mus musculus
tagcactccataccctgtctcttgg

SEQ ID NO: 773541 - DNA, 25 bp, Mus musculus
tagcactccatagcctgtctcttgg

SEQ ID NO: 773542 - DNA, 25 bp, Mus musculus
tagcactcccggcactgtgacatag

SEQ ID NO: 773543 - DNA, 25 bp, Mus musculus
tagcactcccgggactgtgacatag

SEQ ID NO: 773544 - DNA, 25 bp, Mus musculus
tagcactccttactgcttcaaccgg

SEQ ID NO: 773545 - DNA, 25 bp, Mus musculus
tagcactccttagtgcttcaaccgg

SEQ ID NO: 773546 - DNA, 25 bp, Mus musculus
tagcactcgataatttgcttcattt

SEQ ID NO: 773547 - DNA, 25 bp, Mus musculus
tagcactcgatattttgcttcattt

SEQ ID NO: 773548 - DNA, 25 bp, Mus musculus
tagcactctccaaattccctgaaaa

SEQ ID NO: 773549 - DNA, 25 bp, Mus musculus
tagcactctccatattccctgaaaa

SEQ ID NO: 773550 - DNA, 25 bp, Mus musculus
tagcactctgagagtatcctagtga

SEQ ID NO: 773551 - DNA, 25 bp, Mus musculus
tagcactctgagtgtatcctagtga

SEQ ID NO: 773552 - DNA, 25 bp, Mus musculus
tagcactctgtaaatgatgaccact

SEQ ID NO: 773553 - DNA, 25 bp, Mus musculus
tagcactctgtatatgatgaccact

SEQ ID NO: 773554 - DNA, 25 bp, Mus musculus
tagcactcttaaatacttacctcct

SEQ ID NO: 773555 - DNA, 25 bp, Mus musculus
tagcactcttaattacttacctcct

SEQ ID NO: 773556 - DNA, 25 bp, Mus musculus
tagcactctttcagtgcacgcaggt

SEQ ID NO: 773557 - DNA, 25 bp, Mus musculus
tagcactctttctgtgcacgcaggt

SEQ ID NO: 773558 - DNA, 25 bp, Mus musculus
tagcactgacatagtgagccacgac

SEQ ID NO: 773559 - DNA, 25 bp, Mus musculus
tagcactgacatattttaacacttg

SEQ ID NO: 773560 - DNA, 25 bp, Mus musculus
tagcactgacattgtgagccacgac

SEQ ID NO: 773561 - DNA, 25 bp, Mus musculus
tagcactgacattttttaacacttg

SEQ ID NO: 773562 - DNA, 25 bp, Mus musculus
tagcactgccacctaaaccaaaaag

SEQ ID NO: 773563 - DNA, 25 bp, Mus musculus
tagcactgccacgtaaaccaaaaag

SEQ ID NO: 773564 - DNA, 25 bp, Mus musculus
tagcactgcccccatttgcttcttt

SEQ ID NO: 773565 - DNA, 25 bp, Mus musculus
tagcactgccccgatttgcttcttt

SEQ ID NO: 773566 - DNA, 25 bp, Mus musculus
tagcactgcgctccattcagaacaa

SEQ ID NO: 773567 - DNA, 25 bp, Mus musculus
tagcactgcgctgcattcagaacaa

SEQ ID NO: 773568 - DNA, 25 bp, Mus musculus
tagcactggcaaccgagaagcccct

SEQ ID NO: 773569 - DNA, 25 bp, Mus musculus
tagcactggcaagcgagaagcccct

SEQ ID NO: 773570 - DNA, 25 bp, Mus musculus
tagcactggcagcaagtgactcctg

SEQ ID NO: 773571 - DNA, 25 bp, Mus musculus
tagcactggcaggaagtgactcctg

SEQ ID NO: 773572 - DNA, 25 bp, Mus musculus
tagcactgttctcgtgactataaga

SEQ ID NO: 773573 - DNA, 25 bp, Mus musculus
tagcactgttctggtgactataaga

SEQ ID NO: 773574 - DNA, 25 bp, Mus musculus
tagcactgttgcagaagtttgaaaa

SEQ ID NO: 773575 - DNA, 25 bp, Mus musculus
tagcactgttgctgaagtttgaaaa

SEQ ID NO: 773576 - DNA, 25 bp, Mus musculus
tagcacttaaagaatgttccggttt

SEQ ID NO: 773577 - DNA, 25 bp, Mus musculus
tagcacttaaagtatgttccggttt

SEQ ID NO: 773578 - DNA, 25 bp, Mus musculus
tagcacttcactctccaggctgcag

SEQ ID NO: 773579 - DNA, 25 bp, Mus musculus
tagcacttcactgtccaggctgcag

SEQ ID NO: 773580 - DNA, 25 bp, Mus musculus
tagcacttctgtcatggtacatcct

SEQ ID NO: 773581 - DNA, 25 bp, Mus musculus
tagcacttctgtgatggtacatcct

SEQ ID NO: 773582 - DNA, 25 bp, Mus musculus
tagcacttgggcagtttagatcaga

SEQ ID NO: 773583 - DNA, 25 bp, Mus musculus
tagcacttgggctgtttagatcaga

SEQ ID NO: 773584 - DNA, 25 bp, Mus musculus
tagcacttgtaacccctgggttcaa

SEQ ID NO: 773585 - DNA, 25 bp, Mus musculus
tagcacttgtaagccctgggttcaa

SEQ ID NO: 773586 - DNA, 25 bp, Mus musculus
tagcacttgtgtccattcgttctca

SEQ ID NO: 773587 - DNA, 25 bp, Mus musculus
tagcacttgtgtgcattcgttctca

SEQ ID NO: 773588 - DNA, 25 bp, Mus musculus
tagcacttttcaattctctctaaag

SEQ ID NO: 773589 - DNA, 25 bp, Mus musculus
tagcacttttcatttctctctaaag

SEQ ID NO: 773590 - DNA, 25 bp, Mus musculus
tagcagaaaggccacgtggttccct

SEQ ID NO: 773591 - DNA, 25 bp, Mus musculus
tagcagaaaggcgacgtggttccct

SEQ ID NO: 773592 - DNA, 25 bp, Mus musculus
tagcagaactgtccacgtctcttgt

SEQ ID NO: 773593 - DNA, 25 bp, Mus musculus
tagcagaactgtgcacgtctcttgt

SEQ ID NO: 773594 - DNA, 25 bp, Mus musculus
tagcagaagcctaagccggacacct

SEQ ID NO: 773595 - DNA, 25 bp, Mus musculus
tagcagaagccttagccggacacct

SEQ ID NO: 773596 - DNA, 25 bp, Mus musculus
tagcagaagcttagtgatctttcaa

SEQ ID NO: 773597 - DNA, 25 bp, Mus musculus
tagcagaagctttgtgatctttcaa

SEQ ID NO: 773598 - DNA, 25 bp, Mus musculus
tagcagacactgaacccacttaaca

SEQ ID NO: 773599 - DNA, 25 bp, Mus musculus
tagcagacactgtacccacttaaca

SEQ ID NO: 773600 - DNA, 25 bp, Mus musculus
tagcagaccaacaatgtcacatgaa

SEQ ID NO: 773601 - DNA, 25 bp, Mus musculus
tagcagaccaactatgtcacatgaa

SEQ ID NO: 773602 - DNA, 25 bp, Mus musculus
tagcagaccttcagccaggtgggag

SEQ ID NO: 773603 - DNA, 25 bp, Mus musculus
tagcagaccttctgccaggtgggag

SEQ ID NO: 773604 - DNA, 25 bp, Mus musculus
tagcagacgtacattttcgggaatt

SEQ ID NO: 773605 - DNA, 25 bp, Mus musculus
tagcagacgtactttttcgggaatt

SEQ ID NO: 773606 - DNA, 25 bp, Mus musculus
tagcagactatgatgaagtccacga

SEQ ID NO: 773607 - DNA, 25 bp, Mus musculus
tagcagactatgttgaagtccacga

SEQ ID NO: 773608 - DNA, 25 bp, Mus musculus
tagcagactgctagatgccgtttat

SEQ ID NO: 773609 - DNA, 25 bp, Mus musculus
tagcagactgcttgatgccgtttat

SEQ ID NO: 773610 - DNA, 25 bp, Mus musculus
tagcagacttgccttttgtatgccc

SEQ ID NO: 773611 - DNA, 25 bp, Mus musculus
tagcagacttgcgttttgtatgccc

SEQ ID NO: 773612 - DNA, 25 bp, Mus musculus
tagcagagagctcagtactgtcctg

SEQ ID NO: 773613 - DNA, 25 bp, Mus musculus
tagcagagagctgagtactgtcctg

SEQ ID NO: 773614 - DNA, 25 bp, Mus musculus
tagcagagagttagaagcaggagac

SEQ ID NO: 773615 - DNA, 25 bp, Mus musculus
tagcagagagttccttctgtctccc

SEQ ID NO: 773616 - DNA, 25 bp, Mus musculus
tagcagagagttgcttctgtctccc

SEQ ID NO: 773617 - DNA, 25 bp, Mus musculus
tagcagagagtttgaagcaggagac

SEQ ID NO: 773618 - DNA, 25 bp, Mus musculus
tagcagagcctaaccttcatgactt

SEQ ID NO: 773619 - DNA, 25 bp, Mus musculus
tagcagagcctatccttcatgactt

SEQ ID NO: 773620 - DNA, 25 bp, Mus musculus
tagcagagcttcaggcctagggctg

SEQ ID NO: 773621 - DNA, 25 bp, Mus musculus
tagcagagcttctggcctagggctg

SEQ ID NO: 773622 - DNA, 25 bp, Mus musculus
tagcagaggatgcactactcggcca

SEQ ID NO: 773623 - DNA, 25 bp, Mus musculus
tagcagaggatggactactcggcca

SEQ ID NO: 773624 - DNA, 25 bp, Mus musculus
tagcagaggattccctagtctggcc

SEQ ID NO: 773625 - DNA, 25 bp, Mus musculus
tagcagaggattgcctagtctggcc

SEQ ID NO: 773626 - DNA, 25 bp, Mus musculus
tagcagagggctaccgtgtgattga

SEQ ID NO: 773627 - DNA, 25 bp, Mus musculus
tagcagagggcttccgtgtgattga

SEQ ID NO: 773628 - DNA, 25 bp, Mus musculus
tagcagagtgaaccccttttaaaag

SEQ ID NO: 773629 - DNA, 25 bp, Mus musculus
tagcagagtgaagcccttttaaaag

SEQ ID NO: 773630 - DNA, 25 bp, Mus musculus
tagcagagttctcgcctacaataaa

SEQ ID NO: 773631 - DNA, 25 bp, Mus musculus
tagcagagttctggcctacaataaa

SEQ ID NO: 773632 - DNA, 25 bp, Mus musculus
tagcagatccctacctagaacggag

SEQ ID NO: 773633 - DNA, 25 bp, Mus musculus
tagcagatcccttcctagaacggag

SEQ ID NO: 773634 - DNA, 25 bp, Mus musculus
tagcagatgcagctttgcacctctg

SEQ ID NO: 773635 - DNA, 25 bp, Mus musculus
tagcagatgcaggtttgcacctctg

SEQ ID NO: 773636 - DNA, 25 bp, Mus musculus
tagcagatgcctagtgtctagagct

SEQ ID NO: 773637 - DNA, 25 bp, Mus musculus
tagcagatgccttgtgtctagagct

SEQ ID NO: 773638 - DNA, 25 bp, Mus musculus
tagcagatgcggatgggctccagat

SEQ ID NO: 773639 - DNA, 25 bp, Mus musculus
tagcagatgcggttgggctccagat

SEQ ID NO: 773640 - DNA, 25 bp, Mus musculus
tagcagatgcttcatgccttgtgtt

SEQ ID NO: 773641 - DNA, 25 bp, Mus musculus
tagcagatgcttgatgccttgtgtt

SEQ ID NO: 773642 - DNA, 25 bp, Mus musculus
tagcagatggatcgcttcccgatgt

SEQ ID NO: 773643 - DNA, 25 bp, Mus musculus
tagcagatggatggcttcccgatgt

SEQ ID NO: 773644 - DNA, 25 bp, Mus musculus
tagcagattccaatcagtggcctca

SEQ ID NO: 773645 - DNA, 25 bp, Mus musculus
tagcagattccattcagtggcctca

SEQ ID NO: 773646 - DNA, 25 bp, Mus musculus
tagcagcaacacagtgcatgaagat

SEQ ID NO: 773647 - DNA, 25 bp, Mus musculus
tagcagcaacactgtgcatgaagat

SEQ ID NO: 773648 - DNA, 25 bp, Mus musculus
tagcagcaagacaagtaagccagac

SEQ ID NO: 773649 - DNA, 25 bp, Mus musculus
tagcagcaagactagtaagccagac

SEQ ID NO: 773650 - DNA, 25 bp, Mus musculus
tagcagcaagtgacagccctgagac

SEQ ID NO: 773651 - DNA, 25 bp, Mus musculus
tagcagcaagtgtcagccctgagac

SEQ ID NO: 773652 - DNA, 25 bp, Mus musculus
tagcagcacgtacatggagcacccc

SEQ ID NO: 773653 - DNA, 25 bp, Mus musculus
tagcagcacgtagatggagcacccc

SEQ ID NO: 773654 - DNA, 25 bp, Mus musculus
tagcagcactgcagataacaaccac

SEQ ID NO: 773655 - DNA, 25 bp, Mus musculus
tagcagcactgctgataacaaccac

SEQ ID NO: 773656 - DNA, 25 bp, Mus musculus
tagcagcagattctagtgacccaga

SEQ ID NO: 773657 - DNA, 25 bp, Mus musculus
tagcagcagattgtagtgacccaga

SEQ ID NO: 773658 - DNA, 25 bp, Mus musculus
tagcagcagcgcagtgtggacgcca

SEQ ID NO: 773659 - DNA, 25 bp, Mus musculus
tagcagcagcgctgtgtggacgcca

SEQ ID NO: 773660 - DNA, 25 bp, Mus musculus
tagcagcaggcaaagactacccaag

SEQ ID NO: 773661 - DNA, 25 bp, Mus musculus
tagcagcaggcatagactacccaag

SEQ ID NO: 773662 - DNA, 25 bp, Mus musculus
tagcagcagggcactttctgtgtca

SEQ ID NO: 773663 - DNA, 25 bp, Mus musculus
tagcagcagggctctttctgtgtca

SEQ ID NO: 773664 - DNA, 25 bp, Mus musculus
tagcagcatcatatggtacctcttt

SEQ ID NO: 773665 - DNA, 25 bp, Mus musculus
tagcagcatcatttggtacctcttt

SEQ ID NO: 773666 - DNA, 25 bp, Mus musculus
tagcagcatgcacaagagcccacag

SEQ ID NO: 773667 - DNA, 25 bp, Mus musculus
tagcagcatgcagaagagcccacag

SEQ ID NO: 773668 - DNA, 25 bp, Mus musculus
tagcagcatggacagacagccgacc

SEQ ID NO: 773669 - DNA, 25 bp, Mus musculus
tagcagcatggagagacagccgacc

SEQ ID NO: 773670 - DNA, 25 bp, Mus musculus
tagcagcatttcagtatcctgaaaa

SEQ ID NO: 773671 - DNA, 25 bp, Mus musculus
tagcagcatttctgtatcctgaaaa

SEQ ID NO: 773672 - DNA, 25 bp, Mus musculus
tagcagcccattcgccaaaatgcat

SEQ ID NO: 773673 - DNA, 25 bp, Mus musculus
tagcagcccattggccaaaatgcat

SEQ ID NO: 773674 - DNA, 25 bp, Mus musculus
tagcagccgcacaaaagccatcata

SEQ ID NO: 773675 - DNA, 25 bp, Mus musculus
tagcagccgcactaaagccatcata

SEQ ID NO: 773676 - DNA, 25 bp, Mus musculus
tagcagcctcgaacatggcctttgg

SEQ ID NO: 773677 - DNA, 25 bp, Mus musculus
tagcagcctcgatcatggcctttgg

SEQ ID NO: 773678 - DNA, 25 bp, Mus musculus
tagcagcctgcaaagccaaattagc

SEQ ID NO: 773679 - DNA, 25 bp, Mus musculus
tagcagcctgcatagccaaattagc

SEQ ID NO: 773680 - DNA, 25 bp, Mus musculus
tagcagcctggaaggcaccttctgg

SEQ ID NO: 773681 - DNA, 25 bp, Mus musculus
tagcagcctggatggcaccttctgg

SEQ ID NO: 773682 - DNA, 25 bp, Mus musculus
tagcagcgaacacaagtccctcaat

SEQ ID NO: 773683 - DNA, 25 bp, Mus musculus
tagcagcgaacagaagtccctcaat

SEQ ID NO: 773684 - DNA, 25 bp, Mus musculus
tagcagcgacaacgaggaccatcaa

SEQ ID NO: 773685 - DNA, 25 bp, Mus musculus
tagcagcgacaaggaggaccatcaa

SEQ ID NO: 773686 - DNA, 25 bp, Mus musculus
tagcagcgacacctcggatgatgac

SEQ ID NO: 773687 - DNA, 25 bp, Mus musculus
tagcagcgacacgtcggatgatgac

SEQ ID NO: 773688 - DNA, 25 bp, Mus musculus
tagcagcgagacacacgtctgtgga

SEQ ID NO: 773689 - DNA, 25 bp, Mus musculus
tagcagcgagactcacgtctgtgga

SEQ ID NO: 773690 - DNA, 25 bp, Mus musculus
tagcagcgatgaaagccagcagtct

SEQ ID NO: 773691 - DNA, 25 bp, Mus musculus
tagcagcgatgatagccagcagtct

SEQ ID NO: 773692 - DNA, 25 bp, Mus musculus
tagcagcggccaagcttctgtgcat

SEQ ID NO: 773693 - DNA, 25 bp, Mus musculus
tagcagcggccatgcttctgtgcat

SEQ ID NO: 773694 - DNA, 25 bp, Mus musculus
tagcagcggttcactatgagttcaa

SEQ ID NO: 773695 - DNA, 25 bp, Mus musculus
tagcagcggttctctatgagttcaa

SEQ ID NO: 773696 - DNA, 25 bp, Mus musculus
tagcagctcataaaggtggaatcac

SEQ ID NO: 773697 - DNA, 25 bp, Mus musculus
tagcagctcatataggtggaatcac

SEQ ID NO: 773698 - DNA, 25 bp, Mus musculus
tagcagctcccaaggttggtaccgg

SEQ ID NO: 773699 - DNA, 25 bp, Mus musculus
tagcagctcccatggttggtaccgg

SEQ ID NO: 773700 - DNA, 25 bp, Mus musculus
tagcagctccttctcaacagcttca

SEQ ID NO: 773701 - DNA, 25 bp, Mus musculus
tagcagctccttgtcaacagcttca

SEQ ID NO: 773702 - DNA, 25 bp, Mus musculus
tagcagctgtgaatgctctggaggc

SEQ ID NO: 773703 - DNA, 25 bp, Mus musculus
tagcagctgtgattgctctggaggc

SEQ ID NO: 773704 - DNA, 25 bp, Mus musculus
tagcagcttcgtccagtggcagtat

SEQ ID NO: 773705 - DNA, 25 bp, Mus musculus
tagcagcttcgtgcagtggcagtat

SEQ ID NO: 773706 - DNA, 25 bp, Mus musculus
tagcagcttttgattccctgcatcc

SEQ ID NO: 773707 - DNA, 25 bp, Mus musculus
tagcagcttttgtttccctgcatcc

SEQ ID NO: 773708 - DNA, 25 bp, Mus musculus
tagcaggaaagactgggctccccag

SEQ ID NO: 773709 - DNA, 25 bp, Mus musculus
tagcaggaaagagtgggctccccag

SEQ ID NO: 773710 - DNA, 25 bp, Mus musculus
tagcaggaactcactagactaggtt

SEQ ID NO: 773711 - DNA, 25 bp, Mus musculus
tagcaggaactctctagactaggtt

SEQ ID NO: 773712 - DNA, 25 bp, Mus musculus
tagcaggaagcgacccggctctggc

SEQ ID NO: 773713 - DNA, 25 bp, Mus musculus
tagcaggaagcgtcccggctctggc

SEQ ID NO: 773714 - DNA, 25 bp, Mus musculus
tagcaggaatgcagtattgtttttc

SEQ ID NO: 773715 - DNA, 25 bp, Mus musculus
tagcaggaatgctgtattgtttttc

SEQ ID NO: 773716 - DNA, 25 bp, Mus musculus
tagcaggacggactctaacctcaga

SEQ ID NO: 773717 - DNA, 25 bp, Mus musculus
tagcaggacggagtctaacctcaga

SEQ ID NO: 773718 - DNA, 25 bp, Mus musculus
tagcaggaggctaccatgcatcttc

SEQ ID NO: 773719 - DNA, 25 bp, Mus musculus
tagcaggaggcttccatgcatcttc

SEQ ID NO: 773720 - DNA, 25 bp, Mus musculus
tagcaggcaattctgagctcggctt

SEQ ID NO: 773721 - DNA, 25 bp, Mus musculus
tagcaggcaattgtgagctcggctt

SEQ ID NO: 773722 - DNA, 25 bp, Mus musculus
tagcaggcagtccttttagttcctc

SEQ ID NO: 773723 - DNA, 25 bp, Mus musculus
tagcaggcagtcgttttagttcctc

SEQ ID NO: 773724 - DNA, 25 bp, Mus musculus
tagcaggccctcacgtagcataagc

SEQ ID NO: 773725 - DNA, 25 bp, Mus musculus
tagcaggccctctcgtagcataagc

SEQ ID NO: 773726 - DNA, 25 bp, Mus musculus
tagcaggcgctcatggaaagctcaa

SEQ ID NO: 773727 - DNA, 25 bp, Mus musculus
tagcaggcgctcttggaaagctcaa

SEQ ID NO: 773728 - DNA, 25 bp, Mus musculus
tagcaggctaaaagtgtcaattcag

SEQ ID NO: 773729 - DNA, 25 bp, Mus musculus
tagcaggctaaatgtgtcaattcag

SEQ ID NO: 773730 - DNA, 25 bp, Mus musculus
tagcaggctacacagatgacccaat

SEQ ID NO: 773731 - DNA, 25 bp, Mus musculus
tagcaggctacagagatgacccaat

SEQ ID NO: 773732 - DNA, 25 bp, Mus musculus
tagcaggctattccaaacttacaaa

SEQ ID NO: 773733 - DNA, 25 bp, Mus musculus
tagcaggctattgcaaacttacaaa

SEQ ID NO: 773734 - DNA, 25 bp, Mus musculus
tagcaggctgaacagtctggcagtt

SEQ ID NO: 773735 - DNA, 25 bp, Mus musculus
tagcaggctgaaccattgtctagag

SEQ ID NO: 773736 - DNA, 25 bp, Mus musculus
tagcaggctgaagagtctggcagtt

SEQ ID NO: 773737 - DNA, 25 bp, Mus musculus
tagcaggctgaagcattgtctagag

SEQ ID NO: 773738 - DNA, 25 bp, Mus musculus
tagcagggaggtagtgaactaacat

SEQ ID NO: 773739 - DNA, 25 bp, Mus musculus
tagcagggaggttgtgaactaacat

SEQ ID NO: 773740 - DNA, 25 bp, Mus musculus
tagcagggctcactgctttttacct

SEQ ID NO: 773741 - DNA, 25 bp, Mus musculus
tagcagggctcagtgctttttacct

SEQ ID NO: 773742 - DNA, 25 bp, Mus musculus
tagcagggctctacattcagactca

SEQ ID NO: 773743 - DNA, 25 bp, Mus musculus
tagcagggctcttcattcagactca

SEQ ID NO: 773744 - DNA, 25 bp, Mus musculus
tagcaggtacctattacacacagag

SEQ ID NO: 773745 - DNA, 25 bp, Mus musculus
tagcaggtaccttttacacacagag

SEQ ID NO: 773746 - DNA, 25 bp, Mus musculus
tagcaggtcaagaactctaccactg

SEQ ID NO: 773747 - DNA, 25 bp, Mus musculus
tagcaggtcaagtactctaccactg

SEQ ID NO: 773748 - DNA, 25 bp, Mus musculus
tagcaggtcatcaaagcctcacatg

SEQ ID NO: 773749 - DNA, 25 bp, Mus musculus
tagcaggtcatctaagcctcacatg

SEQ ID NO: 773750 - DNA, 25 bp, Mus musculus
tagcaggtcgcacctcgctgtctta

SEQ ID NO: 773751 - DNA, 25 bp, Mus musculus
tagcaggtcgcagctcgctgtctta

SEQ ID NO: 773752 - DNA, 25 bp, Mus musculus
tagcaggtcggtacccatatgctca

SEQ ID NO: 773753 - DNA, 25 bp, Mus musculus
tagcaggtcggttcccatatgctca

SEQ ID NO: 773754 - DNA, 25 bp, Mus musculus
tagcaggtctgtcttgtattccctt

SEQ ID NO: 773755 - DNA, 25 bp, Mus musculus
tagcaggtctgtgttgtattccctt

SEQ ID NO: 773756 - DNA, 25 bp, Mus musculus
tagcaggtgggcagctctcacccgt

SEQ ID NO: 773757 - DNA, 25 bp, Mus musculus
tagcaggtgggccttccaagtaaga

SEQ ID NO: 773758 - DNA, 25 bp, Mus musculus
tagcaggtgggcgttccaagtaaga

SEQ ID NO: 773759 - DNA, 25 bp, Mus musculus
tagcaggtgggctgctctcacccgt

SEQ ID NO: 773760 - DNA, 25 bp, Mus musculus
tagcaggtgttcaagtcctgtggcc

SEQ ID NO: 773761 - DNA, 25 bp, Mus musculus
tagcaggtgttctagtcctgtggcc

SEQ ID NO: 773762 - DNA, 25 bp, Mus musculus
tagcagtacatcaggaaagcctctg

SEQ ID NO: 773763 - DNA, 25 bp, Mus musculus
tagcagtacatctggaaagcctctg

SEQ ID NO: 773764 - DNA, 25 bp, Mus musculus
tagcagtaccctatgcccaggtctt

SEQ ID NO: 773765 - DNA, 25 bp, Mus musculus
tagcagtaccctttgcccaggtctt

SEQ ID NO: 773766 - DNA, 25 bp, Mus musculus
tagcagtatgcacatttgtcactgg

SEQ ID NO: 773767 - DNA, 25 bp, Mus musculus
tagcagtatgcagatttgtcactgg

SEQ ID NO: 773768 - DNA, 25 bp, Mus musculus
tagcagtatgccagggtttgacccc

SEQ ID NO: 773769 - DNA, 25 bp, Mus musculus
tagcagtatgcctgggtttgacccc

SEQ ID NO: 773770 - DNA, 25 bp, Mus musculus
tagcagtcactcatacttgctggac

SEQ ID NO: 773771 - DNA, 25 bp, Mus musculus
tagcagtcactcttacttgctggac

SEQ ID NO: 773772 - DNA, 25 bp, Mus musculus
tagcagtcctcccaagagtccaaaa

SEQ ID NO: 773773 - DNA, 25 bp, Mus musculus
tagcagtcctccgaagagtccaaaa

SEQ ID NO: 773774 - DNA, 25 bp, Mus musculus
tagcagtctccactcttacattttg

SEQ ID NO: 773775 - DNA, 25 bp, Mus musculus
tagcagtctccagtcttacattttg

SEQ ID NO: 773776 - DNA, 25 bp, Mus musculus
tagcagtctgcactcccagatcata

SEQ ID NO: 773777 - DNA, 25 bp, Mus musculus
tagcagtctgcagtcccagatcata

SEQ ID NO: 773778 - DNA, 25 bp, Mus musculus
tagcagtgacagcaggttccagatc

SEQ ID NO: 773779 - DNA, 25 bp, Mus musculus
tagcagtgacaggaggttccagatc

SEQ ID NO: 773780 - DNA, 25 bp, Mus musculus
tagcagtgacttatacacacgcgcg

SEQ ID NO: 773781 - DNA, 25 bp, Mus musculus
tagcagtgacttttacacacgcgcg

SEQ ID NO: 773782 - DNA, 25 bp, Mus musculus
tagcagtgccatacttgtgggttta

SEQ ID NO: 773783 - DNA, 25 bp, Mus musculus
tagcagtgccattcttgtgggttta

SEQ ID NO: 773784 - DNA, 25 bp, Mus musculus
tagcagtggcagattggtcttcaaa

SEQ ID NO: 773785 - DNA, 25 bp, Mus musculus
tagcagtggcagtttggtcttcaaa

SEQ ID NO: 773786 - DNA, 25 bp, Mus musculus
tagcagtggcttatctacctacaaa

SEQ ID NO: 773787 - DNA, 25 bp, Mus musculus
tagcagtggcttttctacctacaaa

SEQ ID NO: 773788 - DNA, 25 bp, Mus musculus
tagcagtgggcaacgtccatcggga

SEQ ID NO: 773789 - DNA, 25 bp, Mus musculus
tagcagtgggcatcgtccatcggga

SEQ ID NO: 773790 - DNA, 25 bp, Mus musculus
tagcagtgggccaactacaatcctc

SEQ ID NO: 773791 - DNA, 25 bp, Mus musculus
tagcagtgggcctactacaatcctc

SEQ ID NO: 773792 - DNA, 25 bp, Mus musculus
tagcagtgtcttcgtgtgcacaggt

SEQ ID NO: 773793 - DNA, 25 bp, Mus musculus
tagcagtgtcttggtgtgcacaggt

SEQ ID NO: 773794 - DNA, 25 bp, Mus musculus
tagcagtgtggcacaagaccctttc

SEQ ID NO: 773795 - DNA, 25 bp, Mus musculus
tagcagtgtggctcaagaccctttc

SEQ ID NO: 773796 - DNA, 25 bp, Mus musculus
tagcagttaccaccttgagcctcta

SEQ ID NO: 773797 - DNA, 25 bp, Mus musculus
tagcagttaccagcttgagcctcta

SEQ ID NO: 773798 - DNA, 25 bp, Mus musculus
tagcagttccctcactttcacatgt

SEQ ID NO: 773799 - DNA, 25 bp, Mus musculus
tagcagttccctgactttcacatgt

SEQ ID NO: 773800 - DNA, 25 bp, Mus musculus
tagcagttgcttaaatacctttcag

SEQ ID NO: 773801 - DNA, 25 bp, Mus musculus
tagcagttgctttaatacctttcag

SEQ ID NO: 773802 - DNA, 25 bp, Mus musculus
tagcagtttaatcggtacattatag

SEQ ID NO: 773803 - DNA, 25 bp, Mus musculus
tagcagtttaatgggtacattatag

SEQ ID NO: 773804 - DNA, 25 bp, Mus musculus
tagcagtttctaagtatcccagtta

SEQ ID NO: 773805 - DNA, 25 bp, Mus musculus
tagcagtttctatgtatcccagtta

SEQ ID NO: 773806 - DNA, 25 bp, Mus musculus
tagcagtttgtcagattgcttggat

SEQ ID NO: 773807 - DNA, 25 bp, Mus musculus
tagcagtttgtctgattgcttggat

SEQ ID NO: 773808 - DNA, 25 bp, Mus musculus
tagcagttttccaacttggcgcaag

SEQ ID NO: 773809 - DNA, 25 bp, Mus musculus
tagcagttttcctacttggcgcaag

SEQ ID NO: 773810 - DNA, 25 bp, Mus musculus
tagcagttttggctggtgctctgaa

SEQ ID NO: 773811 - DNA, 25 bp, Mus musculus
tagcagttttgggtggtgctctgaa

SEQ ID NO: 773812 - DNA, 25 bp, Mus musculus
tagcagttttgtagttcccatttga

SEQ ID NO: 773813 - DNA, 25 bp, Mus musculus
tagcagttttgttgttcccatttga

SEQ ID NO: 773814 - DNA, 25 bp, Mus musculus
tagcataataatacaacgactattc

SEQ ID NO: 773815 - DNA, 25 bp, Mus musculus
tagcataataattcaacgactattc

SEQ ID NO: 773816 - DNA, 25 bp, Mus musculus
tagcataatggactggcctccccta

SEQ ID NO: 773817 - DNA, 25 bp, Mus musculus
tagcataatggagtggcctccccta

SEQ ID NO: 773818 - DNA, 25 bp, Mus musculus
tagcatacaagcatagtaatcctaa

SEQ ID NO: 773819 - DNA, 25 bp, Mus musculus
tagcatacaagcttagtaatcctaa

SEQ ID NO: 773820 - DNA, 25 bp, Mus musculus
tagcatacacagaagccaggcccag

SEQ ID NO: 773821 - DNA, 25 bp, Mus musculus
tagcatacacagtagccaggcccag

SEQ ID NO: 773822 - DNA, 25 bp, Mus musculus
tagcatagagttcctagcctggcgt

SEQ ID NO: 773823 - DNA, 25 bp, Mus musculus
tagcatagagttgctagcctggcgt

SEQ ID NO: 773824 - DNA, 25 bp, Mus musculus
tagcatagctggcaatggagttacc

SEQ ID NO: 773825 - DNA, 25 bp, Mus musculus
tagcatagctgggaatggagttacc

SEQ ID NO: 773826 - DNA, 25 bp, Mus musculus
tagcataggaacaatccccaggctc

SEQ ID NO: 773827 - DNA, 25 bp, Mus musculus
tagcataggaactatccccaggctc

SEQ ID NO: 773828 - DNA, 25 bp, Mus musculus
tagcatagtctacatctctgaacat

SEQ ID NO: 773829 - DNA, 25 bp, Mus musculus
tagcatagtctagatctctgaacat

SEQ ID NO: 773830 - DNA, 25 bp, Mus musculus
tagcatatacctacactattcattt

SEQ ID NO: 773831 - DNA, 25 bp, Mus musculus
tagcatataccttcactattcattt

SEQ ID NO: 773832 - DNA, 25 bp, Mus musculus
tagcatatatttacgaattccaagt

SEQ ID NO: 773833 - DNA, 25 bp, Mus musculus
tagcatatattttcgaattccaagt

SEQ ID NO: 773834 - DNA, 25 bp, Mus musculus
tagcatatccgtcctgctgctcagc

SEQ ID NO: 773835 - DNA, 25 bp, Mus musculus
tagcatatccgtgctgctgctcagc

SEQ ID NO: 773836 - DNA, 25 bp, Mus musculus
tagcatatcctacccttagtatcac

SEQ ID NO: 773837 - DNA, 25 bp, Mus musculus
tagcatatcctactggcgtgtgcca

SEQ ID NO: 773838 - DNA, 25 bp, Mus musculus
tagcatatcctagccttagtatcac

SEQ ID NO: 773839 - DNA, 25 bp, Mus musculus
tagcatatcctagtggcgtgtgcca

SEQ ID NO: 773840 - DNA, 25 bp, Mus musculus
tagcatatgatgagtgtctcagcac

SEQ ID NO: 773841 - DNA, 25 bp, Mus musculus
tagcatatgatgtgtgtctcagcac

SEQ ID NO: 773842 - DNA, 25 bp, Mus musculus
tagcatattcttctattcccattct

SEQ ID NO: 773843 - DNA, 25 bp, Mus musculus
tagcatattcttgtattcccattct

SEQ ID NO: 773844 - DNA, 25 bp, Mus musculus
tagcatatttcactttcctagacac

SEQ ID NO: 773845 - DNA, 25 bp, Mus musculus
tagcatatttcagtttcctagacac

SEQ ID NO: 773846 - DNA, 25 bp, Mus musculus
tagcatcaatgccagctcatggtgg

SEQ ID NO: 773847 - DNA, 25 bp, Mus musculus
tagcatcaatgcgagctcatggtgg

SEQ ID NO: 773848 - DNA, 25 bp, Mus musculus
tagcatcacaaacattttcaggcaa

SEQ ID NO: 773849 - DNA, 25 bp, Mus musculus
tagcatcacaaagattttcaggcaa

SEQ ID NO: 773850 - DNA, 25 bp, Mus musculus
tagcatcacataacgaccttgtcaa

SEQ ID NO: 773851 - DNA, 25 bp, Mus musculus
tagcatcacatatcgaccttgtcaa

SEQ ID NO: 773852 - DNA, 25 bp, Mus musculus
tagcatcaccctattccatgggtat

SEQ ID NO: 773853 - DNA, 25 bp, Mus musculus
tagcatcacccttttccatgggtat

SEQ ID NO: 773854 - DNA, 25 bp, Mus musculus
tagcatcatgtaccgtctcaggact

SEQ ID NO: 773855 - DNA, 25 bp, Mus musculus
tagcatcatgtagcgtctcaggact

SEQ ID NO: 773856 - DNA, 25 bp, Mus musculus
tagcatcatttcctaggccccaaat

SEQ ID NO: 773857 - DNA, 25 bp, Mus musculus
tagcatcatttcgtaggccccaaat

SEQ ID NO: 773858 - DNA, 25 bp, Mus musculus
tagcatcattttcgttctgggttat

SEQ ID NO: 773859 - DNA, 25 bp, Mus musculus
tagcatcattttggttctgggttat

SEQ ID NO: 773860 - DNA, 25 bp, Mus musculus
tagcatccaactatccatctatcag

SEQ ID NO: 773861 - DNA, 25 bp, Mus musculus
tagcatccaactttccatctatcag

SEQ ID NO: 773862 - DNA, 25 bp, Mus musculus
tagcatccagaaagcgactcttcat

SEQ ID NO: 773863 - DNA, 25 bp, Mus musculus
tagcatccagaatgcgactcttcat

SEQ ID NO: 773864 - DNA, 25 bp, Mus musculus
tagcatccagataaagcacacttgt

SEQ ID NO: 773865 - DNA, 25 bp, Mus musculus
tagcatccagattaagcacacttgt

SEQ ID NO: 773866 - DNA, 25 bp, Mus musculus
tagcatcccagaaggtatctcctgc

SEQ ID NO: 773867 - DNA, 25 bp, Mus musculus
tagcatcccagatggtatctcctgc

SEQ ID NO: 773868 - DNA, 25 bp, Mus musculus
tagcatccggcaacatgtagccctt

SEQ ID NO: 773869 - DNA, 25 bp, Mus musculus
tagcatccggcatcatgtagccctt

SEQ ID NO: 773870 - DNA, 25 bp, Mus musculus
tagcatccgtctaaatctgtagttg

SEQ ID NO: 773871 - DNA, 25 bp, Mus musculus
tagcatccgtcttaatctgtagttg

SEQ ID NO: 773872 - DNA, 25 bp, Mus musculus
tagcatcctgagctctcaataacat

SEQ ID NO: 773873 - DNA, 25 bp, Mus musculus
tagcatcctgaggtctcaataacat

SEQ ID NO: 773874 - DNA, 25 bp, Mus musculus
tagcatcctttgaggcaagtgttcc

SEQ ID NO: 773875 - DNA, 25 bp, Mus musculus
tagcatcctttgtggcaagtgttcc

SEQ ID NO: 773876 - DNA, 25 bp, Mus musculus
tagcatcgacataccctcaggatgg

SEQ ID NO: 773877 - DNA, 25 bp, Mus musculus
tagcatcgacattccctcaggatgg

SEQ ID NO: 773878 - DNA, 25 bp, Mus musculus
tagcatcgggccattcgacataagt

SEQ ID NO: 773879 - DNA, 25 bp, Mus musculus
tagcatcgggcctttcgacataagt

SEQ ID NO: 773880 - DNA, 25 bp, Mus musculus
tagcatcgtcagctgtgatgcctgc

SEQ ID NO: 773881 - DNA, 25 bp, Mus musculus
tagcatcgtcaggtgtgatgcctgc

SEQ ID NO: 773882 - DNA, 25 bp, Mus musculus
tagcatctaatacccgtgaacacgc

SEQ ID NO: 773883 - DNA, 25 bp, Mus musculus
tagcatctaatagccgtgaacacgc

SEQ ID NO: 773884 - DNA, 25 bp, Mus musculus
tagcatctagcacagtgcatagcac

SEQ ID NO: 773885 - DNA, 25 bp, Mus musculus
tagcatctagcagagtgcatagcac

SEQ ID NO: 773886 - DNA, 25 bp, Mus musculus
tagcatctagtgagattgtcatggt

SEQ ID NO: 773887 - DNA, 25 bp, Mus musculus
tagcatctagtgtgattgtcatggt

SEQ ID NO: 773888 - DNA, 25 bp, Mus musculus
tagcatctcgtgctaattccctaag

SEQ ID NO: 773889 - DNA, 25 bp, Mus musculus
tagcatctcgtggtaattccctaag

SEQ ID NO: 773890 - DNA, 25 bp, Mus musculus
tagcatctctatctgcaaggtaatg

SEQ ID NO: 773891 - DNA, 25 bp, Mus musculus
tagcatctctatgtgcaaggtaatg

SEQ ID NO: 773892 - DNA, 25 bp, Mus musculus
tagcatctctgtattcatcaatgga

SEQ ID NO: 773893 - DNA, 25 bp, Mus musculus
tagcatctctgttttcatcaatgga

SEQ ID NO: 773894 - DNA, 25 bp, Mus musculus
tagcatctgctcataacttctgctc

SEQ ID NO: 773895 - DNA, 25 bp, Mus musculus
tagcatctgctcttaacttctgctc

SEQ ID NO: 773896 - DNA, 25 bp, Mus musculus
tagcatctgcttcccacgtactgga

SEQ ID NO: 773897 - DNA, 25 bp, Mus musculus
tagcatctgcttgccacgtactgga

SEQ ID NO: 773898 - DNA, 25 bp, Mus musculus
tagcatctggatcccccccagcaca

SEQ ID NO: 773899 - DNA, 25 bp, Mus musculus
tagcatctggatgccccccagcaca

SEQ ID NO: 773900 - DNA, 25 bp, Mus musculus
tagcatctgtcaaggcatctgcgat

SEQ ID NO: 773901 - DNA, 25 bp, Mus musculus
tagcatctgtcatggcatctgcgat

SEQ ID NO: 773902 - DNA, 25 bp, Mus musculus
tagcatcttcccattaggacaagtc

SEQ ID NO: 773903 - DNA, 25 bp, Mus musculus
tagcatcttccctttaggacaagtc

SEQ ID NO: 773904 - DNA, 25 bp, Mus musculus
tagcatcttgctaaatgccctcttt

SEQ ID NO: 773905 - DNA, 25 bp, Mus musculus
tagcatcttgctacataacgagtgg

SEQ ID NO: 773906 - DNA, 25 bp, Mus musculus
tagcatcttgcttaatgccctcttt

SEQ ID NO: 773907 - DNA, 25 bp, Mus musculus
tagcatcttgcttcataacgagtgg

SEQ ID NO: 773908 - DNA, 25 bp, Mus musculus
tagcatctttcactacttcccctgg

SEQ ID NO: 773909 - DNA, 25 bp, Mus musculus
tagcatctttcagtacttcccctgg

SEQ ID NO: 773910 - DNA, 25 bp, Mus musculus
tagcatgagattaccacaccaagat

SEQ ID NO: 773911 - DNA, 25 bp, Mus musculus
tagcatgagatttccacaccaagat

SEQ ID NO: 773912 - DNA, 25 bp, Mus musculus
tagcatgagcatagtgttacacaat

SEQ ID NO: 773913 - DNA, 25 bp, Mus musculus
tagcatgagcattgtgttacacaat

SEQ ID NO: 773914 - DNA, 25 bp, Mus musculus
tagcatgatctaaagccaggcatag

SEQ ID NO: 773915 - DNA, 25 bp, Mus musculus
tagcatgatctaaatttgggacaac

SEQ ID NO: 773916 - DNA, 25 bp, Mus musculus
tagcatgatctatagccaggcatag

SEQ ID NO: 773917 - DNA, 25 bp, Mus musculus
tagcatgatctatatttgggacaac

SEQ ID NO: 773918 - DNA, 25 bp, Mus musculus
tagcatgatgacctgcatctttcca

SEQ ID NO: 773919 - DNA, 25 bp, Mus musculus
tagcatgatgacgtgcatctttcca

SEQ ID NO: 773920 - DNA, 25 bp, Mus musculus
tagcatgatggtatagattttcttc

SEQ ID NO: 773921 - DNA, 25 bp, Mus musculus
tagcatgatggtttagattttcttc

SEQ ID NO: 773922 - DNA, 25 bp, Mus musculus
tagcatgatgttataggcagtcttt

SEQ ID NO: 773923 - DNA, 25 bp, Mus musculus
tagcatgatgttttaggcagtcttt

SEQ ID NO: 773924 - DNA, 25 bp, Mus musculus
tagcatgcacatcatcagcccttca

SEQ ID NO: 773925 - DNA, 25 bp, Mus musculus
tagcatgcacatgatcagcccttca

SEQ ID NO: 773926 - DNA, 25 bp, Mus musculus
tagcatgcatctaacccttgaattt

SEQ ID NO: 773927 - DNA, 25 bp, Mus musculus
tagcatgcatcttacccttgaattt

SEQ ID NO: 773928 - DNA, 25 bp, Mus musculus
tagcatgcatggctctctgggttct

SEQ ID NO: 773929 - DNA, 25 bp, Mus musculus
tagcatgcatgggtctctgggttct

SEQ ID NO: 773930 - DNA, 25 bp, Mus musculus
tagcatgccaagactaccatctcgg

SEQ ID NO: 773931 - DNA, 25 bp, Mus musculus
tagcatgccaagtctaccatctcgg

SEQ ID NO: 773932 - DNA, 25 bp, Mus musculus
tagcatgccattaagcgagggtttt

SEQ ID NO: 773933 - DNA, 25 bp, Mus musculus
tagcatgccatttagcgagggtttt

SEQ ID NO: 773934 - DNA, 25 bp, Mus musculus
tagcatgcctaccatttgccagtca

SEQ ID NO: 773935 - DNA, 25 bp, Mus musculus
tagcatgcctacgatttgccagtca

SEQ ID NO: 773936 - DNA, 25 bp, Mus musculus
tagcatgctaagattcaggactggc

SEQ ID NO: 773937 - DNA, 25 bp, Mus musculus
tagcatgctaagtttcaggactggc

SEQ ID NO: 773938 - DNA, 25 bp, Mus musculus
tagcatgctaggaacttactcagat

SEQ ID NO: 773939 - DNA, 25 bp, Mus musculus
tagcatgctaggtacttactcagat

SEQ ID NO: 773940 - DNA, 25 bp, Mus musculus
tagcatgctattcccaatcagtttt

SEQ ID NO: 773941 - DNA, 25 bp, Mus musculus
tagcatgctattgccaatcagtttt

SEQ ID NO: 773942 - DNA, 25 bp, Mus musculus
tagcatgctcccagtgtctgagaat

SEQ ID NO: 773943 - DNA, 25 bp, Mus musculus
tagcatgctccctgtgtctgagaat

SEQ ID NO: 773944 - DNA, 25 bp, Mus musculus
tagcatgctcttaggttctctaggg

SEQ ID NO: 773945 - DNA, 25 bp, Mus musculus
tagcatgctcttcagattgtggctg

SEQ ID NO: 773946 - DNA, 25 bp, Mus musculus
tagcatgctcttgagattgtggctg

SEQ ID NO: 773947 - DNA, 25 bp, Mus musculus
tagcatgctctttggttctctaggg

SEQ ID NO: 773948 - DNA, 25 bp, Mus musculus
tagcatgctgaacaaggacctcaac

SEQ ID NO: 773949 - DNA, 25 bp, Mus musculus
tagcatgctgaagaaggacctcaac

SEQ ID NO: 773950 - DNA, 25 bp, Mus musculus
tagcatgctgcgagtgcacgggctc

SEQ ID NO: 773951 - DNA, 25 bp, Mus musculus
tagcatgctgcgtgtgcacgggctc

SEQ ID NO: 773952 - DNA, 25 bp, Mus musculus
tagcatggacccctcaagtgggact

SEQ ID NO: 773953 - DNA, 25 bp, Mus musculus
tagcatggacccgtcaagtgggact

SEQ ID NO: 773954 - DNA, 25 bp, Mus musculus
tagcatggcagtcctgtccacagat

SEQ ID NO: 773955 - DNA, 25 bp, Mus musculus
tagcatggcagtgctgtccacagat

SEQ ID NO: 773956 - DNA, 25 bp, Mus musculus
tagcatgggcacctttctgcttcta

SEQ ID NO: 773957 - DNA, 25 bp, Mus musculus
tagcatgggcacgtttctgcttcta

SEQ ID NO: 773958 - DNA, 25 bp, Mus musculus
tagcatgggtggctctctgagtccc

SEQ ID NO: 773959 - DNA, 25 bp, Mus musculus
tagcatgggtgggtctctgagtccc

SEQ ID NO: 773960 - DNA, 25 bp, Mus musculus
tagcatggttttaaagcctgcctcc

SEQ ID NO: 773961 - DNA, 25 bp, Mus musculus
tagcatggtttttaagcctgcctcc

SEQ ID NO: 773962 - DNA, 25 bp, Mus musculus
tagcatgtacacaccccttagggtc

SEQ ID NO: 773963 - DNA, 25 bp, Mus musculus
tagcatgtacaccacacccaaagag

SEQ ID NO: 773964 - DNA, 25 bp, Mus musculus
tagcatgtacacgacacccaaagag

SEQ ID NO: 773965 - DNA, 25 bp, Mus musculus
tagcatgtacactccccttagggtc

SEQ ID NO: 773966 - DNA, 25 bp, Mus musculus
tagcatgtcacaaagtcagcctaag

SEQ ID NO: 773967 - DNA, 25 bp, Mus musculus
tagcatgtcacatagtcagcctaag

SEQ ID NO: 773968 - DNA, 25 bp, Mus musculus
tagcatgtcagcagcagtccaaaag

SEQ ID NO: 773969 - DNA, 25 bp, Mus musculus
tagcatgtcagctgcagtccaaaag

SEQ ID NO: 773970 - DNA, 25 bp, Mus musculus
tagcatgtctgcagggccacagtac

SEQ ID NO: 773971 - DNA, 25 bp, Mus musculus
tagcatgtctgctgggccacagtac

SEQ ID NO: 773972 - DNA, 25 bp, Mus musculus
tagcatgtgacgaaccaagtggagc

SEQ ID NO: 773973 - DNA, 25 bp, Mus musculus
tagcatgtgacgtaccaagtggagc

SEQ ID NO: 773974 - DNA, 25 bp, Mus musculus
tagcatgtgcatcgttttgcgtgca

SEQ ID NO: 773975 - DNA, 25 bp, Mus musculus
tagcatgtgcatggttttgcgtgca

SEQ ID NO: 773976 - DNA, 25 bp, Mus musculus
tagcatgtgcttcagactagtgact

SEQ ID NO: 773977 - DNA, 25 bp, Mus musculus
tagcatgtgcttgagactagtgact

SEQ ID NO: 773978 - DNA, 25 bp, Mus musculus
tagcatgttgctaaagcacttgctt

SEQ ID NO: 773979 - DNA, 25 bp, Mus musculus
tagcatgttgcttaagcacttgctt

SEQ ID NO: 773980 - DNA, 25 bp, Mus musculus
tagcatgtttctccctagctgtctt

SEQ ID NO: 773981 - DNA, 25 bp, Mus musculus
tagcatgtttctgcctagctgtctt

SEQ ID NO: 773982 - DNA, 25 bp, Mus musculus
tagcattaggaacccgttacccaca

SEQ ID NO: 773983 - DNA, 25 bp, Mus musculus
tagcattaggaagccgttacccaca

SEQ ID NO: 773984 - DNA, 25 bp, Mus musculus
tagcattcaattaggcagacactgg

SEQ ID NO: 773985 - DNA, 25 bp, Mus musculus
tagcattcaatttggcagacactgg

SEQ ID NO: 773986 - DNA, 25 bp, Mus musculus
tagcattcacacaaggtaacctccc

SEQ ID NO: 773987 - DNA, 25 bp, Mus musculus
tagcattcacactaggtaacctccc

SEQ ID NO: 773988 - DNA, 25 bp, Mus musculus
tagcattcaggaccctcaaggtcat

SEQ ID NO: 773989 - DNA, 25 bp, Mus musculus
tagcattcaggagcctcaaggtcat

SEQ ID NO: 773990 - DNA, 25 bp, Mus musculus
tagcattcagtgcagttttcaataa

SEQ ID NO: 773991 - DNA, 25 bp, Mus musculus
tagcattcagtggagttttcaataa

SEQ ID NO: 773992 - DNA, 25 bp, Mus musculus
tagcattcctagcatttcagcgcga

SEQ ID NO: 773993 - DNA, 25 bp, Mus musculus
tagcattcctaggatttcagcgcga

SEQ ID NO: 773994 - DNA, 25 bp, Mus musculus
tagcattcgcggctgactggaaacc

SEQ ID NO: 773995 - DNA, 25 bp, Mus musculus
tagcattcgcgggtgactggaaacc

SEQ ID NO: 773996 - DNA, 25 bp, Mus musculus
tagcattcttcccattttgacttgt

SEQ ID NO: 773997 - DNA, 25 bp, Mus musculus
tagcattcttccgattttgacttgt

SEQ ID NO: 773998 - DNA, 25 bp, Mus musculus
tagcattctttgaagcaccctaatc

SEQ ID NO: 773999 - DNA, 25 bp, Mus musculus
tagcattctttgtagcaccctaatc

SEQ ID NO: 774000 - DNA, 25 bp, Mus musculus
tagcattgaattcggcatctgtggc

SEQ ID NO: 774001 - DNA, 25 bp, Mus musculus
tagcattgaattcggtgggtctttc

SEQ ID NO: 774002 - DNA, 25 bp, Mus musculus
tagcattgaattgggcatctgtggc

SEQ ID NO: 774003 - DNA, 25 bp, Mus musculus
tagcattgaattgggtgggtctttc

SEQ ID NO: 774004 - DNA, 25 bp, Mus musculus
tagcattgacttaacaaccccagac

SEQ ID NO: 774005 - DNA, 25 bp, Mus musculus
tagcattgactttacaaccccagac

SEQ ID NO: 774006 - DNA, 25 bp, Mus musculus
tagcattgagaccagcgaaggacaa

SEQ ID NO: 774007 - DNA, 25 bp, Mus musculus
tagcattgagacgagcgaaggacaa

SEQ ID NO: 774008 - DNA, 25 bp, Mus musculus
tagcattggcctctatctcttgcac

SEQ ID NO: 774009 - DNA, 25 bp, Mus musculus
tagcattggcctgtatctcttgcac

SEQ ID NO: 774010 - DNA, 25 bp, Mus musculus
tagcattgtactctgatgaaaggac

SEQ ID NO: 774011 - DNA, 25 bp, Mus musculus
tagcattgtactgtgatgaaaggac

SEQ ID NO: 774012 - DNA, 25 bp, Mus musculus
tagcattgtagtcatgggcaaccta

SEQ ID NO: 774013 - DNA, 25 bp, Mus musculus
tagcattgtagtgatgggcaaccta

SEQ ID NO: 774014 - DNA, 25 bp, Mus musculus
tagcattgtcctcggattgtttgcc

SEQ ID NO: 774015 - DNA, 25 bp, Mus musculus
tagcattgtcctgggattgtttgcc

SEQ ID NO: 774016 - DNA, 25 bp, Mus musculus
tagcatttaagaatacctgtaacga

SEQ ID NO: 774017 - DNA, 25 bp, Mus musculus
tagcatttaagattacctgtaacga

SEQ ID NO: 774018 - DNA, 25 bp, Mus musculus
tagcatttatacataaccacctcag

SEQ ID NO: 774019 - DNA, 25 bp, Mus musculus
tagcatttatacttaaccacctcag

SEQ ID NO: 774020 - DNA, 25 bp, Mus musculus
tagcatttcaatctgcagcagggac

SEQ ID NO: 774021 - DNA, 25 bp, Mus musculus
tagcatttcaatgtgcagcagggac

SEQ ID NO: 774022 - DNA, 25 bp, Mus musculus
tagcatttcaggatgagccaccata

SEQ ID NO: 774023 - DNA, 25 bp, Mus musculus
tagcatttcaggttgagccaccata

SEQ ID NO: 774024 - DNA, 25 bp, Mus musculus
tagcatttccacaggcggtaggcaa

SEQ ID NO: 774025 - DNA, 25 bp, Mus musculus
tagcatttccactggcggtaggcaa

SEQ ID NO: 774026 - DNA, 25 bp, Mus musculus
tagcatttctcacccttctgattaa

SEQ ID NO: 774027 - DNA, 25 bp, Mus musculus
tagcatttctcagccttctgattaa

SEQ ID NO: 774028 - DNA, 25 bp, Mus musculus
tagcatttgcagatgacttcaccct

SEQ ID NO: 774029 - DNA, 25 bp, Mus musculus
tagcatttgcagttgacttcaccct

SEQ ID NO: 774030 - DNA, 25 bp, Mus musculus
tagcattttacactctacctgcggg

SEQ ID NO: 774031 - DNA, 25 bp, Mus musculus
tagcattttacagtctacctgcggg

SEQ ID NO: 774032 - DNA, 25 bp, Mus musculus
tagcattttatacgcgtcgttacgg

SEQ ID NO: 774033 - DNA, 25 bp, Mus musculus
tagcattttataggcgtcgttacgg

SEQ ID NO: 774034 - DNA, 25 bp, Mus musculus
tagcattttggccttgtagggtata

SEQ ID NO: 774035 - DNA, 25 bp, Mus musculus
tagcattttggcgttgtagggtata

SEQ ID NO: 774036 - DNA, 25 bp, Mus musculus
tagcatttttctcaacccatgcctc

SEQ ID NO: 774037 - DNA, 25 bp, Mus musculus
tagcatttttctgaacccatgcctc

SEQ ID NO: 774038 - DNA, 25 bp, Mus musculus
tagcattttttgattggtctcttaa

SEQ ID NO: 774039 - DNA, 25 bp, Mus musculus
tagcattttttgtttggtctcttaa

SEQ ID NO: 774040 - DNA, 25 bp, Mus musculus
tagccaaaacctcgtcagagccttc

SEQ ID NO: 774041 - DNA, 25 bp, Mus musculus
tagccaaaacctggtcagagccttc

SEQ ID NO: 774042 - DNA, 25 bp, Mus musculus
tagccaaaatggaccttcaagtaat

SEQ ID NO: 774043 - DNA, 25 bp, Mus musculus
tagccaaaatggtccttcaagtaat

SEQ ID NO: 774044 - DNA, 25 bp, Mus musculus
tagccaaacccactcctgttggtgg

SEQ ID NO: 774045 - DNA, 25 bp, Mus musculus
tagccaaacccagtcctgttggtgg

SEQ ID NO: 774046 - DNA, 25 bp, Mus musculus
tagccaaacttgacttttcccatag

SEQ ID NO: 774047 - DNA, 25 bp, Mus musculus
tagccaaacttgtcttttcccatag

SEQ ID NO: 774048 - DNA, 25 bp, Mus musculus
tagccaaagaagaactcgacggagt

SEQ ID NO: 774049 - DNA, 25 bp, Mus musculus
tagccaaagaagtactcgacggagt

SEQ ID NO: 774050 - DNA, 25 bp, Mus musculus
tagccaaagacgaccttgaactctt

SEQ ID NO: 774051 - DNA, 25 bp, Mus musculus
tagccaaagacgtccttgaactctt

SEQ ID NO: 774052 - DNA, 25 bp, Mus musculus
tagccaaagtgaacctaagcacaca

SEQ ID NO: 774053 - DNA, 25 bp, Mus musculus
tagccaaagtgatcctaagcacaca

SEQ ID NO: 774054 - DNA, 25 bp, Mus musculus
tagccaacattaaagcattgtggtg

SEQ ID NO: 774055 - DNA, 25 bp, Mus musculus
tagccaacattatagcattgtggtg

SEQ ID NO: 774056 - DNA, 25 bp, Mus musculus
tagccaaccaagagttaagaagtat

SEQ ID NO: 774057 - DNA, 25 bp, Mus musculus
tagccaaccaagtgttaagaagtat

SEQ ID NO: 774058 - DNA, 25 bp, Mus musculus
tagccaaccacccacagaggaaaag

SEQ ID NO: 774059 - DNA, 25 bp, Mus musculus
tagccaaccaccgacagaggaaaag

SEQ ID NO: 774060 - DNA, 25 bp, Mus musculus
tagccaaccgtgcttctcagaacat

SEQ ID NO: 774061 - DNA, 25 bp, Mus musculus
tagccaaccgtggttctcagaacat

SEQ ID NO: 774062 - DNA, 25 bp, Mus musculus
tagccaacttggactcagtgctttg

SEQ ID NO: 774063 - DNA, 25 bp, Mus musculus
tagccaacttggtctcagtgctttg

SEQ ID NO: 774064 - DNA, 25 bp, Mus musculus
tagccaagaattcttatgactcaca

SEQ ID NO: 774065 - DNA, 25 bp, Mus musculus
tagccaagaattgttatgactcaca

SEQ ID NO: 774066 - DNA, 25 bp, Mus musculus
tagccaagagtacagtgtgcaacat

SEQ ID NO: 774067 - DNA, 25 bp, Mus musculus
tagccaagagtagagtgtgcaacat

SEQ ID NO: 774068 - DNA, 25 bp, Mus musculus
tagccaagagtgacttttgctcctc

SEQ ID NO: 774069 - DNA, 25 bp, Mus musculus
tagccaagagtgtcttttgctcctc

SEQ ID NO: 774070 - DNA, 25 bp, Mus musculus
tagccaagatcacaggtaaccccag

SEQ ID NO: 774071 - DNA, 25 bp, Mus musculus
tagccaagatcagaggtaaccccag

SEQ ID NO: 774072 - DNA, 25 bp, Mus musculus
tagccaagcctcaggacgacaagaa

SEQ ID NO: 774073 - DNA, 25 bp, Mus musculus
tagccaagcctctggacgacaagaa

SEQ ID NO: 774074 - DNA, 25 bp, Mus musculus
tagccaagcggcaccatcagaaaat

SEQ ID NO: 774075 - DNA, 25 bp, Mus musculus
tagccaagcggctccatcagaaaat

SEQ ID NO: 774076 - DNA, 25 bp, Mus musculus
tagccaaggataaccaagaccctcc

SEQ ID NO: 774077 - DNA, 25 bp, Mus musculus
tagccaaggatatccaagaccctcc

SEQ ID NO: 774078 - DNA, 25 bp, Mus musculus
tagccaaggcttccagcaaatcctt

SEQ ID NO: 774079 - DNA, 25 bp, Mus musculus
tagccaaggcttgcagcaaatcctt

SEQ ID NO: 774080 - DNA, 25 bp, Mus musculus
tagccaagttggacatcaatgagag

SEQ ID NO: 774081 - DNA, 25 bp, Mus musculus
tagccaagttggtcatcaatgagag

SEQ ID NO: 774082 - DNA, 25 bp, Mus musculus
tagccaatccttccgtgtactttat

SEQ ID NO: 774083 - DNA, 25 bp, Mus musculus
tagccaatccttgcgtgtactttat

SEQ ID NO: 774084 - DNA, 25 bp, Mus musculus
tagccaatctaacaagaccccatct

SEQ ID NO: 774085 - DNA, 25 bp, Mus musculus
tagccaatctaagaagaccccatct

SEQ ID NO: 774086 - DNA, 25 bp, Mus musculus
tagccaatcttaagatccccggtgt

SEQ ID NO: 774087 - DNA, 25 bp, Mus musculus
tagccaatcttatgatccccggtgt

SEQ ID NO: 774088 - DNA, 25 bp, Mus musculus
tagccaatgatgagaactgcggcat

SEQ ID NO: 774089 - DNA, 25 bp, Mus musculus
tagccaatgatgtgaactgcggcat

SEQ ID NO: 774090 - DNA, 25 bp, Mus musculus
tagccaattagtatagcttccgatt

SEQ ID NO: 774091 - DNA, 25 bp, Mus musculus
tagccaattagtttagcttccgatt

SEQ ID NO: 774092 - DNA, 25 bp, Mus musculus
tagccaattatcatgggccgatctc

SEQ ID NO: 774093 - DNA, 25 bp, Mus musculus
tagccaattatcttgggccgatctc

SEQ ID NO: 774094 - DNA, 25 bp, Mus musculus
tagccaattgctaaggtatgtacaa

SEQ ID NO: 774095 - DNA, 25 bp, Mus musculus
tagccaattgcttaggtatgtacaa

SEQ ID NO: 774096 - DNA, 25 bp, Mus musculus
tagccaatttttcagttcttttctg

SEQ ID NO: 774097 - DNA, 25 bp, Mus musculus
tagccaatttttgagttcttttctg

SEQ ID NO: 774098 - DNA, 25 bp, Mus musculus
tagccacacatgacctcaactataa

SEQ ID NO: 774099 - DNA, 25 bp, Mus musculus
tagccacacatgtcctcaactataa

SEQ ID NO: 774100 - DNA, 25 bp, Mus musculus
tagccacagaagagcactgcttcct

SEQ ID NO: 774101 - DNA, 25 bp, Mus musculus
tagccacagaagtgcactgcttcct

SEQ ID NO: 774102 - DNA, 25 bp, Mus musculus
tagccacagaataatcttgtaattg

SEQ ID NO: 774103 - DNA, 25 bp, Mus musculus
tagccacagaattatcttgtaattg

SEQ ID NO: 774104 - DNA, 25 bp, Mus musculus
tagccacaggtgcagatattttcct

SEQ ID NO: 774105 - DNA, 25 bp, Mus musculus
tagccacaggtggagatattttcct

SEQ ID NO: 774106 - DNA, 25 bp, Mus musculus
tagccacatgctactttgttgctgt

SEQ ID NO: 774107 - DNA, 25 bp, Mus musculus
tagccacatgcttctttgttgctgt

SEQ ID NO: 774108 - DNA, 25 bp, Mus musculus
tagccacatgtcagtagcaactcct

SEQ ID NO: 774109 - DNA, 25 bp, Mus musculus
tagccacatgtctgtagcaactcct

SEQ ID NO: 774110 - DNA, 25 bp, Mus musculus
tagccacatttgaagtctaagccat

SEQ ID NO: 774111 - DNA, 25 bp, Mus musculus
tagccacatttgtagtctaagccat

SEQ ID NO: 774112 - DNA, 25 bp, Mus musculus
tagccaccaaggaatgagactctgt

SEQ ID NO: 774113 - DNA, 25 bp, Mus musculus
tagccaccaaggaccacttcagaat

SEQ ID NO: 774114 - DNA, 25 bp, Mus musculus
tagccaccaaggtatgagactctgt

SEQ ID NO: 774115 - DNA, 25 bp, Mus musculus
tagccaccaaggtccacttcagaat

SEQ ID NO: 774116 - DNA, 25 bp, Mus musculus
tagccaccaatgagctcactggtga

SEQ ID NO: 774117 - DNA, 25 bp, Mus musculus
tagccaccaatgtgctcactggtga

SEQ ID NO: 774118 - DNA, 25 bp, Mus musculus
tagccaccagctaggttcagcagga

SEQ ID NO: 774119 - DNA, 25 bp, Mus musculus
tagccaccagcttggttcagcagga

SEQ ID NO: 774120 - DNA, 25 bp, Mus musculus
tagccaccataaaccttattgcatg

SEQ ID NO: 774121 - DNA, 25 bp, Mus musculus
tagccaccataatccttattgcatg

SEQ ID NO: 774122 - DNA, 25 bp, Mus musculus
tagccacccacgctcatatgggtat

SEQ ID NO: 774123 - DNA, 25 bp, Mus musculus
tagccacccacggtcatatgggtat

SEQ ID NO: 774124 - DNA, 25 bp, Mus musculus
tagccacccaggagctgaagtttcc

SEQ ID NO: 774125 - DNA, 25 bp, Mus musculus
tagccacccaggtgctgaagtttcc

SEQ ID NO: 774126 - DNA, 25 bp, Mus musculus
tagccaccccttacgattatgcagt

SEQ ID NO: 774127 - DNA, 25 bp, Mus musculus
tagccacccctttcgattatgcagt

SEQ ID NO: 774128 - DNA, 25 bp, Mus musculus
tagccaccctacctattactagagg

SEQ ID NO: 774129 - DNA, 25 bp, Mus musculus
tagccaccctacgtattactagagg

SEQ ID NO: 774130 - DNA, 25 bp, Mus musculus
tagccaccgtagacagctacgtcat

SEQ ID NO: 774131 - DNA, 25 bp, Mus musculus
tagccaccgtagagactgcatgacc

SEQ ID NO: 774132 - DNA, 25 bp, Mus musculus
tagccaccgtagtcagctacgtcat

SEQ ID NO: 774133 - DNA, 25 bp, Mus musculus
tagccaccgtagtgactgcatgacc

SEQ ID NO: 774134 - DNA, 25 bp, Mus musculus
tagccacctctcctgtaaacattgt

SEQ ID NO: 774135 - DNA, 25 bp, Mus musculus
tagccacctctcgtgtaaacattgt

SEQ ID NO: 774136 - DNA, 25 bp, Mus musculus
tagccaccttttagttaactcccag

SEQ ID NO: 774137 - DNA, 25 bp, Mus musculus
tagccacctttttgttaactcccag

SEQ ID NO: 774138 - DNA, 25 bp, Mus musculus
tagccacggaccacaggaaagccct

SEQ ID NO: 774139 - DNA, 25 bp, Mus musculus
tagccacggacctcaggaaagccct

SEQ ID NO: 774140 - DNA, 25 bp, Mus musculus
tagccacgtacaaagcaacccatag

SEQ ID NO: 774141 - DNA, 25 bp, Mus musculus
tagccacgtacatagcaacccatag

SEQ ID NO: 774142 - DNA, 25 bp, Mus musculus
tagccacgtccccaggtactacagt

SEQ ID NO: 774143 - DNA, 25 bp, Mus musculus
tagccacgtcccgaggtactacagt

SEQ ID NO: 774144 - DNA, 25 bp, Mus musculus
tagccactaaaaccacttgacactg

SEQ ID NO: 774145 - DNA, 25 bp, Mus musculus
tagccactaaaagcacttgacactg

SEQ ID NO: 774146 - DNA, 25 bp, Mus musculus
tagccactaagccattgggccaagc

SEQ ID NO: 774147 - DNA, 25 bp, Mus musculus
tagccactaagcgattgggccaagc

SEQ ID NO: 774148 - DNA, 25 bp, Mus musculus
tagccactcctgcattttgtatttg

SEQ ID NO: 774149 - DNA, 25 bp, Mus musculus
tagccactcctggattttgtatttg

SEQ ID NO: 774150 - DNA, 25 bp, Mus musculus
tagccactgtatcctgcatgtagac

SEQ ID NO: 774151 - DNA, 25 bp, Mus musculus
tagccactgtatgctgcatgtagac

SEQ ID NO: 774152 - DNA, 25 bp, Mus musculus
tagccactgttaaagtgagatcact

SEQ ID NO: 774153 - DNA, 25 bp, Mus musculus
tagccactgttatagtgagatcact

SEQ ID NO: 774154 - DNA, 25 bp, Mus musculus
tagccacttgtgcatggcctaagtt

SEQ ID NO: 774155 - DNA, 25 bp, Mus musculus
tagccacttgtggatggcctaagtt

SEQ ID NO: 774156 - DNA, 25 bp, Mus musculus
tagccagaaatgaggtcctggacat

SEQ ID NO: 774157 - DNA, 25 bp, Mus musculus
tagccagaaatgtggtcctggacat

SEQ ID NO: 774158 - DNA, 25 bp, Mus musculus
tagccagaagccacgttacttcaac

SEQ ID NO: 774159 - DNA, 25 bp, Mus musculus
tagccagaagccagagtacgccagt

SEQ ID NO: 774160 - DNA, 25 bp, Mus musculus
tagccagaagcctcgttacttcaac

SEQ ID NO: 774161 - DNA, 25 bp, Mus musculus
tagccagaagcctgagtacgccagt

SEQ ID NO: 774162 - DNA, 25 bp, Mus musculus
tagccagacaccagtgggtttgacc

SEQ ID NO: 774163 - DNA, 25 bp, Mus musculus
tagccagacacctgtgggtttgacc

SEQ ID NO: 774164 - DNA, 25 bp, Mus musculus
tagccagacatgaactatgtaacat

SEQ ID NO: 774165 - DNA, 25 bp, Mus musculus
tagccagacatgatggtatccatct

SEQ ID NO: 774166 - DNA, 25 bp, Mus musculus
tagccagacatgtactatgtaacat

SEQ ID NO: 774167 - DNA, 25 bp, Mus musculus
tagccagacatgttggtatccatct

SEQ ID NO: 774168 - DNA, 25 bp, Mus musculus
tagccagacgctacagtaacaacct

SEQ ID NO: 774169 - DNA, 25 bp, Mus musculus
tagccagacgcttcagtaacaacct

SEQ ID NO: 774170 - DNA, 25 bp, Mus musculus
tagccagagagcacacgttaggaac

SEQ ID NO: 774171 - DNA, 25 bp, Mus musculus
tagccagagagctcacgttaggaac

SEQ ID NO: 774172 - DNA, 25 bp, Mus musculus
tagccagagcaccagcacgacagaa

SEQ ID NO: 774173 - DNA, 25 bp, Mus musculus
tagccagagcacgagcacgacagaa

SEQ ID NO: 774174 - DNA, 25 bp, Mus musculus
tagccagagctgaggccatacccag

SEQ ID NO: 774175 - DNA, 25 bp, Mus musculus
tagccagagctgtggccatacccag

SEQ ID NO: 774176 - DNA, 25 bp, Mus musculus
tagccagatggcacacgttataatt

SEQ ID NO: 774177 - DNA, 25 bp, Mus musculus
tagccagatggctcacgttataatt

SEQ ID NO: 774178 - DNA, 25 bp, Mus musculus
tagccagcaaagctgcttctgtggt

SEQ ID NO: 774179 - DNA, 25 bp, Mus musculus
tagccagcaaaggtgcttctgtggt

SEQ ID NO: 774180 - DNA, 25 bp, Mus musculus
tagccagcaaggaaattctaagtga

SEQ ID NO: 774181 - DNA, 25 bp, Mus musculus
tagccagcaaggtaattctaagtga

SEQ ID NO: 774182 - DNA, 25 bp, Mus musculus
tagccagcaccacttctgtaaccat

SEQ ID NO: 774183 - DNA, 25 bp, Mus musculus
tagccagcaccagttctgtaaccat

SEQ ID NO: 774184 - DNA, 25 bp, Mus musculus
tagccagcaccgaagggactgctat

SEQ ID NO: 774185 - DNA, 25 bp, Mus musculus
tagccagcaccgtagggactgctat

SEQ ID NO: 774186 - DNA, 25 bp, Mus musculus
tagccagcagctcttgtttttctcc

SEQ ID NO: 774187 - DNA, 25 bp, Mus musculus
tagccagcagctctttgaacccagt

SEQ ID NO: 774188 - DNA, 25 bp, Mus musculus
tagccagcagctgttgtttttctcc

SEQ ID NO: 774189 - DNA, 25 bp, Mus musculus
tagccagcagctgtttgaacccagt

SEQ ID NO: 774190 - DNA, 25 bp, Mus musculus
tagccagcatacaccaggcaaattc

SEQ ID NO: 774191 - DNA, 25 bp, Mus musculus
tagccagcatactccaggcaaattc

SEQ ID NO: 774192 - DNA, 25 bp, Mus musculus
tagccagcatttagcgttctgctca

SEQ ID NO: 774193 - DNA, 25 bp, Mus musculus
tagccagcattttgcgttctgctca

SEQ ID NO: 774194 - DNA, 25 bp, Mus musculus
tagccagccctacgtctacctggtt

SEQ ID NO: 774195 - DNA, 25 bp, Mus musculus
tagccagccctaggtctacctggtt

SEQ ID NO: 774196 - DNA, 25 bp, Mus musculus
tagccagcctctacttgggtagaaa

SEQ ID NO: 774197 - DNA, 25 bp, Mus musculus
tagccagcctcttcttgggtagaaa

SEQ ID NO: 774198 - DNA, 25 bp, Mus musculus
tagccagcctgcacatgtgtagcag

SEQ ID NO: 774199 - DNA, 25 bp, Mus musculus
tagccagcctgctcatgtgtagcag

SEQ ID NO: 774200 - DNA, 25 bp, Mus musculus
tagccagcgtttatcgtagtgaact

SEQ ID NO: 774201 - DNA, 25 bp, Mus musculus
tagccagcgtttttcgtagtgaact

SEQ ID NO: 774202 - DNA, 25 bp, Mus musculus
tagccagctaacagcagtaacccca

SEQ ID NO: 774203 - DNA, 25 bp, Mus musculus
tagccagctaactgcagtaacccca

SEQ ID NO: 774204 - DNA, 25 bp, Mus musculus
tagccagctaccacggtaactccaa

SEQ ID NO: 774205 - DNA, 25 bp, Mus musculus
tagccagctacctcggtaactccaa

SEQ ID NO: 774206 - DNA, 25 bp, Mus musculus
tagccagctataccccaaaattgac

SEQ ID NO: 774207 - DNA, 25 bp, Mus musculus
tagccagctatagcccaaaattgac

SEQ ID NO: 774208 - DNA, 25 bp, Mus musculus
tagccagctctcatggacacttgag

SEQ ID NO: 774209 - DNA, 25 bp, Mus musculus
tagccagctctcttggacacttgag

SEQ ID NO: 774210 - DNA, 25 bp, Mus musculus
tagccagctgtcagactcactttta

SEQ ID NO: 774211 - DNA, 25 bp, Mus musculus
tagccagctgtctgactcactttta

SEQ ID NO: 774212 - DNA, 25 bp, Mus musculus
tagccaggaaccatggacaccacag

SEQ ID NO: 774213 - DNA, 25 bp, Mus musculus
tagccaggaaccttggacaccacag

SEQ ID NO: 774214 - DNA, 25 bp, Mus musculus
tagccaggacctatgtatttcattt

SEQ ID NO: 774215 - DNA, 25 bp, Mus musculus
tagccaggacctcggcgagtccttc

SEQ ID NO: 774216 - DNA, 25 bp, Mus musculus
tagccaggacctgggcgagtccttc

SEQ ID NO: 774217 - DNA, 25 bp, Mus musculus
tagccaggacctttgtatttcattt

SEQ ID NO: 774218 - DNA, 25 bp, Mus musculus
tagccaggcctgactacttggtaaa

SEQ ID NO: 774219 - DNA, 25 bp, Mus musculus
tagccaggcctgtctacttggtaaa

SEQ ID NO: 774220 - DNA, 25 bp, Mus musculus
tagccagggaagcagtaccctccct

SEQ ID NO: 774221 - DNA, 25 bp, Mus musculus
tagccagggaaggagtaccctccct

SEQ ID NO: 774222 - DNA, 25 bp, Mus musculus
tagccagggctacctgatatccaca

SEQ ID NO: 774223 - DNA, 25 bp, Mus musculus
tagccagggctagctgatatccaca

SEQ ID NO: 774224 - DNA, 25 bp, Mus musculus
tagccagggtcaaagttgcttttaa

SEQ ID NO: 774225 - DNA, 25 bp, Mus musculus
tagccagggtcatagttgcttttaa

SEQ ID NO: 774226 - DNA, 25 bp, Mus musculus
tagccagggttacctgtgcctttct

SEQ ID NO: 774227 - DNA, 25 bp, Mus musculus
tagccagggttagctgtgcctttct

SEQ ID NO: 774228 - DNA, 25 bp, Mus musculus
tagccaggtaccctgacatcagaaa

SEQ ID NO: 774229 - DNA, 25 bp, Mus musculus
tagccaggtaccgtgacatcagaaa

SEQ ID NO: 774230 - DNA, 25 bp, Mus musculus
tagccaggtaggacttctatgttga

SEQ ID NO: 774231 - DNA, 25 bp, Mus musculus
tagccaggtaggtcttctatgttga

SEQ ID NO: 774232 - DNA, 25 bp, Mus musculus
tagccaggtatgacaccttggccaa

SEQ ID NO: 774233 - DNA, 25 bp, Mus musculus
tagccaggtatgtcaccttggccaa

SEQ ID NO: 774234 - DNA, 25 bp, Mus musculus
tagccaggtggtaggttccaggacc

SEQ ID NO: 774235 - DNA, 25 bp, Mus musculus
tagccaggtggttggttccaggacc

SEQ ID NO: 774236 - DNA, 25 bp, Mus musculus
tagccaggtgtgcatgttgtcgcca

SEQ ID NO: 774237 - DNA, 25 bp, Mus musculus
tagccaggtgtggatgttgtcgcca

SEQ ID NO: 774238 - DNA, 25 bp, Mus musculus
tagccagtaatcatgggcagccttt

SEQ ID NO: 774239 - DNA, 25 bp, Mus musculus
tagccagtaatcttgggcagccttt

SEQ ID NO: 774240 - DNA, 25 bp, Mus musculus
tagccagtactgatgtatgtttgac

SEQ ID NO: 774241 - DNA, 25 bp, Mus musculus
tagccagtactgttgtatgtttgac

SEQ ID NO: 774242 - DNA, 25 bp, Mus musculus
tagccagtagccatgcaggatatct

SEQ ID NO: 774243 - DNA, 25 bp, Mus musculus
tagccagtagccttgcaggatatct

SEQ ID NO: 774244 - DNA, 25 bp, Mus musculus
tagccagtctgcaggtgattcctaa

SEQ ID NO: 774245 - DNA, 25 bp, Mus musculus
tagccagtctgctggtgattcctaa

SEQ ID NO: 774246 - DNA, 25 bp, Mus musculus
tagccagtgacaaaatgtagggagg

SEQ ID NO: 774247 - DNA, 25 bp, Mus musculus
tagccagtgacataatgtagggagg

SEQ ID NO: 774248 - DNA, 25 bp, Mus musculus
tagccagtggtcagattgcagcagc

SEQ ID NO: 774249 - DNA, 25 bp, Mus musculus
tagccagtggtctgattgcagcagc

SEQ ID NO: 774250 - DNA, 25 bp, Mus musculus
tagccagtgtatacatctgcttgga

SEQ ID NO: 774251 - DNA, 25 bp, Mus musculus
tagccagtgtattcatctgcttgga

SEQ ID NO: 774252 - DNA, 25 bp, Mus musculus
tagccagtgtggaccatcttgttag

SEQ ID NO: 774253 - DNA, 25 bp, Mus musculus
tagccagtgtggtccatcttgttag

SEQ ID NO: 774254 - DNA, 25 bp, Mus musculus
tagccagttatacagagcccagaga

SEQ ID NO: 774255 - DNA, 25 bp, Mus musculus
tagccagttatagagagcccagaga

SEQ ID NO: 774256 - DNA, 25 bp, Mus musculus
tagccagttatcatagggaccagga

SEQ ID NO: 774257 - DNA, 25 bp, Mus musculus
tagccagttatcttagggaccagga

SEQ ID NO: 774258 - DNA, 25 bp, Mus musculus
tagccagttcctatgtgttagctct

SEQ ID NO: 774259 - DNA, 25 bp, Mus musculus
tagccagttcctttgtgttagctct

SEQ ID NO: 774260 - DNA, 25 bp, Mus musculus
tagccataaataaatgccctgttat

SEQ ID NO: 774261 - DNA, 25 bp, Mus musculus
tagccataaatatatgccctgttat

SEQ ID NO: 774262 - DNA, 25 bp, Mus musculus
tagccataagccaccaggctggctg

SEQ ID NO: 774263 - DNA, 25 bp, Mus musculus
tagccataagcctccaggctggctg

SEQ ID NO: 774264 - DNA, 25 bp, Mus musculus
tagccataatagacataatcagtca

SEQ ID NO: 774265 - DNA, 25 bp, Mus musculus
tagccataatagtcataatcagtca

SEQ ID NO: 774266 - DNA, 25 bp, Mus musculus
tagccatagcacaaagaacaggaat

SEQ ID NO: 774267 - DNA, 25 bp, Mus musculus
tagccatagcactaagaacaggaat

SEQ ID NO: 774268 - DNA, 25 bp, Mus musculus
tagccatattagcttatctataatg

SEQ ID NO: 774269 - DNA, 25 bp, Mus musculus
tagccatattaggttatctataatg

SEQ ID NO: 774270 - DNA, 25 bp, Mus musculus
tagccatcaaagactggactctcct

SEQ ID NO: 774271 - DNA, 25 bp, Mus musculus
tagccatcaaagtctggactctcct

SEQ ID NO: 774272 - DNA, 25 bp, Mus musculus
tagccatcaccgctctactggtaat

SEQ ID NO: 774273 - DNA, 25 bp, Mus musculus
tagccatcaccggtctactggtaat

SEQ ID NO: 774274 - DNA, 25 bp, Mus musculus
tagccatcagggaaccttcagtaat

SEQ ID NO: 774275 - DNA, 25 bp, Mus musculus
tagccatcagggtaccttcagtaat

SEQ ID NO: 774276 - DNA, 25 bp, Mus musculus
tagccatccagaaagcatggtggcc

SEQ ID NO: 774277 - DNA, 25 bp, Mus musculus
tagccatccagatagcatggtggcc

SEQ ID NO: 774278 - DNA, 25 bp, Mus musculus
tagccatccatcaaccagatcttct

SEQ ID NO: 774279 - DNA, 25 bp, Mus musculus
tagccatccatctaccagatcttct

SEQ ID NO: 774280 - DNA, 25 bp, Mus musculus
tagccatcctgtccatttgaatcaa

SEQ ID NO: 774281 - DNA, 25 bp, Mus musculus
tagccatcctgtgcatttgaatcaa

SEQ ID NO: 774282 - DNA, 25 bp, Mus musculus
tagccatctcagagtctgtcccaag

SEQ ID NO: 774283 - DNA, 25 bp, Mus musculus
tagccatctcagtgtctgtcccaag

SEQ ID NO: 774284 - DNA, 25 bp, Mus musculus
tagccatctccgcagttggtcttgg

SEQ ID NO: 774285 - DNA, 25 bp, Mus musculus
tagccatctccggagttggtcttgg

SEQ ID NO: 774286 - DNA, 25 bp, Mus musculus
tagccatctgtaaagctaaccctct

SEQ ID NO: 774287 - DNA, 25 bp, Mus musculus
tagccatctgtatagctaaccctct

SEQ ID NO: 774288 - DNA, 25 bp, Mus musculus
tagccatctttcagtcccttttgtt

SEQ ID NO: 774289 - DNA, 25 bp, Mus musculus
tagccatctttctgtcccttttgtt

SEQ ID NO: 774290 - DNA, 25 bp, Mus musculus
tagccatgacctaggaaggcccagc

SEQ ID NO: 774291 - DNA, 25 bp, Mus musculus
tagccatgaccttggaaggcccagc

SEQ ID NO: 774292 - DNA, 25 bp, Mus musculus
tagccatgacgcagggaagcagtgt

SEQ ID NO: 774293 - DNA, 25 bp, Mus musculus
tagccatgacgctgggaagcagtgt

SEQ ID NO: 774294 - DNA, 25 bp, Mus musculus
tagccatgagagctcttctcggcac

SEQ ID NO: 774295 - DNA, 25 bp, Mus musculus
tagccatgagaggtcttctcggcac

SEQ ID NO: 774296 - DNA, 25 bp, Mus musculus
tagccatgaggtacgcttcctctat

SEQ ID NO: 774297 - DNA, 25 bp, Mus musculus
tagccatgaggttcgcttcctctat

SEQ ID NO: 774298 - DNA, 25 bp, Mus musculus
tagccatgcattaattatgtaaagg

SEQ ID NO: 774299 - DNA, 25 bp, Mus musculus
tagccatgcatttattatgtaaagg

SEQ ID NO: 774300 - DNA, 25 bp, Mus musculus
tagccatgctctcatttttgcctgc

SEQ ID NO: 774301 - DNA, 25 bp, Mus musculus
tagccatgctctgatttttgcctgc

SEQ ID NO: 774302 - DNA, 25 bp, Mus musculus
tagccatgctgaagtgcgggatgac

SEQ ID NO: 774303 - DNA, 25 bp, Mus musculus
tagccatgctgatgtgcgggatgac

SEQ ID NO: 774304 - DNA, 25 bp, Mus musculus
tagccatggaatagagccggcgtgt

SEQ ID NO: 774305 - DNA, 25 bp, Mus musculus
tagccatggaattgagccggcgtgt

SEQ ID NO: 774306 - DNA, 25 bp, Mus musculus
tagccatggatcatcaaaacttact

SEQ ID NO: 774307 - DNA, 25 bp, Mus musculus
tagccatggatcttcaaaacttact

SEQ ID NO: 774308 - DNA, 25 bp, Mus musculus
tagccatggctacttctgacgtgaa

SEQ ID NO: 774309 - DNA, 25 bp, Mus musculus
tagccatggctagttctgacgtgaa

SEQ ID NO: 774310 - DNA, 25 bp, Mus musculus
tagccatgggatatgatttcttaaa

SEQ ID NO: 774311 - DNA, 25 bp, Mus musculus
tagccatgggatttgatttcttaaa

SEQ ID NO: 774312 - DNA, 25 bp, Mus musculus
tagccatgttcgacctgcctttctt

SEQ ID NO: 774313 - DNA, 25 bp, Mus musculus
tagccatgttcgtcctgcctttctt

SEQ ID NO: 774314 - DNA, 25 bp, Mus musculus
tagccatgtttgctcccttacctat

SEQ ID NO: 774315 - DNA, 25 bp, Mus musculus
tagccatgtttggtcccttacctat

SEQ ID NO: 774316 - DNA, 25 bp, Mus musculus
tagccattaaagattcctctgtcaa

SEQ ID NO: 774317 - DNA, 25 bp, Mus musculus
tagccattaaagtttcctctgtcaa

SEQ ID NO: 774318 - DNA, 25 bp, Mus musculus
tagccattacgacggtggccaacct

SEQ ID NO: 774319 - DNA, 25 bp, Mus musculus
tagccattacgagggtggccaacct

SEQ ID NO: 774320 - DNA, 25 bp, Mus musculus
tagccattcctacgcacatgaattt

SEQ ID NO: 774321 - DNA, 25 bp, Mus musculus
tagccattcctaggcacatgaattt

SEQ ID NO: 774322 - DNA, 25 bp, Mus musculus
tagccattcctgagaacctaattac

SEQ ID NO: 774323 - DNA, 25 bp, Mus musculus
tagccattcctgatagatgtggttg

SEQ ID NO: 774324 - DNA, 25 bp, Mus musculus
tagccattcctgtgaacctaattac

SEQ ID NO: 774325 - DNA, 25 bp, Mus musculus
tagccattcctgttagatgtggttg

SEQ ID NO: 774326 - DNA, 25 bp, Mus musculus
tagccattgaggctcccaggcggtc

SEQ ID NO: 774327 - DNA, 25 bp, Mus musculus
tagccattgagggtcccaggcggtc

SEQ ID NO: 774328 - DNA, 25 bp, Mus musculus
tagccattggctagaaattctgatt

SEQ ID NO: 774329 - DNA, 25 bp, Mus musculus
tagccattggcttgaaattctgatt

SEQ ID NO: 774330 - DNA, 25 bp, Mus musculus
tagccattggtacttaagtgggttt

SEQ ID NO: 774331 - DNA, 25 bp, Mus musculus
tagccattggtagttaagtgggttt

SEQ ID NO: 774332 - DNA, 25 bp, Mus musculus
tagccattgtacattgactcaaccc

SEQ ID NO: 774333 - DNA, 25 bp, Mus musculus
tagccattgtactttgactcaaccc

SEQ ID NO: 774334 - DNA, 25 bp, Mus musculus
tagccatttctcaatgggctgtcca

SEQ ID NO: 774335 - DNA, 25 bp, Mus musculus
tagccatttctcctttatctgaagc

SEQ ID NO: 774336 - DNA, 25 bp, Mus musculus
tagccatttctcgtttatctgaagc

SEQ ID NO: 774337 - DNA, 25 bp, Mus musculus
tagccatttctctatgggctgtcca

SEQ ID NO: 774338 - DNA, 25 bp, Mus musculus
tagccatttcttcttctcgatgcat

SEQ ID NO: 774339 - DNA, 25 bp, Mus musculus
tagccatttcttgttctcgatgcat

SEQ ID NO: 774340 - DNA, 25 bp, Mus musculus
tagccatttgtgctgaggcatctcc

SEQ ID NO: 774341 - DNA, 25 bp, Mus musculus
tagccatttgtggtgaggcatctcc

SEQ ID NO: 774342 - DNA, 25 bp, Mus musculus
tagccatttgttccatgactccttt

SEQ ID NO: 774343 - DNA, 25 bp, Mus musculus
tagccatttgttgcatgactccttt

SEQ ID NO: 774344 - DNA, 25 bp, Mus musculus
tagccatttttaccttagacggacg

SEQ ID NO: 774345 - DNA, 25 bp, Mus musculus
tagccatttttagcttagacggacg

SEQ ID NO: 774346 - DNA, 25 bp, Mus musculus
tagcccaaagatcatacctgtgatt

SEQ ID NO: 774347 - DNA, 25 bp, Mus musculus
tagcccaaagatgatacctgtgatt

SEQ ID NO: 774348 - DNA, 25 bp, Mus musculus
tagcccaaccccaccccagattggg

SEQ ID NO: 774349 - DNA, 25 bp, Mus musculus
tagcccaacccctccccagattggg

SEQ ID NO: 774350 - DNA, 25 bp, Mus musculus
tagcccaacgctcgctcatatgagc

SEQ ID NO: 774351 - DNA, 25 bp, Mus musculus
tagcccaacgctggctcatatgagc

SEQ ID NO: 774352 - DNA, 25 bp, Mus musculus
tagcccaactgtagtgttcaactgt

SEQ ID NO: 774353 - DNA, 25 bp, Mus musculus
tagcccaactgttgtgttcaactgt

SEQ ID NO: 774354 - DNA, 25 bp, Mus musculus
tagcccaaggcaatacccagcggga

SEQ ID NO: 774355 - DNA, 25 bp, Mus musculus
tagcccaaggcattacccagcggga

SEQ ID NO: 774356 - DNA, 25 bp, Mus musculus
tagcccaaggtaaccaacagaaaaa

SEQ ID NO: 774357 - DNA, 25 bp, Mus musculus
tagcccaaggtatccaacagaaaaa

SEQ ID NO: 774358 - DNA, 25 bp, Mus musculus
tagcccaatcctctcagaagcttgc

SEQ ID NO: 774359 - DNA, 25 bp, Mus musculus
tagcccaatcctgtcagaagcttgc

SEQ ID NO: 774360 - DNA, 25 bp, Mus musculus
tagcccaatgatctggcccgtggac

SEQ ID NO: 774361 - DNA, 25 bp, Mus musculus
tagcccaatgatgtggcccgtggac

SEQ ID NO: 774362 - DNA, 25 bp, Mus musculus
tagcccaatgctaacaggtattaca

SEQ ID NO: 774363 - DNA, 25 bp, Mus musculus
tagcccaatgcttacaggtattaca

SEQ ID NO: 774364 - DNA, 25 bp, Mus musculus
tagcccacaccgcacaaagatctga

SEQ ID NO: 774365 - DNA, 25 bp, Mus musculus
tagcccacaccggacaaagatctga

SEQ ID NO: 774366 - DNA, 25 bp, Mus musculus
tagcccacactgaggagtcgctgag

SEQ ID NO: 774367 - DNA, 25 bp, Mus musculus
tagcccacactgtggagtcgctgag

SEQ ID NO: 774368 - DNA, 25 bp, Mus musculus
tagcccacccatcgatgcatagtga

SEQ ID NO: 774369 - DNA, 25 bp, Mus musculus
tagcccacccatggatgcatagtga

SEQ ID NO: 774370 - DNA, 25 bp, Mus musculus
tagcccacccgtctaatccgttgaa

SEQ ID NO: 774371 - DNA, 25 bp, Mus musculus
tagcccacccgtgtaatccgttgaa

SEQ ID NO: 774372 - DNA, 25 bp, Mus musculus
tagcccaccctgagcagaatctagg

SEQ ID NO: 774373 - DNA, 25 bp, Mus musculus
tagcccaccctgtgcagaatctagg

SEQ ID NO: 774374 - DNA, 25 bp, Mus musculus
tagcccacggaaagatctgcaactg

SEQ ID NO: 774375 - DNA, 25 bp, Mus musculus
tagcccacggaatgatctgcaactg

SEQ ID NO: 774376 - DNA, 25 bp, Mus musculus
tagcccacgttcaataagagcctgt

SEQ ID NO: 774377 - DNA, 25 bp, Mus musculus
tagcccacgttctataagagcctgt

SEQ ID NO: 774378 - DNA, 25 bp, Mus musculus
tagcccactctacagagaggctggt

SEQ ID NO: 774379 - DNA, 25 bp, Mus musculus
tagcccactctagagagaggctggt

SEQ ID NO: 774380 - DNA, 25 bp, Mus musculus
tagcccactctcaatagacatcaga

SEQ ID NO: 774381 - DNA, 25 bp, Mus musculus
tagcccactctctatagacatcaga

SEQ ID NO: 774382 - DNA, 25 bp, Mus musculus
tagcccactggacacctgcaggaag

SEQ ID NO: 774383 - DNA, 25 bp, Mus musculus
tagcccactggagacctgcaggaag

SEQ ID NO: 774384 - DNA, 25 bp, Mus musculus
tagcccagacctcagcagtagtaaa

SEQ ID NO: 774385 - DNA, 25 bp, Mus musculus
tagcccagacctgagcagtagtaaa

SEQ ID NO: 774386 - DNA, 25 bp, Mus musculus
tagcccagagacagtcgcaggatgc

SEQ ID NO: 774387 - DNA, 25 bp, Mus musculus
tagcccagagactgtcgcaggatgc

SEQ ID NO: 774388 - DNA, 25 bp, Mus musculus
tagcccagcatccacacaaatatat

SEQ ID NO: 774389 - DNA, 25 bp, Mus musculus
tagcccagcatcgacacaaatatat

SEQ ID NO: 774390 - DNA, 25 bp, Mus musculus
tagcccaggattcttttcacagtgt

SEQ ID NO: 774391 - DNA, 25 bp, Mus musculus
tagcccaggattgttttcacagtgt

SEQ ID NO: 774392 - DNA, 25 bp, Mus musculus
tagcccaggcagcacccaaatttac

SEQ ID NO: 774393 - DNA, 25 bp, Mus musculus
tagcccaggcaggacccaaatttac

SEQ ID NO: 774394 - DNA, 25 bp, Mus musculus
tagcccaggcctccttttgttaagc

SEQ ID NO: 774395 - DNA, 25 bp, Mus musculus
tagcccaggcctgcttttgttaagc

SEQ ID NO: 774396 - DNA, 25 bp, Mus musculus
tagcccaggcgtccaaggaatcaaa

SEQ ID NO: 774397 - DNA, 25 bp, Mus musculus
tagcccaggcgtgcaaggaatcaaa

SEQ ID NO: 774398 - DNA, 25 bp, Mus musculus
tagcccaggctacctagcgtcaagc

SEQ ID NO: 774399 - DNA, 25 bp, Mus musculus
tagcccaggctagctagcgtcaagc

SEQ ID NO: 774400 - DNA, 25 bp, Mus musculus
tagcccaggtgccattcttacagga

SEQ ID NO: 774401 - DNA, 25 bp, Mus musculus
tagcccaggtgcgattcttacagga

SEQ ID NO: 774402 - DNA, 25 bp, Mus musculus
tagcccaggttaaacccaacagact

SEQ ID NO: 774403 - DNA, 25 bp, Mus musculus
tagcccaggttatacccaacagact

SEQ ID NO: 774404 - DNA, 25 bp, Mus musculus
tagcccagtaccctagtcctatttc

SEQ ID NO: 774405 - DNA, 25 bp, Mus musculus
tagcccagtaccgtagtcctatttc

SEQ ID NO: 774406 - DNA, 25 bp, Mus musculus
tagcccagtactcctttgagagatg

SEQ ID NO: 774407 - DNA, 25 bp, Mus musculus
tagcccagtactgctttgagagatg

SEQ ID NO: 774408 - DNA, 25 bp, Mus musculus
tagcccagtatgctgctgcatgcat

SEQ ID NO: 774409 - DNA, 25 bp, Mus musculus
tagcccagtatggtgctgcatgcat

SEQ ID NO: 774410 - DNA, 25 bp, Mus musculus
tagcccagtcagagcgaacacacat

SEQ ID NO: 774411 - DNA, 25 bp, Mus musculus
tagcccagtcagtgcgaacacacat

SEQ ID NO: 774412 - DNA, 25 bp, Mus musculus
tagcccagtctaccctgtagtggtc

SEQ ID NO: 774413 - DNA, 25 bp, Mus musculus
tagcccagtctagcctgtagtggtc

SEQ ID NO: 774414 - DNA, 25 bp, Mus musculus
tagcccagtgagatctccacagtta

SEQ ID NO: 774415 - DNA, 25 bp, Mus musculus
tagcccagtgagttctccacagtta

SEQ ID NO: 774416 - DNA, 25 bp, Mus musculus
tagcccagtgttacatttaggatac

SEQ ID NO: 774417 - DNA, 25 bp, Mus musculus
tagcccagtgtttcatttaggatac

SEQ ID NO: 774418 - DNA, 25 bp, Mus musculus
tagcccagttttaacatagacccct

SEQ ID NO: 774419 - DNA, 25 bp, Mus musculus
tagcccagtttttacatagacccct

SEQ ID NO: 774420 - DNA, 25 bp, Mus musculus
tagcccataagactcaacatcccat

SEQ ID NO: 774421 - DNA, 25 bp, Mus musculus
tagcccataagagtcaacatcccat

SEQ ID NO: 774422 - DNA, 25 bp, Mus musculus
tagcccatcaccatcaagtgagcga

SEQ ID NO: 774423 - DNA, 25 bp, Mus musculus
tagcccatcaccttcaagtgagcga

SEQ ID NO: 774424 - DNA, 25 bp, Mus musculus
tagcccatcactaaacctgttttac

SEQ ID NO: 774425 - DNA, 25 bp, Mus musculus
tagcccatcacttaacctgttttac

SEQ ID NO: 774426 - DNA, 25 bp, Mus musculus
tagcccatcgggagtgtgtacagta

SEQ ID NO: 774427 - DNA, 25 bp, Mus musculus
tagcccatcgggtgtgtgtacagta

SEQ ID NO: 774428 - DNA, 25 bp, Mus musculus
tagcccatcttacccaacttcagtt

SEQ ID NO: 774429 - DNA, 25 bp, Mus musculus
tagcccatcttagccaacttcagtt

SEQ ID NO: 774430 - DNA, 25 bp, Mus musculus
tagcccatggtcacactgattcaag

SEQ ID NO: 774431 - DNA, 25 bp, Mus musculus
tagcccatggtctcactgattcaag

SEQ ID NO: 774432 - DNA, 25 bp, Mus musculus
tagcccatgtgtaacctgtctgtct

SEQ ID NO: 774433 - DNA, 25 bp, Mus musculus
tagcccatgtgttacctgtctgtct

SEQ ID NO: 774434 - DNA, 25 bp, Mus musculus
tagcccatttgtaaactggtagttt

SEQ ID NO: 774435 - DNA, 25 bp, Mus musculus
tagcccatttgttaactggtagttt

SEQ ID NO: 774436 - DNA, 25 bp, Mus musculus
tagccccacaagctttgttttctat

SEQ ID NO: 774437 - DNA, 25 bp, Mus musculus
tagccccacaaggtttgttttctat

SEQ ID NO: 774438 - DNA, 25 bp, Mus musculus
tagccccacattagactgtttactc

SEQ ID NO: 774439 - DNA, 25 bp, Mus musculus
tagccccacatttgactgtttactc

SEQ ID NO: 774440 - DNA, 25 bp, Mus musculus
tagccccagacaaacagtgttgaga

SEQ ID NO: 774441 - DNA, 25 bp, Mus musculus
tagccccagacatacagtgttgaga

SEQ ID NO: 774442 - DNA, 25 bp, Mus musculus
tagccccagagtatctatcctgttt

SEQ ID NO: 774443 - DNA, 25 bp, Mus musculus
tagccccagagtttctatcctgttt

SEQ ID NO: 774444 - DNA, 25 bp, Mus musculus
tagccccagattagttaccacagtg

SEQ ID NO: 774445 - DNA, 25 bp, Mus musculus
tagccccagatttgttaccacagtg

SEQ ID NO: 774446 - DNA, 25 bp, Mus musculus
tagccccaggaactcatagagttgt

SEQ ID NO: 774447 - DNA, 25 bp, Mus musculus
tagccccaggaagtcatagagttgt

SEQ ID NO: 774448 - DNA, 25 bp, Mus musculus
tagccccagggaccaatgtcctatt

SEQ ID NO: 774449 - DNA, 25 bp, Mus musculus
tagccccagggagcaatgtcctatt

SEQ ID NO: 774450 - DNA, 25 bp, Mus musculus
tagccccagggtaaagtgtctagaa

SEQ ID NO: 774451 - DNA, 25 bp, Mus musculus
tagccccagggttaagtgtctagaa

SEQ ID NO: 774452 - DNA, 25 bp, Mus musculus
tagccccagtgactggtggaatatg

SEQ ID NO: 774453 - DNA, 25 bp, Mus musculus
tagccccagtgagtggtggaatatg

SEQ ID NO: 774454 - DNA, 25 bp, Mus musculus
tagccccatcccaaaaagaacgctt

SEQ ID NO: 774455 - DNA, 25 bp, Mus musculus
tagccccatccctaaaagaacgctt

SEQ ID NO: 774456 - DNA, 25 bp, Mus musculus
tagccccatgtcaaacctcatagtt

SEQ ID NO: 774457 - DNA, 25 bp, Mus musculus
tagccccatgtctaacctcatagtt

SEQ ID NO: 774458 - DNA, 25 bp, Mus musculus
tagccccgagtgagcgagcagacac

SEQ ID NO: 774459 - DNA, 25 bp, Mus musculus
tagccccgagtgtgcgagcagacac

SEQ ID NO: 774460 - DNA, 25 bp, Mus musculus
tagccccgcataccacagaggagag

SEQ ID NO: 774461 - DNA, 25 bp, Mus musculus
tagccccgcatagcacagaggagag

SEQ ID NO: 774462 - DNA, 25 bp, Mus musculus
tagcccctaggcattggttacacac

SEQ ID NO: 774463 - DNA, 25 bp, Mus musculus
tagcccctaggctttggttacacac

SEQ ID NO: 774464 - DNA, 25 bp, Mus musculus
tagcccctatggctgtagcagtggc

SEQ ID NO: 774465 - DNA, 25 bp, Mus musculus
tagcccctatgggtgtagcagtggc

SEQ ID NO: 774466 - DNA, 25 bp, Mus musculus
tagcccctcagtattaccatgtctt

SEQ ID NO: 774467 - DNA, 25 bp, Mus musculus
tagcccctcagttttaccatgtctt

SEQ ID NO: 774468 - DNA, 25 bp, Mus musculus
tagcccctcgttacttatcttctag

SEQ ID NO: 774469 - DNA, 25 bp, Mus musculus
tagcccctcgtttcttatcttctag

SEQ ID NO: 774470 - DNA, 25 bp, Mus musculus
tagcccctctaactcactggaaact

SEQ ID NO: 774471 - DNA, 25 bp, Mus musculus
tagcccctctaagtcactggaaact

SEQ ID NO: 774472 - DNA, 25 bp, Mus musculus
tagcccctcttcagcttagagaagg

SEQ ID NO: 774473 - DNA, 25 bp, Mus musculus
tagcccctcttctgcttagagaagg

SEQ ID NO: 774474 - DNA, 25 bp, Mus musculus
tagcccctgagcacaggacatggag

SEQ ID NO: 774475 - DNA, 25 bp, Mus musculus
tagcccctgagctcaggacatggag

SEQ ID NO: 774476 - DNA, 25 bp, Mus musculus
tagcccctgaggactcagtgcttgg

SEQ ID NO: 774477 - DNA, 25 bp, Mus musculus
tagcccctgaggtctcagtgcttgg

SEQ ID NO: 774478 - DNA, 25 bp, Mus musculus
tagcccctgatgacctacttggaat

SEQ ID NO: 774479 - DNA, 25 bp, Mus musculus
tagcccctgatgtcctacttggaat

SEQ ID NO: 774480 - DNA, 25 bp, Mus musculus
tagcccctgattccagacacattat

SEQ ID NO: 774481 - DNA, 25 bp, Mus musculus
tagcccctgattgcagacacattat

SEQ ID NO: 774482 - DNA, 25 bp, Mus musculus
tagcccctgttgatttgcccacaaa

SEQ ID NO: 774483 - DNA, 25 bp, Mus musculus
tagcccctgttgttttgcccacaaa

SEQ ID NO: 774484 - DNA, 25 bp, Mus musculus
tagccccttaaaaagaagccatttg

SEQ ID NO: 774485 - DNA, 25 bp, Mus musculus
tagccccttaaatagaagccatttg

SEQ ID NO: 774486 - DNA, 25 bp, Mus musculus
tagccccttgagactcatggtttca

SEQ ID NO: 774487 - DNA, 25 bp, Mus musculus
tagccccttgagtctcatggtttca

SEQ ID NO: 774488 - DNA, 25 bp, Mus musculus
tagccccttgttatagctaacctgt

SEQ ID NO: 774489 - DNA, 25 bp, Mus musculus
tagccccttgttttagctaacctgt

SEQ ID NO: 774490 - DNA, 25 bp, Mus musculus
tagcccctttgcaaccataactaaa

SEQ ID NO: 774491 - DNA, 25 bp, Mus musculus
tagcccctttgctaccataactaaa

SEQ ID NO: 774492 - DNA, 25 bp, Mus musculus
tagcccgacaagaaggcatggccca

SEQ ID NO: 774493 - DNA, 25 bp, Mus musculus
tagcccgacaagtaggcatggccca

SEQ ID NO: 774494 - DNA, 25 bp, Mus musculus
tagcccgaggcaatgttgaggttgc

SEQ ID NO: 774495 - DNA, 25 bp, Mus musculus
tagcccgaggcattgttgaggttgc

SEQ ID NO: 774496 - DNA, 25 bp, Mus musculus
tagcccgcccataggtaactcttaa

SEQ ID NO: 774497 - DNA, 25 bp, Mus musculus
tagcccgcccattggtaactcttaa

SEQ ID NO: 774498 - DNA, 25 bp, Mus musculus
tagcccgccctcatgtcaggaattc

SEQ ID NO: 774499 - DNA, 25 bp, Mus musculus
tagcccgccctcttgtcaggaattc

SEQ ID NO: 774500 - DNA, 25 bp, Mus musculus
tagcccggactgcaattagactgtc

SEQ ID NO: 774501 - DNA, 25 bp, Mus musculus
tagcccggactggaattagactgtc

SEQ ID NO: 774502 - DNA, 25 bp, Mus musculus
tagcccggagaaaggcgcactgcaa

SEQ ID NO: 774503 - DNA, 25 bp, Mus musculus
tagcccggagaatggcgcactgcaa

SEQ ID NO: 774504 - DNA, 25 bp, Mus musculus
tagcccgggttaacatcattcacaa

SEQ ID NO: 774505 - DNA, 25 bp, Mus musculus
tagcccgggttatcatcattcacaa

SEQ ID NO: 774506 - DNA, 25 bp, Mus musculus
tagcccgggttcatcaattcataat

SEQ ID NO: 774507 - DNA, 25 bp, Mus musculus
tagcccgggttcttcaattcataat

SEQ ID NO: 774508 - DNA, 25 bp, Mus musculus
tagcccgtaagccatcctaatgaac

SEQ ID NO: 774509 - DNA, 25 bp, Mus musculus
tagcccgtaagcgatcctaatgaac

SEQ ID NO: 774510 - DNA, 25 bp, Mus musculus
tagcccgtcgccaggtgtctggagc

SEQ ID NO: 774511 - DNA, 25 bp, Mus musculus
tagcccgtcgcctggtgtctggagc

SEQ ID NO: 774512 - DNA, 25 bp, Mus musculus
tagcccgttcctacaaagtgcaagt

SEQ ID NO: 774513 - DNA, 25 bp, Mus musculus
tagcccgttccttcaaagtgcaagt

SEQ ID NO: 774514 - DNA, 25 bp, Mus musculus
tagccctaaactctaagaccctctt

SEQ ID NO: 774515 - DNA, 25 bp, Mus musculus
tagccctaaactgtaagaccctctt

SEQ ID NO: 774516 - DNA, 25 bp, Mus musculus
tagccctaccagacccatgtctatt

SEQ ID NO: 774517 - DNA, 25 bp, Mus musculus
tagccctaccagtcccatgtctatt

SEQ ID NO: 774518 - DNA, 25 bp, Mus musculus
tagccctaccgacgacagcatggat

SEQ ID NO: 774519 - DNA, 25 bp, Mus musculus
tagccctaccgaggacagcatggat

SEQ ID NO: 774520 - DNA, 25 bp, Mus musculus
tagccctactgcagcttgcctgaag

SEQ ID NO: 774521 - DNA, 25 bp, Mus musculus
tagccctactgctgcttgcctgaag

SEQ ID NO: 774522 - DNA, 25 bp, Mus musculus
tagccctactgtcagcatggccatg

SEQ ID NO: 774523 - DNA, 25 bp, Mus musculus
tagccctactgtgagcatggccatg

SEQ ID NO: 774524 - DNA, 25 bp, Mus musculus
tagccctagattccaggcagaacta

SEQ ID NO: 774525 - DNA, 25 bp, Mus musculus
tagccctagattgcaggcagaacta

SEQ ID NO: 774526 - DNA, 25 bp, Mus musculus
tagccctatataacaagcctcttac

SEQ ID NO: 774527 - DNA, 25 bp, Mus musculus
tagccctatatatcaagcctcttac

SEQ ID NO: 774528 - DNA, 25 bp, Mus musculus
tagccctatctcaaaaggtccaata

SEQ ID NO: 774529 - DNA, 25 bp, Mus musculus
tagccctatctctaaaggtccaata

SEQ ID NO: 774530 - DNA, 25 bp, Mus musculus
tagccctatgccaggatttgtctgg

SEQ ID NO: 774531 - DNA, 25 bp, Mus musculus
tagccctatgcctggatttgtctgg

SEQ ID NO: 774532 - DNA, 25 bp, Mus musculus
tagccctcaaggcagtggtggccat

SEQ ID NO: 774533 - DNA, 25 bp, Mus musculus
tagccctcaagggagtggtggccat

SEQ ID NO: 774534 - DNA, 25 bp, Mus musculus
tagccctcacaccaagcaaggcgaa

SEQ ID NO: 774535 - DNA, 25 bp, Mus musculus
tagccctcacacgaagcaaggcgaa

SEQ ID NO: 774536 - DNA, 25 bp, Mus musculus
tagccctcactgcacaaatgctttg

SEQ ID NO: 774537 - DNA, 25 bp, Mus musculus
tagccctcactggacaaatgctttg

SEQ ID NO: 774538 - DNA, 25 bp, Mus musculus
tagccctccctcagtttttaactca

SEQ ID NO: 774539 - DNA, 25 bp, Mus musculus
tagccctccctctgtttttaactca

SEQ ID NO: 774540 - DNA, 25 bp, Mus musculus
tagccctcctacatacaaatggact

SEQ ID NO: 774541 - DNA, 25 bp, Mus musculus
tagccctcctacttacaaatggact

SEQ ID NO: 774542 - DNA, 25 bp, Mus musculus
tagccctcctggcaggacaaaggac

SEQ ID NO: 774543 - DNA, 25 bp, Mus musculus
tagccctcctgggaggacaaaggac

SEQ ID NO: 774544 - DNA, 25 bp, Mus musculus
tagccctctgcactagtgggactga

SEQ ID NO: 774545 - DNA, 25 bp, Mus musculus
tagccctctgcagtagtgggactga

SEQ ID NO: 774546 - DNA, 25 bp, Mus musculus
tagccctcttggctgtggtgtccct

SEQ ID NO: 774547 - DNA, 25 bp, Mus musculus
tagccctcttgggtgtggtgtccct

SEQ ID NO: 774548 - DNA, 25 bp, Mus musculus
tagccctgactaagtgacagttccc

SEQ ID NO: 774549 - DNA, 25 bp, Mus musculus
tagccctgactatgtgacagttccc

SEQ ID NO: 774550 - DNA, 25 bp, Mus musculus
tagccctgagcacctcactggtaaa

SEQ ID NO: 774551 - DNA, 25 bp, Mus musculus
tagccctgagcagctcactggtaaa

SEQ ID NO: 774552 - DNA, 25 bp, Mus musculus
tagccctgatcgcacagtgctgatg

SEQ ID NO: 774553 - DNA, 25 bp, Mus musculus
tagccctgatcggacagtgctgatg

SEQ ID NO: 774554 - DNA, 25 bp, Mus musculus
tagccctgcaccagtttggttttgg

SEQ ID NO: 774555 - DNA, 25 bp, Mus musculus
tagccctgcacctgtttggttttgg

SEQ ID NO: 774556 - DNA, 25 bp, Mus musculus
tagccctgcatcactaggtccatag

SEQ ID NO: 774557 - DNA, 25 bp, Mus musculus
tagccctgcatctctaggtccatag

SEQ ID NO: 774558 - DNA, 25 bp, Mus musculus
tagccctgctacctagtctgttagc

SEQ ID NO: 774559 - DNA, 25 bp, Mus musculus
tagccctgctacgtagtctgttagc

SEQ ID NO: 774560 - DNA, 25 bp, Mus musculus
tagccctgcttccaacagtgggtgt

SEQ ID NO: 774561 - DNA, 25 bp, Mus musculus
tagccctgcttccttttgggtacat

SEQ ID NO: 774562 - DNA, 25 bp, Mus musculus
tagccctgcttcgaacagtgggtgt

SEQ ID NO: 774563 - DNA, 25 bp, Mus musculus
tagccctgcttcgttttgggtacat

SEQ ID NO: 774564 - DNA, 25 bp, Mus musculus
tagccctgctttcttgacagtagtt

SEQ ID NO: 774565 - DNA, 25 bp, Mus musculus
tagccctgctttctttcatcctggt

SEQ ID NO: 774566 - DNA, 25 bp, Mus musculus
tagccctgctttgttgacagtagtt

SEQ ID NO: 774567 - DNA, 25 bp, Mus musculus
tagccctgctttgtttcatcctggt

SEQ ID NO: 774568 - DNA, 25 bp, Mus musculus
tagccctggaaaaacggtatctgtt

SEQ ID NO: 774569 - DNA, 25 bp, Mus musculus
tagccctggaaatacggtatctgtt

SEQ ID NO: 774570 - DNA, 25 bp, Mus musculus
tagccctggaacacaggtcatggac

SEQ ID NO: 774571 - DNA, 25 bp, Mus musculus
tagccctggaactcaggtcatggac

SEQ ID NO: 774572 - DNA, 25 bp, Mus musculus
tagccctggatcagctcaaggatga

SEQ ID NO: 774573 - DNA, 25 bp, Mus musculus
tagccctggatctgctcaaggatga

SEQ ID NO: 774574 - DNA, 25 bp, Mus musculus
tagccctggctaactgttacggacg

SEQ ID NO: 774575 - DNA, 25 bp, Mus musculus
tagccctggctacttcaaatgttct

SEQ ID NO: 774576 - DNA, 25 bp, Mus musculus
tagccctggctagttcaaatgttct

SEQ ID NO: 774577 - DNA, 25 bp, Mus musculus
tagccctggctatctgttacggacg

SEQ ID NO: 774578 - DNA, 25 bp, Mus musculus
tagccctgggagagcaggtctctaa

SEQ ID NO: 774579 - DNA, 25 bp, Mus musculus
tagccctgggagtgcaggtctctaa

SEQ ID NO: 774580 - DNA, 25 bp, Mus musculus
tagccctggtccatgagggtgcaga

SEQ ID NO: 774581 - DNA, 25 bp, Mus musculus
tagccctggtccttgagggtgcaga

SEQ ID NO: 774582 - DNA, 25 bp, Mus musculus
tagccctggttaagtttctgaagac

SEQ ID NO: 774583 - DNA, 25 bp, Mus musculus
tagccctggttatgtttctgaagac

SEQ ID NO: 774584 - DNA, 25 bp, Mus musculus
tagccctgtgctctcagatacgctt

SEQ ID NO: 774585 - DNA, 25 bp, Mus musculus
tagccctgtgctgtcagatacgctt

SEQ ID NO: 774586 - DNA, 25 bp, Mus musculus
tagcccttcaagagtgtctgtgtca

SEQ ID NO: 774587 - DNA, 25 bp, Mus musculus
tagcccttcaagtgtgtctgtgtca

SEQ ID NO: 774588 - DNA, 25 bp, Mus musculus
tagcccttcactaactcttgaagac

SEQ ID NO: 774589 - DNA, 25 bp, Mus musculus
tagcccttcacttactcttgaagac

SEQ ID NO: 774590 - DNA, 25 bp, Mus musculus
tagcccttccagacatgcgaatgag

SEQ ID NO: 774591 - DNA, 25 bp, Mus musculus
tagcccttccagtcatgcgaatgag

SEQ ID NO: 774592 - DNA, 25 bp, Mus musculus
tagcccttccatctgcttggtgtta

SEQ ID NO: 774593 - DNA, 25 bp, Mus musculus
tagcccttccatgtgcttggtgtta

SEQ ID NO: 774594 - DNA, 25 bp, Mus musculus
tagcccttctacctattctgataga

SEQ ID NO: 774595 - DNA, 25 bp, Mus musculus
tagcccttctacgtattctgataga

SEQ ID NO: 774596 - DNA, 25 bp, Mus musculus
tagcccttgactaaggtaggcaact

SEQ ID NO: 774597 - DNA, 25 bp, Mus musculus
tagcccttgacttaggtaggcaact

SEQ ID NO: 774598 - DNA, 25 bp, Mus musculus
tagcccttgaggaggagatagcaga

SEQ ID NO: 774599 - DNA, 25 bp, Mus musculus
tagcccttgaggtggagatagcaga

SEQ ID NO: 774600 - DNA, 25 bp, Mus musculus
tagcccttgcggaaaacccaatgtg

SEQ ID NO: 774601 - DNA, 25 bp, Mus musculus
tagcccttgcggtaaacccaatgtg

SEQ ID NO: 774602 - DNA, 25 bp, Mus musculus
tagcccttgctaagctctacagaag

SEQ ID NO: 774603 - DNA, 25 bp, Mus musculus
tagcccttgctatgctctacagaag

SEQ ID NO: 774604 - DNA, 25 bp, Mus musculus
tagcccttggctagttactgacaat

SEQ ID NO: 774605 - DNA, 25 bp, Mus musculus
tagcccttggcttgttactgacaat

SEQ ID NO: 774606 - DNA, 25 bp, Mus musculus
tagccctttatgaccttctacttta

SEQ ID NO: 774607 - DNA, 25 bp, Mus musculus
tagccctttatgtccttctacttta

SEQ ID NO: 774608 - DNA, 25 bp, Mus musculus
tagccctttattcactttccatgtg

SEQ ID NO: 774609 - DNA, 25 bp, Mus musculus
tagccctttattgactttccatgtg

SEQ ID NO: 774610 - DNA, 25 bp, Mus musculus
tagccctttgaacggtggcaccagc

SEQ ID NO: 774611 - DNA, 25 bp, Mus musculus
tagccctttgaagggtggcaccagc

SEQ ID NO: 774612 - DNA, 25 bp, Mus musculus
tagccctttggaatcagcctgtgga

SEQ ID NO: 774613 - DNA, 25 bp, Mus musculus
tagccctttggattcagcctgtgga

SEQ ID NO: 774614 - DNA, 25 bp, Mus musculus
tagccctttgtaagaactaccattg

SEQ ID NO: 774615 - DNA, 25 bp, Mus musculus
tagccctttgtatgaactaccattg

SEQ ID NO: 774616 - DNA, 25 bp, Mus musculus
tagccctttgtgaggtcagtctaca

SEQ ID NO: 774617 - DNA, 25 bp, Mus musculus
tagccctttgtgtggtcagtctaca

SEQ ID NO: 774618 - DNA, 25 bp, Mus musculus
tagcccttttgaattcttgtgttta

SEQ ID NO: 774619 - DNA, 25 bp, Mus musculus
tagcccttttgatttcttgtgttta

SEQ ID NO: 774620 - DNA, 25 bp, Mus musculus
tagccgacaggcaaaagtcccagct

SEQ ID NO: 774621 - DNA, 25 bp, Mus musculus
tagccgacaggctaaagtcccagct

SEQ ID NO: 774622 - DNA, 25 bp, Mus musculus
tagccgagggacacgataccgacgt

SEQ ID NO: 774623 - DNA, 25 bp, Mus musculus
tagccgagggactcgataccgacgt

SEQ ID NO: 774624 - DNA, 25 bp, Mus musculus
tagccgagtggcaggattccattga

SEQ ID NO: 774625 - DNA, 25 bp, Mus musculus
tagccgagtggctggattccattga

SEQ ID NO: 774626 - DNA, 25 bp, Mus musculus
tagccgatatgtaccctgagatgaa

SEQ ID NO: 774627 - DNA, 25 bp, Mus musculus
tagccgatatgttccctgagatgaa

SEQ ID NO: 774628 - DNA, 25 bp, Mus musculus
tagccgatgcgaccgtgcttgtgaa

SEQ ID NO: 774629 - DNA, 25 bp, Mus musculus
tagccgatgcgagcgtgcttgtgaa

SEQ ID NO: 774630 - DNA, 25 bp, Mus musculus
tagccgcactcccaggtagtcagag

SEQ ID NO: 774631 - DNA, 25 bp, Mus musculus
tagccgcactccgaggtagtcagag

SEQ ID NO: 774632 - DNA, 25 bp, Mus musculus
tagccgcagcggcttggagtttaca

SEQ ID NO: 774633 - DNA, 25 bp, Mus musculus
tagccgcagcgggttggagtttaca

SEQ ID NO: 774634 - DNA, 25 bp, Mus musculus
tagccgcatccaaaacaggatgtga

SEQ ID NO: 774635 - DNA, 25 bp, Mus musculus
tagccgcatccataacaggatgtga

SEQ ID NO: 774636 - DNA, 25 bp, Mus musculus
tagccgcattccagggtccctacaa

SEQ ID NO: 774637 - DNA, 25 bp, Mus musculus
tagccgcattcctgggtccctacaa

SEQ ID NO: 774638 - DNA, 25 bp, Mus musculus
tagccgccacgaaacctacactgtg

SEQ ID NO: 774639 - DNA, 25 bp, Mus musculus
tagccgccacgatacctacactgtg

SEQ ID NO: 774640 - DNA, 25 bp, Mus musculus
tagccgccagctccatgtaggtgga

SEQ ID NO: 774641 - DNA, 25 bp, Mus musculus
tagccgccagctgcatgtaggtgga

SEQ ID NO: 774642 - DNA, 25 bp, Mus musculus
tagccgcctcaaatagcaaggagat

SEQ ID NO: 774643 - DNA, 25 bp, Mus musculus
tagccgcctcaattagcaaggagat

SEQ ID NO: 774644 - DNA, 25 bp, Mus musculus
tagccgcctgttaaaatgcaccgat

SEQ ID NO: 774645 - DNA, 25 bp, Mus musculus
tagccgcctgtttaaatgcaccgat

SEQ ID NO: 774646 - DNA, 25 bp, Mus musculus
tagccgccttggagagccgactgga

SEQ ID NO: 774647 - DNA, 25 bp, Mus musculus
tagccgccttggtgagccgactgga

SEQ ID NO: 774648 - DNA, 25 bp, Mus musculus
tagccgcgctgacgctcaaggctaa

SEQ ID NO: 774649 - DNA, 25 bp, Mus musculus
tagccgcgctgaggctcaaggctaa

SEQ ID NO: 774650 - DNA, 25 bp, Mus musculus
tagccgcgggcgactgtaggcaacc

SEQ ID NO: 774651 - DNA, 25 bp, Mus musculus
tagccgcgggcgtctgtaggcaacc

SEQ ID NO: 774652 - DNA, 25 bp, Mus musculus
tagccgctcccaaaccagtgaggat

SEQ ID NO: 774653 - DNA, 25 bp, Mus musculus
tagccgctcccataccagtgaggat

SEQ ID NO: 774654 - DNA, 25 bp, Mus musculus
tagccgctgcttaacaaacccagag

SEQ ID NO: 774655 - DNA, 25 bp, Mus musculus
tagccgctgctttacaaacccagag

SEQ ID NO: 774656 - DNA, 25 bp, Mus musculus
tagccggaccgtacaaaaagagact

SEQ ID NO: 774657 - DNA, 25 bp, Mus musculus
tagccggaccgttcaaaaagagact

SEQ ID NO: 774658 - DNA, 25 bp, Mus musculus
tagccggacgtgcttcaagatgtgc

SEQ ID NO: 774659 - DNA, 25 bp, Mus musculus
tagccggacgtggttcaagatgtgc

SEQ ID NO: 774660 - DNA, 25 bp, Mus musculus
tagccggcaagcatcttctcagctc

SEQ ID NO: 774661 - DNA, 25 bp, Mus musculus
tagccggcaagcttcttctcagctc

SEQ ID NO: 774662 - DNA, 25 bp, Mus musculus
tagccggctatgacacgcatctgat

SEQ ID NO: 774663 - DNA, 25 bp, Mus musculus
tagccggctatgtcacgcatctgat

SEQ ID NO: 774664 - DNA, 25 bp, Mus musculus
tagccgggaatgaagctcagctgtt

SEQ ID NO: 774665 - DNA, 25 bp, Mus musculus
tagccgggaatgtagctcagctgtt

SEQ ID NO: 774666 - DNA, 25 bp, Mus musculus
tagccgggatggactatatcgtaac

SEQ ID NO: 774667 - DNA, 25 bp, Mus musculus
tagccgggatggtctatatcgtaac

SEQ ID NO: 774668 - DNA, 25 bp, Mus musculus
tagccgggcagcactctgtagtgtc

SEQ ID NO: 774669 - DNA, 25 bp, Mus musculus
tagccgggcagctctctgtagtgtc

SEQ ID NO: 774670 - DNA, 25 bp, Mus musculus
tagccgggccctcagtaatcactta

SEQ ID NO: 774671 - DNA, 25 bp, Mus musculus
tagccgggccctgagtaatcactta

SEQ ID NO: 774672 - DNA, 25 bp, Mus musculus
tagccggtgcttctggaatttttct

SEQ ID NO: 774673 - DNA, 25 bp, Mus musculus
tagccggtgcttgtggaatttttct

SEQ ID NO: 774674 - DNA, 25 bp, Mus musculus
tagccgtcatcccttgtacagccaa

SEQ ID NO: 774675 - DNA, 25 bp, Mus musculus
tagccgtcatccgttgtacagccaa

SEQ ID NO: 774676 - DNA, 25 bp, Mus musculus
tagccgtcatctcaagttatttccc

SEQ ID NO: 774677 - DNA, 25 bp, Mus musculus
tagccgtcatctgaagttatttccc

SEQ ID NO: 774678 - DNA, 25 bp, Mus musculus
tagccgtccaaccagctagtgatgt

SEQ ID NO: 774679 - DNA, 25 bp, Mus musculus
tagccgtccaacgagctagtgatgt

SEQ ID NO: 774680 - DNA, 25 bp, Mus musculus
tagccgtctcatagttagcgcatag

SEQ ID NO: 774681 - DNA, 25 bp, Mus musculus
tagccgtctcattgttagcgcatag

SEQ ID NO: 774682 - DNA, 25 bp, Mus musculus
tagccgtctctgcagatattatctt

SEQ ID NO: 774683 - DNA, 25 bp, Mus musculus
tagccgtctctggagatattatctt

SEQ ID NO: 774684 - DNA, 25 bp, Mus musculus
tagccgtcttctctactgccttctt

SEQ ID NO: 774685 - DNA, 25 bp, Mus musculus
tagccgtcttctgtactgccttctt

SEQ ID NO: 774686 - DNA, 25 bp, Mus musculus
tagccgtgatccacagctgttgctg

SEQ ID NO: 774687 - DNA, 25 bp, Mus musculus
tagccgtgatcctcagctgttgctg

SEQ ID NO: 774688 - DNA, 25 bp, Mus musculus
tagccgtgttcgcatgcaccaaaag

SEQ ID NO: 774689 - DNA, 25 bp, Mus musculus
tagccgtgttcggatgcaccaaaag

SEQ ID NO: 774690 - DNA, 25 bp, Mus musculus
tagccgttgttacatgccctgcaga

SEQ ID NO: 774691 - DNA, 25 bp, Mus musculus
tagccgttgttagatgccctgcaga

SEQ ID NO: 774692 - DNA, 25 bp, Mus musculus
tagccgtttctcaccatttttaaga

SEQ ID NO: 774693 - DNA, 25 bp, Mus musculus
tagccgtttctctccatttttaaga

SEQ ID NO: 774694 - DNA, 25 bp, Mus musculus
tagccgtttcttcgcagagtcttgc

SEQ ID NO: 774695 - DNA, 25 bp, Mus musculus
tagccgtttcttggcagagtcttgc

SEQ ID NO: 774696 - DNA, 25 bp, Mus musculus
tagccgtttggacccgactggaaga

SEQ ID NO: 774697 - DNA, 25 bp, Mus musculus
tagccgtttggagccgactggaaga

SEQ ID NO: 774698 - DNA, 25 bp, Mus musculus
tagcctaacttcatactcgtattct

SEQ ID NO: 774699 - DNA, 25 bp, Mus musculus
tagcctaacttcttactcgtattct

SEQ ID NO: 774700 - DNA, 25 bp, Mus musculus
tagcctaaggcaatgcttgtctccc

SEQ ID NO: 774701 - DNA, 25 bp, Mus musculus
tagcctaaggcattgcttgtctccc

SEQ ID NO: 774702 - DNA, 25 bp, Mus musculus
tagcctacagatcacctctcagaga

SEQ ID NO: 774703 - DNA, 25 bp, Mus musculus
tagcctacagatgacctctcagaga

SEQ ID NO: 774704 - DNA, 25 bp, Mus musculus
tagcctacatgtacactctgtggtg

SEQ ID NO: 774705 - DNA, 25 bp, Mus musculus
tagcctacatgttcactctgtggtg

SEQ ID NO: 774706 - DNA, 25 bp, Mus musculus
tagcctaccccaatcctaaagaaag

SEQ ID NO: 774707 - DNA, 25 bp, Mus musculus
tagcctaccccattcctaaagaaag

SEQ ID NO: 774708 - DNA, 25 bp, Mus musculus
tagcctacctgcagggatcgactct

SEQ ID NO: 774709 - DNA, 25 bp, Mus musculus
tagcctacctgctgggatcgactct

SEQ ID NO: 774710 - DNA, 25 bp, Mus musculus
tagcctactttaagggcatgctgcc

SEQ ID NO: 774711 - DNA, 25 bp, Mus musculus
tagcctactttatgggcatgctgcc

SEQ ID NO: 774712 - DNA, 25 bp, Mus musculus
tagcctacttttaatagcgtgtaca

SEQ ID NO: 774713 - DNA, 25 bp, Mus musculus
tagcctactttttatagcgtgtaca

SEQ ID NO: 774714 - DNA, 25 bp, Mus musculus
tagcctagatcacctttcttttcag

SEQ ID NO: 774715 - DNA, 25 bp, Mus musculus
tagcctagatcagctttcttttcag

SEQ ID NO: 774716 - DNA, 25 bp, Mus musculus
tagcctagcaaaagtgagcccttga

SEQ ID NO: 774717 - DNA, 25 bp, Mus musculus
tagcctagcaaatgtgagcccttga

SEQ ID NO: 774718 - DNA, 25 bp, Mus musculus
tagcctagcaccattcttacatgat

SEQ ID NO: 774719 - DNA, 25 bp, Mus musculus
tagcctagcacctttcttacatgat

SEQ ID NO: 774720 - DNA, 25 bp, Mus musculus
tagcctagcagacttcagaattcct

SEQ ID NO: 774721 - DNA, 25 bp, Mus musculus
tagcctagcagagttcagaattcct

SEQ ID NO: 774722 - DNA, 25 bp, Mus musculus
tagcctagccacagaatcttgtttt

SEQ ID NO: 774723 - DNA, 25 bp, Mus musculus
tagcctagccactgaatcttgtttt

SEQ ID NO: 774724 - DNA, 25 bp, Mus musculus
tagcctaggctgatgatgctaacct

SEQ ID NO: 774725 - DNA, 25 bp, Mus musculus
tagcctaggctgttgatgctaacct

SEQ ID NO: 774726 - DNA, 25 bp, Mus musculus
tagcctagggagctggaccacacat

SEQ ID NO: 774727 - DNA, 25 bp, Mus musculus
tagcctagggaggtggaccacacat

SEQ ID NO: 774728 - DNA, 25 bp, Mus musculus
tagcctagggctacgacattgcatg

SEQ ID NO: 774729 - DNA, 25 bp, Mus musculus
tagcctagggcttcgacattgcatg

SEQ ID NO: 774730 - DNA, 25 bp, Mus musculus
tagcctagtgccactaatgggacaa

SEQ ID NO: 774731 - DNA, 25 bp, Mus musculus
tagcctagtgcctctaatgggacaa

SEQ ID NO: 774732 - DNA, 25 bp, Mus musculus
tagcctagttgacctgaacactggt

SEQ ID NO: 774733 - DNA, 25 bp, Mus musculus
tagcctagttgagctgaacactggt

SEQ ID NO: 774734 - DNA, 25 bp, Mus musculus
tagcctagttgccacgtgctcttgc

SEQ ID NO: 774735 - DNA, 25 bp, Mus musculus
tagcctagttgcgacgtgctcttgc

SEQ ID NO: 774736 - DNA, 25 bp, Mus musculus
tagcctagtttgattctggtgacat

SEQ ID NO: 774737 - DNA, 25 bp, Mus musculus
tagcctagtttgtttctggtgacat

SEQ ID NO: 774738 - DNA, 25 bp, Mus musculus
tagcctataatgaactccatcacaa

SEQ ID NO: 774739 - DNA, 25 bp, Mus musculus
tagcctataatgtactccatcacaa

SEQ ID NO: 774740 - DNA, 25 bp, Mus musculus
tagcctatatttcctctcaaggaaa

SEQ ID NO: 774741 - DNA, 25 bp, Mus musculus
tagcctatatttgctctcaaggaaa

SEQ ID NO: 774742 - DNA, 25 bp, Mus musculus
tagcctatcacacatgcccaagggc

SEQ ID NO: 774743 - DNA, 25 bp, Mus musculus
tagcctatcacagatgcccaagggc

SEQ ID NO: 774744 - DNA, 25 bp, Mus musculus
tagcctatgcaaaaaacaggacaat

SEQ ID NO: 774745 - DNA, 25 bp, Mus musculus
tagcctatgcaataaacaggacaat

SEQ ID NO: 774746 - DNA, 25 bp, Mus musculus
tagcctatgtgaattcttctgccca

SEQ ID NO: 774747 - DNA, 25 bp, Mus musculus
tagcctatgtgatttcttctgccca

SEQ ID NO: 774748 - DNA, 25 bp, Mus musculus
tagcctatttttctgcttaagatac

SEQ ID NO: 774749 - DNA, 25 bp, Mus musculus
tagcctatttttgtgcttaagatac

SEQ ID NO: 774750 - DNA, 25 bp, Mus musculus
tagcctcaaattccctatgtagtcc

SEQ ID NO: 774751 - DNA, 25 bp, Mus musculus
tagcctcaaattgcctatgtagtcc

SEQ ID NO: 774752 - DNA, 25 bp, Mus musculus
tagcctcaacttccagtggcaaatg

SEQ ID NO: 774753 - DNA, 25 bp, Mus musculus
tagcctcaacttgcagtggcaaatg

SEQ ID NO: 774754 - DNA, 25 bp, Mus musculus
tagcctcaagccagatactacttat

SEQ ID NO: 774755 - DNA, 25 bp, Mus musculus
tagcctcaagcctgatactacttat

SEQ ID NO: 774756 - DNA, 25 bp, Mus musculus
tagcctcaagttcaccgtctgataa

SEQ ID NO: 774757 - DNA, 25 bp, Mus musculus
tagcctcaagttgaccgtctgataa

SEQ ID NO: 774758 - DNA, 25 bp, Mus musculus
tagcctcacgtgacttgcagggaga

SEQ ID NO: 774759 - DNA, 25 bp, Mus musculus
tagcctcacgtgtcttgcagggaga

SEQ ID NO: 774760 - DNA, 25 bp, Mus musculus
tagcctcactaaagtttcctcaaga

SEQ ID NO: 774761 - DNA, 25 bp, Mus musculus
tagcctcactaatgtttcctcaaga

SEQ ID NO: 774762 - DNA, 25 bp, Mus musculus
tagcctcactctcccgttatgcaaa

SEQ ID NO: 774763 - DNA, 25 bp, Mus musculus
tagcctcactctgccgttatgcaaa

SEQ ID NO: 774764 - DNA, 25 bp, Mus musculus
tagcctcagagcagtttctctaacc

SEQ ID NO: 774765 - DNA, 25 bp, Mus musculus
tagcctcagagctgtttctctaacc

SEQ ID NO: 774766 - DNA, 25 bp, Mus musculus
tagcctcagatccagactgtagttg

SEQ ID NO: 774767 - DNA, 25 bp, Mus musculus
tagcctcagatcgagactgtagttg

SEQ ID NO: 774768 - DNA, 25 bp, Mus musculus
tagcctcagctcagttcaaatctgg

SEQ ID NO: 774769 - DNA, 25 bp, Mus musculus
tagcctcagctcatctatgctcagt

SEQ ID NO: 774770 - DNA, 25 bp, Mus musculus
tagcctcagctctgttcaaatctgg

SEQ ID NO: 774771 - DNA, 25 bp, Mus musculus
tagcctcagctcttctatgctcagt

SEQ ID NO: 774772 - DNA, 25 bp, Mus musculus
tagcctcagggcatgaagctggact

SEQ ID NO: 774773 - DNA, 25 bp, Mus musculus
tagcctcagggcttgaagctggact

SEQ ID NO: 774774 - DNA, 25 bp, Mus musculus
tagcctccaactagcatcagtactt

SEQ ID NO: 774775 - DNA, 25 bp, Mus musculus
tagcctccaacttgcatcagtactt

SEQ ID NO: 774776 - DNA, 25 bp, Mus musculus
tagcctccacacaattgcctgggca

SEQ ID NO: 774777 - DNA, 25 bp, Mus musculus
tagcctccacactattgcctgggca

SEQ ID NO: 774778 - DNA, 25 bp, Mus musculus
tagcctccagagcagagatcagccg

SEQ ID NO: 774779 - DNA, 25 bp, Mus musculus
tagcctccagaggagagatcagccg

SEQ ID NO: 774780 - DNA, 25 bp, Mus musculus
tagcctccatttaggttgtaccttt

SEQ ID NO: 774781 - DNA, 25 bp, Mus musculus
tagcctccattttggttgtaccttt

SEQ ID NO: 774782 - DNA, 25 bp, Mus musculus
tagcctcccggtctacagccaatga

SEQ ID NO: 774783 - DNA, 25 bp, Mus musculus
tagcctcccggtgtacagccaatga

SEQ ID NO: 774784 - DNA, 25 bp, Mus musculus
tagcctcccttacccatttaaagag

SEQ ID NO: 774785 - DNA, 25 bp, Mus musculus
tagcctcccttagccatttaaagag

SEQ ID NO: 774786 - DNA, 25 bp, Mus musculus
tagcctccgcctcggagtaagagaa

SEQ ID NO: 774787 - DNA, 25 bp, Mus musculus
tagcctccgcctgggagtaagagaa

SEQ ID NO: 774788 - DNA, 25 bp, Mus musculus
tagcctcctctgcacatttgggtga

SEQ ID NO: 774789 - DNA, 25 bp, Mus musculus
tagcctcctctggacatttgggtga

SEQ ID NO: 774790 - DNA, 25 bp, Mus musculus
tagcctcctgctaggatctgggtgg

SEQ ID NO: 774791 - DNA, 25 bp, Mus musculus
tagcctcctgcttggatctgggtgg

SEQ ID NO: 774792 - DNA, 25 bp, Mus musculus
tagcctcctgggagagcccgaagga

SEQ ID NO: 774793 - DNA, 25 bp, Mus musculus
tagcctcctgggtgagcccgaagga

SEQ ID NO: 774794 - DNA, 25 bp, Mus musculus
tagcctcctgtgaatctgcaaaaat

SEQ ID NO: 774795 - DNA, 25 bp, Mus musculus
tagcctcctgtgtatctgcaaaaat

SEQ ID NO: 774796 - DNA, 25 bp, Mus musculus
tagcctccttgtctgagcagactat

SEQ ID NO: 774797 - DNA, 25 bp, Mus musculus
tagcctccttgtctgtgttggaaga

SEQ ID NO: 774798 - DNA, 25 bp, Mus musculus
tagcctccttgtgtgagcagactat

SEQ ID NO: 774799 - DNA, 25 bp, Mus musculus
tagcctccttgtgtgtgttggaaga

SEQ ID NO: 774800 - DNA, 25 bp, Mus musculus
tagcctcctttcaccagcgaggaaa

SEQ ID NO: 774801 - DNA, 25 bp, Mus musculus
tagcctcctttctccagcgaggaaa

SEQ ID NO: 774802 - DNA, 25 bp, Mus musculus
tagcctcgacatatcaagttgcggt

SEQ ID NO: 774803 - DNA, 25 bp, Mus musculus
tagcctcgacatttcaagttgcggt

SEQ ID NO: 774804 - DNA, 25 bp, Mus musculus
tagcctcggcgtagatggtttgaac

SEQ ID NO: 774805 - DNA, 25 bp, Mus musculus
tagcctcggcgttgatggtttgaac

SEQ ID NO: 774806 - DNA, 25 bp, Mus musculus
tagcctcggctacatagtttgaagc

SEQ ID NO: 774807 - DNA, 25 bp, Mus musculus
tagcctcggctagatagtttgaagc

SEQ ID NO: 774808 - DNA, 25 bp, Mus musculus
tagcctcgggtcactagggaaagat

SEQ ID NO: 774809 - DNA, 25 bp, Mus musculus
tagcctcgggtctctagggaaagat

SEQ ID NO: 774810 - DNA, 25 bp, Mus musculus
tagcctcggttaacctgcggaagtt

SEQ ID NO: 774811 - DNA, 25 bp, Mus musculus
tagcctcggttatcctgcggaagtt

SEQ ID NO: 774812 - DNA, 25 bp, Mus musculus
tagcctcggtttacctattctcctt

SEQ ID NO: 774813 - DNA, 25 bp, Mus musculus
tagcctcggttttcctattctcctt

SEQ ID NO: 774814 - DNA, 25 bp, Mus musculus
tagcctctaacacaattctctctcg

SEQ ID NO: 774815 - DNA, 25 bp, Mus musculus
tagcctctaacagaattctctctcg

SEQ ID NO: 774816 - DNA, 25 bp, Mus musculus
tagcctctaaggatggattcacgat

SEQ ID NO: 774817 - DNA, 25 bp, Mus musculus
tagcctctaaggttggattcacgat

SEQ ID NO: 774818 - DNA, 25 bp, Mus musculus
tagcctctagagagagaacttgtca

SEQ ID NO: 774819 - DNA, 25 bp, Mus musculus
tagcctctagagtgagaacttgtca

SEQ ID NO: 774820 - DNA, 25 bp, Mus musculus
tagcctctagggagtgctcttgcag

SEQ ID NO: 774821 - DNA, 25 bp, Mus musculus
tagcctctagggtgtgctcttgcag

SEQ ID NO: 774822 - DNA, 25 bp, Mus musculus
tagcctctatgaccatggtgtacat

SEQ ID NO: 774823 - DNA, 25 bp, Mus musculus
tagcctctatgagcatggtgtacat

SEQ ID NO: 774824 - DNA, 25 bp, Mus musculus
tagcctctatgcactgttccatgtt

SEQ ID NO: 774825 - DNA, 25 bp, Mus musculus
tagcctctatgctctgttccatgtt

SEQ ID NO: 774826 - DNA, 25 bp, Mus musculus
tagcctctcaggaaatggtattata

SEQ ID NO: 774827 - DNA, 25 bp, Mus musculus
tagcctctcaggtaatggtattata

SEQ ID NO: 774828 - DNA, 25 bp, Mus musculus
tagcctctcatcactgagcttttag

SEQ ID NO: 774829 - DNA, 25 bp, Mus musculus
tagcctctcatctctgagcttttag

SEQ ID NO: 774830 - DNA, 25 bp, Mus musculus
tagcctctggcaagctctggagtgg

SEQ ID NO: 774831 - DNA, 25 bp, Mus musculus
tagcctctggcatgctctggagtgg

SEQ ID NO: 774832 - DNA, 25 bp, Mus musculus
tagcctctggcgacaagtgctgatg

SEQ ID NO: 774833 - DNA, 25 bp, Mus musculus
tagcctctggcgactttggttaatg

SEQ ID NO: 774834 - DNA, 25 bp, Mus musculus
tagcctctggcgtcaagtgctgatg

SEQ ID NO: 774835 - DNA, 25 bp, Mus musculus
tagcctctggcgtctttggttaatg

SEQ ID NO: 774836 - DNA, 25 bp, Mus musculus
tagcctctggctactggcagtataa

SEQ ID NO: 774837 - DNA, 25 bp, Mus musculus
tagcctctggcttctggcagtataa

SEQ ID NO: 774838 - DNA, 25 bp, Mus musculus
tagcctctgtttctaaaactgtcag

SEQ ID NO: 774839 - DNA, 25 bp, Mus musculus
tagcctctgtttgtaaaactgtcag

SEQ ID NO: 774840 - DNA, 25 bp, Mus musculus
tagcctcttctgatggtcttgttga

SEQ ID NO: 774841 - DNA, 25 bp, Mus musculus
tagcctcttctgttggtcttgttga

SEQ ID NO: 774842 - DNA, 25 bp, Mus musculus
tagcctcttgagagtggatgccatg

SEQ ID NO: 774843 - DNA, 25 bp, Mus musculus
tagcctcttgagtgtggatgccatg

SEQ ID NO: 774844 - DNA, 25 bp, Mus musculus
tagcctcttgtaaccagaaagtcag

SEQ ID NO: 774845 - DNA, 25 bp, Mus musculus
tagcctcttgtatccagaaagtcag

SEQ ID NO: 774846 - DNA, 25 bp, Mus musculus
tagcctctttctaattctgtgcatg

SEQ ID NO: 774847 - DNA, 25 bp, Mus musculus
tagcctctttcttattctgtgcatg

SEQ ID NO: 774848 - DNA, 25 bp, Mus musculus
tagcctcttttgacatatgctctta

SEQ ID NO: 774849 - DNA, 25 bp, Mus musculus
tagcctcttttgtcatatgctctta

SEQ ID NO: 774850 - DNA, 25 bp, Mus musculus
tagcctgaaagcagccttgtatgat

SEQ ID NO: 774851 - DNA, 25 bp, Mus musculus
tagcctgaaagctgccttgtatgat

SEQ ID NO: 774852 - DNA, 25 bp, Mus musculus
tagcctgaacctacttgggatttcc

SEQ ID NO: 774853 - DNA, 25 bp, Mus musculus
tagcctgaacctcaaggcctgcaac

SEQ ID NO: 774854 - DNA, 25 bp, Mus musculus
tagcctgaacctgaaggcctgcaac

SEQ ID NO: 774855 - DNA, 25 bp, Mus musculus
tagcctgaaccttcttgggatttcc

SEQ ID NO: 774856 - DNA, 25 bp, Mus musculus
tagcctgaatggaattagcctcttt

SEQ ID NO: 774857 - DNA, 25 bp, Mus musculus
tagcctgaatggtattagcctcttt

SEQ ID NO: 774858 - DNA, 25 bp, Mus musculus
tagcctgacaatatctcatcccttt

SEQ ID NO: 774859 - DNA, 25 bp, Mus musculus
tagcctgacaatttctcatcccttt

SEQ ID NO: 774860 - DNA, 25 bp, Mus musculus
tagcctgaccaacagcaaccacaag

SEQ ID NO: 774861 - DNA, 25 bp, Mus musculus
tagcctgaccaagagcaaccacaag

SEQ ID NO: 774862 - DNA, 25 bp, Mus musculus
tagcctgaccctaggatgcaatgca

SEQ ID NO: 774863 - DNA, 25 bp, Mus musculus
tagcctgacccttggatgcaatgca

SEQ ID NO: 774864 - DNA, 25 bp, Mus musculus
tagcctgactcaacaccctgtggct

SEQ ID NO: 774865 - DNA, 25 bp, Mus musculus
tagcctgactcatcaccctgtggct

SEQ ID NO: 774866 - DNA, 25 bp, Mus musculus
tagcctgactccactgattgcatgc

SEQ ID NO: 774867 - DNA, 25 bp, Mus musculus
tagcctgactcctctgattgcatgc

SEQ ID NO: 774868 - DNA, 25 bp, Mus musculus
tagcctgactgaccaattgtgacct

SEQ ID NO: 774869 - DNA, 25 bp, Mus musculus
tagcctgactgagcaattgtgacct

SEQ ID NO: 774870 - DNA, 25 bp, Mus musculus
tagcctgactggatcctgggaccag

SEQ ID NO: 774871 - DNA, 25 bp, Mus musculus
tagcctgactggttcctgggaccag

SEQ ID NO: 774872 - DNA, 25 bp, Mus musculus
tagcctgacttcacagtggcttctt

SEQ ID NO: 774873 - DNA, 25 bp, Mus musculus
tagcctgacttctcagtggcttctt

SEQ ID NO: 774874 - DNA, 25 bp, Mus musculus
tagcctgactttccttactggtttt

SEQ ID NO: 774875 - DNA, 25 bp, Mus musculus
tagcctgactttcttttgcgttatc

SEQ ID NO: 774876 - DNA, 25 bp, Mus musculus
tagcctgactttgcttactggtttt

SEQ ID NO: 774877 - DNA, 25 bp, Mus musculus
tagcctgactttgttttgcgttatc

SEQ ID NO: 774878 - DNA, 25 bp, Mus musculus
tagcctgagattcatcaccgactcc

SEQ ID NO: 774879 - DNA, 25 bp, Mus musculus
tagcctgagattgatcaccgactcc

SEQ ID NO: 774880 - DNA, 25 bp, Mus musculus
tagcctgagtggcatgccctctagt

SEQ ID NO: 774881 - DNA, 25 bp, Mus musculus
tagcctgagtgggatgccctctagt

SEQ ID NO: 774882 - DNA, 25 bp, Mus musculus
tagcctgagttaaggcaagaccctg

SEQ ID NO: 774883 - DNA, 25 bp, Mus musculus
tagcctgagttatggcaagaccctg

SEQ ID NO: 774884 - DNA, 25 bp, Mus musculus
tagcctgatgtaacgctttgcgtta

SEQ ID NO: 774885 - DNA, 25 bp, Mus musculus
tagcctgatgtatcgctttgcgtta

SEQ ID NO: 774886 - DNA, 25 bp, Mus musculus
tagcctgcaacccttgtgctttaac

SEQ ID NO: 774887 - DNA, 25 bp, Mus musculus
tagcctgcaaccgttgtgctttaac

SEQ ID NO: 774888 - DNA, 25 bp, Mus musculus
tagcctgcagacaatgggagccctt

SEQ ID NO: 774889 - DNA, 25 bp, Mus musculus
tagcctgcagactatgggagccctt

SEQ ID NO: 774890 - DNA, 25 bp, Mus musculus
tagcctgcagccagataccttgaag

SEQ ID NO: 774891 - DNA, 25 bp, Mus musculus
tagcctgcagcctgataccttgaag

SEQ ID NO: 774892 - DNA, 25 bp, Mus musculus
tagcctgcataaactctccgagtga

SEQ ID NO: 774893 - DNA, 25 bp, Mus musculus
tagcctgcataatctctccgagtga

SEQ ID NO: 774894 - DNA, 25 bp, Mus musculus
tagcctgcatagatcatttatttga

SEQ ID NO: 774895 - DNA, 25 bp, Mus musculus
tagcctgcatagttcatttatttga

SEQ ID NO: 774896 - DNA, 25 bp, Mus musculus
tagcctgccagaacctagactgcaa

SEQ ID NO: 774897 - DNA, 25 bp, Mus musculus
tagcctgccagatcctagactgcaa

SEQ ID NO: 774898 - DNA, 25 bp, Mus musculus
tagcctgccctgcttaacgttattt

SEQ ID NO: 774899 - DNA, 25 bp, Mus musculus
tagcctgccctggttaacgttattt

SEQ ID NO: 774900 - DNA, 25 bp, Mus musculus
tagcctgccggtagtgtctgagctt

SEQ ID NO: 774901 - DNA, 25 bp, Mus musculus
tagcctgccggttgtgtctgagctt

SEQ ID NO: 774902 - DNA, 25 bp, Mus musculus
tagcctgcctagatctagagagctg

SEQ ID NO: 774903 - DNA, 25 bp, Mus musculus
tagcctgcctagttctagagagctg

SEQ ID NO: 774904 - DNA, 25 bp, Mus musculus
tagcctgccttgctggcttatttac

SEQ ID NO: 774905 - DNA, 25 bp, Mus musculus
tagcctgccttggtggcttatttac

SEQ ID NO: 774906 - DNA, 25 bp, Mus musculus
tagcctgcgtgcacatttttccgag

SEQ ID NO: 774907 - DNA, 25 bp, Mus musculus
tagcctgcgtgctcatttttccgag

SEQ ID NO: 774908 - DNA, 25 bp, Mus musculus
tagcctgctcaaaattctcccatga

SEQ ID NO: 774909 - DNA, 25 bp, Mus musculus
tagcctgctcaatattctcccatga

SEQ ID NO: 774910 - DNA, 25 bp, Mus musculus
tagcctgctcccctgatgactgagg

SEQ ID NO: 774911 - DNA, 25 bp, Mus musculus
tagcctgctcccgtgatgactgagg

SEQ ID NO: 774912 - DNA, 25 bp, Mus musculus
tagcctgctgaccttgggctagaaa

SEQ ID NO: 774913 - DNA, 25 bp, Mus musculus
tagcctgctgacgttgggctagaaa

SEQ ID NO: 774914 - DNA, 25 bp, Mus musculus
tagcctgctgggaggctggcttacc

SEQ ID NO: 774915 - DNA, 25 bp, Mus musculus
tagcctgctgggtggctggcttacc

SEQ ID NO: 774916 - DNA, 25 bp, Mus musculus
tagcctgcttgtatacttgtttatg

SEQ ID NO: 774917 - DNA, 25 bp, Mus musculus
tagcctgcttgtttacttgtttatg

SEQ ID NO: 774918 - DNA, 25 bp, Mus musculus
tagcctggacacagggtcagcgaag

SEQ ID NO: 774919 - DNA, 25 bp, Mus musculus
tagcctggacactgggtcagcgaag

SEQ ID NO: 774920 - DNA, 25 bp, Mus musculus
tagcctggactgcttttttacctca

SEQ ID NO: 774921 - DNA, 25 bp, Mus musculus
tagcctggactggttttttacctca

SEQ ID NO: 774922 - DNA, 25 bp, Mus musculus
tagcctggaggcatcgttcttggaa

SEQ ID NO: 774923 - DNA, 25 bp, Mus musculus
tagcctggaggcctgaacagcctat

SEQ ID NO: 774924 - DNA, 25 bp, Mus musculus
tagcctggaggcgtgaacagcctat

SEQ ID NO: 774925 - DNA, 25 bp, Mus musculus
tagcctggaggcttcgttcttggaa

SEQ ID NO: 774926 - DNA, 25 bp, Mus musculus
tagcctggagtcctggacctgagta

SEQ ID NO: 774927 - DNA, 25 bp, Mus musculus
tagcctggagtcgtggacctgagta

SEQ ID NO: 774928 - DNA, 25 bp, Mus musculus
tagcctggatcacatacctggacat

SEQ ID NO: 774929 - DNA, 25 bp, Mus musculus
tagcctggatcagatacctggacat

SEQ ID NO: 774930 - DNA, 25 bp, Mus musculus
tagcctggatggaaaagccctgttc

SEQ ID NO: 774931 - DNA, 25 bp, Mus musculus
tagcctggatggagttgtacgtctc

SEQ ID NO: 774932 - DNA, 25 bp, Mus musculus
tagcctggatggtaaagccctgttc

SEQ ID NO: 774933 - DNA, 25 bp, Mus musculus
tagcctggatggtgttgtacgtctc

SEQ ID NO: 774934 - DNA, 25 bp, Mus musculus
tagcctggcagcatctacagcggaa

SEQ ID NO: 774935 - DNA, 25 bp, Mus musculus
tagcctggcagcttctacagcggaa

SEQ ID NO: 774936 - DNA, 25 bp, Mus musculus
tagcctggcaggctgatgcatgtct

SEQ ID NO: 774937 - DNA, 25 bp, Mus musculus
tagcctggcagggtgatgcatgtct

SEQ ID NO: 774938 - DNA, 25 bp, Mus musculus
tagcctggcagtatttactctttga

SEQ ID NO: 774939 - DNA, 25 bp, Mus musculus
tagcctggcagtttttactctttga

SEQ ID NO: 774940 - DNA, 25 bp, Mus musculus
tagcctggcatgaggtagctgctta

SEQ ID NO: 774941 - DNA, 25 bp, Mus musculus
tagcctggcatgtggtagctgctta

SEQ ID NO: 774942 - DNA, 25 bp, Mus musculus
tagcctggccagagaaccctcactg

SEQ ID NO: 774943 - DNA, 25 bp, Mus musculus
tagcctggccagtgaaccctcactg

SEQ ID NO: 774944 - DNA, 25 bp, Mus musculus
tagcctggcggtaatttcagacgaa

SEQ ID NO: 774945 - DNA, 25 bp, Mus musculus
tagcctggcggttatttcagacgaa

SEQ ID NO: 774946 - DNA, 25 bp, Mus musculus
tagcctggctccagaagttctggaa

SEQ ID NO: 774947 - DNA, 25 bp, Mus musculus
tagcctggctcctgaagttctggaa

SEQ ID NO: 774948 - DNA, 25 bp, Mus musculus
tagcctggctgtctttgggtcagat

SEQ ID NO: 774949 - DNA, 25 bp, Mus musculus
tagcctggctgtgtttgggtcagat

SEQ ID NO: 774950 - DNA, 25 bp, Mus musculus
tagcctggcttaaggagcaagttcc

SEQ ID NO: 774951 - DNA, 25 bp, Mus musculus
tagcctggcttatggagcaagttcc

SEQ ID NO: 774952 - DNA, 25 bp, Mus musculus
tagcctgggagcagatggctgtaac

SEQ ID NO: 774953 - DNA, 25 bp, Mus musculus
tagcctgggagctgatggctgtaac

SEQ ID NO: 774954 - DNA, 25 bp, Mus musculus
tagcctgggattagtactaaggttt

SEQ ID NO: 774955 - DNA, 25 bp, Mus musculus
tagcctgggatttgtactaaggttt

SEQ ID NO: 774956 - DNA, 25 bp, Mus musculus
tagcctgggctaaatcaatcagtga

SEQ ID NO: 774957 - DNA, 25 bp, Mus musculus
tagcctgggctatatcaatcagtga

SEQ ID NO: 774958 - DNA, 25 bp, Mus musculus
tagcctgggctcagagaccggaatg

SEQ ID NO: 774959 - DNA, 25 bp, Mus musculus
tagcctgggctcaggatggttttag

SEQ ID NO: 774960 - DNA, 25 bp, Mus musculus
tagcctgggctctgagaccggaatg

SEQ ID NO: 774961 - DNA, 25 bp, Mus musculus
tagcctgggctctggatggttttag

SEQ ID NO: 774962 - DNA, 25 bp, Mus musculus
tagcctgggtggaatttgtcgaagt

SEQ ID NO: 774963 - DNA, 25 bp, Mus musculus
tagcctgggtggtatttgtcgaagt

SEQ ID NO: 774964 - DNA, 25 bp, Mus musculus
tagcctgggttgacctggaactacc

SEQ ID NO: 774965 - DNA, 25 bp, Mus musculus
tagcctgggttgtcctggaactacc

SEQ ID NO: 774966 - DNA, 25 bp, Mus musculus
tagcctggtgcaaagcccaagacga

SEQ ID NO: 774967 - DNA, 25 bp, Mus musculus
tagcctggtgcatagcccaagacga

SEQ ID NO: 774968 - DNA, 25 bp, Mus musculus
tagcctggttctcacacagtatttc

SEQ ID NO: 774969 - DNA, 25 bp, Mus musculus
tagcctggttctcctttgatgtcaa

SEQ ID NO: 774970 - DNA, 25 bp, Mus musculus
tagcctggttctgacacagtatttc

SEQ ID NO: 774971 - DNA, 25 bp, Mus musculus
tagcctggttctgctttgatgtcaa

SEQ ID NO: 774972 - DNA, 25 bp, Mus musculus
tagcctggttggaaagttgcaagcc

SEQ ID NO: 774973 - DNA, 25 bp, Mus musculus
tagcctggttggtaagttgcaagcc

SEQ ID NO: 774974 - DNA, 25 bp, Mus musculus
tagcctgtaaggcttccttctgaac

SEQ ID NO: 774975 - DNA, 25 bp, Mus musculus
tagcctgtaagggttccttctgaac

SEQ ID NO: 774976 - DNA, 25 bp, Mus musculus
tagcctgtacagctacttatccaga

SEQ ID NO: 774977 - DNA, 25 bp, Mus musculus
tagcctgtacaggtacttatccaga

SEQ ID NO: 774978 - DNA, 25 bp, Mus musculus
tagcctgtacttattacctcatgat

SEQ ID NO: 774979 - DNA, 25 bp, Mus musculus
tagcctgtactttttacctcatgat

SEQ ID NO: 774980 - DNA, 25 bp, Mus musculus
tagcctgtatctaggcctagaagaa

SEQ ID NO: 774981 - DNA, 25 bp, Mus musculus
tagcctgtatctcagtcagtcactg

SEQ ID NO: 774982 - DNA, 25 bp, Mus musculus
tagcctgtatctgagtcagtcactg

SEQ ID NO: 774983 - DNA, 25 bp, Mus musculus
tagcctgtatcttggcctagaagaa

SEQ ID NO: 774984 - DNA, 25 bp, Mus musculus
tagcctgtcaaaaaccctaatgatg

SEQ ID NO: 774985 - DNA, 25 bp, Mus musculus
tagcctgtcaaataccctaatgatg

SEQ ID NO: 774986 - DNA, 25 bp, Mus musculus
tagcctgtcaggattcgacggacgc

SEQ ID NO: 774987 - DNA, 25 bp, Mus musculus
tagcctgtcaggtttcgacggacgc

SEQ ID NO: 774988 - DNA, 25 bp, Mus musculus
tagcctgtccaacgatgctggtgat

SEQ ID NO: 774989 - DNA, 25 bp, Mus musculus
tagcctgtccaaggatgctggtgat

SEQ ID NO: 774990 - DNA, 25 bp, Mus musculus
tagcctgtctgtctgttatggattc

SEQ ID NO: 774991 - DNA, 25 bp, Mus musculus
tagcctgtctgtgtgttatggattc

SEQ ID NO: 774992 - DNA, 25 bp, Mus musculus
tagcctgtgcttatttcatttctca

SEQ ID NO: 774993 - DNA, 25 bp, Mus musculus
tagcctgtgcttttttcatttctca

SEQ ID NO: 774994 - DNA, 25 bp, Mus musculus
tagcctgttaaaatcctcacacgaa

SEQ ID NO: 774995 - DNA, 25 bp, Mus musculus
tagcctgttaaattcctcacacgaa

SEQ ID NO: 774996 - DNA, 25 bp, Mus musculus
tagcctgttcttaaactcactttct

SEQ ID NO: 774997 - DNA, 25 bp, Mus musculus
tagcctgttctttaactcactttct

SEQ ID NO: 774998 - DNA, 25 bp, Mus musculus
tagcctgttgacagcagccctgttc

SEQ ID NO: 774999 - DNA, 25 bp, Mus musculus
tagcctgttgactgcagccctgttc

SEQ ID NO: 775000 - DNA, 25 bp, Mus musculus
tagccttaacttctgattctgggat

SEQ ID NO: 775001 - DNA, 25 bp, Mus musculus
tagccttaacttgtgattctgggat

SEQ ID NO: 775002 - DNA, 25 bp, Mus musculus
tagccttagacccatgatcaccgtg

SEQ ID NO: 775003 - DNA, 25 bp, Mus musculus
tagccttagaccgatgatcaccgtg

SEQ ID NO: 775004 - DNA, 25 bp, Mus musculus
tagccttagaggcactccggattaa

SEQ ID NO: 775005 - DNA, 25 bp, Mus musculus
tagccttagagggactccggattaa

SEQ ID NO: 775006 - DNA, 25 bp, Mus musculus
tagccttagtcaataaacctgtagg

SEQ ID NO: 775007 - DNA, 25 bp, Mus musculus
tagccttagtcattaaacctgtagg

SEQ ID NO: 775008 - DNA, 25 bp, Mus musculus
tagccttataatcgccggaattccg

SEQ ID NO: 775009 - DNA, 25 bp, Mus musculus
tagccttataatggccggaattccg

SEQ ID NO: 775010 - DNA, 25 bp, Mus musculus
tagccttcaaccactgggctccatg

SEQ ID NO: 775011 - DNA, 25 bp, Mus musculus
tagccttcaacctctgggctccatg

SEQ ID NO: 775012 - DNA, 25 bp, Mus musculus
tagccttcaagtaggcctttggaaa

SEQ ID NO: 775013 - DNA, 25 bp, Mus musculus
tagccttcaagttggcctttggaaa

SEQ ID NO: 775014 - DNA, 25 bp, Mus musculus
tagccttcacgtatatttttctctg

SEQ ID NO: 775015 - DNA, 25 bp, Mus musculus
tagccttcacgtttatttttctctg

SEQ ID NO: 775016 - DNA, 25 bp, Mus musculus
tagccttccacacaacttgagcaga

SEQ ID NO: 775017 - DNA, 25 bp, Mus musculus
tagccttccacagaacttgagcaga

SEQ ID NO: 775018 - DNA, 25 bp, Mus musculus
tagccttccagcactgttatttaaa

SEQ ID NO: 775019 - DNA, 25 bp, Mus musculus
tagccttccagctctgttatttaaa

SEQ ID NO: 775020 - DNA, 25 bp, Mus musculus
tagccttccaggatcttggttacaa

SEQ ID NO: 775021 - DNA, 25 bp, Mus musculus
tagccttccaggttcttggttacaa

SEQ ID NO: 775022 - DNA, 25 bp, Mus musculus
tagccttcctaaaatataactgcgt

SEQ ID NO: 775023 - DNA, 25 bp, Mus musculus
tagccttcctaatatataactgcgt

SEQ ID NO: 775024 - DNA, 25 bp, Mus musculus
tagccttcctggagagatcctgtca

SEQ ID NO: 775025 - DNA, 25 bp, Mus musculus
tagccttcctggtgagatcctgtca

SEQ ID NO: 775026 - DNA, 25 bp, Mus musculus
tagccttctgtcaaagcatcatctc

SEQ ID NO: 775027 - DNA, 25 bp, Mus musculus
tagccttctgtctaagcatcatctc

SEQ ID NO: 775028 - DNA, 25 bp, Mus musculus
tagccttcttatctgcaattccgag

SEQ ID NO: 775029 - DNA, 25 bp, Mus musculus
tagccttcttatgtgcaattccgag

SEQ ID NO: 775030 - DNA, 25 bp, Mus musculus
tagccttgacttcgtgcagcacttg

SEQ ID NO: 775031 - DNA, 25 bp, Mus musculus
tagccttgacttggtgcagcacttg

SEQ ID NO: 775032 - DNA, 25 bp, Mus musculus
tagccttgcaacatggagtacacag

SEQ ID NO: 775033 - DNA, 25 bp, Mus musculus
tagccttgcaacttggagtacacag

SEQ ID NO: 775034 - DNA, 25 bp, Mus musculus
tagccttgccagagcactgtagatg

SEQ ID NO: 775035 - DNA, 25 bp, Mus musculus
tagccttgccagctgttgggcccaa

SEQ ID NO: 775036 - DNA, 25 bp, Mus musculus
tagccttgccaggtgttgggcccaa

SEQ ID NO: 775037 - DNA, 25 bp, Mus musculus
tagccttgccagtgcactgtagatg

SEQ ID NO: 775038 - DNA, 25 bp, Mus musculus
tagccttgcctactgagtctgtgtc

SEQ ID NO: 775039 - DNA, 25 bp, Mus musculus
tagccttgcctagtgagtctgtgtc

SEQ ID NO: 775040 - DNA, 25 bp, Mus musculus
tagccttgcctccattgttagggat

SEQ ID NO: 775041 - DNA, 25 bp, Mus musculus
tagccttgcctcgattgttagggat

SEQ ID NO: 775042 - DNA, 25 bp, Mus musculus
tagccttggatgactgccctactga

SEQ ID NO: 775043 - DNA, 25 bp, Mus musculus
tagccttggatgaggatgcaaccct

SEQ ID NO: 775044 - DNA, 25 bp, Mus musculus
tagccttggatgtctgccctactga

SEQ ID NO: 775045 - DNA, 25 bp, Mus musculus
tagccttggatgtggatgcaaccct

SEQ ID NO: 775046 - DNA, 25 bp, Mus musculus
tagccttggcctctagttttaaaca

SEQ ID NO: 775047 - DNA, 25 bp, Mus musculus
tagccttggcctgtagttttaaaca

SEQ ID NO: 775048 - DNA, 25 bp, Mus musculus
tagccttggcggaggttaaccagat

SEQ ID NO: 775049 - DNA, 25 bp, Mus musculus
tagccttggcggtggttaaccagat

SEQ ID NO: 775050 - DNA, 25 bp, Mus musculus
tagccttggcttcctgacctgaaac

SEQ ID NO: 775051 - DNA, 25 bp, Mus musculus
tagccttggcttctcccaaaccaaa

SEQ ID NO: 775052 - DNA, 25 bp, Mus musculus
tagccttggcttgctgacctgaaac

SEQ ID NO: 775053 - DNA, 25 bp, Mus musculus
tagccttggcttgtcccaaaccaaa

SEQ ID NO: 775054 - DNA, 25 bp, Mus musculus
tagccttggtcacttcttacacagt

SEQ ID NO: 775055 - DNA, 25 bp, Mus musculus
tagccttggtcagttcttacacagt

SEQ ID NO: 775056 - DNA, 25 bp, Mus musculus
tagccttgtactcttagtgatccgc

SEQ ID NO: 775057 - DNA, 25 bp, Mus musculus
tagccttgtactgttagtgatccgc

SEQ ID NO: 775058 - DNA, 25 bp, Mus musculus
tagccttgtagccatcattcaagtc

SEQ ID NO: 775059 - DNA, 25 bp, Mus musculus
tagccttgtagcgatcattcaagtc

SEQ ID NO: 775060 - DNA, 25 bp, Mus musculus
tagccttgtataacttacctagtgg

SEQ ID NO: 775061 - DNA, 25 bp, Mus musculus
tagccttgtatatcttacctagtgg

SEQ ID NO: 775062 - DNA, 25 bp, Mus musculus
tagccttgtcttaaccagggatgct

SEQ ID NO: 775063 - DNA, 25 bp, Mus musculus
tagccttgtctttaccagggatgct

SEQ ID NO: 775064 - DNA, 25 bp, Mus musculus
tagccttgttcgaagtctccagaaa

SEQ ID NO: 775065 - DNA, 25 bp, Mus musculus
tagccttgttcgtagtctccagaaa

SEQ ID NO: 775066 - DNA, 25 bp, Mus musculus
tagcctttagaaaacatccaaccca

SEQ ID NO: 775067 - DNA, 25 bp, Mus musculus
tagcctttagaatacatccaaccca

SEQ ID NO: 775068 - DNA, 25 bp, Mus musculus
tagcctttcaaacagttcacacctc

SEQ ID NO: 775069 - DNA, 25 bp, Mus musculus
tagcctttcaaagagttcacacctc

SEQ ID NO: 775070 - DNA, 25 bp, Mus musculus
tagcctttcaagaactcatctgcag

SEQ ID NO: 775071 - DNA, 25 bp, Mus musculus
tagcctttcaagtactcatctgcag

SEQ ID NO: 775072 - DNA, 25 bp, Mus musculus
tagcctttcaatcatctacctggta

SEQ ID NO: 775073 - DNA, 25 bp, Mus musculus
tagcctttcaatgatctacctggta

SEQ ID NO: 775074 - DNA, 25 bp, Mus musculus
tagcctttctcacgctgcaccaaag

SEQ ID NO: 775075 - DNA, 25 bp, Mus musculus
tagcctttctcaggctgcaccaaag

SEQ ID NO: 775076 - DNA, 25 bp, Mus musculus
tagcctttgaatactggagttgtac

SEQ ID NO: 775077 - DNA, 25 bp, Mus musculus
tagcctttgaattctggagttgtac

SEQ ID NO: 775078 - DNA, 25 bp, Mus musculus
tagcctttgcgaatgtgtgatccaa

SEQ ID NO: 775079 - DNA, 25 bp, Mus musculus
tagcctttgcgattgtgtgatccaa

SEQ ID NO: 775080 - DNA, 25 bp, Mus musculus
tagcctttgctccaccctgaataaa

SEQ ID NO: 775081 - DNA, 25 bp, Mus musculus
tagcctttgctcgaccctgaataaa

SEQ ID NO: 775082 - DNA, 25 bp, Mus musculus
tagcctttgcttataaacccatcgg

SEQ ID NO: 775083 - DNA, 25 bp, Mus musculus
tagcctttgcttttaaacccatcgg

SEQ ID NO: 775084 - DNA, 25 bp, Mus musculus
tagcctttggctctagtcccagttt

SEQ ID NO: 775085 - DNA, 25 bp, Mus musculus
tagcctttggctgtagtcccagttt

SEQ ID NO: 775086 - DNA, 25 bp, Mus musculus
tagcctttgtggaccctgatcaaaa

SEQ ID NO: 775087 - DNA, 25 bp, Mus musculus
tagcctttgtggtccctgatcaaaa

SEQ ID NO: 775088 - DNA, 25 bp, Mus musculus
tagccttttgtcacagcactgaaga

SEQ ID NO: 775089 - DNA, 25 bp, Mus musculus
tagccttttgtcatgccttttaaca

SEQ ID NO: 775090 - DNA, 25 bp, Mus musculus
tagccttttgtctcagcactgaaga

SEQ ID NO: 775091 - DNA, 25 bp, Mus musculus
tagccttttgtcttgccttttaaca

SEQ ID NO: 775092 - DNA, 25 bp, Mus musculus
tagcctttttgtactgtaaggtgga

SEQ ID NO: 775093 - DNA, 25 bp, Mus musculus
tagcctttttgttctgtaaggtgga

SEQ ID NO: 775094 - DNA, 25 bp, Mus musculus
tagcgaaagcctcgtttcggcccgg

SEQ ID NO: 775095 - DNA, 25 bp, Mus musculus
tagcgaaagcctggtttcggcccgg

SEQ ID NO: 775096 - DNA, 25 bp, Mus musculus
tagcgaacagacaagcctctgcttc

SEQ ID NO: 775097 - DNA, 25 bp, Mus musculus
tagcgaacagactagcctctgcttc

SEQ ID NO: 775098 - DNA, 25 bp, Mus musculus
tagcgaatcccaactgcgaactcgg

SEQ ID NO: 775099 - DNA, 25 bp, Mus musculus
tagcgaatcccatctgcgaactcgg

SEQ ID NO: 775100 - DNA, 25 bp, Mus musculus
tagcgaatgctaaacctgggcctgc

SEQ ID NO: 775101 - DNA, 25 bp, Mus musculus
tagcgaatgctatacctgggcctgc

SEQ ID NO: 775102 - DNA, 25 bp, Mus musculus
tagcgacactctctctaaacattct

SEQ ID NO: 775103 - DNA, 25 bp, Mus musculus
tagcgacactctgtctaaacattct

SEQ ID NO: 775104 - DNA, 25 bp, Mus musculus
tagcgacccagacagcacagtagca

SEQ ID NO: 775105 - DNA, 25 bp, Mus musculus
tagcgacccagagagcacagtagca

SEQ ID NO: 775106 - DNA, 25 bp, Mus musculus
tagcgaccttctctgagacattagt

SEQ ID NO: 775107 - DNA, 25 bp, Mus musculus
tagcgaccttctgtgagacattagt

SEQ ID NO: 775108 - DNA, 25 bp, Mus musculus
tagcgacctttgacagcagattctg

SEQ ID NO: 775109 - DNA, 25 bp, Mus musculus
tagcgacctttgtcagcagattctg

SEQ ID NO: 775110 - DNA, 25 bp, Mus musculus
tagcgacggtctaggtgtagcataa

SEQ ID NO: 775111 - DNA, 25 bp, Mus musculus
tagcgacggtcttggtgtagcataa

SEQ ID NO: 775112 - DNA, 25 bp, Mus musculus
tagcgactgctgatctgatatacat

SEQ ID NO: 775113 - DNA, 25 bp, Mus musculus
tagcgactgctgttctgatatacat

SEQ ID NO: 775114 - DNA, 25 bp, Mus musculus
tagcgagacaatatcttatcaaact

SEQ ID NO: 775115 - DNA, 25 bp, Mus musculus
tagcgagacaatttcttatcaaact

SEQ ID NO: 775116 - DNA, 25 bp, Mus musculus
tagcgagacttacatcacggagaat

SEQ ID NO: 775117 - DNA, 25 bp, Mus musculus
tagcgagacttagatcacggagaat

SEQ ID NO: 775118 - DNA, 25 bp, Mus musculus
tagcgagcgagcaagcacttcaagt

SEQ ID NO: 775119 - DNA, 25 bp, Mus musculus
tagcgagcgagctagcacttcaagt

SEQ ID NO: 775120 - DNA, 25 bp, Mus musculus
tagcgagcgttactaatccgaagtt

SEQ ID NO: 775121 - DNA, 25 bp, Mus musculus
tagcgagcgttagtaatccgaagtt

SEQ ID NO: 775122 - DNA, 25 bp, Mus musculus
tagcgagctgtgaccccggagatct

SEQ ID NO: 775123 - DNA, 25 bp, Mus musculus
tagcgagctgtgtccccggagatct

SEQ ID NO: 775124 - DNA, 25 bp, Mus musculus
tagcgagcttgcatccaggacatat

SEQ ID NO: 775125 - DNA, 25 bp, Mus musculus
tagcgagcttgcttccaggacatat

SEQ ID NO: 775126 - DNA, 25 bp, Mus musculus
tagcgaggaggtctaaaggttttat

SEQ ID NO: 775127 - DNA, 25 bp, Mus musculus
tagcgaggaggtgtaaaggttttat

SEQ ID NO: 775128 - DNA, 25 bp, Mus musculus
tagcgaggagttcgaccacgttttc

SEQ ID NO: 775129 - DNA, 25 bp, Mus musculus
tagcgaggagttggaccacgttttc

SEQ ID NO: 775130 - DNA, 25 bp, Mus musculus
tagcgagggtttatctcctttgtat

SEQ ID NO: 775131 - DNA, 25 bp, Mus musculus
tagcgagggtttttctcctttgtat

SEQ ID NO: 775132 - DNA, 25 bp, Mus musculus
tagcgagtaaagagttgcccctgca

SEQ ID NO: 775133 - DNA, 25 bp, Mus musculus
tagcgagtaaagtgttgcccctgca

SEQ ID NO: 775134 - DNA, 25 bp, Mus musculus
tagcgagtagaacacagctcctgtg

SEQ ID NO: 775135 - DNA, 25 bp, Mus musculus
tagcgagtagaagacagctcctgtg

SEQ ID NO: 775136 - DNA, 25 bp, Mus musculus
tagcgagtgatcagcaggccaggaa

SEQ ID NO: 775137 - DNA, 25 bp, Mus musculus
tagcgagtgatctgcaggccaggaa

SEQ ID NO: 775138 - DNA, 25 bp, Mus musculus
tagcgagttcagcatcgcccgtcct

SEQ ID NO: 775139 - DNA, 25 bp, Mus musculus
tagcgagttcaggatcgcccgtcct

SEQ ID NO: 775140 - DNA, 25 bp, Mus musculus
tagcgagtttatcgagttcctcagc

SEQ ID NO: 775141 - DNA, 25 bp, Mus musculus
tagcgagtttatggagttcctcagc

SEQ ID NO: 775142 - DNA, 25 bp, Mus musculus
tagcgataggctccattttgcctgt

SEQ ID NO: 775143 - DNA, 25 bp, Mus musculus
tagcgataggctgcattttgcctgt

SEQ ID NO: 775144 - DNA, 25 bp, Mus musculus
tagcgatgactcatggcacccacat

SEQ ID NO: 775145 - DNA, 25 bp, Mus musculus
tagcgatgactcttggcacccacat

SEQ ID NO: 775146 - DNA, 25 bp, Mus musculus
tagcgatgattccatttgtgtcctg

SEQ ID NO: 775147 - DNA, 25 bp, Mus musculus
tagcgatgattcgatttgtgtcctg

SEQ ID NO: 775148 - DNA, 25 bp, Mus musculus
tagcgatgctcaaacacatactctg

SEQ ID NO: 775149 - DNA, 25 bp, Mus musculus
tagcgatgctcatacacatactctg

SEQ ID NO: 775150 - DNA, 25 bp, Mus musculus
tagcgatgggtaattttccagtgat

SEQ ID NO: 775151 - DNA, 25 bp, Mus musculus
tagcgatgggtatttttccagtgat

SEQ ID NO: 775152 - DNA, 25 bp, Mus musculus
tagcgatgtcgtcactgaactcttt

SEQ ID NO: 775153 - DNA, 25 bp, Mus musculus
tagcgatgtcgtgactgaactcttt

SEQ ID NO: 775154 - DNA, 25 bp, Mus musculus
tagcgattcaaaagttgtcactcat

SEQ ID NO: 775155 - DNA, 25 bp, Mus musculus
tagcgattcaaatgttgtcactcat

SEQ ID NO: 775156 - DNA, 25 bp, Mus musculus
tagcgattgattagccctgggcttt

SEQ ID NO: 775157 - DNA, 25 bp, Mus musculus
tagcgattgatttgccctgggcttt

SEQ ID NO: 775158 - DNA, 25 bp, Mus musculus
tagcgatttagcacggccagggtct

SEQ ID NO: 775159 - DNA, 25 bp, Mus musculus
tagcgatttagctcggccagggtct

SEQ ID NO: 775160 - DNA, 25 bp, Mus musculus
tagcgcaccttccagctgcagttaa

SEQ ID NO: 775161 - DNA, 25 bp, Mus musculus
tagcgcaccttcgagctgcagttaa

SEQ ID NO: 775162 - DNA, 25 bp, Mus musculus
tagcgcacggacatgcagtgacgac

SEQ ID NO: 775163 - DNA, 25 bp, Mus musculus
tagcgcacggacttgcagtgacgac

SEQ ID NO: 775164 - DNA, 25 bp, Mus musculus
tagcgcacttacacctgttcaagga

SEQ ID NO: 775165 - DNA, 25 bp, Mus musculus
tagcgcacttactcctgttcaagga

SEQ ID NO: 775166 - DNA, 25 bp, Mus musculus
tagcgcagaagcatcttcacacgac

SEQ ID NO: 775167 - DNA, 25 bp, Mus musculus
tagcgcagaagcatgtgcctgccac

SEQ ID NO: 775168 - DNA, 25 bp, Mus musculus
tagcgcagaagcttcttcacacgac

SEQ ID NO: 775169 - DNA, 25 bp, Mus musculus
tagcgcagaagcttgtgcctgccac

SEQ ID NO: 775170 - DNA, 25 bp, Mus musculus
tagcgcagacccactgaagggccag

SEQ ID NO: 775171 - DNA, 25 bp, Mus musculus
tagcgcagaccctctgaagggccag

SEQ ID NO: 775172 - DNA, 25 bp, Mus musculus
tagcgcagacttctcgaggcaaggc

SEQ ID NO: 775173 - DNA, 25 bp, Mus musculus
tagcgcagacttgtcgaggcaaggc

SEQ ID NO: 775174 - DNA, 25 bp, Mus musculus
tagcgcatggcgaaataatacaata

SEQ ID NO: 775175 - DNA, 25 bp, Mus musculus
tagcgcatggcgtaataatacaata

SEQ ID NO: 775176 - DNA, 25 bp, Mus musculus
tagcgccaattcaatatagcttttg

SEQ ID NO: 775177 - DNA, 25 bp, Mus musculus
tagcgccaattctatatagcttttg

SEQ ID NO: 775178 - DNA, 25 bp, Mus musculus
tagcgccactggcaacagacatcgt

SEQ ID NO: 775179 - DNA, 25 bp, Mus musculus
tagcgccactgggaacagacatcgt

SEQ ID NO: 775180 - DNA, 25 bp, Mus musculus
tagcgccagattctcattgatatgt

SEQ ID NO: 775181 - DNA, 25 bp, Mus musculus
tagcgccagattgtcattgatatgt

SEQ ID NO: 775182 - DNA, 25 bp, Mus musculus
tagcgccctcggatacagtgttaac

SEQ ID NO: 775183 - DNA, 25 bp, Mus musculus
tagcgccctcggttacagtgttaac

SEQ ID NO: 775184 - DNA, 25 bp, Mus musculus
tagcgccgggctacgtataatctgc

SEQ ID NO: 775185 - DNA, 25 bp, Mus musculus
tagcgccgggcttcgtataatctgc

SEQ ID NO: 775186 - DNA, 25 bp, Mus musculus
tagcgcctctggaaatgcttctgtt

SEQ ID NO: 775187 - DNA, 25 bp, Mus musculus
tagcgcctctggtaatgcttctgtt

SEQ ID NO: 775188 - DNA, 25 bp, Mus musculus
tagcgccttatcagtctgcgaacag

SEQ ID NO: 775189 - DNA, 25 bp, Mus musculus
tagcgccttatctgtctgcgaacag

SEQ ID NO: 775190 - DNA, 25 bp, Mus musculus
tagcgcggacctattagtgttcact

SEQ ID NO: 775191 - DNA, 25 bp, Mus musculus
tagcgcggaccttttagtgttcact

SEQ ID NO: 775192 - DNA, 25 bp, Mus musculus
tagcgctaatctaggaaccgccgct

SEQ ID NO: 775193 - DNA, 25 bp, Mus musculus
tagcgctaatcttggaaccgccgct

SEQ ID NO: 775194 - DNA, 25 bp, Mus musculus
tagcgctcatgacgcgtgagttcca

SEQ ID NO: 775195 - DNA, 25 bp, Mus musculus
tagcgctcatgaggcgtgagttcca

SEQ ID NO: 775196 - DNA, 25 bp, Mus musculus
tagcgctccgtaatgcgtgtatttt

SEQ ID NO: 775197 - DNA, 25 bp, Mus musculus
tagcgctccgtattgcgtgtatttt

SEQ ID NO: 775198 - DNA, 25 bp, Mus musculus
tagcgctcctggcttttgtctatgg

SEQ ID NO: 775199 - DNA, 25 bp, Mus musculus
tagcgctcctgggttttgtctatgg

SEQ ID NO: 775200 - DNA, 25 bp, Mus musculus
tagcgctctctacctcagtgggtaa

SEQ ID NO: 775201 - DNA, 25 bp, Mus musculus
tagcgctctctagctcagtgggtaa

SEQ ID NO: 775202 - DNA, 25 bp, Mus musculus
tagcgctctgggagatgagaagcat

SEQ ID NO: 775203 - DNA, 25 bp, Mus musculus
tagcgctctgggtgatgagaagcat

SEQ ID NO: 775204 - DNA, 25 bp, Mus musculus
tagcgctctgttcctggtgcagctg

SEQ ID NO: 775205 - DNA, 25 bp, Mus musculus
tagcgctctgttgctggtgcagctg

SEQ ID NO: 775206 - DNA, 25 bp, Mus musculus
tagcgctggagcagcgagcagctta

SEQ ID NO: 775207 - DNA, 25 bp, Mus musculus
tagcgctggagctgcgagcagctta

SEQ ID NO: 775208 - DNA, 25 bp, Mus musculus
tagcgctggcgcctgaggaattgga

SEQ ID NO: 775209 - DNA, 25 bp, Mus musculus
tagcgctggcgcgtgaggaattgga

SEQ ID NO: 775210 - DNA, 25 bp, Mus musculus
tagcgctggtatctgaccatccaca

SEQ ID NO: 775211 - DNA, 25 bp, Mus musculus
tagcgctggtatgtgaccatccaca

SEQ ID NO: 775212 - DNA, 25 bp, Mus musculus
tagcgctgtgtaaaggcctgcttgg

SEQ ID NO: 775213 - DNA, 25 bp, Mus musculus
tagcgctgtgtataggcctgcttgg

SEQ ID NO: 775214 - DNA, 25 bp, Mus musculus
tagcgcttaatgctcaactgtgtct

SEQ ID NO: 775215 - DNA, 25 bp, Mus musculus
tagcgcttaatggtcaactgtgtct

SEQ ID NO: 775216 - DNA, 25 bp, Mus musculus
tagcggaagattatttctaggactc

SEQ ID NO: 775217 - DNA, 25 bp, Mus musculus
tagcggaagattttttctaggactc

SEQ ID NO: 775218 - DNA, 25 bp, Mus musculus
tagcggaagtagcttctgctgccat

SEQ ID NO: 775219 - DNA, 25 bp, Mus musculus
tagcggaagtaggttctgctgccat

SEQ ID NO: 775220 - DNA, 25 bp, Mus musculus
tagcggatagtgcaactggtctgaa

SEQ ID NO: 775221 - DNA, 25 bp, Mus musculus
tagcggatagtggaactggtctgaa

SEQ ID NO: 775222 - DNA, 25 bp, Mus musculus
tagcggatatgtcccctagaacaat

SEQ ID NO: 775223 - DNA, 25 bp, Mus musculus
tagcggatatgtgccctagaacaat

SEQ ID NO: 775224 - DNA, 25 bp, Mus musculus
tagcggcaccagcaatggcaccaat

SEQ ID NO: 775225 - DNA, 25 bp, Mus musculus
tagcggcaccaggaatggcaccaat

SEQ ID NO: 775226 - DNA, 25 bp, Mus musculus
tagcggcatatcaacctctgtccta

SEQ ID NO: 775227 - DNA, 25 bp, Mus musculus
tagcggcatatctacctctgtccta

SEQ ID NO: 775228 - DNA, 25 bp, Mus musculus
tagcggcatccacagctgtgcagat

SEQ ID NO: 775229 - DNA, 25 bp, Mus musculus
tagcggcatccagagctgtgcagat

SEQ ID NO: 775230 - DNA, 25 bp, Mus musculus
tagcggcccggcaggagacagactc

SEQ ID NO: 775231 - DNA, 25 bp, Mus musculus
tagcggcccggctggagacagactc

SEQ ID NO: 775232 - DNA, 25 bp, Mus musculus
tagcggcgcaccaggcggtccagca

SEQ ID NO: 775233 - DNA, 25 bp, Mus musculus
tagcggcgcacctggcggtccagca

SEQ ID NO: 775234 - DNA, 25 bp, Mus musculus
tagcggctcaccatcgaaggcggct

SEQ ID NO: 775235 - DNA, 25 bp, Mus musculus
tagcggctcaccttcgaaggcggct

SEQ ID NO: 775236 - DNA, 25 bp, Mus musculus
tagcggcttctacagtcttaacaca

SEQ ID NO: 775237 - DNA, 25 bp, Mus musculus
tagcggcttctagagtcttaacaca

SEQ ID NO: 775238 - DNA, 25 bp, Mus musculus
tagcgggcaaggaaccggccaacat

SEQ ID NO: 775239 - DNA, 25 bp, Mus musculus
tagcgggcaaggtaccggccaacat

SEQ ID NO: 775240 - DNA, 25 bp, Mus musculus
tagcgggcatgacactcctcctgaa

SEQ ID NO: 775241 - DNA, 25 bp, Mus musculus
tagcgggcatgagactcctcctgaa

SEQ ID NO: 775242 - DNA, 25 bp, Mus musculus
tagcgggcatgcagcattggccact

SEQ ID NO: 775243 - DNA, 25 bp, Mus musculus
tagcgggcatgctgcattggccact

SEQ ID NO: 775244 - DNA, 25 bp, Mus musculus
tagcgggcgcctcaggtctggaagc

SEQ ID NO: 775245 - DNA, 25 bp, Mus musculus
tagcgggcgcctgaggtctggaagc

SEQ ID NO: 775246 - DNA, 25 bp, Mus musculus
tagcgggtcgcgatctcatccacct

SEQ ID NO: 775247 - DNA, 25 bp, Mus musculus
tagcgggtcgcgttctcatccacct

SEQ ID NO: 775248 - DNA, 25 bp, Mus musculus
tagcgggttcacctttgtataagtg

SEQ ID NO: 775249 - DNA, 25 bp, Mus musculus
tagcgggttcacgtttgtataagtg

SEQ ID NO: 775250 - DNA, 25 bp, Mus musculus
tagcggtagataacattctctcctt

SEQ ID NO: 775251 - DNA, 25 bp, Mus musculus
tagcggtagatatcattctctcctt

SEQ ID NO: 775252 - DNA, 25 bp, Mus musculus
tagcggtatatgctgtgtcccgacc

SEQ ID NO: 775253 - DNA, 25 bp, Mus musculus
tagcggtatatggtgtgtcccgacc

SEQ ID NO: 775254 - DNA, 25 bp, Mus musculus
tagcggtcacttctctctgatcttt

SEQ ID NO: 775255 - DNA, 25 bp, Mus musculus
tagcggtcacttgtctctgatcttt

SEQ ID NO: 775256 - DNA, 25 bp, Mus musculus
tagcggtccctcctaggaatgcagt

SEQ ID NO: 775257 - DNA, 25 bp, Mus musculus
tagcggtccctcgtaggaatgcagt

SEQ ID NO: 775258 - DNA, 25 bp, Mus musculus
tagcggtctagtacatctagtgcat

SEQ ID NO: 775259 - DNA, 25 bp, Mus musculus
tagcggtctagttcatctagtgcat

SEQ ID NO: 775260 - DNA, 25 bp, Mus musculus
tagcggtgaccgcagcaggacacaa

SEQ ID NO: 775261 - DNA, 25 bp, Mus musculus
tagcggtgaccggagcaggacacaa

SEQ ID NO: 775262 - DNA, 25 bp, Mus musculus
tagcggtgccttaacaggagccatc

SEQ ID NO: 775263 - DNA, 25 bp, Mus musculus
tagcggtgcctttacaggagccatc

SEQ ID NO: 775264 - DNA, 25 bp, Mus musculus
tagcggtttaataacagacactggc

SEQ ID NO: 775265 - DNA, 25 bp, Mus musculus
tagcggtttaattacagacactggc

SEQ ID NO: 775266 - DNA, 25 bp, Mus musculus
tagcgtaagtgcaatgcctgccacc

SEQ ID NO: 775267 - DNA, 25 bp, Mus musculus
tagcgtaagtgctatgcctgccacc

SEQ ID NO: 775268 - DNA, 25 bp, Mus musculus
tagcgtacagggaaaccgtcttcac

SEQ ID NO: 775269 - DNA, 25 bp, Mus musculus
tagcgtacagggtaaccgtcttcac

SEQ ID NO: 775270 - DNA, 25 bp, Mus musculus
tagcgtacatttaaaagggccctgg

SEQ ID NO: 775271 - DNA, 25 bp, Mus musculus
tagcgtacattttaaagggccctgg

SEQ ID NO: 775272 - DNA, 25 bp, Mus musculus
tagcgtaggaccacgatcctggtaa

SEQ ID NO: 775273 - DNA, 25 bp, Mus musculus
tagcgtaggacctcgatcctggtaa

SEQ ID NO: 775274 - DNA, 25 bp, Mus musculus
tagcgtcctaaaccaagtgatccat

SEQ ID NO: 775275 - DNA, 25 bp, Mus musculus
tagcgtcctaaagcaagtgatccat

SEQ ID NO: 775276 - DNA, 25 bp, Mus musculus
tagcgtgaacagacctgtgagcaat

SEQ ID NO: 775277 - DNA, 25 bp, Mus musculus
tagcgtgaacagtcctgtgagcaat

SEQ ID NO: 775278 - DNA, 25 bp, Mus musculus
tagcgtgaccacatccatcttaaaa

SEQ ID NO: 775279 - DNA, 25 bp, Mus musculus
tagcgtgaccacttccatcttaaaa

SEQ ID NO: 775280 - DNA, 25 bp, Mus musculus
tagcgtgagcatcgctgcttctgat

SEQ ID NO: 775281 - DNA, 25 bp, Mus musculus
tagcgtgagcatggctgcttctgat

SEQ ID NO: 775282 - DNA, 25 bp, Mus musculus
tagcgtgcacatcaaccctctggga

SEQ ID NO: 775283 - DNA, 25 bp, Mus musculus
tagcgtgcacatgaaccctctggga

SEQ ID NO: 775284 - DNA, 25 bp, Mus musculus
tagcgtgccgttagcagttggtttc

SEQ ID NO: 775285 - DNA, 25 bp, Mus musculus
tagcgtgccgtttgcagttggtttc

SEQ ID NO: 775286 - DNA, 25 bp, Mus musculus
tagcgtgcgccaagcagaaggctct

SEQ ID NO: 775287 - DNA, 25 bp, Mus musculus
tagcgtgcgccatgcagaaggctct

SEQ ID NO: 775288 - DNA, 25 bp, Mus musculus
tagcgtggagccagcaccttgggtc

SEQ ID NO: 775289 - DNA, 25 bp, Mus musculus
tagcgtggagcctgcaccttgggtc

SEQ ID NO: 775290 - DNA, 25 bp, Mus musculus
tagcgtgggtgtaagcaaactccat

SEQ ID NO: 775291 - DNA, 25 bp, Mus musculus
tagcgtgggtgttagcaaactccat

SEQ ID NO: 775292 - DNA, 25 bp, Mus musculus
tagcgtgtcctgaggtctcctaagc

SEQ ID NO: 775293 - DNA, 25 bp, Mus musculus
tagcgtgtcctgtggtctcctaagc

SEQ ID NO: 775294 - DNA, 25 bp, Mus musculus
tagcgtgtctaacgccaggttggta

SEQ ID NO: 775295 - DNA, 25 bp, Mus musculus
tagcgtgtctaaggccaggttggta

SEQ ID NO: 775296 - DNA, 25 bp, Mus musculus
tagcgtgtgtaaatcgtgtttgcaa

SEQ ID NO: 775297 - DNA, 25 bp, Mus musculus
tagcgtgtgtaattcgtgtttgcaa

SEQ ID NO: 775298 - DNA, 25 bp, Mus musculus
tagcgtgtgtggaaagacttctgtt

SEQ ID NO: 775299 - DNA, 25 bp, Mus musculus
tagcgtgtgtggtaagacttctgtt

SEQ ID NO: 775300 - DNA, 25 bp, Mus musculus
tagcgttaataacttggccggaagc

SEQ ID NO: 775301 - DNA, 25 bp, Mus musculus
tagcgttaataagttggccggaagc

SEQ ID NO: 775302 - DNA, 25 bp, Mus musculus
tagcgttacctcagtgatcttacac

SEQ ID NO: 775303 - DNA, 25 bp, Mus musculus
tagcgttacctctgtgatcttacac

SEQ ID NO: 775304 - DNA, 25 bp, Mus musculus
tagcgttcagttaggccagatgtta

SEQ ID NO: 775305 - DNA, 25 bp, Mus musculus
tagcgttcagtttggccagatgtta

SEQ ID NO: 775306 - DNA, 25 bp, Mus musculus
tagcgttcccacaggagctgtgtgc

SEQ ID NO: 775307 - DNA, 25 bp, Mus musculus
tagcgttcccactggagctgtgtgc

SEQ ID NO: 775308 - DNA, 25 bp, Mus musculus
tagcgttctcctattactacgtaga

SEQ ID NO: 775309 - DNA, 25 bp, Mus musculus
tagcgttctccttttactacgtaga

SEQ ID NO: 775310 - DNA, 25 bp, Mus musculus
tagcgttcttagatgacattttgac

SEQ ID NO: 775311 - DNA, 25 bp, Mus musculus
tagcgttcttagttgacattttgac

SEQ ID NO: 775312 - DNA, 25 bp, Mus musculus
tagcgttgtcccagcatagtgaaga

SEQ ID NO: 775313 - DNA, 25 bp, Mus musculus
tagcgttgtccctgcatagtgaaga

SEQ ID NO: 775314 - DNA, 25 bp, Mus musculus
tagctaaaagtaccctcatccacca

SEQ ID NO: 775315 - DNA, 25 bp, Mus musculus
tagctaaaagtagcctcatccacca

SEQ ID NO: 775316 - DNA, 25 bp, Mus musculus
tagctaaatggtaggacctctcctt

SEQ ID NO: 775317 - DNA, 25 bp, Mus musculus
tagctaaatggttggacctctcctt

SEQ ID NO: 775318 - DNA, 25 bp, Mus musculus
tagctaacacatcccatctcataca

SEQ ID NO: 775319 - DNA, 25 bp, Mus musculus
tagctaacacatgccatctcataca

SEQ ID NO: 775320 - DNA, 25 bp, Mus musculus
tagctaaccctacgcaggactgctt

SEQ ID NO: 775321 - DNA, 25 bp, Mus musculus
tagctaaccctaggcaggactgctt

SEQ ID NO: 775322 - DNA, 25 bp, Mus musculus
tagctaacctaaatgtggacactgc

SEQ ID NO: 775323 - DNA, 25 bp, Mus musculus
tagctaacctaattgtggacactgc

SEQ ID NO: 775324 - DNA, 25 bp, Mus musculus
tagctaactttaattcccaccgtgg

SEQ ID NO: 775325 - DNA, 25 bp, Mus musculus
tagctaactttatttcccaccgtgg

SEQ ID NO: 775326 - DNA, 25 bp, Mus musculus
tagctaagacttacctgacttccgt

SEQ ID NO: 775327 - DNA, 25 bp, Mus musculus
tagctaagactttcctgacttccgt

SEQ ID NO: 775328 - DNA, 25 bp, Mus musculus
tagctaagaggtcgtatttaaatcc

SEQ ID NO: 775329 - DNA, 25 bp, Mus musculus
tagctaagaggtggtatttaaatcc

SEQ ID NO: 775330 - DNA, 25 bp, Mus musculus
tagctaagccctatcctacagcttt

SEQ ID NO: 775331 - DNA, 25 bp, Mus musculus
tagctaagccctttcctacagcttt

SEQ ID NO: 775332 - DNA, 25 bp, Mus musculus
tagctaagggctagctcacccttct

SEQ ID NO: 775333 - DNA, 25 bp, Mus musculus
tagctaagggcttgctcacccttct

SEQ ID NO: 775334 - DNA, 25 bp, Mus musculus
tagctaatgagcagggcagtctctt

SEQ ID NO: 775335 - DNA, 25 bp, Mus musculus
tagctaatgagctgggcagtctctt

SEQ ID NO: 775336 - DNA, 25 bp, Mus musculus
tagctaatggaaccccatctgtcct

SEQ ID NO: 775337 - DNA, 25 bp, Mus musculus
tagctaatggaagcccatctgtcct

SEQ ID NO: 775338 - DNA, 25 bp, Mus musculus
tagctaattaacacttgtgttcccc

SEQ ID NO: 775339 - DNA, 25 bp, Mus musculus
tagctaattaactcttgtgttcccc

SEQ ID NO: 775340 - DNA, 25 bp, Mus musculus
tagctaattgcactgaaccacactt

SEQ ID NO: 775341 - DNA, 25 bp, Mus musculus
tagctaattgcagtgaaccacactt

SEQ ID NO: 775342 - DNA, 25 bp, Mus musculus
tagctacacaccacctgttagaagt

SEQ ID NO: 775343 - DNA, 25 bp, Mus musculus
tagctacacacctcctgttagaagt

SEQ ID NO: 775344 - DNA, 25 bp, Mus musculus
tagctacagggtcccaagtgttgcc

SEQ ID NO: 775345 - DNA, 25 bp, Mus musculus
tagctacagggtgccaagtgttgcc

SEQ ID NO: 775346 - DNA, 25 bp, Mus musculus
tagctaccacataggtttttctata

SEQ ID NO: 775347 - DNA, 25 bp, Mus musculus
tagctaccacattggtttttctata

SEQ ID NO: 775348 - DNA, 25 bp, Mus musculus
tagctaccctatagtgccttgtgca

SEQ ID NO: 775349 - DNA, 25 bp, Mus musculus
tagctaccctattgtgccttgtgca

SEQ ID NO: 775350 - DNA, 25 bp, Mus musculus
tagctaccctgaagatcccagcttt

SEQ ID NO: 775351 - DNA, 25 bp, Mus musculus
tagctaccctgatgatcccagcttt

SEQ ID NO: 775352 - DNA, 25 bp, Mus musculus
tagctaccgacgacactggtaatgt

SEQ ID NO: 775353 - DNA, 25 bp, Mus musculus
tagctaccgacgtcactggtaatgt

SEQ ID NO: 775354 - DNA, 25 bp, Mus musculus
tagctacctgtcaagatctgcatct

SEQ ID NO: 775355 - DNA, 25 bp, Mus musculus
tagctacctgtctagatctgcatct

SEQ ID NO: 775356 - DNA, 25 bp, Mus musculus
tagctacggtgcactcccaacatgg

SEQ ID NO: 775357 - DNA, 25 bp, Mus musculus
tagctacggtgctctcccaacatgg

SEQ ID NO: 775358 - DNA, 25 bp, Mus musculus
tagctactaacaatatcctttcctt

SEQ ID NO: 775359 - DNA, 25 bp, Mus musculus
tagctactaacattatcctttcctt

SEQ ID NO: 775360 - DNA, 25 bp, Mus musculus
tagctactactaccctgaactcacg

SEQ ID NO: 775361 - DNA, 25 bp, Mus musculus
tagctactactagcctgaactcacg

SEQ ID NO: 775362 - DNA, 25 bp, Mus musculus
tagctactagcccagtcctgaaaaa

SEQ ID NO: 775363 - DNA, 25 bp, Mus musculus
tagctactagccgagtcctgaaaaa

SEQ ID NO: 775364 - DNA, 25 bp, Mus musculus
tagctactcataccagatcactgtc

SEQ ID NO: 775365 - DNA, 25 bp, Mus musculus
tagctactcatagcagatcactgtc

SEQ ID NO: 775366 - DNA, 25 bp, Mus musculus
tagctactgatcaaagtgccctttc

SEQ ID NO: 775367 - DNA, 25 bp, Mus musculus
tagctactgatctaagtgccctttc

SEQ ID NO: 775368 - DNA, 25 bp, Mus musculus
tagctactgcggcttcactctggtg

SEQ ID NO: 775369 - DNA, 25 bp, Mus musculus
tagctactgcgggttcactctggtg

SEQ ID NO: 775370 - DNA, 25 bp, Mus musculus
tagctactgctaaaccatctcaact

SEQ ID NO: 775371 - DNA, 25 bp, Mus musculus
tagctactgctataccatctcaact

SEQ ID NO: 775372 - DNA, 25 bp, Mus musculus
tagctactgcttcgacaagaggctc

SEQ ID NO: 775373 - DNA, 25 bp, Mus musculus
tagctactgcttggacaagaggctc

SEQ ID NO: 775374 - DNA, 25 bp, Mus musculus
tagctactttcacttttgtcctcac

SEQ ID NO: 775375 - DNA, 25 bp, Mus musculus
tagctactttcagttttgtcctcac

SEQ ID NO: 775376 - DNA, 25 bp, Mus musculus
tagctagaatttatcagtatcctga

SEQ ID NO: 775377 - DNA, 25 bp, Mus musculus
tagctagaatttttcagtatcctga

SEQ ID NO: 775378 - DNA, 25 bp, Mus musculus
tagctagacatgctccccaaaacga

SEQ ID NO: 775379 - DNA, 25 bp, Mus musculus
tagctagacatggtccccaaaacga

SEQ ID NO: 775380 - DNA, 25 bp, Mus musculus
tagctagactgtaatgttaattaag

SEQ ID NO: 775381 - DNA, 25 bp, Mus musculus
tagctagactgttatgttaattaag

SEQ ID NO: 775382 - DNA, 25 bp, Mus musculus
tagctagatcctatcccactgaaac

SEQ ID NO: 775383 - DNA, 25 bp, Mus musculus
tagctagatcctttcccactgaaac

SEQ ID NO: 775384 - DNA, 25 bp, Mus musculus
tagctagcatttccctacactgaac

SEQ ID NO: 775385 - DNA, 25 bp, Mus musculus
tagctagcatttgcctacactgaac

SEQ ID NO: 775386 - DNA, 25 bp, Mus musculus
tagctagccactaccagcttggtga

SEQ ID NO: 775387 - DNA, 25 bp, Mus musculus
tagctagccacttccagcttggtga

SEQ ID NO: 775388 - DNA, 25 bp, Mus musculus
tagctagccagaatgatcctcagaa

SEQ ID NO: 775389 - DNA, 25 bp, Mus musculus
tagctagccagattgatcctcagaa

SEQ ID NO: 775390 - DNA, 25 bp, Mus musculus
tagctagcctagacctggcaagcat

SEQ ID NO: 775391 - DNA, 25 bp, Mus musculus
tagctagcctagtcctggcaagcat

SEQ ID NO: 775392 - DNA, 25 bp, Mus musculus
tagctagcgctgactgttggagtgc

SEQ ID NO: 775393 - DNA, 25 bp, Mus musculus
tagctagcgctgtctgttggagtgc

SEQ ID NO: 775394 - DNA, 25 bp, Mus musculus
tagctagctcaccagtccatttttt

SEQ ID NO: 775395 - DNA, 25 bp, Mus musculus
tagctagctcacgagtccatttttt

SEQ ID NO: 775396 - DNA, 25 bp, Mus musculus
tagctagctcatcgccagttcttta

SEQ ID NO: 775397 - DNA, 25 bp, Mus musculus
tagctagctcatggccagttcttta

SEQ ID NO: 775398 - DNA, 25 bp, Mus musculus
tagctaggactcaatgtgtggtgta

SEQ ID NO: 775399 - DNA, 25 bp, Mus musculus
tagctaggactctatgtgtggtgta

SEQ ID NO: 775400 - DNA, 25 bp, Mus musculus
tagctaggagaccatggaccatttt

SEQ ID NO: 775401 - DNA, 25 bp, Mus musculus
tagctaggagacgatggaccatttt

SEQ ID NO: 775402 - DNA, 25 bp, Mus musculus
tagctaggcagcatttcgaccaagt

SEQ ID NO: 775403 - DNA, 25 bp, Mus musculus
tagctaggcagcttttcgaccaagt

SEQ ID NO: 775404 - DNA, 25 bp, Mus musculus
tagctaggttgtcgatccagttcct

SEQ ID NO: 775405 - DNA, 25 bp, Mus musculus
tagctaggttgtggatccagttcct

SEQ ID NO: 775406 - DNA, 25 bp, Mus musculus
tagctagtagagacgctcgctacac

SEQ ID NO: 775407 - DNA, 25 bp, Mus musculus
tagctagtagagtcgctcgctacac

SEQ ID NO: 775408 - DNA, 25 bp, Mus musculus
tagctagtaggcaagtccacatgcc

SEQ ID NO: 775409 - DNA, 25 bp, Mus musculus
tagctagtaggctagtccacatgcc

SEQ ID NO: 775410 - DNA, 25 bp, Mus musculus
tagctagttgctcatcctggatttg

SEQ ID NO: 775411 - DNA, 25 bp, Mus musculus
tagctagttgctgatcctggatttg

SEQ ID NO: 775412 - DNA, 25 bp, Mus musculus
tagctagtttatctctttggtttaa

SEQ ID NO: 775413 - DNA, 25 bp, Mus musculus
tagctagtttatgtctttggtttaa

SEQ ID NO: 775414 - DNA, 25 bp, Mus musculus
tagctagtttccatcgtgtctccat

SEQ ID NO: 775415 - DNA, 25 bp, Mus musculus
tagctagtttccttcgtgtctccat

SEQ ID NO: 775416 - DNA, 25 bp, Mus musculus
tagctataacccctctagctccttt

SEQ ID NO: 775417 - DNA, 25 bp, Mus musculus
tagctataacccgtctagctccttt

SEQ ID NO: 775418 - DNA, 25 bp, Mus musculus
tagctatagcgtcccatgattcttt

SEQ ID NO: 775419 - DNA, 25 bp, Mus musculus
tagctatagcgtgccatgattcttt

SEQ ID NO: 775420 - DNA, 25 bp, Mus musculus
tagctatcacatccagtgccgggaa

SEQ ID NO: 775421 - DNA, 25 bp, Mus musculus
tagctatcacatgcagtgccgggaa

SEQ ID NO: 775422 - DNA, 25 bp, Mus musculus
tagctatcaggacaggacgccttcc

SEQ ID NO: 775423 - DNA, 25 bp, Mus musculus
tagctatcaggagaggacgccttcc

SEQ ID NO: 775424 - DNA, 25 bp, Mus musculus
tagctatcattaagtccttgcctgc

SEQ ID NO: 775425 - DNA, 25 bp, Mus musculus
tagctatcattatgtccttgcctgc

SEQ ID NO: 775426 - DNA, 25 bp, Mus musculus
tagctatcctaaaacactgtcttgt

SEQ ID NO: 775427 - DNA, 25 bp, Mus musculus
tagctatcctaatacactgtcttgt

SEQ ID NO: 775428 - DNA, 25 bp, Mus musculus
tagctatctatacggcatcttcctc

SEQ ID NO: 775429 - DNA, 25 bp, Mus musculus
tagctatctatagggcatcttcctc

SEQ ID NO: 775430 - DNA, 25 bp, Mus musculus
tagctatctcgtaaggctgctggct

SEQ ID NO: 775431 - DNA, 25 bp, Mus musculus
tagctatctcgttaggctgctggct

SEQ ID NO: 775432 - DNA, 25 bp, Mus musculus
tagctatgactcaaccagggatgtg

SEQ ID NO: 775433 - DNA, 25 bp, Mus musculus
tagctatgactctaccagggatgtg

SEQ ID NO: 775434 - DNA, 25 bp, Mus musculus
tagctatgcacacttgtagtcccag

SEQ ID NO: 775435 - DNA, 25 bp, Mus musculus
tagctatgcacagttgtagtcccag

SEQ ID NO: 775436 - DNA, 25 bp, Mus musculus
tagctatggatcatacctgggtcac

SEQ ID NO: 775437 - DNA, 25 bp, Mus musculus
tagctatggatcttacctgggtcac

SEQ ID NO: 775438 - DNA, 25 bp, Mus musculus
tagctatggccccattgtcaatggc

SEQ ID NO: 775439 - DNA, 25 bp, Mus musculus
tagctatggcccgattgtcaatggc

SEQ ID NO: 775440 - DNA, 25 bp, Mus musculus
tagctatggctaaggtgaccactac

SEQ ID NO: 775441 - DNA, 25 bp, Mus musculus
tagctatggctatggtgaccactac

SEQ ID NO: 775442 - DNA, 25 bp, Mus musculus
tagctatggctgactgtaggtttat

SEQ ID NO: 775443 - DNA, 25 bp, Mus musculus
tagctatggctgcatttcccaagaa

SEQ ID NO: 775444 - DNA, 25 bp, Mus musculus
tagctatggctggatttcccaagaa

SEQ ID NO: 775445 - DNA, 25 bp, Mus musculus
tagctatggctgtctgtaggtttat

SEQ ID NO: 775446 - DNA, 25 bp, Mus musculus
tagctatgggccaattgtttgcatg

SEQ ID NO: 775447 - DNA, 25 bp, Mus musculus
tagctatgggcctattgtttgcatg

SEQ ID NO: 775448 - DNA, 25 bp, Mus musculus
tagctatgggcgctaatcccaactc

SEQ ID NO: 775449 - DNA, 25 bp, Mus musculus
tagctatgggcggtaatcccaactc

SEQ ID NO: 775450 - DNA, 25 bp, Mus musculus
tagctatgtcttaggcactcttgtc

SEQ ID NO: 775451 - DNA, 25 bp, Mus musculus
tagctatgtctttggcactcttgtc

SEQ ID NO: 775452 - DNA, 25 bp, Mus musculus
tagctatgtgtccaacaagccctgt

SEQ ID NO: 775453 - DNA, 25 bp, Mus musculus
tagctatgtgtcgaacaagccctgt

SEQ ID NO: 775454 - DNA, 25 bp, Mus musculus
tagctattacccaatttccctgtta

SEQ ID NO: 775455 - DNA, 25 bp, Mus musculus
tagctattaccctatttccctgtta

SEQ ID NO: 775456 - DNA, 25 bp, Mus musculus
tagctattcagtatcccagcattag

SEQ ID NO: 775457 - DNA, 25 bp, Mus musculus
tagctattcagtttcccagcattag

SEQ ID NO: 775458 - DNA, 25 bp, Mus musculus
tagctatttaaaatatcccttcctt

SEQ ID NO: 775459 - DNA, 25 bp, Mus musculus
tagctatttaaattatcccttcctt

SEQ ID NO: 775460 - DNA, 25 bp, Mus musculus
tagctattttaacccttctttcctg

SEQ ID NO: 775461 - DNA, 25 bp, Mus musculus
tagctattttaagccttctttcctg

SEQ ID NO: 775462 - DNA, 25 bp, Mus musculus
tagctcacaagtctttgctgttact

SEQ ID NO: 775463 - DNA, 25 bp, Mus musculus
tagctcacaagtgtttgctgttact

SEQ ID NO: 775464 - DNA, 25 bp, Mus musculus
tagctcacacatatctggactcaca

SEQ ID NO: 775465 - DNA, 25 bp, Mus musculus
tagctcacacatttctggactcaca

SEQ ID NO: 775466 - DNA, 25 bp, Mus musculus
tagctcacaccaagctgagaggaga

SEQ ID NO: 775467 - DNA, 25 bp, Mus musculus
tagctcacaccatgctgagaggaga

SEQ ID NO: 775468 - DNA, 25 bp, Mus musculus
tagctcacactacgtaaatgcccct

SEQ ID NO: 775469 - DNA, 25 bp, Mus musculus
tagctcacactaggtaaatgcccct

SEQ ID NO: 775470 - DNA, 25 bp, Mus musculus
tagctcacagtccatcggaggatcc

SEQ ID NO: 775471 - DNA, 25 bp, Mus musculus
tagctcacagtcgatcggaggatcc

SEQ ID NO: 775472 - DNA, 25 bp, Mus musculus
tagctcacagtgattccagatgaaa

SEQ ID NO: 775473 - DNA, 25 bp, Mus musculus
tagctcacagtgtttccagatgaaa

SEQ ID NO: 775474 - DNA, 25 bp, Mus musculus
tagctcacatttcggttggtcttgg

SEQ ID NO: 775475 - DNA, 25 bp, Mus musculus
tagctcacatttgggttggtcttgg

SEQ ID NO: 775476 - DNA, 25 bp, Mus musculus
tagctcaccacacttgttataaggg

SEQ ID NO: 775477 - DNA, 25 bp, Mus musculus
tagctcaccacagttgttataaggg

SEQ ID NO: 775478 - DNA, 25 bp, Mus musculus
tagctcaccgctcctgggtgcaaag

SEQ ID NO: 775479 - DNA, 25 bp, Mus musculus
tagctcaccgctgctgggtgcaaag

SEQ ID NO: 775480 - DNA, 25 bp, Mus musculus
tagctcacctgaagagggctcttga

SEQ ID NO: 775481 - DNA, 25 bp, Mus musculus
tagctcacctgatgagggctcttga

SEQ ID NO: 775482 - DNA, 25 bp, Mus musculus
tagctcacgactcaacccgggacag

SEQ ID NO: 775483 - DNA, 25 bp, Mus musculus
tagctcacgactgaacccgggacag

SEQ ID NO: 775484 - DNA, 25 bp, Mus musculus
tagctcacggcaagcacacaagcgg

SEQ ID NO: 775485 - DNA, 25 bp, Mus musculus
tagctcacggcatgcacacaagcgg

SEQ ID NO: 775486 - DNA, 25 bp, Mus musculus
tagctcactagcacctgacgaaagg

SEQ ID NO: 775487 - DNA, 25 bp, Mus musculus
tagctcactagctcctgacgaaagg

SEQ ID NO: 775488 - DNA, 25 bp, Mus musculus
tagctcactgtaaatgcccatgtca

SEQ ID NO: 775489 - DNA, 25 bp, Mus musculus
tagctcactgtatatgcccatgtca

SEQ ID NO: 775490 - DNA, 25 bp, Mus musculus
tagctcacttttctaaccgcagttc

SEQ ID NO: 775491 - DNA, 25 bp, Mus musculus
tagctcacttttgtaaccgcagttc

SEQ ID NO: 775492 - DNA, 25 bp, Mus musculus
tagctcagaactccaggtctacctg

SEQ ID NO: 775493 - DNA, 25 bp, Mus musculus
tagctcagaactgcaggtctacctg

SEQ ID NO: 775494 - DNA, 25 bp, Mus musculus
tagctcagaatcacttcgcggctac

SEQ ID NO: 775495 - DNA, 25 bp, Mus musculus
tagctcagaatctcttcgcggctac

SEQ ID NO: 775496 - DNA, 25 bp, Mus musculus
tagctcagacttagcatttatactt

SEQ ID NO: 775497 - DNA, 25 bp, Mus musculus
tagctcagactttgcatttatactt

SEQ ID NO: 775498 - DNA, 25 bp, Mus musculus
tagctcagagatagaacactagcct

SEQ ID NO: 775499 - DNA, 25 bp, Mus musculus
tagctcagagattgaacactagcct

SEQ ID NO: 775500 - DNA, 25 bp, Mus musculus
tagctcagagctcccgagcctggaa

SEQ ID NO: 775501 - DNA, 25 bp, Mus musculus
tagctcagagctgccgagcctggaa

SEQ ID NO: 775502 - DNA, 25 bp, Mus musculus
tagctcagatgcctgcttgataaag

SEQ ID NO: 775503 - DNA, 25 bp, Mus musculus
tagctcagatgcgtgcttgataaag

SEQ ID NO: 775504 - DNA, 25 bp, Mus musculus
tagctcagcctcagtaagttaccct

SEQ ID NO: 775505 - DNA, 25 bp, Mus musculus
tagctcagcctctgtaagttaccct

SEQ ID NO: 775506 - DNA, 25 bp, Mus musculus
tagctcagcggtctactattgcaac

SEQ ID NO: 775507 - DNA, 25 bp, Mus musculus
tagctcagcggtgtactattgcaac

SEQ ID NO: 775508 - DNA, 25 bp, Mus musculus
tagctcaggccgaatgtgactgcat

SEQ ID NO: 775509 - DNA, 25 bp, Mus musculus
tagctcaggccgtatgtgactgcat

SEQ ID NO: 775510 - DNA, 25 bp, Mus musculus
tagctcagggccaagtgacaggttt

SEQ ID NO: 775511 - DNA, 25 bp, Mus musculus
tagctcagggcctagtgacaggttt

SEQ ID NO: 775512 - DNA, 25 bp, Mus musculus
tagctcagtccacggttcagacagc

SEQ ID NO: 775513 - DNA, 25 bp, Mus musculus
tagctcagtccagggttcagacagc

SEQ ID NO: 775514 - DNA, 25 bp, Mus musculus
tagctcagtggtagagcgcttgcct

SEQ ID NO: 775515 - DNA, 25 bp, Mus musculus
tagctcagtggttgagcgcttgcct

SEQ ID NO: 775516 - DNA, 25 bp, Mus musculus
tagctcagttctctggacatgaaac

SEQ ID NO: 775517 - DNA, 25 bp, Mus musculus
tagctcagttctgtggacatgaaac

SEQ ID NO: 775518 - DNA, 25 bp, Mus musculus
tagctcataggtccttcataagcct

SEQ ID NO: 775519 - DNA, 25 bp, Mus musculus
tagctcataggtgcttcataagcct

SEQ ID NO: 775520 - DNA, 25 bp, Mus musculus
tagctcatcactctggttaaagccc

SEQ ID NO: 775521 - DNA, 25 bp, Mus musculus
tagctcatcactgtggttaaagccc

SEQ ID NO: 775522 - DNA, 25 bp, Mus musculus
tagctcatgctaactgttccttttc

SEQ ID NO: 775523 - DNA, 25 bp, Mus musculus
tagctcatgctatctgttccttttc

SEQ ID NO: 775524 - DNA, 25 bp, Mus musculus
tagctcatggccctcaatacagagt

SEQ ID NO: 775525 - DNA, 25 bp, Mus musculus
tagctcatggccgtcaatacagagt

SEQ ID NO: 775526 - DNA, 25 bp, Mus musculus
tagctccaagctagaatactctatg

SEQ ID NO: 775527 - DNA, 25 bp, Mus musculus
tagctccaagcttgaatactctatg

SEQ ID NO: 775528 - DNA, 25 bp, Mus musculus
tagctccactctccggtggttaaaa

SEQ ID NO: 775529 - DNA, 25 bp, Mus musculus
tagctccactctgcggtggttaaaa

SEQ ID NO: 775530 - DNA, 25 bp, Mus musculus
tagctccagagaactgagtctcctg

SEQ ID NO: 775531 - DNA, 25 bp, Mus musculus
tagctccagagatctgagtctcctg

SEQ ID NO: 775532 - DNA, 25 bp, Mus musculus
tagctccagctcctccggagatgac

SEQ ID NO: 775533 - DNA, 25 bp, Mus musculus
tagctccagctcgtccggagatgac

SEQ ID NO: 775534 - DNA, 25 bp, Mus musculus
tagctccaggaaacacacgtgctgt

SEQ ID NO: 775535 - DNA, 25 bp, Mus musculus
tagctccaggaatcacacgtgctgt

SEQ ID NO: 775536 - DNA, 25 bp, Mus musculus
tagctccaggagctgtcttagtcag

SEQ ID NO: 775537 - DNA, 25 bp, Mus musculus
tagctccaggaggtgtcttagtcag

SEQ ID NO: 775538 - DNA, 25 bp, Mus musculus
tagctccagggcatagcagcggtaa

SEQ ID NO: 775539 - DNA, 25 bp, Mus musculus
tagctccagggcttagcagcggtaa

SEQ ID NO: 775540 - DNA, 25 bp, Mus musculus
tagctccaggtaaggaaaaacccag

SEQ ID NO: 775541 - DNA, 25 bp, Mus musculus
tagctccaggtatggaaaaacccag

SEQ ID NO: 775542 - DNA, 25 bp, Mus musculus
tagctccaggttacggaaccccata

SEQ ID NO: 775543 - DNA, 25 bp, Mus musculus
tagctccaggtttcggaaccccata

SEQ ID NO: 775544 - DNA, 25 bp, Mus musculus
tagctccatagtaatactggcacaa

SEQ ID NO: 775545 - DNA, 25 bp, Mus musculus
tagctccatagttatactggcacaa

SEQ ID NO: 775546 - DNA, 25 bp, Mus musculus
tagctccatgctacaacataccaag

SEQ ID NO: 775547 - DNA, 25 bp, Mus musculus
tagctccatgcttcaacataccaag

SEQ ID NO: 775548 - DNA, 25 bp, Mus musculus
tagctccatggcaacaatcttacca

SEQ ID NO: 775549 - DNA, 25 bp, Mus musculus
tagctccatggctacaatcttacca

SEQ ID NO: 775550 - DNA, 25 bp, Mus musculus
tagctccatgtactccatcatccat

SEQ ID NO: 775551 - DNA, 25 bp, Mus musculus
tagctccatgtagtccatcatccat

SEQ ID NO: 775552 - DNA, 25 bp, Mus musculus
tagctccattcaaaacacttttgaa

SEQ ID NO: 775553 - DNA, 25 bp, Mus musculus
tagctccattcataacacttttgaa

SEQ ID NO: 775554 - DNA, 25 bp, Mus musculus
tagctcccaaatcatactgtcctgc

SEQ ID NO: 775555 - DNA, 25 bp, Mus musculus
tagctcccaaatgatactgtcctgc

SEQ ID NO: 775556 - DNA, 25 bp, Mus musculus
tagctcccaactaaccgagaacagt

SEQ ID NO: 775557 - DNA, 25 bp, Mus musculus
tagctcccaacttaccgagaacagt

SEQ ID NO: 775558 - DNA, 25 bp, Mus musculus
tagctcccagctcgaaacaacggaa

SEQ ID NO: 775559 - DNA, 25 bp, Mus musculus
tagctcccagctggaaacaacggaa

SEQ ID NO: 775560 - DNA, 25 bp, Mus musculus
tagctcccaggcagctgtcagcgct

SEQ ID NO: 775561 - DNA, 25 bp, Mus musculus
tagctcccaggctgctgtcagcgct

SEQ ID NO: 775562 - DNA, 25 bp, Mus musculus
tagctcccagggattacttcagaaa

SEQ ID NO: 775563 - DNA, 25 bp, Mus musculus
tagctcccagggtttacttcagaaa

SEQ ID NO: 775564 - DNA, 25 bp, Mus musculus
tagctcccctaaagccaggtttggt

SEQ ID NO: 775565 - DNA, 25 bp, Mus musculus
tagctcccctaatgccaggtttggt

SEQ ID NO: 775566 - DNA, 25 bp, Mus musculus
tagctcccgatcatccaagtattat

SEQ ID NO: 775567 - DNA, 25 bp, Mus musculus
tagctcccgatcttccaagtattat

SEQ ID NO: 775568 - DNA, 25 bp, Mus musculus
tagctccctcagctcgctaataaag

SEQ ID NO: 775569 - DNA, 25 bp, Mus musculus
tagctccctcaggtcgctaataaag

SEQ ID NO: 775570 - DNA, 25 bp, Mus musculus
tagctccctgccacaggcagattaa

SEQ ID NO: 775571 - DNA, 25 bp, Mus musculus
tagctccctgcctcaggcagattaa

SEQ ID NO: 775572 - DNA, 25 bp, Mus musculus
tagctcccttacctttatctgaagt

SEQ ID NO: 775573 - DNA, 25 bp, Mus musculus
tagctcccttacgtttatctgaagt

SEQ ID NO: 775574 - DNA, 25 bp, Mus musculus
tagctcccttctcaaccatatttat

SEQ ID NO: 775575 - DNA, 25 bp, Mus musculus
tagctcccttctgaaccatatttat

SEQ ID NO: 775576 - DNA, 25 bp, Mus musculus
tagctcccttgtacttatggaatcc

SEQ ID NO: 775577 - DNA, 25 bp, Mus musculus
tagctcccttgttcttatggaatcc

SEQ ID NO: 775578 - DNA, 25 bp, Mus musculus
tagctcctaactctcaggctgacgg

SEQ ID NO: 775579 - DNA, 25 bp, Mus musculus
tagctcctaactgtcaggctgacgg

SEQ ID NO: 775580 - DNA, 25 bp, Mus musculus
tagctcctccaaatcgacttctttt

SEQ ID NO: 775581 - DNA, 25 bp, Mus musculus
tagctcctccaattcgacttctttt

SEQ ID NO: 775582 - DNA, 25 bp, Mus musculus
tagctcctccccaggaggctaaaaa

SEQ ID NO: 775583 - DNA, 25 bp, Mus musculus
tagctcctcccctggaggctaaaaa

SEQ ID NO: 775584 - DNA, 25 bp, Mus musculus
tagctcctcccgatatttatgcaag

SEQ ID NO: 775585 - DNA, 25 bp, Mus musculus
tagctcctcccgttatttatgcaag

SEQ ID NO: 775586 - DNA, 25 bp, Mus musculus
tagctcctctggcaagggttcatat

SEQ ID NO: 775587 - DNA, 25 bp, Mus musculus
tagctcctctgggaagggttcatat

SEQ ID NO: 775588 - DNA, 25 bp, Mus musculus
tagctcctctgtcacatgggatact

SEQ ID NO: 775589 - DNA, 25 bp, Mus musculus
tagctcctctgtgacatgggatact

SEQ ID NO: 775590 - DNA, 25 bp, Mus musculus
tagctcctcttcagggaatagtggg

SEQ ID NO: 775591 - DNA, 25 bp, Mus musculus
tagctcctcttctgggaatagtggg

SEQ ID NO: 775592 - DNA, 25 bp, Mus musculus
tagctcctctttatctgggattcca

SEQ ID NO: 775593 - DNA, 25 bp, Mus musculus
tagctcctctttttctgggattcca

SEQ ID NO: 775594 - DNA, 25 bp, Mus musculus
tagctcctgaacaacgtagtaataa

SEQ ID NO: 775595 - DNA, 25 bp, Mus musculus
tagctcctgaactacgtagtaataa

SEQ ID NO: 775596 - DNA, 25 bp, Mus musculus
tagctcctgccgcatgtggcttcag

SEQ ID NO: 775597 - DNA, 25 bp, Mus musculus
tagctcctgccggatgtggcttcag

SEQ ID NO: 775598 - DNA, 25 bp, Mus musculus
tagctcctggagcttctgacgattg

SEQ ID NO: 775599 - DNA, 25 bp, Mus musculus
tagctcctggaggttctgacgattg

SEQ ID NO: 775600 - DNA, 25 bp, Mus musculus
tagctcctgttgataagtccctttt

SEQ ID NO: 775601 - DNA, 25 bp, Mus musculus
tagctcctgttgttaagtccctttt

SEQ ID NO: 775602 - DNA, 25 bp, Mus musculus
tagctccttaagactttgatcactg

SEQ ID NO: 775603 - DNA, 25 bp, Mus musculus
tagctccttaagtctttgatcactg

SEQ ID NO: 775604 - DNA, 25 bp, Mus musculus
tagctccttataaacctctagttgg

SEQ ID NO: 775605 - DNA, 25 bp, Mus musculus
tagctccttatatacctctagttgg

SEQ ID NO: 775606 - DNA, 25 bp, Mus musculus
tagctccttattcccaaagtgtcaa

SEQ ID NO: 775607 - DNA, 25 bp, Mus musculus
tagctccttattgccaaagtgtcaa

SEQ ID NO: 775608 - DNA, 25 bp, Mus musculus
tagctccttcatccattgccagtgg

SEQ ID NO: 775609 - DNA, 25 bp, Mus musculus
tagctccttcatcgtaacagcagcg

SEQ ID NO: 775610 - DNA, 25 bp, Mus musculus
tagctccttcatgcattgccagtgg

SEQ ID NO: 775611 - DNA, 25 bp, Mus musculus
tagctccttcatggtaacagcagcg

SEQ ID NO: 775612 - DNA, 25 bp, Mus musculus
tagctccttccaaccagggatggtc

SEQ ID NO: 775613 - DNA, 25 bp, Mus musculus
tagctccttccatccagggatggtc

SEQ ID NO: 775614 - DNA, 25 bp, Mus musculus
tagctcgcccttacgatgatgtgaa

SEQ ID NO: 775615 - DNA, 25 bp, Mus musculus
tagctcgccctttcgatgatgtgaa

SEQ ID NO: 775616 - DNA, 25 bp, Mus musculus
tagctcgctcggacttcttagttcc

SEQ ID NO: 775617 - DNA, 25 bp, Mus musculus
tagctcgctcggtcttcttagttcc

SEQ ID NO: 775618 - DNA, 25 bp, Mus musculus
tagctcggtatgctagccacaggcc

SEQ ID NO: 775619 - DNA, 25 bp, Mus musculus
tagctcggtatggtagccacaggcc

SEQ ID NO: 775620 - DNA, 25 bp, Mus musculus
tagctcggtggaaccctcagtgaaa

SEQ ID NO: 775621 - DNA, 25 bp, Mus musculus
tagctcggtggatccctcagtgaaa

SEQ ID NO: 775622 - DNA, 25 bp, Mus musculus
tagctcggtgtgctaggcagatctc

SEQ ID NO: 775623 - DNA, 25 bp, Mus musculus
tagctcggtgtggtaggcagatctc

SEQ ID NO: 775624 - DNA, 25 bp, Mus musculus
tagctcgtggagaagactgcttgcc

SEQ ID NO: 775625 - DNA, 25 bp, Mus musculus
tagctcgtggagtagactgcttgcc

SEQ ID NO: 775626 - DNA, 25 bp, Mus musculus
tagctcgtgtacaataaaccctctt

SEQ ID NO: 775627 - DNA, 25 bp, Mus musculus
tagctcgtgtactataaaccctctt

SEQ ID NO: 775628 - DNA, 25 bp, Mus musculus
tagctctaacgtatgcatataaggg

SEQ ID NO: 775629 - DNA, 25 bp, Mus musculus
tagctctaacgtttgcatataaggg

SEQ ID NO: 775630 - DNA, 25 bp, Mus musculus
tagctctaagatatcttcctccgga

SEQ ID NO: 775631 - DNA, 25 bp, Mus musculus
tagctctaagatttcttcctccgga

SEQ ID NO: 775632 - DNA, 25 bp, Mus musculus
tagctctaccatactgtatacagta

SEQ ID NO: 775633 - DNA, 25 bp, Mus musculus
tagctctaccattctgtatacagta

SEQ ID NO: 775634 - DNA, 25 bp, Mus musculus
tagctctagccgagtatattttgat

SEQ ID NO: 775635 - DNA, 25 bp, Mus musculus
tagctctagccgtgtatattttgat

SEQ ID NO: 775636 - DNA, 25 bp, Mus musculus
tagctctagtcactctttctcggtt

SEQ ID NO: 775637 - DNA, 25 bp, Mus musculus
tagctctagtcagtctttctcggtt

SEQ ID NO: 775638 - DNA, 25 bp, Mus musculus
tagctctatgcccttgtgtagtggg

SEQ ID NO: 775639 - DNA, 25 bp, Mus musculus
tagctctatgccgttgtgtagtggg

SEQ ID NO: 775640 - DNA, 25 bp, Mus musculus
tagctctatggactctttggcttag

SEQ ID NO: 775641 - DNA, 25 bp, Mus musculus
tagctctatggagtctttggcttag

SEQ ID NO: 775642 - DNA, 25 bp, Mus musculus
tagctctcacacatgagctttccta

SEQ ID NO: 775643 - DNA, 25 bp, Mus musculus
tagctctcacacttgagctttccta

SEQ ID NO: 775644 - DNA, 25 bp, Mus musculus
tagctctcattactagctgcccagg

SEQ ID NO: 775645 - DNA, 25 bp, Mus musculus
tagctctcattagtagctgcccagg

SEQ ID NO: 775646 - DNA, 25 bp, Mus musculus
tagctctccaaaaccctgttgtgag

SEQ ID NO: 775647 - DNA, 25 bp, Mus musculus
tagctctccaaatccctgttgtgag

SEQ ID NO: 775648 - DNA, 25 bp, Mus musculus
tagctctccagtccctgaatttgtg

SEQ ID NO: 775649 - DNA, 25 bp, Mus musculus
tagctctccagtgcctgaatttgtg

SEQ ID NO: 775650 - DNA, 25 bp, Mus musculus
tagctctcccgccaacggtgagaag

SEQ ID NO: 775651 - DNA, 25 bp, Mus musculus
tagctctcccgcgaacggtgagaag

SEQ ID NO: 775652 - DNA, 25 bp, Mus musculus
tagctctcccttagtcaactatgta

SEQ ID NO: 775653 - DNA, 25 bp, Mus musculus
tagctctccctttgtcaactatgta

SEQ ID NO: 775654 - DNA, 25 bp, Mus musculus
tagctctcctggagctaaacacagc

SEQ ID NO: 775655 - DNA, 25 bp, Mus musculus
tagctctcctggtgctaaacacagc

SEQ ID NO: 775656 - DNA, 25 bp, Mus musculus
tagctctcctttcctggctgaggta

SEQ ID NO: 775657 - DNA, 25 bp, Mus musculus
tagctctcctttgctggctgaggta

SEQ ID NO: 775658 - DNA, 25 bp, Mus musculus
tagctctcgtgtattgcctattaca

SEQ ID NO: 775659 - DNA, 25 bp, Mus musculus
tagctctcgtgttttgcctattaca

SEQ ID NO: 775660 - DNA, 25 bp, Mus musculus
tagctctctatactgttacgttcag

SEQ ID NO: 775661 - DNA, 25 bp, Mus musculus
tagctctctatagtgttacgttcag

SEQ ID NO: 775662 - DNA, 25 bp, Mus musculus
tagctctctctgagtacccaaggaa

SEQ ID NO: 775663 - DNA, 25 bp, Mus musculus
tagctctctctgtgtacccaaggaa

SEQ ID NO: 775664 - DNA, 25 bp, Mus musculus
tagctctctgaacaactagcccttg

SEQ ID NO: 775665 - DNA, 25 bp, Mus musculus
tagctctctgaagaactagcccttg

SEQ ID NO: 775666 - DNA, 25 bp, Mus musculus
tagctctgaacgacagcctgcggga

SEQ ID NO: 775667 - DNA, 25 bp, Mus musculus
tagctctgaacgtcagcctgcggga

SEQ ID NO: 775668 - DNA, 25 bp, Mus musculus
tagctctgactcctggaactagctc

SEQ ID NO: 775669 - DNA, 25 bp, Mus musculus
tagctctgactcgtggaactagctc

SEQ ID NO: 775670 - DNA, 25 bp, Mus musculus
tagctctgagagactcctactctgg

SEQ ID NO: 775671 - DNA, 25 bp, Mus musculus
tagctctgagagtctcctactctgg

SEQ ID NO: 775672 - DNA, 25 bp, Mus musculus
tagctctgaggccacttattccaat

SEQ ID NO: 775673 - DNA, 25 bp, Mus musculus
tagctctgaggcgacttattccaat

SEQ ID NO: 775674 - DNA, 25 bp, Mus musculus
tagctctgcccaccaaagctgagat

SEQ ID NO: 775675 - DNA, 25 bp, Mus musculus
tagctctgcccagcaaagctgagat

SEQ ID NO: 775676 - DNA, 25 bp, Mus musculus
tagctctggttgatctgcaactcga

SEQ ID NO: 775677 - DNA, 25 bp, Mus musculus
tagctctggttgttctgcaactcga

SEQ ID NO: 775678 - DNA, 25 bp, Mus musculus
tagctctgtagtagagccctcatat

SEQ ID NO: 775679 - DNA, 25 bp, Mus musculus
tagctctgtagttgagccctcatat

SEQ ID NO: 775680 - DNA, 25 bp, Mus musculus
tagctctgtgcgctgttggtcttca

SEQ ID NO: 775681 - DNA, 25 bp, Mus musculus
tagctctgtgcggtgttggtcttca

SEQ ID NO: 775682 - DNA, 25 bp, Mus musculus
tagctctgtgctctcggaatggaac

SEQ ID NO: 775683 - DNA, 25 bp, Mus musculus
tagctctgtgctgtcggaatggaac

SEQ ID NO: 775684 - DNA, 25 bp, Mus musculus
tagctctgttgaagaggctggcctc

SEQ ID NO: 775685 - DNA, 25 bp, Mus musculus
tagctctgttgatgaggctggcctc

SEQ ID NO: 775686 - DNA, 25 bp, Mus musculus
tagctcttaatacccaggaggcctc

SEQ ID NO: 775687 - DNA, 25 bp, Mus musculus
tagctcttaatagccaggaggcctc

SEQ ID NO: 775688 - DNA, 25 bp, Mus musculus
tagctcttagtcactctgagatggc

SEQ ID NO: 775689 - DNA, 25 bp, Mus musculus
tagctcttagtctctctgagatggc

SEQ ID NO: 775690 - DNA, 25 bp, Mus musculus
tagctcttcagaacgcccttggaaa

SEQ ID NO: 775691 - DNA, 25 bp, Mus musculus
tagctcttcagatcgcccttggaaa

SEQ ID NO: 775692 - DNA, 25 bp, Mus musculus
tagctcttcagtacttgcaactttg

SEQ ID NO: 775693 - DNA, 25 bp, Mus musculus
tagctcttcagtctaacgtggtctc

SEQ ID NO: 775694 - DNA, 25 bp, Mus musculus
tagctcttcagtgtaacgtggtctc

SEQ ID NO: 775695 - DNA, 25 bp, Mus musculus
tagctcttcagttcttgcaactttg

SEQ ID NO: 775696 - DNA, 25 bp, Mus musculus
tagctcttccatcatctcatgcagg

SEQ ID NO: 775697 - DNA, 25 bp, Mus musculus
tagctcttccatgatctcatgcagg

SEQ ID NO: 775698 - DNA, 25 bp, Mus musculus
tagctcttgcataggaacctacatc

SEQ ID NO: 775699 - DNA, 25 bp, Mus musculus
tagctcttgcattggaacctacatc

SEQ ID NO: 775700 - DNA, 25 bp, Mus musculus
tagctcttggctcattagtttttca

SEQ ID NO: 775701 - DNA, 25 bp, Mus musculus
tagctcttggctgattagtttttca

SEQ ID NO: 775702 - DNA, 25 bp, Mus musculus
tagctcttggtgaagcttgctgcct

SEQ ID NO: 775703 - DNA, 25 bp, Mus musculus
tagctcttggtgtagcttgctgcct

SEQ ID NO: 775704 - DNA, 25 bp, Mus musculus
tagctcttgtatccccttcccagac

SEQ ID NO: 775705 - DNA, 25 bp, Mus musculus
tagctcttgtatgcccttcccagac

SEQ ID NO: 775706 - DNA, 25 bp, Mus musculus
tagctctttacacctagatccgttt

SEQ ID NO: 775707 - DNA, 25 bp, Mus musculus
tagctctttacagctagatccgttt

SEQ ID NO: 775708 - DNA, 25 bp, Mus musculus
tagctctttgctaggattgcttggg

SEQ ID NO: 775709 - DNA, 25 bp, Mus musculus
tagctctttgcttggattgcttggg

SEQ ID NO: 775710 - DNA, 25 bp, Mus musculus
tagctcttttccagatattgacaga

SEQ ID NO: 775711 - DNA, 25 bp, Mus musculus
tagctcttttcctgatattgacaga

SEQ ID NO: 775712 - DNA, 25 bp, Mus musculus
tagctgaacagaccgtcttccttta

SEQ ID NO: 775713 - DNA, 25 bp, Mus musculus
tagctgaacagagcgtcttccttta

SEQ ID NO: 775714 - DNA, 25 bp, Mus musculus
tagctgaagaacaggtgcgagctgg

SEQ ID NO: 775715 - DNA, 25 bp, Mus musculus
tagctgaagaactggtgcgagctgg

SEQ ID NO: 775716 - DNA, 25 bp, Mus musculus
tagctgaagctgactgggctgttca

SEQ ID NO: 775717 - DNA, 25 bp, Mus musculus
tagctgaagctgtctgggctgttca

SEQ ID NO: 775718 - DNA, 25 bp, Mus musculus
tagctgaaggctaggagttccgagt

SEQ ID NO: 775719 - DNA, 25 bp, Mus musculus
tagctgaaggcttggagttccgagt

SEQ ID NO: 775720 - DNA, 25 bp, Mus musculus
tagctgaattgacttgttacttctg

SEQ ID NO: 775721 - DNA, 25 bp, Mus musculus
tagctgaattgagttgttacttctg

SEQ ID NO: 775722 - DNA, 25 bp, Mus musculus
tagctgacagtgctactgacttttt

SEQ ID NO: 775723 - DNA, 25 bp, Mus musculus
tagctgacagtggtactgacttttt

SEQ ID NO: 775724 - DNA, 25 bp, Mus musculus
tagctgacctcaacgggtgcaatac

SEQ ID NO: 775725 - DNA, 25 bp, Mus musculus
tagctgacctcatcgggtgcaatac

SEQ ID NO: 775726 - DNA, 25 bp, Mus musculus
tagctgactaggcagatgcatgaac

SEQ ID NO: 775727 - DNA, 25 bp, Mus musculus
tagctgactagggagatgcatgaac

SEQ ID NO: 775728 - DNA, 25 bp, Mus musculus
tagctgactatcaagggttggccct

SEQ ID NO: 775729 - DNA, 25 bp, Mus musculus
tagctgactatctagggttggccct

SEQ ID NO: 775730 - DNA, 25 bp, Mus musculus
tagctgactcatactaacctgtgct

SEQ ID NO: 775731 - DNA, 25 bp, Mus musculus
tagctgactcattctaacctgtgct

SEQ ID NO: 775732 - DNA, 25 bp, Mus musculus
tagctgagacacagtggcactgtgg

SEQ ID NO: 775733 - DNA, 25 bp, Mus musculus
tagctgagacactgtggcactgtgg

SEQ ID NO: 775734 - DNA, 25 bp, Mus musculus
tagctgagaccccagaagacggtat

SEQ ID NO: 775735 - DNA, 25 bp, Mus musculus
tagctgagacccgagaagacggtat

SEQ ID NO: 775736 - DNA, 25 bp, Mus musculus
tagctgagatttctgatctttaacc

SEQ ID NO: 775737 - DNA, 25 bp, Mus musculus
tagctgagatttgtgatctttaacc

SEQ ID NO: 775738 - DNA, 25 bp, Mus musculus
tagctgagcaaacagctgcccggga

SEQ ID NO: 775739 - DNA, 25 bp, Mus musculus
tagctgagcaaagagctgcccggga

SEQ ID NO: 775740 - DNA, 25 bp, Mus musculus
tagctgagccctagcctgtaggaga

SEQ ID NO: 775741 - DNA, 25 bp, Mus musculus
tagctgagcccttgcctgtaggaga

SEQ ID NO: 775742 - DNA, 25 bp, Mus musculus
tagctgagctacagattcataacaa

SEQ ID NO: 775743 - DNA, 25 bp, Mus musculus
tagctgagctactgattcataacaa

SEQ ID NO: 775744 - DNA, 25 bp, Mus musculus
tagctgaggctcaccctgggagacc

SEQ ID NO: 775745 - DNA, 25 bp, Mus musculus
tagctgaggctctccctgggagacc

SEQ ID NO: 775746 - DNA, 25 bp, Mus musculus
tagctgatatcactggaacactccc

SEQ ID NO: 775747 - DNA, 25 bp, Mus musculus
tagctgatatcagtggaacactccc

SEQ ID NO: 775748 - DNA, 25 bp, Mus musculus
tagctgatcactctacctaggatgt

SEQ ID NO: 775749 - DNA, 25 bp, Mus musculus
tagctgatcactgtacctaggatgt

SEQ ID NO: 775750 - DNA, 25 bp, Mus musculus
tagctgatgagaatctttgtagaga

SEQ ID NO: 775751 - DNA, 25 bp, Mus musculus
tagctgatgagattctttgtagaga

SEQ ID NO: 775752 - DNA, 25 bp, Mus musculus
tagctgatgatccgaataactacct

SEQ ID NO: 775753 - DNA, 25 bp, Mus musculus
tagctgatgatcggaataactacct

SEQ ID NO: 775754 - DNA, 25 bp, Mus musculus
tagctgatgcagaaagtccagacaa

SEQ ID NO: 775755 - DNA, 25 bp, Mus musculus
tagctgatgcagtaagtccagacaa

SEQ ID NO: 775756 - DNA, 25 bp, Mus musculus
tagctgcaccgtctttgtgtagagc

SEQ ID NO: 775757 - DNA, 25 bp, Mus musculus
tagctgcaccgtgtttgtgtagagc

SEQ ID NO: 775758 - DNA, 25 bp, Mus musculus
tagctgcagaacatgcctctctcct

SEQ ID NO: 775759 - DNA, 25 bp, Mus musculus
tagctgcagaacttgcctctctcct

SEQ ID NO: 775760 - DNA, 25 bp, Mus musculus
tagctgcagagaccatgcgtaccac

SEQ ID NO: 775761 - DNA, 25 bp, Mus musculus
tagctgcagagagcatgcgtaccac

SEQ ID NO: 775762 - DNA, 25 bp, Mus musculus
tagctgcagcagatactctccttac

SEQ ID NO: 775763 - DNA, 25 bp, Mus musculus
tagctgcagcagttactctccttac

SEQ ID NO: 775764 - DNA, 25 bp, Mus musculus
tagctgcagctcaaggaaagcccaa

SEQ ID NO: 775765 - DNA, 25 bp, Mus musculus
tagctgcagctctaggaaagcccaa

SEQ ID NO: 775766 - DNA, 25 bp, Mus musculus
tagctgcagctgacaactttacaaa

SEQ ID NO: 775767 - DNA, 25 bp, Mus musculus
tagctgcagctgtcaactttacaaa

SEQ ID NO: 775768 - DNA, 25 bp, Mus musculus
tagctgcatcctaaacccaaatgtc

SEQ ID NO: 775769 - DNA, 25 bp, Mus musculus
tagctgcatccttaacccaaatgtc

SEQ ID NO: 775770 - DNA, 25 bp, Mus musculus
tagctgccaattagttcctctgttt

SEQ ID NO: 775771 - DNA, 25 bp, Mus musculus
tagctgccaatttgttcctctgttt

SEQ ID NO: 775772 - DNA, 25 bp, Mus musculus
tagctgccacgaagtgacacatttc

SEQ ID NO: 775773 - DNA, 25 bp, Mus musculus
tagctgccacgatgtgacacatttc

SEQ ID NO: 775774 - DNA, 25 bp, Mus musculus
tagctgccagacaaagggttcgaga

SEQ ID NO: 775775 - DNA, 25 bp, Mus musculus
tagctgccagactaagggttcgaga

SEQ ID NO: 775776 - DNA, 25 bp, Mus musculus
tagctgccagcgctttaggacagtc

SEQ ID NO: 775777 - DNA, 25 bp, Mus musculus
tagctgccagcggtttaggacagtc

SEQ ID NO: 775778 - DNA, 25 bp, Mus musculus
tagctgccaggaattgggagtcatc

SEQ ID NO: 775779 - DNA, 25 bp, Mus musculus
tagctgccaggatttgggagtcatc

SEQ ID NO: 775780 - DNA, 25 bp, Mus musculus
tagctgccctgaatagaaggttacc

SEQ ID NO: 775781 - DNA, 25 bp, Mus musculus
tagctgccctgattagaaggttacc

SEQ ID NO: 775782 - DNA, 25 bp, Mus musculus
tagctgccgcagcaaaagccacagg

SEQ ID NO: 775783 - DNA, 25 bp, Mus musculus
tagctgccgcaggaaaagccacagg

SEQ ID NO: 775784 - DNA, 25 bp, Mus musculus
tagctgcctcagcagacatggctgg

SEQ ID NO: 775785 - DNA, 25 bp, Mus musculus
tagctgcctcaggagacatggctgg

SEQ ID NO: 775786 - DNA, 25 bp, Mus musculus
tagctgcctcccaactgtaaatatg

SEQ ID NO: 775787 - DNA, 25 bp, Mus musculus
tagctgcctccctactgtaaatatg

SEQ ID NO: 775788 - DNA, 25 bp, Mus musculus
tagctgcctctgagatgtgtctgca

SEQ ID NO: 775789 - DNA, 25 bp, Mus musculus
tagctgcctctgtgatgtgtctgca

SEQ ID NO: 775790 - DNA, 25 bp, Mus musculus
tagctgcctgggactgttgagactc

SEQ ID NO: 775791 - DNA, 25 bp, Mus musculus
tagctgcctgggtctgttgagactc

SEQ ID NO: 775792 - DNA, 25 bp, Mus musculus
tagctgcgacttatgcttcttgctt

SEQ ID NO: 775793 - DNA, 25 bp, Mus musculus
tagctgcgacttttgcttcttgctt

SEQ ID NO: 775794 - DNA, 25 bp, Mus musculus
tagctgcgttcccagttactgacca

SEQ ID NO: 775795 - DNA, 25 bp, Mus musculus
tagctgcgttccgagttactgacca

SEQ ID NO: 775796 - DNA, 25 bp, Mus musculus
tagctgctactaacatatctgtgaa

SEQ ID NO: 775797 - DNA, 25 bp, Mus musculus
tagctgctactatcatatctgtgaa

SEQ ID NO: 775798 - DNA, 25 bp, Mus musculus
tagctgctcagcacttcatcgaagt

SEQ ID NO: 775799 - DNA, 25 bp, Mus musculus
tagctgctcagctcttcatcgaagt

SEQ ID NO: 775800 - DNA, 25 bp, Mus musculus
tagctgctccaaagatatccagtat

SEQ ID NO: 775801 - DNA, 25 bp, Mus musculus
tagctgctccaatgatatccagtat

SEQ ID NO: 775802 - DNA, 25 bp, Mus musculus
tagctgctccagatcccatgacggt

SEQ ID NO: 775803 - DNA, 25 bp, Mus musculus
tagctgctccagttcccatgacggt

SEQ ID NO: 775804 - DNA, 25 bp, Mus musculus
tagctgctcccaaaatgctgtgggt

SEQ ID NO: 775805 - DNA, 25 bp, Mus musculus
tagctgctcccataatgctgtgggt

SEQ ID NO: 775806 - DNA, 25 bp, Mus musculus
tagctgctctacctgactttgtggc

SEQ ID NO: 775807 - DNA, 25 bp, Mus musculus
tagctgctctacgtgactttgtggc

SEQ ID NO: 775808 - DNA, 25 bp, Mus musculus
tagctgctgagcctataacttcaag

SEQ ID NO: 775809 - DNA, 25 bp, Mus musculus
tagctgctgagcgtataacttcaag

SEQ ID NO: 775810 - DNA, 25 bp, Mus musculus
tagctgctgccaagttgattgtctt

SEQ ID NO: 775811 - DNA, 25 bp, Mus musculus
tagctgctgccatgttgattgtctt

SEQ ID NO: 775812 - DNA, 25 bp, Mus musculus
tagctgctggctataggtacacata

SEQ ID NO: 775813 - DNA, 25 bp, Mus musculus
tagctgctggctttaggtacacata

SEQ ID NO: 775814 - DNA, 25 bp, Mus musculus
tagctgcttaaaaggagtgggacca

SEQ ID NO: 775815 - DNA, 25 bp, Mus musculus
tagctgcttaaatggagtgggacca

SEQ ID NO: 775816 - DNA, 25 bp, Mus musculus
tagctgcttcaactttcctagaaaa

SEQ ID NO: 775817 - DNA, 25 bp, Mus musculus
tagctgcttcaagtttcctagaaaa

SEQ ID NO: 775818 - DNA, 25 bp, Mus musculus
tagctgctttctatgttactatcat

SEQ ID NO: 775819 - DNA, 25 bp, Mus musculus
tagctgctttctttgttactatcat

SEQ ID NO: 775820 - DNA, 25 bp, Mus musculus
tagctgcttttccaggtgactgagt

SEQ ID NO: 775821 - DNA, 25 bp, Mus musculus
tagctgcttttcgaggtgactgagt

SEQ ID NO: 775822 - DNA, 25 bp, Mus musculus
tagctgctttttatcctaccctatt

SEQ ID NO: 775823 - DNA, 25 bp, Mus musculus
tagctgctttttttcctaccctatt

SEQ ID NO: 775824 - DNA, 25 bp, Mus musculus
tagctggaacccagcaactgatgct

SEQ ID NO: 775825 - DNA, 25 bp, Mus musculus
tagctggaaccctgcaactgatgct

SEQ ID NO: 775826 - DNA, 25 bp, Mus musculus
tagctggacagaccatcggaggcct

SEQ ID NO: 775827 - DNA, 25 bp, Mus musculus
tagctggacagagcatcggaggcct

SEQ ID NO: 775828 - DNA, 25 bp, Mus musculus
tagctggagagacacttcccaggac

SEQ ID NO: 775829 - DNA, 25 bp, Mus musculus
tagctggagagagacttcccaggac

SEQ ID NO: 775830 - DNA, 25 bp, Mus musculus
tagctggatgctaggtccttgtgta

SEQ ID NO: 775831 - DNA, 25 bp, Mus musculus
tagctggatgcttggtccttgtgta

SEQ ID NO: 775832 - DNA, 25 bp, Mus musculus
tagctggcacgcataccaacaagat

SEQ ID NO: 775833 - DNA, 25 bp, Mus musculus
tagctggcacgcttaccaacaagat

SEQ ID NO: 775834 - DNA, 25 bp, Mus musculus
tagctggcatctccttgtctgaaca

SEQ ID NO: 775835 - DNA, 25 bp, Mus musculus
tagctggcatctgcttgtctgaaca

SEQ ID NO: 775836 - DNA, 25 bp, Mus musculus
tagctggccaagaccttcctgtaag

SEQ ID NO: 775837 - DNA, 25 bp, Mus musculus
tagctggccaagtccttcctgtaag

SEQ ID NO: 775838 - DNA, 25 bp, Mus musculus
tagctggcctagattccgtatgtag

SEQ ID NO: 775839 - DNA, 25 bp, Mus musculus
tagctggcctagtttccgtatgtag

SEQ ID NO: 775840 - DNA, 25 bp, Mus musculus
tagctggcctcaaccctggtgacag

SEQ ID NO: 775841 - DNA, 25 bp, Mus musculus
tagctggcctcatccctggtgacag

SEQ ID NO: 775842 - DNA, 25 bp, Mus musculus
tagctggcgctgcatgatctggaac

SEQ ID NO: 775843 - DNA, 25 bp, Mus musculus
tagctggcgctggatgatctggaac

SEQ ID NO: 775844 - DNA, 25 bp, Mus musculus
tagctggctattcggatatgctgca

SEQ ID NO: 775845 - DNA, 25 bp, Mus musculus
tagctggctattgggatatgctgca

SEQ ID NO: 775846 - DNA, 25 bp, Mus musculus
tagctggctcttacaggaggatgac

SEQ ID NO: 775847 - DNA, 25 bp, Mus musculus
tagctggctctttcaggaggatgac

SEQ ID NO: 775848 - DNA, 25 bp, Mus musculus
tagctggctgatcccattctcctgt

SEQ ID NO: 775849 - DNA, 25 bp, Mus musculus
tagctggctgatgccattctcctgt

SEQ ID NO: 775850 - DNA, 25 bp, Mus musculus
tagctggctggtaatgggctgcttc

SEQ ID NO: 775851 - DNA, 25 bp, Mus musculus
tagctggctggttatgggctgcttc

SEQ ID NO: 775852 - DNA, 25 bp, Mus musculus
tagctggctgttcgatggatttcca

SEQ ID NO: 775853 - DNA, 25 bp, Mus musculus
tagctggctgttggatggatttcca

SEQ ID NO: 775854 - DNA, 25 bp, Mus musculus
tagctgggaactccaccttcataat

SEQ ID NO: 775855 - DNA, 25 bp, Mus musculus
tagctgggaactgcaccttcataat

SEQ ID NO: 775856 - DNA, 25 bp, Mus musculus
tagctgggatctacctcattttcat

SEQ ID NO: 775857 - DNA, 25 bp, Mus musculus
tagctgggatcttcctcattttcat

SEQ ID NO: 775858 - DNA, 25 bp, Mus musculus
tagctgggcactctgttaagctctt

SEQ ID NO: 775859 - DNA, 25 bp, Mus musculus
tagctgggcactgtgttaagctctt

SEQ ID NO: 775860 - DNA, 25 bp, Mus musculus
tagctgggcaggaagctctgacgca

SEQ ID NO: 775861 - DNA, 25 bp, Mus musculus
tagctgggcaggtagctctgacgca

SEQ ID NO: 775862 - DNA, 25 bp, Mus musculus
tagctgggccgtagtggttccatgc

SEQ ID NO: 775863 - DNA, 25 bp, Mus musculus
tagctgggccgttgtggttccatgc

SEQ ID NO: 775864 - DNA, 25 bp, Mus musculus
tagctgggcggacatctcagactcg

SEQ ID NO: 775865 - DNA, 25 bp, Mus musculus
tagctgggcggagatctcagactcg

SEQ ID NO: 775866 - DNA, 25 bp, Mus musculus
tagctgggcggcatggcaagatcct

SEQ ID NO: 775867 - DNA, 25 bp, Mus musculus
tagctgggcggcttggcaagatcct

SEQ ID NO: 775868 - DNA, 25 bp, Mus musculus
tagctgggctctcaggacctagatg

SEQ ID NO: 775869 - DNA, 25 bp, Mus musculus
tagctgggctctgaggacctagatg

SEQ ID NO: 775870 - DNA, 25 bp, Mus musculus
tagctgggtataatcatctttgtgc

SEQ ID NO: 775871 - DNA, 25 bp, Mus musculus
tagctgggtatattcatctttgtgc

SEQ ID NO: 775872 - DNA, 25 bp, Mus musculus
tagctggtcacccaagtgtacaaac

SEQ ID NO: 775873 - DNA, 25 bp, Mus musculus
tagctggtcaccgaagtgtacaaac

SEQ ID NO: 775874 - DNA, 25 bp, Mus musculus
tagctggtctcccattgctcaacaa

SEQ ID NO: 775875 - DNA, 25 bp, Mus musculus
tagctggtctccgattgctcaacaa

SEQ ID NO: 775876 - DNA, 25 bp, Mus musculus
tagctggtctgtagagagatctcct

SEQ ID NO: 775877 - DNA, 25 bp, Mus musculus
tagctggtctgttgagagatctcct

SEQ ID NO: 775878 - DNA, 25 bp, Mus musculus
tagctggtgactctgaagccctggc

SEQ ID NO: 775879 - DNA, 25 bp, Mus musculus
tagctggtgactgtgaagccctggc

SEQ ID NO: 775880 - DNA, 25 bp, Mus musculus
tagctggtgcacacgccctttgcgt

SEQ ID NO: 775881 - DNA, 25 bp, Mus musculus
tagctggtgcactcgccctttgcgt

SEQ ID NO: 775882 - DNA, 25 bp, Mus musculus
tagctggtgccaagagatgtcccaa

SEQ ID NO: 775883 - DNA, 25 bp, Mus musculus
tagctggtgccatgagatgtcccaa

SEQ ID NO: 775884 - DNA, 25 bp, Mus musculus
tagctggtggacagttaggccctgt

SEQ ID NO: 775885 - DNA, 25 bp, Mus musculus
tagctggtggactgttaggccctgt

SEQ ID NO: 775886 - DNA, 25 bp, Mus musculus
tagctggttattcttcttagatgaa

SEQ ID NO: 775887 - DNA, 25 bp, Mus musculus
tagctggttattgttcttagatgaa

SEQ ID NO: 775888 - DNA, 25 bp, Mus musculus
tagctggtttccatcgtaagtctgg

SEQ ID NO: 775889 - DNA, 25 bp, Mus musculus
tagctggtttccttcgtaagtctgg

SEQ ID NO: 775890 - DNA, 25 bp, Mus musculus
tagctggtttctacgtgaccaccaa

SEQ ID NO: 775891 - DNA, 25 bp, Mus musculus
tagctggtttcttcgtgaccaccaa

SEQ ID NO: 775892 - DNA, 25 bp, Mus musculus
tagctggttttcaaatgtgttcatg

SEQ ID NO: 775893 - DNA, 25 bp, Mus musculus
tagctggttttctaatgtgttcatg

SEQ ID NO: 775894 - DNA, 25 bp, Mus musculus
tagctgtaaaccattgttgccgccg

SEQ ID NO: 775895 - DNA, 25 bp, Mus musculus
tagctgtaaacctttgttgccgccg

SEQ ID NO: 775896 - DNA, 25 bp, Mus musculus
tagctgtaactgaagtgcccacgtc

SEQ ID NO: 775897 - DNA, 25 bp, Mus musculus
tagctgtaactgtagtgcccacgtc

SEQ ID NO: 775898 - DNA, 25 bp, Mus musculus
tagctgtagtacattgacccgaggg

SEQ ID NO: 775899 - DNA, 25 bp, Mus musculus
tagctgtagtactttgacccgaggg

SEQ ID NO: 775900 - DNA, 25 bp, Mus musculus
tagctgtatcccatgctagagtctg

SEQ ID NO: 775901 - DNA, 25 bp, Mus musculus
tagctgtatcccttgctagagtctg

SEQ ID NO: 775902 - DNA, 25 bp, Mus musculus
tagctgtatttgaagcaatcatcag

SEQ ID NO: 775903 - DNA, 25 bp, Mus musculus
tagctgtatttgtagcaatcatcag

SEQ ID NO: 775904 - DNA, 25 bp, Mus musculus
tagctgtcaatcctggcacactctg

SEQ ID NO: 775905 - DNA, 25 bp, Mus musculus
tagctgtcaatcgtggcacactctg

SEQ ID NO: 775906 - DNA, 25 bp, Mus musculus
tagctgtccatcaatgctgcttatg

SEQ ID NO: 775907 - DNA, 25 bp, Mus musculus
tagctgtccatctatgctgcttatg

SEQ ID NO: 775908 - DNA, 25 bp, Mus musculus
tagctgtcctagcacttagggtcct

SEQ ID NO: 775909 - DNA, 25 bp, Mus musculus
tagctgtcctaggacttagggtcct

SEQ ID NO: 775910 - DNA, 25 bp, Mus musculus
tagctgtctatgcttgttgctcaac

SEQ ID NO: 775911 - DNA, 25 bp, Mus musculus
tagctgtctatggttgttgctcaac

SEQ ID NO: 775912 - DNA, 25 bp, Mus musculus
tagctgtgacccctcccgtcacagg

SEQ ID NO: 775913 - DNA, 25 bp, Mus musculus
tagctgtgacccgtcccgtcacagg

SEQ ID NO: 775914 - DNA, 25 bp, Mus musculus
tagctgtgatcccaaattctttttg

SEQ ID NO: 775915 - DNA, 25 bp, Mus musculus
tagctgtgatccgaaattctttttg

SEQ ID NO: 775916 - DNA, 25 bp, Mus musculus
tagctgtgcaggctttgtgctctga

SEQ ID NO: 775917 - DNA, 25 bp, Mus musculus
tagctgtgcagggtttgtgctctga

SEQ ID NO: 775918 - DNA, 25 bp, Mus musculus
tagctgtgccttcgacagacctgag

SEQ ID NO: 775919 - DNA, 25 bp, Mus musculus
tagctgtgccttggacagacctgag

SEQ ID NO: 775920 - DNA, 25 bp, Mus musculus
tagctgtgctccatggatccaaaat

SEQ ID NO: 775921 - DNA, 25 bp, Mus musculus
tagctgtgctccttggatccaaaat

SEQ ID NO: 775922 - DNA, 25 bp, Mus musculus
tagctgtgcttgagcccttcacact

SEQ ID NO: 775923 - DNA, 25 bp, Mus musculus
tagctgtgcttgtgcccttcacact

SEQ ID NO: 775924 - DNA, 25 bp, Mus musculus
tagctgtgctttcgaccagagtgca

SEQ ID NO: 775925 - DNA, 25 bp, Mus musculus
tagctgtgctttggaccagagtgca

SEQ ID NO: 775926 - DNA, 25 bp, Mus musculus
tagctgtggcttctgaccgctgctc

SEQ ID NO: 775927 - DNA, 25 bp, Mus musculus
tagctgtggcttgtgaccgctgctc

SEQ ID NO: 775928 - DNA, 25 bp, Mus musculus
tagctgtgggaaatctgtcatagat

SEQ ID NO: 775929 - DNA, 25 bp, Mus musculus
tagctgtgggaattctgtcatagat

SEQ ID NO: 775930 - DNA, 25 bp, Mus musculus
tagctgtggtagagttccttcttca

SEQ ID NO: 775931 - DNA, 25 bp, Mus musculus
tagctgtggtagtgttccttcttca

SEQ ID NO: 775932 - DNA, 25 bp, Mus musculus
tagctgtggtttaagacggctggca

SEQ ID NO: 775933 - DNA, 25 bp, Mus musculus
tagctgtggttttagacggctggca

SEQ ID NO: 775934 - DNA, 25 bp, Mus musculus
tagctgtgtctcattatggccggat

SEQ ID NO: 775935 - DNA, 25 bp, Mus musculus
tagctgtgtctctttatggccggat

SEQ ID NO: 775936 - DNA, 25 bp, Mus musculus
tagctgttccgaagggtctcaggtt

SEQ ID NO: 775937 - DNA, 25 bp, Mus musculus
tagctgttccgatgggtctcaggtt

SEQ ID NO: 775938 - DNA, 25 bp, Mus musculus
tagctgttctcaaagaaatagccat

SEQ ID NO: 775939 - DNA, 25 bp, Mus musculus
tagctgttctcatagaaatagccat

SEQ ID NO: 775940 - DNA, 25 bp, Mus musculus
tagctgttctgaactgtacccaagg

SEQ ID NO: 775941 - DNA, 25 bp, Mus musculus
tagctgttctgatctgtacccaagg

SEQ ID NO: 775942 - DNA, 25 bp, Mus musculus
tagctgttgagtaagtgccgctccc

SEQ ID NO: 775943 - DNA, 25 bp, Mus musculus
tagctgttgagttagtgccgctccc

SEQ ID NO: 775944 - DNA, 25 bp, Mus musculus
tagctgttgcccagtagaccatagt

SEQ ID NO: 775945 - DNA, 25 bp, Mus musculus
tagctgttgccctgtagaccatagt

SEQ ID NO: 775946 - DNA, 25 bp, Mus musculus
tagctgttggctagatcatggtaaa

SEQ ID NO: 775947 - DNA, 25 bp, Mus musculus
tagctgttggcttgatcatggtaaa

SEQ ID NO: 775948 - DNA, 25 bp, Mus musculus
tagctgttgttgacccagtaactgt

SEQ ID NO: 775949 - DNA, 25 bp, Mus musculus
tagctgttgttgtcccagtaactgt

SEQ ID NO: 775950 - DNA, 25 bp, Mus musculus
tagctgtttgttaatgtcagaaaaa

SEQ ID NO: 775951 - DNA, 25 bp, Mus musculus
tagctgtttgtttatgtcagaaaaa

SEQ ID NO: 775952 - DNA, 25 bp, Mus musculus
tagctgttttcaaccacataatggc

SEQ ID NO: 775953 - DNA, 25 bp, Mus musculus
tagctgttttcatccacataatggc

SEQ ID NO: 775954 - DNA, 25 bp, Mus musculus
tagcttaaagcactgaactgtacca

SEQ ID NO: 775955 - DNA, 25 bp, Mus musculus
tagcttaaagcagtgaactgtacca

SEQ ID NO: 775956 - DNA, 25 bp, Mus musculus
tagcttaacttgcttgggtccctga

SEQ ID NO: 775957 - DNA, 25 bp, Mus musculus
tagcttaacttggttgggtccctga

SEQ ID NO: 775958 - DNA, 25 bp, Mus musculus
tagcttaaggcgattttaatcccct

SEQ ID NO: 775959 - DNA, 25 bp, Mus musculus
tagcttaaggcgtttttaatcccct

SEQ ID NO: 775960 - DNA, 25 bp, Mus musculus
tagcttaattctcagcccaatgcct

SEQ ID NO: 775961 - DNA, 25 bp, Mus musculus
tagcttaattctgagcccaatgcct

SEQ ID NO: 775962 - DNA, 25 bp, Mus musculus
tagcttacagggagtgagtctctgg

SEQ ID NO: 775963 - DNA, 25 bp, Mus musculus
tagcttacagggtgtgagtctctgg

SEQ ID NO: 775964 - DNA, 25 bp, Mus musculus
tagcttacataaccagccctgggag

SEQ ID NO: 775965 - DNA, 25 bp, Mus musculus
tagcttacataagcagccctgggag

SEQ ID NO: 775966 - DNA, 25 bp, Mus musculus
tagcttaccctccttggactcattc

SEQ ID NO: 775967 - DNA, 25 bp, Mus musculus
tagcttaccctcgttggactcattc

SEQ ID NO: 775968 - DNA, 25 bp, Mus musculus
tagcttacttaaaatcactgaactt

SEQ ID NO: 775969 - DNA, 25 bp, Mus musculus
tagcttacttaatatcactgaactt

SEQ ID NO: 775970 - DNA, 25 bp, Mus musculus
tagcttagcggcagcggtctccgta

SEQ ID NO: 775971 - DNA, 25 bp, Mus musculus
tagcttagcggctgcggtctccgta

SEQ ID NO: 775972 - DNA, 25 bp, Mus musculus
tagcttagctagacatggttcttta

SEQ ID NO: 775973 - DNA, 25 bp, Mus musculus
tagcttagctagtcatggttcttta

SEQ ID NO: 775974 - DNA, 25 bp, Mus musculus
tagcttagctgtcagctgtccatca

SEQ ID NO: 775975 - DNA, 25 bp, Mus musculus
tagcttagctgtgagctgtccatca

SEQ ID NO: 775976 - DNA, 25 bp, Mus musculus
tagcttaggctaaggattcctgtcc

SEQ ID NO: 775977 - DNA, 25 bp, Mus musculus
tagcttaggctatggattcctgtcc

SEQ ID NO: 775978 - DNA, 25 bp, Mus musculus
tagcttagtctgatgtttcatgcaa

SEQ ID NO: 775979 - DNA, 25 bp, Mus musculus
tagcttagtctgttgtttcatgcaa

SEQ ID NO: 775980 - DNA, 25 bp, Mus musculus
tagcttatacctattactgagagtt

SEQ ID NO: 775981 - DNA, 25 bp, Mus musculus
tagcttataccttttactgagagtt

SEQ ID NO: 775982 - DNA, 25 bp, Mus musculus
tagcttataggtacttttagcaaga

SEQ ID NO: 775983 - DNA, 25 bp, Mus musculus
tagcttataggttcttttagcaaga

SEQ ID NO: 775984 - DNA, 25 bp, Mus musculus
tagcttatccccatggacagtagga

SEQ ID NO: 775985 - DNA, 25 bp, Mus musculus
tagcttatccccttggacagtagga

SEQ ID NO: 775986 - DNA, 25 bp, Mus musculus
tagcttatcctgagccgcctcgatt

SEQ ID NO: 775987 - DNA, 25 bp, Mus musculus
tagcttatcctgtgccgcctcgatt

SEQ ID NO: 775988 - DNA, 25 bp, Mus musculus
tagcttatccttctgaggaccctaa

SEQ ID NO: 775989 - DNA, 25 bp, Mus musculus
tagcttatccttgtgaggaccctaa

SEQ ID NO: 775990 - DNA, 25 bp, Mus musculus
tagcttatgattatatagttgattg

SEQ ID NO: 775991 - DNA, 25 bp, Mus musculus
tagcttatgattttatagttgattg

SEQ ID NO: 775992 - DNA, 25 bp, Mus musculus
tagcttatgcttcggctggtggtca

SEQ ID NO: 775993 - DNA, 25 bp, Mus musculus
tagcttatgcttgggctggtggtca

SEQ ID NO: 775994 - DNA, 25 bp, Mus musculus
tagcttatttgacagaggtgcctat

SEQ ID NO: 775995 - DNA, 25 bp, Mus musculus
tagcttatttgagagaggtgcctat

SEQ ID NO: 775996 - DNA, 25 bp, Mus musculus
tagcttcaacaaccatctcgtaaca

SEQ ID NO: 775997 - DNA, 25 bp, Mus musculus
tagcttcaacaagcatctcgtaaca

SEQ ID NO: 775998 - DNA, 25 bp, Mus musculus
tagcttcaccaacatgttcttctca

SEQ ID NO: 775999 - DNA, 25 bp, Mus musculus
tagcttcaccaagatgttcttctca

SEQ ID NO: 776000 - DNA, 25 bp, Mus musculus
tagcttcaccacattggtattttca

SEQ ID NO: 776001 - DNA, 25 bp, Mus musculus
tagcttcaccactttggtattttca

SEQ ID NO: 776002 - DNA, 25 bp, Mus musculus
tagcttcactcccaatccctattgg

SEQ ID NO: 776003 - DNA, 25 bp, Mus musculus
tagcttcactccgaatccctattgg

SEQ ID NO: 776004 - DNA, 25 bp, Mus musculus
tagcttcacttacaatcatcatttg

SEQ ID NO: 776005 - DNA, 25 bp, Mus musculus
tagcttcacttagaatcatcatttg

SEQ ID NO: 776006 - DNA, 25 bp, Mus musculus
tagcttcagaagctccggtggtagc

SEQ ID NO: 776007 - DNA, 25 bp, Mus musculus
tagcttcagaaggtccggtggtagc

SEQ ID NO: 776008 - DNA, 25 bp, Mus musculus
tagcttcagagactgtatcctcatt

SEQ ID NO: 776009 - DNA, 25 bp, Mus musculus
tagcttcagagagtgtatcctcatt

SEQ ID NO: 776010 - DNA, 25 bp, Mus musculus
tagcttcagattaaccagcatttaa

SEQ ID NO: 776011 - DNA, 25 bp, Mus musculus
tagcttcagatttaccagcatttaa

SEQ ID NO: 776012 - DNA, 25 bp, Mus musculus
tagcttcagctaaaaaccacacaat

SEQ ID NO: 776013 - DNA, 25 bp, Mus musculus
tagcttcagctataaaccacacaat

SEQ ID NO: 776014 - DNA, 25 bp, Mus musculus
tagcttcataacatgaaccttcccc

SEQ ID NO: 776015 - DNA, 25 bp, Mus musculus
tagcttcataacttgaaccttcccc

SEQ ID NO: 776016 - DNA, 25 bp, Mus musculus
tagcttcataagcatcccaaggtaa

SEQ ID NO: 776017 - DNA, 25 bp, Mus musculus
tagcttcataaggatcccaaggtaa

SEQ ID NO: 776018 - DNA, 25 bp, Mus musculus
tagcttcatcagcttctgcagtcaa

SEQ ID NO: 776019 - DNA, 25 bp, Mus musculus
tagcttcatcaggttctgcagtcaa

SEQ ID NO: 776020 - DNA, 25 bp, Mus musculus
tagcttcatgttcagctttgctgta

SEQ ID NO: 776021 - DNA, 25 bp, Mus musculus
tagcttcatgttgagctttgctgta

SEQ ID NO: 776022 - DNA, 25 bp, Mus musculus
tagcttccaagcagaaagagaccat

SEQ ID NO: 776023 - DNA, 25 bp, Mus musculus
tagcttccaagctgaaagagaccat

SEQ ID NO: 776024 - DNA, 25 bp, Mus musculus
tagcttccacccaaggtccagagta

SEQ ID NO: 776025 - DNA, 25 bp, Mus musculus
tagcttccaccctaggtccagagta

SEQ ID NO: 776026 - DNA, 25 bp, Mus musculus
tagcttccactaacctaagacctgt

SEQ ID NO: 776027 - DNA, 25 bp, Mus musculus
tagcttccactatcctaagacctgt

SEQ ID NO: 776028 - DNA, 25 bp, Mus musculus
tagcttccactgatgccaacttgag

SEQ ID NO: 776029 - DNA, 25 bp, Mus musculus
tagcttccactgttgccaacttgag

SEQ ID NO: 776030 - DNA, 25 bp, Mus musculus
tagcttccagtacgatttcaaccaa

SEQ ID NO: 776031 - DNA, 25 bp, Mus musculus
tagcttccagtaggatttcaaccaa

SEQ ID NO: 776032 - DNA, 25 bp, Mus musculus
tagcttcccaaaagatccccaaact

SEQ ID NO: 776033 - DNA, 25 bp, Mus musculus
tagcttcccaaatgatccccaaact

SEQ ID NO: 776034 - DNA, 25 bp, Mus musculus
tagcttccctacatgcaagtttcaa

SEQ ID NO: 776035 - DNA, 25 bp, Mus musculus
tagcttccctacttgcaagtttcaa

SEQ ID NO: 776036 - DNA, 25 bp, Mus musculus
tagcttccgagcctcagcatcgact

SEQ ID NO: 776037 - DNA, 25 bp, Mus musculus
tagcttccgagcgtcagcatcgact

SEQ ID NO: 776038 - DNA, 25 bp, Mus musculus
tagcttcctaatctacataccatgt

SEQ ID NO: 776039 - DNA, 25 bp, Mus musculus
tagcttcctaatgtacataccatgt

SEQ ID NO: 776040 - DNA, 25 bp, Mus musculus
tagcttcctctcctgagagggcagt

SEQ ID NO: 776041 - DNA, 25 bp, Mus musculus
tagcttcctctcgtgagagggcagt

SEQ ID NO: 776042 - DNA, 25 bp, Mus musculus
tagcttcctgacacaaaacgttctt

SEQ ID NO: 776043 - DNA, 25 bp, Mus musculus
tagcttcctgactcaaaacgttctt

SEQ ID NO: 776044 - DNA, 25 bp, Mus musculus
tagcttcctgctacagttgcagccc

SEQ ID NO: 776045 - DNA, 25 bp, Mus musculus
tagcttcctgcttcagttgcagccc

SEQ ID NO: 776046 - DNA, 25 bp, Mus musculus
tagcttcctggtagtatcccaagga

SEQ ID NO: 776047 - DNA, 25 bp, Mus musculus
tagcttcctggttgtatcccaagga

SEQ ID NO: 776048 - DNA, 25 bp, Mus musculus
tagcttccttccacagttcaggatg

SEQ ID NO: 776049 - DNA, 25 bp, Mus musculus
tagcttccttcctcagttcaggatg

SEQ ID NO: 776050 - DNA, 25 bp, Mus musculus
tagcttccttgacatggtcagttta

SEQ ID NO: 776051 - DNA, 25 bp, Mus musculus
tagcttccttgagatggtcagttta

SEQ ID NO: 776052 - DNA, 25 bp, Mus musculus
tagcttcgaaagctgatgcttccct

SEQ ID NO: 776053 - DNA, 25 bp, Mus musculus
tagcttcgaaaggtgatgcttccct

SEQ ID NO: 776054 - DNA, 25 bp, Mus musculus
tagcttcgtcacacactgttcttga

SEQ ID NO: 776055 - DNA, 25 bp, Mus musculus
tagcttcgtcactcactgttcttga

SEQ ID NO: 776056 - DNA, 25 bp, Mus musculus
tagcttctaaacagtgcataccatt

SEQ ID NO: 776057 - DNA, 25 bp, Mus musculus
tagcttctaaactgtgcataccatt

SEQ ID NO: 776058 - DNA, 25 bp, Mus musculus
tagcttctacccctctactagagtt

SEQ ID NO: 776059 - DNA, 25 bp, Mus musculus
tagcttctacccgtctactagagtt

SEQ ID NO: 776060 - DNA, 25 bp, Mus musculus
tagcttctactactggtatggactt

SEQ ID NO: 776061 - DNA, 25 bp, Mus musculus
tagcttctactagtggtatggactt

SEQ ID NO: 776062 - DNA, 25 bp, Mus musculus
tagcttctactgattcaggcatcca

SEQ ID NO: 776063 - DNA, 25 bp, Mus musculus
tagcttctactgtttcaggcatcca

SEQ ID NO: 776064 - DNA, 25 bp, Mus musculus
tagcttctagctaaccaatggctgt

SEQ ID NO: 776065 - DNA, 25 bp, Mus musculus
tagcttctagcttaccaatggctgt

SEQ ID NO: 776066 - DNA, 25 bp, Mus musculus
tagcttctagttcctgctcttgcat

SEQ ID NO: 776067 - DNA, 25 bp, Mus musculus
tagcttctagttgctgctcttgcat

SEQ ID NO: 776068 - DNA, 25 bp, Mus musculus
tagcttctcatgcagggatgtccat

SEQ ID NO: 776069 - DNA, 25 bp, Mus musculus
tagcttctcatggagggatgtccat

SEQ ID NO: 776070 - DNA, 25 bp, Mus musculus
tagcttctcattcccaggtaaccct

SEQ ID NO: 776071 - DNA, 25 bp, Mus musculus
tagcttctcattgccaggtaaccct

SEQ ID NO: 776072 - DNA, 25 bp, Mus musculus
tagcttctccatcaattcctttgct

SEQ ID NO: 776073 - DNA, 25 bp, Mus musculus
tagcttctccatgaattcctttgct

SEQ ID NO: 776074 - DNA, 25 bp, Mus musculus
tagcttctccccagtcagagtttga

SEQ ID NO: 776075 - DNA, 25 bp, Mus musculus
tagcttctcccctgtcagagtttga

SEQ ID NO: 776076 - DNA, 25 bp, Mus musculus
tagcttctcgttatctgctctgagt

SEQ ID NO: 776077 - DNA, 25 bp, Mus musculus
tagcttctcgttttctgctctgagt

SEQ ID NO: 776078 - DNA, 25 bp, Mus musculus
tagcttctctaaagctcatctgacg

SEQ ID NO: 776079 - DNA, 25 bp, Mus musculus
tagcttctctaatgctcatctgacg

SEQ ID NO: 776080 - DNA, 25 bp, Mus musculus
tagcttctctgtaatgattttatca

SEQ ID NO: 776081 - DNA, 25 bp, Mus musculus
tagcttctctgttatgattttatca

SEQ ID NO: 776082 - DNA, 25 bp, Mus musculus
tagcttctgagccatatcttttgct

SEQ ID NO: 776083 - DNA, 25 bp, Mus musculus
tagcttctgagcgatatcttttgct

SEQ ID NO: 776084 - DNA, 25 bp, Mus musculus
tagcttctgctaacgtgaaggtaac

SEQ ID NO: 776085 - DNA, 25 bp, Mus musculus
tagcttctgctaagagcacctaacc

SEQ ID NO: 776086 - DNA, 25 bp, Mus musculus
tagcttctgctatcgtgaaggtaac

SEQ ID NO: 776087 - DNA, 25 bp, Mus musculus
tagcttctgctatgagcacctaacc

SEQ ID NO: 776088 - DNA, 25 bp, Mus musculus
tagcttctgtgcatctgtgtgggtg

SEQ ID NO: 776089 - DNA, 25 bp, Mus musculus
tagcttctgtgcttctgtgtgggtg

SEQ ID NO: 776090 - DNA, 25 bp, Mus musculus
tagcttcttcccaggctagatatgt

SEQ ID NO: 776091 - DNA, 25 bp, Mus musculus
tagcttcttccctggctagatatgt

SEQ ID NO: 776092 - DNA, 25 bp, Mus musculus
tagcttcttctcaacttgggtcaag

SEQ ID NO: 776093 - DNA, 25 bp, Mus musculus
tagcttcttctctacttgggtcaag

SEQ ID NO: 776094 - DNA, 25 bp, Mus musculus
tagcttctttccagatctatcatca

SEQ ID NO: 776095 - DNA, 25 bp, Mus musculus
tagcttctttcctgatctatcatca

SEQ ID NO: 776096 - DNA, 25 bp, Mus musculus
tagcttctttctacctacttggtat

SEQ ID NO: 776097 - DNA, 25 bp, Mus musculus
tagcttctttcttcctacttggtat

SEQ ID NO: 776098 - DNA, 25 bp, Mus musculus
tagcttgaacttcgaccctccagta

SEQ ID NO: 776099 - DNA, 25 bp, Mus musculus
tagcttgaacttggaccctccagta

SEQ ID NO: 776100 - DNA, 25 bp, Mus musculus
tagcttgacctgactgctttgatgt

SEQ ID NO: 776101 - DNA, 25 bp, Mus musculus
tagcttgacctgtctgctttgatgt

SEQ ID NO: 776102 - DNA, 25 bp, Mus musculus
tagcttgactccaggtgttccatat

SEQ ID NO: 776103 - DNA, 25 bp, Mus musculus
tagcttgactcctggtgttccatat

SEQ ID NO: 776104 - DNA, 25 bp, Mus musculus
tagcttgagacacctaggatacggt

SEQ ID NO: 776105 - DNA, 25 bp, Mus musculus
tagcttgagacagctaggatacggt

SEQ ID NO: 776106 - DNA, 25 bp, Mus musculus
tagcttgaggcccttccaaaggact

SEQ ID NO: 776107 - DNA, 25 bp, Mus musculus
tagcttgaggccgttccaaaggact

SEQ ID NO: 776108 - DNA, 25 bp, Mus musculus
tagcttgatggccttcagcagcaaa

SEQ ID NO: 776109 - DNA, 25 bp, Mus musculus
tagcttgatggcgttcagcagcaaa

SEQ ID NO: 776110 - DNA, 25 bp, Mus musculus
tagcttgatgggatattggcctaac

SEQ ID NO: 776111 - DNA, 25 bp, Mus musculus
tagcttgatgggttattggcctaac

SEQ ID NO: 776112 - DNA, 25 bp, Mus musculus
tagcttgattgcctttctaacgtca

SEQ ID NO: 776113 - DNA, 25 bp, Mus musculus
tagcttgattgcgtttctaacgtca

SEQ ID NO: 776114 - DNA, 25 bp, Mus musculus
tagcttgcactgcttcctttgtaaa

SEQ ID NO: 776115 - DNA, 25 bp, Mus musculus
tagcttgcactggttcctttgtaaa

SEQ ID NO: 776116 - DNA, 25 bp, Mus musculus
tagcttgcccggaatcttcatagtg

SEQ ID NO: 776117 - DNA, 25 bp, Mus musculus
tagcttgcccggtatcttcatagtg

SEQ ID NO: 776118 - DNA, 25 bp, Mus musculus
tagcttgccgtgctgcacacatagg

SEQ ID NO: 776119 - DNA, 25 bp, Mus musculus
tagcttgccgtggtgcacacatagg

SEQ ID NO: 776120 - DNA, 25 bp, Mus musculus
tagcttgcctaaaaaaccatgtgcg

SEQ ID NO: 776121 - DNA, 25 bp, Mus musculus
tagcttgcctaataaaccatgtgcg

SEQ ID NO: 776122 - DNA, 25 bp, Mus musculus
tagcttgcgcatcctgttttcttga

SEQ ID NO: 776123 - DNA, 25 bp, Mus musculus
tagcttgcgcatgctgttttcttga

SEQ ID NO: 776124 - DNA, 25 bp, Mus musculus
tagcttgctcacctattgttctcaa

SEQ ID NO: 776125 - DNA, 25 bp, Mus musculus
tagcttgctcacgtattgttctcaa

SEQ ID NO: 776126 - DNA, 25 bp, Mus musculus
tagcttgctccaagactgtggtgag

SEQ ID NO: 776127 - DNA, 25 bp, Mus musculus
tagcttgctccatgactgtggtgag

SEQ ID NO: 776128 - DNA, 25 bp, Mus musculus
tagcttgctgggactcagctctcct

SEQ ID NO: 776129 - DNA, 25 bp, Mus musculus
tagcttgctgggtctcagctctcct

SEQ ID NO: 776130 - DNA, 25 bp, Mus musculus
tagcttgcttagcacaggccagctt

SEQ ID NO: 776131 - DNA, 25 bp, Mus musculus
tagcttgcttaggacaggccagctt

SEQ ID NO: 776132 - DNA, 25 bp, Mus musculus
tagcttggaagcaggtcagctctgg

SEQ ID NO: 776133 - DNA, 25 bp, Mus musculus
tagcttggaagctggtcagctctgg

SEQ ID NO: 776134 - DNA, 25 bp, Mus musculus
tagcttggacctctctaggtgggcc

SEQ ID NO: 776135 - DNA, 25 bp, Mus musculus
tagcttggacctgtctaggtgggcc

SEQ ID NO: 776136 - DNA, 25 bp, Mus musculus
tagcttggatcacattcatccctgt

SEQ ID NO: 776137 - DNA, 25 bp, Mus musculus
tagcttggatcagattcatccctgt

SEQ ID NO: 776138 - DNA, 25 bp, Mus musculus
tagcttggccagatcctcttgcatc

SEQ ID NO: 776139 - DNA, 25 bp, Mus musculus
tagcttggccagttcctcttgcatc

SEQ ID NO: 776140 - DNA, 25 bp, Mus musculus
tagcttggcttcatgacaatcatag

SEQ ID NO: 776141 - DNA, 25 bp, Mus musculus
tagcttggcttcttgacaatcatag

SEQ ID NO: 776142 - DNA, 25 bp, Mus musculus
tagcttgggagaagttcccaaaaat

SEQ ID NO: 776143 - DNA, 25 bp, Mus musculus
tagcttgggagatgttcccaaaaat

SEQ ID NO: 776144 - DNA, 25 bp, Mus musculus
tagcttgggccaagttgacaacagt

SEQ ID NO: 776145 - DNA, 25 bp, Mus musculus
tagcttgggccatgttgacaacagt

SEQ ID NO: 776146 - DNA, 25 bp, Mus musculus
tagcttgggctaatgacaccctgtt

SEQ ID NO: 776147 - DNA, 25 bp, Mus musculus
tagcttgggctattgacaccctgtt

SEQ ID NO: 776148 - DNA, 25 bp, Mus musculus
tagcttgggcttctgggctcagttc

SEQ ID NO: 776149 - DNA, 25 bp, Mus musculus
tagcttgggcttgtgggctcagttc

SEQ ID NO: 776150 - DNA, 25 bp, Mus musculus
tagcttgggtaactcagggtcctgc

SEQ ID NO: 776151 - DNA, 25 bp, Mus musculus
tagcttgggtaagtcagggtcctgc

SEQ ID NO: 776152 - DNA, 25 bp, Mus musculus
tagcttgggtaccattcacctacag

SEQ ID NO: 776153 - DNA, 25 bp, Mus musculus
tagcttgggtacgattcacctacag

SEQ ID NO: 776154 - DNA, 25 bp, Mus musculus
tagcttgtacctatacttcactgac

SEQ ID NO: 776155 - DNA, 25 bp, Mus musculus
tagcttgtacctttacttcactgac

SEQ ID NO: 776156 - DNA, 25 bp, Mus musculus
tagcttgtagagaccacccaacaac

SEQ ID NO: 776157 - DNA, 25 bp, Mus musculus
tagcttgtagagtccacccaacaac

SEQ ID NO: 776158 - DNA, 25 bp, Mus musculus
tagcttgtatcactctgcttactag

SEQ ID NO: 776159 - DNA, 25 bp, Mus musculus
tagcttgtatcagtctgcttactag

SEQ ID NO: 776160 - DNA, 25 bp, Mus musculus
tagcttgtcagcattggcattttta

SEQ ID NO: 776161 - DNA, 25 bp, Mus musculus
tagcttgtcagctttggcattttta

SEQ ID NO: 776162 - DNA, 25 bp, Mus musculus
tagcttgtccatatgtttgcaacag

SEQ ID NO: 776163 - DNA, 25 bp, Mus musculus
tagcttgtccatttgtttgcaacag

SEQ ID NO: 776164 - DNA, 25 bp, Mus musculus
tagcttgtccccaaggtttcagctt

SEQ ID NO: 776165 - DNA, 25 bp, Mus musculus
tagcttgtcccctaggtttcagctt

SEQ ID NO: 776166 - DNA, 25 bp, Mus musculus
tagcttgtctatacactttgtgtgt

SEQ ID NO: 776167 - DNA, 25 bp, Mus musculus
tagcttgtctattcactttgtgtgt

SEQ ID NO: 776168 - DNA, 25 bp, Mus musculus
tagcttgtgcctatttcttcagaac

SEQ ID NO: 776169 - DNA, 25 bp, Mus musculus
tagcttgtgcctttttcttcagaac

SEQ ID NO: 776170 - DNA, 25 bp, Mus musculus
tagcttgtgtgcctgtagtctgtga

SEQ ID NO: 776171 - DNA, 25 bp, Mus musculus
tagcttgtgtgcgtgtagtctgtga

SEQ ID NO: 776172 - DNA, 25 bp, Mus musculus
tagcttgtgttaaatctggtaaacc

SEQ ID NO: 776173 - DNA, 25 bp, Mus musculus
tagcttgtgttatatctggtaaacc

SEQ ID NO: 776174 - DNA, 25 bp, Mus musculus
tagcttgttacaatagtggaattct

SEQ ID NO: 776175 - DNA, 25 bp, Mus musculus
tagcttgttacattagtggaattct

SEQ ID NO: 776176 - DNA, 25 bp, Mus musculus
tagcttgttagcagtgaccatcttg

SEQ ID NO: 776177 - DNA, 25 bp, Mus musculus
tagcttgttagctgtgaccatcttg

SEQ ID NO: 776178 - DNA, 25 bp, Mus musculus
tagcttgttctaaagctacctgttg

SEQ ID NO: 776179 - DNA, 25 bp, Mus musculus
tagcttgttctatagctacctgttg

SEQ ID NO: 776180 - DNA, 25 bp, Mus musculus
tagcttgtttggctccaatgactca

SEQ ID NO: 776181 - DNA, 25 bp, Mus musculus
tagcttgtttgggtccaatgactca

SEQ ID NO: 776182 - DNA, 25 bp, Mus musculus
tagctttacaagctaagtctggtct

SEQ ID NO: 776183 - DNA, 25 bp, Mus musculus
tagctttacaaggtaagtctggtct

SEQ ID NO: 776184 - DNA, 25 bp, Mus musculus
tagctttaccagcaggtttcacggg

SEQ ID NO: 776185 - DNA, 25 bp, Mus musculus
tagctttaccaggaggtttcacggg

SEQ ID NO: 776186 - DNA, 25 bp, Mus musculus
tagctttactccctagtgaccagtc

SEQ ID NO: 776187 - DNA, 25 bp, Mus musculus
tagctttactccgtagtgaccagtc

SEQ ID NO: 776188 - DNA, 25 bp, Mus musculus
tagctttacttcagtgtcccttaca

SEQ ID NO: 776189 - DNA, 25 bp, Mus musculus
tagctttacttctgtgtcccttaca

SEQ ID NO: 776190 - DNA, 25 bp, Mus musculus
tagctttatgtgcagggcgttcatt

SEQ ID NO: 776191 - DNA, 25 bp, Mus musculus
tagctttatgtggagggcgttcatt

SEQ ID NO: 776192 - DNA, 25 bp, Mus musculus
tagctttcagctctggtgccgtgca

SEQ ID NO: 776193 - DNA, 25 bp, Mus musculus
tagctttcagctgtggtgccgtgca

SEQ ID NO: 776194 - DNA, 25 bp, Mus musculus
tagctttcccaaaatccgtcatttc

SEQ ID NO: 776195 - DNA, 25 bp, Mus musculus
tagctttcccaatatccgtcatttc

SEQ ID NO: 776196 - DNA, 25 bp, Mus musculus
tagctttcctacagttctattttga

SEQ ID NO: 776197 - DNA, 25 bp, Mus musculus
tagctttcctaccagatatcacaga

SEQ ID NO: 776198 - DNA, 25 bp, Mus musculus
tagctttcctacgagatatcacaga

SEQ ID NO: 776199 - DNA, 25 bp, Mus musculus
tagctttcctactgttctattttga

SEQ ID NO: 776200 - DNA, 25 bp, Mus musculus
tagctttctctgactaagttccctt

SEQ ID NO: 776201 - DNA, 25 bp, Mus musculus
tagctttctctgtctaagttccctt

SEQ ID NO: 776202 - DNA, 25 bp, Mus musculus
tagctttctgcaccccagaagtgca

SEQ ID NO: 776203 - DNA, 25 bp, Mus musculus
tagctttctgcagcccagaagtgca

SEQ ID NO: 776204 - DNA, 25 bp, Mus musculus
tagctttctgctagtgacggttacc

SEQ ID NO: 776205 - DNA, 25 bp, Mus musculus
tagctttctgcttgtgacggttacc

SEQ ID NO: 776206 - DNA, 25 bp, Mus musculus
tagctttctgtaaccatccttgggc

SEQ ID NO: 776207 - DNA, 25 bp, Mus musculus
tagctttctgtaagactctcaaccc

SEQ ID NO: 776208 - DNA, 25 bp, Mus musculus
tagctttctgtatccatccttgggc

SEQ ID NO: 776209 - DNA, 25 bp, Mus musculus
tagctttctgtatgactctcaaccc

SEQ ID NO: 776210 - DNA, 25 bp, Mus musculus
tagctttcttggaaccacctgccta

SEQ ID NO: 776211 - DNA, 25 bp, Mus musculus
tagctttcttggtaccacctgccta

SEQ ID NO: 776212 - DNA, 25 bp, Mus musculus
tagctttgaattatctctcctgtct

SEQ ID NO: 776213 - DNA, 25 bp, Mus musculus
tagctttgaattttctctcctgtct

SEQ ID NO: 776214 - DNA, 25 bp, Mus musculus
tagctttgactactttaaaatcatg

SEQ ID NO: 776215 - DNA, 25 bp, Mus musculus
tagctttgactagtttaaaatcatg

SEQ ID NO: 776216 - DNA, 25 bp, Mus musculus
tagctttgagtcactccgtatgaat

SEQ ID NO: 776217 - DNA, 25 bp, Mus musculus
tagctttgagtctctccgtatgaat

SEQ ID NO: 776218 - DNA, 25 bp, Mus musculus
tagctttgagttctgttgtgtttct

SEQ ID NO: 776219 - DNA, 25 bp, Mus musculus
tagctttgagttgtgttgtgtttct

SEQ ID NO: 776220 - DNA, 25 bp, Mus musculus
tagctttgcatcaaccagagactgt

SEQ ID NO: 776221 - DNA, 25 bp, Mus musculus
tagctttgcatctaccagagactgt

SEQ ID NO: 776222 - DNA, 25 bp, Mus musculus
tagctttgcatgcacctgtgtgaaa

SEQ ID NO: 776223 - DNA, 25 bp, Mus musculus
tagctttgcatggacctgtgtgaaa

SEQ ID NO: 776224 - DNA, 25 bp, Mus musculus
tagctttgccctctccttaggattt

SEQ ID NO: 776225 - DNA, 25 bp, Mus musculus
tagctttgccctgtccttaggattt

SEQ ID NO: 776226 - DNA, 25 bp, Mus musculus
tagctttgctctccttttgaaccag

SEQ ID NO: 776227 - DNA, 25 bp, Mus musculus
tagctttgctctgcttttgaaccag

SEQ ID NO: 776228 - DNA, 25 bp, Mus musculus
tagctttggcacagcctgtggcatt

SEQ ID NO: 776229 - DNA, 25 bp, Mus musculus
tagctttggcactgcctgtggcatt

SEQ ID NO: 776230 - DNA, 25 bp, Mus musculus
tagctttggctacagtgacattcag

SEQ ID NO: 776231 - DNA, 25 bp, Mus musculus
tagctttggctagagtgacattcag

SEQ ID NO: 776232 - DNA, 25 bp, Mus musculus
tagctttggctgaccaagtctgaat

SEQ ID NO: 776233 - DNA, 25 bp, Mus musculus
tagctttggctgtccaagtctgaat

SEQ ID NO: 776234 - DNA, 25 bp, Mus musculus
tagctttggcttcagttgtacatga

SEQ ID NO: 776235 - DNA, 25 bp, Mus musculus
tagctttggcttgagttgtacatga

SEQ ID NO: 776236 - DNA, 25 bp, Mus musculus
tagctttgggagatcctcatttcca

SEQ ID NO: 776237 - DNA, 25 bp, Mus musculus
tagctttgggagttcctcatttcca

SEQ ID NO: 776238 - DNA, 25 bp, Mus musculus
tagctttgggtcaccttttgtcaaa

SEQ ID NO: 776239 - DNA, 25 bp, Mus musculus
tagctttgggtctccttttgtcaaa

SEQ ID NO: 776240 - DNA, 25 bp, Mus musculus
tagctttggtctcttcatgtatgcc

SEQ ID NO: 776241 - DNA, 25 bp, Mus musculus
tagctttggtctgttcatgtatgcc

SEQ ID NO: 776242 - DNA, 25 bp, Mus musculus
tagctttggtgaatcatttcccctt

SEQ ID NO: 776243 - DNA, 25 bp, Mus musculus
tagctttggtgattcatttcccctt

SEQ ID NO: 776244 - DNA, 25 bp, Mus musculus
tagctttgtcaacaactcgatgaag

SEQ ID NO: 776245 - DNA, 25 bp, Mus musculus
tagctttgtcaagaactcgatgaag

SEQ ID NO: 776246 - DNA, 25 bp, Mus musculus
tagctttgtcttagccccatgtccc

SEQ ID NO: 776247 - DNA, 25 bp, Mus musculus
tagctttgtctttgccccatgtccc

SEQ ID NO: 776248 - DNA, 25 bp, Mus musculus
tagctttgtgccatgcagcgtttga

SEQ ID NO: 776249 - DNA, 25 bp, Mus musculus
tagctttgtgccttgcagcgtttga

SEQ ID NO: 776250 - DNA, 25 bp, Mus musculus
tagcttttactaattttgtggataa

SEQ ID NO: 776251 - DNA, 25 bp, Mus musculus
tagcttttactatttttgtggataa

SEQ ID NO: 776252 - DNA, 25 bp, Mus musculus
tagcttttagtaattttccacatct

SEQ ID NO: 776253 - DNA, 25 bp, Mus musculus
tagcttttagtatttttccacatct

SEQ ID NO: 776254 - DNA, 25 bp, Mus musculus
tagcttttatctcaagtgccttaag

SEQ ID NO: 776255 - DNA, 25 bp, Mus musculus
tagcttttatctgaagtgccttaag

SEQ ID NO: 776256 - DNA, 25 bp, Mus musculus
tagcttttcctactcaacacgtttt

SEQ ID NO: 776257 - DNA, 25 bp, Mus musculus
tagcttttcctagtcaacacgtttt

SEQ ID NO: 776258 - DNA, 25 bp, Mus musculus
tagcttttcctgatcctgtgaacaa

SEQ ID NO: 776259 - DNA, 25 bp, Mus musculus
tagcttttcctgatgtgaatgtacc

SEQ ID NO: 776260 - DNA, 25 bp, Mus musculus
tagcttttcctgttcctgtgaacaa

SEQ ID NO: 776261 - DNA, 25 bp, Mus musculus
tagcttttcctgttgtgaatgtacc

SEQ ID NO: 776262 - DNA, 25 bp, Mus musculus
tagcttttccttcatgtcagtagcc

SEQ ID NO: 776263 - DNA, 25 bp, Mus musculus
tagcttttccttgatgtcagtagcc

SEQ ID NO: 776264 - DNA, 25 bp, Mus musculus
tagcttttctcaacccctaaaacta

SEQ ID NO: 776265 - DNA, 25 bp, Mus musculus
tagcttttctcatcccctaaaacta

SEQ ID NO: 776266 - DNA, 25 bp, Mus musculus
tagcttttctcccttaggcagctta

SEQ ID NO: 776267 - DNA, 25 bp, Mus musculus
tagcttttctccgttaggcagctta

SEQ ID NO: 776268 - DNA, 25 bp, Mus musculus
tagcttttctgaagtgactatactg

SEQ ID NO: 776269 - DNA, 25 bp, Mus musculus
tagcttttctgatgtgactatactg

SEQ ID NO: 776270 - DNA, 25 bp, Mus musculus
tagcttttgaggctaactccctctg

SEQ ID NO: 776271 - DNA, 25 bp, Mus musculus
tagcttttgagggtaactccctctg

SEQ ID NO: 776272 - DNA, 25 bp, Mus musculus
tagcttttggttagcttcgtcactc

SEQ ID NO: 776273 - DNA, 25 bp, Mus musculus
tagcttttggtttgcttcgtcactc

SEQ ID NO: 776274 - DNA, 25 bp, Mus musculus
tagcttttgtttacaccctggaaat

SEQ ID NO: 776275 - DNA, 25 bp, Mus musculus
tagcttttgtttataaacccacacg

SEQ ID NO: 776276 - DNA, 25 bp, Mus musculus
tagcttttgttttcaccctggaaat

SEQ ID NO: 776277 - DNA, 25 bp, Mus musculus
tagcttttgtttttaaacccacacg

SEQ ID NO: 776278 - DNA, 25 bp, Mus musculus
tagctttttattagaccagttgtga

SEQ ID NO: 776279 - DNA, 25 bp, Mus musculus
tagctttttatttgaccagttgtga

SEQ ID NO: 776280 - DNA, 25 bp, Mus musculus
tagctttttctaacttcgggtccat

SEQ ID NO: 776281 - DNA, 25 bp, Mus musculus
tagctttttctatcttcgggtccat

SEQ ID NO: 776282 - DNA, 25 bp, Mus musculus
tagctttttggtagccagccctaag

SEQ ID NO: 776283 - DNA, 25 bp, Mus musculus
tagctttttggttgccagccctaag

SEQ ID NO: 776284 - DNA, 25 bp, Mus musculus
tagcttttttctaccatctggtttg

SEQ ID NO: 776285 - DNA, 25 bp, Mus musculus
tagcttttttcttccatctggtttg

SEQ ID NO: 776286 - DNA, 25 bp, Mus musculus
taggaaaaaactcctgggtggcctt

SEQ ID NO: 776287 - DNA, 25 bp, Mus musculus
taggaaaaaactgctgggtggcctt

SEQ ID NO: 776288 - DNA, 25 bp, Mus musculus
taggaaaaatgcatcccatggaagt

SEQ ID NO: 776289 - DNA, 25 bp, Mus musculus
taggaaaaatgcttcccatggaagt

SEQ ID NO: 776290 - DNA, 25 bp, Mus musculus
taggaaaaccctctttgtagtcgtg

SEQ ID NO: 776291 - DNA, 25 bp, Mus musculus
taggaaaaccctgtttgtagtcgtg

SEQ ID NO: 776292 - DNA, 25 bp, Mus musculus
taggaaaagccccttgccagccaag

SEQ ID NO: 776293 - DNA, 25 bp, Mus musculus
taggaaaagcccgttgccagccaag

SEQ ID NO: 776294 - DNA, 25 bp, Mus musculus
taggaaaaggtgcagcatgctgaaa

SEQ ID NO: 776295 - DNA, 25 bp, Mus musculus
taggaaaaggtggagcatgctgaaa

SEQ ID NO: 776296 - DNA, 25 bp, Mus musculus
taggaaaatcccatcactacgagcc

SEQ ID NO: 776297 - DNA, 25 bp, Mus musculus
taggaaaatcccttcactacgagcc

SEQ ID NO: 776298 - DNA, 25 bp, Mus musculus
taggaaacaacccagacttcacttt

SEQ ID NO: 776299 - DNA, 25 bp, Mus musculus
taggaaacaaccgagacttcacttt

SEQ ID NO: 776300 - DNA, 25 bp, Mus musculus
taggaaacacggcaaacccatgcgg

SEQ ID NO: 776301 - DNA, 25 bp, Mus musculus
taggaaacacgggaaacccatgcgg

SEQ ID NO: 776302 - DNA, 25 bp, Mus musculus
taggaaacactcaggtctctgaact

SEQ ID NO: 776303 - DNA, 25 bp, Mus musculus
taggaaacactctggtctctgaact

SEQ ID NO: 776304 - DNA, 25 bp, Mus musculus
taggaaacagatccacccattcatt

SEQ ID NO: 776305 - DNA, 25 bp, Mus musculus
taggaaacagatgcacccattcatt

SEQ ID NO: 776306 - DNA, 25 bp, Mus musculus
taggaaacataaccttggagatccg

SEQ ID NO: 776307 - DNA, 25 bp, Mus musculus
taggaaacataagcttggagatccg

SEQ ID NO: 776308 - DNA, 25 bp, Mus musculus
taggaaaccagtctcacctttttca

SEQ ID NO: 776309 - DNA, 25 bp, Mus musculus
taggaaaccagtgtcacctttttca

SEQ ID NO: 776310 - DNA, 25 bp, Mus musculus
taggaaacccacattagttgaatgt

SEQ ID NO: 776311 - DNA, 25 bp, Mus musculus
taggaaacccactttagttgaatgt

SEQ ID NO: 776312 - DNA, 25 bp, Mus musculus
taggaaacccagatggcatgtgtat

SEQ ID NO: 776313 - DNA, 25 bp, Mus musculus
taggaaacccagttggcatgtgtat

SEQ ID NO: 776314 - DNA, 25 bp, Mus musculus
taggaaaccggacagacagtcccca

SEQ ID NO: 776315 - DNA, 25 bp, Mus musculus
taggaaaccggagagacagtcccca

SEQ ID NO: 776316 - DNA, 25 bp, Mus musculus
taggaaacctttacacacattggtg

SEQ ID NO: 776317 - DNA, 25 bp, Mus musculus
taggaaaccttttcacacattggtg

SEQ ID NO: 776318 - DNA, 25 bp, Mus musculus
taggaaacgctcacgggaggcctgt

SEQ ID NO: 776319 - DNA, 25 bp, Mus musculus
taggaaacgctctcgggaggcctgt

SEQ ID NO: 776320 - DNA, 25 bp, Mus musculus
taggaaacgtgtctccccgtgtata

SEQ ID NO: 776321 - DNA, 25 bp, Mus musculus
taggaaacgtgtgtccccgtgtata

SEQ ID NO: 776322 - DNA, 25 bp, Mus musculus
taggaaactacaagacttccgtcat

SEQ ID NO: 776323 - DNA, 25 bp, Mus musculus
taggaaactacatgacttccgtcat

SEQ ID NO: 776324 - DNA, 25 bp, Mus musculus
taggaaactcttactaccactactc

SEQ ID NO: 776325 - DNA, 25 bp, Mus musculus
taggaaactctttctaccactactc

SEQ ID NO: 776326 - DNA, 25 bp, Mus musculus
taggaaactggcctctttacaaccg

SEQ ID NO: 776327 - DNA, 25 bp, Mus musculus
taggaaactggcgtctttacaaccg

SEQ ID NO: 776328 - DNA, 25 bp, Mus musculus
taggaaactgtcatctctccatgtt

SEQ ID NO: 776329 - DNA, 25 bp, Mus musculus
taggaaactgtcttctctccatgtt

SEQ ID NO: 776330 - DNA, 25 bp, Mus musculus
taggaaagagggagcctgtccatgt

SEQ ID NO: 776331 - DNA, 25 bp, Mus musculus
taggaaagagggtgcctgtccatgt

SEQ ID NO: 776332 - DNA, 25 bp, Mus musculus
taggaaagcctcatgcattcagcca

SEQ ID NO: 776333 - DNA, 25 bp, Mus musculus
taggaaagcctcttgcattcagcca

SEQ ID NO: 776334 - DNA, 25 bp, Mus musculus
taggaaagcctgcactagaggttat

SEQ ID NO: 776335 - DNA, 25 bp, Mus musculus
taggaaagcctggactagaggttat

SEQ ID NO: 776336 - DNA, 25 bp, Mus musculus
taggaaaggcagctcagattcccca

SEQ ID NO: 776337 - DNA, 25 bp, Mus musculus
taggaaaggcaggtcagattcccca

SEQ ID NO: 776338 - DNA, 25 bp, Mus musculus
taggaaatcccaactgacctgtgcg

SEQ ID NO: 776339 - DNA, 25 bp, Mus musculus
taggaaatcccatctgacctgtgcg

SEQ ID NO: 776340 - DNA, 25 bp, Mus musculus
taggaaatcctactagcaagctggc

SEQ ID NO: 776341 - DNA, 25 bp, Mus musculus
taggaaatcctagtagcaagctggc

SEQ ID NO: 776342 - DNA, 25 bp, Mus musculus
taggaaatgaccaccaagccagtaa

SEQ ID NO: 776343 - DNA, 25 bp, Mus musculus
taggaaatgacctccaagccagtaa

SEQ ID NO: 776344 - DNA, 25 bp, Mus musculus
taggaaatgcacctcggagaaatta

SEQ ID NO: 776345 - DNA, 25 bp, Mus musculus
taggaaatgcacgtcggagaaatta

SEQ ID NO: 776346 - DNA, 25 bp, Mus musculus
taggaaatgcctacttccattccaa

SEQ ID NO: 776347 - DNA, 25 bp, Mus musculus
taggaaatgccttcttccattccaa

SEQ ID NO: 776348 - DNA, 25 bp, Mus musculus
taggaaatgctgaactgctcactag

SEQ ID NO: 776349 - DNA, 25 bp, Mus musculus
taggaaatgctgtactgctcactag

SEQ ID NO: 776350 - DNA, 25 bp, Mus musculus
taggaaatgtctccgacccagcttg

SEQ ID NO: 776351 - DNA, 25 bp, Mus musculus
taggaaatgtctgcgacccagcttg

SEQ ID NO: 776352 - DNA, 25 bp, Mus musculus
taggaaatgtgcaaatgagatccaa

SEQ ID NO: 776353 - DNA, 25 bp, Mus musculus
taggaaatgtgctaatgagatccaa

SEQ ID NO: 776354 - DNA, 25 bp, Mus musculus
taggaaatttgacgccccgactctg

SEQ ID NO: 776355 - DNA, 25 bp, Mus musculus
taggaaatttgaggccccgactctg

SEQ ID NO: 776356 - DNA, 25 bp, Mus musculus
taggaacacatgctcgatggcaggt

SEQ ID NO: 776357 - DNA, 25 bp, Mus musculus
taggaacacatggtcgatggcaggt

SEQ ID NO: 776358 - DNA, 25 bp, Mus musculus
taggaacaccaaccgccatgctagt

SEQ ID NO: 776359 - DNA, 25 bp, Mus musculus
taggaacaccaagcgccatgctagt

SEQ ID NO: 776360 - DNA, 25 bp, Mus musculus
taggaacacctgagtcccttggtaa

SEQ ID NO: 776361 - DNA, 25 bp, Mus musculus
taggaacacctgtgtcccttggtaa

SEQ ID NO: 776362 - DNA, 25 bp, Mus musculus
taggaacactctcttttgccagcaa

SEQ ID NO: 776363 - DNA, 25 bp, Mus musculus
taggaacactctgttttgccagcaa

SEQ ID NO: 776364 - DNA, 25 bp, Mus musculus
taggaacagaaaaccgacctgcagt

SEQ ID NO: 776365 - DNA, 25 bp, Mus musculus
taggaacagaaatccgacctgcagt

SEQ ID NO: 776366 - DNA, 25 bp, Mus musculus
taggaacagacaacgggcctgggct

SEQ ID NO: 776367 - DNA, 25 bp, Mus musculus
taggaacagacatcgggcctgggct

SEQ ID NO: 776368 - DNA, 25 bp, Mus musculus
taggaacagtttaaagagtctcagt

SEQ ID NO: 776369 - DNA, 25 bp, Mus musculus
taggaacagttttaagagtctcagt

SEQ ID NO: 776370 - DNA, 25 bp, Mus musculus
taggaacatctcacagtttctcacc

SEQ ID NO: 776371 - DNA, 25 bp, Mus musculus
taggaacatctctcagtttctcacc

SEQ ID NO: 776372 - DNA, 25 bp, Mus musculus
taggaacattgcagtgcacgccact

SEQ ID NO: 776373 - DNA, 25 bp, Mus musculus
taggaacattgctgtgcacgccact

SEQ ID NO: 776374 - DNA, 25 bp, Mus musculus
taggaaccaaccaacctgccattgg

SEQ ID NO: 776375 - DNA, 25 bp, Mus musculus
taggaaccaacctacctgccattgg

SEQ ID NO: 776376 - DNA, 25 bp, Mus musculus
taggaaccaagccacccaggttact

SEQ ID NO: 776377 - DNA, 25 bp, Mus musculus
taggaaccaagcgacccaggttact

SEQ ID NO: 776378 - DNA, 25 bp, Mus musculus
taggaaccactccattctaggaagt

SEQ ID NO: 776379 - DNA, 25 bp, Mus musculus
taggaaccactcgattctaggaagt

SEQ ID NO: 776380 - DNA, 25 bp, Mus musculus
taggaaccacttaaccttcaaggag

SEQ ID NO: 776381 - DNA, 25 bp, Mus musculus
taggaaccactttaccttcaaggag

SEQ ID NO: 776382 - DNA, 25 bp, Mus musculus
taggaacccacaaagcctacctaca

SEQ ID NO: 776383 - DNA, 25 bp, Mus musculus
taggaacccacatagcctacctaca

SEQ ID NO: 776384 - DNA, 25 bp, Mus musculus
taggaacccagaagccaccttctga

SEQ ID NO: 776385 - DNA, 25 bp, Mus musculus
taggaacccagatgccaccttctga

SEQ ID NO: 776386 - DNA, 25 bp, Mus musculus
taggaaccccagaaatgatgacaaa

SEQ ID NO: 776387 - DNA, 25 bp, Mus musculus
taggaaccccagagctgagttgttt

SEQ ID NO: 776388 - DNA, 25 bp, Mus musculus
taggaaccccagtaatgatgacaaa

SEQ ID NO: 776389 - DNA, 25 bp, Mus musculus
taggaaccccagtgctgagttgttt

SEQ ID NO: 776390 - DNA, 25 bp, Mus musculus
taggaaccctagagaagctcaccca

SEQ ID NO: 776391 - DNA, 25 bp, Mus musculus
taggaaccctagtgaagctcaccca

SEQ ID NO: 776392 - DNA, 25 bp, Mus musculus
taggaaccctggagtggactggcca

SEQ ID NO: 776393 - DNA, 25 bp, Mus musculus
taggaaccctggtgtggactggcca

SEQ ID NO: 776394 - DNA, 25 bp, Mus musculus
taggaaccgagaagtacggccagca

SEQ ID NO: 776395 - DNA, 25 bp, Mus musculus
taggaaccgagatgtacggccagca

SEQ ID NO: 776396 - DNA, 25 bp, Mus musculus
taggaacctataacagagcgtatgt

SEQ ID NO: 776397 - DNA, 25 bp, Mus musculus
taggaacctatatcagagcgtatgt

SEQ ID NO: 776398 - DNA, 25 bp, Mus musculus
taggaacctgccacatttggttttg

SEQ ID NO: 776399 - DNA, 25 bp, Mus musculus
taggaacctgcctcatttggttttg

SEQ ID NO: 776400 - DNA, 25 bp, Mus musculus
taggaaccttgcacatgggaacaga

SEQ ID NO: 776401 - DNA, 25 bp, Mus musculus
taggaaccttgctcatgggaacaga

SEQ ID NO: 776402 - DNA, 25 bp, Mus musculus
taggaaccttggagtgtacaaatgt

SEQ ID NO: 776403 - DNA, 25 bp, Mus musculus
taggaaccttggtgtgtacaaatgt

SEQ ID NO: 776404 - DNA, 25 bp, Mus musculus
taggaacgcacccatacaaaaggct

SEQ ID NO: 776405 - DNA, 25 bp, Mus musculus
taggaacgcaccgatacaaaaggct

SEQ ID NO: 776406 - DNA, 25 bp, Mus musculus
taggaacgcccgctgctgtagaaca

SEQ ID NO: 776407 - DNA, 25 bp, Mus musculus
taggaacgcccggtgctgtagaaca

SEQ ID NO: 776408 - DNA, 25 bp, Mus musculus
taggaacgctgcaacctgggtataa

SEQ ID NO: 776409 - DNA, 25 bp, Mus musculus
taggaacgctgctacctgggtataa

SEQ ID NO: 776410 - DNA, 25 bp, Mus musculus
taggaacggataacttccccgattg

SEQ ID NO: 776411 - DNA, 25 bp, Mus musculus
taggaacggatatcttccccgattg

SEQ ID NO: 776412 - DNA, 25 bp, Mus musculus
taggaacggcccagagtaggatgca

SEQ ID NO: 776413 - DNA, 25 bp, Mus musculus
taggaacggccctgagtaggatgca

SEQ ID NO: 776414 - DNA, 25 bp, Mus musculus
taggaacgtgtcagatgggagccat

SEQ ID NO: 776415 - DNA, 25 bp, Mus musculus
taggaacgtgtctgatgggagccat

SEQ ID NO: 776416 - DNA, 25 bp, Mus musculus
taggaactatctcgacctcttcatt

SEQ ID NO: 776417 - DNA, 25 bp, Mus musculus
taggaactatctggacctcttcatt

SEQ ID NO: 776418 - DNA, 25 bp, Mus musculus
taggaactatgtacagaacccagag

SEQ ID NO: 776419 - DNA, 25 bp, Mus musculus
taggaactatgttcagaacccagag

SEQ ID NO: 776420 - DNA, 25 bp, Mus musculus
taggaactccataaactccagcatg

SEQ ID NO: 776421 - DNA, 25 bp, Mus musculus
taggaactccattaactccagcatg

SEQ ID NO: 776422 - DNA, 25 bp, Mus musculus
taggaactcctaaggaactcactta

SEQ ID NO: 776423 - DNA, 25 bp, Mus musculus
taggaactcctatggaactcactta

SEQ ID NO: 776424 - DNA, 25 bp, Mus musculus
taggaactcgacatccctaatcatc

SEQ ID NO: 776425 - DNA, 25 bp, Mus musculus
taggaactcgacttccctaatcatc

SEQ ID NO: 776426 - DNA, 25 bp, Mus musculus
taggaactctgacccatgcgggagc

SEQ ID NO: 776427 - DNA, 25 bp, Mus musculus
taggaactctgagccatgcgggagc

SEQ ID NO: 776428 - DNA, 25 bp, Mus musculus
taggaactctttcgtagtccttttg

SEQ ID NO: 776429 - DNA, 25 bp, Mus musculus
taggaactctttggtagtccttttg

SEQ ID NO: 776430 - DNA, 25 bp, Mus musculus
taggaactgaggacttcagtccttt

SEQ ID NO: 776431 - DNA, 25 bp, Mus musculus
taggaactgaggtcttcagtccttt

SEQ ID NO: 776432 - DNA, 25 bp, Mus musculus
taggaactgggaataacgttttctg

SEQ ID NO: 776433 - DNA, 25 bp, Mus musculus
taggaactgggattaacgttttctg

SEQ ID NO: 776434 - DNA, 25 bp, Mus musculus
taggaacttagactcccagcttggg

SEQ ID NO: 776435 - DNA, 25 bp, Mus musculus
taggaacttagagtcccagcttggg

SEQ ID NO: 776436 - DNA, 25 bp, Mus musculus
taggaagaaactctacctgccgctc

SEQ ID NO: 776437 - DNA, 25 bp, Mus musculus
taggaagaaactgtacctgccgctc

SEQ ID NO: 776438 - DNA, 25 bp, Mus musculus
taggaagaaatgcacgttccaatct

SEQ ID NO: 776439 - DNA, 25 bp, Mus musculus
taggaagaaatggacgttccaatct

SEQ ID NO: 776440 - DNA, 25 bp, Mus musculus
taggaagaagcacaccgttttggtt

SEQ ID NO: 776441 - DNA, 25 bp, Mus musculus
taggaagaagcagaccgttttggtt

SEQ ID NO: 776442 - DNA, 25 bp, Mus musculus
taggaagaatccacaccacgaccat

SEQ ID NO: 776443 - DNA, 25 bp, Mus musculus
taggaagaatcctcaccacgaccat

SEQ ID NO: 776444 - DNA, 25 bp, Mus musculus
taggaagacactcaacaacgacatt

SEQ ID NO: 776445 - DNA, 25 bp, Mus musculus
taggaagacactgaacaacgacatt

SEQ ID NO: 776446 - DNA, 25 bp, Mus musculus
taggaagacttcacaacacccctag

SEQ ID NO: 776447 - DNA, 25 bp, Mus musculus
taggaagacttctcaacacccctag

SEQ ID NO: 776448 - DNA, 25 bp, Mus musculus
taggaagagcaccatatccaattgg

SEQ ID NO: 776449 - DNA, 25 bp, Mus musculus
taggaagagcacgatatccaattgg

SEQ ID NO: 776450 - DNA, 25 bp, Mus musculus
taggaagagcctactctaccctggc

SEQ ID NO: 776451 - DNA, 25 bp, Mus musculus
taggaagagccttctctaccctggc

SEQ ID NO: 776452 - DNA, 25 bp, Mus musculus
taggaagagctcaagcccctagcta

SEQ ID NO: 776453 - DNA, 25 bp, Mus musculus
taggaagagctctagcccctagcta

SEQ ID NO: 776454 - DNA, 25 bp, Mus musculus
taggaagatctcacttcgagctcca

SEQ ID NO: 776455 - DNA, 25 bp, Mus musculus
taggaagatctctcttcgagctcca

SEQ ID NO: 776456 - DNA, 25 bp, Mus musculus
taggaagattccacagtagctgctg

SEQ ID NO: 776457 - DNA, 25 bp, Mus musculus
taggaagattcctcagtagctgctg

SEQ ID NO: 776458 - DNA, 25 bp, Mus musculus
taggaagcagcaaccagtgccgtag

SEQ ID NO: 776459 - DNA, 25 bp, Mus musculus
taggaagcagcatccagtgccgtag

SEQ ID NO: 776460 - DNA, 25 bp, Mus musculus
taggaagcatagatgccgtccgttc

SEQ ID NO: 776461 - DNA, 25 bp, Mus musculus
taggaagcatagttgccgtccgttc

SEQ ID NO: 776462 - DNA, 25 bp, Mus musculus
taggaagccaccatcccgcttgtgg

SEQ ID NO: 776463 - DNA, 25 bp, Mus musculus
taggaagccaccttcccgcttgtgg

SEQ ID NO: 776464 - DNA, 25 bp, Mus musculus
taggaagccagacgtaccaaaaaga

SEQ ID NO: 776465 - DNA, 25 bp, Mus musculus
taggaagccagaggtaccaaaaaga

SEQ ID NO: 776466 - DNA, 25 bp, Mus musculus
taggaagccccaccgccaaaggagg

SEQ ID NO: 776467 - DNA, 25 bp, Mus musculus
taggaagccccagcgccaaaggagg

SEQ ID NO: 776468 - DNA, 25 bp, Mus musculus
taggaagccctcaggaagccatgct

SEQ ID NO: 776469 - DNA, 25 bp, Mus musculus
taggaagccctctggaagccatgct

SEQ ID NO: 776470 - DNA, 25 bp, Mus musculus
taggaagcccttcggatcctcctga

SEQ ID NO: 776471 - DNA, 25 bp, Mus musculus
taggaagcccttgggatcctcctga

SEQ ID NO: 776472 - DNA, 25 bp, Mus musculus
taggaagcctcgactcttatcccga

SEQ ID NO: 776473 - DNA, 25 bp, Mus musculus
taggaagcctcgtctcttatcccga

SEQ ID NO: 776474 - DNA, 25 bp, Mus musculus
taggaagcgtcccaaagccattcaa

SEQ ID NO: 776475 - DNA, 25 bp, Mus musculus
taggaagcgtccgaaagccattcaa

SEQ ID NO: 776476 - DNA, 25 bp, Mus musculus
taggaagctgaaatcctcatccctt

SEQ ID NO: 776477 - DNA, 25 bp, Mus musculus
taggaagctgaattcctcatccctt

SEQ ID NO: 776478 - DNA, 25 bp, Mus musculus
taggaagcttaaaaaagtgtgcctc

SEQ ID NO: 776479 - DNA, 25 bp, Mus musculus
taggaagcttaataaagtgtgcctc

SEQ ID NO: 776480 - DNA, 25 bp, Mus musculus
taggaaggagccagagtcctctgca

SEQ ID NO: 776481 - DNA, 25 bp, Mus musculus
taggaaggagcctgagtcctctgca

SEQ ID NO: 776482 - DNA, 25 bp, Mus musculus
taggaaggccataatcaacttgggt

SEQ ID NO: 776483 - DNA, 25 bp, Mus musculus
taggaaggccattatcaacttgggt

SEQ ID NO: 776484 - DNA, 25 bp, Mus musculus
taggaaggctccattaccagttctc

SEQ ID NO: 776485 - DNA, 25 bp, Mus musculus
taggaaggctcctttaccagttctc

SEQ ID NO: 776486 - DNA, 25 bp, Mus musculus
taggaaggtcccattgcagccctcc

SEQ ID NO: 776487 - DNA, 25 bp, Mus musculus
taggaaggtccctttgcagccctcc

SEQ ID NO: 776488 - DNA, 25 bp, Mus musculus
taggaaggtcggctatttggcaaat

SEQ ID NO: 776489 - DNA, 25 bp, Mus musculus
taggaaggtcgggtatttggcaaat

SEQ ID NO: 776490 - DNA, 25 bp, Mus musculus
taggaaggtggaaaagtgttgctct

SEQ ID NO: 776491 - DNA, 25 bp, Mus musculus
taggaaggtggataagtgttgctct

SEQ ID NO: 776492 - DNA, 25 bp, Mus musculus
taggaagtcaacacatgcaagcgat

SEQ ID NO: 776493 - DNA, 25 bp, Mus musculus
taggaagtcaactcatgcaagcgat

SEQ ID NO: 776494 - DNA, 25 bp, Mus musculus
taggaagtccccataaagcacgccg

SEQ ID NO: 776495 - DNA, 25 bp, Mus musculus
taggaagtccccttaaagcacgccg

SEQ ID NO: 776496 - DNA, 25 bp, Mus musculus
taggaagtctttacacgcctcaggt

SEQ ID NO: 776497 - DNA, 25 bp, Mus musculus
taggaagtcttttcacgcctcaggt

SEQ ID NO: 776498 - DNA, 25 bp, Mus musculus
taggaagtgctccttggccccaaac

SEQ ID NO: 776499 - DNA, 25 bp, Mus musculus
taggaagtgctcgttggccccaaac

SEQ ID NO: 776500 - DNA, 25 bp, Mus musculus
taggaagtgtaaccgctttcccagc

SEQ ID NO: 776501 - DNA, 25 bp, Mus musculus
taggaagtgtaagcgctttcccagc

SEQ ID NO: 776502 - DNA, 25 bp, Mus musculus
taggaagtttatcctgcctccccta

SEQ ID NO: 776503 - DNA, 25 bp, Mus musculus
taggaagtttatgctgcctccccta

SEQ ID NO: 776504 - DNA, 25 bp, Mus musculus
taggaataaaggctcccgtcacact

SEQ ID NO: 776505 - DNA, 25 bp, Mus musculus
taggaataaagggtcccgtcacact

SEQ ID NO: 776506 - DNA, 25 bp, Mus musculus
taggaataacttccatgggttccat

SEQ ID NO: 776507 - DNA, 25 bp, Mus musculus
taggaataacttgcatgggttccat

SEQ ID NO: 776508 - DNA, 25 bp, Mus musculus
taggaatagggtcctgccctgtcgt

SEQ ID NO: 776509 - DNA, 25 bp, Mus musculus
taggaatagggtgctgccctgtcgt

SEQ ID NO: 776510 - DNA, 25 bp, Mus musculus
taggaatattgccacccttagctgg

SEQ ID NO: 776511 - DNA, 25 bp, Mus musculus
taggaatattgcgacccttagctgg

SEQ ID NO: 776512 - DNA, 25 bp, Mus musculus
taggaatcgattagacagccccaag

SEQ ID NO: 776513 - DNA, 25 bp, Mus musculus
taggaatcgatttgacagccccaag

SEQ ID NO: 776514 - DNA, 25 bp, Mus musculus
taggaatctctgaaagtctggctgc

SEQ ID NO: 776515 - DNA, 25 bp, Mus musculus
taggaatctctgtaagtctggctgc

SEQ ID NO: 776516 - DNA, 25 bp, Mus musculus
taggaatctgctcggaactcactga

SEQ ID NO: 776517 - DNA, 25 bp, Mus musculus
taggaatctgctgggaactcactga

SEQ ID NO: 776518 - DNA, 25 bp, Mus musculus
taggaatgaaacagcctgctgtgtc

SEQ ID NO: 776519 - DNA, 25 bp, Mus musculus
taggaatgaaactgcctgctgtgtc

SEQ ID NO: 776520 - DNA, 25 bp, Mus musculus
taggaatgataaaaaggctggcttt

SEQ ID NO: 776521 - DNA, 25 bp, Mus musculus
taggaatgataataaggctggcttt

SEQ ID NO: 776522 - DNA, 25 bp, Mus musculus
taggaatgatgtcaggctgtcagca

SEQ ID NO: 776523 - DNA, 25 bp, Mus musculus
taggaatgatgtgaggctgtcagca

SEQ ID NO: 776524 - DNA, 25 bp, Mus musculus
taggaatgcacaaggcgcgcacaca

SEQ ID NO: 776525 - DNA, 25 bp, Mus musculus
taggaatgcacatggcgcgcacaca

SEQ ID NO: 776526 - DNA, 25 bp, Mus musculus
taggaatgccctcctatttcagcat

SEQ ID NO: 776527 - DNA, 25 bp, Mus musculus
taggaatgccctgctatttcagcat

SEQ ID NO: 776528 - DNA, 25 bp, Mus musculus
taggaatgcctgcatttgtcacccc

SEQ ID NO: 776529 - DNA, 25 bp, Mus musculus
taggaatgcctggatttgtcacccc

SEQ ID NO: 776530 - DNA, 25 bp, Mus musculus
taggaatggctcacatgggctcata

SEQ ID NO: 776531 - DNA, 25 bp, Mus musculus
taggaatggctctcatgggctcata

SEQ ID NO: 776532 - DNA, 25 bp, Mus musculus
taggaatgggcccttgtgctccctg

SEQ ID NO: 776533 - DNA, 25 bp, Mus musculus
taggaatgggccgttgtgctccctg

SEQ ID NO: 776534 - DNA, 25 bp, Mus musculus
taggaatggtccactgggctgtttc

SEQ ID NO: 776535 - DNA, 25 bp, Mus musculus
taggaatggtcctctgggctgtttc

SEQ ID NO: 776536 - DNA, 25 bp, Mus musculus
taggaatggtgcacccctgttgcgg

SEQ ID NO: 776537 - DNA, 25 bp, Mus musculus
taggaatggtgctcccctgttgcgg

SEQ ID NO: 776538 - DNA, 25 bp, Mus musculus
taggaattctcaacagtggaagatc

SEQ ID NO: 776539 - DNA, 25 bp, Mus musculus
taggaattctcatcagtggaagatc

SEQ ID NO: 776540 - DNA, 25 bp, Mus musculus
taggaattggagactgaagaacccc

SEQ ID NO: 776541 - DNA, 25 bp, Mus musculus
taggaattggagtctgaagaacccc

SEQ ID NO: 776542 - DNA, 25 bp, Mus musculus
taggaattggtgagcccttgactta

SEQ ID NO: 776543 - DNA, 25 bp, Mus musculus
taggaattggtgtgcccttgactta

SEQ ID NO: 776544 - DNA, 25 bp, Mus musculus
taggaatttataaggcaagttggac

SEQ ID NO: 776545 - DNA, 25 bp, Mus musculus
taggaatttatatggcaagttggac

SEQ ID NO: 776546 - DNA, 25 bp, Mus musculus
taggaattttcgacttgtcttcttc

SEQ ID NO: 776547 - DNA, 25 bp, Mus musculus
taggaattttcgtcttgtcttcttc

SEQ ID NO: 776548 - DNA, 25 bp, Mus musculus
taggaattttctacgggactccagt

SEQ ID NO: 776549 - DNA, 25 bp, Mus musculus
taggaattttcttcgggactccagt

SEQ ID NO: 776550 - DNA, 25 bp, Mus musculus
taggacaacttgaggctccttgctc

SEQ ID NO: 776551 - DNA, 25 bp, Mus musculus
taggacaacttgtggctccttgctc

SEQ ID NO: 776552 - DNA, 25 bp, Mus musculus
taggacaactttacgcagaggcaga

SEQ ID NO: 776553 - DNA, 25 bp, Mus musculus
taggacaacttttcgcagaggcaga

SEQ ID NO: 776554 - DNA, 25 bp, Mus musculus
taggacaagaatagtgccatgagtt

SEQ ID NO: 776555 - DNA, 25 bp, Mus musculus
taggacaagaattgtgccatgagtt

SEQ ID NO: 776556 - DNA, 25 bp, Mus musculus
taggacacacaacgctcggcctgaa

SEQ ID NO: 776557 - DNA, 25 bp, Mus musculus
taggacacacaaggctcggcctgaa

SEQ ID NO: 776558 - DNA, 25 bp, Mus musculus
taggacacacggagctttcccatca

SEQ ID NO: 776559 - DNA, 25 bp, Mus musculus
taggacacacggtgctttcccatca

SEQ ID NO: 776560 - DNA, 25 bp, Mus musculus
taggacacctttcatcatcctcagg

SEQ ID NO: 776561 - DNA, 25 bp, Mus musculus
taggacacctttgatcatcctcagg

SEQ ID NO: 776562 - DNA, 25 bp, Mus musculus
taggacacgtagcacatcttgacaa

SEQ ID NO: 776563 - DNA, 25 bp, Mus musculus
taggacacgtaggacatcttgacaa

SEQ ID NO: 776564 - DNA, 25 bp, Mus musculus
taggacacgtgtcatgcctttctgt

SEQ ID NO: 776565 - DNA, 25 bp, Mus musculus
taggacacgtgtgatgcctttctgt

SEQ ID NO: 776566 - DNA, 25 bp, Mus musculus
taggacactatgagggtagaacccc

SEQ ID NO: 776567 - DNA, 25 bp, Mus musculus
taggacactatgtgggtagaacccc

SEQ ID NO: 776568 - DNA, 25 bp, Mus musculus
taggacagaaacaagatctccctcc

SEQ ID NO: 776569 - DNA, 25 bp, Mus musculus
taggacagaaactagatctccctcc

SEQ ID NO: 776570 - DNA, 25 bp, Mus musculus
taggacagacgtatgctatgaacga

SEQ ID NO: 776571 - DNA, 25 bp, Mus musculus
taggacagacgtttgctatgaacga

SEQ ID NO: 776572 - DNA, 25 bp, Mus musculus
taggacagatctctgtcacccctga

SEQ ID NO: 776573 - DNA, 25 bp, Mus musculus
taggacagatctgtgtcacccctga

SEQ ID NO: 776574 - DNA, 25 bp, Mus musculus
taggacagcctaaaacccagcttgt

SEQ ID NO: 776575 - DNA, 25 bp, Mus musculus
taggacagcctataacccagcttgt

SEQ ID NO: 776576 - DNA, 25 bp, Mus musculus
taggacagctctaccctcgtcttca

SEQ ID NO: 776577 - DNA, 25 bp, Mus musculus
taggacagctcttccctcgtcttca

SEQ ID NO: 776578 - DNA, 25 bp, Mus musculus
taggacagctttcagtgtagcccaa

SEQ ID NO: 776579 - DNA, 25 bp, Mus musculus
taggacagctttgagtgtagcccaa

SEQ ID NO: 776580 - DNA, 25 bp, Mus musculus
taggacagtcaccaccttgtaaatg

SEQ ID NO: 776581 - DNA, 25 bp, Mus musculus
taggacagtcacgaccttgtaaatg

SEQ ID NO: 776582 - DNA, 25 bp, Mus musculus
taggacagtttgctaatctttatgc

SEQ ID NO: 776583 - DNA, 25 bp, Mus musculus
taggacagtttggtaatctttatgc

SEQ ID NO: 776584 - DNA, 25 bp, Mus musculus
taggacatccctaataacacggcct

SEQ ID NO: 776585 - DNA, 25 bp, Mus musculus
taggacatcccttataacacggcct

SEQ ID NO: 776586 - DNA, 25 bp, Mus musculus
taggacatcctcctcacatgaatgt

SEQ ID NO: 776587 - DNA, 25 bp, Mus musculus
taggacatcctcgtcacatgaatgt

SEQ ID NO: 776588 - DNA, 25 bp, Mus musculus
taggacatctctccccagggtggta

SEQ ID NO: 776589 - DNA, 25 bp, Mus musculus
taggacatctctgcccagggtggta

SEQ ID NO: 776590 - DNA, 25 bp, Mus musculus
taggacatgaagctctggcagccct

SEQ ID NO: 776591 - DNA, 25 bp, Mus musculus
taggacatgaaggtctggcagccct

SEQ ID NO: 776592 - DNA, 25 bp, Mus musculus
taggacatgcctctggaacaacttt

SEQ ID NO: 776593 - DNA, 25 bp, Mus musculus
taggacatgcctgtggaacaacttt

SEQ ID NO: 776594 - DNA, 25 bp, Mus musculus
taggacattcaacacggccttcagt

SEQ ID NO: 776595 - DNA, 25 bp, Mus musculus
taggacattcaagacggccttcagt

SEQ ID NO: 776596 - DNA, 25 bp, Mus musculus
taggacattctcacagcatccgatg

SEQ ID NO: 776597 - DNA, 25 bp, Mus musculus
taggacattctctcagcatccgatg

SEQ ID NO: 776598 - DNA, 25 bp, Mus musculus
taggacattgaaataattccagata

SEQ ID NO: 776599 - DNA, 25 bp, Mus musculus
taggacattgaattaattccagata

SEQ ID NO: 776600 - DNA, 25 bp, Mus musculus
taggacattgacctgtatctggtgg

SEQ ID NO: 776601 - DNA, 25 bp, Mus musculus
taggacattgacgtgtatctggtgg

SEQ ID NO: 776602 - DNA, 25 bp, Mus musculus
taggacattgggatttcagggtaca

SEQ ID NO: 776603 - DNA, 25 bp, Mus musculus
taggacattgggttttcagggtaca

SEQ ID NO: 776604 - DNA, 25 bp, Mus musculus
taggacattttaatcagtgtgtgtg

SEQ ID NO: 776605 - DNA, 25 bp, Mus musculus
taggacattttattcagtgtgtgtg

SEQ ID NO: 776606 - DNA, 25 bp, Mus musculus
taggaccaactgcaagttaatgtgg

SEQ ID NO: 776607 - DNA, 25 bp, Mus musculus
taggaccaactggaagttaatgtgg

SEQ ID NO: 776608 - DNA, 25 bp, Mus musculus
taggaccacaagctagtgcagccat

SEQ ID NO: 776609 - DNA, 25 bp, Mus musculus
taggaccacaaggtagtgcagccat

SEQ ID NO: 776610 - DNA, 25 bp, Mus musculus
taggaccacctgctacaagactgct

SEQ ID NO: 776611 - DNA, 25 bp, Mus musculus
taggaccacctggtacaagactgct

SEQ ID NO: 776612 - DNA, 25 bp, Mus musculus
taggaccactcccttttaccagctt

SEQ ID NO: 776613 - DNA, 25 bp, Mus musculus
taggaccactccgttttaccagctt

SEQ ID NO: 776614 - DNA, 25 bp, Mus musculus
taggaccagcccactgataggttat

SEQ ID NO: 776615 - DNA, 25 bp, Mus musculus
taggaccagccctctgataggttat

SEQ ID NO: 776616 - DNA, 25 bp, Mus musculus
taggaccagctcatcgaacacagag

SEQ ID NO: 776617 - DNA, 25 bp, Mus musculus
taggaccagctcttcgaacacagag

SEQ ID NO: 776618 - DNA, 25 bp, Mus musculus
taggaccagggccagaacgtctcca

SEQ ID NO: 776619 - DNA, 25 bp, Mus musculus
taggaccagggcgagaacgtctcca

SEQ ID NO: 776620 - DNA, 25 bp, Mus musculus
taggaccaggtcaacaatgtacatt

SEQ ID NO: 776621 - DNA, 25 bp, Mus musculus
taggaccaggtctacaatgtacatt

SEQ ID NO: 776622 - DNA, 25 bp, Mus musculus
taggaccaggtgcaaaaagcacctt

SEQ ID NO: 776623 - DNA, 25 bp, Mus musculus
taggaccaggtggaaaaagcacctt

SEQ ID NO: 776624 - DNA, 25 bp, Mus musculus
taggaccatctcagggtggaacatt

SEQ ID NO: 776625 - DNA, 25 bp, Mus musculus
taggaccatctctgggtggaacatt

SEQ ID NO: 776626 - DNA, 25 bp, Mus musculus
taggacccaaggagcctttgcatca

SEQ ID NO: 776627 - DNA, 25 bp, Mus musculus
taggacccaaggtgcctttgcatca

SEQ ID NO: 776628 - DNA, 25 bp, Mus musculus
taggacccaattaagcagtccgttt

SEQ ID NO: 776629 - DNA, 25 bp, Mus musculus
taggacccaattccttggcttctca

SEQ ID NO: 776630 - DNA, 25 bp, Mus musculus
taggacccaattgcttggcttctca

SEQ ID NO: 776631 - DNA, 25 bp, Mus musculus
taggacccaatttagcagtccgttt

SEQ ID NO: 776632 - DNA, 25 bp, Mus musculus
taggacccactaatacagtgctgct

SEQ ID NO: 776633 - DNA, 25 bp, Mus musculus
taggacccactattacagtgctgct

SEQ ID NO: 776634 - DNA, 25 bp, Mus musculus
taggacccaggcaagttctgtcaga

SEQ ID NO: 776635 - DNA, 25 bp, Mus musculus
taggacccaggctagttctgtcaga

SEQ ID NO: 776636 - DNA, 25 bp, Mus musculus
taggaccccggtccatactggagag

SEQ ID NO: 776637 - DNA, 25 bp, Mus musculus
taggaccccggtgcatactggagag

SEQ ID NO: 776638 - DNA, 25 bp, Mus musculus
taggaccctcagatacagacattat

SEQ ID NO: 776639 - DNA, 25 bp, Mus musculus
taggaccctcagttacagacattat

SEQ ID NO: 776640 - DNA, 25 bp, Mus musculus
taggaccctctgaagacttcacatc

SEQ ID NO: 776641 - DNA, 25 bp, Mus musculus
taggaccctctgtagacttcacatc

SEQ ID NO: 776642 - DNA, 25 bp, Mus musculus
taggaccgattcatagccatacctc

SEQ ID NO: 776643 - DNA, 25 bp, Mus musculus
taggaccgattcttagccatacctc

SEQ ID NO: 776644 - DNA, 25 bp, Mus musculus
taggaccgcggtactattttgttgg

SEQ ID NO: 776645 - DNA, 25 bp, Mus musculus
taggaccgcggttctattttgttgg

SEQ ID NO: 776646 - DNA, 25 bp, Mus musculus
taggacctacgaatctgtggcccaa

SEQ ID NO: 776647 - DNA, 25 bp, Mus musculus
taggacctacgattctgtggcccaa

SEQ ID NO: 776648 - DNA, 25 bp, Mus musculus
taggacctataccattcttctctct

SEQ ID NO: 776649 - DNA, 25 bp, Mus musculus
taggacctatacgattcttctctct

SEQ ID NO: 776650 - DNA, 25 bp, Mus musculus
taggacctcaccaccatcgcctggg

SEQ ID NO: 776651 - DNA, 25 bp, Mus musculus
taggacctcacctccatcgcctggg

SEQ ID NO: 776652 - DNA, 25 bp, Mus musculus
taggacctgcagcacaatgtcatta

SEQ ID NO: 776653 - DNA, 25 bp, Mus musculus
taggacctgcaggacaatgtcatta

SEQ ID NO: 776654 - DNA, 25 bp, Mus musculus
taggacctggcacacataggcgctt

SEQ ID NO: 776655 - DNA, 25 bp, Mus musculus
taggacctggcagacataggcgctt

SEQ ID NO: 776656 - DNA, 25 bp, Mus musculus
taggacctggttccaaggaaccctt

SEQ ID NO: 776657 - DNA, 25 bp, Mus musculus
taggacctggttgcaaggaaccctt

SEQ ID NO: 776658 - DNA, 25 bp, Mus musculus
taggaccttgacaacatggatagac

SEQ ID NO: 776659 - DNA, 25 bp, Mus musculus
taggaccttgactacatggatagac

SEQ ID NO: 776660 - DNA, 25 bp, Mus musculus
taggaccttggactaacatcagcaa

SEQ ID NO: 776661 - DNA, 25 bp, Mus musculus
taggaccttggagtaacatcagcaa

SEQ ID NO: 776662 - DNA, 25 bp, Mus musculus
taggacctttagactctgaaatctg

SEQ ID NO: 776663 - DNA, 25 bp, Mus musculus
taggacctttagtctctgaaatctg

SEQ ID NO: 776664 - DNA, 25 bp, Mus musculus
taggacgcggctaaaacttggccaa

SEQ ID NO: 776665 - DNA, 25 bp, Mus musculus
taggacgcggcttaaacttggccaa

SEQ ID NO: 776666 - DNA, 25 bp, Mus musculus
taggacgctgacaagtttttagaac

SEQ ID NO: 776667 - DNA, 25 bp, Mus musculus
taggacgctgactagtttttagaac

SEQ ID NO: 776668 - DNA, 25 bp, Mus musculus
taggacgcttacatgctcaggttta

SEQ ID NO: 776669 - DNA, 25 bp, Mus musculus
taggacgcttacttgctcaggttta

SEQ ID NO: 776670 - DNA, 25 bp, Mus musculus
taggacggcagccttatgccaccac

SEQ ID NO: 776671 - DNA, 25 bp, Mus musculus
taggacggcagcgttatgccaccac

SEQ ID NO: 776672 - DNA, 25 bp, Mus musculus
taggacgtcgtgagtttgtaacttt

SEQ ID NO: 776673 - DNA, 25 bp, Mus musculus
taggacgtcgtgtgtttgtaacttt

SEQ ID NO: 776674 - DNA, 25 bp, Mus musculus
taggacgtggacagctggaagcccc

SEQ ID NO: 776675 - DNA, 25 bp, Mus musculus
taggacgtggactgctggaagcccc

SEQ ID NO: 776676 - DNA, 25 bp, Mus musculus
taggacgtggttcttacctccacat

SEQ ID NO: 776677 - DNA, 25 bp, Mus musculus
taggacgtggttgttacctccacat

SEQ ID NO: 776678 - DNA, 25 bp, Mus musculus
taggacgtgttaaccctggattggt

SEQ ID NO: 776679 - DNA, 25 bp, Mus musculus
taggacgtgttatccctggattggt

SEQ ID NO: 776680 - DNA, 25 bp, Mus musculus
taggacgttggtagcgcttcttcgg

SEQ ID NO: 776681 - DNA, 25 bp, Mus musculus
taggacgttggttgcgcttcttcgg

SEQ ID NO: 776682 - DNA, 25 bp, Mus musculus
taggactataacacgatgcagcaga

SEQ ID NO: 776683 - DNA, 25 bp, Mus musculus
taggactataactcgatgcagcaga

SEQ ID NO: 776684 - DNA, 25 bp, Mus musculus
taggactatgacctccacggcggct

SEQ ID NO: 776685 - DNA, 25 bp, Mus musculus
taggactatgacgtccacggcggct

SEQ ID NO: 776686 - DNA, 25 bp, Mus musculus
taggactatgtccaagcgtttcgac

SEQ ID NO: 776687 - DNA, 25 bp, Mus musculus
taggactatgtcgaagcgtttcgac

SEQ ID NO: 776688 - DNA, 25 bp, Mus musculus
taggactcaaatcaccaagactgtg

SEQ ID NO: 776689 - DNA, 25 bp, Mus musculus
taggactcaaatgaccaagactgtg

SEQ ID NO: 776690 - DNA, 25 bp, Mus musculus
taggactcactgacaaagccagtta

SEQ ID NO: 776691 - DNA, 25 bp, Mus musculus
taggactcactgtcaaagccagtta

SEQ ID NO: 776692 - DNA, 25 bp, Mus musculus
taggactcagagatcttccaaagtg

SEQ ID NO: 776693 - DNA, 25 bp, Mus musculus
taggactcagagcacaaaccggttc

SEQ ID NO: 776694 - DNA, 25 bp, Mus musculus
taggactcagaggacaaaccggttc

SEQ ID NO: 776695 - DNA, 25 bp, Mus musculus
taggactcagagttcttccaaagtg

SEQ ID NO: 776696 - DNA, 25 bp, Mus musculus
taggactccactattaaaaatcaag

SEQ ID NO: 776697 - DNA, 25 bp, Mus musculus
taggactccacttttaaaaatcaag

SEQ ID NO: 776698 - DNA, 25 bp, Mus musculus
taggactccgcaattctaggatgat

SEQ ID NO: 776699 - DNA, 25 bp, Mus musculus
taggactccgcatttctaggatgat

SEQ ID NO: 776700 - DNA, 25 bp, Mus musculus
taggactcgctcatgtggctatgaa

SEQ ID NO: 776701 - DNA, 25 bp, Mus musculus
taggactcgctcttgtggctatgaa

SEQ ID NO: 776702 - DNA, 25 bp, Mus musculus
taggactcgggcagtagctcatagt

SEQ ID NO: 776703 - DNA, 25 bp, Mus musculus
taggactcgggctgtagctcatagt

SEQ ID NO: 776704 - DNA, 25 bp, Mus musculus
taggactcggtcatgattttttact

SEQ ID NO: 776705 - DNA, 25 bp, Mus musculus
taggactcggtcttgattttttact

SEQ ID NO: 776706 - DNA, 25 bp, Mus musculus
taggactctatgagctccagttact

SEQ ID NO: 776707 - DNA, 25 bp, Mus musculus
taggactctatgtgctccagttact

SEQ ID NO: 776708 - DNA, 25 bp, Mus musculus
taggactctgcaataactctataat

SEQ ID NO: 776709 - DNA, 25 bp, Mus musculus
taggactctgcattaactctataat

SEQ ID NO: 776710 - DNA, 25 bp, Mus musculus
taggactctgtgcacctgttgtgtg

SEQ ID NO: 776711 - DNA, 25 bp, Mus musculus
taggactctgtggacctgttgtgtg

SEQ ID NO: 776712 - DNA, 25 bp, Mus musculus
taggactcttggcacttttgacagc

SEQ ID NO: 776713 - DNA, 25 bp, Mus musculus
taggactcttgggacttttgacagc

SEQ ID NO: 776714 - DNA, 25 bp, Mus musculus
taggactctttgcattaggttgggt

SEQ ID NO: 776715 - DNA, 25 bp, Mus musculus
taggactctttggattaggttgggt

SEQ ID NO: 776716 - DNA, 25 bp, Mus musculus
taggactgactacctccaggcagac

SEQ ID NO: 776717 - DNA, 25 bp, Mus musculus
taggactgactagctccaggcagac

SEQ ID NO: 776718 - DNA, 25 bp, Mus musculus
taggactgaggcctgtgacttctgc

SEQ ID NO: 776719 - DNA, 25 bp, Mus musculus
taggactgaggcgtgtgacttctgc

SEQ ID NO: 776720 - DNA, 25 bp, Mus musculus
taggactgattgaagcctaggctgc

SEQ ID NO: 776721 - DNA, 25 bp, Mus musculus
taggactgattgtagcctaggctgc

SEQ ID NO: 776722 - DNA, 25 bp, Mus musculus
taggactgcaagactctgcagccaa

SEQ ID NO: 776723 - DNA, 25 bp, Mus musculus
taggactgcaagtctctgcagccaa

SEQ ID NO: 776724 - DNA, 25 bp, Mus musculus
taggactgcagaaatataccacttg

SEQ ID NO: 776725 - DNA, 25 bp, Mus musculus
taggactgcagatatataccacttg

SEQ ID NO: 776726 - DNA, 25 bp, Mus musculus
taggactgccacaagagggcgcgct

SEQ ID NO: 776727 - DNA, 25 bp, Mus musculus
taggactgccactagagggcgcgct

SEQ ID NO: 776728 - DNA, 25 bp, Mus musculus
taggactgcccgcatttcagggctg

SEQ ID NO: 776729 - DNA, 25 bp, Mus musculus
taggactgcccggatttcagggctg

SEQ ID NO: 776730 - DNA, 25 bp, Mus musculus
taggactgctttagtggatggccac

SEQ ID NO: 776731 - DNA, 25 bp, Mus musculus
taggactgcttttgtggatggccac

SEQ ID NO: 776732 - DNA, 25 bp, Mus musculus
taggactggaatctagctcaccaac

SEQ ID NO: 776733 - DNA, 25 bp, Mus musculus
taggactggaatgtagctcaccaac

SEQ ID NO: 776734 - DNA, 25 bp, Mus musculus
taggactggattcgagccggcttcc

SEQ ID NO: 776735 - DNA, 25 bp, Mus musculus
taggactggattggagccggcttcc

SEQ ID NO: 776736 - DNA, 25 bp, Mus musculus
taggactggtaaaccaacagggact

SEQ ID NO: 776737 - DNA, 25 bp, Mus musculus
taggactggtaatccaacagggact

SEQ ID NO: 776738 - DNA, 25 bp, Mus musculus
taggactggtccattgctattcact

SEQ ID NO: 776739 - DNA, 25 bp, Mus musculus
taggactggtcctttgctattcact

SEQ ID NO: 776740 - DNA, 25 bp, Mus musculus
taggacttaactagttacatgtttt

SEQ ID NO: 776741 - DNA, 25 bp, Mus musculus
taggacttaacttgttacatgtttt

SEQ ID NO: 776742 - DNA, 25 bp, Mus musculus
taggacttagtcacacttcgggagc

SEQ ID NO: 776743 - DNA, 25 bp, Mus musculus
taggacttagtctcacttcgggagc

SEQ ID NO: 776744 - DNA, 25 bp, Mus musculus
taggacttcccaccgaagcctacat

SEQ ID NO: 776745 - DNA, 25 bp, Mus musculus
taggacttcccagcgaagcctacat

SEQ ID NO: 776746 - DNA, 25 bp, Mus musculus
taggacttctgaagaactcttcccc

SEQ ID NO: 776747 - DNA, 25 bp, Mus musculus
taggacttctgaatccactgctgtc

SEQ ID NO: 776748 - DNA, 25 bp, Mus musculus
taggacttctgatgaactcttcccc

SEQ ID NO: 776749 - DNA, 25 bp, Mus musculus
taggacttctgattccactgctgtc

SEQ ID NO: 776750 - DNA, 25 bp, Mus musculus
taggacttgagacttgtggttattc

SEQ ID NO: 776751 - DNA, 25 bp, Mus musculus
taggacttgagagttgtggttattc

SEQ ID NO: 776752 - DNA, 25 bp, Mus musculus
taggacttgcacacaaacagcccca

SEQ ID NO: 776753 - DNA, 25 bp, Mus musculus
taggacttgcactcaaacagcccca

SEQ ID NO: 776754 - DNA, 25 bp, Mus musculus
taggacttgctgcagctcattgctg

SEQ ID NO: 776755 - DNA, 25 bp, Mus musculus
taggacttgctggagctcattgctg

SEQ ID NO: 776756 - DNA, 25 bp, Mus musculus
taggacttgtttagttatttgcaac

SEQ ID NO: 776757 - DNA, 25 bp, Mus musculus
taggacttgttttgttatttgcaac

SEQ ID NO: 776758 - DNA, 25 bp, Mus musculus
taggactttaacactggtctctctc

SEQ ID NO: 776759 - DNA, 25 bp, Mus musculus
taggactttaactctggtctctctc

SEQ ID NO: 776760 - DNA, 25 bp, Mus musculus
taggactttcctagaggagcccaag

SEQ ID NO: 776761 - DNA, 25 bp, Mus musculus
taggactttccttgaggagcccaag

SEQ ID NO: 776762 - DNA, 25 bp, Mus musculus
taggactttcggatttcttcgttgg

SEQ ID NO: 776763 - DNA, 25 bp, Mus musculus
taggactttcggttttcttcgttgg

SEQ ID NO: 776764 - DNA, 25 bp, Mus musculus
taggactttgacctgttttcttccg

SEQ ID NO: 776765 - DNA, 25 bp, Mus musculus
taggactttgacgtgttttcttccg

SEQ ID NO: 776766 - DNA, 25 bp, Mus musculus
taggacttttttccaattggacaga

SEQ ID NO: 776767 - DNA, 25 bp, Mus musculus
taggacttttttgcaattggacaga

SEQ ID NO: 776768 - DNA, 25 bp, Mus musculus
taggagaaaaagctctaggcttgtc

SEQ ID NO: 776769 - DNA, 25 bp, Mus musculus
taggagaaaaaggtctaggcttgtc

SEQ ID NO: 776770 - DNA, 25 bp, Mus musculus
taggagaaacctattttgagcagta

SEQ ID NO: 776771 - DNA, 25 bp, Mus musculus
taggagaaaccttttttgagcagta

SEQ ID NO: 776772 - DNA, 25 bp, Mus musculus
taggagaactgccttcaattccagg

SEQ ID NO: 776773 - DNA, 25 bp, Mus musculus
taggagaactgcgttcaattccagg

SEQ ID NO: 776774 - DNA, 25 bp, Mus musculus
taggagaacttgatactcttcccaa

SEQ ID NO: 776775 - DNA, 25 bp, Mus musculus
taggagaacttgttactcttcccaa

SEQ ID NO: 776776 - DNA, 25 bp, Mus musculus
taggagacactcctcttaggcatgt

SEQ ID NO: 776777 - DNA, 25 bp, Mus musculus
taggagacactcgtcttaggcatgt

SEQ ID NO: 776778 - DNA, 25 bp, Mus musculus
taggagacagttccatgtgaccggc

SEQ ID NO: 776779 - DNA, 25 bp, Mus musculus
taggagacagttgcatgtgaccggc

SEQ ID NO: 776780 - DNA, 25 bp, Mus musculus
taggagaccatccagctggttgccc

SEQ ID NO: 776781 - DNA, 25 bp, Mus musculus
taggagaccatcgagctggttgccc

SEQ ID NO: 776782 - DNA, 25 bp, Mus musculus
taggagaccgttctggcacactcac

SEQ ID NO: 776783 - DNA, 25 bp, Mus musculus
taggagaccgttgtggcacactcac

SEQ ID NO: 776784 - DNA, 25 bp, Mus musculus
taggagacctcaagcactatgtgaa

SEQ ID NO: 776785 - DNA, 25 bp, Mus musculus
taggagacctcatgcactatgtgaa

SEQ ID NO: 776786 - DNA, 25 bp, Mus musculus
taggagacctgaacctcgcttcaga

SEQ ID NO: 776787 - DNA, 25 bp, Mus musculus
taggagacctgatcctcgcttcaga

SEQ ID NO: 776788 - DNA, 25 bp, Mus musculus
taggagacgccaccaccttgcaaac

SEQ ID NO: 776789 - DNA, 25 bp, Mus musculus
taggagacgccagcaccttgcaaac

SEQ ID NO: 776790 - DNA, 25 bp, Mus musculus
taggagactcgccttaaatgccctc

SEQ ID NO: 776791 - DNA, 25 bp, Mus musculus
taggagactcgcgttaaatgccctc

SEQ ID NO: 776792 - DNA, 25 bp, Mus musculus
taggagactctgagcatatgtggaa

SEQ ID NO: 776793 - DNA, 25 bp, Mus musculus
taggagactctgtgcatatgtggaa

SEQ ID NO: 776794 - DNA, 25 bp, Mus musculus
taggagactggcattccgtcttcca

SEQ ID NO: 776795 - DNA, 25 bp, Mus musculus
taggagactggctttccgtcttcca

SEQ ID NO: 776796 - DNA, 25 bp, Mus musculus
taggagactgtcatcatctagataa

SEQ ID NO: 776797 - DNA, 25 bp, Mus musculus
taggagactgtcttcatctagataa

SEQ ID NO: 776798 - DNA, 25 bp, Mus musculus
taggagagaccccaggctgtgactt

SEQ ID NO: 776799 - DNA, 25 bp, Mus musculus
taggagagacccgaggctgtgactt

SEQ ID NO: 776800 - DNA, 25 bp, Mus musculus
taggagagactcacaacttcgccaa

SEQ ID NO: 776801 - DNA, 25 bp, Mus musculus
taggagagactctcaacttcgccaa

SEQ ID NO: 776802 - DNA, 25 bp, Mus musculus
taggagagcatcatgggacacgcat

SEQ ID NO: 776803 - DNA, 25 bp, Mus musculus
taggagagcatcttgggacacgcat

SEQ ID NO: 776804 - DNA, 25 bp, Mus musculus
taggagagcgcactcagccaggcac

SEQ ID NO: 776805 - DNA, 25 bp, Mus musculus
taggagagcgcagtcagccaggcac

SEQ ID NO: 776806 - DNA, 25 bp, Mus musculus
taggagagcggtactgcaaggccac

SEQ ID NO: 776807 - DNA, 25 bp, Mus musculus
taggagagcggttctgcaaggccac

SEQ ID NO: 776808 - DNA, 25 bp, Mus musculus
taggagaggatgagcttaatcttgt

SEQ ID NO: 776809 - DNA, 25 bp, Mus musculus
taggagaggatgtgcttaatcttgt

SEQ ID NO: 776810 - DNA, 25 bp, Mus musculus
taggagaggattccacatggctccc

SEQ ID NO: 776811 - DNA, 25 bp, Mus musculus
taggagaggattgcacatggctccc

SEQ ID NO: 776812 - DNA, 25 bp, Mus musculus
taggagatagtcctcaggcctgaga

SEQ ID NO: 776813 - DNA, 25 bp, Mus musculus
taggagatagtcgtcaggcctgaga

SEQ ID NO: 776814 - DNA, 25 bp, Mus musculus
taggagatatcacccaccgtctgcc

SEQ ID NO: 776815 - DNA, 25 bp, Mus musculus
taggagatatcagccaccgtctgcc

SEQ ID NO: 776816 - DNA, 25 bp, Mus musculus
taggagatctgacctttgccagccc

SEQ ID NO: 776817 - DNA, 25 bp, Mus musculus
taggagatctgagctttgccagccc

SEQ ID NO: 776818 - DNA, 25 bp, Mus musculus
taggagatgttcacccatcctgcag

SEQ ID NO: 776819 - DNA, 25 bp, Mus musculus
taggagatgttctcccatcctgcag

SEQ ID NO: 776820 - DNA, 25 bp, Mus musculus
taggagattcctacccaaactgttt

SEQ ID NO: 776821 - DNA, 25 bp, Mus musculus
taggagattccttcccaaactgttt

SEQ ID NO: 776822 - DNA, 25 bp, Mus musculus
taggagcaaagccagggcccttccc

SEQ ID NO: 776823 - DNA, 25 bp, Mus musculus
taggagcaaagcgagggcccttccc

SEQ ID NO: 776824 - DNA, 25 bp, Mus musculus
taggagcaacacacagggctggatt

SEQ ID NO: 776825 - DNA, 25 bp, Mus musculus
taggagcaacacatggacaatgggc

SEQ ID NO: 776826 - DNA, 25 bp, Mus musculus
taggagcaacactcagggctggatt

SEQ ID NO: 776827 - DNA, 25 bp, Mus musculus
taggagcaacacttggacaatgggc

SEQ ID NO: 776828 - DNA, 25 bp, Mus musculus
taggagcaacctacgagagatcttt

SEQ ID NO: 776829 - DNA, 25 bp, Mus musculus
taggagcaaccttcgagagatcttt

SEQ ID NO: 776830 - DNA, 25 bp, Mus musculus
taggagcaagagaccacgacgccat

SEQ ID NO: 776831 - DNA, 25 bp, Mus musculus
taggagcaagagtccacgacgccat

SEQ ID NO: 776832 - DNA, 25 bp, Mus musculus
taggagcacacactagcccattggt

SEQ ID NO: 776833 - DNA, 25 bp, Mus musculus
taggagcacacagtagcccattggt

SEQ ID NO: 776834 - DNA, 25 bp, Mus musculus
taggagcacactcggctgcttctga

SEQ ID NO: 776835 - DNA, 25 bp, Mus musculus
taggagcacactgggctgcttctga

SEQ ID NO: 776836 - DNA, 25 bp, Mus musculus
taggagcacggtaatttgctgaaat

SEQ ID NO: 776837 - DNA, 25 bp, Mus musculus
taggagcacggttatttgctgaaat

SEQ ID NO: 776838 - DNA, 25 bp, Mus musculus
taggagcagaggaagcattcaaact

SEQ ID NO: 776839 - DNA, 25 bp, Mus musculus
taggagcagaggtagcattcaaact

SEQ ID NO: 776840 - DNA, 25 bp, Mus musculus
taggagcagcacaggcactgacaat

SEQ ID NO: 776841 - DNA, 25 bp, Mus musculus
taggagcagcactggcactgacaat

SEQ ID NO: 776842 - DNA, 25 bp, Mus musculus
taggagcagccacgatgcctcgcct

SEQ ID NO: 776843 - DNA, 25 bp, Mus musculus
taggagcagccaggatgcctcgcct

SEQ ID NO: 776844 - DNA, 25 bp, Mus musculus
taggagcattgacccaagcacccat

SEQ ID NO: 776845 - DNA, 25 bp, Mus musculus
taggagcattgagccaagcacccat

SEQ ID NO: 776846 - DNA, 25 bp, Mus musculus
taggagccaccgagagcttccacct

SEQ ID NO: 776847 - DNA, 25 bp, Mus musculus
taggagccaccgtgagcttccacct

SEQ ID NO: 776848 - DNA, 25 bp, Mus musculus
taggagccatcacgctacagtctct

SEQ ID NO: 776849 - DNA, 25 bp, Mus musculus
taggagccatcaggctacagtctct

SEQ ID NO: 776850 - DNA, 25 bp, Mus musculus
taggagcccacacaaacgaaaaaga

SEQ ID NO: 776851 - DNA, 25 bp, Mus musculus
taggagcccacagaaacgaaaaaga

SEQ ID NO: 776852 - DNA, 25 bp, Mus musculus
taggagcccagcatcgagtggagaa

SEQ ID NO: 776853 - DNA, 25 bp, Mus musculus
taggagcccagcttcgagtggagaa

SEQ ID NO: 776854 - DNA, 25 bp, Mus musculus
taggagccccaaaagcttcactgtt

SEQ ID NO: 776855 - DNA, 25 bp, Mus musculus
taggagccccaatagcttcactgtt

SEQ ID NO: 776856 - DNA, 25 bp, Mus musculus
taggagcccgtgaacaagcgtcagg

SEQ ID NO: 776857 - DNA, 25 bp, Mus musculus
taggagcccgtgtacaagcgtcagg

SEQ ID NO: 776858 - DNA, 25 bp, Mus musculus
taggagccctgcctctccaggtgta

SEQ ID NO: 776859 - DNA, 25 bp, Mus musculus
taggagccctgcgtctccaggtgta

SEQ ID NO: 776860 - DNA, 25 bp, Mus musculus
taggagccgggcatccataagacag

SEQ ID NO: 776861 - DNA, 25 bp, Mus musculus
taggagccgggcttccataagacag

SEQ ID NO: 776862 - DNA, 25 bp, Mus musculus
taggagcctaatactgttggacaaa

SEQ ID NO: 776863 - DNA, 25 bp, Mus musculus
taggagcctaattctgttggacaaa

SEQ ID NO: 776864 - DNA, 25 bp, Mus musculus
taggagcctgcgaatattgtttact

SEQ ID NO: 776865 - DNA, 25 bp, Mus musculus
taggagcctgcgtatattgtttact

SEQ ID NO: 776866 - DNA, 25 bp, Mus musculus
taggagcctggtccaaacccactgt

SEQ ID NO: 776867 - DNA, 25 bp, Mus musculus
taggagcctggtgcaaacccactgt

SEQ ID NO: 776868 - DNA, 25 bp, Mus musculus
taggagcctttgaggatgctgtaca

SEQ ID NO: 776869 - DNA, 25 bp, Mus musculus
taggagcctttgcttagggcccagt

SEQ ID NO: 776870 - DNA, 25 bp, Mus musculus
taggagcctttggttagggcccagt

SEQ ID NO: 776871 - DNA, 25 bp, Mus musculus
taggagcctttgtggatgctgtaca

SEQ ID NO: 776872 - DNA, 25 bp, Mus musculus
taggagctccaactatttgtccatc

SEQ ID NO: 776873 - DNA, 25 bp, Mus musculus
taggagctccaagtatttgtccatc

SEQ ID NO: 776874 - DNA, 25 bp, Mus musculus
taggagctgaaaaccatgctgacct

SEQ ID NO: 776875 - DNA, 25 bp, Mus musculus
taggagctgaaatccatgctgacct

SEQ ID NO: 776876 - DNA, 25 bp, Mus musculus
taggagctgacacgagagcagccac

SEQ ID NO: 776877 - DNA, 25 bp, Mus musculus
taggagctgacaggagagcagccac

SEQ ID NO: 776878 - DNA, 25 bp, Mus musculus
taggagctgtccacagctttacctg

SEQ ID NO: 776879 - DNA, 25 bp, Mus musculus
taggagctgtcctcagctttacctg

SEQ ID NO: 776880 - DNA, 25 bp, Mus musculus
taggagcttcctctctttggcctag

SEQ ID NO: 776881 - DNA, 25 bp, Mus musculus
taggagcttcctgtctttggcctag

SEQ ID NO: 776882 - DNA, 25 bp, Mus musculus
taggagcttgcacatacccattccc

SEQ ID NO: 776883 - DNA, 25 bp, Mus musculus
taggagcttgcagatacccattccc

SEQ ID NO: 776884 - DNA, 25 bp, Mus musculus
taggagcttggcaaaggtgtagcaa

SEQ ID NO: 776885 - DNA, 25 bp, Mus musculus
taggagcttggctaaggtgtagcaa

SEQ ID NO: 776886 - DNA, 25 bp, Mus musculus
taggagcttttaagcttcctgacca

SEQ ID NO: 776887 - DNA, 25 bp, Mus musculus
taggagcttttacatggcagccaat

SEQ ID NO: 776888 - DNA, 25 bp, Mus musculus
taggagcttttagatggcagccaat

SEQ ID NO: 776889 - DNA, 25 bp, Mus musculus
taggagcttttatgcttcctgacca

SEQ ID NO: 776890 - DNA, 25 bp, Mus musculus
taggaggaaatgatgctgccccgat

SEQ ID NO: 776891 - DNA, 25 bp, Mus musculus
taggaggaaatgttgctgccccgat

SEQ ID NO: 776892 - DNA, 25 bp, Mus musculus
taggaggaacaactcacagtcagag

SEQ ID NO: 776893 - DNA, 25 bp, Mus musculus
taggaggaacaagtcacagtcagag

SEQ ID NO: 776894 - DNA, 25 bp, Mus musculus
taggaggaacccaccatgtcacctt

SEQ ID NO: 776895 - DNA, 25 bp, Mus musculus
taggaggaaccctccatgtcacctt

SEQ ID NO: 776896 - DNA, 25 bp, Mus musculus
taggaggaacctcaaggcttgcctg

SEQ ID NO: 776897 - DNA, 25 bp, Mus musculus
taggaggaacctgaaggcttgcctg

SEQ ID NO: 776898 - DNA, 25 bp, Mus musculus
taggaggaaggcatctctctgccct

SEQ ID NO: 776899 - DNA, 25 bp, Mus musculus
taggaggaaggcttctctctgccct

SEQ ID NO: 776900 - DNA, 25 bp, Mus musculus
taggaggagctaaacattttcttta

SEQ ID NO: 776901 - DNA, 25 bp, Mus musculus
taggaggagctatacattttcttta

SEQ ID NO: 776902 - DNA, 25 bp, Mus musculus
taggaggatagcactgtccgcatct

SEQ ID NO: 776903 - DNA, 25 bp, Mus musculus
taggaggatagctctgtccgcatct

SEQ ID NO: 776904 - DNA, 25 bp, Mus musculus
taggaggcacagcacccaagcaata

SEQ ID NO: 776905 - DNA, 25 bp, Mus musculus
taggaggcacaggacccaagcaata

SEQ ID NO: 776906 - DNA, 25 bp, Mus musculus
taggaggccctgagtgtcactggta

SEQ ID NO: 776907 - DNA, 25 bp, Mus musculus
taggaggccctgtgtgtcactggta

SEQ ID NO: 776908 - DNA, 25 bp, Mus musculus
taggaggccggccataacgccgttc

SEQ ID NO: 776909 - DNA, 25 bp, Mus musculus
taggaggccggcgataacgccgttc

SEQ ID NO: 776910 - DNA, 25 bp, Mus musculus
taggaggcctcactgctcctgttat

SEQ ID NO: 776911 - DNA, 25 bp, Mus musculus
taggaggcctcagtgctcctgttat

SEQ ID NO: 776912 - DNA, 25 bp, Mus musculus
taggaggccttgagtctgtgagacc

SEQ ID NO: 776913 - DNA, 25 bp, Mus musculus
taggaggccttgtgtctgtgagacc

SEQ ID NO: 776914 - DNA, 25 bp, Mus musculus
taggaggcgcctcttggtcacagca

SEQ ID NO: 776915 - DNA, 25 bp, Mus musculus
taggaggcgcctgttggtcacagca

SEQ ID NO: 776916 - DNA, 25 bp, Mus musculus
taggaggcgctcaggtattcacgaa

SEQ ID NO: 776917 - DNA, 25 bp, Mus musculus
taggaggcgctctggtattcacgaa

SEQ ID NO: 776918 - DNA, 25 bp, Mus musculus
taggaggctctgctctacagggtaa

SEQ ID NO: 776919 - DNA, 25 bp, Mus musculus
taggaggctctggtctacagggtaa

SEQ ID NO: 776920 - DNA, 25 bp, Mus musculus
taggaggcttcaacactgtgtttgc

SEQ ID NO: 776921 - DNA, 25 bp, Mus musculus
taggaggcttcatcactgtgtttgc

SEQ ID NO: 776922 - DNA, 25 bp, Mus musculus
taggagggatccagaggtccctgct

SEQ ID NO: 776923 - DNA, 25 bp, Mus musculus
taggagggatcctgaggtccctgct

SEQ ID NO: 776924 - DNA, 25 bp, Mus musculus
taggaggtagatactgagtctagca

SEQ ID NO: 776925 - DNA, 25 bp, Mus musculus
taggaggtagattctgagtctagca

SEQ ID NO: 776926 - DNA, 25 bp, Mus musculus
taggaggtattcaaacttgcatgtt

SEQ ID NO: 776927 - DNA, 25 bp, Mus musculus
taggaggtattctaacttgcatgtt

SEQ ID NO: 776928 - DNA, 25 bp, Mus musculus
taggaggtcacaccagtggagtcct

SEQ ID NO: 776929 - DNA, 25 bp, Mus musculus
taggaggtcacagcagtggagtcct

SEQ ID NO: 776930 - DNA, 25 bp, Mus musculus
taggaggtcaccagttttcagtcct

SEQ ID NO: 776931 - DNA, 25 bp, Mus musculus
taggaggtcacctgttttcagtcct

SEQ ID NO: 776932 - DNA, 25 bp, Mus musculus
taggaggtctcccacagtgacagct

SEQ ID NO: 776933 - DNA, 25 bp, Mus musculus
taggaggtctccgacagtgacagct

SEQ ID NO: 776934 - DNA, 25 bp, Mus musculus
taggaggttcccagtcttgaagtct

SEQ ID NO: 776935 - DNA, 25 bp, Mus musculus
taggaggttccctgtcttgaagtct

SEQ ID NO: 776936 - DNA, 25 bp, Mus musculus
taggaggttgcccaattttgtttct

SEQ ID NO: 776937 - DNA, 25 bp, Mus musculus
taggaggttgccgaattttgtttct

SEQ ID NO: 776938 - DNA, 25 bp, Mus musculus
taggagtaattgagccccgaggtcg

SEQ ID NO: 776939 - DNA, 25 bp, Mus musculus
taggagtaattgtgccccgaggtcg

SEQ ID NO: 776940 - DNA, 25 bp, Mus musculus
taggagtacctaccaccaaagagac

SEQ ID NO: 776941 - DNA, 25 bp, Mus musculus
taggagtacctagcaccaaagagac

SEQ ID NO: 776942 - DNA, 25 bp, Mus musculus
taggagtcagagattctgccccatg

SEQ ID NO: 776943 - DNA, 25 bp, Mus musculus
taggagtcagagtttctgccccatg

SEQ ID NO: 776944 - DNA, 25 bp, Mus musculus
taggagtcaggacctcaacactggg

SEQ ID NO: 776945 - DNA, 25 bp, Mus musculus
taggagtcaggagctcaacactggg

SEQ ID NO: 776946 - DNA, 25 bp, Mus musculus
taggagtccaccatcttagctctga

SEQ ID NO: 776947 - DNA, 25 bp, Mus musculus
taggagtccaccttcttagctctga

SEQ ID NO: 776948 - DNA, 25 bp, Mus musculus
taggagtcccataagcccagaacta

SEQ ID NO: 776949 - DNA, 25 bp, Mus musculus
taggagtcccattagcccagaacta

SEQ ID NO: 776950 - DNA, 25 bp, Mus musculus
taggagtccccaaggtgctatcaaa

SEQ ID NO: 776951 - DNA, 25 bp, Mus musculus
taggagtccccaccagaaagccagg

SEQ ID NO: 776952 - DNA, 25 bp, Mus musculus
taggagtccccagcagaaagccagg

SEQ ID NO: 776953 - DNA, 25 bp, Mus musculus
taggagtccccatggtgctatcaaa

SEQ ID NO: 776954 - DNA, 25 bp, Mus musculus
taggagtcccgaacctgtaggcgac

SEQ ID NO: 776955 - DNA, 25 bp, Mus musculus
taggagtcccgatcctgtaggcgac

SEQ ID NO: 776956 - DNA, 25 bp, Mus musculus
taggagtcctctcctgtgagtcttg

SEQ ID NO: 776957 - DNA, 25 bp, Mus musculus
taggagtcctctgctgtgagtcttg

SEQ ID NO: 776958 - DNA, 25 bp, Mus musculus
taggagtccttaaatcctttggtcc

SEQ ID NO: 776959 - DNA, 25 bp, Mus musculus
taggagtccttatatcctttggtcc

SEQ ID NO: 776960 - DNA, 25 bp, Mus musculus
taggagtcggttatcttacaggagt

SEQ ID NO: 776961 - DNA, 25 bp, Mus musculus
taggagtcggttttcttacaggagt

SEQ ID NO: 776962 - DNA, 25 bp, Mus musculus
taggagtctatcatggatgtcctct

SEQ ID NO: 776963 - DNA, 25 bp, Mus musculus
taggagtctatcttggatgtcctct

SEQ ID NO: 776964 - DNA, 25 bp, Mus musculus
taggagtgaatgagagtctgagcaa

SEQ ID NO: 776965 - DNA, 25 bp, Mus musculus
taggagtgaatgtgagtctgagcaa

SEQ ID NO: 776966 - DNA, 25 bp, Mus musculus
taggagtgcctgatgcagactgtgc

SEQ ID NO: 776967 - DNA, 25 bp, Mus musculus
taggagtgcctgttgcagactgtgc

SEQ ID NO: 776968 - DNA, 25 bp, Mus musculus
taggagtgctttcgattcattttct

SEQ ID NO: 776969 - DNA, 25 bp, Mus musculus
taggagtgctttggattcattttct

SEQ ID NO: 776970 - DNA, 25 bp, Mus musculus
taggagtggcagctctcacccacct

SEQ ID NO: 776971 - DNA, 25 bp, Mus musculus
taggagtggcaggtctcacccacct

SEQ ID NO: 776972 - DNA, 25 bp, Mus musculus
taggagtgggaaccagaaccattat

SEQ ID NO: 776973 - DNA, 25 bp, Mus musculus
taggagtgggaagcagaaccattat

SEQ ID NO: 776974 - DNA, 25 bp, Mus musculus
taggagtgtctcagtgcttcataaa

SEQ ID NO: 776975 - DNA, 25 bp, Mus musculus
taggagtgtctctgtgcttcataaa

SEQ ID NO: 776976 - DNA, 25 bp, Mus musculus
taggagttcacaccgtaagtacctc

SEQ ID NO: 776977 - DNA, 25 bp, Mus musculus
taggagttcacagcgtaagtacctc

SEQ ID NO: 776978 - DNA, 25 bp, Mus musculus
taggagttccttctaatttctttat

SEQ ID NO: 776979 - DNA, 25 bp, Mus musculus
taggagttccttgtaatttctttat

SEQ ID NO: 776980 - DNA, 25 bp, Mus musculus
taggagttctaaccttgccttttta

SEQ ID NO: 776981 - DNA, 25 bp, Mus musculus
taggagttctaagcttgccttttta

SEQ ID NO: 776982 - DNA, 25 bp, Mus musculus
taggagttgaaacttctacgttata

SEQ ID NO: 776983 - DNA, 25 bp, Mus musculus
taggagttgaaagttctacgttata

SEQ ID NO: 776984 - DNA, 25 bp, Mus musculus
taggagttgccaaatgccattttat

SEQ ID NO: 776985 - DNA, 25 bp, Mus musculus
taggagttgccatatgccattttat

SEQ ID NO: 776986 - DNA, 25 bp, Mus musculus
taggagttggtgctagggccagggc

SEQ ID NO: 776987 - DNA, 25 bp, Mus musculus
taggagttggtggtagggccagggc

SEQ ID NO: 776988 - DNA, 25 bp, Mus musculus
taggataagggcagggccctctctc

SEQ ID NO: 776989 - DNA, 25 bp, Mus musculus
taggataagggctgggccctctctc

SEQ ID NO: 776990 - DNA, 25 bp, Mus musculus
taggatacacgccacacttgataag

SEQ ID NO: 776991 - DNA, 25 bp, Mus musculus
taggatacacgcgacacttgataag

SEQ ID NO: 776992 - DNA, 25 bp, Mus musculus
taggatacagacaccatcaagatgg

SEQ ID NO: 776993 - DNA, 25 bp, Mus musculus
taggatacagactccatcaagatgg

SEQ ID NO: 776994 - DNA, 25 bp, Mus musculus
taggatacaggcacagggttgaatg

SEQ ID NO: 776995 - DNA, 25 bp, Mus musculus
taggatacaggctcagggttgaatg

SEQ ID NO: 776996 - DNA, 25 bp, Mus musculus
taggatacatacacgccagaccctg

SEQ ID NO: 776997 - DNA, 25 bp, Mus musculus
taggatacatactcgccagaccctg

SEQ ID NO: 776998 - DNA, 25 bp, Mus musculus
taggatacgtgcagactcttaggtc

SEQ ID NO: 776999 - DNA, 25 bp, Mus musculus
taggatacgtgctgactcttaggtc

SEQ ID NO: 777000 - DNA, 25 bp, Mus musculus
taggatactgtcatacctctttgta

SEQ ID NO: 777001 - DNA, 25 bp, Mus musculus
taggatactgtcttacctctttgta

SEQ ID NO: 777002 - DNA, 25 bp, Mus musculus
taggatactttaccccatgaccatt

SEQ ID NO: 777003 - DNA, 25 bp, Mus musculus
taggatactttagcccatgaccatt

SEQ ID NO: 777004 - DNA, 25 bp, Mus musculus
taggatagacaccatggaataaaga

SEQ ID NO: 777005 - DNA, 25 bp, Mus musculus
taggatagacacgatggaataaaga

SEQ ID NO: 777006 - DNA, 25 bp, Mus musculus
taggatagcaacatatgggatgaat

SEQ ID NO: 777007 - DNA, 25 bp, Mus musculus
taggatagcaacttatgggatgaat

SEQ ID NO: 777008 - DNA, 25 bp, Mus musculus
taggatattgtacggctgcagtaac

SEQ ID NO: 777009 - DNA, 25 bp, Mus musculus
taggatattgtagggctgcagtaac

SEQ ID NO: 777010 - DNA, 25 bp, Mus musculus
taggatcaaaggcctgcatcactac

SEQ ID NO: 777011 - DNA, 25 bp, Mus musculus
taggatcaaagggctgcatcactac

SEQ ID NO: 777012 - DNA, 25 bp, Mus musculus
taggatcaaggcctcctcacaaaag

SEQ ID NO: 777013 - DNA, 25 bp, Mus musculus
taggatcaaggcgtcctcacaaaag

SEQ ID NO: 777014 - DNA, 25 bp, Mus musculus
taggatcagatgaagggacaggccc

SEQ ID NO: 777015 - DNA, 25 bp, Mus musculus
taggatcagatgtagggacaggccc

SEQ ID NO: 777016 - DNA, 25 bp, Mus musculus
taggatcatataaaacctcaccaaa

SEQ ID NO: 777017 - DNA, 25 bp, Mus musculus
taggatcatatataacctcaccaaa

SEQ ID NO: 777018 - DNA, 25 bp, Mus musculus
taggatcattccctgatacttgctc

SEQ ID NO: 777019 - DNA, 25 bp, Mus musculus
taggatcattccgtgatacttgctc

SEQ ID NO: 777020 - DNA, 25 bp, Mus musculus
taggatccatggctatattcacatg

SEQ ID NO: 777021 - DNA, 25 bp, Mus musculus
taggatccatgggtatattcacatg

SEQ ID NO: 777022 - DNA, 25 bp, Mus musculus
taggatccccgaacagttccagctc

SEQ ID NO: 777023 - DNA, 25 bp, Mus musculus
taggatccccgatcagttccagctc

SEQ ID NO: 777024 - DNA, 25 bp, Mus musculus
taggatccgagccaccacgaaaagc

SEQ ID NO: 777025 - DNA, 25 bp, Mus musculus
taggatccgagcgaccacgaaaagc

SEQ ID NO: 777026 - DNA, 25 bp, Mus musculus
taggatccgcatatgggtggactct

SEQ ID NO: 777027 - DNA, 25 bp, Mus musculus
taggatccgcatttgggtggactct

SEQ ID NO: 777028 - DNA, 25 bp, Mus musculus
taggatcctggaaggtctacatata

SEQ ID NO: 777029 - DNA, 25 bp, Mus musculus
taggatcctggatggtctacatata

SEQ ID NO: 777030 - DNA, 25 bp, Mus musculus
taggatccttgtagtcaccccatac

SEQ ID NO: 777031 - DNA, 25 bp, Mus musculus
taggatccttgttgtcaccccatac

SEQ ID NO: 777032 - DNA, 25 bp, Mus musculus
taggatcgagtgcttattgggacaa

SEQ ID NO: 777033 - DNA, 25 bp, Mus musculus
taggatcgagtggttattgggacaa

SEQ ID NO: 777034 - DNA, 25 bp, Mus musculus
taggatctatagatgccaccaccct

SEQ ID NO: 777035 - DNA, 25 bp, Mus musculus
taggatctatagttgccaccaccct

SEQ ID NO: 777036 - DNA, 25 bp, Mus musculus
taggatctatctagccatttggagg

SEQ ID NO: 777037 - DNA, 25 bp, Mus musculus
taggatctatcttgccatttggagg

SEQ ID NO: 777038 - DNA, 25 bp, Mus musculus
taggatctcattcctcaggttggcc

SEQ ID NO: 777039 - DNA, 25 bp, Mus musculus
taggatctcattgctcaggttggcc

SEQ ID NO: 777040 - DNA, 25 bp, Mus musculus
taggatctccccaggtcacacagta

SEQ ID NO: 777041 - DNA, 25 bp, Mus musculus
taggatctcccctggtcacacagta

SEQ ID NO: 777042 - DNA, 25 bp, Mus musculus
taggatcttgttattctgttatgaa

SEQ ID NO: 777043 - DNA, 25 bp, Mus musculus
taggatcttgtttttctgttatgaa

SEQ ID NO: 777044 - DNA, 25 bp, Mus musculus
taggatgaagctagccactcggcta

SEQ ID NO: 777045 - DNA, 25 bp, Mus musculus
taggatgaagcttgccactcggcta

SEQ ID NO: 777046 - DNA, 25 bp, Mus musculus
taggatgacaaaacaccctgatgtg

SEQ ID NO: 777047 - DNA, 25 bp, Mus musculus
taggatgacaaatcaccctgatgtg

SEQ ID NO: 777048 - DNA, 25 bp, Mus musculus
taggatgacactagcaaaagcttgt

SEQ ID NO: 777049 - DNA, 25 bp, Mus musculus
taggatgacacttgcaaaagcttgt

SEQ ID NO: 777050 - DNA, 25 bp, Mus musculus
taggatgacgagaccttggaaacaa

SEQ ID NO: 777051 - DNA, 25 bp, Mus musculus
taggatgacgagtccttggaaacaa

SEQ ID NO: 777052 - DNA, 25 bp, Mus musculus
taggatgatctcaactgccagttag

SEQ ID NO: 777053 - DNA, 25 bp, Mus musculus
taggatgatctctactgccagttag

SEQ ID NO: 777054 - DNA, 25 bp, Mus musculus
taggatgccaaacgccctaggttca

SEQ ID NO: 777055 - DNA, 25 bp, Mus musculus
taggatgccaaaggccctaggttca

SEQ ID NO: 777056 - DNA, 25 bp, Mus musculus
taggatgccatcagactaatgtctc

SEQ ID NO: 777057 - DNA, 25 bp, Mus musculus
taggatgccatctgactaatgtctc

SEQ ID NO: 777058 - DNA, 25 bp, Mus musculus
taggatgcccctaaattagccttgt

SEQ ID NO: 777059 - DNA, 25 bp, Mus musculus
taggatgccccttaattagccttgt

SEQ ID NO: 777060 - DNA, 25 bp, Mus musculus
taggatgccgagatagagcacatgt

SEQ ID NO: 777061 - DNA, 25 bp, Mus musculus
taggatgccgagttagagcacatgt

SEQ ID NO: 777062 - DNA, 25 bp, Mus musculus
taggatgcctcaatgttatagacat

SEQ ID NO: 777063 - DNA, 25 bp, Mus musculus
taggatgcctcattgttatagacat

SEQ ID NO: 777064 - DNA, 25 bp, Mus musculus
taggatgcctccatttccttgttct

SEQ ID NO: 777065 - DNA, 25 bp, Mus musculus
taggatgcctccttttccttgttct

SEQ ID NO: 777066 - DNA, 25 bp, Mus musculus
taggatgcctttaggtttggtcaac

SEQ ID NO: 777067 - DNA, 25 bp, Mus musculus
taggatgccttttggtttggtcaac

SEQ ID NO: 777068 - DNA, 25 bp, Mus musculus
taggatgctcctactgtctgactct

SEQ ID NO: 777069 - DNA, 25 bp, Mus musculus
taggatgctccttctgtctgactct

SEQ ID NO: 777070 - DNA, 25 bp, Mus musculus
taggatgctcgtatgtacttctttg

SEQ ID NO: 777071 - DNA, 25 bp, Mus musculus
taggatgctcgtttgtacttctttg

SEQ ID NO: 777072 - DNA, 25 bp, Mus musculus
taggatgctgggaggatcccatagt

SEQ ID NO: 777073 - DNA, 25 bp, Mus musculus
taggatgctgggtggatcccatagt

SEQ ID NO: 777074 - DNA, 25 bp, Mus musculus
taggatgcttccatcagaacacagg

SEQ ID NO: 777075 - DNA, 25 bp, Mus musculus
taggatgcttccttcagaacacagg

SEQ ID NO: 777076 - DNA, 25 bp, Mus musculus
taggatggcatccatttctaaatca

SEQ ID NO: 777077 - DNA, 25 bp, Mus musculus
taggatggcatcgatttctaaatca

SEQ ID NO: 777078 - DNA, 25 bp, Mus musculus
taggatgggcttaaactcgaaattc

SEQ ID NO: 777079 - DNA, 25 bp, Mus musculus
taggatgggctttaactcgaaattc

SEQ ID NO: 777080 - DNA, 25 bp, Mus musculus
taggatggtcgtcgtcttgtcatga

SEQ ID NO: 777081 - DNA, 25 bp, Mus musculus
taggatggtcgtggtcttgtcatga

SEQ ID NO: 777082 - DNA, 25 bp, Mus musculus
taggatggttatcagcctccttggc

SEQ ID NO: 777083 - DNA, 25 bp, Mus musculus
taggatggttatgagcctccttggc

SEQ ID NO: 777084 - DNA, 25 bp, Mus musculus
taggatgtcagcctaactcttctct

SEQ ID NO: 777085 - DNA, 25 bp, Mus musculus
taggatgtcagcgtaactcttctct

SEQ ID NO: 777086 - DNA, 25 bp, Mus musculus
taggatgtcattattgcctgcctta

SEQ ID NO: 777087 - DNA, 25 bp, Mus musculus
taggatgtcatttttgcctgcctta

SEQ ID NO: 777088 - DNA, 25 bp, Mus musculus
taggatgtccctactacaccaagga

SEQ ID NO: 777089 - DNA, 25 bp, Mus musculus
taggatgtcccttctacaccaagga

SEQ ID NO: 777090 - DNA, 25 bp, Mus musculus
taggatgtcctacaatcaccttgct

SEQ ID NO: 777091 - DNA, 25 bp, Mus musculus
taggatgtcctagaatcaccttgct

SEQ ID NO: 777092 - DNA, 25 bp, Mus musculus
taggatgtctccacagaattcatgt

SEQ ID NO: 777093 - DNA, 25 bp, Mus musculus
taggatgtctcctcagaattcatgt

SEQ ID NO: 777094 - DNA, 25 bp, Mus musculus
taggatgtggtacccctactttctc

SEQ ID NO: 777095 - DNA, 25 bp, Mus musculus
taggatgtggtagccctactttctc

SEQ ID NO: 777096 - DNA, 25 bp, Mus musculus
taggatgtgtcaccacgagtagccc

SEQ ID NO: 777097 - DNA, 25 bp, Mus musculus
taggatgtgtcagcacgagtagccc

SEQ ID NO: 777098 - DNA, 25 bp, Mus musculus
taggattaatcccttgtcaccacaa

SEQ ID NO: 777099 - DNA, 25 bp, Mus musculus
taggattaatccgttgtcaccacaa

SEQ ID NO: 777100 - DNA, 25 bp, Mus musculus
taggattacaaaccccagacctggg

SEQ ID NO: 777101 - DNA, 25 bp, Mus musculus
taggattacaaagcccagacctggg

SEQ ID NO: 777102 - DNA, 25 bp, Mus musculus
taggattactacaggtcaggctaag

SEQ ID NO: 777103 - DNA, 25 bp, Mus musculus
taggattactactggtcaggctaag

SEQ ID NO: 777104 - DNA, 25 bp, Mus musculus
taggattagcacagggttgtcggcc

SEQ ID NO: 777105 - DNA, 25 bp, Mus musculus
taggattagcactgggttgtcggcc

SEQ ID NO: 777106 - DNA, 25 bp, Mus musculus
taggattataacacaggcgaccggt

SEQ ID NO: 777107 - DNA, 25 bp, Mus musculus
taggattataactcaggcgaccggt

SEQ ID NO: 777108 - DNA, 25 bp, Mus musculus
taggattcaaagacgttccaaatat

SEQ ID NO: 777109 - DNA, 25 bp, Mus musculus
taggattcaaagtcgttccaaatat

SEQ ID NO: 777110 - DNA, 25 bp, Mus musculus
taggattcctcccatggctaatgaa

SEQ ID NO: 777111 - DNA, 25 bp, Mus musculus
taggattcctccgatggctaatgaa

SEQ ID NO: 777112 - DNA, 25 bp, Mus musculus
taggattcgatcagatcacccacac

SEQ ID NO: 777113 - DNA, 25 bp, Mus musculus
taggattcgatctgatcacccacac

SEQ ID NO: 777114 - DNA, 25 bp, Mus musculus
taggattctaggattctccctgagc

SEQ ID NO: 777115 - DNA, 25 bp, Mus musculus
taggattctaggtttctccctgagc

SEQ ID NO: 777116 - DNA, 25 bp, Mus musculus
taggattctcacaggaataccccac

SEQ ID NO: 777117 - DNA, 25 bp, Mus musculus
taggattctcactggaataccccac

SEQ ID NO: 777118 - DNA, 25 bp, Mus musculus
taggattctctacctttggtcccca

SEQ ID NO: 777119 - DNA, 25 bp, Mus musculus
taggattctctagctttggtcccca

SEQ ID NO: 777120 - DNA, 25 bp, Mus musculus
taggattcttctcagttgaaaagac

SEQ ID NO: 777121 - DNA, 25 bp, Mus musculus
taggattcttctgagttgaaaagac

SEQ ID NO: 777122 - DNA, 25 bp, Mus musculus
taggattgtcaccatctgtggcaca

SEQ ID NO: 777123 - DNA, 25 bp, Mus musculus
taggattgtcacgatctgtggcaca

SEQ ID NO: 777124 - DNA, 25 bp, Mus musculus
taggattgttagagggcgttcccct

SEQ ID NO: 777125 - DNA, 25 bp, Mus musculus
taggattgttagcttgtcgtctttt

SEQ ID NO: 777126 - DNA, 25 bp, Mus musculus
taggattgttaggttgtcgtctttt

SEQ ID NO: 777127 - DNA, 25 bp, Mus musculus
taggattgttagtgggcgttcccct

SEQ ID NO: 777128 - DNA, 25 bp, Mus musculus
taggatttcatccttgcacagaaag

SEQ ID NO: 777129 - DNA, 25 bp, Mus musculus
taggatttcatcgttgcacagaaag

SEQ ID NO: 777130 - DNA, 25 bp, Mus musculus
taggatttccctcccatgtttcacg

SEQ ID NO: 777131 - DNA, 25 bp, Mus musculus
taggatttccctgccatgtttcacg

SEQ ID NO: 777132 - DNA, 25 bp, Mus musculus
taggatttgcccaactcacaggaga

SEQ ID NO: 777133 - DNA, 25 bp, Mus musculus
taggatttgccctactcacaggaga

SEQ ID NO: 777134 - DNA, 25 bp, Mus musculus
taggatttgcctattggtgatgctg

SEQ ID NO: 777135 - DNA, 25 bp, Mus musculus
taggatttgccttttggtgatgctg

SEQ ID NO: 777136 - DNA, 25 bp, Mus musculus
taggatttggacatagctcaatggt

SEQ ID NO: 777137 - DNA, 25 bp, Mus musculus
taggatttggacttagctcaatggt

SEQ ID NO: 777138 - DNA, 25 bp, Mus musculus
taggatttgtatattcttctcctcc

SEQ ID NO: 777139 - DNA, 25 bp, Mus musculus
taggatttgtattttcttctcctcc

SEQ ID NO: 777140 - DNA, 25 bp, Mus musculus
taggattttacccaaggctaatatc

SEQ ID NO: 777141 - DNA, 25 bp, Mus musculus
taggattttaccgaaggctaatatc

SEQ ID NO: 777142 - DNA, 25 bp, Mus musculus
taggattttgatatgtacagtttta

SEQ ID NO: 777143 - DNA, 25 bp, Mus musculus
taggattttgatttgtacagtttta

SEQ ID NO: 777144 - DNA, 25 bp, Mus musculus
taggattttgttctacatgaccaca

SEQ ID NO: 777145 - DNA, 25 bp, Mus musculus
taggattttgttgtacatgaccaca

SEQ ID NO: 777146 - DNA, 25 bp, Mus musculus
taggatttttctacaagaccttttg

SEQ ID NO: 777147 - DNA, 25 bp, Mus musculus
taggatttttcttcaagaccttttg

SEQ ID NO: 777148 - DNA, 25 bp, Mus musculus
taggcaaaacatcacagaggaaaaa

SEQ ID NO: 777149 - DNA, 25 bp, Mus musculus
taggcaaaacatgacagaggaaaaa

SEQ ID NO: 777150 - DNA, 25 bp, Mus musculus
taggcaaaatctatactcccaaccc

SEQ ID NO: 777151 - DNA, 25 bp, Mus musculus
taggcaaaatctttactcccaaccc

SEQ ID NO: 777152 - DNA, 25 bp, Mus musculus
taggcaaaccttaagattcaagact

SEQ ID NO: 777153 - DNA, 25 bp, Mus musculus
taggcaaacctttagattcaagact

SEQ ID NO: 777154 - DNA, 25 bp, Mus musculus
taggcaaagatgactgtctgtggta

SEQ ID NO: 777155 - DNA, 25 bp, Mus musculus
taggcaaagatgtctgtctgtggta

SEQ ID NO: 777156 - DNA, 25 bp, Mus musculus
taggcaaagcctctaccactaaacc

SEQ ID NO: 777157 - DNA, 25 bp, Mus musculus
taggcaaagcctgtaccactaaacc

SEQ ID NO: 777158 - DNA, 25 bp, Mus musculus
taggcaaagcttcatgcaacccttg

SEQ ID NO: 777159 - DNA, 25 bp, Mus musculus
taggcaaagcttgatgcaacccttg

SEQ ID NO: 777160 - DNA, 25 bp, Mus musculus
taggcaaagggccttaccctgggat

SEQ ID NO: 777161 - DNA, 25 bp, Mus musculus
taggcaaagggcgttaccctgggat

SEQ ID NO: 777162 - DNA, 25 bp, Mus musculus
taggcaaagtcaacccagagctcaa

SEQ ID NO: 777163 - DNA, 25 bp, Mus musculus
taggcaaagtcatcccagagctcaa

SEQ ID NO: 777164 - DNA, 25 bp, Mus musculus
taggcaaataagaagtttacccttg

SEQ ID NO: 777165 - DNA, 25 bp, Mus musculus
taggcaaataagtagtttacccttg

SEQ ID NO: 777166 - DNA, 25 bp, Mus musculus
taggcaaatagcagtgtactgtata

SEQ ID NO: 777167 - DNA, 25 bp, Mus musculus
taggcaaatagctgtgtactgtata

SEQ ID NO: 777168 - DNA, 25 bp, Mus musculus
taggcaaatatcactgatggacata

SEQ ID NO: 777169 - DNA, 25 bp, Mus musculus
taggcaaatatctctgatggacata

SEQ ID NO: 777170 - DNA, 25 bp, Mus musculus
taggcaacagaacccaccagaggct

SEQ ID NO: 777171 - DNA, 25 bp, Mus musculus
taggcaacagaagccaccagaggct

SEQ ID NO: 777172 - DNA, 25 bp, Mus musculus
taggcaaccacccttgtgtttttat

SEQ ID NO: 777173 - DNA, 25 bp, Mus musculus
taggcaaccaccgttgtgtttttat

SEQ ID NO: 777174 - DNA, 25 bp, Mus musculus
taggcaaccatacgactgtcaccca

SEQ ID NO: 777175 - DNA, 25 bp, Mus musculus
taggcaaccataggactgtcaccca

SEQ ID NO: 777176 - DNA, 25 bp, Mus musculus
taggcaacccgtcagtaagttatgg

SEQ ID NO: 777177 - DNA, 25 bp, Mus musculus
taggcaacccgtgagtaagttatgg

SEQ ID NO: 777178 - DNA, 25 bp, Mus musculus
taggcaacccttatgaaaggaccca

SEQ ID NO: 777179 - DNA, 25 bp, Mus musculus
taggcaacccttttgaaaggaccca

SEQ ID NO: 777180 - DNA, 25 bp, Mus musculus
taggcaacctggatgtgcccatgtg

SEQ ID NO: 777181 - DNA, 25 bp, Mus musculus
taggcaacctggttgtgcccatgtg

SEQ ID NO: 777182 - DNA, 25 bp, Mus musculus
taggcaacgtgacagttctcagttc

SEQ ID NO: 777183 - DNA, 25 bp, Mus musculus
taggcaacgtgagagttctcagttc

SEQ ID NO: 777184 - DNA, 25 bp, Mus musculus
taggcaactagaaccttgtctttga

SEQ ID NO: 777185 - DNA, 25 bp, Mus musculus
taggcaactagatccttgtctttga

SEQ ID NO: 777186 - DNA, 25 bp, Mus musculus
taggcaactattagaccaaccgagt

SEQ ID NO: 777187 - DNA, 25 bp, Mus musculus
taggcaactatttgaccaaccgagt

SEQ ID NO: 777188 - DNA, 25 bp, Mus musculus
taggcaactcctagtttagctccat

SEQ ID NO: 777189 - DNA, 25 bp, Mus musculus
taggcaactccttgtttagctccat

SEQ ID NO: 777190 - DNA, 25 bp, Mus musculus
taggcaactgcaactgagacatgtt

SEQ ID NO: 777191 - DNA, 25 bp, Mus musculus
taggcaactgcatctgagacatgtt

SEQ ID NO: 777192 - DNA, 25 bp, Mus musculus
taggcaactgggacttaaaccacat

SEQ ID NO: 777193 - DNA, 25 bp, Mus musculus
taggcaactgggtcttaaaccacat

SEQ ID NO: 777194 - DNA, 25 bp, Mus musculus
taggcaactggtataagaaccggcg

SEQ ID NO: 777195 - DNA, 25 bp, Mus musculus
taggcaactggtttaagaaccggcg

SEQ ID NO: 777196 - DNA, 25 bp, Mus musculus
taggcaagagagagtgctccacctt

SEQ ID NO: 777197 - DNA, 25 bp, Mus musculus
taggcaagagagtgtgctccacctt

SEQ ID NO: 777198 - DNA, 25 bp, Mus musculus
taggcaagcaagcacaaccagccca

SEQ ID NO: 777199 - DNA, 25 bp, Mus musculus
taggcaagcaaggacaaccagccca

SEQ ID NO: 777200 - DNA, 25 bp, Mus musculus
taggcaagccaactgcgggcagcca

SEQ ID NO: 777201 - DNA, 25 bp, Mus musculus
taggcaagccaagtgcgggcagcca

SEQ ID NO: 777202 - DNA, 25 bp, Mus musculus
taggcaagctgaagcggtgccgacc

SEQ ID NO: 777203 - DNA, 25 bp, Mus musculus
taggcaagctgatgcggtgccgacc

SEQ ID NO: 777204 - DNA, 25 bp, Mus musculus
taggcaaggacacgtgcccttcttt

SEQ ID NO: 777205 - DNA, 25 bp, Mus musculus
taggcaaggacaggtgcccttcttt

SEQ ID NO: 777206 - DNA, 25 bp, Mus musculus
taggcaaggcatagtaatctcggtt

SEQ ID NO: 777207 - DNA, 25 bp, Mus musculus
taggcaaggcattgtaatctcggtt

SEQ ID NO: 777208 - DNA, 25 bp, Mus musculus
taggcaagggctactgaaacttcaa

SEQ ID NO: 777209 - DNA, 25 bp, Mus musculus
taggcaagggcttctgaaacttcaa

SEQ ID NO: 777210 - DNA, 25 bp, Mus musculus
taggcaagtgcacccctgacgctgt

SEQ ID NO: 777211 - DNA, 25 bp, Mus musculus
taggcaagtgcagccctgacgctgt

SEQ ID NO: 777212 - DNA, 25 bp, Mus musculus
taggcaagtgctctgtcgctgagcc

SEQ ID NO: 777213 - DNA, 25 bp, Mus musculus
taggcaagtgctgtgtcgctgagcc

SEQ ID NO: 777214 - DNA, 25 bp, Mus musculus
taggcaagttctagctctgagggag

SEQ ID NO: 777215 - DNA, 25 bp, Mus musculus
taggcaagttcttgctctgagggag

SEQ ID NO: 777216 - DNA, 25 bp, Mus musculus
taggcaatacaccaagggcgagatt

SEQ ID NO: 777217 - DNA, 25 bp, Mus musculus
taggcaatacacgaagggcgagatt

SEQ ID NO: 777218 - DNA, 25 bp, Mus musculus
taggcaatcatgctgctcacagcac

SEQ ID NO: 777219 - DNA, 25 bp, Mus musculus
taggcaatcatggtgctcacagcac

SEQ ID NO: 777220 - DNA, 25 bp, Mus musculus
taggcaatccaaatcagtccccaga

SEQ ID NO: 777221 - DNA, 25 bp, Mus musculus
taggcaatccaattcagtccccaga

SEQ ID NO: 777222 - DNA, 25 bp, Mus musculus
taggcaatccctatacgactcttat

SEQ ID NO: 777223 - DNA, 25 bp, Mus musculus
taggcaatccctttacgactcttat

SEQ ID NO: 777224 - DNA, 25 bp, Mus musculus
taggcaatctcaaatcctcatagag

SEQ ID NO: 777225 - DNA, 25 bp, Mus musculus
taggcaatctcatatcctcatagag

SEQ ID NO: 777226 - DNA, 25 bp, Mus musculus
taggcaatgtcaccgcctggcagca

SEQ ID NO: 777227 - DNA, 25 bp, Mus musculus
taggcaatgtcagcgcctggcagca

SEQ ID NO: 777228 - DNA, 25 bp, Mus musculus
taggcacaatttaccacaccagcat

SEQ ID NO: 777229 - DNA, 25 bp, Mus musculus
taggcacaattttccacaccagcat

SEQ ID NO: 777230 - DNA, 25 bp, Mus musculus
taggcacacatacctttgaaagcat

SEQ ID NO: 777231 - DNA, 25 bp, Mus musculus
taggcacacatagctttgaaagcat

SEQ ID NO: 777232 - DNA, 25 bp, Mus musculus
taggcacagagcatcatcacatact

SEQ ID NO: 777233 - DNA, 25 bp, Mus musculus
taggcacagagcttcatcacatact

SEQ ID NO: 777234 - DNA, 25 bp, Mus musculus
taggcacagagtagtcttgaacatt

SEQ ID NO: 777235 - DNA, 25 bp, Mus musculus
taggcacagagttgtcttgaacatt

SEQ ID NO: 777236 - DNA, 25 bp, Mus musculus
taggcacagccccattttggatagt

SEQ ID NO: 777237 - DNA, 25 bp, Mus musculus
taggcacagcccgattttggatagt

SEQ ID NO: 777238 - DNA, 25 bp, Mus musculus
taggcacaggacaccatgcatgctt

SEQ ID NO: 777239 - DNA, 25 bp, Mus musculus
taggcacaggactccatgcatgctt

SEQ ID NO: 777240 - DNA, 25 bp, Mus musculus
taggcacaggagagtcaccacccag

SEQ ID NO: 777241 - DNA, 25 bp, Mus musculus
taggcacaggagtgtcaccacccag

SEQ ID NO: 777242 - DNA, 25 bp, Mus musculus
taggcacaggttacagtcccttgaa

SEQ ID NO: 777243 - DNA, 25 bp, Mus musculus
taggcacaggtttcagtcccttgaa

SEQ ID NO: 777244 - DNA, 25 bp, Mus musculus
taggcacatgctcagcaaggacttg

SEQ ID NO: 777245 - DNA, 25 bp, Mus musculus
taggcacatgctgagcaaggacttg

SEQ ID NO: 777246 - DNA, 25 bp, Mus musculus
taggcaccacctactaaaggtcctt

SEQ ID NO: 777247 - DNA, 25 bp, Mus musculus
taggcaccaccttctaaaggtcctt

SEQ ID NO: 777248 - DNA, 25 bp, Mus musculus
taggcacccacgagttctaggtttt

SEQ ID NO: 777249 - DNA, 25 bp, Mus musculus
taggcacccacgtgttctaggtttt

SEQ ID NO: 777250 - DNA, 25 bp, Mus musculus
taggcacccctaatccatgtggctt

SEQ ID NO: 777251 - DNA, 25 bp, Mus musculus
taggcacccctattccatgtggctt

SEQ ID NO: 777252 - DNA, 25 bp, Mus musculus
taggcaccgctcatcagtacttaat

SEQ ID NO: 777253 - DNA, 25 bp, Mus musculus
taggcaccgctcttcagtacttaat

SEQ ID NO: 777254 - DNA, 25 bp, Mus musculus
taggcacctactacccggagaaacg

SEQ ID NO: 777255 - DNA, 25 bp, Mus musculus
taggcacctacttcccggagaaacg

SEQ ID NO: 777256 - DNA, 25 bp, Mus musculus
taggcacctcccacatatgaagcaa

SEQ ID NO: 777257 - DNA, 25 bp, Mus musculus
taggcacctccctcatatgaagcaa

SEQ ID NO: 777258 - DNA, 25 bp, Mus musculus
taggcacctcggacgccaatgggct

SEQ ID NO: 777259 - DNA, 25 bp, Mus musculus
taggcacctcggtcgccaatgggct

SEQ ID NO: 777260 - DNA, 25 bp, Mus musculus
taggcacctctgactcattttgaga

SEQ ID NO: 777261 - DNA, 25 bp, Mus musculus
taggcacctctgagggcaggcagaa

SEQ ID NO: 777262 - DNA, 25 bp, Mus musculus
taggcacctctgtctcattttgaga

SEQ ID NO: 777263 - DNA, 25 bp, Mus musculus
taggcacctctgtgggcaggcagaa

SEQ ID NO: 777264 - DNA, 25 bp, Mus musculus
taggcacctgaactacatggagctt

SEQ ID NO: 777265 - DNA, 25 bp, Mus musculus
taggcacctgaagtacatggagctt

SEQ ID NO: 777266 - DNA, 25 bp, Mus musculus
taggcacgcaccatccagcttaagg

SEQ ID NO: 777267 - DNA, 25 bp, Mus musculus
taggcacgcaccttccagcttaagg

SEQ ID NO: 777268 - DNA, 25 bp, Mus musculus
taggcacgcatgcagctcccaagtc

SEQ ID NO: 777269 - DNA, 25 bp, Mus musculus
taggcacgcatggagctcccaagtc

SEQ ID NO: 777270 - DNA, 25 bp, Mus musculus
taggcacggcaacggtgagcttctt

SEQ ID NO: 777271 - DNA, 25 bp, Mus musculus
taggcacggcaagggtgagcttctt

SEQ ID NO: 777272 - DNA, 25 bp, Mus musculus
taggcactaacacacacgcggcata

SEQ ID NO: 777273 - DNA, 25 bp, Mus musculus
taggcactaacagacacgcggcata

SEQ ID NO: 777274 - DNA, 25 bp, Mus musculus
taggcactacccatcaccatagtac

SEQ ID NO: 777275 - DNA, 25 bp, Mus musculus
taggcactacccttcaccatagtac

SEQ ID NO: 777276 - DNA, 25 bp, Mus musculus
taggcactatgtagagagactcggt

SEQ ID NO: 777277 - DNA, 25 bp, Mus musculus
taggcactatgttgagagactcggt

SEQ ID NO: 777278 - DNA, 25 bp, Mus musculus
taggcactcataccttttattttta

SEQ ID NO: 777279 - DNA, 25 bp, Mus musculus
taggcactcatagcttttattttta

SEQ ID NO: 777280 - DNA, 25 bp, Mus musculus
taggcactccagaggccacgcaggc

SEQ ID NO: 777281 - DNA, 25 bp, Mus musculus
taggcactccagtggccacgcaggc

SEQ ID NO: 777282 - DNA, 25 bp, Mus musculus
taggcactccatacacaattctctc

SEQ ID NO: 777283 - DNA, 25 bp, Mus musculus
taggcactccatagccaaaggttgt

SEQ ID NO: 777284 - DNA, 25 bp, Mus musculus
taggcactccattcacaattctctc

SEQ ID NO: 777285 - DNA, 25 bp, Mus musculus
taggcactccattgccaaaggttgt

SEQ ID NO: 777286 - DNA, 25 bp, Mus musculus
taggcactctgcacatctcattatg

SEQ ID NO: 777287 - DNA, 25 bp, Mus musculus
taggcactctgctcatctcattatg

SEQ ID NO: 777288 - DNA, 25 bp, Mus musculus
taggcactgactctctggccagaac

SEQ ID NO: 777289 - DNA, 25 bp, Mus musculus
taggcactgactgtctggccagaac

SEQ ID NO: 777290 - DNA, 25 bp, Mus musculus
taggcactgatgacaacaccctcat

SEQ ID NO: 777291 - DNA, 25 bp, Mus musculus
taggcactgatgtcaacaccctcat

SEQ ID NO: 777292 - DNA, 25 bp, Mus musculus
taggcactgccaattgttggtgctt

SEQ ID NO: 777293 - DNA, 25 bp, Mus musculus
taggcactgccatttgttggtgctt

SEQ ID NO: 777294 - DNA, 25 bp, Mus musculus
taggcactggcaatcattgattgtt

SEQ ID NO: 777295 - DNA, 25 bp, Mus musculus
taggcactggcattcattgattgtt

SEQ ID NO: 777296 - DNA, 25 bp, Mus musculus
taggcactggtgaaagactgggact

SEQ ID NO: 777297 - DNA, 25 bp, Mus musculus
taggcactggtgtaagactgggact

SEQ ID NO: 777298 - DNA, 25 bp, Mus musculus
taggcactgtaaccagaaggcccag

SEQ ID NO: 777299 - DNA, 25 bp, Mus musculus
taggcactgtaagcagaaggcccag

SEQ ID NO: 777300 - DNA, 25 bp, Mus musculus
taggcagaaaccctccagacttttt

SEQ ID NO: 777301 - DNA, 25 bp, Mus musculus
taggcagaaaccgtccagacttttt

SEQ ID NO: 777302 - DNA, 25 bp, Mus musculus
taggcagaactccaactacagcttc

SEQ ID NO: 777303 - DNA, 25 bp, Mus musculus
taggcagaactcctcggcgaagtct

SEQ ID NO: 777304 - DNA, 25 bp, Mus musculus
taggcagaactcctctgacatgctc

SEQ ID NO: 777305 - DNA, 25 bp, Mus musculus
taggcagaactcgaactacagcttc

SEQ ID NO: 777306 - DNA, 25 bp, Mus musculus
taggcagaactcgtcggcgaagtct

SEQ ID NO: 777307 - DNA, 25 bp, Mus musculus
taggcagaactcgtctgacatgctc

SEQ ID NO: 777308 - DNA, 25 bp, Mus musculus
taggcagacataatggctttatccc

SEQ ID NO: 777309 - DNA, 25 bp, Mus musculus
taggcagacatattggctttatccc

SEQ ID NO: 777310 - DNA, 25 bp, Mus musculus
taggcagacgctattcgagctgagc

SEQ ID NO: 777311 - DNA, 25 bp, Mus musculus
taggcagacgcttttcgagctgagc

SEQ ID NO: 777312 - DNA, 25 bp, Mus musculus
taggcagactcaactaccctgtggg

SEQ ID NO: 777313 - DNA, 25 bp, Mus musculus
taggcagactcatctaccctgtggg

SEQ ID NO: 777314 - DNA, 25 bp, Mus musculus
taggcagactgaaacttgcttttgg

SEQ ID NO: 777315 - DNA, 25 bp, Mus musculus
taggcagactgatacttgcttttgg

SEQ ID NO: 777316 - DNA, 25 bp, Mus musculus
taggcagactgcatggcgctgcaga

SEQ ID NO: 777317 - DNA, 25 bp, Mus musculus
taggcagactgcttggcgctgcaga

SEQ ID NO: 777318 - DNA, 25 bp, Mus musculus
taggcagagactccaactccagcca

SEQ ID NO: 777319 - DNA, 25 bp, Mus musculus
taggcagagactgcaactccagcca

SEQ ID NO: 777320 - DNA, 25 bp, Mus musculus
taggcagagatgagacacccactcc

SEQ ID NO: 777321 - DNA, 25 bp, Mus musculus
taggcagagatgtgacacccactcc

SEQ ID NO: 777322 - DNA, 25 bp, Mus musculus
taggcagagcccagcaatgaggtcc

SEQ ID NO: 777323 - DNA, 25 bp, Mus musculus
taggcagagccctgcaatgaggtcc

SEQ ID NO: 777324 - DNA, 25 bp, Mus musculus
taggcagagctcaccatccaaatca

SEQ ID NO: 777325 - DNA, 25 bp, Mus musculus
taggcagagctctccatccaaatca

SEQ ID NO: 777326 - DNA, 25 bp, Mus musculus
taggcagcaagaccttccagacctc

SEQ ID NO: 777327 - DNA, 25 bp, Mus musculus
taggcagcaagagcttccagacctc

SEQ ID NO: 777328 - DNA, 25 bp, Mus musculus
taggcagcacacatgggccgtgtaa

SEQ ID NO: 777329 - DNA, 25 bp, Mus musculus
taggcagcacacttgggccgtgtaa

SEQ ID NO: 777330 - DNA, 25 bp, Mus musculus
taggcagcaccaccaggacagtgta

SEQ ID NO: 777331 - DNA, 25 bp, Mus musculus
taggcagcaccagcaggacagtgta

SEQ ID NO: 777332 - DNA, 25 bp, Mus musculus
taggcagcactcaacttcggagcta

SEQ ID NO: 777333 - DNA, 25 bp, Mus musculus
taggcagcactctacttcggagcta

SEQ ID NO: 777334 - DNA, 25 bp, Mus musculus
taggcagcactgataaaatattttg

SEQ ID NO: 777335 - DNA, 25 bp, Mus musculus
taggcagcactgttaaaatattttg

SEQ ID NO: 777336 - DNA, 25 bp, Mus musculus
taggcagcagatattacccagtgtt

SEQ ID NO: 777337 - DNA, 25 bp, Mus musculus
taggcagcagattttacccagtgtt

SEQ ID NO: 777338 - DNA, 25 bp, Mus musculus
taggcagcagcaatgtggtacacag

SEQ ID NO: 777339 - DNA, 25 bp, Mus musculus
taggcagcagcattgtggtacacag

SEQ ID NO: 777340 - DNA, 25 bp, Mus musculus
taggcagcatctccttcactcagtt

SEQ ID NO: 777341 - DNA, 25 bp, Mus musculus
taggcagcatctgcttcactcagtt

SEQ ID NO: 777342 - DNA, 25 bp, Mus musculus
taggcagccaccaatctcaatcttc

SEQ ID NO: 777343 - DNA, 25 bp, Mus musculus
taggcagccacctatctcaatcttc

SEQ ID NO: 777344 - DNA, 25 bp, Mus musculus
taggcagcccataactttaggcctt

SEQ ID NO: 777345 - DNA, 25 bp, Mus musculus
taggcagcccattactttaggcctt

SEQ ID NO: 777346 - DNA, 25 bp, Mus musculus
taggcagccctaagggcactaccgg

SEQ ID NO: 777347 - DNA, 25 bp, Mus musculus
taggcagccctacaacttattatgt

SEQ ID NO: 777348 - DNA, 25 bp, Mus musculus
taggcagccctagaacttattatgt

SEQ ID NO: 777349 - DNA, 25 bp, Mus musculus
taggcagccctatgggcactaccgg

SEQ ID NO: 777350 - DNA, 25 bp, Mus musculus
taggcagccctgagtcacgtggtcg

SEQ ID NO: 777351 - DNA, 25 bp, Mus musculus
taggcagccctgtgtcacgtggtcg

SEQ ID NO: 777352 - DNA, 25 bp, Mus musculus
taggcagcctccagacgatctggga

SEQ ID NO: 777353 - DNA, 25 bp, Mus musculus
taggcagcctcctgacgatctggga

SEQ ID NO: 777354 - DNA, 25 bp, Mus musculus
taggcagcctgaaacagctggatca

SEQ ID NO: 777355 - DNA, 25 bp, Mus musculus
taggcagcctgatacagctggatca

SEQ ID NO: 777356 - DNA, 25 bp, Mus musculus
taggcagctatccattctttggcac

SEQ ID NO: 777357 - DNA, 25 bp, Mus musculus
taggcagctatcgattctttggcac

SEQ ID NO: 777358 - DNA, 25 bp, Mus musculus
taggcagctcacatgtagatacaca

SEQ ID NO: 777359 - DNA, 25 bp, Mus musculus
taggcagctcacttgtagatacaca

SEQ ID NO: 777360 - DNA, 25 bp, Mus musculus
taggcagctcgacgctagaccatca

SEQ ID NO: 777361 - DNA, 25 bp, Mus musculus
taggcagctcgaggctagaccatca

SEQ ID NO: 777362 - DNA, 25 bp, Mus musculus
taggcagctgttcgcattaacaaac

SEQ ID NO: 777363 - DNA, 25 bp, Mus musculus
taggcagctgttggcattaacaaac

SEQ ID NO: 777364 - DNA, 25 bp, Mus musculus
taggcagcttatagttccgaacgag

SEQ ID NO: 777365 - DNA, 25 bp, Mus musculus
taggcagcttattgttccgaacgag

SEQ ID NO: 777366 - DNA, 25 bp, Mus musculus
taggcagcttctccgggtgaacaga

SEQ ID NO: 777367 - DNA, 25 bp, Mus musculus
taggcagcttctgcgggtgaacaga

SEQ ID NO: 777368 - DNA, 25 bp, Mus musculus
taggcagcttgcaagaggtttactt

SEQ ID NO: 777369 - DNA, 25 bp, Mus musculus
taggcagcttgctagaggtttactt

SEQ ID NO: 777370 - DNA, 25 bp, Mus musculus
taggcaggagttcctagtccagcct

SEQ ID NO: 777371 - DNA, 25 bp, Mus musculus
taggcaggagttgctagtccagcct

SEQ ID NO: 777372 - DNA, 25 bp, Mus musculus
taggcaggatatacccactctataa

SEQ ID NO: 777373 - DNA, 25 bp, Mus musculus
taggcaggatattcccactctataa

SEQ ID NO: 777374 - DNA, 25 bp, Mus musculus
taggcaggcaggatcagttctactc

SEQ ID NO: 777375 - DNA, 25 bp, Mus musculus
taggcaggcaggttcagttctactc

SEQ ID NO: 777376 - DNA, 25 bp, Mus musculus
taggcaggcatgaaaccatacatat

SEQ ID NO: 777377 - DNA, 25 bp, Mus musculus
taggcaggcatgtaaccatacatat

SEQ ID NO: 777378 - DNA, 25 bp, Mus musculus
taggcaggccacaattttgtgcttt

SEQ ID NO: 777379 - DNA, 25 bp, Mus musculus
taggcaggccactattttgtgcttt

SEQ ID NO: 777380 - DNA, 25 bp, Mus musculus
taggcaggcctgactctcgggtaaa

SEQ ID NO: 777381 - DNA, 25 bp, Mus musculus
taggcaggcctgtctctcgggtaaa

SEQ ID NO: 777382 - DNA, 25 bp, Mus musculus
taggcagggatcacatactctccag

SEQ ID NO: 777383 - DNA, 25 bp, Mus musculus
taggcagggatctcatactctccag

SEQ ID NO: 777384 - DNA, 25 bp, Mus musculus
taggcagggtctctgactccctagt

SEQ ID NO: 777385 - DNA, 25 bp, Mus musculus
taggcagggtctgtgactccctagt

SEQ ID NO: 777386 - DNA, 25 bp, Mus musculus
taggcaggtaagaccaaagggcaga

SEQ ID NO: 777387 - DNA, 25 bp, Mus musculus
taggcaggtaagtccaaagggcaga

SEQ ID NO: 777388 - DNA, 25 bp, Mus musculus
taggcaggttgtcagcagttagctt

SEQ ID NO: 777389 - DNA, 25 bp, Mus musculus
taggcaggttgtgagcagttagctt

SEQ ID NO: 777390 - DNA, 25 bp, Mus musculus
taggcagtacctagctaatgcagac

SEQ ID NO: 777391 - DNA, 25 bp, Mus musculus
taggcagtaccttgctaatgcagac

SEQ ID NO: 777392 - DNA, 25 bp, Mus musculus
taggcagtactacaaatgttaactt

SEQ ID NO: 777393 - DNA, 25 bp, Mus musculus
taggcagtactagaaatgttaactt

SEQ ID NO: 777394 - DNA, 25 bp, Mus musculus
taggcagtagaacgccactatagtt

SEQ ID NO: 777395 - DNA, 25 bp, Mus musculus
taggcagtagaaggccactatagtt

SEQ ID NO: 777396 - DNA, 25 bp, Mus musculus
taggcagtctcaaagtcaaggttat

SEQ ID NO: 777397 - DNA, 25 bp, Mus musculus
taggcagtctcatagtcaaggttat

SEQ ID NO: 777398 - DNA, 25 bp, Mus musculus
taggcagtctggcaaattctgtgaa

SEQ ID NO: 777399 - DNA, 25 bp, Mus musculus
taggcagtctgggaaattctgtgaa

SEQ ID NO: 777400 - DNA, 25 bp, Mus musculus
taggcagtcttaatctctggatccc

SEQ ID NO: 777401 - DNA, 25 bp, Mus musculus
taggcagtcttattctctggatccc

SEQ ID NO: 777402 - DNA, 25 bp, Mus musculus
taggcagtgcagaacggccttacca

SEQ ID NO: 777403 - DNA, 25 bp, Mus musculus
taggcagtgcagtacggccttacca

SEQ ID NO: 777404 - DNA, 25 bp, Mus musculus
taggcagtgcctctcctgagacaaa

SEQ ID NO: 777405 - DNA, 25 bp, Mus musculus
taggcagtgcctgtcctgagacaaa

SEQ ID NO: 777406 - DNA, 25 bp, Mus musculus
taggcagtgcttccctaggttgtca

SEQ ID NO: 777407 - DNA, 25 bp, Mus musculus
taggcagtgcttgcctaggttgtca

SEQ ID NO: 777408 - DNA, 25 bp, Mus musculus
taggcagttcagagcgtatgtttac

SEQ ID NO: 777409 - DNA, 25 bp, Mus musculus
taggcagttcagtgcgtatgtttac

SEQ ID NO: 777410 - DNA, 25 bp, Mus musculus
taggcagttcttataccaaggttca

SEQ ID NO: 777411 - DNA, 25 bp, Mus musculus
taggcagttcttttaccaaggttca

SEQ ID NO: 777412 - DNA, 25 bp, Mus musculus
taggcatactctctggccatgacaa

SEQ ID NO: 777413 - DNA, 25 bp, Mus musculus
taggcatactctgtggccatgacaa

SEQ ID NO: 777414 - DNA, 25 bp, Mus musculus
taggcatactgcattctgtgggtca

SEQ ID NO: 777415 - DNA, 25 bp, Mus musculus
taggcatactgctttctgtgggtca

SEQ ID NO: 777416 - DNA, 25 bp, Mus musculus
taggcatatattcatactgtgtttt

SEQ ID NO: 777417 - DNA, 25 bp, Mus musculus
taggcatatattgatactgtgtttt

SEQ ID NO: 777418 - DNA, 25 bp, Mus musculus
taggcatatctgagtggcattttct

SEQ ID NO: 777419 - DNA, 25 bp, Mus musculus
taggcatatctgtgtggcattttct

SEQ ID NO: 777420 - DNA, 25 bp, Mus musculus
taggcatatttaccccaaagcagca

SEQ ID NO: 777421 - DNA, 25 bp, Mus musculus
taggcatatttagcccaaagcagca

SEQ ID NO: 777422 - DNA, 25 bp, Mus musculus
taggcatcacaccttgacaccagaa

SEQ ID NO: 777423 - DNA, 25 bp, Mus musculus
taggcatcacacgttgacaccagaa

SEQ ID NO: 777424 - DNA, 25 bp, Mus musculus
taggcatcacggacgaggcgactga

SEQ ID NO: 777425 - DNA, 25 bp, Mus musculus
taggcatcacggtcgaggcgactga

SEQ ID NO: 777426 - DNA, 25 bp, Mus musculus
taggcatcagatatcaccagctact

SEQ ID NO: 777427 - DNA, 25 bp, Mus musculus
taggcatcagatttcaccagctact

SEQ ID NO: 777428 - DNA, 25 bp, Mus musculus
taggcatccggacacagcggctgaa

SEQ ID NO: 777429 - DNA, 25 bp, Mus musculus
taggcatccggagacagcggctgaa

SEQ ID NO: 777430 - DNA, 25 bp, Mus musculus
taggcatcgtgtaacctaacctcaa

SEQ ID NO: 777431 - DNA, 25 bp, Mus musculus
taggcatcgtgttacctaacctcaa

SEQ ID NO: 777432 - DNA, 25 bp, Mus musculus
taggcatctgccaagcaaagagtgg

SEQ ID NO: 777433 - DNA, 25 bp, Mus musculus
taggcatctgcctagcaaagagtgg

SEQ ID NO: 777434 - DNA, 25 bp, Mus musculus
taggcatctggtatttgttttgtat

SEQ ID NO: 777435 - DNA, 25 bp, Mus musculus
taggcatctggtttttgttttgtat

SEQ ID NO: 777436 - DNA, 25 bp, Mus musculus
taggcatctgtcagtcacacatggt

SEQ ID NO: 777437 - DNA, 25 bp, Mus musculus
taggcatctgtctgtcacacatggt

SEQ ID NO: 777438 - DNA, 25 bp, Mus musculus
taggcatgaactacagtggcccagc

SEQ ID NO: 777439 - DNA, 25 bp, Mus musculus
taggcatgaacttcagtggcccagc

SEQ ID NO: 777440 - DNA, 25 bp, Mus musculus
taggcatgacagagggcaccttccc

SEQ ID NO: 777441 - DNA, 25 bp, Mus musculus
taggcatgacagtgggcaccttccc

SEQ ID NO: 777442 - DNA, 25 bp, Mus musculus
taggcatgccggaggatgcgggcac

SEQ ID NO: 777443 - DNA, 25 bp, Mus musculus
taggcatgccggtggatgcgggcac

SEQ ID NO: 777444 - DNA, 25 bp, Mus musculus
taggcatgcctcaaccagatcaaat

SEQ ID NO: 777445 - DNA, 25 bp, Mus musculus
taggcatgcctctaccagatcaaat

SEQ ID NO: 777446 - DNA, 25 bp, Mus musculus
taggcatgctctagtggcagcggca

SEQ ID NO: 777447 - DNA, 25 bp, Mus musculus
taggcatgctcttgtggcagcggca

SEQ ID NO: 777448 - DNA, 25 bp, Mus musculus
taggcatgctgtcgtttgtatctgt

SEQ ID NO: 777449 - DNA, 25 bp, Mus musculus
taggcatgctgtggtttgtatctgt

SEQ ID NO: 777450 - DNA, 25 bp, Mus musculus
taggcatggactagggccagttctg

SEQ ID NO: 777451 - DNA, 25 bp, Mus musculus
taggcatggacttgggccagttctg

SEQ ID NO: 777452 - DNA, 25 bp, Mus musculus
taggcatggagaagtcccactcgtt

SEQ ID NO: 777453 - DNA, 25 bp, Mus musculus
taggcatggagatgtcccactcgtt

SEQ ID NO: 777454 - DNA, 25 bp, Mus musculus
taggcatggcatcccacttgaggga

SEQ ID NO: 777455 - DNA, 25 bp, Mus musculus
taggcatggcatgccacttgaggga

SEQ ID NO: 777456 - DNA, 25 bp, Mus musculus
taggcatggccaacgttggtggcat

SEQ ID NO: 777457 - DNA, 25 bp, Mus musculus
taggcatggccatcgttggtggcat

SEQ ID NO: 777458 - DNA, 25 bp, Mus musculus
taggcatgggccaagcacgcagtgt

SEQ ID NO: 777459 - DNA, 25 bp, Mus musculus
taggcatgggcctagcacgcagtgt

SEQ ID NO: 777460 - DNA, 25 bp, Mus musculus
taggcatgggctctttctgaaactc

SEQ ID NO: 777461 - DNA, 25 bp, Mus musculus
taggcatgggctgtttctgaaactc

SEQ ID NO: 777462 - DNA, 25 bp, Mus musculus
taggcatgtgcgagtgaaggtcaaa

SEQ ID NO: 777463 - DNA, 25 bp, Mus musculus
taggcatgtgcgtgtgaaggtcaaa

SEQ ID NO: 777464 - DNA, 25 bp, Mus musculus
taggcattaaggacccctctgtgtt

SEQ ID NO: 777465 - DNA, 25 bp, Mus musculus
taggcattaaggtcccctctgtgtt

SEQ ID NO: 777466 - DNA, 25 bp, Mus musculus
taggcattaatgcttctacccacac

SEQ ID NO: 777467 - DNA, 25 bp, Mus musculus
taggcattaatggttctacccacac

SEQ ID NO: 777468 - DNA, 25 bp, Mus musculus
taggcattcagcaaaggttctcccc

SEQ ID NO: 777469 - DNA, 25 bp, Mus musculus
taggcattcagctaaggttctcccc

SEQ ID NO: 777470 - DNA, 25 bp, Mus musculus
taggcattcccactacactatgggt

SEQ ID NO: 777471 - DNA, 25 bp, Mus musculus
taggcattcccagtacactatgggt

SEQ ID NO: 777472 - DNA, 25 bp, Mus musculus
taggcattggcaacgttcagtgcaa

SEQ ID NO: 777473 - DNA, 25 bp, Mus musculus
taggcattggcatcgttcagtgcaa

SEQ ID NO: 777474 - DNA, 25 bp, Mus musculus
taggcattgggaacccttcacagac

SEQ ID NO: 777475 - DNA, 25 bp, Mus musculus
taggcattgggatcccttcacagac

SEQ ID NO: 777476 - DNA, 25 bp, Mus musculus
taggcattgtgtactgtcatatcag

SEQ ID NO: 777477 - DNA, 25 bp, Mus musculus
taggcattgtgttctgtcatatcag

SEQ ID NO: 777478 - DNA, 25 bp, Mus musculus
taggcattgtttataactattgagc

SEQ ID NO: 777479 - DNA, 25 bp, Mus musculus
taggcattgtttttaactattgagc

SEQ ID NO: 777480 - DNA, 25 bp, Mus musculus
taggcatttcagattatcttgggtt

SEQ ID NO: 777481 - DNA, 25 bp, Mus musculus
taggcatttcagtttatcttgggtt

SEQ ID NO: 777482 - DNA, 25 bp, Mus musculus
taggccaaaccgctgatgcagaaat

SEQ ID NO: 777483 - DNA, 25 bp, Mus musculus
taggccaaaccggtgatgcagaaat

SEQ ID NO: 777484 - DNA, 25 bp, Mus musculus
taggccaaacctagtacttcgaaga

SEQ ID NO: 777485 - DNA, 25 bp, Mus musculus
taggccaaaccttgtacttcgaaga

SEQ ID NO: 777486 - DNA, 25 bp, Mus musculus
taggccaaactgctggagccaggtt

SEQ ID NO: 777487 - DNA, 25 bp, Mus musculus
taggccaaactggtggagccaggtt

SEQ ID NO: 777488 - DNA, 25 bp, Mus musculus
taggccaaccttacaggccaattgg

SEQ ID NO: 777489 - DNA, 25 bp, Mus musculus
taggccaacctttcaggccaattgg

SEQ ID NO: 777490 - DNA, 25 bp, Mus musculus
taggccaatttcagagcagcagatc

SEQ ID NO: 777491 - DNA, 25 bp, Mus musculus
taggccaatttctgagcagcagatc

SEQ ID NO: 777492 - DNA, 25 bp, Mus musculus
taggccacaagcctgctagatcttt

SEQ ID NO: 777493 - DNA, 25 bp, Mus musculus
taggccacaagcgtgctagatcttt

SEQ ID NO: 777494 - DNA, 25 bp, Mus musculus
taggccacaccacagattttcaaag

SEQ ID NO: 777495 - DNA, 25 bp, Mus musculus
taggccacaccagagattttcaaag

SEQ ID NO: 777496 - DNA, 25 bp, Mus musculus
taggccacagaaccctccttaaggg

SEQ ID NO: 777497 - DNA, 25 bp, Mus musculus
taggccacagaagcctccttaaggg

SEQ ID NO: 777498 - DNA, 25 bp, Mus musculus
taggccacagataactcagcagtta

SEQ ID NO: 777499 - DNA, 25 bp, Mus musculus
taggccacagattactcagcagtta

SEQ ID NO: 777500 - DNA, 25 bp, Mus musculus
taggccacaggcactagatctgcta

SEQ ID NO: 777501 - DNA, 25 bp, Mus musculus
taggccacaggctctagatctgcta

SEQ ID NO: 777502 - DNA, 25 bp, Mus musculus
taggccaccctgatgctcagagaga

SEQ ID NO: 777503 - DNA, 25 bp, Mus musculus
taggccaccctgttgctcagagaga

SEQ ID NO: 777504 - DNA, 25 bp, Mus musculus
taggccacgcacactgctgcaggga

SEQ ID NO: 777505 - DNA, 25 bp, Mus musculus
taggccacgcactctgctgcaggga

SEQ ID NO: 777506 - DNA, 25 bp, Mus musculus
taggccactggcaactgaactcaca

SEQ ID NO: 777507 - DNA, 25 bp, Mus musculus
taggccactggctactgaactcaca

SEQ ID NO: 777508 - DNA, 25 bp, Mus musculus
taggccagaagccactacgtgactc

SEQ ID NO: 777509 - DNA, 25 bp, Mus musculus
taggccagaagcgactacgtgactc

SEQ ID NO: 777510 - DNA, 25 bp, Mus musculus
taggccagaagtacccaactgtgag

SEQ ID NO: 777511 - DNA, 25 bp, Mus musculus
taggccagaagttcccaactgtgag

SEQ ID NO: 777512 - DNA, 25 bp, Mus musculus
taggccagatccatcactggaggac

SEQ ID NO: 777513 - DNA, 25 bp, Mus musculus
taggccagatccttcactggaggac

SEQ ID NO: 777514 - DNA, 25 bp, Mus musculus
taggccaggagccacccagagtcat

SEQ ID NO: 777515 - DNA, 25 bp, Mus musculus
taggccaggagcgacccagagtcat

SEQ ID NO: 777516 - DNA, 25 bp, Mus musculus
taggccaggccaagtggctacagca

SEQ ID NO: 777517 - DNA, 25 bp, Mus musculus
taggccaggccatgtggctacagca

SEQ ID NO: 777518 - DNA, 25 bp, Mus musculus
taggccaggcctcatgctgcatggt

SEQ ID NO: 777519 - DNA, 25 bp, Mus musculus
taggccaggcctgatgctgcatggt

SEQ ID NO: 777520 - DNA, 25 bp, Mus musculus
taggccagtctgcataatcgacaga

SEQ ID NO: 777521 - DNA, 25 bp, Mus musculus
taggccagtctggataatcgacaga

SEQ ID NO: 777522 - DNA, 25 bp, Mus musculus
taggccagtgatcctgtgtactata

SEQ ID NO: 777523 - DNA, 25 bp, Mus musculus
taggccagtgatgctgtgtactata

SEQ ID NO: 777524 - DNA, 25 bp, Mus musculus
taggccagtgctctatcgctgggct

SEQ ID NO: 777525 - DNA, 25 bp, Mus musculus
taggccagtgctgtatcgctgggct

SEQ ID NO: 777526 - DNA, 25 bp, Mus musculus
taggccatctctatatcattcactt

SEQ ID NO: 777527 - DNA, 25 bp, Mus musculus
taggccatctctttatcattcactt

SEQ ID NO: 777528 - DNA, 25 bp, Mus musculus
taggccatgttcaggcctgggtaga

SEQ ID NO: 777529 - DNA, 25 bp, Mus musculus
taggccatgttctggcctgggtaga

SEQ ID NO: 777530 - DNA, 25 bp, Mus musculus
taggccattatcaggagtcaggatc

SEQ ID NO: 777531 - DNA, 25 bp, Mus musculus
taggccattatctggagtcaggatc

SEQ ID NO: 777532 - DNA, 25 bp, Mus musculus
taggccattcctacttggctttcaa

SEQ ID NO: 777533 - DNA, 25 bp, Mus musculus
taggccattccttcttggctttcaa

SEQ ID NO: 777534 - DNA, 25 bp, Mus musculus
taggccattcgaagacagccttttt

SEQ ID NO: 777535 - DNA, 25 bp, Mus musculus
taggccattcgatgacagccttttt

SEQ ID NO: 777536 - DNA, 25 bp, Mus musculus
taggccattcggaacttctgggtgc

SEQ ID NO: 777537 - DNA, 25 bp, Mus musculus
taggccattcggtacttctgggtgc

SEQ ID NO: 777538 - DNA, 25 bp, Mus musculus
taggccattgatccatctttccgac

SEQ ID NO: 777539 - DNA, 25 bp, Mus musculus
taggccattgatgcatctttccgac

SEQ ID NO: 777540 - DNA, 25 bp, Mus musculus
taggccattgtaaacacttgtatat

SEQ ID NO: 777541 - DNA, 25 bp, Mus musculus
taggccattgtatacacttgtatat

SEQ ID NO: 777542 - DNA, 25 bp, Mus musculus
taggcccaaaagcttactctcataa

SEQ ID NO: 777543 - DNA, 25 bp, Mus musculus
taggcccaaaaggttactctcataa

SEQ ID NO: 777544 - DNA, 25 bp, Mus musculus
taggcccaaaccacaaggtcacagt

SEQ ID NO: 777545 - DNA, 25 bp, Mus musculus
taggcccaaacctcaaggtcacagt

SEQ ID NO: 777546 - DNA, 25 bp, Mus musculus
taggcccaacagatcagtacccaag

SEQ ID NO: 777547 - DNA, 25 bp, Mus musculus
taggcccaacagttcagtacccaag

SEQ ID NO: 777548 - DNA, 25 bp, Mus musculus
taggcccaagccagccgctgaagtt

SEQ ID NO: 777549 - DNA, 25 bp, Mus musculus
taggcccaagcctgccgctgaagtt

SEQ ID NO: 777550 - DNA, 25 bp, Mus musculus
taggcccacttgcaatcccagacat

SEQ ID NO: 777551 - DNA, 25 bp, Mus musculus
taggcccacttggaatcccagacat

SEQ ID NO: 777552 - DNA, 25 bp, Mus musculus
taggcccagaagcacctgtgataca

SEQ ID NO: 777553 - DNA, 25 bp, Mus musculus
taggcccagaaggacctgtgataca

SEQ ID NO: 777554 - DNA, 25 bp, Mus musculus
taggcccagctcacagaaacttgga

SEQ ID NO: 777555 - DNA, 25 bp, Mus musculus
taggcccagctctcagaaacttgga

SEQ ID NO: 777556 - DNA, 25 bp, Mus musculus
taggcccataggagatcagcccagg

SEQ ID NO: 777557 - DNA, 25 bp, Mus musculus
taggcccataggtgatcagcccagg

SEQ ID NO: 777558 - DNA, 25 bp, Mus musculus
taggcccatgaactggattggactt

SEQ ID NO: 777559 - DNA, 25 bp, Mus musculus
taggcccatgaagtggattggactt

SEQ ID NO: 777560 - DNA, 25 bp, Mus musculus
taggcccctaatatgctgcttttaa

SEQ ID NO: 777561 - DNA, 25 bp, Mus musculus
taggcccctaatttgctgcttttaa

SEQ ID NO: 777562 - DNA, 25 bp, Mus musculus
taggcccctaggacatttggatttt

SEQ ID NO: 777563 - DNA, 25 bp, Mus musculus
taggcccctaggtcatttggatttt

SEQ ID NO: 777564 - DNA, 25 bp, Mus musculus
taggcccctctgctaccaagtaggg

SEQ ID NO: 777565 - DNA, 25 bp, Mus musculus
taggcccctctggtaccaagtaggg

SEQ ID NO: 777566 - DNA, 25 bp, Mus musculus
taggcccctcttattatccattaca

SEQ ID NO: 777567 - DNA, 25 bp, Mus musculus
taggcccctctttttatccattaca

SEQ ID NO: 777568 - DNA, 25 bp, Mus musculus
taggcccctgttagtaagtacgctg

SEQ ID NO: 777569 - DNA, 25 bp, Mus musculus
taggcccctgtttgtaagtacgctg

SEQ ID NO: 777570 - DNA, 25 bp, Mus musculus
taggcccgaggaatatcagcttcat

SEQ ID NO: 777571 - DNA, 25 bp, Mus musculus
taggcccgaggattatcagcttcat

SEQ ID NO: 777572 - DNA, 25 bp, Mus musculus
taggccctaacccaaggctgagcat

SEQ ID NO: 777573 - DNA, 25 bp, Mus musculus
taggccctaaccgaaggctgagcat

SEQ ID NO: 777574 - DNA, 25 bp, Mus musculus
taggccctaataagctttgcacatt

SEQ ID NO: 777575 - DNA, 25 bp, Mus musculus
taggccctaatatgctttgcacatt

SEQ ID NO: 777576 - DNA, 25 bp, Mus musculus
taggccctacttcttagtaccttgt

SEQ ID NO: 777577 - DNA, 25 bp, Mus musculus
taggccctacttgttagtaccttgt

SEQ ID NO: 777578 - DNA, 25 bp, Mus musculus
taggccctaggccaactttcttagt

SEQ ID NO: 777579 - DNA, 25 bp, Mus musculus
taggccctaggcgaactttcttagt

SEQ ID NO: 777580 - DNA, 25 bp, Mus musculus
taggccctagggagtttttcatcct

SEQ ID NO: 777581 - DNA, 25 bp, Mus musculus
taggccctagggtgtttttcatcct

SEQ ID NO: 777582 - DNA, 25 bp, Mus musculus
taggccctatataattattctgtta

SEQ ID NO: 777583 - DNA, 25 bp, Mus musculus
taggccctatattattattctgtta

SEQ ID NO: 777584 - DNA, 25 bp, Mus musculus
taggccctatgtatgtggaccagta

SEQ ID NO: 777585 - DNA, 25 bp, Mus musculus
taggccctatgtcagagagtccagt

SEQ ID NO: 777586 - DNA, 25 bp, Mus musculus
taggccctatgtgagagagtccagt

SEQ ID NO: 777587 - DNA, 25 bp, Mus musculus
taggccctatgtttgtggaccagta

SEQ ID NO: 777588 - DNA, 25 bp, Mus musculus
taggccctcaaacaatctgtcgaat

SEQ ID NO: 777589 - DNA, 25 bp, Mus musculus
taggccctcaaagaatctgtcgaat

SEQ ID NO: 777590 - DNA, 25 bp, Mus musculus
taggccctcaagaatgacgttccca

SEQ ID NO: 777591 - DNA, 25 bp, Mus musculus
taggccctcaagtatgacgttccca

SEQ ID NO: 777592 - DNA, 25 bp, Mus musculus
taggccctcagtcaccgccttagaa

SEQ ID NO: 777593 - DNA, 25 bp, Mus musculus
taggccctcagtgaccgccttagaa

SEQ ID NO: 777594 - DNA, 25 bp, Mus musculus
taggccctcatgagctcggcatgtc

SEQ ID NO: 777595 - DNA, 25 bp, Mus musculus
taggccctcatgtgctcggcatgtc

SEQ ID NO: 777596 - DNA, 25 bp, Mus musculus
taggccctctaacggttaaatgcca

SEQ ID NO: 777597 - DNA, 25 bp, Mus musculus
taggccctctaagggttaaatgcca

SEQ ID NO: 777598 - DNA, 25 bp, Mus musculus
taggccctgaacagaggtagtcttg

SEQ ID NO: 777599 - DNA, 25 bp, Mus musculus
taggccctgaactgaggtagtcttg

SEQ ID NO: 777600 - DNA, 25 bp, Mus musculus
taggccctgagcagctggagaacac

SEQ ID NO: 777601 - DNA, 25 bp, Mus musculus
taggccctgagctgctggagaacac

SEQ ID NO: 777602 - DNA, 25 bp, Mus musculus
taggccctgattatatggagcccat

SEQ ID NO: 777603 - DNA, 25 bp, Mus musculus
taggccctgattttatggagcccat

SEQ ID NO: 777604 - DNA, 25 bp, Mus musculus
taggccctggccaggattgtgcaca

SEQ ID NO: 777605 - DNA, 25 bp, Mus musculus
taggccctggcctggattgtgcaca

SEQ ID NO: 777606 - DNA, 25 bp, Mus musculus
taggccctgtccctttgatgttaag

SEQ ID NO: 777607 - DNA, 25 bp, Mus musculus
taggccctgtccgtttgatgttaag

SEQ ID NO: 777608 - DNA, 25 bp, Mus musculus
taggccctgtgcatacactgatgat

SEQ ID NO: 777609 - DNA, 25 bp, Mus musculus
taggccctgtgcttacactgatgat

SEQ ID NO: 777610 - DNA, 25 bp, Mus musculus
taggcccttacgactgtcagaatcc

SEQ ID NO: 777611 - DNA, 25 bp, Mus musculus
taggcccttacgtctgtcagaatcc

SEQ ID NO: 777612 - DNA, 25 bp, Mus musculus
taggcccttcacacatatgttacag

SEQ ID NO: 777613 - DNA, 25 bp, Mus musculus
taggcccttcactcatatgttacag

SEQ ID NO: 777614 - DNA, 25 bp, Mus musculus
taggcccttcctatgagaggtaaaa

SEQ ID NO: 777615 - DNA, 25 bp, Mus musculus
taggcccttcctttgagaggtaaaa

SEQ ID NO: 777616 - DNA, 25 bp, Mus musculus
taggcccttcggaaagctgcttgtt

SEQ ID NO: 777617 - DNA, 25 bp, Mus musculus
taggcccttcggtaagctgcttgtt

SEQ ID NO: 777618 - DNA, 25 bp, Mus musculus
taggcccttgctacacgggcactca

SEQ ID NO: 777619 - DNA, 25 bp, Mus musculus
taggcccttgcttcacgggcactca

SEQ ID NO: 777620 - DNA, 25 bp, Mus musculus
taggccgacccaaaggtgccctggc

SEQ ID NO: 777621 - DNA, 25 bp, Mus musculus
taggccgacccataggtgccctggc

SEQ ID NO: 777622 - DNA, 25 bp, Mus musculus
taggccgacgagatcccagttaagt

SEQ ID NO: 777623 - DNA, 25 bp, Mus musculus
taggccgacgagttcccagttaagt

SEQ ID NO: 777624 - DNA, 25 bp, Mus musculus
taggccgataatctgctttttgagt

SEQ ID NO: 777625 - DNA, 25 bp, Mus musculus
taggccgataatgtgctttttgagt

SEQ ID NO: 777626 - DNA, 25 bp, Mus musculus
taggccgcggctcggttaatattca

SEQ ID NO: 777627 - DNA, 25 bp, Mus musculus
taggccgcggctgggttaatattca

SEQ ID NO: 777628 - DNA, 25 bp, Mus musculus
taggccgctgggacttcgatactca

SEQ ID NO: 777629 - DNA, 25 bp, Mus musculus
taggccgctgggtcttcgatactca

SEQ ID NO: 777630 - DNA, 25 bp, Mus musculus
taggccggggtcaagcaaacacata

SEQ ID NO: 777631 - DNA, 25 bp, Mus musculus
taggccggggtctagcaaacacata

SEQ ID NO: 777632 - DNA, 25 bp, Mus musculus
taggccgtacggcagcagccagtct

SEQ ID NO: 777633 - DNA, 25 bp, Mus musculus
taggccgtacgggagcagccagtct

SEQ ID NO: 777634 - DNA, 25 bp, Mus musculus
taggccgtgtagaacacataattca

SEQ ID NO: 777635 - DNA, 25 bp, Mus musculus
taggccgtgtagtacacataattca

SEQ ID NO: 777636 - DNA, 25 bp, Mus musculus
taggccgttttgctctacagtccca

SEQ ID NO: 777637 - DNA, 25 bp, Mus musculus
taggccgttttggtctacagtccca

SEQ ID NO: 777638 - DNA, 25 bp, Mus musculus
taggcctacctaatgtcctggcaga

SEQ ID NO: 777639 - DNA, 25 bp, Mus musculus
taggcctacctattgtcctggcaga

SEQ ID NO: 777640 - DNA, 25 bp, Mus musculus
taggcctagaccactgggtttttca

SEQ ID NO: 777641 - DNA, 25 bp, Mus musculus
taggcctagacctctgggtttttca

SEQ ID NO: 777642 - DNA, 25 bp, Mus musculus
taggcctagcttcttccatttacat

SEQ ID NO: 777643 - DNA, 25 bp, Mus musculus
taggcctagcttgttccatttacat

SEQ ID NO: 777644 - DNA, 25 bp, Mus musculus
taggcctattgtaaacagggctgca

SEQ ID NO: 777645 - DNA, 25 bp, Mus musculus
taggcctattgttaacagggctgca

SEQ ID NO: 777646 - DNA, 25 bp, Mus musculus
taggcctcatttacccagaattcat

SEQ ID NO: 777647 - DNA, 25 bp, Mus musculus
taggcctcattttcccagaattcat

SEQ ID NO: 777648 - DNA, 25 bp, Mus musculus
taggcctccttgcacatatggaaca

SEQ ID NO: 777649 - DNA, 25 bp, Mus musculus
taggcctccttggacatatggaaca

SEQ ID NO: 777650 - DNA, 25 bp, Mus musculus
taggcctctgcaccacatgtgctgg

SEQ ID NO: 777651 - DNA, 25 bp, Mus musculus
taggcctctgcagcacatgtgctgg

SEQ ID NO: 777652 - DNA, 25 bp, Mus musculus
taggcctgactccttgtgttgagct

SEQ ID NO: 777653 - DNA, 25 bp, Mus musculus
taggcctgactcgttgtgttgagct

SEQ ID NO: 777654 - DNA, 25 bp, Mus musculus
taggcctgacttaaaaattacacaa

SEQ ID NO: 777655 - DNA, 25 bp, Mus musculus
taggcctgactttaaaattacacaa

SEQ ID NO: 777656 - DNA, 25 bp, Mus musculus
taggcctgaggtacaggttcctgtg

SEQ ID NO: 777657 - DNA, 25 bp, Mus musculus
taggcctgaggttcaggttcctgtg

SEQ ID NO: 777658 - DNA, 25 bp, Mus musculus
taggcctgagtaacacttggtgtgc

SEQ ID NO: 777659 - DNA, 25 bp, Mus musculus
taggcctgagtatcacttggtgtgc

SEQ ID NO: 777660 - DNA, 25 bp, Mus musculus
taggcctgatctagaacctaccctc

SEQ ID NO: 777661 - DNA, 25 bp, Mus musculus
taggcctgatcttgaacctaccctc

SEQ ID NO: 777662 - DNA, 25 bp, Mus musculus
taggcctgctcaccgtagacaattg

SEQ ID NO: 777663 - DNA, 25 bp, Mus musculus
taggcctgctcagcgtagacaattg

SEQ ID NO: 777664 - DNA, 25 bp, Mus musculus
taggcctgcttcactatgtatgaca

SEQ ID NO: 777665 - DNA, 25 bp, Mus musculus
taggcctgcttctctatgtatgaca

SEQ ID NO: 777666 - DNA, 25 bp, Mus musculus
taggcctggactaggctgcgtagct

SEQ ID NO: 777667 - DNA, 25 bp, Mus musculus
taggcctggacttggctgcgtagct

SEQ ID NO: 777668 - DNA, 25 bp, Mus musculus
taggcctggcatcttctctcatgga

SEQ ID NO: 777669 - DNA, 25 bp, Mus musculus
taggcctggcatgttctctcatgga

SEQ ID NO: 777670 - DNA, 25 bp, Mus musculus
taggcctggcctatccgaggcgcgt

SEQ ID NO: 777671 - DNA, 25 bp, Mus musculus
taggcctggcctttccgaggcgcgt

SEQ ID NO: 777672 - DNA, 25 bp, Mus musculus
taggcctgggagataactcttcttg

SEQ ID NO: 777673 - DNA, 25 bp, Mus musculus
taggcctgggagttaactcttcttg

SEQ ID NO: 777674 - DNA, 25 bp, Mus musculus
taggcctgtctcattcgttaaaagc

SEQ ID NO: 777675 - DNA, 25 bp, Mus musculus
taggcctgtctctttcgttaaaagc

SEQ ID NO: 777676 - DNA, 25 bp, Mus musculus
taggccttaacccaaggcaacctct

SEQ ID NO: 777677 - DNA, 25 bp, Mus musculus
taggccttaaccgaaggcaacctct

SEQ ID NO: 777678 - DNA, 25 bp, Mus musculus
taggccttactgcaagccgctgagg

SEQ ID NO: 777679 - DNA, 25 bp, Mus musculus
taggccttactggaagccgctgagg

SEQ ID NO: 777680 - DNA, 25 bp, Mus musculus
taggccttcagcatgacattcttca

SEQ ID NO: 777681 - DNA, 25 bp, Mus musculus
taggccttcagcttgacattcttca

SEQ ID NO: 777682 - DNA, 25 bp, Mus musculus
taggccttcctaaaatcaatttgca

SEQ ID NO: 777683 - DNA, 25 bp, Mus musculus
taggccttcctataatcaatttgca

SEQ ID NO: 777684 - DNA, 25 bp, Mus musculus
taggccttgacaactatgattacag

SEQ ID NO: 777685 - DNA, 25 bp, Mus musculus
taggccttgacatctatgattacag

SEQ ID NO: 777686 - DNA, 25 bp, Mus musculus
taggccttgccacggtcttctagat

SEQ ID NO: 777687 - DNA, 25 bp, Mus musculus
taggccttgccagggtcttctagat

SEQ ID NO: 777688 - DNA, 25 bp, Mus musculus
taggccttggccactgaaaatggct

SEQ ID NO: 777689 - DNA, 25 bp, Mus musculus
taggccttggcctctgaaaatggct

SEQ ID NO: 777690 - DNA, 25 bp, Mus musculus
taggccttggttccaagacctctga

SEQ ID NO: 777691 - DNA, 25 bp, Mus musculus
taggccttggttgcaagacctctga

SEQ ID NO: 777692 - DNA, 25 bp, Mus musculus
taggccttgtaaaaagcgctgtgtg

SEQ ID NO: 777693 - DNA, 25 bp, Mus musculus
taggccttgtaataagcgctgtgtg

SEQ ID NO: 777694 - DNA, 25 bp, Mus musculus
taggcctttagtccggagggatcca

SEQ ID NO: 777695 - DNA, 25 bp, Mus musculus
taggcctttagtgcggagggatcca

SEQ ID NO: 777696 - DNA, 25 bp, Mus musculus
taggcctttatgagtgactgctagg

SEQ ID NO: 777697 - DNA, 25 bp, Mus musculus
taggcctttatgtgtgactgctagg

SEQ ID NO: 777698 - DNA, 25 bp, Mus musculus
taggcctttccacgagatgggctct

SEQ ID NO: 777699 - DNA, 25 bp, Mus musculus
taggcctttccaggagatgggctct

SEQ ID NO: 777700 - DNA, 25 bp, Mus musculus
taggcctttgaaagctgcttctggc

SEQ ID NO: 777701 - DNA, 25 bp, Mus musculus
taggcctttgaatgctgcttctggc

SEQ ID NO: 777702 - DNA, 25 bp, Mus musculus
taggcctttgctactttactaaatg

SEQ ID NO: 777703 - DNA, 25 bp, Mus musculus
taggcctttgcttctttactaaatg

SEQ ID NO: 777704 - DNA, 25 bp, Mus musculus
taggcgaactggctgtacttttcct

SEQ ID NO: 777705 - DNA, 25 bp, Mus musculus
taggcgaactgggtgtacttttcct

SEQ ID NO: 777706 - DNA, 25 bp, Mus musculus
taggcgacagcgagagcactcccaa

SEQ ID NO: 777707 - DNA, 25 bp, Mus musculus
taggcgacagcgtgagcactcccaa

SEQ ID NO: 777708 - DNA, 25 bp, Mus musculus
taggcgacgaatcatcttgtcccat

SEQ ID NO: 777709 - DNA, 25 bp, Mus musculus
taggcgacgaatgatcttgtcccat

SEQ ID NO: 777710 - DNA, 25 bp, Mus musculus
taggcgagggaaactgctactccct

SEQ ID NO: 777711 - DNA, 25 bp, Mus musculus
taggcgagggaatctgctactccct

SEQ ID NO: 777712 - DNA, 25 bp, Mus musculus
taggcgataagtctacatttgttta

SEQ ID NO: 777713 - DNA, 25 bp, Mus musculus
taggcgataagtgtacatttgttta

SEQ ID NO: 777714 - DNA, 25 bp, Mus musculus
taggcgatgcttcgccagtacatga

SEQ ID NO: 777715 - DNA, 25 bp, Mus musculus
taggcgatgcttggccagtacatga

SEQ ID NO: 777716 - DNA, 25 bp, Mus musculus
taggcgcctccaagacgacgcggct

SEQ ID NO: 777717 - DNA, 25 bp, Mus musculus
taggcgcctccatgacgacgcggct

SEQ ID NO: 777718 - DNA, 25 bp, Mus musculus
taggcgctgataaactgagtcccat

SEQ ID NO: 777719 - DNA, 25 bp, Mus musculus
taggcgctgatatactgagtcccat

SEQ ID NO: 777720 - DNA, 25 bp, Mus musculus
taggcgctgatcaggatatctcctt

SEQ ID NO: 777721 - DNA, 25 bp, Mus musculus
taggcgctgatctggatatctcctt

SEQ ID NO: 777722 - DNA, 25 bp, Mus musculus
taggcgctgtgacggctagctttta

SEQ ID NO: 777723 - DNA, 25 bp, Mus musculus
taggcgctgtgagggctagctttta

SEQ ID NO: 777724 - DNA, 25 bp, Mus musculus
taggcgcttatgaaagcccggcagt

SEQ ID NO: 777725 - DNA, 25 bp, Mus musculus
taggcgcttatgtaagcccggcagt

SEQ ID NO: 777726 - DNA, 25 bp, Mus musculus
taggcggaacctaccggatctagaa

SEQ ID NO: 777727 - DNA, 25 bp, Mus musculus
taggcggaaccttccggatctagaa

SEQ ID NO: 777728 - DNA, 25 bp, Mus musculus
taggcggagactacgtgtttacaac

SEQ ID NO: 777729 - DNA, 25 bp, Mus musculus
taggcggagacttcgtgtttacaac

SEQ ID NO: 777730 - DNA, 25 bp, Mus musculus
taggcggcatcacggtgcctctcct

SEQ ID NO: 777731 - DNA, 25 bp, Mus musculus
taggcggcatcagggtgcctctcct

SEQ ID NO: 777732 - DNA, 25 bp, Mus musculus
taggcggccaagaagtcactccatg

SEQ ID NO: 777733 - DNA, 25 bp, Mus musculus
taggcggccaagtagtcactccatg

SEQ ID NO: 777734 - DNA, 25 bp, Mus musculus
taggcggctgagatcttggtgtatc

SEQ ID NO: 777735 - DNA, 25 bp, Mus musculus
taggcggctgagttcttggtgtatc

SEQ ID NO: 777736 - DNA, 25 bp, Mus musculus
taggcggctgtgactcagaccgcag

SEQ ID NO: 777737 - DNA, 25 bp, Mus musculus
taggcggctgtgtctcagaccgcag

SEQ ID NO: 777738 - DNA, 25 bp, Mus musculus
taggcgggaaggcattttcttagaa

SEQ ID NO: 777739 - DNA, 25 bp, Mus musculus
taggcgggaagggattttcttagaa

SEQ ID NO: 777740 - DNA, 25 bp, Mus musculus
taggcggttgagcttgttgatctta

SEQ ID NO: 777741 - DNA, 25 bp, Mus musculus
taggcggttgaggttgttgatctta

SEQ ID NO: 777742 - DNA, 25 bp, Mus musculus
taggcgtaagagaatatgcaccagg

SEQ ID NO: 777743 - DNA, 25 bp, Mus musculus
taggcgtaagagtatatgcaccagg

SEQ ID NO: 777744 - DNA, 25 bp, Mus musculus
taggcgtacagtcagtttgaaccat

SEQ ID NO: 777745 - DNA, 25 bp, Mus musculus
taggcgtacagtgagtttgaaccat

SEQ ID NO: 777746 - DNA, 25 bp, Mus musculus
taggcgtctttcagagatggcccag

SEQ ID NO: 777747 - DNA, 25 bp, Mus musculus
taggcgtctttctgagatggcccag

SEQ ID NO: 777748 - DNA, 25 bp, Mus musculus
taggcgtgccaacagttcaagagac

SEQ ID NO: 777749 - DNA, 25 bp, Mus musculus
taggcgtgccaagagttcaagagac

SEQ ID NO: 777750 - DNA, 25 bp, Mus musculus
taggcgtgggctacacagcttggaa

SEQ ID NO: 777751 - DNA, 25 bp, Mus musculus
taggcgtgggcttcacagcttggaa

SEQ ID NO: 777752 - DNA, 25 bp, Mus musculus
taggctaaaactcagtcacagggag

SEQ ID NO: 777753 - DNA, 25 bp, Mus musculus
taggctaaaactgagtcacagggag

SEQ ID NO: 777754 - DNA, 25 bp, Mus musculus
taggctaaactgagaaaattcccgt

SEQ ID NO: 777755 - DNA, 25 bp, Mus musculus
taggctaaactgtgaaaattcccgt

SEQ ID NO: 777756 - DNA, 25 bp, Mus musculus
taggctaagcctacagatgctgtat

SEQ ID NO: 777757 - DNA, 25 bp, Mus musculus
taggctaagccttcagatgctgtat

SEQ ID NO: 777758 - DNA, 25 bp, Mus musculus
taggctaagtcgacactgtccttca

SEQ ID NO: 777759 - DNA, 25 bp, Mus musculus
taggctaagtcgtcactgtccttca

SEQ ID NO: 777760 - DNA, 25 bp, Mus musculus
taggctaatgctcaacaagaccagt

SEQ ID NO: 777761 - DNA, 25 bp, Mus musculus
taggctaatgctgaacaagaccagt

SEQ ID NO: 777762 - DNA, 25 bp, Mus musculus
taggctaattatactctttcccatc

SEQ ID NO: 777763 - DNA, 25 bp, Mus musculus
taggctaattattctctttcccatc

SEQ ID NO: 777764 - DNA, 25 bp, Mus musculus
taggctacacagaaatacccagttt

SEQ ID NO: 777765 - DNA, 25 bp, Mus musculus
taggctacacagtaatacccagttt

SEQ ID NO: 777766 - DNA, 25 bp, Mus musculus
taggctacacctccagtcttgtgaa

SEQ ID NO: 777767 - DNA, 25 bp, Mus musculus
taggctacacctgcagtcttgtgaa

SEQ ID NO: 777768 - DNA, 25 bp, Mus musculus
taggctacactgagttcccagctga

SEQ ID NO: 777769 - DNA, 25 bp, Mus musculus
taggctacactgtgttcccagctga

SEQ ID NO: 777770 - DNA, 25 bp, Mus musculus
taggctacatagaaacatgtgcctc

SEQ ID NO: 777771 - DNA, 25 bp, Mus musculus
taggctacatagtaacatgtgcctc

SEQ ID NO: 777772 - DNA, 25 bp, Mus musculus
taggctacatctcaagacctagctt

SEQ ID NO: 777773 - DNA, 25 bp, Mus musculus
taggctacatctgaagacctagctt

SEQ ID NO: 777774 - DNA, 25 bp, Mus musculus
taggctaccatgaactaagtgctgt

SEQ ID NO: 777775 - DNA, 25 bp, Mus musculus
taggctaccatgtactaagtgctgt

SEQ ID NO: 777776 - DNA, 25 bp, Mus musculus
taggctaccctgattttccaactag

SEQ ID NO: 777777 - DNA, 25 bp, Mus musculus
taggctaccctgtttttccaactag

SEQ ID NO: 777778 - DNA, 25 bp, Mus musculus
taggctacgtacagggatgacccct

SEQ ID NO: 777779 - DNA, 25 bp, Mus musculus
taggctacgtactgggatgacccct

SEQ ID NO: 777780 - DNA, 25 bp, Mus musculus
taggctactatgaatgtcgcagact

SEQ ID NO: 777781 - DNA, 25 bp, Mus musculus
taggctactatgtatgtcgcagact

SEQ ID NO: 777782 - DNA, 25 bp, Mus musculus
taggctactctaataatggcagcac

SEQ ID NO: 777783 - DNA, 25 bp, Mus musculus
taggctactctattaatggcagcac

SEQ ID NO: 777784 - DNA, 25 bp, Mus musculus
taggctagcctcaaaacccagagat

SEQ ID NO: 777785 - DNA, 25 bp, Mus musculus
taggctagcctccaatttacagaga

SEQ ID NO: 777786 - DNA, 25 bp, Mus musculus
taggctagcctcgaatttacagaga

SEQ ID NO: 777787 - DNA, 25 bp, Mus musculus
taggctagcctctaaacccagagat

SEQ ID NO: 777788 - DNA, 25 bp, Mus musculus
taggctagcctgatttgctaagcaa

SEQ ID NO: 777789 - DNA, 25 bp, Mus musculus
taggctagcctgttttgctaagcaa

SEQ ID NO: 777790 - DNA, 25 bp, Mus musculus
taggctagggctctgtggtcaatac

SEQ ID NO: 777791 - DNA, 25 bp, Mus musculus
taggctagggctgtgtggtcaatac

SEQ ID NO: 777792 - DNA, 25 bp, Mus musculus
taggctaggtttagaaaccagccca

SEQ ID NO: 777793 - DNA, 25 bp, Mus musculus
taggctaggttttgaaaccagccca

SEQ ID NO: 777794 - DNA, 25 bp, Mus musculus
taggctatattccacctcgtctctc

SEQ ID NO: 777795 - DNA, 25 bp, Mus musculus
taggctatattcgacctcgtctctc

SEQ ID NO: 777796 - DNA, 25 bp, Mus musculus
taggctatcactcttcatctcagaa

SEQ ID NO: 777797 - DNA, 25 bp, Mus musculus
taggctatcactgttcatctcagaa

SEQ ID NO: 777798 - DNA, 25 bp, Mus musculus
taggctatggacctcatgtgcatat

SEQ ID NO: 777799 - DNA, 25 bp, Mus musculus
taggctatggacgtcatgtgcatat

SEQ ID NO: 777800 - DNA, 25 bp, Mus musculus
taggctcaacacagaacagctgatt

SEQ ID NO: 777801 - DNA, 25 bp, Mus musculus
taggctcaacactgaacagctgatt

SEQ ID NO: 777802 - DNA, 25 bp, Mus musculus
taggctcactaaagggccgtggttc

SEQ ID NO: 777803 - DNA, 25 bp, Mus musculus
taggctcactaatgggccgtggttc

SEQ ID NO: 777804 - DNA, 25 bp, Mus musculus
taggctcagattagccccagcgcgg

SEQ ID NO: 777805 - DNA, 25 bp, Mus musculus
taggctcagattcactcagttcagt

SEQ ID NO: 777806 - DNA, 25 bp, Mus musculus
taggctcagattgactcagttcagt

SEQ ID NO: 777807 - DNA, 25 bp, Mus musculus
taggctcagatttgccccagcgcgg

SEQ ID NO: 777808 - DNA, 25 bp, Mus musculus
taggctcagccaatcctttcagtag

SEQ ID NO: 777809 - DNA, 25 bp, Mus musculus
taggctcagccattcctttcagtag

SEQ ID NO: 777810 - DNA, 25 bp, Mus musculus
taggctcaggtaccttgttccttgg

SEQ ID NO: 777811 - DNA, 25 bp, Mus musculus
taggctcaggtagcttgttccttgg

SEQ ID NO: 777812 - DNA, 25 bp, Mus musculus
taggctcagtctctgacactgagaa

SEQ ID NO: 777813 - DNA, 25 bp, Mus musculus
taggctcagtctgtgacactgagaa

SEQ ID NO: 777814 - DNA, 25 bp, Mus musculus
taggctcattggcttgaacatgtag

SEQ ID NO: 777815 - DNA, 25 bp, Mus musculus
taggctcattgggttgaacatgtag

SEQ ID NO: 777816 - DNA, 25 bp, Mus musculus
taggctcatttgctgtggccaagct

SEQ ID NO: 777817 - DNA, 25 bp, Mus musculus
taggctcatttggtgtggccaagct

SEQ ID NO: 777818 - DNA, 25 bp, Mus musculus
taggctccaacgaaactgcaattta

SEQ ID NO: 777819 - DNA, 25 bp, Mus musculus
taggctccaacgtaactgcaattta

SEQ ID NO: 777820 - DNA, 25 bp, Mus musculus
taggctccatccataaaaaccccag

SEQ ID NO: 777821 - DNA, 25 bp, Mus musculus
taggctccatccttaaaaaccccag

SEQ ID NO: 777822 - DNA, 25 bp, Mus musculus
taggctccatgtcctttgcttcttg

SEQ ID NO: 777823 - DNA, 25 bp, Mus musculus
taggctccatgtgctttgcttcttg

SEQ ID NO: 777824 - DNA, 25 bp, Mus musculus
taggctcccacacatgatcctaggt

SEQ ID NO: 777825 - DNA, 25 bp, Mus musculus
taggctcccacagatgatcctaggt

SEQ ID NO: 777826 - DNA, 25 bp, Mus musculus
taggctcccaggctagacttacgtg

SEQ ID NO: 777827 - DNA, 25 bp, Mus musculus
taggctcccaggcttctgtagaatg

SEQ ID NO: 777828 - DNA, 25 bp, Mus musculus
taggctcccagggtagacttacgtg

SEQ ID NO: 777829 - DNA, 25 bp, Mus musculus
taggctcccagggttctgtagaatg

SEQ ID NO: 777830 - DNA, 25 bp, Mus musculus
taggctccctggaagaatctgtcct

SEQ ID NO: 777831 - DNA, 25 bp, Mus musculus
taggctccctggtagaatctgtcct

SEQ ID NO: 777832 - DNA, 25 bp, Mus musculus
taggctccggctacccacagggaaa

SEQ ID NO: 777833 - DNA, 25 bp, Mus musculus
taggctccggcttcccacagggaaa

SEQ ID NO: 777834 - DNA, 25 bp, Mus musculus
taggctcctaatctctgtctctggg

SEQ ID NO: 777835 - DNA, 25 bp, Mus musculus
taggctcctaatgtctgtctctggg

SEQ ID NO: 777836 - DNA, 25 bp, Mus musculus
taggctcctagcattgtttccacag

SEQ ID NO: 777837 - DNA, 25 bp, Mus musculus
taggctcctagctttgtttccacag

SEQ ID NO: 777838 - DNA, 25 bp, Mus musculus
taggctcctgaccatgttgcaagaa

SEQ ID NO: 777839 - DNA, 25 bp, Mus musculus
taggctcctgacgatgttgcaagaa

SEQ ID NO: 777840 - DNA, 25 bp, Mus musculus
taggctcctgcaatcacatgtgcat

SEQ ID NO: 777841 - DNA, 25 bp, Mus musculus
taggctcctgcattcacatgtgcat

SEQ ID NO: 777842 - DNA, 25 bp, Mus musculus
taggctcctgtgctttgtataggtc

SEQ ID NO: 777843 - DNA, 25 bp, Mus musculus
taggctcctgtggtttgtataggtc

SEQ ID NO: 777844 - DNA, 25 bp, Mus musculus
taggctccttcgctattggaccaga

SEQ ID NO: 777845 - DNA, 25 bp, Mus musculus
taggctccttcggtattggaccaga

SEQ ID NO: 777846 - DNA, 25 bp, Mus musculus
taggctcgggttaggcactaagata

SEQ ID NO: 777847 - DNA, 25 bp, Mus musculus
taggctcgggtttggcactaagata

SEQ ID NO: 777848 - DNA, 25 bp, Mus musculus
taggctctaaaccatgcatctcaaa

SEQ ID NO: 777849 - DNA, 25 bp, Mus musculus
taggctctaaacgatgcatctcaaa

SEQ ID NO: 777850 - DNA, 25 bp, Mus musculus
taggctctgcccagtagatttcact

SEQ ID NO: 777851 - DNA, 25 bp, Mus musculus
taggctctgccctgtagatttcact

SEQ ID NO: 777852 - DNA, 25 bp, Mus musculus
taggctctggaaatcttgccctgtg

SEQ ID NO: 777853 - DNA, 25 bp, Mus musculus
taggctctggaattcttgccctgtg

SEQ ID NO: 777854 - DNA, 25 bp, Mus musculus
taggctctggccatttggagaagaa

SEQ ID NO: 777855 - DNA, 25 bp, Mus musculus
taggctctggccttttggagaagaa

SEQ ID NO: 777856 - DNA, 25 bp, Mus musculus
taggctctgggacagccctaccata

SEQ ID NO: 777857 - DNA, 25 bp, Mus musculus
taggctctgggagagccctaccata

SEQ ID NO: 777858 - DNA, 25 bp, Mus musculus
taggctctgggcatagaactcaagt

SEQ ID NO: 777859 - DNA, 25 bp, Mus musculus
taggctctgggcttagaactcaagt

SEQ ID NO: 777860 - DNA, 25 bp, Mus musculus
taggctctgtatacagaacacaaga

SEQ ID NO: 777861 - DNA, 25 bp, Mus musculus
taggctctgtattcagaacacaaga

SEQ ID NO: 777862 - DNA, 25 bp, Mus musculus
taggctcttacaactggagtttatg

SEQ ID NO: 777863 - DNA, 25 bp, Mus musculus
taggctcttacacgccaagtggatg

SEQ ID NO: 777864 - DNA, 25 bp, Mus musculus
taggctcttacaggccaagtggatg

SEQ ID NO: 777865 - DNA, 25 bp, Mus musculus
taggctcttacatctggagtttatg

SEQ ID NO: 777866 - DNA, 25 bp, Mus musculus
taggctcttcccaaatgtttcatct

SEQ ID NO: 777867 - DNA, 25 bp, Mus musculus
taggctcttccctaatgtttcatct

SEQ ID NO: 777868 - DNA, 25 bp, Mus musculus
taggctcttccgcaattacacacat

SEQ ID NO: 777869 - DNA, 25 bp, Mus musculus
taggctcttccggaattacacacat

SEQ ID NO: 777870 - DNA, 25 bp, Mus musculus
taggctcttggcctcacatcaaagc

SEQ ID NO: 777871 - DNA, 25 bp, Mus musculus
taggctcttggcctgttagtagcct

SEQ ID NO: 777872 - DNA, 25 bp, Mus musculus
taggctcttggcgtcacatcaaagc

SEQ ID NO: 777873 - DNA, 25 bp, Mus musculus
taggctcttggcgtgttagtagcct

SEQ ID NO: 777874 - DNA, 25 bp, Mus musculus
taggctctttgtatgtctgggcttt

SEQ ID NO: 777875 - DNA, 25 bp, Mus musculus
taggctctttgtttgtctgggcttt

SEQ ID NO: 777876 - DNA, 25 bp, Mus musculus
taggctgaaaccaagcggccccaag

SEQ ID NO: 777877 - DNA, 25 bp, Mus musculus
taggctgaaacctagcggccccaag

SEQ ID NO: 777878 - DNA, 25 bp, Mus musculus
taggctgaaatgaacccttcgtgca

SEQ ID NO: 777879 - DNA, 25 bp, Mus musculus
taggctgaaatgtacccttcgtgca

SEQ ID NO: 777880 - DNA, 25 bp, Mus musculus
taggctgaccaactagtcccaggca

SEQ ID NO: 777881 - DNA, 25 bp, Mus musculus
taggctgaccaagtagtcccaggca

SEQ ID NO: 777882 - DNA, 25 bp, Mus musculus
taggctgaccagagattacagaatt

SEQ ID NO: 777883 - DNA, 25 bp, Mus musculus
taggctgaccagtgattacagaatt

SEQ ID NO: 777884 - DNA, 25 bp, Mus musculus
taggctgactaccaaggtcccctat

SEQ ID NO: 777885 - DNA, 25 bp, Mus musculus
taggctgactacgaaggtcccctat

SEQ ID NO: 777886 - DNA, 25 bp, Mus musculus
taggctgactagcagctttcctgta

SEQ ID NO: 777887 - DNA, 25 bp, Mus musculus
taggctgactaggagctttcctgta

SEQ ID NO: 777888 - DNA, 25 bp, Mus musculus
taggctgactccatcgagccgatgt

SEQ ID NO: 777889 - DNA, 25 bp, Mus musculus
taggctgactccttcgagccgatgt

SEQ ID NO: 777890 - DNA, 25 bp, Mus musculus
taggctgaggccagtctgccactgc

SEQ ID NO: 777891 - DNA, 25 bp, Mus musculus
taggctgaggcctgtctgccactgc

SEQ ID NO: 777892 - DNA, 25 bp, Mus musculus
taggctgaggtccatgtctgagttc

SEQ ID NO: 777893 - DNA, 25 bp, Mus musculus
taggctgaggtcgatgtctgagttc

SEQ ID NO: 777894 - DNA, 25 bp, Mus musculus
taggctgatgcgctgcttagctcca

SEQ ID NO: 777895 - DNA, 25 bp, Mus musculus
taggctgatgcggtgcttagctcca

SEQ ID NO: 777896 - DNA, 25 bp, Mus musculus
taggctgcaagccatacctggacag

SEQ ID NO: 777897 - DNA, 25 bp, Mus musculus
taggctgcaagcgatacctggacag

SEQ ID NO: 777898 - DNA, 25 bp, Mus musculus
taggctgcaattatgagacacaatc

SEQ ID NO: 777899 - DNA, 25 bp, Mus musculus
taggctgcaattttgagacacaatc

SEQ ID NO: 777900 - DNA, 25 bp, Mus musculus
taggctgcaccaagtatatgtaaca

SEQ ID NO: 777901 - DNA, 25 bp, Mus musculus
taggctgcaccatgtatatgtaaca

SEQ ID NO: 777902 - DNA, 25 bp, Mus musculus
taggctgcacctaaagtggccaaga

SEQ ID NO: 777903 - DNA, 25 bp, Mus musculus
taggctgcaccttaagtggccaaga

SEQ ID NO: 777904 - DNA, 25 bp, Mus musculus
taggctgcagctccctgcatttact

SEQ ID NO: 777905 - DNA, 25 bp, Mus musculus
taggctgcagctgcctgcatttact

SEQ ID NO: 777906 - DNA, 25 bp, Mus musculus
taggctgcattgatttgagttcatt

SEQ ID NO: 777907 - DNA, 25 bp, Mus musculus
taggctgcattgttttgagttcatt

SEQ ID NO: 777908 - DNA, 25 bp, Mus musculus
taggctgcatttcccaatgaggttt

SEQ ID NO: 777909 - DNA, 25 bp, Mus musculus
taggctgcatttgccaatgaggttt

SEQ ID NO: 777910 - DNA, 25 bp, Mus musculus
taggctgccactcggtactgaggcc

SEQ ID NO: 777911 - DNA, 25 bp, Mus musculus
taggctgccactgggtactgaggcc

SEQ ID NO: 777912 - DNA, 25 bp, Mus musculus
taggctgccgctacacagtgtagac

SEQ ID NO: 777913 - DNA, 25 bp, Mus musculus
taggctgccgcttcacagtgtagac

SEQ ID NO: 777914 - DNA, 25 bp, Mus musculus
taggctgctattcatgtctgtaata

SEQ ID NO: 777915 - DNA, 25 bp, Mus musculus
taggctgctattgatgtctgtaata

SEQ ID NO: 777916 - DNA, 25 bp, Mus musculus
taggctgctcctacttaaagttttc

SEQ ID NO: 777917 - DNA, 25 bp, Mus musculus
taggctgctccttcttaaagttttc

SEQ ID NO: 777918 - DNA, 25 bp, Mus musculus
taggctgctgctagcattctgtcct

SEQ ID NO: 777919 - DNA, 25 bp, Mus musculus
taggctgctgcttgcattctgtcct

SEQ ID NO: 777920 - DNA, 25 bp, Mus musculus
taggctgctgggaccagtgtcaaat

SEQ ID NO: 777921 - DNA, 25 bp, Mus musculus
taggctgctgggtccagtgtcaaat

SEQ ID NO: 777922 - DNA, 25 bp, Mus musculus
taggctgctgttcagtatactgtaa

SEQ ID NO: 777923 - DNA, 25 bp, Mus musculus
taggctgctgttgagtatactgtaa

SEQ ID NO: 777924 - DNA, 25 bp, Mus musculus
taggctggacatagtggtgtatgcc

SEQ ID NO: 777925 - DNA, 25 bp, Mus musculus
taggctggacattgtggtgtatgcc

SEQ ID NO: 777926 - DNA, 25 bp, Mus musculus
taggctggcatgactgaacatatga

SEQ ID NO: 777927 - DNA, 25 bp, Mus musculus
taggctggcatgtctgaacatatga

SEQ ID NO: 777928 - DNA, 25 bp, Mus musculus
taggctggccatccctttacatatt

SEQ ID NO: 777929 - DNA, 25 bp, Mus musculus
taggctggccatgcctttacatatt

SEQ ID NO: 777930 - DNA, 25 bp, Mus musculus
taggctggcctaccttacataaaga

SEQ ID NO: 777931 - DNA, 25 bp, Mus musculus
taggctggcctagcttacataaaga

SEQ ID NO: 777932 - DNA, 25 bp, Mus musculus
taggctggctttctttctacgttaa

SEQ ID NO: 777933 - DNA, 25 bp, Mus musculus
taggctggctttgtttctacgttaa

SEQ ID NO: 777934 - DNA, 25 bp, Mus musculus
taggctgggaagaaactgtaggcta

SEQ ID NO: 777935 - DNA, 25 bp, Mus musculus
taggctgggaagaaactgtaggtta

SEQ ID NO: 777936 - DNA, 25 bp, Mus musculus
taggctgggaagtaactgtaggcta

SEQ ID NO: 777937 - DNA, 25 bp, Mus musculus
taggctgggaagtaactgtaggtta

SEQ ID NO: 777938 - DNA, 25 bp, Mus musculus
taggctgggatacctccaggcccta

SEQ ID NO: 777939 - DNA, 25 bp, Mus musculus
taggctgggatagctccaggcccta

SEQ ID NO: 777940 - DNA, 25 bp, Mus musculus
taggctgtagtgaagcacataattt

SEQ ID NO: 777941 - DNA, 25 bp, Mus musculus
taggctgtagtgtagcacataattt

SEQ ID NO: 777942 - DNA, 25 bp, Mus musculus
taggctgtcacacgcaggaatccct

SEQ ID NO: 777943 - DNA, 25 bp, Mus musculus
taggctgtcacaggcaggaatccct

SEQ ID NO: 777944 - DNA, 25 bp, Mus musculus
taggctgtcagcaagatgccagagt

SEQ ID NO: 777945 - DNA, 25 bp, Mus musculus
taggctgtcagctagatgccagagt

SEQ ID NO: 777946 - DNA, 25 bp, Mus musculus
taggctgtccacatctgagcaactg

SEQ ID NO: 777947 - DNA, 25 bp, Mus musculus
taggctgtccacttctgagcaactg

SEQ ID NO: 777948 - DNA, 25 bp, Mus musculus
taggctgtcctgaaagtacccactg

SEQ ID NO: 777949 - DNA, 25 bp, Mus musculus
taggctgtcctgtaagtacccactg

SEQ ID NO: 777950 - DNA, 25 bp, Mus musculus
taggctgtgtttacataacttcttt

SEQ ID NO: 777951 - DNA, 25 bp, Mus musculus
taggctgtgttttcataacttcttt

SEQ ID NO: 777952 - DNA, 25 bp, Mus musculus
taggctgttaagacttacccatcct

SEQ ID NO: 777953 - DNA, 25 bp, Mus musculus
taggctgttaagtcttacccatcct

SEQ ID NO: 777954 - DNA, 25 bp, Mus musculus
taggcttagctcatacactttctgg

SEQ ID NO: 777955 - DNA, 25 bp, Mus musculus
taggcttagctcttacactttctgg

SEQ ID NO: 777956 - DNA, 25 bp, Mus musculus
taggcttagggacaattgatatcat

SEQ ID NO: 777957 - DNA, 25 bp, Mus musculus
taggcttagggagaattgatatcat

SEQ ID NO: 777958 - DNA, 25 bp, Mus musculus
taggcttatcacaaagcctctaggg

SEQ ID NO: 777959 - DNA, 25 bp, Mus musculus
taggcttatcactaagcctctaggg

SEQ ID NO: 777960 - DNA, 25 bp, Mus musculus
taggcttatgaaaggtaacccgtgg

SEQ ID NO: 777961 - DNA, 25 bp, Mus musculus
taggcttatgaatggtaacccgtgg

SEQ ID NO: 777962 - DNA, 25 bp, Mus musculus
taggcttcaaccctgttcccttcta

SEQ ID NO: 777963 - DNA, 25 bp, Mus musculus
taggcttcaaccgtgttcccttcta

SEQ ID NO: 777964 - DNA, 25 bp, Mus musculus
taggcttcaagcctccatgacctga

SEQ ID NO: 777965 - DNA, 25 bp, Mus musculus
taggcttcaagcgtccatgacctga

SEQ ID NO: 777966 - DNA, 25 bp, Mus musculus
taggcttcagacattgggtacttgg

SEQ ID NO: 777967 - DNA, 25 bp, Mus musculus
taggcttcagactttgggtacttgg

SEQ ID NO: 777968 - DNA, 25 bp, Mus musculus
taggcttcagagctgtccctcctgt

SEQ ID NO: 777969 - DNA, 25 bp, Mus musculus
taggcttcagaggtgtccctcctgt

SEQ ID NO: 777970 - DNA, 25 bp, Mus musculus
taggcttcaggacggagggaggtct

SEQ ID NO: 777971 - DNA, 25 bp, Mus musculus
taggcttcaggagggagggaggtct

SEQ ID NO: 777972 - DNA, 25 bp, Mus musculus
taggcttcagtaaaccatggaggga

SEQ ID NO: 777973 - DNA, 25 bp, Mus musculus
taggcttcagtataccatggaggga

SEQ ID NO: 777974 - DNA, 25 bp, Mus musculus
taggcttcatgtcgccgggttgtta

SEQ ID NO: 777975 - DNA, 25 bp, Mus musculus
taggcttcatgtggccgggttgtta

SEQ ID NO: 777976 - DNA, 25 bp, Mus musculus
taggcttccaagaagcttgagctac

SEQ ID NO: 777977 - DNA, 25 bp, Mus musculus
taggcttccaagaggcaagtattaa

SEQ ID NO: 777978 - DNA, 25 bp, Mus musculus
taggcttccaagtagcttgagctac

SEQ ID NO: 777979 - DNA, 25 bp, Mus musculus
taggcttccaagtggcaagtattaa

SEQ ID NO: 777980 - DNA, 25 bp, Mus musculus
taggcttccatcaggtttcaggttc

SEQ ID NO: 777981 - DNA, 25 bp, Mus musculus
taggcttccatcatagagagtatat

SEQ ID NO: 777982 - DNA, 25 bp, Mus musculus
taggcttccatctggtttcaggttc

SEQ ID NO: 777983 - DNA, 25 bp, Mus musculus
taggcttccatcttagagagtatat

SEQ ID NO: 777984 - DNA, 25 bp, Mus musculus
taggcttccatgatgtacagcagtg

SEQ ID NO: 777985 - DNA, 25 bp, Mus musculus
taggcttccatgttgtacagcagtg

SEQ ID NO: 777986 - DNA, 25 bp, Mus musculus
taggcttcccatatcttgggtacaa

SEQ ID NO: 777987 - DNA, 25 bp, Mus musculus
taggcttcccatttcttgggtacaa

SEQ ID NO: 777988 - DNA, 25 bp, Mus musculus
taggcttccttacagccccttctta

SEQ ID NO: 777989 - DNA, 25 bp, Mus musculus
taggcttccttagagccccttctta

SEQ ID NO: 777990 - DNA, 25 bp, Mus musculus
taggcttctagaatggagccaccca

SEQ ID NO: 777991 - DNA, 25 bp, Mus musculus
taggcttctagattggagccaccca

SEQ ID NO: 777992 - DNA, 25 bp, Mus musculus
taggcttctcggcactctcttggca

SEQ ID NO: 777993 - DNA, 25 bp, Mus musculus
taggcttctcgggactctcttggca

SEQ ID NO: 777994 - DNA, 25 bp, Mus musculus
taggcttctgaaccacccagaactc

SEQ ID NO: 777995 - DNA, 25 bp, Mus musculus
taggcttctgaagcacccagaactc

SEQ ID NO: 777996 - DNA, 25 bp, Mus musculus
taggcttctgttcctgcgaagaatt

SEQ ID NO: 777997 - DNA, 25 bp, Mus musculus
taggcttctgttgctgcgaagaatt

SEQ ID NO: 777998 - DNA, 25 bp, Mus musculus
taggcttcttccacagcagatactg

SEQ ID NO: 777999 - DNA, 25 bp, Mus musculus
taggcttcttcctcagcagatactg

SEQ ID NO: 778000 - DNA, 25 bp, Mus musculus
taggcttcttcgaggtcatccctca

SEQ ID NO: 778001 - DNA, 25 bp, Mus musculus
taggcttcttcgtggtcatccctca

SEQ ID NO: 778002 - DNA, 25 bp, Mus musculus
taggcttcttgcagatcgtctggag

SEQ ID NO: 778003 - DNA, 25 bp, Mus musculus
taggcttcttgctgatcgtctggag

SEQ ID NO: 778004 - DNA, 25 bp, Mus musculus
taggcttcttgtactattgaagttg

SEQ ID NO: 778005 - DNA, 25 bp, Mus musculus
taggcttcttgttctattgaagttg

SEQ ID NO: 778006 - DNA, 25 bp, Mus musculus
taggcttctttcacatctgggaaat

SEQ ID NO: 778007 - DNA, 25 bp, Mus musculus
taggcttctttctcatctgggaaat

SEQ ID NO: 778008 - DNA, 25 bp, Mus musculus
taggcttgacatatctcagtagggt

SEQ ID NO: 778009 - DNA, 25 bp, Mus musculus
taggcttgacatttctcagtagggt

SEQ ID NO: 778010 - DNA, 25 bp, Mus musculus
taggcttgagatatcatctgctctc

SEQ ID NO: 778011 - DNA, 25 bp, Mus musculus
taggcttgagatttcatctgctctc

SEQ ID NO: 778012 - DNA, 25 bp, Mus musculus
taggcttgataccacctccctgtag

SEQ ID NO: 778013 - DNA, 25 bp, Mus musculus
taggcttgatacgacctccctgtag

SEQ ID NO: 778014 - DNA, 25 bp, Mus musculus
taggcttgccccagtatggactggg

SEQ ID NO: 778015 - DNA, 25 bp, Mus musculus
taggcttgcccctgtatggactggg

SEQ ID NO: 778016 - DNA, 25 bp, Mus musculus
taggcttgcctaacagaataccaga

SEQ ID NO: 778017 - DNA, 25 bp, Mus musculus
taggcttgcctatcagaataccaga

SEQ ID NO: 778018 - DNA, 25 bp, Mus musculus
taggcttgccttataggtattataa

SEQ ID NO: 778019 - DNA, 25 bp, Mus musculus
taggcttgccttttaggtattataa

SEQ ID NO: 778020 - DNA, 25 bp, Mus musculus
taggcttgcgcacaagactctctta

SEQ ID NO: 778021 - DNA, 25 bp, Mus musculus
taggcttgcgcagaagactctctta

SEQ ID NO: 778022 - DNA, 25 bp, Mus musculus
taggcttgcgctaggaacttagaac

SEQ ID NO: 778023 - DNA, 25 bp, Mus musculus
taggcttgcgctcgagtccgcgtaa

SEQ ID NO: 778024 - DNA, 25 bp, Mus musculus
taggcttgcgctggagtccgcgtaa

SEQ ID NO: 778025 - DNA, 25 bp, Mus musculus
taggcttgcgcttggaacttagaac

SEQ ID NO: 778026 - DNA, 25 bp, Mus musculus
taggcttggacccaaactgaccacc

SEQ ID NO: 778027 - DNA, 25 bp, Mus musculus
taggcttggaccgaaactgaccacc

SEQ ID NO: 778028 - DNA, 25 bp, Mus musculus
taggcttggagccacttaggaaatc

SEQ ID NO: 778029 - DNA, 25 bp, Mus musculus
taggcttggagcgacttaggaaatc

SEQ ID NO: 778030 - DNA, 25 bp, Mus musculus
taggcttggcttcggcttaaggttc

SEQ ID NO: 778031 - DNA, 25 bp, Mus musculus
taggcttggcttgggcttaaggttc

SEQ ID NO: 778032 - DNA, 25 bp, Mus musculus
taggcttgggagacaaattgctcat

SEQ ID NO: 778033 - DNA, 25 bp, Mus musculus
taggcttgggagactagccgttgct

SEQ ID NO: 778034 - DNA, 25 bp, Mus musculus
taggcttgggagtcaaattgctcat

SEQ ID NO: 778035 - DNA, 25 bp, Mus musculus
taggcttgggagtctagccgttgct

SEQ ID NO: 778036 - DNA, 25 bp, Mus musculus
taggcttgtacaattctagaactgt

SEQ ID NO: 778037 - DNA, 25 bp, Mus musculus
taggcttgtacatttctagaactgt

SEQ ID NO: 778038 - DNA, 25 bp, Mus musculus
taggcttgtgctacctgtcttgcat

SEQ ID NO: 778039 - DNA, 25 bp, Mus musculus
taggcttgtgcttcctgtcttgcat

SEQ ID NO: 778040 - DNA, 25 bp, Mus musculus
taggctttcagcatcaggcagcttc

SEQ ID NO: 778041 - DNA, 25 bp, Mus musculus
taggctttcagcttcaggcagcttc

SEQ ID NO: 778042 - DNA, 25 bp, Mus musculus
taggctttcatacactgggagatac

SEQ ID NO: 778043 - DNA, 25 bp, Mus musculus
taggctttcatagactgggagatac

SEQ ID NO: 778044 - DNA, 25 bp, Mus musculus
taggctttccctctgctaaacctat

SEQ ID NO: 778045 - DNA, 25 bp, Mus musculus
taggctttccctgtgctaaacctat

SEQ ID NO: 778046 - DNA, 25 bp, Mus musculus
taggctttcctcataacatcctctg

SEQ ID NO: 778047 - DNA, 25 bp, Mus musculus
taggctttcctcttaacatcctctg

SEQ ID NO: 778048 - DNA, 25 bp, Mus musculus
taggctttgaggctgccgaaacaaa

SEQ ID NO: 778049 - DNA, 25 bp, Mus musculus
taggctttgagggtgccgaaacaaa

SEQ ID NO: 778050 - DNA, 25 bp, Mus musculus
taggctttgccgcaaccttgagaag

SEQ ID NO: 778051 - DNA, 25 bp, Mus musculus
taggctttgccggaaccttgagaag

SEQ ID NO: 778052 - DNA, 25 bp, Mus musculus
taggctttgctaattctgaggttga

SEQ ID NO: 778053 - DNA, 25 bp, Mus musculus
taggctttgctatttctgaggttga

SEQ ID NO: 778054 - DNA, 25 bp, Mus musculus
taggctttggtaagctacactcaaa

SEQ ID NO: 778055 - DNA, 25 bp, Mus musculus
taggctttggtatgctacactcaaa

SEQ ID NO: 778056 - DNA, 25 bp, Mus musculus
taggctttggtgatactgctggttt

SEQ ID NO: 778057 - DNA, 25 bp, Mus musculus
taggctttggtgttactgctggttt

SEQ ID NO: 778058 - DNA, 25 bp, Mus musculus
taggcttttgctccagtggaggcgg

SEQ ID NO: 778059 - DNA, 25 bp, Mus musculus
taggcttttgctgcagtggaggcgg

SEQ ID NO: 778060 - DNA, 25 bp, Mus musculus
taggctttttctatcaaccaatcag

SEQ ID NO: 778061 - DNA, 25 bp, Mus musculus
taggctttttctttcaaccaatcag

SEQ ID NO: 778062 - DNA, 25 bp, Mus musculus
tagggaaactccatgctctgaggca

SEQ ID NO: 778063 - DNA, 25 bp, Mus musculus
tagggaaactccttgctctgaggca

SEQ ID NO: 778064 - DNA, 25 bp, Mus musculus
tagggaaactctatgtacccactat

SEQ ID NO: 778065 - DNA, 25 bp, Mus musculus
tagggaaactctttgtacccactat

SEQ ID NO: 778066 - DNA, 25 bp, Mus musculus
tagggaaagaccacacactgggaac

SEQ ID NO: 778067 - DNA, 25 bp, Mus musculus
tagggaaagacctcacactgggaac

SEQ ID NO: 778068 - DNA, 25 bp, Mus musculus
tagggaaagcccagcttgaagaccc

SEQ ID NO: 778069 - DNA, 25 bp, Mus musculus
tagggaaagccctgcttgaagaccc

SEQ ID NO: 778070 - DNA, 25 bp, Mus musculus
tagggaaattctcggctggcatcaa

SEQ ID NO: 778071 - DNA, 25 bp, Mus musculus
tagggaaattctgggctggcatcaa

SEQ ID NO: 778072 - DNA, 25 bp, Mus musculus
tagggaacagggacagtctgaatca

SEQ ID NO: 778073 - DNA, 25 bp, Mus musculus
tagggaacagggtcagtctgaatca

SEQ ID NO: 778074 - DNA, 25 bp, Mus musculus
tagggaacatacatctactggagaa

SEQ ID NO: 778075 - DNA, 25 bp, Mus musculus
tagggaacatacttctactggagaa

SEQ ID NO: 778076 - DNA, 25 bp, Mus musculus
tagggaaccccaactgtgacggcca

SEQ ID NO: 778077 - DNA, 25 bp, Mus musculus
tagggaaccccatctgtgacggcca

SEQ ID NO: 778078 - DNA, 25 bp, Mus musculus
tagggaacgtgaccctccacagagc

SEQ ID NO: 778079 - DNA, 25 bp, Mus musculus
tagggaacgtgagcctccacagagc

SEQ ID NO: 778080 - DNA, 25 bp, Mus musculus
tagggaactaacaccacttgcacag

SEQ ID NO: 778081 - DNA, 25 bp, Mus musculus
tagggaactaactccacttgcacag

SEQ ID NO: 778082 - DNA, 25 bp, Mus musculus
tagggaagacctaggccacacgacc

SEQ ID NO: 778083 - DNA, 25 bp, Mus musculus
tagggaagaccttggccacacgacc

SEQ ID NO: 778084 - DNA, 25 bp, Mus musculus
tagggaagacttactcttaaagcat

SEQ ID NO: 778085 - DNA, 25 bp, Mus musculus
tagggaagactttctcttaaagcat

SEQ ID NO: 778086 - DNA, 25 bp, Mus musculus
tagggaagccctatactaaacactg

SEQ ID NO: 778087 - DNA, 25 bp, Mus musculus
tagggaagccctttactaaacactg

SEQ ID NO: 778088 - DNA, 25 bp, Mus musculus
tagggaagctacatcgttccaggcc

SEQ ID NO: 778089 - DNA, 25 bp, Mus musculus
tagggaagctacttcgttccaggcc

SEQ ID NO: 778090 - DNA, 25 bp, Mus musculus
tagggaaggctcacaggttactctc

SEQ ID NO: 778091 - DNA, 25 bp, Mus musculus
tagggaaggctctcaggttactctc

SEQ ID NO: 778092 - DNA, 25 bp, Mus musculus
tagggaagtagcagcagccagccct

SEQ ID NO: 778093 - DNA, 25 bp, Mus musculus
tagggaagtagctgcagccagccct

SEQ ID NO: 778094 - DNA, 25 bp, Mus musculus
tagggaagtattacttgctttagta

SEQ ID NO: 778095 - DNA, 25 bp, Mus musculus
tagggaagtatttcttgctttagta

SEQ ID NO: 778096 - DNA, 25 bp, Mus musculus
tagggaagtcacctcacagcaggct

SEQ ID NO: 778097 - DNA, 25 bp, Mus musculus
tagggaagtcacgtcacagcaggct

SEQ ID NO: 778098 - DNA, 25 bp, Mus musculus
tagggaagttgtacctgtcgacctc

SEQ ID NO: 778099 - DNA, 25 bp, Mus musculus
tagggaagttgttcctgtcgacctc

SEQ ID NO: 778100 - DNA, 25 bp, Mus musculus
tagggaagtttcactgcccgaaaag

SEQ ID NO: 778101 - DNA, 25 bp, Mus musculus
tagggaagtttctctgcccgaaaag

SEQ ID NO: 778102 - DNA, 25 bp, Mus musculus
tagggaatccaaattcagactcgaa

SEQ ID NO: 778103 - DNA, 25 bp, Mus musculus
tagggaatccaatttcagactcgaa

SEQ ID NO: 778104 - DNA, 25 bp, Mus musculus
tagggaatccccaggattgtgccgg

SEQ ID NO: 778105 - DNA, 25 bp, Mus musculus
tagggaatcccctggattgtgccgg

SEQ ID NO: 778106 - DNA, 25 bp, Mus musculus
tagggaatcgtcagagatctcctta

SEQ ID NO: 778107 - DNA, 25 bp, Mus musculus
tagggaatcgtctgagatctcctta

SEQ ID NO: 778108 - DNA, 25 bp, Mus musculus
tagggaatctcgaggacctttccaa

SEQ ID NO: 778109 - DNA, 25 bp, Mus musculus
tagggaatctcgtggacctttccaa

SEQ ID NO: 778110 - DNA, 25 bp, Mus musculus
tagggaatgactatagacattgcaa

SEQ ID NO: 778111 - DNA, 25 bp, Mus musculus
tagggaatgactttagacattgcaa

SEQ ID NO: 778112 - DNA, 25 bp, Mus musculus
tagggaatgctgagtgccttctgca

SEQ ID NO: 778113 - DNA, 25 bp, Mus musculus
tagggaatgctgtgtgccttctgca

SEQ ID NO: 778114 - DNA, 25 bp, Mus musculus
tagggacacaagacctggaccagcc

SEQ ID NO: 778115 - DNA, 25 bp, Mus musculus
tagggacacaagtcctggaccagcc

SEQ ID NO: 778116 - DNA, 25 bp, Mus musculus
tagggacacatgaaactcgagcctg

SEQ ID NO: 778117 - DNA, 25 bp, Mus musculus
tagggacacatgtaactcgagcctg

SEQ ID NO: 778118 - DNA, 25 bp, Mus musculus
tagggacaccgccagctggatctga

SEQ ID NO: 778119 - DNA, 25 bp, Mus musculus
tagggacaccgcgagctggatctga

SEQ ID NO: 778120 - DNA, 25 bp, Mus musculus
tagggacacgttcatgcctctctgt

SEQ ID NO: 778121 - DNA, 25 bp, Mus musculus
tagggacacgttgatgcctctctgt

SEQ ID NO: 778122 - DNA, 25 bp, Mus musculus
tagggacagcacagttggccctggt

SEQ ID NO: 778123 - DNA, 25 bp, Mus musculus
tagggacagcactgttggccctggt

SEQ ID NO: 778124 - DNA, 25 bp, Mus musculus
tagggacagtaaaagccacgcactt

SEQ ID NO: 778125 - DNA, 25 bp, Mus musculus
tagggacagtaatagccacgcactt

SEQ ID NO: 778126 - DNA, 25 bp, Mus musculus
tagggacagtctaccacagggtctc

SEQ ID NO: 778127 - DNA, 25 bp, Mus musculus
tagggacagtcttccacagggtctc

SEQ ID NO: 778128 - DNA, 25 bp, Mus musculus
tagggacagttacccagcctgctga

SEQ ID NO: 778129 - DNA, 25 bp, Mus musculus
tagggacagttagccagcctgctga

SEQ ID NO: 778130 - DNA, 25 bp, Mus musculus
tagggacatttacctgtgacacatt

SEQ ID NO: 778131 - DNA, 25 bp, Mus musculus
tagggacatttagctgtgacacatt

SEQ ID NO: 778132 - DNA, 25 bp, Mus musculus
tagggaccaagaatcgaactcatga

SEQ ID NO: 778133 - DNA, 25 bp, Mus musculus
tagggaccaagattcgaactcatga

SEQ ID NO: 778134 - DNA, 25 bp, Mus musculus
tagggaccaccactatccagctcag

SEQ ID NO: 778135 - DNA, 25 bp, Mus musculus
tagggaccaccagtatccagctcag

SEQ ID NO: 778136 - DNA, 25 bp, Mus musculus
tagggaccagtaactcacatcaatg

SEQ ID NO: 778137 - DNA, 25 bp, Mus musculus
tagggaccagtatctcacatcaatg

SEQ ID NO: 778138 - DNA, 25 bp, Mus musculus
tagggacccaggaaatgctgttttc

SEQ ID NO: 778139 - DNA, 25 bp, Mus musculus
tagggacccaggtaatgctgttttc

SEQ ID NO: 778140 - DNA, 25 bp, Mus musculus
tagggacccatcatgaggccacatt

SEQ ID NO: 778141 - DNA, 25 bp, Mus musculus
tagggacccatcttgaggccacatt

SEQ ID NO: 778142 - DNA, 25 bp, Mus musculus
tagggaccctgtcccattgctcgtt

SEQ ID NO: 778143 - DNA, 25 bp, Mus musculus
tagggaccctgtgccattgctcgtt

SEQ ID NO: 778144 - DNA, 25 bp, Mus musculus
tagggacccttgaacagactctggc

SEQ ID NO: 778145 - DNA, 25 bp, Mus musculus
tagggacccttgtacagactctggc

SEQ ID NO: 778146 - DNA, 25 bp, Mus musculus
tagggaccgcctatcacgccgactg

SEQ ID NO: 778147 - DNA, 25 bp, Mus musculus
tagggaccgcctttcacgccgactg

SEQ ID NO: 778148 - DNA, 25 bp, Mus musculus
tagggaccgctcacttatcccgggt

SEQ ID NO: 778149 - DNA, 25 bp, Mus musculus
tagggaccgctctcttatcccgggt

SEQ ID NO: 778150 - DNA, 25 bp, Mus musculus
tagggacctacaaagctgcaacagc

SEQ ID NO: 778151 - DNA, 25 bp, Mus musculus
tagggacctacatagctgcaacagc

SEQ ID NO: 778152 - DNA, 25 bp, Mus musculus
tagggaccttagagtgaatgatcgt

SEQ ID NO: 778153 - DNA, 25 bp, Mus musculus
tagggaccttagtgtgaatgatcgt

SEQ ID NO: 778154 - DNA, 25 bp, Mus musculus
tagggaccttccctttgaaactctg

SEQ ID NO: 778155 - DNA, 25 bp, Mus musculus
tagggaccttccgtttgaaactctg

SEQ ID NO: 778156 - DNA, 25 bp, Mus musculus
tagggacgagatcagcgctccttct

SEQ ID NO: 778157 - DNA, 25 bp, Mus musculus
tagggacgagatgagcgctccttct

SEQ ID NO: 778158 - DNA, 25 bp, Mus musculus
tagggactatatatcaggccaggga

SEQ ID NO: 778159 - DNA, 25 bp, Mus musculus
tagggactatatttcaggccaggga

SEQ ID NO: 778160 - DNA, 25 bp, Mus musculus
tagggactatgaaacccaccaaaga

SEQ ID NO: 778161 - DNA, 25 bp, Mus musculus
tagggactatgatacccaccaaaga

SEQ ID NO: 778162 - DNA, 25 bp, Mus musculus
tagggactcagcaatgtcagagata

SEQ ID NO: 778163 - DNA, 25 bp, Mus musculus
tagggactcagctatgtcagagata

SEQ ID NO: 778164 - DNA, 25 bp, Mus musculus
tagggactgaccatgcttgagacct

SEQ ID NO: 778165 - DNA, 25 bp, Mus musculus
tagggactgaccttgcttgagacct

SEQ ID NO: 778166 - DNA, 25 bp, Mus musculus
tagggactgcacaggctgcctcaac

SEQ ID NO: 778167 - DNA, 25 bp, Mus musculus
tagggactgcactggctgcctcaac

SEQ ID NO: 778168 - DNA, 25 bp, Mus musculus
tagggactggccacttccaaggcga

SEQ ID NO: 778169 - DNA, 25 bp, Mus musculus
tagggactggcctcttccaaggcga

SEQ ID NO: 778170 - DNA, 25 bp, Mus musculus
tagggactggtcactcatccagaga

SEQ ID NO: 778171 - DNA, 25 bp, Mus musculus
tagggactggtctctcatccagaga

SEQ ID NO: 778172 - DNA, 25 bp, Mus musculus
tagggactgtacatggcgggatttt

SEQ ID NO: 778173 - DNA, 25 bp, Mus musculus
tagggactgtacttggcgggatttt

SEQ ID NO: 778174 - DNA, 25 bp, Mus musculus
tagggacttacactctatccctggc

SEQ ID NO: 778175 - DNA, 25 bp, Mus musculus
tagggacttacagtctatccctggc

SEQ ID NO: 778176 - DNA, 25 bp, Mus musculus
tagggagaagttattccacaccaca

SEQ ID NO: 778177 - DNA, 25 bp, Mus musculus
tagggagaagtttttccacaccaca

SEQ ID NO: 778178 - DNA, 25 bp, Mus musculus
tagggagaatgtccctcccattcgc

SEQ ID NO: 778179 - DNA, 25 bp, Mus musculus
tagggagaatgtgcctcccattcgc

SEQ ID NO: 778180 - DNA, 25 bp, Mus musculus
tagggagacagaaacgaacttactt

SEQ ID NO: 778181 - DNA, 25 bp, Mus musculus
tagggagacagatacgaacttactt

SEQ ID NO: 778182 - DNA, 25 bp, Mus musculus
tagggagaccctcgagatctcaaga

SEQ ID NO: 778183 - DNA, 25 bp, Mus musculus
tagggagaccctggagatctcaaga

SEQ ID NO: 778184 - DNA, 25 bp, Mus musculus
tagggagactacactccatttccct

SEQ ID NO: 778185 - DNA, 25 bp, Mus musculus
tagggagactactctccatttccct

SEQ ID NO: 778186 - DNA, 25 bp, Mus musculus
tagggagaggacctgctttccagca

SEQ ID NO: 778187 - DNA, 25 bp, Mus musculus
tagggagaggacgtgctttccagca

SEQ ID NO: 778188 - DNA, 25 bp, Mus musculus
tagggagagttcagctatgccatct

SEQ ID NO: 778189 - DNA, 25 bp, Mus musculus
tagggagagttctgctatgccatct

SEQ ID NO: 778190 - DNA, 25 bp, Mus musculus
tagggagcaagtctctcatctctgg

SEQ ID NO: 778191 - DNA, 25 bp, Mus musculus
tagggagcaagtgtctcatctctgg

SEQ ID NO: 778192 - DNA, 25 bp, Mus musculus
tagggagcacccattgtggctggta

SEQ ID NO: 778193 - DNA, 25 bp, Mus musculus
tagggagcaccctttgtggctggta

SEQ ID NO: 778194 - DNA, 25 bp, Mus musculus
tagggagcagttaggcaggtcttca

SEQ ID NO: 778195 - DNA, 25 bp, Mus musculus
tagggagcagtttggcaggtcttca

SEQ ID NO: 778196 - DNA, 25 bp, Mus musculus
tagggagccactctagttccttgcg

SEQ ID NO: 778197 - DNA, 25 bp, Mus musculus
tagggagccactgtagttccttgcg

SEQ ID NO: 778198 - DNA, 25 bp, Mus musculus
tagggagccatcataccgcagcgat

SEQ ID NO: 778199 - DNA, 25 bp, Mus musculus
tagggagccatcttaccgcagcgat

SEQ ID NO: 778200 - DNA, 25 bp, Mus musculus
tagggagccctcataggagtgatta

SEQ ID NO: 778201 - DNA, 25 bp, Mus musculus
tagggagccctcttaggagtgatta

SEQ ID NO: 778202 - DNA, 25 bp, Mus musculus
tagggagcctagacaagaattcgta

SEQ ID NO: 778203 - DNA, 25 bp, Mus musculus
tagggagcctagtcaagaattcgta

SEQ ID NO: 778204 - DNA, 25 bp, Mus musculus
tagggagcctttacccaggagcagg

SEQ ID NO: 778205 - DNA, 25 bp, Mus musculus
tagggagccttttcccaggagcagg

SEQ ID NO: 778206 - DNA, 25 bp, Mus musculus
tagggagcgttcattacagcacatt

SEQ ID NO: 778207 - DNA, 25 bp, Mus musculus
tagggagcgttctttacagcacatt

SEQ ID NO: 778208 - DNA, 25 bp, Mus musculus
tagggagctagtcgtttttaaaatg

SEQ ID NO: 778209 - DNA, 25 bp, Mus musculus
tagggagctagtggtttttaaaatg

SEQ ID NO: 778210 - DNA, 25 bp, Mus musculus
tagggagcttcaaggccaggttgat

SEQ ID NO: 778211 - DNA, 25 bp, Mus musculus
tagggagcttcatggccaggttgat

SEQ ID NO: 778212 - DNA, 25 bp, Mus musculus
tagggagggtctccttgcctgaaca

SEQ ID NO: 778213 - DNA, 25 bp, Mus musculus
tagggagggtctgcttgcctgaaca

SEQ ID NO: 778214 - DNA, 25 bp, Mus musculus
tagggagggtgactttcttttccat

SEQ ID NO: 778215 - DNA, 25 bp, Mus musculus
tagggagggtgagtttcttttccat

SEQ ID NO: 778216 - DNA, 25 bp, Mus musculus
tagggagggtgtcgcctctgtctcg

SEQ ID NO: 778217 - DNA, 25 bp, Mus musculus
tagggagggtgtggcctctgtctcg

SEQ ID NO: 778218 - DNA, 25 bp, Mus musculus
tagggaggttggacattggtttctt

SEQ ID NO: 778219 - DNA, 25 bp, Mus musculus
tagggaggttggtcattggtttctt

SEQ ID NO: 778220 - DNA, 25 bp, Mus musculus
tagggagtaccactattacatttta

SEQ ID NO: 778221 - DNA, 25 bp, Mus musculus
tagggagtaccagtattacatttta

SEQ ID NO: 778222 - DNA, 25 bp, Mus musculus
tagggagtgactccttcatacttcc

SEQ ID NO: 778223 - DNA, 25 bp, Mus musculus
tagggagtgactgcttcatacttcc

SEQ ID NO: 778224 - DNA, 25 bp, Mus musculus
tagggagtgttaagcctgcagcaaa

SEQ ID NO: 778225 - DNA, 25 bp, Mus musculus
tagggagtgttatgcctgcagcaaa

SEQ ID NO: 778226 - DNA, 25 bp, Mus musculus
tagggagtgtttatgctcacctgta

SEQ ID NO: 778227 - DNA, 25 bp, Mus musculus
tagggagtgtttttgctcacctgta

SEQ ID NO: 778228 - DNA, 25 bp, Mus musculus
tagggagttaagaggcagagacacc

SEQ ID NO: 778229 - DNA, 25 bp, Mus musculus
tagggagttaagtggcagagacacc

SEQ ID NO: 778230 - DNA, 25 bp, Mus musculus
tagggatacggactttatccatttt

SEQ ID NO: 778231 - DNA, 25 bp, Mus musculus
tagggatacggagtttatccatttt

SEQ ID NO: 778232 - DNA, 25 bp, Mus musculus
tagggatagcagatgccagactttg

SEQ ID NO: 778233 - DNA, 25 bp, Mus musculus
tagggatagcagttgccagactttg

SEQ ID NO: 778234 - DNA, 25 bp, Mus musculus
tagggataggagacaccacgccctt

SEQ ID NO: 778235 - DNA, 25 bp, Mus musculus
tagggataggagtcaccacgccctt

SEQ ID NO: 778236 - DNA, 25 bp, Mus musculus
tagggatagggcatctggttttaca

SEQ ID NO: 778237 - DNA, 25 bp, Mus musculus
tagggatagggcttctggttttaca

SEQ ID NO: 778238 - DNA, 25 bp, Mus musculus
tagggatcaattcaggctctcgtgc

SEQ ID NO: 778239 - DNA, 25 bp, Mus musculus
tagggatcaattgaggctctcgtgc

SEQ ID NO: 778240 - DNA, 25 bp, Mus musculus
tagggatcacaaagtgtcacatgtt

SEQ ID NO: 778241 - DNA, 25 bp, Mus musculus
tagggatcacaatgtgtcacatgtt

SEQ ID NO: 778242 - DNA, 25 bp, Mus musculus
tagggatcatccaccatgctatggt

SEQ ID NO: 778243 - DNA, 25 bp, Mus musculus
tagggatcatcctccatgctatggt

SEQ ID NO: 778244 - DNA, 25 bp, Mus musculus
tagggatccactacactagttccag

SEQ ID NO: 778245 - DNA, 25 bp, Mus musculus
tagggatccacttcactagttccag

SEQ ID NO: 778246 - DNA, 25 bp, Mus musculus
tagggatctaccaacacatgtctga

SEQ ID NO: 778247 - DNA, 25 bp, Mus musculus
tagggatctacctacacatgtctga

SEQ ID NO: 778248 - DNA, 25 bp, Mus musculus
tagggatctgccaccaagaataaaa

SEQ ID NO: 778249 - DNA, 25 bp, Mus musculus
tagggatctgcctccaagaataaaa

SEQ ID NO: 778250 - DNA, 25 bp, Mus musculus
tagggatgaccgaagtgccaggcaa

SEQ ID NO: 778251 - DNA, 25 bp, Mus musculus
tagggatgaccgtagtgccaggcaa

SEQ ID NO: 778252 - DNA, 25 bp, Mus musculus
tagggatgagacaacagggccttat

SEQ ID NO: 778253 - DNA, 25 bp, Mus musculus
tagggatgagactacagggccttat

SEQ ID NO: 778254 - DNA, 25 bp, Mus musculus
tagggatgcatcacaacggttgacc

SEQ ID NO: 778255 - DNA, 25 bp, Mus musculus
tagggatgcatcacagtgctacata

SEQ ID NO: 778256 - DNA, 25 bp, Mus musculus
tagggatgcatctcaacggttgacc

SEQ ID NO: 778257 - DNA, 25 bp, Mus musculus
tagggatgcatctcagtgctacata

SEQ ID NO: 778258 - DNA, 25 bp, Mus musculus
tagggatgccagcacatacctttaa

SEQ ID NO: 778259 - DNA, 25 bp, Mus musculus
tagggatgccaggacatacctttaa

SEQ ID NO: 778260 - DNA, 25 bp, Mus musculus
tagggatgcttgacattagtacaga

SEQ ID NO: 778261 - DNA, 25 bp, Mus musculus
tagggatgcttgtcattagtacaga

SEQ ID NO: 778262 - DNA, 25 bp, Mus musculus
tagggatggagactttaaacccagc

SEQ ID NO: 778263 - DNA, 25 bp, Mus musculus
tagggatggagagtttaaacccagc

SEQ ID NO: 778264 - DNA, 25 bp, Mus musculus
tagggatggatcaggctccacttaa

SEQ ID NO: 778265 - DNA, 25 bp, Mus musculus
tagggatggatctggctccacttaa

SEQ ID NO: 778266 - DNA, 25 bp, Mus musculus
tagggatggctgctacttcagactt

SEQ ID NO: 778267 - DNA, 25 bp, Mus musculus
tagggatggctggtacttcagactt

SEQ ID NO: 778268 - DNA, 25 bp, Mus musculus
tagggatggttgctttgcctgctac

SEQ ID NO: 778269 - DNA, 25 bp, Mus musculus
tagggatggttggtttgcctgctac

SEQ ID NO: 778270 - DNA, 25 bp, Mus musculus
tagggattagctattgccaccttca

SEQ ID NO: 778271 - DNA, 25 bp, Mus musculus
tagggattagcttttgccaccttca

SEQ ID NO: 778272 - DNA, 25 bp, Mus musculus
tagggattattactccatcaaacct

SEQ ID NO: 778273 - DNA, 25 bp, Mus musculus
tagggattattagtccatcaaacct

SEQ ID NO: 778274 - DNA, 25 bp, Mus musculus
tagggattatttagtgtcttaggct

SEQ ID NO: 778275 - DNA, 25 bp, Mus musculus
tagggattattttgtgtcttaggct

SEQ ID NO: 778276 - DNA, 25 bp, Mus musculus
tagggattcaagctcctgtcttcaa

SEQ ID NO: 778277 - DNA, 25 bp, Mus musculus
tagggattcaaggtcctgtcttcaa

SEQ ID NO: 778278 - DNA, 25 bp, Mus musculus
tagggattcgacctctatcttcatc

SEQ ID NO: 778279 - DNA, 25 bp, Mus musculus
tagggattcgacgtctatcttcatc

SEQ ID NO: 778280 - DNA, 25 bp, Mus musculus
tagggattgcctcagcttcttgaaa

SEQ ID NO: 778281 - DNA, 25 bp, Mus musculus
tagggattgcctgagcttcttgaaa

SEQ ID NO: 778282 - DNA, 25 bp, Mus musculus
tagggcaagcacatcggccactgac

SEQ ID NO: 778283 - DNA, 25 bp, Mus musculus
tagggcaagcacttcggccactgac

SEQ ID NO: 778284 - DNA, 25 bp, Mus musculus
tagggcaaggctctgtcttctgtgt

SEQ ID NO: 778285 - DNA, 25 bp, Mus musculus
tagggcaaggctgtgtcttctgtgt

SEQ ID NO: 778286 - DNA, 25 bp, Mus musculus
tagggcaattatatacaatgctcac

SEQ ID NO: 778287 - DNA, 25 bp, Mus musculus
tagggcaattatttacaatgctcac

SEQ ID NO: 778288 - DNA, 25 bp, Mus musculus
tagggcacaaacaaatctcggtagt

SEQ ID NO: 778289 - DNA, 25 bp, Mus musculus
tagggcacaaactaatctcggtagt

SEQ ID NO: 778290 - DNA, 25 bp, Mus musculus
tagggcacactcctgagggcctgtc

SEQ ID NO: 778291 - DNA, 25 bp, Mus musculus
tagggcacactcgtgagggcctgtc

SEQ ID NO: 778292 - DNA, 25 bp, Mus musculus
tagggcacatgacatttccagcctc

SEQ ID NO: 778293 - DNA, 25 bp, Mus musculus
tagggcacatgagatttccagcctc

SEQ ID NO: 778294 - DNA, 25 bp, Mus musculus
tagggcaccagaagcttcggtccaa

SEQ ID NO: 778295 - DNA, 25 bp, Mus musculus
tagggcaccagatgcttcggtccaa

SEQ ID NO: 778296 - DNA, 25 bp, Mus musculus
tagggcacccatagctgagacccca

SEQ ID NO: 778297 - DNA, 25 bp, Mus musculus
tagggcacccattgctgagacccca

SEQ ID NO: 778298 - DNA, 25 bp, Mus musculus
tagggcaccgtgacaacacaaatgt

SEQ ID NO: 778299 - DNA, 25 bp, Mus musculus
tagggcaccgtgtcaacacaaatgt

SEQ ID NO: 778300 - DNA, 25 bp, Mus musculus
tagggcacgtgtaacctgcatccca

SEQ ID NO: 778301 - DNA, 25 bp, Mus musculus
tagggcacgtgttacctgcatccca

SEQ ID NO: 778302 - DNA, 25 bp, Mus musculus
tagggcactggtacccataggagct

SEQ ID NO: 778303 - DNA, 25 bp, Mus musculus
tagggcactggtagacgctgcgcca

SEQ ID NO: 778304 - DNA, 25 bp, Mus musculus
tagggcactggttcccataggagct

SEQ ID NO: 778305 - DNA, 25 bp, Mus musculus
tagggcactggttgacgctgcgcca

SEQ ID NO: 778306 - DNA, 25 bp, Mus musculus
tagggcacttaaccatccagtcaga

SEQ ID NO: 778307 - DNA, 25 bp, Mus musculus
tagggcacttaagcatccagtcaga

SEQ ID NO: 778308 - DNA, 25 bp, Mus musculus
tagggcacttctactctggaatgga

SEQ ID NO: 778309 - DNA, 25 bp, Mus musculus
tagggcacttcttctctggaatgga

SEQ ID NO: 778310 - DNA, 25 bp, Mus musculus
tagggcagaacaacgggctcagtac

SEQ ID NO: 778311 - DNA, 25 bp, Mus musculus
tagggcagaacatcgggctcagtac

SEQ ID NO: 778312 - DNA, 25 bp, Mus musculus
tagggcagagcgatgacccactggc

SEQ ID NO: 778313 - DNA, 25 bp, Mus musculus
tagggcagagcgttgacccactggc

SEQ ID NO: 778314 - DNA, 25 bp, Mus musculus
tagggcagattaattccattagatt

SEQ ID NO: 778315 - DNA, 25 bp, Mus musculus
tagggcagattatttccattagatt

SEQ ID NO: 778316 - DNA, 25 bp, Mus musculus
tagggcagccatagctctttgctgt

SEQ ID NO: 778317 - DNA, 25 bp, Mus musculus
tagggcagccattgctctttgctgt

SEQ ID NO: 778318 - DNA, 25 bp, Mus musculus
tagggcagctccatggtgaacctgt

SEQ ID NO: 778319 - DNA, 25 bp, Mus musculus
tagggcagctccttggtgaacctgt

SEQ ID NO: 778320 - DNA, 25 bp, Mus musculus
tagggcagttcactatcagacaaac

SEQ ID NO: 778321 - DNA, 25 bp, Mus musculus
tagggcagttcagtatcagacaaac

SEQ ID NO: 778322 - DNA, 25 bp, Mus musculus
tagggcatcaaactttaggtaactt

SEQ ID NO: 778323 - DNA, 25 bp, Mus musculus
tagggcatcaaagtttaggtaactt

SEQ ID NO: 778324 - DNA, 25 bp, Mus musculus
tagggcatgctgatcagtgtaatgt

SEQ ID NO: 778325 - DNA, 25 bp, Mus musculus
tagggcatgctgttcagtgtaatgt

SEQ ID NO: 778326 - DNA, 25 bp, Mus musculus
tagggcattgtcatccttgtatatg

SEQ ID NO: 778327 - DNA, 25 bp, Mus musculus
tagggcattgtcttccttgtatatg

SEQ ID NO: 778328 - DNA, 25 bp, Mus musculus
tagggcatttggacatgttttcaat

SEQ ID NO: 778329 - DNA, 25 bp, Mus musculus
tagggcatttggtcatgttttcaat

SEQ ID NO: 778330 - DNA, 25 bp, Mus musculus
tagggccaaggcacattcgggtcag

SEQ ID NO: 778331 - DNA, 25 bp, Mus musculus
tagggccaaggcactacgtgtcagt

SEQ ID NO: 778332 - DNA, 25 bp, Mus musculus
tagggccaaggctcattcgggtcag

SEQ ID NO: 778333 - DNA, 25 bp, Mus musculus
tagggccaaggctctacgtgtcagt

SEQ ID NO: 778334 - DNA, 25 bp, Mus musculus
tagggccacacaagatccgggtaaa

SEQ ID NO: 778335 - DNA, 25 bp, Mus musculus
tagggccacacatgatccgggtaaa

SEQ ID NO: 778336 - DNA, 25 bp, Mus musculus
tagggccacctcaagcatctggaga

SEQ ID NO: 778337 - DNA, 25 bp, Mus musculus
tagggccacctctagcatctggaga

SEQ ID NO: 778338 - DNA, 25 bp, Mus musculus
tagggccacctgattgtgtacaacg

SEQ ID NO: 778339 - DNA, 25 bp, Mus musculus
tagggccacctgtttgtgtacaacg

SEQ ID NO: 778340 - DNA, 25 bp, Mus musculus
tagggccataacagccatttccagc

SEQ ID NO: 778341 - DNA, 25 bp, Mus musculus
tagggccataactgccatttccagc

SEQ ID NO: 778342 - DNA, 25 bp, Mus musculus
tagggcccaaccagaattggtcctg

SEQ ID NO: 778343 - DNA, 25 bp, Mus musculus
tagggcccaacctgaattggtcctg

SEQ ID NO: 778344 - DNA, 25 bp, Mus musculus
tagggcccaatgagctgccagtgtt

SEQ ID NO: 778345 - DNA, 25 bp, Mus musculus
tagggcccaatgtgctgccagtgtt

SEQ ID NO: 778346 - DNA, 25 bp, Mus musculus
tagggcccagagaactagggttaca

SEQ ID NO: 778347 - DNA, 25 bp, Mus musculus
tagggcccagagtactagggttaca

SEQ ID NO: 778348 - DNA, 25 bp, Mus musculus
tagggcccagctactaagagccaaa

SEQ ID NO: 778349 - DNA, 25 bp, Mus musculus
tagggcccagcttctaagagccaaa

SEQ ID NO: 778350 - DNA, 25 bp, Mus musculus
tagggcccagggaagagccagaaac

SEQ ID NO: 778351 - DNA, 25 bp, Mus musculus
tagggcccagggtagagccagaaac

SEQ ID NO: 778352 - DNA, 25 bp, Mus musculus
tagggccccagaacaacatgaggtt

SEQ ID NO: 778353 - DNA, 25 bp, Mus musculus
tagggccccagatcaacatgaggtt

SEQ ID NO: 778354 - DNA, 25 bp, Mus musculus
tagggcccctgaaattccttggaaa

SEQ ID NO: 778355 - DNA, 25 bp, Mus musculus
tagggcccctgatattccttggaaa

SEQ ID NO: 778356 - DNA, 25 bp, Mus musculus
tagggccctctcaggatgcttggct

SEQ ID NO: 778357 - DNA, 25 bp, Mus musculus
tagggccctctctggatgcttggct

SEQ ID NO: 778358 - DNA, 25 bp, Mus musculus
tagggccgcagtcgcttacgtaatc

SEQ ID NO: 778359 - DNA, 25 bp, Mus musculus
tagggccgcagtggcttacgtaatc

SEQ ID NO: 778360 - DNA, 25 bp, Mus musculus
tagggcctaccacacggcaggtaca

SEQ ID NO: 778361 - DNA, 25 bp, Mus musculus
tagggcctaccagacggcaggtaca

SEQ ID NO: 778362 - DNA, 25 bp, Mus musculus
tagggcctagtgatcagaccccaga

SEQ ID NO: 778363 - DNA, 25 bp, Mus musculus
tagggcctagtgttcagaccccaga

SEQ ID NO: 778364 - DNA, 25 bp, Mus musculus
tagggcctcaaaacatgtgctctgt

SEQ ID NO: 778365 - DNA, 25 bp, Mus musculus
tagggcctcaaatcatgtgctctgt

SEQ ID NO: 778366 - DNA, 25 bp, Mus musculus
tagggcctcatgctatctgcagaca

SEQ ID NO: 778367 - DNA, 25 bp, Mus musculus
tagggcctcatggtatctgcagaca

SEQ ID NO: 778368 - DNA, 25 bp, Mus musculus
tagggcctgctgattgcaacaccaa

SEQ ID NO: 778369 - DNA, 25 bp, Mus musculus
tagggcctgctgtttgcaacaccaa

SEQ ID NO: 778370 - DNA, 25 bp, Mus musculus
tagggcctgggacgataaaactgaa

SEQ ID NO: 778371 - DNA, 25 bp, Mus musculus
tagggcctgggaggataaaactgaa

SEQ ID NO: 778372 - DNA, 25 bp, Mus musculus
tagggcctgtcacacacccagttta

SEQ ID NO: 778373 - DNA, 25 bp, Mus musculus
tagggcctgtcagacacccagttta

SEQ ID NO: 778374 - DNA, 25 bp, Mus musculus
tagggcctgtttccttctactgcag

SEQ ID NO: 778375 - DNA, 25 bp, Mus musculus
tagggcctgtttgcttctactgcag

SEQ ID NO: 778376 - DNA, 25 bp, Mus musculus
tagggccttgccacaggtgccagat

SEQ ID NO: 778377 - DNA, 25 bp, Mus musculus
tagggccttgcctcaggtgccagat

SEQ ID NO: 778378 - DNA, 25 bp, Mus musculus
tagggccttttactctgaagctcgc

SEQ ID NO: 778379 - DNA, 25 bp, Mus musculus
tagggccttttagtctgaagctcgc

SEQ ID NO: 778380 - DNA, 25 bp, Mus musculus
tagggcgacaccctgccttagggaa

SEQ ID NO: 778381 - DNA, 25 bp, Mus musculus
tagggcgacaccgtgccttagggaa

SEQ ID NO: 778382 - DNA, 25 bp, Mus musculus
tagggcgagaagctaccaggtcaac

SEQ ID NO: 778383 - DNA, 25 bp, Mus musculus
tagggcgagaaggtaccaggtcaac

SEQ ID NO: 778384 - DNA, 25 bp, Mus musculus
tagggcgcttcaaggcgttcgcagt

SEQ ID NO: 778385 - DNA, 25 bp, Mus musculus
tagggcgcttcatggcgttcgcagt

SEQ ID NO: 778386 - DNA, 25 bp, Mus musculus
tagggcggagcacgattatgggact

SEQ ID NO: 778387 - DNA, 25 bp, Mus musculus
tagggcggagcaggattatgggact

SEQ ID NO: 778388 - DNA, 25 bp, Mus musculus
tagggcggtctccaactgccagtgc

SEQ ID NO: 778389 - DNA, 25 bp, Mus musculus
tagggcggtctcgaactgccagtgc

SEQ ID NO: 778390 - DNA, 25 bp, Mus musculus
tagggcgtccagctttgtccagtag

SEQ ID NO: 778391 - DNA, 25 bp, Mus musculus
tagggcgtccaggtttgtccagtag

SEQ ID NO: 778392 - DNA, 25 bp, Mus musculus
tagggcgtgacacccttttctgtaa

SEQ ID NO: 778393 - DNA, 25 bp, Mus musculus
tagggcgtgacagccttttctgtaa

SEQ ID NO: 778394 - DNA, 25 bp, Mus musculus
tagggcgttcacacgagcttttcta

SEQ ID NO: 778395 - DNA, 25 bp, Mus musculus
tagggcgttcactcgagcttttcta

SEQ ID NO: 778396 - DNA, 25 bp, Mus musculus
tagggctaaagcagcaccgtggctc

SEQ ID NO: 778397 - DNA, 25 bp, Mus musculus
tagggctaaagctgcaccgtggctc

SEQ ID NO: 778398 - DNA, 25 bp, Mus musculus
tagggctaaaggactggttaagagc

SEQ ID NO: 778399 - DNA, 25 bp, Mus musculus
tagggctaaaggtctggttaagagc

SEQ ID NO: 778400 - DNA, 25 bp, Mus musculus
tagggctaaatcacagtcggatgtt

SEQ ID NO: 778401 - DNA, 25 bp, Mus musculus
tagggctaaatctcagtcggatgtt

SEQ ID NO: 778402 - DNA, 25 bp, Mus musculus
tagggctacactcttgcgccatcag

SEQ ID NO: 778403 - DNA, 25 bp, Mus musculus
tagggctacactgttgcgccatcag

SEQ ID NO: 778404 - DNA, 25 bp, Mus musculus
tagggctacataaggcactggctca

SEQ ID NO: 778405 - DNA, 25 bp, Mus musculus
tagggctacatatggcactggctca

SEQ ID NO: 778406 - DNA, 25 bp, Mus musculus
tagggctactgaagcgagcagctgt

SEQ ID NO: 778407 - DNA, 25 bp, Mus musculus
tagggctactgatgcgagcagctgt

SEQ ID NO: 778408 - DNA, 25 bp, Mus musculus
tagggctatctgcttgactctcttc

SEQ ID NO: 778409 - DNA, 25 bp, Mus musculus
tagggctatctggttgactctcttc

SEQ ID NO: 778410 - DNA, 25 bp, Mus musculus
tagggctcaattccacatggttcaa

SEQ ID NO: 778411 - DNA, 25 bp, Mus musculus
tagggctcaattgcacatggttcaa

SEQ ID NO: 778412 - DNA, 25 bp, Mus musculus
tagggctcagccactatagtgacat

SEQ ID NO: 778413 - DNA, 25 bp, Mus musculus
tagggctcagcctctatagtgacat

SEQ ID NO: 778414 - DNA, 25 bp, Mus musculus
tagggctcatatagcccttgaacaa

SEQ ID NO: 778415 - DNA, 25 bp, Mus musculus
tagggctcatattgcccttgaacaa

SEQ ID NO: 778416 - DNA, 25 bp, Mus musculus
tagggctccaccacggtgtctgaga

SEQ ID NO: 778417 - DNA, 25 bp, Mus musculus
tagggctccacctcggtgtctgaga

SEQ ID NO: 778418 - DNA, 25 bp, Mus musculus
tagggctccacgaactgagtatgtg

SEQ ID NO: 778419 - DNA, 25 bp, Mus musculus
tagggctccacgtactgagtatgtg

SEQ ID NO: 778420 - DNA, 25 bp, Mus musculus
tagggctccagactccaagagggct

SEQ ID NO: 778421 - DNA, 25 bp, Mus musculus
tagggctccagagtccaagagggct

SEQ ID NO: 778422 - DNA, 25 bp, Mus musculus
tagggctccctactcttttatgtct

SEQ ID NO: 778423 - DNA, 25 bp, Mus musculus
tagggctccctagtcttttatgtct

SEQ ID NO: 778424 - DNA, 25 bp, Mus musculus
tagggctctcctctcttagatgcag

SEQ ID NO: 778425 - DNA, 25 bp, Mus musculus
tagggctctcctgtcttagatgcag

SEQ ID NO: 778426 - DNA, 25 bp, Mus musculus
tagggctcttttagtaggaaatgtt

SEQ ID NO: 778427 - DNA, 25 bp, Mus musculus
tagggctctttttgtaggaaatgtt

SEQ ID NO: 778428 - DNA, 25 bp, Mus musculus
tagggctgacatcactaacctctgt

SEQ ID NO: 778429 - DNA, 25 bp, Mus musculus
tagggctgacatgactaacctctgt

SEQ ID NO: 778430 - DNA, 25 bp, Mus musculus
tagggctgcatcaaggcagtggttt

SEQ ID NO: 778431 - DNA, 25 bp, Mus musculus
tagggctgcatctaggcagtggttt

SEQ ID NO: 778432 - DNA, 25 bp, Mus musculus
tagggctgcccaaggtctacctgag

SEQ ID NO: 778433 - DNA, 25 bp, Mus musculus
tagggctgcccatggtctacctgag

SEQ ID NO: 778434 - DNA, 25 bp, Mus musculus
tagggctgctctcttccaagttccc

SEQ ID NO: 778435 - DNA, 25 bp, Mus musculus
tagggctgctctgttccaagttccc

SEQ ID NO: 778436 - DNA, 25 bp, Mus musculus
tagggctggcagaaatcctggaact

SEQ ID NO: 778437 - DNA, 25 bp, Mus musculus
tagggctggcagtaatcctggaact

SEQ ID NO: 778438 - DNA, 25 bp, Mus musculus
tagggctggccaagtagctcagcta

SEQ ID NO: 778439 - DNA, 25 bp, Mus musculus
tagggctggccatgtagctcagcta

SEQ ID NO: 778440 - DNA, 25 bp, Mus musculus
tagggctggctccaacaagtagcaa

SEQ ID NO: 778441 - DNA, 25 bp, Mus musculus
tagggctggctcgaacaagtagcaa

SEQ ID NO: 778442 - DNA, 25 bp, Mus musculus
tagggctgggccatgagcacacaat

SEQ ID NO: 778443 - DNA, 25 bp, Mus musculus
tagggctgggccttgagcacacaat

SEQ ID NO: 778444 - DNA, 25 bp, Mus musculus
tagggctgggttagtgagtccctcc

SEQ ID NO: 778445 - DNA, 25 bp, Mus musculus
tagggctgggtttgtgagtccctcc

SEQ ID NO: 778446 - DNA, 25 bp, Mus musculus
tagggctgtagcattctgatagatt

SEQ ID NO: 778447 - DNA, 25 bp, Mus musculus
tagggctgtagctttctgatagatt

SEQ ID NO: 778448 - DNA, 25 bp, Mus musculus
tagggctgtgtaatctaccaaaaga

SEQ ID NO: 778449 - DNA, 25 bp, Mus musculus
tagggctgtgtattctaccaaaaga

SEQ ID NO: 778450 - DNA, 25 bp, Mus musculus
tagggctgtgtgatctccaagagac

SEQ ID NO: 778451 - DNA, 25 bp, Mus musculus
tagggctgtgtgttctccaagagac

SEQ ID NO: 778452 - DNA, 25 bp, Mus musculus
tagggcttaaagatgcaatattgac

SEQ ID NO: 778453 - DNA, 25 bp, Mus musculus
tagggcttaaagttgcaatattgac

SEQ ID NO: 778454 - DNA, 25 bp, Mus musculus
tagggcttaaatccaattttctttg

SEQ ID NO: 778455 - DNA, 25 bp, Mus musculus
tagggcttaaatgcaattttctttg

SEQ ID NO: 778456 - DNA, 25 bp, Mus musculus
tagggcttacctagctgattaccat

SEQ ID NO: 778457 - DNA, 25 bp, Mus musculus
tagggcttaccttgctgattaccat

SEQ ID NO: 778458 - DNA, 25 bp, Mus musculus
tagggcttagcaatcatttaacaga

SEQ ID NO: 778459 - DNA, 25 bp, Mus musculus
tagggcttagcattcatttaacaga

SEQ ID NO: 778460 - DNA, 25 bp, Mus musculus
tagggcttagctcgcaatggtgaca

SEQ ID NO: 778461 - DNA, 25 bp, Mus musculus
tagggcttagctggcaatggtgaca

SEQ ID NO: 778462 - DNA, 25 bp, Mus musculus
tagggcttatagaatccagatgcat

SEQ ID NO: 778463 - DNA, 25 bp, Mus musculus
tagggcttatagtatccagatgcat

SEQ ID NO: 778464 - DNA, 25 bp, Mus musculus
tagggcttcagacgacaccgcagtg

SEQ ID NO: 778465 - DNA, 25 bp, Mus musculus
tagggcttcagaggacaccgcagtg

SEQ ID NO: 778466 - DNA, 25 bp, Mus musculus
tagggcttcagtcctgcaataccga

SEQ ID NO: 778467 - DNA, 25 bp, Mus musculus
tagggcttcagtgctgcaataccga

SEQ ID NO: 778468 - DNA, 25 bp, Mus musculus
tagggcttccgcaaaaaagcacaag

SEQ ID NO: 778469 - DNA, 25 bp, Mus musculus
tagggcttccgctaaaaagcacaag

SEQ ID NO: 778470 - DNA, 25 bp, Mus musculus
tagggcttcctcactgtccatgggc

SEQ ID NO: 778471 - DNA, 25 bp, Mus musculus
tagggcttcctccattcttagaact

SEQ ID NO: 778472 - DNA, 25 bp, Mus musculus
tagggcttcctcgattcttagaact

SEQ ID NO: 778473 - DNA, 25 bp, Mus musculus
tagggcttcctctctgtccatgggc

SEQ ID NO: 778474 - DNA, 25 bp, Mus musculus
tagggcttccttcatgaaacttcag

SEQ ID NO: 778475 - DNA, 25 bp, Mus musculus
tagggcttccttgatgaaacttcag

SEQ ID NO: 778476 - DNA, 25 bp, Mus musculus
tagggcttgaagctcgacttgtcct

SEQ ID NO: 778477 - DNA, 25 bp, Mus musculus
tagggcttgaaggtcgacttgtcct

SEQ ID NO: 778478 - DNA, 25 bp, Mus musculus
tagggcttgcctcgtgacactgtac

SEQ ID NO: 778479 - DNA, 25 bp, Mus musculus
tagggcttgcctggtgacactgtac

SEQ ID NO: 778480 - DNA, 25 bp, Mus musculus
tagggcttgggtacaggactttcac

SEQ ID NO: 778481 - DNA, 25 bp, Mus musculus
tagggcttgggttcaggactttcac

SEQ ID NO: 778482 - DNA, 25 bp, Mus musculus
tagggctttacaacccctgaatgat

SEQ ID NO: 778483 - DNA, 25 bp, Mus musculus
tagggctttacatcccctgaatgat

SEQ ID NO: 778484 - DNA, 25 bp, Mus musculus
tagggctttaggctgggcccattct

SEQ ID NO: 778485 - DNA, 25 bp, Mus musculus
tagggctttagggtgggcccattct

SEQ ID NO: 778486 - DNA, 25 bp, Mus musculus
tagggctttcccacgtgtgttctaa

SEQ ID NO: 778487 - DNA, 25 bp, Mus musculus
tagggctttccctcgtgtgttctaa

SEQ ID NO: 778488 - DNA, 25 bp, Mus musculus
tagggctttgagagcattttcaatg

SEQ ID NO: 778489 - DNA, 25 bp, Mus musculus
tagggctttgagtgcattttcaatg

SEQ ID NO: 778490 - DNA, 25 bp, Mus musculus
tagggctttgctatgcccgttgaat

SEQ ID NO: 778491 - DNA, 25 bp, Mus musculus
tagggctttgctttgcccgttgaat

SEQ ID NO: 778492 - DNA, 25 bp, Mus musculus
tagggctttgtgagatccattacat

SEQ ID NO: 778493 - DNA, 25 bp, Mus musculus
tagggctttgtgtgatccattacat

SEQ ID NO: 778494 - DNA, 25 bp, Mus musculus
taggggcgtgtaacattggctttca

SEQ ID NO: 778495 - DNA, 25 bp, Mus musculus
taggggcgtgtatcattggctttca

SEQ ID NO: 778496 - DNA, 25 bp, Mus musculus
taggggctcccacaaactgaaccat

SEQ ID NO: 778497 - DNA, 25 bp, Mus musculus
taggggctcccagaaactgaaccat

SEQ ID NO: 778498 - DNA, 25 bp, Mus musculus
taggggcttgaccttctcagtggct

SEQ ID NO: 778499 - DNA, 25 bp, Mus musculus
taggggcttgacgttctcagtggct

SEQ ID NO: 778500 - DNA, 25 bp, Mus musculus
tagggggctgctaccattgttttta

SEQ ID NO: 778501 - DNA, 25 bp, Mus musculus
tagggggctgcttccattgttttta

SEQ ID NO: 778502 - DNA, 25 bp, Mus musculus
taggggggccctaccactagagctc

SEQ ID NO: 778503 - DNA, 25 bp, Mus musculus
taggggggcccttccactagagctc

SEQ ID NO: 778504 - DNA, 25 bp, Mus musculus
tagggggttcggagtctgctcacac

SEQ ID NO: 778505 - DNA, 25 bp, Mus musculus
tagggggttcggtgtctgctcacac

SEQ ID NO: 778506 - DNA, 25 bp, Mus musculus
tagggtaaacctccctgatacttat

SEQ ID NO: 778507 - DNA, 25 bp, Mus musculus
tagggtaaacctgcctgatacttat

SEQ ID NO: 778508 - DNA, 25 bp, Mus musculus
tagggtaaactccacactctctgac

SEQ ID NO: 778509 - DNA, 25 bp, Mus musculus
tagggtaaactcgacactctctgac

SEQ ID NO: 778510 - DNA, 25 bp, Mus musculus
tagggtaaaggcagtcttctgactt

SEQ ID NO: 778511 - DNA, 25 bp, Mus musculus
tagggtaaaggctgtcttctgactt

SEQ ID NO: 778512 - DNA, 25 bp, Mus musculus
tagggtaaccatacctaagctgccc

SEQ ID NO: 778513 - DNA, 25 bp, Mus musculus
tagggtaaccattcctaagctgccc

SEQ ID NO: 778514 - DNA, 25 bp, Mus musculus
tagggtaaggttcttgcccactggc

SEQ ID NO: 778515 - DNA, 25 bp, Mus musculus
tagggtaaggttgttgcccactggc

SEQ ID NO: 778516 - DNA, 25 bp, Mus musculus
tagggtaagtctacactccaccata

SEQ ID NO: 778517 - DNA, 25 bp, Mus musculus
tagggtaagtcttcactccaccata

SEQ ID NO: 778518 - DNA, 25 bp, Mus musculus
tagggtacatttatcttgcctcaat

SEQ ID NO: 778519 - DNA, 25 bp, Mus musculus
tagggtacatttttcttgcctcaat

SEQ ID NO: 778520 - DNA, 25 bp, Mus musculus
tagggtacctatatgtgttgtgttt

SEQ ID NO: 778521 - DNA, 25 bp, Mus musculus
tagggtacctatttgtgttgtgttt

SEQ ID NO: 778522 - DNA, 25 bp, Mus musculus
tagggtacctcaaacacgtgacata

SEQ ID NO: 778523 - DNA, 25 bp, Mus musculus
tagggtacctcatacacgtgacata

SEQ ID NO: 778524 - DNA, 25 bp, Mus musculus
tagggtactactctaggttgattcc

SEQ ID NO: 778525 - DNA, 25 bp, Mus musculus
tagggtactactgtaggttgattcc

SEQ ID NO: 778526 - DNA, 25 bp, Mus musculus
tagggtactcaaaccctttaccttg

SEQ ID NO: 778527 - DNA, 25 bp, Mus musculus
tagggtactcaatccctttaccttg

SEQ ID NO: 778528 - DNA, 25 bp, Mus musculus
tagggtagagataggcaaacagcca

SEQ ID NO: 778529 - DNA, 25 bp, Mus musculus
tagggtagagattggcaaacagcca

SEQ ID NO: 778530 - DNA, 25 bp, Mus musculus
tagggtagaggccacgtttgcacct

SEQ ID NO: 778531 - DNA, 25 bp, Mus musculus
tagggtagaggcgacgtttgcacct

SEQ ID NO: 778532 - DNA, 25 bp, Mus musculus
tagggtagccatagccagcactggt

SEQ ID NO: 778533 - DNA, 25 bp, Mus musculus
tagggtagccattgccagcactggt

SEQ ID NO: 778534 - DNA, 25 bp, Mus musculus
tagggtaggcacacgctgagccagt

SEQ ID NO: 778535 - DNA, 25 bp, Mus musculus
tagggtaggcactcgctgagccagt

SEQ ID NO: 778536 - DNA, 25 bp, Mus musculus
tagggtagggcaccctctctcctta

SEQ ID NO: 778537 - DNA, 25 bp, Mus musculus
tagggtagggcagcctctctcctta

SEQ ID NO: 778538 - DNA, 25 bp, Mus musculus
tagggtagtaggctcatgctttagt

SEQ ID NO: 778539 - DNA, 25 bp, Mus musculus
tagggtagtagggtcatgctttagt

SEQ ID NO: 778540 - DNA, 25 bp, Mus musculus
tagggtatcatcactatcaacacag

SEQ ID NO: 778541 - DNA, 25 bp, Mus musculus
tagggtatcatctctatcaacacag

SEQ ID NO: 778542 - DNA, 25 bp, Mus musculus
tagggtatctgtatatctttcaaaa

SEQ ID NO: 778543 - DNA, 25 bp, Mus musculus
tagggtatctgtttatctttcaaaa

SEQ ID NO: 778544 - DNA, 25 bp, Mus musculus
tagggtatggtgcactacagttagt

SEQ ID NO: 778545 - DNA, 25 bp, Mus musculus
tagggtatggtggactacagttagt

SEQ ID NO: 778546 - DNA, 25 bp, Mus musculus
tagggtattcagctgctttgtgctt

SEQ ID NO: 778547 - DNA, 25 bp, Mus musculus
tagggtattcaggtgctttgtgctt

SEQ ID NO: 778548 - DNA, 25 bp, Mus musculus
tagggtatttcaaaactgccaaggg

SEQ ID NO: 778549 - DNA, 25 bp, Mus musculus
tagggtatttcataactgccaaggg

SEQ ID NO: 778550 - DNA, 25 bp, Mus musculus
tagggtcaaaagctctgggcgtggt

SEQ ID NO: 778551 - DNA, 25 bp, Mus musculus
tagggtcaaaaggtctgggcgtggt

SEQ ID NO: 778552 - DNA, 25 bp, Mus musculus
tagggtcaacctaccatggccaagg

SEQ ID NO: 778553 - DNA, 25 bp, Mus musculus
tagggtcaaccttccatggccaagg

SEQ ID NO: 778554 - DNA, 25 bp, Mus musculus
tagggtcacaacctacatcccatat

SEQ ID NO: 778555 - DNA, 25 bp, Mus musculus
tagggtcacaacgtacatcccatat

SEQ ID NO: 778556 - DNA, 25 bp, Mus musculus
tagggtcaccctagagcagcagctc

SEQ ID NO: 778557 - DNA, 25 bp, Mus musculus
tagggtcacccttgagcagcagctc

SEQ ID NO: 778558 - DNA, 25 bp, Mus musculus
tagggtcatactactaaccccatca

SEQ ID NO: 778559 - DNA, 25 bp, Mus musculus
tagggtcatacttctaaccccatca

SEQ ID NO: 778560 - DNA, 25 bp, Mus musculus
tagggtccagaacccttctacttca

SEQ ID NO: 778561 - DNA, 25 bp, Mus musculus
tagggtccagaagccttctacttca

SEQ ID NO: 778562 - DNA, 25 bp, Mus musculus
tagggtccagtcagacgtgctcagc

SEQ ID NO: 778563 - DNA, 25 bp, Mus musculus
tagggtccagtctgacgtgctcagc

SEQ ID NO: 778564 - DNA, 25 bp, Mus musculus
tagggtccatttctcagcagccatt

SEQ ID NO: 778565 - DNA, 25 bp, Mus musculus
tagggtccatttgtcagcagccatt

SEQ ID NO: 778566 - DNA, 25 bp, Mus musculus
tagggtcccctcactgatacctaaa

SEQ ID NO: 778567 - DNA, 25 bp, Mus musculus
tagggtcccctctctgatacctaaa

SEQ ID NO: 778568 - DNA, 25 bp, Mus musculus
tagggtcccgtgacaccaatgtgaa

SEQ ID NO: 778569 - DNA, 25 bp, Mus musculus
tagggtcccgtgtcaccaatgtgaa

SEQ ID NO: 778570 - DNA, 25 bp, Mus musculus
tagggtcctagcacacatgtctggt

SEQ ID NO: 778571 - DNA, 25 bp, Mus musculus
tagggtcctagctcacatgtctggt

SEQ ID NO: 778572 - DNA, 25 bp, Mus musculus
tagggtcctgctactggtcatatga

SEQ ID NO: 778573 - DNA, 25 bp, Mus musculus
tagggtcctgcttctggtcatatga

SEQ ID NO: 778574 - DNA, 25 bp, Mus musculus
tagggtcctgtcagtgatacgatca

SEQ ID NO: 778575 - DNA, 25 bp, Mus musculus
tagggtcctgtctgtgatacgatca

SEQ ID NO: 778576 - DNA, 25 bp, Mus musculus
tagggtccttgaaatgagaccaaat

SEQ ID NO: 778577 - DNA, 25 bp, Mus musculus
tagggtccttgatatgagaccaaat

SEQ ID NO: 778578 - DNA, 25 bp, Mus musculus
tagggtccttggaggcagctagtct

SEQ ID NO: 778579 - DNA, 25 bp, Mus musculus
tagggtccttggtggcagctagtct

SEQ ID NO: 778580 - DNA, 25 bp, Mus musculus
tagggtcgagctcaactctgttcct

SEQ ID NO: 778581 - DNA, 25 bp, Mus musculus
tagggtcgagctgaactctgttcct

SEQ ID NO: 778582 - DNA, 25 bp, Mus musculus
tagggtcggcatacagggccttgct

SEQ ID NO: 778583 - DNA, 25 bp, Mus musculus
tagggtcggcattcagggccttgct

SEQ ID NO: 778584 - DNA, 25 bp, Mus musculus
tagggtctacctaacctttctagct

SEQ ID NO: 778585 - DNA, 25 bp, Mus musculus
tagggtctaccttacctttctagct

SEQ ID NO: 778586 - DNA, 25 bp, Mus musculus
tagggtctattcagtgagtcatggt

SEQ ID NO: 778587 - DNA, 25 bp, Mus musculus
tagggtctattctgtgagtcatggt

SEQ ID NO: 778588 - DNA, 25 bp, Mus musculus
tagggtctcagcagtctactataag

SEQ ID NO: 778589 - DNA, 25 bp, Mus musculus
tagggtctcagctgtctactataag

SEQ ID NO: 778590 - DNA, 25 bp, Mus musculus
tagggtctcagtcagttgtatagga

SEQ ID NO: 778591 - DNA, 25 bp, Mus musculus
tagggtctcagtgagttgtatagga

SEQ ID NO: 778592 - DNA, 25 bp, Mus musculus
tagggtctccaaacctgacgtttat

SEQ ID NO: 778593 - DNA, 25 bp, Mus musculus
tagggtctccaatcctgacgtttat

SEQ ID NO: 778594 - DNA, 25 bp, Mus musculus
tagggtctcctacttcactttagaa

SEQ ID NO: 778595 - DNA, 25 bp, Mus musculus
tagggtctcctagttcactttagaa

SEQ ID NO: 778596 - DNA, 25 bp, Mus musculus
tagggtctcgctatttaagatcatc

SEQ ID NO: 778597 - DNA, 25 bp, Mus musculus
tagggtctcgctttttaagatcatc

SEQ ID NO: 778598 - DNA, 25 bp, Mus musculus
tagggtctctttatgaagtgttggc

SEQ ID NO: 778599 - DNA, 25 bp, Mus musculus
tagggtctctttttgaagtgttggc

SEQ ID NO: 778600 - DNA, 25 bp, Mus musculus
tagggtctgaccagtgctctcaatg

SEQ ID NO: 778601 - DNA, 25 bp, Mus musculus
tagggtctgacctgtgctctcaatg

SEQ ID NO: 778602 - DNA, 25 bp, Mus musculus
tagggtctgagccaggagtcctcaa

SEQ ID NO: 778603 - DNA, 25 bp, Mus musculus
tagggtctgagcgaggagtcctcaa

SEQ ID NO: 778604 - DNA, 25 bp, Mus musculus
tagggtcttatacttgcacctcaag

SEQ ID NO: 778605 - DNA, 25 bp, Mus musculus
tagggtcttatagttgcacctcaag

SEQ ID NO: 778606 - DNA, 25 bp, Mus musculus
tagggtcttattacgtagccctggc

SEQ ID NO: 778607 - DNA, 25 bp, Mus musculus
tagggtcttatttcgtagccctggc

SEQ ID NO: 778608 - DNA, 25 bp, Mus musculus
tagggtcttcaacaccttagcgcga

SEQ ID NO: 778609 - DNA, 25 bp, Mus musculus
tagggtcttcaagaccttagcgcga

SEQ ID NO: 778610 - DNA, 25 bp, Mus musculus
tagggtcttgatatgcagccttggc

SEQ ID NO: 778611 - DNA, 25 bp, Mus musculus
tagggtcttgatttgcagccttggc

SEQ ID NO: 778612 - DNA, 25 bp, Mus musculus
tagggtgaaagcagtgtcccctgtc

SEQ ID NO: 778613 - DNA, 25 bp, Mus musculus
tagggtgaaagctgtgtcccctgtc

SEQ ID NO: 778614 - DNA, 25 bp, Mus musculus
tagggtgaaattagcttgtaagggt

SEQ ID NO: 778615 - DNA, 25 bp, Mus musculus
tagggtgaaatttgcttgtaagggt

SEQ ID NO: 778616 - DNA, 25 bp, Mus musculus
tagggtgaactcaatgagcaaggcc

SEQ ID NO: 778617 - DNA, 25 bp, Mus musculus
tagggtgaactctatgagcaaggcc

SEQ ID NO: 778618 - DNA, 25 bp, Mus musculus
tagggtgacaataccctctctgcat

SEQ ID NO: 778619 - DNA, 25 bp, Mus musculus
tagggtgacaattccctctctgcat

SEQ ID NO: 778620 - DNA, 25 bp, Mus musculus
tagggtgacactcgagccacgtggc

SEQ ID NO: 778621 - DNA, 25 bp, Mus musculus
tagggtgacactggagccacgtggc

SEQ ID NO: 778622 - DNA, 25 bp, Mus musculus
tagggtgacagcagtgtcactgctc

SEQ ID NO: 778623 - DNA, 25 bp, Mus musculus
tagggtgacagctgtgtcactgctc

SEQ ID NO: 778624 - DNA, 25 bp, Mus musculus
tagggtgagcgaaatggcctgccct

SEQ ID NO: 778625 - DNA, 25 bp, Mus musculus
tagggtgagcgatatggcctgccct

SEQ ID NO: 778626 - DNA, 25 bp, Mus musculus
tagggtgatctactctccaaaacga

SEQ ID NO: 778627 - DNA, 25 bp, Mus musculus
tagggtgatctagtctccaaaacga

SEQ ID NO: 778628 - DNA, 25 bp, Mus musculus
tagggtgattttcgcactgttccca

SEQ ID NO: 778629 - DNA, 25 bp, Mus musculus
tagggtgattttggcactgttccca

SEQ ID NO: 778630 - DNA, 25 bp, Mus musculus
tagggtgcaaacataaactatataa

SEQ ID NO: 778631 - DNA, 25 bp, Mus musculus
tagggtgcaaacttaaactatataa

SEQ ID NO: 778632 - DNA, 25 bp, Mus musculus
tagggtgcaagcacaaccagcaact

SEQ ID NO: 778633 - DNA, 25 bp, Mus musculus
tagggtgcaagctcaaccagcaact

SEQ ID NO: 778634 - DNA, 25 bp, Mus musculus
tagggtgcagtaagtggccagttat

SEQ ID NO: 778635 - DNA, 25 bp, Mus musculus
tagggtgcagtatgtggccagttat

SEQ ID NO: 778636 - DNA, 25 bp, Mus musculus
tagggtgctatcacaggcgcctata

SEQ ID NO: 778637 - DNA, 25 bp, Mus musculus
tagggtgctatctcaggcgcctata

SEQ ID NO: 778638 - DNA, 25 bp, Mus musculus
tagggtgctgagattgctcgtccat

SEQ ID NO: 778639 - DNA, 25 bp, Mus musculus
tagggtgctgagtttgctcgtccat

SEQ ID NO: 778640 - DNA, 25 bp, Mus musculus
tagggtggacacaactcccgaggac

SEQ ID NO: 778641 - DNA, 25 bp, Mus musculus
tagggtggacactactcccgaggac

SEQ ID NO: 778642 - DNA, 25 bp, Mus musculus
tagggtggccaaaggcaaccgccat

SEQ ID NO: 778643 - DNA, 25 bp, Mus musculus
tagggtggccaatggcaaccgccat

SEQ ID NO: 778644 - DNA, 25 bp, Mus musculus
tagggtggcctcacacttggagcct

SEQ ID NO: 778645 - DNA, 25 bp, Mus musculus
tagggtggcctcataacttcagata

SEQ ID NO: 778646 - DNA, 25 bp, Mus musculus
tagggtggcctctcacttggagcct

SEQ ID NO: 778647 - DNA, 25 bp, Mus musculus
tagggtggcctcttaacttcagata

SEQ ID NO: 778648 - DNA, 25 bp, Mus musculus
tagggtggctctcgccgagattatc

SEQ ID NO: 778649 - DNA, 25 bp, Mus musculus
tagggtggctctggccgagattatc

SEQ ID NO: 778650 - DNA, 25 bp, Mus musculus
tagggtgggctcagtgccctcataa

SEQ ID NO: 778651 - DNA, 25 bp, Mus musculus
tagggtgggctctgtgccctcataa

SEQ ID NO: 778652 - DNA, 25 bp, Mus musculus
tagggtgggtttaaccacatcaaat

SEQ ID NO: 778653 - DNA, 25 bp, Mus musculus
tagggtgggttttaccacatcaaat

SEQ ID NO: 778654 - DNA, 25 bp, Mus musculus
tagggtggtaggatcctgctattat

SEQ ID NO: 778655 - DNA, 25 bp, Mus musculus
tagggtggtaggttcctgctattat

SEQ ID NO: 778656 - DNA, 25 bp, Mus musculus
tagggtggtcccatggcattgctcc

SEQ ID NO: 778657 - DNA, 25 bp, Mus musculus
tagggtggtcccttggcattgctcc

SEQ ID NO: 778658 - DNA, 25 bp, Mus musculus
tagggtggtgagacccttcctggct

SEQ ID NO: 778659 - DNA, 25 bp, Mus musculus
tagggtggtgagtcccttcctggct

SEQ ID NO: 778660 - DNA, 25 bp, Mus musculus
tagggtgtacccagatggtctgaac

SEQ ID NO: 778661 - DNA, 25 bp, Mus musculus
tagggtgtaccctgatggtctgaac

SEQ ID NO: 778662 - DNA, 25 bp, Mus musculus
tagggtgtcatcatcagcagcttac

SEQ ID NO: 778663 - DNA, 25 bp, Mus musculus
tagggtgtcatcttcagcagcttac

SEQ ID NO: 778664 - DNA, 25 bp, Mus musculus
tagggtgtctgtcgccttaccaatt

SEQ ID NO: 778665 - DNA, 25 bp, Mus musculus
tagggtgtctgtggccttaccaatt

SEQ ID NO: 778666 - DNA, 25 bp, Mus musculus
tagggtgtgccaaccaccattcagt

SEQ ID NO: 778667 - DNA, 25 bp, Mus musculus
tagggtgtgccatccaccattcagt

SEQ ID NO: 778668 - DNA, 25 bp, Mus musculus
tagggtgtggttctatcaagaactc

SEQ ID NO: 778669 - DNA, 25 bp, Mus musculus
tagggtgtggttgtatcaagaactc

SEQ ID NO: 778670 - DNA, 25 bp, Mus musculus
tagggtgtgtacatgggacatacca

SEQ ID NO: 778671 - DNA, 25 bp, Mus musculus
tagggtgtgtacttgggacatacca

SEQ ID NO: 778672 - DNA, 25 bp, Mus musculus
tagggtgttgctaaagattcttcat

SEQ ID NO: 778673 - DNA, 25 bp, Mus musculus
tagggtgttgcttaagattcttcat

SEQ ID NO: 778674 - DNA, 25 bp, Mus musculus
tagggttactgtcccacgctggtca

SEQ ID NO: 778675 - DNA, 25 bp, Mus musculus
tagggttactgtgccacgctggtca

SEQ ID NO: 778676 - DNA, 25 bp, Mus musculus
tagggttattcaatccgttaccagg

SEQ ID NO: 778677 - DNA, 25 bp, Mus musculus
tagggttattcattccgttaccagg

SEQ ID NO: 778678 - DNA, 25 bp, Mus musculus
tagggttcaccaaagcagactctgc

SEQ ID NO: 778679 - DNA, 25 bp, Mus musculus
tagggttcaccatagcagactctgc

SEQ ID NO: 778680 - DNA, 25 bp, Mus musculus
tagggttcatttatggtgaggtcac

SEQ ID NO: 778681 - DNA, 25 bp, Mus musculus
tagggttcatttttggtgaggtcac

SEQ ID NO: 778682 - DNA, 25 bp, Mus musculus
tagggttccaaactagtcactaggc

SEQ ID NO: 778683 - DNA, 25 bp, Mus musculus
tagggttccaaagtagtcactaggc

SEQ ID NO: 778684 - DNA, 25 bp, Mus musculus
tagggttccactctaggtaggcact

SEQ ID NO: 778685 - DNA, 25 bp, Mus musculus
tagggttccactgtaggtaggcact

SEQ ID NO: 778686 - DNA, 25 bp, Mus musculus
tagggttccctacgaatgcgtattg

SEQ ID NO: 778687 - DNA, 25 bp, Mus musculus
tagggttccctaggaatgcgtattg

SEQ ID NO: 778688 - DNA, 25 bp, Mus musculus
tagggttcttgtctcaggactctgc

SEQ ID NO: 778689 - DNA, 25 bp, Mus musculus
tagggttcttgtgtcaggactctgc

SEQ ID NO: 778690 - DNA, 25 bp, Mus musculus
tagggttctttgcatgtaccacatt

SEQ ID NO: 778691 - DNA, 25 bp, Mus musculus
tagggttctttggatgtaccacatt

SEQ ID NO: 778692 - DNA, 25 bp, Mus musculus
tagggttgactcatctgctcagggt

SEQ ID NO: 778693 - DNA, 25 bp, Mus musculus
tagggttgactcttctgctcagggt

SEQ ID NO: 778694 - DNA, 25 bp, Mus musculus
tagggttgactgatcccgatcccaa

SEQ ID NO: 778695 - DNA, 25 bp, Mus musculus
tagggttgactgttcccgatcccaa

SEQ ID NO: 778696 - DNA, 25 bp, Mus musculus
tagggttgagtcctagcccagcttc

SEQ ID NO: 778697 - DNA, 25 bp, Mus musculus
tagggttgagtcgtagcccagcttc

SEQ ID NO: 778698 - DNA, 25 bp, Mus musculus
tagggttgagtgagcccgacactgc

SEQ ID NO: 778699 - DNA, 25 bp, Mus musculus
tagggttgagtgtgcccgacactgc

SEQ ID NO: 778700 - DNA, 25 bp, Mus musculus
tagggttgccgaaccatcactccag

SEQ ID NO: 778701 - DNA, 25 bp, Mus musculus
tagggttgccgatccatcactccag

SEQ ID NO: 778702 - DNA, 25 bp, Mus musculus
tagggttgcggaagtgtgccaccac

SEQ ID NO: 778703 - DNA, 25 bp, Mus musculus
tagggttgcggatgtgtgccaccac

SEQ ID NO: 778704 - DNA, 25 bp, Mus musculus
tagggttgctgacgcgttttttcct

SEQ ID NO: 778705 - DNA, 25 bp, Mus musculus
tagggttgctgaggcgttttttcct

SEQ ID NO: 778706 - DNA, 25 bp, Mus musculus
tagggttggcagactgtagcctacc

SEQ ID NO: 778707 - DNA, 25 bp, Mus musculus
tagggttggcagtctgtagcctacc

SEQ ID NO: 778708 - DNA, 25 bp, Mus musculus
tagggttggcccagcccaacatcta

SEQ ID NO: 778709 - DNA, 25 bp, Mus musculus
tagggttggccctgcccaacatcta

SEQ ID NO: 778710 - DNA, 25 bp, Mus musculus
tagggttggcctagactgggacaca

SEQ ID NO: 778711 - DNA, 25 bp, Mus musculus
tagggttggccttgactgggacaca

SEQ ID NO: 778712 - DNA, 25 bp, Mus musculus
tagggttggttgcaagtgcctttac

SEQ ID NO: 778713 - DNA, 25 bp, Mus musculus
tagggttggttggaagtgcctttac

SEQ ID NO: 778714 - DNA, 25 bp, Mus musculus
tagggttgtgggagcacatcaccat

SEQ ID NO: 778715 - DNA, 25 bp, Mus musculus
tagggttgtgggtgcacatcaccat

SEQ ID NO: 778716 - DNA, 25 bp, Mus musculus
tagggtttagataccttaggcagac

SEQ ID NO: 778717 - DNA, 25 bp, Mus musculus
tagggtttagattccttaggcagac

SEQ ID NO: 778718 - DNA, 25 bp, Mus musculus
tagggtttcttacatagaagtgatt

SEQ ID NO: 778719 - DNA, 25 bp, Mus musculus
tagggtttcttagatagaagtgatt

SEQ ID NO: 778720 - DNA, 25 bp, Mus musculus
tagggtttggaaacacagtcatgta

SEQ ID NO: 778721 - DNA, 25 bp, Mus musculus
tagggtttggaatcacagtcatgta

SEQ ID NO: 778722 - DNA, 25 bp, Mus musculus
tagggtttgtgaatctcatttgtca

SEQ ID NO: 778723 - DNA, 25 bp, Mus musculus
tagggtttgtgattctcatttgtca

SEQ ID NO: 778724 - DNA, 25 bp, Mus musculus
tagggtttgtgcacccgactcgagt

SEQ ID NO: 778725 - DNA, 25 bp, Mus musculus
tagggtttgtgctcccgactcgagt

SEQ ID NO: 778726 - DNA, 25 bp, Mus musculus
taggtaaaacctcatccgtgccatt

SEQ ID NO: 778727 - DNA, 25 bp, Mus musculus
taggtaaaacctgatccgtgccatt

SEQ ID NO: 778728 - DNA, 25 bp, Mus musculus
taggtaaaggcaaccctgggcctaa

SEQ ID NO: 778729 - DNA, 25 bp, Mus musculus
taggtaaaggcatccctgggcctaa

SEQ ID NO: 778730 - DNA, 25 bp, Mus musculus
taggtaaaggctagcttcatgttcc

SEQ ID NO: 778731 - DNA, 25 bp, Mus musculus
taggtaaaggcttgcttcatgttcc

SEQ ID NO: 778732 - DNA, 25 bp, Mus musculus
taggtaaagtctagctcctgtgctg

SEQ ID NO: 778733 - DNA, 25 bp, Mus musculus
taggtaaagtcttgctcctgtgctg

SEQ ID NO: 778734 - DNA, 25 bp, Mus musculus
taggtaaatccaccccaagtccttt

SEQ ID NO: 778735 - DNA, 25 bp, Mus musculus
taggtaaatccagcccaagtccttt

SEQ ID NO: 778736 - DNA, 25 bp, Mus musculus
taggtaaattccattcagagcatat

SEQ ID NO: 778737 - DNA, 25 bp, Mus musculus
taggtaaattcctttcagagcatat

SEQ ID NO: 778738 - DNA, 25 bp, Mus musculus
taggtaaccaagctgactccatcct

SEQ ID NO: 778739 - DNA, 25 bp, Mus musculus
taggtaaccaaggtgactccatcct

SEQ ID NO: 778740 - DNA, 25 bp, Mus musculus
taggtaaccctgctctgactaacta

SEQ ID NO: 778741 - DNA, 25 bp, Mus musculus
taggtaaccctggtctgactaacta

SEQ ID NO: 778742 - DNA, 25 bp, Mus musculus
taggtaactaaaccccatgccttat

SEQ ID NO: 778743 - DNA, 25 bp, Mus musculus
taggtaactaaagcccatgccttat

SEQ ID NO: 778744 - DNA, 25 bp, Mus musculus
taggtaactggtctacctcccactg

SEQ ID NO: 778745 - DNA, 25 bp, Mus musculus
taggtaactggtgtacctcccactg

SEQ ID NO: 778746 - DNA, 25 bp, Mus musculus
taggtaacttccattctgcagtcct

SEQ ID NO: 778747 - DNA, 25 bp, Mus musculus
taggtaacttcctttctgcagtcct

SEQ ID NO: 778748 - DNA, 25 bp, Mus musculus
taggtaagctagcttcttgtaggga

SEQ ID NO: 778749 - DNA, 25 bp, Mus musculus
taggtaagctaggttcttgtaggga

SEQ ID NO: 778750 - DNA, 25 bp, Mus musculus
taggtaaggccccaagcacctcaga

SEQ ID NO: 778751 - DNA, 25 bp, Mus musculus
taggtaaggcccgaagcacctcaga

SEQ ID NO: 778752 - DNA, 25 bp, Mus musculus
taggtaagttccattgtatacaaat

SEQ ID NO: 778753 - DNA, 25 bp, Mus musculus
taggtaagttcctttgtatacaaat

SEQ ID NO: 778754 - DNA, 25 bp, Mus musculus
taggtaataactaaggctcctctct

SEQ ID NO: 778755 - DNA, 25 bp, Mus musculus
taggtaataacttaggctcctctct

SEQ ID NO: 778756 - DNA, 25 bp, Mus musculus
taggtaatcaccatagtggcagcaa

SEQ ID NO: 778757 - DNA, 25 bp, Mus musculus
taggtaatcaccttagtggcagcaa

SEQ ID NO: 778758 - DNA, 25 bp, Mus musculus
taggtaatccttacatagagacctt

SEQ ID NO: 778759 - DNA, 25 bp, Mus musculus
taggtaatcctttcatagagacctt

SEQ ID NO: 778760 - DNA, 25 bp, Mus musculus
taggtaattaacactctacactaat

SEQ ID NO: 778761 - DNA, 25 bp, Mus musculus
taggtaattaactctctacactaat

SEQ ID NO: 778762 - DNA, 25 bp, Mus musculus
taggtacagaataagccccaggaat

SEQ ID NO: 778763 - DNA, 25 bp, Mus musculus
taggtacagaattagccccaggaat

SEQ ID NO: 778764 - DNA, 25 bp, Mus musculus
taggtacagtgcatggtcctggact

SEQ ID NO: 778765 - DNA, 25 bp, Mus musculus
taggtacagtgcttggtcctggact

SEQ ID NO: 778766 - DNA, 25 bp, Mus musculus
taggtacatcaaagaggcgcctgtg

SEQ ID NO: 778767 - DNA, 25 bp, Mus musculus
taggtacatcaatgaggcgcctgtg

SEQ ID NO: 778768 - DNA, 25 bp, Mus musculus
taggtacatttcacatttctcatcc

SEQ ID NO: 778769 - DNA, 25 bp, Mus musculus
taggtacatttctcatttctcatcc

SEQ ID NO: 778770 - DNA, 25 bp, Mus musculus
taggtaccagccatgcccagagtat

SEQ ID NO: 778771 - DNA, 25 bp, Mus musculus
taggtaccagccttgcccagagtat

SEQ ID NO: 778772 - DNA, 25 bp, Mus musculus
taggtaccatctaacttaacaagtg

SEQ ID NO: 778773 - DNA, 25 bp, Mus musculus
taggtaccatcttacttaacaagtg

SEQ ID NO: 778774 - DNA, 25 bp, Mus musculus
taggtaccctggagtgcagaacaat

SEQ ID NO: 778775 - DNA, 25 bp, Mus musculus
taggtaccctggtgtgcagaacaat

SEQ ID NO: 778776 - DNA, 25 bp, Mus musculus
taggtaccgaacagctgccatggta

SEQ ID NO: 778777 - DNA, 25 bp, Mus musculus
taggtaccgaactgctgccatggta

SEQ ID NO: 778778 - DNA, 25 bp, Mus musculus
taggtacggtgacgactctgcctgc

SEQ ID NO: 778779 - DNA, 25 bp, Mus musculus
taggtacggtgaggactctgcctgc

SEQ ID NO: 778780 - DNA, 25 bp, Mus musculus
taggtactgctcacaccagaagcca

SEQ ID NO: 778781 - DNA, 25 bp, Mus musculus
taggtactgctctcaccagaagcca

SEQ ID NO: 778782 - DNA, 25 bp, Mus musculus
taggtagaaatcacccatctaggat

SEQ ID NO: 778783 - DNA, 25 bp, Mus musculus
taggtagaaatctcccatctaggat

SEQ ID NO: 778784 - DNA, 25 bp, Mus musculus
taggtagaagcaatctcaccctggt

SEQ ID NO: 778785 - DNA, 25 bp, Mus musculus
taggtagaagcattctcaccctggt

SEQ ID NO: 778786 - DNA, 25 bp, Mus musculus
taggtagaccagacacgtgttgggt

SEQ ID NO: 778787 - DNA, 25 bp, Mus musculus
taggtagaccagtcacgtgttgggt

SEQ ID NO: 778788 - DNA, 25 bp, Mus musculus
taggtagactgcctcagggaagcca

SEQ ID NO: 778789 - DNA, 25 bp, Mus musculus
taggtagactgcgtcagggaagcca

SEQ ID NO: 778790 - DNA, 25 bp, Mus musculus
taggtagacttacacttggatcaac

SEQ ID NO: 778791 - DNA, 25 bp, Mus musculus
taggtagacttagacttggatcaac

SEQ ID NO: 778792 - DNA, 25 bp, Mus musculus
taggtagagatccacgtctcgtcgt

SEQ ID NO: 778793 - DNA, 25 bp, Mus musculus
taggtagagatcgacgtctcgtcgt

SEQ ID NO: 778794 - DNA, 25 bp, Mus musculus
taggtagcaattaaactggagtaat

SEQ ID NO: 778795 - DNA, 25 bp, Mus musculus
taggtagcaatttaactggagtaat

SEQ ID NO: 778796 - DNA, 25 bp, Mus musculus
taggtagcctggctcagcatcccaa

SEQ ID NO: 778797 - DNA, 25 bp, Mus musculus
taggtagcctgggtcagcatcccaa

SEQ ID NO: 778798 - DNA, 25 bp, Mus musculus
taggtagctcccaggaaggatccca

SEQ ID NO: 778799 - DNA, 25 bp, Mus musculus
taggtagctccctggaaggatccca

SEQ ID NO: 778800 - DNA, 25 bp, Mus musculus
taggtagcttcacaaatgctctccc

SEQ ID NO: 778801 - DNA, 25 bp, Mus musculus
taggtagcttcagaaatgctctccc

SEQ ID NO: 778802 - DNA, 25 bp, Mus musculus
taggtaggaagaatctcatgtgcaa

SEQ ID NO: 778803 - DNA, 25 bp, Mus musculus
taggtaggaagattctcatgtgcaa

SEQ ID NO: 778804 - DNA, 25 bp, Mus musculus
taggtaggccagacgtatcttttcc

SEQ ID NO: 778805 - DNA, 25 bp, Mus musculus
taggtaggccagtcgtatcttttcc

SEQ ID NO: 778806 - DNA, 25 bp, Mus musculus
taggtaggcctcacttcggagcagg

SEQ ID NO: 778807 - DNA, 25 bp, Mus musculus
taggtaggcctcattttctgaatct

SEQ ID NO: 778808 - DNA, 25 bp, Mus musculus
taggtaggcctctcttcggagcagg

SEQ ID NO: 778809 - DNA, 25 bp, Mus musculus
taggtaggcctctttttctgaatct

SEQ ID NO: 778810 - DNA, 25 bp, Mus musculus
taggtagggagacagcttcaagcat

SEQ ID NO: 778811 - DNA, 25 bp, Mus musculus
taggtagggagagagcttcaagcat

SEQ ID NO: 778812 - DNA, 25 bp, Mus musculus
taggtagggcacatacttagctgca

SEQ ID NO: 778813 - DNA, 25 bp, Mus musculus
taggtagggcacttacttagctgca

SEQ ID NO: 778814 - DNA, 25 bp, Mus musculus
taggtagggccaagtgtgccagaaa

SEQ ID NO: 778815 - DNA, 25 bp, Mus musculus
taggtagggccatgtgtgccagaaa

SEQ ID NO: 778816 - DNA, 25 bp, Mus musculus
taggtaggtatgatcaagccaagcc

SEQ ID NO: 778817 - DNA, 25 bp, Mus musculus
taggtaggtatgttcaagccaagcc

SEQ ID NO: 778818 - DNA, 25 bp, Mus musculus
taggtagtcccgcagaaggtctgca

SEQ ID NO: 778819 - DNA, 25 bp, Mus musculus
taggtagtcccggagaaggtctgca

SEQ ID NO: 778820 - DNA, 25 bp, Mus musculus
taggtagtcttcaatccttgtttcc

SEQ ID NO: 778821 - DNA, 25 bp, Mus musculus
taggtagtcttctatccttgtttcc

SEQ ID NO: 778822 - DNA, 25 bp, Mus musculus
taggtagtgtatcttacttctgtta

SEQ ID NO: 778823 - DNA, 25 bp, Mus musculus
taggtagtgtatgttacttctgtta

SEQ ID NO: 778824 - DNA, 25 bp, Mus musculus
taggtagtgtccacttgatcctgga

SEQ ID NO: 778825 - DNA, 25 bp, Mus musculus
taggtagtgtcctcttgatcctgga

SEQ ID NO: 778826 - DNA, 25 bp, Mus musculus
taggtagtttgcacacaggccttcc

SEQ ID NO: 778827 - DNA, 25 bp, Mus musculus
taggtagtttgctcacaggccttcc

SEQ ID NO: 778828 - DNA, 25 bp, Mus musculus
taggtatagacacttgctggcaaac

SEQ ID NO: 778829 - DNA, 25 bp, Mus musculus
taggtatagacagttgctggcaaac

SEQ ID NO: 778830 - DNA, 25 bp, Mus musculus
taggtatagagtatgtttacaccct

SEQ ID NO: 778831 - DNA, 25 bp, Mus musculus
taggtatagagtttgtttacaccct

SEQ ID NO: 778832 - DNA, 25 bp, Mus musculus
taggtataggccctacttccatggc

SEQ ID NO: 778833 - DNA, 25 bp, Mus musculus
taggtataggccgtacttccatggc

SEQ ID NO: 778834 - DNA, 25 bp, Mus musculus
taggtatatcgcctccagacaatat

SEQ ID NO: 778835 - DNA, 25 bp, Mus musculus
taggtatatcgcgtccagacaatat

SEQ ID NO: 778836 - DNA, 25 bp, Mus musculus
taggtatccaagcacaaccttgaat

SEQ ID NO: 778837 - DNA, 25 bp, Mus musculus
taggtatccaaggacaaccttgaat

SEQ ID NO: 778838 - DNA, 25 bp, Mus musculus
taggtatccactaacagtgccttct

SEQ ID NO: 778839 - DNA, 25 bp, Mus musculus
taggtatccacttacagtgccttct

SEQ ID NO: 778840 - DNA, 25 bp, Mus musculus
taggtatgcaagatgcaggcattac

SEQ ID NO: 778841 - DNA, 25 bp, Mus musculus
taggtatgcaagttgcaggcattac

SEQ ID NO: 778842 - DNA, 25 bp, Mus musculus
taggtatgccataaacagctatagt

SEQ ID NO: 778843 - DNA, 25 bp, Mus musculus
taggtatgccattaacagctatagt

SEQ ID NO: 778844 - DNA, 25 bp, Mus musculus
taggtatgccttactagcttagcta

SEQ ID NO: 778845 - DNA, 25 bp, Mus musculus
taggtatgcctttctagcttagcta

SEQ ID NO: 778846 - DNA, 25 bp, Mus musculus
taggtatgcgatacgtttccccaaa

SEQ ID NO: 778847 - DNA, 25 bp, Mus musculus
taggtatgcgattcgtttccccaaa

SEQ ID NO: 778848 - DNA, 25 bp, Mus musculus
taggtattatatacatttgtttcac

SEQ ID NO: 778849 - DNA, 25 bp, Mus musculus
taggtattatattcatttgtttcac

SEQ ID NO: 778850 - DNA, 25 bp, Mus musculus
taggtattctcaactgtccgctgct

SEQ ID NO: 778851 - DNA, 25 bp, Mus musculus
taggtattctcatctgtccgctgct

SEQ ID NO: 778852 - DNA, 25 bp, Mus musculus
taggtattcttcatatggagcccag

SEQ ID NO: 778853 - DNA, 25 bp, Mus musculus
taggtattcttcttatggagcccag

SEQ ID NO: 778854 - DNA, 25 bp, Mus musculus
taggtattggagatatagactgttg

SEQ ID NO: 778855 - DNA, 25 bp, Mus musculus
taggtattggagttatagactgttg

SEQ ID NO: 778856 - DNA, 25 bp, Mus musculus
taggtatttctccagctgtctttaa

SEQ ID NO: 778857 - DNA, 25 bp, Mus musculus
taggtatttctcgagctgtctttaa

SEQ ID NO: 778858 - DNA, 25 bp, Mus musculus
taggtcaaaaggctccaccccagtt

SEQ ID NO: 778859 - DNA, 25 bp, Mus musculus
taggtcaaaagggtccaccccagtt

SEQ ID NO: 778860 - DNA, 25 bp, Mus musculus
taggtcaaagacaggtggcctcctt

SEQ ID NO: 778861 - DNA, 25 bp, Mus musculus
taggtcaaagactggtggcctcctt

SEQ ID NO: 778862 - DNA, 25 bp, Mus musculus
taggtcaagcctatgctcactcttt

SEQ ID NO: 778863 - DNA, 25 bp, Mus musculus
taggtcaagcctttgctcactcttt

SEQ ID NO: 778864 - DNA, 25 bp, Mus musculus
taggtcacaaacctcgagtcaccaa

SEQ ID NO: 778865 - DNA, 25 bp, Mus musculus
taggtcacaaacgtcgagtcaccaa

SEQ ID NO: 778866 - DNA, 25 bp, Mus musculus
taggtcacagaccaggtgtccctgc

SEQ ID NO: 778867 - DNA, 25 bp, Mus musculus
taggtcacagacgaggtgtccctgc

SEQ ID NO: 778868 - DNA, 25 bp, Mus musculus
taggtcacataccttctagagctcc

SEQ ID NO: 778869 - DNA, 25 bp, Mus musculus
taggtcacatacgttctagagctcc

SEQ ID NO: 778870 - DNA, 25 bp, Mus musculus
taggtcacatgaatagggaaaaaat

SEQ ID NO: 778871 - DNA, 25 bp, Mus musculus
taggtcacatgattagggaaaaaat

SEQ ID NO: 778872 - DNA, 25 bp, Mus musculus
taggtcacattcatacactaagaaa

SEQ ID NO: 778873 - DNA, 25 bp, Mus musculus
taggtcacattcctatgtagggagt

SEQ ID NO: 778874 - DNA, 25 bp, Mus musculus
taggtcacattcgtatgtagggagt

SEQ ID NO: 778875 - DNA, 25 bp, Mus musculus
taggtcacattcttacactaagaaa

SEQ ID NO: 778876 - DNA, 25 bp, Mus musculus
taggtcaccctacaaagccataagg

SEQ ID NO: 778877 - DNA, 25 bp, Mus musculus
taggtcaccctagaaagccataagg

SEQ ID NO: 778878 - DNA, 25 bp, Mus musculus
taggtcacccttagcattatatcaa

SEQ ID NO: 778879 - DNA, 25 bp, Mus musculus
taggtcaccctttgcattatatcaa

SEQ ID NO: 778880 - DNA, 25 bp, Mus musculus
taggtcactaggcaacagaccccaa

SEQ ID NO: 778881 - DNA, 25 bp, Mus musculus
taggtcactagggaacagaccccaa

SEQ ID NO: 778882 - DNA, 25 bp, Mus musculus
taggtcactcatagggtcttctttc

SEQ ID NO: 778883 - DNA, 25 bp, Mus musculus
taggtcactcattgggtcttctttc

SEQ ID NO: 778884 - DNA, 25 bp, Mus musculus
taggtcactgccattcgacacaggg

SEQ ID NO: 778885 - DNA, 25 bp, Mus musculus
taggtcactgcctttcgacacaggg

SEQ ID NO: 778886 - DNA, 25 bp, Mus musculus
taggtcactgttaagatgctctggc

SEQ ID NO: 778887 - DNA, 25 bp, Mus musculus
taggtcactgtttagatgctctggc

SEQ ID NO: 778888 - DNA, 25 bp, Mus musculus
taggtcagaggacactcaccagagt

SEQ ID NO: 778889 - DNA, 25 bp, Mus musculus
taggtcagaggagactcaccagagt

SEQ ID NO: 778890 - DNA, 25 bp, Mus musculus
taggtcagctccctcaaaacaggcc

SEQ ID NO: 778891 - DNA, 25 bp, Mus musculus
taggtcagctccgtcaaaacaggcc

SEQ ID NO: 778892 - DNA, 25 bp, Mus musculus
taggtcagggctacagcagcatctt

SEQ ID NO: 778893 - DNA, 25 bp, Mus musculus
taggtcagggcttcagcagcatctt

SEQ ID NO: 778894 - DNA, 25 bp, Mus musculus
taggtcaggtgccttatctcagctt

SEQ ID NO: 778895 - DNA, 25 bp, Mus musculus
taggtcaggtgcgttatctcagctt

SEQ ID NO: 778896 - DNA, 25 bp, Mus musculus
taggtcagtcacaacgctgcacata

SEQ ID NO: 778897 - DNA, 25 bp, Mus musculus
taggtcagtcactacgctgcacata

SEQ ID NO: 778898 - DNA, 25 bp, Mus musculus
taggtcataactctctttcctcttc

SEQ ID NO: 778899 - DNA, 25 bp, Mus musculus
taggtcataactgtctttcctcttc

SEQ ID NO: 778900 - DNA, 25 bp, Mus musculus
taggtcatacctattcatccattat

SEQ ID NO: 778901 - DNA, 25 bp, Mus musculus
taggtcataccttttcatccattat

SEQ ID NO: 778902 - DNA, 25 bp, Mus musculus
taggtcatcattagtggctcccatt

SEQ ID NO: 778903 - DNA, 25 bp, Mus musculus
taggtcatcatttgtggctcccatt

SEQ ID NO: 778904 - DNA, 25 bp, Mus musculus
taggtcatgcaccaagaaggagaag

SEQ ID NO: 778905 - DNA, 25 bp, Mus musculus
taggtcatgcacgaagaaggagaag

SEQ ID NO: 778906 - DNA, 25 bp, Mus musculus
taggtcatgcttctgctactgcagc

SEQ ID NO: 778907 - DNA, 25 bp, Mus musculus
taggtcatgcttgtgctactgcagc

SEQ ID NO: 778908 - DNA, 25 bp, Mus musculus
taggtcatggtgaccagccacttga

SEQ ID NO: 778909 - DNA, 25 bp, Mus musculus
taggtcatggtgtccagccacttga

SEQ ID NO: 778910 - DNA, 25 bp, Mus musculus
taggtcatgtagacacctgtccatt

SEQ ID NO: 778911 - DNA, 25 bp, Mus musculus
taggtcatgtagtcacctgtccatt

SEQ ID NO: 778912 - DNA, 25 bp, Mus musculus
taggtcattgccaccaaagtccggc

SEQ ID NO: 778913 - DNA, 25 bp, Mus musculus
taggtcattgcctccaaagtccggc

SEQ ID NO: 778914 - DNA, 25 bp, Mus musculus
taggtcatttaacctacctccctag

SEQ ID NO: 778915 - DNA, 25 bp, Mus musculus
taggtcatttaagctacctccctag

SEQ ID NO: 778916 - DNA, 25 bp, Mus musculus
taggtccaagtaactggttattttg

SEQ ID NO: 778917 - DNA, 25 bp, Mus musculus
taggtccaagtatctggttattttg

SEQ ID NO: 778918 - DNA, 25 bp, Mus musculus
taggtccactagcagaatgtcccac

SEQ ID NO: 778919 - DNA, 25 bp, Mus musculus
taggtccactaggagaatgtcccac

SEQ ID NO: 778920 - DNA, 25 bp, Mus musculus
taggtccacttcagcttagggtcct

SEQ ID NO: 778921 - DNA, 25 bp, Mus musculus
taggtccacttctgcttagggtcct

SEQ ID NO: 778922 - DNA, 25 bp, Mus musculus
taggtccagatcactgctttgcagg

SEQ ID NO: 778923 - DNA, 25 bp, Mus musculus
taggtccagatctctgctttgcagg

SEQ ID NO: 778924 - DNA, 25 bp, Mus musculus
taggtccaggagactctgtggtcac

SEQ ID NO: 778925 - DNA, 25 bp, Mus musculus
taggtccaggagtctctgtggtcac

SEQ ID NO: 778926 - DNA, 25 bp, Mus musculus
taggtccatgtacagttcttccgga

SEQ ID NO: 778927 - DNA, 25 bp, Mus musculus
taggtccatgtagagttcttccgga

SEQ ID NO: 778928 - DNA, 25 bp, Mus musculus
taggtcccaactctgtggacttcac

SEQ ID NO: 778929 - DNA, 25 bp, Mus musculus
taggtcccaactgtgtggacttcac

SEQ ID NO: 778930 - DNA, 25 bp, Mus musculus
taggtcccaatacgcggaactggtt

SEQ ID NO: 778931 - DNA, 25 bp, Mus musculus
taggtcccaataggcggaactggtt

SEQ ID NO: 778932 - DNA, 25 bp, Mus musculus
taggtcccactcaacttaggccagg

SEQ ID NO: 778933 - DNA, 25 bp, Mus musculus
taggtcccactctacttaggccagg

SEQ ID NO: 778934 - DNA, 25 bp, Mus musculus
taggtcccagcccaaatagaaatta

SEQ ID NO: 778935 - DNA, 25 bp, Mus musculus
taggtcccagccgaaatagaaatta

SEQ ID NO: 778936 - DNA, 25 bp, Mus musculus
taggtcccaggcagcttcgatttta

SEQ ID NO: 778937 - DNA, 25 bp, Mus musculus
taggtcccaggctgcttcgatttta

SEQ ID NO: 778938 - DNA, 25 bp, Mus musculus
taggtcccagggatcacatcagaaa

SEQ ID NO: 778939 - DNA, 25 bp, Mus musculus
taggtcccagggttcacatcagaaa

SEQ ID NO: 778940 - DNA, 25 bp, Mus musculus
taggtccccattaggagcgttggca

SEQ ID NO: 778941 - DNA, 25 bp, Mus musculus
taggtccccatttggagcgttggca

SEQ ID NO: 778942 - DNA, 25 bp, Mus musculus
taggtccccttaaggcaggaaggct

SEQ ID NO: 778943 - DNA, 25 bp, Mus musculus
taggtccccttatggcaggaaggct

SEQ ID NO: 778944 - DNA, 25 bp, Mus musculus
taggtccctcgaagcacacagcatc

SEQ ID NO: 778945 - DNA, 25 bp, Mus musculus
taggtccctcgatgcacacagcatc

SEQ ID NO: 778946 - DNA, 25 bp, Mus musculus
taggtcccttctaagcctggcctaa

SEQ ID NO: 778947 - DNA, 25 bp, Mus musculus
taggtcccttcttagcctggcctaa

SEQ ID NO: 778948 - DNA, 25 bp, Mus musculus
taggtcctacctccgatcctttaat

SEQ ID NO: 778949 - DNA, 25 bp, Mus musculus
taggtcctacctgcgatcctttaat

SEQ ID NO: 778950 - DNA, 25 bp, Mus musculus
taggtcctaggactgctgtcttcca

SEQ ID NO: 778951 - DNA, 25 bp, Mus musculus
taggtcctaggagtgctgtcttcca

SEQ ID NO: 778952 - DNA, 25 bp, Mus musculus
taggtcctagtgctacctcctggaa

SEQ ID NO: 778953 - DNA, 25 bp, Mus musculus
taggtcctagtggtacctcctggaa

SEQ ID NO: 778954 - DNA, 25 bp, Mus musculus
taggtcctatcacttctgttgctaa

SEQ ID NO: 778955 - DNA, 25 bp, Mus musculus
taggtcctatcagttctgttgctaa

SEQ ID NO: 778956 - DNA, 25 bp, Mus musculus
taggtcctatctcctgaaggttcca

SEQ ID NO: 778957 - DNA, 25 bp, Mus musculus
taggtcctatctgctgaaggttcca

SEQ ID NO: 778958 - DNA, 25 bp, Mus musculus
taggtcctcaaaaccaaacaagccc

SEQ ID NO: 778959 - DNA, 25 bp, Mus musculus
taggtcctcaaatccaaacaagccc

SEQ ID NO: 778960 - DNA, 25 bp, Mus musculus
taggtcctccctacagtatggaaac

SEQ ID NO: 778961 - DNA, 25 bp, Mus musculus
taggtcctcccttcagtatggaaac

SEQ ID NO: 778962 - DNA, 25 bp, Mus musculus
taggtcctctctcactgggtggaga

SEQ ID NO: 778963 - DNA, 25 bp, Mus musculus
taggtcctctctgactgggtggaga

SEQ ID NO: 778964 - DNA, 25 bp, Mus musculus
taggtcctctgtccctgatgtcatc

SEQ ID NO: 778965 - DNA, 25 bp, Mus musculus
taggtcctctgtgcctgatgtcatc

SEQ ID NO: 778966 - DNA, 25 bp, Mus musculus
taggtcctgactcgccagctgtggc

SEQ ID NO: 778967 - DNA, 25 bp, Mus musculus
taggtcctgactggccagctgtggc

SEQ ID NO: 778968 - DNA, 25 bp, Mus musculus
taggtcctgagtcagccattgcact

SEQ ID NO: 778969 - DNA, 25 bp, Mus musculus
taggtcctgagtgagccattgcact

SEQ ID NO: 778970 - DNA, 25 bp, Mus musculus
taggtcctgcatcctgtttccaaca

SEQ ID NO: 778971 - DNA, 25 bp, Mus musculus
taggtcctgcatgctgtttccaaca

SEQ ID NO: 778972 - DNA, 25 bp, Mus musculus
taggtcctgggaaatagcagcccgt

SEQ ID NO: 778973 - DNA, 25 bp, Mus musculus
taggtcctgggatatagcagcccgt

SEQ ID NO: 778974 - DNA, 25 bp, Mus musculus
taggtccttgctcttccgtgttcac

SEQ ID NO: 778975 - DNA, 25 bp, Mus musculus
taggtccttgctgttccgtgttcac

SEQ ID NO: 778976 - DNA, 25 bp, Mus musculus
taggtcgagctaacctgggaaaggt

SEQ ID NO: 778977 - DNA, 25 bp, Mus musculus
taggtcgagctatcctgggaaaggt

SEQ ID NO: 778978 - DNA, 25 bp, Mus musculus
taggtcgctcttccctttaaaggct

SEQ ID NO: 778979 - DNA, 25 bp, Mus musculus
taggtcgctcttgcctttaaaggct

SEQ ID NO: 778980 - DNA, 25 bp, Mus musculus
taggtcgcttctagagatgccttgc

SEQ ID NO: 778981 - DNA, 25 bp, Mus musculus
taggtcgcttcttgagatgccttgc

SEQ ID NO: 778982 - DNA, 25 bp, Mus musculus
taggtcggcccaccttgagaaaaat

SEQ ID NO: 778983 - DNA, 25 bp, Mus musculus
taggtcggcccagcttgagaaaaat

SEQ ID NO: 778984 - DNA, 25 bp, Mus musculus
taggtcggcctactatcaattacat

SEQ ID NO: 778985 - DNA, 25 bp, Mus musculus
taggtcggcctagtatcaattacat

SEQ ID NO: 778986 - DNA, 25 bp, Mus musculus
taggtcggccttctgaacgctggaa

SEQ ID NO: 778987 - DNA, 25 bp, Mus musculus
taggtcggccttgtgaacgctggaa

SEQ ID NO: 778988 - DNA, 25 bp, Mus musculus
taggtcgtcgataagcttctgagtt

SEQ ID NO: 778989 - DNA, 25 bp, Mus musculus
taggtcgtcgattagcttctgagtt

SEQ ID NO: 778990 - DNA, 25 bp, Mus musculus
taggtcgtttaactaactcacattt

SEQ ID NO: 778991 - DNA, 25 bp, Mus musculus
taggtcgtttaagtaactcacattt

SEQ ID NO: 778992 - DNA, 25 bp, Mus musculus
taggtctaaccccagccaaagatga

SEQ ID NO: 778993 - DNA, 25 bp, Mus musculus
taggtctaacccgagccaaagatga

SEQ ID NO: 778994 - DNA, 25 bp, Mus musculus
taggtctaatccatgggcccctggt

SEQ ID NO: 778995 - DNA, 25 bp, Mus musculus
taggtctaatccttgggcccctggt

SEQ ID NO: 778996 - DNA, 25 bp, Mus musculus
taggtctacagaaacagtgggtttt

SEQ ID NO: 778997 - DNA, 25 bp, Mus musculus
taggtctacagatacagtgggtttt

SEQ ID NO: 778998 - DNA, 25 bp, Mus musculus
taggtctcatctccatgccaagagt

SEQ ID NO: 778999 - DNA, 25 bp, Mus musculus
taggtctcatctgcatgccaagagt

SEQ ID NO: 779000 - DNA, 25 bp, Mus musculus
taggtctcccatcgcccattataaa

SEQ ID NO: 779001 - DNA, 25 bp, Mus musculus
taggtctcccatggcccattataaa

SEQ ID NO: 779002 - DNA, 25 bp, Mus musculus
taggtctcccttactgcagaatggt

SEQ ID NO: 779003 - DNA, 25 bp, Mus musculus
taggtctccctttctgcagaatggt

SEQ ID NO: 779004 - DNA, 25 bp, Mus musculus
taggtctctagcataggttgcttcc

SEQ ID NO: 779005 - DNA, 25 bp, Mus musculus
taggtctctagcttaggttgcttcc

SEQ ID NO: 779006 - DNA, 25 bp, Mus musculus
taggtctctcctactatcttaaaga

SEQ ID NO: 779007 - DNA, 25 bp, Mus musculus
taggtctctccttctatcttaaaga

SEQ ID NO: 779008 - DNA, 25 bp, Mus musculus
taggtctctctccttcggactggtg

SEQ ID NO: 779009 - DNA, 25 bp, Mus musculus
taggtctctctcgttcggactggtg

SEQ ID NO: 779010 - DNA, 25 bp, Mus musculus
taggtctgacttagtgaccctgcca

SEQ ID NO: 779011 - DNA, 25 bp, Mus musculus
taggtctgactttgtgaccctgcca

SEQ ID NO: 779012 - DNA, 25 bp, Mus musculus
taggtctgatggctccagtatgtgc

SEQ ID NO: 779013 - DNA, 25 bp, Mus musculus
taggtctgatgggtccagtatgtgc

SEQ ID NO: 779014 - DNA, 25 bp, Mus musculus
taggtctgcactctgggtcatcatg

SEQ ID NO: 779015 - DNA, 25 bp, Mus musculus
taggtctgcactgtgggtcatcatg

SEQ ID NO: 779016 - DNA, 25 bp, Mus musculus
taggtctgcctcaggcagtcaaact

SEQ ID NO: 779017 - DNA, 25 bp, Mus musculus
taggtctgcctctggcagtcaaact

SEQ ID NO: 779018 - DNA, 25 bp, Mus musculus
taggtctggtctaccagggcatgtg

SEQ ID NO: 779019 - DNA, 25 bp, Mus musculus
taggtctggtcttccagggcatgtg

SEQ ID NO: 779020 - DNA, 25 bp, Mus musculus
taggtctggtgaccagggaccactc

SEQ ID NO: 779021 - DNA, 25 bp, Mus musculus
taggtctggtgagcagggaccactc

SEQ ID NO: 779022 - DNA, 25 bp, Mus musculus
taggtctgtcttcttaggccgtgtc

SEQ ID NO: 779023 - DNA, 25 bp, Mus musculus
taggtctgtcttcttgtgtgactgt

SEQ ID NO: 779024 - DNA, 25 bp, Mus musculus
taggtctgtcttgttaggccgtgtc

SEQ ID NO: 779025 - DNA, 25 bp, Mus musculus
taggtctgtcttgttgtgtgactgt

SEQ ID NO: 779026 - DNA, 25 bp, Mus musculus
taggtctgtgaaatgcatgttttca

SEQ ID NO: 779027 - DNA, 25 bp, Mus musculus
taggtctgtgaattgcatgttttca

SEQ ID NO: 779028 - DNA, 25 bp, Mus musculus
taggtcttaatcatttttcttcgta

SEQ ID NO: 779029 - DNA, 25 bp, Mus musculus
taggtcttaatcttttttcttcgta

SEQ ID NO: 779030 - DNA, 25 bp, Mus musculus
taggtcttatacatgctctaccact

SEQ ID NO: 779031 - DNA, 25 bp, Mus musculus
taggtcttatacttgctctaccact

SEQ ID NO: 779032 - DNA, 25 bp, Mus musculus
taggtcttatcccactgttggtgct

SEQ ID NO: 779033 - DNA, 25 bp, Mus musculus
taggtcttatccgactgttggtgct

SEQ ID NO: 779034 - DNA, 25 bp, Mus musculus
taggtcttcaaaccctgactactca

SEQ ID NO: 779035 - DNA, 25 bp, Mus musculus
taggtcttcaaagcctgactactca

SEQ ID NO: 779036 - DNA, 25 bp, Mus musculus
taggtcttcggactgttgcgtactc

SEQ ID NO: 779037 - DNA, 25 bp, Mus musculus
taggtcttcggagtgttgcgtactc

SEQ ID NO: 779038 - DNA, 25 bp, Mus musculus
taggtcttgcttaggacaccctgac

SEQ ID NO: 779039 - DNA, 25 bp, Mus musculus
taggtcttgctttggacaccctgac

SEQ ID NO: 779040 - DNA, 25 bp, Mus musculus
taggtcttgtccaggtgactctgac

SEQ ID NO: 779041 - DNA, 25 bp, Mus musculus
taggtcttgtcctggtgactctgac

SEQ ID NO: 779042 - DNA, 25 bp, Mus musculus
taggtcttgtgtaattgtcatccag

SEQ ID NO: 779043 - DNA, 25 bp, Mus musculus
taggtcttgtgttattgtcatccag

SEQ ID NO: 779044 - DNA, 25 bp, Mus musculus
taggtctttcagagcctgttctgtc

SEQ ID NO: 779045 - DNA, 25 bp, Mus musculus
taggtctttcagtgcctgttctgtc

SEQ ID NO: 779046 - DNA, 25 bp, Mus musculus
taggtctttttgattgctgtggctt

SEQ ID NO: 779047 - DNA, 25 bp, Mus musculus
taggtctttttgtttgctgtggctt

SEQ ID NO: 779048 - DNA, 25 bp, Mus musculus
taggtgaaccctcagagactctctc

SEQ ID NO: 779049 - DNA, 25 bp, Mus musculus
taggtgaaccctgagagactctctc

SEQ ID NO: 779050 - DNA, 25 bp, Mus musculus
taggtgaagttcacactcttcctga

SEQ ID NO: 779051 - DNA, 25 bp, Mus musculus
taggtgaagttctcactcttcctga

SEQ ID NO: 779052 - DNA, 25 bp, Mus musculus
taggtgaatctaaagctcttaggca

SEQ ID NO: 779053 - DNA, 25 bp, Mus musculus
taggtgaatctatagctcttaggca

SEQ ID NO: 779054 - DNA, 25 bp, Mus musculus
taggtgacagttactcattttcccc

SEQ ID NO: 779055 - DNA, 25 bp, Mus musculus
taggtgacagtttctcattttcccc

SEQ ID NO: 779056 - DNA, 25 bp, Mus musculus
taggtgaccaacaatagtctcccct

SEQ ID NO: 779057 - DNA, 25 bp, Mus musculus
taggtgaccaactatagtctcccct

SEQ ID NO: 779058 - DNA, 25 bp, Mus musculus
taggtgaccttccattactgctgct

SEQ ID NO: 779059 - DNA, 25 bp, Mus musculus
taggtgaccttcgattactgctgct

SEQ ID NO: 779060 - DNA, 25 bp, Mus musculus
taggtgacggttccgagacatcgcc

SEQ ID NO: 779061 - DNA, 25 bp, Mus musculus
taggtgacggttgcgagacatcgcc

SEQ ID NO: 779062 - DNA, 25 bp, Mus musculus
taggtgactctcatccactgcagga

SEQ ID NO: 779063 - DNA, 25 bp, Mus musculus
taggtgactctcttccactgcagga

SEQ ID NO: 779064 - DNA, 25 bp, Mus musculus
taggtgactgcacgttcttctggca

SEQ ID NO: 779065 - DNA, 25 bp, Mus musculus
taggtgactgcaggttcttctggca

SEQ ID NO: 779066 - DNA, 25 bp, Mus musculus
taggtgacttcactgattcaactct

SEQ ID NO: 779067 - DNA, 25 bp, Mus musculus
taggtgacttcagtgattcaactct

SEQ ID NO: 779068 - DNA, 25 bp, Mus musculus
taggtgactttgctctagccacagt

SEQ ID NO: 779069 - DNA, 25 bp, Mus musculus
taggtgactttggtctagccacagt

SEQ ID NO: 779070 - DNA, 25 bp, Mus musculus
taggtgagagttccctgagcactgc

SEQ ID NO: 779071 - DNA, 25 bp, Mus musculus
taggtgagagttgcctgagcactgc

SEQ ID NO: 779072 - DNA, 25 bp, Mus musculus
taggtgagatatccctccctttctt

SEQ ID NO: 779073 - DNA, 25 bp, Mus musculus
taggtgagatatgcctccctttctt

SEQ ID NO: 779074 - DNA, 25 bp, Mus musculus
taggtgagcactacatactgtcagt

SEQ ID NO: 779075 - DNA, 25 bp, Mus musculus
taggtgagcacttcatactgtcagt

SEQ ID NO: 779076 - DNA, 25 bp, Mus musculus
taggtgagctcgaatctggccctgc

SEQ ID NO: 779077 - DNA, 25 bp, Mus musculus
taggtgagctcgtatctggccctgc

SEQ ID NO: 779078 - DNA, 25 bp, Mus musculus
taggtgagctgaacctggaccgcca

SEQ ID NO: 779079 - DNA, 25 bp, Mus musculus
taggtgagctgatcctggaccgcca

SEQ ID NO: 779080 - DNA, 25 bp, Mus musculus
taggtgatacagctcgagtcttgat

SEQ ID NO: 779081 - DNA, 25 bp, Mus musculus
taggtgatacaggtcgagtcttgat

SEQ ID NO: 779082 - DNA, 25 bp, Mus musculus
taggtgatagttcttcccctcgaga

SEQ ID NO: 779083 - DNA, 25 bp, Mus musculus
taggtgatagttgttcccctcgaga

SEQ ID NO: 779084 - DNA, 25 bp, Mus musculus
taggtgatccaaagtcttcttccca

SEQ ID NO: 779085 - DNA, 25 bp, Mus musculus
taggtgatccaatgtcttcttccca

SEQ ID NO: 779086 - DNA, 25 bp, Mus musculus
taggtgcaagtccagtctctccaaa

SEQ ID NO: 779087 - DNA, 25 bp, Mus musculus
taggtgcaagtcgagtctctccaaa

SEQ ID NO: 779088 - DNA, 25 bp, Mus musculus
taggtgcacacaagctccggaatta

SEQ ID NO: 779089 - DNA, 25 bp, Mus musculus
taggtgcacacatgctccggaatta

SEQ ID NO: 779090 - DNA, 25 bp, Mus musculus
taggtgcacttacaacatgggacgc

SEQ ID NO: 779091 - DNA, 25 bp, Mus musculus
taggtgcacttagaacatgggacgc

SEQ ID NO: 779092 - DNA, 25 bp, Mus musculus
taggtgcaggaacagatcccctttc

SEQ ID NO: 779093 - DNA, 25 bp, Mus musculus
taggtgcaggaagagatcccctttc

SEQ ID NO: 779094 - DNA, 25 bp, Mus musculus
taggtgcatgacagctaacccggcg

SEQ ID NO: 779095 - DNA, 25 bp, Mus musculus
taggtgcatgactgctaacccggcg

SEQ ID NO: 779096 - DNA, 25 bp, Mus musculus
taggtgcattgtccattgtagagag

SEQ ID NO: 779097 - DNA, 25 bp, Mus musculus
taggtgcattgtgcattgtagagag

SEQ ID NO: 779098 - DNA, 25 bp, Mus musculus
taggtgccaccaccaatatctgcag

SEQ ID NO: 779099 - DNA, 25 bp, Mus musculus
taggtgccaccagcaatatctgcag

SEQ ID NO: 779100 - DNA, 25 bp, Mus musculus
taggtgccacggacagatgccggac

SEQ ID NO: 779101 - DNA, 25 bp, Mus musculus
taggtgccacggtcagatgccggac

SEQ ID NO: 779102 - DNA, 25 bp, Mus musculus
taggtgccattgaacctggtgttct

SEQ ID NO: 779103 - DNA, 25 bp, Mus musculus
taggtgccattgtacctggtgttct

SEQ ID NO: 779104 - DNA, 25 bp, Mus musculus
taggtgccctgaagcatgtcatgca

SEQ ID NO: 779105 - DNA, 25 bp, Mus musculus
taggtgccctgatgcatgtcatgca

SEQ ID NO: 779106 - DNA, 25 bp, Mus musculus
taggtgccgcagcattcaagattgt

SEQ ID NO: 779107 - DNA, 25 bp, Mus musculus
taggtgccgcaggattcaagattgt

SEQ ID NO: 779108 - DNA, 25 bp, Mus musculus
taggtgctacgcctggctttgaacc

SEQ ID NO: 779109 - DNA, 25 bp, Mus musculus
taggtgctacgcgtggctttgaacc

SEQ ID NO: 779110 - DNA, 25 bp, Mus musculus
taggtgctagagatggcttctgccc

SEQ ID NO: 779111 - DNA, 25 bp, Mus musculus
taggtgctagagttggcttctgccc

SEQ ID NO: 779112 - DNA, 25 bp, Mus musculus
taggtgctatagagcagccagtgct

SEQ ID NO: 779113 - DNA, 25 bp, Mus musculus
taggtgctatagtgcagccagtgct

SEQ ID NO: 779114 - DNA, 25 bp, Mus musculus
taggtgctcattagcctggttttag

SEQ ID NO: 779115 - DNA, 25 bp, Mus musculus
taggtgctcatttgcctggttttag

SEQ ID NO: 779116 - DNA, 25 bp, Mus musculus
taggtgctccacaaatgtttcctgt

SEQ ID NO: 779117 - DNA, 25 bp, Mus musculus
taggtgctccactaatgtttcctgt

SEQ ID NO: 779118 - DNA, 25 bp, Mus musculus
taggtgctcctaagtgtccctttac

SEQ ID NO: 779119 - DNA, 25 bp, Mus musculus
taggtgctcctatgtgtccctttac

SEQ ID NO: 779120 - DNA, 25 bp, Mus musculus
taggtgctctaaacctctctagggc

SEQ ID NO: 779121 - DNA, 25 bp, Mus musculus
taggtgctctaatcctctctagggc

SEQ ID NO: 779122 - DNA, 25 bp, Mus musculus
taggtgctctctcacagggaacaga

SEQ ID NO: 779123 - DNA, 25 bp, Mus musculus
taggtgctctctgacagggaacaga

SEQ ID NO: 779124 - DNA, 25 bp, Mus musculus
taggtgctggaaagctcccacctgt

SEQ ID NO: 779125 - DNA, 25 bp, Mus musculus
taggtgctggaatgctcccacctgt

SEQ ID NO: 779126 - DNA, 25 bp, Mus musculus
taggtgctggctagctaatggcctt

SEQ ID NO: 779127 - DNA, 25 bp, Mus musculus
taggtgctggcttgctaatggcctt

SEQ ID NO: 779128 - DNA, 25 bp, Mus musculus
taggtgcttcctccggtggcatctc

SEQ ID NO: 779129 - DNA, 25 bp, Mus musculus
taggtgcttcctgcggtggcatctc

SEQ ID NO: 779130 - DNA, 25 bp, Mus musculus
taggtggaagacacctataacccca

SEQ ID NO: 779131 - DNA, 25 bp, Mus musculus
taggtggaagactcctataacccca

SEQ ID NO: 779132 - DNA, 25 bp, Mus musculus
taggtggaagctcgtcccaggcttc

SEQ ID NO: 779133 - DNA, 25 bp, Mus musculus
taggtggaagctggtcccaggcttc

SEQ ID NO: 779134 - DNA, 25 bp, Mus musculus
taggtggacactaggtacctctctg

SEQ ID NO: 779135 - DNA, 25 bp, Mus musculus
taggtggacacttggtacctctctg

SEQ ID NO: 779136 - DNA, 25 bp, Mus musculus
taggtggaccatagaccaggttaac

SEQ ID NO: 779137 - DNA, 25 bp, Mus musculus
taggtggaccattgaccaggttaac

SEQ ID NO: 779138 - DNA, 25 bp, Mus musculus
taggtggacgagcactggcctccac

SEQ ID NO: 779139 - DNA, 25 bp, Mus musculus
taggtggacgaggactggcctccac

SEQ ID NO: 779140 - DNA, 25 bp, Mus musculus
taggtggagtgaccacctcccagat

SEQ ID NO: 779141 - DNA, 25 bp, Mus musculus
taggtggagtgagcacctcccagat

SEQ ID NO: 779142 - DNA, 25 bp, Mus musculus
taggtggattagcatcagcctggat

SEQ ID NO: 779143 - DNA, 25 bp, Mus musculus
taggtggattaggatcagcctggat

SEQ ID NO: 779144 - DNA, 25 bp, Mus musculus
taggtggcaataaggaatcagtgtt

SEQ ID NO: 779145 - DNA, 25 bp, Mus musculus
taggtggcaatatggaatcagtgtt

SEQ ID NO: 779146 - DNA, 25 bp, Mus musculus
taggtggcaatgatctggttcagtt

SEQ ID NO: 779147 - DNA, 25 bp, Mus musculus
taggtggcaatgttctggttcagtt

SEQ ID NO: 779148 - DNA, 25 bp, Mus musculus
taggtggcactacggactctgaaat

SEQ ID NO: 779149 - DNA, 25 bp, Mus musculus
taggtggcactagggactctgaaat

SEQ ID NO: 779150 - DNA, 25 bp, Mus musculus
taggtggcagttatcctggccaaga

SEQ ID NO: 779151 - DNA, 25 bp, Mus musculus
taggtggcagttttcctggccaaga

SEQ ID NO: 779152 - DNA, 25 bp, Mus musculus
taggtggccagcacttcagtgtcat

SEQ ID NO: 779153 - DNA, 25 bp, Mus musculus
taggtggccagctcttcagtgtcat

SEQ ID NO: 779154 - DNA, 25 bp, Mus musculus
taggtggccctacgctttagtgttt

SEQ ID NO: 779155 - DNA, 25 bp, Mus musculus
taggtggccctaggctttagtgttt

SEQ ID NO: 779156 - DNA, 25 bp, Mus musculus
taggtggcgaccaagcacacagtgt

SEQ ID NO: 779157 - DNA, 25 bp, Mus musculus
taggtggcgacctagcacacagtgt

SEQ ID NO: 779158 - DNA, 25 bp, Mus musculus
taggtggcgtggagggcgccctctt

SEQ ID NO: 779159 - DNA, 25 bp, Mus musculus
taggtggcgtggtgggcgccctctt

SEQ ID NO: 779160 - DNA, 25 bp, Mus musculus
taggtggcttggattccccagctgc

SEQ ID NO: 779161 - DNA, 25 bp, Mus musculus
taggtggcttggtttccccagctgc

SEQ ID NO: 779162 - DNA, 25 bp, Mus musculus
taggtgggcagcatcttgactttgc

SEQ ID NO: 779163 - DNA, 25 bp, Mus musculus
taggtgggcagcttcttgactttgc

SEQ ID NO: 779164 - DNA, 25 bp, Mus musculus
taggtgggctacacattggctttta

SEQ ID NO: 779165 - DNA, 25 bp, Mus musculus
taggtgggctactcattggctttta

SEQ ID NO: 779166 - DNA, 25 bp, Mus musculus
taggtgggtaatcatcggctgcctt

SEQ ID NO: 779167 - DNA, 25 bp, Mus musculus
taggtgggtaatgatcggctgcctt

SEQ ID NO: 779168 - DNA, 25 bp, Mus musculus
taggtgggtgagcacttcctgtcca

SEQ ID NO: 779169 - DNA, 25 bp, Mus musculus
taggtgggtgaggacttcctgtcca

SEQ ID NO: 779170 - DNA, 25 bp, Mus musculus
taggtggtaccaacaaccgagctcc

SEQ ID NO: 779171 - DNA, 25 bp, Mus musculus
taggtggtaccatcaaccgagctcc

SEQ ID NO: 779172 - DNA, 25 bp, Mus musculus
taggtggtagctcgacccatctaac

SEQ ID NO: 779173 - DNA, 25 bp, Mus musculus
taggtggtagctggacccatctaac

SEQ ID NO: 779174 - DNA, 25 bp, Mus musculus
taggtggtatatactttgctcttga

SEQ ID NO: 779175 - DNA, 25 bp, Mus musculus
taggtggtatattctttgctcttga

SEQ ID NO: 779176 - DNA, 25 bp, Mus musculus
taggtggtcatgatacttcttaaag

SEQ ID NO: 779177 - DNA, 25 bp, Mus musculus
taggtggtcatgttacttcttaaag

SEQ ID NO: 779178 - DNA, 25 bp, Mus musculus
taggtggtgtgtccttagtctttcc

SEQ ID NO: 779179 - DNA, 25 bp, Mus musculus
taggtggtgtgtgcttagtctttcc

SEQ ID NO: 779180 - DNA, 25 bp, Mus musculus
taggtggttcttcatgctcacccaa

SEQ ID NO: 779181 - DNA, 25 bp, Mus musculus
taggtggttcttgatgctcacccaa

SEQ ID NO: 779182 - DNA, 25 bp, Mus musculus
taggtggttggtccaaagcagcact

SEQ ID NO: 779183 - DNA, 25 bp, Mus musculus
taggtggttggtgcaaagcagcact

SEQ ID NO: 779184 - DNA, 25 bp, Mus musculus
taggtgtaagcccatctgctggcaa

SEQ ID NO: 779185 - DNA, 25 bp, Mus musculus
taggtgtaagccgatctgctggcaa

SEQ ID NO: 779186 - DNA, 25 bp, Mus musculus
taggtgtagcatagatactcaaagt

SEQ ID NO: 779187 - DNA, 25 bp, Mus musculus
taggtgtagcattgatactcaaagt

SEQ ID NO: 779188 - DNA, 25 bp, Mus musculus
taggtgtcaggacagcagcacccat

SEQ ID NO: 779189 - DNA, 25 bp, Mus musculus
taggtgtcaggagagcagcacccat

SEQ ID NO: 779190 - DNA, 25 bp, Mus musculus
taggtgtccaatactcgagggattg

SEQ ID NO: 779191 - DNA, 25 bp, Mus musculus
taggtgtccaattctcgagggattg

SEQ ID NO: 779192 - DNA, 25 bp, Mus musculus
taggtgtctgctattctacaataca

SEQ ID NO: 779193 - DNA, 25 bp, Mus musculus
taggtgtctgcttttctacaataca

SEQ ID NO: 779194 - DNA, 25 bp, Mus musculus
taggtgtgacctctacttaacatgg

SEQ ID NO: 779195 - DNA, 25 bp, Mus musculus
taggtgtgacctgtacttaacatgg

SEQ ID NO: 779196 - DNA, 25 bp, Mus musculus
taggtgtgattgaaggccagactcc

SEQ ID NO: 779197 - DNA, 25 bp, Mus musculus
taggtgtgattgtaggccagactcc

SEQ ID NO: 779198 - DNA, 25 bp, Mus musculus
taggtgtgctcccagttacagatgt

SEQ ID NO: 779199 - DNA, 25 bp, Mus musculus
taggtgtgctccgagttacagatgt

SEQ ID NO: 779200 - DNA, 25 bp, Mus musculus
taggtgtggaaactcctcctgtcac

SEQ ID NO: 779201 - DNA, 25 bp, Mus musculus
taggtgtggaaagtcctcctgtcac

SEQ ID NO: 779202 - DNA, 25 bp, Mus musculus
taggtgtgggttacttgctttcgtc

SEQ ID NO: 779203 - DNA, 25 bp, Mus musculus
taggtgtgggtttcttgctttcgtc

SEQ ID NO: 779204 - DNA, 25 bp, Mus musculus
taggtgtggtgcacttgtctacccc

SEQ ID NO: 779205 - DNA, 25 bp, Mus musculus
taggtgtggtgctcttgtctacccc

SEQ ID NO: 779206 - DNA, 25 bp, Mus musculus
taggtgtgtagtctttggtccttgt

SEQ ID NO: 779207 - DNA, 25 bp, Mus musculus
taggtgtgtagtgtttggtccttgt

SEQ ID NO: 779208 - DNA, 25 bp, Mus musculus
taggtgtgtctacttgaggctttcc

SEQ ID NO: 779209 - DNA, 25 bp, Mus musculus
taggtgtgtctagttgaggctttcc

SEQ ID NO: 779210 - DNA, 25 bp, Mus musculus
taggtgtgtgttcacacgcatgcat

SEQ ID NO: 779211 - DNA, 25 bp, Mus musculus
taggtgtgtgttgacacgcatgcat

SEQ ID NO: 779212 - DNA, 25 bp, Mus musculus
taggtgttatccatcacaaggcctg

SEQ ID NO: 779213 - DNA, 25 bp, Mus musculus
taggtgttatccttcacaaggcctg

SEQ ID NO: 779214 - DNA, 25 bp, Mus musculus
taggtgttccagaacaccggcctgg

SEQ ID NO: 779215 - DNA, 25 bp, Mus musculus
taggtgttccagtacaccggcctgg

SEQ ID NO: 779216 - DNA, 25 bp, Mus musculus
taggtgttgccccatgggacttaag

SEQ ID NO: 779217 - DNA, 25 bp, Mus musculus
taggtgttgcccgatgggacttaag

SEQ ID NO: 779218 - DNA, 25 bp, Mus musculus
taggttaaatgcatcaccctcactc

SEQ ID NO: 779219 - DNA, 25 bp, Mus musculus
taggttaaatgcttcaccctcactc

SEQ ID NO: 779220 - DNA, 25 bp, Mus musculus
taggttaactagaattgctatgcag

SEQ ID NO: 779221 - DNA, 25 bp, Mus musculus
taggttaactagtattgctatgcag

SEQ ID NO: 779222 - DNA, 25 bp, Mus musculus
taggttaacttaatgcttctttctg

SEQ ID NO: 779223 - DNA, 25 bp, Mus musculus
taggttaacttattgcttctttctg

SEQ ID NO: 779224 - DNA, 25 bp, Mus musculus
taggttacaccccatagccagaagg

SEQ ID NO: 779225 - DNA, 25 bp, Mus musculus
taggttacacccgatagccagaagg

SEQ ID NO: 779226 - DNA, 25 bp, Mus musculus
taggttacctctctaagtctgatgc

SEQ ID NO: 779227 - DNA, 25 bp, Mus musculus
taggttacctctgtaagtctgatgc

SEQ ID NO: 779228 - DNA, 25 bp, Mus musculus
taggttactgccagtgaccgctctg

SEQ ID NO: 779229 - DNA, 25 bp, Mus musculus
taggttactgcctgtgaccgctctg

SEQ ID NO: 779230 - DNA, 25 bp, Mus musculus
taggttagacccacaggcatactct

SEQ ID NO: 779231 - DNA, 25 bp, Mus musculus
taggttagaccctcaggcatactct

SEQ ID NO: 779232 - DNA, 25 bp, Mus musculus
taggttagggaacaccaccagccag

SEQ ID NO: 779233 - DNA, 25 bp, Mus musculus
taggttagggaagaccaccagccag

SEQ ID NO: 779234 - DNA, 25 bp, Mus musculus
taggttagtatgatactgtgcacac

SEQ ID NO: 779235 - DNA, 25 bp, Mus musculus
taggttagtatgttactgtgcacac

SEQ ID NO: 779236 - DNA, 25 bp, Mus musculus
taggttagtcccatggtgtctaatc

SEQ ID NO: 779237 - DNA, 25 bp, Mus musculus
taggttagtcccttggtgtctaatc

SEQ ID NO: 779238 - DNA, 25 bp, Mus musculus
taggttatatatagaattccaggcc

SEQ ID NO: 779239 - DNA, 25 bp, Mus musculus
taggttatatattgaattccaggcc

SEQ ID NO: 779240 - DNA, 25 bp, Mus musculus
taggttatcataatacccacctttc

SEQ ID NO: 779241 - DNA, 25 bp, Mus musculus
taggttatcatattacccacctttc

SEQ ID NO: 779242 - DNA, 25 bp, Mus musculus
taggttatgacccacccatccaaat

SEQ ID NO: 779243 - DNA, 25 bp, Mus musculus
taggttatgaccgacccatccaaat

SEQ ID NO: 779244 - DNA, 25 bp, Mus musculus
taggttattgtaccttcatttacca

SEQ ID NO: 779245 - DNA, 25 bp, Mus musculus
taggttattgtagcttcatttacca

SEQ ID NO: 779246 - DNA, 25 bp, Mus musculus
taggttatttgacacctttagtgta

SEQ ID NO: 779247 - DNA, 25 bp, Mus musculus
taggttatttgagacctttagtgta

SEQ ID NO: 779248 - DNA, 25 bp, Mus musculus
taggttcaactcaactatccctcct

SEQ ID NO: 779249 - DNA, 25 bp, Mus musculus
taggttcaactctactatccctcct

SEQ ID NO: 779250 - DNA, 25 bp, Mus musculus
taggttcaatgcaataaattcaagt

SEQ ID NO: 779251 - DNA, 25 bp, Mus musculus
taggttcaatgctataaattcaagt

SEQ ID NO: 779252 - DNA, 25 bp, Mus musculus
taggttcaccacctcagtctaaggg

SEQ ID NO: 779253 - DNA, 25 bp, Mus musculus
taggttcaccacgtcagtctaaggg

SEQ ID NO: 779254 - DNA, 25 bp, Mus musculus
taggttcaccagaggattctataaa

SEQ ID NO: 779255 - DNA, 25 bp, Mus musculus
taggttcaccagtggattctataaa

SEQ ID NO: 779256 - DNA, 25 bp, Mus musculus
taggttcaccttataggctacggat

SEQ ID NO: 779257 - DNA, 25 bp, Mus musculus
taggttcaccttttaggctacggat

SEQ ID NO: 779258 - DNA, 25 bp, Mus musculus
taggttcagacaaatcttctagatc

SEQ ID NO: 779259 - DNA, 25 bp, Mus musculus
taggttcagacatatcttctagatc

SEQ ID NO: 779260 - DNA, 25 bp, Mus musculus
taggttcaggaaccccaagctgaag

SEQ ID NO: 779261 - DNA, 25 bp, Mus musculus
taggttcaggaagcccaagctgaag

SEQ ID NO: 779262 - DNA, 25 bp, Mus musculus
taggttcaggatcggtgccagtggg

SEQ ID NO: 779263 - DNA, 25 bp, Mus musculus
taggttcaggatgggtgccagtggg

SEQ ID NO: 779264 - DNA, 25 bp, Mus musculus
taggttcattaccacgttggaggag

SEQ ID NO: 779265 - DNA, 25 bp, Mus musculus
taggttcattacgacgttggaggag

SEQ ID NO: 779266 - DNA, 25 bp, Mus musculus
taggttcattttaagacagtacatc

SEQ ID NO: 779267 - DNA, 25 bp, Mus musculus
taggttcatttttagacagtacatc

SEQ ID NO: 779268 - DNA, 25 bp, Mus musculus
taggttccagcaaggacccattctt

SEQ ID NO: 779269 - DNA, 25 bp, Mus musculus
taggttccagcatggacccattctt

SEQ ID NO: 779270 - DNA, 25 bp, Mus musculus
taggttccagtcacaaccacctata

SEQ ID NO: 779271 - DNA, 25 bp, Mus musculus
taggttccagtctcaaccacctata

SEQ ID NO: 779272 - DNA, 25 bp, Mus musculus
taggttccatctccaacacgaaaaa

SEQ ID NO: 779273 - DNA, 25 bp, Mus musculus
taggttccatctgcaacacgaaaaa

SEQ ID NO: 779274 - DNA, 25 bp, Mus musculus
taggttcccagcacttgcatttaca

SEQ ID NO: 779275 - DNA, 25 bp, Mus musculus
taggttcccagctcttgcatttaca

SEQ ID NO: 779276 - DNA, 25 bp, Mus musculus
taggttcccattcctttatacattt

SEQ ID NO: 779277 - DNA, 25 bp, Mus musculus
taggttcccattgctttatacattt

SEQ ID NO: 779278 - DNA, 25 bp, Mus musculus
taggttcctcacatatcactgtaga

SEQ ID NO: 779279 - DNA, 25 bp, Mus musculus
taggttcctcacttatcactgtaga

SEQ ID NO: 779280 - DNA, 25 bp, Mus musculus
taggttcctctaatccatgtaaatt

SEQ ID NO: 779281 - DNA, 25 bp, Mus musculus
taggttcctctattccatgtaaatt

SEQ ID NO: 779282 - DNA, 25 bp, Mus musculus
taggttccttttagtattatctttg

SEQ ID NO: 779283 - DNA, 25 bp, Mus musculus
taggttcctttttgtattatctttg

SEQ ID NO: 779284 - DNA, 25 bp, Mus musculus
taggttcgaccaatcgtgagtctgt

SEQ ID NO: 779285 - DNA, 25 bp, Mus musculus
taggttcgaccattcgtgagtctgt

SEQ ID NO: 779286 - DNA, 25 bp, Mus musculus
taggttcgccaacttctggtcgtgc

SEQ ID NO: 779287 - DNA, 25 bp, Mus musculus
taggttcgccaagttctggtcgtgc

SEQ ID NO: 779288 - DNA, 25 bp, Mus musculus
taggttcgcccaccatcgactgagg

SEQ ID NO: 779289 - DNA, 25 bp, Mus musculus
taggttcgcccagcatcgactgagg

SEQ ID NO: 779290 - DNA, 25 bp, Mus musculus
taggttctagctcagcacgcagtgt

SEQ ID NO: 779291 - DNA, 25 bp, Mus musculus
taggttctagctgagcacgcagtgt

SEQ ID NO: 779292 - DNA, 25 bp, Mus musculus
taggttctagttcctttcttccggt

SEQ ID NO: 779293 - DNA, 25 bp, Mus musculus
taggttctagttgctttcttccggt

SEQ ID NO: 779294 - DNA, 25 bp, Mus musculus
taggttctatgtacacgttccgatg

SEQ ID NO: 779295 - DNA, 25 bp, Mus musculus
taggttctatgttcacgttccgatg

SEQ ID NO: 779296 - DNA, 25 bp, Mus musculus
taggttctccctattaatccctaat

SEQ ID NO: 779297 - DNA, 25 bp, Mus musculus
taggttctcccttttaatccctaat

SEQ ID NO: 779298 - DNA, 25 bp, Mus musculus
taggttctcctcaagattcatgtct

SEQ ID NO: 779299 - DNA, 25 bp, Mus musculus
taggttctcctctagattcatgtct

SEQ ID NO: 779300 - DNA, 25 bp, Mus musculus
taggttctctacaatcccagcgagt

SEQ ID NO: 779301 - DNA, 25 bp, Mus musculus
taggttctctactatcccagcgagt

SEQ ID NO: 779302 - DNA, 25 bp, Mus musculus
taggttctctgtacacatattcaca

SEQ ID NO: 779303 - DNA, 25 bp, Mus musculus
taggttctctgttcacatattcaca

SEQ ID NO: 779304 - DNA, 25 bp, Mus musculus
taggttctgatcactggtccttcct

SEQ ID NO: 779305 - DNA, 25 bp, Mus musculus
taggttctgatctctggtccttcct

SEQ ID NO: 779306 - DNA, 25 bp, Mus musculus
taggttctgttacctccacactgac

SEQ ID NO: 779307 - DNA, 25 bp, Mus musculus
taggttctgttagctccacactgac

SEQ ID NO: 779308 - DNA, 25 bp, Mus musculus
taggttcttctgatgcagttgaaaa

SEQ ID NO: 779309 - DNA, 25 bp, Mus musculus
taggttcttctgttgcagttgaaaa

SEQ ID NO: 779310 - DNA, 25 bp, Mus musculus
taggttgaaaaactcacctgtgggt

SEQ ID NO: 779311 - DNA, 25 bp, Mus musculus
taggttgaaaaagtcacctgtgggt

SEQ ID NO: 779312 - DNA, 25 bp, Mus musculus
taggttgaggtaatgagcagcttga

SEQ ID NO: 779313 - DNA, 25 bp, Mus musculus
taggttgaggtattgagcagcttga

SEQ ID NO: 779314 - DNA, 25 bp, Mus musculus
taggttgatctaccacaagatgcaa

SEQ ID NO: 779315 - DNA, 25 bp, Mus musculus
taggttgatctagcacaagatgcaa

SEQ ID NO: 779316 - DNA, 25 bp, Mus musculus
taggttgcacaacgacaggacattt

SEQ ID NO: 779317 - DNA, 25 bp, Mus musculus
taggttgcacaaggacaggacattt

SEQ ID NO: 779318 - DNA, 25 bp, Mus musculus
taggttgcaccacgttcttttctct

SEQ ID NO: 779319 - DNA, 25 bp, Mus musculus
taggttgcaccaggttcttttctct

SEQ ID NO: 779320 - DNA, 25 bp, Mus musculus
taggttgcattcagatccacactga

SEQ ID NO: 779321 - DNA, 25 bp, Mus musculus
taggttgcattctgatccacactga

SEQ ID NO: 779322 - DNA, 25 bp, Mus musculus
taggttgcccagactatagttgaac

SEQ ID NO: 779323 - DNA, 25 bp, Mus musculus
taggttgcccagtctatagttgaac

SEQ ID NO: 779324 - DNA, 25 bp, Mus musculus
taggttgctcctcaaactgactgta

SEQ ID NO: 779325 - DNA, 25 bp, Mus musculus
taggttgctcctgaaactgactgta

SEQ ID NO: 779326 - DNA, 25 bp, Mus musculus
taggttgctctacggctgtgacatt

SEQ ID NO: 779327 - DNA, 25 bp, Mus musculus
taggttgctctagggctgtgacatt

SEQ ID NO: 779328 - DNA, 25 bp, Mus musculus
taggttgctttaaggcaaggtttgc

SEQ ID NO: 779329 - DNA, 25 bp, Mus musculus
taggttgctttatggcaaggtttgc

SEQ ID NO: 779330 - DNA, 25 bp, Mus musculus
taggttgctttcaccaattgcttcc

SEQ ID NO: 779331 - DNA, 25 bp, Mus musculus
taggttgctttctccaattgcttcc

SEQ ID NO: 779332 - DNA, 25 bp, Mus musculus
taggttggcctgatgttgcttgcat

SEQ ID NO: 779333 - DNA, 25 bp, Mus musculus
taggttggcctgttgttgcttgcat

SEQ ID NO: 779334 - DNA, 25 bp, Mus musculus
taggttggccttatctttactctag

SEQ ID NO: 779335 - DNA, 25 bp, Mus musculus
taggttggccttttctttactctag

SEQ ID NO: 779336 - DNA, 25 bp, Mus musculus
taggttggtatgacacatgcccatg

SEQ ID NO: 779337 - DNA, 25 bp, Mus musculus
taggttggtatgtcacatgcccatg

SEQ ID NO: 779338 - DNA, 25 bp, Mus musculus
taggttggtgtcactattgctccaa

SEQ ID NO: 779339 - DNA, 25 bp, Mus musculus
taggttggtgtctctattgctccaa

SEQ ID NO: 779340 - DNA, 25 bp, Mus musculus
taggttggtgttctatcccttatcc

SEQ ID NO: 779341 - DNA, 25 bp, Mus musculus
taggttggtgttgtatcccttatcc

SEQ ID NO: 779342 - DNA, 25 bp, Mus musculus
taggttgtcaagatgcacagcacag

SEQ ID NO: 779343 - DNA, 25 bp, Mus musculus
taggttgtcaagttgcacagcacag

SEQ ID NO: 779344 - DNA, 25 bp, Mus musculus
taggttgtcaatccagttcctgaga

SEQ ID NO: 779345 - DNA, 25 bp, Mus musculus
taggttgtcaatgcagttcctgaga

SEQ ID NO: 779346 - DNA, 25 bp, Mus musculus
taggttgtgcttctcatgctttcca

SEQ ID NO: 779347 - DNA, 25 bp, Mus musculus
taggttgtgcttgtcatgctttcca

SEQ ID NO: 779348 - DNA, 25 bp, Mus musculus
taggttgttaggactctgctgtcac

SEQ ID NO: 779349 - DNA, 25 bp, Mus musculus
taggttgttaggtctctgctgtcac

SEQ ID NO: 779350 - DNA, 25 bp, Mus musculus
taggttgtttctctctgaggttctt

SEQ ID NO: 779351 - DNA, 25 bp, Mus musculus
taggttgtttctgtctgaggttctt

SEQ ID NO: 779352 - DNA, 25 bp, Mus musculus
taggttgttttaagacgtgttccct

SEQ ID NO: 779353 - DNA, 25 bp, Mus musculus
taggttgttttatgacgtgttccct

SEQ ID NO: 779354 - DNA, 25 bp, Mus musculus
taggtttaaagcagtttcacttacg

SEQ ID NO: 779355 - DNA, 25 bp, Mus musculus
taggtttaaagctgtttcacttacg

SEQ ID NO: 779356 - DNA, 25 bp, Mus musculus
taggtttaagccacacagagaaggg

SEQ ID NO: 779357 - DNA, 25 bp, Mus musculus
taggtttaagcctcacagagaaggg

SEQ ID NO: 779358 - DNA, 25 bp, Mus musculus
taggtttcaaccacaagcttttgta

SEQ ID NO: 779359 - DNA, 25 bp, Mus musculus
taggtttcaacctcaagcttttgta

SEQ ID NO: 779360 - DNA, 25 bp, Mus musculus
taggtttcacacataatttcttcaa

SEQ ID NO: 779361 - DNA, 25 bp, Mus musculus
taggtttcacacttaatttcttcaa

SEQ ID NO: 779362 - DNA, 25 bp, Mus musculus
taggtttcactacggttagagttag

SEQ ID NO: 779363 - DNA, 25 bp, Mus musculus
taggtttcactagggttagagttag

SEQ ID NO: 779364 - DNA, 25 bp, Mus musculus
taggtttccctccaagatctgtgac

SEQ ID NO: 779365 - DNA, 25 bp, Mus musculus
taggtttccctcgaagatctgtgac

SEQ ID NO: 779366 - DNA, 25 bp, Mus musculus
taggtttcgcccaggtgttggacac

SEQ ID NO: 779367 - DNA, 25 bp, Mus musculus
taggtttcgccctggtgttggacac

SEQ ID NO: 779368 - DNA, 25 bp, Mus musculus
taggtttctctgaccttattgtctg

SEQ ID NO: 779369 - DNA, 25 bp, Mus musculus
taggtttctctgtccttattgtctg

SEQ ID NO: 779370 - DNA, 25 bp, Mus musculus
taggtttctgtgcaacaacaacaac

SEQ ID NO: 779371 - DNA, 25 bp, Mus musculus
taggtttctgtggaacaacaacaac

SEQ ID NO: 779372 - DNA, 25 bp, Mus musculus
taggtttcttccatatcctgtctgt

SEQ ID NO: 779373 - DNA, 25 bp, Mus musculus
taggtttcttccttatcctgtctgt

SEQ ID NO: 779374 - DNA, 25 bp, Mus musculus
taggtttcttttcgatggagttgga

SEQ ID NO: 779375 - DNA, 25 bp, Mus musculus
taggtttcttttggatggagttgga

SEQ ID NO: 779376 - DNA, 25 bp, Mus musculus
taggtttgaatccacaattcctgtg

SEQ ID NO: 779377 - DNA, 25 bp, Mus musculus
taggtttgaatcgacaattcctgtg

SEQ ID NO: 779378 - DNA, 25 bp, Mus musculus
taggtttgagctccacagtgtttca

SEQ ID NO: 779379 - DNA, 25 bp, Mus musculus
taggtttgagctgcacagtgtttca

SEQ ID NO: 779380 - DNA, 25 bp, Mus musculus
taggtttgctggctgttagtttctg

SEQ ID NO: 779381 - DNA, 25 bp, Mus musculus
taggtttgctgggtgttagtttctg

SEQ ID NO: 779382 - DNA, 25 bp, Mus musculus
taggtttgtcctatgttagttccat

SEQ ID NO: 779383 - DNA, 25 bp, Mus musculus
taggtttgtcctttgttagttccat

SEQ ID NO: 779384 - DNA, 25 bp, Mus musculus
taggttttaatcctggtcttgaggt

SEQ ID NO: 779385 - DNA, 25 bp, Mus musculus
taggttttaatcgtggtcttgaggt

SEQ ID NO: 779386 - DNA, 25 bp, Mus musculus
taggttttacaacactgccttgtgt

SEQ ID NO: 779387 - DNA, 25 bp, Mus musculus
taggttttacaagactgccttgtgt

SEQ ID NO: 779388 - DNA, 25 bp, Mus musculus
taggttttactgaactgggcgccct

SEQ ID NO: 779389 - DNA, 25 bp, Mus musculus
taggttttactgtactgggcgccct

SEQ ID NO: 779390 - DNA, 25 bp, Mus musculus
taggttttagtcatgaccctgctga

SEQ ID NO: 779391 - DNA, 25 bp, Mus musculus
taggttttagtcttgaccctgctga

SEQ ID NO: 779392 - DNA, 25 bp, Mus musculus
taggttttcacccaaggtctctcac

SEQ ID NO: 779393 - DNA, 25 bp, Mus musculus
taggttttcaccgaaggtctctcac

SEQ ID NO: 779394 - DNA, 25 bp, Mus musculus
taggttttcagcatctattggttgc

SEQ ID NO: 779395 - DNA, 25 bp, Mus musculus
taggttttcagcttctattggttgc

SEQ ID NO: 779396 - DNA, 25 bp, Mus musculus
taggttttcattccgcttgtgtagc

SEQ ID NO: 779397 - DNA, 25 bp, Mus musculus
taggttttcattgcgcttgtgtagc

SEQ ID NO: 779398 - DNA, 25 bp, Mus musculus
taggttttcctgaggccagtggttt

SEQ ID NO: 779399 - DNA, 25 bp, Mus musculus
taggttttcctgtggccagtggttt

SEQ ID NO: 779400 - DNA, 25 bp, Mus musculus
taggttttcgtgaaagactcttgct

SEQ ID NO: 779401 - DNA, 25 bp, Mus musculus
taggttttcgtgtaagactcttgct

SEQ ID NO: 779402 - DNA, 25 bp, Mus musculus
taggttttctaaccgtgtctagcat

SEQ ID NO: 779403 - DNA, 25 bp, Mus musculus
taggttttctaagcgtgtctagcat

SEQ ID NO: 779404 - DNA, 25 bp, Mus musculus
taggttttctcactttgacaagccc

SEQ ID NO: 779405 - DNA, 25 bp, Mus musculus
taggttttctcagtttgacaagccc

SEQ ID NO: 779406 - DNA, 25 bp, Mus musculus
taggttttctggaagtgtgttgcac

SEQ ID NO: 779407 - DNA, 25 bp, Mus musculus
taggttttctggtagtgtgttgcac

SEQ ID NO: 779408 - DNA, 25 bp, Mus musculus
taggttttcttcacaggcttcaaaa

SEQ ID NO: 779409 - DNA, 25 bp, Mus musculus
taggttttcttctcaggcttcaaaa

SEQ ID NO: 779410 - DNA, 25 bp, Mus musculus
taggttttctttccgcttatgaact

SEQ ID NO: 779411 - DNA, 25 bp, Mus musculus
taggttttctttgcgcttatgaact

SEQ ID NO: 779412 - DNA, 25 bp, Mus musculus
taggttttgtcaccatggccaggat

SEQ ID NO: 779413 - DNA, 25 bp, Mus musculus
taggttttgtcagcatggccaggat

SEQ ID NO: 779414 - DNA, 25 bp, Mus musculus
taggttttgtggccttccaccttct

SEQ ID NO: 779415 - DNA, 25 bp, Mus musculus
taggttttgtgggcttccaccttct

SEQ ID NO: 779416 - DNA, 25 bp, Mus musculus
tagtaaaaaagtacgagccgcccag

SEQ ID NO: 779417 - DNA, 25 bp, Mus musculus
tagtaaaaaagttcgagccgcccag

SEQ ID NO: 779418 - DNA, 25 bp, Mus musculus
tagtaaaactccctttctgaccaag

SEQ ID NO: 779419 - DNA, 25 bp, Mus musculus
tagtaaaactccgtttctgaccaag

SEQ ID NO: 779420 - DNA, 25 bp, Mus musculus
tagtaaaaggccatcaggtcagcaa

SEQ ID NO: 779421 - DNA, 25 bp, Mus musculus
tagtaaaaggccttcaggtcagcaa

SEQ ID NO: 779422 - DNA, 25 bp, Mus musculus
tagtaaaatgtgcacaggcgtcagg

SEQ ID NO: 779423 - DNA, 25 bp, Mus musculus
tagtaaaatgtggacaggcgtcagg

SEQ ID NO: 779424 - DNA, 25 bp, Mus musculus
tagtaaaccagcctgagatgcccca

SEQ ID NO: 779425 - DNA, 25 bp, Mus musculus
tagtaaaccagcgtgagatgcccca

SEQ ID NO: 779426 - DNA, 25 bp, Mus musculus
tagtaaacggctacagaccatctgt

SEQ ID NO: 779427 - DNA, 25 bp, Mus musculus
tagtaaacggcttcagaccatctgt

SEQ ID NO: 779428 - DNA, 25 bp, Mus musculus
tagtaaagaactctcacctgatttc

SEQ ID NO: 779429 - DNA, 25 bp, Mus musculus
tagtaaagaactgtcacctgatttc

SEQ ID NO: 779430 - DNA, 25 bp, Mus musculus
tagtaaagccttctctttcgtgtgt

SEQ ID NO: 779431 - DNA, 25 bp, Mus musculus
tagtaaagccttgtctttcgtgtgt

SEQ ID NO: 779432 - DNA, 25 bp, Mus musculus
tagtaaatagcccttcatcccagaa

SEQ ID NO: 779433 - DNA, 25 bp, Mus musculus
tagtaaatagccgttcatcccagaa

SEQ ID NO: 779434 - DNA, 25 bp, Mus musculus
tagtaaatattcacagcctgacatc

SEQ ID NO: 779435 - DNA, 25 bp, Mus musculus
tagtaaatattctcagcctgacatc

SEQ ID NO: 779436 - DNA, 25 bp, Mus musculus
tagtaaatcagtaagtcacttctaa

SEQ ID NO: 779437 - DNA, 25 bp, Mus musculus
tagtaaatcagttagtcacttctaa

SEQ ID NO: 779438 - DNA, 25 bp, Mus musculus
tagtaaatccttcagttgcagccag

SEQ ID NO: 779439 - DNA, 25 bp, Mus musculus
tagtaaatccttgagttgcagccag

SEQ ID NO: 779440 - DNA, 25 bp, Mus musculus
tagtaaatgccacagttctgggagt

SEQ ID NO: 779441 - DNA, 25 bp, Mus musculus
tagtaaatgccagagttctgggagt

SEQ ID NO: 779442 - DNA, 25 bp, Mus musculus
tagtaaattttccatgagccacatt

SEQ ID NO: 779443 - DNA, 25 bp, Mus musculus
tagtaaattttcgatgagccacatt

SEQ ID NO: 779444 - DNA, 25 bp, Mus musculus
tagtaacaaaacagtcctgcccagc

SEQ ID NO: 779445 - DNA, 25 bp, Mus musculus
tagtaacaaaactgtcctgcccagc

SEQ ID NO: 779446 - DNA, 25 bp, Mus musculus
tagtaacaatcgacagcaatgcgaa

SEQ ID NO: 779447 - DNA, 25 bp, Mus musculus
tagtaacaatcgtcagcaatgcgaa

SEQ ID NO: 779448 - DNA, 25 bp, Mus musculus
tagtaacacaggcacactatggctg

SEQ ID NO: 779449 - DNA, 25 bp, Mus musculus
tagtaacacagggacactatggctg

SEQ ID NO: 779450 - DNA, 25 bp, Mus musculus
tagtaacacggtagacatggaggct

SEQ ID NO: 779451 - DNA, 25 bp, Mus musculus
tagtaacacggttgacatggaggct

SEQ ID NO: 779452 - DNA, 25 bp, Mus musculus
tagtaacactgacggcggctggtcc

SEQ ID NO: 779453 - DNA, 25 bp, Mus musculus
tagtaacactgagggcggctggtcc

SEQ ID NO: 779454 - DNA, 25 bp, Mus musculus
tagtaacactgtctgctcaatgggc

SEQ ID NO: 779455 - DNA, 25 bp, Mus musculus
tagtaacactgtgtgctcaatgggc

SEQ ID NO: 779456 - DNA, 25 bp, Mus musculus
tagtaacaggaacgaccggcctagg

SEQ ID NO: 779457 - DNA, 25 bp, Mus musculus
tagtaacaggaaggaccggcctagg

SEQ ID NO: 779458 - DNA, 25 bp, Mus musculus
tagtaacagtgacctcaaagttttc

SEQ ID NO: 779459 - DNA, 25 bp, Mus musculus
tagtaacagtgagctcaaagttttc

SEQ ID NO: 779460 - DNA, 25 bp, Mus musculus
tagtaacagtggagttccttgggaa

SEQ ID NO: 779461 - DNA, 25 bp, Mus musculus
tagtaacagtggtgttccttgggaa

SEQ ID NO: 779462 - DNA, 25 bp, Mus musculus
tagtaacatcctatgatgccccagg

SEQ ID NO: 779463 - DNA, 25 bp, Mus musculus
tagtaacatcctttgatgccccagg

SEQ ID NO: 779464 - DNA, 25 bp, Mus musculus
tagtaaccatgtcactgctttcctc

SEQ ID NO: 779465 - DNA, 25 bp, Mus musculus
tagtaaccatgtgactgctttcctc

SEQ ID NO: 779466 - DNA, 25 bp, Mus musculus
tagtaaccgctcctcaagagccgaa

SEQ ID NO: 779467 - DNA, 25 bp, Mus musculus
tagtaaccgctcgtcaagagccgaa

SEQ ID NO: 779468 - DNA, 25 bp, Mus musculus
tagtaaccggagctacagagacagt

SEQ ID NO: 779469 - DNA, 25 bp, Mus musculus
tagtaaccggaggtacagagacagt

SEQ ID NO: 779470 - DNA, 25 bp, Mus musculus
tagtaacctcgcctctcttcttgaa

SEQ ID NO: 779471 - DNA, 25 bp, Mus musculus
tagtaacctcgcgtctcttcttgaa

SEQ ID NO: 779472 - DNA, 25 bp, Mus musculus
tagtaacctgcacctcagagcggaa

SEQ ID NO: 779473 - DNA, 25 bp, Mus musculus
tagtaacctgcagctcagagcggaa

SEQ ID NO: 779474 - DNA, 25 bp, Mus musculus
tagtaacggcccacttaagatttat

SEQ ID NO: 779475 - DNA, 25 bp, Mus musculus
tagtaacggccctcttaagatttat

SEQ ID NO: 779476 - DNA, 25 bp, Mus musculus
tagtaactacagcttttcctaccct

SEQ ID NO: 779477 - DNA, 25 bp, Mus musculus
tagtaactacaggttttcctaccct

SEQ ID NO: 779478 - DNA, 25 bp, Mus musculus
tagtaactagcacaccggttccgaa

SEQ ID NO: 779479 - DNA, 25 bp, Mus musculus
tagtaactagcagaccggttccgaa

SEQ ID NO: 779480 - DNA, 25 bp, Mus musculus
tagtaactctctaaatcttcttggg

SEQ ID NO: 779481 - DNA, 25 bp, Mus musculus
tagtaactctcttaatcttcttggg

SEQ ID NO: 779482 - DNA, 25 bp, Mus musculus
tagtaactgggtattcaacaaactg

SEQ ID NO: 779483 - DNA, 25 bp, Mus musculus
tagtaactgggttttcaacaaactg

SEQ ID NO: 779484 - DNA, 25 bp, Mus musculus
tagtaacttcataccgcccttcagt

SEQ ID NO: 779485 - DNA, 25 bp, Mus musculus
tagtaacttcattccgcccttcagt

SEQ ID NO: 779486 - DNA, 25 bp, Mus musculus
tagtaacttggcatcattctgcgca

SEQ ID NO: 779487 - DNA, 25 bp, Mus musculus
tagtaacttggcttcattctgcgca

SEQ ID NO: 779488 - DNA, 25 bp, Mus musculus
tagtaactttgcagactgcaccggg

SEQ ID NO: 779489 - DNA, 25 bp, Mus musculus
tagtaactttgctgactgcaccggg

SEQ ID NO: 779490 - DNA, 25 bp, Mus musculus
tagtaagaccctatctgtcccttct

SEQ ID NO: 779491 - DNA, 25 bp, Mus musculus
tagtaagaccctttctgtcccttct

SEQ ID NO: 779492 - DNA, 25 bp, Mus musculus
tagtaagacctaataattcctggct

SEQ ID NO: 779493 - DNA, 25 bp, Mus musculus
tagtaagacctattaattcctggct

SEQ ID NO: 779494 - DNA, 25 bp, Mus musculus
tagtaagacgccaactgcccaggcg

SEQ ID NO: 779495 - DNA, 25 bp, Mus musculus
tagtaagacgcctactgcccaggcg

SEQ ID NO: 779496 - DNA, 25 bp, Mus musculus
tagtaagacttcctcagccgggcag

SEQ ID NO: 779497 - DNA, 25 bp, Mus musculus
tagtaagacttcgtcagccgggcag

SEQ ID NO: 779498 - DNA, 25 bp, Mus musculus
tagtaagatctgacacagtacctca

SEQ ID NO: 779499 - DNA, 25 bp, Mus musculus
tagtaagatctgtcacagtacctca

SEQ ID NO: 779500 - DNA, 25 bp, Mus musculus
tagtaagatgacattcctcgctggc

SEQ ID NO: 779501 - DNA, 25 bp, Mus musculus
tagtaagatgactttcctcgctggc

SEQ ID NO: 779502 - DNA, 25 bp, Mus musculus
tagtaagcacgaacatgctcctttt

SEQ ID NO: 779503 - DNA, 25 bp, Mus musculus
tagtaagcacgatcatgctcctttt

SEQ ID NO: 779504 - DNA, 25 bp, Mus musculus
tagtaagcacttacagcaggcaaaa

SEQ ID NO: 779505 - DNA, 25 bp, Mus musculus
tagtaagcactttcagcaggcaaaa

SEQ ID NO: 779506 - DNA, 25 bp, Mus musculus
tagtaagcggctcatcattgcgatc

SEQ ID NO: 779507 - DNA, 25 bp, Mus musculus
tagtaagcggctgatcattgcgatc

SEQ ID NO: 779508 - DNA, 25 bp, Mus musculus
tagtaagctagaacttcccttcctg

SEQ ID NO: 779509 - DNA, 25 bp, Mus musculus
tagtaagctagatcttcccttcctg

SEQ ID NO: 779510 - DNA, 25 bp, Mus musculus
tagtaagctctacgtcagtcaaggc

SEQ ID NO: 779511 - DNA, 25 bp, Mus musculus
tagtaagctctaggtcagtcaaggc

SEQ ID NO: 779512 - DNA, 25 bp, Mus musculus
tagtaagcttatcatcagcctgaaa

SEQ ID NO: 779513 - DNA, 25 bp, Mus musculus
tagtaagcttatgatcagcctgaaa

SEQ ID NO: 779514 - DNA, 25 bp, Mus musculus
tagtaaggacaactcgcctccagct

SEQ ID NO: 779515 - DNA, 25 bp, Mus musculus
tagtaaggacaagtcgcctccagct

SEQ ID NO: 779516 - DNA, 25 bp, Mus musculus
tagtaaggagttactgttgtcagtc

SEQ ID NO: 779517 - DNA, 25 bp, Mus musculus
tagtaaggagtttctgttgtcagtc

SEQ ID NO: 779518 - DNA, 25 bp, Mus musculus
tagtaaggatcacttttgttcggaa

SEQ ID NO: 779519 - DNA, 25 bp, Mus musculus
tagtaaggatcagttttgttcggaa

SEQ ID NO: 779520 - DNA, 25 bp, Mus musculus
tagtaaggtcctaccagctgtggcc

SEQ ID NO: 779521 - DNA, 25 bp, Mus musculus
tagtaaggtccttccagctgtggcc

SEQ ID NO: 779522 - DNA, 25 bp, Mus musculus
tagtaaggtgtacagcctcaccctg

SEQ ID NO: 779523 - DNA, 25 bp, Mus musculus
tagtaaggtgtagagcctcaccctg

SEQ ID NO: 779524 - DNA, 25 bp, Mus musculus
tagtaagtactacgaggcatatgtg

SEQ ID NO: 779525 - DNA, 25 bp, Mus musculus
tagtaagtactaggaggcatatgtg

SEQ ID NO: 779526 - DNA, 25 bp, Mus musculus
tagtaagtgccaatatccacccaac

SEQ ID NO: 779527 - DNA, 25 bp, Mus musculus
tagtaagtgccattatccacccaac

SEQ ID NO: 779528 - DNA, 25 bp, Mus musculus
tagtaagtggcactccttggaccat

SEQ ID NO: 779529 - DNA, 25 bp, Mus musculus
tagtaagtggcagtccttggaccat

SEQ ID NO: 779530 - DNA, 25 bp, Mus musculus
tagtaagtgttccttccagttaatg

SEQ ID NO: 779531 - DNA, 25 bp, Mus musculus
tagtaagtgttcgttccagttaatg

SEQ ID NO: 779532 - DNA, 25 bp, Mus musculus
tagtaatatctacaccaatacacat

SEQ ID NO: 779533 - DNA, 25 bp, Mus musculus
tagtaatatctagaccaatacacat

SEQ ID NO: 779534 - DNA, 25 bp, Mus musculus
tagtaatatttacggacttcaggac

SEQ ID NO: 779535 - DNA, 25 bp, Mus musculus
tagtaatatttagggacttcaggac

SEQ ID NO: 779536 - DNA, 25 bp, Mus musculus
tagtaatccattccatctgtttcct

SEQ ID NO: 779537 - DNA, 25 bp, Mus musculus
tagtaatccattgcatctgtttcct

SEQ ID NO: 779538 - DNA, 25 bp, Mus musculus
tagtaatctactattcccattcctt

SEQ ID NO: 779539 - DNA, 25 bp, Mus musculus
tagtaatctacttttcccattcctt

SEQ ID NO: 779540 - DNA, 25 bp, Mus musculus
tagtaatgaagtagctgtttcctct

SEQ ID NO: 779541 - DNA, 25 bp, Mus musculus
tagtaatgaagttgctgtttcctct

SEQ ID NO: 779542 - DNA, 25 bp, Mus musculus
tagtaatgactacctgccagacctg

SEQ ID NO: 779543 - DNA, 25 bp, Mus musculus
tagtaatgactagctgccagacctg

SEQ ID NO: 779544 - DNA, 25 bp, Mus musculus
tagtaatgccagcaaaacccctccg

SEQ ID NO: 779545 - DNA, 25 bp, Mus musculus
tagtaatgccaggaaaacccctccg

SEQ ID NO: 779546 - DNA, 25 bp, Mus musculus
tagtaatgtgccaggtgacagccca

SEQ ID NO: 779547 - DNA, 25 bp, Mus musculus
tagtaatgtgcctggtgacagccca

SEQ ID NO: 779548 - DNA, 25 bp, Mus musculus
tagtaattaatcctgctgagccatc

SEQ ID NO: 779549 - DNA, 25 bp, Mus musculus
tagtaattaatcgtgctgagccatc

SEQ ID NO: 779550 - DNA, 25 bp, Mus musculus
tagtaattactcagacttccggtct

SEQ ID NO: 779551 - DNA, 25 bp, Mus musculus
tagtaattactctgacttccggtct

SEQ ID NO: 779552 - DNA, 25 bp, Mus musculus
tagtaattacttcttcttgaaaacg

SEQ ID NO: 779553 - DNA, 25 bp, Mus musculus
tagtaattacttgttcttgaaaacg

SEQ ID NO: 779554 - DNA, 25 bp, Mus musculus
tagtaattatttaccctggttgctt

SEQ ID NO: 779555 - DNA, 25 bp, Mus musculus
tagtaattattttccctggttgctt

SEQ ID NO: 779556 - DNA, 25 bp, Mus musculus
tagtaattcacacctagcatgagga

SEQ ID NO: 779557 - DNA, 25 bp, Mus musculus
tagtaattcacagctagcatgagga

SEQ ID NO: 779558 - DNA, 25 bp, Mus musculus
tagtaatttatgaagcagaaccaat

SEQ ID NO: 779559 - DNA, 25 bp, Mus musculus
tagtaatttatgtagcagaaccaat

SEQ ID NO: 779560 - DNA, 25 bp, Mus musculus
tagtaatttgcccattccttcagac

SEQ ID NO: 779561 - DNA, 25 bp, Mus musculus
tagtaatttgccgattccttcagac

SEQ ID NO: 779562 - DNA, 25 bp, Mus musculus
tagtaatttttaccccagagccagg

SEQ ID NO: 779563 - DNA, 25 bp, Mus musculus
tagtaatttttagcccagagccagg

SEQ ID NO: 779564 - DNA, 25 bp, Mus musculus
tagtaatttttgacttcagcttttt

SEQ ID NO: 779565 - DNA, 25 bp, Mus musculus
tagtaatttttgtcttcagcttttt

SEQ ID NO: 779566 - DNA, 25 bp, Mus musculus
tagtacaacgcacaacccttggttg

SEQ ID NO: 779567 - DNA, 25 bp, Mus musculus
tagtacaacgcagaacccttggttg

SEQ ID NO: 779568 - DNA, 25 bp, Mus musculus
tagtacaagctaccacgtgcacaga

SEQ ID NO: 779569 - DNA, 25 bp, Mus musculus
tagtacaagctagcacgtgcacaga

SEQ ID NO: 779570 - DNA, 25 bp, Mus musculus
tagtacacatgtatagcgtctcccc

SEQ ID NO: 779571 - DNA, 25 bp, Mus musculus
tagtacacatgtttagcgtctcccc

SEQ ID NO: 779572 - DNA, 25 bp, Mus musculus
tagtacaccagcaacggcaaggcat

SEQ ID NO: 779573 - DNA, 25 bp, Mus musculus
tagtacaccagctacggcaaggcat

SEQ ID NO: 779574 - DNA, 25 bp, Mus musculus
tagtacaccggacgaaaacagtctt

SEQ ID NO: 779575 - DNA, 25 bp, Mus musculus
tagtacaccggaggaaaacagtctt

SEQ ID NO: 779576 - DNA, 25 bp, Mus musculus
tagtacacctgactattccacacag

SEQ ID NO: 779577 - DNA, 25 bp, Mus musculus
tagtacacctgagtattccacacag

SEQ ID NO: 779578 - DNA, 25 bp, Mus musculus
tagtacacctggcaggtctaccttt

SEQ ID NO: 779579 - DNA, 25 bp, Mus musculus
tagtacacctgggaggtctaccttt

SEQ ID NO: 779580 - DNA, 25 bp, Mus musculus
tagtacactgccaggttcctcgaaa

SEQ ID NO: 779581 - DNA, 25 bp, Mus musculus
tagtacactgcctggttcctcgaaa

SEQ ID NO: 779582 - DNA, 25 bp, Mus musculus
tagtacagagccctattgagcccca

SEQ ID NO: 779583 - DNA, 25 bp, Mus musculus
tagtacagagccgtattgagcccca

SEQ ID NO: 779584 - DNA, 25 bp, Mus musculus
tagtacaggaaacggcatcaccagt

SEQ ID NO: 779585 - DNA, 25 bp, Mus musculus
tagtacaggaaagggcatcaccagt

SEQ ID NO: 779586 - DNA, 25 bp, Mus musculus
tagtacagtttcaggagaaagaccc

SEQ ID NO: 779587 - DNA, 25 bp, Mus musculus
tagtacagtttctggagaaagaccc

SEQ ID NO: 779588 - DNA, 25 bp, Mus musculus
tagtacatagaccagtagttctcaa

SEQ ID NO: 779589 - DNA, 25 bp, Mus musculus
tagtacatagacgagtagttctcaa

SEQ ID NO: 779590 - DNA, 25 bp, Mus musculus
tagtacatgtacacgtacccggcta

SEQ ID NO: 779591 - DNA, 25 bp, Mus musculus
tagtacatgtactcgtacccggcta

SEQ ID NO: 779592 - DNA, 25 bp, Mus musculus
tagtacatgtgaaccaggactgtag

SEQ ID NO: 779593 - DNA, 25 bp, Mus musculus
tagtacatgtgatccaggactgtag

SEQ ID NO: 779594 - DNA, 25 bp, Mus musculus
tagtacatgttcataattactgagc

SEQ ID NO: 779595 - DNA, 25 bp, Mus musculus
tagtacatgttcttaattactgagc

SEQ ID NO: 779596 - DNA, 25 bp, Mus musculus
tagtacatttgactgttgcttaatc

SEQ ID NO: 779597 - DNA, 25 bp, Mus musculus
tagtacatttgagtgttgcttaatc

SEQ ID NO: 779598 - DNA, 25 bp, Mus musculus
tagtaccaagcactgactaagccag

SEQ ID NO: 779599 - DNA, 25 bp, Mus musculus
tagtaccaagcagtgactaagccag

SEQ ID NO: 779600 - DNA, 25 bp, Mus musculus
tagtaccaccttcagtagctgaaga

SEQ ID NO: 779601 - DNA, 25 bp, Mus musculus
tagtaccaccttgagtagctgaaga

SEQ ID NO: 779602 - DNA, 25 bp, Mus musculus
tagtaccaggaaacatgctaaagat

SEQ ID NO: 779603 - DNA, 25 bp, Mus musculus
tagtaccaggaatcatgctaaagat

SEQ ID NO: 779604 - DNA, 25 bp, Mus musculus
tagtaccagtgtactgcagctttct

SEQ ID NO: 779605 - DNA, 25 bp, Mus musculus
tagtaccagtgttctgcagctttct

SEQ ID NO: 779606 - DNA, 25 bp, Mus musculus
tagtaccatccaagaacttcaacag

SEQ ID NO: 779607 - DNA, 25 bp, Mus musculus
tagtaccatccatgaacttcaacag

SEQ ID NO: 779608 - DNA, 25 bp, Mus musculus
tagtaccattatcaaccctaggaga

SEQ ID NO: 779609 - DNA, 25 bp, Mus musculus
tagtaccattatgaaccctaggaga

SEQ ID NO: 779610 - DNA, 25 bp, Mus musculus
tagtacccacctccccatagtggag

SEQ ID NO: 779611 - DNA, 25 bp, Mus musculus
tagtacccacctgcccatagtggag

SEQ ID NO: 779612 - DNA, 25 bp, Mus musculus
tagtaccccattccctgagcatagt

SEQ ID NO: 779613 - DNA, 25 bp, Mus musculus
tagtaccccattgcctgagcatagt

SEQ ID NO: 779614 - DNA, 25 bp, Mus musculus
tagtaccccttaaaggttgtctcag

SEQ ID NO: 779615 - DNA, 25 bp, Mus musculus
tagtaccccttataggttgtctcag

SEQ ID NO: 779616 - DNA, 25 bp, Mus musculus
tagtaccctcatcgtagcttgcacc

SEQ ID NO: 779617 - DNA, 25 bp, Mus musculus
tagtaccctcatggtagcttgcacc

SEQ ID NO: 779618 - DNA, 25 bp, Mus musculus
tagtaccgaggtaaacatccctgct

SEQ ID NO: 779619 - DNA, 25 bp, Mus musculus
tagtaccgaggttaacatccctgct

SEQ ID NO: 779620 - DNA, 25 bp, Mus musculus
tagtaccggtgtcctggtcggccaa

SEQ ID NO: 779621 - DNA, 25 bp, Mus musculus
tagtaccggtgtgctggtcggccaa

SEQ ID NO: 779622 - DNA, 25 bp, Mus musculus
tagtacctcctcatctgagacacag

SEQ ID NO: 779623 - DNA, 25 bp, Mus musculus
tagtacctcctcttctgagacacag

SEQ ID NO: 779624 - DNA, 25 bp, Mus musculus
tagtacctctgcatactccggcccc

SEQ ID NO: 779625 - DNA, 25 bp, Mus musculus
tagtacctctgcttactccggcccc

SEQ ID NO: 779626 - DNA, 25 bp, Mus musculus
tagtaccttctacagcacagtgggc

SEQ ID NO: 779627 - DNA, 25 bp, Mus musculus
tagtaccttctagagcacagtgggc

SEQ ID NO: 779628 - DNA, 25 bp, Mus musculus
tagtaccttgacctctaaagccaat

SEQ ID NO: 779629 - DNA, 25 bp, Mus musculus
tagtaccttgacgtctaaagccaat

SEQ ID NO: 779630 - DNA, 25 bp, Mus musculus
tagtacctttctcttgacggcgttt

SEQ ID NO: 779631 - DNA, 25 bp, Mus musculus
tagtacctttctgttgacggcgttt

SEQ ID NO: 779632 - DNA, 25 bp, Mus musculus
tagtacgagcataggactgagtcca

SEQ ID NO: 779633 - DNA, 25 bp, Mus musculus
tagtacgagcattggactgagtcca

SEQ ID NO: 779634 - DNA, 25 bp, Mus musculus
tagtacgggaacaactcagccggtc

SEQ ID NO: 779635 - DNA, 25 bp, Mus musculus
tagtacgggaactactcagccggtc

SEQ ID NO: 779636 - DNA, 25 bp, Mus musculus
tagtacgtacagattccggctttgg

SEQ ID NO: 779637 - DNA, 25 bp, Mus musculus
tagtacgtacagtttccggctttgg

SEQ ID NO: 779638 - DNA, 25 bp, Mus musculus
tagtacgtgtatctgttcccgtgcc

SEQ ID NO: 779639 - DNA, 25 bp, Mus musculus
tagtacgtgtatgtgttcccgtgcc

SEQ ID NO: 779640 - DNA, 25 bp, Mus musculus
tagtacgttcccattagaagtgaat

SEQ ID NO: 779641 - DNA, 25 bp, Mus musculus
tagtacgttccctttagaagtgaat

SEQ ID NO: 779642 - DNA, 25 bp, Mus musculus
tagtacgttcgtctggctgccacta

SEQ ID NO: 779643 - DNA, 25 bp, Mus musculus
tagtacgttcgtgtggctgccacta

SEQ ID NO: 779644 - DNA, 25 bp, Mus musculus
tagtactaaaggacctgcatattaa

SEQ ID NO: 779645 - DNA, 25 bp, Mus musculus
tagtactaaaggtcctgcatattaa

SEQ ID NO: 779646 - DNA, 25 bp, Mus musculus
tagtactcaattcttgtgtgcctac

SEQ ID NO: 779647 - DNA, 25 bp, Mus musculus
tagtactcaattgttgtgtgcctac

SEQ ID NO: 779648 - DNA, 25 bp, Mus musculus
tagtactcagacaactcatgtgtgg

SEQ ID NO: 779649 - DNA, 25 bp, Mus musculus
tagtactcagactactcatgtgtgg

SEQ ID NO: 779650 - DNA, 25 bp, Mus musculus
tagtactcatttcaaaggttggcac

SEQ ID NO: 779651 - DNA, 25 bp, Mus musculus
tagtactcatttgaaaggttggcac

SEQ ID NO: 779652 - DNA, 25 bp, Mus musculus
tagtactccggcctcattacggaac

SEQ ID NO: 779653 - DNA, 25 bp, Mus musculus
tagtactccggcgtcattacggaac

SEQ ID NO: 779654 - DNA, 25 bp, Mus musculus
tagtactctgtgagacctttcgaaa

SEQ ID NO: 779655 - DNA, 25 bp, Mus musculus
tagtactctgtgtgacctttcgaaa

SEQ ID NO: 779656 - DNA, 25 bp, Mus musculus
tagtactgaataatgtgatttctta

SEQ ID NO: 779657 - DNA, 25 bp, Mus musculus
tagtactgaatattgtgatttctta

SEQ ID NO: 779658 - DNA, 25 bp, Mus musculus
tagtactgcaagctgggctcggcta

SEQ ID NO: 779659 - DNA, 25 bp, Mus musculus
tagtactgcaaggtgggctcggcta

SEQ ID NO: 779660 - DNA, 25 bp, Mus musculus
tagtactgctatattttgggtctgt

SEQ ID NO: 779661 - DNA, 25 bp, Mus musculus
tagtactgctattttttgggtctgt

SEQ ID NO: 779662 - DNA, 25 bp, Mus musculus
tagtactgtactatgcttggaaaga

SEQ ID NO: 779663 - DNA, 25 bp, Mus musculus
tagtactgtactttgcttggaaaga

SEQ ID NO: 779664 - DNA, 25 bp, Mus musculus
tagtactgtcccacttttctgaacc

SEQ ID NO: 779665 - DNA, 25 bp, Mus musculus
tagtactgtccctcttttctgaacc

SEQ ID NO: 779666 - DNA, 25 bp, Mus musculus
tagtactgtgctagagggactcgcc

SEQ ID NO: 779667 - DNA, 25 bp, Mus musculus
tagtactgtgcttgagggactcgcc

SEQ ID NO: 779668 - DNA, 25 bp, Mus musculus
tagtacttacccacatttctagccc

SEQ ID NO: 779669 - DNA, 25 bp, Mus musculus
tagtacttaccctcatttctagccc

SEQ ID NO: 779670 - DNA, 25 bp, Mus musculus
tagtacttatcacatagccacaggt

SEQ ID NO: 779671 - DNA, 25 bp, Mus musculus
tagtacttatcagatagccacaggt

SEQ ID NO: 779672 - DNA, 25 bp, Mus musculus
tagtacttccacaggctcttccttt

SEQ ID NO: 779673 - DNA, 25 bp, Mus musculus
tagtacttccactggctcttccttt

SEQ ID NO: 779674 - DNA, 25 bp, Mus musculus
tagtactttattctgtgccacgtgg

SEQ ID NO: 779675 - DNA, 25 bp, Mus musculus
tagtactttattgtgtgccacgtgg

SEQ ID NO: 779676 - DNA, 25 bp, Mus musculus
tagtactttccccaagcgatggtgg

SEQ ID NO: 779677 - DNA, 25 bp, Mus musculus
tagtactttcccgaagcgatggtgg

SEQ ID NO: 779678 - DNA, 25 bp, Mus musculus
tagtactttcttatgcctcatggta

SEQ ID NO: 779679 - DNA, 25 bp, Mus musculus
tagtactttcttttgcctcatggta

SEQ ID NO: 779680 - DNA, 25 bp, Mus musculus
tagtacttttatatgcagatcctgt

SEQ ID NO: 779681 - DNA, 25 bp, Mus musculus
tagtacttttatttgcagatcctgt

SEQ ID NO: 779682 - DNA, 25 bp, Mus musculus
tagtagaacaatcctgtaatcccag

SEQ ID NO: 779683 - DNA, 25 bp, Mus musculus
tagtagaacaatgctgtaatcccag

SEQ ID NO: 779684 - DNA, 25 bp, Mus musculus
tagtagaatcttcattgctcgccga

SEQ ID NO: 779685 - DNA, 25 bp, Mus musculus
tagtagaatcttgattgctcgccga

SEQ ID NO: 779686 - DNA, 25 bp, Mus musculus
tagtagacccataatcttctagaat

SEQ ID NO: 779687 - DNA, 25 bp, Mus musculus
tagtagacccattatcttctagaat

SEQ ID NO: 779688 - DNA, 25 bp, Mus musculus
tagtagactgtgctgtatttggaac

SEQ ID NO: 779689 - DNA, 25 bp, Mus musculus
tagtagactgtggtgtatttggaac

SEQ ID NO: 779690 - DNA, 25 bp, Mus musculus
tagtagacttggatgcttaggagga

SEQ ID NO: 779691 - DNA, 25 bp, Mus musculus
tagtagacttggttgcttaggagga

SEQ ID NO: 779692 - DNA, 25 bp, Mus musculus
tagtagagcagaacttccctcaggc

SEQ ID NO: 779693 - DNA, 25 bp, Mus musculus
tagtagagcagatcttccctcaggc

SEQ ID NO: 779694 - DNA, 25 bp, Mus musculus
tagtagaggctcatagactgggcgt

SEQ ID NO: 779695 - DNA, 25 bp, Mus musculus
tagtagaggctcttagactgggcgt

SEQ ID NO: 779696 - DNA, 25 bp, Mus musculus
tagtagagtccgaatcgtcctcagc

SEQ ID NO: 779697 - DNA, 25 bp, Mus musculus
tagtagagtccgtatcgtcctcagc

SEQ ID NO: 779698 - DNA, 25 bp, Mus musculus
tagtagatacaaaccctcctggtct

SEQ ID NO: 779699 - DNA, 25 bp, Mus musculus
tagtagatacaatccctcctggtct

SEQ ID NO: 779700 - DNA, 25 bp, Mus musculus
tagtagatctgcatactaaaccttt

SEQ ID NO: 779701 - DNA, 25 bp, Mus musculus
tagtagatctgcttactaaaccttt

SEQ ID NO: 779702 - DNA, 25 bp, Mus musculus
tagtagatgaacagcttgatcttca

SEQ ID NO: 779703 - DNA, 25 bp, Mus musculus
tagtagatgaactgcttgatcttca

SEQ ID NO: 779704 - DNA, 25 bp, Mus musculus
tagtagatggatagccgccttacat

SEQ ID NO: 779705 - DNA, 25 bp, Mus musculus
tagtagatggattgccgccttacat

SEQ ID NO: 779706 - DNA, 25 bp, Mus musculus
tagtagcacacgagtaaggcacctg

SEQ ID NO: 779707 - DNA, 25 bp, Mus musculus
tagtagcacacgtgtaaggcacctg

SEQ ID NO: 779708 - DNA, 25 bp, Mus musculus
tagtagcacctactggtgtcacctt

SEQ ID NO: 779709 - DNA, 25 bp, Mus musculus
tagtagcacctagtggtgtcacctt

SEQ ID NO: 779710 - DNA, 25 bp, Mus musculus
tagtagcagaacacaccggtggaaa

SEQ ID NO: 779711 - DNA, 25 bp, Mus musculus
tagtagcagaactcaccggtggaaa

SEQ ID NO: 779712 - DNA, 25 bp, Mus musculus
tagtagcagccaaccatggatctgt

SEQ ID NO: 779713 - DNA, 25 bp, Mus musculus
tagtagcagccatccatggatctgt

SEQ ID NO: 779714 - DNA, 25 bp, Mus musculus
tagtagcaggccatatcgttcactc

SEQ ID NO: 779715 - DNA, 25 bp, Mus musculus
tagtagcaggccttatcgttcactc

SEQ ID NO: 779716 - DNA, 25 bp, Mus musculus
tagtagccaaggacgggcacctcta

SEQ ID NO: 779717 - DNA, 25 bp, Mus musculus
tagtagccaaggagacacacccgga

SEQ ID NO: 779718 - DNA, 25 bp, Mus musculus
tagtagccaaggtcgggcacctcta

SEQ ID NO: 779719 - DNA, 25 bp, Mus musculus
tagtagccaaggtgacacacccgga

SEQ ID NO: 779720 - DNA, 25 bp, Mus musculus
tagtagcccggcatgtttttggttt

SEQ ID NO: 779721 - DNA, 25 bp, Mus musculus
tagtagcccggcttgtttttggttt

SEQ ID NO: 779722 - DNA, 25 bp, Mus musculus
tagtagcctggcactgatagctgtt

SEQ ID NO: 779723 - DNA, 25 bp, Mus musculus
tagtagcctggctctgatagctgtt

SEQ ID NO: 779724 - DNA, 25 bp, Mus musculus
tagtagcgacagatgcccagggaga

SEQ ID NO: 779725 - DNA, 25 bp, Mus musculus
tagtagcgacagttgcccagggaga

SEQ ID NO: 779726 - DNA, 25 bp, Mus musculus
tagtagcgggccaggagcactacga

SEQ ID NO: 779727 - DNA, 25 bp, Mus musculus
tagtagcgggcctggagcactacga

SEQ ID NO: 779728 - DNA, 25 bp, Mus musculus
tagtagcgttggaaggacctgccat

SEQ ID NO: 779729 - DNA, 25 bp, Mus musculus
tagtagcgttggtaggacctgccat

SEQ ID NO: 779730 - DNA, 25 bp, Mus musculus
tagtagctagctccatgttcataac

SEQ ID NO: 779731 - DNA, 25 bp, Mus musculus
tagtagctagctgcatgttcataac

SEQ ID NO: 779732 - DNA, 25 bp, Mus musculus
tagtagctattacaaggactgtgtc

SEQ ID NO: 779733 - DNA, 25 bp, Mus musculus
tagtagctattagaaggactgtgtc

SEQ ID NO: 779734 - DNA, 25 bp, Mus musculus
tagtagctccagaacccagcttgct

SEQ ID NO: 779735 - DNA, 25 bp, Mus musculus
tagtagctccagtacccagcttgct

SEQ ID NO: 779736 - DNA, 25 bp, Mus musculus
tagtagctccatcaaaggtcaccgc

SEQ ID NO: 779737 - DNA, 25 bp, Mus musculus
tagtagctccatgaaaggtcaccgc

SEQ ID NO: 779738 - DNA, 25 bp, Mus musculus
tagtagctctatcgtttgtctgaac

SEQ ID NO: 779739 - DNA, 25 bp, Mus musculus
tagtagctctatggtttgtctgaac

SEQ ID NO: 779740 - DNA, 25 bp, Mus musculus
tagtagctggagctccctgctcagt

SEQ ID NO: 779741 - DNA, 25 bp, Mus musculus
tagtagctggaggtccctgctcagt

SEQ ID NO: 779742 - DNA, 25 bp, Mus musculus
tagtagctggccatttcatgcttgg

SEQ ID NO: 779743 - DNA, 25 bp, Mus musculus
tagtagctggccttttcatgcttgg

SEQ ID NO: 779744 - DNA, 25 bp, Mus musculus
tagtagctgtccaactgactgtggg

SEQ ID NO: 779745 - DNA, 25 bp, Mus musculus
tagtagctgtcctactgactgtggg

SEQ ID NO: 779746 - DNA, 25 bp, Mus musculus
tagtagcttccaagggcattgccaa

SEQ ID NO: 779747 - DNA, 25 bp, Mus musculus
tagtagcttccatgggcattgccaa

SEQ ID NO: 779748 - DNA, 25 bp, Mus musculus
tagtagcttgatagctggattccta

SEQ ID NO: 779749 - DNA, 25 bp, Mus musculus
tagtagcttgattgctggattccta

SEQ ID NO: 779750 - DNA, 25 bp, Mus musculus
tagtagctttatctggcctgttttt

SEQ ID NO: 779751 - DNA, 25 bp, Mus musculus
tagtagctttatgtggcctgttttt

SEQ ID NO: 779752 - DNA, 25 bp, Mus musculus
tagtaggactagactcgggccacat

SEQ ID NO: 779753 - DNA, 25 bp, Mus musculus
tagtaggactagtctcgggccacat

SEQ ID NO: 779754 - DNA, 25 bp, Mus musculus
tagtaggcaggaaccacgtccctat

SEQ ID NO: 779755 - DNA, 25 bp, Mus musculus
tagtaggcaggatccacgtccctat

SEQ ID NO: 779756 - DNA, 25 bp, Mus musculus
tagtaggcctaaagatagcagtgat

SEQ ID NO: 779757 - DNA, 25 bp, Mus musculus
tagtaggcctaatgatagcagtgat

SEQ ID NO: 779758 - DNA, 25 bp, Mus musculus
tagtaggcctggatctgttgctttc

SEQ ID NO: 779759 - DNA, 25 bp, Mus musculus
tagtaggcctggttctgttgctttc

SEQ ID NO: 779760 - DNA, 25 bp, Mus musculus
tagtagggaattactttgctctttc

SEQ ID NO: 779761 - DNA, 25 bp, Mus musculus
tagtagggaatttctttgctctttc

SEQ ID NO: 779762 - DNA, 25 bp, Mus musculus
tagtagggagcaagcttagacgctt

SEQ ID NO: 779763 - DNA, 25 bp, Mus musculus
tagtagggagcatgcttagacgctt

SEQ ID NO: 779764 - DNA, 25 bp, Mus musculus
tagtagggcccgagactagcagctc

SEQ ID NO: 779765 - DNA, 25 bp, Mus musculus
tagtagggcccgtgactagcagctc

SEQ ID NO: 779766 - DNA, 25 bp, Mus musculus
tagtagggctcaaaagatccccacc

SEQ ID NO: 779767 - DNA, 25 bp, Mus musculus
tagtagggctcataagatccccacc

SEQ ID NO: 779768 - DNA, 25 bp, Mus musculus
tagtagggcttaccctgaaaacagc

SEQ ID NO: 779769 - DNA, 25 bp, Mus musculus
tagtagggcttagcctgaaaacagc

SEQ ID NO: 779770 - DNA, 25 bp, Mus musculus
tagtagggtccaccttaaaatcgct

SEQ ID NO: 779771 - DNA, 25 bp, Mus musculus
tagtagggtccagcttaaaatcgct

SEQ ID NO: 779772 - DNA, 25 bp, Mus musculus
tagtaggtaccacctagtgctgtgg

SEQ ID NO: 779773 - DNA, 25 bp, Mus musculus
tagtaggtaccagctagtgctgtgg

SEQ ID NO: 779774 - DNA, 25 bp, Mus musculus
tagtaggtagatcgtgctctgtctg

SEQ ID NO: 779775 - DNA, 25 bp, Mus musculus
tagtaggtagatggtgctctgtctg

SEQ ID NO: 779776 - DNA, 25 bp, Mus musculus
tagtaggtccacatcatttgcaggt

SEQ ID NO: 779777 - DNA, 25 bp, Mus musculus
tagtaggtccacttcatttgcaggt

SEQ ID NO: 779778 - DNA, 25 bp, Mus musculus
tagtaggtgccactcgattggttcc

SEQ ID NO: 779779 - DNA, 25 bp, Mus musculus
tagtaggtgccagtcgattggttcc

SEQ ID NO: 779780 - DNA, 25 bp, Mus musculus
tagtaggttctgcttcagctgcagg

SEQ ID NO: 779781 - DNA, 25 bp, Mus musculus
tagtaggttctggttcagctgcagg

SEQ ID NO: 779782 - DNA, 25 bp, Mus musculus
tagtagtaaaagacccagcccaaag

SEQ ID NO: 779783 - DNA, 25 bp, Mus musculus
tagtagtaaaagtcccagcccaaag

SEQ ID NO: 779784 - DNA, 25 bp, Mus musculus
tagtagtactgtccttcagctgcca

SEQ ID NO: 779785 - DNA, 25 bp, Mus musculus
tagtagtactgtgcttcagctgcca

SEQ ID NO: 779786 - DNA, 25 bp, Mus musculus
tagtagtagctgcatgggcttcacg

SEQ ID NO: 779787 - DNA, 25 bp, Mus musculus
tagtagtagctggatgggcttcacg

SEQ ID NO: 779788 - DNA, 25 bp, Mus musculus
tagtagtatagtatcctgacctaac

SEQ ID NO: 779789 - DNA, 25 bp, Mus musculus
tagtagtatagtttcctgacctaac

SEQ ID NO: 779790 - DNA, 25 bp, Mus musculus
tagtagtatatccaaccattgatta

SEQ ID NO: 779791 - DNA, 25 bp, Mus musculus
tagtagtatatccaagcatttaata

SEQ ID NO: 779792 - DNA, 25 bp, Mus musculus
tagtagtatatcgaaccattgatta

SEQ ID NO: 779793 - DNA, 25 bp, Mus musculus
tagtagtatatcgaagcatttaata

SEQ ID NO: 779794 - DNA, 25 bp, Mus musculus
tagtagtcacttcacctcggtgagt

SEQ ID NO: 779795 - DNA, 25 bp, Mus musculus
tagtagtcacttgacctcggtgagt

SEQ ID NO: 779796 - DNA, 25 bp, Mus musculus
tagtagtccacaattgagccaactt

SEQ ID NO: 779797 - DNA, 25 bp, Mus musculus
tagtagtccacaccttcaaactcaa

SEQ ID NO: 779798 - DNA, 25 bp, Mus musculus
tagtagtccacagcttcaaactcaa

SEQ ID NO: 779799 - DNA, 25 bp, Mus musculus
tagtagtccacatttgagccaactt

SEQ ID NO: 779800 - DNA, 25 bp, Mus musculus
tagtagtcctataatcttaaccctt

SEQ ID NO: 779801 - DNA, 25 bp, Mus musculus
tagtagtcctattatcttaaccctt

SEQ ID NO: 779802 - DNA, 25 bp, Mus musculus
tagtagtcctggattgattcaaaaa

SEQ ID NO: 779803 - DNA, 25 bp, Mus musculus
tagtagtcctggtttgattcaaaaa

SEQ ID NO: 779804 - DNA, 25 bp, Mus musculus
tagtagtcgccactgcggctccttt

SEQ ID NO: 779805 - DNA, 25 bp, Mus musculus
tagtagtcgccagtgcggctccttt

SEQ ID NO: 779806 - DNA, 25 bp, Mus musculus
tagtagtctcctacaggactcttag

SEQ ID NO: 779807 - DNA, 25 bp, Mus musculus
tagtagtctccttcaggactcttag

SEQ ID NO: 779808 - DNA, 25 bp, Mus musculus
tagtagtgacttaccccacaggatg

SEQ ID NO: 779809 - DNA, 25 bp, Mus musculus
tagtagtgactttccccacaggatg

SEQ ID NO: 779810 - DNA, 25 bp, Mus musculus
tagtagtgggcactataccgcatct

SEQ ID NO: 779811 - DNA, 25 bp, Mus musculus
tagtagtgggcagtataccgcatct

SEQ ID NO: 779812 - DNA, 25 bp, Mus musculus
tagtagtgtacgacagtgttctctg

SEQ ID NO: 779813 - DNA, 25 bp, Mus musculus
tagtagtgtacgtcagtgttctctg

SEQ ID NO: 779814 - DNA, 25 bp, Mus musculus
tagtagttaattcaccatggtagtt

SEQ ID NO: 779815 - DNA, 25 bp, Mus musculus
tagtagttaattgaccatggtagtt

SEQ ID NO: 779816 - DNA, 25 bp, Mus musculus
tagtagttcttgaagcagcttgcaa

SEQ ID NO: 779817 - DNA, 25 bp, Mus musculus
tagtagttcttgtagcagcttgcaa

SEQ ID NO: 779818 - DNA, 25 bp, Mus musculus
tagtagtttattccctttccttgat

SEQ ID NO: 779819 - DNA, 25 bp, Mus musculus
tagtagtttattgcctttccttgat

SEQ ID NO: 779820 - DNA, 25 bp, Mus musculus
tagtagtttctaacatatgctttat

SEQ ID NO: 779821 - DNA, 25 bp, Mus musculus
tagtagtttctatcatatgctttat

SEQ ID NO: 779822 - DNA, 25 bp, Mus musculus
tagtagtttgccatcttcttaacaa

SEQ ID NO: 779823 - DNA, 25 bp, Mus musculus
tagtagtttgccttcttcttaacaa

SEQ ID NO: 779824 - DNA, 25 bp, Mus musculus
tagtataaagtcctagctctggttg

SEQ ID NO: 779825 - DNA, 25 bp, Mus musculus
tagtataaagtcgtagctctggttg

SEQ ID NO: 779826 - DNA, 25 bp, Mus musculus
tagtataacagcctcagccactttg

SEQ ID NO: 779827 - DNA, 25 bp, Mus musculus
tagtataacagcgtcagccactttg

SEQ ID NO: 779828 - DNA, 25 bp, Mus musculus
tagtataatgaaacccatgtgcttg

SEQ ID NO: 779829 - DNA, 25 bp, Mus musculus
tagtataatgaatcccatgtgcttg

SEQ ID NO: 779830 - DNA, 25 bp, Mus musculus
tagtatactgaacccttctctctgc

SEQ ID NO: 779831 - DNA, 25 bp, Mus musculus
tagtatactgaagccttctctctgc

SEQ ID NO: 779832 - DNA, 25 bp, Mus musculus
tagtatagtcacatacatctgcccc

SEQ ID NO: 779833 - DNA, 25 bp, Mus musculus
tagtatagtcacttacatctgcccc

SEQ ID NO: 779834 - DNA, 25 bp, Mus musculus
tagtatatctcaaaccatcctgcca

SEQ ID NO: 779835 - DNA, 25 bp, Mus musculus
tagtatatctcataccatcctgcca

SEQ ID NO: 779836 - DNA, 25 bp, Mus musculus
tagtatatggaccatcaggtgctgg

SEQ ID NO: 779837 - DNA, 25 bp, Mus musculus
tagtatatggacgatcaggtgctgg

SEQ ID NO: 779838 - DNA, 25 bp, Mus musculus
tagtatatgtaaaggtgtccaataa

SEQ ID NO: 779839 - DNA, 25 bp, Mus musculus
tagtatatgtaatggtgtccaataa

SEQ ID NO: 779840 - DNA, 25 bp, Mus musculus
tagtatatgtgaacaccttcctgtt

SEQ ID NO: 779841 - DNA, 25 bp, Mus musculus
tagtatatgtgatcaccttcctgtt

SEQ ID NO: 779842 - DNA, 25 bp, Mus musculus
tagtatcacagaccaccaagagcct

SEQ ID NO: 779843 - DNA, 25 bp, Mus musculus
tagtatcacagagcaccaagagcct

SEQ ID NO: 779844 - DNA, 25 bp, Mus musculus
tagtatcagtttccctattggtacg

SEQ ID NO: 779845 - DNA, 25 bp, Mus musculus
tagtatcagtttgcctattggtacg

SEQ ID NO: 779846 - DNA, 25 bp, Mus musculus
tagtatcccgctacacgcctgtgaa

SEQ ID NO: 779847 - DNA, 25 bp, Mus musculus
tagtatcccgcttcacgcctgtgaa

SEQ ID NO: 779848 - DNA, 25 bp, Mus musculus
tagtatccctaacgcctgttgtgtc

SEQ ID NO: 779849 - DNA, 25 bp, Mus musculus
tagtatccctaaggcctgttgtgtc

SEQ ID NO: 779850 - DNA, 25 bp, Mus musculus
tagtatccctttaaaacaggaagcg

SEQ ID NO: 779851 - DNA, 25 bp, Mus musculus
tagtatcccttttaaacaggaagcg

SEQ ID NO: 779852 - DNA, 25 bp, Mus musculus
tagtatcctcttagcaccatgttct

SEQ ID NO: 779853 - DNA, 25 bp, Mus musculus
tagtatcctctttgcaccatgttct

SEQ ID NO: 779854 - DNA, 25 bp, Mus musculus
tagtatcggcttactgcccttgcaa

SEQ ID NO: 779855 - DNA, 25 bp, Mus musculus
tagtatcggctttctgcccttgcaa

SEQ ID NO: 779856 - DNA, 25 bp, Mus musculus
tagtatcgtggcagttcttcaggca

SEQ ID NO: 779857 - DNA, 25 bp, Mus musculus
tagtatcgtggctgttcttcaggca

SEQ ID NO: 779858 - DNA, 25 bp, Mus musculus
tagtatctaagcaaccgagccggat

SEQ ID NO: 779859 - DNA, 25 bp, Mus musculus
tagtatctaagctaccgagccggat

SEQ ID NO: 779860 - DNA, 25 bp, Mus musculus
tagtatctacttacaaccgggccct

SEQ ID NO: 779861 - DNA, 25 bp, Mus musculus
tagtatctactttcaaccgggccct

SEQ ID NO: 779862 - DNA, 25 bp, Mus musculus
tagtatctcaggacttagtagcata

SEQ ID NO: 779863 - DNA, 25 bp, Mus musculus
tagtatctcaggtcttagtagcata

SEQ ID NO: 779864 - DNA, 25 bp, Mus musculus
tagtatctcagtcttcattcttctt

SEQ ID NO: 779865 - DNA, 25 bp, Mus musculus
tagtatctcagtgttcattcttctt

SEQ ID NO: 779866 - DNA, 25 bp, Mus musculus
tagtatcttgccctcagtccaaaca

SEQ ID NO: 779867 - DNA, 25 bp, Mus musculus
tagtatcttgccgtcagtccaaaca

SEQ ID NO: 779868 - DNA, 25 bp, Mus musculus
tagtatcttgttcttttacctcaaa

SEQ ID NO: 779869 - DNA, 25 bp, Mus musculus
tagtatcttgttgttttacctcaaa

SEQ ID NO: 779870 - DNA, 25 bp, Mus musculus
tagtatgaacggcttcttcatcccc

SEQ ID NO: 779871 - DNA, 25 bp, Mus musculus
tagtatgaacgggttcttcatcccc

SEQ ID NO: 779872 - DNA, 25 bp, Mus musculus
tagtatgagacacccatttcctcct

SEQ ID NO: 779873 - DNA, 25 bp, Mus musculus
tagtatgagacagccatttcctcct

SEQ ID NO: 779874 - DNA, 25 bp, Mus musculus
tagtatgagcctagggccacaggga

SEQ ID NO: 779875 - DNA, 25 bp, Mus musculus
tagtatgagccttgggccacaggga

SEQ ID NO: 779876 - DNA, 25 bp, Mus musculus
tagtatgatatgattgacgctccaa

SEQ ID NO: 779877 - DNA, 25 bp, Mus musculus
tagtatgatatgtttgacgctccaa

SEQ ID NO: 779878 - DNA, 25 bp, Mus musculus
tagtatgcaataactacctccagtg

SEQ ID NO: 779879 - DNA, 25 bp, Mus musculus
tagtatgcaatatctacctccagtg

SEQ ID NO: 779880 - DNA, 25 bp, Mus musculus
tagtatgcactaccctcgcatcagc

SEQ ID NO: 779881 - DNA, 25 bp, Mus musculus
tagtatgcactagcctcgcatcagc

SEQ ID NO: 779882 - DNA, 25 bp, Mus musculus
tagtatgccaagaatctgtctatga

SEQ ID NO: 779883 - DNA, 25 bp, Mus musculus
tagtatgccaagtatctgtctatga

SEQ ID NO: 779884 - DNA, 25 bp, Mus musculus
tagtatgccactacagacagacctg

SEQ ID NO: 779885 - DNA, 25 bp, Mus musculus
tagtatgccacttcagacagacctg

SEQ ID NO: 779886 - DNA, 25 bp, Mus musculus
tagtatgctcatagtcgggtggacc

SEQ ID NO: 779887 - DNA, 25 bp, Mus musculus
tagtatgctcattgtcgggtggacc

SEQ ID NO: 779888 - DNA, 25 bp, Mus musculus
tagtatgctgctcaagtttcttttt

SEQ ID NO: 779889 - DNA, 25 bp, Mus musculus
tagtatgctgctgaagtttcttttt

SEQ ID NO: 779890 - DNA, 25 bp, Mus musculus
tagtatggcagacgtgttggctcac

SEQ ID NO: 779891 - DNA, 25 bp, Mus musculus
tagtatggcagaggtgttggctcac

SEQ ID NO: 779892 - DNA, 25 bp, Mus musculus
tagtatgtgccaatatagccaagat

SEQ ID NO: 779893 - DNA, 25 bp, Mus musculus
tagtatgtgccattatagccaagat

SEQ ID NO: 779894 - DNA, 25 bp, Mus musculus
tagtatgttgagcagcgtcgtcacc

SEQ ID NO: 779895 - DNA, 25 bp, Mus musculus
tagtatgttgaggagcgtcgtcacc

SEQ ID NO: 779896 - DNA, 25 bp, Mus musculus
tagtatgtttctcagtggtctctcc

SEQ ID NO: 779897 - DNA, 25 bp, Mus musculus
tagtatgtttctgagtggtctctcc

SEQ ID NO: 779898 - DNA, 25 bp, Mus musculus
tagtattactatatgggccactacg

SEQ ID NO: 779899 - DNA, 25 bp, Mus musculus
tagtattactatttgggccactacg

SEQ ID NO: 779900 - DNA, 25 bp, Mus musculus
tagtattactttccaaaccttgggt

SEQ ID NO: 779901 - DNA, 25 bp, Mus musculus
tagtattactttgcaaaccttgggt

SEQ ID NO: 779902 - DNA, 25 bp, Mus musculus
tagtattcagctctcttgagacccg

SEQ ID NO: 779903 - DNA, 25 bp, Mus musculus
tagtattcagctgtcttgagacccg

SEQ ID NO: 779904 - DNA, 25 bp, Mus musculus
tagtattcaggtcacaagcccttcg

SEQ ID NO: 779905 - DNA, 25 bp, Mus musculus
tagtattcaggtgacaagcccttcg

SEQ ID NO: 779906 - DNA, 25 bp, Mus musculus
tagtattcatctcctgacactggct

SEQ ID NO: 779907 - DNA, 25 bp, Mus musculus
tagtattcatctgctgacactggct

SEQ ID NO: 779908 - DNA, 25 bp, Mus musculus
tagtattcgtagatggccaagcccc

SEQ ID NO: 779909 - DNA, 25 bp, Mus musculus
tagtattcgtagttggccaagcccc

SEQ ID NO: 779910 - DNA, 25 bp, Mus musculus
tagtattctcagaacatttccagta

SEQ ID NO: 779911 - DNA, 25 bp, Mus musculus
tagtattctcagtacatttccagta

SEQ ID NO: 779912 - DNA, 25 bp, Mus musculus
tagtattgtcacatctttatagaga

SEQ ID NO: 779913 - DNA, 25 bp, Mus musculus
tagtattgtcacttctttatagaga

SEQ ID NO: 779914 - DNA, 25 bp, Mus musculus
tagtatttacagctggcttctttta

SEQ ID NO: 779915 - DNA, 25 bp, Mus musculus
tagtatttacaggtggcttctttta

SEQ ID NO: 779916 - DNA, 25 bp, Mus musculus
tagtatttatttccctatacccaag

SEQ ID NO: 779917 - DNA, 25 bp, Mus musculus
tagtatttatttgcctatacccaag

SEQ ID NO: 779918 - DNA, 25 bp, Mus musculus
tagtatttcacgaatctgtgaccaa

SEQ ID NO: 779919 - DNA, 25 bp, Mus musculus
tagtatttcacgtatctgtgaccaa

SEQ ID NO: 779920 - DNA, 25 bp, Mus musculus
tagtatttcataacagcacatcaat

SEQ ID NO: 779921 - DNA, 25 bp, Mus musculus
tagtatttcatatcagcacatcaat

SEQ ID NO: 779922 - DNA, 25 bp, Mus musculus
tagtatttccaccactccttttgaa

SEQ ID NO: 779923 - DNA, 25 bp, Mus musculus
tagtatttccacgactccttttgaa

SEQ ID NO: 779924 - DNA, 25 bp, Mus musculus
tagtatttcctcactagtctcatca

SEQ ID NO: 779925 - DNA, 25 bp, Mus musculus
tagtatttcctctctagtctcatca

SEQ ID NO: 779926 - DNA, 25 bp, Mus musculus
tagtatttgagcagtaccacccacc

SEQ ID NO: 779927 - DNA, 25 bp, Mus musculus
tagtatttgagctgtaccacccacc

SEQ ID NO: 779928 - DNA, 25 bp, Mus musculus
tagtatttgcatatcctactgcctg

SEQ ID NO: 779929 - DNA, 25 bp, Mus musculus
tagtatttgcatttcctactgcctg

SEQ ID NO: 779930 - DNA, 25 bp, Mus musculus
tagtatttgttaattcttccgttct

SEQ ID NO: 779931 - DNA, 25 bp, Mus musculus
tagtatttgttatttcttccgttct

SEQ ID NO: 779932 - DNA, 25 bp, Mus musculus
tagtattttactcactagccttttt

SEQ ID NO: 779933 - DNA, 25 bp, Mus musculus
tagtattttactgactagccttttt

SEQ ID NO: 779934 - DNA, 25 bp, Mus musculus
tagtattttcagaccgttccccact

SEQ ID NO: 779935 - DNA, 25 bp, Mus musculus
tagtattttcagtccgttccccact

SEQ ID NO: 779936 - DNA, 25 bp, Mus musculus
tagtattttctcactacttcctctt

SEQ ID NO: 779937 - DNA, 25 bp, Mus musculus
tagtattttctctctacttcctctt

SEQ ID NO: 779938 - DNA, 25 bp, Mus musculus
tagtattttgatagtgttccaccag

SEQ ID NO: 779939 - DNA, 25 bp, Mus musculus
tagtattttgattgtgttccaccag

SEQ ID NO: 779940 - DNA, 25 bp, Mus musculus
tagtcaaaaagtcccgagctaggaa

SEQ ID NO: 779941 - DNA, 25 bp, Mus musculus
tagtcaaaaagtgccgagctaggaa

SEQ ID NO: 779942 - DNA, 25 bp, Mus musculus
tagtcaaaacggacttaggccattt

SEQ ID NO: 779943 - DNA, 25 bp, Mus musculus
tagtcaaaacggtcttaggccattt

SEQ ID NO: 779944 - DNA, 25 bp, Mus musculus
tagtcaaacagaacctgtcccgggc

SEQ ID NO: 779945 - DNA, 25 bp, Mus musculus
tagtcaaacagatcctgtcccgggc

SEQ ID NO: 779946 - DNA, 25 bp, Mus musculus
tagtcaaactccaagcccaaagaac

SEQ ID NO: 779947 - DNA, 25 bp, Mus musculus
tagtcaaactcctagcccaaagaac

SEQ ID NO: 779948 - DNA, 25 bp, Mus musculus
tagtcaaagggcaatgcagctttaa

SEQ ID NO: 779949 - DNA, 25 bp, Mus musculus
tagtcaaagggctatgcagctttaa

SEQ ID NO: 779950 - DNA, 25 bp, Mus musculus
tagtcaaatccacagcctagtctgc

SEQ ID NO: 779951 - DNA, 25 bp, Mus musculus
tagtcaaatccagagcctagtctgc

SEQ ID NO: 779952 - DNA, 25 bp, Mus musculus
tagtcaacatcaaatccctgggctt

SEQ ID NO: 779953 - DNA, 25 bp, Mus musculus
tagtcaacatcatatccctgggctt

SEQ ID NO: 779954 - DNA, 25 bp, Mus musculus
tagtcaacatttactggttcttcag

SEQ ID NO: 779955 - DNA, 25 bp, Mus musculus
tagtcaacattttctggttcttcag

SEQ ID NO: 779956 - DNA, 25 bp, Mus musculus
tagtcaacctttccctagcagatgt

SEQ ID NO: 779957 - DNA, 25 bp, Mus musculus
tagtcaacctttgcctagcagatgt

SEQ ID NO: 779958 - DNA, 25 bp, Mus musculus
tagtcaactactaggatctcctaaa

SEQ ID NO: 779959 - DNA, 25 bp, Mus musculus
tagtcaactacttggatctcctaaa

SEQ ID NO: 779960 - DNA, 25 bp, Mus musculus
tagtcaacttgcaatacttccccaa

SEQ ID NO: 779961 - DNA, 25 bp, Mus musculus
tagtcaacttgccagtctctctcgg

SEQ ID NO: 779962 - DNA, 25 bp, Mus musculus
tagtcaacttgcgagtctctctcgg

SEQ ID NO: 779963 - DNA, 25 bp, Mus musculus
tagtcaacttgctatacttccccaa

SEQ ID NO: 779964 - DNA, 25 bp, Mus musculus
tagtcaagagttaatatttaccctg

SEQ ID NO: 779965 - DNA, 25 bp, Mus musculus
tagtcaagagtttatatttaccctg

SEQ ID NO: 779966 - DNA, 25 bp, Mus musculus
tagtcaagcatcatcctgaattccg

SEQ ID NO: 779967 - DNA, 25 bp, Mus musculus
tagtcaagcatcttcctgaattccg

SEQ ID NO: 779968 - DNA, 25 bp, Mus musculus
tagtcaagccgcagacagtcttcag

SEQ ID NO: 779969 - DNA, 25 bp, Mus musculus
tagtcaagccgctgacagtcttcag

SEQ ID NO: 779970 - DNA, 25 bp, Mus musculus
tagtcaaggaagacacccagggtga

SEQ ID NO: 779971 - DNA, 25 bp, Mus musculus
tagtcaaggaagtcacccagggtga

SEQ ID NO: 779972 - DNA, 25 bp, Mus musculus
tagtcaaggcacatcaatgcttcag

SEQ ID NO: 779973 - DNA, 25 bp, Mus musculus
tagtcaaggcacttcaatgcttcag

SEQ ID NO: 779974 - DNA, 25 bp, Mus musculus
tagtcaaggtcacaggcagctgttc

SEQ ID NO: 779975 - DNA, 25 bp, Mus musculus
tagtcaaggtcagaggcagctgttc

SEQ ID NO: 779976 - DNA, 25 bp, Mus musculus
tagtcaagtatcattgatctccaaa

SEQ ID NO: 779977 - DNA, 25 bp, Mus musculus
tagtcaagtatctttgatctccaaa

SEQ ID NO: 779978 - DNA, 25 bp, Mus musculus
tagtcaagtggcctaccaagtttta

SEQ ID NO: 779979 - DNA, 25 bp, Mus musculus
tagtcaagtggcgtaccaagtttta

SEQ ID NO: 779980 - DNA, 25 bp, Mus musculus
tagtcaattctgcagcttacccgaa

SEQ ID NO: 779981 - DNA, 25 bp, Mus musculus
tagtcaattctggagcttacccgaa

SEQ ID NO: 779982 - DNA, 25 bp, Mus musculus
tagtcacaaaagatcccctttcaat

SEQ ID NO: 779983 - DNA, 25 bp, Mus musculus
tagtcacaaaagttcccctttcaat

SEQ ID NO: 779984 - DNA, 25 bp, Mus musculus
tagtcacaatatagccacggtttat

SEQ ID NO: 779985 - DNA, 25 bp, Mus musculus
tagtcacaatattgccacggtttat

SEQ ID NO: 779986 - DNA, 25 bp, Mus musculus
tagtcacaggagaggtgctgccttt

SEQ ID NO: 779987 - DNA, 25 bp, Mus musculus
tagtcacaggagtggtgctgccttt

SEQ ID NO: 779988 - DNA, 25 bp, Mus musculus
tagtcacagggaaccacacagagat

SEQ ID NO: 779989 - DNA, 25 bp, Mus musculus
tagtcacagggatccacacagagat

SEQ ID NO: 779990 - DNA, 25 bp, Mus musculus
tagtcacagtccatcacactaggaa

SEQ ID NO: 779991 - DNA, 25 bp, Mus musculus
tagtcacagtccttcacactaggaa

SEQ ID NO: 779992 - DNA, 25 bp, Mus musculus
tagtcacatgggaataaagattcgg

SEQ ID NO: 779993 - DNA, 25 bp, Mus musculus
tagtcacatgggtataaagattcgg

SEQ ID NO: 779994 - DNA, 25 bp, Mus musculus
tagtcacattccaatcagcagcagc

SEQ ID NO: 779995 - DNA, 25 bp, Mus musculus
tagtcacattcctatcagcagcagc

SEQ ID NO: 779996 - DNA, 25 bp, Mus musculus
tagtcaccagcgaacacgcctttaa

SEQ ID NO: 779997 - DNA, 25 bp, Mus musculus
tagtcaccagcgtacacgcctttaa

SEQ ID NO: 779998 - DNA, 25 bp, Mus musculus
tagtcaccatgtcactgagcagtgt

SEQ ID NO: 779999 - DNA, 25 bp, Mus musculus
tagtcaccatgtgactgagcagtgt

SEQ ID NO: 780000 - DNA, 25 bp, Mus musculus
tagtcaccctggagcatgagatgta

SEQ ID NO: 780001 - DNA, 25 bp, Mus musculus
tagtcaccctggtgcatgagatgta

SEQ ID NO: 780002 - DNA, 25 bp, Mus musculus
tagtcaccgtatatatgtctttttt

SEQ ID NO: 780003 - DNA, 25 bp, Mus musculus
tagtcaccgtatttatgtctttttt

SEQ ID NO: 780004 - DNA, 25 bp, Mus musculus
tagtcacctaatactccacatggag

SEQ ID NO: 780005 - DNA, 25 bp, Mus musculus
tagtcacctaattctccacatggag

SEQ ID NO: 780006 - DNA, 25 bp, Mus musculus
tagtcacctataaaacacacccatg

SEQ ID NO: 780007 - DNA, 25 bp, Mus musculus
tagtcacctatataacacacccatg

SEQ ID NO: 780008 - DNA, 25 bp, Mus musculus
tagtcacctgaaagctctatggcct

SEQ ID NO: 780009 - DNA, 25 bp, Mus musculus
tagtcacctgaatgctctatggcct

SEQ ID NO: 780010 - DNA, 25 bp, Mus musculus
tagtcacgacccagttctacatagg

SEQ ID NO: 780011 - DNA, 25 bp, Mus musculus
tagtcacgaccctgttctacatagg

SEQ ID NO: 780012 - DNA, 25 bp, Mus musculus
tagtcacgccttaagctttggttgt

SEQ ID NO: 780013 - DNA, 25 bp, Mus musculus
tagtcacgcctttagctttggttgt

SEQ ID NO: 780014 - DNA, 25 bp, Mus musculus
tagtcacggcatactgctgaggcat

SEQ ID NO: 780015 - DNA, 25 bp, Mus musculus
tagtcacggcattctgctgaggcat

SEQ ID NO: 780016 - DNA, 25 bp, Mus musculus
tagtcacgtattcctctgtccaagc

SEQ ID NO: 780017 - DNA, 25 bp, Mus musculus
tagtcacgtattgctctgtccaagc

SEQ ID NO: 780018 - DNA, 25 bp, Mus musculus
tagtcactacagagccctcaaaggg

SEQ ID NO: 780019 - DNA, 25 bp, Mus musculus
tagtcactacagtgccctcaaaggg

SEQ ID NO: 780020 - DNA, 25 bp, Mus musculus
tagtcactaggccaccagtgttcct

SEQ ID NO: 780021 - DNA, 25 bp, Mus musculus
tagtcactaggcgaccagtgttcct

SEQ ID NO: 780022 - DNA, 25 bp, Mus musculus
tagtcactcactatgtttattctcc

SEQ ID NO: 780023 - DNA, 25 bp, Mus musculus
tagtcactcactttgtttattctcc

SEQ ID NO: 780024 - DNA, 25 bp, Mus musculus
tagtcactcagtcgcttgatatggg

SEQ ID NO: 780025 - DNA, 25 bp, Mus musculus
tagtcactcagtggcttgatatggg

SEQ ID NO: 780026 - DNA, 25 bp, Mus musculus
tagtcactcttgattgtggctttta

SEQ ID NO: 780027 - DNA, 25 bp, Mus musculus
tagtcactcttgtttgtggctttta

SEQ ID NO: 780028 - DNA, 25 bp, Mus musculus
tagtcactgatactctactccctgg

SEQ ID NO: 780029 - DNA, 25 bp, Mus musculus
tagtcactgatagtctactccctgg

SEQ ID NO: 780030 - DNA, 25 bp, Mus musculus
tagtcactgatcacatcgctacaac

SEQ ID NO: 780031 - DNA, 25 bp, Mus musculus
tagtcactgatctcatcgctacaac

SEQ ID NO: 780032 - DNA, 25 bp, Mus musculus
tagtcactgcggactcctcacgaat

SEQ ID NO: 780033 - DNA, 25 bp, Mus musculus
tagtcactgcggtctcctcacgaat

SEQ ID NO: 780034 - DNA, 25 bp, Mus musculus
tagtcactgtagctgctggcagaca

SEQ ID NO: 780035 - DNA, 25 bp, Mus musculus
tagtcactgtaggtgctggcagaca

SEQ ID NO: 780036 - DNA, 25 bp, Mus musculus
tagtcacttactctaacaacaccca

SEQ ID NO: 780037 - DNA, 25 bp, Mus musculus
tagtcacttactgtaacaacaccca

SEQ ID NO: 780038 - DNA, 25 bp, Mus musculus
tagtcacttgtgagaatcccaattc

SEQ ID NO: 780039 - DNA, 25 bp, Mus musculus
tagtcacttgtgtgaatcccaattc

SEQ ID NO: 780040 - DNA, 25 bp, Mus musculus
tagtcacttgttctcactcctagag

SEQ ID NO: 780041 - DNA, 25 bp, Mus musculus
tagtcacttgttgtcactcctagag

SEQ ID NO: 780042 - DNA, 25 bp, Mus musculus
tagtcagaagacaggcatccataga

SEQ ID NO: 780043 - DNA, 25 bp, Mus musculus
tagtcagaagactggcatccataga

SEQ ID NO: 780044 - DNA, 25 bp, Mus musculus
tagtcagacactcgctgggagtcct

SEQ ID NO: 780045 - DNA, 25 bp, Mus musculus
tagtcagacactggctgggagtcct

SEQ ID NO: 780046 - DNA, 25 bp, Mus musculus
tagtcagagaggcaagccgttgcta

SEQ ID NO: 780047 - DNA, 25 bp, Mus musculus
tagtcagagagggaagccgttgcta

SEQ ID NO: 780048 - DNA, 25 bp, Mus musculus
tagtcagagcacacagcactccact

SEQ ID NO: 780049 - DNA, 25 bp, Mus musculus
tagtcagagcactcagcactccact

SEQ ID NO: 780050 - DNA, 25 bp, Mus musculus
tagtcagagccacgccccgggagca

SEQ ID NO: 780051 - DNA, 25 bp, Mus musculus
tagtcagagccaggccccgggagca

SEQ ID NO: 780052 - DNA, 25 bp, Mus musculus
tagtcagagctacctgggtgaccca

SEQ ID NO: 780053 - DNA, 25 bp, Mus musculus
tagtcagagctagctgggtgaccca

SEQ ID NO: 780054 - DNA, 25 bp, Mus musculus
tagtcagcaatgcacatgcctctgg

SEQ ID NO: 780055 - DNA, 25 bp, Mus musculus
tagtcagcaatggacatgcctctgg

SEQ ID NO: 780056 - DNA, 25 bp, Mus musculus
tagtcagcacttctagatcaccatc

SEQ ID NO: 780057 - DNA, 25 bp, Mus musculus
tagtcagcacttgtagatcaccatc

SEQ ID NO: 780058 - DNA, 25 bp, Mus musculus
tagtcagcatgcaggtctcagttct

SEQ ID NO: 780059 - DNA, 25 bp, Mus musculus
tagtcagcatgctggtctcagttct

SEQ ID NO: 780060 - DNA, 25 bp, Mus musculus
tagtcagcattcacacctgtgcaga

SEQ ID NO: 780061 - DNA, 25 bp, Mus musculus
tagtcagcattctcacctgtgcaga

SEQ ID NO: 780062 - DNA, 25 bp, Mus musculus
tagtcagcccacagaggcgtcaaac

SEQ ID NO: 780063 - DNA, 25 bp, Mus musculus
tagtcagcccactgaggcgtcaaac

SEQ ID NO: 780064 - DNA, 25 bp, Mus musculus
tagtcagcctaacctatctcagaca

SEQ ID NO: 780065 - DNA, 25 bp, Mus musculus
tagtcagcctaagctatctcagaca

SEQ ID NO: 780066 - DNA, 25 bp, Mus musculus
tagtcagcctctccttcaagctatt

SEQ ID NO: 780067 - DNA, 25 bp, Mus musculus
tagtcagcctctgcttcaagctatt

SEQ ID NO: 780068 - DNA, 25 bp, Mus musculus
tagtcagcctgtaaatgccacttca

SEQ ID NO: 780069 - DNA, 25 bp, Mus musculus
tagtcagcctgttaatgccacttca

SEQ ID NO: 780070 - DNA, 25 bp, Mus musculus
tagtcagctatccagtgttctcaat

SEQ ID NO: 780071 - DNA, 25 bp, Mus musculus
tagtcagctatcgagtgttctcaat

SEQ ID NO: 780072 - DNA, 25 bp, Mus musculus
tagtcagctgcccagcagcgatgca

SEQ ID NO: 780073 - DNA, 25 bp, Mus musculus
tagtcagctgccgagcagcgatgca

SEQ ID NO: 780074 - DNA, 25 bp, Mus musculus
tagtcaggacggaccaggagctgct

SEQ ID NO: 780075 - DNA, 25 bp, Mus musculus
tagtcaggacggtccaggagctgct

SEQ ID NO: 780076 - DNA, 25 bp, Mus musculus
tagtcaggcaagacggtccacagta

SEQ ID NO: 780077 - DNA, 25 bp, Mus musculus
tagtcaggcaagtcggtccacagta

SEQ ID NO: 780078 - DNA, 25 bp, Mus musculus
tagtcaggccacatgtaaagtttta

SEQ ID NO: 780079 - DNA, 25 bp, Mus musculus
tagtcaggccacttgtaaagtttta

SEQ ID NO: 780080 - DNA, 25 bp, Mus musculus
tagtcaggctctcgagatcatccgg

SEQ ID NO: 780081 - DNA, 25 bp, Mus musculus
tagtcaggctctggagatcatccgg

SEQ ID NO: 780082 - DNA, 25 bp, Mus musculus
tagtcagggaccctgagtccagctc

SEQ ID NO: 780083 - DNA, 25 bp, Mus musculus
tagtcagggaccgtgagtccagctc

SEQ ID NO: 780084 - DNA, 25 bp, Mus musculus
tagtcagggcctccacataaagtgc

SEQ ID NO: 780085 - DNA, 25 bp, Mus musculus
tagtcagggcctgcacataaagtgc

SEQ ID NO: 780086 - DNA, 25 bp, Mus musculus
tagtcaggttggatgtctactagtt

SEQ ID NO: 780087 - DNA, 25 bp, Mus musculus
tagtcaggttggttgtctactagtt

SEQ ID NO: 780088 - DNA, 25 bp, Mus musculus
tagtcagtacaacctggtggctgct

SEQ ID NO: 780089 - DNA, 25 bp, Mus musculus
tagtcagtacaagctggtggctgct

SEQ ID NO: 780090 - DNA, 25 bp, Mus musculus
tagtcagtcaagctcctcactggtc

SEQ ID NO: 780091 - DNA, 25 bp, Mus musculus
tagtcagtcaaggtcctcactggtc

SEQ ID NO: 780092 - DNA, 25 bp, Mus musculus
tagtcagtcattctgctgccgatgt

SEQ ID NO: 780093 - DNA, 25 bp, Mus musculus
tagtcagtcattgtgctgccgatgt

SEQ ID NO: 780094 - DNA, 25 bp, Mus musculus
tagtcagtctggaggcacactgcct

SEQ ID NO: 780095 - DNA, 25 bp, Mus musculus
tagtcagtctggtggcacactgcct

SEQ ID NO: 780096 - DNA, 25 bp, Mus musculus
tagtcagtgaggaccaccatccttg

SEQ ID NO: 780097 - DNA, 25 bp, Mus musculus
tagtcagtgaggtccaccatccttg

SEQ ID NO: 780098 - DNA, 25 bp, Mus musculus
tagtcagtgagtatcccgggaggct

SEQ ID NO: 780099 - DNA, 25 bp, Mus musculus
tagtcagtgagtttcccgggaggct

SEQ ID NO: 780100 - DNA, 25 bp, Mus musculus
tagtcagtgataagactccctgggc

SEQ ID NO: 780101 - DNA, 25 bp, Mus musculus
tagtcagtgatatgactccctgggc

SEQ ID NO: 780102 - DNA, 25 bp, Mus musculus
tagtcagtgtatcctcatagcctcc

SEQ ID NO: 780103 - DNA, 25 bp, Mus musculus
tagtcagtgtatgctcatagcctcc

SEQ ID NO: 780104 - DNA, 25 bp, Mus musculus
tagtcagtgtgacgaagccttttca

SEQ ID NO: 780105 - DNA, 25 bp, Mus musculus
tagtcagtgtgaggaagccttttca

SEQ ID NO: 780106 - DNA, 25 bp, Mus musculus
tagtcagttgagaagcacagagaac

SEQ ID NO: 780107 - DNA, 25 bp, Mus musculus
tagtcagttgagtagcacagagaac

SEQ ID NO: 780108 - DNA, 25 bp, Mus musculus
tagtcagttgatcttttaacaaaag

SEQ ID NO: 780109 - DNA, 25 bp, Mus musculus
tagtcagttgatgttttaacaaaag

SEQ ID NO: 780110 - DNA, 25 bp, Mus musculus
tagtcagttggcctttaccgtaaca

SEQ ID NO: 780111 - DNA, 25 bp, Mus musculus
tagtcagttggcgtttaccgtaaca

SEQ ID NO: 780112 - DNA, 25 bp, Mus musculus
tagtcataaaataccagctttccaa

SEQ ID NO: 780113 - DNA, 25 bp, Mus musculus
tagtcataaaattccagctttccaa

SEQ ID NO: 780114 - DNA, 25 bp, Mus musculus
tagtcataatacatccttcttaatt

SEQ ID NO: 780115 - DNA, 25 bp, Mus musculus
tagtcataatacttccttcttaatt

SEQ ID NO: 780116 - DNA, 25 bp, Mus musculus
tagtcataccaacccactgataagc

SEQ ID NO: 780117 - DNA, 25 bp, Mus musculus
tagtcataccaagccactgataagc

SEQ ID NO: 780118 - DNA, 25 bp, Mus musculus
tagtcatcaggcagtagcacctctt

SEQ ID NO: 780119 - DNA, 25 bp, Mus musculus
tagtcatcaggctgtagcacctctt

SEQ ID NO: 780120 - DNA, 25 bp, Mus musculus
tagtcatcattgctagattctgaga

SEQ ID NO: 780121 - DNA, 25 bp, Mus musculus
tagtcatcattggtagattctgaga

SEQ ID NO: 780122 - DNA, 25 bp, Mus musculus
tagtcatccagccaggagctgtttt

SEQ ID NO: 780123 - DNA, 25 bp, Mus musculus
tagtcatccagcgaggagctgtttt

SEQ ID NO: 780124 - DNA, 25 bp, Mus musculus
tagtcatcctggaccggctgcagtg

SEQ ID NO: 780125 - DNA, 25 bp, Mus musculus
tagtcatcctggtccggctgcagtg

SEQ ID NO: 780126 - DNA, 25 bp, Mus musculus
tagtcatctaccaacctttctatgg

SEQ ID NO: 780127 - DNA, 25 bp, Mus musculus
tagtcatctacctacctttctatgg

SEQ ID NO: 780128 - DNA, 25 bp, Mus musculus
tagtcatctatcatgaggtttctca

SEQ ID NO: 780129 - DNA, 25 bp, Mus musculus
tagtcatctatcttgaggtttctca

SEQ ID NO: 780130 - DNA, 25 bp, Mus musculus
tagtcatctatgactgtgcctccct

SEQ ID NO: 780131 - DNA, 25 bp, Mus musculus
tagtcatctatgtctgtgcctccct

SEQ ID NO: 780132 - DNA, 25 bp, Mus musculus
tagtcatctgcaaagctctagacat

SEQ ID NO: 780133 - DNA, 25 bp, Mus musculus
tagtcatctgcatagctctagacat

SEQ ID NO: 780134 - DNA, 25 bp, Mus musculus
tagtcatcttccaggcgttatttgc

SEQ ID NO: 780135 - DNA, 25 bp, Mus musculus
tagtcatcttcctggcgttatttgc

SEQ ID NO: 780136 - DNA, 25 bp, Mus musculus
tagtcatgaagccaaatctctgcgc

SEQ ID NO: 780137 - DNA, 25 bp, Mus musculus
tagtcatgaagcgaaatctctgcgc

SEQ ID NO: 780138 - DNA, 25 bp, Mus musculus
tagtcatgactcctggaagttgagc

SEQ ID NO: 780139 - DNA, 25 bp, Mus musculus
tagtcatgactcgtggaagttgagc

SEQ ID NO: 780140 - DNA, 25 bp, Mus musculus
tagtcatggcagatcagcacctctc

SEQ ID NO: 780141 - DNA, 25 bp, Mus musculus
tagtcatggcagttcagcacctctc

SEQ ID NO: 780142 - DNA, 25 bp, Mus musculus
tagtcatgtagcatgagtttcaaac

SEQ ID NO: 780143 - DNA, 25 bp, Mus musculus
tagtcatgtagcttgagtttcaaac

SEQ ID NO: 780144 - DNA, 25 bp, Mus musculus
tagtcattacgtatgctccagcctt

SEQ ID NO: 780145 - DNA, 25 bp, Mus musculus
tagtcattacgtttgctccagcctt

SEQ ID NO: 780146 - DNA, 25 bp, Mus musculus
tagtcattatcaaaacctgcccagc

SEQ ID NO: 780147 - DNA, 25 bp, Mus musculus
tagtcattatcataacctgcccagc

SEQ ID NO: 780148 - DNA, 25 bp, Mus musculus
tagtcattcagcagtcttctttgcc

SEQ ID NO: 780149 - DNA, 25 bp, Mus musculus
tagtcattcagctgtcttctttgcc

SEQ ID NO: 780150 - DNA, 25 bp, Mus musculus
tagtcattcccacaccgtgagctca

SEQ ID NO: 780151 - DNA, 25 bp, Mus musculus
tagtcattcccagaccgtgagctca

SEQ ID NO: 780152 - DNA, 25 bp, Mus musculus
tagtcattctaaccatggtccttga

SEQ ID NO: 780153 - DNA, 25 bp, Mus musculus
tagtcattctaagcatggtccttga

SEQ ID NO: 780154 - DNA, 25 bp, Mus musculus
tagtcattctcgagggcatggtgga

SEQ ID NO: 780155 - DNA, 25 bp, Mus musculus
tagtcattctcgtgggcatggtgga

SEQ ID NO: 780156 - DNA, 25 bp, Mus musculus
tagtcattgacaatgtgccgcccaa

SEQ ID NO: 780157 - DNA, 25 bp, Mus musculus
tagtcattgacattgtgccgcccaa

SEQ ID NO: 780158 - DNA, 25 bp, Mus musculus
tagtcattgtctcgtcacttctgag

SEQ ID NO: 780159 - DNA, 25 bp, Mus musculus
tagtcattgtctggtcacttctgag

SEQ ID NO: 780160 - DNA, 25 bp, Mus musculus
tagtcatttcagctaaccttcagat

SEQ ID NO: 780161 - DNA, 25 bp, Mus musculus
tagtcatttcaggtaaccttcagat

SEQ ID NO: 780162 - DNA, 25 bp, Mus musculus
tagtcatttctcaagggcagacccg

SEQ ID NO: 780163 - DNA, 25 bp, Mus musculus
tagtcatttctctagggcagacccg

SEQ ID NO: 780164 - DNA, 25 bp, Mus musculus
tagtcattttaaaaacgcggtcctt

SEQ ID NO: 780165 - DNA, 25 bp, Mus musculus
tagtcattttaataacgcggtcctt

SEQ ID NO: 780166 - DNA, 25 bp, Mus musculus
tagtccaaaaagcattgtccatgag

SEQ ID NO: 780167 - DNA, 25 bp, Mus musculus
tagtccaaaaaggattgtccatgag

SEQ ID NO: 780168 - DNA, 25 bp, Mus musculus
tagtccaaaggccattcatgttcaa

SEQ ID NO: 780169 - DNA, 25 bp, Mus musculus
tagtccaaaggcgattcatgttcaa

SEQ ID NO: 780170 - DNA, 25 bp, Mus musculus
tagtccaacctcacatcatatctgt

SEQ ID NO: 780171 - DNA, 25 bp, Mus musculus
tagtccaacctctcatcatatctgt

SEQ ID NO: 780172 - DNA, 25 bp, Mus musculus
tagtccaagaaaactacgcttcctg

SEQ ID NO: 780173 - DNA, 25 bp, Mus musculus
tagtccaagaaatctacgcttcctg

SEQ ID NO: 780174 - DNA, 25 bp, Mus musculus
tagtccaagtttcctttagtttgag

SEQ ID NO: 780175 - DNA, 25 bp, Mus musculus
tagtccaagtttgctttagtttgag

SEQ ID NO: 780176 - DNA, 25 bp, Mus musculus
tagtccaatctgacgcaagtttcac

SEQ ID NO: 780177 - DNA, 25 bp, Mus musculus
tagtccaatctgtcgcaagtttcac

SEQ ID NO: 780178 - DNA, 25 bp, Mus musculus
tagtccacagcacatagcctgtgtt

SEQ ID NO: 780179 - DNA, 25 bp, Mus musculus
tagtccacagcagatagcctgtgtt

SEQ ID NO: 780180 - DNA, 25 bp, Mus musculus
tagtccacagctcggtagagatgtc

SEQ ID NO: 780181 - DNA, 25 bp, Mus musculus
tagtccacagctgggtagagatgtc

SEQ ID NO: 780182 - DNA, 25 bp, Mus musculus
tagtccacatgcctacacttcatgt

SEQ ID NO: 780183 - DNA, 25 bp, Mus musculus
tagtccacatgcgtacacttcatgt

SEQ ID NO: 780184 - DNA, 25 bp, Mus musculus
tagtccacattgacttgtcagccag

SEQ ID NO: 780185 - DNA, 25 bp, Mus musculus
tagtccacattgtcttgtcagccag

SEQ ID NO: 780186 - DNA, 25 bp, Mus musculus
tagtccacccacactattttaaggt

SEQ ID NO: 780187 - DNA, 25 bp, Mus musculus
tagtccacccactctattttaaggt

SEQ ID NO: 780188 - DNA, 25 bp, Mus musculus
tagtccactctacctgtttcatttc

SEQ ID NO: 780189 - DNA, 25 bp, Mus musculus
tagtccactctagctgtttcatttc

SEQ ID NO: 780190 - DNA, 25 bp, Mus musculus
tagtccacttgaattcttccctgtt

SEQ ID NO: 780191 - DNA, 25 bp, Mus musculus
tagtccacttgatttcttccctgtt

SEQ ID NO: 780192 - DNA, 25 bp, Mus musculus
tagtccagaattatcaattggtcca

SEQ ID NO: 780193 - DNA, 25 bp, Mus musculus
tagtccagaattttcaattggtcca

SEQ ID NO: 780194 - DNA, 25 bp, Mus musculus
tagtccagactgaaggttcttgttc

SEQ ID NO: 780195 - DNA, 25 bp, Mus musculus
tagtccagactgtaggttcttgttc

SEQ ID NO: 780196 - DNA, 25 bp, Mus musculus
tagtccagagcgaatgctgatgcgt

SEQ ID NO: 780197 - DNA, 25 bp, Mus musculus
tagtccagagcgtatgctgatgcgt

SEQ ID NO: 780198 - DNA, 25 bp, Mus musculus
tagtccagcacaaacctacgagcca

SEQ ID NO: 780199 - DNA, 25 bp, Mus musculus
tagtccagcacatacctacgagcca

SEQ ID NO: 780200 - DNA, 25 bp, Mus musculus
tagtccagcataaccttaaggtcaa

SEQ ID NO: 780201 - DNA, 25 bp, Mus musculus
tagtccagcatatccttaaggtcaa

SEQ ID NO: 780202 - DNA, 25 bp, Mus musculus
tagtccagccttcaggatatcactg

SEQ ID NO: 780203 - DNA, 25 bp, Mus musculus
tagtccagccttgaggatatcactg

SEQ ID NO: 780204 - DNA, 25 bp, Mus musculus
tagtccaggagcaaaccaatccagt

SEQ ID NO: 780205 - DNA, 25 bp, Mus musculus
tagtccaggagctaaccaatccagt

SEQ ID NO: 780206 - DNA, 25 bp, Mus musculus
tagtccagtctcacagggcgcttga

SEQ ID NO: 780207 - DNA, 25 bp, Mus musculus
tagtccagtctctcagggcgcttga

SEQ ID NO: 780208 - DNA, 25 bp, Mus musculus
tagtccatagcaaagtaccatacgt

SEQ ID NO: 780209 - DNA, 25 bp, Mus musculus
tagtccatagcatagtaccatacgt

SEQ ID NO: 780210 - DNA, 25 bp, Mus musculus
tagtccatccctaggctaggagtca

SEQ ID NO: 780211 - DNA, 25 bp, Mus musculus
tagtccatcccttggctaggagtca

SEQ ID NO: 780212 - DNA, 25 bp, Mus musculus
tagtccatgcatctttgcatctcta

SEQ ID NO: 780213 - DNA, 25 bp, Mus musculus
tagtccatgcatgtttgcatctcta

SEQ ID NO: 780214 - DNA, 25 bp, Mus musculus
tagtccatggttcacttagacataa

SEQ ID NO: 780215 - DNA, 25 bp, Mus musculus
tagtccatggttgacttagacataa

SEQ ID NO: 780216 - DNA, 25 bp, Mus musculus
tagtccatgtggatgcatgcgcctt

SEQ ID NO: 780217 - DNA, 25 bp, Mus musculus
tagtccatgtggttgcatgcgcctt

SEQ ID NO: 780218 - DNA, 25 bp, Mus musculus
tagtccatgttacccacatagtggt

SEQ ID NO: 780219 - DNA, 25 bp, Mus musculus
tagtccatgttagccacatagtggt

SEQ ID NO: 780220 - DNA, 25 bp, Mus musculus
tagtcccaacccctcacgagatctt

SEQ ID NO: 780221 - DNA, 25 bp, Mus musculus
tagtcccaacccgtcacgagatctt

SEQ ID NO: 780222 - DNA, 25 bp, Mus musculus
tagtcccaaggacggaactctggtc

SEQ ID NO: 780223 - DNA, 25 bp, Mus musculus
tagtcccaaggagggaactctggtc

SEQ ID NO: 780224 - DNA, 25 bp, Mus musculus
tagtcccacaatatgcttttccttc

SEQ ID NO: 780225 - DNA, 25 bp, Mus musculus
tagtcccacaatttgcttttccttc

SEQ ID NO: 780226 - DNA, 25 bp, Mus musculus
tagtcccacccaaaacattcatgat

SEQ ID NO: 780227 - DNA, 25 bp, Mus musculus
tagtcccacccataacattcatgat

SEQ ID NO: 780228 - DNA, 25 bp, Mus musculus
tagtcccactttaaagtgatccatt

SEQ ID NO: 780229 - DNA, 25 bp, Mus musculus
tagtcccacttttaagtgatccatt

SEQ ID NO: 780230 - DNA, 25 bp, Mus musculus
tagtcccaggagactaccatgtgat

SEQ ID NO: 780231 - DNA, 25 bp, Mus musculus
tagtcccaggagtctaccatgtgat

SEQ ID NO: 780232 - DNA, 25 bp, Mus musculus
tagtcccagggaacgcgcaatgctc

SEQ ID NO: 780233 - DNA, 25 bp, Mus musculus
tagtcccagggatcgcgcaatgctc

SEQ ID NO: 780234 - DNA, 25 bp, Mus musculus
tagtcccagtacactagagtcagtg

SEQ ID NO: 780235 - DNA, 25 bp, Mus musculus
tagtcccagtactctagagtcagtg

SEQ ID NO: 780236 - DNA, 25 bp, Mus musculus
tagtcccagtcccacttgaagaaaa

SEQ ID NO: 780237 - DNA, 25 bp, Mus musculus
tagtcccagtccgacttgaagaaaa

SEQ ID NO: 780238 - DNA, 25 bp, Mus musculus
tagtcccatcatagacagtggcagt

SEQ ID NO: 780239 - DNA, 25 bp, Mus musculus
tagtcccatcattgacagtggcagt

SEQ ID NO: 780240 - DNA, 25 bp, Mus musculus
tagtcccattccctgctttctgatg

SEQ ID NO: 780241 - DNA, 25 bp, Mus musculus
tagtcccattccgtgctttctgatg

SEQ ID NO: 780242 - DNA, 25 bp, Mus musculus
tagtccccaccaaaatcagggcaac

SEQ ID NO: 780243 - DNA, 25 bp, Mus musculus
tagtccccaccataatcagggcaac

SEQ ID NO: 780244 - DNA, 25 bp, Mus musculus
tagtccccagatactttaacctgtc

SEQ ID NO: 780245 - DNA, 25 bp, Mus musculus
tagtccccagattctttaacctgtc

SEQ ID NO: 780246 - DNA, 25 bp, Mus musculus
tagtccccagccctgggcaaaagat

SEQ ID NO: 780247 - DNA, 25 bp, Mus musculus
tagtccccagccgtgggcaaaagat

SEQ ID NO: 780248 - DNA, 25 bp, Mus musculus
tagtccccaggaccctcatgagtgt

SEQ ID NO: 780249 - DNA, 25 bp, Mus musculus
tagtccccaggagcctcatgagtgt

SEQ ID NO: 780250 - DNA, 25 bp, Mus musculus
tagtccccattgaggcttagtagct

SEQ ID NO: 780251 - DNA, 25 bp, Mus musculus
tagtccccattgtggcttagtagct

SEQ ID NO: 780252 - DNA, 25 bp, Mus musculus
tagtccccgccgagcgtgggctata

SEQ ID NO: 780253 - DNA, 25 bp, Mus musculus
tagtccccgccgtgcgtgggctata

SEQ ID NO: 780254 - DNA, 25 bp, Mus musculus
tagtccccgggaacgagcttctaga

SEQ ID NO: 780255 - DNA, 25 bp, Mus musculus
tagtccccgggatcgagcttctaga

SEQ ID NO: 780256 - DNA, 25 bp, Mus musculus
tagtccccgttgcacacgatgagga

SEQ ID NO: 780257 - DNA, 25 bp, Mus musculus
tagtccccgttggacacgatgagga

SEQ ID NO: 780258 - DNA, 25 bp, Mus musculus
tagtcccctgctatcaatgaacatc

SEQ ID NO: 780259 - DNA, 25 bp, Mus musculus
tagtcccctgctttcaatgaacatc

SEQ ID NO: 780260 - DNA, 25 bp, Mus musculus
tagtccccttccctgtggttccaga

SEQ ID NO: 780261 - DNA, 25 bp, Mus musculus
tagtccccttccgtgtggttccaga

SEQ ID NO: 780262 - DNA, 25 bp, Mus musculus
tagtcccggagcctgatggttattc

SEQ ID NO: 780263 - DNA, 25 bp, Mus musculus
tagtcccggagcgtgatggttattc

SEQ ID NO: 780264 - DNA, 25 bp, Mus musculus
tagtcccggcgtagcgagctggctc

SEQ ID NO: 780265 - DNA, 25 bp, Mus musculus
tagtcccggcgttgcgagctggctc

SEQ ID NO: 780266 - DNA, 25 bp, Mus musculus
tagtccctacatcatggcctacatg

SEQ ID NO: 780267 - DNA, 25 bp, Mus musculus
tagtccctacatgatggcctacatg

SEQ ID NO: 780268 - DNA, 25 bp, Mus musculus
tagtccctacgccagacagaagcag

SEQ ID NO: 780269 - DNA, 25 bp, Mus musculus
tagtccctacgcgagacagaagcag

SEQ ID NO: 780270 - DNA, 25 bp, Mus musculus
tagtccctatagctctgatgctccg

SEQ ID NO: 780271 - DNA, 25 bp, Mus musculus
tagtccctataggtctgatgctccg

SEQ ID NO: 780272 - DNA, 25 bp, Mus musculus
tagtccctatgcagagcactttaca

SEQ ID NO: 780273 - DNA, 25 bp, Mus musculus
tagtccctatgctgagcactttaca

SEQ ID NO: 780274 - DNA, 25 bp, Mus musculus
tagtccctctatcttatgattaatg

SEQ ID NO: 780275 - DNA, 25 bp, Mus musculus
tagtccctctatgttatgattaatg

SEQ ID NO: 780276 - DNA, 25 bp, Mus musculus
tagtccctgaataagtcccaaacac

SEQ ID NO: 780277 - DNA, 25 bp, Mus musculus
tagtccctgaattagtcccaaacac

SEQ ID NO: 780278 - DNA, 25 bp, Mus musculus
tagtccctgcagaagctacggaccc

SEQ ID NO: 780279 - DNA, 25 bp, Mus musculus
tagtccctgcagtagctacggaccc

SEQ ID NO: 780280 - DNA, 25 bp, Mus musculus
tagtccctgtatatccctggatcaa

SEQ ID NO: 780281 - DNA, 25 bp, Mus musculus
tagtccctgtatttccctggatcaa

SEQ ID NO: 780282 - DNA, 25 bp, Mus musculus
tagtccctgtcgctgatgtgccaag

SEQ ID NO: 780283 - DNA, 25 bp, Mus musculus
tagtccctgtcggtgatgtgccaag

SEQ ID NO: 780284 - DNA, 25 bp, Mus musculus
tagtcccttcgtatgcgttgagaat

SEQ ID NO: 780285 - DNA, 25 bp, Mus musculus
tagtcccttcgtttgcgttgagaat

SEQ ID NO: 780286 - DNA, 25 bp, Mus musculus
tagtcccttctgagctcaggtaaaa

SEQ ID NO: 780287 - DNA, 25 bp, Mus musculus
tagtcccttctgtgctcaggtaaaa

SEQ ID NO: 780288 - DNA, 25 bp, Mus musculus
tagtcccttgggacatgattaaaca

SEQ ID NO: 780289 - DNA, 25 bp, Mus musculus
tagtcccttgggtcatgattaaaca

SEQ ID NO: 780290 - DNA, 25 bp, Mus musculus
tagtccgacaagctgacaggagctt

SEQ ID NO: 780291 - DNA, 25 bp, Mus musculus
tagtccgacaaggtgacaggagctt

SEQ ID NO: 780292 - DNA, 25 bp, Mus musculus
tagtccgccacacagtgacgtcagg

SEQ ID NO: 780293 - DNA, 25 bp, Mus musculus
tagtccgccacagagtgacgtcagg

SEQ ID NO: 780294 - DNA, 25 bp, Mus musculus
tagtccgctatgatccttgtaggtc

SEQ ID NO: 780295 - DNA, 25 bp, Mus musculus
tagtccgctatgttccttgtaggtc

SEQ ID NO: 780296 - DNA, 25 bp, Mus musculus
tagtccggacagaattgggctccct

SEQ ID NO: 780297 - DNA, 25 bp, Mus musculus
tagtccggacagtattgggctccct

SEQ ID NO: 780298 - DNA, 25 bp, Mus musculus
tagtccgggtggagatccgcctttt

SEQ ID NO: 780299 - DNA, 25 bp, Mus musculus
tagtccgggtggtgatccgcctttt

SEQ ID NO: 780300 - DNA, 25 bp, Mus musculus
tagtccgtttgaatatccctctggg

SEQ ID NO: 780301 - DNA, 25 bp, Mus musculus
tagtccgtttgattatccctctggg

SEQ ID NO: 780302 - DNA, 25 bp, Mus musculus
tagtcctaatacacagtttcttggt

SEQ ID NO: 780303 - DNA, 25 bp, Mus musculus
tagtcctaatactcagtttcttggt

SEQ ID NO: 780304 - DNA, 25 bp, Mus musculus
tagtcctagacgctgctttttatta

SEQ ID NO: 780305 - DNA, 25 bp, Mus musculus
tagtcctagacggtgctttttatta

SEQ ID NO: 780306 - DNA, 25 bp, Mus musculus
tagtcctagattcccttaaactctt

SEQ ID NO: 780307 - DNA, 25 bp, Mus musculus
tagtcctagattgccttaaactctt

SEQ ID NO: 780308 - DNA, 25 bp, Mus musculus
tagtcctagctcctggaaaggtgaa

SEQ ID NO: 780309 - DNA, 25 bp, Mus musculus
tagtcctagctcgtggaaaggtgaa

SEQ ID NO: 780310 - DNA, 25 bp, Mus musculus
tagtcctcaacaagtctgtcctaaa

SEQ ID NO: 780311 - DNA, 25 bp, Mus musculus
tagtcctcaacatgtctgtcctaaa

SEQ ID NO: 780312 - DNA, 25 bp, Mus musculus
tagtcctcagcacttgcccgtggaa

SEQ ID NO: 780313 - DNA, 25 bp, Mus musculus
tagtcctcagcagttgcccgtggaa

SEQ ID NO: 780314 - DNA, 25 bp, Mus musculus
tagtcctcaggaatcttgcataaag

SEQ ID NO: 780315 - DNA, 25 bp, Mus musculus
tagtcctcaggattcttgcataaag

SEQ ID NO: 780316 - DNA, 25 bp, Mus musculus
tagtcctcagtacaaatcacatcct

SEQ ID NO: 780317 - DNA, 25 bp, Mus musculus
tagtcctcagtagaaatcacatcct

SEQ ID NO: 780318 - DNA, 25 bp, Mus musculus
tagtcctcattaacacagcttgcct

SEQ ID NO: 780319 - DNA, 25 bp, Mus musculus
tagtcctcattatcacagcttgcct

SEQ ID NO: 780320 - DNA, 25 bp, Mus musculus
tagtcctccatcacaaggcagcctt

SEQ ID NO: 780321 - DNA, 25 bp, Mus musculus
tagtcctccatctcaaggcagcctt

SEQ ID NO: 780322 - DNA, 25 bp, Mus musculus
tagtcctcccatcgcaagggtgctg

SEQ ID NO: 780323 - DNA, 25 bp, Mus musculus
tagtcctcccatggcaagggtgctg

SEQ ID NO: 780324 - DNA, 25 bp, Mus musculus
tagtcctcctcgaagatattgatgt

SEQ ID NO: 780325 - DNA, 25 bp, Mus musculus
tagtcctcctcgtagatattgatgt

SEQ ID NO: 780326 - DNA, 25 bp, Mus musculus
tagtcctcctctacctcaggaagag

SEQ ID NO: 780327 - DNA, 25 bp, Mus musculus
tagtcctcctcttcctcaggaagag

SEQ ID NO: 780328 - DNA, 25 bp, Mus musculus
tagtcctccttaacctgtcctttgt

SEQ ID NO: 780329 - DNA, 25 bp, Mus musculus
tagtcctccttatcctgtcctttgt

SEQ ID NO: 780330 - DNA, 25 bp, Mus musculus
tagtcctccttgaaggtctgtccag

SEQ ID NO: 780331 - DNA, 25 bp, Mus musculus
tagtcctccttgtaggtctgtccag

SEQ ID NO: 780332 - DNA, 25 bp, Mus musculus
tagtcctctaccaagtttgtttctt

SEQ ID NO: 780333 - DNA, 25 bp, Mus musculus
tagtcctctacctagtttgtttctt

SEQ ID NO: 780334 - DNA, 25 bp, Mus musculus
tagtcctctcggatgtggctgccaa

SEQ ID NO: 780335 - DNA, 25 bp, Mus musculus
tagtcctctcggttgtggctgccaa

SEQ ID NO: 780336 - DNA, 25 bp, Mus musculus
tagtcctctgcgatggttcggtagg

SEQ ID NO: 780337 - DNA, 25 bp, Mus musculus
tagtcctctgcgttggttcggtagg

SEQ ID NO: 780338 - DNA, 25 bp, Mus musculus
tagtcctctgtgacccataagactg

SEQ ID NO: 780339 - DNA, 25 bp, Mus musculus
tagtcctctgtgtcccataagactg

SEQ ID NO: 780340 - DNA, 25 bp, Mus musculus
tagtcctgagtgatcgaatccatcg

SEQ ID NO: 780341 - DNA, 25 bp, Mus musculus
tagtcctgagtgttcgaatccatcg

SEQ ID NO: 780342 - DNA, 25 bp, Mus musculus
tagtcctgcccgagatgagtgcttc

SEQ ID NO: 780343 - DNA, 25 bp, Mus musculus
tagtcctgcccgtgatgagtgcttc

SEQ ID NO: 780344 - DNA, 25 bp, Mus musculus
tagtcctgcctccttcacttgtgat

SEQ ID NO: 780345 - DNA, 25 bp, Mus musculus
tagtcctgcctcgttcacttgtgat

SEQ ID NO: 780346 - DNA, 25 bp, Mus musculus
tagtcctgctcgaggtaagctaccc

SEQ ID NO: 780347 - DNA, 25 bp, Mus musculus
tagtcctgctcgtggtaagctaccc

SEQ ID NO: 780348 - DNA, 25 bp, Mus musculus
tagtcctgcttgcatcctggagttt

SEQ ID NO: 780349 - DNA, 25 bp, Mus musculus
tagtcctgcttggatcctggagttt

SEQ ID NO: 780350 - DNA, 25 bp, Mus musculus
tagtcctgtaggagagtggctttgt

SEQ ID NO: 780351 - DNA, 25 bp, Mus musculus
tagtcctgtaggtgagtggctttgt

SEQ ID NO: 780352 - DNA, 25 bp, Mus musculus
tagtcctgttcaatatgccactgag

SEQ ID NO: 780353 - DNA, 25 bp, Mus musculus
tagtcctgttcattatgccactgag

SEQ ID NO: 780354 - DNA, 25 bp, Mus musculus
tagtcctgtttcactcccaagtagc

SEQ ID NO: 780355 - DNA, 25 bp, Mus musculus
tagtcctgtttctctcccaagtagc

SEQ ID NO: 780356 - DNA, 25 bp, Mus musculus
tagtccttacgtagtttctgcgatt

SEQ ID NO: 780357 - DNA, 25 bp, Mus musculus
tagtccttacgttgtttctgcgatt

SEQ ID NO: 780358 - DNA, 25 bp, Mus musculus
tagtccttagacaagtcagctcaag

SEQ ID NO: 780359 - DNA, 25 bp, Mus musculus
tagtccttagactagtcagctcaag

SEQ ID NO: 780360 - DNA, 25 bp, Mus musculus
tagtccttattacaagttttgtgtt

SEQ ID NO: 780361 - DNA, 25 bp, Mus musculus
tagtccttattagaagttttgtgtt

SEQ ID NO: 780362 - DNA, 25 bp, Mus musculus
tagtccttctaacagtgcggatttc

SEQ ID NO: 780363 - DNA, 25 bp, Mus musculus
tagtccttctaagagtgcggatttc

SEQ ID NO: 780364 - DNA, 25 bp, Mus musculus
tagtccttctgtcgctttgtaattt

SEQ ID NO: 780365 - DNA, 25 bp, Mus musculus
tagtccttctgtggctttgtaattt

SEQ ID NO: 780366 - DNA, 25 bp, Mus musculus
tagtccttgcacctcaaaagttcgc

SEQ ID NO: 780367 - DNA, 25 bp, Mus musculus
tagtccttgcacgtcaaaagttcgc

SEQ ID NO: 780368 - DNA, 25 bp, Mus musculus
tagtccttgcgtaatcccaaatacc

SEQ ID NO: 780369 - DNA, 25 bp, Mus musculus
tagtccttgcgttatcccaaatacc

SEQ ID NO: 780370 - DNA, 25 bp, Mus musculus
tagtccttgctaattgctgctcact

SEQ ID NO: 780371 - DNA, 25 bp, Mus musculus
tagtccttgctatttgctgctcact

SEQ ID NO: 780372 - DNA, 25 bp, Mus musculus
tagtccttggtgatgcttggctcat

SEQ ID NO: 780373 - DNA, 25 bp, Mus musculus
tagtccttggtgttgcttggctcat

SEQ ID NO: 780374 - DNA, 25 bp, Mus musculus
tagtccttgtgtatagtcctgcgtt

SEQ ID NO: 780375 - DNA, 25 bp, Mus musculus
tagtccttgtgtttagtcctgcgtt

SEQ ID NO: 780376 - DNA, 25 bp, Mus musculus
tagtcctttcctccgctggaacttc

SEQ ID NO: 780377 - DNA, 25 bp, Mus musculus
tagtcctttcctgcgctggaacttc

SEQ ID NO: 780378 - DNA, 25 bp, Mus musculus
tagtcctttggacggaggtgtatac

SEQ ID NO: 780379 - DNA, 25 bp, Mus musculus
tagtcctttggagggaggtgtatac

SEQ ID NO: 780380 - DNA, 25 bp, Mus musculus
tagtcgaagatgattccaccagctt

SEQ ID NO: 780381 - DNA, 25 bp, Mus musculus
tagtcgaagatgtttccaccagctt

SEQ ID NO: 780382 - DNA, 25 bp, Mus musculus
tagtcgaaggtcactgtcagtcttt

SEQ ID NO: 780383 - DNA, 25 bp, Mus musculus
tagtcgaaggtctctgtcagtcttt

SEQ ID NO: 780384 - DNA, 25 bp, Mus musculus
tagtcgacatccagcagcctatgtg

SEQ ID NO: 780385 - DNA, 25 bp, Mus musculus
tagtcgacatcctgcagcctatgtg

SEQ ID NO: 780386 - DNA, 25 bp, Mus musculus
tagtcgacatggctccggcaaccgt

SEQ ID NO: 780387 - DNA, 25 bp, Mus musculus
tagtcgacatgggtccggcaaccgt

SEQ ID NO: 780388 - DNA, 25 bp, Mus musculus
tagtcgacgcctcagttttaagtaa

SEQ ID NO: 780389 - DNA, 25 bp, Mus musculus
tagtcgacgcctgagttttaagtaa

SEQ ID NO: 780390 - DNA, 25 bp, Mus musculus
tagtcgactactacccagaatatga

SEQ ID NO: 780391 - DNA, 25 bp, Mus musculus
tagtcgactacttcccagaatatga

SEQ ID NO: 780392 - DNA, 25 bp, Mus musculus
tagtcgaggactattcgcttttctg

SEQ ID NO: 780393 - DNA, 25 bp, Mus musculus
tagtcgaggacttttcgcttttctg

SEQ ID NO: 780394 - DNA, 25 bp, Mus musculus
tagtcgatcgcgctccctggagaaa

SEQ ID NO: 780395 - DNA, 25 bp, Mus musculus
tagtcgatcgcggtccctggagaaa

SEQ ID NO: 780396 - DNA, 25 bp, Mus musculus
tagtcgatctcaacaccaggctgaa

SEQ ID NO: 780397 - DNA, 25 bp, Mus musculus
tagtcgatctcatcaccaggctgaa

SEQ ID NO: 780398 - DNA, 25 bp, Mus musculus
tagtcgatgctaagttatgtataac

SEQ ID NO: 780399 - DNA, 25 bp, Mus musculus
tagtcgatgctatgttatgtataac

SEQ ID NO: 780400 - DNA, 25 bp, Mus musculus
tagtcgatgtttatcccagtgcctt

SEQ ID NO: 780401 - DNA, 25 bp, Mus musculus
tagtcgatgtttttcccagtgcctt

SEQ ID NO: 780402 - DNA, 25 bp, Mus musculus
tagtcgatttacatccctaattatt

SEQ ID NO: 780403 - DNA, 25 bp, Mus musculus
tagtcgatttacttccctaattatt

SEQ ID NO: 780404 - DNA, 25 bp, Mus musculus
tagtcgcagcacatggaaggcggaa

SEQ ID NO: 780405 - DNA, 25 bp, Mus musculus
tagtcgcagcacttggaaggcggaa

SEQ ID NO: 780406 - DNA, 25 bp, Mus musculus
tagtcgcaggacatcacttaagcct

SEQ ID NO: 780407 - DNA, 25 bp, Mus musculus
tagtcgcaggacttcacttaagcct

SEQ ID NO: 780408 - DNA, 25 bp, Mus musculus
tagtcgcatctgacaggaagtttgt

SEQ ID NO: 780409 - DNA, 25 bp, Mus musculus
tagtcgcatctgtcaggaagtttgt

SEQ ID NO: 780410 - DNA, 25 bp, Mus musculus
tagtcgcattttacaagtatcgcaa

SEQ ID NO: 780411 - DNA, 25 bp, Mus musculus
tagtcgcatttttcaagtatcgcaa

SEQ ID NO: 780412 - DNA, 25 bp, Mus musculus
tagtcgccaactactaggtctaacc

SEQ ID NO: 780413 - DNA, 25 bp, Mus musculus
tagtcgccaacttctaggtctaacc

SEQ ID NO: 780414 - DNA, 25 bp, Mus musculus
tagtcgcccctccattgagagttgg

SEQ ID NO: 780415 - DNA, 25 bp, Mus musculus
tagtcgcccctcgattgagagttgg

SEQ ID NO: 780416 - DNA, 25 bp, Mus musculus
tagtcgctgcgtcgatctgaatcat

SEQ ID NO: 780417 - DNA, 25 bp, Mus musculus
tagtcgctgcgtggatctgaatcat

SEQ ID NO: 780418 - DNA, 25 bp, Mus musculus
tagtcgcttagtatctccatcagta

SEQ ID NO: 780419 - DNA, 25 bp, Mus musculus
tagtcgcttagtttctccatcagta

SEQ ID NO: 780420 - DNA, 25 bp, Mus musculus
tagtcgctttctatggctttcagaa

SEQ ID NO: 780421 - DNA, 25 bp, Mus musculus
tagtcgctttctttggctttcagaa

SEQ ID NO: 780422 - DNA, 25 bp, Mus musculus
tagtcggacccgactgatgggttca

SEQ ID NO: 780423 - DNA, 25 bp, Mus musculus
tagtcggacccgtctgatgggttca

SEQ ID NO: 780424 - DNA, 25 bp, Mus musculus
tagtcgggactgctgtctacctgtc

SEQ ID NO: 780425 - DNA, 25 bp, Mus musculus
tagtcgggactggtgtctacctgtc

SEQ ID NO: 780426 - DNA, 25 bp, Mus musculus
tagtcgggcatcagcagttggcctg

SEQ ID NO: 780427 - DNA, 25 bp, Mus musculus
tagtcgggcatctgcagttggcctg

SEQ ID NO: 780428 - DNA, 25 bp, Mus musculus
tagtcgggctctagtttcctcttag

SEQ ID NO: 780429 - DNA, 25 bp, Mus musculus
tagtcgggctcttgtttcctcttag

SEQ ID NO: 780430 - DNA, 25 bp, Mus musculus
tagtcgggcttgagtgtctacgtca

SEQ ID NO: 780431 - DNA, 25 bp, Mus musculus
tagtcgggcttgtgtgtctacgtca

SEQ ID NO: 780432 - DNA, 25 bp, Mus musculus
tagtcggtcacacaaatccgctcct

SEQ ID NO: 780433 - DNA, 25 bp, Mus musculus
tagtcggtcacagaaatccgctcct

SEQ ID NO: 780434 - DNA, 25 bp, Mus musculus
tagtcggtggctatgggcatctgct

SEQ ID NO: 780435 - DNA, 25 bp, Mus musculus
tagtcggtggctttgggcatctgct

SEQ ID NO: 780436 - DNA, 25 bp, Mus musculus
tagtcggttttcagcatgacagcat

SEQ ID NO: 780437 - DNA, 25 bp, Mus musculus
tagtcggttttctgcatgacagcat

SEQ ID NO: 780438 - DNA, 25 bp, Mus musculus
tagtcgtcccacaggagaccaggca

SEQ ID NO: 780439 - DNA, 25 bp, Mus musculus
tagtcgtcccactggagaccaggca

SEQ ID NO: 780440 - DNA, 25 bp, Mus musculus
tagtcgtctaccatagggcccagag

SEQ ID NO: 780441 - DNA, 25 bp, Mus musculus
tagtcgtctaccttagggcccagag

SEQ ID NO: 780442 - DNA, 25 bp, Mus musculus
tagtcgtctcccaggaattctaact

SEQ ID NO: 780443 - DNA, 25 bp, Mus musculus
tagtcgtctccctggaattctaact

SEQ ID NO: 780444 - DNA, 25 bp, Mus musculus
tagtcgtgaaagatgccaaattggc

SEQ ID NO: 780445 - DNA, 25 bp, Mus musculus
tagtcgtgaaagttgccaaattggc

SEQ ID NO: 780446 - DNA, 25 bp, Mus musculus
tagtcgtgaaatccctaacaagtca

SEQ ID NO: 780447 - DNA, 25 bp, Mus musculus
tagtcgtgaaatgcctaacaagtca

SEQ ID NO: 780448 - DNA, 25 bp, Mus musculus
tagtctaacacactggaccctattt

SEQ ID NO: 780449 - DNA, 25 bp, Mus musculus
tagtctaacacagtggaccctattt

SEQ ID NO: 780450 - DNA, 25 bp, Mus musculus
tagtctaagcccagtgcagcagtat

SEQ ID NO: 780451 - DNA, 25 bp, Mus musculus
tagtctaagccctgtgcagcagtat

SEQ ID NO: 780452 - DNA, 25 bp, Mus musculus
tagtctacagatcccacaaagttct

SEQ ID NO: 780453 - DNA, 25 bp, Mus musculus
tagtctacagatgccacaaagttct

SEQ ID NO: 780454 - DNA, 25 bp, Mus musculus
tagtctaccaccagtgttaacgcac

SEQ ID NO: 780455 - DNA, 25 bp, Mus musculus
tagtctaccacctgtgttaacgcac

SEQ ID NO: 780456 - DNA, 25 bp, Mus musculus
tagtctacccgacgagtaatgtttt

SEQ ID NO: 780457 - DNA, 25 bp, Mus musculus
tagtctacccgaggagtaatgtttt

SEQ ID NO: 780458 - DNA, 25 bp, Mus musculus
tagtctactaatcctaatgcattgt

SEQ ID NO: 780459 - DNA, 25 bp, Mus musculus
tagtctactaatgctaatgcattgt

SEQ ID NO: 780460 - DNA, 25 bp, Mus musculus
tagtctagaggaaggcaggcaagcc

SEQ ID NO: 780461 - DNA, 25 bp, Mus musculus
tagtctagaggatggcaggcaagcc

SEQ ID NO: 780462 - DNA, 25 bp, Mus musculus
tagtctagagtgacctatcctggct

SEQ ID NO: 780463 - DNA, 25 bp, Mus musculus
tagtctagagtgtcctatcctggct

SEQ ID NO: 780464 - DNA, 25 bp, Mus musculus
tagtctagatgtaacgctctcccaa

SEQ ID NO: 780465 - DNA, 25 bp, Mus musculus
tagtctagatgttacgctctcccaa

SEQ ID NO: 780466 - DNA, 25 bp, Mus musculus
tagtctagccatatgcagcatagtc

SEQ ID NO: 780467 - DNA, 25 bp, Mus musculus
tagtctagccatttgcagcatagtc

SEQ ID NO: 780468 - DNA, 25 bp, Mus musculus
tagtctagcctgctattctccttct

SEQ ID NO: 780469 - DNA, 25 bp, Mus musculus
tagtctagcctggtattctccttct

SEQ ID NO: 780470 - DNA, 25 bp, Mus musculus
tagtctaggacacgagttctcaggt

SEQ ID NO: 780471 - DNA, 25 bp, Mus musculus
tagtctaggacaggagttctcaggt

SEQ ID NO: 780472 - DNA, 25 bp, Mus musculus
tagtctaggcctaggactgtctggc

SEQ ID NO: 780473 - DNA, 25 bp, Mus musculus
tagtctaggccttggactgtctggc

SEQ ID NO: 780474 - DNA, 25 bp, Mus musculus
tagtctagtcataacttgtcatcta

SEQ ID NO: 780475 - DNA, 25 bp, Mus musculus
tagtctagtcattacttgtcatcta

SEQ ID NO: 780476 - DNA, 25 bp, Mus musculus
tagtctagtgctatatggccctcag

SEQ ID NO: 780477 - DNA, 25 bp, Mus musculus
tagtctagtgctttatggccctcag

SEQ ID NO: 780478 - DNA, 25 bp, Mus musculus
tagtctagtgttaacagtttctcat

SEQ ID NO: 780479 - DNA, 25 bp, Mus musculus
tagtctagtgtttacagtttctcat

SEQ ID NO: 780480 - DNA, 25 bp, Mus musculus
tagtctagtttcaacggagctttcg

SEQ ID NO: 780481 - DNA, 25 bp, Mus musculus
tagtctagtttctacggagctttcg

SEQ ID NO: 780482 - DNA, 25 bp, Mus musculus
tagtctagtttgcaacagcccttgg

SEQ ID NO: 780483 - DNA, 25 bp, Mus musculus
tagtctagtttggaacagcccttgg

SEQ ID NO: 780484 - DNA, 25 bp, Mus musculus
tagtctattcagagtgagcttgctc

SEQ ID NO: 780485 - DNA, 25 bp, Mus musculus
tagtctattcagtgtgagcttgctc

SEQ ID NO: 780486 - DNA, 25 bp, Mus musculus
tagtctattcttacacttgcattag

SEQ ID NO: 780487 - DNA, 25 bp, Mus musculus
tagtctattctttcacttgcattag

SEQ ID NO: 780488 - DNA, 25 bp, Mus musculus
tagtctattttcagaaccaaaggga

SEQ ID NO: 780489 - DNA, 25 bp, Mus musculus
tagtctattttctgaaccaaaggga

SEQ ID NO: 780490 - DNA, 25 bp, Mus musculus
tagtctcaaattagtgccccacaat

SEQ ID NO: 780491 - DNA, 25 bp, Mus musculus
tagtctcaaattcttagttacccaa

SEQ ID NO: 780492 - DNA, 25 bp, Mus musculus
tagtctcaaattgttagttacccaa

SEQ ID NO: 780493 - DNA, 25 bp, Mus musculus
tagtctcaaatttgtgccccacaat

SEQ ID NO: 780494 - DNA, 25 bp, Mus musculus
tagtctcaacacatgggctcaagca

SEQ ID NO: 780495 - DNA, 25 bp, Mus musculus
tagtctcaacacttgggctcaagca

SEQ ID NO: 780496 - DNA, 25 bp, Mus musculus
tagtctcaactcaagggtccctgta

SEQ ID NO: 780497 - DNA, 25 bp, Mus musculus
tagtctcaactcaccctgataaact

SEQ ID NO: 780498 - DNA, 25 bp, Mus musculus
tagtctcaactctagggtccctgta

SEQ ID NO: 780499 - DNA, 25 bp, Mus musculus
tagtctcaactctccctgataaact

SEQ ID NO: 780500 - DNA, 25 bp, Mus musculus
tagtctcaactgctgcaagagaaaa

SEQ ID NO: 780501 - DNA, 25 bp, Mus musculus
tagtctcaactggtgcaagagaaaa

SEQ ID NO: 780502 - DNA, 25 bp, Mus musculus
tagtctcaatcacccctggtttttt

SEQ ID NO: 780503 - DNA, 25 bp, Mus musculus
tagtctcaatcagccctggtttttt

SEQ ID NO: 780504 - DNA, 25 bp, Mus musculus
tagtctcaatccactggccaagtga

SEQ ID NO: 780505 - DNA, 25 bp, Mus musculus
tagtctcaatcctctggccaagtga

SEQ ID NO: 780506 - DNA, 25 bp, Mus musculus
tagtctcacactattttcttctgtg

SEQ ID NO: 780507 - DNA, 25 bp, Mus musculus
tagtctcacacttttttcttctgtg

SEQ ID NO: 780508 - DNA, 25 bp, Mus musculus
tagtctcacagccttatgaccaagg

SEQ ID NO: 780509 - DNA, 25 bp, Mus musculus
tagtctcacagcgttatgaccaagg

SEQ ID NO: 780510 - DNA, 25 bp, Mus musculus
tagtctcacataactttgcccaggt

SEQ ID NO: 780511 - DNA, 25 bp, Mus musculus
tagtctcacatatctttgcccaggt

SEQ ID NO: 780512 - DNA, 25 bp, Mus musculus
tagtctcacgtgattcgggctagca

SEQ ID NO: 780513 - DNA, 25 bp, Mus musculus
tagtctcacgtgtttcgggctagca

SEQ ID NO: 780514 - DNA, 25 bp, Mus musculus
tagtctcagaaacccacgattggat

SEQ ID NO: 780515 - DNA, 25 bp, Mus musculus
tagtctcagaaagccacgattggat

SEQ ID NO: 780516 - DNA, 25 bp, Mus musculus
tagtctcagcacagaccgtggagtg

SEQ ID NO: 780517 - DNA, 25 bp, Mus musculus
tagtctcagcactgaccgtggagtg

SEQ ID NO: 780518 - DNA, 25 bp, Mus musculus
tagtctcagctgagacaggacctct

SEQ ID NO: 780519 - DNA, 25 bp, Mus musculus
tagtctcagctgtgacaggacctct

SEQ ID NO: 780520 - DNA, 25 bp, Mus musculus
tagtctcaggccaccaaactgggaa

SEQ ID NO: 780521 - DNA, 25 bp, Mus musculus
tagtctcaggcctccaaactgggaa

SEQ ID NO: 780522 - DNA, 25 bp, Mus musculus
tagtctcagtaactttattttccct

SEQ ID NO: 780523 - DNA, 25 bp, Mus musculus
tagtctcagtaagtttattttccct

SEQ ID NO: 780524 - DNA, 25 bp, Mus musculus
tagtctcagtcaacccaagagtgca

SEQ ID NO: 780525 - DNA, 25 bp, Mus musculus
tagtctcagtcatcccaagagtgca

SEQ ID NO: 780526 - DNA, 25 bp, Mus musculus
tagtctcatcaaagccaaagagccc

SEQ ID NO: 780527 - DNA, 25 bp, Mus musculus
tagtctcatcaatgccaaagagccc

SEQ ID NO: 780528 - DNA, 25 bp, Mus musculus
tagtctcatgagattgcctgctcca

SEQ ID NO: 780529 - DNA, 25 bp, Mus musculus
tagtctcatgagtttgcctgctcca

SEQ ID NO: 780530 - DNA, 25 bp, Mus musculus
tagtctcattagataactcacgtat

SEQ ID NO: 780531 - DNA, 25 bp, Mus musculus
tagtctcattagttaactcacgtat

SEQ ID NO: 780532 - DNA, 25 bp, Mus musculus
tagtctcattctaagccttggctgg

SEQ ID NO: 780533 - DNA, 25 bp, Mus musculus
tagtctcattcttagccttggctgg

SEQ ID NO: 780534 - DNA, 25 bp, Mus musculus
tagtctccaacaaatttcatcatat

SEQ ID NO: 780535 - DNA, 25 bp, Mus musculus
tagtctccaacatatttcatcatat

SEQ ID NO: 780536 - DNA, 25 bp, Mus musculus
tagtctccactcagacatccctgtt

SEQ ID NO: 780537 - DNA, 25 bp, Mus musculus
tagtctccactctgacatccctgtt

SEQ ID NO: 780538 - DNA, 25 bp, Mus musculus
tagtctccaggtatacccctgacaa

SEQ ID NO: 780539 - DNA, 25 bp, Mus musculus
tagtctccaggtttacccctgacaa

SEQ ID NO: 780540 - DNA, 25 bp, Mus musculus
tagtctcccaggattgccaacacac

SEQ ID NO: 780541 - DNA, 25 bp, Mus musculus
tagtctcccaggtttgccaacacac

SEQ ID NO: 780542 - DNA, 25 bp, Mus musculus
tagtctccgaaactgcctagaggtc

SEQ ID NO: 780543 - DNA, 25 bp, Mus musculus
tagtctccgaaagtgcctagaggtc

SEQ ID NO: 780544 - DNA, 25 bp, Mus musculus
tagtctcctaatacagtagtagcag

SEQ ID NO: 780545 - DNA, 25 bp, Mus musculus
tagtctcctaattcagtagtagcag

SEQ ID NO: 780546 - DNA, 25 bp, Mus musculus
tagtctcctactatgtgaaccctaa

SEQ ID NO: 780547 - DNA, 25 bp, Mus musculus
tagtctcctactttgtgaaccctaa

SEQ ID NO: 780548 - DNA, 25 bp, Mus musculus
tagtctcctcagctcacgacaggag

SEQ ID NO: 780549 - DNA, 25 bp, Mus musculus
tagtctcctcaggtcacgacaggag

SEQ ID NO: 780550 - DNA, 25 bp, Mus musculus
tagtctcctgggatagccgatgcct

SEQ ID NO: 780551 - DNA, 25 bp, Mus musculus
tagtctcctgggttagccgatgcct

SEQ ID NO: 780552 - DNA, 25 bp, Mus musculus
tagtctccttaaatacttttcctct

SEQ ID NO: 780553 - DNA, 25 bp, Mus musculus
tagtctccttaattacttttcctct

SEQ ID NO: 780554 - DNA, 25 bp, Mus musculus
tagtctccttttctgcttgagaagg

SEQ ID NO: 780555 - DNA, 25 bp, Mus musculus
tagtctccttttgtgcttgagaagg

SEQ ID NO: 780556 - DNA, 25 bp, Mus musculus
tagtctcgatacatcagtggatttg

SEQ ID NO: 780557 - DNA, 25 bp, Mus musculus
tagtctcgatacttcagtggatttg

SEQ ID NO: 780558 - DNA, 25 bp, Mus musculus
tagtctcgcgcacgttcgttgcaca

SEQ ID NO: 780559 - DNA, 25 bp, Mus musculus
tagtctcgcgcaggttcgttgcaca

SEQ ID NO: 780560 - DNA, 25 bp, Mus musculus
tagtctcgtcagagtccttgtagct

SEQ ID NO: 780561 - DNA, 25 bp, Mus musculus
tagtctcgtcagtgtccttgtagct

SEQ ID NO: 780562 - DNA, 25 bp, Mus musculus
tagtctctaagtatttgtcatttcc

SEQ ID NO: 780563 - DNA, 25 bp, Mus musculus
tagtctctaagtttttgtcatttcc

SEQ ID NO: 780564 - DNA, 25 bp, Mus musculus
tagtctctacttctgctctggtcta

SEQ ID NO: 780565 - DNA, 25 bp, Mus musculus
tagtctctacttgtgctctggtcta

SEQ ID NO: 780566 - DNA, 25 bp, Mus musculus
tagtctctagtcaggcagcacgtcg

SEQ ID NO: 780567 - DNA, 25 bp, Mus musculus
tagtctctagtctggcagcacgtcg

SEQ ID NO: 780568 - DNA, 25 bp, Mus musculus
tagtctctagttctttcttgctact

SEQ ID NO: 780569 - DNA, 25 bp, Mus musculus
tagtctctagttgtttcttgctact

SEQ ID NO: 780570 - DNA, 25 bp, Mus musculus
tagtctctcaatccatatggtcttt

SEQ ID NO: 780571 - DNA, 25 bp, Mus musculus
tagtctctcaatgcatatggtcttt

SEQ ID NO: 780572 - DNA, 25 bp, Mus musculus
tagtctctcattatactgcaaagtg

SEQ ID NO: 780573 - DNA, 25 bp, Mus musculus
tagtctctcattttactgcaaagtg

SEQ ID NO: 780574 - DNA, 25 bp, Mus musculus
tagtctctctccatttggctggaaa

SEQ ID NO: 780575 - DNA, 25 bp, Mus musculus
tagtctctctccttttggctggaaa

SEQ ID NO: 780576 - DNA, 25 bp, Mus musculus
tagtctctctgcataccaaacaggc

SEQ ID NO: 780577 - DNA, 25 bp, Mus musculus
tagtctctctgcttaccaaacaggc

SEQ ID NO: 780578 - DNA, 25 bp, Mus musculus
tagtctctgaaacccaagtcctatc

SEQ ID NO: 780579 - DNA, 25 bp, Mus musculus
tagtctctgaaagccaagtcctatc

SEQ ID NO: 780580 - DNA, 25 bp, Mus musculus
tagtctctgctaaggaagtttatta

SEQ ID NO: 780581 - DNA, 25 bp, Mus musculus
tagtctctgctatggaagtttatta

SEQ ID NO: 780582 - DNA, 25 bp, Mus musculus
tagtctctgctgacaccatacacac

SEQ ID NO: 780583 - DNA, 25 bp, Mus musculus
tagtctctgctgtcaccatacacac

SEQ ID NO: 780584 - DNA, 25 bp, Mus musculus
tagtctctgcttcccatacacaaaa

SEQ ID NO: 780585 - DNA, 25 bp, Mus musculus
tagtctctgcttgccatacacaaaa

SEQ ID NO: 780586 - DNA, 25 bp, Mus musculus
tagtctctggagatggccctcgtgg

SEQ ID NO: 780587 - DNA, 25 bp, Mus musculus
tagtctctggagttggccctcgtgg

SEQ ID NO: 780588 - DNA, 25 bp, Mus musculus
tagtctctgtttcttgcacatatca

SEQ ID NO: 780589 - DNA, 25 bp, Mus musculus
tagtctctgtttgttgcacatatca

SEQ ID NO: 780590 - DNA, 25 bp, Mus musculus
tagtctcttcagatgcagtggcaac

SEQ ID NO: 780591 - DNA, 25 bp, Mus musculus
tagtctcttcagttgcagtggcaac

SEQ ID NO: 780592 - DNA, 25 bp, Mus musculus
tagtctgaatgcagctggacctcct

SEQ ID NO: 780593 - DNA, 25 bp, Mus musculus
tagtctgaatgctgctggacctcct

SEQ ID NO: 780594 - DNA, 25 bp, Mus musculus
tagtctgaatgtatgcaggcattgg

SEQ ID NO: 780595 - DNA, 25 bp, Mus musculus
tagtctgaatgtttgcaggcattgg

SEQ ID NO: 780596 - DNA, 25 bp, Mus musculus
tagtctgaccttatcaccaggaaac

SEQ ID NO: 780597 - DNA, 25 bp, Mus musculus
tagtctgaccttttcaccaggaaac

SEQ ID NO: 780598 - DNA, 25 bp, Mus musculus
tagtctgactgcagttccatggctg

SEQ ID NO: 780599 - DNA, 25 bp, Mus musculus
tagtctgactgctgttccatggctg

SEQ ID NO: 780600 - DNA, 25 bp, Mus musculus
tagtctgacttaatatcccgggctg

SEQ ID NO: 780601 - DNA, 25 bp, Mus musculus
tagtctgacttattatcccgggctg

SEQ ID NO: 780602 - DNA, 25 bp, Mus musculus
tagtctgagaagagccaccttaaaa

SEQ ID NO: 780603 - DNA, 25 bp, Mus musculus
tagtctgagaagtgccaccttaaaa

SEQ ID NO: 780604 - DNA, 25 bp, Mus musculus
tagtctgagatgacttgccctcatt

SEQ ID NO: 780605 - DNA, 25 bp, Mus musculus
tagtctgagatgtcttgccctcatt

SEQ ID NO: 780606 - DNA, 25 bp, Mus musculus
tagtctgatcaaagttgtgtgggta

SEQ ID NO: 780607 - DNA, 25 bp, Mus musculus
tagtctgatcaatgttgtgtgggta

SEQ ID NO: 780608 - DNA, 25 bp, Mus musculus
tagtctgcactcacaccttcgaaga

SEQ ID NO: 780609 - DNA, 25 bp, Mus musculus
tagtctgcactctcaccttcgaaga

SEQ ID NO: 780610 - DNA, 25 bp, Mus musculus
tagtctgcagtcatataaggtcact

SEQ ID NO: 780611 - DNA, 25 bp, Mus musculus
tagtctgcagtcttataaggtcact

SEQ ID NO: 780612 - DNA, 25 bp, Mus musculus
tagtctgccactaaaatatgcaagt

SEQ ID NO: 780613 - DNA, 25 bp, Mus musculus
tagtctgccacttaaatatgcaagt

SEQ ID NO: 780614 - DNA, 25 bp, Mus musculus
tagtctgccatcatgaagctgctcg

SEQ ID NO: 780615 - DNA, 25 bp, Mus musculus
tagtctgccatcttgaagctgctcg

SEQ ID NO: 780616 - DNA, 25 bp, Mus musculus
tagtctgccctcagcatctgtgttc

SEQ ID NO: 780617 - DNA, 25 bp, Mus musculus
tagtctgccctctgcatctgtgttc

SEQ ID NO: 780618 - DNA, 25 bp, Mus musculus
tagtctgccgtgacaagagcacatg

SEQ ID NO: 780619 - DNA, 25 bp, Mus musculus
tagtctgccgtgtcaagagcacatg

SEQ ID NO: 780620 - DNA, 25 bp, Mus musculus
tagtctgctagacttcttttctgtg

SEQ ID NO: 780621 - DNA, 25 bp, Mus musculus
tagtctgctagagttcttttctgtg

SEQ ID NO: 780622 - DNA, 25 bp, Mus musculus
tagtctgctgagactaccctaaagc

SEQ ID NO: 780623 - DNA, 25 bp, Mus musculus
tagtctgctgagtctaccctaaagc

SEQ ID NO: 780624 - DNA, 25 bp, Mus musculus
tagtctgctgcaaacctttattttt

SEQ ID NO: 780625 - DNA, 25 bp, Mus musculus
tagtctgctgcatacctttattttt

SEQ ID NO: 780626 - DNA, 25 bp, Mus musculus
tagtctgctggcactcacttgcaaa

SEQ ID NO: 780627 - DNA, 25 bp, Mus musculus
tagtctgctggctctcacttgcaaa

SEQ ID NO: 780628 - DNA, 25 bp, Mus musculus
tagtctggactcacacttcagggta

SEQ ID NO: 780629 - DNA, 25 bp, Mus musculus
tagtctggactctcacttcagggta

SEQ ID NO: 780630 - DNA, 25 bp, Mus musculus
tagtctggcagtcaaatgtacataa

SEQ ID NO: 780631 - DNA, 25 bp, Mus musculus
tagtctggcagtgaaatgtacataa

SEQ ID NO: 780632 - DNA, 25 bp, Mus musculus
tagtctggccatcgacctctggcat

SEQ ID NO: 780633 - DNA, 25 bp, Mus musculus
tagtctggccatggacctctggcat

SEQ ID NO: 780634 - DNA, 25 bp, Mus musculus
tagtctgggccaaccttttgtaaat

SEQ ID NO: 780635 - DNA, 25 bp, Mus musculus
tagtctgggccatccttttgtaaat

SEQ ID NO: 780636 - DNA, 25 bp, Mus musculus
tagtctgggtgtcggccgctctcat

SEQ ID NO: 780637 - DNA, 25 bp, Mus musculus
tagtctgggtgtgggccgctctcat

SEQ ID NO: 780638 - DNA, 25 bp, Mus musculus
tagtctggtatgactgtgctttgat

SEQ ID NO: 780639 - DNA, 25 bp, Mus musculus
tagtctggtatgtctgtgctttgat

SEQ ID NO: 780640 - DNA, 25 bp, Mus musculus
tagtctggtcctccaagagcggaag

SEQ ID NO: 780641 - DNA, 25 bp, Mus musculus
tagtctggtcctgcaagagcggaag

SEQ ID NO: 780642 - DNA, 25 bp, Mus musculus
tagtctgtacagacagtcctgatct

SEQ ID NO: 780643 - DNA, 25 bp, Mus musculus
tagtctgtacagtcagtcctgatct

SEQ ID NO: 780644 - DNA, 25 bp, Mus musculus
tagtctgtatgcaccattgtattgt

SEQ ID NO: 780645 - DNA, 25 bp, Mus musculus
tagtctgtatgctccattgtattgt

SEQ ID NO: 780646 - DNA, 25 bp, Mus musculus
tagtctgtcagcagtaccagggaac

SEQ ID NO: 780647 - DNA, 25 bp, Mus musculus
tagtctgtcagctgtaccagggaac

SEQ ID NO: 780648 - DNA, 25 bp, Mus musculus
tagtctgtctaacggagcttgcctc

SEQ ID NO: 780649 - DNA, 25 bp, Mus musculus
tagtctgtctaagggagcttgcctc

SEQ ID NO: 780650 - DNA, 25 bp, Mus musculus
tagtctgtcttaaagagtgagttcc

SEQ ID NO: 780651 - DNA, 25 bp, Mus musculus
tagtctgtcttatagagtgagttcc

SEQ ID NO: 780652 - DNA, 25 bp, Mus musculus
tagtctgtcttcacatgggagcagc

SEQ ID NO: 780653 - DNA, 25 bp, Mus musculus
tagtctgtcttctcatgggagcagc

SEQ ID NO: 780654 - DNA, 25 bp, Mus musculus
tagtctgtctttatgcataatactg

SEQ ID NO: 780655 - DNA, 25 bp, Mus musculus
tagtctgtctttttgcataatactg

SEQ ID NO: 780656 - DNA, 25 bp, Mus musculus
tagtctgtgagacaggacttgcctg

SEQ ID NO: 780657 - DNA, 25 bp, Mus musculus
tagtctgtgagagaggacttgcctg

SEQ ID NO: 780658 - DNA, 25 bp, Mus musculus
tagtctgtgcatcaaacagggcttg

SEQ ID NO: 780659 - DNA, 25 bp, Mus musculus
tagtctgtgcatgaaacagggcttg

SEQ ID NO: 780660 - DNA, 25 bp, Mus musculus
tagtctgtgtctcccatcctgattt

SEQ ID NO: 780661 - DNA, 25 bp, Mus musculus
tagtctgtgtctgccatcctgattt

SEQ ID NO: 780662 - DNA, 25 bp, Mus musculus
tagtctgtgtgaccctcagaaaggc

SEQ ID NO: 780663 - DNA, 25 bp, Mus musculus
tagtctgtgtgagcctcagaaaggc

SEQ ID NO: 780664 - DNA, 25 bp, Mus musculus
tagtctgttagtccccagctggtag

SEQ ID NO: 780665 - DNA, 25 bp, Mus musculus
tagtctgttagtgcccagctggtag

SEQ ID NO: 780666 - DNA, 25 bp, Mus musculus
tagtctgttcctctgattcccagca

SEQ ID NO: 780667 - DNA, 25 bp, Mus musculus
tagtctgttcctgtgattcccagca

SEQ ID NO: 780668 - DNA, 25 bp, Mus musculus
tagtctgtttttctaatgggataat

SEQ ID NO: 780669 - DNA, 25 bp, Mus musculus
tagtctgtttttgtaatgggataat

SEQ ID NO: 780670 - DNA, 25 bp, Mus musculus
tagtcttaaaaccttgccttcattc

SEQ ID NO: 780671 - DNA, 25 bp, Mus musculus
tagtcttaaaacgttgccttcattc

SEQ ID NO: 780672 - DNA, 25 bp, Mus musculus
tagtcttaacagaggcatgctttat

SEQ ID NO: 780673 - DNA, 25 bp, Mus musculus
tagtcttaacagtggcatgctttat

SEQ ID NO: 780674 - DNA, 25 bp, Mus musculus
tagtcttacagacccgcctagggat

SEQ ID NO: 780675 - DNA, 25 bp, Mus musculus
tagtcttacagagccgcctagggat

SEQ ID NO: 780676 - DNA, 25 bp, Mus musculus
tagtcttacattagctcctatttaa

SEQ ID NO: 780677 - DNA, 25 bp, Mus musculus
tagtcttacatttgctcctatttaa

SEQ ID NO: 780678 - DNA, 25 bp, Mus musculus
tagtcttactaccttgtgatctcag

SEQ ID NO: 780679 - DNA, 25 bp, Mus musculus
tagtcttactacgttgtgatctcag

SEQ ID NO: 780680 - DNA, 25 bp, Mus musculus
tagtcttaggtcacagggattgggc

SEQ ID NO: 780681 - DNA, 25 bp, Mus musculus
tagtcttaggtctcagggattgggc

SEQ ID NO: 780682 - DNA, 25 bp, Mus musculus
tagtcttataacatattaccattgt

SEQ ID NO: 780683 - DNA, 25 bp, Mus musculus
tagtcttataacttattaccattgt

SEQ ID NO: 780684 - DNA, 25 bp, Mus musculus
tagtcttatgatctagttagcgggc

SEQ ID NO: 780685 - DNA, 25 bp, Mus musculus
tagtcttatgatgtagttagcgggc

SEQ ID NO: 780686 - DNA, 25 bp, Mus musculus
tagtcttcaacaaggagcccaggga

SEQ ID NO: 780687 - DNA, 25 bp, Mus musculus
tagtcttcaacatggagcccaggga

SEQ ID NO: 780688 - DNA, 25 bp, Mus musculus
tagtcttcacaccttgagccatttg

SEQ ID NO: 780689 - DNA, 25 bp, Mus musculus
tagtcttcacacgttgagccatttg

SEQ ID NO: 780690 - DNA, 25 bp, Mus musculus
tagtcttcacgaccacaaagcaggc

SEQ ID NO: 780691 - DNA, 25 bp, Mus musculus
tagtcttcacgagcacaaagcaggc

SEQ ID NO: 780692 - DNA, 25 bp, Mus musculus
tagtcttcattaccttctcctatgt

SEQ ID NO: 780693 - DNA, 25 bp, Mus musculus
tagtcttcattagcttctcctatgt

SEQ ID NO: 780694 - DNA, 25 bp, Mus musculus
tagtcttccaacctgtgggtcttgg

SEQ ID NO: 780695 - DNA, 25 bp, Mus musculus
tagtcttccaacgtgtgggtcttgg

SEQ ID NO: 780696 - DNA, 25 bp, Mus musculus
tagtcttccagtccagcatgacatt

SEQ ID NO: 780697 - DNA, 25 bp, Mus musculus
tagtcttccagtgcagcatgacatt

SEQ ID NO: 780698 - DNA, 25 bp, Mus musculus
tagtcttcccaacatttagtccagt

SEQ ID NO: 780699 - DNA, 25 bp, Mus musculus
tagtcttcccaagatttagtccagt

SEQ ID NO: 780700 - DNA, 25 bp, Mus musculus
tagtcttccccaccgaattatgcaa

SEQ ID NO: 780701 - DNA, 25 bp, Mus musculus
tagtcttccccagcgaattatgcaa

SEQ ID NO: 780702 - DNA, 25 bp, Mus musculus
tagtcttccttccatgtttggtgaa

SEQ ID NO: 780703 - DNA, 25 bp, Mus musculus
tagtcttccttcgatgtttggtgaa

SEQ ID NO: 780704 - DNA, 25 bp, Mus musculus
tagtcttcctttcctgtcggacaag

SEQ ID NO: 780705 - DNA, 25 bp, Mus musculus
tagtcttcctttgctgtcggacaag

SEQ ID NO: 780706 - DNA, 25 bp, Mus musculus
tagtcttcgtgcctcatggtgagga

SEQ ID NO: 780707 - DNA, 25 bp, Mus musculus
tagtcttcgtgcgtcatggtgagga

SEQ ID NO: 780708 - DNA, 25 bp, Mus musculus
tagtcttctctgacagacaccggca

SEQ ID NO: 780709 - DNA, 25 bp, Mus musculus
tagtcttctctgtcagacaccggca

SEQ ID NO: 780710 - DNA, 25 bp, Mus musculus
tagtcttctgcaagtcgcacaatgt

SEQ ID NO: 780711 - DNA, 25 bp, Mus musculus
tagtcttctgcatgtcgcacaatgt

SEQ ID NO: 780712 - DNA, 25 bp, Mus musculus
tagtcttctgtgacattctatctga

SEQ ID NO: 780713 - DNA, 25 bp, Mus musculus
tagtcttctgtgtcattctatctga

SEQ ID NO: 780714 - DNA, 25 bp, Mus musculus
tagtcttctgttccccagtttctga

SEQ ID NO: 780715 - DNA, 25 bp, Mus musculus
tagtcttctgttgcccagtttctga

SEQ ID NO: 780716 - DNA, 25 bp, Mus musculus
tagtcttgaaaaatgtcccattcgg

SEQ ID NO: 780717 - DNA, 25 bp, Mus musculus
tagtcttgaaaattgtcccattcgg

SEQ ID NO: 780718 - DNA, 25 bp, Mus musculus
tagtcttgaactcctgaacgccttg

SEQ ID NO: 780719 - DNA, 25 bp, Mus musculus
tagtcttgaactgctgaacgccttg

SEQ ID NO: 780720 - DNA, 25 bp, Mus musculus
tagtcttgacaaacaaccagttgag

SEQ ID NO: 780721 - DNA, 25 bp, Mus musculus
tagtcttgacaatcaaccagttgag

SEQ ID NO: 780722 - DNA, 25 bp, Mus musculus
tagtcttgaggcattcgctagaaaa

SEQ ID NO: 780723 - DNA, 25 bp, Mus musculus
tagtcttgaggctttcgctagaaaa

SEQ ID NO: 780724 - DNA, 25 bp, Mus musculus
tagtcttgattaagatgtgtgtgca

SEQ ID NO: 780725 - DNA, 25 bp, Mus musculus
tagtcttgattatgatgtgtgtgca

SEQ ID NO: 780726 - DNA, 25 bp, Mus musculus
tagtcttgattcacgggcacattcc

SEQ ID NO: 780727 - DNA, 25 bp, Mus musculus
tagtcttgattctcgggcacattcc

SEQ ID NO: 780728 - DNA, 25 bp, Mus musculus
tagtcttgcagaaccgcagaggctt

SEQ ID NO: 780729 - DNA, 25 bp, Mus musculus
tagtcttgcagatccgcagaggctt

SEQ ID NO: 780730 - DNA, 25 bp, Mus musculus
tagtcttgcattctgtagctaaagc

SEQ ID NO: 780731 - DNA, 25 bp, Mus musculus
tagtcttgcattgtgtagctaaagc

SEQ ID NO: 780732 - DNA, 25 bp, Mus musculus
tagtcttgccaaatcacagtgttgc

SEQ ID NO: 780733 - DNA, 25 bp, Mus musculus
tagtcttgccaattcacagtgttgc

SEQ ID NO: 780734 - DNA, 25 bp, Mus musculus
tagtcttggagaactaccctttctg

SEQ ID NO: 780735 - DNA, 25 bp, Mus musculus
tagtcttggagatctaccctttctg

SEQ ID NO: 780736 - DNA, 25 bp, Mus musculus
tagtcttgggtgaccttattcttca

SEQ ID NO: 780737 - DNA, 25 bp, Mus musculus
tagtcttgggtgtccttattcttca

SEQ ID NO: 780738 - DNA, 25 bp, Mus musculus
tagtcttggtttagcacaggatctc

SEQ ID NO: 780739 - DNA, 25 bp, Mus musculus
tagtcttggttttgcacaggatctc

SEQ ID NO: 780740 - DNA, 25 bp, Mus musculus
tagtcttgtcgtatagccctatggg

SEQ ID NO: 780741 - DNA, 25 bp, Mus musculus
tagtcttgtcgtttagccctatggg

SEQ ID NO: 780742 - DNA, 25 bp, Mus musculus
tagtcttgtgctacacagcaggtgt

SEQ ID NO: 780743 - DNA, 25 bp, Mus musculus
tagtcttgtgcttcacagcaggtgt

SEQ ID NO: 780744 - DNA, 25 bp, Mus musculus
tagtcttgtttgacaaagctaccta

SEQ ID NO: 780745 - DNA, 25 bp, Mus musculus
tagtcttgtttgtcaaagctaccta

SEQ ID NO: 780746 - DNA, 25 bp, Mus musculus
tagtctttactgcaagatcacccca

SEQ ID NO: 780747 - DNA, 25 bp, Mus musculus
tagtctttactggaagatcacccca

SEQ ID NO: 780748 - DNA, 25 bp, Mus musculus
tagtctttaggccagcatcagcttc

SEQ ID NO: 780749 - DNA, 25 bp, Mus musculus
tagtctttaggcgagcatcagcttc

SEQ ID NO: 780750 - DNA, 25 bp, Mus musculus
tagtctttagtacggcaagcagatc

SEQ ID NO: 780751 - DNA, 25 bp, Mus musculus
tagtctttagtagggcaagcagatc

SEQ ID NO: 780752 - DNA, 25 bp, Mus musculus
tagtctttatctcttgtggaaaaca

SEQ ID NO: 780753 - DNA, 25 bp, Mus musculus
tagtctttatctgttgtggaaaaca

SEQ ID NO: 780754 - DNA, 25 bp, Mus musculus
tagtctttatgaaggtcaccacctc

SEQ ID NO: 780755 - DNA, 25 bp, Mus musculus
tagtctttatgatggtcaccacctc

SEQ ID NO: 780756 - DNA, 25 bp, Mus musculus
tagtctttcaaaccctagtttccta

SEQ ID NO: 780757 - DNA, 25 bp, Mus musculus
tagtctttcaaagcctagtttccta

SEQ ID NO: 780758 - DNA, 25 bp, Mus musculus
tagtctttcaagacgtgtgcattgc

SEQ ID NO: 780759 - DNA, 25 bp, Mus musculus
tagtctttcaagtcgtgtgcattgc

SEQ ID NO: 780760 - DNA, 25 bp, Mus musculus
tagtctttcattccttttcgttttg

SEQ ID NO: 780761 - DNA, 25 bp, Mus musculus
tagtctttcattgcttttcgttttg

SEQ ID NO: 780762 - DNA, 25 bp, Mus musculus
tagtctttcctcatccagagaaggt

SEQ ID NO: 780763 - DNA, 25 bp, Mus musculus
tagtctttcctcttccagagaaggt

SEQ ID NO: 780764 - DNA, 25 bp, Mus musculus
tagtctttgaagcaacatcgtacat

SEQ ID NO: 780765 - DNA, 25 bp, Mus musculus
tagtctttgaaggaacatcgtacat

SEQ ID NO: 780766 - DNA, 25 bp, Mus musculus
tagtctttggaaccaatcctactag

SEQ ID NO: 780767 - DNA, 25 bp, Mus musculus
tagtctttggaagcaatcctactag

SEQ ID NO: 780768 - DNA, 25 bp, Mus musculus
tagtctttgtaaatctgcatatggc

SEQ ID NO: 780769 - DNA, 25 bp, Mus musculus
tagtctttgtaattctgcatatggc

SEQ ID NO: 780770 - DNA, 25 bp, Mus musculus
tagtcttttaccctttggctgtatt

SEQ ID NO: 780771 - DNA, 25 bp, Mus musculus
tagtcttttaccgtttggctgtatt

SEQ ID NO: 780772 - DNA, 25 bp, Mus musculus
tagtctttttcaacacagtcatagc

SEQ ID NO: 780773 - DNA, 25 bp, Mus musculus
tagtctttttcatcacagtcatagc

SEQ ID NO: 780774 - DNA, 25 bp, Mus musculus
tagtgaaaaagcaagcgtgctgctt

SEQ ID NO: 780775 - DNA, 25 bp, Mus musculus
tagtgaaaaagctagcgtgctgctt

SEQ ID NO: 780776 - DNA, 25 bp, Mus musculus
tagtgaaaagaaaccccattggcct

SEQ ID NO: 780777 - DNA, 25 bp, Mus musculus
tagtgaaaagaatccccattggcct

SEQ ID NO: 780778 - DNA, 25 bp, Mus musculus
tagtgaaacaggcgcaatggtgcgc

SEQ ID NO: 780779 - DNA, 25 bp, Mus musculus
tagtgaaacaggggcaatggtgcgc

SEQ ID NO: 780780 - DNA, 25 bp, Mus musculus
tagtgaaaccggaacaccctgggag

SEQ ID NO: 780781 - DNA, 25 bp, Mus musculus
tagtgaaaccggtacaccctgggag

SEQ ID NO: 780782 - DNA, 25 bp, Mus musculus
tagtgaaaggcaactccgttccttc

SEQ ID NO: 780783 - DNA, 25 bp, Mus musculus
tagtgaaaggcacccaaccgggctt

SEQ ID NO: 780784 - DNA, 25 bp, Mus musculus
tagtgaaaggcagccaaccgggctt

SEQ ID NO: 780785 - DNA, 25 bp, Mus musculus
tagtgaaaggcatctccgttccttc

SEQ ID NO: 780786 - DNA, 25 bp, Mus musculus
tagtgaaatgaccttgcctctctgt

SEQ ID NO: 780787 - DNA, 25 bp, Mus musculus
tagtgaaatgacgttgcctctctgt

SEQ ID NO: 780788 - DNA, 25 bp, Mus musculus
tagtgaacaccgcagggccgagcat

SEQ ID NO: 780789 - DNA, 25 bp, Mus musculus
tagtgaacaccggagggccgagcat

SEQ ID NO: 780790 - DNA, 25 bp, Mus musculus
tagtgaacattccacggtgcctgat

SEQ ID NO: 780791 - DNA, 25 bp, Mus musculus
tagtgaacattcgacggtgcctgat

SEQ ID NO: 780792 - DNA, 25 bp, Mus musculus
tagtgaaccgtacgcttgggaggcg

SEQ ID NO: 780793 - DNA, 25 bp, Mus musculus
tagtgaaccgtaggcttgggaggcg

SEQ ID NO: 780794 - DNA, 25 bp, Mus musculus
tagtgaactgagaagcttctgctgt

SEQ ID NO: 780795 - DNA, 25 bp, Mus musculus
tagtgaactgagtagcttctgctgt

SEQ ID NO: 780796 - DNA, 25 bp, Mus musculus
tagtgaagagttctagttgcccaac

SEQ ID NO: 780797 - DNA, 25 bp, Mus musculus
tagtgaagagttgtagttgcccaac

SEQ ID NO: 780798 - DNA, 25 bp, Mus musculus
tagtgaagcattcctcaggctaaga

SEQ ID NO: 780799 - DNA, 25 bp, Mus musculus
tagtgaagcattgctcaggctaaga

SEQ ID NO: 780800 - DNA, 25 bp, Mus musculus
tagtgaagccacacgctccattaat

SEQ ID NO: 780801 - DNA, 25 bp, Mus musculus
tagtgaagccactcgctccattaat

SEQ ID NO: 780802 - DNA, 25 bp, Mus musculus
tagtgaagctacacctaggtatgcg

SEQ ID NO: 780803 - DNA, 25 bp, Mus musculus
tagtgaagctactcctaggtatgcg

SEQ ID NO: 780804 - DNA, 25 bp, Mus musculus
tagtgaagctgaaggagccgcacaa

SEQ ID NO: 780805 - DNA, 25 bp, Mus musculus
tagtgaagctgatggagccgcacaa

SEQ ID NO: 780806 - DNA, 25 bp, Mus musculus
tagtgaagctgtaggccagagcaat

SEQ ID NO: 780807 - DNA, 25 bp, Mus musculus
tagtgaagctgttggccagagcaat

SEQ ID NO: 780808 - DNA, 25 bp, Mus musculus
tagtgaagtcctacctcaaaataaa

SEQ ID NO: 780809 - DNA, 25 bp, Mus musculus
tagtgaagtccttcctcaaaataaa

SEQ ID NO: 780810 - DNA, 25 bp, Mus musculus
tagtgaatagagatacccctcctcc

SEQ ID NO: 780811 - DNA, 25 bp, Mus musculus
tagtgaatagagttacccctcctcc

SEQ ID NO: 780812 - DNA, 25 bp, Mus musculus
tagtgaatccatcccaccatagtac

SEQ ID NO: 780813 - DNA, 25 bp, Mus musculus
tagtgaatccatgccaccatagtac

SEQ ID NO: 780814 - DNA, 25 bp, Mus musculus
tagtgaatctcaagggatcgtccca

SEQ ID NO: 780815 - DNA, 25 bp, Mus musculus
tagtgaatctcatgggatcgtccca

SEQ ID NO: 780816 - DNA, 25 bp, Mus musculus
tagtgaatgccaactttcctcaacc

SEQ ID NO: 780817 - DNA, 25 bp, Mus musculus
tagtgaatgccatctttcctcaacc

SEQ ID NO: 780818 - DNA, 25 bp, Mus musculus
tagtgaatgccgagtgcctagctaa

SEQ ID NO: 780819 - DNA, 25 bp, Mus musculus
tagtgaatgccgtgtgcctagctaa

SEQ ID NO: 780820 - DNA, 25 bp, Mus musculus
tagtgaatgctcagaattagggcct

SEQ ID NO: 780821 - DNA, 25 bp, Mus musculus
tagtgaatgctctgaattagggcct

SEQ ID NO: 780822 - DNA, 25 bp, Mus musculus
tagtgaatgcttccagtctgatacc

SEQ ID NO: 780823 - DNA, 25 bp, Mus musculus
tagtgaatgcttgcagtctgatacc

SEQ ID NO: 780824 - DNA, 25 bp, Mus musculus
tagtgacaaaccagcttcttcatgt

SEQ ID NO: 780825 - DNA, 25 bp, Mus musculus
tagtgacaaacctgcttcttcatgt

SEQ ID NO: 780826 - DNA, 25 bp, Mus musculus
tagtgacaatggcatcacagttgta

SEQ ID NO: 780827 - DNA, 25 bp, Mus musculus
tagtgacaatgggatcacagttgta

SEQ ID NO: 780828 - DNA, 25 bp, Mus musculus
tagtgacacctacgatccgcatgga

SEQ ID NO: 780829 - DNA, 25 bp, Mus musculus
tagtgacacctaggatccgcatgga

SEQ ID NO: 780830 - DNA, 25 bp, Mus musculus
tagtgacacgtgacctccgtttgtt

SEQ ID NO: 780831 - DNA, 25 bp, Mus musculus
tagtgacacgtgtcctccgtttgtt

SEQ ID NO: 780832 - DNA, 25 bp, Mus musculus
tagtgacacttgacgctggagcagc

SEQ ID NO: 780833 - DNA, 25 bp, Mus musculus
tagtgacacttgtcgctggagcagc

SEQ ID NO: 780834 - DNA, 25 bp, Mus musculus
tagtgacagcacaggccgtgtgttt

SEQ ID NO: 780835 - DNA, 25 bp, Mus musculus
tagtgacagcactggccgtgtgttt

SEQ ID NO: 780836 - DNA, 25 bp, Mus musculus
tagtgacagcttactctctgagttt

SEQ ID NO: 780837 - DNA, 25 bp, Mus musculus
tagtgacagctttctctctgagttt

SEQ ID NO: 780838 - DNA, 25 bp, Mus musculus
tagtgacagtctctaagccagcctg

SEQ ID NO: 780839 - DNA, 25 bp, Mus musculus
tagtgacagtctgtaagccagcctg

SEQ ID NO: 780840 - DNA, 25 bp, Mus musculus
tagtgacatgtcacatcccaaatga

SEQ ID NO: 780841 - DNA, 25 bp, Mus musculus
tagtgacatgtctcatcccaaatga

SEQ ID NO: 780842 - DNA, 25 bp, Mus musculus
tagtgaccgggcatgactactcccc

SEQ ID NO: 780843 - DNA, 25 bp, Mus musculus
tagtgaccgggcttgactactcccc

SEQ ID NO: 780844 - DNA, 25 bp, Mus musculus
tagtgaccgtccagtcttagttaac

SEQ ID NO: 780845 - DNA, 25 bp, Mus musculus
tagtgaccgtcctgtcttagttaac

SEQ ID NO: 780846 - DNA, 25 bp, Mus musculus
tagtgacctgtacgcagtggcaaat

SEQ ID NO: 780847 - DNA, 25 bp, Mus musculus
tagtgacctgtaggcagtggcaaat

SEQ ID NO: 780848 - DNA, 25 bp, Mus musculus
tagtgacctttaagagacccagccc

SEQ ID NO: 780849 - DNA, 25 bp, Mus musculus
tagtgacctttatgagacccagccc

SEQ ID NO: 780850 - DNA, 25 bp, Mus musculus
tagtgacgtgatactggtaaccttc

SEQ ID NO: 780851 - DNA, 25 bp, Mus musculus
tagtgacgtgattctggtaaccttc

SEQ ID NO: 780852 - DNA, 25 bp, Mus musculus
tagtgacgtgtgagaccaacaccgg

SEQ ID NO: 780853 - DNA, 25 bp, Mus musculus
tagtgacgtgtgtgaccaacaccgg

SEQ ID NO: 780854 - DNA, 25 bp, Mus musculus
tagtgactattcattctcaccccga

SEQ ID NO: 780855 - DNA, 25 bp, Mus musculus
tagtgactattctttctcaccccga

SEQ ID NO: 780856 - DNA, 25 bp, Mus musculus
tagtgactcccacctatatcatcat

SEQ ID NO: 780857 - DNA, 25 bp, Mus musculus
tagtgactcccagctatatcatcat

SEQ ID NO: 780858 - DNA, 25 bp, Mus musculus
tagtgactctggatttacccctaat

SEQ ID NO: 780859 - DNA, 25 bp, Mus musculus
tagtgactctggttttacccctaat

SEQ ID NO: 780860 - DNA, 25 bp, Mus musculus
tagtgactgaagaggccgagctcat

SEQ ID NO: 780861 - DNA, 25 bp, Mus musculus
tagtgactgaagtggccgagctcat

SEQ ID NO: 780862 - DNA, 25 bp, Mus musculus
tagtgactgagcacttgggagcccc

SEQ ID NO: 780863 - DNA, 25 bp, Mus musculus
tagtgactgagctcttgggagcccc

SEQ ID NO: 780864 - DNA, 25 bp, Mus musculus
tagtgactggaaatctggagctgac

SEQ ID NO: 780865 - DNA, 25 bp, Mus musculus
tagtgactggaattctggagctgac

SEQ ID NO: 780866 - DNA, 25 bp, Mus musculus
tagtgactgtctatcccacaattac

SEQ ID NO: 780867 - DNA, 25 bp, Mus musculus
tagtgactgtctctttctgcgtcct

SEQ ID NO: 780868 - DNA, 25 bp, Mus musculus
tagtgactgtctgtttctgcgtcct

SEQ ID NO: 780869 - DNA, 25 bp, Mus musculus
tagtgactgtctttcccacaattac

SEQ ID NO: 780870 - DNA, 25 bp, Mus musculus
tagtgacttagaaacctcctagcgt

SEQ ID NO: 780871 - DNA, 25 bp, Mus musculus
tagtgacttagatacctcctagcgt

SEQ ID NO: 780872 - DNA, 25 bp, Mus musculus
tagtgacttcctcttaattatacat

SEQ ID NO: 780873 - DNA, 25 bp, Mus musculus
tagtgacttcctgttaattatacat

SEQ ID NO: 780874 - DNA, 25 bp, Mus musculus
tagtgacttcgaagctcatctcaaa

SEQ ID NO: 780875 - DNA, 25 bp, Mus musculus
tagtgacttcgatgctcatctcaaa

SEQ ID NO: 780876 - DNA, 25 bp, Mus musculus
tagtgacttgctatagtcctaaatg

SEQ ID NO: 780877 - DNA, 25 bp, Mus musculus
tagtgacttgctttagtcctaaatg

SEQ ID NO: 780878 - DNA, 25 bp, Mus musculus
tagtgactttacagcatcgtggtgt

SEQ ID NO: 780879 - DNA, 25 bp, Mus musculus
tagtgactttactgcatcgtggtgt

SEQ ID NO: 780880 - DNA, 25 bp, Mus musculus
tagtgactttttaatacggttcttg

SEQ ID NO: 780881 - DNA, 25 bp, Mus musculus
tagtgacttttttatacggttcttg

SEQ ID NO: 780882 - DNA, 25 bp, Mus musculus
tagtgagaagccatctcaacccctt

SEQ ID NO: 780883 - DNA, 25 bp, Mus musculus
tagtgagaagccttctcaacccctt

SEQ ID NO: 780884 - DNA, 25 bp, Mus musculus
tagtgagacatgctcgaggctgcca

SEQ ID NO: 780885 - DNA, 25 bp, Mus musculus
tagtgagacatggtcgaggctgcca

SEQ ID NO: 780886 - DNA, 25 bp, Mus musculus
tagtgagaccaacctcatgaggcct

SEQ ID NO: 780887 - DNA, 25 bp, Mus musculus
tagtgagaccaagctcatgaggcct

SEQ ID NO: 780888 - DNA, 25 bp, Mus musculus
tagtgagacgaaaggcacttgccac

SEQ ID NO: 780889 - DNA, 25 bp, Mus musculus
tagtgagacgaatggcacttgccac

SEQ ID NO: 780890 - DNA, 25 bp, Mus musculus
tagtgagagcttccttcagcccaat

SEQ ID NO: 780891 - DNA, 25 bp, Mus musculus
tagtgagagcttgcttcagcccaat

SEQ ID NO: 780892 - DNA, 25 bp, Mus musculus
tagtgagagtgtcgcctgcctccta

SEQ ID NO: 780893 - DNA, 25 bp, Mus musculus
tagtgagagtgtggcctgcctccta

SEQ ID NO: 780894 - DNA, 25 bp, Mus musculus
tagtgagatgcacacctgagctgct

SEQ ID NO: 780895 - DNA, 25 bp, Mus musculus
tagtgagatgcagacctgagctgct

SEQ ID NO: 780896 - DNA, 25 bp, Mus musculus
tagtgagcatttcacttgtctcccg

SEQ ID NO: 780897 - DNA, 25 bp, Mus musculus
tagtgagcatttgacttgtctcccg

SEQ ID NO: 780898 - DNA, 25 bp, Mus musculus
tagtgagccgttctcatgtgttcat

SEQ ID NO: 780899 - DNA, 25 bp, Mus musculus
tagtgagccgttgtcatgtgttcat

SEQ ID NO: 780900 - DNA, 25 bp, Mus musculus
tagtgagcctgcatgctgacctcag

SEQ ID NO: 780901 - DNA, 25 bp, Mus musculus
tagtgagcctgcttgctgacctcag

SEQ ID NO: 780902 - DNA, 25 bp, Mus musculus
tagtgagcctggaaattgctgccaa

SEQ ID NO: 780903 - DNA, 25 bp, Mus musculus
tagtgagcctggtaattgctgccaa

SEQ ID NO: 780904 - DNA, 25 bp, Mus musculus
tagtgagcgctaactctgctccagg

SEQ ID NO: 780905 - DNA, 25 bp, Mus musculus
tagtgagcgctatctctgctccagg

SEQ ID NO: 780906 - DNA, 25 bp, Mus musculus
tagtgagctcacatccctttgcttt

SEQ ID NO: 780907 - DNA, 25 bp, Mus musculus
tagtgagctcacttccctttgcttt

SEQ ID NO: 780908 - DNA, 25 bp, Mus musculus
tagtgagctctgctagttctggttc

SEQ ID NO: 780909 - DNA, 25 bp, Mus musculus
tagtgagctctggtagttctggttc

SEQ ID NO: 780910 - DNA, 25 bp, Mus musculus
tagtgagcttgcctcttgttaagag

SEQ ID NO: 780911 - DNA, 25 bp, Mus musculus
tagtgagcttgcgtcttgttaagag

SEQ ID NO: 780912 - DNA, 25 bp, Mus musculus
tagtgaggacatacttcctgctttc

SEQ ID NO: 780913 - DNA, 25 bp, Mus musculus
tagtgaggacattcttcctgctttc

SEQ ID NO: 780914 - DNA, 25 bp, Mus musculus
tagtgaggcagtcgtgtcctcagtt

SEQ ID NO: 780915 - DNA, 25 bp, Mus musculus
tagtgaggcagtggtgtcctcagtt

SEQ ID NO: 780916 - DNA, 25 bp, Mus musculus
tagtgaggtcgcaaatgaattgccc

SEQ ID NO: 780917 - DNA, 25 bp, Mus musculus
tagtgaggtcgctaatgaattgccc

SEQ ID NO: 780918 - DNA, 25 bp, Mus musculus
tagtgagtaattactgcttgccagt

SEQ ID NO: 780919 - DNA, 25 bp, Mus musculus
tagtgagtaatttctgcttgccagt

SEQ ID NO: 780920 - DNA, 25 bp, Mus musculus
tagtgagtagggagtcccacttctt

SEQ ID NO: 780921 - DNA, 25 bp, Mus musculus
tagtgagtagggtgtcccacttctt

SEQ ID NO: 780922 - DNA, 25 bp, Mus musculus
tagtgagtcatcactgttgccattc

SEQ ID NO: 780923 - DNA, 25 bp, Mus musculus
tagtgagtcatctctgttgccattc

SEQ ID NO: 780924 - DNA, 25 bp, Mus musculus
tagtgagtgaatatggaccccaaag

SEQ ID NO: 780925 - DNA, 25 bp, Mus musculus
tagtgagtgaatttggaccccaaag

SEQ ID NO: 780926 - DNA, 25 bp, Mus musculus
tagtgagtgcctcccatgcatacct

SEQ ID NO: 780927 - DNA, 25 bp, Mus musculus
tagtgagtgcctgccatgcatacct

SEQ ID NO: 780928 - DNA, 25 bp, Mus musculus
tagtgagtgctcatgtctgacaaat

SEQ ID NO: 780929 - DNA, 25 bp, Mus musculus
tagtgagtgctcttgtctgacaaat

SEQ ID NO: 780930 - DNA, 25 bp, Mus musculus
tagtgagtgtgacatggcgtccctc

SEQ ID NO: 780931 - DNA, 25 bp, Mus musculus
tagtgagtgtgagatggcgtccctc

SEQ ID NO: 780932 - DNA, 25 bp, Mus musculus
tagtgagtgtttccatgtgtctcct

SEQ ID NO: 780933 - DNA, 25 bp, Mus musculus
tagtgagtgtttgcatgtgtctcct

SEQ ID NO: 780934 - DNA, 25 bp, Mus musculus
tagtgagttcccaacttgggccaga

SEQ ID NO: 780935 - DNA, 25 bp, Mus musculus
tagtgagttccctacttgggccaga

SEQ ID NO: 780936 - DNA, 25 bp, Mus musculus
tagtgagttctaacccagcccaacc

SEQ ID NO: 780937 - DNA, 25 bp, Mus musculus
tagtgagttctatcccagcccaacc

SEQ ID NO: 780938 - DNA, 25 bp, Mus musculus
tagtgagtttagaatttgagcccag

SEQ ID NO: 780939 - DNA, 25 bp, Mus musculus
tagtgagtttagtatttgagcccag

SEQ ID NO: 780940 - DNA, 25 bp, Mus musculus
tagtgataaccgagcttcacaggac

SEQ ID NO: 780941 - DNA, 25 bp, Mus musculus
tagtgataaccgtgcttcacaggac

SEQ ID NO: 780942 - DNA, 25 bp, Mus musculus
tagtgatacctgactggtctgtgtg

SEQ ID NO: 780943 - DNA, 25 bp, Mus musculus
tagtgatacctgtctggtctgtgtg

SEQ ID NO: 780944 - DNA, 25 bp, Mus musculus
tagtgataccttctctctagcctcc

SEQ ID NO: 780945 - DNA, 25 bp, Mus musculus
tagtgataccttgtctctagcctcc

SEQ ID NO: 780946 - DNA, 25 bp, Mus musculus
tagtgatactctcaccctgaatcag

SEQ ID NO: 780947 - DNA, 25 bp, Mus musculus
tagtgatactctgaccctgaatcag

SEQ ID NO: 780948 - DNA, 25 bp, Mus musculus
tagtgatcctcccagctatgagttt

SEQ ID NO: 780949 - DNA, 25 bp, Mus musculus
tagtgatcctccgagctatgagttt

SEQ ID NO: 780950 - DNA, 25 bp, Mus musculus
tagtgatcctgacatcttgacatgg

SEQ ID NO: 780951 - DNA, 25 bp, Mus musculus
tagtgatcctgagatcttgacatgg

SEQ ID NO: 780952 - DNA, 25 bp, Mus musculus
tagtgatctaaaacatggctagcat

SEQ ID NO: 780953 - DNA, 25 bp, Mus musculus
tagtgatctaaatcatggctagcat

SEQ ID NO: 780954 - DNA, 25 bp, Mus musculus
tagtgatgaaggagcccagtgccag

SEQ ID NO: 780955 - DNA, 25 bp, Mus musculus
tagtgatgaaggtgcccagtgccag

SEQ ID NO: 780956 - DNA, 25 bp, Mus musculus
tagtgatgacaacccagctgaggac

SEQ ID NO: 780957 - DNA, 25 bp, Mus musculus
tagtgatgacaagccagctgaggac

SEQ ID NO: 780958 - DNA, 25 bp, Mus musculus
tagtgatgacctaaccaagccaatc

SEQ ID NO: 780959 - DNA, 25 bp, Mus musculus
tagtgatgaccttaccaagccaatc

SEQ ID NO: 780960 - DNA, 25 bp, Mus musculus
tagtgatgactccacagatgatgag

SEQ ID NO: 780961 - DNA, 25 bp, Mus musculus
tagtgatgactcgacagatgatgag

SEQ ID NO: 780962 - DNA, 25 bp, Mus musculus
tagtgatgacttcgccacggactac

SEQ ID NO: 780963 - DNA, 25 bp, Mus musculus
tagtgatgacttggccacggactac

SEQ ID NO: 780964 - DNA, 25 bp, Mus musculus
tagtgatgccatcagcagaggccct

SEQ ID NO: 780965 - DNA, 25 bp, Mus musculus
tagtgatgccatgagcagaggccct

SEQ ID NO: 780966 - DNA, 25 bp, Mus musculus
tagtgatgggaaccattacaccagc

SEQ ID NO: 780967 - DNA, 25 bp, Mus musculus
tagtgatgggaagcattacaccagc

SEQ ID NO: 780968 - DNA, 25 bp, Mus musculus
tagtgatgggctcatggcgggctct

SEQ ID NO: 780969 - DNA, 25 bp, Mus musculus
tagtgatgggctgatggcgggctct

SEQ ID NO: 780970 - DNA, 25 bp, Mus musculus
tagtgatggtttatcatcaaccttt

SEQ ID NO: 780971 - DNA, 25 bp, Mus musculus
tagtgatggtttttcatcaaccttt

SEQ ID NO: 780972 - DNA, 25 bp, Mus musculus
tagtgatgtagcattctgtcattgt

SEQ ID NO: 780973 - DNA, 25 bp, Mus musculus
tagtgatgtagctttctgtcattgt

SEQ ID NO: 780974 - DNA, 25 bp, Mus musculus
tagtgattctcccttcgtaaaaaca

SEQ ID NO: 780975 - DNA, 25 bp, Mus musculus
tagtgattctccgttcgtaaaaaca

SEQ ID NO: 780976 - DNA, 25 bp, Mus musculus
tagtgattcttcaacttgctcgcta

SEQ ID NO: 780977 - DNA, 25 bp, Mus musculus
tagtgattcttctacttgctcgcta

SEQ ID NO: 780978 - DNA, 25 bp, Mus musculus
tagtgattgaatcagctccttcccc

SEQ ID NO: 780979 - DNA, 25 bp, Mus musculus
tagtgattgaatgagctccttcccc

SEQ ID NO: 780980 - DNA, 25 bp, Mus musculus
tagtgatttaccagtgccgacggga

SEQ ID NO: 780981 - DNA, 25 bp, Mus musculus
tagtgatttacctgtgccgacggga

SEQ ID NO: 780982 - DNA, 25 bp, Mus musculus
tagtgatttgaactacagctctcct

SEQ ID NO: 780983 - DNA, 25 bp, Mus musculus
tagtgatttgaagtacagctctcct

SEQ ID NO: 780984 - DNA, 25 bp, Mus musculus
tagtgcaaactactggaaccacccc

SEQ ID NO: 780985 - DNA, 25 bp, Mus musculus
tagtgcaaactagtggaaccacccc

SEQ ID NO: 780986 - DNA, 25 bp, Mus musculus
tagtgcaaatacaggcgacttttca

SEQ ID NO: 780987 - DNA, 25 bp, Mus musculus
tagtgcaaatactggcgacttttca

SEQ ID NO: 780988 - DNA, 25 bp, Mus musculus
tagtgcaatatgaacaccgctgatt

SEQ ID NO: 780989 - DNA, 25 bp, Mus musculus
tagtgcaatatgtacaccgctgatt

SEQ ID NO: 780990 - DNA, 25 bp, Mus musculus
tagtgcaatgagaaggtgtggccct

SEQ ID NO: 780991 - DNA, 25 bp, Mus musculus
tagtgcaatgagtaggtgtggccct

SEQ ID NO: 780992 - DNA, 25 bp, Mus musculus
tagtgcaatgccagtgttgaccgca

SEQ ID NO: 780993 - DNA, 25 bp, Mus musculus
tagtgcaatgcctgtgttgaccgca

SEQ ID NO: 780994 - DNA, 25 bp, Mus musculus
tagtgcaatttcctgcttgcttttc

SEQ ID NO: 780995 - DNA, 25 bp, Mus musculus
tagtgcaatttcgtgcttgcttttc

SEQ ID NO: 780996 - DNA, 25 bp, Mus musculus
tagtgcacaactcttattccagcat

SEQ ID NO: 780997 - DNA, 25 bp, Mus musculus
tagtgcacaactgttattccagcat

SEQ ID NO: 780998 - DNA, 25 bp, Mus musculus
tagtgcacagatatccagcacttgg

SEQ ID NO: 780999 - DNA, 25 bp, Mus musculus
tagtgcacagatttccagcacttgg

SEQ ID NO: 781000 - DNA, 25 bp, Mus musculus
tagtgcactgttaatccttcaaggg

SEQ ID NO: 781001 - DNA, 25 bp, Mus musculus
tagtgcactgtttatccttcaaggg

SEQ ID NO: 781002 - DNA, 25 bp, Mus musculus
tagtgcacttatattggaacacagt

SEQ ID NO: 781003 - DNA, 25 bp, Mus musculus
tagtgcacttattttggaacacagt

SEQ ID NO: 781004 - DNA, 25 bp, Mus musculus
tagtgcagcaatctgtaaccccggg

SEQ ID NO: 781005 - DNA, 25 bp, Mus musculus
tagtgcagcaatgtgtaaccccggg

SEQ ID NO: 781006 - DNA, 25 bp, Mus musculus
tagtgcaggcctaggagggcatgct

SEQ ID NO: 781007 - DNA, 25 bp, Mus musculus
tagtgcaggccttggagggcatgct

SEQ ID NO: 781008 - DNA, 25 bp, Mus musculus
tagtgcagtgaactccctcgtgctt

SEQ ID NO: 781009 - DNA, 25 bp, Mus musculus
tagtgcagtgaagtccctcgtgctt

SEQ ID NO: 781010 - DNA, 25 bp, Mus musculus
tagtgcatagcgaagccctggattc

SEQ ID NO: 781011 - DNA, 25 bp, Mus musculus
tagtgcatagcgtagccctggattc

SEQ ID NO: 781012 - DNA, 25 bp, Mus musculus
tagtgcatatataagtggcctctgg

SEQ ID NO: 781013 - DNA, 25 bp, Mus musculus
tagtgcatatattagtggcctctgg

SEQ ID NO: 781014 - DNA, 25 bp, Mus musculus
tagtgcatctttatcgcttttgagc

SEQ ID NO: 781015 - DNA, 25 bp, Mus musculus
tagtgcatctttttcgcttttgagc

SEQ ID NO: 781016 - DNA, 25 bp, Mus musculus
tagtgcatgcaacgtcctagatatt

SEQ ID NO: 781017 - DNA, 25 bp, Mus musculus
tagtgcatgcaaggtcctagatatt

SEQ ID NO: 781018 - DNA, 25 bp, Mus musculus
tagtgcatgctcacccagacttggt

SEQ ID NO: 781019 - DNA, 25 bp, Mus musculus
tagtgcatgctctcccagacttggt

SEQ ID NO: 781020 - DNA, 25 bp, Mus musculus
tagtgcatgcttagtgccgggtacc

SEQ ID NO: 781021 - DNA, 25 bp, Mus musculus
tagtgcatgctttgtgccgggtacc

SEQ ID NO: 781022 - DNA, 25 bp, Mus musculus
tagtgcattaccacagagccacatc

SEQ ID NO: 781023 - DNA, 25 bp, Mus musculus
tagtgcattacctcagagccacatc

SEQ ID NO: 781024 - DNA, 25 bp, Mus musculus
tagtgcattccaaggtgtttcaggg

SEQ ID NO: 781025 - DNA, 25 bp, Mus musculus
tagtgcattccatggtgtttcaggg

SEQ ID NO: 781026 - DNA, 25 bp, Mus musculus
tagtgcattctcacaaggcccaggt

SEQ ID NO: 781027 - DNA, 25 bp, Mus musculus
tagtgcattctctcaaggcccaggt

SEQ ID NO: 781028 - DNA, 25 bp, Mus musculus
tagtgcattgatccatggacccctg

SEQ ID NO: 781029 - DNA, 25 bp, Mus musculus
tagtgcattgatgcatggacccctg

SEQ ID NO: 781030 - DNA, 25 bp, Mus musculus
tagtgccaacacatagagcccggat

SEQ ID NO: 781031 - DNA, 25 bp, Mus musculus
tagtgccaacacttagagcccggat

SEQ ID NO: 781032 - DNA, 25 bp, Mus musculus
tagtgccaatgcacacaacacgtgg

SEQ ID NO: 781033 - DNA, 25 bp, Mus musculus
tagtgccaatgctcacaacacgtgg

SEQ ID NO: 781034 - DNA, 25 bp, Mus musculus
tagtgccaggcccttaaaagctaga

SEQ ID NO: 781035 - DNA, 25 bp, Mus musculus
tagtgccaggccgttaaaagctaga

SEQ ID NO: 781036 - DNA, 25 bp, Mus musculus
tagtgccatcgaaattgcccgtgct

SEQ ID NO: 781037 - DNA, 25 bp, Mus musculus
tagtgccatcgatattgcccgtgct

SEQ ID NO: 781038 - DNA, 25 bp, Mus musculus
tagtgccatcgcagttcctgttggt

SEQ ID NO: 781039 - DNA, 25 bp, Mus musculus
tagtgccatcgctgttcctgttggt

SEQ ID NO: 781040 - DNA, 25 bp, Mus musculus
tagtgccattttcgccggacatggt

SEQ ID NO: 781041 - DNA, 25 bp, Mus musculus
tagtgccattttggccggacatggt

SEQ ID NO: 781042 - DNA, 25 bp, Mus musculus
tagtgcccaccaagtgcctggtagg

SEQ ID NO: 781043 - DNA, 25 bp, Mus musculus
tagtgcccaccatgtgcctggtagg

SEQ ID NO: 781044 - DNA, 25 bp, Mus musculus
tagtgcccactgagatctcatggga

SEQ ID NO: 781045 - DNA, 25 bp, Mus musculus
tagtgcccactgtgatctcatggga

SEQ ID NO: 781046 - DNA, 25 bp, Mus musculus
tagtgcccacttagatctcttacct

SEQ ID NO: 781047 - DNA, 25 bp, Mus musculus
tagtgcccactttgatctcttacct

SEQ ID NO: 781048 - DNA, 25 bp, Mus musculus
tagtgcccagacattctatatgatg

SEQ ID NO: 781049 - DNA, 25 bp, Mus musculus
tagtgcccagactttctatatgatg

SEQ ID NO: 781050 - DNA, 25 bp, Mus musculus
tagtgcccagcaaccaagttgttgt

SEQ ID NO: 781051 - DNA, 25 bp, Mus musculus
tagtgcccagcatccaagttgttgt

SEQ ID NO: 781052 - DNA, 25 bp, Mus musculus
tagtgcccaggaatcaaccaaaaca

SEQ ID NO: 781053 - DNA, 25 bp, Mus musculus
tagtgcccaggattcaaccaaaaca

SEQ ID NO: 781054 - DNA, 25 bp, Mus musculus
tagtgcccgatgaccagccccgagt

SEQ ID NO: 781055 - DNA, 25 bp, Mus musculus
tagtgcccgatgtccagccccgagt

SEQ ID NO: 781056 - DNA, 25 bp, Mus musculus
tagtgcccggctaagaaatgtgaac

SEQ ID NO: 781057 - DNA, 25 bp, Mus musculus
tagtgcccggcttagaaatgtgaac

SEQ ID NO: 781058 - DNA, 25 bp, Mus musculus
tagtgccctattaagtatcctcaaa

SEQ ID NO: 781059 - DNA, 25 bp, Mus musculus
tagtgccctatttagtatcctcaaa

SEQ ID NO: 781060 - DNA, 25 bp, Mus musculus
tagtgccctgagagccagtcttttc

SEQ ID NO: 781061 - DNA, 25 bp, Mus musculus
tagtgccctgagtgccagtcttttc

SEQ ID NO: 781062 - DNA, 25 bp, Mus musculus
tagtgccgctttctgttgacaagta

SEQ ID NO: 781063 - DNA, 25 bp, Mus musculus
tagtgccgctttgtgttgacaagta

SEQ ID NO: 781064 - DNA, 25 bp, Mus musculus
tagtgccggtggatgtccagccctt

SEQ ID NO: 781065 - DNA, 25 bp, Mus musculus
tagtgccggtggttgtccagccctt

SEQ ID NO: 781066 - DNA, 25 bp, Mus musculus
tagtgccgtgtcaggcagctcacta

SEQ ID NO: 781067 - DNA, 25 bp, Mus musculus
tagtgccgtgtctggcagctcacta

SEQ ID NO: 781068 - DNA, 25 bp, Mus musculus
tagtgcctagtcattcacttgctgt

SEQ ID NO: 781069 - DNA, 25 bp, Mus musculus
tagtgcctagtctttcacttgctgt

SEQ ID NO: 781070 - DNA, 25 bp, Mus musculus
tagtgcctatggaggtgatcagaac

SEQ ID NO: 781071 - DNA, 25 bp, Mus musculus
tagtgcctatggtggtgatcagaac

SEQ ID NO: 781072 - DNA, 25 bp, Mus musculus
tagtgcctcaccagagagtgactgc

SEQ ID NO: 781073 - DNA, 25 bp, Mus musculus
tagtgcctcacctgagagtgactgc

SEQ ID NO: 781074 - DNA, 25 bp, Mus musculus
tagtgcctcccacccagatctggaa

SEQ ID NO: 781075 - DNA, 25 bp, Mus musculus
tagtgcctcccagccagatctggaa

SEQ ID NO: 781076 - DNA, 25 bp, Mus musculus
tagtgcctcgacagatgaagacatg

SEQ ID NO: 781077 - DNA, 25 bp, Mus musculus
tagtgcctcgactgatgaagacatg

SEQ ID NO: 781078 - DNA, 25 bp, Mus musculus
tagtgcctctacatatcagtggtta

SEQ ID NO: 781079 - DNA, 25 bp, Mus musculus
tagtgcctctacttatcagtggtta

SEQ ID NO: 781080 - DNA, 25 bp, Mus musculus
tagtgcctctgactgtgacttgcag

SEQ ID NO: 781081 - DNA, 25 bp, Mus musculus
tagtgcctctgagtgtgacttgcag

SEQ ID NO: 781082 - DNA, 25 bp, Mus musculus
tagtgcctggcaatttgtgaaatat

SEQ ID NO: 781083 - DNA, 25 bp, Mus musculus
tagtgcctggcattttgtgaaatat

SEQ ID NO: 781084 - DNA, 25 bp, Mus musculus
tagtgcctgtaaatcccaaagatca

SEQ ID NO: 781085 - DNA, 25 bp, Mus musculus
tagtgcctgtaattcccaaagatca

SEQ ID NO: 781086 - DNA, 25 bp, Mus musculus
tagtgccttaatcaagtcaccaaag

SEQ ID NO: 781087 - DNA, 25 bp, Mus musculus
tagtgccttaatgaagtcaccaaag

SEQ ID NO: 781088 - DNA, 25 bp, Mus musculus
tagtgccttacgacaatggagctta

SEQ ID NO: 781089 - DNA, 25 bp, Mus musculus
tagtgccttacgtcaatggagctta

SEQ ID NO: 781090 - DNA, 25 bp, Mus musculus
tagtgccttcagcacggtctatcaa

SEQ ID NO: 781091 - DNA, 25 bp, Mus musculus
tagtgccttcaggacggtctatcaa

SEQ ID NO: 781092 - DNA, 25 bp, Mus musculus
tagtgccttgcaaatgtagctgaat

SEQ ID NO: 781093 - DNA, 25 bp, Mus musculus
tagtgccttgcatatgtagctgaat

SEQ ID NO: 781094 - DNA, 25 bp, Mus musculus
tagtgccttgccacgtactgaaggg

SEQ ID NO: 781095 - DNA, 25 bp, Mus musculus
tagtgccttgcctcgtactgaaggg

SEQ ID NO: 781096 - DNA, 25 bp, Mus musculus
tagtgcctttgtctttacctctggg

SEQ ID NO: 781097 - DNA, 25 bp, Mus musculus
tagtgcctttgtgtttacctctggg

SEQ ID NO: 781098 - DNA, 25 bp, Mus musculus
tagtgcgcacaaactggtgttcatt

SEQ ID NO: 781099 - DNA, 25 bp, Mus musculus
tagtgcgcacaatctggtgttcatt

SEQ ID NO: 781100 - DNA, 25 bp, Mus musculus
tagtgcggctagagacaggagttca

SEQ ID NO: 781101 - DNA, 25 bp, Mus musculus
tagtgcggctagtgacaggagttca

SEQ ID NO: 781102 - DNA, 25 bp, Mus musculus
tagtgcgggctcaaatgctcggtgc

SEQ ID NO: 781103 - DNA, 25 bp, Mus musculus
tagtgcgggctctaatgctcggtgc

SEQ ID NO: 781104 - DNA, 25 bp, Mus musculus
tagtgcgttccaaagcccgggaaca

SEQ ID NO: 781105 - DNA, 25 bp, Mus musculus
tagtgcgttccatagcccgggaaca

SEQ ID NO: 781106 - DNA, 25 bp, Mus musculus
tagtgctaatttactgcagatgtta

SEQ ID NO: 781107 - DNA, 25 bp, Mus musculus
tagtgctaattttctgcagatgtta

SEQ ID NO: 781108 - DNA, 25 bp, Mus musculus
tagtgctaggaaaaagggcatgttc

SEQ ID NO: 781109 - DNA, 25 bp, Mus musculus
tagtgctaggaataagggcatgttc

SEQ ID NO: 781110 - DNA, 25 bp, Mus musculus
tagtgctaggcacatactgttgttt

SEQ ID NO: 781111 - DNA, 25 bp, Mus musculus
tagtgctaggcagatactgttgttt

SEQ ID NO: 781112 - DNA, 25 bp, Mus musculus
tagtgctatcatcatccctgaatca

SEQ ID NO: 781113 - DNA, 25 bp, Mus musculus
tagtgctatcatgatccctgaatca

SEQ ID NO: 781114 - DNA, 25 bp, Mus musculus
tagtgctattacctgttggccacga

SEQ ID NO: 781115 - DNA, 25 bp, Mus musculus
tagtgctattacgtgttggccacga

SEQ ID NO: 781116 - DNA, 25 bp, Mus musculus
tagtgctcaaacacttcacatcctc

SEQ ID NO: 781117 - DNA, 25 bp, Mus musculus
tagtgctcaaactcttcacatcctc

SEQ ID NO: 781118 - DNA, 25 bp, Mus musculus
tagtgctcacccatctctgttgtga

SEQ ID NO: 781119 - DNA, 25 bp, Mus musculus
tagtgctcacccttctctgttgtga

SEQ ID NO: 781120 - DNA, 25 bp, Mus musculus
tagtgctcactgctctgcaggacag

SEQ ID NO: 781121 - DNA, 25 bp, Mus musculus
tagtgctcactggtctgcaggacag

SEQ ID NO: 781122 - DNA, 25 bp, Mus musculus
tagtgctcagtgagctcagttctca

SEQ ID NO: 781123 - DNA, 25 bp, Mus musculus
tagtgctcagtgtgctcagttctca

SEQ ID NO: 781124 - DNA, 25 bp, Mus musculus
tagtgctcgctcatctatacaaggg

SEQ ID NO: 781125 - DNA, 25 bp, Mus musculus
tagtgctcgctcttctatacaaggg

SEQ ID NO: 781126 - DNA, 25 bp, Mus musculus
tagtgctctactacggaaccacata

SEQ ID NO: 781127 - DNA, 25 bp, Mus musculus
tagtgctctacttcggaaccacata

SEQ ID NO: 781128 - DNA, 25 bp, Mus musculus
tagtgctctggaccgttcccctggg

SEQ ID NO: 781129 - DNA, 25 bp, Mus musculus
tagtgctctggagcgttcccctggg

SEQ ID NO: 781130 - DNA, 25 bp, Mus musculus
tagtgctctgtcaaggccctagctg

SEQ ID NO: 781131 - DNA, 25 bp, Mus musculus
tagtgctctgtctaggccctagctg

SEQ ID NO: 781132 - DNA, 25 bp, Mus musculus
tagtgctgaagacgagaatgctgaa

SEQ ID NO: 781133 - DNA, 25 bp, Mus musculus
tagtgctgaagaggagaatgctgaa

SEQ ID NO: 781134 - DNA, 25 bp, Mus musculus
tagtgctgaagcctgctgtctgcat

SEQ ID NO: 781135 - DNA, 25 bp, Mus musculus
tagtgctgaagcgtgctgtctgcat

SEQ ID NO: 781136 - DNA, 25 bp, Mus musculus
tagtgctgacggactatggccagat

SEQ ID NO: 781137 - DNA, 25 bp, Mus musculus
tagtgctgacggtctatggccagat

SEQ ID NO: 781138 - DNA, 25 bp, Mus musculus
tagtgctgagtcactacacaccttc

SEQ ID NO: 781139 - DNA, 25 bp, Mus musculus
tagtgctgagtctctacacaccttc

SEQ ID NO: 781140 - DNA, 25 bp, Mus musculus
tagtgctgattgcatgtgactcatg

SEQ ID NO: 781141 - DNA, 25 bp, Mus musculus
tagtgctgattggatgtgactcatg

SEQ ID NO: 781142 - DNA, 25 bp, Mus musculus
tagtgctgccttattctaggaccac

SEQ ID NO: 781143 - DNA, 25 bp, Mus musculus
tagtgctgcctttttctaggaccac

SEQ ID NO: 781144 - DNA, 25 bp, Mus musculus
tagtgctgcgctcgttttcgcggct

SEQ ID NO: 781145 - DNA, 25 bp, Mus musculus
tagtgctgcgctggttttcgcggct

SEQ ID NO: 781146 - DNA, 25 bp, Mus musculus
tagtgctgctaaagtgtgcacctcc

SEQ ID NO: 781147 - DNA, 25 bp, Mus musculus
tagtgctgctaatgtgtgcacctcc

SEQ ID NO: 781148 - DNA, 25 bp, Mus musculus
tagtgctgggctcgttttgttgaac

SEQ ID NO: 781149 - DNA, 25 bp, Mus musculus
tagtgctgggctggttttgttgaac

SEQ ID NO: 781150 - DNA, 25 bp, Mus musculus
tagtgctgtgggagccatactcttt

SEQ ID NO: 781151 - DNA, 25 bp, Mus musculus
tagtgctgtgggtgccatactcttt

SEQ ID NO: 781152 - DNA, 25 bp, Mus musculus
tagtgcttaaatccaacgtcccgag

SEQ ID NO: 781153 - DNA, 25 bp, Mus musculus
tagtgcttaaatgcaacgtcccgag

SEQ ID NO: 781154 - DNA, 25 bp, Mus musculus
tagtgcttaagcctctctggaaaaa

SEQ ID NO: 781155 - DNA, 25 bp, Mus musculus
tagtgcttaagcgtctctggaaaaa

SEQ ID NO: 781156 - DNA, 25 bp, Mus musculus
tagtgcttaggcagcgaccctatgg

SEQ ID NO: 781157 - DNA, 25 bp, Mus musculus
tagtgcttaggctgcgaccctatgg

SEQ ID NO: 781158 - DNA, 25 bp, Mus musculus
tagtgcttagtaactagtcttagtt

SEQ ID NO: 781159 - DNA, 25 bp, Mus musculus
tagtgcttagtatctagtcttagtt

SEQ ID NO: 781160 - DNA, 25 bp, Mus musculus
tagtgcttcacccagtccaagcaag

SEQ ID NO: 781161 - DNA, 25 bp, Mus musculus
tagtgcttcaccgagtccaagcaag

SEQ ID NO: 781162 - DNA, 25 bp, Mus musculus
tagtgcttcctgaaccgggaaagag

SEQ ID NO: 781163 - DNA, 25 bp, Mus musculus
tagtgcttcctgtaccgggaaagag

SEQ ID NO: 781164 - DNA, 25 bp, Mus musculus
tagtgcttgaatacaggctgcttga

SEQ ID NO: 781165 - DNA, 25 bp, Mus musculus
tagtgcttgaattcaggctgcttga

SEQ ID NO: 781166 - DNA, 25 bp, Mus musculus
tagtgcttgcccctgattaaagaaa

SEQ ID NO: 781167 - DNA, 25 bp, Mus musculus
tagtgcttgcccgtgattaaagaaa

SEQ ID NO: 781168 - DNA, 25 bp, Mus musculus
tagtgcttgctgatcacaagtctaa

SEQ ID NO: 781169 - DNA, 25 bp, Mus musculus
tagtgcttgctgttcacaagtctaa

SEQ ID NO: 781170 - DNA, 25 bp, Mus musculus
tagtgcttgtggaaactcttctcaa

SEQ ID NO: 781171 - DNA, 25 bp, Mus musculus
tagtgcttgtggtaactcttctcaa

SEQ ID NO: 781172 - DNA, 25 bp, Mus musculus
tagtgctttgatcagacggttccca

SEQ ID NO: 781173 - DNA, 25 bp, Mus musculus
tagtgctttgatgagacggttccca

SEQ ID NO: 781174 - DNA, 25 bp, Mus musculus
tagtggaaacccacaatgctgcgat

SEQ ID NO: 781175 - DNA, 25 bp, Mus musculus
tagtggaaaccctcaatgctgcgat

SEQ ID NO: 781176 - DNA, 25 bp, Mus musculus
tagtggaagaataccagcttcccta

SEQ ID NO: 781177 - DNA, 25 bp, Mus musculus
tagtggaagaattccagcttcccta

SEQ ID NO: 781178 - DNA, 25 bp, Mus musculus
tagtggaagtctaccttgtcttgcc

SEQ ID NO: 781179 - DNA, 25 bp, Mus musculus
tagtggaagtcttccttgtcttgcc

SEQ ID NO: 781180 - DNA, 25 bp, Mus musculus
tagtggaatacgcagttcgctcccc

SEQ ID NO: 781181 - DNA, 25 bp, Mus musculus
tagtggaatacggagttcgctcccc

SEQ ID NO: 781182 - DNA, 25 bp, Mus musculus
tagtggaattccactcaaggttttt

SEQ ID NO: 781183 - DNA, 25 bp, Mus musculus
tagtggaattcctctcaaggttttt

SEQ ID NO: 781184 - DNA, 25 bp, Mus musculus
tagtggacagcaactagtagctgta

SEQ ID NO: 781185 - DNA, 25 bp, Mus musculus
tagtggacagcaactcgaccatggc

SEQ ID NO: 781186 - DNA, 25 bp, Mus musculus
tagtggacagcatctagtagctgta

SEQ ID NO: 781187 - DNA, 25 bp, Mus musculus
tagtggacagcatctcgaccatggc

SEQ ID NO: 781188 - DNA, 25 bp, Mus musculus
tagtggacatgcacctaatcttgct

SEQ ID NO: 781189 - DNA, 25 bp, Mus musculus
tagtggacatgctcctaatcttgct

SEQ ID NO: 781190 - DNA, 25 bp, Mus musculus
tagtggaccacaccaaatccttcca

SEQ ID NO: 781191 - DNA, 25 bp, Mus musculus
tagtggaccacagcaaatccttcca

SEQ ID NO: 781192 - DNA, 25 bp, Mus musculus
tagtggaccacgctgacatctcctt

SEQ ID NO: 781193 - DNA, 25 bp, Mus musculus
tagtggaccacggtgacatctcctt

SEQ ID NO: 781194 - DNA, 25 bp, Mus musculus
tagtggactctgcatgcggctagct

SEQ ID NO: 781195 - DNA, 25 bp, Mus musculus
tagtggactctggatgcggctagct

SEQ ID NO: 781196 - DNA, 25 bp, Mus musculus
tagtggacttgcagcgaggccccaa

SEQ ID NO: 781197 - DNA, 25 bp, Mus musculus
tagtggacttgctgcgaggccccaa

SEQ ID NO: 781198 - DNA, 25 bp, Mus musculus
tagtggagcagtaacctagcaagca

SEQ ID NO: 781199 - DNA, 25 bp, Mus musculus
tagtggagcagttacctagcaagca

SEQ ID NO: 781200 - DNA, 25 bp, Mus musculus
tagtggagctggagcctcagtatcc

SEQ ID NO: 781201 - DNA, 25 bp, Mus musculus
tagtggagctggtgcctcagtatcc

SEQ ID NO: 781202 - DNA, 25 bp, Mus musculus
tagtggaggtgtacagccaactcac

SEQ ID NO: 781203 - DNA, 25 bp, Mus musculus
tagtggaggtgttcagccaactcac

SEQ ID NO: 781204 - DNA, 25 bp, Mus musculus
tagtggatgctcaggtcacctacat

SEQ ID NO: 781205 - DNA, 25 bp, Mus musculus
tagtggatgctctggtcacctacat

SEQ ID NO: 781206 - DNA, 25 bp, Mus musculus
tagtggatgtgtaggcaaccttaat

SEQ ID NO: 781207 - DNA, 25 bp, Mus musculus
tagtggatgtgttggcaaccttaat

SEQ ID NO: 781208 - DNA, 25 bp, Mus musculus
tagtggattccaatgtaaaaggctt

SEQ ID NO: 781209 - DNA, 25 bp, Mus musculus
tagtggattccattgtaaaaggctt

SEQ ID NO: 781210 - DNA, 25 bp, Mus musculus
tagtggcaatctatggcctccgatg

SEQ ID NO: 781211 - DNA, 25 bp, Mus musculus
tagtggcaatctttggcctccgatg

SEQ ID NO: 781212 - DNA, 25 bp, Mus musculus
tagtggcaatgcactgcacgcaggc

SEQ ID NO: 781213 - DNA, 25 bp, Mus musculus
tagtggcaatgctctgcacgcaggc

SEQ ID NO: 781214 - DNA, 25 bp, Mus musculus
tagtggcacagtcgcaaagcccctg

SEQ ID NO: 781215 - DNA, 25 bp, Mus musculus
tagtggcacagtggcaaagcccctg

SEQ ID NO: 781216 - DNA, 25 bp, Mus musculus
tagtggcaccacctcattaatcaga

SEQ ID NO: 781217 - DNA, 25 bp, Mus musculus
tagtggcaccacgtcattaatcaga

SEQ ID NO: 781218 - DNA, 25 bp, Mus musculus
tagtggcagcaacttctttccaggg

SEQ ID NO: 781219 - DNA, 25 bp, Mus musculus
tagtggcagcaagttctttccaggg

SEQ ID NO: 781220 - DNA, 25 bp, Mus musculus
tagtggcagcctagggagtcactag

SEQ ID NO: 781221 - DNA, 25 bp, Mus musculus
tagtggcagccttgggagtcactag

SEQ ID NO: 781222 - DNA, 25 bp, Mus musculus
tagtggcattacatagggatctttt

SEQ ID NO: 781223 - DNA, 25 bp, Mus musculus
tagtggcattacttagggatctttt

SEQ ID NO: 781224 - DNA, 25 bp, Mus musculus
tagtggccaaccactacgtggtggt

SEQ ID NO: 781225 - DNA, 25 bp, Mus musculus
tagtggccaacctctacgtggtggt

SEQ ID NO: 781226 - DNA, 25 bp, Mus musculus
tagtggccacggagcttccttggga

SEQ ID NO: 781227 - DNA, 25 bp, Mus musculus
tagtggccacggtgcttccttggga

SEQ ID NO: 781228 - DNA, 25 bp, Mus musculus
tagtggcccactaatgtttaaattt

SEQ ID NO: 781229 - DNA, 25 bp, Mus musculus
tagtggcccacttatgtttaaattt

SEQ ID NO: 781230 - DNA, 25 bp, Mus musculus
tagtggcccagtcaacacatgcctt

SEQ ID NO: 781231 - DNA, 25 bp, Mus musculus
tagtggcccagtgaacacatgcctt

SEQ ID NO: 781232 - DNA, 25 bp, Mus musculus
tagtggcccatcaggataggtctgc

SEQ ID NO: 781233 - DNA, 25 bp, Mus musculus
tagtggcccatctggataggtctgc

SEQ ID NO: 781234 - DNA, 25 bp, Mus musculus
tagtggcccggtatgcaagtgcaga

SEQ ID NO: 781235 - DNA, 25 bp, Mus musculus
tagtggcccggtttgcaagtgcaga

SEQ ID NO: 781236 - DNA, 25 bp, Mus musculus
tagtggccctttaatgcatgcacag

SEQ ID NO: 781237 - DNA, 25 bp, Mus musculus
tagtggcccttttatgcatgcacag

SEQ ID NO: 781238 - DNA, 25 bp, Mus musculus
tagtggccgtcacccaggagataca

SEQ ID NO: 781239 - DNA, 25 bp, Mus musculus
tagtggccgtcagccaggagataca

SEQ ID NO: 781240 - DNA, 25 bp, Mus musculus
tagtggcctgctagtcttaaacttt

SEQ ID NO: 781241 - DNA, 25 bp, Mus musculus
tagtggcctgcttgtcttaaacttt

SEQ ID NO: 781242 - DNA, 25 bp, Mus musculus
tagtggcctgtactcaaccgttttg

SEQ ID NO: 781243 - DNA, 25 bp, Mus musculus
tagtggcctgtagtcaaccgttttg

SEQ ID NO: 781244 - DNA, 25 bp, Mus musculus
tagtggcctgttagcctgcctgcgg

SEQ ID NO: 781245 - DNA, 25 bp, Mus musculus
tagtggcctgtttgcctgcctgcgg

SEQ ID NO: 781246 - DNA, 25 bp, Mus musculus
tagtggctaacaaaaatcccagggt

SEQ ID NO: 781247 - DNA, 25 bp, Mus musculus
tagtggctaacataaatcccagggt

SEQ ID NO: 781248 - DNA, 25 bp, Mus musculus
tagtggctagtccttccactctgaa

SEQ ID NO: 781249 - DNA, 25 bp, Mus musculus
tagtggctagtcgttccactctgaa

SEQ ID NO: 781250 - DNA, 25 bp, Mus musculus
tagtggctcatacgatatacccaga

SEQ ID NO: 781251 - DNA, 25 bp, Mus musculus
tagtggctcataggatatacccaga

SEQ ID NO: 781252 - DNA, 25 bp, Mus musculus
tagtggctcatgctgctttcaataa

SEQ ID NO: 781253 - DNA, 25 bp, Mus musculus
tagtggctcatggtgctttcaataa

SEQ ID NO: 781254 - DNA, 25 bp, Mus musculus
tagtggctccagatgaaacccttgc

SEQ ID NO: 781255 - DNA, 25 bp, Mus musculus
tagtggctccagttgaaacccttgc

SEQ ID NO: 781256 - DNA, 25 bp, Mus musculus
tagtggctcccaagctgaatagttc

SEQ ID NO: 781257 - DNA, 25 bp, Mus musculus
tagtggctcccatgctgaatagttc

SEQ ID NO: 781258 - DNA, 25 bp, Mus musculus
tagtggctctaacacctcaagcatt

SEQ ID NO: 781259 - DNA, 25 bp, Mus musculus
tagtggctctaagacctcaagcatt

SEQ ID NO: 781260 - DNA, 25 bp, Mus musculus
tagtggctctcaagccacaactgga

SEQ ID NO: 781261 - DNA, 25 bp, Mus musculus
tagtggctctcatgccacaactgga

SEQ ID NO: 781262 - DNA, 25 bp, Mus musculus
tagtggctgatcaaacgagttgtgt

SEQ ID NO: 781263 - DNA, 25 bp, Mus musculus
tagtggctgatctaacgagttgtgt

SEQ ID NO: 781264 - DNA, 25 bp, Mus musculus
tagtggctgcatcaccctctgtcta

SEQ ID NO: 781265 - DNA, 25 bp, Mus musculus
tagtggctgcatgaccctctgtcta

SEQ ID NO: 781266 - DNA, 25 bp, Mus musculus
tagtggctgcccacagcaaccagca

SEQ ID NO: 781267 - DNA, 25 bp, Mus musculus
tagtggctgccctcagcaaccagca

SEQ ID NO: 781268 - DNA, 25 bp, Mus musculus
tagtggctggccattgtgcttcttt

SEQ ID NO: 781269 - DNA, 25 bp, Mus musculus
tagtggctggcctttgtgcttcttt

SEQ ID NO: 781270 - DNA, 25 bp, Mus musculus
tagtggctggctacagaggaaacag

SEQ ID NO: 781271 - DNA, 25 bp, Mus musculus
tagtggctggcttcagaggaaacag

SEQ ID NO: 781272 - DNA, 25 bp, Mus musculus
tagtggcttctgcaaaaattcttat

SEQ ID NO: 781273 - DNA, 25 bp, Mus musculus
tagtggcttctggaaaaattcttat

SEQ ID NO: 781274 - DNA, 25 bp, Mus musculus
tagtggctttccagtagctcccttc

SEQ ID NO: 781275 - DNA, 25 bp, Mus musculus
tagtggctttcctgtagctcccttc

SEQ ID NO: 781276 - DNA, 25 bp, Mus musculus
tagtgggaacttactctgtttctca

SEQ ID NO: 781277 - DNA, 25 bp, Mus musculus
tagtgggaactttctctgtttctca

SEQ ID NO: 781278 - DNA, 25 bp, Mus musculus
tagtgggacaaaccctttgaaaatg

SEQ ID NO: 781279 - DNA, 25 bp, Mus musculus
tagtgggacaaagcctttgaaaatg

SEQ ID NO: 781280 - DNA, 25 bp, Mus musculus
tagtgggacatgaggacctctacaa

SEQ ID NO: 781281 - DNA, 25 bp, Mus musculus
tagtgggacatgtggacctctacaa

SEQ ID NO: 781282 - DNA, 25 bp, Mus musculus
tagtgggaccagagacagaagctgt

SEQ ID NO: 781283 - DNA, 25 bp, Mus musculus
tagtgggaccagtgacagaagctgt

SEQ ID NO: 781284 - DNA, 25 bp, Mus musculus
tagtgggaccccatgtgagctagtc

SEQ ID NO: 781285 - DNA, 25 bp, Mus musculus
tagtgggaccccttgtgagctagtc

SEQ ID NO: 781286 - DNA, 25 bp, Mus musculus
tagtgggagttcatttgtggcctgt

SEQ ID NO: 781287 - DNA, 25 bp, Mus musculus
tagtgggagttcttttgtggcctgt

SEQ ID NO: 781288 - DNA, 25 bp, Mus musculus
tagtgggatcccctctcaattttaa

SEQ ID NO: 781289 - DNA, 25 bp, Mus musculus
tagtgggatcccgtctcaattttaa

SEQ ID NO: 781290 - DNA, 25 bp, Mus musculus
tagtgggatcctactcatgggtcca

SEQ ID NO: 781291 - DNA, 25 bp, Mus musculus
tagtgggatccttctcatgggtcca

SEQ ID NO: 781292 - DNA, 25 bp, Mus musculus
tagtgggcagtcaggctcccattcc

SEQ ID NO: 781293 - DNA, 25 bp, Mus musculus
tagtgggcagtctggctcccattcc

SEQ ID NO: 781294 - DNA, 25 bp, Mus musculus
tagtgggcctgtatggccaaaccca

SEQ ID NO: 781295 - DNA, 25 bp, Mus musculus
tagtgggcctgtttggccaaaccca

SEQ ID NO: 781296 - DNA, 25 bp, Mus musculus
tagtgggcgatcaggctctgccata

SEQ ID NO: 781297 - DNA, 25 bp, Mus musculus
tagtgggcgatctggctctgccata

SEQ ID NO: 781298 - DNA, 25 bp, Mus musculus
tagtgggctcgcctttaagtcccat

SEQ ID NO: 781299 - DNA, 25 bp, Mus musculus
tagtgggctcgcgtttaagtcccat

SEQ ID NO: 781300 - DNA, 25 bp, Mus musculus
tagtgggctctcaacaaatatcaga

SEQ ID NO: 781301 - DNA, 25 bp, Mus musculus
tagtgggctctctacaaatatcaga

SEQ ID NO: 781302 - DNA, 25 bp, Mus musculus
tagtgggctgaacgcatgccccttg

SEQ ID NO: 781303 - DNA, 25 bp, Mus musculus
tagtgggctgaaggcatgccccttg

SEQ ID NO: 781304 - DNA, 25 bp, Mus musculus
tagtgggtaccacctatcctatcaa

SEQ ID NO: 781305 - DNA, 25 bp, Mus musculus
tagtgggtaccagctatcctatcaa

SEQ ID NO: 781306 - DNA, 25 bp, Mus musculus
tagtgggtagacatttcttctctct

SEQ ID NO: 781307 - DNA, 25 bp, Mus musculus
tagtgggtagacttttcttctctct

SEQ ID NO: 781308 - DNA, 25 bp, Mus musculus
tagtgggtaggtccctttctcatga

SEQ ID NO: 781309 - DNA, 25 bp, Mus musculus
tagtgggtaggtgcctttctcatga

SEQ ID NO: 781310 - DNA, 25 bp, Mus musculus
tagtgggtccttcctcatgatgtag

SEQ ID NO: 781311 - DNA, 25 bp, Mus musculus
tagtgggtccttgctcatgatgtag

SEQ ID NO: 781312 - DNA, 25 bp, Mus musculus
tagtgggtgtacagtttgagttttg

SEQ ID NO: 781313 - DNA, 25 bp, Mus musculus
tagtgggtgtactgtttgagttttg

SEQ ID NO: 781314 - DNA, 25 bp, Mus musculus
tagtgggttctaaaaagcagggctg

SEQ ID NO: 781315 - DNA, 25 bp, Mus musculus
tagtgggttctataaagcagggctg

SEQ ID NO: 781316 - DNA, 25 bp, Mus musculus
tagtgggttctcaacacccgcatcc

SEQ ID NO: 781317 - DNA, 25 bp, Mus musculus
tagtgggttctcatcatgaatgtga

SEQ ID NO: 781318 - DNA, 25 bp, Mus musculus
tagtgggttctctacacccgcatcc

SEQ ID NO: 781319 - DNA, 25 bp, Mus musculus
tagtgggttctcttcatgaatgtga

SEQ ID NO: 781320 - DNA, 25 bp, Mus musculus
tagtgggttctgagcatttctcctg

SEQ ID NO: 781321 - DNA, 25 bp, Mus musculus
tagtgggttctgtgcatttctcctg

SEQ ID NO: 781322 - DNA, 25 bp, Mus musculus
tagtgggtttccacttcacctgata

SEQ ID NO: 781323 - DNA, 25 bp, Mus musculus
tagtgggtttcctcttcacctgata

SEQ ID NO: 781324 - DNA, 25 bp, Mus musculus
tagtgggtttgaagaccctgtccca

SEQ ID NO: 781325 - DNA, 25 bp, Mus musculus
tagtgggtttgatgaccctgtccca

SEQ ID NO: 781326 - DNA, 25 bp, Mus musculus
tagtggtaattcacttactgtttat

SEQ ID NO: 781327 - DNA, 25 bp, Mus musculus
tagtggtaattcagcttgctcccac

SEQ ID NO: 781328 - DNA, 25 bp, Mus musculus
tagtggtaattctcttactgtttat

SEQ ID NO: 781329 - DNA, 25 bp, Mus musculus
tagtggtaattctgcttgctcccac

SEQ ID NO: 781330 - DNA, 25 bp, Mus musculus
tagtggtactccctatttcttcacg

SEQ ID NO: 781331 - DNA, 25 bp, Mus musculus
tagtggtactccgtatttcttcacg

SEQ ID NO: 781332 - DNA, 25 bp, Mus musculus
tagtggtagatcactgcttttttat

SEQ ID NO: 781333 - DNA, 25 bp, Mus musculus
tagtggtagatctctgcttttttat

SEQ ID NO: 781334 - DNA, 25 bp, Mus musculus
tagtggtcaaacctttcttagtgtt

SEQ ID NO: 781335 - DNA, 25 bp, Mus musculus
tagtggtcaaacgtttcttagtgtt

SEQ ID NO: 781336 - DNA, 25 bp, Mus musculus
tagtggtcatttctcatttcataac

SEQ ID NO: 781337 - DNA, 25 bp, Mus musculus
tagtggtcatttgtcatttcataac

SEQ ID NO: 781338 - DNA, 25 bp, Mus musculus
tagtggtccctgcatgctcatggat

SEQ ID NO: 781339 - DNA, 25 bp, Mus musculus
tagtggtccctggatgctcatggat

SEQ ID NO: 781340 - DNA, 25 bp, Mus musculus
tagtggtccgctcgttcaaacaaag

SEQ ID NO: 781341 - DNA, 25 bp, Mus musculus
tagtggtccgctggttcaaacaaag

SEQ ID NO: 781342 - DNA, 25 bp, Mus musculus
tagtggtccgtcaagctgccttaca

SEQ ID NO: 781343 - DNA, 25 bp, Mus musculus
tagtggtccgtctagctgccttaca

SEQ ID NO: 781344 - DNA, 25 bp, Mus musculus
tagtggtcgctcaagatttctactc

SEQ ID NO: 781345 - DNA, 25 bp, Mus musculus
tagtggtcgctctagatttctactc

SEQ ID NO: 781346 - DNA, 25 bp, Mus musculus
tagtggtctgctagggttgccgaac

SEQ ID NO: 781347 - DNA, 25 bp, Mus musculus
tagtggtctgcttgggttgccgaac

SEQ ID NO: 781348 - DNA, 25 bp, Mus musculus
tagtggtgaaccaagaaccaaagtt

SEQ ID NO: 781349 - DNA, 25 bp, Mus musculus
tagtggtgaacctagaaccaaagtt

SEQ ID NO: 781350 - DNA, 25 bp, Mus musculus
tagtggtgatggcacaccccaacag

SEQ ID NO: 781351 - DNA, 25 bp, Mus musculus
tagtggtgatgggacaccccaacag

SEQ ID NO: 781352 - DNA, 25 bp, Mus musculus
tagtggtgcttgcaaacccatcaca

SEQ ID NO: 781353 - DNA, 25 bp, Mus musculus
tagtggtgcttggaaacccatcaca

SEQ ID NO: 781354 - DNA, 25 bp, Mus musculus
tagtggttcacaccttgggcaacgc

SEQ ID NO: 781355 - DNA, 25 bp, Mus musculus
tagtggttcacagcttgggcaacgc

SEQ ID NO: 781356 - DNA, 25 bp, Mus musculus
tagtggttcaggatggtgtaagcat

SEQ ID NO: 781357 - DNA, 25 bp, Mus musculus
tagtggttcaggttggtgtaagcat

SEQ ID NO: 781358 - DNA, 25 bp, Mus musculus
tagtggttccctagtgtacatgcct

SEQ ID NO: 781359 - DNA, 25 bp, Mus musculus
tagtggttcccttgtgtacatgcct

SEQ ID NO: 781360 - DNA, 25 bp, Mus musculus
tagtggttgagaacgtctctggtca

SEQ ID NO: 781361 - DNA, 25 bp, Mus musculus
tagtggttgagatcgtctctggtca

SEQ ID NO: 781362 - DNA, 25 bp, Mus musculus
tagtggtttaatccctctcttctcg

SEQ ID NO: 781363 - DNA, 25 bp, Mus musculus
tagtggtttaatgcctctcttctcg

SEQ ID NO: 781364 - DNA, 25 bp, Mus musculus
tagtgtaaaccgagccaggcatagc

SEQ ID NO: 781365 - DNA, 25 bp, Mus musculus
tagtgtaaaccgtgccaggcatagc

SEQ ID NO: 781366 - DNA, 25 bp, Mus musculus
tagtgtaacaccacgctggctctaa

SEQ ID NO: 781367 - DNA, 25 bp, Mus musculus
tagtgtaacacctcgctggctctaa

SEQ ID NO: 781368 - DNA, 25 bp, Mus musculus
tagtgtaaccttcccttgctgatat

SEQ ID NO: 781369 - DNA, 25 bp, Mus musculus
tagtgtaaccttgccttgctgatat

SEQ ID NO: 781370 - DNA, 25 bp, Mus musculus
tagtgtaagaacagcgcagccgcag

SEQ ID NO: 781371 - DNA, 25 bp, Mus musculus
tagtgtaagaactgcgcagccgcag

SEQ ID NO: 781372 - DNA, 25 bp, Mus musculus
tagtgtacatcccatcagaaccagc

SEQ ID NO: 781373 - DNA, 25 bp, Mus musculus
tagtgtacatccgatcagaaccagc

SEQ ID NO: 781374 - DNA, 25 bp, Mus musculus
tagtgtacatctaggccagctgcct

SEQ ID NO: 781375 - DNA, 25 bp, Mus musculus
tagtgtacatcttggccagctgcct

SEQ ID NO: 781376 - DNA, 25 bp, Mus musculus
tagtgtacctcaccagagggtattc

SEQ ID NO: 781377 - DNA, 25 bp, Mus musculus
tagtgtacctcagcagagggtattc

SEQ ID NO: 781378 - DNA, 25 bp, Mus musculus
tagtgtactttacgcttttcttgga

SEQ ID NO: 781379 - DNA, 25 bp, Mus musculus
tagtgtactttaggcttttcttgga

SEQ ID NO: 781380 - DNA, 25 bp, Mus musculus
tagtgtagactgataccccgatgcc

SEQ ID NO: 781381 - DNA, 25 bp, Mus musculus
tagtgtagactgttaccccgatgcc

SEQ ID NO: 781382 - DNA, 25 bp, Mus musculus
tagtgtagccgaccagaacccttta

SEQ ID NO: 781383 - DNA, 25 bp, Mus musculus
tagtgtagccgagcagaacccttta

SEQ ID NO: 781384 - DNA, 25 bp, Mus musculus
tagtgtagggaaccttgcaggccaa

SEQ ID NO: 781385 - DNA, 25 bp, Mus musculus
tagtgtagggaagcttgcaggccaa

SEQ ID NO: 781386 - DNA, 25 bp, Mus musculus
tagtgtagtcttccttctcagaaga

SEQ ID NO: 781387 - DNA, 25 bp, Mus musculus
tagtgtagtcttgcttctcagaaga

SEQ ID NO: 781388 - DNA, 25 bp, Mus musculus
tagtgtataccaactactgacatat

SEQ ID NO: 781389 - DNA, 25 bp, Mus musculus
tagtgtataccatctactgacatat

SEQ ID NO: 781390 - DNA, 25 bp, Mus musculus
tagtgtatgattctccttctgcctc

SEQ ID NO: 781391 - DNA, 25 bp, Mus musculus
tagtgtatgattgtccttctgcctc

SEQ ID NO: 781392 - DNA, 25 bp, Mus musculus
tagtgtatgctaccattggctatat

SEQ ID NO: 781393 - DNA, 25 bp, Mus musculus
tagtgtatgctagcattggctatat

SEQ ID NO: 781394 - DNA, 25 bp, Mus musculus
tagtgtatggttatcctccttctgg

SEQ ID NO: 781395 - DNA, 25 bp, Mus musculus
tagtgtatggttttcctccttctgg

SEQ ID NO: 781396 - DNA, 25 bp, Mus musculus
tagtgtattcatcgtcaccccagta

SEQ ID NO: 781397 - DNA, 25 bp, Mus musculus
tagtgtattcatggtcaccccagta

SEQ ID NO: 781398 - DNA, 25 bp, Mus musculus
tagtgtatttgaaccctgaatcccc

SEQ ID NO: 781399 - DNA, 25 bp, Mus musculus
tagtgtatttgatccctgaatcccc

SEQ ID NO: 781400 - DNA, 25 bp, Mus musculus
tagtgtcaatgccatcatctaccca

SEQ ID NO: 781401 - DNA, 25 bp, Mus musculus
tagtgtcaatgcgatcatctaccca

SEQ ID NO: 781402 - DNA, 25 bp, Mus musculus
tagtgtcacccgagtgtgggttagt

SEQ ID NO: 781403 - DNA, 25 bp, Mus musculus
tagtgtcacccgtgtgtgggttagt

SEQ ID NO: 781404 - DNA, 25 bp, Mus musculus
tagtgtcacttgagctcagttcatc

SEQ ID NO: 781405 - DNA, 25 bp, Mus musculus
tagtgtcacttgtgctcagttcatc

SEQ ID NO: 781406 - DNA, 25 bp, Mus musculus
tagtgtcagacgaagtcctgtttga

SEQ ID NO: 781407 - DNA, 25 bp, Mus musculus
tagtgtcagacgtagtcctgtttga

SEQ ID NO: 781408 - DNA, 25 bp, Mus musculus
tagtgtcagcttcatttttactttt

SEQ ID NO: 781409 - DNA, 25 bp, Mus musculus
tagtgtcagcttgatttttactttt

SEQ ID NO: 781410 - DNA, 25 bp, Mus musculus
tagtgtcatgctccaggtgctagtg

SEQ ID NO: 781411 - DNA, 25 bp, Mus musculus
tagtgtcatgctgcaggtgctagtg

SEQ ID NO: 781412 - DNA, 25 bp, Mus musculus
tagtgtcatggtcacgctcactcac

SEQ ID NO: 781413 - DNA, 25 bp, Mus musculus
tagtgtcatggtgacgctcactcac

SEQ ID NO: 781414 - DNA, 25 bp, Mus musculus
tagtgtccaggaagaggcccagttc

SEQ ID NO: 781415 - DNA, 25 bp, Mus musculus
tagtgtccaggatgaggcccagttc

SEQ ID NO: 781416 - DNA, 25 bp, Mus musculus
tagtgtccaggtctgactaccggag

SEQ ID NO: 781417 - DNA, 25 bp, Mus musculus
tagtgtccaggtgtgactaccggag

SEQ ID NO: 781418 - DNA, 25 bp, Mus musculus
tagtgtccatgcaaacagtgtccct

SEQ ID NO: 781419 - DNA, 25 bp, Mus musculus
tagtgtccatgctaacagtgtccct

SEQ ID NO: 781420 - DNA, 25 bp, Mus musculus
tagtgtcccagaaccagtgaattca

SEQ ID NO: 781421 - DNA, 25 bp, Mus musculus
tagtgtcccagatccagtgaattca

SEQ ID NO: 781422 - DNA, 25 bp, Mus musculus
tagtgtcccaggattctctgaggtt

SEQ ID NO: 781423 - DNA, 25 bp, Mus musculus
tagtgtcccaggtttctctgaggtt

SEQ ID NO: 781424 - DNA, 25 bp, Mus musculus
tagtgtccccacctatgtgacaaat

SEQ ID NO: 781425 - DNA, 25 bp, Mus musculus
tagtgtccccacgtatgtgacaaat

SEQ ID NO: 781426 - DNA, 25 bp, Mus musculus
tagtgtccccttctgagttcaggta

SEQ ID NO: 781427 - DNA, 25 bp, Mus musculus
tagtgtccccttgtgagttcaggta

SEQ ID NO: 781428 - DNA, 25 bp, Mus musculus
tagtgtccctccatgggtcagagag

SEQ ID NO: 781429 - DNA, 25 bp, Mus musculus
tagtgtccctccttgggtcagagag

SEQ ID NO: 781430 - DNA, 25 bp, Mus musculus
tagtgtccctgtagccttaaatgta

SEQ ID NO: 781431 - DNA, 25 bp, Mus musculus
tagtgtccctgttgccttaaatgta

SEQ ID NO: 781432 - DNA, 25 bp, Mus musculus
tagtgtccgtgccatccggattgac

SEQ ID NO: 781433 - DNA, 25 bp, Mus musculus
tagtgtccgtgcgatccggattgac

SEQ ID NO: 781434 - DNA, 25 bp, Mus musculus
tagtgtcctcttaggtccccatgga

SEQ ID NO: 781435 - DNA, 25 bp, Mus musculus
tagtgtcctctttggtccccatgga

SEQ ID NO: 781436 - DNA, 25 bp, Mus musculus
tagtgtcctgagctaaagtaccaag

SEQ ID NO: 781437 - DNA, 25 bp, Mus musculus
tagtgtcctgaggtaaagtaccaag

SEQ ID NO: 781438 - DNA, 25 bp, Mus musculus
tagtgtcctgcacctcggagaatac

SEQ ID NO: 781439 - DNA, 25 bp, Mus musculus
tagtgtcctgcagctcggagaatac

SEQ ID NO: 781440 - DNA, 25 bp, Mus musculus
tagtgtcctggcacttggcaaggaa

SEQ ID NO: 781441 - DNA, 25 bp, Mus musculus
tagtgtcctggctcttggcaaggaa

SEQ ID NO: 781442 - DNA, 25 bp, Mus musculus
tagtgtccttaaaagcctgtatcca

SEQ ID NO: 781443 - DNA, 25 bp, Mus musculus
tagtgtccttaatagcctgtatcca

SEQ ID NO: 781444 - DNA, 25 bp, Mus musculus
tagtgtctaaacctaggaccttact

SEQ ID NO: 781445 - DNA, 25 bp, Mus musculus
tagtgtctaaacgtaggaccttact

SEQ ID NO: 781446 - DNA, 25 bp, Mus musculus
tagtgtctcacactttcattcctgg

SEQ ID NO: 781447 - DNA, 25 bp, Mus musculus
tagtgtctcacagtttcattcctgg

SEQ ID NO: 781448 - DNA, 25 bp, Mus musculus
tagtgtctccatacggctgttcggc

SEQ ID NO: 781449 - DNA, 25 bp, Mus musculus
tagtgtctccattcggctgttcggc

SEQ ID NO: 781450 - DNA, 25 bp, Mus musculus
tagtgtctccccatgaattctgtgg

SEQ ID NO: 781451 - DNA, 25 bp, Mus musculus
tagtgtctccccttgaattctgtgg

SEQ ID NO: 781452 - DNA, 25 bp, Mus musculus
tagtgtctcctcaaagcaatagaaa

SEQ ID NO: 781453 - DNA, 25 bp, Mus musculus
tagtgtctcctctaagcaatagaaa

SEQ ID NO: 781454 - DNA, 25 bp, Mus musculus
tagtgtctcctgctccaagggatgc

SEQ ID NO: 781455 - DNA, 25 bp, Mus musculus
tagtgtctcctggtccaagggatgc

SEQ ID NO: 781456 - DNA, 25 bp, Mus musculus
tagtgtctccttacaaacaaccaaa

SEQ ID NO: 781457 - DNA, 25 bp, Mus musculus
tagtgtctcctttcaaacaaccaaa

SEQ ID NO: 781458 - DNA, 25 bp, Mus musculus
tagtgtctctagagcgctgggtcac

SEQ ID NO: 781459 - DNA, 25 bp, Mus musculus
tagtgtctctagtgcgctgggtcac

SEQ ID NO: 781460 - DNA, 25 bp, Mus musculus
tagtgtctgacaccaggcagtttat

SEQ ID NO: 781461 - DNA, 25 bp, Mus musculus
tagtgtctgacagcaggcagtttat

SEQ ID NO: 781462 - DNA, 25 bp, Mus musculus
tagtgtctgggcaaagtctccttca

SEQ ID NO: 781463 - DNA, 25 bp, Mus musculus
tagtgtctgggctaagtctccttca

SEQ ID NO: 781464 - DNA, 25 bp, Mus musculus
tagtgtctgtaacaaggccttcgct

SEQ ID NO: 781465 - DNA, 25 bp, Mus musculus
tagtgtctgtaagaaggccttcgct

SEQ ID NO: 781466 - DNA, 25 bp, Mus musculus
tagtgtcttctaacgaactgtagct

SEQ ID NO: 781467 - DNA, 25 bp, Mus musculus
tagtgtcttctatcgaactgtagct

SEQ ID NO: 781468 - DNA, 25 bp, Mus musculus
tagtgtcttgctcactccccaggtc

SEQ ID NO: 781469 - DNA, 25 bp, Mus musculus
tagtgtcttgctgactccccaggtc

SEQ ID NO: 781470 - DNA, 25 bp, Mus musculus
tagtgtcttgtgcatctggttcatt

SEQ ID NO: 781471 - DNA, 25 bp, Mus musculus
tagtgtcttgtggatctggttcatt

SEQ ID NO: 781472 - DNA, 25 bp, Mus musculus
tagtgtgaaagaacttctcccgctg

SEQ ID NO: 781473 - DNA, 25 bp, Mus musculus
tagtgtgaaagatcttctcccgctg

SEQ ID NO: 781474 - DNA, 25 bp, Mus musculus
tagtgtgaacagagaggccctggct

SEQ ID NO: 781475 - DNA, 25 bp, Mus musculus
tagtgtgaacagtgaggccctggct

SEQ ID NO: 781476 - DNA, 25 bp, Mus musculus
tagtgtgaattacccttgtctctgt

SEQ ID NO: 781477 - DNA, 25 bp, Mus musculus
tagtgtgaattagccttgtctctgt

SEQ ID NO: 781478 - DNA, 25 bp, Mus musculus
tagtgtgacttcagccttcatgtcc

SEQ ID NO: 781479 - DNA, 25 bp, Mus musculus
tagtgtgacttcctacctcaggatc

SEQ ID NO: 781480 - DNA, 25 bp, Mus musculus
tagtgtgacttcgtacctcaggatc

SEQ ID NO: 781481 - DNA, 25 bp, Mus musculus
tagtgtgacttctgccttcatgtcc

SEQ ID NO: 781482 - DNA, 25 bp, Mus musculus
tagtgtgagcctcctaccatttcca

SEQ ID NO: 781483 - DNA, 25 bp, Mus musculus
tagtgtgagcctgctaccatttcca

SEQ ID NO: 781484 - DNA, 25 bp, Mus musculus
tagtgtgagcgaactcttgttccca

SEQ ID NO: 781485 - DNA, 25 bp, Mus musculus
tagtgtgagcgatctcttgttccca

SEQ ID NO: 781486 - DNA, 25 bp, Mus musculus
tagtgtgagcgcacagcaccgggct

SEQ ID NO: 781487 - DNA, 25 bp, Mus musculus
tagtgtgagcgctcagcaccgggct

SEQ ID NO: 781488 - DNA, 25 bp, Mus musculus
tagtgtgagctaaggcgctgccaaa

SEQ ID NO: 781489 - DNA, 25 bp, Mus musculus
tagtgtgagctaatcccatcgtgtg

SEQ ID NO: 781490 - DNA, 25 bp, Mus musculus
tagtgtgagctatggcgctgccaaa

SEQ ID NO: 781491 - DNA, 25 bp, Mus musculus
tagtgtgagctattcccatcgtgtg

SEQ ID NO: 781492 - DNA, 25 bp, Mus musculus
tagtgtgatcatcccagtagcctcc

SEQ ID NO: 781493 - DNA, 25 bp, Mus musculus
tagtgtgatcatgccagtagcctcc

SEQ ID NO: 781494 - DNA, 25 bp, Mus musculus
tagtgtgatctgaggagaatgtaca

SEQ ID NO: 781495 - DNA, 25 bp, Mus musculus
tagtgtgatctgtggagaatgtaca

SEQ ID NO: 781496 - DNA, 25 bp, Mus musculus
tagtgtgcaaaaaaccttgtgttca

SEQ ID NO: 781497 - DNA, 25 bp, Mus musculus
tagtgtgcaaaataccttgtgttca

SEQ ID NO: 781498 - DNA, 25 bp, Mus musculus
tagtgtgcaaatcagctggtggctt

SEQ ID NO: 781499 - DNA, 25 bp, Mus musculus
tagtgtgcaaatgagctggtggctt

SEQ ID NO: 781500 - DNA, 25 bp, Mus musculus
tagtgtgcacagaccctaggttgaa

SEQ ID NO: 781501 - DNA, 25 bp, Mus musculus
tagtgtgcacagtccctaggttgaa

SEQ ID NO: 781502 - DNA, 25 bp, Mus musculus
tagtgtgcactcacttttgtgtata

SEQ ID NO: 781503 - DNA, 25 bp, Mus musculus
tagtgtgcactctcttttgtgtata

SEQ ID NO: 781504 - DNA, 25 bp, Mus musculus
tagtgtgcactgatgaaaggttttc

SEQ ID NO: 781505 - DNA, 25 bp, Mus musculus
tagtgtgcactgttgaaaggttttc

SEQ ID NO: 781506 - DNA, 25 bp, Mus musculus
tagtgtgcaggtaacaatcagattt

SEQ ID NO: 781507 - DNA, 25 bp, Mus musculus
tagtgtgcaggttacaatcagattt

SEQ ID NO: 781508 - DNA, 25 bp, Mus musculus
tagtgtgcagtgaccgagacgtttc

SEQ ID NO: 781509 - DNA, 25 bp, Mus musculus
tagtgtgcagtgtccgagacgtttc

SEQ ID NO: 781510 - DNA, 25 bp, Mus musculus
tagtgtgccataccctcatgaaaaa

SEQ ID NO: 781511 - DNA, 25 bp, Mus musculus
tagtgtgccatagcctcatgaaaaa

SEQ ID NO: 781512 - DNA, 25 bp, Mus musculus
tagtgtgccattcagaattggcccc

SEQ ID NO: 781513 - DNA, 25 bp, Mus musculus
tagtgtgccattgagaattggcccc

SEQ ID NO: 781514 - DNA, 25 bp, Mus musculus
tagtgtgccttcatgggtcctacca

SEQ ID NO: 781515 - DNA, 25 bp, Mus musculus
tagtgtgccttcttgggtcctacca

SEQ ID NO: 781516 - DNA, 25 bp, Mus musculus
tagtgtgctaccatgttctttgaag

SEQ ID NO: 781517 - DNA, 25 bp, Mus musculus
tagtgtgctaccttgttctttgaag

SEQ ID NO: 781518 - DNA, 25 bp, Mus musculus
tagtgtgctaggcaaacctttagat

SEQ ID NO: 781519 - DNA, 25 bp, Mus musculus
tagtgtgctagggaaacctttagat

SEQ ID NO: 781520 - DNA, 25 bp, Mus musculus
tagtgtgctctgagttattagggac

SEQ ID NO: 781521 - DNA, 25 bp, Mus musculus
tagtgtgctctgtgttattagggac

SEQ ID NO: 781522 - DNA, 25 bp, Mus musculus
tagtgtgctgctctgtacatacctc

SEQ ID NO: 781523 - DNA, 25 bp, Mus musculus
tagtgtgctgctgtgtacatacctc

SEQ ID NO: 781524 - DNA, 25 bp, Mus musculus
tagtgtggacacatgagaagctggc

SEQ ID NO: 781525 - DNA, 25 bp, Mus musculus
tagtgtggacacttgagaagctggc

SEQ ID NO: 781526 - DNA, 25 bp, Mus musculus
tagtgtggaggcaactgcatggtaa

SEQ ID NO: 781527 - DNA, 25 bp, Mus musculus
tagtgtggaggctactgcatggtaa

SEQ ID NO: 781528 - DNA, 25 bp, Mus musculus
tagtgtggatgacccgtgttccttt

SEQ ID NO: 781529 - DNA, 25 bp, Mus musculus
tagtgtggatgagccgtgttccttt

SEQ ID NO: 781530 - DNA, 25 bp, Mus musculus
tagtgtggattcagctcaccccatc

SEQ ID NO: 781531 - DNA, 25 bp, Mus musculus
tagtgtggattctgctcaccccatc

SEQ ID NO: 781532 - DNA, 25 bp, Mus musculus
tagtgtgggtagatattgttgttta

SEQ ID NO: 781533 - DNA, 25 bp, Mus musculus
tagtgtgggtagttattgttgttta

SEQ ID NO: 781534 - DNA, 25 bp, Mus musculus
tagtgtgggttcacggtcatcccca

SEQ ID NO: 781535 - DNA, 25 bp, Mus musculus
tagtgtgggttctcggtcatcccca

SEQ ID NO: 781536 - DNA, 25 bp, Mus musculus
tagtgtggtcagatcaaagttgcat

SEQ ID NO: 781537 - DNA, 25 bp, Mus musculus
tagtgtggtcagttcaaagttgcat

SEQ ID NO: 781538 - DNA, 25 bp, Mus musculus
tagtgtggtcgtcagcttaatgttt

SEQ ID NO: 781539 - DNA, 25 bp, Mus musculus
tagtgtggtcgtgagcttaatgttt

SEQ ID NO: 781540 - DNA, 25 bp, Mus musculus
tagtgtggtgtgactcccactgcct

SEQ ID NO: 781541 - DNA, 25 bp, Mus musculus
tagtgtggtgtgtctcccactgcct

SEQ ID NO: 781542 - DNA, 25 bp, Mus musculus
tagtgtgtatcaccttccaggacag

SEQ ID NO: 781543 - DNA, 25 bp, Mus musculus
tagtgtgtatcagcttccaggacag

SEQ ID NO: 781544 - DNA, 25 bp, Mus musculus
tagtgtgtcccaagtccatagcctc

SEQ ID NO: 781545 - DNA, 25 bp, Mus musculus
tagtgtgtcccatgtccatagcctc

SEQ ID NO: 781546 - DNA, 25 bp, Mus musculus
tagtgtgtcccgcaggtccgatagc

SEQ ID NO: 781547 - DNA, 25 bp, Mus musculus
tagtgtgtcccggaggtccgatagc

SEQ ID NO: 781548 - DNA, 25 bp, Mus musculus
tagtgtgtcgtaaatctccacctct

SEQ ID NO: 781549 - DNA, 25 bp, Mus musculus
tagtgtgtcgtatatctccacctct

SEQ ID NO: 781550 - DNA, 25 bp, Mus musculus
tagtgtgtctgtagccacttccaga

SEQ ID NO: 781551 - DNA, 25 bp, Mus musculus
tagtgtgtctgttgccacttccaga

SEQ ID NO: 781552 - DNA, 25 bp, Mus musculus
tagtgtgtctttacgtttcccagtt

SEQ ID NO: 781553 - DNA, 25 bp, Mus musculus
tagtgtgtcttttcgtttcccagtt

SEQ ID NO: 781554 - DNA, 25 bp, Mus musculus
tagtgtgtgaaaaaaggcttttctt

SEQ ID NO: 781555 - DNA, 25 bp, Mus musculus
tagtgtgtgaaataaggcttttctt

SEQ ID NO: 781556 - DNA, 25 bp, Mus musculus
tagtgtgtgctgaaaaccacaaggt

SEQ ID NO: 781557 - DNA, 25 bp, Mus musculus
tagtgtgtgctgtaaaccacaaggt

SEQ ID NO: 781558 - DNA, 25 bp, Mus musculus
tagtgtgtggatctctggattcttc

SEQ ID NO: 781559 - DNA, 25 bp, Mus musculus
tagtgtgtggatgtctggattcttc

SEQ ID NO: 781560 - DNA, 25 bp, Mus musculus
tagtgtgtggcaacactagtgctgg

SEQ ID NO: 781561 - DNA, 25 bp, Mus musculus
tagtgtgtggcatcactagtgctgg

SEQ ID NO: 781562 - DNA, 25 bp, Mus musculus
tagtgtgtgtataacctggacaagt

SEQ ID NO: 781563 - DNA, 25 bp, Mus musculus
tagtgtgtgtattacctggacaagt

SEQ ID NO: 781564 - DNA, 25 bp, Mus musculus
tagtgtgtgtgaatgctttgcatgc

SEQ ID NO: 781565 - DNA, 25 bp, Mus musculus
tagtgtgtgtgattgctttgcatgc

SEQ ID NO: 781566 - DNA, 25 bp, Mus musculus
tagtgtgttactactgtcagtgtct

SEQ ID NO: 781567 - DNA, 25 bp, Mus musculus
tagtgtgttacttctgtcagtgtct

SEQ ID NO: 781568 - DNA, 25 bp, Mus musculus
tagtgtgttcacacagatgatctga

SEQ ID NO: 781569 - DNA, 25 bp, Mus musculus
tagtgtgttcactcagatgatctga

SEQ ID NO: 781570 - DNA, 25 bp, Mus musculus
tagtgtgttcatccaccatggtgga

SEQ ID NO: 781571 - DNA, 25 bp, Mus musculus
tagtgtgttcatgcaccatggtgga

SEQ ID NO: 781572 - DNA, 25 bp, Mus musculus
tagtgtgttcctatccttgtccatt

SEQ ID NO: 781573 - DNA, 25 bp, Mus musculus
tagtgtgttcctttccttgtccatt

SEQ ID NO: 781574 - DNA, 25 bp, Mus musculus
tagtgtgttctcacttgccattgaa

SEQ ID NO: 781575 - DNA, 25 bp, Mus musculus
tagtgtgttctctcttgccattgaa

SEQ ID NO: 781576 - DNA, 25 bp, Mus musculus
tagtgtgttgaaagcatgcgggaaa

SEQ ID NO: 781577 - DNA, 25 bp, Mus musculus
tagtgtgttgaatgcatgcgggaaa

SEQ ID NO: 781578 - DNA, 25 bp, Mus musculus
tagtgtgttgttagggacatcccta

SEQ ID NO: 781579 - DNA, 25 bp, Mus musculus
tagtgtgttgtttgggacatcccta

SEQ ID NO: 781580 - DNA, 25 bp, Mus musculus
tagtgtgtttgcatttgcatccctt

SEQ ID NO: 781581 - DNA, 25 bp, Mus musculus
tagtgtgtttgcttttgcatccctt

SEQ ID NO: 781582 - DNA, 25 bp, Mus musculus
tagtgttaacctctcatacctcaca

SEQ ID NO: 781583 - DNA, 25 bp, Mus musculus
tagtgttaacctgtcatacctcaca

SEQ ID NO: 781584 - DNA, 25 bp, Mus musculus
tagtgttaactcaaatttacaaagg

SEQ ID NO: 781585 - DNA, 25 bp, Mus musculus
tagtgttaactctaatttacaaagg

SEQ ID NO: 781586 - DNA, 25 bp, Mus musculus
tagtgttaagagaccatccctgggc

SEQ ID NO: 781587 - DNA, 25 bp, Mus musculus
tagtgttaagagtccatccctgggc

SEQ ID NO: 781588 - DNA, 25 bp, Mus musculus
tagtgttaatgcaggcgcgtgcgca

SEQ ID NO: 781589 - DNA, 25 bp, Mus musculus
tagtgttaatgctggcgcgtgcgca

SEQ ID NO: 781590 - DNA, 25 bp, Mus musculus
tagtgttacattaccaagtgcagat

SEQ ID NO: 781591 - DNA, 25 bp, Mus musculus
tagtgttacatttccaagtgcagat

SEQ ID NO: 781592 - DNA, 25 bp, Mus musculus
tagtgttagagtacgctgctgccag

SEQ ID NO: 781593 - DNA, 25 bp, Mus musculus
tagtgttagagttcgctgctgccag

SEQ ID NO: 781594 - DNA, 25 bp, Mus musculus
tagtgttagatacaggctggtgatc

SEQ ID NO: 781595 - DNA, 25 bp, Mus musculus
tagtgttagatagaggctggtgatc

SEQ ID NO: 781596 - DNA, 25 bp, Mus musculus
tagtgttagcggcttttctgttggt

SEQ ID NO: 781597 - DNA, 25 bp, Mus musculus
tagtgttagcgggttttctgttggt

SEQ ID NO: 781598 - DNA, 25 bp, Mus musculus
tagtgttagcttacatcttgctttt

SEQ ID NO: 781599 - DNA, 25 bp, Mus musculus
tagtgttagctttcatcttgctttt

SEQ ID NO: 781600 - DNA, 25 bp, Mus musculus
tagtgttaggcacctgtacaggtca

SEQ ID NO: 781601 - DNA, 25 bp, Mus musculus
tagtgttaggcagctgtacaggtca

SEQ ID NO: 781602 - DNA, 25 bp, Mus musculus
tagtgttagtgcagcgcccggtgaa

SEQ ID NO: 781603 - DNA, 25 bp, Mus musculus
tagtgttagtgctgcgcccggtgaa

SEQ ID NO: 781604 - DNA, 25 bp, Mus musculus
tagtgttatcatatcagacttctga

SEQ ID NO: 781605 - DNA, 25 bp, Mus musculus
tagtgttatcatttcagacttctga

SEQ ID NO: 781606 - DNA, 25 bp, Mus musculus
tagtgttatgctccggaacccaatg

SEQ ID NO: 781607 - DNA, 25 bp, Mus musculus
tagtgttatgctgcggaacccaatg

SEQ ID NO: 781608 - DNA, 25 bp, Mus musculus
tagtgttcactcagacttgtaggtt

SEQ ID NO: 781609 - DNA, 25 bp, Mus musculus
tagtgttcactctgacttgtaggtt

SEQ ID NO: 781610 - DNA, 25 bp, Mus musculus
tagtgttcataccattgtgccttat

SEQ ID NO: 781611 - DNA, 25 bp, Mus musculus
tagtgttcatacgattgtgccttat

SEQ ID NO: 781612 - DNA, 25 bp, Mus musculus
tagtgttcccttactgaagacctca

SEQ ID NO: 781613 - DNA, 25 bp, Mus musculus
tagtgttccctttctgaagacctca

SEQ ID NO: 781614 - DNA, 25 bp, Mus musculus
tagtgttcggcgaacacagagcggc

SEQ ID NO: 781615 - DNA, 25 bp, Mus musculus
tagtgttcggcgtacacagagcggc

SEQ ID NO: 781616 - DNA, 25 bp, Mus musculus
tagtgttcggtgactccttgaagaa

SEQ ID NO: 781617 - DNA, 25 bp, Mus musculus
tagtgttcggtgtctccttgaagaa

SEQ ID NO: 781618 - DNA, 25 bp, Mus musculus
tagtgttcgtggctcctttggtcag

SEQ ID NO: 781619 - DNA, 25 bp, Mus musculus
tagtgttcgtgggtcctttggtcag

SEQ ID NO: 781620 - DNA, 25 bp, Mus musculus
tagtgttcgttgatgctctgtctaa

SEQ ID NO: 781621 - DNA, 25 bp, Mus musculus
tagtgttcgttgttgctctgtctaa

SEQ ID NO: 781622 - DNA, 25 bp, Mus musculus
tagtgttctagcatgttccttcctt

SEQ ID NO: 781623 - DNA, 25 bp, Mus musculus
tagtgttctagcttgttccttcctt

SEQ ID NO: 781624 - DNA, 25 bp, Mus musculus
tagtgttctcttcctgcggtcagga

SEQ ID NO: 781625 - DNA, 25 bp, Mus musculus
tagtgttctcttgctgcggtcagga

SEQ ID NO: 781626 - DNA, 25 bp, Mus musculus
tagtgttctgatcggaggtctcttc

SEQ ID NO: 781627 - DNA, 25 bp, Mus musculus
tagtgttctgatgggaggtctcttc

SEQ ID NO: 781628 - DNA, 25 bp, Mus musculus
tagtgttctggcacagcctatgtaa

SEQ ID NO: 781629 - DNA, 25 bp, Mus musculus
tagtgttctggcctaggagctgtac

SEQ ID NO: 781630 - DNA, 25 bp, Mus musculus
tagtgttctggcgtaggagctgtac

SEQ ID NO: 781631 - DNA, 25 bp, Mus musculus
tagtgttctggctcagcctatgtaa

SEQ ID NO: 781632 - DNA, 25 bp, Mus musculus
tagtgttcttctattctcatccaca

SEQ ID NO: 781633 - DNA, 25 bp, Mus musculus
tagtgttcttcttttctcatccaca

SEQ ID NO: 781634 - DNA, 25 bp, Mus musculus
tagtgttgcggaagtccaggccaca

SEQ ID NO: 781635 - DNA, 25 bp, Mus musculus
tagtgttgcggatgtccaggccaca

SEQ ID NO: 781636 - DNA, 25 bp, Mus musculus
tagtgttgcttgcttcactttgtgg

SEQ ID NO: 781637 - DNA, 25 bp, Mus musculus
tagtgttgcttggttcactttgtgg

SEQ ID NO: 781638 - DNA, 25 bp, Mus musculus
tagtgttggacgaggctaccgcagc

SEQ ID NO: 781639 - DNA, 25 bp, Mus musculus
tagtgttggacgtggctaccgcagc

SEQ ID NO: 781640 - DNA, 25 bp, Mus musculus
tagtgttggatgctgctgccctgaa

SEQ ID NO: 781641 - DNA, 25 bp, Mus musculus
tagtgttggatggtgctgccctgaa

SEQ ID NO: 781642 - DNA, 25 bp, Mus musculus
tagtgttggcttaactgtgatgaca

SEQ ID NO: 781643 - DNA, 25 bp, Mus musculus
tagtgttggctttactgtgatgaca

SEQ ID NO: 781644 - DNA, 25 bp, Mus musculus
tagtgttggtggcacctcacgtatc

SEQ ID NO: 781645 - DNA, 25 bp, Mus musculus
tagtgttggtgggacctcacgtatc

SEQ ID NO: 781646 - DNA, 25 bp, Mus musculus
tagtgttgtaagctctattaggcaa

SEQ ID NO: 781647 - DNA, 25 bp, Mus musculus
tagtgttgtaaggtctattaggcaa

SEQ ID NO: 781648 - DNA, 25 bp, Mus musculus
tagtgttgtaccaagccttttctgt

SEQ ID NO: 781649 - DNA, 25 bp, Mus musculus
tagtgttgtacctagccttttctgt

SEQ ID NO: 781650 - DNA, 25 bp, Mus musculus
tagtgtttaagaccctgagctgctc

SEQ ID NO: 781651 - DNA, 25 bp, Mus musculus
tagtgtttaagagcctgagctgctc

SEQ ID NO: 781652 - DNA, 25 bp, Mus musculus
tagtgtttaatcatccggaaagctt

SEQ ID NO: 781653 - DNA, 25 bp, Mus musculus
tagtgtttaatcttccggaaagctt

SEQ ID NO: 781654 - DNA, 25 bp, Mus musculus
tagtgtttagcaaggtatcctttaa

SEQ ID NO: 781655 - DNA, 25 bp, Mus musculus
tagtgtttagcatggtatcctttaa

SEQ ID NO: 781656 - DNA, 25 bp, Mus musculus
tagtgtttatataagcatgtgccga

SEQ ID NO: 781657 - DNA, 25 bp, Mus musculus
tagtgtttatattagcatgtgccga

SEQ ID NO: 781658 - DNA, 25 bp, Mus musculus
tagtgtttccttctgcctttggcca

SEQ ID NO: 781659 - DNA, 25 bp, Mus musculus
tagtgtttccttgtgcctttggcca

SEQ ID NO: 781660 - DNA, 25 bp, Mus musculus
tagtgtttctacataaccctttcag

SEQ ID NO: 781661 - DNA, 25 bp, Mus musculus
tagtgtttctacttaaccctttcag

SEQ ID NO: 781662 - DNA, 25 bp, Mus musculus
tagtgtttcttacagtgcacattta

SEQ ID NO: 781663 - DNA, 25 bp, Mus musculus
tagtgtttcttagagtgcacattta

SEQ ID NO: 781664 - DNA, 25 bp, Mus musculus
tagtgtttgctgatctaagcacgat

SEQ ID NO: 781665 - DNA, 25 bp, Mus musculus
tagtgtttgctgttctaagcacgat

SEQ ID NO: 781666 - DNA, 25 bp, Mus musculus
tagtgttttcggcttgagctaccac

SEQ ID NO: 781667 - DNA, 25 bp, Mus musculus
tagtgttttcgggttgagctaccac

SEQ ID NO: 781668 - DNA, 25 bp, Mus musculus
tagttaaaaccccatggtctccagc

SEQ ID NO: 781669 - DNA, 25 bp, Mus musculus
tagttaaaacccgatggtctccagc

SEQ ID NO: 781670 - DNA, 25 bp, Mus musculus
tagttaaattctctcaagtctccaa

SEQ ID NO: 781671 - DNA, 25 bp, Mus musculus
tagttaaattctgtcaagtctccaa

SEQ ID NO: 781672 - DNA, 25 bp, Mus musculus
tagttaacagatcctacaaaggtct

SEQ ID NO: 781673 - DNA, 25 bp, Mus musculus
tagttaacagatgctacaaaggtct

SEQ ID NO: 781674 - DNA, 25 bp, Mus musculus
tagttaaccatcagcatgccgattg

SEQ ID NO: 781675 - DNA, 25 bp, Mus musculus
tagttaaccatctgcatgccgattg

SEQ ID NO: 781676 - DNA, 25 bp, Mus musculus
tagttaacctctcatctgcaatccc

SEQ ID NO: 781677 - DNA, 25 bp, Mus musculus
tagttaacctctgatctgcaatccc

SEQ ID NO: 781678 - DNA, 25 bp, Mus musculus
tagttaagactacagattcctttat

SEQ ID NO: 781679 - DNA, 25 bp, Mus musculus
tagttaagactagagattcctttat

SEQ ID NO: 781680 - DNA, 25 bp, Mus musculus
tagttaatcagtagttcccctaaag

SEQ ID NO: 781681 - DNA, 25 bp, Mus musculus
tagttaatcagttgttcccctaaag

SEQ ID NO: 781682 - DNA, 25 bp, Mus musculus
tagttaatctccatcacttacctgt

SEQ ID NO: 781683 - DNA, 25 bp, Mus musculus
tagttaatctccttcacttacctgt

SEQ ID NO: 781684 - DNA, 25 bp, Mus musculus
tagttaatctctcttggcaaggcga

SEQ ID NO: 781685 - DNA, 25 bp, Mus musculus
tagttaatctctgttggcaaggcga

SEQ ID NO: 781686 - DNA, 25 bp, Mus musculus
tagttaatgcacaggtcccactgtc

SEQ ID NO: 781687 - DNA, 25 bp, Mus musculus
tagttaatgcactggtcccactgtc

SEQ ID NO: 781688 - DNA, 25 bp, Mus musculus
tagttacacaccatgggtcccagga

SEQ ID NO: 781689 - DNA, 25 bp, Mus musculus
tagttacacaccttgggtcccagga

SEQ ID NO: 781690 - DNA, 25 bp, Mus musculus
tagttacacccaccaggcatgaact

SEQ ID NO: 781691 - DNA, 25 bp, Mus musculus
tagttacacccagcaggcatgaact

SEQ ID NO: 781692 - DNA, 25 bp, Mus musculus
tagttacacggcacgctccggtgat

SEQ ID NO: 781693 - DNA, 25 bp, Mus musculus
tagttacacggctcgctccggtgat

SEQ ID NO: 781694 - DNA, 25 bp, Mus musculus
tagttacagagcacgcttggcttct

SEQ ID NO: 781695 - DNA, 25 bp, Mus musculus
tagttacagagctcgcttggcttct

SEQ ID NO: 781696 - DNA, 25 bp, Mus musculus
tagttacagtggaggcactttctac

SEQ ID NO: 781697 - DNA, 25 bp, Mus musculus
tagttacagtggtggcactttctac

SEQ ID NO: 781698 - DNA, 25 bp, Mus musculus
tagttacagttccacttcctttgat

SEQ ID NO: 781699 - DNA, 25 bp, Mus musculus
tagttacagttcgacttcctttgat

SEQ ID NO: 781700 - DNA, 25 bp, Mus musculus
tagttacatagcacccaggacttcc

SEQ ID NO: 781701 - DNA, 25 bp, Mus musculus
tagttacatagctcccaggacttcc

SEQ ID NO: 781702 - DNA, 25 bp, Mus musculus
tagttaccagcacgtgtttccttgg

SEQ ID NO: 781703 - DNA, 25 bp, Mus musculus
tagttaccagcaggtgtttccttgg

SEQ ID NO: 781704 - DNA, 25 bp, Mus musculus
tagttaccagtgatgttaccagcat

SEQ ID NO: 781705 - DNA, 25 bp, Mus musculus
tagttaccagtgttgttaccagcat

SEQ ID NO: 781706 - DNA, 25 bp, Mus musculus
tagttaccatttacattaacagcat

SEQ ID NO: 781707 - DNA, 25 bp, Mus musculus
tagttaccattttcattaacagcat

SEQ ID NO: 781708 - DNA, 25 bp, Mus musculus
tagttacccagtatgaccctaatca

SEQ ID NO: 781709 - DNA, 25 bp, Mus musculus
tagttacccagtttgaccctaatca

SEQ ID NO: 781710 - DNA, 25 bp, Mus musculus
tagttaccgctcacaaacgtaccaa

SEQ ID NO: 781711 - DNA, 25 bp, Mus musculus
tagttaccgctctcaaacgtaccaa

SEQ ID NO: 781712 - DNA, 25 bp, Mus musculus
tagttacctattatacaattgttgg

SEQ ID NO: 781713 - DNA, 25 bp, Mus musculus
tagttacctattttacaattgttgg

SEQ ID NO: 781714 - DNA, 25 bp, Mus musculus
tagttacctgtgagagaggccccag

SEQ ID NO: 781715 - DNA, 25 bp, Mus musculus
tagttacctgtgtgagaggccccag

SEQ ID NO: 781716 - DNA, 25 bp, Mus musculus
tagttacgcattaggttttccgaga

SEQ ID NO: 781717 - DNA, 25 bp, Mus musculus
tagttacgcatttggttttccgaga

SEQ ID NO: 781718 - DNA, 25 bp, Mus musculus
tagttacgggttactactggttcat

SEQ ID NO: 781719 - DNA, 25 bp, Mus musculus
tagttacgggtttctactggttcat

SEQ ID NO: 781720 - DNA, 25 bp, Mus musculus
tagttacgttcaccacttgtctcat

SEQ ID NO: 781721 - DNA, 25 bp, Mus musculus
tagttacgttcagcacttgtctcat

SEQ ID NO: 781722 - DNA, 25 bp, Mus musculus
tagttactaaacaggccggctggct

SEQ ID NO: 781723 - DNA, 25 bp, Mus musculus
tagttactaaactggccggctggct

SEQ ID NO: 781724 - DNA, 25 bp, Mus musculus
tagttactacacagaaggaaggcca

SEQ ID NO: 781725 - DNA, 25 bp, Mus musculus
tagttactacactgaaggaaggcca

SEQ ID NO: 781726 - DNA, 25 bp, Mus musculus
tagttactcaccaccctcagagagt

SEQ ID NO: 781727 - DNA, 25 bp, Mus musculus
tagttactcacctccctcagagagt

SEQ ID NO: 781728 - DNA, 25 bp, Mus musculus
tagttactcaggagctccagtgcgc

SEQ ID NO: 781729 - DNA, 25 bp, Mus musculus
tagttactcaggtgctccagtgcgc

SEQ ID NO: 781730 - DNA, 25 bp, Mus musculus
tagttactctcaaaaggtccttagg

SEQ ID NO: 781731 - DNA, 25 bp, Mus musculus
tagttactctcataaggtccttagg

SEQ ID NO: 781732 - DNA, 25 bp, Mus musculus
tagttactgaccaggttttctccta

SEQ ID NO: 781733 - DNA, 25 bp, Mus musculus
tagttactgacctggttttctccta

SEQ ID NO: 781734 - DNA, 25 bp, Mus musculus
tagttactgcctctaactgccagta

SEQ ID NO: 781735 - DNA, 25 bp, Mus musculus
tagttactgcctgtaactgccagta

SEQ ID NO: 781736 - DNA, 25 bp, Mus musculus
tagttacttctgatgacaatttgaa

SEQ ID NO: 781737 - DNA, 25 bp, Mus musculus
tagttacttctgttgacaatttgaa

SEQ ID NO: 781738 - DNA, 25 bp, Mus musculus
tagttactttaaatctctgggaagc

SEQ ID NO: 781739 - DNA, 25 bp, Mus musculus
tagttactttaattctctgggaagc

SEQ ID NO: 781740 - DNA, 25 bp, Mus musculus
tagttacttttcctttggaatgaat

SEQ ID NO: 781741 - DNA, 25 bp, Mus musculus
tagttacttttcgtttggaatgaat

SEQ ID NO: 781742 - DNA, 25 bp, Mus musculus
tagttagaactacgcagtaagaccc

SEQ ID NO: 781743 - DNA, 25 bp, Mus musculus
tagttagaactaggcagtaagaccc

SEQ ID NO: 781744 - DNA, 25 bp, Mus musculus
tagttagacgcacctttctttttcc

SEQ ID NO: 781745 - DNA, 25 bp, Mus musculus
tagttagacgcagctttctttttcc

SEQ ID NO: 781746 - DNA, 25 bp, Mus musculus
tagttagagattcggtctccaaaaa

SEQ ID NO: 781747 - DNA, 25 bp, Mus musculus
tagttagagattgggtctccaaaaa

SEQ ID NO: 781748 - DNA, 25 bp, Mus musculus
tagttagatgtcacctgtgggtccc

SEQ ID NO: 781749 - DNA, 25 bp, Mus musculus
tagttagatgtctcctgtgggtccc

SEQ ID NO: 781750 - DNA, 25 bp, Mus musculus
tagttagcctggatcaaagtggaat

SEQ ID NO: 781751 - DNA, 25 bp, Mus musculus
tagttagcctggttcaaagtggaat

SEQ ID NO: 781752 - DNA, 25 bp, Mus musculus
tagttagcgtgtattagagggagtc

SEQ ID NO: 781753 - DNA, 25 bp, Mus musculus
tagttagcgtgttttagagggagtc

SEQ ID NO: 781754 - DNA, 25 bp, Mus musculus
tagttagctggcctcttgacaccta

SEQ ID NO: 781755 - DNA, 25 bp, Mus musculus
tagttagctggcgtcttgacaccta

SEQ ID NO: 781756 - DNA, 25 bp, Mus musculus
tagttagcttagctctgtctcttgt

SEQ ID NO: 781757 - DNA, 25 bp, Mus musculus
tagttagcttaggtctgtctcttgt

SEQ ID NO: 781758 - DNA, 25 bp, Mus musculus
tagttaggacagcatgggaccataa

SEQ ID NO: 781759 - DNA, 25 bp, Mus musculus
tagttaggacaggatgggaccataa

SEQ ID NO: 781760 - DNA, 25 bp, Mus musculus
tagttaggcaccatgtgcctgctct

SEQ ID NO: 781761 - DNA, 25 bp, Mus musculus
tagttaggcaccttgtgcctgctct

SEQ ID NO: 781762 - DNA, 25 bp, Mus musculus
tagttaggcatccttctcatctttg

SEQ ID NO: 781763 - DNA, 25 bp, Mus musculus
tagttaggcatcgttctcatctttg

SEQ ID NO: 781764 - DNA, 25 bp, Mus musculus
tagttaggttccattcagacccatt

SEQ ID NO: 781765 - DNA, 25 bp, Mus musculus
tagttaggttcctttcagacccatt

SEQ ID NO: 781766 - DNA, 25 bp, Mus musculus
tagttagtgagtccttccattttac

SEQ ID NO: 781767 - DNA, 25 bp, Mus musculus
tagttagtgagtgcttccattttac

SEQ ID NO: 781768 - DNA, 25 bp, Mus musculus
tagttagtgtctccctgtcgctttc

SEQ ID NO: 781769 - DNA, 25 bp, Mus musculus
tagttagtgtctgcctgtcgctttc

SEQ ID NO: 781770 - DNA, 25 bp, Mus musculus
tagttatacctcaacccttatgcaa

SEQ ID NO: 781771 - DNA, 25 bp, Mus musculus
tagttatacctctacccttatgcaa

SEQ ID NO: 781772 - DNA, 25 bp, Mus musculus
tagttatcgcctacctcatgatgcg

SEQ ID NO: 781773 - DNA, 25 bp, Mus musculus
tagttatcgccttcctcatgatgcg

SEQ ID NO: 781774 - DNA, 25 bp, Mus musculus
tagttatgctatctcagggctcaga

SEQ ID NO: 781775 - DNA, 25 bp, Mus musculus
tagttatgctatgtcagggctcaga

SEQ ID NO: 781776 - DNA, 25 bp, Mus musculus
tagttatgctctcccctgacagggc

SEQ ID NO: 781777 - DNA, 25 bp, Mus musculus
tagttatgctctgccctgacagggc

SEQ ID NO: 781778 - DNA, 25 bp, Mus musculus
tagttatggccgcatttgctttctc

SEQ ID NO: 781779 - DNA, 25 bp, Mus musculus
tagttatggccggatttgctttctc

SEQ ID NO: 781780 - DNA, 25 bp, Mus musculus
tagttatggttgaaagcctgcatca

SEQ ID NO: 781781 - DNA, 25 bp, Mus musculus
tagttatggttgtaagcctgcatca

SEQ ID NO: 781782 - DNA, 25 bp, Mus musculus
tagttatgtgaaatgctgacgttac

SEQ ID NO: 781783 - DNA, 25 bp, Mus musculus
tagttatgtgaattgctgacgttac

SEQ ID NO: 781784 - DNA, 25 bp, Mus musculus
tagttattacacacccaggcctaaa

SEQ ID NO: 781785 - DNA, 25 bp, Mus musculus
tagttattacactcccaggcctaaa

SEQ ID NO: 781786 - DNA, 25 bp, Mus musculus
tagttattaccaacctgaggggagt

SEQ ID NO: 781787 - DNA, 25 bp, Mus musculus
tagttattaccatcctgaggggagt

SEQ ID NO: 781788 - DNA, 25 bp, Mus musculus
tagttattcaatagctcagccatat

SEQ ID NO: 781789 - DNA, 25 bp, Mus musculus
tagttattcaattgctcagccatat

SEQ ID NO: 781790 - DNA, 25 bp, Mus musculus
tagttattccatacccacagtaata

SEQ ID NO: 781791 - DNA, 25 bp, Mus musculus
tagttattccattcccacagtaata

SEQ ID NO: 781792 - DNA, 25 bp, Mus musculus
tagttattcttaaggccgctcatct

SEQ ID NO: 781793 - DNA, 25 bp, Mus musculus
tagttattcttatggccgctcatct

SEQ ID NO: 781794 - DNA, 25 bp, Mus musculus
tagttattgcccattggccagcagg

SEQ ID NO: 781795 - DNA, 25 bp, Mus musculus
tagttattgccctttggccagcagg

SEQ ID NO: 781796 - DNA, 25 bp, Mus musculus
tagttatttttcagactccgggtca

SEQ ID NO: 781797 - DNA, 25 bp, Mus musculus
tagttatttttctgactccgggtca

SEQ ID NO: 781798 - DNA, 25 bp, Mus musculus
tagttcaagacaccggcaccaagat

SEQ ID NO: 781799 - DNA, 25 bp, Mus musculus
tagttcaagacagcggcaccaagat

SEQ ID NO: 781800 - DNA, 25 bp, Mus musculus
tagttcaagacccatgcagagtgct

SEQ ID NO: 781801 - DNA, 25 bp, Mus musculus
tagttcaagaccgatgcagagtgct

SEQ ID NO: 781802 - DNA, 25 bp, Mus musculus
tagttcaagccccagcctattggat

SEQ ID NO: 781803 - DNA, 25 bp, Mus musculus
tagttcaagcccgagcctattggat

SEQ ID NO: 781804 - DNA, 25 bp, Mus musculus
tagttcaatttcctgttgtgcttag

SEQ ID NO: 781805 - DNA, 25 bp, Mus musculus
tagttcaatttcgtgttgtgcttag

SEQ ID NO: 781806 - DNA, 25 bp, Mus musculus
tagttcacacctagatttcactcca

SEQ ID NO: 781807 - DNA, 25 bp, Mus musculus
tagttcacaccttgatttcactcca

SEQ ID NO: 781808 - DNA, 25 bp, Mus musculus
tagttcacatccagtgggccttgaa

SEQ ID NO: 781809 - DNA, 25 bp, Mus musculus
tagttcacatcctgtgggccttgaa

SEQ ID NO: 781810 - DNA, 25 bp, Mus musculus
tagttcacatgtccccataaatagg

SEQ ID NO: 781811 - DNA, 25 bp, Mus musculus
tagttcacatgtgcccataaatagg

SEQ ID NO: 781812 - DNA, 25 bp, Mus musculus
tagttcacattacctcaccacagtt

SEQ ID NO: 781813 - DNA, 25 bp, Mus musculus
tagttcacattagctcaccacagtt

SEQ ID NO: 781814 - DNA, 25 bp, Mus musculus
tagttcaccacacgaatcagaaaat

SEQ ID NO: 781815 - DNA, 25 bp, Mus musculus
tagttcaccacaggaatcagaaaat

SEQ ID NO: 781816 - DNA, 25 bp, Mus musculus
tagttcacccctagtaattccagca

SEQ ID NO: 781817 - DNA, 25 bp, Mus musculus
tagttcaccccttgtaattccagca

SEQ ID NO: 781818 - DNA, 25 bp, Mus musculus
tagttcacctttctattcatttttg

SEQ ID NO: 781819 - DNA, 25 bp, Mus musculus
tagttcacctttgtattcatttttg

SEQ ID NO: 781820 - DNA, 25 bp, Mus musculus
tagttcacggccacgactcaagggt

SEQ ID NO: 781821 - DNA, 25 bp, Mus musculus
tagttcacggcctcgactcaagggt

SEQ ID NO: 781822 - DNA, 25 bp, Mus musculus
tagttcactgctcatccacaggaaa

SEQ ID NO: 781823 - DNA, 25 bp, Mus musculus
tagttcactgctgatccacaggaaa

SEQ ID NO: 781824 - DNA, 25 bp, Mus musculus
tagttcagagtaaaccccatcctgc

SEQ ID NO: 781825 - DNA, 25 bp, Mus musculus
tagttcagagtataccccatcctgc

SEQ ID NO: 781826 - DNA, 25 bp, Mus musculus
tagttcaggaccatcctagactcta

SEQ ID NO: 781827 - DNA, 25 bp, Mus musculus
tagttcaggaccttcctagactcta

SEQ ID NO: 781828 - DNA, 25 bp, Mus musculus
tagttcaggctaatcttaaactcac

SEQ ID NO: 781829 - DNA, 25 bp, Mus musculus
tagttcaggctattcttaaactcac

SEQ ID NO: 781830 - DNA, 25 bp, Mus musculus
tagttcagggcaccatccaccattg

SEQ ID NO: 781831 - DNA, 25 bp, Mus musculus
tagttcagggcagcatccaccattg

SEQ ID NO: 781832 - DNA, 25 bp, Mus musculus
tagttcagtggaacatgaggagccc

SEQ ID NO: 781833 - DNA, 25 bp, Mus musculus
tagttcagtggatcatgaggagccc

SEQ ID NO: 781834 - DNA, 25 bp, Mus musculus
tagttcatacaacggacaaatctca

SEQ ID NO: 781835 - DNA, 25 bp, Mus musculus
tagttcatacaagggacaaatctca

SEQ ID NO: 781836 - DNA, 25 bp, Mus musculus
tagttcatccttcttacctaacaag

SEQ ID NO: 781837 - DNA, 25 bp, Mus musculus
tagttcatccttgttacctaacaag

SEQ ID NO: 781838 - DNA, 25 bp, Mus musculus
tagttcatgggcactgttcactgaa

SEQ ID NO: 781839 - DNA, 25 bp, Mus musculus
tagttcatgggctctgttcactgaa

SEQ ID NO: 781840 - DNA, 25 bp, Mus musculus
tagttcatttaaagtgtctgtctcc

SEQ ID NO: 781841 - DNA, 25 bp, Mus musculus
tagttcatttaatgtgtctgtctcc

SEQ ID NO: 781842 - DNA, 25 bp, Mus musculus
tagttccaaattccacacccttaga

SEQ ID NO: 781843 - DNA, 25 bp, Mus musculus
tagttccaaattgcacacccttaga

SEQ ID NO: 781844 - DNA, 25 bp, Mus musculus
tagttccaacgtatgctttaagtat

SEQ ID NO: 781845 - DNA, 25 bp, Mus musculus
tagttccaacgtttgctttaagtat

SEQ ID NO: 781846 - DNA, 25 bp, Mus musculus
tagttccaatcccaagacatgtcct

SEQ ID NO: 781847 - DNA, 25 bp, Mus musculus
tagttccaatccgaagacatgtcct

SEQ ID NO: 781848 - DNA, 25 bp, Mus musculus
tagttccacactcccttttagaggc

SEQ ID NO: 781849 - DNA, 25 bp, Mus musculus
tagttccacactgccttttagaggc

SEQ ID NO: 781850 - DNA, 25 bp, Mus musculus
tagttccacctaaagcactgggatt

SEQ ID NO: 781851 - DNA, 25 bp, Mus musculus
tagttccacctatagcactgggatt

SEQ ID NO: 781852 - DNA, 25 bp, Mus musculus
tagttccactctactatcagccata

SEQ ID NO: 781853 - DNA, 25 bp, Mus musculus
tagttccactcttctatcagccata

SEQ ID NO: 781854 - DNA, 25 bp, Mus musculus
tagttccagctcctcagactcggac

SEQ ID NO: 781855 - DNA, 25 bp, Mus musculus
tagttccagctcgtcagactcggac

SEQ ID NO: 781856 - DNA, 25 bp, Mus musculus
tagttccagggtaacggcctcattt

SEQ ID NO: 781857 - DNA, 25 bp, Mus musculus
tagttccagggttacggcctcattt

SEQ ID NO: 781858 - DNA, 25 bp, Mus musculus
tagttccagtgaattgggtcatatc

SEQ ID NO: 781859 - DNA, 25 bp, Mus musculus
tagttccagtgatttgggtcatatc

SEQ ID NO: 781860 - DNA, 25 bp, Mus musculus
tagttccagtgcaagtagccagcaa

SEQ ID NO: 781861 - DNA, 25 bp, Mus musculus
tagttccagtgctagtagccagcaa

SEQ ID NO: 781862 - DNA, 25 bp, Mus musculus
tagttccattccagcattgtgtcaa

SEQ ID NO: 781863 - DNA, 25 bp, Mus musculus
tagttccattcctgcattgtgtcaa

SEQ ID NO: 781864 - DNA, 25 bp, Mus musculus
tagttcccagaaatttacagagccg

SEQ ID NO: 781865 - DNA, 25 bp, Mus musculus
tagttcccagaattttacagagccg

SEQ ID NO: 781866 - DNA, 25 bp, Mus musculus
tagttcccagacagttctaggtaac

SEQ ID NO: 781867 - DNA, 25 bp, Mus musculus
tagttcccagactgttctaggtaac

SEQ ID NO: 781868 - DNA, 25 bp, Mus musculus
tagttcccagcactaacacgatgac

SEQ ID NO: 781869 - DNA, 25 bp, Mus musculus
tagttcccagcagtaacacgatgac

SEQ ID NO: 781870 - DNA, 25 bp, Mus musculus
tagttcccagcgatatattcctgag

SEQ ID NO: 781871 - DNA, 25 bp, Mus musculus
tagttcccagcgttatattcctgag

SEQ ID NO: 781872 - DNA, 25 bp, Mus musculus
tagttcccgttactcctgagaacat

SEQ ID NO: 781873 - DNA, 25 bp, Mus musculus
tagttcccgttagtcctgagaacat

SEQ ID NO: 781874 - DNA, 25 bp, Mus musculus
tagttccctcagactaccaggacaa

SEQ ID NO: 781875 - DNA, 25 bp, Mus musculus
tagttccctcagtctaccaggacaa

SEQ ID NO: 781876 - DNA, 25 bp, Mus musculus
tagttccctctcattgtagttgttt

SEQ ID NO: 781877 - DNA, 25 bp, Mus musculus
tagttccctctctttgtagttgttt

SEQ ID NO: 781878 - DNA, 25 bp, Mus musculus
tagttccctggcacagtaggacatt

SEQ ID NO: 781879 - DNA, 25 bp, Mus musculus
tagttccctggctcagtaggacatt

SEQ ID NO: 781880 - DNA, 25 bp, Mus musculus
tagttcctaaggcaccggaggtatt

SEQ ID NO: 781881 - DNA, 25 bp, Mus musculus
tagttcctaagggaccggaggtatt

SEQ ID NO: 781882 - DNA, 25 bp, Mus musculus
tagttcctagaaccatttccaccag

SEQ ID NO: 781883 - DNA, 25 bp, Mus musculus
tagttcctagaagcatttccaccag

SEQ ID NO: 781884 - DNA, 25 bp, Mus musculus
tagttcctaggtaaaaggctattct

SEQ ID NO: 781885 - DNA, 25 bp, Mus musculus
tagttcctaggttaaaggctattct

SEQ ID NO: 781886 - DNA, 25 bp, Mus musculus
tagttcctcagtcccttttagagta

SEQ ID NO: 781887 - DNA, 25 bp, Mus musculus
tagttcctcagtgccttttagagta

SEQ ID NO: 781888 - DNA, 25 bp, Mus musculus
tagttcctcctactgatgcagggat

SEQ ID NO: 781889 - DNA, 25 bp, Mus musculus
tagttcctcctagtgatgcagggat

SEQ ID NO: 781890 - DNA, 25 bp, Mus musculus
tagttcctcctcaaagtctctgaga

SEQ ID NO: 781891 - DNA, 25 bp, Mus musculus
tagttcctcctctaagtctctgaga

SEQ ID NO: 781892 - DNA, 25 bp, Mus musculus
tagttcctcctgcatagagactccc

SEQ ID NO: 781893 - DNA, 25 bp, Mus musculus
tagttcctcctggatagagactccc

SEQ ID NO: 781894 - DNA, 25 bp, Mus musculus
tagttcctctgcactcacgtatgtt

SEQ ID NO: 781895 - DNA, 25 bp, Mus musculus
tagttcctctgctctcacgtatgtt

SEQ ID NO: 781896 - DNA, 25 bp, Mus musculus
tagttcctgattaagacacctgtct

SEQ ID NO: 781897 - DNA, 25 bp, Mus musculus
tagttcctgattcagactaccccag

SEQ ID NO: 781898 - DNA, 25 bp, Mus musculus
tagttcctgattgagactaccccag

SEQ ID NO: 781899 - DNA, 25 bp, Mus musculus
tagttcctgatttagacacctgtct

SEQ ID NO: 781900 - DNA, 25 bp, Mus musculus
tagttcctgtctcttcatttaccat

SEQ ID NO: 781901 - DNA, 25 bp, Mus musculus
tagttcctgtctgttcatttaccat

SEQ ID NO: 781902 - DNA, 25 bp, Mus musculus
tagttccttctaagttcccaacaat

SEQ ID NO: 781903 - DNA, 25 bp, Mus musculus
tagttccttctatgttcccaacaat

SEQ ID NO: 781904 - DNA, 25 bp, Mus musculus
tagttccttgggattagctcttggc

SEQ ID NO: 781905 - DNA, 25 bp, Mus musculus
tagttccttgggtttagctcttggc

SEQ ID NO: 781906 - DNA, 25 bp, Mus musculus
tagttccttgtcaccatggacttgg

SEQ ID NO: 781907 - DNA, 25 bp, Mus musculus
tagttccttgtctccatggacttgg

SEQ ID NO: 781908 - DNA, 25 bp, Mus musculus
tagttcctttacacaactcggcagt

SEQ ID NO: 781909 - DNA, 25 bp, Mus musculus
tagttcctttactcaactcggcagt

SEQ ID NO: 781910 - DNA, 25 bp, Mus musculus
tagttcgacaggagtgcttattgac

SEQ ID NO: 781911 - DNA, 25 bp, Mus musculus
tagttcgacaggtgtgcttattgac

SEQ ID NO: 781912 - DNA, 25 bp, Mus musculus
tagttcgcacagatgctctgcaggt

SEQ ID NO: 781913 - DNA, 25 bp, Mus musculus
tagttcgcacagttgctctgcaggt

SEQ ID NO: 781914 - DNA, 25 bp, Mus musculus
tagttcggcatcaagttctgcttaa

SEQ ID NO: 781915 - DNA, 25 bp, Mus musculus
tagttcggcatctagttctgcttaa

SEQ ID NO: 781916 - DNA, 25 bp, Mus musculus
tagttcggctaacctgtgtccacag

SEQ ID NO: 781917 - DNA, 25 bp, Mus musculus
tagttcggctaagctgtgtccacag

SEQ ID NO: 781918 - DNA, 25 bp, Mus musculus
tagttcgtgaatcctgtgttcccca

SEQ ID NO: 781919 - DNA, 25 bp, Mus musculus
tagttcgtgaatgctgtgttcccca

SEQ ID NO: 781920 - DNA, 25 bp, Mus musculus
tagttcgtggtcacacacagcctga

SEQ ID NO: 781921 - DNA, 25 bp, Mus musculus
tagttcgtggtctcacacagcctga

SEQ ID NO: 781922 - DNA, 25 bp, Mus musculus
tagttctaacccaaacccacagttg

SEQ ID NO: 781923 - DNA, 25 bp, Mus musculus
tagttctaaccctaacccacagttg

SEQ ID NO: 781924 - DNA, 25 bp, Mus musculus
tagttctagcgcactagcatggcac

SEQ ID NO: 781925 - DNA, 25 bp, Mus musculus
tagttctagcgctctagcatggcac

SEQ ID NO: 781926 - DNA, 25 bp, Mus musculus
tagttctagcggataagccccatct

SEQ ID NO: 781927 - DNA, 25 bp, Mus musculus
tagttctagcggttaagccccatct

SEQ ID NO: 781928 - DNA, 25 bp, Mus musculus
tagttctatcaaatcctgtgttaca

SEQ ID NO: 781929 - DNA, 25 bp, Mus musculus
tagttctatcaaattccctgccaag

SEQ ID NO: 781930 - DNA, 25 bp, Mus musculus
tagttctatcaattcctgtgttaca

SEQ ID NO: 781931 - DNA, 25 bp, Mus musculus
tagttctatcaatttccctgccaag

SEQ ID NO: 781932 - DNA, 25 bp, Mus musculus
tagttctatgtaagttccacatatc

SEQ ID NO: 781933 - DNA, 25 bp, Mus musculus
tagttctatgtatgttccacatatc

SEQ ID NO: 781934 - DNA, 25 bp, Mus musculus
tagttctcaaggacttagctgctat

SEQ ID NO: 781935 - DNA, 25 bp, Mus musculus
tagttctcaaggtcttagctgctat

SEQ ID NO: 781936 - DNA, 25 bp, Mus musculus
tagttctcactgctttctgacttga

SEQ ID NO: 781937 - DNA, 25 bp, Mus musculus
tagttctcactggtttctgacttga

SEQ ID NO: 781938 - DNA, 25 bp, Mus musculus
tagttctcatcacctacagtaccca

SEQ ID NO: 781939 - DNA, 25 bp, Mus musculus
tagttctcatcagctacagtaccca

SEQ ID NO: 781940 - DNA, 25 bp, Mus musculus
tagttctcatgactttggattatgg

SEQ ID NO: 781941 - DNA, 25 bp, Mus musculus
tagttctcatgagtttggattatgg

SEQ ID NO: 781942 - DNA, 25 bp, Mus musculus
tagttctccagaccgtcaaggtttc

SEQ ID NO: 781943 - DNA, 25 bp, Mus musculus
tagttctccagagcgtcaaggtttc

SEQ ID NO: 781944 - DNA, 25 bp, Mus musculus
tagttctccattcatgactggccct

SEQ ID NO: 781945 - DNA, 25 bp, Mus musculus
tagttctccattgatgactggccct

SEQ ID NO: 781946 - DNA, 25 bp, Mus musculus
tagttctcctgtccatgtgtccagc

SEQ ID NO: 781947 - DNA, 25 bp, Mus musculus
tagttctcctgtgcatgtgtccagc

SEQ ID NO: 781948 - DNA, 25 bp, Mus musculus
tagttctctaacaactgactttgag

SEQ ID NO: 781949 - DNA, 25 bp, Mus musculus
tagttctctaactactgactttgag

SEQ ID NO: 781950 - DNA, 25 bp, Mus musculus
tagttctctccgcattctttaggag

SEQ ID NO: 781951 - DNA, 25 bp, Mus musculus
tagttctctccggattctttaggag

SEQ ID NO: 781952 - DNA, 25 bp, Mus musculus
tagttctctgctcagaccgggtgtt

SEQ ID NO: 781953 - DNA, 25 bp, Mus musculus
tagttctctgctgagaccgggtgtt

SEQ ID NO: 781954 - DNA, 25 bp, Mus musculus
tagttctctttccatagcttctgtc

SEQ ID NO: 781955 - DNA, 25 bp, Mus musculus
tagttctctttcgatagcttctgtc

SEQ ID NO: 781956 - DNA, 25 bp, Mus musculus
tagttctgaaccatgttttcctcac

SEQ ID NO: 781957 - DNA, 25 bp, Mus musculus
tagttctgaaccttgttttcctcac

SEQ ID NO: 781958 - DNA, 25 bp, Mus musculus
tagttctgagagaaatcacaccatc

SEQ ID NO: 781959 - DNA, 25 bp, Mus musculus
tagttctgagagtaatcacaccatc

SEQ ID NO: 781960 - DNA, 25 bp, Mus musculus
tagttctgcagactccaacaccctt

SEQ ID NO: 781961 - DNA, 25 bp, Mus musculus
tagttctgcagagtccaacaccctt

SEQ ID NO: 781962 - DNA, 25 bp, Mus musculus
tagttctggctcagtgttttacctc

SEQ ID NO: 781963 - DNA, 25 bp, Mus musculus
tagttctggctctgtgttttacctc

SEQ ID NO: 781964 - DNA, 25 bp, Mus musculus
tagttctgggctctttgtggcttct

SEQ ID NO: 781965 - DNA, 25 bp, Mus musculus
tagttctgggctgtttgtggcttct

SEQ ID NO: 781966 - DNA, 25 bp, Mus musculus
tagttctgggtgacttcactgcctt

SEQ ID NO: 781967 - DNA, 25 bp, Mus musculus
tagttctgggtgtcttcactgcctt

SEQ ID NO: 781968 - DNA, 25 bp, Mus musculus
tagttctggttcattctggactttg

SEQ ID NO: 781969 - DNA, 25 bp, Mus musculus
tagttctggttctttctggactttg

SEQ ID NO: 781970 - DNA, 25 bp, Mus musculus
tagttctgtattataacccctgagg

SEQ ID NO: 781971 - DNA, 25 bp, Mus musculus
tagttctgtattttaacccctgagg

SEQ ID NO: 781972 - DNA, 25 bp, Mus musculus
tagttctgtcagcatctcatttggt

SEQ ID NO: 781973 - DNA, 25 bp, Mus musculus
tagttctgtcaggatctcatttggt

SEQ ID NO: 781974 - DNA, 25 bp, Mus musculus
tagttcttagagatgctagctagca

SEQ ID NO: 781975 - DNA, 25 bp, Mus musculus
tagttcttagagttgctagctagca

SEQ ID NO: 781976 - DNA, 25 bp, Mus musculus
tagttcttatctagttcctatggtt

SEQ ID NO: 781977 - DNA, 25 bp, Mus musculus
tagttcttatcttgttcctatggtt

SEQ ID NO: 781978 - DNA, 25 bp, Mus musculus
tagttcttcatgatacggcacctca

SEQ ID NO: 781979 - DNA, 25 bp, Mus musculus
tagttcttcatgttacggcacctca

SEQ ID NO: 781980 - DNA, 25 bp, Mus musculus
tagttcttcccaaacttgactgatg

SEQ ID NO: 781981 - DNA, 25 bp, Mus musculus
tagttcttcccatacttgactgatg

SEQ ID NO: 781982 - DNA, 25 bp, Mus musculus
tagttcttgcttatggctaccagcc

SEQ ID NO: 781983 - DNA, 25 bp, Mus musculus
tagttcttgcttttggctaccagcc

SEQ ID NO: 781984 - DNA, 25 bp, Mus musculus
tagttctttcttcggctggatctca

SEQ ID NO: 781985 - DNA, 25 bp, Mus musculus
tagttctttcttgggctggatctca

SEQ ID NO: 781986 - DNA, 25 bp, Mus musculus
tagttcttttggctagtgtgtccct

SEQ ID NO: 781987 - DNA, 25 bp, Mus musculus
tagttcttttgggtagtgtgtccct

SEQ ID NO: 781988 - DNA, 25 bp, Mus musculus
tagttcttttgtacctttgaagatt

SEQ ID NO: 781989 - DNA, 25 bp, Mus musculus
tagttcttttgttcctttgaagatt

SEQ ID NO: 781990 - DNA, 25 bp, Mus musculus
tagttgacagtgcttaggagccctc

SEQ ID NO: 781991 - DNA, 25 bp, Mus musculus
tagttgacagtggttaggagccctc

SEQ ID NO: 781992 - DNA, 25 bp, Mus musculus
tagttgaccactcatcctctgtgta

SEQ ID NO: 781993 - DNA, 25 bp, Mus musculus
tagttgaccactgatcctctgtgta

SEQ ID NO: 781994 - DNA, 25 bp, Mus musculus
tagttgactgacagatgtcccttca

SEQ ID NO: 781995 - DNA, 25 bp, Mus musculus
tagttgactgactgatgtcccttca

SEQ ID NO: 781996 - DNA, 25 bp, Mus musculus
tagttgacttaaccgcatgagacac

SEQ ID NO: 781997 - DNA, 25 bp, Mus musculus
tagttgacttaagcgcatgagacac

SEQ ID NO: 781998 - DNA, 25 bp, Mus musculus
tagttgagatggcaaccgcgcctgc

SEQ ID NO: 781999 - DNA, 25 bp, Mus musculus
tagttgagatgggaaccgcgcctgc

SEQ ID NO: 782000 - DNA, 25 bp, Mus musculus
tagttgagccatcttttggcagccc

SEQ ID NO: 782001 - DNA, 25 bp, Mus musculus
tagttgagccatgttttggcagccc

SEQ ID NO: 782002 - DNA, 25 bp, Mus musculus
tagttgagcctcctgtggtataacc

SEQ ID NO: 782003 - DNA, 25 bp, Mus musculus
tagttgagcctcgtgtggtataacc

SEQ ID NO: 782004 - DNA, 25 bp, Mus musculus
tagttgagtctcattccttttccct

SEQ ID NO: 782005 - DNA, 25 bp, Mus musculus
tagttgagtctctttccttttccct

SEQ ID NO: 782006 - DNA, 25 bp, Mus musculus
tagttgatacagatgcccttatgaa

SEQ ID NO: 782007 - DNA, 25 bp, Mus musculus
tagttgatacagttgcccttatgaa

SEQ ID NO: 782008 - DNA, 25 bp, Mus musculus
tagttgatatccctatagacttata

SEQ ID NO: 782009 - DNA, 25 bp, Mus musculus
tagttgatatccgtatagacttata

SEQ ID NO: 782010 - DNA, 25 bp, Mus musculus
tagttgatggttcctgtcacaagcc

SEQ ID NO: 782011 - DNA, 25 bp, Mus musculus
tagttgatggttgctgtcacaagcc

SEQ ID NO: 782012 - DNA, 25 bp, Mus musculus
tagttgattgctaaactcagtaatg

SEQ ID NO: 782013 - DNA, 25 bp, Mus musculus
tagttgattgcttaactcagtaatg

SEQ ID NO: 782014 - DNA, 25 bp, Mus musculus
tagttgatttgtctgaaccgtggct

SEQ ID NO: 782015 - DNA, 25 bp, Mus musculus
tagttgatttgtgtgaaccgtggct

SEQ ID NO: 782016 - DNA, 25 bp, Mus musculus
tagttgattttcctctgcgaggcac

SEQ ID NO: 782017 - DNA, 25 bp, Mus musculus
tagttgattttcgtctgcgaggcac

SEQ ID NO: 782018 - DNA, 25 bp, Mus musculus
tagttgcacattattaaacctgtat

SEQ ID NO: 782019 - DNA, 25 bp, Mus musculus
tagttgcacatttttaaacctgtat

SEQ ID NO: 782020 - DNA, 25 bp, Mus musculus
tagttgcacctaagtcaggacacct

SEQ ID NO: 782021 - DNA, 25 bp, Mus musculus
tagttgcacctatgtcaggacacct

SEQ ID NO: 782022 - DNA, 25 bp, Mus musculus
tagttgcacgccatcaatcgcagca

SEQ ID NO: 782023 - DNA, 25 bp, Mus musculus
tagttgcacgccttcaatcgcagca

SEQ ID NO: 782024 - DNA, 25 bp, Mus musculus
tagttgcaggcactgatgcttctgt

SEQ ID NO: 782025 - DNA, 25 bp, Mus musculus
tagttgcaggcagtgatgcttctgt

SEQ ID NO: 782026 - DNA, 25 bp, Mus musculus
tagttgccaaatatgggatcacaat

SEQ ID NO: 782027 - DNA, 25 bp, Mus musculus
tagttgccaaatttgggatcacaat

SEQ ID NO: 782028 - DNA, 25 bp, Mus musculus
tagttgccacttcctgttactgctg

SEQ ID NO: 782029 - DNA, 25 bp, Mus musculus
tagttgccacttgctgttactgctg

SEQ ID NO: 782030 - DNA, 25 bp, Mus musculus
tagttgccagaaaaatccttgcttt

SEQ ID NO: 782031 - DNA, 25 bp, Mus musculus
tagttgccagaataatccttgcttt

SEQ ID NO: 782032 - DNA, 25 bp, Mus musculus
tagttgcccattatagtctaaaaaa

SEQ ID NO: 782033 - DNA, 25 bp, Mus musculus
tagttgcccattttagtctaaaaaa

SEQ ID NO: 782034 - DNA, 25 bp, Mus musculus
tagttgccgcgaccactggagttcg

SEQ ID NO: 782035 - DNA, 25 bp, Mus musculus
tagttgccgcgagcactggagttcg

SEQ ID NO: 782036 - DNA, 25 bp, Mus musculus
tagttgcctcccataaaacttcagt

SEQ ID NO: 782037 - DNA, 25 bp, Mus musculus
tagttgcctcccttaaaacttcagt

SEQ ID NO: 782038 - DNA, 25 bp, Mus musculus
tagttgcgctcgctttggtttccct

SEQ ID NO: 782039 - DNA, 25 bp, Mus musculus
tagttgcgctcggtttggtttccct

SEQ ID NO: 782040 - DNA, 25 bp, Mus musculus
tagttgctacttagtactcctttct

SEQ ID NO: 782041 - DNA, 25 bp, Mus musculus
tagttgctactttgtactcctttct

SEQ ID NO: 782042 - DNA, 25 bp, Mus musculus
tagttgctagaaagcccactcctac

SEQ ID NO: 782043 - DNA, 25 bp, Mus musculus
tagttgctagaatgcccactcctac

SEQ ID NO: 782044 - DNA, 25 bp, Mus musculus
tagttgctattccttgacctgatgt

SEQ ID NO: 782045 - DNA, 25 bp, Mus musculus
tagttgctattcgttgacctgatgt

SEQ ID NO: 782046 - DNA, 25 bp, Mus musculus
tagttgctcacaaattcatctcttg

SEQ ID NO: 782047 - DNA, 25 bp, Mus musculus
tagttgctcacatattcatctcttg

SEQ ID NO: 782048 - DNA, 25 bp, Mus musculus
tagttgctctcccagtttttattgt

SEQ ID NO: 782049 - DNA, 25 bp, Mus musculus
tagttgctctccgagtttttattgt

SEQ ID NO: 782050 - DNA, 25 bp, Mus musculus
tagttgctctgtagtgtccagcttc

SEQ ID NO: 782051 - DNA, 25 bp, Mus musculus
tagttgctctgtattgatgtctctt

SEQ ID NO: 782052 - DNA, 25 bp, Mus musculus
tagttgctctgttgtgtccagcttc

SEQ ID NO: 782053 - DNA, 25 bp, Mus musculus
tagttgctctgttttgatgtctctt

SEQ ID NO: 782054 - DNA, 25 bp, Mus musculus
tagttgctgccaaaccaaggacacc

SEQ ID NO: 782055 - DNA, 25 bp, Mus musculus
tagttgctgccataccaaggacacc

SEQ ID NO: 782056 - DNA, 25 bp, Mus musculus
tagttgctgtggcaacttagtaaca

SEQ ID NO: 782057 - DNA, 25 bp, Mus musculus
tagttgctgtgggaacttagtaaca

SEQ ID NO: 782058 - DNA, 25 bp, Mus musculus
tagttgctgttaccatcccctttgt

SEQ ID NO: 782059 - DNA, 25 bp, Mus musculus
tagttgctgttagcatcccctttgt

SEQ ID NO: 782060 - DNA, 25 bp, Mus musculus
tagttggacacgctacactgacggc

SEQ ID NO: 782061 - DNA, 25 bp, Mus musculus
tagttggacacggtacactgacggc

SEQ ID NO: 782062 - DNA, 25 bp, Mus musculus
tagttggaccttctaatgcgtttgg

SEQ ID NO: 782063 - DNA, 25 bp, Mus musculus
tagttggaccttgtaatgcgtttgg

SEQ ID NO: 782064 - DNA, 25 bp, Mus musculus
tagttggactttccctagggctttc

SEQ ID NO: 782065 - DNA, 25 bp, Mus musculus
tagttggactttgcctagggctttc

SEQ ID NO: 782066 - DNA, 25 bp, Mus musculus
tagttggagccaaatcagcttgtgt

SEQ ID NO: 782067 - DNA, 25 bp, Mus musculus
tagttggagccatatcagcttgtgt

SEQ ID NO: 782068 - DNA, 25 bp, Mus musculus
tagttggaggtcataataagctttc

SEQ ID NO: 782069 - DNA, 25 bp, Mus musculus
tagttggaggtcttaataagctttc

SEQ ID NO: 782070 - DNA, 25 bp, Mus musculus
tagttggcaagcaccagtaagataa

SEQ ID NO: 782071 - DNA, 25 bp, Mus musculus
tagttggcaagctccagtaagataa

SEQ ID NO: 782072 - DNA, 25 bp, Mus musculus
tagttggcattgatcaaagcagaag

SEQ ID NO: 782073 - DNA, 25 bp, Mus musculus
tagttggcattgttcaaagcagaag

SEQ ID NO: 782074 - DNA, 25 bp, Mus musculus
tagttggccactcaccgtgaggaca

SEQ ID NO: 782075 - DNA, 25 bp, Mus musculus
tagttggccactgaccgtgaggaca

SEQ ID NO: 782076 - DNA, 25 bp, Mus musculus
tagttggccagcactctcaaaggga

SEQ ID NO: 782077 - DNA, 25 bp, Mus musculus
tagttggccagctctctcaaaggga

SEQ ID NO: 782078 - DNA, 25 bp, Mus musculus
tagttggccaggcttggtgctactt

SEQ ID NO: 782079 - DNA, 25 bp, Mus musculus
tagttggccagggttggtgctactt

SEQ ID NO: 782080 - DNA, 25 bp, Mus musculus
tagttggccatccacctccaagatt

SEQ ID NO: 782081 - DNA, 25 bp, Mus musculus
tagttggccatcgacctccaagatt

SEQ ID NO: 782082 - DNA, 25 bp, Mus musculus
tagttggcccgaagaccagagcctt

SEQ ID NO: 782083 - DNA, 25 bp, Mus musculus
tagttggcccgatgaccagagcctt

SEQ ID NO: 782084 - DNA, 25 bp, Mus musculus
tagttggcgattcagtcccctagca

SEQ ID NO: 782085 - DNA, 25 bp, Mus musculus
tagttggcgattgagtcccctagca

SEQ ID NO: 782086 - DNA, 25 bp, Mus musculus
tagttgggaactaatgtgatcacag

SEQ ID NO: 782087 - DNA, 25 bp, Mus musculus
tagttgggaacttatgtgatcacag

SEQ ID NO: 782088 - DNA, 25 bp, Mus musculus
tagttgggaagcactgacattctgt

SEQ ID NO: 782089 - DNA, 25 bp, Mus musculus
tagttgggaagctctgacattctgt

SEQ ID NO: 782090 - DNA, 25 bp, Mus musculus
tagttgggaggcacgtctaggcccc

SEQ ID NO: 782091 - DNA, 25 bp, Mus musculus
tagttgggaggctcgtctaggcccc

SEQ ID NO: 782092 - DNA, 25 bp, Mus musculus
tagttgggccagcatagctctatca

SEQ ID NO: 782093 - DNA, 25 bp, Mus musculus
tagttgggccaggatagctctatca

SEQ ID NO: 782094 - DNA, 25 bp, Mus musculus
tagttgggctagctcgaacttaccc

SEQ ID NO: 782095 - DNA, 25 bp, Mus musculus
tagttgggctaggtcgaacttaccc

SEQ ID NO: 782096 - DNA, 25 bp, Mus musculus
tagttgggtgcaaggtctagcctaa

SEQ ID NO: 782097 - DNA, 25 bp, Mus musculus
tagttgggtgcatggtctagcctaa

SEQ ID NO: 782098 - DNA, 25 bp, Mus musculus
tagttggtactcacggacaggtttt

SEQ ID NO: 782099 - DNA, 25 bp, Mus musculus
tagttggtactctcggacaggtttt

SEQ ID NO: 782100 - DNA, 25 bp, Mus musculus
tagttggtccttcccttatttatta

SEQ ID NO: 782101 - DNA, 25 bp, Mus musculus
tagttggtccttgccttatttatta

SEQ ID NO: 782102 - DNA, 25 bp, Mus musculus
tagttggtctcacaatcctactggg

SEQ ID NO: 782103 - DNA, 25 bp, Mus musculus
tagttggtctcagaatcctactggg

SEQ ID NO: 782104 - DNA, 25 bp, Mus musculus
tagttggttcttctccttagtcttc

SEQ ID NO: 782105 - DNA, 25 bp, Mus musculus
tagttggttcttgtccttagtcttc

SEQ ID NO: 782106 - DNA, 25 bp, Mus musculus
tagttggtttttagtgtttattcag

SEQ ID NO: 782107 - DNA, 25 bp, Mus musculus
tagttggttttttgtgtttattcag

SEQ ID NO: 782108 - DNA, 25 bp, Mus musculus
tagttgtaatttcagcaaagcacag

SEQ ID NO: 782109 - DNA, 25 bp, Mus musculus
tagttgtaatttgagcaaagcacag

SEQ ID NO: 782110 - DNA, 25 bp, Mus musculus
tagttgtatccccagatgtcctggc

SEQ ID NO: 782111 - DNA, 25 bp, Mus musculus
tagttgtatcccgagatgtcctggc

SEQ ID NO: 782112 - DNA, 25 bp, Mus musculus
tagttgtcctctagcaatccacgct

SEQ ID NO: 782113 - DNA, 25 bp, Mus musculus
tagttgtcctcttgcaatccacgct

SEQ ID NO: 782114 - DNA, 25 bp, Mus musculus
tagttgtcggtactggttgtatttt

SEQ ID NO: 782115 - DNA, 25 bp, Mus musculus
tagttgtcggtagtggttgtatttt

SEQ ID NO: 782116 - DNA, 25 bp, Mus musculus
tagttgtctacaccatcaggtctcc

SEQ ID NO: 782117 - DNA, 25 bp, Mus musculus
tagttgtctacagcatcaggtctcc

SEQ ID NO: 782118 - DNA, 25 bp, Mus musculus
tagttgtctattacccagaaaacac

SEQ ID NO: 782119 - DNA, 25 bp, Mus musculus
tagttgtctatttcccagaaaacac

SEQ ID NO: 782120 - DNA, 25 bp, Mus musculus
tagttgtgatcgagcagccaagcgc

SEQ ID NO: 782121 - DNA, 25 bp, Mus musculus
tagttgtgatcgtgcagccaagcgc

SEQ ID NO: 782122 - DNA, 25 bp, Mus musculus
tagttgtgcacaactataatctcag

SEQ ID NO: 782123 - DNA, 25 bp, Mus musculus
tagttgtgcacatctataatctcag

SEQ ID NO: 782124 - DNA, 25 bp, Mus musculus
tagttgtgcctaatcattttctctc

SEQ ID NO: 782125 - DNA, 25 bp, Mus musculus
tagttgtgcctattcattttctctc

SEQ ID NO: 782126 - DNA, 25 bp, Mus musculus
tagttgtgcttaagccagccaggct

SEQ ID NO: 782127 - DNA, 25 bp, Mus musculus
tagttgtgcttatgccagccaggct

SEQ ID NO: 782128 - DNA, 25 bp, Mus musculus
tagttgtggaaccagcagcgtgatt

SEQ ID NO: 782129 - DNA, 25 bp, Mus musculus
tagttgtggaacgagcagcgtgatt

SEQ ID NO: 782130 - DNA, 25 bp, Mus musculus
tagttgtggggtatcactggctgct

SEQ ID NO: 782131 - DNA, 25 bp, Mus musculus
tagttgtggggtttcactggctgct

SEQ ID NO: 782132 - DNA, 25 bp, Mus musculus
tagttgtgtatcaacttgacaccat

SEQ ID NO: 782133 - DNA, 25 bp, Mus musculus
tagttgtgtatctacttgacaccat

SEQ ID NO: 782134 - DNA, 25 bp, Mus musculus
tagttgtgtgtacacgcatgtgcgt

SEQ ID NO: 782135 - DNA, 25 bp, Mus musculus
tagttgtgtgtagacgcatgtgcgt

SEQ ID NO: 782136 - DNA, 25 bp, Mus musculus
tagttgtgtgtgcttggtgaccctc

SEQ ID NO: 782137 - DNA, 25 bp, Mus musculus
tagttgtgtgtggttggtgaccctc

SEQ ID NO: 782138 - DNA, 25 bp, Mus musculus
tagttgtgttacacgctcacagcat

SEQ ID NO: 782139 - DNA, 25 bp, Mus musculus
tagttgtgttactcgctcacagcat

SEQ ID NO: 782140 - DNA, 25 bp, Mus musculus
tagttgtgttcgatactggcttgta

SEQ ID NO: 782141 - DNA, 25 bp, Mus musculus
tagttgtgttcgttactggcttgta

SEQ ID NO: 782142 - DNA, 25 bp, Mus musculus
tagttgttagttccttttgttgaat

SEQ ID NO: 782143 - DNA, 25 bp, Mus musculus
tagttgttagttgcttttgttgaat

SEQ ID NO: 782144 - DNA, 25 bp, Mus musculus
tagttgtttgcaatggcgtcttcct

SEQ ID NO: 782145 - DNA, 25 bp, Mus musculus
tagttgtttgcattggcgtcttcct

SEQ ID NO: 782146 - DNA, 25 bp, Mus musculus
tagtttaaccataacttcatcttat

SEQ ID NO: 782147 - DNA, 25 bp, Mus musculus
tagtttaaccattacttcatcttat

SEQ ID NO: 782148 - DNA, 25 bp, Mus musculus
tagtttacctgacttcttaaggtgg

SEQ ID NO: 782149 - DNA, 25 bp, Mus musculus
tagtttacctgagttcttaaggtgg

SEQ ID NO: 782150 - DNA, 25 bp, Mus musculus
tagtttactagtatccatggcctgg

SEQ ID NO: 782151 - DNA, 25 bp, Mus musculus
tagtttactagtttccatggcctgg

SEQ ID NO: 782152 - DNA, 25 bp, Mus musculus
tagtttactccaaaagacagcttag

SEQ ID NO: 782153 - DNA, 25 bp, Mus musculus
tagtttactccataagacagcttag

SEQ ID NO: 782154 - DNA, 25 bp, Mus musculus
tagtttactcttaacaattctacct

SEQ ID NO: 782155 - DNA, 25 bp, Mus musculus
tagtttactctttacaattctacct

SEQ ID NO: 782156 - DNA, 25 bp, Mus musculus
tagtttactggaatccttcgaaatg

SEQ ID NO: 782157 - DNA, 25 bp, Mus musculus
tagtttactggattccttcgaaatg

SEQ ID NO: 782158 - DNA, 25 bp, Mus musculus
tagtttagctccatgtctgctacca

SEQ ID NO: 782159 - DNA, 25 bp, Mus musculus
tagtttagctccttgtctgctacca

SEQ ID NO: 782160 - DNA, 25 bp, Mus musculus
tagtttagcttccacagtgttttga

SEQ ID NO: 782161 - DNA, 25 bp, Mus musculus
tagtttagcttcgacagtgttttga

SEQ ID NO: 782162 - DNA, 25 bp, Mus musculus
tagtttaggaaaccactacctgatt

SEQ ID NO: 782163 - DNA, 25 bp, Mus musculus
tagtttaggaaagcactacctgatt

SEQ ID NO: 782164 - DNA, 25 bp, Mus musculus
tagtttaggttccagttcatcccag

SEQ ID NO: 782165 - DNA, 25 bp, Mus musculus
tagtttaggttcgagttcatcccag

SEQ ID NO: 782166 - DNA, 25 bp, Mus musculus
tagtttataggtaatgatccaccca

SEQ ID NO: 782167 - DNA, 25 bp, Mus musculus
tagtttataggttatgatccaccca

SEQ ID NO: 782168 - DNA, 25 bp, Mus musculus
tagtttatattcagctgttcagcat

SEQ ID NO: 782169 - DNA, 25 bp, Mus musculus
tagtttatattctgctgttcagcat

SEQ ID NO: 782170 - DNA, 25 bp, Mus musculus
tagtttatctcacgcctatagtatg

SEQ ID NO: 782171 - DNA, 25 bp, Mus musculus
tagtttatctcaggcctatagtatg

SEQ ID NO: 782172 - DNA, 25 bp, Mus musculus
tagtttatggtgagccagatgctat

SEQ ID NO: 782173 - DNA, 25 bp, Mus musculus
tagtttatggtgtgccagatgctat

SEQ ID NO: 782174 - DNA, 25 bp, Mus musculus
tagtttcaaatgactgtccaagtca

SEQ ID NO: 782175 - DNA, 25 bp, Mus musculus
tagtttcaaatgtctgtccaagtca

SEQ ID NO: 782176 - DNA, 25 bp, Mus musculus
tagtttcaacaacgacattcttggg

SEQ ID NO: 782177 - DNA, 25 bp, Mus musculus
tagtttcaacaaggacattcttggg

SEQ ID NO: 782178 - DNA, 25 bp, Mus musculus
tagtttcaacccacaggctatctgg

SEQ ID NO: 782179 - DNA, 25 bp, Mus musculus
tagtttcaaccctcaggctatctgg

SEQ ID NO: 782180 - DNA, 25 bp, Mus musculus
tagtttcaccaaagatccaaaatta

SEQ ID NO: 782181 - DNA, 25 bp, Mus musculus
tagtttcaccaatgatccaaaatta

SEQ ID NO: 782182 - DNA, 25 bp, Mus musculus
tagtttcagaaaatcccatgccctc

SEQ ID NO: 782183 - DNA, 25 bp, Mus musculus
tagtttcagaaattcccatgccctc

SEQ ID NO: 782184 - DNA, 25 bp, Mus musculus
tagtttcagatgattcctgccttgg

SEQ ID NO: 782185 - DNA, 25 bp, Mus musculus
tagtttcagatgtttcctgccttgg

SEQ ID NO: 782186 - DNA, 25 bp, Mus musculus
tagtttcagggtcagctagctagtt

SEQ ID NO: 782187 - DNA, 25 bp, Mus musculus
tagtttcagggtgagctagctagtt

SEQ ID NO: 782188 - DNA, 25 bp, Mus musculus
tagtttcatatgactacctgcctgc

SEQ ID NO: 782189 - DNA, 25 bp, Mus musculus
tagtttcatatgtctacctgcctgc

SEQ ID NO: 782190 - DNA, 25 bp, Mus musculus
tagtttccaaatcgttctcctcttg

SEQ ID NO: 782191 - DNA, 25 bp, Mus musculus
tagtttccaaatggttctcctcttg

SEQ ID NO: 782192 - DNA, 25 bp, Mus musculus
tagtttccaaggacagtctcatgct

SEQ ID NO: 782193 - DNA, 25 bp, Mus musculus
tagtttccaaggtcagtctcatgct

SEQ ID NO: 782194 - DNA, 25 bp, Mus musculus
tagtttccacagaaaggtttgcctg

SEQ ID NO: 782195 - DNA, 25 bp, Mus musculus
tagtttccacagtaaggtttgcctg

SEQ ID NO: 782196 - DNA, 25 bp, Mus musculus
tagtttccactactctcaagcaaga

SEQ ID NO: 782197 - DNA, 25 bp, Mus musculus
tagtttccactagtctcaagcaaga

SEQ ID NO: 782198 - DNA, 25 bp, Mus musculus
tagtttccagacatctgtttgaaat

SEQ ID NO: 782199 - DNA, 25 bp, Mus musculus
tagtttccagaccagtaggcagtat

SEQ ID NO: 782200 - DNA, 25 bp, Mus musculus
tagtttccagacgagtaggcagtat

SEQ ID NO: 782201 - DNA, 25 bp, Mus musculus
tagtttccagacttctgtttgaaat

SEQ ID NO: 782202 - DNA, 25 bp, Mus musculus
tagtttccatcgagtctccatactc

SEQ ID NO: 782203 - DNA, 25 bp, Mus musculus
tagtttccatcgtgtctccatactc

SEQ ID NO: 782204 - DNA, 25 bp, Mus musculus
tagtttcccaatcaagcagtgtgtg

SEQ ID NO: 782205 - DNA, 25 bp, Mus musculus
tagtttcccaatgaagcagtgtgtg

SEQ ID NO: 782206 - DNA, 25 bp, Mus musculus
tagtttccctgcacaccttcatgat

SEQ ID NO: 782207 - DNA, 25 bp, Mus musculus
tagtttccctgcactcaaatctgtt

SEQ ID NO: 782208 - DNA, 25 bp, Mus musculus
tagtttccctgctcaccttcatgat

SEQ ID NO: 782209 - DNA, 25 bp, Mus musculus
tagtttccctgctctcaaatctgtt

SEQ ID NO: 782210 - DNA, 25 bp, Mus musculus
tagtttccctggactgcagttacaa

SEQ ID NO: 782211 - DNA, 25 bp, Mus musculus
tagtttccctggtctgcagttacaa

SEQ ID NO: 782212 - DNA, 25 bp, Mus musculus
tagtttccggctacctggagttaga

SEQ ID NO: 782213 - DNA, 25 bp, Mus musculus
tagtttccggcttcctggagttaga

SEQ ID NO: 782214 - DNA, 25 bp, Mus musculus
tagtttcctctgagattcagtgcat

SEQ ID NO: 782215 - DNA, 25 bp, Mus musculus
tagtttcctctgtgattcagtgcat

SEQ ID NO: 782216 - DNA, 25 bp, Mus musculus
tagtttcctgacatgtttctgtaca

SEQ ID NO: 782217 - DNA, 25 bp, Mus musculus
tagtttcctgacttgtttctgtaca

SEQ ID NO: 782218 - DNA, 25 bp, Mus musculus
tagtttctaactccgtcacattttt

SEQ ID NO: 782219 - DNA, 25 bp, Mus musculus
tagtttctaactgcgtcacattttt

SEQ ID NO: 782220 - DNA, 25 bp, Mus musculus
tagtttctaagtaagccattttgac

SEQ ID NO: 782221 - DNA, 25 bp, Mus musculus
tagtttctaagttagccattttgac

SEQ ID NO: 782222 - DNA, 25 bp, Mus musculus
tagtttctactcagatttttggtgc

SEQ ID NO: 782223 - DNA, 25 bp, Mus musculus
tagtttctactctgatttttggtgc

SEQ ID NO: 782224 - DNA, 25 bp, Mus musculus
tagtttctaggcacttgagctttgt

SEQ ID NO: 782225 - DNA, 25 bp, Mus musculus
tagtttctaggctcttgagctttgt

SEQ ID NO: 782226 - DNA, 25 bp, Mus musculus
tagtttctagttccctttctaccca

SEQ ID NO: 782227 - DNA, 25 bp, Mus musculus
tagtttctagttgcctttctaccca

SEQ ID NO: 782228 - DNA, 25 bp, Mus musculus
tagtttctcacactcactgctgctg

SEQ ID NO: 782229 - DNA, 25 bp, Mus musculus
tagtttctcacagtcactgctgctg

SEQ ID NO: 782230 - DNA, 25 bp, Mus musculus
tagtttctcaccacttcagtctttg

SEQ ID NO: 782231 - DNA, 25 bp, Mus musculus
tagtttctcacctcttcagtctttg

SEQ ID NO: 782232 - DNA, 25 bp, Mus musculus
tagtttctcactcatggaccgatac

SEQ ID NO: 782233 - DNA, 25 bp, Mus musculus
tagtttctcactgatggaccgatac

SEQ ID NO: 782234 - DNA, 25 bp, Mus musculus
tagtttctccacagctggagaccat

SEQ ID NO: 782235 - DNA, 25 bp, Mus musculus
tagtttctccactgctggagaccat

SEQ ID NO: 782236 - DNA, 25 bp, Mus musculus
tagtttctctaacctttgggtcaag

SEQ ID NO: 782237 - DNA, 25 bp, Mus musculus
tagtttctctaagctttgggtcaag

SEQ ID NO: 782238 - DNA, 25 bp, Mus musculus
tagtttctctagcaacggtagtctt

SEQ ID NO: 782239 - DNA, 25 bp, Mus musculus
tagtttctctaggaacggtagtctt

SEQ ID NO: 782240 - DNA, 25 bp, Mus musculus
tagtttctgaatagggatgttttga

SEQ ID NO: 782241 - DNA, 25 bp, Mus musculus
tagtttctgaattgggatgttttga

SEQ ID NO: 782242 - DNA, 25 bp, Mus musculus
tagtttctgccaatgtaccacattg

SEQ ID NO: 782243 - DNA, 25 bp, Mus musculus
tagtttctgccattgtaccacattg

SEQ ID NO: 782244 - DNA, 25 bp, Mus musculus
tagtttctgggcaatgcactgcaca

SEQ ID NO: 782245 - DNA, 25 bp, Mus musculus
tagtttctgggctatgcactgcaca

SEQ ID NO: 782246 - DNA, 25 bp, Mus musculus
tagtttctgtagaataccttccgcc

SEQ ID NO: 782247 - DNA, 25 bp, Mus musculus
tagtttctgtagtataccttccgcc

SEQ ID NO: 782248 - DNA, 25 bp, Mus musculus
tagtttctgtggcagctcacactga

SEQ ID NO: 782249 - DNA, 25 bp, Mus musculus
tagtttctgtgggagctcacactga

SEQ ID NO: 782250 - DNA, 25 bp, Mus musculus
tagtttctgttcatatacaacacaa

SEQ ID NO: 782251 - DNA, 25 bp, Mus musculus
tagtttctgttcttatacaacacaa

SEQ ID NO: 782252 - DNA, 25 bp, Mus musculus
tagtttctgtttcaagacttctttt

SEQ ID NO: 782253 - DNA, 25 bp, Mus musculus
tagtttctgtttgaagacttctttt

SEQ ID NO: 782254 - DNA, 25 bp, Mus musculus
tagtttcttaaaagcaagaactctt

SEQ ID NO: 782255 - DNA, 25 bp, Mus musculus
tagtttcttaaatgcaagaactctt

SEQ ID NO: 782256 - DNA, 25 bp, Mus musculus
tagtttcttctaatccagttgctgg

SEQ ID NO: 782257 - DNA, 25 bp, Mus musculus
tagtttcttctattccagttgctgg

SEQ ID NO: 782258 - DNA, 25 bp, Mus musculus
tagtttctttcaagttcctctcggc

SEQ ID NO: 782259 - DNA, 25 bp, Mus musculus
tagtttctttcatgttcctctcggc

SEQ ID NO: 782260 - DNA, 25 bp, Mus musculus
tagtttctttgaacagtgtcctgga

SEQ ID NO: 782261 - DNA, 25 bp, Mus musculus
tagtttctttgatcagtgtcctgga

SEQ ID NO: 782262 - DNA, 25 bp, Mus musculus
tagtttctttttcgaggcactcaga

SEQ ID NO: 782263 - DNA, 25 bp, Mus musculus
tagtttctttttggaggcactcaga

SEQ ID NO: 782264 - DNA, 25 bp, Mus musculus
tagtttgaagccagctggaattagc

SEQ ID NO: 782265 - DNA, 25 bp, Mus musculus
tagtttgaagcctgctggaattagc

SEQ ID NO: 782266 - DNA, 25 bp, Mus musculus
tagtttgaagtcataggccagcctg

SEQ ID NO: 782267 - DNA, 25 bp, Mus musculus
tagtttgaagtcttaggccagcctg

SEQ ID NO: 782268 - DNA, 25 bp, Mus musculus
tagtttgacactccatttttgatgg

SEQ ID NO: 782269 - DNA, 25 bp, Mus musculus
tagtttgacactgcatttttgatgg

SEQ ID NO: 782270 - DNA, 25 bp, Mus musculus
tagtttgagatcaatctgttcgtga

SEQ ID NO: 782271 - DNA, 25 bp, Mus musculus
tagtttgagatctatctgttcgtga

SEQ ID NO: 782272 - DNA, 25 bp, Mus musculus
tagtttgaggctaaggatggacgct

SEQ ID NO: 782273 - DNA, 25 bp, Mus musculus
tagtttgaggcttaggatggacgct

SEQ ID NO: 782274 - DNA, 25 bp, Mus musculus
tagtttgagtttcacctctgtctgc

SEQ ID NO: 782275 - DNA, 25 bp, Mus musculus
tagtttgagtttgacctctgtctgc

SEQ ID NO: 782276 - DNA, 25 bp, Mus musculus
tagtttgatagtctgcatctgtgaa

SEQ ID NO: 782277 - DNA, 25 bp, Mus musculus
tagtttgatagtgtgcatctgtgaa

SEQ ID NO: 782278 - DNA, 25 bp, Mus musculus
tagtttgcaaatacttacactgaaa

SEQ ID NO: 782279 - DNA, 25 bp, Mus musculus
tagtttgcaaattcttacactgaaa

SEQ ID NO: 782280 - DNA, 25 bp, Mus musculus
tagtttgcacccattttgtatgtaa

SEQ ID NO: 782281 - DNA, 25 bp, Mus musculus
tagtttgcaccctttttgtatgtaa

SEQ ID NO: 782282 - DNA, 25 bp, Mus musculus
tagtttgcaggaaacctcctcagca

SEQ ID NO: 782283 - DNA, 25 bp, Mus musculus
tagtttgcaggatacctcctcagca

SEQ ID NO: 782284 - DNA, 25 bp, Mus musculus
tagtttgccacgacaaacggcactt

SEQ ID NO: 782285 - DNA, 25 bp, Mus musculus
tagtttgccacgtcaaacggcactt

SEQ ID NO: 782286 - DNA, 25 bp, Mus musculus
tagtttgccctacttcttcatagat

SEQ ID NO: 782287 - DNA, 25 bp, Mus musculus
tagtttgccctagttcttcatagat

SEQ ID NO: 782288 - DNA, 25 bp, Mus musculus
tagtttgcctagaaagacccagccc

SEQ ID NO: 782289 - DNA, 25 bp, Mus musculus
tagtttgcctagtaagacccagccc

SEQ ID NO: 782290 - DNA, 25 bp, Mus musculus
tagtttgcctttcattgtccctgta

SEQ ID NO: 782291 - DNA, 25 bp, Mus musculus
tagtttgcctttgattgtccctgta

SEQ ID NO: 782292 - DNA, 25 bp, Mus musculus
tagtttgctaacacgtgcctttgca

SEQ ID NO: 782293 - DNA, 25 bp, Mus musculus
tagtttgctaactcgtgcctttgca

SEQ ID NO: 782294 - DNA, 25 bp, Mus musculus
tagtttgctatcatcctattggaca

SEQ ID NO: 782295 - DNA, 25 bp, Mus musculus
tagtttgctatcttcctattggaca

SEQ ID NO: 782296 - DNA, 25 bp, Mus musculus
tagtttgctcgtcttgtgtatgctt

SEQ ID NO: 782297 - DNA, 25 bp, Mus musculus
tagtttgctcgtgttgtgtatgctt

SEQ ID NO: 782298 - DNA, 25 bp, Mus musculus
tagtttggacttcacccgacggata

SEQ ID NO: 782299 - DNA, 25 bp, Mus musculus
tagtttggacttgacccgacggata

SEQ ID NO: 782300 - DNA, 25 bp, Mus musculus
tagtttggattgctagcctgtgcca

SEQ ID NO: 782301 - DNA, 25 bp, Mus musculus
tagtttggattggtagcctgtgcca

SEQ ID NO: 782302 - DNA, 25 bp, Mus musculus
tagtttggccaacaacccagggttg

SEQ ID NO: 782303 - DNA, 25 bp, Mus musculus
tagtttggccaagaacccagggttg

SEQ ID NO: 782304 - DNA, 25 bp, Mus musculus
tagtttggcttacatcctccagttc

SEQ ID NO: 782305 - DNA, 25 bp, Mus musculus
tagtttggcttagatcctccagttc

SEQ ID NO: 782306 - DNA, 25 bp, Mus musculus
tagtttgggaacaggtttgtccaca

SEQ ID NO: 782307 - DNA, 25 bp, Mus musculus
tagtttgggaactggtttgtccaca

SEQ ID NO: 782308 - DNA, 25 bp, Mus musculus
tagtttggtatcacagacgccttcc

SEQ ID NO: 782309 - DNA, 25 bp, Mus musculus
tagtttggtatctcagacgccttcc

SEQ ID NO: 782310 - DNA, 25 bp, Mus musculus
tagtttggtgccagctctgggtcat

SEQ ID NO: 782311 - DNA, 25 bp, Mus musculus
tagtttggtgcctgctctgggtcat

SEQ ID NO: 782312 - DNA, 25 bp, Mus musculus
tagtttgtaaaacgttcaaagtcag

SEQ ID NO: 782313 - DNA, 25 bp, Mus musculus
tagtttgtaaaaggttcaaagtcag

SEQ ID NO: 782314 - DNA, 25 bp, Mus musculus
tagtttgtcaggaagcaccaccatc

SEQ ID NO: 782315 - DNA, 25 bp, Mus musculus
tagtttgtcaggtagcaccaccatc

SEQ ID NO: 782316 - DNA, 25 bp, Mus musculus
tagtttgtcagtacctgcagtcagt

SEQ ID NO: 782317 - DNA, 25 bp, Mus musculus
tagtttgtcagttcctgcagtcagt

SEQ ID NO: 782318 - DNA, 25 bp, Mus musculus
tagtttgtccttctctcgtgatcat

SEQ ID NO: 782319 - DNA, 25 bp, Mus musculus
tagtttgtccttgtctcgtgatcat

SEQ ID NO: 782320 - DNA, 25 bp, Mus musculus
tagtttgtctctatgaagctgcatg

SEQ ID NO: 782321 - DNA, 25 bp, Mus musculus
tagtttgtctctttgaagctgcatg

SEQ ID NO: 782322 - DNA, 25 bp, Mus musculus
tagtttgtctttaagatggttttca

SEQ ID NO: 782323 - DNA, 25 bp, Mus musculus
tagtttgtcttttagatggttttca

SEQ ID NO: 782324 - DNA, 25 bp, Mus musculus
tagtttgtgcttcatgtccctgctt

SEQ ID NO: 782325 - DNA, 25 bp, Mus musculus
tagtttgtgcttgatgtccctgctt

SEQ ID NO: 782326 - DNA, 25 bp, Mus musculus
tagtttgtggtaaatgcctgcattc

SEQ ID NO: 782327 - DNA, 25 bp, Mus musculus
tagtttgtggtatatgcctgcattc

SEQ ID NO: 782328 - DNA, 25 bp, Mus musculus
tagtttgttaatagattaagctgta

SEQ ID NO: 782329 - DNA, 25 bp, Mus musculus
tagtttgttaattgattaagctgta

SEQ ID NO: 782330 - DNA, 25 bp, Mus musculus
tagtttgttgtaaaattggttcatc

SEQ ID NO: 782331 - DNA, 25 bp, Mus musculus
tagtttgttgtataattggttcatc

SEQ ID NO: 782332 - DNA, 25 bp, Mus musculus
tagtttgtttcacagtagagggtcc

SEQ ID NO: 782333 - DNA, 25 bp, Mus musculus
tagtttgtttcagagtagagggtcc

SEQ ID NO: 782334 - DNA, 25 bp, Mus musculus
tagtttgtttgcattgataccataa

SEQ ID NO: 782335 - DNA, 25 bp, Mus musculus
tagtttgtttgctttgataccataa

SEQ ID NO: 782336 - DNA, 25 bp, Mus musculus
tagttttagcctcacaaacgcccaa

SEQ ID NO: 782337 - DNA, 25 bp, Mus musculus
tagttttagcctgacaaacgcccaa

SEQ ID NO: 782338 - DNA, 25 bp, Mus musculus
tagttttagctcatgaacagtttca

SEQ ID NO: 782339 - DNA, 25 bp, Mus musculus
tagttttagctcttgaacagtttca

SEQ ID NO: 782340 - DNA, 25 bp, Mus musculus
tagttttatccccatctttcattag

SEQ ID NO: 782341 - DNA, 25 bp, Mus musculus
tagttttatcccgatctttcattag

SEQ ID NO: 782342 - DNA, 25 bp, Mus musculus
tagttttattacctcccataggaat

SEQ ID NO: 782343 - DNA, 25 bp, Mus musculus
tagttttattacgtcccataggaat

SEQ ID NO: 782344 - DNA, 25 bp, Mus musculus
tagttttattcgacttgaagaaaag

SEQ ID NO: 782345 - DNA, 25 bp, Mus musculus
tagttttattcgtcttgaagaaaag

SEQ ID NO: 782346 - DNA, 25 bp, Mus musculus
tagttttcaagtcgagtactcttct

SEQ ID NO: 782347 - DNA, 25 bp, Mus musculus
tagttttcaagtggagtactcttct

SEQ ID NO: 782348 - DNA, 25 bp, Mus musculus
tagttttcacctctagctctggatg

SEQ ID NO: 782349 - DNA, 25 bp, Mus musculus
tagttttcacctgtagctctggatg

SEQ ID NO: 782350 - DNA, 25 bp, Mus musculus
tagttttcagtccttaagtgccatg

SEQ ID NO: 782351 - DNA, 25 bp, Mus musculus
tagttttcagtcgttaagtgccatg

SEQ ID NO: 782352 - DNA, 25 bp, Mus musculus
tagttttccaagagtgtaccattaa

SEQ ID NO: 782353 - DNA, 25 bp, Mus musculus
tagttttccaagtgtgtaccattaa

SEQ ID NO: 782354 - DNA, 25 bp, Mus musculus
tagttttccattagcatgatgtgtt

SEQ ID NO: 782355 - DNA, 25 bp, Mus musculus
tagttttccattaggcctctgacat

SEQ ID NO: 782356 - DNA, 25 bp, Mus musculus
tagttttccatttgcatgatgtgtt

SEQ ID NO: 782357 - DNA, 25 bp, Mus musculus
tagttttccatttggcctctgacat

SEQ ID NO: 782358 - DNA, 25 bp, Mus musculus
tagttttctattatgttctccttat

SEQ ID NO: 782359 - DNA, 25 bp, Mus musculus
tagttttctattttgttctccttat

SEQ ID NO: 782360 - DNA, 25 bp, Mus musculus
tagttttctcgtatgcatgttgaca

SEQ ID NO: 782361 - DNA, 25 bp, Mus musculus
tagttttctcgtttgcatgttgaca

SEQ ID NO: 782362 - DNA, 25 bp, Mus musculus
tagttttctctcctgtgtgtcaggt

SEQ ID NO: 782363 - DNA, 25 bp, Mus musculus
tagttttctctcgtgtgtgtcaggt

SEQ ID NO: 782364 - DNA, 25 bp, Mus musculus
tagttttctgttactccactggttt

SEQ ID NO: 782365 - DNA, 25 bp, Mus musculus
tagttttctgtttctccactggttt

SEQ ID NO: 782366 - DNA, 25 bp, Mus musculus
tagttttcttctctgtcatattgca

SEQ ID NO: 782367 - DNA, 25 bp, Mus musculus
tagttttcttctgtgtcatattgca

SEQ ID NO: 782368 - DNA, 25 bp, Mus musculus
tagttttcttttcctcgcacaaaat

SEQ ID NO: 782369 - DNA, 25 bp, Mus musculus
tagttttcttttgctcgcacaaaat

SEQ ID NO: 782370 - DNA, 25 bp, Mus musculus
tagttttgacaccaaattggttagt

SEQ ID NO: 782371 - DNA, 25 bp, Mus musculus
tagttttgacacgaaattggttagt

SEQ ID NO: 782372 - DNA, 25 bp, Mus musculus
tagttttgccggacaccagctgtat

SEQ ID NO: 782373 - DNA, 25 bp, Mus musculus
tagttttgccggtcaccagctgtat

SEQ ID NO: 782374 - DNA, 25 bp, Mus musculus
tagttttgccttacagacttaagtc

SEQ ID NO: 782375 - DNA, 25 bp, Mus musculus
tagttttgcctttcagacttaagtc

SEQ ID NO: 782376 - DNA, 25 bp, Mus musculus
tagttttgctacacctttattaaag

SEQ ID NO: 782377 - DNA, 25 bp, Mus musculus
tagttttgctactcctttattaaag

SEQ ID NO: 782378 - DNA, 25 bp, Mus musculus
tagttttggccgcaacgctctggag

SEQ ID NO: 782379 - DNA, 25 bp, Mus musculus
tagttttggccggaacgctctggag

SEQ ID NO: 782380 - DNA, 25 bp, Mus musculus
tagttttgggcaagcattcttaatg

SEQ ID NO: 782381 - DNA, 25 bp, Mus musculus
tagttttgggcatgcattcttaatg

SEQ ID NO: 782382 - DNA, 25 bp, Mus musculus
tagttttgtagcctcctgagtgtct

SEQ ID NO: 782383 - DNA, 25 bp, Mus musculus
tagttttgtagcgtcctgagtgtct

SEQ ID NO: 782384 - DNA, 25 bp, Mus musculus
tagttttgttagcatgactcggcat

SEQ ID NO: 782385 - DNA, 25 bp, Mus musculus
tagttttgttaggatgactcggcat

SEQ ID NO: 782386 - DNA, 25 bp, Mus musculus
tagtttttacatatttcaggcagtg

SEQ ID NO: 782387 - DNA, 25 bp, Mus musculus
tagtttttacatttttcaggcagtg

SEQ ID NO: 782388 - DNA, 25 bp, Mus musculus
tagtttttacttaggcacgtgttct

SEQ ID NO: 782389 - DNA, 25 bp, Mus musculus
tagtttttactttggcacgtgttct

SEQ ID NO: 782390 - DNA, 25 bp, Mus musculus
tagtttttatctcacctccttaatg

SEQ ID NO: 782391 - DNA, 25 bp, Mus musculus
tagtttttatctgacctccttaatg

SEQ ID NO: 782392 - DNA, 25 bp, Mus musculus
tagtttttcagaaaggtcccagaag

SEQ ID NO: 782393 - DNA, 25 bp, Mus musculus
tagtttttcagataggtcccagaag

SEQ ID NO: 782394 - DNA, 25 bp, Mus musculus
tagtttttcagtaagccccaggtgc

SEQ ID NO: 782395 - DNA, 25 bp, Mus musculus
tagtttttcagttagccccaggtgc

SEQ ID NO: 782396 - DNA, 25 bp, Mus musculus
tagtttttccataggtgtgtagtca

SEQ ID NO: 782397 - DNA, 25 bp, Mus musculus
tagtttttccattggtgtgtagtca

SEQ ID NO: 782398 - DNA, 25 bp, Mus musculus
tagtttttccttaccaccgtatctg

SEQ ID NO: 782399 - DNA, 25 bp, Mus musculus
tagtttttcctttccaccgtatctg

SEQ ID NO: 782400 - DNA, 25 bp, Mus musculus
tagtttttgctcacgtaaaggccca

SEQ ID NO: 782401 - DNA, 25 bp, Mus musculus
tagtttttgctctcgtaaaggccca

SEQ ID NO: 782402 - DNA, 25 bp, Mus musculus
tagttttttaccagactccccagct

SEQ ID NO: 782403 - DNA, 25 bp, Mus musculus
tagttttttacctgactccccagct

SEQ ID NO: 782404 - DNA, 25 bp, Mus musculus
tagttttttcctcgtctcatctgaa

SEQ ID NO: 782405 - DNA, 25 bp, Mus musculus
tagttttttcctggtctcatctgaa

SEQ ID NO: 782406 - DNA, 25 bp, Mus musculus
tataaaaaatttctcctgtgtctat

SEQ ID NO: 782407 - DNA, 25 bp, Mus musculus
tataaaaaatttgtcctgtgtctat

SEQ ID NO: 782408 - DNA, 25 bp, Mus musculus
tataaaaagagcacaccctccacac

SEQ ID NO: 782409 - DNA, 25 bp, Mus musculus
tataaaaagagctcaccctccacac

SEQ ID NO: 782410 - DNA, 25 bp, Mus musculus
tataaaacaaccaaccatccacttc

SEQ ID NO: 782411 - DNA, 25 bp, Mus musculus
tataaaacaacctaccatccacttc

SEQ ID NO: 782412 - DNA, 25 bp, Mus musculus
tataaaaccggtattcagaatgaag

SEQ ID NO: 782413 - DNA, 25 bp, Mus musculus
tataaaaccggttttcagaatgaag

SEQ ID NO: 782414 - DNA, 25 bp, Mus musculus
tataaaactaacacccatctcagct

SEQ ID NO: 782415 - DNA, 25 bp, Mus musculus
tataaaactaactcccatctcagct

SEQ ID NO: 782416 - DNA, 25 bp, Mus musculus
tataaaactcttacttaaccatgga

SEQ ID NO: 782417 - DNA, 25 bp, Mus musculus
tataaaactctttcttaaccatgga

SEQ ID NO: 782418 - DNA, 25 bp, Mus musculus
tataaaagacttcctttggtcatgg

SEQ ID NO: 782419 - DNA, 25 bp, Mus musculus
tataaaagacttgctttggtcatgg

SEQ ID NO: 782420 - DNA, 25 bp, Mus musculus
tataaaagagtgagcttcttacagt

SEQ ID NO: 782421 - DNA, 25 bp, Mus musculus
tataaaagagtgtgcttcttacagt

SEQ ID NO: 782422 - DNA, 25 bp, Mus musculus
tataaaagatttcacctattcatgc

SEQ ID NO: 782423 - DNA, 25 bp, Mus musculus
tataaaagatttgacctattcatgc

SEQ ID NO: 782424 - DNA, 25 bp, Mus musculus
tataaaagctgaagcttggcccctc

SEQ ID NO: 782425 - DNA, 25 bp, Mus musculus
tataaaagctgatgcttggcccctc

SEQ ID NO: 782426 - DNA, 25 bp, Mus musculus
tataaaagtcccaaaggtccagcct

SEQ ID NO: 782427 - DNA, 25 bp, Mus musculus
tataaaagtccctaaggtccagcct

SEQ ID NO: 782428 - DNA, 25 bp, Mus musculus
tataaaatacagaggttttcctctt

SEQ ID NO: 782429 - DNA, 25 bp, Mus musculus
tataaaatacagtggttttcctctt

SEQ ID NO: 782430 - DNA, 25 bp, Mus musculus
tataaaatacttctacttctgggct

SEQ ID NO: 782431 - DNA, 25 bp, Mus musculus
tataaaatacttgtacttctgggct

SEQ ID NO: 782432 - DNA, 25 bp, Mus musculus
tataaaatatccattgaccgaccaa

SEQ ID NO: 782433 - DNA, 25 bp, Mus musculus
tataaaatatcctttgaccgaccaa

SEQ ID NO: 782434 - DNA, 25 bp, Mus musculus
tataaaatcagtaggtcattcagct

SEQ ID NO: 782435 - DNA, 25 bp, Mus musculus
tataaaatcagttggtcattcagct

SEQ ID NO: 782436 - DNA, 25 bp, Mus musculus
tataaaatctaaccctatccaccaa

SEQ ID NO: 782437 - DNA, 25 bp, Mus musculus
tataaaatctaagcctatccaccaa

SEQ ID NO: 782438 - DNA, 25 bp, Mus musculus
tataaaatgctcactgctcattgct

SEQ ID NO: 782439 - DNA, 25 bp, Mus musculus
tataaaatgctctctgctcattgct

SEQ ID NO: 782440 - DNA, 25 bp, Mus musculus
tataaaatggtaaaaagcgtcttct

SEQ ID NO: 782441 - DNA, 25 bp, Mus musculus
tataaaatggtataaagcgtcttct

SEQ ID NO: 782442 - DNA, 25 bp, Mus musculus
tataaaatttgtatatcgccggttg

SEQ ID NO: 782443 - DNA, 25 bp, Mus musculus
tataaaatttgtttatcgccggttg

SEQ ID NO: 782444 - DNA, 25 bp, Mus musculus
tataaacacgttatctccttggtca

SEQ ID NO: 782445 - DNA, 25 bp, Mus musculus
tataaacacgttttctccttggtca

SEQ ID NO: 782446 - DNA, 25 bp, Mus musculus
tataaacactggaggaggcccgcca

SEQ ID NO: 782447 - DNA, 25 bp, Mus musculus
tataaacactggtggaggcccgcca

SEQ ID NO: 782448 - DNA, 25 bp, Mus musculus
tataaaccattaagctacacacaag

SEQ ID NO: 782449 - DNA, 25 bp, Mus musculus
tataaaccattatgctacacacaag

SEQ ID NO: 782450 - DNA, 25 bp, Mus musculus
tataaacccatgaccatttactaag

SEQ ID NO: 782451 - DNA, 25 bp, Mus musculus
tataaacccatgtccatttactaag

SEQ ID NO: 782452 - DNA, 25 bp, Mus musculus
tataaaccctccacgggatggtgca

SEQ ID NO: 782453 - DNA, 25 bp, Mus musculus
tataaaccctcctcgggatggtgca

SEQ ID NO: 782454 - DNA, 25 bp, Mus musculus
tataaaccggcgctgccatgttctg

SEQ ID NO: 782455 - DNA, 25 bp, Mus musculus
tataaaccggcggtgccatgttctg

SEQ ID NO: 782456 - DNA, 25 bp, Mus musculus
tataaaccgtgtaagcagctcagga

SEQ ID NO: 782457 - DNA, 25 bp, Mus musculus
tataaaccgtgttagcagctcagga

SEQ ID NO: 782458 - DNA, 25 bp, Mus musculus
tataaacggtgacagcaacttgcat

SEQ ID NO: 782459 - DNA, 25 bp, Mus musculus
tataaacggtgagagcaacttgcat

SEQ ID NO: 782460 - DNA, 25 bp, Mus musculus
tataaactcagtcttagccagccca

SEQ ID NO: 782461 - DNA, 25 bp, Mus musculus
tataaactcagtgttagccagccca

SEQ ID NO: 782462 - DNA, 25 bp, Mus musculus
tataaacttgcacctttaacaattg

SEQ ID NO: 782463 - DNA, 25 bp, Mus musculus
tataaacttgcagctttaacaattg

SEQ ID NO: 782464 - DNA, 25 bp, Mus musculus
tataaagaattccaaccggcctctg

SEQ ID NO: 782465 - DNA, 25 bp, Mus musculus
tataaagaattcgaaccggcctctg

SEQ ID NO: 782466 - DNA, 25 bp, Mus musculus
tataaagaccatcctgagccagacc

SEQ ID NO: 782467 - DNA, 25 bp, Mus musculus
tataaagaccatgctgagccagacc

SEQ ID NO: 782468 - DNA, 25 bp, Mus musculus
tataaagagcttaggttcgccctgt

SEQ ID NO: 782469 - DNA, 25 bp, Mus musculus
tataaagagctttggttcgccctgt

SEQ ID NO: 782470 - DNA, 25 bp, Mus musculus
tataaagcaaatctcgccagcctca

SEQ ID NO: 782471 - DNA, 25 bp, Mus musculus
tataaagcaaatgtcgccagcctca

SEQ ID NO: 782472 - DNA, 25 bp, Mus musculus
tataaagcagaaagcctgtccttct

SEQ ID NO: 782473 - DNA, 25 bp, Mus musculus
tataaagcagaatgcctgtccttct

SEQ ID NO: 782474 - DNA, 25 bp, Mus musculus
tataaagccccaaaagcaagtcact

SEQ ID NO: 782475 - DNA, 25 bp, Mus musculus
tataaagccccataagcaagtcact

SEQ ID NO: 782476 - DNA, 25 bp, Mus musculus
tataaagcctgccaacccactggag

SEQ ID NO: 782477 - DNA, 25 bp, Mus musculus
tataaagcctgcgaacccactggag

SEQ ID NO: 782478 - DNA, 25 bp, Mus musculus
tataaagctagacactgccgggagt

SEQ ID NO: 782479 - DNA, 25 bp, Mus musculus
tataaagctagagactgccgggagt

SEQ ID NO: 782480 - DNA, 25 bp, Mus musculus
tataaaggagccaaagcccctgacc

SEQ ID NO: 782481 - DNA, 25 bp, Mus musculus
tataaaggagcctaagcccctgacc

SEQ ID NO: 782482 - DNA, 25 bp, Mus musculus
tataaaggcccactccagtgtggac

SEQ ID NO: 782483 - DNA, 25 bp, Mus musculus
tataaaggcccagtccagtgtggac

SEQ ID NO: 782484 - DNA, 25 bp, Mus musculus
tataaagtcactaggccattgcatg

SEQ ID NO: 782485 - DNA, 25 bp, Mus musculus
tataaagtcacttggccattgcatg

SEQ ID NO: 782486 - DNA, 25 bp, Mus musculus
tataaagtgatcatacgcccaggga

SEQ ID NO: 782487 - DNA, 25 bp, Mus musculus
tataaagtgatcttacgcccaggga

SEQ ID NO: 782488 - DNA, 25 bp, Mus musculus
tataaagtggacaggcaagttgagt

SEQ ID NO: 782489 - DNA, 25 bp, Mus musculus
tataaagtggactggcaagttgagt

SEQ ID NO: 782490 - DNA, 25 bp, Mus musculus
tataaagtgtgtactgccccactgg

SEQ ID NO: 782491 - DNA, 25 bp, Mus musculus
tataaagtgtgttctgccccactgg

SEQ ID NO: 782492 - DNA, 25 bp, Mus musculus
tataaagttgtcctggcgggcgccc

SEQ ID NO: 782493 - DNA, 25 bp, Mus musculus
tataaagttgtcgtggcgggcgccc

SEQ ID NO: 782494 - DNA, 25 bp, Mus musculus
tataaataactgagctgtcagggct

SEQ ID NO: 782495 - DNA, 25 bp, Mus musculus
tataaataactgtgctgtcagggct

SEQ ID NO: 782496 - DNA, 25 bp, Mus musculus
tataaatactatacatgccagaagc

SEQ ID NO: 782497 - DNA, 25 bp, Mus musculus
tataaatactattcatgccagaagc

SEQ ID NO: 782498 - DNA, 25 bp, Mus musculus
tataaatactggcttccgttcacct

SEQ ID NO: 782499 - DNA, 25 bp, Mus musculus
tataaatactgggttccgttcacct

SEQ ID NO: 782500 - DNA, 25 bp, Mus musculus
tataaataggccaaccttgtggttc

SEQ ID NO: 782501 - DNA, 25 bp, Mus musculus
tataaataggcctaccttgtggttc

SEQ ID NO: 782502 - DNA, 25 bp, Mus musculus
tataaatcaccacatttggtgccca

SEQ ID NO: 782503 - DNA, 25 bp, Mus musculus
tataaatcaccagatttggtgccca

SEQ ID NO: 782504 - DNA, 25 bp, Mus musculus
tataaatcccctccagttccttgtt

SEQ ID NO: 782505 - DNA, 25 bp, Mus musculus
tataaatcccctgcagttccttgtt

SEQ ID NO: 782506 - DNA, 25 bp, Mus musculus
tataaatccgacctctggatccgtt

SEQ ID NO: 782507 - DNA, 25 bp, Mus musculus
tataaatccgacgtctggatccgtt

SEQ ID NO: 782508 - DNA, 25 bp, Mus musculus
tataaatctcatacttctacccacc

SEQ ID NO: 782509 - DNA, 25 bp, Mus musculus
tataaatctcattcttctacccacc

SEQ ID NO: 782510 - DNA, 25 bp, Mus musculus
tataaatgaacccatatgtgtgtgt

SEQ ID NO: 782511 - DNA, 25 bp, Mus musculus
tataaatgaaccgatatgtgtgtgt

SEQ ID NO: 782512 - DNA, 25 bp, Mus musculus
tataaatgacttccggtggccacag

SEQ ID NO: 782513 - DNA, 25 bp, Mus musculus
tataaatgacttgcggtggccacag

SEQ ID NO: 782514 - DNA, 25 bp, Mus musculus
tataaatgcatcactggtgtgagcc

SEQ ID NO: 782515 - DNA, 25 bp, Mus musculus
tataaatgcatctctggtgtgagcc

SEQ ID NO: 782516 - DNA, 25 bp, Mus musculus
tataaatggcagagccctgagcggg

SEQ ID NO: 782517 - DNA, 25 bp, Mus musculus
tataaatggcagtgccctgagcggg

SEQ ID NO: 782518 - DNA, 25 bp, Mus musculus
tataaatgtacaagtccccgctgtc

SEQ ID NO: 782519 - DNA, 25 bp, Mus musculus
tataaatgtacatgtccccgctgtc

SEQ ID NO: 782520 - DNA, 25 bp, Mus musculus
tataaatgtttcctctgacctaggg

SEQ ID NO: 782521 - DNA, 25 bp, Mus musculus
tataaatgtttcgtctgacctaggg

SEQ ID NO: 782522 - DNA, 25 bp, Mus musculus
tataaattcacccttctgcaatctt

SEQ ID NO: 782523 - DNA, 25 bp, Mus musculus
tataaattcaccgttctgcaatctt

SEQ ID NO: 782524 - DNA, 25 bp, Mus musculus
tataaattctttcaatcagctgtgc

SEQ ID NO: 782525 - DNA, 25 bp, Mus musculus
tataaattctttgaatcagctgtgc

SEQ ID NO: 782526 - DNA, 25 bp, Mus musculus
tataaattgttacaccccactctac

SEQ ID NO: 782527 - DNA, 25 bp, Mus musculus
tataaattgttagaccccactctac

SEQ ID NO: 782528 - DNA, 25 bp, Mus musculus
tataaatttgcaaatcttcctccta

SEQ ID NO: 782529 - DNA, 25 bp, Mus musculus
tataaatttgcatatcttcctccta

SEQ ID NO: 782530 - DNA, 25 bp, Mus musculus
tataaatttgtgacccgatcagaga

SEQ ID NO: 782531 - DNA, 25 bp, Mus musculus
tataaatttgtgtcccgatcagaga

SEQ ID NO: 782532 - DNA, 25 bp, Mus musculus
tataaatttgttatgcttgattaaa

SEQ ID NO: 782533 - DNA, 25 bp, Mus musculus
tataaatttgttttgcttgattaaa

SEQ ID NO: 782534 - DNA, 25 bp, Mus musculus
tataaatttttccttcccttgctct

SEQ ID NO: 782535 - DNA, 25 bp, Mus musculus
tataaatttttcgttcccttgctct

SEQ ID NO: 782536 - DNA, 25 bp, Mus musculus
tataacaaacacaaccttcctggcc

SEQ ID NO: 782537 - DNA, 25 bp, Mus musculus
tataacaaacactaccttcctggcc

SEQ ID NO: 782538 - DNA, 25 bp, Mus musculus
tataacaatgctcgttcccggagga

SEQ ID NO: 782539 - DNA, 25 bp, Mus musculus
tataacaatgctggttcccggagga

SEQ ID NO: 782540 - DNA, 25 bp, Mus musculus
tataacaattctaagctttcttgga

SEQ ID NO: 782541 - DNA, 25 bp, Mus musculus
tataacaattcttagctttcttgga

SEQ ID NO: 782542 - DNA, 25 bp, Mus musculus
tataacacaggccaccggtttcaga

SEQ ID NO: 782543 - DNA, 25 bp, Mus musculus
tataacacaggcgaccggtttcaga

SEQ ID NO: 782544 - DNA, 25 bp, Mus musculus
tataacacaggtcccacgtgcactg

SEQ ID NO: 782545 - DNA, 25 bp, Mus musculus
tataacacaggtgccacgtgcactg

SEQ ID NO: 782546 - DNA, 25 bp, Mus musculus
tataacacccatcttcaggaaataa

SEQ ID NO: 782547 - DNA, 25 bp, Mus musculus
tataacacccatgttcaggaaataa

SEQ ID NO: 782548 - DNA, 25 bp, Mus musculus
tataacactagcagtgtctctgtct

SEQ ID NO: 782549 - DNA, 25 bp, Mus musculus
tataacactagctgtgtctctgtct

SEQ ID NO: 782550 - DNA, 25 bp, Mus musculus
tataacagtagtacctggcacacag

SEQ ID NO: 782551 - DNA, 25 bp, Mus musculus
tataacagtagttcctggcacacag

SEQ ID NO: 782552 - DNA, 25 bp, Mus musculus
tataacatattgacctcacaggcac

SEQ ID NO: 782553 - DNA, 25 bp, Mus musculus
tataacatattgtcctcacaggcac

SEQ ID NO: 782554 - DNA, 25 bp, Mus musculus
tataacatcttcatctagtctctgc

SEQ ID NO: 782555 - DNA, 25 bp, Mus musculus
tataacatcttcttctagtctctgc

SEQ ID NO: 782556 - DNA, 25 bp, Mus musculus
tataacattaatatctctctcctta

SEQ ID NO: 782557 - DNA, 25 bp, Mus musculus
tataacattaatttctctctcctta

SEQ ID NO: 782558 - DNA, 25 bp, Mus musculus
tataacattataccaccagtgcctc

SEQ ID NO: 782559 - DNA, 25 bp, Mus musculus
tataacattatagcaccagtgcctc

SEQ ID NO: 782560 - DNA, 25 bp, Mus musculus
tataacatttgaaagtgtgctgtca

SEQ ID NO: 782561 - DNA, 25 bp, Mus musculus
tataacatttgatagtgtgctgtca

SEQ ID NO: 782562 - DNA, 25 bp, Mus musculus
tataacattttcagcaggccgcaga

SEQ ID NO: 782563 - DNA, 25 bp, Mus musculus
tataacattttctgcaggccgcaga

SEQ ID NO: 782564 - DNA, 25 bp, Mus musculus
tataaccaaagaccatgggttcact

SEQ ID NO: 782565 - DNA, 25 bp, Mus musculus
tataaccaaagagcatgggttcact

SEQ ID NO: 782566 - DNA, 25 bp, Mus musculus
tataaccacacaaacgggaggctcc

SEQ ID NO: 782567 - DNA, 25 bp, Mus musculus
tataaccacacatacgggaggctcc

SEQ ID NO: 782568 - DNA, 25 bp, Mus musculus
tataaccactaactcctgaggctga

SEQ ID NO: 782569 - DNA, 25 bp, Mus musculus
tataaccactaagtcctgaggctga

SEQ ID NO: 782570 - DNA, 25 bp, Mus musculus
tataaccactcacagtcatgcccag

SEQ ID NO: 782571 - DNA, 25 bp, Mus musculus
tataaccactcagagtcatgcccag

SEQ ID NO: 782572 - DNA, 25 bp, Mus musculus
tataaccagagacccaagagccaaa

SEQ ID NO: 782573 - DNA, 25 bp, Mus musculus
tataaccagagagccaagagccaaa

SEQ ID NO: 782574 - DNA, 25 bp, Mus musculus
tataaccagcaaagggaagggcaca

SEQ ID NO: 782575 - DNA, 25 bp, Mus musculus
tataaccagcaatgggaagggcaca

SEQ ID NO: 782576 - DNA, 25 bp, Mus musculus
tataaccatcgcactttaggcaggg

SEQ ID NO: 782577 - DNA, 25 bp, Mus musculus
tataaccatcgctctttaggcaggg

SEQ ID NO: 782578 - DNA, 25 bp, Mus musculus
tataaccatgagattgactatctga

SEQ ID NO: 782579 - DNA, 25 bp, Mus musculus
tataaccatgagtttgactatctga

SEQ ID NO: 782580 - DNA, 25 bp, Mus musculus
tataaccatgccaagagtgcctgtc

SEQ ID NO: 782581 - DNA, 25 bp, Mus musculus
tataaccatgcctagagtgcctgtc

SEQ ID NO: 782582 - DNA, 25 bp, Mus musculus
tataaccatgtgaggcctcgatcct

SEQ ID NO: 782583 - DNA, 25 bp, Mus musculus
tataaccatgtgtggcctcgatcct

SEQ ID NO: 782584 - DNA, 25 bp, Mus musculus
tataacccaaagaactcaggagact

SEQ ID NO: 782585 - DNA, 25 bp, Mus musculus
tataacccaaagtactcaggagact

SEQ ID NO: 782586 - DNA, 25 bp, Mus musculus
tataacccacaaaaatgtcatgaag

SEQ ID NO: 782587 - DNA, 25 bp, Mus musculus
tataacccacaataatgtcatgaag

SEQ ID NO: 782588 - DNA, 25 bp, Mus musculus
tataacccactgcttgcggaagccc

SEQ ID NO: 782589 - DNA, 25 bp, Mus musculus
tataacccactggttgcggaagccc

SEQ ID NO: 782590 - DNA, 25 bp, Mus musculus
tataacccagggatgagctgcacag

SEQ ID NO: 782591 - DNA, 25 bp, Mus musculus
tataacccagggttgagctgcacag

SEQ ID NO: 782592 - DNA, 25 bp, Mus musculus
tataacccattacccattgctctat

SEQ ID NO: 782593 - DNA, 25 bp, Mus musculus
tataacccattagccattgctctat

SEQ ID NO: 782594 - DNA, 25 bp, Mus musculus
tataaccctaccaggcattgtatcg

SEQ ID NO: 782595 - DNA, 25 bp, Mus musculus
tataaccctacctggcattgtatcg

SEQ ID NO: 782596 - DNA, 25 bp, Mus musculus
tataaccctagaagcatcacgagag

SEQ ID NO: 782597 - DNA, 25 bp, Mus musculus
tataaccctagatgcatcacgagag

SEQ ID NO: 782598 - DNA, 25 bp, Mus musculus
tataaccctcataccagtgacctca

SEQ ID NO: 782599 - DNA, 25 bp, Mus musculus
tataaccctcattccagtgacctca

SEQ ID NO: 782600 - DNA, 25 bp, Mus musculus
tataaccgctttacttcctggaatg

SEQ ID NO: 782601 - DNA, 25 bp, Mus musculus
tataaccgcttttcttcctggaatg

SEQ ID NO: 782602 - DNA, 25 bp, Mus musculus
tataaccgtagccttccagtttagg

SEQ ID NO: 782603 - DNA, 25 bp, Mus musculus
tataaccgtagcgttccagtttagg

SEQ ID NO: 782604 - DNA, 25 bp, Mus musculus
tataacctacttatccacgagcgga

SEQ ID NO: 782605 - DNA, 25 bp, Mus musculus
tataacctacttttccacgagcgga

SEQ ID NO: 782606 - DNA, 25 bp, Mus musculus
tataacctataactcctgcgcacac

SEQ ID NO: 782607 - DNA, 25 bp, Mus musculus
tataacctataagtcctgcgcacac

SEQ ID NO: 782608 - DNA, 25 bp, Mus musculus
tataacctgctgacagaagcctgac

SEQ ID NO: 782609 - DNA, 25 bp, Mus musculus
tataacctgctgtcagaagcctgac

SEQ ID NO: 782610 - DNA, 25 bp, Mus musculus
tataacctggacaggaaacttgttt

SEQ ID NO: 782611 - DNA, 25 bp, Mus musculus
tataacctggactggaaacttgttt

SEQ ID NO: 782612 - DNA, 25 bp, Mus musculus
tataacctgtataagctctggcccg

SEQ ID NO: 782613 - DNA, 25 bp, Mus musculus
tataacctgtattagctctggcccg

SEQ ID NO: 782614 - DNA, 25 bp, Mus musculus
tataacctgtgtcctctggagacca

SEQ ID NO: 782615 - DNA, 25 bp, Mus musculus
tataacctgtgtgctctggagacca

SEQ ID NO: 782616 - DNA, 25 bp, Mus musculus
tataacctgtttcagggacggcctc

SEQ ID NO: 782617 - DNA, 25 bp, Mus musculus
tataacctgtttgagggacggcctc

SEQ ID NO: 782618 - DNA, 25 bp, Mus musculus
tataaccttcggcaaaaaggaggag

SEQ ID NO: 782619 - DNA, 25 bp, Mus musculus
tataaccttcgggaaaaaggaggag

SEQ ID NO: 782620 - DNA, 25 bp, Mus musculus
tataacgaaggcatggagtaccaga

SEQ ID NO: 782621 - DNA, 25 bp, Mus musculus
tataacgaaggcttggagtaccaga

SEQ ID NO: 782622 - DNA, 25 bp, Mus musculus
tataacgccctcacagatccatgag

SEQ ID NO: 782623 - DNA, 25 bp, Mus musculus
tataacgccctctcagatccatgag

SEQ ID NO: 782624 - DNA, 25 bp, Mus musculus
tataacgccgatatttctaccttcc

SEQ ID NO: 782625 - DNA, 25 bp, Mus musculus
tataacgccgatttttctaccttcc

SEQ ID NO: 782626 - DNA, 25 bp, Mus musculus
tataacgtacttagttttccctctg

SEQ ID NO: 782627 - DNA, 25 bp, Mus musculus
tataacgtactttgttttccctctg

SEQ ID NO: 782628 - DNA, 25 bp, Mus musculus
tataactaccttcttcattactgaa

SEQ ID NO: 782629 - DNA, 25 bp, Mus musculus
tataactaccttgttcattactgaa

SEQ ID NO: 782630 - DNA, 25 bp, Mus musculus
tataactagcggctgtgtgtgcaga

SEQ ID NO: 782631 - DNA, 25 bp, Mus musculus
tataactagcgggtgtgtgtgcaga

SEQ ID NO: 782632 - DNA, 25 bp, Mus musculus
tataactcaagcacttccctgaagt

SEQ ID NO: 782633 - DNA, 25 bp, Mus musculus
tataactcaagctcttccctgaagt

SEQ ID NO: 782634 - DNA, 25 bp, Mus musculus
tataactcaccacctttatccttat

SEQ ID NO: 782635 - DNA, 25 bp, Mus musculus
tataactcaccagctttatccttat

SEQ ID NO: 782636 - DNA, 25 bp, Mus musculus
tataactcagttctcctatgtgcct

SEQ ID NO: 782637 - DNA, 25 bp, Mus musculus
tataactcagttgtcctatgtgcct

SEQ ID NO: 782638 - DNA, 25 bp, Mus musculus
tataactcatctcgctatatccagt

SEQ ID NO: 782639 - DNA, 25 bp, Mus musculus
tataactcatctggctatatccagt

SEQ ID NO: 782640 - DNA, 25 bp, Mus musculus
tataactcatgaccctgaaggacca

SEQ ID NO: 782641 - DNA, 25 bp, Mus musculus
tataactcatgagcctgaaggacca

SEQ ID NO: 782642 - DNA, 25 bp, Mus musculus
tataactcatttaaaggcaactcat

SEQ ID NO: 782643 - DNA, 25 bp, Mus musculus
tataactcattttaaggcaactcat

SEQ ID NO: 782644 - DNA, 25 bp, Mus musculus
tataactccagcactactttgccca

SEQ ID NO: 782645 - DNA, 25 bp, Mus musculus
tataactccagctctactttgccca

SEQ ID NO: 782646 - DNA, 25 bp, Mus musculus
tataactcctttaactgttggtttg

SEQ ID NO: 782647 - DNA, 25 bp, Mus musculus
tataactccttttactgttggtttg

SEQ ID NO: 782648 - DNA, 25 bp, Mus musculus
tataactcgatccatccagtgctca

SEQ ID NO: 782649 - DNA, 25 bp, Mus musculus
tataactcgatcgatccagtgctca

SEQ ID NO: 782650 - DNA, 25 bp, Mus musculus
tataactctgaacacccatgatagt

SEQ ID NO: 782651 - DNA, 25 bp, Mus musculus
tataactctgaagacccatgatagt

SEQ ID NO: 782652 - DNA, 25 bp, Mus musculus
tataactcttgtcaagggccttctg

SEQ ID NO: 782653 - DNA, 25 bp, Mus musculus
tataactcttgtgaagggccttctg

SEQ ID NO: 782654 - DNA, 25 bp, Mus musculus
tataactgaactacacctccagggc

SEQ ID NO: 782655 - DNA, 25 bp, Mus musculus
tataactgaacttcacctccagggc

SEQ ID NO: 782656 - DNA, 25 bp, Mus musculus
tataactgccttaacactgctgtgt

SEQ ID NO: 782657 - DNA, 25 bp, Mus musculus
tataactgcctttacactgctgtgt

SEQ ID NO: 782658 - DNA, 25 bp, Mus musculus
tataactgcgctctgtatgtgaatc

SEQ ID NO: 782659 - DNA, 25 bp, Mus musculus
tataactgcgctgtgtatgtgaatc

SEQ ID NO: 782660 - DNA, 25 bp, Mus musculus
tataactgggagcatagcacacacc

SEQ ID NO: 782661 - DNA, 25 bp, Mus musculus
tataactgggaggatagcacacacc

SEQ ID NO: 782662 - DNA, 25 bp, Mus musculus
tataactgtgagaggcttgctgcca

SEQ ID NO: 782663 - DNA, 25 bp, Mus musculus
tataactgtgagtggcttgctgcca

SEQ ID NO: 782664 - DNA, 25 bp, Mus musculus
tataacttcttgactttccctccat

SEQ ID NO: 782665 - DNA, 25 bp, Mus musculus
tataacttcttgtctttccctccat

SEQ ID NO: 782666 - DNA, 25 bp, Mus musculus
tataacttgacaacccaaagccagt

SEQ ID NO: 782667 - DNA, 25 bp, Mus musculus
tataacttgacatcccaaagccagt

SEQ ID NO: 782668 - DNA, 25 bp, Mus musculus
tataacttgtcaccgagtagccacc

SEQ ID NO: 782669 - DNA, 25 bp, Mus musculus
tataacttgtcagcgagtagccacc

SEQ ID NO: 782670 - DNA, 25 bp, Mus musculus
tataactttcaaagaccagccatga

SEQ ID NO: 782671 - DNA, 25 bp, Mus musculus
tataactttcaatgaccagccatga

SEQ ID NO: 782672 - DNA, 25 bp, Mus musculus
tataactttgtaccattttagataa

SEQ ID NO: 782673 - DNA, 25 bp, Mus musculus
tataactttgtagcattttagataa

SEQ ID NO: 782674 - DNA, 25 bp, Mus musculus
tataacttttttctacgtagctgtt

SEQ ID NO: 782675 - DNA, 25 bp, Mus musculus
tataacttttttgtacgtagctgtt

SEQ ID NO: 782676 - DNA, 25 bp, Mus musculus
tataagaaactaaccagctgggcgt

SEQ ID NO: 782677 - DNA, 25 bp, Mus musculus
tataagaaactatccagctgggcgt

SEQ ID NO: 782678 - DNA, 25 bp, Mus musculus
tataagactgagattccttcccact

SEQ ID NO: 782679 - DNA, 25 bp, Mus musculus
tataagactgagtttccttcccact

SEQ ID NO: 782680 - DNA, 25 bp, Mus musculus
tataagactttaaaattgcctttat

SEQ ID NO: 782681 - DNA, 25 bp, Mus musculus
tataagactttataattgcctttat

SEQ ID NO: 782682 - DNA, 25 bp, Mus musculus
tataagatcccactagaaggaagga

SEQ ID NO: 782683 - DNA, 25 bp, Mus musculus
tataagatcccagtagaaggaagga

SEQ ID NO: 782684 - DNA, 25 bp, Mus musculus
tataagatgtgcactatcccaccca

SEQ ID NO: 782685 - DNA, 25 bp, Mus musculus
tataagatgtgcatcctcggtcatg

SEQ ID NO: 782686 - DNA, 25 bp, Mus musculus
tataagatgtgctctatcccaccca

SEQ ID NO: 782687 - DNA, 25 bp, Mus musculus
tataagatgtgcttcctcggtcatg

SEQ ID NO: 782688 - DNA, 25 bp, Mus musculus
tataagcactacagtgtgtgccttt

SEQ ID NO: 782689 - DNA, 25 bp, Mus musculus
tataagcactactgtgtgtgccttt

SEQ ID NO: 782690 - DNA, 25 bp, Mus musculus
tataagcactttctccccagtttca

SEQ ID NO: 782691 - DNA, 25 bp, Mus musculus
tataagcactttgtccccagtttca

SEQ ID NO: 782692 - DNA, 25 bp, Mus musculus
tataagcagactcgcgccaactact

SEQ ID NO: 782693 - DNA, 25 bp, Mus musculus
tataagcagactggcgccaactact

SEQ ID NO: 782694 - DNA, 25 bp, Mus musculus
tataagcagcaccaggatctttccc

SEQ ID NO: 782695 - DNA, 25 bp, Mus musculus
tataagcagcacgaggatctttccc

SEQ ID NO: 782696 - DNA, 25 bp, Mus musculus
tataagcatcataatttatctattc

SEQ ID NO: 782697 - DNA, 25 bp, Mus musculus
tataagcatcattatttatctattc

SEQ ID NO: 782698 - DNA, 25 bp, Mus musculus
tataagcatgctagtcacccaggga

SEQ ID NO: 782699 - DNA, 25 bp, Mus musculus
tataagcatgcttgtcacccaggga

SEQ ID NO: 782700 - DNA, 25 bp, Mus musculus
tataagccaaacactctgaaacccc

SEQ ID NO: 782701 - DNA, 25 bp, Mus musculus
tataagccaaactctctgaaacccc

SEQ ID NO: 782702 - DNA, 25 bp, Mus musculus
tataagccaggaagcccaaatacag

SEQ ID NO: 782703 - DNA, 25 bp, Mus musculus
tataagccaggatgcccaaatacag

SEQ ID NO: 782704 - DNA, 25 bp, Mus musculus
tataagccccataggaaccgaggat

SEQ ID NO: 782705 - DNA, 25 bp, Mus musculus
tataagccccattggaaccgaggat

SEQ ID NO: 782706 - DNA, 25 bp, Mus musculus
tataagcccctacagttcacggtgg

SEQ ID NO: 782707 - DNA, 25 bp, Mus musculus
tataagcccctagagttcacggtgg

SEQ ID NO: 782708 - DNA, 25 bp, Mus musculus
tataagcctccaatgagctcagaga

SEQ ID NO: 782709 - DNA, 25 bp, Mus musculus
tataagcctccattgagctcagaga

SEQ ID NO: 782710 - DNA, 25 bp, Mus musculus
tataagccttgtagcatatgagcca

SEQ ID NO: 782711 - DNA, 25 bp, Mus musculus
tataagccttgttgcatatgagcca

SEQ ID NO: 782712 - DNA, 25 bp, Mus musculus
tataagcttgatagtgaaactgaga

SEQ ID NO: 782713 - DNA, 25 bp, Mus musculus
tataagcttgattgtgaaactgaga

SEQ ID NO: 782714 - DNA, 25 bp, Mus musculus
tataaggaaagtacactggaaacgt

SEQ ID NO: 782715 - DNA, 25 bp, Mus musculus
tataaggaaagttcactggaaacgt

SEQ ID NO: 782716 - DNA, 25 bp, Mus musculus
tataaggacccacttgctcttgcca

SEQ ID NO: 782717 - DNA, 25 bp, Mus musculus
tataaggacccagttgctcttgcca

SEQ ID NO: 782718 - DNA, 25 bp, Mus musculus
tataaggactgcagcacactttcca

SEQ ID NO: 782719 - DNA, 25 bp, Mus musculus
tataaggactgctgcacactttcca

SEQ ID NO: 782720 - DNA, 25 bp, Mus musculus
tataaggactggaattgtgttttta

SEQ ID NO: 782721 - DNA, 25 bp, Mus musculus
tataaggactggtattgtgttttta

SEQ ID NO: 782722 - DNA, 25 bp, Mus musculus
tataaggattggaacactggtggga

SEQ ID NO: 782723 - DNA, 25 bp, Mus musculus
tataaggattggtacactggtggga

SEQ ID NO: 782724 - DNA, 25 bp, Mus musculus
tataaggcaactaagaagctcatgt

SEQ ID NO: 782725 - DNA, 25 bp, Mus musculus
tataaggcaacttagaagctcatgt

SEQ ID NO: 782726 - DNA, 25 bp, Mus musculus
tataaggcagtgacgggcacactca

SEQ ID NO: 782727 - DNA, 25 bp, Mus musculus
tataaggcagtgtcgggcacactca

SEQ ID NO: 782728 - DNA, 25 bp, Mus musculus
tataaggccagcctcacctgcatag

SEQ ID NO: 782729 - DNA, 25 bp, Mus musculus
tataaggccagcgtcacctgcatag

SEQ ID NO: 782730 - DNA, 25 bp, Mus musculus
tataaggccagtatatgggatttta

SEQ ID NO: 782731 - DNA, 25 bp, Mus musculus
tataaggccagtttatgggatttta

SEQ ID NO: 782732 - DNA, 25 bp, Mus musculus
tataaggcctatctttgggtttgtt

SEQ ID NO: 782733 - DNA, 25 bp, Mus musculus
tataaggcctatgtttgggtttgtt

SEQ ID NO: 782734 - DNA, 25 bp, Mus musculus
tataaggctctcaacttacatgatt

SEQ ID NO: 782735 - DNA, 25 bp, Mus musculus
tataaggctctctacttacatgatt

SEQ ID NO: 782736 - DNA, 25 bp, Mus musculus
tataaggcttccaacttgcacacag

SEQ ID NO: 782737 - DNA, 25 bp, Mus musculus
tataaggcttcctacttgcacacag

SEQ ID NO: 782738 - DNA, 25 bp, Mus musculus
tataaggcttctagtgtacacaaga

SEQ ID NO: 782739 - DNA, 25 bp, Mus musculus
tataaggcttcttgtgtacacaaga

SEQ ID NO: 782740 - DNA, 25 bp, Mus musculus
tataagggaggtatatttgagccgg

SEQ ID NO: 782741 - DNA, 25 bp, Mus musculus
tataagggaggtttatttgagccgg

SEQ ID NO: 782742 - DNA, 25 bp, Mus musculus
tataagggcactcggatccgaactc

SEQ ID NO: 782743 - DNA, 25 bp, Mus musculus
tataagggcactgggatccgaactc

SEQ ID NO: 782744 - DNA, 25 bp, Mus musculus
tataagggtcgacttttttcaccag

SEQ ID NO: 782745 - DNA, 25 bp, Mus musculus
tataagggtcgagttttttcaccag

SEQ ID NO: 782746 - DNA, 25 bp, Mus musculus
tataagggtgttaggtcctctggaa

SEQ ID NO: 782747 - DNA, 25 bp, Mus musculus
tataagggtgtttggtcctctggaa

SEQ ID NO: 782748 - DNA, 25 bp, Mus musculus
tataaggtaaacaagcaggatgcac

SEQ ID NO: 782749 - DNA, 25 bp, Mus musculus
tataaggtaaactagcaggatgcac

SEQ ID NO: 782750 - DNA, 25 bp, Mus musculus
tataaggtcagcaaaatcttggtgt

SEQ ID NO: 782751 - DNA, 25 bp, Mus musculus
tataaggtcagctaaatcttggtgt

SEQ ID NO: 782752 - DNA, 25 bp, Mus musculus
tataaggtcattaccctccagtaca

SEQ ID NO: 782753 - DNA, 25 bp, Mus musculus
tataaggtcatttccctccagtaca

SEQ ID NO: 782754 - DNA, 25 bp, Mus musculus
tataaggtccaaatagctgaactaa

SEQ ID NO: 782755 - DNA, 25 bp, Mus musculus
tataaggtccaattagctgaactaa

SEQ ID NO: 782756 - DNA, 25 bp, Mus musculus
tataaggtccttaccaagttttctg

SEQ ID NO: 782757 - DNA, 25 bp, Mus musculus
tataaggtcctttccaagttttctg

SEQ ID NO: 782758 - DNA, 25 bp, Mus musculus
tataaggtcttacttgtgtcttggg

SEQ ID NO: 782759 - DNA, 25 bp, Mus musculus
tataaggtcttagttgtgtcttggg

SEQ ID NO: 782760 - DNA, 25 bp, Mus musculus
tataaggttttgatgaggattagaa

SEQ ID NO: 782761 - DNA, 25 bp, Mus musculus
tataaggttttgttgaggattagaa

SEQ ID NO: 782762 - DNA, 25 bp, Mus musculus
tataagtaaaggatgtactgcccca

SEQ ID NO: 782763 - DNA, 25 bp, Mus musculus
tataagtaaaggttgtactgcccca

SEQ ID NO: 782764 - DNA, 25 bp, Mus musculus
tataagtaagtgagcacttgcctag

SEQ ID NO: 782765 - DNA, 25 bp, Mus musculus
tataagtaagtgtgcacttgcctag

SEQ ID NO: 782766 - DNA, 25 bp, Mus musculus
tataagtcccatatataaacccact

SEQ ID NO: 782767 - DNA, 25 bp, Mus musculus
tataagtcccatttataaacccact

SEQ ID NO: 782768 - DNA, 25 bp, Mus musculus
tataagtcccttcatccacagtaaa

SEQ ID NO: 782769 - DNA, 25 bp, Mus musculus
tataagtcccttgatccacagtaaa

SEQ ID NO: 782770 - DNA, 25 bp, Mus musculus
tataagtctgttccttttatatcag

SEQ ID NO: 782771 - DNA, 25 bp, Mus musculus
tataagtctgttgcttttatatcag

SEQ ID NO: 782772 - DNA, 25 bp, Mus musculus
tataagtgagccaccattccctaaa

SEQ ID NO: 782773 - DNA, 25 bp, Mus musculus
tataagtgagcctccattccctaaa

SEQ ID NO: 782774 - DNA, 25 bp, Mus musculus
tataagtgccatctgccgggaattg

SEQ ID NO: 782775 - DNA, 25 bp, Mus musculus
tataagtgccatgtgccgggaattg

SEQ ID NO: 782776 - DNA, 25 bp, Mus musculus
tataagtgcctcagtgttgtgaaac

SEQ ID NO: 782777 - DNA, 25 bp, Mus musculus
tataagtgcctctgtgttgtgaaac

SEQ ID NO: 782778 - DNA, 25 bp, Mus musculus
tataagtgctttactcctggagaac

SEQ ID NO: 782779 - DNA, 25 bp, Mus musculus
tataagtgcttttctcctggagaac

SEQ ID NO: 782780 - DNA, 25 bp, Mus musculus
tataagttcacccagcaaagccgta

SEQ ID NO: 782781 - DNA, 25 bp, Mus musculus
tataagttcaccgagcaaagccgta

SEQ ID NO: 782782 - DNA, 25 bp, Mus musculus
tataagttctttcacaggcccttcc

SEQ ID NO: 782783 - DNA, 25 bp, Mus musculus
tataagttctttgacaggcccttcc

SEQ ID NO: 782784 - DNA, 25 bp, Mus musculus
tataagtttccacattaaccacctt

SEQ ID NO: 782785 - DNA, 25 bp, Mus musculus
tataagtttccagattaaccacctt

SEQ ID NO: 782786 - DNA, 25 bp, Mus musculus
tataagtttttcctacatagtacta

SEQ ID NO: 782787 - DNA, 25 bp, Mus musculus
tataagtttttcgtacatagtacta

SEQ ID NO: 782788 - DNA, 25 bp, Mus musculus
tataataacataatctaggagcaag

SEQ ID NO: 782789 - DNA, 25 bp, Mus musculus
tataataacatattctaggagcaag

SEQ ID NO: 782790 - DNA, 25 bp, Mus musculus
tataatacacagcagttagcccttg

SEQ ID NO: 782791 - DNA, 25 bp, Mus musculus
tataatacacaggagttagcccttg

SEQ ID NO: 782792 - DNA, 25 bp, Mus musculus
tataatacatacaacatccagctct

SEQ ID NO: 782793 - DNA, 25 bp, Mus musculus
tataatacatactacatccagctct

SEQ ID NO: 782794 - DNA, 25 bp, Mus musculus
tataataccacaaggcctgcctact

SEQ ID NO: 782795 - DNA, 25 bp, Mus musculus
tataataccacatggcctgcctact

SEQ ID NO: 782796 - DNA, 25 bp, Mus musculus
tataataccgtactttgccctttgt

SEQ ID NO: 782797 - DNA, 25 bp, Mus musculus
tataataccgtagtttgccctttgt

SEQ ID NO: 782798 - DNA, 25 bp, Mus musculus
tataatactctcacacctccatcat

SEQ ID NO: 782799 - DNA, 25 bp, Mus musculus
tataatactctctcacctccatcat

SEQ ID NO: 782800 - DNA, 25 bp, Mus musculus
tataatagcagcacacgcttcctac

SEQ ID NO: 782801 - DNA, 25 bp, Mus musculus
tataatagcagctcacgcttcctac

SEQ ID NO: 782802 - DNA, 25 bp, Mus musculus
tataatagtgtcagatggtatcgta

SEQ ID NO: 782803 - DNA, 25 bp, Mus musculus
tataatagtgtctgatggtatcgta

SEQ ID NO: 782804 - DNA, 25 bp, Mus musculus
tataatatactccttgtcaatgaca

SEQ ID NO: 782805 - DNA, 25 bp, Mus musculus
tataatatactcgttgtcaatgaca

SEQ ID NO: 782806 - DNA, 25 bp, Mus musculus
tataatatccagactttccatggct

SEQ ID NO: 782807 - DNA, 25 bp, Mus musculus
tataatatccagtctttccatggct

SEQ ID NO: 782808 - DNA, 25 bp, Mus musculus
tataatatccgcacctgctacatca

SEQ ID NO: 782809 - DNA, 25 bp, Mus musculus
tataatatccgctcctgctacatca

SEQ ID NO: 782810 - DNA, 25 bp, Mus musculus
tataatatcgagaagctgccaacca

SEQ ID NO: 782811 - DNA, 25 bp, Mus musculus
tataatatcgagtagctgccaacca

SEQ ID NO: 782812 - DNA, 25 bp, Mus musculus
tataatatcttcaagcaccttccag

SEQ ID NO: 782813 - DNA, 25 bp, Mus musculus
tataatatcttctagcaccttccag

SEQ ID NO: 782814 - DNA, 25 bp, Mus musculus
tataatcacataactcttggctggt

SEQ ID NO: 782815 - DNA, 25 bp, Mus musculus
tataatcacatatctcttggctggt

SEQ ID NO: 782816 - DNA, 25 bp, Mus musculus
tataatcagcggcacacacatcttc

SEQ ID NO: 782817 - DNA, 25 bp, Mus musculus
tataatcagcgggacacacatcttc

SEQ ID NO: 782818 - DNA, 25 bp, Mus musculus
tataatccacacattcgtatctctg

SEQ ID NO: 782819 - DNA, 25 bp, Mus musculus
tataatccacactttcgtatctctg

SEQ ID NO: 782820 - DNA, 25 bp, Mus musculus
tataatccagagcattttggtcttc

SEQ ID NO: 782821 - DNA, 25 bp, Mus musculus
tataatccagaggattttggtcttc

SEQ ID NO: 782822 - DNA, 25 bp, Mus musculus
tataatccatgcctcaactgtgacc

SEQ ID NO: 782823 - DNA, 25 bp, Mus musculus
tataatccatgcgtcaactgtgacc

SEQ ID NO: 782824 - DNA, 25 bp, Mus musculus
tataatcccagaactccgaaagtag

SEQ ID NO: 782825 - DNA, 25 bp, Mus musculus
tataatcccagacccggtggaggca

SEQ ID NO: 782826 - DNA, 25 bp, Mus musculus
tataatcccagagccggtggaggca

SEQ ID NO: 782827 - DNA, 25 bp, Mus musculus
tataatcccagatctccgaaagtag

SEQ ID NO: 782828 - DNA, 25 bp, Mus musculus
tataatcccctaagtggtcaccgaa

SEQ ID NO: 782829 - DNA, 25 bp, Mus musculus
tataatcccctatgtggtcaccgaa

SEQ ID NO: 782830 - DNA, 25 bp, Mus musculus
tataatccccttctgcaactctgta

SEQ ID NO: 782831 - DNA, 25 bp, Mus musculus
tataatccccttgtgcaactctgta

SEQ ID NO: 782832 - DNA, 25 bp, Mus musculus
tataatccgccgagttgtgtgcctg

SEQ ID NO: 782833 - DNA, 25 bp, Mus musculus
tataatccgccgtgttgtgtgcctg

SEQ ID NO: 782834 - DNA, 25 bp, Mus musculus
tataatccgggccaggaccaacact

SEQ ID NO: 782835 - DNA, 25 bp, Mus musculus
tataatccgggcgaggaccaacact

SEQ ID NO: 782836 - DNA, 25 bp, Mus musculus
tataatccgtccactagaatcctca

SEQ ID NO: 782837 - DNA, 25 bp, Mus musculus
tataatccgtcctctagaatcctca

SEQ ID NO: 782838 - DNA, 25 bp, Mus musculus
tataatcctctgctctttctagtcc

SEQ ID NO: 782839 - DNA, 25 bp, Mus musculus
tataatcctctggtctttctagtcc

SEQ ID NO: 782840 - DNA, 25 bp, Mus musculus
tataatcctgaacccataacgctcg

SEQ ID NO: 782841 - DNA, 25 bp, Mus musculus
tataatcctgaagccataacgctcg

SEQ ID NO: 782842 - DNA, 25 bp, Mus musculus
tataatcctgtaacagtttcctata

SEQ ID NO: 782843 - DNA, 25 bp, Mus musculus
tataatcctgtatcagtttcctata

SEQ ID NO: 782844 - DNA, 25 bp, Mus musculus
tataatcctgtcatccaagatccca

SEQ ID NO: 782845 - DNA, 25 bp, Mus musculus
tataatcctgtcttccaagatccca

SEQ ID NO: 782846 - DNA, 25 bp, Mus musculus
tataatcctgtgctctactgtgact

SEQ ID NO: 782847 - DNA, 25 bp, Mus musculus
tataatcctgtggtctactgtgact

SEQ ID NO: 782848 - DNA, 25 bp, Mus musculus
tataatctaagaaccgtttggcaaa

SEQ ID NO: 782849 - DNA, 25 bp, Mus musculus
tataatctaagatccgtttggcaaa

SEQ ID NO: 782850 - DNA, 25 bp, Mus musculus
tataatctgggcagtcttctatggc

SEQ ID NO: 782851 - DNA, 25 bp, Mus musculus
tataatctgggctgtcttctatggc

SEQ ID NO: 782852 - DNA, 25 bp, Mus musculus
tataatcttaccagtgatgcacctg

SEQ ID NO: 782853 - DNA, 25 bp, Mus musculus
tataatcttacctgtgatgcacctg

SEQ ID NO: 782854 - DNA, 25 bp, Mus musculus
tataatctttctaactctcctgtgc

SEQ ID NO: 782855 - DNA, 25 bp, Mus musculus
tataatctttcttactctcctgtgc

SEQ ID NO: 782856 - DNA, 25 bp, Mus musculus
tataatgaatgaccacatctgcccc

SEQ ID NO: 782857 - DNA, 25 bp, Mus musculus
tataatgaatgagcacatctgcccc

SEQ ID NO: 782858 - DNA, 25 bp, Mus musculus
tataatgacataatccaaggcttgg

SEQ ID NO: 782859 - DNA, 25 bp, Mus musculus
tataatgacatattccaaggcttgg

SEQ ID NO: 782860 - DNA, 25 bp, Mus musculus
tataatgacctgactcagtaccctg

SEQ ID NO: 782861 - DNA, 25 bp, Mus musculus
tataatgacctgagcccatttgtcc

SEQ ID NO: 782862 - DNA, 25 bp, Mus musculus
tataatgacctgtctcagtaccctg

SEQ ID NO: 782863 - DNA, 25 bp, Mus musculus
tataatgacctgtgcccatttgtcc

SEQ ID NO: 782864 - DNA, 25 bp, Mus musculus
tataatgactcccacctgaaatcac

SEQ ID NO: 782865 - DNA, 25 bp, Mus musculus
tataatgactccgacctgaaatcac

SEQ ID NO: 782866 - DNA, 25 bp, Mus musculus
tataatgagcatacgactttcctac

SEQ ID NO: 782867 - DNA, 25 bp, Mus musculus
tataatgagcattcgactttcctac

SEQ ID NO: 782868 - DNA, 25 bp, Mus musculus
tataatgatccactttttactttgt

SEQ ID NO: 782869 - DNA, 25 bp, Mus musculus
tataatgatccagtttttactttgt

SEQ ID NO: 782870 - DNA, 25 bp, Mus musculus
tataatgcaaagcttctcaaccttc

SEQ ID NO: 782871 - DNA, 25 bp, Mus musculus
tataatgcaaaggttctcaaccttc

SEQ ID NO: 782872 - DNA, 25 bp, Mus musculus
tataatgcaatactcccttcccttg

SEQ ID NO: 782873 - DNA, 25 bp, Mus musculus
tataatgcaatagtcccttcccttg

SEQ ID NO: 782874 - DNA, 25 bp, Mus musculus
tataatgcatctccccagagtattt

SEQ ID NO: 782875 - DNA, 25 bp, Mus musculus
tataatgcatctgcccagagtattt

SEQ ID NO: 782876 - DNA, 25 bp, Mus musculus
tataatgccagtctgtcttacatag

SEQ ID NO: 782877 - DNA, 25 bp, Mus musculus
tataatgccagtgtgtcttacatag

SEQ ID NO: 782878 - DNA, 25 bp, Mus musculus
tataatgcccagagcgatgctttgc

SEQ ID NO: 782879 - DNA, 25 bp, Mus musculus
tataatgcccagtgcgatgctttgc

SEQ ID NO: 782880 - DNA, 25 bp, Mus musculus
tataatgcctaccttcaaaaccaga

SEQ ID NO: 782881 - DNA, 25 bp, Mus musculus
tataatgcctacgttcaaaaccaga

SEQ ID NO: 782882 - DNA, 25 bp, Mus musculus
tataatgctactatcttctacagtg

SEQ ID NO: 782883 - DNA, 25 bp, Mus musculus
tataatgctactttcttctacagtg

SEQ ID NO: 782884 - DNA, 25 bp, Mus musculus
tataatgctgcaaacaccctgtccg

SEQ ID NO: 782885 - DNA, 25 bp, Mus musculus
tataatgctgcacttctgaacacac

SEQ ID NO: 782886 - DNA, 25 bp, Mus musculus
tataatgctgcagttctgaacacac

SEQ ID NO: 782887 - DNA, 25 bp, Mus musculus
tataatgctgcatacaccctgtccg

SEQ ID NO: 782888 - DNA, 25 bp, Mus musculus
tataatgctgtgaaccctccctcaa

SEQ ID NO: 782889 - DNA, 25 bp, Mus musculus
tataatgctgtgtaccctccctcaa

SEQ ID NO: 782890 - DNA, 25 bp, Mus musculus
tataatggagaaatgggccccgcag

SEQ ID NO: 782891 - DNA, 25 bp, Mus musculus
tataatggagaattgggccccgcag

SEQ ID NO: 782892 - DNA, 25 bp, Mus musculus
tataatggatctcgtaacctagtga

SEQ ID NO: 782893 - DNA, 25 bp, Mus musculus
tataatggatctggtaacctagtga

SEQ ID NO: 782894 - DNA, 25 bp, Mus musculus
tataatggctctcctcctcttttgt

SEQ ID NO: 782895 - DNA, 25 bp, Mus musculus
tataatggctctgctcctcttttgt

SEQ ID NO: 782896 - DNA, 25 bp, Mus musculus
tataatgtaccccttctcagtgctg

SEQ ID NO: 782897 - DNA, 25 bp, Mus musculus
tataatgtacccgttctcagtgctg

SEQ ID NO: 782898 - DNA, 25 bp, Mus musculus
tataatgtcaccatcggaggccaga

SEQ ID NO: 782899 - DNA, 25 bp, Mus musculus
tataatgtcaccttcggaggccaga

SEQ ID NO: 782900 - DNA, 25 bp, Mus musculus
tataatgtccaacactgacctctcg

SEQ ID NO: 782901 - DNA, 25 bp, Mus musculus
tataatgtccaagactgacctctcg

SEQ ID NO: 782902 - DNA, 25 bp, Mus musculus
tataatgtctcaagggtcccagcag

SEQ ID NO: 782903 - DNA, 25 bp, Mus musculus
tataatgtctcatgggtcccagcag

SEQ ID NO: 782904 - DNA, 25 bp, Mus musculus
tataatgttctgaacttgttagcac

SEQ ID NO: 782905 - DNA, 25 bp, Mus musculus
tataatgttctgatccttttgtatt

SEQ ID NO: 782906 - DNA, 25 bp, Mus musculus
tataatgttctgtacttgttagcac

SEQ ID NO: 782907 - DNA, 25 bp, Mus musculus
tataatgttctgttccttttgtatt

SEQ ID NO: 782908 - DNA, 25 bp, Mus musculus
tataatgttttcagcatacaccaaa

SEQ ID NO: 782909 - DNA, 25 bp, Mus musculus
tataatgttttctgcatacaccaaa

SEQ ID NO: 782910 - DNA, 25 bp, Mus musculus
tataattatgcccagtcctgccatc

SEQ ID NO: 782911 - DNA, 25 bp, Mus musculus
tataattatgccgagtcctgccatc

SEQ ID NO: 782912 - DNA, 25 bp, Mus musculus
tataattcgtaaaggccctgtggac

SEQ ID NO: 782913 - DNA, 25 bp, Mus musculus
tataattcgtaatggccctgtggac

SEQ ID NO: 782914 - DNA, 25 bp, Mus musculus
tataattctcgaaactgcagcgcgt

SEQ ID NO: 782915 - DNA, 25 bp, Mus musculus
tataattctcgatactgcagcgcgt

SEQ ID NO: 782916 - DNA, 25 bp, Mus musculus
tataattctgctactggctacttgt

SEQ ID NO: 782917 - DNA, 25 bp, Mus musculus
tataattctgcttctggctacttgt

SEQ ID NO: 782918 - DNA, 25 bp, Mus musculus
tataattctttcaacccttactctt

SEQ ID NO: 782919 - DNA, 25 bp, Mus musculus
tataattctttctacccttactctt

SEQ ID NO: 782920 - DNA, 25 bp, Mus musculus
tataattgcatcagaatcccacccc

SEQ ID NO: 782921 - DNA, 25 bp, Mus musculus
tataattgcatctgaatcccacccc

SEQ ID NO: 782922 - DNA, 25 bp, Mus musculus
tataattggtcaagccctgtggcag

SEQ ID NO: 782923 - DNA, 25 bp, Mus musculus
tataattggtcatgccctgtggcag

SEQ ID NO: 782924 - DNA, 25 bp, Mus musculus
tataattggttcctacgtgtacctg

SEQ ID NO: 782925 - DNA, 25 bp, Mus musculus
tataattggttcgtacgtgtacctg

SEQ ID NO: 782926 - DNA, 25 bp, Mus musculus
tataattgtaacctactggctattc

SEQ ID NO: 782927 - DNA, 25 bp, Mus musculus
tataattgtaacgtactggctattc

SEQ ID NO: 782928 - DNA, 25 bp, Mus musculus
tataatttacctaccacctatgttt

SEQ ID NO: 782929 - DNA, 25 bp, Mus musculus
tataatttaccttccacctatgttt

SEQ ID NO: 782930 - DNA, 25 bp, Mus musculus
tataatttagttatacaggtctcag

SEQ ID NO: 782931 - DNA, 25 bp, Mus musculus
tataatttagttttacaggtctcag

SEQ ID NO: 782932 - DNA, 25 bp, Mus musculus
tataatttcaatctcttaccccttt

SEQ ID NO: 782933 - DNA, 25 bp, Mus musculus
tataatttcaatgtcttaccccttt

SEQ ID NO: 782934 - DNA, 25 bp, Mus musculus
tataatttcattacaaaggtttcct

SEQ ID NO: 782935 - DNA, 25 bp, Mus musculus
tataatttcatttcaaaggtttcct

SEQ ID NO: 782936 - DNA, 25 bp, Mus musculus
tataatttcccacaactctttagaa

SEQ ID NO: 782937 - DNA, 25 bp, Mus musculus
tataatttcccagaactctttagaa

SEQ ID NO: 782938 - DNA, 25 bp, Mus musculus
tataatttccctatgatgttacttt

SEQ ID NO: 782939 - DNA, 25 bp, Mus musculus
tataatttccctttgatgttacttt

SEQ ID NO: 782940 - DNA, 25 bp, Mus musculus
tataattttccccatgtgttctgtt

SEQ ID NO: 782941 - DNA, 25 bp, Mus musculus
tataattttcccgatgtgttctgtt

SEQ ID NO: 782942 - DNA, 25 bp, Mus musculus
tatacaaaccatcctaccaagttcc

SEQ ID NO: 782943 - DNA, 25 bp, Mus musculus
tatacaaaccatgctaccaagttcc

SEQ ID NO: 782944 - DNA, 25 bp, Mus musculus
tatacaaagtaacggtaaggtctct

SEQ ID NO: 782945 - DNA, 25 bp, Mus musculus
tatacaaagtaagggtaaggtctct

SEQ ID NO: 782946 - DNA, 25 bp, Mus musculus
tatacaaattctctgccctgagctc

SEQ ID NO: 782947 - DNA, 25 bp, Mus musculus
tatacaaattctgtgccctgagctc

SEQ ID NO: 782948 - DNA, 25 bp, Mus musculus
tatacaacaaccaaatcacaccagc

SEQ ID NO: 782949 - DNA, 25 bp, Mus musculus
tatacaacaacctaatcacaccagc

SEQ ID NO: 782950 - DNA, 25 bp, Mus musculus
tatacaaccaggctcaacaaaacaa

SEQ ID NO: 782951 - DNA, 25 bp, Mus musculus
tatacaaccagggtcaacaaaacaa

SEQ ID NO: 782952 - DNA, 25 bp, Mus musculus
tatacaacccaaaactacatgccca

SEQ ID NO: 782953 - DNA, 25 bp, Mus musculus
tatacaacccaatactacatgccca

SEQ ID NO: 782954 - DNA, 25 bp, Mus musculus
tatacaacgcctcactgagagccat

SEQ ID NO: 782955 - DNA, 25 bp, Mus musculus
tatacaacgcctgactgagagccat

SEQ ID NO: 782956 - DNA, 25 bp, Mus musculus
tatacaacgtgtagacggttccctg

SEQ ID NO: 782957 - DNA, 25 bp, Mus musculus
tatacaacgtgttgacggttccctg

SEQ ID NO: 782958 - DNA, 25 bp, Mus musculus
tatacaactcatcgttcacaaggga

SEQ ID NO: 782959 - DNA, 25 bp, Mus musculus
tatacaactcatggttcacaaggga

SEQ ID NO: 782960 - DNA, 25 bp, Mus musculus
tatacaacttgtatccttgtcccac

SEQ ID NO: 782961 - DNA, 25 bp, Mus musculus
tatacaacttgtttccttgtcccac

SEQ ID NO: 782962 - DNA, 25 bp, Mus musculus
tatacaacttttcacaaggctctgt

SEQ ID NO: 782963 - DNA, 25 bp, Mus musculus
tatacaacttttgacaaggctctgt

SEQ ID NO: 782964 - DNA, 25 bp, Mus musculus
tatacaagtcacaagctcattactg

SEQ ID NO: 782965 - DNA, 25 bp, Mus musculus
tatacaagtcactagctcattactg

SEQ ID NO: 782966 - DNA, 25 bp, Mus musculus
tatacaataaagacgctgcccaagg

SEQ ID NO: 782967 - DNA, 25 bp, Mus musculus
tatacaataaagtcgctgcccaagg

SEQ ID NO: 782968 - DNA, 25 bp, Mus musculus
tatacaatatgcatttaaggacctt

SEQ ID NO: 782969 - DNA, 25 bp, Mus musculus
tatacaatatgcttttaaggacctt

SEQ ID NO: 782970 - DNA, 25 bp, Mus musculus
tatacaatccctacatgaattatgg

SEQ ID NO: 782971 - DNA, 25 bp, Mus musculus
tatacaatcccttcatgaattatgg

SEQ ID NO: 782972 - DNA, 25 bp, Mus musculus
tatacaatcgggagtcctgcacagc

SEQ ID NO: 782973 - DNA, 25 bp, Mus musculus
tatacaatcgggtgtcctgcacagc

SEQ ID NO: 782974 - DNA, 25 bp, Mus musculus
tatacaatgcttaaggtgcagtgga

SEQ ID NO: 782975 - DNA, 25 bp, Mus musculus
tatacaatgctttaggtgcagtgga

SEQ ID NO: 782976 - DNA, 25 bp, Mus musculus
tatacaattgcccaatatccccaga

SEQ ID NO: 782977 - DNA, 25 bp, Mus musculus
tatacaattgccgaatatccccaga

SEQ ID NO: 782978 - DNA, 25 bp, Mus musculus
tatacacaaaggcagtacggcggat

SEQ ID NO: 782979 - DNA, 25 bp, Mus musculus
tatacacaaagggagtacggcggat

SEQ ID NO: 782980 - DNA, 25 bp, Mus musculus
tatacacaactcagctcagtcaggt

SEQ ID NO: 782981 - DNA, 25 bp, Mus musculus
tatacacaactctgctcagtcaggt

SEQ ID NO: 782982 - DNA, 25 bp, Mus musculus
tatacacacaacaagacttctcgcc

SEQ ID NO: 782983 - DNA, 25 bp, Mus musculus
tatacacacaactagacttctcgcc

SEQ ID NO: 782984 - DNA, 25 bp, Mus musculus
tatacacaggctacccctttaaaga

SEQ ID NO: 782985 - DNA, 25 bp, Mus musculus
tatacacaggcttcccctttaaaga

SEQ ID NO: 782986 - DNA, 25 bp, Mus musculus
tatacacaggtactttgggccaaaa

SEQ ID NO: 782987 - DNA, 25 bp, Mus musculus
tatacacaggtagtttgggccaaaa

SEQ ID NO: 782988 - DNA, 25 bp, Mus musculus
tatacacaggttactggcacagccc

SEQ ID NO: 782989 - DNA, 25 bp, Mus musculus
tatacacaggtttctggcacagccc

SEQ ID NO: 782990 - DNA, 25 bp, Mus musculus
tatacacagttcaccagtcacactg

SEQ ID NO: 782991 - DNA, 25 bp, Mus musculus
tatacacagttctccagtcacactg

SEQ ID NO: 782992 - DNA, 25 bp, Mus musculus
tatacacatcagattcccttcctat

SEQ ID NO: 782993 - DNA, 25 bp, Mus musculus
tatacacatcagtttcccttcctat

SEQ ID NO: 782994 - DNA, 25 bp, Mus musculus
tatacacatgctatgctgtgtggct

SEQ ID NO: 782995 - DNA, 25 bp, Mus musculus
tatacacatgctttgctgtgtggct

SEQ ID NO: 782996 - DNA, 25 bp, Mus musculus
tatacacatgtaaactccacacgcg

SEQ ID NO: 782997 - DNA, 25 bp, Mus musculus
tatacacatgtatactccacacgcg

SEQ ID NO: 782998 - DNA, 25 bp, Mus musculus
tatacaccctgtctaatttaatctt

SEQ ID NO: 782999 - DNA, 25 bp, Mus musculus
tatacaccctgtgtaatttaatctt

SEQ ID NO: 783000 - DNA, 25 bp, Mus musculus
tatacaccttctattagcctacata

SEQ ID NO: 783001 - DNA, 25 bp, Mus musculus
tatacaccttcttttagcctacata

SEQ ID NO: 783002 - DNA, 25 bp, Mus musculus
tatacacctttactctgacggcaga

SEQ ID NO: 783003 - DNA, 25 bp, Mus musculus
tatacacctttagtctgacggcaga

SEQ ID NO: 783004 - DNA, 25 bp, Mus musculus
tatacacgaaccatcttgtttccca

SEQ ID NO: 783005 - DNA, 25 bp, Mus musculus
tatacacgaaccttcttgtttccca

SEQ ID NO: 783006 - DNA, 25 bp, Mus musculus
tatacacgtatgaaccccaggactt

SEQ ID NO: 783007 - DNA, 25 bp, Mus musculus
tatacacgtatgtaccccaggactt

SEQ ID NO: 783008 - DNA, 25 bp, Mus musculus
tatacacgtgtgcacttgacaagat

SEQ ID NO: 783009 - DNA, 25 bp, Mus musculus
tatacacgtgtggacttgacaagat

SEQ ID NO: 783010 - DNA, 25 bp, Mus musculus
tatacactagtaatcctctgcatat

SEQ ID NO: 783011 - DNA, 25 bp, Mus musculus
tatacactagtattcctctgcatat

SEQ ID NO: 783012 - DNA, 25 bp, Mus musculus
tatacactcaatccttgggccacag

SEQ ID NO: 783013 - DNA, 25 bp, Mus musculus
tatacactcaatgcttgggccacag

SEQ ID NO: 783014 - DNA, 25 bp, Mus musculus
tatacactgcttaggaacacctcac

SEQ ID NO: 783015 - DNA, 25 bp, Mus musculus
tatacactgctttggaacacctcac

SEQ ID NO: 783016 - DNA, 25 bp, Mus musculus
tatacactgtacatattgactgccc

SEQ ID NO: 783017 - DNA, 25 bp, Mus musculus
tatacactgtacttattgactgccc

SEQ ID NO: 783018 - DNA, 25 bp, Mus musculus
tatacacttagtattcccacttctg

SEQ ID NO: 783019 - DNA, 25 bp, Mus musculus
tatacacttagttttcccacttctg

SEQ ID NO: 783020 - DNA, 25 bp, Mus musculus
tatacacttcatccacacatacagt

SEQ ID NO: 783021 - DNA, 25 bp, Mus musculus
tatacacttcatgcacacatacagt

SEQ ID NO: 783022 - DNA, 25 bp, Mus musculus
tatacacttctgacatatgttcgtt

SEQ ID NO: 783023 - DNA, 25 bp, Mus musculus
tatacacttctgtcatatgttcgtt

SEQ ID NO: 783024 - DNA, 25 bp, Mus musculus
tatacagaactacagctccaggcgg

SEQ ID NO: 783025 - DNA, 25 bp, Mus musculus
tatacagaactagagctccaggcgg

SEQ ID NO: 783026 - DNA, 25 bp, Mus musculus
tatacagaggagcactgcctggcct

SEQ ID NO: 783027 - DNA, 25 bp, Mus musculus
tatacagaggaggactgcctggcct

SEQ ID NO: 783028 - DNA, 25 bp, Mus musculus
tatacagatgacaggatcccatggt

SEQ ID NO: 783029 - DNA, 25 bp, Mus musculus
tatacagatgactggatcccatggt

SEQ ID NO: 783030 - DNA, 25 bp, Mus musculus
tatacagatgagacccacagtctct

SEQ ID NO: 783031 - DNA, 25 bp, Mus musculus
tatacagatgagtcccacagtctct

SEQ ID NO: 783032 - DNA, 25 bp, Mus musculus
tatacagattgtcagctccaacttg

SEQ ID NO: 783033 - DNA, 25 bp, Mus musculus
tatacagattgtgagctccaacttg

SEQ ID NO: 783034 - DNA, 25 bp, Mus musculus
tatacagcagcacaggcaatcacaa

SEQ ID NO: 783035 - DNA, 25 bp, Mus musculus
tatacagcagcactgtccaacgggc

SEQ ID NO: 783036 - DNA, 25 bp, Mus musculus
tatacagcagcagaggcaatcacaa

SEQ ID NO: 783037 - DNA, 25 bp, Mus musculus
tatacagcagcagtgtccaacgggc

SEQ ID NO: 783038 - DNA, 25 bp, Mus musculus
tatacagcagctatccatagggttg

SEQ ID NO: 783039 - DNA, 25 bp, Mus musculus
tatacagcagctttccatagggttg

SEQ ID NO: 783040 - DNA, 25 bp, Mus musculus
tatacagcagttccatttagccctt

SEQ ID NO: 783041 - DNA, 25 bp, Mus musculus
tatacagcagttgcatttagccctt

SEQ ID NO: 783042 - DNA, 25 bp, Mus musculus
tatacagccacgaccctctatgtgt

SEQ ID NO: 783043 - DNA, 25 bp, Mus musculus
tatacagccacgtccctctatgtgt

SEQ ID NO: 783044 - DNA, 25 bp, Mus musculus
tatacagcctccattttaaccacta

SEQ ID NO: 783045 - DNA, 25 bp, Mus musculus
tatacagcctcctttttaaccacta

SEQ ID NO: 783046 - DNA, 25 bp, Mus musculus
tatacagcgggccagctcacacatg

SEQ ID NO: 783047 - DNA, 25 bp, Mus musculus
tatacagcgggcgagctcacacatg

SEQ ID NO: 783048 - DNA, 25 bp, Mus musculus
tatacagctgtacctcgaggcaaca

SEQ ID NO: 783049 - DNA, 25 bp, Mus musculus
tatacagctgtagctcgaggcaaca

SEQ ID NO: 783050 - DNA, 25 bp, Mus musculus
tatacagcttatactggtaaccaca

SEQ ID NO: 783051 - DNA, 25 bp, Mus musculus
tatacagcttattctggtaaccaca

SEQ ID NO: 783052 - DNA, 25 bp, Mus musculus
tatacaggatatcctagtccccgtg

SEQ ID NO: 783053 - DNA, 25 bp, Mus musculus
tatacaggatatgctagtccccgtg

SEQ ID NO: 783054 - DNA, 25 bp, Mus musculus
tatacaggcagtacccagggagggc

SEQ ID NO: 783055 - DNA, 25 bp, Mus musculus
tatacaggcagttcccagggagggc

SEQ ID NO: 783056 - DNA, 25 bp, Mus musculus
tatacaggctgcacacgtgaaattt

SEQ ID NO: 783057 - DNA, 25 bp, Mus musculus
tatacaggctgctcacgtgaaattt

SEQ ID NO: 783058 - DNA, 25 bp, Mus musculus
tatacagggtctcttttccttaccg

SEQ ID NO: 783059 - DNA, 25 bp, Mus musculus
tatacagggtctgttttccttaccg

SEQ ID NO: 783060 - DNA, 25 bp, Mus musculus
tatacaggtcaaccaaccgtttcca

SEQ ID NO: 783061 - DNA, 25 bp, Mus musculus
tatacaggtcaagcaaccgtttcca

SEQ ID NO: 783062 - DNA, 25 bp, Mus musculus
tatacaggttgtctggtatcccaag

SEQ ID NO: 783063 - DNA, 25 bp, Mus musculus
tatacaggttgtgtggtatcccaag

SEQ ID NO: 783064 - DNA, 25 bp, Mus musculus
tatacagtaatgagccacgtgatgt

SEQ ID NO: 783065 - DNA, 25 bp, Mus musculus
tatacagtaatgtgccacgtgatgt

SEQ ID NO: 783066 - DNA, 25 bp, Mus musculus
tatacagtcttgctggtctgatcca

SEQ ID NO: 783067 - DNA, 25 bp, Mus musculus
tatacagtcttggtggtctgatcca

SEQ ID NO: 783068 - DNA, 25 bp, Mus musculus
tatacagtgacacgcagttcccatc

SEQ ID NO: 783069 - DNA, 25 bp, Mus musculus
tatacagtgacaggcagttcccatc

SEQ ID NO: 783070 - DNA, 25 bp, Mus musculus
tatacagtggctccaagacttgccc

SEQ ID NO: 783071 - DNA, 25 bp, Mus musculus
tatacagtggctgcaagacttgccc

SEQ ID NO: 783072 - DNA, 25 bp, Mus musculus
tatacagttccaccctgtttactaa

SEQ ID NO: 783073 - DNA, 25 bp, Mus musculus
tatacagttccagcctgtttactaa

SEQ ID NO: 783074 - DNA, 25 bp, Mus musculus
tatacagttttaaggcctcttttgg

SEQ ID NO: 783075 - DNA, 25 bp, Mus musculus
tatacagttttatggcctcttttgg

SEQ ID NO: 783076 - DNA, 25 bp, Mus musculus
tatacataccacatcctttagagcc

SEQ ID NO: 783077 - DNA, 25 bp, Mus musculus
tatacataccacttcctttagagcc

SEQ ID NO: 783078 - DNA, 25 bp, Mus musculus
tatacatacgaacatgatgcatgca

SEQ ID NO: 783079 - DNA, 25 bp, Mus musculus
tatacatacgaagatgatgcatgca

SEQ ID NO: 783080 - DNA, 25 bp, Mus musculus
tatacatactggcttgctttttctg

SEQ ID NO: 783081 - DNA, 25 bp, Mus musculus
tatacatactgggttgctttttctg

SEQ ID NO: 783082 - DNA, 25 bp, Mus musculus
tatacatatctacacaaccacacac

SEQ ID NO: 783083 - DNA, 25 bp, Mus musculus
tatacatatctagacaaccacacac

SEQ ID NO: 783084 - DNA, 25 bp, Mus musculus
tatacatcagtaatgggttgggcat

SEQ ID NO: 783085 - DNA, 25 bp, Mus musculus
tatacatcagtattgggttgggcat

SEQ ID NO: 783086 - DNA, 25 bp, Mus musculus
tatacatcagtgaagccacccctct

SEQ ID NO: 783087 - DNA, 25 bp, Mus musculus
tatacatcagtgtagccacccctct

SEQ ID NO: 783088 - DNA, 25 bp, Mus musculus
tatacatcccttcagccctagaaat

SEQ ID NO: 783089 - DNA, 25 bp, Mus musculus
tatacatcccttgagccctagaaat

SEQ ID NO: 783090 - DNA, 25 bp, Mus musculus
tatacatccgccaatgaccgtgcgt

SEQ ID NO: 783091 - DNA, 25 bp, Mus musculus
tatacatccgcctatgaccgtgcgt

SEQ ID NO: 783092 - DNA, 25 bp, Mus musculus
tatacatccggtcctttcaggatag

SEQ ID NO: 783093 - DNA, 25 bp, Mus musculus
tatacatccggtgctttcaggatag

SEQ ID NO: 783094 - DNA, 25 bp, Mus musculus
tatacatcctacacatccagagact

SEQ ID NO: 783095 - DNA, 25 bp, Mus musculus
tatacatcctactcatccagagact

SEQ ID NO: 783096 - DNA, 25 bp, Mus musculus
tatacatcctgaaagcactcacctc

SEQ ID NO: 783097 - DNA, 25 bp, Mus musculus
tatacatcctgatagcactcacctc

SEQ ID NO: 783098 - DNA, 25 bp, Mus musculus
tatacatctcttcgcactgactcga

SEQ ID NO: 783099 - DNA, 25 bp, Mus musculus
tatacatctcttggcactgactcga

SEQ ID NO: 783100 - DNA, 25 bp, Mus musculus
tatacatgataactaagcactcaag

SEQ ID NO: 783101 - DNA, 25 bp, Mus musculus
tatacatgataagtaagcactcaag

SEQ ID NO: 783102 - DNA, 25 bp, Mus musculus
tatacatgcagtcctcattttccac

SEQ ID NO: 783103 - DNA, 25 bp, Mus musculus
tatacatgcagtgctcattttccac

SEQ ID NO: 783104 - DNA, 25 bp, Mus musculus
tatacatgctaaactactgctgtgc

SEQ ID NO: 783105 - DNA, 25 bp, Mus musculus
tatacatgctaatctactgctgtgc

SEQ ID NO: 783106 - DNA, 25 bp, Mus musculus
tatacatggcgaacggattctccgt

SEQ ID NO: 783107 - DNA, 25 bp, Mus musculus
tatacatggcgatcggattctccgt

SEQ ID NO: 783108 - DNA, 25 bp, Mus musculus
tatacatgtccacatttgatttttg

SEQ ID NO: 783109 - DNA, 25 bp, Mus musculus
tatacatgtccagatttgatttttg

SEQ ID NO: 783110 - DNA, 25 bp, Mus musculus
tatacatgtgtcagacgttggtcac

SEQ ID NO: 783111 - DNA, 25 bp, Mus musculus
tatacatgtgtctgacgttggtcac

SEQ ID NO: 783112 - DNA, 25 bp, Mus musculus
tatacatgtttaattggccatatat

SEQ ID NO: 783113 - DNA, 25 bp, Mus musculus
tatacatgtttatttggccatatat

SEQ ID NO: 783114 - DNA, 25 bp, Mus musculus
tatacattagtcatccttactttcc

SEQ ID NO: 783115 - DNA, 25 bp, Mus musculus
tatacattagtcttccttactttcc

SEQ ID NO: 783116 - DNA, 25 bp, Mus musculus
tatacattcattagcagtccccttg

SEQ ID NO: 783117 - DNA, 25 bp, Mus musculus
tatacattcatttgcagtccccttg

SEQ ID NO: 783118 - DNA, 25 bp, Mus musculus
tatacattcccgattgttgaatatt

SEQ ID NO: 783119 - DNA, 25 bp, Mus musculus
tatacattcccgtttgttgaatatt

SEQ ID NO: 783120 - DNA, 25 bp, Mus musculus
tatacattctcgactcttcataagg

SEQ ID NO: 783121 - DNA, 25 bp, Mus musculus
tatacattctcgtctcttcataagg

SEQ ID NO: 783122 - DNA, 25 bp, Mus musculus
tatacatttcccagcctgcaaggaa

SEQ ID NO: 783123 - DNA, 25 bp, Mus musculus
tatacatttccctgcctgcaaggaa

SEQ ID NO: 783124 - DNA, 25 bp, Mus musculus
tatacatttctccaaggcggtacat

SEQ ID NO: 783125 - DNA, 25 bp, Mus musculus
tatacatttctcgaaggcggtacat

SEQ ID NO: 783126 - DNA, 25 bp, Mus musculus
tatacatttgtactacttccccatc

SEQ ID NO: 783127 - DNA, 25 bp, Mus musculus
tatacatttgtagtacttccccatc

SEQ ID NO: 783128 - DNA, 25 bp, Mus musculus
tatacatttgttcaacagcgcccct

SEQ ID NO: 783129 - DNA, 25 bp, Mus musculus
tatacatttgttgaacagcgcccct

SEQ ID NO: 783130 - DNA, 25 bp, Mus musculus
tatacattttcccaaactacctcat

SEQ ID NO: 783131 - DNA, 25 bp, Mus musculus
tatacattttccgaaactacctcat

SEQ ID NO: 783132 - DNA, 25 bp, Mus musculus
tataccaatctcatgctgcattaca

SEQ ID NO: 783133 - DNA, 25 bp, Mus musculus
tataccaatctcttgctgcattaca

SEQ ID NO: 783134 - DNA, 25 bp, Mus musculus
tataccaccataccctcgttgtgta

SEQ ID NO: 783135 - DNA, 25 bp, Mus musculus
tataccaccatagcctcgttgtgta

SEQ ID NO: 783136 - DNA, 25 bp, Mus musculus
tataccaccatgcattctcttctgg

SEQ ID NO: 783137 - DNA, 25 bp, Mus musculus
tataccaccatggattctcttctgg

SEQ ID NO: 783138 - DNA, 25 bp, Mus musculus
tataccacccacacgttatccattg

SEQ ID NO: 783139 - DNA, 25 bp, Mus musculus
tataccacccactcgttatccattg

SEQ ID NO: 783140 - DNA, 25 bp, Mus musculus
tataccaccgttaagcgtagtcccg

SEQ ID NO: 783141 - DNA, 25 bp, Mus musculus
tataccaccgtttagcgtagtcccg

SEQ ID NO: 783142 - DNA, 25 bp, Mus musculus
tataccactcttctcatttcttcct

SEQ ID NO: 783143 - DNA, 25 bp, Mus musculus
tataccactcttgtcatttcttcct

SEQ ID NO: 783144 - DNA, 25 bp, Mus musculus
tataccacttctcaaatatgcaccc

SEQ ID NO: 783145 - DNA, 25 bp, Mus musculus
tataccacttctgaaatatgcaccc

SEQ ID NO: 783146 - DNA, 25 bp, Mus musculus
tataccagagatccctgaggctgct

SEQ ID NO: 783147 - DNA, 25 bp, Mus musculus
tataccagagatgcctgaggctgct

SEQ ID NO: 783148 - DNA, 25 bp, Mus musculus
tataccagaggacatccaactatgt

SEQ ID NO: 783149 - DNA, 25 bp, Mus musculus
tataccagaggagatccaactatgt

SEQ ID NO: 783150 - DNA, 25 bp, Mus musculus
tataccagatttaccactgatgtac

SEQ ID NO: 783151 - DNA, 25 bp, Mus musculus
tataccagattttccactgatgtac

SEQ ID NO: 783152 - DNA, 25 bp, Mus musculus
tataccagccttaatctgtggtgga

SEQ ID NO: 783153 - DNA, 25 bp, Mus musculus
tataccagcctttatctgtggtgga

SEQ ID NO: 783154 - DNA, 25 bp, Mus musculus
tataccagtgacaatactaaggaaa

SEQ ID NO: 783155 - DNA, 25 bp, Mus musculus
tataccagtgactatactaaggaaa

SEQ ID NO: 783156 - DNA, 25 bp, Mus musculus
tataccagttgccttttatcccaaa

SEQ ID NO: 783157 - DNA, 25 bp, Mus musculus
tataccagttgcgttttatcccaaa

SEQ ID NO: 783158 - DNA, 25 bp, Mus musculus
tataccagttttcttcatcacgatg

SEQ ID NO: 783159 - DNA, 25 bp, Mus musculus
tataccagttttgttcatcacgatg

SEQ ID NO: 783160 - DNA, 25 bp, Mus musculus
tataccatccttattgccatttttg

SEQ ID NO: 783161 - DNA, 25 bp, Mus musculus
tataccatcctttttgccatttttg

SEQ ID NO: 783162 - DNA, 25 bp, Mus musculus
tataccatctcactgcaatgcagaa

SEQ ID NO: 783163 - DNA, 25 bp, Mus musculus
tataccatctcagtgcaatgcagaa

SEQ ID NO: 783164 - DNA, 25 bp, Mus musculus
tataccatggcaagtcacagcccta

SEQ ID NO: 783165 - DNA, 25 bp, Mus musculus
tataccatggcatgtcacagcccta

SEQ ID NO: 783166 - DNA, 25 bp, Mus musculus
tataccatgtggagctttctcagaa

SEQ ID NO: 783167 - DNA, 25 bp, Mus musculus
tataccatgtggtgctttctcagaa

SEQ ID NO: 783168 - DNA, 25 bp, Mus musculus
tataccatgttcactgcttaatttg

SEQ ID NO: 783169 - DNA, 25 bp, Mus musculus
tataccatgttctctgcttaatttg

SEQ ID NO: 783170 - DNA, 25 bp, Mus musculus
tataccattaacacagttgattgac

SEQ ID NO: 783171 - DNA, 25 bp, Mus musculus
tataccattaactcagttgattgac

SEQ ID NO: 783172 - DNA, 25 bp, Mus musculus
tataccattcttagctgaatgacat

SEQ ID NO: 783173 - DNA, 25 bp, Mus musculus
tataccattcttccatgcctggaag

SEQ ID NO: 783174 - DNA, 25 bp, Mus musculus
tataccattcttgcatgcctggaag

SEQ ID NO: 783175 - DNA, 25 bp, Mus musculus
tataccattctttgctgaatgacat

SEQ ID NO: 783176 - DNA, 25 bp, Mus musculus
tatacccaacccagtgaattccgtt

SEQ ID NO: 783177 - DNA, 25 bp, Mus musculus
tatacccaaccctgtgaattccgtt

SEQ ID NO: 783178 - DNA, 25 bp, Mus musculus
tatacccagataactcataccttgg

SEQ ID NO: 783179 - DNA, 25 bp, Mus musculus
tatacccagatatctcataccttgg

SEQ ID NO: 783180 - DNA, 25 bp, Mus musculus
tatacccagttgactgctagctccc

SEQ ID NO: 783181 - DNA, 25 bp, Mus musculus
tatacccagttgtctgctagctccc

SEQ ID NO: 783182 - DNA, 25 bp, Mus musculus
tatacccatctccttgtggacaaat

SEQ ID NO: 783183 - DNA, 25 bp, Mus musculus
tatacccatctcgttgtggacaaat

SEQ ID NO: 783184 - DNA, 25 bp, Mus musculus
tataccccaagtacccgagaggaag

SEQ ID NO: 783185 - DNA, 25 bp, Mus musculus
tataccccaagttcccgagaggaag

SEQ ID NO: 783186 - DNA, 25 bp, Mus musculus
tataccccacaacgttgcagcaggg

SEQ ID NO: 783187 - DNA, 25 bp, Mus musculus
tataccccacaaggttgcagcaggg

SEQ ID NO: 783188 - DNA, 25 bp, Mus musculus
tatacccctcaaagcgtgctttaaa

SEQ ID NO: 783189 - DNA, 25 bp, Mus musculus
tatacccctcaatgcgtgctttaaa

SEQ ID NO: 783190 - DNA, 25 bp, Mus musculus
tatacccggaagatagcagctacaa

SEQ ID NO: 783191 - DNA, 25 bp, Mus musculus
tatacccggaagttagcagctacaa

SEQ ID NO: 783192 - DNA, 25 bp, Mus musculus
tatacccgtgaactctcaccaacat

SEQ ID NO: 783193 - DNA, 25 bp, Mus musculus
tatacccgtgaagtctcaccaacat

SEQ ID NO: 783194 - DNA, 25 bp, Mus musculus
tataccctaagcaatgtcgtcatcg

SEQ ID NO: 783195 - DNA, 25 bp, Mus musculus
tataccctaagcatttttcctcaag

SEQ ID NO: 783196 - DNA, 25 bp, Mus musculus
tataccctaagctatgtcgtcatcg

SEQ ID NO: 783197 - DNA, 25 bp, Mus musculus
tataccctaagcttttttcctcaag

SEQ ID NO: 783198 - DNA, 25 bp, Mus musculus
tataccctatttcaaagatctgttg

SEQ ID NO: 783199 - DNA, 25 bp, Mus musculus
tataccctatttgaaagatctgttg

SEQ ID NO: 783200 - DNA, 25 bp, Mus musculus
tataccctccccatttttaggatga

SEQ ID NO: 783201 - DNA, 25 bp, Mus musculus
tataccctccccttttttaggatga

SEQ ID NO: 783202 - DNA, 25 bp, Mus musculus
tataccctctacctcggaaggagca

SEQ ID NO: 783203 - DNA, 25 bp, Mus musculus
tataccctctacgtcggaaggagca

SEQ ID NO: 783204 - DNA, 25 bp, Mus musculus
tataccctgatgacctgcgaaatgc

SEQ ID NO: 783205 - DNA, 25 bp, Mus musculus
tataccctgatgtcctgcgaaatgc

SEQ ID NO: 783206 - DNA, 25 bp, Mus musculus
tataccctggcaatcagagtcactc

SEQ ID NO: 783207 - DNA, 25 bp, Mus musculus
tataccctggcattcagagtcactc

SEQ ID NO: 783208 - DNA, 25 bp, Mus musculus
tataccctggctaccctaattaaag

SEQ ID NO: 783209 - DNA, 25 bp, Mus musculus
tataccctggcttccctaattaaag

SEQ ID NO: 783210 - DNA, 25 bp, Mus musculus
tataccctgggacggcactcaccaa

SEQ ID NO: 783211 - DNA, 25 bp, Mus musculus
tataccctgggagggcactcaccaa

SEQ ID NO: 783212 - DNA, 25 bp, Mus musculus
tatacccttgtgaaactcagaatca

SEQ ID NO: 783213 - DNA, 25 bp, Mus musculus
tatacccttgtgtaactcagaatca

SEQ ID NO: 783214 - DNA, 25 bp, Mus musculus
tatacccttttaccacagtcagttt

SEQ ID NO: 783215 - DNA, 25 bp, Mus musculus
tatacccttttagcacagtcagttt

SEQ ID NO: 783216 - DNA, 25 bp, Mus musculus
tataccgcatgcatgcaggagcctg

SEQ ID NO: 783217 - DNA, 25 bp, Mus musculus
tataccgcatgcttgcaggagcctg

SEQ ID NO: 783218 - DNA, 25 bp, Mus musculus
tataccgtcaagatcagtggctcgc

SEQ ID NO: 783219 - DNA, 25 bp, Mus musculus
tataccgtcaagttcagtggctcgc

SEQ ID NO: 783220 - DNA, 25 bp, Mus musculus
tatacctaaatgagtgtgtattctg

SEQ ID NO: 783221 - DNA, 25 bp, Mus musculus
tatacctaaatgtgtgtgtattctg

SEQ ID NO: 783222 - DNA, 25 bp, Mus musculus
tatacctaccccacaagacagatgg

SEQ ID NO: 783223 - DNA, 25 bp, Mus musculus
tatacctacccctcaagacagatgg

SEQ ID NO: 783224 - DNA, 25 bp, Mus musculus
tatacctagagaaacattccccttc

SEQ ID NO: 783225 - DNA, 25 bp, Mus musculus
tatacctagagatacattccccttc

SEQ ID NO: 783226 - DNA, 25 bp, Mus musculus
tatacctatgatattttctgggcac

SEQ ID NO: 783227 - DNA, 25 bp, Mus musculus
tatacctatgattttttctgggcac

SEQ ID NO: 783228 - DNA, 25 bp, Mus musculus
tatacctatttaactctttcttaag

SEQ ID NO: 783229 - DNA, 25 bp, Mus musculus
tatacctatttatctctttcttaag

SEQ ID NO: 783230 - DNA, 25 bp, Mus musculus
tatacctcaagcatccaacatctag

SEQ ID NO: 783231 - DNA, 25 bp, Mus musculus
tatacctcaagcttccaacatctag

SEQ ID NO: 783232 - DNA, 25 bp, Mus musculus
tatacctcaataagtcctctagctc

SEQ ID NO: 783233 - DNA, 25 bp, Mus musculus
tatacctcaatatgtcctctagctc

SEQ ID NO: 783234 - DNA, 25 bp, Mus musculus
tatacctcagcaccatggagcgcag

SEQ ID NO: 783235 - DNA, 25 bp, Mus musculus
tatacctcagcagcatggagcgcag

SEQ ID NO: 783236 - DNA, 25 bp, Mus musculus
tatacctcagtacgttacccttcca

SEQ ID NO: 783237 - DNA, 25 bp, Mus musculus
tatacctcagtaggttacccttcca

SEQ ID NO: 783238 - DNA, 25 bp, Mus musculus
tatacctcctcgcagatgtttctcg

SEQ ID NO: 783239 - DNA, 25 bp, Mus musculus
tatacctcctcggagatgtttctcg

SEQ ID NO: 783240 - DNA, 25 bp, Mus musculus
tatacctcgtgccttctatttaaac

SEQ ID NO: 783241 - DNA, 25 bp, Mus musculus
tatacctcgtgcgttctatttaaac

SEQ ID NO: 783242 - DNA, 25 bp, Mus musculus
tatacctcttggctacagggtgggc

SEQ ID NO: 783243 - DNA, 25 bp, Mus musculus
tatacctcttgggtacagggtgggc

SEQ ID NO: 783244 - DNA, 25 bp, Mus musculus
tatacctgacaactacctctcaagc

SEQ ID NO: 783245 - DNA, 25 bp, Mus musculus
tatacctgacaagtacctctcaagc

SEQ ID NO: 783246 - DNA, 25 bp, Mus musculus
tatacctgagctcatcgaatacgtc

SEQ ID NO: 783247 - DNA, 25 bp, Mus musculus
tatacctgagctgatcgaatacgtc

SEQ ID NO: 783248 - DNA, 25 bp, Mus musculus
tatacctgcaaacgcacctaacctg

SEQ ID NO: 783249 - DNA, 25 bp, Mus musculus
tatacctgcaaaggcacctaacctg

SEQ ID NO: 783250 - DNA, 25 bp, Mus musculus
tatacctgcagaacatcccctgaaa

SEQ ID NO: 783251 - DNA, 25 bp, Mus musculus
tatacctgcagatcatcccctgaaa

SEQ ID NO: 783252 - DNA, 25 bp, Mus musculus
tatacctggtcaccaccaagcaggt

SEQ ID NO: 783253 - DNA, 25 bp, Mus musculus
tatacctggtcagcaccaagcaggt

SEQ ID NO: 783254 - DNA, 25 bp, Mus musculus
tatacctggtcgctctcagactcag

SEQ ID NO: 783255 - DNA, 25 bp, Mus musculus
tatacctggtcggtctcagactcag

SEQ ID NO: 783256 - DNA, 25 bp, Mus musculus
tatacctgtgcgaacactcactgta

SEQ ID NO: 783257 - DNA, 25 bp, Mus musculus
tatacctgtgcgtacactcactgta

SEQ ID NO: 783258 - DNA, 25 bp, Mus musculus
tataccttaatgatgttacttactg

SEQ ID NO: 783259 - DNA, 25 bp, Mus musculus
tataccttaatgttgttacttactg

SEQ ID NO: 783260 - DNA, 25 bp, Mus musculus
tataccttacctctgagtgtgcgct

SEQ ID NO: 783261 - DNA, 25 bp, Mus musculus
tataccttacctgtgagtgtgcgct

SEQ ID NO: 783262 - DNA, 25 bp, Mus musculus
tataccttagtaagaggcctccttc

SEQ ID NO: 783263 - DNA, 25 bp, Mus musculus
tataccttagtatgaggcctccttc

SEQ ID NO: 783264 - DNA, 25 bp, Mus musculus
tataccttgcccacaagcattggag

SEQ ID NO: 783265 - DNA, 25 bp, Mus musculus
tataccttgccctcaagcattggag

SEQ ID NO: 783266 - DNA, 25 bp, Mus musculus
tatacgaacccgcagatgatctcca

SEQ ID NO: 783267 - DNA, 25 bp, Mus musculus
tatacgaacccggagatgatctcca

SEQ ID NO: 783268 - DNA, 25 bp, Mus musculus
tatacgacagccctgtgtgccgact

SEQ ID NO: 783269 - DNA, 25 bp, Mus musculus
tatacgacagccgtgtgtgccgact

SEQ ID NO: 783270 - DNA, 25 bp, Mus musculus
tatacgcaacagacacacagcagct

SEQ ID NO: 783271 - DNA, 25 bp, Mus musculus
tatacgcaacagtcacacagcagct

SEQ ID NO: 783272 - DNA, 25 bp, Mus musculus
tatacgcaatgccttcactagataa

SEQ ID NO: 783273 - DNA, 25 bp, Mus musculus
tatacgcaatgcgttcactagataa

SEQ ID NO: 783274 - DNA, 25 bp, Mus musculus
tatacgccaagcacatcttcctgta

SEQ ID NO: 783275 - DNA, 25 bp, Mus musculus
tatacgccaagctcatcttcctgta

SEQ ID NO: 783276 - DNA, 25 bp, Mus musculus
tatacgcccgtcacaagtatttctg

SEQ ID NO: 783277 - DNA, 25 bp, Mus musculus
tatacgcccgtctcaagtatttctg

SEQ ID NO: 783278 - DNA, 25 bp, Mus musculus
tatacgcctcttcccatcatgaata

SEQ ID NO: 783279 - DNA, 25 bp, Mus musculus
tatacgcctcttgccatcatgaata

SEQ ID NO: 783280 - DNA, 25 bp, Mus musculus
tatacgcgaaatcccagtactggtg

SEQ ID NO: 783281 - DNA, 25 bp, Mus musculus
tatacgcgaaatgccagtactggtg

SEQ ID NO: 783282 - DNA, 25 bp, Mus musculus
tatacgcttactaatgaattaccat

SEQ ID NO: 783283 - DNA, 25 bp, Mus musculus
tatacgcttacttatgaattaccat

SEQ ID NO: 783284 - DNA, 25 bp, Mus musculus
tatacggatttccgatttctaccca

SEQ ID NO: 783285 - DNA, 25 bp, Mus musculus
tatacggatttcggatttctaccca

SEQ ID NO: 783286 - DNA, 25 bp, Mus musculus
tatacggcccaaactagagactctg

SEQ ID NO: 783287 - DNA, 25 bp, Mus musculus
tatacggcccaatctagagactctg

SEQ ID NO: 783288 - DNA, 25 bp, Mus musculus
tatacggcgtagagacaccattatg

SEQ ID NO: 783289 - DNA, 25 bp, Mus musculus
tatacggcgtagtgacaccattatg

SEQ ID NO: 783290 - DNA, 25 bp, Mus musculus
tatacggctacaatgtattatgcag

SEQ ID NO: 783291 - DNA, 25 bp, Mus musculus
tatacggctacattgtattatgcag

SEQ ID NO: 783292 - DNA, 25 bp, Mus musculus
tatacgggaaccaatatttgctcaa

SEQ ID NO: 783293 - DNA, 25 bp, Mus musculus
tatacgggaacctatatttgctcaa

SEQ ID NO: 783294 - DNA, 25 bp, Mus musculus
tatacgggaccaaatctattggaaa

SEQ ID NO: 783295 - DNA, 25 bp, Mus musculus
tatacgggaccatatctattggaaa

SEQ ID NO: 783296 - DNA, 25 bp, Mus musculus
tatacgggtagtcgctgacgtcttt

SEQ ID NO: 783297 - DNA, 25 bp, Mus musculus
tatacgggtagtggctgacgtcttt

SEQ ID NO: 783298 - DNA, 25 bp, Mus musculus
tatacggtacttatttaatagccct

SEQ ID NO: 783299 - DNA, 25 bp, Mus musculus
tatacggtacttttttaatagccct

SEQ ID NO: 783300 - DNA, 25 bp, Mus musculus
tatacggtgtgtctggctttccaga

SEQ ID NO: 783301 - DNA, 25 bp, Mus musculus
tatacggtgtgtgtggctttccaga

SEQ ID NO: 783302 - DNA, 25 bp, Mus musculus
tatacggtttgtcacgtggctctgt

SEQ ID NO: 783303 - DNA, 25 bp, Mus musculus
tatacggtttgtgacgtggctctgt

SEQ ID NO: 783304 - DNA, 25 bp, Mus musculus
tatacgtacagcaccaaccatttct

SEQ ID NO: 783305 - DNA, 25 bp, Mus musculus
tatacgtacagctccaaccatttct

SEQ ID NO: 783306 - DNA, 25 bp, Mus musculus
tatacgtcccagaagaaccctcaca

SEQ ID NO: 783307 - DNA, 25 bp, Mus musculus
tatacgtcccagtagaaccctcaca

SEQ ID NO: 783308 - DNA, 25 bp, Mus musculus
tatacgtgggcactcttgagattct

SEQ ID NO: 783309 - DNA, 25 bp, Mus musculus
tatacgtgggcagtcttgagattct

SEQ ID NO: 783310 - DNA, 25 bp, Mus musculus
tatacgtgtcaaacctcagtgacta

SEQ ID NO: 783311 - DNA, 25 bp, Mus musculus
tatacgtgtcaatcctcagtgacta

SEQ ID NO: 783312 - DNA, 25 bp, Mus musculus
tatacgtgttataatgaatgcttct

SEQ ID NO: 783313 - DNA, 25 bp, Mus musculus
tatacgtgttattatgaatgcttct

SEQ ID NO: 783314 - DNA, 25 bp, Mus musculus
tatacgttaggcctccctacagagc

SEQ ID NO: 783315 - DNA, 25 bp, Mus musculus
tatacgttaggcgtccctacagagc

SEQ ID NO: 783316 - DNA, 25 bp, Mus musculus
tatacgttcctaattcacatgtttt

SEQ ID NO: 783317 - DNA, 25 bp, Mus musculus
tatacgttcctatttcacatgtttt

SEQ ID NO: 783318 - DNA, 25 bp, Mus musculus
tatacgttctgcactgttcctgttg

SEQ ID NO: 783319 - DNA, 25 bp, Mus musculus
tatacgttctgctctgttcctgttg

SEQ ID NO: 783320 - DNA, 25 bp, Mus musculus
tatactacatggctatgctattgga

SEQ ID NO: 783321 - DNA, 25 bp, Mus musculus
tatactacatgggtatgctattgga

SEQ ID NO: 783322 - DNA, 25 bp, Mus musculus
tatactacctgcaacgctcaccgtt

SEQ ID NO: 783323 - DNA, 25 bp, Mus musculus
tatactacctgctacgctcaccgtt

SEQ ID NO: 783324 - DNA, 25 bp, Mus musculus
tatactactaacactcgggcttttt

SEQ ID NO: 783325 - DNA, 25 bp, Mus musculus
tatactactaactctcgggcttttt

SEQ ID NO: 783326 - DNA, 25 bp, Mus musculus
tatactactataatcctaacacttg

SEQ ID NO: 783327 - DNA, 25 bp, Mus musculus
tatactactatattcctaacacttg

SEQ ID NO: 783328 - DNA, 25 bp, Mus musculus
tatactagaactccatcttggtttc

SEQ ID NO: 783329 - DNA, 25 bp, Mus musculus
tatactagaactgcatcttggtttc

SEQ ID NO: 783330 - DNA, 25 bp, Mus musculus
tatactagaagcacattcggccact

SEQ ID NO: 783331 - DNA, 25 bp, Mus musculus
tatactagaagctcattcggccact

SEQ ID NO: 783332 - DNA, 25 bp, Mus musculus
tatactagcatcacaaaggcatcta

SEQ ID NO: 783333 - DNA, 25 bp, Mus musculus
tatactagcatctcaaaggcatcta

SEQ ID NO: 783334 - DNA, 25 bp, Mus musculus
tatactagttcaatttgtccctcct

SEQ ID NO: 783335 - DNA, 25 bp, Mus musculus
tatactagttcattttgtccctcct

SEQ ID NO: 783336 - DNA, 25 bp, Mus musculus
tatactatagggacacttgcataaa

SEQ ID NO: 783337 - DNA, 25 bp, Mus musculus
tatactatagggtcacttgcataaa

SEQ ID NO: 783338 - DNA, 25 bp, Mus musculus
tatactatctgtccatttgtcatgt

SEQ ID NO: 783339 - DNA, 25 bp, Mus musculus
tatactatctgtgcatttgtcatgt

SEQ ID NO: 783340 - DNA, 25 bp, Mus musculus
tatactatgaagacacaaatgtgcc

SEQ ID NO: 783341 - DNA, 25 bp, Mus musculus
tatactatgaagtcacaaatgtgcc

SEQ ID NO: 783342 - DNA, 25 bp, Mus musculus
tatactattagcaccaaaccccaag

SEQ ID NO: 783343 - DNA, 25 bp, Mus musculus
tatactattagctccaaaccccaag

SEQ ID NO: 783344 - DNA, 25 bp, Mus musculus
tatactatttctaacctacctcact

SEQ ID NO: 783345 - DNA, 25 bp, Mus musculus
tatactatttcttacctacctcact

SEQ ID NO: 783346 - DNA, 25 bp, Mus musculus
tatactattttaagacacccctcca

SEQ ID NO: 783347 - DNA, 25 bp, Mus musculus
tatactattttatgacacccctcca

SEQ ID NO: 783348 - DNA, 25 bp, Mus musculus
tatactcaagtgactatgaacgtag

SEQ ID NO: 783349 - DNA, 25 bp, Mus musculus
tatactcaagtgtctatgaacgtag

SEQ ID NO: 783350 - DNA, 25 bp, Mus musculus
tatactcaatcacgaactctttttc

SEQ ID NO: 783351 - DNA, 25 bp, Mus musculus
tatactcaatcaggaactctttttc

SEQ ID NO: 783352 - DNA, 25 bp, Mus musculus
tatactcaatgcctcgaaaccctta

SEQ ID NO: 783353 - DNA, 25 bp, Mus musculus
tatactcaatgcgtcgaaaccctta

SEQ ID NO: 783354 - DNA, 25 bp, Mus musculus
tatactcaggatccctctgactcag

SEQ ID NO: 783355 - DNA, 25 bp, Mus musculus
tatactcaggatgcctctgactcag

SEQ ID NO: 783356 - DNA, 25 bp, Mus musculus
tatactcaggcacactgttcagtgt

SEQ ID NO: 783357 - DNA, 25 bp, Mus musculus
tatactcaggcagactgttcagtgt

SEQ ID NO: 783358 - DNA, 25 bp, Mus musculus
tatactcatcgcattaatactgaag

SEQ ID NO: 783359 - DNA, 25 bp, Mus musculus
tatactcatcgctttaatactgaag

SEQ ID NO: 783360 - DNA, 25 bp, Mus musculus
tatactcatgacagcaacactgata

SEQ ID NO: 783361 - DNA, 25 bp, Mus musculus
tatactcatgactgcaacactgata

SEQ ID NO: 783362 - DNA, 25 bp, Mus musculus
tatactcatgccctaccattttaga

SEQ ID NO: 783363 - DNA, 25 bp, Mus musculus
tatactcatgccgtaccattttaga

SEQ ID NO: 783364 - DNA, 25 bp, Mus musculus
tatactccaatgactgtgtaaggta

SEQ ID NO: 783365 - DNA, 25 bp, Mus musculus
tatactccaatgtctgtgtaaggta

SEQ ID NO: 783366 - DNA, 25 bp, Mus musculus
tatactcccaacacccaggacaagt

SEQ ID NO: 783367 - DNA, 25 bp, Mus musculus
tatactcccaactcccaggacaagt

SEQ ID NO: 783368 - DNA, 25 bp, Mus musculus
tatactcccacccagagggtgtagc

SEQ ID NO: 783369 - DNA, 25 bp, Mus musculus
tatactcccaccgagagggtgtagc

SEQ ID NO: 783370 - DNA, 25 bp, Mus musculus
tatactcctactaacccattcttta

SEQ ID NO: 783371 - DNA, 25 bp, Mus musculus
tatactcctacttacccattcttta

SEQ ID NO: 783372 - DNA, 25 bp, Mus musculus
tatactcgactgcatctacaacccg

SEQ ID NO: 783373 - DNA, 25 bp, Mus musculus
tatactcgactggatctacaacccg

SEQ ID NO: 783374 - DNA, 25 bp, Mus musculus
tatactcgggttaatttttggtctg

SEQ ID NO: 783375 - DNA, 25 bp, Mus musculus
tatactcgggtttatttttggtctg

SEQ ID NO: 783376 - DNA, 25 bp, Mus musculus
tatactcgtggccacccaggcttga

SEQ ID NO: 783377 - DNA, 25 bp, Mus musculus
tatactcgtggcgacccaggcttga

SEQ ID NO: 783378 - DNA, 25 bp, Mus musculus
tatactctagtgagacttcctacct

SEQ ID NO: 783379 - DNA, 25 bp, Mus musculus
tatactctagtgtgacttcctacct

SEQ ID NO: 783380 - DNA, 25 bp, Mus musculus
tatactctatttactcttgacaaca

SEQ ID NO: 783381 - DNA, 25 bp, Mus musculus
tatactctattttctcttgacaaca

SEQ ID NO: 783382 - DNA, 25 bp, Mus musculus
tatactctcatcagccacggtagat

SEQ ID NO: 783383 - DNA, 25 bp, Mus musculus
tatactctcatctgccacggtagat

SEQ ID NO: 783384 - DNA, 25 bp, Mus musculus
tatactctgatgagccagcgacttt

SEQ ID NO: 783385 - DNA, 25 bp, Mus musculus
tatactctgatgtgccagcgacttt

SEQ ID NO: 783386 - DNA, 25 bp, Mus musculus
tatactctggagcacaccattttat

SEQ ID NO: 783387 - DNA, 25 bp, Mus musculus
tatactctggagcatcgtgatggtt

SEQ ID NO: 783388 - DNA, 25 bp, Mus musculus
tatactctggaggacaccattttat

SEQ ID NO: 783389 - DNA, 25 bp, Mus musculus
tatactctggaggatcgtgatggtt

SEQ ID NO: 783390 - DNA, 25 bp, Mus musculus
tatactcttctcacatgtataggtg

SEQ ID NO: 783391 - DNA, 25 bp, Mus musculus
tatactcttctctcatgtataggtg

SEQ ID NO: 783392 - DNA, 25 bp, Mus musculus
tatactcttgaaagattgattagca

SEQ ID NO: 783393 - DNA, 25 bp, Mus musculus
tatactcttgaatgattgattagca

SEQ ID NO: 783394 - DNA, 25 bp, Mus musculus
tatactgaaacccaacaagcctctt

SEQ ID NO: 783395 - DNA, 25 bp, Mus musculus
tatactgaaaccgaacaagcctctt

SEQ ID NO: 783396 - DNA, 25 bp, Mus musculus
tatactgaaacgaggcgctatttat

SEQ ID NO: 783397 - DNA, 25 bp, Mus musculus
tatactgaaacgtggcgctatttat

SEQ ID NO: 783398 - DNA, 25 bp, Mus musculus
tatactgacaaccaagctgctttat

SEQ ID NO: 783399 - DNA, 25 bp, Mus musculus
tatactgacaacgaagctgctttat

SEQ ID NO: 783400 - DNA, 25 bp, Mus musculus
tatactgagaaaaccactacctgtg

SEQ ID NO: 783401 - DNA, 25 bp, Mus musculus
tatactgagaaatccactacctgtg

SEQ ID NO: 783402 - DNA, 25 bp, Mus musculus
tatactgattccatagcttgtttgt

SEQ ID NO: 783403 - DNA, 25 bp, Mus musculus
tatactgattccttagcttgtttgt

SEQ ID NO: 783404 - DNA, 25 bp, Mus musculus
tatactgcatgtagagagctcgcca

SEQ ID NO: 783405 - DNA, 25 bp, Mus musculus
tatactgcatgttgagagctcgcca

SEQ ID NO: 783406 - DNA, 25 bp, Mus musculus
tatactgccacaagattgtaaattt

SEQ ID NO: 783407 - DNA, 25 bp, Mus musculus
tatactgccacatgattgtaaattt

SEQ ID NO: 783408 - DNA, 25 bp, Mus musculus
tatactgccaccacttgattgtaag

SEQ ID NO: 783409 - DNA, 25 bp, Mus musculus
tatactgccacctcttgattgtaag

SEQ ID NO: 783410 - DNA, 25 bp, Mus musculus
tatactgcctgtatttgtggcttta

SEQ ID NO: 783411 - DNA, 25 bp, Mus musculus
tatactgcctgtttttgtggcttta

SEQ ID NO: 783412 - DNA, 25 bp, Mus musculus
tatactgcggcactgtgagtgcacc

SEQ ID NO: 783413 - DNA, 25 bp, Mus musculus
tatactgcggcagtgtgagtgcacc

SEQ ID NO: 783414 - DNA, 25 bp, Mus musculus
tatactgctcatcgtagccagcacc

SEQ ID NO: 783415 - DNA, 25 bp, Mus musculus
tatactgctcatggtagccagcacc

SEQ ID NO: 783416 - DNA, 25 bp, Mus musculus
tatactgcttatatctgtggattca

SEQ ID NO: 783417 - DNA, 25 bp, Mus musculus
tatactgcttatttctgtggattca

SEQ ID NO: 783418 - DNA, 25 bp, Mus musculus
tatactggatcaaacctctggtgca

SEQ ID NO: 783419 - DNA, 25 bp, Mus musculus
tatactggatcatacctctggtgca

SEQ ID NO: 783420 - DNA, 25 bp, Mus musculus
tatactggccaaaatcccgacttca

SEQ ID NO: 783421 - DNA, 25 bp, Mus musculus
tatactggccaatatcccgacttca

SEQ ID NO: 783422 - DNA, 25 bp, Mus musculus
tatactgggcaacgcacaactacct

SEQ ID NO: 783423 - DNA, 25 bp, Mus musculus
tatactgggcaaggcacaactacct

SEQ ID NO: 783424 - DNA, 25 bp, Mus musculus
tatactggtctcagggattactctc

SEQ ID NO: 783425 - DNA, 25 bp, Mus musculus
tatactggtctctgggattactctc

SEQ ID NO: 783426 - DNA, 25 bp, Mus musculus
tatactgtccttaccctaaatactt

SEQ ID NO: 783427 - DNA, 25 bp, Mus musculus
tatactgtcctttccctaaatactt

SEQ ID NO: 783428 - DNA, 25 bp, Mus musculus
tatactgtctaaatgttcatcctaa

SEQ ID NO: 783429 - DNA, 25 bp, Mus musculus
tatactgtctaattgttcatcctaa

SEQ ID NO: 783430 - DNA, 25 bp, Mus musculus
tatactgtgaatcatctctctatga

SEQ ID NO: 783431 - DNA, 25 bp, Mus musculus
tatactgtgaatgatctctctatga

SEQ ID NO: 783432 - DNA, 25 bp, Mus musculus
tatactgtgataattttgctgctga

SEQ ID NO: 783433 - DNA, 25 bp, Mus musculus
tatactgtgatatttttgctgctga

SEQ ID NO: 783434 - DNA, 25 bp, Mus musculus
tatactgtgattatagtactactgc

SEQ ID NO: 783435 - DNA, 25 bp, Mus musculus
tatactgtgattttagtactactgc

SEQ ID NO: 783436 - DNA, 25 bp, Mus musculus
tatactgtgtagaactcctgggata

SEQ ID NO: 783437 - DNA, 25 bp, Mus musculus
tatactgtgtagtactcctgggata

SEQ ID NO: 783438 - DNA, 25 bp, Mus musculus
tatactgttaacatgaccctagttg

SEQ ID NO: 783439 - DNA, 25 bp, Mus musculus
tatactgttaacttgaccctagttg

SEQ ID NO: 783440 - DNA, 25 bp, Mus musculus
tatactgttgacctccagggatgtc

SEQ ID NO: 783441 - DNA, 25 bp, Mus musculus
tatactgttgacgtccagggatgtc

SEQ ID NO: 783442 - DNA, 25 bp, Mus musculus
tatactgtttctccaatggtgaggt

SEQ ID NO: 783443 - DNA, 25 bp, Mus musculus
tatactgtttctgcaatggtgaggt

SEQ ID NO: 783444 - DNA, 25 bp, Mus musculus
tatacttaatgcactttaaccaagg

SEQ ID NO: 783445 - DNA, 25 bp, Mus musculus
tatacttaatgctctttaaccaagg

SEQ ID NO: 783446 - DNA, 25 bp, Mus musculus
tatacttacatccagtcagggccca

SEQ ID NO: 783447 - DNA, 25 bp, Mus musculus
tatacttacatccagttttactcag

SEQ ID NO: 783448 - DNA, 25 bp, Mus musculus
tatacttacatcgagtcagggccca

SEQ ID NO: 783449 - DNA, 25 bp, Mus musculus
tatacttacatcgagttttactcag

SEQ ID NO: 783450 - DNA, 25 bp, Mus musculus
tatacttactccactgccaagtaga

SEQ ID NO: 783451 - DNA, 25 bp, Mus musculus
tatacttactcctctgccaagtaga

SEQ ID NO: 783452 - DNA, 25 bp, Mus musculus
tatacttataacatcctaggtaact

SEQ ID NO: 783453 - DNA, 25 bp, Mus musculus
tatacttataacttcctaggtaact

SEQ ID NO: 783454 - DNA, 25 bp, Mus musculus
tatacttatgatccacttgctgcca

SEQ ID NO: 783455 - DNA, 25 bp, Mus musculus
tatacttatgatgcacttgctgcca

SEQ ID NO: 783456 - DNA, 25 bp, Mus musculus
tatacttcacaccacttattctttc

SEQ ID NO: 783457 - DNA, 25 bp, Mus musculus
tatacttcacacgacttattctttc

SEQ ID NO: 783458 - DNA, 25 bp, Mus musculus
tatacttcagaaccgttggagtcca

SEQ ID NO: 783459 - DNA, 25 bp, Mus musculus
tatacttcagaagcgttggagtcca

SEQ ID NO: 783460 - DNA, 25 bp, Mus musculus
tatacttccccaaacctatgtaact

SEQ ID NO: 783461 - DNA, 25 bp, Mus musculus
tatacttccccatacctatgtaact

SEQ ID NO: 783462 - DNA, 25 bp, Mus musculus
tatacttcggtacatctttggcttg

SEQ ID NO: 783463 - DNA, 25 bp, Mus musculus
tatacttcggtagatctttggcttg

SEQ ID NO: 783464 - DNA, 25 bp, Mus musculus
tatacttcgtctccaacttatgtcg

SEQ ID NO: 783465 - DNA, 25 bp, Mus musculus
tatacttcgtctgcaacttatgtcg

SEQ ID NO: 783466 - DNA, 25 bp, Mus musculus
tatacttcgtgtacctggtggtcag

SEQ ID NO: 783467 - DNA, 25 bp, Mus musculus
tatacttcgtgttcctggtggtcag

SEQ ID NO: 783468 - DNA, 25 bp, Mus musculus
tatacttctatacatactgccttat

SEQ ID NO: 783469 - DNA, 25 bp, Mus musculus
tatacttctatagatactgccttat

SEQ ID NO: 783470 - DNA, 25 bp, Mus musculus
tatacttctcaactgtgtttgctgc

SEQ ID NO: 783471 - DNA, 25 bp, Mus musculus
tatacttctcaagtgtgtttgctgc

SEQ ID NO: 783472 - DNA, 25 bp, Mus musculus
tatacttctttgctactttcaccta

SEQ ID NO: 783473 - DNA, 25 bp, Mus musculus
tatacttctttggtactttcaccta

SEQ ID NO: 783474 - DNA, 25 bp, Mus musculus
tatacttgccaacgtggagaacaaa

SEQ ID NO: 783475 - DNA, 25 bp, Mus musculus
tatacttgccaaggtggagaacaaa

SEQ ID NO: 783476 - DNA, 25 bp, Mus musculus
tatactttaaaaacatgttctcccc

SEQ ID NO: 783477 - DNA, 25 bp, Mus musculus
tatactttaaaatcatgttctcccc

SEQ ID NO: 783478 - DNA, 25 bp, Mus musculus
tatactttacacacttaattatgaa

SEQ ID NO: 783479 - DNA, 25 bp, Mus musculus
tatactttacactcttaattatgaa

SEQ ID NO: 783480 - DNA, 25 bp, Mus musculus
tatactttactaatctacatcacaa

SEQ ID NO: 783481 - DNA, 25 bp, Mus musculus
tatactttactattctacatcacaa

SEQ ID NO: 783482 - DNA, 25 bp, Mus musculus
tatactttctgtcgagaacctgcag

SEQ ID NO: 783483 - DNA, 25 bp, Mus musculus
tatactttctgtggagaacctgcag

SEQ ID NO: 783484 - DNA, 25 bp, Mus musculus
tatactttggtcatttgttcattct

SEQ ID NO: 783485 - DNA, 25 bp, Mus musculus
tatactttggtcttttgttcattct

SEQ ID NO: 783486 - DNA, 25 bp, Mus musculus
tatactttgtatagctggccctatg

SEQ ID NO: 783487 - DNA, 25 bp, Mus musculus
tatactttgtattgctggccctatg

SEQ ID NO: 783488 - DNA, 25 bp, Mus musculus
tatactttgtgactgcaatgcattt

SEQ ID NO: 783489 - DNA, 25 bp, Mus musculus
tatactttgtgagtgcaatgcattt

SEQ ID NO: 783490 - DNA, 25 bp, Mus musculus
tatacttttaacatttctggctaga

SEQ ID NO: 783491 - DNA, 25 bp, Mus musculus
tatacttttaacttttctggctaga

SEQ ID NO: 783492 - DNA, 25 bp, Mus musculus
tatacttttaggacccatgtccaca

SEQ ID NO: 783493 - DNA, 25 bp, Mus musculus
tatacttttaggtcccatgtccaca

SEQ ID NO: 783494 - DNA, 25 bp, Mus musculus
tatacttttcttacgctgatgaggg

SEQ ID NO: 783495 - DNA, 25 bp, Mus musculus
tatacttttctttcgctgatgaggg

SEQ ID NO: 783496 - DNA, 25 bp, Mus musculus
tatacttttgagatctctactaaaa

SEQ ID NO: 783497 - DNA, 25 bp, Mus musculus
tatacttttgagttctctactaaaa

SEQ ID NO: 783498 - DNA, 25 bp, Mus musculus
tatacttttggtattttgtgagact

SEQ ID NO: 783499 - DNA, 25 bp, Mus musculus
tatacttttggttttttgtgagact

SEQ ID NO: 783500 - DNA, 25 bp, Mus musculus
tatactttttccatccttatcctaa

SEQ ID NO: 783501 - DNA, 25 bp, Mus musculus
tatactttttcccatctgtgtgtgt

SEQ ID NO: 783502 - DNA, 25 bp, Mus musculus
tatactttttccgatctgtgtgtgt

SEQ ID NO: 783503 - DNA, 25 bp, Mus musculus
tatactttttccttccttatcctaa

SEQ ID NO: 783504 - DNA, 25 bp, Mus musculus
tatactttttgccactggtaccatc

SEQ ID NO: 783505 - DNA, 25 bp, Mus musculus
tatactttttgcgactggtaccatc

SEQ ID NO: 783506 - DNA, 25 bp, Mus musculus
tatagaaaccagatcccatcagcct

SEQ ID NO: 783507 - DNA, 25 bp, Mus musculus
tatagaaaccagttcccatcagcct

SEQ ID NO: 783508 - DNA, 25 bp, Mus musculus
tatagaaaggtccttagtttcttgt

SEQ ID NO: 783509 - DNA, 25 bp, Mus musculus
tatagaaaggtcgttagtttcttgt

SEQ ID NO: 783510 - DNA, 25 bp, Mus musculus
tatagaaatttgattatggaacccg

SEQ ID NO: 783511 - DNA, 25 bp, Mus musculus
tatagaaatttgtttatggaacccg

SEQ ID NO: 783512 - DNA, 25 bp, Mus musculus
tatagaacccaaaatgaagcccaca

SEQ ID NO: 783513 - DNA, 25 bp, Mus musculus
tatagaacccaatatgaagcccaca

SEQ ID NO: 783514 - DNA, 25 bp, Mus musculus
tatagaaccgacacattctctgctt

SEQ ID NO: 783515 - DNA, 25 bp, Mus musculus
tatagaaccgactcattctctgctt

SEQ ID NO: 783516 - DNA, 25 bp, Mus musculus
tatagaacgctaagctctcacttgt

SEQ ID NO: 783517 - DNA, 25 bp, Mus musculus
tatagaacgctatgctctcacttgt

SEQ ID NO: 783518 - DNA, 25 bp, Mus musculus
tatagaactaccacagtaccacaga

SEQ ID NO: 783519 - DNA, 25 bp, Mus musculus
tatagaactacctcagtaccacaga

SEQ ID NO: 783520 - DNA, 25 bp, Mus musculus
tatagaactcccagcgacatcatat

SEQ ID NO: 783521 - DNA, 25 bp, Mus musculus
tatagaactccctgcgacatcatat

SEQ ID NO: 783522 - DNA, 25 bp, Mus musculus
tatagaacttagctcacccagccca

SEQ ID NO: 783523 - DNA, 25 bp, Mus musculus
tatagaacttaggtcacccagccca

SEQ ID NO: 783524 - DNA, 25 bp, Mus musculus
tatagaagaacaacactccctctgc

SEQ ID NO: 783525 - DNA, 25 bp, Mus musculus
tatagaagaacatcactccctctgc

SEQ ID NO: 783526 - DNA, 25 bp, Mus musculus
tatagaagcaatacacccagcccct

SEQ ID NO: 783527 - DNA, 25 bp, Mus musculus
tatagaagcaattcacccagcccct

SEQ ID NO: 783528 - DNA, 25 bp, Mus musculus
tatagaagctttaccctgaccctgt

SEQ ID NO: 783529 - DNA, 25 bp, Mus musculus
tatagaagcttttccctgaccctgt

SEQ ID NO: 783530 - DNA, 25 bp, Mus musculus
tatagaaggatcaccatgctcatgg

SEQ ID NO: 783531 - DNA, 25 bp, Mus musculus
tatagaaggatctccatgctcatgg

SEQ ID NO: 783532 - DNA, 25 bp, Mus musculus
tatagaagtagcacaccttccactg

SEQ ID NO: 783533 - DNA, 25 bp, Mus musculus
tatagaagtagctcaccttccactg

SEQ ID NO: 783534 - DNA, 25 bp, Mus musculus
tatagaagttaaatgtctcctccta

SEQ ID NO: 783535 - DNA, 25 bp, Mus musculus
tatagaagttaattgtctcctccta

SEQ ID NO: 783536 - DNA, 25 bp, Mus musculus
tatagaatattgatgtgtctggcca

SEQ ID NO: 783537 - DNA, 25 bp, Mus musculus
tatagaatattgttgtgtctggcca

SEQ ID NO: 783538 - DNA, 25 bp, Mus musculus
tatagaatcaacaccttccagtctg

SEQ ID NO: 783539 - DNA, 25 bp, Mus musculus
tatagaatcaactccttccagtctg

SEQ ID NO: 783540 - DNA, 25 bp, Mus musculus
tatagaatctgtaacccttggttga

SEQ ID NO: 783541 - DNA, 25 bp, Mus musculus
tatagaatctgttacccttggttga

SEQ ID NO: 783542 - DNA, 25 bp, Mus musculus
tatagaatgcctcgcaggcctttct

SEQ ID NO: 783543 - DNA, 25 bp, Mus musculus
tatagaatgcctggcaggcctttct

SEQ ID NO: 783544 - DNA, 25 bp, Mus musculus
tatagaatttggaacctctcaggtt

SEQ ID NO: 783545 - DNA, 25 bp, Mus musculus
tatagaatttggtacctctcaggtt

SEQ ID NO: 783546 - DNA, 25 bp, Mus musculus
tatagacaaggcagtcattgagttt

SEQ ID NO: 783547 - DNA, 25 bp, Mus musculus
tatagacaaggctgtcattgagttt

SEQ ID NO: 783548 - DNA, 25 bp, Mus musculus
tatagacacatactaatactggttt

SEQ ID NO: 783549 - DNA, 25 bp, Mus musculus
tatagacacatagtaatactggttt

SEQ ID NO: 783550 - DNA, 25 bp, Mus musculus
tatagacaccacactgaccttggta

SEQ ID NO: 783551 - DNA, 25 bp, Mus musculus
tatagacaccactctgaccttggta

SEQ ID NO: 783552 - DNA, 25 bp, Mus musculus
tatagacacccacagcttgatgcag

SEQ ID NO: 783553 - DNA, 25 bp, Mus musculus
tatagacacccagagcttgatgcag

SEQ ID NO: 783554 - DNA, 25 bp, Mus musculus
tatagacacggaatacccaccagca

SEQ ID NO: 783555 - DNA, 25 bp, Mus musculus
tatagacacggattacccaccagca

SEQ ID NO: 783556 - DNA, 25 bp, Mus musculus
tatagacagatacttccagcccagc

SEQ ID NO: 783557 - DNA, 25 bp, Mus musculus
tatagacagatagttccagcccagc

SEQ ID NO: 783558 - DNA, 25 bp, Mus musculus
tatagacagattccaggtccctggt

SEQ ID NO: 783559 - DNA, 25 bp, Mus musculus
tatagacagattgcaggtccctggt

SEQ ID NO: 783560 - DNA, 25 bp, Mus musculus
tatagacagccactcttccttctgc

SEQ ID NO: 783561 - DNA, 25 bp, Mus musculus
tatagacagccagtcttccttctgc

SEQ ID NO: 783562 - DNA, 25 bp, Mus musculus
tatagacaggcccactgctcgaagg

SEQ ID NO: 783563 - DNA, 25 bp, Mus musculus
tatagacaggccgactgctcgaagg

SEQ ID NO: 783564 - DNA, 25 bp, Mus musculus
tatagacagggcatggcttctggcc

SEQ ID NO: 783565 - DNA, 25 bp, Mus musculus
tatagacagggcttggcttctggcc

SEQ ID NO: 783566 - DNA, 25 bp, Mus musculus
tatagacagttgagatctcccctct

SEQ ID NO: 783567 - DNA, 25 bp, Mus musculus
tatagacagttgtgatctcccctct

SEQ ID NO: 783568 - DNA, 25 bp, Mus musculus
tatagacatttgcttcagtgttctg

SEQ ID NO: 783569 - DNA, 25 bp, Mus musculus
tatagacatttggttcagtgttctg

SEQ ID NO: 783570 - DNA, 25 bp, Mus musculus
tatagaccaactcaagcaacagcag

SEQ ID NO: 783571 - DNA, 25 bp, Mus musculus
tatagaccaactgaagcaacagcag

SEQ ID NO: 783572 - DNA, 25 bp, Mus musculus
tatagaccatgtatcttccagacaa

SEQ ID NO: 783573 - DNA, 25 bp, Mus musculus
tatagaccatgtttcttccagacaa

SEQ ID NO: 783574 - DNA, 25 bp, Mus musculus
tatagacccaagatcctccctgttc

SEQ ID NO: 783575 - DNA, 25 bp, Mus musculus
tatagacccaagttcctccctgttc

SEQ ID NO: 783576 - DNA, 25 bp, Mus musculus
tatagacccgaaacccggtgatcta

SEQ ID NO: 783577 - DNA, 25 bp, Mus musculus
tatagacccgaatcccggtgatcta

SEQ ID NO: 783578 - DNA, 25 bp, Mus musculus
tatagaccgtgtacctgctagacca

SEQ ID NO: 783579 - DNA, 25 bp, Mus musculus
tatagaccgtgttcctgctagacca

SEQ ID NO: 783580 - DNA, 25 bp, Mus musculus
tatagacctgagagcagggcatttt

SEQ ID NO: 783581 - DNA, 25 bp, Mus musculus
tatagacctgagtgcagggcatttt

SEQ ID NO: 783582 - DNA, 25 bp, Mus musculus
tatagacctgatctggagaacgact

SEQ ID NO: 783583 - DNA, 25 bp, Mus musculus
tatagacctgatgtggagaacgact

SEQ ID NO: 783584 - DNA, 25 bp, Mus musculus
tatagacgatgtatttctgcccacg

SEQ ID NO: 783585 - DNA, 25 bp, Mus musculus
tatagacgatgtttttctgcccacg

SEQ ID NO: 783586 - DNA, 25 bp, Mus musculus
tatagacgcactaccttacaaagct

SEQ ID NO: 783587 - DNA, 25 bp, Mus musculus
tatagacgcacttccttacaaagct

SEQ ID NO: 783588 - DNA, 25 bp, Mus musculus
tatagacgccccatttatgacggag

SEQ ID NO: 783589 - DNA, 25 bp, Mus musculus
tatagacgccccttttatgacggag

SEQ ID NO: 783590 - DNA, 25 bp, Mus musculus
tatagacgctttcagatctacccga

SEQ ID NO: 783591 - DNA, 25 bp, Mus musculus
tatagacgctttgagatctacccga

SEQ ID NO: 783592 - DNA, 25 bp, Mus musculus
tatagacggcgcaggtttgtctcca

SEQ ID NO: 783593 - DNA, 25 bp, Mus musculus
tatagacggcgctggtttgtctcca

SEQ ID NO: 783594 - DNA, 25 bp, Mus musculus
tatagacggtgcctttcccttcgag

SEQ ID NO: 783595 - DNA, 25 bp, Mus musculus
tatagacggtgcgtttcccttcgag

SEQ ID NO: 783596 - DNA, 25 bp, Mus musculus
tatagactacatccttgtggcccct

SEQ ID NO: 783597 - DNA, 25 bp, Mus musculus
tatagactacatgcttgtggcccct

SEQ ID NO: 783598 - DNA, 25 bp, Mus musculus
tatagactcgatacctttggccaaa

SEQ ID NO: 783599 - DNA, 25 bp, Mus musculus
tatagactcgattcctttggccaaa

SEQ ID NO: 783600 - DNA, 25 bp, Mus musculus
tatagactcgctaacttcctcatat

SEQ ID NO: 783601 - DNA, 25 bp, Mus musculus
tatagactcgcttacttcctcatat

SEQ ID NO: 783602 - DNA, 25 bp, Mus musculus
tatagacttacaaaacccttcctgc

SEQ ID NO: 783603 - DNA, 25 bp, Mus musculus
tatagacttacataacccttcctgc

SEQ ID NO: 783604 - DNA, 25 bp, Mus musculus
tatagacttcctcgtctaactcctg

SEQ ID NO: 783605 - DNA, 25 bp, Mus musculus
tatagacttcctggtctaactcctg

SEQ ID NO: 783606 - DNA, 25 bp, Mus musculus
tatagagaaataaacacctccacag

SEQ ID NO: 783607 - DNA, 25 bp, Mus musculus
tatagagaaatatacacctccacag

SEQ ID NO: 783608 - DNA, 25 bp, Mus musculus
tatagagaagccctgtgttagaaaa

SEQ ID NO: 783609 - DNA, 25 bp, Mus musculus
tatagagaagccgtgtgttagaaaa

SEQ ID NO: 783610 - DNA, 25 bp, Mus musculus
tatagagaattcatgcctcccattc

SEQ ID NO: 783611 - DNA, 25 bp, Mus musculus
tatagagaattcttgcctcccattc

SEQ ID NO: 783612 - DNA, 25 bp, Mus musculus
tatagagagaacctctgcttccacc

SEQ ID NO: 783613 - DNA, 25 bp, Mus musculus
tatagagagaacgtctgcttccacc

SEQ ID NO: 783614 - DNA, 25 bp, Mus musculus
tatagagaggccattgcttgctgct

SEQ ID NO: 783615 - DNA, 25 bp, Mus musculus
tatagagaggcctttgcttgctgct

SEQ ID NO: 783616 - DNA, 25 bp, Mus musculus
tatagagatattacctgtgtgtaga

SEQ ID NO: 783617 - DNA, 25 bp, Mus musculus
tatagagatatttcctgtgtgtaga

SEQ ID NO: 783618 - DNA, 25 bp, Mus musculus
tatagagatccaagcaaacacacat

SEQ ID NO: 783619 - DNA, 25 bp, Mus musculus
tatagagatccatgcaaacacacat

SEQ ID NO: 783620 - DNA, 25 bp, Mus musculus
tatagagatgctccacaactacaat

SEQ ID NO: 783621 - DNA, 25 bp, Mus musculus
tatagagatgctgcacaactacaat

SEQ ID NO: 783622 - DNA, 25 bp, Mus musculus
tatagagcacctcggagcgacttcc

SEQ ID NO: 783623 - DNA, 25 bp, Mus musculus
tatagagcacctgggagcgacttcc

SEQ ID NO: 783624 - DNA, 25 bp, Mus musculus
tatagagcactaacctctgctgctg

SEQ ID NO: 783625 - DNA, 25 bp, Mus musculus
tatagagcactatcctctgctgctg

SEQ ID NO: 783626 - DNA, 25 bp, Mus musculus
tatagaggaggtacccaaggaggct

SEQ ID NO: 783627 - DNA, 25 bp, Mus musculus
tatagaggaggttcccaaggaggct

SEQ ID NO: 783628 - DNA, 25 bp, Mus musculus
tatagaggagtcacatccctacttc

SEQ ID NO: 783629 - DNA, 25 bp, Mus musculus
tatagaggagtctcatccctacttc

SEQ ID NO: 783630 - DNA, 25 bp, Mus musculus
tatagaggccacatgcttcctggat

SEQ ID NO: 783631 - DNA, 25 bp, Mus musculus
tatagaggccaccttctctgtgaac

SEQ ID NO: 783632 - DNA, 25 bp, Mus musculus
tatagaggccacgttctctgtgaac

SEQ ID NO: 783633 - DNA, 25 bp, Mus musculus
tatagaggccacttgcttcctggat

SEQ ID NO: 783634 - DNA, 25 bp, Mus musculus
tatagaggccagagtgaccttgggt

SEQ ID NO: 783635 - DNA, 25 bp, Mus musculus
tatagaggccagtgtgaccttgggt

SEQ ID NO: 783636 - DNA, 25 bp, Mus musculus
tatagagtcttgctactcagcccag

SEQ ID NO: 783637 - DNA, 25 bp, Mus musculus
tatagagtcttggtactcagcccag

SEQ ID NO: 783638 - DNA, 25 bp, Mus musculus
tatagagttcgtaccagtatagcca

SEQ ID NO: 783639 - DNA, 25 bp, Mus musculus
tatagagttcgttccagtatagcca

SEQ ID NO: 783640 - DNA, 25 bp, Mus musculus
tatagagttttacctgtgtggctgc

SEQ ID NO: 783641 - DNA, 25 bp, Mus musculus
tatagagttttagctgtgtggctgc

SEQ ID NO: 783642 - DNA, 25 bp, Mus musculus
tatagatatatcatggaccacaaca

SEQ ID NO: 783643 - DNA, 25 bp, Mus musculus
tatagatatatcttggaccacaaca

SEQ ID NO: 783644 - DNA, 25 bp, Mus musculus
tatagatatctcaggcctggcagct

SEQ ID NO: 783645 - DNA, 25 bp, Mus musculus
tatagatatctctggcctggcagct

SEQ ID NO: 783646 - DNA, 25 bp, Mus musculus
tatagatccggcatgcttagacatc

SEQ ID NO: 783647 - DNA, 25 bp, Mus musculus
tatagatccggcttgcttagacatc

SEQ ID NO: 783648 - DNA, 25 bp, Mus musculus
tatagatcctaccattaggttattg

SEQ ID NO: 783649 - DNA, 25 bp, Mus musculus
tatagatcctacgattaggttattg

SEQ ID NO: 783650 - DNA, 25 bp, Mus musculus
tatagatccttactttggtcctcgc

SEQ ID NO: 783651 - DNA, 25 bp, Mus musculus
tatagatccttagtttggtcctcgc

SEQ ID NO: 783652 - DNA, 25 bp, Mus musculus
tatagatctctaatccccttgtatt

SEQ ID NO: 783653 - DNA, 25 bp, Mus musculus
tatagatctctattccccttgtatt

SEQ ID NO: 783654 - DNA, 25 bp, Mus musculus
tatagatctggcaggcactgaaccc

SEQ ID NO: 783655 - DNA, 25 bp, Mus musculus
tatagatctggctggcactgaaccc

SEQ ID NO: 783656 - DNA, 25 bp, Mus musculus
tatagatctgtcaggttttcttgct

SEQ ID NO: 783657 - DNA, 25 bp, Mus musculus
tatagatctgtctggttttcttgct

SEQ ID NO: 783658 - DNA, 25 bp, Mus musculus
tatagatgaaccacacctgcgcagt

SEQ ID NO: 783659 - DNA, 25 bp, Mus musculus
tatagatgaacctcacctgcgcagt

SEQ ID NO: 783660 - DNA, 25 bp, Mus musculus
tatagatgacgactatcaaatcggt

SEQ ID NO: 783661 - DNA, 25 bp, Mus musculus
tatagatgacgagtatcaaatcggt

SEQ ID NO: 783662 - DNA, 25 bp, Mus musculus
tatagatgcactaggctattccctg

SEQ ID NO: 783663 - DNA, 25 bp, Mus musculus
tatagatgcacttggctattccctg

SEQ ID NO: 783664 - DNA, 25 bp, Mus musculus
tatagatggatcctgctctgtgcta

SEQ ID NO: 783665 - DNA, 25 bp, Mus musculus
tatagatggatcgtgctctgtgcta

SEQ ID NO: 783666 - DNA, 25 bp, Mus musculus
tatagatgtgatcctgtaaccctac

SEQ ID NO: 783667 - DNA, 25 bp, Mus musculus
tatagatgtgatgctgtaaccctac

SEQ ID NO: 783668 - DNA, 25 bp, Mus musculus
tatagattcactcccatttcagatc

SEQ ID NO: 783669 - DNA, 25 bp, Mus musculus
tatagattcactgccatttcagatc

SEQ ID NO: 783670 - DNA, 25 bp, Mus musculus
tatagattcatacctgtgcatgaaa

SEQ ID NO: 783671 - DNA, 25 bp, Mus musculus
tatagattcatagctgtgcatgaaa

SEQ ID NO: 783672 - DNA, 25 bp, Mus musculus
tatagattctgcaacgaccttcaaa

SEQ ID NO: 783673 - DNA, 25 bp, Mus musculus
tatagattctgctacgaccttcaaa

SEQ ID NO: 783674 - DNA, 25 bp, Mus musculus
tatagattgctcaagatcagtggtt

SEQ ID NO: 783675 - DNA, 25 bp, Mus musculus
tatagattgctctagatcagtggtt

SEQ ID NO: 783676 - DNA, 25 bp, Mus musculus
tatagattggcaaaccccacagtgc

SEQ ID NO: 783677 - DNA, 25 bp, Mus musculus
tatagattggcataccccacagtgc

SEQ ID NO: 783678 - DNA, 25 bp, Mus musculus
tatagattgtgtcggtgttggcctt

SEQ ID NO: 783679 - DNA, 25 bp, Mus musculus
tatagattgtgtgggtgttggcctt

SEQ ID NO: 783680 - DNA, 25 bp, Mus musculus
tatagatttcatatactgtgttaac

SEQ ID NO: 783681 - DNA, 25 bp, Mus musculus
tatagatttcatttactgtgttaac

SEQ ID NO: 783682 - DNA, 25 bp, Mus musculus
tatagatttccactttggacttgtt

SEQ ID NO: 783683 - DNA, 25 bp, Mus musculus
tatagatttccagtttggacttgtt

SEQ ID NO: 783684 - DNA, 25 bp, Mus musculus
tatagcaaggtcacccgctttgcta

SEQ ID NO: 783685 - DNA, 25 bp, Mus musculus
tatagcaaggtctcccgctttgcta

SEQ ID NO: 783686 - DNA, 25 bp, Mus musculus
tatagcacaaggagtcactgttcag

SEQ ID NO: 783687 - DNA, 25 bp, Mus musculus
tatagcacaaggtgtcactgttcag

SEQ ID NO: 783688 - DNA, 25 bp, Mus musculus
tatagcacagaaaaacccccacaga

SEQ ID NO: 783689 - DNA, 25 bp, Mus musculus
tatagcacagaataacccccacaga

SEQ ID NO: 783690 - DNA, 25 bp, Mus musculus
tatagcacagacagtcttccactct

SEQ ID NO: 783691 - DNA, 25 bp, Mus musculus
tatagcacagactgtcttccactct

SEQ ID NO: 783692 - DNA, 25 bp, Mus musculus
tatagcacctttagtctatgcgctt

SEQ ID NO: 783693 - DNA, 25 bp, Mus musculus
tatagcaccttttgtctatgcgctt

SEQ ID NO: 783694 - DNA, 25 bp, Mus musculus
tatagcactaggataggcacccctc

SEQ ID NO: 783695 - DNA, 25 bp, Mus musculus
tatagcactaggttaggcacccctc

SEQ ID NO: 783696 - DNA, 25 bp, Mus musculus
tatagcactcggcagctcacgagct

SEQ ID NO: 783697 - DNA, 25 bp, Mus musculus
tatagcactcgggagctcacgagct

SEQ ID NO: 783698 - DNA, 25 bp, Mus musculus
tatagcagatgtatagcttggtctt

SEQ ID NO: 783699 - DNA, 25 bp, Mus musculus
tatagcagatgtttagcttggtctt

SEQ ID NO: 783700 - DNA, 25 bp, Mus musculus
tatagcagcggccattctggtgaca

SEQ ID NO: 783701 - DNA, 25 bp, Mus musculus
tatagcagcggcgattctggtgaca

SEQ ID NO: 783702 - DNA, 25 bp, Mus musculus
tatagcaggatgatctttcagagat

SEQ ID NO: 783703 - DNA, 25 bp, Mus musculus
tatagcaggatgttctttcagagat

SEQ ID NO: 783704 - DNA, 25 bp, Mus musculus
tatagcataactcttaccctaaagt

SEQ ID NO: 783705 - DNA, 25 bp, Mus musculus
tatagcataactgttaccctaaagt

SEQ ID NO: 783706 - DNA, 25 bp, Mus musculus
tatagcatacttacgggcttgcctt

SEQ ID NO: 783707 - DNA, 25 bp, Mus musculus
tatagcatactttcgggcttgcctt

SEQ ID NO: 783708 - DNA, 25 bp, Mus musculus
tatagcatcagaatgtcccacaagt

SEQ ID NO: 783709 - DNA, 25 bp, Mus musculus
tatagcatcagattgtcccacaagt

SEQ ID NO: 783710 - DNA, 25 bp, Mus musculus
tatagcatcatgaagcgtctcagga

SEQ ID NO: 783711 - DNA, 25 bp, Mus musculus
tatagcatcatgtagcgtctcagga

SEQ ID NO: 783712 - DNA, 25 bp, Mus musculus
tatagcatgttactccttccttcaa

SEQ ID NO: 783713 - DNA, 25 bp, Mus musculus
tatagcatgttagtccttccttcaa

SEQ ID NO: 783714 - DNA, 25 bp, Mus musculus
tatagccaaaatcactcaccctaag

SEQ ID NO: 783715 - DNA, 25 bp, Mus musculus
tatagccaaaatgactcaccctaag

SEQ ID NO: 783716 - DNA, 25 bp, Mus musculus
tatagccaagaacccttaggagtct

SEQ ID NO: 783717 - DNA, 25 bp, Mus musculus
tatagccaagaagccttaggagtct

SEQ ID NO: 783718 - DNA, 25 bp, Mus musculus
tatagccaagcacggactaagcagt

SEQ ID NO: 783719 - DNA, 25 bp, Mus musculus
tatagccaagcagggactaagcagt

SEQ ID NO: 783720 - DNA, 25 bp, Mus musculus
tatagccaagttagaggtcaagcct

SEQ ID NO: 783721 - DNA, 25 bp, Mus musculus
tatagccaagttatgtagagccagt

SEQ ID NO: 783722 - DNA, 25 bp, Mus musculus
tatagccaagtttgaggtcaagcct

SEQ ID NO: 783723 - DNA, 25 bp, Mus musculus
tatagccaagttttgtagagccagt

SEQ ID NO: 783724 - DNA, 25 bp, Mus musculus
tatagccacctacttggaacgctac

SEQ ID NO: 783725 - DNA, 25 bp, Mus musculus
tatagccacctagttggaacgctac

SEQ ID NO: 783726 - DNA, 25 bp, Mus musculus
tatagccacggccatctgcatgagc

SEQ ID NO: 783727 - DNA, 25 bp, Mus musculus
tatagccacggcgatctgcatgagc

SEQ ID NO: 783728 - DNA, 25 bp, Mus musculus
tatagccactttagtatctgcacca

SEQ ID NO: 783729 - DNA, 25 bp, Mus musculus
tatagccacttttgtatctgcacca

SEQ ID NO: 783730 - DNA, 25 bp, Mus musculus
tatagccagaccctagggacacttc

SEQ ID NO: 783731 - DNA, 25 bp, Mus musculus
tatagccagaccgtagggacacttc

SEQ ID NO: 783732 - DNA, 25 bp, Mus musculus
tatagccagatgagccaccaagacc

SEQ ID NO: 783733 - DNA, 25 bp, Mus musculus
tatagccagatgtgccaccaagacc

SEQ ID NO: 783734 - DNA, 25 bp, Mus musculus
tatagccatattcctgcttcagttc

SEQ ID NO: 783735 - DNA, 25 bp, Mus musculus
tatagccatattgctgcttcagttc

SEQ ID NO: 783736 - DNA, 25 bp, Mus musculus
tatagccatcataaggttcagcagc

SEQ ID NO: 783737 - DNA, 25 bp, Mus musculus
tatagccatcattaggttcagcagc

SEQ ID NO: 783738 - DNA, 25 bp, Mus musculus
tatagccatccaacaaccagatctt

SEQ ID NO: 783739 - DNA, 25 bp, Mus musculus
tatagccatccatcaaccagatctt

SEQ ID NO: 783740 - DNA, 25 bp, Mus musculus
tatagcccaaagacctcaatacagg

SEQ ID NO: 783741 - DNA, 25 bp, Mus musculus
tatagcccaaagtcctcaatacagg

SEQ ID NO: 783742 - DNA, 25 bp, Mus musculus
tatagcccaaccaacaagaatattg

SEQ ID NO: 783743 - DNA, 25 bp, Mus musculus
tatagcccaacctacaagaatattg

SEQ ID NO: 783744 - DNA, 25 bp, Mus musculus
tatagcccacacatgcatatgcagc

SEQ ID NO: 783745 - DNA, 25 bp, Mus musculus
tatagcccacacttgcatatgcagc

SEQ ID NO: 783746 - DNA, 25 bp, Mus musculus
tatagcccacataacccttttagta

SEQ ID NO: 783747 - DNA, 25 bp, Mus musculus
tatagcccacattacccttttagta

SEQ ID NO: 783748 - DNA, 25 bp, Mus musculus
tatagcccaggcaggtagtttccga

SEQ ID NO: 783749 - DNA, 25 bp, Mus musculus
tatagcccaggctggtagtttccga

SEQ ID NO: 783750 - DNA, 25 bp, Mus musculus
tatagcccattgagccgccaagtta

SEQ ID NO: 783751 - DNA, 25 bp, Mus musculus
tatagcccattgtgccgccaagtta

SEQ ID NO: 783752 - DNA, 25 bp, Mus musculus
tatagccccgagattccaaagaaca

SEQ ID NO: 783753 - DNA, 25 bp, Mus musculus
tatagccccgagtttccaaagaaca

SEQ ID NO: 783754 - DNA, 25 bp, Mus musculus
tatagccccggacgttcaagtcctg

SEQ ID NO: 783755 - DNA, 25 bp, Mus musculus
tatagccccggaggttcaagtcctg

SEQ ID NO: 783756 - DNA, 25 bp, Mus musculus
tatagccctttgatcatagtcctga

SEQ ID NO: 783757 - DNA, 25 bp, Mus musculus
tatagccctttgttcatagtcctga

SEQ ID NO: 783758 - DNA, 25 bp, Mus musculus
tatagcctacgtaggtgtggaaaac

SEQ ID NO: 783759 - DNA, 25 bp, Mus musculus
tatagcctacgttggtgtggaaaac

SEQ ID NO: 783760 - DNA, 25 bp, Mus musculus
tatagcctattgaccaccgttaaga

SEQ ID NO: 783761 - DNA, 25 bp, Mus musculus
tatagcctattgtccaccgttaaga

SEQ ID NO: 783762 - DNA, 25 bp, Mus musculus
tatagcctccatactacagttcaga

SEQ ID NO: 783763 - DNA, 25 bp, Mus musculus
tatagcctccattctacagttcaga

SEQ ID NO: 783764 - DNA, 25 bp, Mus musculus
tatagcctcgacaatttgtctgaag

SEQ ID NO: 783765 - DNA, 25 bp, Mus musculus
tatagcctcgactatttgtctgaag

SEQ ID NO: 783766 - DNA, 25 bp, Mus musculus
tatagcctctcccagaatatataga

SEQ ID NO: 783767 - DNA, 25 bp, Mus musculus
tatagcctctccgagaatatataga

SEQ ID NO: 783768 - DNA, 25 bp, Mus musculus
tatagcctctgccaccttgtataaa

SEQ ID NO: 783769 - DNA, 25 bp, Mus musculus
tatagcctctgcgaccttgtataaa

SEQ ID NO: 783770 - DNA, 25 bp, Mus musculus
tatagcctgcatcaagttgacgtaa

SEQ ID NO: 783771 - DNA, 25 bp, Mus musculus
tatagcctgcatgaagttgacgtaa

SEQ ID NO: 783772 - DNA, 25 bp, Mus musculus
tatagcctgcttaacttaatagttt

SEQ ID NO: 783773 - DNA, 25 bp, Mus musculus
tatagcctgctttacttaatagttt

SEQ ID NO: 783774 - DNA, 25 bp, Mus musculus
tatagcctgtacaggatgggccgtc

SEQ ID NO: 783775 - DNA, 25 bp, Mus musculus
tatagcctgtactggatgggccgtc

SEQ ID NO: 783776 - DNA, 25 bp, Mus musculus
tatagcctgtgtagtgcacacctgc

SEQ ID NO: 783777 - DNA, 25 bp, Mus musculus
tatagcctgtgttgtgcacacctgc

SEQ ID NO: 783778 - DNA, 25 bp, Mus musculus
tatagccttgctctgatggttttag

SEQ ID NO: 783779 - DNA, 25 bp, Mus musculus
tatagccttgctgtgatggttttag

SEQ ID NO: 783780 - DNA, 25 bp, Mus musculus
tatagcgagaagacgcacgctcgcc

SEQ ID NO: 783781 - DNA, 25 bp, Mus musculus
tatagcgagaagtcgcacgctcgcc

SEQ ID NO: 783782 - DNA, 25 bp, Mus musculus
tatagcggtgatagcctgggaagac

SEQ ID NO: 783783 - DNA, 25 bp, Mus musculus
tatagcggtgattgcctgggaagac

SEQ ID NO: 783784 - DNA, 25 bp, Mus musculus
tatagcgtcctcaagtgctacctac

SEQ ID NO: 783785 - DNA, 25 bp, Mus musculus
tatagcgtcctctagtgctacctac

SEQ ID NO: 783786 - DNA, 25 bp, Mus musculus
tatagcgtccttcaaagtgttaaat

SEQ ID NO: 783787 - DNA, 25 bp, Mus musculus
tatagcgtccttgaaagtgttaaat

SEQ ID NO: 783788 - DNA, 25 bp, Mus musculus
tatagctaaataatgcccagtgact

SEQ ID NO: 783789 - DNA, 25 bp, Mus musculus
tatagctaaatattgcccagtgact

SEQ ID NO: 783790 - DNA, 25 bp, Mus musculus
tatagctaacttatcttggtgacag

SEQ ID NO: 783791 - DNA, 25 bp, Mus musculus
tatagctaacttttcttggtgacag

SEQ ID NO: 783792 - DNA, 25 bp, Mus musculus
tatagctacagcataaacctcaact

SEQ ID NO: 783793 - DNA, 25 bp, Mus musculus
tatagctacagcttaaacctcaact

SEQ ID NO: 783794 - DNA, 25 bp, Mus musculus
tatagctacatgatctggccacatg

SEQ ID NO: 783795 - DNA, 25 bp, Mus musculus
tatagctacatgttctggccacatg

SEQ ID NO: 783796 - DNA, 25 bp, Mus musculus
tatagctcactaaaggatccatggc

SEQ ID NO: 783797 - DNA, 25 bp, Mus musculus
tatagctcactataggatccatggc

SEQ ID NO: 783798 - DNA, 25 bp, Mus musculus
tatagctcagagaagcacgtcccca

SEQ ID NO: 783799 - DNA, 25 bp, Mus musculus
tatagctcagagtagcacgtcccca

SEQ ID NO: 783800 - DNA, 25 bp, Mus musculus
tatagctcaggaaatttttcacacc

SEQ ID NO: 783801 - DNA, 25 bp, Mus musculus
tatagctcaggatatttttcacacc

SEQ ID NO: 783802 - DNA, 25 bp, Mus musculus
tatagctcatctctgataccccgga

SEQ ID NO: 783803 - DNA, 25 bp, Mus musculus
tatagctcatctgtgataccccgga

SEQ ID NO: 783804 - DNA, 25 bp, Mus musculus
tatagctcatgtccaaggacctggg

SEQ ID NO: 783805 - DNA, 25 bp, Mus musculus
tatagctcatgtgcaaggacctggg

SEQ ID NO: 783806 - DNA, 25 bp, Mus musculus
tatagctccaggatacggaacccca

SEQ ID NO: 783807 - DNA, 25 bp, Mus musculus
tatagctccaggttacggaacccca

SEQ ID NO: 783808 - DNA, 25 bp, Mus musculus
tatagctccattcataacacttttg

SEQ ID NO: 783809 - DNA, 25 bp, Mus musculus
tatagctccattgataacacttttg

SEQ ID NO: 783810 - DNA, 25 bp, Mus musculus
tatagctcgagtctgccatgcgcat

SEQ ID NO: 783811 - DNA, 25 bp, Mus musculus
tatagctcgagtgtgccatgcgcat

SEQ ID NO: 783812 - DNA, 25 bp, Mus musculus
tatagctctagccacatttgtagca

SEQ ID NO: 783813 - DNA, 25 bp, Mus musculus
tatagctctagcgacatttgtagca

SEQ ID NO: 783814 - DNA, 25 bp, Mus musculus
tatagctctggtaatccttggaact

SEQ ID NO: 783815 - DNA, 25 bp, Mus musculus
tatagctctggttatccttggaact

SEQ ID NO: 783816 - DNA, 25 bp, Mus musculus
tatagctgaaggctcggctctgcag

SEQ ID NO: 783817 - DNA, 25 bp, Mus musculus
tatagctgaagggtcggctctgcag

SEQ ID NO: 783818 - DNA, 25 bp, Mus musculus
tatagctgaccaataataaaacatt

SEQ ID NO: 783819 - DNA, 25 bp, Mus musculus
tatagctgaccattaataaaacatt

SEQ ID NO: 783820 - DNA, 25 bp, Mus musculus
tatagctgcatcctaaacccaaatg

SEQ ID NO: 783821 - DNA, 25 bp, Mus musculus
tatagctgcatcgtaaacccaaatg

SEQ ID NO: 783822 - DNA, 25 bp, Mus musculus
tatagctgccaaagggaccttgctt

SEQ ID NO: 783823 - DNA, 25 bp, Mus musculus
tatagctgccaaatagttcctctgt

SEQ ID NO: 783824 - DNA, 25 bp, Mus musculus
tatagctgccaatgggaccttgctt

SEQ ID NO: 783825 - DNA, 25 bp, Mus musculus
tatagctgccaattagttcctctgt

SEQ ID NO: 783826 - DNA, 25 bp, Mus musculus
tatagctgccccacttttgttttaa

SEQ ID NO: 783827 - DNA, 25 bp, Mus musculus
tatagctgcccctcttttgttttaa

SEQ ID NO: 783828 - DNA, 25 bp, Mus musculus
tatagctgctttcggtactaactcc

SEQ ID NO: 783829 - DNA, 25 bp, Mus musculus
tatagctgctttgggtactaactcc

SEQ ID NO: 783830 - DNA, 25 bp, Mus musculus
tatagctggcaaaaccacggctctg

SEQ ID NO: 783831 - DNA, 25 bp, Mus musculus
tatagctggcaataccacggctctg

SEQ ID NO: 783832 - DNA, 25 bp, Mus musculus
tatagctggctaactgctctgtagt

SEQ ID NO: 783833 - DNA, 25 bp, Mus musculus
tatagctggctatctgctctgtagt

SEQ ID NO: 783834 - DNA, 25 bp, Mus musculus
tatagctgtaacatgccttcagaat

SEQ ID NO: 783835 - DNA, 25 bp, Mus musculus
tatagctgtaacttgccttcagaat

SEQ ID NO: 783836 - DNA, 25 bp, Mus musculus
tatagctgtaggcttcaaaggaatc

SEQ ID NO: 783837 - DNA, 25 bp, Mus musculus
tatagctgtagggttcaaaggaatc

SEQ ID NO: 783838 - DNA, 25 bp, Mus musculus
tatagctgtcgtcggctctctacca

SEQ ID NO: 783839 - DNA, 25 bp, Mus musculus
tatagctgtcgtgggctctctacca

SEQ ID NO: 783840 - DNA, 25 bp, Mus musculus
tatagcttaacaatggcaggtacct

SEQ ID NO: 783841 - DNA, 25 bp, Mus musculus
tatagcttaacattggcaggtacct

SEQ ID NO: 783842 - DNA, 25 bp, Mus musculus
tatagcttaactcgcagactacttg

SEQ ID NO: 783843 - DNA, 25 bp, Mus musculus
tatagcttaactggcagactacttg

SEQ ID NO: 783844 - DNA, 25 bp, Mus musculus
tatagcttatgactaccacactggg

SEQ ID NO: 783845 - DNA, 25 bp, Mus musculus
tatagcttatgagtaccacactggg

SEQ ID NO: 783846 - DNA, 25 bp, Mus musculus
tatagcttcggacacagtggtgcgt

SEQ ID NO: 783847 - DNA, 25 bp, Mus musculus
tatagcttcggagacagtggtgcgt

SEQ ID NO: 783848 - DNA, 25 bp, Mus musculus
tatagcttcttacctagcgtttcca

SEQ ID NO: 783849 - DNA, 25 bp, Mus musculus
tatagcttcttagctagcgtttcca

SEQ ID NO: 783850 - DNA, 25 bp, Mus musculus
tatagcttcttgcagcctctgagga

SEQ ID NO: 783851 - DNA, 25 bp, Mus musculus
tatagcttcttggagcctctgagga

SEQ ID NO: 783852 - DNA, 25 bp, Mus musculus
tatagcttgtaaccagtgatgtgat

SEQ ID NO: 783853 - DNA, 25 bp, Mus musculus
tatagcttgtaagcagtgatgtgat

SEQ ID NO: 783854 - DNA, 25 bp, Mus musculus
tatagctttagccacatcgccagga

SEQ ID NO: 783855 - DNA, 25 bp, Mus musculus
tatagctttagcgacatcgccagga

SEQ ID NO: 783856 - DNA, 25 bp, Mus musculus
tatagctttggtctaaaccaggctg

SEQ ID NO: 783857 - DNA, 25 bp, Mus musculus
tatagctttggtgtaaaccaggctg

SEQ ID NO: 783858 - DNA, 25 bp, Mus musculus
tatagcttttcaaccttgagacctc

SEQ ID NO: 783859 - DNA, 25 bp, Mus musculus
tatagcttttcatccttgagacctc

SEQ ID NO: 783860 - DNA, 25 bp, Mus musculus
tataggaaaccacggcctttcttag

SEQ ID NO: 783861 - DNA, 25 bp, Mus musculus
tataggaaaccagggcctttcttag

SEQ ID NO: 783862 - DNA, 25 bp, Mus musculus
tataggaaacctagtggatggcttc

SEQ ID NO: 783863 - DNA, 25 bp, Mus musculus
tataggaaaccttgtggatggcttc

SEQ ID NO: 783864 - DNA, 25 bp, Mus musculus
tataggaaccaactctagtcctctg

SEQ ID NO: 783865 - DNA, 25 bp, Mus musculus
tataggaaccaagtctagtcctctg

SEQ ID NO: 783866 - DNA, 25 bp, Mus musculus
tataggaagaccagccatagcctgc

SEQ ID NO: 783867 - DNA, 25 bp, Mus musculus
tataggaagacctgccatagcctgc

SEQ ID NO: 783868 - DNA, 25 bp, Mus musculus
tataggaatagaactcctttcacac

SEQ ID NO: 783869 - DNA, 25 bp, Mus musculus
tataggaatagatctcctttcacac

SEQ ID NO: 783870 - DNA, 25 bp, Mus musculus
tataggaatcccatgttctggctac

SEQ ID NO: 783871 - DNA, 25 bp, Mus musculus
tataggaatcccttgttctggctac

SEQ ID NO: 783872 - DNA, 25 bp, Mus musculus
tataggacagacacccaatcgtcac

SEQ ID NO: 783873 - DNA, 25 bp, Mus musculus
tataggacagactcccaatcgtcac

SEQ ID NO: 783874 - DNA, 25 bp, Mus musculus
tataggacccatacgcctgaagagg

SEQ ID NO: 783875 - DNA, 25 bp, Mus musculus
tataggacccattcgcctgaagagg

SEQ ID NO: 783876 - DNA, 25 bp, Mus musculus
tataggaccctaagcaaactccacc

SEQ ID NO: 783877 - DNA, 25 bp, Mus musculus
tataggaccctatgcaaactccacc

SEQ ID NO: 783878 - DNA, 25 bp, Mus musculus
tataggacctatctgtgaactttat

SEQ ID NO: 783879 - DNA, 25 bp, Mus musculus
tataggacctatgtgtgaactttat

SEQ ID NO: 783880 - DNA, 25 bp, Mus musculus
tataggactggtcctccccacaaga

SEQ ID NO: 783881 - DNA, 25 bp, Mus musculus
tataggactggtgctccccacaaga

SEQ ID NO: 783882 - DNA, 25 bp, Mus musculus
tataggagacctcagccttccctgt

SEQ ID NO: 783883 - DNA, 25 bp, Mus musculus
tataggagacctgagccttccctgt

SEQ ID NO: 783884 - DNA, 25 bp, Mus musculus
tataggagagccattcagggaatta

SEQ ID NO: 783885 - DNA, 25 bp, Mus musculus
tataggagagcctttcagggaatta

SEQ ID NO: 783886 - DNA, 25 bp, Mus musculus
tataggatgaccaacagagccaact

SEQ ID NO: 783887 - DNA, 25 bp, Mus musculus
tataggatgacctacagagccaact

SEQ ID NO: 783888 - DNA, 25 bp, Mus musculus
tataggatttagcaagccaccaagt

SEQ ID NO: 783889 - DNA, 25 bp, Mus musculus
tataggatttaggaagccaccaagt

SEQ ID NO: 783890 - DNA, 25 bp, Mus musculus
tataggcacccgacatagactgctg

SEQ ID NO: 783891 - DNA, 25 bp, Mus musculus
tataggcacccgtcatagactgctg

SEQ ID NO: 783892 - DNA, 25 bp, Mus musculus
tataggcagcttataggcacccaag

SEQ ID NO: 783893 - DNA, 25 bp, Mus musculus
tataggcagcttttaggcacccaag

SEQ ID NO: 783894 - DNA, 25 bp, Mus musculus
tataggcatgcactaatccgggtag

SEQ ID NO: 783895 - DNA, 25 bp, Mus musculus
tataggcatgcagtaatccgggtag

SEQ ID NO: 783896 - DNA, 25 bp, Mus musculus
tataggcattggacactcacatctt

SEQ ID NO: 783897 - DNA, 25 bp, Mus musculus
tataggcattggtcactcacatctt

SEQ ID NO: 783898 - DNA, 25 bp, Mus musculus
tataggccaagtcttgtttacccca

SEQ ID NO: 783899 - DNA, 25 bp, Mus musculus
tataggccaagtgttgtttacccca

SEQ ID NO: 783900 - DNA, 25 bp, Mus musculus
tataggccatggctttccagttctg

SEQ ID NO: 783901 - DNA, 25 bp, Mus musculus
tataggccatgggtttccagttctg

SEQ ID NO: 783902 - DNA, 25 bp, Mus musculus
tataggcccctcatggactagagaa

SEQ ID NO: 783903 - DNA, 25 bp, Mus musculus
tataggcccctcttggactagagaa

SEQ ID NO: 783904 - DNA, 25 bp, Mus musculus
tataggccctcaacaactcatgcag

SEQ ID NO: 783905 - DNA, 25 bp, Mus musculus
tataggccctcatcaactcatgcag

SEQ ID NO: 783906 - DNA, 25 bp, Mus musculus
tataggccctttaataagatacatt

SEQ ID NO: 783907 - DNA, 25 bp, Mus musculus
tataggcccttttataagatacatt

SEQ ID NO: 783908 - DNA, 25 bp, Mus musculus
tataggccggagatcgccgtccagt

SEQ ID NO: 783909 - DNA, 25 bp, Mus musculus
tataggccggagttcgccgtccagt

SEQ ID NO: 783910 - DNA, 25 bp, Mus musculus
tataggcctggtacgtaagcatact

SEQ ID NO: 783911 - DNA, 25 bp, Mus musculus
tataggcctggttcgtaagcatact

SEQ ID NO: 783912 - DNA, 25 bp, Mus musculus
tataggcctgtgaccaaacattccc

SEQ ID NO: 783913 - DNA, 25 bp, Mus musculus
tataggcctgtgtccaaacattccc

SEQ ID NO: 783914 - DNA, 25 bp, Mus musculus
tataggctaaatccactccattcat

SEQ ID NO: 783915 - DNA, 25 bp, Mus musculus
tataggctaaatgcactccattcat

SEQ ID NO: 783916 - DNA, 25 bp, Mus musculus
tataggctagcacccttttttactc

SEQ ID NO: 783917 - DNA, 25 bp, Mus musculus
tataggctagcagccttttttactc

SEQ ID NO: 783918 - DNA, 25 bp, Mus musculus
tataggctccgacacctttgaaaga

SEQ ID NO: 783919 - DNA, 25 bp, Mus musculus
tataggctccgagacctttgaaaga

SEQ ID NO: 783920 - DNA, 25 bp, Mus musculus
tataggctctctcggtgtttcattc

SEQ ID NO: 783921 - DNA, 25 bp, Mus musculus
tataggctctctgggtgtttcattc

SEQ ID NO: 783922 - DNA, 25 bp, Mus musculus
tataggcttaccagatgttactact

SEQ ID NO: 783923 - DNA, 25 bp, Mus musculus
tataggcttacctgatgttactact

SEQ ID NO: 783924 - DNA, 25 bp, Mus musculus
tataggcttagcagtgtctgagacc

SEQ ID NO: 783925 - DNA, 25 bp, Mus musculus
tataggcttagctgtgtctgagacc

SEQ ID NO: 783926 - DNA, 25 bp, Mus musculus
tataggcttcacactttacttgacc

SEQ ID NO: 783927 - DNA, 25 bp, Mus musculus
tataggcttcactctttacttgacc

SEQ ID NO: 783928 - DNA, 25 bp, Mus musculus
tataggcttgccctatggctaactg

SEQ ID NO: 783929 - DNA, 25 bp, Mus musculus
tataggcttgccgtatggctaactg

SEQ ID NO: 783930 - DNA, 25 bp, Mus musculus
tataggcttttaatctgtatctcag

SEQ ID NO: 783931 - DNA, 25 bp, Mus musculus
tataggcttttattctgtatctcag

SEQ ID NO: 783932 - DNA, 25 bp, Mus musculus
tatagggacactcgacttcatcttc

SEQ ID NO: 783933 - DNA, 25 bp, Mus musculus
tatagggacactggacttcatcttc

SEQ ID NO: 783934 - DNA, 25 bp, Mus musculus
tatagggacgacagttcaggacatc

SEQ ID NO: 783935 - DNA, 25 bp, Mus musculus
tatagggacgactgttcaggacatc

SEQ ID NO: 783936 - DNA, 25 bp, Mus musculus
tatagggagcgtctgtgagtcccct

SEQ ID NO: 783937 - DNA, 25 bp, Mus musculus
tatagggagcgtgtgtgagtcccct

SEQ ID NO: 783938 - DNA, 25 bp, Mus musculus
tatagggataatattgagaaggcat

SEQ ID NO: 783939 - DNA, 25 bp, Mus musculus
tatagggataattttgagaaggcat

SEQ ID NO: 783940 - DNA, 25 bp, Mus musculus
tatagggcaacacccagagggctcc

SEQ ID NO: 783941 - DNA, 25 bp, Mus musculus
tatagggcaacagccagagggctcc

SEQ ID NO: 783942 - DNA, 25 bp, Mus musculus
tatagggcacctctctctcttgctg

SEQ ID NO: 783943 - DNA, 25 bp, Mus musculus
tatagggcacctgtctctcttgctg

SEQ ID NO: 783944 - DNA, 25 bp, Mus musculus
tatagggcagctctggttttcatcc

SEQ ID NO: 783945 - DNA, 25 bp, Mus musculus
tatagggcagctgtggttttcatcc

SEQ ID NO: 783946 - DNA, 25 bp, Mus musculus
tatagggcagtcattagcagacatt

SEQ ID NO: 783947 - DNA, 25 bp, Mus musculus
tatagggcagtctttagcagacatt

SEQ ID NO: 783948 - DNA, 25 bp, Mus musculus
tatagggcatctatccaatagcagt

SEQ ID NO: 783949 - DNA, 25 bp, Mus musculus
tatagggcatctttccaatagcagt

SEQ ID NO: 783950 - DNA, 25 bp, Mus musculus
tatagggccagaccaggaaggtatc

SEQ ID NO: 783951 - DNA, 25 bp, Mus musculus
tatagggccagagcaggaaggtatc

SEQ ID NO: 783952 - DNA, 25 bp, Mus musculus
tatagggcccatccctgggaaggat

SEQ ID NO: 783953 - DNA, 25 bp, Mus musculus
tatagggcccatgcctgggaaggat

SEQ ID NO: 783954 - DNA, 25 bp, Mus musculus
tatagggctagacttcaggtaccag

SEQ ID NO: 783955 - DNA, 25 bp, Mus musculus
tatagggctagagttcaggtaccag

SEQ ID NO: 783956 - DNA, 25 bp, Mus musculus
tatagggtccatccagcaggatcta

SEQ ID NO: 783957 - DNA, 25 bp, Mus musculus
tatagggtccatgcagcaggatcta

SEQ ID NO: 783958 - DNA, 25 bp, Mus musculus
tatagggtggctacctgactgaggc

SEQ ID NO: 783959 - DNA, 25 bp, Mus musculus
tatagggtggcttcctgactgaggc

SEQ ID NO: 783960 - DNA, 25 bp, Mus musculus
tataggtacgtcactcacacaagga

SEQ ID NO: 783961 - DNA, 25 bp, Mus musculus
tataggtacgtctctcacacaagga

SEQ ID NO: 783962 - DNA, 25 bp, Mus musculus
tataggtactaaatctgaagccaca

SEQ ID NO: 783963 - DNA, 25 bp, Mus musculus
tataggtactaattctgaagccaca

SEQ ID NO: 783964 - DNA, 25 bp, Mus musculus
tataggtatggcaacactgcggccc

SEQ ID NO: 783965 - DNA, 25 bp, Mus musculus
tataggtatggctacactgcggccc

SEQ ID NO: 783966 - DNA, 25 bp, Mus musculus
tataggtcagtgatcaccttccaga

SEQ ID NO: 783967 - DNA, 25 bp, Mus musculus
tataggtcagtgttcaccttccaga

SEQ ID NO: 783968 - DNA, 25 bp, Mus musculus
tataggtccaaaaaagctctgtact

SEQ ID NO: 783969 - DNA, 25 bp, Mus musculus
tataggtccaaataagctctgtact

SEQ ID NO: 783970 - DNA, 25 bp, Mus musculus
tataggtgaattccccgtcagcaaa

SEQ ID NO: 783971 - DNA, 25 bp, Mus musculus
tataggtgaattgcccgtcagcaaa

SEQ ID NO: 783972 - DNA, 25 bp, Mus musculus
tataggtgagcaccgcttactgtct

SEQ ID NO: 783973 - DNA, 25 bp, Mus musculus
tataggtgagcagcgcttactgtct

SEQ ID NO: 783974 - DNA, 25 bp, Mus musculus
tataggtgcagacatctcggccaat

SEQ ID NO: 783975 - DNA, 25 bp, Mus musculus
tataggtgcagagatctcggccaat

SEQ ID NO: 783976 - DNA, 25 bp, Mus musculus
tataggtgttcccatatgaataaac

SEQ ID NO: 783977 - DNA, 25 bp, Mus musculus
tataggtgttccgatatgaataaac

SEQ ID NO: 783978 - DNA, 25 bp, Mus musculus
tataggttctctatcgtttgttaag

SEQ ID NO: 783979 - DNA, 25 bp, Mus musculus
tataggttctctttcgtttgttaag

SEQ ID NO: 783980 - DNA, 25 bp, Mus musculus
tataggttctgactcatgggcccgc

SEQ ID NO: 783981 - DNA, 25 bp, Mus musculus
tataggttctgagtcatgggcccgc

SEQ ID NO: 783982 - DNA, 25 bp, Mus musculus
tataggttgcaaaactaaatgaaag

SEQ ID NO: 783983 - DNA, 25 bp, Mus musculus
tataggttgcaatactaaatgaaag

SEQ ID NO: 783984 - DNA, 25 bp, Mus musculus
tataggttgggtcctttgcctctca

SEQ ID NO: 783985 - DNA, 25 bp, Mus musculus
tataggttgggtgctttgcctctca

SEQ ID NO: 783986 - DNA, 25 bp, Mus musculus
tataggtttgcaccatgacacccga

SEQ ID NO: 783987 - DNA, 25 bp, Mus musculus
tataggtttgcagcatgacacccga

SEQ ID NO: 783988 - DNA, 25 bp, Mus musculus
tataggtttgccctttgaattagca

SEQ ID NO: 783989 - DNA, 25 bp, Mus musculus
tataggtttgccgtttgaattagca

SEQ ID NO: 783990 - DNA, 25 bp, Mus musculus
tatagtacacaccagccacacatgc

SEQ ID NO: 783991 - DNA, 25 bp, Mus musculus
tatagtacacacgagccacacatgc

SEQ ID NO: 783992 - DNA, 25 bp, Mus musculus
tatagtaccagaaacgtggtggctt

SEQ ID NO: 783993 - DNA, 25 bp, Mus musculus
tatagtaccagatacgtggtggctt

SEQ ID NO: 783994 - DNA, 25 bp, Mus musculus
tatagtacctcccagaatcttgtat

SEQ ID NO: 783995 - DNA, 25 bp, Mus musculus
tatagtacctccgagaatcttgtat

SEQ ID NO: 783996 - DNA, 25 bp, Mus musculus
tatagtacgtttacattctcccaga

SEQ ID NO: 783997 - DNA, 25 bp, Mus musculus
tatagtacgttttcattctcccaga

SEQ ID NO: 783998 - DNA, 25 bp, Mus musculus
tatagtagctttcatcctgtgcacc

SEQ ID NO: 783999 - DNA, 25 bp, Mus musculus
tatagtagctttgatcctgtgcacc

SEQ ID NO: 784000 - DNA, 25 bp, Mus musculus
tatagtaggagcagaaatccatgct

SEQ ID NO: 784001 - DNA, 25 bp, Mus musculus
tatagtaggagctgaaatccatgct

SEQ ID NO: 784002 - DNA, 25 bp, Mus musculus
tatagtatcccaatgtccagcactg

SEQ ID NO: 784003 - DNA, 25 bp, Mus musculus
tatagtatcccattgtccagcactg

SEQ ID NO: 784004 - DNA, 25 bp, Mus musculus
tatagtatgcaaaatctacctccag

SEQ ID NO: 784005 - DNA, 25 bp, Mus musculus
tatagtatgcaatatctacctccag

SEQ ID NO: 784006 - DNA, 25 bp, Mus musculus
tatagtattgtgaaaccctttcatg

SEQ ID NO: 784007 - DNA, 25 bp, Mus musculus
tatagtattgtgagagttccctctg

SEQ ID NO: 784008 - DNA, 25 bp, Mus musculus
tatagtattgtgtaaccctttcatg

SEQ ID NO: 784009 - DNA, 25 bp, Mus musculus
tatagtattgtgtgagttccctctg

SEQ ID NO: 784010 - DNA, 25 bp, Mus musculus
tatagtcacatcactctccaagagg

SEQ ID NO: 784011 - DNA, 25 bp, Mus musculus
tatagtcacatctctctccaagagg

SEQ ID NO: 784012 - DNA, 25 bp, Mus musculus
tatagtcacggacctactgctgcta

SEQ ID NO: 784013 - DNA, 25 bp, Mus musculus
tatagtcacggagctactgctgcta

SEQ ID NO: 784014 - DNA, 25 bp, Mus musculus
tatagtcactatacccttttagttt

SEQ ID NO: 784015 - DNA, 25 bp, Mus musculus
tatagtcactattcccttttagttt

SEQ ID NO: 784016 - DNA, 25 bp, Mus musculus
tatagtcaggcaaagtagtccacac

SEQ ID NO: 784017 - DNA, 25 bp, Mus musculus
tatagtcaggcacggcccgtgacct

SEQ ID NO: 784018 - DNA, 25 bp, Mus musculus
tatagtcaggcagggcccgtgacct

SEQ ID NO: 784019 - DNA, 25 bp, Mus musculus
tatagtcaggcatagtagtccacac

SEQ ID NO: 784020 - DNA, 25 bp, Mus musculus
tatagtcatatcaagaaggtgtcag

SEQ ID NO: 784021 - DNA, 25 bp, Mus musculus
tatagtcatatctagaaggtgtcag

SEQ ID NO: 784022 - DNA, 25 bp, Mus musculus
tatagtccagtcctttccacaggca

SEQ ID NO: 784023 - DNA, 25 bp, Mus musculus
tatagtccagtcgtttccacaggca

SEQ ID NO: 784024 - DNA, 25 bp, Mus musculus
tatagtcccactagaaccatggcca

SEQ ID NO: 784025 - DNA, 25 bp, Mus musculus
tatagtcccacttgaaccatggcca

SEQ ID NO: 784026 - DNA, 25 bp, Mus musculus
tatagtcccagcaaccttggagaat

SEQ ID NO: 784027 - DNA, 25 bp, Mus musculus
tatagtcccagctaccttggagaat

SEQ ID NO: 784028 - DNA, 25 bp, Mus musculus
tatagtcccagtccttggtaagctg

SEQ ID NO: 784029 - DNA, 25 bp, Mus musculus
tatagtcccagtgcttggtaagctg

SEQ ID NO: 784030 - DNA, 25 bp, Mus musculus
tatagtccccgtaggcagcagctgc

SEQ ID NO: 784031 - DNA, 25 bp, Mus musculus
tatagtccccgttggcagcagctgc

SEQ ID NO: 784032 - DNA, 25 bp, Mus musculus
tatagtcccgccacatcctggatct

SEQ ID NO: 784033 - DNA, 25 bp, Mus musculus
tatagtcccgcctcatcctggatct

SEQ ID NO: 784034 - DNA, 25 bp, Mus musculus
tatagtcccttgattttgagtgtga

SEQ ID NO: 784035 - DNA, 25 bp, Mus musculus
tatagtcccttgtttttgagtgtga

SEQ ID NO: 784036 - DNA, 25 bp, Mus musculus
tatagtccctttatgtcgaagggtg

SEQ ID NO: 784037 - DNA, 25 bp, Mus musculus
tatagtccctttttgtcgaagggtg

SEQ ID NO: 784038 - DNA, 25 bp, Mus musculus
tatagtccgcccaaagagtgtgcac

SEQ ID NO: 784039 - DNA, 25 bp, Mus musculus
tatagtccgccctaagagtgtgcac

SEQ ID NO: 784040 - DNA, 25 bp, Mus musculus
tatagtcctattactgagcttttaa

SEQ ID NO: 784041 - DNA, 25 bp, Mus musculus
tatagtcctatttctgagcttttaa

SEQ ID NO: 784042 - DNA, 25 bp, Mus musculus
tatagtcgccggctcaaagaggttt

SEQ ID NO: 784043 - DNA, 25 bp, Mus musculus
tatagtcgccgggtcaaagaggttt

SEQ ID NO: 784044 - DNA, 25 bp, Mus musculus
tatagtcgggctagaggcttaggca

SEQ ID NO: 784045 - DNA, 25 bp, Mus musculus
tatagtcgggcttgaggcttaggca

SEQ ID NO: 784046 - DNA, 25 bp, Mus musculus
tatagtctcaatcacccctggtttt

SEQ ID NO: 784047 - DNA, 25 bp, Mus musculus
tatagtctcaatgacccctggtttt

SEQ ID NO: 784048 - DNA, 25 bp, Mus musculus
tatagtctcggcaagttgggaggct

SEQ ID NO: 784049 - DNA, 25 bp, Mus musculus
tatagtctcggctagttgggaggct

SEQ ID NO: 784050 - DNA, 25 bp, Mus musculus
tatagtctgttcctctgattcccag

SEQ ID NO: 784051 - DNA, 25 bp, Mus musculus
tatagtctgttcgtctgattcccag

SEQ ID NO: 784052 - DNA, 25 bp, Mus musculus
tatagtcttagcacattgctgctcg

SEQ ID NO: 784053 - DNA, 25 bp, Mus musculus
tatagtcttagctcattgctgctcg

SEQ ID NO: 784054 - DNA, 25 bp, Mus musculus
tatagtcttcccacagtgtcagaaa

SEQ ID NO: 784055 - DNA, 25 bp, Mus musculus
tatagtcttccctcagtgtcagaaa

SEQ ID NO: 784056 - DNA, 25 bp, Mus musculus
tatagtcttgggacttccaaggccc

SEQ ID NO: 784057 - DNA, 25 bp, Mus musculus
tatagtcttgggtcttccaaggccc

SEQ ID NO: 784058 - DNA, 25 bp, Mus musculus
tatagtcttgtgagtaccattatga

SEQ ID NO: 784059 - DNA, 25 bp, Mus musculus
tatagtcttgtgtgtaccattatga

SEQ ID NO: 784060 - DNA, 25 bp, Mus musculus
tatagtgaaactcttttggcttcgt

SEQ ID NO: 784061 - DNA, 25 bp, Mus musculus
tatagtgaaactgttttggcttcgt

SEQ ID NO: 784062 - DNA, 25 bp, Mus musculus
tatagtgaaagaagcctggctcggc

SEQ ID NO: 784063 - DNA, 25 bp, Mus musculus
tatagtgaaagatgcctggctcggc

SEQ ID NO: 784064 - DNA, 25 bp, Mus musculus
tatagtgaccccagtttccattaaa

SEQ ID NO: 784065 - DNA, 25 bp, Mus musculus
tatagtgacccctgtttccattaaa

SEQ ID NO: 784066 - DNA, 25 bp, Mus musculus
tatagtgacgtgatgtgtaaataca

SEQ ID NO: 784067 - DNA, 25 bp, Mus musculus
tatagtgacgtgttgtgtaaataca

SEQ ID NO: 784068 - DNA, 25 bp, Mus musculus
tatagtgactccatcacagctttct

SEQ ID NO: 784069 - DNA, 25 bp, Mus musculus
tatagtgactccttcacagctttct

SEQ ID NO: 784070 - DNA, 25 bp, Mus musculus
tatagtgagcctacggacagaccga

SEQ ID NO: 784071 - DNA, 25 bp, Mus musculus
tatagtgagccttcggacagaccga

SEQ ID NO: 784072 - DNA, 25 bp, Mus musculus
tatagtgatggccttcagcatcctc

SEQ ID NO: 784073 - DNA, 25 bp, Mus musculus
tatagtgatggcgttcagcatcctc

SEQ ID NO: 784074 - DNA, 25 bp, Mus musculus
tatagtgcacgcatgtcactttggc

SEQ ID NO: 784075 - DNA, 25 bp, Mus musculus
tatagtgcacgcttgtcactttggc

SEQ ID NO: 784076 - DNA, 25 bp, Mus musculus
tatagtgcagccaacttgtgggtgt

SEQ ID NO: 784077 - DNA, 25 bp, Mus musculus
tatagtgcagcctacttgtgggtgt

SEQ ID NO: 784078 - DNA, 25 bp, Mus musculus
tatagtgcatctcctggttctgtac

SEQ ID NO: 784079 - DNA, 25 bp, Mus musculus
tatagtgcatctcgtgaatcataca

SEQ ID NO: 784080 - DNA, 25 bp, Mus musculus
tatagtgcatctgctggttctgtac

SEQ ID NO: 784081 - DNA, 25 bp, Mus musculus
tatagtgcatctggtgaatcataca

SEQ ID NO: 784082 - DNA, 25 bp, Mus musculus
tatagtgcattgatcatctgtggca

SEQ ID NO: 784083 - DNA, 25 bp, Mus musculus
tatagtgcattgttcatctgtggca

SEQ ID NO: 784084 - DNA, 25 bp, Mus musculus
tatagtgccaagacatggagcagac

SEQ ID NO: 784085 - DNA, 25 bp, Mus musculus
tatagtgccaagtcatggagcagac

SEQ ID NO: 784086 - DNA, 25 bp, Mus musculus
tatagtgccatacggctctggtcaa

SEQ ID NO: 784087 - DNA, 25 bp, Mus musculus
tatagtgccatagggctctggtcaa

SEQ ID NO: 784088 - DNA, 25 bp, Mus musculus
tatagtgcccatacatttgcgttat

SEQ ID NO: 784089 - DNA, 25 bp, Mus musculus
tatagtgcccattcatttgcgttat

SEQ ID NO: 784090 - DNA, 25 bp, Mus musculus
tatagtgcctcacagtatggactga

SEQ ID NO: 784091 - DNA, 25 bp, Mus musculus
tatagtgcctcagagtatggactga

SEQ ID NO: 784092 - DNA, 25 bp, Mus musculus
tatagtgctaccacctgagacccga

SEQ ID NO: 784093 - DNA, 25 bp, Mus musculus
tatagtgctacctcctgagacccga

SEQ ID NO: 784094 - DNA, 25 bp, Mus musculus
tatagtgctgcacttcggccgcgtg

SEQ ID NO: 784095 - DNA, 25 bp, Mus musculus
tatagtgctgcagttcggccgcgtg

SEQ ID NO: 784096 - DNA, 25 bp, Mus musculus
tatagtgctgcgcatccagggtaat

SEQ ID NO: 784097 - DNA, 25 bp, Mus musculus
tatagtgctgcggatccagggtaat

SEQ ID NO: 784098 - DNA, 25 bp, Mus musculus
tatagtgctgttcccattgctgtaa

SEQ ID NO: 784099 - DNA, 25 bp, Mus musculus
tatagtgctgttgccattgctgtaa

SEQ ID NO: 784100 - DNA, 25 bp, Mus musculus
tatagtggacttctgcacttagcac

SEQ ID NO: 784101 - DNA, 25 bp, Mus musculus
tatagtggacttgtgcacttagcac

SEQ ID NO: 784102 - DNA, 25 bp, Mus musculus
tatagtggagatccgttctgtccgt

SEQ ID NO: 784103 - DNA, 25 bp, Mus musculus
tatagtggagatgcgttctgtccgt

SEQ ID NO: 784104 - DNA, 25 bp, Mus musculus
tatagtggcattctagacctcctga

SEQ ID NO: 784105 - DNA, 25 bp, Mus musculus
tatagtggcattgtagacctcctga

SEQ ID NO: 784106 - DNA, 25 bp, Mus musculus
tatagtgggcatccttcatgtgagt

SEQ ID NO: 784107 - DNA, 25 bp, Mus musculus
tatagtgggcatgcttcatgtgagt

SEQ ID NO: 784108 - DNA, 25 bp, Mus musculus
tatagtggtgtgagattctgtgtct

SEQ ID NO: 784109 - DNA, 25 bp, Mus musculus
tatagtggtgtgtgattctgtgtct

SEQ ID NO: 784110 - DNA, 25 bp, Mus musculus
tatagtgtagccaaccaaccattct

SEQ ID NO: 784111 - DNA, 25 bp, Mus musculus
tatagtgtagcctaccaaccattct

SEQ ID NO: 784112 - DNA, 25 bp, Mus musculus
tatagtgtagcgatcagccccgacg

SEQ ID NO: 784113 - DNA, 25 bp, Mus musculus
tatagtgtagcgttcagccccgacg

SEQ ID NO: 784114 - DNA, 25 bp, Mus musculus
tatagtgtcaatccaacctacctac

SEQ ID NO: 784115 - DNA, 25 bp, Mus musculus
tatagtgtcaatgcaacctacctac

SEQ ID NO: 784116 - DNA, 25 bp, Mus musculus
tatagtgtctgtccacatcgcggcc

SEQ ID NO: 784117 - DNA, 25 bp, Mus musculus
tatagtgtctgtgcacatcgcggcc

SEQ ID NO: 784118 - DNA, 25 bp, Mus musculus
tatagtgtgaatcgccacatctctt

SEQ ID NO: 784119 - DNA, 25 bp, Mus musculus
tatagtgtgaatggccacatctctt

SEQ ID NO: 784120 - DNA, 25 bp, Mus musculus
tatagtgtgcccactaagtcagaat

SEQ ID NO: 784121 - DNA, 25 bp, Mus musculus
tatagtgtgccctctaagtcagaat

SEQ ID NO: 784122 - DNA, 25 bp, Mus musculus
tatagtgtttttccctctacaagag

SEQ ID NO: 784123 - DNA, 25 bp, Mus musculus
tatagtgtttttgcctctacaagag

SEQ ID NO: 784124 - DNA, 25 bp, Mus musculus
tatagttactatacctggtcttatt

SEQ ID NO: 784125 - DNA, 25 bp, Mus musculus
tatagttactattcctggtcttatt

SEQ ID NO: 784126 - DNA, 25 bp, Mus musculus
tatagttactccattatctctctgt

SEQ ID NO: 784127 - DNA, 25 bp, Mus musculus
tatagttactcctttatctctctgt

SEQ ID NO: 784128 - DNA, 25 bp, Mus musculus
tatagttagaagatgttggcccttt

SEQ ID NO: 784129 - DNA, 25 bp, Mus musculus
tatagttagaagttgttggcccttt

SEQ ID NO: 784130 - DNA, 25 bp, Mus musculus
tatagttatgtaatttgctcccagt

SEQ ID NO: 784131 - DNA, 25 bp, Mus musculus
tatagttatgtattttgctcccagt

SEQ ID NO: 784132 - DNA, 25 bp, Mus musculus
tatagttccctaacctgggttgatc

SEQ ID NO: 784133 - DNA, 25 bp, Mus musculus
tatagttccctatcctgggttgatc

SEQ ID NO: 784134 - DNA, 25 bp, Mus musculus
tatagttcctcacgacgtacttggg

SEQ ID NO: 784135 - DNA, 25 bp, Mus musculus
tatagttcctcaggacgtacttggg

SEQ ID NO: 784136 - DNA, 25 bp, Mus musculus
tatagttcggcaacacagcggtgaa

SEQ ID NO: 784137 - DNA, 25 bp, Mus musculus
tatagttcggcatcacagcggtgaa

SEQ ID NO: 784138 - DNA, 25 bp, Mus musculus
tatagttctcaaaacccaggtcatg

SEQ ID NO: 784139 - DNA, 25 bp, Mus musculus
tatagttctcaatacccaggtcatg

SEQ ID NO: 784140 - DNA, 25 bp, Mus musculus
tatagttctttgactttccagcttc

SEQ ID NO: 784141 - DNA, 25 bp, Mus musculus
tatagttctttgtctttccagcttc

SEQ ID NO: 784142 - DNA, 25 bp, Mus musculus
tatagttgttaaatccatgaatgag

SEQ ID NO: 784143 - DNA, 25 bp, Mus musculus
tatagttgttaattccatgaatgag

SEQ ID NO: 784144 - DNA, 25 bp, Mus musculus
tatagtttatgtctcctcatcatga

SEQ ID NO: 784145 - DNA, 25 bp, Mus musculus
tatagtttatgtgtcctcatcatga

SEQ ID NO: 784146 - DNA, 25 bp, Mus musculus
tatagtttctcaccttccctttcag

SEQ ID NO: 784147 - DNA, 25 bp, Mus musculus
tatagtttctcagcttccctttcag

SEQ ID NO: 784148 - DNA, 25 bp, Mus musculus
tatagtttctccaacagacaccttg

SEQ ID NO: 784149 - DNA, 25 bp, Mus musculus
tatagtttctcctacagacaccttg

SEQ ID NO: 784150 - DNA, 25 bp, Mus musculus
tatagtttctggcactatttttata

SEQ ID NO: 784151 - DNA, 25 bp, Mus musculus
tatagtttctgggactatttttata

SEQ ID NO: 784152 - DNA, 25 bp, Mus musculus
tatagtttgcataactacccagcag

SEQ ID NO: 784153 - DNA, 25 bp, Mus musculus
tatagtttgcattactacccagcag

SEQ ID NO: 784154 - DNA, 25 bp, Mus musculus
tatagtttgcttacgattccaagag

SEQ ID NO: 784155 - DNA, 25 bp, Mus musculus
tatagtttgctttcgattccaagag

SEQ ID NO: 784156 - DNA, 25 bp, Mus musculus
tatagttttacacggttgacacagc

SEQ ID NO: 784157 - DNA, 25 bp, Mus musculus
tatagttttacagggttgacacagc

SEQ ID NO: 784158 - DNA, 25 bp, Mus musculus
tatataaaatagcagggcttctttt

SEQ ID NO: 784159 - DNA, 25 bp, Mus musculus
tatataaaataggagggcttctttt

SEQ ID NO: 784160 - DNA, 25 bp, Mus musculus
tatataaagataacacgggctggtg

SEQ ID NO: 784161 - DNA, 25 bp, Mus musculus
tatataaagatatcacgggctggtg

SEQ ID NO: 784162 - DNA, 25 bp, Mus musculus
tatataaatggtcgctgggctcctg

SEQ ID NO: 784163 - DNA, 25 bp, Mus musculus
tatataaatggtggctgggctcctg

SEQ ID NO: 784164 - DNA, 25 bp, Mus musculus
tatataaatttaagccagtctcggc

SEQ ID NO: 784165 - DNA, 25 bp, Mus musculus
tatataaatttatgccagtctcggc

SEQ ID NO: 784166 - DNA, 25 bp, Mus musculus
tatataacaacaccctacaggtatg

SEQ ID NO: 784167 - DNA, 25 bp, Mus musculus
tatataacaacagcctacaggtatg

SEQ ID NO: 784168 - DNA, 25 bp, Mus musculus
tatataaccctgagccttgggaaaa

SEQ ID NO: 784169 - DNA, 25 bp, Mus musculus
tatataaccctgagcttagaaaaag

SEQ ID NO: 784170 - DNA, 25 bp, Mus musculus
tatataaccctgtgccttgggaaaa

SEQ ID NO: 784171 - DNA, 25 bp, Mus musculus
tatataaccctgtgcttagaaaaag

SEQ ID NO: 784172 - DNA, 25 bp, Mus musculus
tatataacgaatactcggagattgg

SEQ ID NO: 784173 - DNA, 25 bp, Mus musculus
tatataacgaattctcggagattgg

SEQ ID NO: 784174 - DNA, 25 bp, Mus musculus
tatataacgtctatggctcttcctt

SEQ ID NO: 784175 - DNA, 25 bp, Mus musculus
tatataacgtctttggctcttcctt

SEQ ID NO: 784176 - DNA, 25 bp, Mus musculus
tatataactagtcagcacagcttca

SEQ ID NO: 784177 - DNA, 25 bp, Mus musculus
tatataactagtgagcacagcttca

SEQ ID NO: 784178 - DNA, 25 bp, Mus musculus
tatataactctgcactacttctctg

SEQ ID NO: 784179 - DNA, 25 bp, Mus musculus
tatataactctgcagctttcaaagc

SEQ ID NO: 784180 - DNA, 25 bp, Mus musculus
tatataactctggactacttctctg

SEQ ID NO: 784181 - DNA, 25 bp, Mus musculus
tatataactctggagctttcaaagc

SEQ ID NO: 784182 - DNA, 25 bp, Mus musculus
tatataactgtcaccgtttctgccc

SEQ ID NO: 784183 - DNA, 25 bp, Mus musculus
tatataactgtctccgtttctgccc

SEQ ID NO: 784184 - DNA, 25 bp, Mus musculus
tatataacttctagtctttccctcc

SEQ ID NO: 784185 - DNA, 25 bp, Mus musculus
tatataacttcttgtctttccctcc

SEQ ID NO: 784186 - DNA, 25 bp, Mus musculus
tatataagcgtccatcgtgcctacc

SEQ ID NO: 784187 - DNA, 25 bp, Mus musculus
tatataagcgtcgatcgtgcctacc

SEQ ID NO: 784188 - DNA, 25 bp, Mus musculus
tatataaggaagcttcgccgccgct

SEQ ID NO: 784189 - DNA, 25 bp, Mus musculus
tatataaggaaggttcgccgccgct

SEQ ID NO: 784190 - DNA, 25 bp, Mus musculus
tatataagtaacacacatgcacatg

SEQ ID NO: 784191 - DNA, 25 bp, Mus musculus
tatataagtaactcacatgcacatg

SEQ ID NO: 784192 - DNA, 25 bp, Mus musculus
tatataatactcataccctctgtcc

SEQ ID NO: 784193 - DNA, 25 bp, Mus musculus
tatataatactcttaccctctgtcc

SEQ ID NO: 784194 - DNA, 25 bp, Mus musculus
tatataatcatgctgctcatgggca

SEQ ID NO: 784195 - DNA, 25 bp, Mus musculus
tatataatcatggtgctcatgggca

SEQ ID NO: 784196 - DNA, 25 bp, Mus musculus
tatataatccccaacctgtgctcag

SEQ ID NO: 784197 - DNA, 25 bp, Mus musculus
tatataatcccctacctgtgctcag

SEQ ID NO: 784198 - DNA, 25 bp, Mus musculus
tatataatctttcacataagcttga

SEQ ID NO: 784199 - DNA, 25 bp, Mus musculus
tatataatctttgacataagcttga

SEQ ID NO: 784200 - DNA, 25 bp, Mus musculus
tatatacaagctctaagcagtgtta

SEQ ID NO: 784201 - DNA, 25 bp, Mus musculus
tatatacaagctgtaagcagtgtta

SEQ ID NO: 784202 - DNA, 25 bp, Mus musculus
tatatacaatcacataagcatacag

SEQ ID NO: 784203 - DNA, 25 bp, Mus musculus
tatatacaatcagataagcatacag

SEQ ID NO: 784204 - DNA, 25 bp, Mus musculus
tatatacacccaatattgactgaga

SEQ ID NO: 784205 - DNA, 25 bp, Mus musculus
tatatacacccattattgactgaga

SEQ ID NO: 784206 - DNA, 25 bp, Mus musculus
tatatacactctagagcagtggtcc

SEQ ID NO: 784207 - DNA, 25 bp, Mus musculus
tatatacactcttgagcagtggtcc

SEQ ID NO: 784208 - DNA, 25 bp, Mus musculus
tatatacactttctcatctgccatt

SEQ ID NO: 784209 - DNA, 25 bp, Mus musculus
tatatacactttgtcatctgccatt

SEQ ID NO: 784210 - DNA, 25 bp, Mus musculus
tatatacagtacattgccaatcatg

SEQ ID NO: 784211 - DNA, 25 bp, Mus musculus
tatatacagtactttgccaatcatg

SEQ ID NO: 784212 - DNA, 25 bp, Mus musculus
tatatacatctgactgcatgaggat

SEQ ID NO: 784213 - DNA, 25 bp, Mus musculus
tatatacatctgtctgcatgaggat

SEQ ID NO: 784214 - DNA, 25 bp, Mus musculus
tatatacatgctagattgtgtctgc

SEQ ID NO: 784215 - DNA, 25 bp, Mus musculus
tatatacatgcttgattgtgtctgc

SEQ ID NO: 784216 - DNA, 25 bp, Mus musculus
tatataccatcccatattcagggca

SEQ ID NO: 784217 - DNA, 25 bp, Mus musculus
tatataccatccgatattcagggca

SEQ ID NO: 784218 - DNA, 25 bp, Mus musculus
tatatacccaacaaggctgccttac

SEQ ID NO: 784219 - DNA, 25 bp, Mus musculus
tatatacccaactaggctgccttac

SEQ ID NO: 784220 - DNA, 25 bp, Mus musculus
tatatacccagtaccagctgttcca

SEQ ID NO: 784221 - DNA, 25 bp, Mus musculus
tatatacccagttccagctgttcca

SEQ ID NO: 784222 - DNA, 25 bp, Mus musculus
tatataccctgaatgtccctagacc

SEQ ID NO: 784223 - DNA, 25 bp, Mus musculus
tatataccctgattgtccctagacc

SEQ ID NO: 784224 - DNA, 25 bp, Mus musculus
tatatacctcagaccaaagacagca

SEQ ID NO: 784225 - DNA, 25 bp, Mus musculus
tatatacctcagtccaaagacagca

SEQ ID NO: 784226 - DNA, 25 bp, Mus musculus
tatatacctggacgtctttgcccct

SEQ ID NO: 784227 - DNA, 25 bp, Mus musculus
tatatacctggaggtctttgcccct

SEQ ID NO: 784228 - DNA, 25 bp, Mus musculus
tatatacctggtccttgatggagaa

SEQ ID NO: 784229 - DNA, 25 bp, Mus musculus
tatatacctggtgcttgatggagaa

SEQ ID NO: 784230 - DNA, 25 bp, Mus musculus
tatatacctgtaacctaactgctca

SEQ ID NO: 784231 - DNA, 25 bp, Mus musculus
tatatacctgtatcctaactgctca

SEQ ID NO: 784232 - DNA, 25 bp, Mus musculus
tatataccttccagtgttcacacag

SEQ ID NO: 784233 - DNA, 25 bp, Mus musculus
tatataccttcctgtgttcacacag

SEQ ID NO: 784234 - DNA, 25 bp, Mus musculus
tatatacgacccacaaaaacctgct

SEQ ID NO: 784235 - DNA, 25 bp, Mus musculus
tatatacgaccctcaaaaacctgct

SEQ ID NO: 784236 - DNA, 25 bp, Mus musculus
tatatactcagaaagcctcggaccg

SEQ ID NO: 784237 - DNA, 25 bp, Mus musculus
tatatactcagatagcctcggaccg

SEQ ID NO: 784238 - DNA, 25 bp, Mus musculus
tatatactcagtctcgctatcccag

SEQ ID NO: 784239 - DNA, 25 bp, Mus musculus
tatatactcagtgtcgctatcccag

SEQ ID NO: 784240 - DNA, 25 bp, Mus musculus
tatatactgcaaagagatgcctcag

SEQ ID NO: 784241 - DNA, 25 bp, Mus musculus
tatatactgcaatgagatgcctcag

SEQ ID NO: 784242 - DNA, 25 bp, Mus musculus
tatatacttcctaaacttgtttgat

SEQ ID NO: 784243 - DNA, 25 bp, Mus musculus
tatatacttccttaacttgtttgat

SEQ ID NO: 784244 - DNA, 25 bp, Mus musculus
tatatacttttcctggtgcctcgaa

SEQ ID NO: 784245 - DNA, 25 bp, Mus musculus
tatatacttttcgtggtgcctcgaa

SEQ ID NO: 784246 - DNA, 25 bp, Mus musculus
tatatagaagcaacttccttgtaaa

SEQ ID NO: 784247 - DNA, 25 bp, Mus musculus
tatatagaagcatcttccttgtaaa

SEQ ID NO: 784248 - DNA, 25 bp, Mus musculus
tatatagcaagacccaaactcccac

SEQ ID NO: 784249 - DNA, 25 bp, Mus musculus
tatatagcaagagccaaactcccac

SEQ ID NO: 784250 - DNA, 25 bp, Mus musculus
tatatagcacccattagcctatccc

SEQ ID NO: 784251 - DNA, 25 bp, Mus musculus
tatatagcaccctttagcctatccc

SEQ ID NO: 784252 - DNA, 25 bp, Mus musculus
tatatagcatgtacaggtccctggg

SEQ ID NO: 784253 - DNA, 25 bp, Mus musculus
tatatagcatgttcaggtccctggg

SEQ ID NO: 784254 - DNA, 25 bp, Mus musculus
tatatagccacgatgtaccacaatg

SEQ ID NO: 784255 - DNA, 25 bp, Mus musculus
tatatagccacgttgtaccacaatg

SEQ ID NO: 784256 - DNA, 25 bp, Mus musculus
tatatagcctctaaggtggccttat

SEQ ID NO: 784257 - DNA, 25 bp, Mus musculus
tatatagcctcttaggtggccttat

SEQ ID NO: 784258 - DNA, 25 bp, Mus musculus
tatatagcgctaatctaagaaatgt

SEQ ID NO: 784259 - DNA, 25 bp, Mus musculus
tatatagcgctattctaagaaatgt

SEQ ID NO: 784260 - DNA, 25 bp, Mus musculus
tatatagctgagaccttggtgtgcg

SEQ ID NO: 784261 - DNA, 25 bp, Mus musculus
tatatagctgagtccttggtgtgcg

SEQ ID NO: 784262 - DNA, 25 bp, Mus musculus
tatatagctggcaccttcatggtct

SEQ ID NO: 784263 - DNA, 25 bp, Mus musculus
tatatagctggctccttcatggtct

SEQ ID NO: 784264 - DNA, 25 bp, Mus musculus
tatataggaagcccgaggttcccaa

SEQ ID NO: 784265 - DNA, 25 bp, Mus musculus
tatataggaagcgcgaggttcccaa

SEQ ID NO: 784266 - DNA, 25 bp, Mus musculus
tatatagggcctcgtctcagaatca

SEQ ID NO: 784267 - DNA, 25 bp, Mus musculus
tatatagggcctggtctcagaatca

SEQ ID NO: 784268 - DNA, 25 bp, Mus musculus
tatataggtgttcatcctgtggtgc

SEQ ID NO: 784269 - DNA, 25 bp, Mus musculus
tatataggtgttgatcctgtggtgc

SEQ ID NO: 784270 - DNA, 25 bp, Mus musculus
tatatagtattaatttgcagcccaa

SEQ ID NO: 784271 - DNA, 25 bp, Mus musculus
tatatagtattattttgcagcccaa

SEQ ID NO: 784272 - DNA, 25 bp, Mus musculus
tatatagtccctccactctttgata

SEQ ID NO: 784273 - DNA, 25 bp, Mus musculus
tatatagtccctgcactctttgata

SEQ ID NO: 784274 - DNA, 25 bp, Mus musculus
tatatagtgaatacccagacagaca

SEQ ID NO: 784275 - DNA, 25 bp, Mus musculus
tatatagtgaattcccagacagaca

SEQ ID NO: 784276 - DNA, 25 bp, Mus musculus
tatatatacacccaagcttcccaag

SEQ ID NO: 784277 - DNA, 25 bp, Mus musculus
tatatatacaccgaagcttcccaag

SEQ ID NO: 784278 - DNA, 25 bp, Mus musculus
tatatatactcacctcgtccagggt

SEQ ID NO: 784279 - DNA, 25 bp, Mus musculus
tatatatactcagctcgtccagggt

SEQ ID NO: 784280 - DNA, 25 bp, Mus musculus
tatatatagtccctagtctggcctg

SEQ ID NO: 784281 - DNA, 25 bp, Mus musculus
tatatatagtccgtagtctggcctg

SEQ ID NO: 784282 - DNA, 25 bp, Mus musculus
tatatatatggaattgttgctgtta

SEQ ID NO: 784283 - DNA, 25 bp, Mus musculus
tatatatatggatttgttgctgtta

SEQ ID NO: 784284 - DNA, 25 bp, Mus musculus
tatatatatgttatcccctagggtg

SEQ ID NO: 784285 - DNA, 25 bp, Mus musculus
tatatatatgttttcccctagggtg

SEQ ID NO: 784286 - DNA, 25 bp, Mus musculus
tatatatattttccacagccaggga

SEQ ID NO: 784287 - DNA, 25 bp, Mus musculus
tatatatattttgcacagccaggga

SEQ ID NO: 784288 - DNA, 25 bp, Mus musculus
tatatatccacaagttcctcttcgc

SEQ ID NO: 784289 - DNA, 25 bp, Mus musculus
tatatatccacatgttcctcttcgc

SEQ ID NO: 784290 - DNA, 25 bp, Mus musculus
tatatatcccgtctcttaattaaaa

SEQ ID NO: 784291 - DNA, 25 bp, Mus musculus
tatatatcccgtgtcttaattaaaa

SEQ ID NO: 784292 - DNA, 25 bp, Mus musculus
tatatatcccttacagccccattaa

SEQ ID NO: 784293 - DNA, 25 bp, Mus musculus
tatatatccctttcagccccattaa

SEQ ID NO: 784294 - DNA, 25 bp, Mus musculus
tatatatcgggtagtcatctttctt

SEQ ID NO: 784295 - DNA, 25 bp, Mus musculus
tatatatcgggttgtcatctttctt

SEQ ID NO: 784296 - DNA, 25 bp, Mus musculus
tatatatctcaacacgaggtagttc

SEQ ID NO: 784297 - DNA, 25 bp, Mus musculus
tatatatctcaagacgaggtagttc

SEQ ID NO: 784298 - DNA, 25 bp, Mus musculus
tatatatgacttcactccctctttc

SEQ ID NO: 784299 - DNA, 25 bp, Mus musculus
tatatatgacttgactccctctttc

SEQ ID NO: 784300 - DNA, 25 bp, Mus musculus
tatatatgccttacggagcccagag

SEQ ID NO: 784301 - DNA, 25 bp, Mus musculus
tatatatgcctttcggagcccagag

SEQ ID NO: 784302 - DNA, 25 bp, Mus musculus
tatatatggagtagctcccttcccc

SEQ ID NO: 784303 - DNA, 25 bp, Mus musculus
tatatatggagttgctcccttcccc

SEQ ID NO: 784304 - DNA, 25 bp, Mus musculus
tatatatggcacattttctttctac

SEQ ID NO: 784305 - DNA, 25 bp, Mus musculus
tatatatggcactttttctttctac

SEQ ID NO: 784306 - DNA, 25 bp, Mus musculus
tatatatgtatgagccaccattcct

SEQ ID NO: 784307 - DNA, 25 bp, Mus musculus
tatatatgtatgtgccaccattcct

SEQ ID NO: 784308 - DNA, 25 bp, Mus musculus
tatatatgtgtgacctgagtacttg

SEQ ID NO: 784309 - DNA, 25 bp, Mus musculus
tatatatgtgtgtcctgagtacttg

SEQ ID NO: 784310 - DNA, 25 bp, Mus musculus
tatatattaagtctctccctctctg

SEQ ID NO: 784311 - DNA, 25 bp, Mus musculus
tatatattaagtgtctccctctctg

SEQ ID NO: 784312 - DNA, 25 bp, Mus musculus
tatatattcccaaggatctcctgct

SEQ ID NO: 784313 - DNA, 25 bp, Mus musculus
tatatattcccatggatctcctgct

SEQ ID NO: 784314 - DNA, 25 bp, Mus musculus
tatatattccctaaactactgagtt

SEQ ID NO: 784315 - DNA, 25 bp, Mus musculus
tatatattcccttaactactgagtt

SEQ ID NO: 784316 - DNA, 25 bp, Mus musculus
tatatattccttcttcaaccgggac

SEQ ID NO: 784317 - DNA, 25 bp, Mus musculus
tatatattccttgttcaaccgggac

SEQ ID NO: 784318 - DNA, 25 bp, Mus musculus
tatatattctacaattcctaacaaa

SEQ ID NO: 784319 - DNA, 25 bp, Mus musculus
tatatattctactattcctaacaaa

SEQ ID NO: 784320 - DNA, 25 bp, Mus musculus
tatatattgtgacatccctccatct

SEQ ID NO: 784321 - DNA, 25 bp, Mus musculus
tatatattgtgagatccctccatct

SEQ ID NO: 784322 - DNA, 25 bp, Mus musculus
tatatattgtttccccgagtttctc

SEQ ID NO: 784323 - DNA, 25 bp, Mus musculus
tatatattgtttgcccgagtttctc

SEQ ID NO: 784324 - DNA, 25 bp, Mus musculus
tatatattttacaggacagaaaggt

SEQ ID NO: 784325 - DNA, 25 bp, Mus musculus
tatatattttactggacagaaaggt

SEQ ID NO: 784326 - DNA, 25 bp, Mus musculus
tatatatttttgcaaagctgacctt

SEQ ID NO: 784327 - DNA, 25 bp, Mus musculus
tatatatttttggaaagctgacctt

SEQ ID NO: 784328 - DNA, 25 bp, Mus musculus
tatatcaaacagatgagattcatgg

SEQ ID NO: 784329 - DNA, 25 bp, Mus musculus
tatatcaaacagttgagattcatgg

SEQ ID NO: 784330 - DNA, 25 bp, Mus musculus
tatatcaacactctggcttcccttt

SEQ ID NO: 784331 - DNA, 25 bp, Mus musculus
tatatcaacactgtggcttcccttt

SEQ ID NO: 784332 - DNA, 25 bp, Mus musculus
tatatcaagcacacagcagcacaga

SEQ ID NO: 784333 - DNA, 25 bp, Mus musculus
tatatcaagcactcagcagcacaga

SEQ ID NO: 784334 - DNA, 25 bp, Mus musculus
tatatcaatctacgctggaggaggt

SEQ ID NO: 784335 - DNA, 25 bp, Mus musculus
tatatcaatctaggctggaggaggt

SEQ ID NO: 784336 - DNA, 25 bp, Mus musculus
tatatcacaccgactgagtatatgg

SEQ ID NO: 784337 - DNA, 25 bp, Mus musculus
tatatcacaccgtctgagtatatgg

SEQ ID NO: 784338 - DNA, 25 bp, Mus musculus
tatatcacatggactctggccggaa

SEQ ID NO: 784339 - DNA, 25 bp, Mus musculus
tatatcacatggtctctggccggaa

SEQ ID NO: 784340 - DNA, 25 bp, Mus musculus
tatatcacccgtactcaatttgttg

SEQ ID NO: 784341 - DNA, 25 bp, Mus musculus
tatatcacccgttctcaatttgttg

SEQ ID NO: 784342 - DNA, 25 bp, Mus musculus
tatatcactacaacgtgctctctgg

SEQ ID NO: 784343 - DNA, 25 bp, Mus musculus
tatatcactacatcgtgctctctgg

SEQ ID NO: 784344 - DNA, 25 bp, Mus musculus
tatatcactttgattaacgtttcgt

SEQ ID NO: 784345 - DNA, 25 bp, Mus musculus
tatatcactttgtttaacgtttcgt

SEQ ID NO: 784346 - DNA, 25 bp, Mus musculus
tatatcagacgaaggcggctattat

SEQ ID NO: 784347 - DNA, 25 bp, Mus musculus
tatatcagacgatggcggctattat

SEQ ID NO: 784348 - DNA, 25 bp, Mus musculus
tatatcagccttcacggctatggct

SEQ ID NO: 784349 - DNA, 25 bp, Mus musculus
tatatcagccttgacggctatggct

SEQ ID NO: 784350 - DNA, 25 bp, Mus musculus
tatatcaggtagctcagccccacag

SEQ ID NO: 784351 - DNA, 25 bp, Mus musculus
tatatcaggtaggtcagccccacag

SEQ ID NO: 784352 - DNA, 25 bp, Mus musculus
tatatcaggtatcagccaaggctgc

SEQ ID NO: 784353 - DNA, 25 bp, Mus musculus
tatatcaggtatgagccaaggctgc

SEQ ID NO: 784354 - DNA, 25 bp, Mus musculus
tatatcagtttacaccatttccagt

SEQ ID NO: 784355 - DNA, 25 bp, Mus musculus
tatatcagtttagaccatttccagt

SEQ ID NO: 784356 - DNA, 25 bp, Mus musculus
tatatcatctcccatgagccggtga

SEQ ID NO: 784357 - DNA, 25 bp, Mus musculus
tatatcatctccgatgagccggtga

SEQ ID NO: 784358 - DNA, 25 bp, Mus musculus
tatatccaagaacctagtgggcccc

SEQ ID NO: 784359 - DNA, 25 bp, Mus musculus
tatatccaagaagctagtgggcccc

SEQ ID NO: 784360 - DNA, 25 bp, Mus musculus
tatatccaagcacccgaatccgtta

SEQ ID NO: 784361 - DNA, 25 bp, Mus musculus
tatatccaagcagccgaatccgtta

SEQ ID NO: 784362 - DNA, 25 bp, Mus musculus
tatatccaatctacacagctcggtg

SEQ ID NO: 784363 - DNA, 25 bp, Mus musculus
tatatccaatcttcacagctcggtg

SEQ ID NO: 784364 - DNA, 25 bp, Mus musculus
tatatccacaccaatgaccacaaat

SEQ ID NO: 784365 - DNA, 25 bp, Mus musculus
tatatccacacctatgaccacaaat

SEQ ID NO: 784366 - DNA, 25 bp, Mus musculus
tatatccagtttctaccctacaaat

SEQ ID NO: 784367 - DNA, 25 bp, Mus musculus
tatatccagtttgtaccctacaaat

SEQ ID NO: 784368 - DNA, 25 bp, Mus musculus
tatatccatgatactgacacttaga

SEQ ID NO: 784369 - DNA, 25 bp, Mus musculus
tatatccatgattctgacacttaga

SEQ ID NO: 784370 - DNA, 25 bp, Mus musculus
tatatccatgtaactcacccaaaaa

SEQ ID NO: 784371 - DNA, 25 bp, Mus musculus
tatatccatgtatctcacccaaaaa

SEQ ID NO: 784372 - DNA, 25 bp, Mus musculus
tatatccatttgctaggcttctgct

SEQ ID NO: 784373 - DNA, 25 bp, Mus musculus
tatatccatttggtaggcttctgct

SEQ ID NO: 784374 - DNA, 25 bp, Mus musculus
tatatcccaaaactcatcatctcta

SEQ ID NO: 784375 - DNA, 25 bp, Mus musculus
tatatcccaaaagtcatcatctcta

SEQ ID NO: 784376 - DNA, 25 bp, Mus musculus
tatatcccaagcaaacactgttcca

SEQ ID NO: 784377 - DNA, 25 bp, Mus musculus
tatatcccaagctaacactgttcca

SEQ ID NO: 784378 - DNA, 25 bp, Mus musculus
tatatcccagaacacaccttgatgc

SEQ ID NO: 784379 - DNA, 25 bp, Mus musculus
tatatcccagaagacaccttgatgc

SEQ ID NO: 784380 - DNA, 25 bp, Mus musculus
tatatcccccacataacaaatcatc

SEQ ID NO: 784381 - DNA, 25 bp, Mus musculus
tatatcccccacttaacaaatcatc

SEQ ID NO: 784382 - DNA, 25 bp, Mus musculus
tatatcccggagagaagtacctttt

SEQ ID NO: 784383 - DNA, 25 bp, Mus musculus
tatatcccggagtgaagtacctttt

SEQ ID NO: 784384 - DNA, 25 bp, Mus musculus
tatatccctgaaacgacatctttag

SEQ ID NO: 784385 - DNA, 25 bp, Mus musculus
tatatccctgaatcgacatctttag

SEQ ID NO: 784386 - DNA, 25 bp, Mus musculus
tatatccctgccagttcctgaaggt

SEQ ID NO: 784387 - DNA, 25 bp, Mus musculus
tatatccctgcctgttcctgaaggt

SEQ ID NO: 784388 - DNA, 25 bp, Mus musculus
tatatccgggaccatgacacacttg

SEQ ID NO: 784389 - DNA, 25 bp, Mus musculus
tatatccgggacgatgacacacttg

SEQ ID NO: 784390 - DNA, 25 bp, Mus musculus
tatatcctatgtatatacatcttaa

SEQ ID NO: 784391 - DNA, 25 bp, Mus musculus
tatatcctatgtttatacatcttaa

SEQ ID NO: 784392 - DNA, 25 bp, Mus musculus
tatatcctattcatgccccatcgat

SEQ ID NO: 784393 - DNA, 25 bp, Mus musculus
tatatcctattcttgccccatcgat

SEQ ID NO: 784394 - DNA, 25 bp, Mus musculus
tatatcctcatgaccttagggacag

SEQ ID NO: 784395 - DNA, 25 bp, Mus musculus
tatatcctcatgtccttagggacag

SEQ ID NO: 784396 - DNA, 25 bp, Mus musculus
tatatcctcattagcatttgtcttt

SEQ ID NO: 784397 - DNA, 25 bp, Mus musculus
tatatcctcatttgcatttgtcttt

SEQ ID NO: 784398 - DNA, 25 bp, Mus musculus
tatatcctcgccaaggcaacctgtt

SEQ ID NO: 784399 - DNA, 25 bp, Mus musculus
tatatcctcgcctaggcaacctgtt

SEQ ID NO: 784400 - DNA, 25 bp, Mus musculus
tatatcctctcactgctttcctagc

SEQ ID NO: 784401 - DNA, 25 bp, Mus musculus
tatatcctctcagtgctttcctagc

SEQ ID NO: 784402 - DNA, 25 bp, Mus musculus
tatatcctctttcgccggtctgtgc

SEQ ID NO: 784403 - DNA, 25 bp, Mus musculus
tatatcctctttggccggtctgtgc

SEQ ID NO: 784404 - DNA, 25 bp, Mus musculus
tatatcctggatcctgtcctgtttt

SEQ ID NO: 784405 - DNA, 25 bp, Mus musculus
tatatcctggatgctgtcctgtttt

SEQ ID NO: 784406 - DNA, 25 bp, Mus musculus
tatatcctgggaactgggttttaat

SEQ ID NO: 784407 - DNA, 25 bp, Mus musculus
tatatcctgggatctgggttttaat

SEQ ID NO: 784408 - DNA, 25 bp, Mus musculus
tatatcctgttgacaggtatctgac

SEQ ID NO: 784409 - DNA, 25 bp, Mus musculus
tatatcctgttgtcaggtatctgac

SEQ ID NO: 784410 - DNA, 25 bp, Mus musculus
tatatccttgcaagcctcaaaggtg

SEQ ID NO: 784411 - DNA, 25 bp, Mus musculus
tatatccttgcatgcctcaaaggtg

SEQ ID NO: 784412 - DNA, 25 bp, Mus musculus
tatatcgagcctaaccctaccaaat

SEQ ID NO: 784413 - DNA, 25 bp, Mus musculus
tatatcgagccttaccctaccaaat

SEQ ID NO: 784414 - DNA, 25 bp, Mus musculus
tatatcgggttgacatctttctttg

SEQ ID NO: 784415 - DNA, 25 bp, Mus musculus
tatatcgggttgtcatctttctttg

SEQ ID NO: 784416 - DNA, 25 bp, Mus musculus
tatatcgtggacccaaagtcgatac

SEQ ID NO: 784417 - DNA, 25 bp, Mus musculus
tatatcgtggacgcaaagtcgatac

SEQ ID NO: 784418 - DNA, 25 bp, Mus musculus
tatatctaagccagtgttcttgctg

SEQ ID NO: 784419 - DNA, 25 bp, Mus musculus
tatatctaagcctgtgttcttgctg

SEQ ID NO: 784420 - DNA, 25 bp, Mus musculus
tatatctacctcaacaactgtctga

SEQ ID NO: 784421 - DNA, 25 bp, Mus musculus
tatatctacctctacaactgtctga

SEQ ID NO: 784422 - DNA, 25 bp, Mus musculus
tatatctagttaactctgccttgct

SEQ ID NO: 784423 - DNA, 25 bp, Mus musculus
tatatctagttatctctgccttgct

SEQ ID NO: 784424 - DNA, 25 bp, Mus musculus
tatatctccagaaagcagcctgcac

SEQ ID NO: 784425 - DNA, 25 bp, Mus musculus
tatatctccagatagcagcctgcac

SEQ ID NO: 784426 - DNA, 25 bp, Mus musculus
tatatctcccaactttctatctgaa

SEQ ID NO: 784427 - DNA, 25 bp, Mus musculus
tatatctcccaagtttctatctgaa

SEQ ID NO: 784428 - DNA, 25 bp, Mus musculus
tatatctcccttcatgtttatccat

SEQ ID NO: 784429 - DNA, 25 bp, Mus musculus
tatatctcccttgatgtttatccat

SEQ ID NO: 784430 - DNA, 25 bp, Mus musculus
tatatctcctgtcaccgttaatctc

SEQ ID NO: 784431 - DNA, 25 bp, Mus musculus
tatatctcctgtgaccgttaatctc

SEQ ID NO: 784432 - DNA, 25 bp, Mus musculus
tatatctctatcacaatctctctgc

SEQ ID NO: 784433 - DNA, 25 bp, Mus musculus
tatatctctatctcaatctctctgc

SEQ ID NO: 784434 - DNA, 25 bp, Mus musculus
tatatctgatgtcatgccccagcat

SEQ ID NO: 784435 - DNA, 25 bp, Mus musculus
tatatctgatgtgatgccccagcat

SEQ ID NO: 784436 - DNA, 25 bp, Mus musculus
tatatctgctttacacgtgtgtgta

SEQ ID NO: 784437 - DNA, 25 bp, Mus musculus
tatatctgcttttcacgtgtgtgta

SEQ ID NO: 784438 - DNA, 25 bp, Mus musculus
tatatctggactctcctgtattata

SEQ ID NO: 784439 - DNA, 25 bp, Mus musculus
tatatctggactgtcctgtattata

SEQ ID NO: 784440 - DNA, 25 bp, Mus musculus
tatatctgggagagtaggtatgtct

SEQ ID NO: 784441 - DNA, 25 bp, Mus musculus
tatatctgggagtgtaggtatgtct

SEQ ID NO: 784442 - DNA, 25 bp, Mus musculus
tatatctgtaaactttccctaatag

SEQ ID NO: 784443 - DNA, 25 bp, Mus musculus
tatatctgtaaagtttccctaatag

SEQ ID NO: 784444 - DNA, 25 bp, Mus musculus
tatatctgtggtagtctgtgccttt

SEQ ID NO: 784445 - DNA, 25 bp, Mus musculus
tatatctgtggttgtctgtgccttt

SEQ ID NO: 784446 - DNA, 25 bp, Mus musculus
tatatcttagaaaccctgtctaggg

SEQ ID NO: 784447 - DNA, 25 bp, Mus musculus
tatatcttagaatccctgtctaggg

SEQ ID NO: 784448 - DNA, 25 bp, Mus musculus
tatatcttatctcaggactcttcgc

SEQ ID NO: 784449 - DNA, 25 bp, Mus musculus
tatatcttatctgaggactcttcgc

SEQ ID NO: 784450 - DNA, 25 bp, Mus musculus
tatatcttcaacactcctgcatacc

SEQ ID NO: 784451 - DNA, 25 bp, Mus musculus
tatatcttcaactctcctgcatacc

SEQ ID NO: 784452 - DNA, 25 bp, Mus musculus
tatatcttcaggactatttcactaa

SEQ ID NO: 784453 - DNA, 25 bp, Mus musculus
tatatcttcaggtctatttcactaa

SEQ ID NO: 784454 - DNA, 25 bp, Mus musculus
tatatcttccacatcggattcgaaa

SEQ ID NO: 784455 - DNA, 25 bp, Mus musculus
tatatcttccacttcggattcgaaa

SEQ ID NO: 784456 - DNA, 25 bp, Mus musculus
tatatcttcccaaactggttttgtt

SEQ ID NO: 784457 - DNA, 25 bp, Mus musculus
tatatcttcccatactggttttgtt

SEQ ID NO: 784458 - DNA, 25 bp, Mus musculus
tatatcttgttgcattcagtgtggg

SEQ ID NO: 784459 - DNA, 25 bp, Mus musculus
tatatcttgttggattcagtgtggg

SEQ ID NO: 784460 - DNA, 25 bp, Mus musculus
tatatgaatggacctctcggctgct

SEQ ID NO: 784461 - DNA, 25 bp, Mus musculus
tatatgaatggagctctcggctgct

SEQ ID NO: 784462 - DNA, 25 bp, Mus musculus
tatatgacctccaagatgccaaaag

SEQ ID NO: 784463 - DNA, 25 bp, Mus musculus
tatatgacctcctagatgccaaaag

SEQ ID NO: 784464 - DNA, 25 bp, Mus musculus
tatatgactcgcactctcaatcctg

SEQ ID NO: 784465 - DNA, 25 bp, Mus musculus
tatatgactcgctctctcaatcctg

SEQ ID NO: 784466 - DNA, 25 bp, Mus musculus
tatatgagagtcagtgccaagtctt

SEQ ID NO: 784467 - DNA, 25 bp, Mus musculus
tatatgagagtctgtgccaagtctt

SEQ ID NO: 784468 - DNA, 25 bp, Mus musculus
tatatgagcagacggactttaggct

SEQ ID NO: 784469 - DNA, 25 bp, Mus musculus
tatatgagcagagggactttaggct

SEQ ID NO: 784470 - DNA, 25 bp, Mus musculus
tatatgagtcagaggctgccatacg

SEQ ID NO: 784471 - DNA, 25 bp, Mus musculus
tatatgagtcagtggctgccatacg

SEQ ID NO: 784472 - DNA, 25 bp, Mus musculus
tatatgataactcgatctgcctgga

SEQ ID NO: 784473 - DNA, 25 bp, Mus musculus
tatatgataactggatctgcctgga

SEQ ID NO: 784474 - DNA, 25 bp, Mus musculus
tatatgatacttacactttgaaact

SEQ ID NO: 784475 - DNA, 25 bp, Mus musculus
tatatgatactttcactttgaaact

SEQ ID NO: 784476 - DNA, 25 bp, Mus musculus
tatatgatagtgagcgttcgccttc

SEQ ID NO: 784477 - DNA, 25 bp, Mus musculus
tatatgatagtgtgcgttcgccttc

SEQ ID NO: 784478 - DNA, 25 bp, Mus musculus
tatatgatcattccacatcctcttc

SEQ ID NO: 784479 - DNA, 25 bp, Mus musculus
tatatgatcattgcacatcctcttc

SEQ ID NO: 784480 - DNA, 25 bp, Mus musculus
tatatgatctccctttgttcctacc

SEQ ID NO: 784481 - DNA, 25 bp, Mus musculus
tatatgatctccgtttgttcctacc

SEQ ID NO: 784482 - DNA, 25 bp, Mus musculus
tatatgatctctacctcagaccttg

SEQ ID NO: 784483 - DNA, 25 bp, Mus musculus
tatatgatctcttcctcagaccttg

SEQ ID NO: 784484 - DNA, 25 bp, Mus musculus
tatatgattccgctcctgctctgta

SEQ ID NO: 784485 - DNA, 25 bp, Mus musculus
tatatgattccggtcctgctctgta

SEQ ID NO: 784486 - DNA, 25 bp, Mus musculus
tatatgcaagtgaacccagggagga

SEQ ID NO: 784487 - DNA, 25 bp, Mus musculus
tatatgcaagtgtacccagggagga

SEQ ID NO: 784488 - DNA, 25 bp, Mus musculus
tatatgcaatgcactcactctcagc

SEQ ID NO: 784489 - DNA, 25 bp, Mus musculus
tatatgcaatgctctcactctcagc

SEQ ID NO: 784490 - DNA, 25 bp, Mus musculus
tatatgcaccttcggcaagcccgac

SEQ ID NO: 784491 - DNA, 25 bp, Mus musculus
tatatgcaccttgggcaagcccgac

SEQ ID NO: 784492 - DNA, 25 bp, Mus musculus
tatatgcagaatacccaagactcaa

SEQ ID NO: 784493 - DNA, 25 bp, Mus musculus
tatatgcagaattcccaagactcaa

SEQ ID NO: 784494 - DNA, 25 bp, Mus musculus
tatatgcagcacaaattggagtcag

SEQ ID NO: 784495 - DNA, 25 bp, Mus musculus
tatatgcagcactaattggagtcag

SEQ ID NO: 784496 - DNA, 25 bp, Mus musculus
tatatgcataccaatgtcgtgaccc

SEQ ID NO: 784497 - DNA, 25 bp, Mus musculus
tatatgcatacctatgtcgtgaccc

SEQ ID NO: 784498 - DNA, 25 bp, Mus musculus
tatatgcatgctacttggctatcaa

SEQ ID NO: 784499 - DNA, 25 bp, Mus musculus
tatatgcatgcttcttggctatcaa

SEQ ID NO: 784500 - DNA, 25 bp, Mus musculus
tatatgccagggagttccctttcaa

SEQ ID NO: 784501 - DNA, 25 bp, Mus musculus
tatatgccagggtgttccctttcaa

SEQ ID NO: 784502 - DNA, 25 bp, Mus musculus
tatatgcccgctaaagtgtctgctt

SEQ ID NO: 784503 - DNA, 25 bp, Mus musculus
tatatgcccgcttaagtgtctgctt

SEQ ID NO: 784504 - DNA, 25 bp, Mus musculus
tatatgccctaccacgcctagtttt

SEQ ID NO: 784505 - DNA, 25 bp, Mus musculus
tatatgccctacgacgcctagtttt

SEQ ID NO: 784506 - DNA, 25 bp, Mus musculus
tatatgcctatgatcttatgtctgt

SEQ ID NO: 784507 - DNA, 25 bp, Mus musculus
tatatgcctatgttcttatgtctgt

SEQ ID NO: 784508 - DNA, 25 bp, Mus musculus
tatatgcctctcatgtacacacagt

SEQ ID NO: 784509 - DNA, 25 bp, Mus musculus
tatatgcctctcttgtacacacagt

SEQ ID NO: 784510 - DNA, 25 bp, Mus musculus
tatatgcctttcacgccaacagttt

SEQ ID NO: 784511 - DNA, 25 bp, Mus musculus
tatatgcctttctcgccaacagttt

SEQ ID NO: 784512 - DNA, 25 bp, Mus musculus
tatatgcgccgtcgtggctaccgcc

SEQ ID NO: 784513 - DNA, 25 bp, Mus musculus
tatatgcgccgtggtggctaccgcc

SEQ ID NO: 784514 - DNA, 25 bp, Mus musculus
tatatgcgtgggaggctgagatcct

SEQ ID NO: 784515 - DNA, 25 bp, Mus musculus
tatatgcgtgggtggctgagatcct

SEQ ID NO: 784516 - DNA, 25 bp, Mus musculus
tatatgctatttagaagaccccact

SEQ ID NO: 784517 - DNA, 25 bp, Mus musculus
tatatgctattttgaagaccccact

SEQ ID NO: 784518 - DNA, 25 bp, Mus musculus
tatatgctcacacttctagaagatg

SEQ ID NO: 784519 - DNA, 25 bp, Mus musculus
tatatgctcacagttctagaagatg

SEQ ID NO: 784520 - DNA, 25 bp, Mus musculus
tatatgctccagataagagtctgca

SEQ ID NO: 784521 - DNA, 25 bp, Mus musculus
tatatgctccagttaagagtctgca

SEQ ID NO: 784522 - DNA, 25 bp, Mus musculus
tatatgctctgcagggttgggcttt

SEQ ID NO: 784523 - DNA, 25 bp, Mus musculus
tatatgctctgctgggttgggcttt

SEQ ID NO: 784524 - DNA, 25 bp, Mus musculus
tatatgctgcctaccttttgtgctg

SEQ ID NO: 784525 - DNA, 25 bp, Mus musculus
tatatgctgccttccttttgtgctg

SEQ ID NO: 784526 - DNA, 25 bp, Mus musculus
tatatgctgtgcaggtcagtggcct

SEQ ID NO: 784527 - DNA, 25 bp, Mus musculus
tatatgctgtgctggtcagtggcct

SEQ ID NO: 784528 - DNA, 25 bp, Mus musculus
tatatgcttcaaattcattcagaga

SEQ ID NO: 784529 - DNA, 25 bp, Mus musculus
tatatgcttcaatttcattcagaga

SEQ ID NO: 784530 - DNA, 25 bp, Mus musculus
tatatgcttgttaccttgcacctgt

SEQ ID NO: 784531 - DNA, 25 bp, Mus musculus
tatatgcttgtttccttgcacctgt

SEQ ID NO: 784532 - DNA, 25 bp, Mus musculus
tatatggaactaaagcattagctta

SEQ ID NO: 784533 - DNA, 25 bp, Mus musculus
tatatggaactatagcattagctta

SEQ ID NO: 784534 - DNA, 25 bp, Mus musculus
tatatggacctaccttaaggcgatt

SEQ ID NO: 784535 - DNA, 25 bp, Mus musculus
tatatggacctagcttaaggcgatt

SEQ ID NO: 784536 - DNA, 25 bp, Mus musculus
tatatggactataggctggcccggc

SEQ ID NO: 784537 - DNA, 25 bp, Mus musculus
tatatggactattggctggcccggc

SEQ ID NO: 784538 - DNA, 25 bp, Mus musculus
tatatggagccaattgtgtctgtgt

SEQ ID NO: 784539 - DNA, 25 bp, Mus musculus
tatatggagccatttgtgtctgtgt

SEQ ID NO: 784540 - DNA, 25 bp, Mus musculus
tatatggagctaccaaccttcctgc

SEQ ID NO: 784541 - DNA, 25 bp, Mus musculus
tatatggagctagcaaccttcctgc

SEQ ID NO: 784542 - DNA, 25 bp, Mus musculus
tatatggagtgaaggctctttccct

SEQ ID NO: 784543 - DNA, 25 bp, Mus musculus
tatatggagtgatggctctttccct

SEQ ID NO: 784544 - DNA, 25 bp, Mus musculus
tatatggatgtacctctgcccctga

SEQ ID NO: 784545 - DNA, 25 bp, Mus musculus
tatatggatgtagctctgcccctga

SEQ ID NO: 784546 - DNA, 25 bp, Mus musculus
tatatggatttgactctgtgaccca

SEQ ID NO: 784547 - DNA, 25 bp, Mus musculus
tatatggatttgtctctgtgaccca

SEQ ID NO: 784548 - DNA, 25 bp, Mus musculus
tatatggcacctctgggccttttca

SEQ ID NO: 784549 - DNA, 25 bp, Mus musculus
tatatggcacctgtgggccttttca

SEQ ID NO: 784550 - DNA, 25 bp, Mus musculus
tatatggcactaccttcatgacacc

SEQ ID NO: 784551 - DNA, 25 bp, Mus musculus
tatatggcactagcttcatgacacc

SEQ ID NO: 784552 - DNA, 25 bp, Mus musculus
tatatggcactcatactgaaaatgt

SEQ ID NO: 784553 - DNA, 25 bp, Mus musculus
tatatggcactcttactgaaaatgt

SEQ ID NO: 784554 - DNA, 25 bp, Mus musculus
tatatggcaggtctcaacctcccaa

SEQ ID NO: 784555 - DNA, 25 bp, Mus musculus
tatatggcaggtgtcaacctcccaa

SEQ ID NO: 784556 - DNA, 25 bp, Mus musculus
tatatggcatgcagtgacaccctta

SEQ ID NO: 784557 - DNA, 25 bp, Mus musculus
tatatggcatgctgtgacaccctta

SEQ ID NO: 784558 - DNA, 25 bp, Mus musculus
tatatggcccatagtcacaaaagtt

SEQ ID NO: 784559 - DNA, 25 bp, Mus musculus
tatatggcccatcgcagacactttg

SEQ ID NO: 784560 - DNA, 25 bp, Mus musculus
tatatggcccatggcagacactttg

SEQ ID NO: 784561 - DNA, 25 bp, Mus musculus
tatatggcccattgtcacaaaagtt

SEQ ID NO: 784562 - DNA, 25 bp, Mus musculus
tatatggccggtctgagaccagcca

SEQ ID NO: 784563 - DNA, 25 bp, Mus musculus
tatatggccggtgtgagaccagcca

SEQ ID NO: 784564 - DNA, 25 bp, Mus musculus
tatatgggaacgctggcttatggca

SEQ ID NO: 784565 - DNA, 25 bp, Mus musculus
tatatgggaacggtggcttatggca

SEQ ID NO: 784566 - DNA, 25 bp, Mus musculus
tatatggggcaaccatggctcccat

SEQ ID NO: 784567 - DNA, 25 bp, Mus musculus
tatatggggcaagcatggctcccat

SEQ ID NO: 784568 - DNA, 25 bp, Mus musculus
tatatgggtgatatctctccttcca

SEQ ID NO: 784569 - DNA, 25 bp, Mus musculus
tatatgggtgatttctctccttcca

SEQ ID NO: 784570 - DNA, 25 bp, Mus musculus
tatatgggttacaagtgacactgaa

SEQ ID NO: 784571 - DNA, 25 bp, Mus musculus
tatatgggttactagtgacactgaa

SEQ ID NO: 784572 - DNA, 25 bp, Mus musculus
tatatggtatttctcctctgggttc

SEQ ID NO: 784573 - DNA, 25 bp, Mus musculus
tatatggtatttgtcctctgggttc

SEQ ID NO: 784574 - DNA, 25 bp, Mus musculus
tatatggtcagtcctgtgcaataga

SEQ ID NO: 784575 - DNA, 25 bp, Mus musculus
tatatggtcagtgctgtgcaataga

SEQ ID NO: 784576 - DNA, 25 bp, Mus musculus
tatatggtcctcctgttggcttatc

SEQ ID NO: 784577 - DNA, 25 bp, Mus musculus
tatatggtcctcgtgttggcttatc

SEQ ID NO: 784578 - DNA, 25 bp, Mus musculus
tatatggtgctactgctctgtgggc

SEQ ID NO: 784579 - DNA, 25 bp, Mus musculus
tatatggtgctagtgctctgtgggc

SEQ ID NO: 784580 - DNA, 25 bp, Mus musculus
tatatggtggagaacaagctgggct

SEQ ID NO: 784581 - DNA, 25 bp, Mus musculus
tatatggtggagtacaagctgggct

SEQ ID NO: 784582 - DNA, 25 bp, Mus musculus
tatatgtaaacacagatgaccttgc

SEQ ID NO: 784583 - DNA, 25 bp, Mus musculus
tatatgtaaacagagatgaccttgc

SEQ ID NO: 784584 - DNA, 25 bp, Mus musculus
tatatgtacataatgaccctgattc

SEQ ID NO: 784585 - DNA, 25 bp, Mus musculus
tatatgtacataccccaacagagaa

SEQ ID NO: 784586 - DNA, 25 bp, Mus musculus
tatatgtacatagcccaacagagaa

SEQ ID NO: 784587 - DNA, 25 bp, Mus musculus
tatatgtacatattgaccctgattc

SEQ ID NO: 784588 - DNA, 25 bp, Mus musculus
tatatgtaccttatctgcatgtaat

SEQ ID NO: 784589 - DNA, 25 bp, Mus musculus
tatatgtaccttttctgcatgtaat

SEQ ID NO: 784590 - DNA, 25 bp, Mus musculus
tatatgtacgttattgttgagttaa

SEQ ID NO: 784591 - DNA, 25 bp, Mus musculus
tatatgtacgtttttgttgagttaa

SEQ ID NO: 784592 - DNA, 25 bp, Mus musculus
tatatgtagtgtagtgtgaaatatc

SEQ ID NO: 784593 - DNA, 25 bp, Mus musculus
tatatgtagtgttgtgtgaaatatc

SEQ ID NO: 784594 - DNA, 25 bp, Mus musculus
tatatgtatatcagtaccccccctt

SEQ ID NO: 784595 - DNA, 25 bp, Mus musculus
tatatgtatatctgtaccccccctt

SEQ ID NO: 784596 - DNA, 25 bp, Mus musculus
tatatgtattctcgtatgtcttctt

SEQ ID NO: 784597 - DNA, 25 bp, Mus musculus
tatatgtattctggtatgtcttctt

SEQ ID NO: 784598 - DNA, 25 bp, Mus musculus
tatatgtcaggcaacacttctgctg

SEQ ID NO: 784599 - DNA, 25 bp, Mus musculus
tatatgtcaggctacacttctgctg

SEQ ID NO: 784600 - DNA, 25 bp, Mus musculus
tatatgtcatgtcaatctcacttat

SEQ ID NO: 784601 - DNA, 25 bp, Mus musculus
tatatgtcatgtgaatctcacttat

SEQ ID NO: 784602 - DNA, 25 bp, Mus musculus
tatatgtctaacaagccattcctcc

SEQ ID NO: 784603 - DNA, 25 bp, Mus musculus
tatatgtctaactagccattcctcc

SEQ ID NO: 784604 - DNA, 25 bp, Mus musculus
tatatgtctatgctatgccctgtag

SEQ ID NO: 784605 - DNA, 25 bp, Mus musculus
tatatgtctatggtatgccctgtag

SEQ ID NO: 784606 - DNA, 25 bp, Mus musculus
tatatgtctgacatctctaccaacc

SEQ ID NO: 784607 - DNA, 25 bp, Mus musculus
tatatgtctgacttctctaccaacc

SEQ ID NO: 784608 - DNA, 25 bp, Mus musculus
tatatgtctgatacgctgcctgtgt

SEQ ID NO: 784609 - DNA, 25 bp, Mus musculus
tatatgtctgattcgctgcctgtgt

SEQ ID NO: 784610 - DNA, 25 bp, Mus musculus
tatatgtctggaaggagctgtttag

SEQ ID NO: 784611 - DNA, 25 bp, Mus musculus
tatatgtctggatggagctgtttag

SEQ ID NO: 784612 - DNA, 25 bp, Mus musculus
tatatgtctgtgcatcttgaaaggg

SEQ ID NO: 784613 - DNA, 25 bp, Mus musculus
tatatgtctgtggatcttgaaaggg

SEQ ID NO: 784614 - DNA, 25 bp, Mus musculus
tatatgtgatgtccttttccagtat

SEQ ID NO: 784615 - DNA, 25 bp, Mus musculus
tatatgtgatgtgcttttccagtat

SEQ ID NO: 784616 - DNA, 25 bp, Mus musculus
tatatgtgcatcagctaaaagcaaa

SEQ ID NO: 784617 - DNA, 25 bp, Mus musculus
tatatgtgcatctgctaaaagcaaa

SEQ ID NO: 784618 - DNA, 25 bp, Mus musculus
tatatgtgtacccttctgtctgtgc

SEQ ID NO: 784619 - DNA, 25 bp, Mus musculus
tatatgtgtaccgttctgtctgtgc

SEQ ID NO: 784620 - DNA, 25 bp, Mus musculus
tatatgtgtatcacccgtgtgcctg

SEQ ID NO: 784621 - DNA, 25 bp, Mus musculus
tatatgtgtatctcccgtgtgcctg

SEQ ID NO: 784622 - DNA, 25 bp, Mus musculus
tatatgtgtgtaacatttgcatgtc

SEQ ID NO: 784623 - DNA, 25 bp, Mus musculus
tatatgtgtgtatcatttgcatgtc

SEQ ID NO: 784624 - DNA, 25 bp, Mus musculus
tatatgtgtgtcaattttcttaaac

SEQ ID NO: 784625 - DNA, 25 bp, Mus musculus
tatatgtgtgtctattttcttaaac

SEQ ID NO: 784626 - DNA, 25 bp, Mus musculus
tatatgtgtgtgaacgtgtctctgt

SEQ ID NO: 784627 - DNA, 25 bp, Mus musculus
tatatgtgtgtgtacgtgtctctgt

SEQ ID NO: 784628 - DNA, 25 bp, Mus musculus
tatatgttagagagcacttgcaaac

SEQ ID NO: 784629 - DNA, 25 bp, Mus musculus
tatatgttagagtgcacttgcaaac

SEQ ID NO: 784630 - DNA, 25 bp, Mus musculus
tatatgttattgagtctcctcgcca

SEQ ID NO: 784631 - DNA, 25 bp, Mus musculus
tatatgttattgtgtctcctcgcca

SEQ ID NO: 784632 - DNA, 25 bp, Mus musculus
tatatgttcctaagtagtccctaca

SEQ ID NO: 784633 - DNA, 25 bp, Mus musculus
tatatgttcctatgtagtccctaca

SEQ ID NO: 784634 - DNA, 25 bp, Mus musculus
tatatgttccttcctggtcttgggc

SEQ ID NO: 784635 - DNA, 25 bp, Mus musculus
tatatgttccttgctggtcttgggc

SEQ ID NO: 784636 - DNA, 25 bp, Mus musculus
tatatgtttcaaatggactcctggt

SEQ ID NO: 784637 - DNA, 25 bp, Mus musculus
tatatgtttcaattggactcctggt

SEQ ID NO: 784638 - DNA, 25 bp, Mus musculus
tatatgtttctgacttgccaacaac

SEQ ID NO: 784639 - DNA, 25 bp, Mus musculus
tatatgtttctgtcttgccaacaac

SEQ ID NO: 784640 - DNA, 25 bp, Mus musculus
tatattaaagcccttggtcacccaa

SEQ ID NO: 784641 - DNA, 25 bp, Mus musculus
tatattaaagccgttggtcacccaa

SEQ ID NO: 784642 - DNA, 25 bp, Mus musculus
tatattaaagctacgggtgggataa

SEQ ID NO: 784643 - DNA, 25 bp, Mus musculus
tatattaaagcttcgggtgggataa

SEQ ID NO: 784644 - DNA, 25 bp, Mus musculus
tatattaactataacgtccccaggg

SEQ ID NO: 784645 - DNA, 25 bp, Mus musculus
tatattaactattacgtccccaggg

SEQ ID NO: 784646 - DNA, 25 bp, Mus musculus
tatattaacttacctgtccactcag

SEQ ID NO: 784647 - DNA, 25 bp, Mus musculus
tatattaacttagctgtccactcag

SEQ ID NO: 784648 - DNA, 25 bp, Mus musculus
tatattaatactccagctgctcctg

SEQ ID NO: 784649 - DNA, 25 bp, Mus musculus
tatattaatactgcagctgctcctg

SEQ ID NO: 784650 - DNA, 25 bp, Mus musculus
tatattactctaaggatctgcagtc

SEQ ID NO: 784651 - DNA, 25 bp, Mus musculus
tatattactctatggatctgcagtc

SEQ ID NO: 784652 - DNA, 25 bp, Mus musculus
tatattagacatcgttcccaccgag

SEQ ID NO: 784653 - DNA, 25 bp, Mus musculus
tatattagacatggttcccaccgag

SEQ ID NO: 784654 - DNA, 25 bp, Mus musculus
tatattagctatattaacccttctt

SEQ ID NO: 784655 - DNA, 25 bp, Mus musculus
tatattagctattttaacccttctt

SEQ ID NO: 784656 - DNA, 25 bp, Mus musculus
tatattagctttcccaaaatccgtc

SEQ ID NO: 784657 - DNA, 25 bp, Mus musculus
tatattagctttgccaaaatccgtc

SEQ ID NO: 784658 - DNA, 25 bp, Mus musculus
tatattaggtttcctcggtggtgtt

SEQ ID NO: 784659 - DNA, 25 bp, Mus musculus
tatattaggtttgctcggtggtgtt

SEQ ID NO: 784660 - DNA, 25 bp, Mus musculus
tatattagtagtcctgctccaggct

SEQ ID NO: 784661 - DNA, 25 bp, Mus musculus
tatattagtagtgctgctccaggct

SEQ ID NO: 784662 - DNA, 25 bp, Mus musculus
tatattatagccatgagaacgccag

SEQ ID NO: 784663 - DNA, 25 bp, Mus musculus
tatattatagccttgagaacgccag

SEQ ID NO: 784664 - DNA, 25 bp, Mus musculus
tatattatctccctggtactctcca

SEQ ID NO: 784665 - DNA, 25 bp, Mus musculus
tatattatctccgtggtactctcca

SEQ ID NO: 784666 - DNA, 25 bp, Mus musculus
tatattatctttacgtttgtctggg

SEQ ID NO: 784667 - DNA, 25 bp, Mus musculus
tatattatcttttcgtttgtctggg

SEQ ID NO: 784668 - DNA, 25 bp, Mus musculus
tatattattgacatacccagtgtgc

SEQ ID NO: 784669 - DNA, 25 bp, Mus musculus
tatattattgacttacccagtgtgc

SEQ ID NO: 784670 - DNA, 25 bp, Mus musculus
tatattatttatatccattacgtgg

SEQ ID NO: 784671 - DNA, 25 bp, Mus musculus
tatattatttatttccattacgtgg

SEQ ID NO: 784672 - DNA, 25 bp, Mus musculus
tatattcaaagcctctcatcgtgtc

SEQ ID NO: 784673 - DNA, 25 bp, Mus musculus
tatattcaaagcgtctcatcgtgtc

SEQ ID NO: 784674 - DNA, 25 bp, Mus musculus
tatattcaatccctttgtcaccagt

SEQ ID NO: 784675 - DNA, 25 bp, Mus musculus
tatattcaatccgtttgtcaccagt

SEQ ID NO: 784676 - DNA, 25 bp, Mus musculus
tatattcactaaccaatttctttga

SEQ ID NO: 784677 - DNA, 25 bp, Mus musculus
tatattcactaagcaatttctttga

SEQ ID NO: 784678 - DNA, 25 bp, Mus musculus
tatattcagagaacacattttttct

SEQ ID NO: 784679 - DNA, 25 bp, Mus musculus
tatattcagagatcacattttttct

SEQ ID NO: 784680 - DNA, 25 bp, Mus musculus
tatattcagcagcttcgcagccgga

SEQ ID NO: 784681 - DNA, 25 bp, Mus musculus
tatattcagcaggttcgcagccgga

SEQ ID NO: 784682 - DNA, 25 bp, Mus musculus
tatattcaggagattaaggcagtgg

SEQ ID NO: 784683 - DNA, 25 bp, Mus musculus
tatattcaggagtttaaggcagtgg

SEQ ID NO: 784684 - DNA, 25 bp, Mus musculus
tatattcagggtctttggctttgtt

SEQ ID NO: 784685 - DNA, 25 bp, Mus musculus
tatattcagggtgtttggctttgtt

SEQ ID NO: 784686 - DNA, 25 bp, Mus musculus
tatattcatgcaatcaccccatttc

SEQ ID NO: 784687 - DNA, 25 bp, Mus musculus
tatattcatgcattcaccccatttc

SEQ ID NO: 784688 - DNA, 25 bp, Mus musculus
tatattcatttcacacaagctccca

SEQ ID NO: 784689 - DNA, 25 bp, Mus musculus
tatattcatttctcacaagctccca

SEQ ID NO: 784690 - DNA, 25 bp, Mus musculus
tatattccacctccctgagataagc

SEQ ID NO: 784691 - DNA, 25 bp, Mus musculus
tatattccacctgcctgagataagc

SEQ ID NO: 784692 - DNA, 25 bp, Mus musculus
tatattcccagaaccttaaacgaag

SEQ ID NO: 784693 - DNA, 25 bp, Mus musculus
tatattcccagatccttaaacgaag

SEQ ID NO: 784694 - DNA, 25 bp, Mus musculus
tatattcctgaacgccacgtggcca

SEQ ID NO: 784695 - DNA, 25 bp, Mus musculus
tatattcctgaaggccacgtggcca

SEQ ID NO: 784696 - DNA, 25 bp, Mus musculus
tatattcctgcccaacacaagtgag

SEQ ID NO: 784697 - DNA, 25 bp, Mus musculus
tatattcctgccgaacacaagtgag

SEQ ID NO: 784698 - DNA, 25 bp, Mus musculus
tatattcctggaagagattctcaaa

SEQ ID NO: 784699 - DNA, 25 bp, Mus musculus
tatattcctggatgagattctcaaa

SEQ ID NO: 784700 - DNA, 25 bp, Mus musculus
tatattcgaattacctgcacagcag

SEQ ID NO: 784701 - DNA, 25 bp, Mus musculus
tatattcgaatttcctgcacagcag

SEQ ID NO: 784702 - DNA, 25 bp, Mus musculus
tatattctaattcctgtttcccctg

SEQ ID NO: 784703 - DNA, 25 bp, Mus musculus
tatattctaattgctgtttcccctg

SEQ ID NO: 784704 - DNA, 25 bp, Mus musculus
tatattctacataggcactaacaat

SEQ ID NO: 784705 - DNA, 25 bp, Mus musculus
tatattctacattggcactaacaat

SEQ ID NO: 784706 - DNA, 25 bp, Mus musculus
tatattctagtcaaatcccctctgt

SEQ ID NO: 784707 - DNA, 25 bp, Mus musculus
tatattctagtctaatcccctctgt

SEQ ID NO: 784708 - DNA, 25 bp, Mus musculus
tatattctagttatatcaggataat

SEQ ID NO: 784709 - DNA, 25 bp, Mus musculus
tatattctagttttatcaggataat

SEQ ID NO: 784710 - DNA, 25 bp, Mus musculus
tatattctcaccatcattggccgtg

SEQ ID NO: 784711 - DNA, 25 bp, Mus musculus
tatattctcaccttcattggccgtg

SEQ ID NO: 784712 - DNA, 25 bp, Mus musculus
tatattctcaggcactgcatgcaat

SEQ ID NO: 784713 - DNA, 25 bp, Mus musculus
tatattctcagggactgcatgcaat

SEQ ID NO: 784714 - DNA, 25 bp, Mus musculus
tatattctcataagtgcacaccaaa

SEQ ID NO: 784715 - DNA, 25 bp, Mus musculus
tatattctcatatgtgcacaccaaa

SEQ ID NO: 784716 - DNA, 25 bp, Mus musculus
tatattctctctcagctccaaggaa

SEQ ID NO: 784717 - DNA, 25 bp, Mus musculus
tatattctctctgagctccaaggaa

SEQ ID NO: 784718 - DNA, 25 bp, Mus musculus
tatattctctggcttctgttgtgac

SEQ ID NO: 784719 - DNA, 25 bp, Mus musculus
tatattctctgggttctgttgtgac

SEQ ID NO: 784720 - DNA, 25 bp, Mus musculus
tatattctggcacttccctcttcta

SEQ ID NO: 784721 - DNA, 25 bp, Mus musculus
tatattctggcagttccctcttcta

SEQ ID NO: 784722 - DNA, 25 bp, Mus musculus
tatattcttaccagagagccacagt

SEQ ID NO: 784723 - DNA, 25 bp, Mus musculus
tatattcttacctgagagccacagt

SEQ ID NO: 784724 - DNA, 25 bp, Mus musculus
tatattcttagtctccacagttctg

SEQ ID NO: 784725 - DNA, 25 bp, Mus musculus
tatattcttagtgtccacagttctg

SEQ ID NO: 784726 - DNA, 25 bp, Mus musculus
tatattcttcacaattccccatctg

SEQ ID NO: 784727 - DNA, 25 bp, Mus musculus
tatattcttcactattccccatctg

SEQ ID NO: 784728 - DNA, 25 bp, Mus musculus
tatattcttgtgaatgagactgctc

SEQ ID NO: 784729 - DNA, 25 bp, Mus musculus
tatattcttgtgtatgagactgctc

SEQ ID NO: 784730 - DNA, 25 bp, Mus musculus
tatattgaatggacgatcctgagat

SEQ ID NO: 784731 - DNA, 25 bp, Mus musculus
tatattgaatggtcgatcctgagat

SEQ ID NO: 784732 - DNA, 25 bp, Mus musculus
tatattgagtcaacttgttccgcct

SEQ ID NO: 784733 - DNA, 25 bp, Mus musculus
tatattgagtcatcttgttccgcct

SEQ ID NO: 784734 - DNA, 25 bp, Mus musculus
tatattgagtctaaaccgtttccca

SEQ ID NO: 784735 - DNA, 25 bp, Mus musculus
tatattgagtcttaaccgtttccca

SEQ ID NO: 784736 - DNA, 25 bp, Mus musculus
tatattgatgcccttggccgtcaac

SEQ ID NO: 784737 - DNA, 25 bp, Mus musculus
tatattgatgccgttggccgtcaac

SEQ ID NO: 784738 - DNA, 25 bp, Mus musculus
tatattgattgtactgctcccgctg

SEQ ID NO: 784739 - DNA, 25 bp, Mus musculus
tatattgattgttctgctcccgctg

SEQ ID NO: 784740 - DNA, 25 bp, Mus musculus
tatattgcagagcaaccctataaat

SEQ ID NO: 784741 - DNA, 25 bp, Mus musculus
tatattgcagaggaaccctataaat

SEQ ID NO: 784742 - DNA, 25 bp, Mus musculus
tatattgcccaaacgggacccaaat

SEQ ID NO: 784743 - DNA, 25 bp, Mus musculus
tatattgcccaatcgggacccaaat

SEQ ID NO: 784744 - DNA, 25 bp, Mus musculus
tatattgcctaaattacaccagcca

SEQ ID NO: 784745 - DNA, 25 bp, Mus musculus
tatattgcctaatttacaccagcca

SEQ ID NO: 784746 - DNA, 25 bp, Mus musculus
tatattgcctccaccaagactggca

SEQ ID NO: 784747 - DNA, 25 bp, Mus musculus
tatattgcctcctccaagactggca

SEQ ID NO: 784748 - DNA, 25 bp, Mus musculus
tatattggacagcacgggccctgta

SEQ ID NO: 784749 - DNA, 25 bp, Mus musculus
tatattggacaggacgggccctgta

SEQ ID NO: 784750 - DNA, 25 bp, Mus musculus
tatattggagacacagacctgctgg

SEQ ID NO: 784751 - DNA, 25 bp, Mus musculus
tatattggagactcagacctgctgg

SEQ ID NO: 784752 - DNA, 25 bp, Mus musculus
tatattggagtcagctcttcacctg

SEQ ID NO: 784753 - DNA, 25 bp, Mus musculus
tatattggagtctgctcttcacctg

SEQ ID NO: 784754 - DNA, 25 bp, Mus musculus
tatattggcattagtggcttcttgc

SEQ ID NO: 784755 - DNA, 25 bp, Mus musculus
tatattggcatttgtggcttcttgc

SEQ ID NO: 784756 - DNA, 25 bp, Mus musculus
tatattgggtgccttatccaccaga

SEQ ID NO: 784757 - DNA, 25 bp, Mus musculus
tatattgggtgcgttatccaccaga

SEQ ID NO: 784758 - DNA, 25 bp, Mus musculus
tatattggtttactcattcattaat

SEQ ID NO: 784759 - DNA, 25 bp, Mus musculus
tatattggtttagtcattcattaat

SEQ ID NO: 784760 - DNA, 25 bp, Mus musculus
tatattgtactgaggtgcctgccct

SEQ ID NO: 784761 - DNA, 25 bp, Mus musculus
tatattgtactgtggtgcctgccct

SEQ ID NO: 784762 - DNA, 25 bp, Mus musculus
tatattgtcctacctaaagctaaag

SEQ ID NO: 784763 - DNA, 25 bp, Mus musculus
tatattgtcctagctaaagctaaag

SEQ ID NO: 784764 - DNA, 25 bp, Mus musculus
tatattgtgcccatgattacggtgg

SEQ ID NO: 784765 - DNA, 25 bp, Mus musculus
tatattgtgcccttgattacggtgg

SEQ ID NO: 784766 - DNA, 25 bp, Mus musculus
tatattgtgggcaacatatctcaag

SEQ ID NO: 784767 - DNA, 25 bp, Mus musculus
tatattgtgggctacatatctcaag

SEQ ID NO: 784768 - DNA, 25 bp, Mus musculus
tatattgttgcaaccctacttcttc

SEQ ID NO: 784769 - DNA, 25 bp, Mus musculus
tatattgttgcatccctacttcttc

SEQ ID NO: 784770 - DNA, 25 bp, Mus musculus
tatattgttgtgacccacatcaccc

SEQ ID NO: 784771 - DNA, 25 bp, Mus musculus
tatattgttgtgtcccacatcaccc

SEQ ID NO: 784772 - DNA, 25 bp, Mus musculus
tatattgtttgcatcccattgccct

SEQ ID NO: 784773 - DNA, 25 bp, Mus musculus
tatattgtttgcttcccattgccct

SEQ ID NO: 784774 - DNA, 25 bp, Mus musculus
tatatttaaatcacagactctggct

SEQ ID NO: 784775 - DNA, 25 bp, Mus musculus
tatatttaaatccaccgcatctctc

SEQ ID NO: 784776 - DNA, 25 bp, Mus musculus
tatatttaaatcgaccgcatctctc

SEQ ID NO: 784777 - DNA, 25 bp, Mus musculus
tatatttaaatctcagactctggct

SEQ ID NO: 784778 - DNA, 25 bp, Mus musculus
tatatttaactcaggatagtgctga

SEQ ID NO: 784779 - DNA, 25 bp, Mus musculus
tatatttaactctggatagtgctga

SEQ ID NO: 784780 - DNA, 25 bp, Mus musculus
tatatttaacttctccagttttctc

SEQ ID NO: 784781 - DNA, 25 bp, Mus musculus
tatatttaacttgtccagttttctc

SEQ ID NO: 784782 - DNA, 25 bp, Mus musculus
tatatttaatgaactcacccctgag

SEQ ID NO: 784783 - DNA, 25 bp, Mus musculus
tatatttaatgatctcacccctgag

SEQ ID NO: 784784 - DNA, 25 bp, Mus musculus
tatatttaattaatgttctctgaca

SEQ ID NO: 784785 - DNA, 25 bp, Mus musculus
tatatttaattattgttctctgaca

SEQ ID NO: 784786 - DNA, 25 bp, Mus musculus
tatatttacacaactaggccaccta

SEQ ID NO: 784787 - DNA, 25 bp, Mus musculus
tatatttacacatctaggccaccta

SEQ ID NO: 784788 - DNA, 25 bp, Mus musculus
tatatttagaaaactggcctgtatt

SEQ ID NO: 784789 - DNA, 25 bp, Mus musculus
tatatttagaaatctggcctgtatt

SEQ ID NO: 784790 - DNA, 25 bp, Mus musculus
tatatttatgcacttgtacaatttt

SEQ ID NO: 784791 - DNA, 25 bp, Mus musculus
tatatttatgcagttgtacaatttt

SEQ ID NO: 784792 - DNA, 25 bp, Mus musculus
tatatttattctcagccattttggg

SEQ ID NO: 784793 - DNA, 25 bp, Mus musculus
tatatttattctgagccattttggg

SEQ ID NO: 784794 - DNA, 25 bp, Mus musculus
tatatttcaagcattctgccaggga

SEQ ID NO: 784795 - DNA, 25 bp, Mus musculus
tatatttcaagctttctgccaggga

SEQ ID NO: 784796 - DNA, 25 bp, Mus musculus
tatatttcacaccacattttgcacc

SEQ ID NO: 784797 - DNA, 25 bp, Mus musculus
tatatttcacacgacattttgcacc

SEQ ID NO: 784798 - DNA, 25 bp, Mus musculus
tatatttcacttcgtcatccgactg

SEQ ID NO: 784799 - DNA, 25 bp, Mus musculus
tatatttcacttggtcatccgactg

SEQ ID NO: 784800 - DNA, 25 bp, Mus musculus
tatatttcatggcaagtgacctgag

SEQ ID NO: 784801 - DNA, 25 bp, Mus musculus
tatatttcatgggaagtgacctgag

SEQ ID NO: 784802 - DNA, 25 bp, Mus musculus
tatatttcccaaacagcctggtgga

SEQ ID NO: 784803 - DNA, 25 bp, Mus musculus
tatatttcccaatcagcctggtgga

SEQ ID NO: 784804 - DNA, 25 bp, Mus musculus
tatatttccctcctcctataaagga

SEQ ID NO: 784805 - DNA, 25 bp, Mus musculus
tatatttccctcgtcctataaagga

SEQ ID NO: 784806 - DNA, 25 bp, Mus musculus
tatatttcctgcagatttttattag

SEQ ID NO: 784807 - DNA, 25 bp, Mus musculus
tatatttcctgctgatttttattag

SEQ ID NO: 784808 - DNA, 25 bp, Mus musculus
tatatttctcaaacggacctcaggc

SEQ ID NO: 784809 - DNA, 25 bp, Mus musculus
tatatttctcaatcggacctcaggc

SEQ ID NO: 784810 - DNA, 25 bp, Mus musculus
tatatttctctcactttcttagcgg

SEQ ID NO: 784811 - DNA, 25 bp, Mus musculus
tatatttctctctctttcttagcgg

SEQ ID NO: 784812 - DNA, 25 bp, Mus musculus
tatatttcttttctctgacccatca

SEQ ID NO: 784813 - DNA, 25 bp, Mus musculus
tatatttcttttgtctgacccatca

SEQ ID NO: 784814 - DNA, 25 bp, Mus musculus
tatatttgcacgaacagccctgaat

SEQ ID NO: 784815 - DNA, 25 bp, Mus musculus
tatatttgcacgctcccaactgtgt

SEQ ID NO: 784816 - DNA, 25 bp, Mus musculus
tatatttgcacggtcccaactgtgt

SEQ ID NO: 784817 - DNA, 25 bp, Mus musculus
tatatttgcacgtacagccctgaat

SEQ ID NO: 784818 - DNA, 25 bp, Mus musculus
tatatttgctttactgtttcagata

SEQ ID NO: 784819 - DNA, 25 bp, Mus musculus
tatatttgcttttctgtttcagata

SEQ ID NO: 784820 - DNA, 25 bp, Mus musculus
tatatttgttacaatgtcatacttt

SEQ ID NO: 784821 - DNA, 25 bp, Mus musculus
tatatttgttactatgtcatacttt

SEQ ID NO: 784822 - DNA, 25 bp, Mus musculus
tatattttagtcaatcctccctttt

SEQ ID NO: 784823 - DNA, 25 bp, Mus musculus
tatattttagtctatcctccctttt

SEQ ID NO: 784824 - DNA, 25 bp, Mus musculus
tatattttcaacatgtccctttaag

SEQ ID NO: 784825 - DNA, 25 bp, Mus musculus
tatattttcaacttgtccctttaag

SEQ ID NO: 784826 - DNA, 25 bp, Mus musculus
tatattttccttcctatctcctttt

SEQ ID NO: 784827 - DNA, 25 bp, Mus musculus
tatattttccttgctatctcctttt

SEQ ID NO: 784828 - DNA, 25 bp, Mus musculus
tatattttcttaagcatgctcgatg

SEQ ID NO: 784829 - DNA, 25 bp, Mus musculus
tatattttcttatgcatgctcgatg

SEQ ID NO: 784830 - DNA, 25 bp, Mus musculus
tatattttctttctccgttgttttg

SEQ ID NO: 784831 - DNA, 25 bp, Mus musculus
tatattttctttgtccgttgttttg

SEQ ID NO: 784832 - DNA, 25 bp, Mus musculus
tatattttgaaacgccaagctattt

SEQ ID NO: 784833 - DNA, 25 bp, Mus musculus
tatattttgaaaggccaagctattt

SEQ ID NO: 784834 - DNA, 25 bp, Mus musculus
tatattttgacaaactgctccccaa

SEQ ID NO: 784835 - DNA, 25 bp, Mus musculus
tatattttgacatactgctccccaa

SEQ ID NO: 784836 - DNA, 25 bp, Mus musculus
tatattttgatcacattctttctca

SEQ ID NO: 784837 - DNA, 25 bp, Mus musculus
tatattttgatctcattctttctca

SEQ ID NO: 784838 - DNA, 25 bp, Mus musculus
tatattttgattagcaacgtttggg

SEQ ID NO: 784839 - DNA, 25 bp, Mus musculus
tatattttgatttgcaacgtttggg

SEQ ID NO: 784840 - DNA, 25 bp, Mus musculus
tatattttggtaacgcctccaggcc

SEQ ID NO: 784841 - DNA, 25 bp, Mus musculus
tatattttggtatcgcctccaggcc

SEQ ID NO: 784842 - DNA, 25 bp, Mus musculus
tatattttgtttccggctttcctct

SEQ ID NO: 784843 - DNA, 25 bp, Mus musculus
tatattttgtttgcggctttcctct

SEQ ID NO: 784844 - DNA, 25 bp, Mus musculus
tatatttttaccaccgtatgacagt

SEQ ID NO: 784845 - DNA, 25 bp, Mus musculus
tatatttttacctccgtatgacagt

SEQ ID NO: 784846 - DNA, 25 bp, Mus musculus
tatatttttgcacccctggagtctc

SEQ ID NO: 784847 - DNA, 25 bp, Mus musculus
tatatttttgcagccctggagtctc

SEQ ID NO: 784848 - DNA, 25 bp, Mus musculus
tatatttttgccctaagcccctctg

SEQ ID NO: 784849 - DNA, 25 bp, Mus musculus
tatatttttgccgtaagcccctctg

SEQ ID NO: 784850 - DNA, 25 bp, Mus musculus
tatattttttctaggtgtttattgg

SEQ ID NO: 784851 - DNA, 25 bp, Mus musculus
tatattttttcttggtgtttattgg

SEQ ID NO: 784852 - DNA, 25 bp, Mus musculus
tatcaaaatcaactagtccccatta

SEQ ID NO: 784853 - DNA, 25 bp, Mus musculus
tatcaaaatcaagtagtccccatta

SEQ ID NO: 784854 - DNA, 25 bp, Mus musculus
tatcaaacaaaaagtccagtggtgt

SEQ ID NO: 784855 - DNA, 25 bp, Mus musculus
tatcaaacaaaatgtccagtggtgt

SEQ ID NO: 784856 - DNA, 25 bp, Mus musculus
tatcaaaccctgatgctgttgggaa

SEQ ID NO: 784857 - DNA, 25 bp, Mus musculus
tatcaaaccctgttgctgttgggaa

SEQ ID NO: 784858 - DNA, 25 bp, Mus musculus
tatcaaactataccaccagctgttg

SEQ ID NO: 784859 - DNA, 25 bp, Mus musculus
tatcaaactatagcaccagctgttg

SEQ ID NO: 784860 - DNA, 25 bp, Mus musculus
tatcaaactctccataggccaaagt

SEQ ID NO: 784861 - DNA, 25 bp, Mus musculus
tatcaaactctcgataggccaaagt

SEQ ID NO: 784862 - DNA, 25 bp, Mus musculus
tatcaaactgagctcccagcggttg

SEQ ID NO: 784863 - DNA, 25 bp, Mus musculus
tatcaaactgaggtcccagcggttg

SEQ ID NO: 784864 - DNA, 25 bp, Mus musculus
tatcaaactgccatttcttccggtt

SEQ ID NO: 784865 - DNA, 25 bp, Mus musculus
tatcaaactgccttttcttccggtt

SEQ ID NO: 784866 - DNA, 25 bp, Mus musculus
tatcaaagaactctgccaagcatgg

SEQ ID NO: 784867 - DNA, 25 bp, Mus musculus
tatcaaagaactgtgccaagcatgg

SEQ ID NO: 784868 - DNA, 25 bp, Mus musculus
tatcaaagagcgcagtttcacacta

SEQ ID NO: 784869 - DNA, 25 bp, Mus musculus
tatcaaagagcggagtttcacacta

SEQ ID NO: 784870 - DNA, 25 bp, Mus musculus
tatcaaagcaaacgccagctcttct

SEQ ID NO: 784871 - DNA, 25 bp, Mus musculus
tatcaaagcaaaggccagctcttct

SEQ ID NO: 784872 - DNA, 25 bp, Mus musculus
tatcaaagcaacaacgtgttcgtgt

SEQ ID NO: 784873 - DNA, 25 bp, Mus musculus
tatcaaagcaactacgtgttcgtgt

SEQ ID NO: 784874 - DNA, 25 bp, Mus musculus
tatcaaagccctctttgactacgat

SEQ ID NO: 784875 - DNA, 25 bp, Mus musculus
tatcaaagccctgtttgactacgat

SEQ ID NO: 784876 - DNA, 25 bp, Mus musculus
tatcaaagccgtcatttcccatggg

SEQ ID NO: 784877 - DNA, 25 bp, Mus musculus
tatcaaagccgtgatttcccatggg

SEQ ID NO: 784878 - DNA, 25 bp, Mus musculus
tatcaaaggtaaccctcctagtcat

SEQ ID NO: 784879 - DNA, 25 bp, Mus musculus
tatcaaaggtaagcctcctagtcat

SEQ ID NO: 784880 - DNA, 25 bp, Mus musculus
tatcaaataagtaaccttttcctgt

SEQ ID NO: 784881 - DNA, 25 bp, Mus musculus
tatcaaataagttaccttttcctgt

SEQ ID NO: 784882 - DNA, 25 bp, Mus musculus
tatcaaatgtggacatcgcccagta

SEQ ID NO: 784883 - DNA, 25 bp, Mus musculus
tatcaaatgtggtcatcgcccagta

SEQ ID NO: 784884 - DNA, 25 bp, Mus musculus
tatcaaatgtgtcaggtttatgacc

SEQ ID NO: 784885 - DNA, 25 bp, Mus musculus
tatcaaatgtgtgaggtttatgacc

SEQ ID NO: 784886 - DNA, 25 bp, Mus musculus
tatcaaattcatcaatcagaagtcc

SEQ ID NO: 784887 - DNA, 25 bp, Mus musculus
tatcaaattcatgaatcagaagtcc

SEQ ID NO: 784888 - DNA, 25 bp, Mus musculus
tatcaaattctacggcagccatggc

SEQ ID NO: 784889 - DNA, 25 bp, Mus musculus
tatcaaattctagggcagccatggc

SEQ ID NO: 784890 - DNA, 25 bp, Mus musculus
tatcaaattctcatccttgtttttg

SEQ ID NO: 784891 - DNA, 25 bp, Mus musculus
tatcaaattctcttccttgtttttg

SEQ ID NO: 784892 - DNA, 25 bp, Mus musculus
tatcaacaactaattaaccttagac

SEQ ID NO: 784893 - DNA, 25 bp, Mus musculus
tatcaacaactatttaaccttagac

SEQ ID NO: 784894 - DNA, 25 bp, Mus musculus
tatcaacaatccaataacatgcatg

SEQ ID NO: 784895 - DNA, 25 bp, Mus musculus
tatcaacaatcctataacatgcatg

SEQ ID NO: 784896 - DNA, 25 bp, Mus musculus
tatcaacacctgaatccctgaaatg

SEQ ID NO: 784897 - DNA, 25 bp, Mus musculus
tatcaacacctgtatccctgaaatg

SEQ ID NO: 784898 - DNA, 25 bp, Mus musculus
tatcaacagcgtcggtgggcagcaa

SEQ ID NO: 784899 - DNA, 25 bp, Mus musculus
tatcaacagcgtgggtgggcagcaa

SEQ ID NO: 784900 - DNA, 25 bp, Mus musculus
tatcaaccactccagactccttagg

SEQ ID NO: 784901 - DNA, 25 bp, Mus musculus
tatcaaccactcgagactccttagg

SEQ ID NO: 784902 - DNA, 25 bp, Mus musculus
tatcaaccagtgcaagtgaccaact

SEQ ID NO: 784903 - DNA, 25 bp, Mus musculus
tatcaaccagtggaagtgaccaact

SEQ ID NO: 784904 - DNA, 25 bp, Mus musculus
tatcaaccatcacgctacagcaggg

SEQ ID NO: 784905 - DNA, 25 bp, Mus musculus
tatcaaccatcaggctacagcaggg

SEQ ID NO: 784906 - DNA, 25 bp, Mus musculus
tatcaaccctcaaattcctcagtat

SEQ ID NO: 784907 - DNA, 25 bp, Mus musculus
tatcaaccctcatattcctcagtat

SEQ ID NO: 784908 - DNA, 25 bp, Mus musculus
tatcaacctactccagaccagcaga

SEQ ID NO: 784909 - DNA, 25 bp, Mus musculus
tatcaacctactgcagaccagcaga

SEQ ID NO: 784910 - DNA, 25 bp, Mus musculus
tatcaacctctgagggaagccgtga

SEQ ID NO: 784911 - DNA, 25 bp, Mus musculus
tatcaacctctgtgggaagccgtga

SEQ ID NO: 784912 - DNA, 25 bp, Mus musculus
tatcaactaactcccgtttagagac

SEQ ID NO: 784913 - DNA, 25 bp, Mus musculus
tatcaactaactgccgtttagagac

SEQ ID NO: 784914 - DNA, 25 bp, Mus musculus
tatcaactcattccttatcttttcc

SEQ ID NO: 784915 - DNA, 25 bp, Mus musculus
tatcaactcattgcttatcttttcc

SEQ ID NO: 784916 - DNA, 25 bp, Mus musculus
tatcaactccggctacagctggcct

SEQ ID NO: 784917 - DNA, 25 bp, Mus musculus
tatcaactccgggtacagctggcct

SEQ ID NO: 784918 - DNA, 25 bp, Mus musculus
tatcaactgtaaatgtgtgcccctt

SEQ ID NO: 784919 - DNA, 25 bp, Mus musculus
tatcaactgtaattgtgtgcccctt

SEQ ID NO: 784920 - DNA, 25 bp, Mus musculus
tatcaactgttacgctgtagctcca

SEQ ID NO: 784921 - DNA, 25 bp, Mus musculus
tatcaactgttaggctgtagctcca

SEQ ID NO: 784922 - DNA, 25 bp, Mus musculus
tatcaactttctaaactcccttcag

SEQ ID NO: 784923 - DNA, 25 bp, Mus musculus
tatcaactttcttaactcccttcag

SEQ ID NO: 784924 - DNA, 25 bp, Mus musculus
tatcaagaaactcaccctgtaccct

SEQ ID NO: 784925 - DNA, 25 bp, Mus musculus
tatcaagaaactgaccctgtaccct

SEQ ID NO: 784926 - DNA, 25 bp, Mus musculus
tatcaagaagacaagttggccaaac

SEQ ID NO: 784927 - DNA, 25 bp, Mus musculus
tatcaagaagactagttggccaaac

SEQ ID NO: 784928 - DNA, 25 bp, Mus musculus
tatcaagaccttcgtgcaggcccag

SEQ ID NO: 784929 - DNA, 25 bp, Mus musculus
tatcaagaccttggtgcaggcccag

SEQ ID NO: 784930 - DNA, 25 bp, Mus musculus
tatcaagactccagagacctcagtg

SEQ ID NO: 784931 - DNA, 25 bp, Mus musculus
tatcaagactcctgagacctcagtg

SEQ ID NO: 784932 - DNA, 25 bp, Mus musculus
tatcaagagggcctttcctgttgtc

SEQ ID NO: 784933 - DNA, 25 bp, Mus musculus
tatcaagagggcgtttcctgttgtc

SEQ ID NO: 784934 - DNA, 25 bp, Mus musculus
tatcaagatattacgactcattcat

SEQ ID NO: 784935 - DNA, 25 bp, Mus musculus
tatcaagatatttcgactcattcat

SEQ ID NO: 784936 - DNA, 25 bp, Mus musculus
tatcaagccatccactagaccctgt

SEQ ID NO: 784937 - DNA, 25 bp, Mus musculus
tatcaagccatcgactagaccctgt

SEQ ID NO: 784938 - DNA, 25 bp, Mus musculus
tatcaagccattaccccagtgtgta

SEQ ID NO: 784939 - DNA, 25 bp, Mus musculus
tatcaagccatttccccagtgtgta

SEQ ID NO: 784940 - DNA, 25 bp, Mus musculus
tatcaagcgcatattggcagcactt

SEQ ID NO: 784941 - DNA, 25 bp, Mus musculus
tatcaagcgcattttggcagcactt

SEQ ID NO: 784942 - DNA, 25 bp, Mus musculus
tatcaagctccactgtagggcaaca

SEQ ID NO: 784943 - DNA, 25 bp, Mus musculus
tatcaagctccagtgtagggcaaca

SEQ ID NO: 784944 - DNA, 25 bp, Mus musculus
tatcaaggacaacctgcttggccag

SEQ ID NO: 784945 - DNA, 25 bp, Mus musculus
tatcaaggacaagctgcttggccag

SEQ ID NO: 784946 - DNA, 25 bp, Mus musculus
tatcaaggcattctcgaaacaccaa

SEQ ID NO: 784947 - DNA, 25 bp, Mus musculus
tatcaaggcattgtcgaaacaccaa

SEQ ID NO: 784948 - DNA, 25 bp, Mus musculus
tatcaagggcttactttggtgactg

SEQ ID NO: 784949 - DNA, 25 bp, Mus musculus
tatcaagggcttcttaattccggat

SEQ ID NO: 784950 - DNA, 25 bp, Mus musculus
tatcaagggcttgttaattccggat

SEQ ID NO: 784951 - DNA, 25 bp, Mus musculus
tatcaagggctttctttggtgactg

SEQ ID NO: 784952 - DNA, 25 bp, Mus musculus
tatcaaggtgaacctagagggccac

SEQ ID NO: 784953 - DNA, 25 bp, Mus musculus
tatcaaggtgaagctagagggccac

SEQ ID NO: 784954 - DNA, 25 bp, Mus musculus
tatcaaggtgttatgtttcgcacgg

SEQ ID NO: 784955 - DNA, 25 bp, Mus musculus
tatcaaggtgttttgtttcgcacgg

SEQ ID NO: 784956 - DNA, 25 bp, Mus musculus
tatcaaggttatccatgattctgtt

SEQ ID NO: 784957 - DNA, 25 bp, Mus musculus
tatcaaggttatgcatgattctgtt

SEQ ID NO: 784958 - DNA, 25 bp, Mus musculus
tatcaagtaataaagttttccctca

SEQ ID NO: 784959 - DNA, 25 bp, Mus musculus
tatcaagtaatatagttttccctca

SEQ ID NO: 784960 - DNA, 25 bp, Mus musculus
tatcaagtccctagatggctccgtg

SEQ ID NO: 784961 - DNA, 25 bp, Mus musculus
tatcaagtcccttgatggctccgtg

SEQ ID NO: 784962 - DNA, 25 bp, Mus musculus
tatcaagtgccgactgactctgcaa

SEQ ID NO: 784963 - DNA, 25 bp, Mus musculus
tatcaagtgccgtctgactctgcaa

SEQ ID NO: 784964 - DNA, 25 bp, Mus musculus
tatcaagtgctgaaacccggtggct

SEQ ID NO: 784965 - DNA, 25 bp, Mus musculus
tatcaagtgctgtaacccggtggct

SEQ ID NO: 784966 - DNA, 25 bp, Mus musculus
tatcaagtgggcaggctgattcctt

SEQ ID NO: 784967 - DNA, 25 bp, Mus musculus
tatcaagtgggctggctgattcctt

SEQ ID NO: 784968 - DNA, 25 bp, Mus musculus
tatcaagtgtagacagccgtctgtt

SEQ ID NO: 784969 - DNA, 25 bp, Mus musculus
tatcaagtgtagtcagccgtctgtt

SEQ ID NO: 784970 - DNA, 25 bp, Mus musculus
tatcaagttgccagtaagtcataca

SEQ ID NO: 784971 - DNA, 25 bp, Mus musculus
tatcaagttgcctgtaagtcataca

SEQ ID NO: 784972 - DNA, 25 bp, Mus musculus
tatcaagtttagagtatctggtttt

SEQ ID NO: 784973 - DNA, 25 bp, Mus musculus
tatcaagtttagtgtatctggtttt

SEQ ID NO: 784974 - DNA, 25 bp, Mus musculus
tatcaatacgaaatgggcagccaca

SEQ ID NO: 784975 - DNA, 25 bp, Mus musculus
tatcaatacgaattgggcagccaca

SEQ ID NO: 784976 - DNA, 25 bp, Mus musculus
tatcaatactagatggaaggaccag

SEQ ID NO: 784977 - DNA, 25 bp, Mus musculus
tatcaatactagttggaaggaccag

SEQ ID NO: 784978 - DNA, 25 bp, Mus musculus
tatcaatcctgcagtagccctagaa

SEQ ID NO: 784979 - DNA, 25 bp, Mus musculus
tatcaatcctgctgtagccctagaa

SEQ ID NO: 784980 - DNA, 25 bp, Mus musculus
tatcaatctgtcaatcctgtccgtg

SEQ ID NO: 784981 - DNA, 25 bp, Mus musculus
tatcaatctgtctatcctgtccgtg

SEQ ID NO: 784982 - DNA, 25 bp, Mus musculus
tatcaatgactgagacccccaattt

SEQ ID NO: 784983 - DNA, 25 bp, Mus musculus
tatcaatgactgtgacccccaattt

SEQ ID NO: 784984 - DNA, 25 bp, Mus musculus
tatcaatgccacagagttgtctgtc

SEQ ID NO: 784985 - DNA, 25 bp, Mus musculus
tatcaatgccactgagttgtctgtc

SEQ ID NO: 784986 - DNA, 25 bp, Mus musculus
tatcaatgcctgagtaacatccctc

SEQ ID NO: 784987 - DNA, 25 bp, Mus musculus
tatcaatgcctgtgtaacatccctc

SEQ ID NO: 784988 - DNA, 25 bp, Mus musculus
tatcaatggtctcgagccgtccaaa

SEQ ID NO: 784989 - DNA, 25 bp, Mus musculus
tatcaatggtctggagccgtccaaa

SEQ ID NO: 784990 - DNA, 25 bp, Mus musculus
tatcaatgtattctatcctgggtgg

SEQ ID NO: 784991 - DNA, 25 bp, Mus musculus
tatcaatgtattgtatcctgggtgg

SEQ ID NO: 784992 - DNA, 25 bp, Mus musculus
tatcaattaagcctttctcccaagc

SEQ ID NO: 784993 - DNA, 25 bp, Mus musculus
tatcaattaagcgtttctcccaagc

SEQ ID NO: 784994 - DNA, 25 bp, Mus musculus
tatcaattaagtccctatcaaaaaa

SEQ ID NO: 784995 - DNA, 25 bp, Mus musculus
tatcaattaagtgcctatcaaaaaa

SEQ ID NO: 784996 - DNA, 25 bp, Mus musculus
tatcaattacatatccggctggcct

SEQ ID NO: 784997 - DNA, 25 bp, Mus musculus
tatcaattacatttccggctggcct

SEQ ID NO: 784998 - DNA, 25 bp, Mus musculus
tatcaattcaatcatccactctagg

SEQ ID NO: 784999 - DNA, 25 bp, Mus musculus
tatcaattcaatgatccactctagg

SEQ ID NO: 785000 - DNA, 25 bp, Mus musculus
tatcaattccttcttcacatctctg

SEQ ID NO: 785001 - DNA, 25 bp, Mus musculus
tatcaattccttgttcacatctctg

SEQ ID NO: 785002 - DNA, 25 bp, Mus musculus
tatcacaaaacaccactcctggact

SEQ ID NO: 785003 - DNA, 25 bp, Mus musculus
tatcacaaaacagcactcctggact

SEQ ID NO: 785004 - DNA, 25 bp, Mus musculus
tatcacaaaatacagttccaggcca

SEQ ID NO: 785005 - DNA, 25 bp, Mus musculus
tatcacaaaatagagttccaggcca

SEQ ID NO: 785006 - DNA, 25 bp, Mus musculus
tatcacaaagtaccaggcccttggc

SEQ ID NO: 785007 - DNA, 25 bp, Mus musculus
tatcacaaagtagcaggcccttggc

SEQ ID NO: 785008 - DNA, 25 bp, Mus musculus
tatcacaacctaatcatcccagcga

SEQ ID NO: 785009 - DNA, 25 bp, Mus musculus
tatcacaacctattcatcccagcga

SEQ ID NO: 785010 - DNA, 25 bp, Mus musculus
tatcacaatatcaattctgccctct

SEQ ID NO: 785011 - DNA, 25 bp, Mus musculus
tatcacaatatctattctgccctct

SEQ ID NO: 785012 - DNA, 25 bp, Mus musculus
tatcacacagaacgaccatatgcca

SEQ ID NO: 785013 - DNA, 25 bp, Mus musculus
tatcacacagaaggaccatatgcca

SEQ ID NO: 785014 - DNA, 25 bp, Mus musculus
tatcacacagagagcgcagcatgct

SEQ ID NO: 785015 - DNA, 25 bp, Mus musculus
tatcacacagagtgcgcagcatgct

SEQ ID NO: 785016 - DNA, 25 bp, Mus musculus
tatcacacagtcatagaaactatct

SEQ ID NO: 785017 - DNA, 25 bp, Mus musculus
tatcacacagtcttagaaactatct

SEQ ID NO: 785018 - DNA, 25 bp, Mus musculus
tatcacacttcaccccataataata

SEQ ID NO: 785019 - DNA, 25 bp, Mus musculus
tatcacacttcagcccataataata

SEQ ID NO: 785020 - DNA, 25 bp, Mus musculus
tatcacagcctgcatagcctagagt

SEQ ID NO: 785021 - DNA, 25 bp, Mus musculus
tatcacagcctggatagcctagagt

SEQ ID NO: 785022 - DNA, 25 bp, Mus musculus
tatcacagctgtcggcgtgcggctc

SEQ ID NO: 785023 - DNA, 25 bp, Mus musculus
tatcacagctgtgggcgtgcggctc

SEQ ID NO: 785024 - DNA, 25 bp, Mus musculus
tatcacagtcatatgcagcctagga

SEQ ID NO: 785025 - DNA, 25 bp, Mus musculus
tatcacagtcatttgcagcctagga

SEQ ID NO: 785026 - DNA, 25 bp, Mus musculus
tatcacagtcttaggctactagcag

SEQ ID NO: 785027 - DNA, 25 bp, Mus musculus
tatcacagtctttggctactagcag

SEQ ID NO: 785028 - DNA, 25 bp, Mus musculus
tatcacatacctctgtcctggatgc

SEQ ID NO: 785029 - DNA, 25 bp, Mus musculus
tatcacatacctgtgtcctggatgc

SEQ ID NO: 785030 - DNA, 25 bp, Mus musculus
tatcacatagccaagcaccatcatg

SEQ ID NO: 785031 - DNA, 25 bp, Mus musculus
tatcacatagcctagcaccatcatg

SEQ ID NO: 785032 - DNA, 25 bp, Mus musculus
tatcacatcagtctccaacatctgc

SEQ ID NO: 785033 - DNA, 25 bp, Mus musculus
tatcacatcagtgtccaacatctgc

SEQ ID NO: 785034 - DNA, 25 bp, Mus musculus
tatcacatgtcacaggcagccatac

SEQ ID NO: 785035 - DNA, 25 bp, Mus musculus
tatcacatgtcagaggcagccatac

SEQ ID NO: 785036 - DNA, 25 bp, Mus musculus
tatcaccaagcccacaaagctactg

SEQ ID NO: 785037 - DNA, 25 bp, Mus musculus
tatcaccaagccgacaaagctactg

SEQ ID NO: 785038 - DNA, 25 bp, Mus musculus
tatcaccaagctccgttttatgttt

SEQ ID NO: 785039 - DNA, 25 bp, Mus musculus
tatcaccaagctgcgttttatgttt

SEQ ID NO: 785040 - DNA, 25 bp, Mus musculus
tatcaccaagtacccaaatgagtta

SEQ ID NO: 785041 - DNA, 25 bp, Mus musculus
tatcaccaagtagccaaatgagtta

SEQ ID NO: 785042 - DNA, 25 bp, Mus musculus
tatcaccaccttatttacttcacta

SEQ ID NO: 785043 - DNA, 25 bp, Mus musculus
tatcaccaccttttttacttcacta

SEQ ID NO: 785044 - DNA, 25 bp, Mus musculus
tatcaccagaccactgctggaccta

SEQ ID NO: 785045 - DNA, 25 bp, Mus musculus
tatcaccagacctctgctggaccta

SEQ ID NO: 785046 - DNA, 25 bp, Mus musculus
tatcaccagctccagcgacggcgag

SEQ ID NO: 785047 - DNA, 25 bp, Mus musculus
tatcaccagctcgagcgacggcgag

SEQ ID NO: 785048 - DNA, 25 bp, Mus musculus
tatcaccagtcactggccttagcca

SEQ ID NO: 785049 - DNA, 25 bp, Mus musculus
tatcaccagtcagtggccttagcca

SEQ ID NO: 785050 - DNA, 25 bp, Mus musculus
tatcaccatgttatatctatctctg

SEQ ID NO: 785051 - DNA, 25 bp, Mus musculus
tatcaccatgttttatctatctctg

SEQ ID NO: 785052 - DNA, 25 bp, Mus musculus
tatcaccatttgatcacctttatcc

SEQ ID NO: 785053 - DNA, 25 bp, Mus musculus
tatcaccatttgttcacctttatcc

SEQ ID NO: 785054 - DNA, 25 bp, Mus musculus
tatcaccccacaagttcacttagtt

SEQ ID NO: 785055 - DNA, 25 bp, Mus musculus
tatcaccccacatgttcacttagtt

SEQ ID NO: 785056 - DNA, 25 bp, Mus musculus
tatcaccccgcacatggatgttcaa

SEQ ID NO: 785057 - DNA, 25 bp, Mus musculus
tatcaccccgcagatggatgttcaa

SEQ ID NO: 785058 - DNA, 25 bp, Mus musculus
tatcacccctacaccttattaaata

SEQ ID NO: 785059 - DNA, 25 bp, Mus musculus
tatcacccctactccttattaaata

SEQ ID NO: 785060 - DNA, 25 bp, Mus musculus
tatcacccttagatctagaagtttc

SEQ ID NO: 785061 - DNA, 25 bp, Mus musculus
tatcacccttagttctagaagtttc

SEQ ID NO: 785062 - DNA, 25 bp, Mus musculus
tatcacccttcgaggatcttctggt

SEQ ID NO: 785063 - DNA, 25 bp, Mus musculus
tatcacccttcgtggatcttctggt

SEQ ID NO: 785064 - DNA, 25 bp, Mus musculus
tatcacccttctctgtatttcaaaa

SEQ ID NO: 785065 - DNA, 25 bp, Mus musculus
tatcacccttctgtgtatttcaaaa

SEQ ID NO: 785066 - DNA, 25 bp, Mus musculus
tatcaccgaagcacacaccatgtat

SEQ ID NO: 785067 - DNA, 25 bp, Mus musculus
tatcaccgaagctcacaccatgtat

SEQ ID NO: 785068 - DNA, 25 bp, Mus musculus
tatcaccgaccacactgagctcaga

SEQ ID NO: 785069 - DNA, 25 bp, Mus musculus
tatcaccgaccagactgagctcaga

SEQ ID NO: 785070 - DNA, 25 bp, Mus musculus
tatcaccgcggacaagatgcctgct

SEQ ID NO: 785071 - DNA, 25 bp, Mus musculus
tatcaccgcggagaagatgcctgct

SEQ ID NO: 785072 - DNA, 25 bp, Mus musculus
tatcaccgtcatctgcccttgggag

SEQ ID NO: 785073 - DNA, 25 bp, Mus musculus
tatcaccgtcatgtgcccttgggag

SEQ ID NO: 785074 - DNA, 25 bp, Mus musculus
tatcacctatacagagccctactta

SEQ ID NO: 785075 - DNA, 25 bp, Mus musculus
tatcacctatactgagccctactta

SEQ ID NO: 785076 - DNA, 25 bp, Mus musculus
tatcacctgcacctgcatttcacag

SEQ ID NO: 785077 - DNA, 25 bp, Mus musculus
tatcacctgcacgtgcatttcacag

SEQ ID NO: 785078 - DNA, 25 bp, Mus musculus
tatcacctggctatccggttccaca

SEQ ID NO: 785079 - DNA, 25 bp, Mus musculus
tatcacctggctttccggttccaca

SEQ ID NO: 785080 - DNA, 25 bp, Mus musculus
tatcacctgtacctccctgaatacc

SEQ ID NO: 785081 - DNA, 25 bp, Mus musculus
tatcacctgtacgtccctgaatacc

SEQ ID NO: 785082 - DNA, 25 bp, Mus musculus
tatcaccttgtgcttctgaatcgct

SEQ ID NO: 785083 - DNA, 25 bp, Mus musculus
tatcaccttgtggttctgaatcgct

SEQ ID NO: 785084 - DNA, 25 bp, Mus musculus
tatcacctttccaagtctgagctgg

SEQ ID NO: 785085 - DNA, 25 bp, Mus musculus
tatcacctttcctagtctgagctgg

SEQ ID NO: 785086 - DNA, 25 bp, Mus musculus
tatcacctttctagaggacctcaaa

SEQ ID NO: 785087 - DNA, 25 bp, Mus musculus
tatcacctttcttgaggacctcaaa

SEQ ID NO: 785088 - DNA, 25 bp, Mus musculus
tatcaccttttcaaagctcatccag

SEQ ID NO: 785089 - DNA, 25 bp, Mus musculus
tatcaccttttctaagctcatccag

SEQ ID NO: 785090 - DNA, 25 bp, Mus musculus
tatcacgactctcaggtaccatccg

SEQ ID NO: 785091 - DNA, 25 bp, Mus musculus
tatcacgactctgaggtaccatccg

SEQ ID NO: 785092 - DNA, 25 bp, Mus musculus
tatcacgcacgacagcgacgacgca

SEQ ID NO: 785093 - DNA, 25 bp, Mus musculus
tatcacgcacgagagcgacgacgca

SEQ ID NO: 785094 - DNA, 25 bp, Mus musculus
tatcacgctgtgaccacgaggaaga

SEQ ID NO: 785095 - DNA, 25 bp, Mus musculus
tatcacgctgtgtccacgaggaaga

SEQ ID NO: 785096 - DNA, 25 bp, Mus musculus
tatcacgcttcaactattccttaag

SEQ ID NO: 785097 - DNA, 25 bp, Mus musculus
tatcacgcttcatctattccttaag

SEQ ID NO: 785098 - DNA, 25 bp, Mus musculus
tatcacggtcttagaaacactcagt

SEQ ID NO: 785099 - DNA, 25 bp, Mus musculus
tatcacggtctttgaaacactcagt

SEQ ID NO: 785100 - DNA, 25 bp, Mus musculus
tatcacgtgggtatttatcagtact

SEQ ID NO: 785101 - DNA, 25 bp, Mus musculus
tatcacgtgggtttttatcagtact

SEQ ID NO: 785102 - DNA, 25 bp, Mus musculus
tatcacgtgtgaaccaggcaataaa

SEQ ID NO: 785103 - DNA, 25 bp, Mus musculus
tatcacgtgtgatccaggcaataaa

SEQ ID NO: 785104 - DNA, 25 bp, Mus musculus
tatcactaattcaccatggcactgc

SEQ ID NO: 785105 - DNA, 25 bp, Mus musculus
tatcactaattctccatggcactgc

SEQ ID NO: 785106 - DNA, 25 bp, Mus musculus
tatcactacctgaatgtagcagagg

SEQ ID NO: 785107 - DNA, 25 bp, Mus musculus
tatcactacctgaattcccattacc

SEQ ID NO: 785108 - DNA, 25 bp, Mus musculus
tatcactacctgtatgtagcagagg

SEQ ID NO: 785109 - DNA, 25 bp, Mus musculus
tatcactacctgtattcccattacc

SEQ ID NO: 785110 - DNA, 25 bp, Mus musculus
tatcactactgcacctaacttttat

SEQ ID NO: 785111 - DNA, 25 bp, Mus musculus
tatcactactgctcctaacttttat

SEQ ID NO: 785112 - DNA, 25 bp, Mus musculus
tatcactagcccatactcattttat

SEQ ID NO: 785113 - DNA, 25 bp, Mus musculus
tatcactagcccttactcattttat

SEQ ID NO: 785114 - DNA, 25 bp, Mus musculus
tatcactagctcaaggtcgtgtcca

SEQ ID NO: 785115 - DNA, 25 bp, Mus musculus
tatcactagctctaggtcgtgtcca

SEQ ID NO: 785116 - DNA, 25 bp, Mus musculus
tatcactcaaaaagccttctcctaa

SEQ ID NO: 785117 - DNA, 25 bp, Mus musculus
tatcactcaaaaatccccaagttcc

SEQ ID NO: 785118 - DNA, 25 bp, Mus musculus
tatcactcaaaatgccttctcctaa

SEQ ID NO: 785119 - DNA, 25 bp, Mus musculus
tatcactcaaaattccccaagttcc

SEQ ID NO: 785120 - DNA, 25 bp, Mus musculus
tatcactcaccaagccgaaacacat

SEQ ID NO: 785121 - DNA, 25 bp, Mus musculus
tatcactcaccatgccgaaacacat

SEQ ID NO: 785122 - DNA, 25 bp, Mus musculus
tatcactcagtgctgctctcggtag

SEQ ID NO: 785123 - DNA, 25 bp, Mus musculus
tatcactcagtggtgctctcggtag

SEQ ID NO: 785124 - DNA, 25 bp, Mus musculus
tatcactccaccatcaactgagagg

SEQ ID NO: 785125 - DNA, 25 bp, Mus musculus
tatcactccaccttcaactgagagg

SEQ ID NO: 785126 - DNA, 25 bp, Mus musculus
tatcactcccacctgcttgtaaaga

SEQ ID NO: 785127 - DNA, 25 bp, Mus musculus
tatcactcccacgtgcttgtaaaga

SEQ ID NO: 785128 - DNA, 25 bp, Mus musculus
tatcactccgaaccaccaatgtttt

SEQ ID NO: 785129 - DNA, 25 bp, Mus musculus
tatcactccgaagcaccaatgtttt

SEQ ID NO: 785130 - DNA, 25 bp, Mus musculus
tatcactgacctaagcctctctagt

SEQ ID NO: 785131 - DNA, 25 bp, Mus musculus
tatcactgaccttagcctctctagt

SEQ ID NO: 785132 - DNA, 25 bp, Mus musculus
tatcactgagatactcgttgtctcc

SEQ ID NO: 785133 - DNA, 25 bp, Mus musculus
tatcactgagatcggaggaactgta

SEQ ID NO: 785134 - DNA, 25 bp, Mus musculus
tatcactgagatgggaggaactgta

SEQ ID NO: 785135 - DNA, 25 bp, Mus musculus
tatcactgagattctcgttgtctcc

SEQ ID NO: 785136 - DNA, 25 bp, Mus musculus
tatcactgaggccagaccgacctag

SEQ ID NO: 785137 - DNA, 25 bp, Mus musculus
tatcactgaggcgagaccgacctag

SEQ ID NO: 785138 - DNA, 25 bp, Mus musculus
tatcactgagtcacactccagtgcc

SEQ ID NO: 785139 - DNA, 25 bp, Mus musculus
tatcactgagtctcactccagtgcc

SEQ ID NO: 785140 - DNA, 25 bp, Mus musculus
tatcactgcaagaacagcgtagcct

SEQ ID NO: 785141 - DNA, 25 bp, Mus musculus
tatcactgcaagtacagcgtagcct

SEQ ID NO: 785142 - DNA, 25 bp, Mus musculus
tatcactgctggaatttggatgtat

SEQ ID NO: 785143 - DNA, 25 bp, Mus musculus
tatcactgctggtatttggatgtat

SEQ ID NO: 785144 - DNA, 25 bp, Mus musculus
tatcactgggtcaacgcacaactgt

SEQ ID NO: 785145 - DNA, 25 bp, Mus musculus
tatcactgggtctacgcacaactgt

SEQ ID NO: 785146 - DNA, 25 bp, Mus musculus
tatcactggtagatggtggcattct

SEQ ID NO: 785147 - DNA, 25 bp, Mus musculus
tatcactggtagttggtggcattct

SEQ ID NO: 785148 - DNA, 25 bp, Mus musculus
tatcactgtcatattacgcacaagg

SEQ ID NO: 785149 - DNA, 25 bp, Mus musculus
tatcactgtcattttacgcacaagg

SEQ ID NO: 785150 - DNA, 25 bp, Mus musculus
tatcactgtgtgaagttcacataac

SEQ ID NO: 785151 - DNA, 25 bp, Mus musculus
tatcactgtgtgtagttcacataac

SEQ ID NO: 785152 - DNA, 25 bp, Mus musculus
tatcactgttttaaccatcaaaggg

SEQ ID NO: 785153 - DNA, 25 bp, Mus musculus
tatcactgtttttaccatcaaaggg

SEQ ID NO: 785154 - DNA, 25 bp, Mus musculus
tatcacttcagcctcaatatctatg

SEQ ID NO: 785155 - DNA, 25 bp, Mus musculus
tatcacttcagcgtcaatatctatg

SEQ ID NO: 785156 - DNA, 25 bp, Mus musculus
tatcacttccacaaaagcagcttga

SEQ ID NO: 785157 - DNA, 25 bp, Mus musculus
tatcacttccacaggtttgggtttc

SEQ ID NO: 785158 - DNA, 25 bp, Mus musculus
tatcacttccaccaagaactgcatg

SEQ ID NO: 785159 - DNA, 25 bp, Mus musculus
tatcacttccacgaagaactgcatg

SEQ ID NO: 785160 - DNA, 25 bp, Mus musculus
tatcacttccactaaagcagcttga

SEQ ID NO: 785161 - DNA, 25 bp, Mus musculus
tatcacttccactggtttgggtttc

SEQ ID NO: 785162 - DNA, 25 bp, Mus musculus
tatcacttcctgacgccctatgtat

SEQ ID NO: 785163 - DNA, 25 bp, Mus musculus
tatcacttcctgtcgccctatgtat

SEQ ID NO: 785164 - DNA, 25 bp, Mus musculus
tatcacttcttcaagtacagtccta

SEQ ID NO: 785165 - DNA, 25 bp, Mus musculus
tatcacttcttctagtacagtccta

SEQ ID NO: 785166 - DNA, 25 bp, Mus musculus
tatcacttgcaacatgctaccagct

SEQ ID NO: 785167 - DNA, 25 bp, Mus musculus
tatcacttgcaacgcgagtcaggat

SEQ ID NO: 785168 - DNA, 25 bp, Mus musculus
tatcacttgcaagatgctaccagct

SEQ ID NO: 785169 - DNA, 25 bp, Mus musculus
tatcacttgcaaggcgagtcaggat

SEQ ID NO: 785170 - DNA, 25 bp, Mus musculus
tatcacttgctgaagatggcttatt

SEQ ID NO: 785171 - DNA, 25 bp, Mus musculus
tatcacttgctgtagatggcttatt

SEQ ID NO: 785172 - DNA, 25 bp, Mus musculus
tatcacttgtccagagtgggaatag

SEQ ID NO: 785173 - DNA, 25 bp, Mus musculus
tatcacttgtccctggaaatgaaga

SEQ ID NO: 785174 - DNA, 25 bp, Mus musculus
tatcacttgtccgtggaaatgaaga

SEQ ID NO: 785175 - DNA, 25 bp, Mus musculus
tatcacttgtcctgagtgggaatag

SEQ ID NO: 785176 - DNA, 25 bp, Mus musculus
tatcactttataactcaccaccttt

SEQ ID NO: 785177 - DNA, 25 bp, Mus musculus
tatcactttatatctcaccaccttt

SEQ ID NO: 785178 - DNA, 25 bp, Mus musculus
tatcactttgaaagctgtagccaag

SEQ ID NO: 785179 - DNA, 25 bp, Mus musculus
tatcactttgaatgctgtagccaag

SEQ ID NO: 785180 - DNA, 25 bp, Mus musculus
tatcagaaagttagcaggccatcct

SEQ ID NO: 785181 - DNA, 25 bp, Mus musculus
tatcagaaagtttgcaggccatcct

SEQ ID NO: 785182 - DNA, 25 bp, Mus musculus
tatcagaagcttaatcctagccagg

SEQ ID NO: 785183 - DNA, 25 bp, Mus musculus
tatcagaagctttatcctagccagg

SEQ ID NO: 785184 - DNA, 25 bp, Mus musculus
tatcagacaagcagagagtttgtat

SEQ ID NO: 785185 - DNA, 25 bp, Mus musculus
tatcagacaagctgagagtttgtat

SEQ ID NO: 785186 - DNA, 25 bp, Mus musculus
tatcagacagcaaacatcccgaatt

SEQ ID NO: 785187 - DNA, 25 bp, Mus musculus
tatcagacagcatacatcccgaatt

SEQ ID NO: 785188 - DNA, 25 bp, Mus musculus
tatcagacagtcctatttcttctta

SEQ ID NO: 785189 - DNA, 25 bp, Mus musculus
tatcagacagtcgtatttcttctta

SEQ ID NO: 785190 - DNA, 25 bp, Mus musculus
tatcagaccagacgccatgttacac

SEQ ID NO: 785191 - DNA, 25 bp, Mus musculus
tatcagaccagaggccatgttacac

SEQ ID NO: 785192 - DNA, 25 bp, Mus musculus
tatcagacccataaaagcaaaagca

SEQ ID NO: 785193 - DNA, 25 bp, Mus musculus
tatcagacccattaaagcaaaagca

SEQ ID NO: 785194 - DNA, 25 bp, Mus musculus
tatcagaccggtcgttccagggagt

SEQ ID NO: 785195 - DNA, 25 bp, Mus musculus
tatcagaccggtggttccagggagt

SEQ ID NO: 785196 - DNA, 25 bp, Mus musculus
tatcagacgcaaaatctaggcatgg

SEQ ID NO: 785197 - DNA, 25 bp, Mus musculus
tatcagacgcaatatctaggcatgg

SEQ ID NO: 785198 - DNA, 25 bp, Mus musculus
tatcagactgacccctcgggcacat

SEQ ID NO: 785199 - DNA, 25 bp, Mus musculus
tatcagactgacgcctcgggcacat

SEQ ID NO: 785200 - DNA, 25 bp, Mus musculus
tatcagagaacgaacgactccaggg

SEQ ID NO: 785201 - DNA, 25 bp, Mus musculus
tatcagagaacgtacgactccaggg

SEQ ID NO: 785202 - DNA, 25 bp, Mus musculus
tatcagagacaccaggcacgagacc

SEQ ID NO: 785203 - DNA, 25 bp, Mus musculus
tatcagagacacgaggcacgagacc

SEQ ID NO: 785204 - DNA, 25 bp, Mus musculus
tatcagagacttacatactatgtgt

SEQ ID NO: 785205 - DNA, 25 bp, Mus musculus
tatcagagactttcatactatgtgt

SEQ ID NO: 785206 - DNA, 25 bp, Mus musculus
tatcagagagatagccccagggaca

SEQ ID NO: 785207 - DNA, 25 bp, Mus musculus
tatcagagagattgccccagggaca

SEQ ID NO: 785208 - DNA, 25 bp, Mus musculus
tatcagagcaagcagctgtcgagct

SEQ ID NO: 785209 - DNA, 25 bp, Mus musculus
tatcagagcaaggagctgtcgagct

SEQ ID NO: 785210 - DNA, 25 bp, Mus musculus
tatcagagcagacacgctactccct

SEQ ID NO: 785211 - DNA, 25 bp, Mus musculus
tatcagagcagagacgctactccct

SEQ ID NO: 785212 - DNA, 25 bp, Mus musculus
tatcagagcattcccctcagacgag

SEQ ID NO: 785213 - DNA, 25 bp, Mus musculus
tatcagagcattgccctcagacgag

SEQ ID NO: 785214 - DNA, 25 bp, Mus musculus
tatcagagccctagagtctgccaag

SEQ ID NO: 785215 - DNA, 25 bp, Mus musculus
tatcagagcccttgagtctgccaag

SEQ ID NO: 785216 - DNA, 25 bp, Mus musculus
tatcagagcctgctacagtgagtcc

SEQ ID NO: 785217 - DNA, 25 bp, Mus musculus
tatcagagcctggtacagtgagtcc

SEQ ID NO: 785218 - DNA, 25 bp, Mus musculus
tatcagagctcaaacctgactggag

SEQ ID NO: 785219 - DNA, 25 bp, Mus musculus
tatcagagctcatacctgactggag

SEQ ID NO: 785220 - DNA, 25 bp, Mus musculus
tatcagagttttccagagccccctt

SEQ ID NO: 785221 - DNA, 25 bp, Mus musculus
tatcagagttttgcagagccccctt

SEQ ID NO: 785222 - DNA, 25 bp, Mus musculus
tatcagatatccagcccatgagata

SEQ ID NO: 785223 - DNA, 25 bp, Mus musculus
tatcagatatcctgcccatgagata

SEQ ID NO: 785224 - DNA, 25 bp, Mus musculus
tatcagatctttccggacccatcag

SEQ ID NO: 785225 - DNA, 25 bp, Mus musculus
tatcagatctttgcggacccatcag

SEQ ID NO: 785226 - DNA, 25 bp, Mus musculus
tatcagatggagcaaccagtgctgc

SEQ ID NO: 785227 - DNA, 25 bp, Mus musculus
tatcagatggaggaaccagtgctgc

SEQ ID NO: 785228 - DNA, 25 bp, Mus musculus
tatcagatgtttattaccacgtttt

SEQ ID NO: 785229 - DNA, 25 bp, Mus musculus
tatcagatgttttttaccacgtttt

SEQ ID NO: 785230 - DNA, 25 bp, Mus musculus
tatcagattatccatctcgcttaga

SEQ ID NO: 785231 - DNA, 25 bp, Mus musculus
tatcagattatcgatctcgcttaga

SEQ ID NO: 785232 - DNA, 25 bp, Mus musculus
tatcagattctcagatctcaccgag

SEQ ID NO: 785233 - DNA, 25 bp, Mus musculus
tatcagattctctgatctcaccgag

SEQ ID NO: 785234 - DNA, 25 bp, Mus musculus
tatcagattggaccttgaatttatc

SEQ ID NO: 785235 - DNA, 25 bp, Mus musculus
tatcagattggagcttgaatttatc

SEQ ID NO: 785236 - DNA, 25 bp, Mus musculus
tatcagcaacagcagtatggctctg

SEQ ID NO: 785237 - DNA, 25 bp, Mus musculus
tatcagcaacaggagtatggctctg

SEQ ID NO: 785238 - DNA, 25 bp, Mus musculus
tatcagcagcacactaaacccagga

SEQ ID NO: 785239 - DNA, 25 bp, Mus musculus
tatcagcagcactctaaacccagga

SEQ ID NO: 785240 - DNA, 25 bp, Mus musculus
tatcagcattctcggaggtgaatct

SEQ ID NO: 785241 - DNA, 25 bp, Mus musculus
tatcagcattctgggaggtgaatct

SEQ ID NO: 785242 - DNA, 25 bp, Mus musculus
tatcagccaagccacatatttagtt

SEQ ID NO: 785243 - DNA, 25 bp, Mus musculus
tatcagccaagcgacatatttagtt

SEQ ID NO: 785244 - DNA, 25 bp, Mus musculus
tatcagccacacaagcaaccctaga

SEQ ID NO: 785245 - DNA, 25 bp, Mus musculus
tatcagccacactagcaaccctaga

SEQ ID NO: 785246 - DNA, 25 bp, Mus musculus
tatcagccagagaagcaaggcggtt

SEQ ID NO: 785247 - DNA, 25 bp, Mus musculus
tatcagccagagtagcaaggcggtt

SEQ ID NO: 785248 - DNA, 25 bp, Mus musculus
tatcagccatttccataggcagata

SEQ ID NO: 785249 - DNA, 25 bp, Mus musculus
tatcagccatttgcataggcagata

SEQ ID NO: 785250 - DNA, 25 bp, Mus musculus
tatcagcctgctataattcaagact

SEQ ID NO: 785251 - DNA, 25 bp, Mus musculus
tatcagcctgctttaattcaagact

SEQ ID NO: 785252 - DNA, 25 bp, Mus musculus
tatcagcgcctgatgacagtggcag

SEQ ID NO: 785253 - DNA, 25 bp, Mus musculus
tatcagcgcctgttgacagtggcag

SEQ ID NO: 785254 - DNA, 25 bp, Mus musculus
tatcagctacatcagctctgggcct

SEQ ID NO: 785255 - DNA, 25 bp, Mus musculus
tatcagctacatgagctctgggcct

SEQ ID NO: 785256 - DNA, 25 bp, Mus musculus
tatcagctatgtacgactatccacc

SEQ ID NO: 785257 - DNA, 25 bp, Mus musculus
tatcagctatgttcgactatccacc

SEQ ID NO: 785258 - DNA, 25 bp, Mus musculus
tatcagctctgcatggtggaggcct

SEQ ID NO: 785259 - DNA, 25 bp, Mus musculus
tatcagctctgcttggtggaggcct

SEQ ID NO: 785260 - DNA, 25 bp, Mus musculus
tatcagctctgtccattcacacgtt

SEQ ID NO: 785261 - DNA, 25 bp, Mus musculus
tatcagctctgtgcattcacacgtt

SEQ ID NO: 785262 - DNA, 25 bp, Mus musculus
tatcagctgaggattcttctccacg

SEQ ID NO: 785263 - DNA, 25 bp, Mus musculus
tatcagctgaggtttcttctccacg

SEQ ID NO: 785264 - DNA, 25 bp, Mus musculus
tatcagctgatcccccgtgtagaag

SEQ ID NO: 785265 - DNA, 25 bp, Mus musculus
tatcagctgatcgcccgtgtagaag

SEQ ID NO: 785266 - DNA, 25 bp, Mus musculus
tatcagctgtccagagatgctcctg

SEQ ID NO: 785267 - DNA, 25 bp, Mus musculus
tatcagctgtcctgagatgctcctg

SEQ ID NO: 785268 - DNA, 25 bp, Mus musculus
tatcagcttaccctttaatgcctaa

SEQ ID NO: 785269 - DNA, 25 bp, Mus musculus
tatcagcttaccgtttaatgcctaa

SEQ ID NO: 785270 - DNA, 25 bp, Mus musculus
tatcagctttagagagtgcgtagtc

SEQ ID NO: 785271 - DNA, 25 bp, Mus musculus
tatcagctttagtgagtgcgtagtc

SEQ ID NO: 785272 - DNA, 25 bp, Mus musculus
tatcagctttgccacagtacatttt

SEQ ID NO: 785273 - DNA, 25 bp, Mus musculus
tatcagctttgcgacagtacatttt

SEQ ID NO: 785274 - DNA, 25 bp, Mus musculus
tatcaggaagcacctgggaagtgtc

SEQ ID NO: 785275 - DNA, 25 bp, Mus musculus
tatcaggaagcagctgggaagtgtc

SEQ ID NO: 785276 - DNA, 25 bp, Mus musculus
tatcaggagttactgttgctactat

SEQ ID NO: 785277 - DNA, 25 bp, Mus musculus
tatcaggagttagtgttgctactat

SEQ ID NO: 785278 - DNA, 25 bp, Mus musculus
tatcaggagttgcacttgggtatct

SEQ ID NO: 785279 - DNA, 25 bp, Mus musculus
tatcaggagttggacttgggtatct

SEQ ID NO: 785280 - DNA, 25 bp, Mus musculus
tatcaggatcttctgggcagctcac

SEQ ID NO: 785281 - DNA, 25 bp, Mus musculus
tatcaggatcttgtgggcagctcac

SEQ ID NO: 785282 - DNA, 25 bp, Mus musculus
tatcaggatgaaagcttgccccagt

SEQ ID NO: 785283 - DNA, 25 bp, Mus musculus
tatcaggatgaatgcttgccccagt

SEQ ID NO: 785284 - DNA, 25 bp, Mus musculus
tatcaggcaaggaggctgcctgctg

SEQ ID NO: 785285 - DNA, 25 bp, Mus musculus
tatcaggcaaggtggctgcctgctg

SEQ ID NO: 785286 - DNA, 25 bp, Mus musculus
tatcaggcagctccatctgtaccat

SEQ ID NO: 785287 - DNA, 25 bp, Mus musculus
tatcaggcagctgcatctgtaccat

SEQ ID NO: 785288 - DNA, 25 bp, Mus musculus
tatcaggcatagcagtggacacaca

SEQ ID NO: 785289 - DNA, 25 bp, Mus musculus
tatcaggcataggagtggacacaca

SEQ ID NO: 785290 - DNA, 25 bp, Mus musculus
tatcaggcatgcagaggctggcgca

SEQ ID NO: 785291 - DNA, 25 bp, Mus musculus
tatcaggcatgctgaggctggcgca

SEQ ID NO: 785292 - DNA, 25 bp, Mus musculus
tatcaggccctcactgatcaagaag

SEQ ID NO: 785293 - DNA, 25 bp, Mus musculus
tatcaggccctctctgatcaagaag

SEQ ID NO: 785294 - DNA, 25 bp, Mus musculus
tatcaggcctctctgtatcactttt

SEQ ID NO: 785295 - DNA, 25 bp, Mus musculus
tatcaggcctctgtgtatcactttt

SEQ ID NO: 785296 - DNA, 25 bp, Mus musculus
tatcaggctgctcgctttgggatta

SEQ ID NO: 785297 - DNA, 25 bp, Mus musculus
tatcaggctgctggctttgggatta

SEQ ID NO: 785298 - DNA, 25 bp, Mus musculus
tatcaggcttggaagtaatcaccct

SEQ ID NO: 785299 - DNA, 25 bp, Mus musculus
tatcaggcttggtagtaatcaccct

SEQ ID NO: 785300 - DNA, 25 bp, Mus musculus
tatcagggatctctcagcactcctc

SEQ ID NO: 785301 - DNA, 25 bp, Mus musculus
tatcagggatctgtcagcactcctc

SEQ ID NO: 785302 - DNA, 25 bp, Mus musculus
tatcagggcaatcgacggccgaaga

SEQ ID NO: 785303 - DNA, 25 bp, Mus musculus
tatcagggcaatggacggccgaaga

SEQ ID NO: 785304 - DNA, 25 bp, Mus musculus
tatcagggcagtcaccaaacttggt

SEQ ID NO: 785305 - DNA, 25 bp, Mus musculus
tatcagggcagtgaccaaacttggt

SEQ ID NO: 785306 - DNA, 25 bp, Mus musculus
tatcagggccataagcatagatctt

SEQ ID NO: 785307 - DNA, 25 bp, Mus musculus
tatcagggccattagcatagatctt

SEQ ID NO: 785308 - DNA, 25 bp, Mus musculus
tatcagggcccaatcggaggatacc

SEQ ID NO: 785309 - DNA, 25 bp, Mus musculus
tatcagggcccattcggaggatacc

SEQ ID NO: 785310 - DNA, 25 bp, Mus musculus
tatcagggtcttccaccctggtacg

SEQ ID NO: 785311 - DNA, 25 bp, Mus musculus
tatcagggtcttgcaccctggtacg

SEQ ID NO: 785312 - DNA, 25 bp, Mus musculus
tatcaggtatctctgtccgtgctca

SEQ ID NO: 785313 - DNA, 25 bp, Mus musculus
tatcaggtatctgtgtccgtgctca

SEQ ID NO: 785314 - DNA, 25 bp, Mus musculus
tatcaggtccacagataccgagtga

SEQ ID NO: 785315 - DNA, 25 bp, Mus musculus
tatcaggtccactgataccgagtga

SEQ ID NO: 785316 - DNA, 25 bp, Mus musculus
tatcaggtctctatggctgtaccca

SEQ ID NO: 785317 - DNA, 25 bp, Mus musculus
tatcaggtctctttggctgtaccca

SEQ ID NO: 785318 - DNA, 25 bp, Mus musculus
tatcaggtctgccataaattcttcc

SEQ ID NO: 785319 - DNA, 25 bp, Mus musculus
tatcaggtctgcgataaattcttcc

SEQ ID NO: 785320 - DNA, 25 bp, Mus musculus
tatcaggtgcaaaaggccccggaga

SEQ ID NO: 785321 - DNA, 25 bp, Mus musculus
tatcaggtgcaataggccccggaga

SEQ ID NO: 785322 - DNA, 25 bp, Mus musculus
tatcaggtggccacttagaagccat

SEQ ID NO: 785323 - DNA, 25 bp, Mus musculus
tatcaggtggcctcttagaagccat

SEQ ID NO: 785324 - DNA, 25 bp, Mus musculus
tatcaggttcctcgagagccactgg

SEQ ID NO: 785325 - DNA, 25 bp, Mus musculus
tatcaggttcctggagagccactgg

SEQ ID NO: 785326 - DNA, 25 bp, Mus musculus
tatcagtaaagaaattgttgttcaa

SEQ ID NO: 785327 - DNA, 25 bp, Mus musculus
tatcagtaaagatattgttgttcaa

SEQ ID NO: 785328 - DNA, 25 bp, Mus musculus
tatcagtaacagaattcctcctgaa

SEQ ID NO: 785329 - DNA, 25 bp, Mus musculus
tatcagtaacagtattcctcctgaa

SEQ ID NO: 785330 - DNA, 25 bp, Mus musculus
tatcagtacgtccgcaatggaagaa

SEQ ID NO: 785331 - DNA, 25 bp, Mus musculus
tatcagtacgtcggcaatggaagaa

SEQ ID NO: 785332 - DNA, 25 bp, Mus musculus
tatcagtatgccatcagtcagtctt

SEQ ID NO: 785333 - DNA, 25 bp, Mus musculus
tatcagtatgccttcagtcagtctt

SEQ ID NO: 785334 - DNA, 25 bp, Mus musculus
tatcagtcacagaaaacaacctgtt

SEQ ID NO: 785335 - DNA, 25 bp, Mus musculus
tatcagtcacagtaaacaacctgtt

SEQ ID NO: 785336 - DNA, 25 bp, Mus musculus
tatcagtcagcacgcagcaaaactt

SEQ ID NO: 785337 - DNA, 25 bp, Mus musculus
tatcagtcagcaggcagcaaaactt

SEQ ID NO: 785338 - DNA, 25 bp, Mus musculus
tatcagtccaggaatggcccgggaa

SEQ ID NO: 785339 - DNA, 25 bp, Mus musculus
tatcagtccaggtatggcccgggaa

SEQ ID NO: 785340 - DNA, 25 bp, Mus musculus
tatcagtcctataaagaccatctct

SEQ ID NO: 785341 - DNA, 25 bp, Mus musculus
tatcagtcctattaagaccatctct

SEQ ID NO: 785342 - DNA, 25 bp, Mus musculus
tatcagtcgaatcggtggtgttcac

SEQ ID NO: 785343 - DNA, 25 bp, Mus musculus
tatcagtcgaatgggtggtgttcac

SEQ ID NO: 785344 - DNA, 25 bp, Mus musculus
tatcagtgagacattctaccccaca

SEQ ID NO: 785345 - DNA, 25 bp, Mus musculus
tatcagtgagactttctaccccaca

SEQ ID NO: 785346 - DNA, 25 bp, Mus musculus
tatcagtgagtacctggtcctcggg

SEQ ID NO: 785347 - DNA, 25 bp, Mus musculus
tatcagtgagtagctggtcctcggg

SEQ ID NO: 785348 - DNA, 25 bp, Mus musculus
tatcagtgcaagagaactgtgaggt

SEQ ID NO: 785349 - DNA, 25 bp, Mus musculus
tatcagtgcaagtgaactgtgaggt

SEQ ID NO: 785350 - DNA, 25 bp, Mus musculus
tatcagtggagtctctgcacggcaa

SEQ ID NO: 785351 - DNA, 25 bp, Mus musculus
tatcagtggagtgtctgcacggcaa

SEQ ID NO: 785352 - DNA, 25 bp, Mus musculus
tatcagtggcaactatttaccagtt

SEQ ID NO: 785353 - DNA, 25 bp, Mus musculus
tatcagtggcaagtatttaccagtt

SEQ ID NO: 785354 - DNA, 25 bp, Mus musculus
tatcagtggctgatcgcctgtgttc

SEQ ID NO: 785355 - DNA, 25 bp, Mus musculus
tatcagtggctgttcgcctgtgttc

SEQ ID NO: 785356 - DNA, 25 bp, Mus musculus
tatcagtgggataaactccttgtac

SEQ ID NO: 785357 - DNA, 25 bp, Mus musculus
tatcagtgggattaactccttgtac

SEQ ID NO: 785358 - DNA, 25 bp, Mus musculus
tatcagtgtcagacgctacagaatt

SEQ ID NO: 785359 - DNA, 25 bp, Mus musculus
tatcagtgtcagtcgctacagaatt

SEQ ID NO: 785360 - DNA, 25 bp, Mus musculus
tatcagtgtggactgtcccatgcct

SEQ ID NO: 785361 - DNA, 25 bp, Mus musculus
tatcagtgtggagtgtcccatgcct

SEQ ID NO: 785362 - DNA, 25 bp, Mus musculus
tatcagttacccaagcaagatccct

SEQ ID NO: 785363 - DNA, 25 bp, Mus musculus
tatcagttaccctagcaagatccct

SEQ ID NO: 785364 - DNA, 25 bp, Mus musculus
tatcagttcaggcaagtcagttcag

SEQ ID NO: 785365 - DNA, 25 bp, Mus musculus
tatcagttcagggaagtcagttcag

SEQ ID NO: 785366 - DNA, 25 bp, Mus musculus
tatcagttcgcaaagctccaagtat

SEQ ID NO: 785367 - DNA, 25 bp, Mus musculus
tatcagttcgcatagctccaagtat

SEQ ID NO: 785368 - DNA, 25 bp, Mus musculus
tatcagttgatgcacttttggttgt

SEQ ID NO: 785369 - DNA, 25 bp, Mus musculus
tatcagttgatggacttttggttgt

SEQ ID NO: 785370 - DNA, 25 bp, Mus musculus
tatcagttgtacattctccttgctc

SEQ ID NO: 785371 - DNA, 25 bp, Mus musculus
tatcagttgtactttctccttgctc

SEQ ID NO: 785372 - DNA, 25 bp, Mus musculus
tatcagtttactagagcatgctcct

SEQ ID NO: 785373 - DNA, 25 bp, Mus musculus
tatcagtttacttgagcatgctcct

SEQ ID NO: 785374 - DNA, 25 bp, Mus musculus
tatcagtttcacagtctgggatgtt

SEQ ID NO: 785375 - DNA, 25 bp, Mus musculus
tatcagtttcactgtctgggatgtt

SEQ ID NO: 785376 - DNA, 25 bp, Mus musculus
tatcagtttctaccagacagtttct

SEQ ID NO: 785377 - DNA, 25 bp, Mus musculus
tatcagtttctagcagacagtttct

SEQ ID NO: 785378 - DNA, 25 bp, Mus musculus
tatcagtttctgcaagggttgcccc

SEQ ID NO: 785379 - DNA, 25 bp, Mus musculus
tatcagtttctggaagggttgcccc

SEQ ID NO: 785380 - DNA, 25 bp, Mus musculus
tatcagtttttcacattcgcacgca

SEQ ID NO: 785381 - DNA, 25 bp, Mus musculus
tatcagtttttccacccttgcaaaa

SEQ ID NO: 785382 - DNA, 25 bp, Mus musculus
tatcagtttttcgacccttgcaaaa

SEQ ID NO: 785383 - DNA, 25 bp, Mus musculus
tatcagtttttctcattcgcacgca

SEQ ID NO: 785384 - DNA, 25 bp, Mus musculus
tatcataacatcatagtggtcagga

SEQ ID NO: 785385 - DNA, 25 bp, Mus musculus
tatcataacatcttagtggtcagga

SEQ ID NO: 785386 - DNA, 25 bp, Mus musculus
tatcataaggtcacttttccctttt

SEQ ID NO: 785387 - DNA, 25 bp, Mus musculus
tatcataaggtctcttttccctttt

SEQ ID NO: 785388 - DNA, 25 bp, Mus musculus
tatcataatacccacctttcgtcat

SEQ ID NO: 785389 - DNA, 25 bp, Mus musculus
tatcataataccgacctttcgtcat

SEQ ID NO: 785390 - DNA, 25 bp, Mus musculus
tatcataatacgcatgtccattttc

SEQ ID NO: 785391 - DNA, 25 bp, Mus musculus
tatcataatacggatgtccattttc

SEQ ID NO: 785392 - DNA, 25 bp, Mus musculus
tatcataccattccttgcctggtga

SEQ ID NO: 785393 - DNA, 25 bp, Mus musculus
tatcataccattgcttgcctggtga

SEQ ID NO: 785394 - DNA, 25 bp, Mus musculus
tatcatactcacattccatcctgat

SEQ ID NO: 785395 - DNA, 25 bp, Mus musculus
tatcatactcactttccatcctgat

SEQ ID NO: 785396 - DNA, 25 bp, Mus musculus
tatcatagtcagaagcaggctatag

SEQ ID NO: 785397 - DNA, 25 bp, Mus musculus
tatcatagtcagtagcaggctatag

SEQ ID NO: 785398 - DNA, 25 bp, Mus musculus
tatcatagtctacctggagcagccc

SEQ ID NO: 785399 - DNA, 25 bp, Mus musculus
tatcatagtctagctggagcagccc

SEQ ID NO: 785400 - DNA, 25 bp, Mus musculus
tatcatagtctcagcactgtcttcc

SEQ ID NO: 785401 - DNA, 25 bp, Mus musculus
tatcatagtctctgcactgtcttcc

SEQ ID NO: 785402 - DNA, 25 bp, Mus musculus
tatcatagtttcctgtgcttagcca

SEQ ID NO: 785403 - DNA, 25 bp, Mus musculus
tatcatagtttcgtgtgcttagcca

SEQ ID NO: 785404 - DNA, 25 bp, Mus musculus
tatcatatactcactctgactctga

SEQ ID NO: 785405 - DNA, 25 bp, Mus musculus
tatcatatactctctctgactctga

SEQ ID NO: 785406 - DNA, 25 bp, Mus musculus
tatcatatatctctttccctcttaa

SEQ ID NO: 785407 - DNA, 25 bp, Mus musculus
tatcatatatctgtttccctcttaa

SEQ ID NO: 785408 - DNA, 25 bp, Mus musculus
tatcatatcattataatcgacccaa

SEQ ID NO: 785409 - DNA, 25 bp, Mus musculus
tatcatatcattttaatcgacccaa

SEQ ID NO: 785410 - DNA, 25 bp, Mus musculus
tatcatatcgctctctggaatcagg

SEQ ID NO: 785411 - DNA, 25 bp, Mus musculus
tatcatatcgctgtctggaatcagg

SEQ ID NO: 785412 - DNA, 25 bp, Mus musculus
tatcatatgtgtcaagtccaagctt

SEQ ID NO: 785413 - DNA, 25 bp, Mus musculus
tatcatatgtgtgaagtccaagctt

SEQ ID NO: 785414 - DNA, 25 bp, Mus musculus
tatcatatttctctggagggttgcc

SEQ ID NO: 785415 - DNA, 25 bp, Mus musculus
tatcatatttctgtggagggttgcc

SEQ ID NO: 785416 - DNA, 25 bp, Mus musculus
tatcatcaaccacctaggacacata

SEQ ID NO: 785417 - DNA, 25 bp, Mus musculus
tatcatcaaccagctaggacacata

SEQ ID NO: 785418 - DNA, 25 bp, Mus musculus
tatcatcaccccaactttttatatt

SEQ ID NO: 785419 - DNA, 25 bp, Mus musculus
tatcatcacccctactttttatatt

SEQ ID NO: 785420 - DNA, 25 bp, Mus musculus
tatcatcactgtacatttggagagg

SEQ ID NO: 785421 - DNA, 25 bp, Mus musculus
tatcatcactgttcatttggagagg

SEQ ID NO: 785422 - DNA, 25 bp, Mus musculus
tatcatcagaatctacaaacacatg

SEQ ID NO: 785423 - DNA, 25 bp, Mus musculus
tatcatcagaatgtacaaacacatg

SEQ ID NO: 785424 - DNA, 25 bp, Mus musculus
tatcatcagggcatgtataccttat

SEQ ID NO: 785425 - DNA, 25 bp, Mus musculus
tatcatcagggcttgtataccttat

SEQ ID NO: 785426 - DNA, 25 bp, Mus musculus
tatcatcatcccaagccaaattcta

SEQ ID NO: 785427 - DNA, 25 bp, Mus musculus
tatcatcatccctagccaaattcta

SEQ ID NO: 785428 - DNA, 25 bp, Mus musculus
tatcatcatgctagacttccaaagg

SEQ ID NO: 785429 - DNA, 25 bp, Mus musculus
tatcatcatgcttgacttccaaagg

SEQ ID NO: 785430 - DNA, 25 bp, Mus musculus
tatcatcattatattgtccatcttt

SEQ ID NO: 785431 - DNA, 25 bp, Mus musculus
tatcatcattattttgtccatcttt

SEQ ID NO: 785432 - DNA, 25 bp, Mus musculus
tatcatccagataaacaaagtgcag

SEQ ID NO: 785433 - DNA, 25 bp, Mus musculus
tatcatccagattaacaaagtgcag

SEQ ID NO: 785434 - DNA, 25 bp, Mus musculus
tatcatccatgtattttgtaatcct

SEQ ID NO: 785435 - DNA, 25 bp, Mus musculus
tatcatccatgttttttgtaatcct

SEQ ID NO: 785436 - DNA, 25 bp, Mus musculus
tatcatcccattatgccttagaggc

SEQ ID NO: 785437 - DNA, 25 bp, Mus musculus
tatcatcccattttgccttagaggc

SEQ ID NO: 785438 - DNA, 25 bp, Mus musculus
tatcatccggagacggcctggtgga

SEQ ID NO: 785439 - DNA, 25 bp, Mus musculus
tatcatccggagtcggcctggtgga

SEQ ID NO: 785440 - DNA, 25 bp, Mus musculus
tatcatccggccaagccagtcttta

SEQ ID NO: 785441 - DNA, 25 bp, Mus musculus
tatcatccggcctagccagtcttta

SEQ ID NO: 785442 - DNA, 25 bp, Mus musculus
tatcatcctaacactccggtgatgg

SEQ ID NO: 785443 - DNA, 25 bp, Mus musculus
tatcatcctaactctccggtgatgg

SEQ ID NO: 785444 - DNA, 25 bp, Mus musculus
tatcatcctattagagagtttgagg

SEQ ID NO: 785445 - DNA, 25 bp, Mus musculus
tatcatcctattcaccagcacttaa

SEQ ID NO: 785446 - DNA, 25 bp, Mus musculus
tatcatcctattgaccagcacttaa

SEQ ID NO: 785447 - DNA, 25 bp, Mus musculus
tatcatcctatttgagagtttgagg

SEQ ID NO: 785448 - DNA, 25 bp, Mus musculus
tatcatcctctcaaccactatttct

SEQ ID NO: 785449 - DNA, 25 bp, Mus musculus
tatcatcctctctaccactatttct

SEQ ID NO: 785450 - DNA, 25 bp, Mus musculus
tatcatcctgacacttaatccttct

SEQ ID NO: 785451 - DNA, 25 bp, Mus musculus
tatcatcctgactcttaatccttct

SEQ ID NO: 785452 - DNA, 25 bp, Mus musculus
tatcatcctgtacttgaccctgtgg

SEQ ID NO: 785453 - DNA, 25 bp, Mus musculus
tatcatcctgtagttgaccctgtgg

SEQ ID NO: 785454 - DNA, 25 bp, Mus musculus
tatcatcctgtcctagccttgactt

SEQ ID NO: 785455 - DNA, 25 bp, Mus musculus
tatcatcctgtcgtagccttgactt

SEQ ID NO: 785456 - DNA, 25 bp, Mus musculus
tatcatctaacaaaccctacttgga

SEQ ID NO: 785457 - DNA, 25 bp, Mus musculus
tatcatctaacataccctacttgga

SEQ ID NO: 785458 - DNA, 25 bp, Mus musculus
tatcatctacgtcatggctggccag

SEQ ID NO: 785459 - DNA, 25 bp, Mus musculus
tatcatctacgtgatggctggccag

SEQ ID NO: 785460 - DNA, 25 bp, Mus musculus
tatcatctgagaacagcacccctag

SEQ ID NO: 785461 - DNA, 25 bp, Mus musculus
tatcatctgagatcagcacccctag

SEQ ID NO: 785462 - DNA, 25 bp, Mus musculus
tatcatctgtgcagtgcttagcctt

SEQ ID NO: 785463 - DNA, 25 bp, Mus musculus
tatcatctgtgctgtgcttagcctt

SEQ ID NO: 785464 - DNA, 25 bp, Mus musculus
tatcatctgtggatctcagtgcaaa

SEQ ID NO: 785465 - DNA, 25 bp, Mus musculus
tatcatctgtggcagtaccatccct

SEQ ID NO: 785466 - DNA, 25 bp, Mus musculus
tatcatctgtgggagtaccatccct

SEQ ID NO: 785467 - DNA, 25 bp, Mus musculus
tatcatctgtggttctcagtgcaaa

SEQ ID NO: 785468 - DNA, 25 bp, Mus musculus
tatcatcttatacccagacggctct

SEQ ID NO: 785469 - DNA, 25 bp, Mus musculus
tatcatcttatagccagacggctct

SEQ ID NO: 785470 - DNA, 25 bp, Mus musculus
tatcatcttcggagtgcctggagaa

SEQ ID NO: 785471 - DNA, 25 bp, Mus musculus
tatcatcttcggtgtgcctggagaa

SEQ ID NO: 785472 - DNA, 25 bp, Mus musculus
tatcatcttgctcttatacttactg

SEQ ID NO: 785473 - DNA, 25 bp, Mus musculus
tatcatcttgctgttatacttactg

SEQ ID NO: 785474 - DNA, 25 bp, Mus musculus
tatcatctttctctcttcaactgct

SEQ ID NO: 785475 - DNA, 25 bp, Mus musculus
tatcatctttctgtcttcaactgct

SEQ ID NO: 785476 - DNA, 25 bp, Mus musculus
tatcatgaaagtcgctagagatttt

SEQ ID NO: 785477 - DNA, 25 bp, Mus musculus
tatcatgaaagtggctagagatttt

SEQ ID NO: 785478 - DNA, 25 bp, Mus musculus
tatcatgacacaactgactcagtat

SEQ ID NO: 785479 - DNA, 25 bp, Mus musculus
tatcatgacacatctgactcagtat

SEQ ID NO: 785480 - DNA, 25 bp, Mus musculus
tatcatgacaccagttgtcccagca

SEQ ID NO: 785481 - DNA, 25 bp, Mus musculus
tatcatgacacctgttgtcccagca

SEQ ID NO: 785482 - DNA, 25 bp, Mus musculus
tatcatgaccccaattatagacgat

SEQ ID NO: 785483 - DNA, 25 bp, Mus musculus
tatcatgacccctattatagacgat

SEQ ID NO: 785484 - DNA, 25 bp, Mus musculus
tatcatgacggcattgtactgtgga

SEQ ID NO: 785485 - DNA, 25 bp, Mus musculus
tatcatgacggctttgtactgtgga

SEQ ID NO: 785486 - DNA, 25 bp, Mus musculus
tatcatgagccaagcttgtgctgag

SEQ ID NO: 785487 - DNA, 25 bp, Mus musculus
tatcatgagccatgcttgtgctgag

SEQ ID NO: 785488 - DNA, 25 bp, Mus musculus
tatcatgagttgcttctttccatca

SEQ ID NO: 785489 - DNA, 25 bp, Mus musculus
tatcatgagttggttctttccatca

SEQ ID NO: 785490 - DNA, 25 bp, Mus musculus
tatcatgattatcgcttctgctctt

SEQ ID NO: 785491 - DNA, 25 bp, Mus musculus
tatcatgattatggcttctgctctt

SEQ ID NO: 785492 - DNA, 25 bp, Mus musculus
tatcatgattctatttatgaagcaa

SEQ ID NO: 785493 - DNA, 25 bp, Mus musculus
tatcatgattctttttatgaagcaa

SEQ ID NO: 785494 - DNA, 25 bp, Mus musculus
tatcatgcttctcttgtaggccagt

SEQ ID NO: 785495 - DNA, 25 bp, Mus musculus
tatcatgcttctgttgtaggccagt

SEQ ID NO: 785496 - DNA, 25 bp, Mus musculus
tatcatggagcactcagggcaccaa

SEQ ID NO: 785497 - DNA, 25 bp, Mus musculus
tatcatggagcagtcagggcaccaa

SEQ ID NO: 785498 - DNA, 25 bp, Mus musculus
tatcatggagccagttaccttcttc

SEQ ID NO: 785499 - DNA, 25 bp, Mus musculus
tatcatggagcctgttaccttcttc

SEQ ID NO: 785500 - DNA, 25 bp, Mus musculus
tatcatggaggcaatagcctggaaa

SEQ ID NO: 785501 - DNA, 25 bp, Mus musculus
tatcatggaggctatagcctggaaa

SEQ ID NO: 785502 - DNA, 25 bp, Mus musculus
tatcatggatctaacacgggctctg

SEQ ID NO: 785503 - DNA, 25 bp, Mus musculus
tatcatggatcttacacgggctctg

SEQ ID NO: 785504 - DNA, 25 bp, Mus musculus
tatcatggctccctatcgaatacaa

SEQ ID NO: 785505 - DNA, 25 bp, Mus musculus
tatcatggctccgtatcgaatacaa

SEQ ID NO: 785506 - DNA, 25 bp, Mus musculus
tatcatgggatcattctgcccatca

SEQ ID NO: 785507 - DNA, 25 bp, Mus musculus
tatcatgggatctttctgcccatca

SEQ ID NO: 785508 - DNA, 25 bp, Mus musculus
tatcatggtgagaagcatgctgcat

SEQ ID NO: 785509 - DNA, 25 bp, Mus musculus
tatcatggtgagtagcatgctgcat

SEQ ID NO: 785510 - DNA, 25 bp, Mus musculus
tatcatggtggcaaacgtccagact

SEQ ID NO: 785511 - DNA, 25 bp, Mus musculus
tatcatggtggctaacgtccagact

SEQ ID NO: 785512 - DNA, 25 bp, Mus musculus
tatcatgtacacactgagggcctat

SEQ ID NO: 785513 - DNA, 25 bp, Mus musculus
tatcatgtacacaggcacgcttgac

SEQ ID NO: 785514 - DNA, 25 bp, Mus musculus
tatcatgtacactctgagggcctat

SEQ ID NO: 785515 - DNA, 25 bp, Mus musculus
tatcatgtacactggcacgcttgac

SEQ ID NO: 785516 - DNA, 25 bp, Mus musculus
tatcatgtacatcttggaactggag

SEQ ID NO: 785517 - DNA, 25 bp, Mus musculus
tatcatgtacatgttggaactggag

SEQ ID NO: 785518 - DNA, 25 bp, Mus musculus
tatcatgtaccaccaacttgttgcg

SEQ ID NO: 785519 - DNA, 25 bp, Mus musculus
tatcatgtaccagcaacttgttgcg

SEQ ID NO: 785520 - DNA, 25 bp, Mus musculus
tatcatgtcatgagtccccacactg

SEQ ID NO: 785521 - DNA, 25 bp, Mus musculus
tatcatgtcatgtgtccccacactg

SEQ ID NO: 785522 - DNA, 25 bp, Mus musculus
tatcatgtccaaatccacttctggg

SEQ ID NO: 785523 - DNA, 25 bp, Mus musculus
tatcatgtccaattccacttctggg

SEQ ID NO: 785524 - DNA, 25 bp, Mus musculus
tatcatgtccatatcagcagtcctg

SEQ ID NO: 785525 - DNA, 25 bp, Mus musculus
tatcatgtccatttcagcagtcctg

SEQ ID NO: 785526 - DNA, 25 bp, Mus musculus
tatcatgtccgcagacacactggag

SEQ ID NO: 785527 - DNA, 25 bp, Mus musculus
tatcatgtccgctgacacactggag

SEQ ID NO: 785528 - DNA, 25 bp, Mus musculus
tatcatgtgacacggctattcagtt

SEQ ID NO: 785529 - DNA, 25 bp, Mus musculus
tatcatgtgacagggctattcagtt

SEQ ID NO: 785530 - DNA, 25 bp, Mus musculus
tatcatgtgagtcgttggtcggatc

SEQ ID NO: 785531 - DNA, 25 bp, Mus musculus
tatcatgtgagtggttggtcggatc

SEQ ID NO: 785532 - DNA, 25 bp, Mus musculus
tatcatgtgctgattaatcttgtgc

SEQ ID NO: 785533 - DNA, 25 bp, Mus musculus
tatcatgtgctgtttaatcttgtgc

SEQ ID NO: 785534 - DNA, 25 bp, Mus musculus
tatcatgttctgatacgcatctctc

SEQ ID NO: 785535 - DNA, 25 bp, Mus musculus
tatcatgttctgttacgcatctctc

SEQ ID NO: 785536 - DNA, 25 bp, Mus musculus
tatcatgtttacagccagtgcaccg

SEQ ID NO: 785537 - DNA, 25 bp, Mus musculus
tatcatgtttactgccagtgcaccg

SEQ ID NO: 785538 - DNA, 25 bp, Mus musculus
tatcattaaactacgttagcgaggg

SEQ ID NO: 785539 - DNA, 25 bp, Mus musculus
tatcattaaacttcgttagcgaggg

SEQ ID NO: 785540 - DNA, 25 bp, Mus musculus
tatcattatcacacctgtaacaaac

SEQ ID NO: 785541 - DNA, 25 bp, Mus musculus
tatcattatcactcctgtaacaaac

SEQ ID NO: 785542 - DNA, 25 bp, Mus musculus
tatcattatgctactttctgctgac

SEQ ID NO: 785543 - DNA, 25 bp, Mus musculus
tatcattatgcttctttctgctgac

SEQ ID NO: 785544 - DNA, 25 bp, Mus musculus
tatcattcaaagcactggccggtta

SEQ ID NO: 785545 - DNA, 25 bp, Mus musculus
tatcattcaaagctgaactgtctct

SEQ ID NO: 785546 - DNA, 25 bp, Mus musculus
tatcattcaaaggactggccggtta

SEQ ID NO: 785547 - DNA, 25 bp, Mus musculus
tatcattcaaaggtgaactgtctct

SEQ ID NO: 785548 - DNA, 25 bp, Mus musculus
tatcattcagtcagttacccatctc

SEQ ID NO: 785549 - DNA, 25 bp, Mus musculus
tatcattcagtctgttacccatctc

SEQ ID NO: 785550 - DNA, 25 bp, Mus musculus
tatcattcatgcagagggtgggcca

SEQ ID NO: 785551 - DNA, 25 bp, Mus musculus
tatcattcatgctgagggtgggcca

SEQ ID NO: 785552 - DNA, 25 bp, Mus musculus
tatcattccaagacagctcccaaag

SEQ ID NO: 785553 - DNA, 25 bp, Mus musculus
tatcattccaagtcagctcccaaag

SEQ ID NO: 785554 - DNA, 25 bp, Mus musculus
tatcattccctgattcagatcagga

SEQ ID NO: 785555 - DNA, 25 bp, Mus musculus
tatcattccctgtttcagatcagga

SEQ ID NO: 785556 - DNA, 25 bp, Mus musculus
tatcattcgtggcactcccacgtaa

SEQ ID NO: 785557 - DNA, 25 bp, Mus musculus
tatcattcgtgggactcccacgtaa

SEQ ID NO: 785558 - DNA, 25 bp, Mus musculus
tatcattctgcgacaacggatacgg

SEQ ID NO: 785559 - DNA, 25 bp, Mus musculus
tatcattctgcgtcaacggatacgg

SEQ ID NO: 785560 - DNA, 25 bp, Mus musculus
tatcattgacttagtggccattctc

SEQ ID NO: 785561 - DNA, 25 bp, Mus musculus
tatcattgactttgtggccattctc

SEQ ID NO: 785562 - DNA, 25 bp, Mus musculus
tatcattggttgcattggagcgtga

SEQ ID NO: 785563 - DNA, 25 bp, Mus musculus
tatcattggttggattggagcgtga

SEQ ID NO: 785564 - DNA, 25 bp, Mus musculus
tatcattgtctgaagcacgctgcta

SEQ ID NO: 785565 - DNA, 25 bp, Mus musculus
tatcattgtctgtagcacgctgcta

SEQ ID NO: 785566 - DNA, 25 bp, Mus musculus
tatcatttattcatccttgtggcac

SEQ ID NO: 785567 - DNA, 25 bp, Mus musculus
tatcatttattcttccttgtggcac

SEQ ID NO: 785568 - DNA, 25 bp, Mus musculus
tatcatttccacatcactgctaggt

SEQ ID NO: 785569 - DNA, 25 bp, Mus musculus
tatcatttccacttcactgctaggt

SEQ ID NO: 785570 - DNA, 25 bp, Mus musculus
tatcatttccggagagacccgggat

SEQ ID NO: 785571 - DNA, 25 bp, Mus musculus
tatcatttccggtgagacccgggat

SEQ ID NO: 785572 - DNA, 25 bp, Mus musculus
tatcatttgcctcattggctgacag

SEQ ID NO: 785573 - DNA, 25 bp, Mus musculus
tatcatttgcctgattggctgacag

SEQ ID NO: 785574 - DNA, 25 bp, Mus musculus
tatcatttgctacgcttgtataagg

SEQ ID NO: 785575 - DNA, 25 bp, Mus musculus
tatcatttgctaggcttgtataagg

SEQ ID NO: 785576 - DNA, 25 bp, Mus musculus
tatcatttgtttccatccagtgtgc

SEQ ID NO: 785577 - DNA, 25 bp, Mus musculus
tatcatttgtttgcatccagtgtgc

SEQ ID NO: 785578 - DNA, 25 bp, Mus musculus
tatcattttaaacagtgccactgtg

SEQ ID NO: 785579 - DNA, 25 bp, Mus musculus
tatcattttaaagagtgccactgtg

SEQ ID NO: 785580 - DNA, 25 bp, Mus musculus
tatcattttgtcattaatgacccag

SEQ ID NO: 785581 - DNA, 25 bp, Mus musculus
tatcattttgtctttaatgacccag

SEQ ID NO: 785582 - DNA, 25 bp, Mus musculus
tatccaaacaatatgctaccgtgtt

SEQ ID NO: 785583 - DNA, 25 bp, Mus musculus
tatccaaacaatccattcaaacctg

SEQ ID NO: 785584 - DNA, 25 bp, Mus musculus
tatccaaacaatgcattcaaacctg

SEQ ID NO: 785585 - DNA, 25 bp, Mus musculus
tatccaaacaatttgctaccgtgtt

SEQ ID NO: 785586 - DNA, 25 bp, Mus musculus
tatccaaagcagccaaacccaattc

SEQ ID NO: 785587 - DNA, 25 bp, Mus musculus
tatccaaagcaggcaaacccaattc

SEQ ID NO: 785588 - DNA, 25 bp, Mus musculus
tatccaaaggtaccaaattctgcag

SEQ ID NO: 785589 - DNA, 25 bp, Mus musculus
tatccaaaggtagcaaattctgcag

SEQ ID NO: 785590 - DNA, 25 bp, Mus musculus
tatccaaatgcaaccatatttcatt

SEQ ID NO: 785591 - DNA, 25 bp, Mus musculus
tatccaaatgcatccatatttcatt

SEQ ID NO: 785592 - DNA, 25 bp, Mus musculus
tatccaaatgctagccctagggcta

SEQ ID NO: 785593 - DNA, 25 bp, Mus musculus
tatccaaatgcttgccctagggcta

SEQ ID NO: 785594 - DNA, 25 bp, Mus musculus
tatccaaattacattccctcttagg

SEQ ID NO: 785595 - DNA, 25 bp, Mus musculus
tatccaaattactttccctcttagg

SEQ ID NO: 785596 - DNA, 25 bp, Mus musculus
tatccaacaagcagctatcatccct

SEQ ID NO: 785597 - DNA, 25 bp, Mus musculus
tatccaacaagctgctatcatccct

SEQ ID NO: 785598 - DNA, 25 bp, Mus musculus
tatccaacaatgatcagaagcccag

SEQ ID NO: 785599 - DNA, 25 bp, Mus musculus
tatccaacaatgttcagaagcccag

SEQ ID NO: 785600 - DNA, 25 bp, Mus musculus
tatccaaccaaaacaatagacgaat

SEQ ID NO: 785601 - DNA, 25 bp, Mus musculus
tatccaaccaaatcaatagacgaat

SEQ ID NO: 785602 - DNA, 25 bp, Mus musculus
tatccaaccagcaacttaacaatat

SEQ ID NO: 785603 - DNA, 25 bp, Mus musculus
tatccaaccagctacttaacaatat

SEQ ID NO: 785604 - DNA, 25 bp, Mus musculus
tatccaacccccagactatcaggaa

SEQ ID NO: 785605 - DNA, 25 bp, Mus musculus
tatccaaccccctgactatcaggaa

SEQ ID NO: 785606 - DNA, 25 bp, Mus musculus
tatccaacgtgccaattcttatctt

SEQ ID NO: 785607 - DNA, 25 bp, Mus musculus
tatccaacgtgcgaattcttatctt

SEQ ID NO: 785608 - DNA, 25 bp, Mus musculus
tatccaactcataaagttccaacgg

SEQ ID NO: 785609 - DNA, 25 bp, Mus musculus
tatccaactcattaagttccaacgg

SEQ ID NO: 785610 - DNA, 25 bp, Mus musculus
tatccaagaaaccttttgagtcttt

SEQ ID NO: 785611 - DNA, 25 bp, Mus musculus
tatccaagaaacgttttgagtcttt

SEQ ID NO: 785612 - DNA, 25 bp, Mus musculus
tatccaagaaataagctccagcatc

SEQ ID NO: 785613 - DNA, 25 bp, Mus musculus
tatccaagaaattagctccagcatc

SEQ ID NO: 785614 - DNA, 25 bp, Mus musculus
tatccaagcagtataatttttcctt

SEQ ID NO: 785615 - DNA, 25 bp, Mus musculus
tatccaagcagtttaatttttcctt

SEQ ID NO: 785616 - DNA, 25 bp, Mus musculus
tatccaagctatatctaggcagact

SEQ ID NO: 785617 - DNA, 25 bp, Mus musculus
tatccaagctatttctaggcagact

SEQ ID NO: 785618 - DNA, 25 bp, Mus musculus
tatccaaggtgcagaatcttggagg

SEQ ID NO: 785619 - DNA, 25 bp, Mus musculus
tatccaaggtgctgaatcttggagg

SEQ ID NO: 785620 - DNA, 25 bp, Mus musculus
tatccaatgcagattggctttttaa

SEQ ID NO: 785621 - DNA, 25 bp, Mus musculus
tatccaatgcagtttggctttttaa

SEQ ID NO: 785622 - DNA, 25 bp, Mus musculus
tatccaatgtagagggcaaaattcc

SEQ ID NO: 785623 - DNA, 25 bp, Mus musculus
tatccaatgtagtgggcaaaattcc

SEQ ID NO: 785624 - DNA, 25 bp, Mus musculus
tatccaatttccaccccttaatggg

SEQ ID NO: 785625 - DNA, 25 bp, Mus musculus
tatccaatttcctccccttaatggg

SEQ ID NO: 785626 - DNA, 25 bp, Mus musculus
tatccaattttacctcttcctgagt

SEQ ID NO: 785627 - DNA, 25 bp, Mus musculus
tatccaattttagctcttcctgagt

SEQ ID NO: 785628 - DNA, 25 bp, Mus musculus
tatccacaccctatatcccacacag

SEQ ID NO: 785629 - DNA, 25 bp, Mus musculus
tatccacaccctttatcccacacag

SEQ ID NO: 785630 - DNA, 25 bp, Mus musculus
tatccacacctaatgctgaagccat

SEQ ID NO: 785631 - DNA, 25 bp, Mus musculus
tatccacacctattgctgaagccat

SEQ ID NO: 785632 - DNA, 25 bp, Mus musculus
tatccacagattagggttgctgtca

SEQ ID NO: 785633 - DNA, 25 bp, Mus musculus
tatccacagatttgggttgctgtca

SEQ ID NO: 785634 - DNA, 25 bp, Mus musculus
tatccacagggaagactctcttcta

SEQ ID NO: 785635 - DNA, 25 bp, Mus musculus
tatccacagggatgactctcttcta

SEQ ID NO: 785636 - DNA, 25 bp, Mus musculus
tatccacaggtgctgcggccatgat

SEQ ID NO: 785637 - DNA, 25 bp, Mus musculus
tatccacaggtggtgcggccatgat

SEQ ID NO: 785638 - DNA, 25 bp, Mus musculus
tatccacagtcgatcaaacatcatg

SEQ ID NO: 785639 - DNA, 25 bp, Mus musculus
tatccacagtcgttcaaacatcatg

SEQ ID NO: 785640 - DNA, 25 bp, Mus musculus
tatccacagttcctaacatccgtga

SEQ ID NO: 785641 - DNA, 25 bp, Mus musculus
tatccacagttcgtaacatccgtga

SEQ ID NO: 785642 - DNA, 25 bp, Mus musculus
tatccacataaaaccaccctttgaa

SEQ ID NO: 785643 - DNA, 25 bp, Mus musculus
tatccacataaatccaccctttgaa

SEQ ID NO: 785644 - DNA, 25 bp, Mus musculus
tatccacatctgaccacaggctgga

SEQ ID NO: 785645 - DNA, 25 bp, Mus musculus
tatccacatctgtccacaggctgga

SEQ ID NO: 785646 - DNA, 25 bp, Mus musculus
tatccacattacctagagcaaggtg

SEQ ID NO: 785647 - DNA, 25 bp, Mus musculus
tatccacattacgtagagcaaggtg

SEQ ID NO: 785648 - DNA, 25 bp, Mus musculus
tatccacattgtatcaggctgctta

SEQ ID NO: 785649 - DNA, 25 bp, Mus musculus
tatccacattgtttcaggctgctta

SEQ ID NO: 785650 - DNA, 25 bp, Mus musculus
tatccaccaagtcctgcagacctga

SEQ ID NO: 785651 - DNA, 25 bp, Mus musculus
tatccaccaagtgctgcagacctga

SEQ ID NO: 785652 - DNA, 25 bp, Mus musculus
tatccacccgtcaggcaagttggct

SEQ ID NO: 785653 - DNA, 25 bp, Mus musculus
tatccacccgtctggcaagttggct

SEQ ID NO: 785654 - DNA, 25 bp, Mus musculus
tatccaccgctacttttaattcctt

SEQ ID NO: 785655 - DNA, 25 bp, Mus musculus
tatccaccgctagttttaattcctt

SEQ ID NO: 785656 - DNA, 25 bp, Mus musculus
tatccaccggctctaatcgatgcat

SEQ ID NO: 785657 - DNA, 25 bp, Mus musculus
tatccaccggctgtaatcgatgcat

SEQ ID NO: 785658 - DNA, 25 bp, Mus musculus
tatccaccggtgcatgaaattcaat

SEQ ID NO: 785659 - DNA, 25 bp, Mus musculus
tatccaccggtggatgaaattcaat

SEQ ID NO: 785660 - DNA, 25 bp, Mus musculus
tatccacctatacaaagtcaccttg

SEQ ID NO: 785661 - DNA, 25 bp, Mus musculus
tatccacctatagaaagtcaccttg

SEQ ID NO: 785662 - DNA, 25 bp, Mus musculus
tatccacctcaaagatgttgctgct

SEQ ID NO: 785663 - DNA, 25 bp, Mus musculus
tatccacctcaatgatgttgctgct

SEQ ID NO: 785664 - DNA, 25 bp, Mus musculus
tatccacctcttataacctttggtg

SEQ ID NO: 785665 - DNA, 25 bp, Mus musculus
tatccacctcttttaacctttggtg

SEQ ID NO: 785666 - DNA, 25 bp, Mus musculus
tatccacctgtccatattacttaac

SEQ ID NO: 785667 - DNA, 25 bp, Mus musculus
tatccacctgtcgatattacttaac

SEQ ID NO: 785668 - DNA, 25 bp, Mus musculus
tatccacgagatccaattccagagt

SEQ ID NO: 785669 - DNA, 25 bp, Mus musculus
tatccacgagatgcaattccagagt

SEQ ID NO: 785670 - DNA, 25 bp, Mus musculus
tatccacgccacctgattgaagagc

SEQ ID NO: 785671 - DNA, 25 bp, Mus musculus
tatccacgccacgtgattgaagagc

SEQ ID NO: 785672 - DNA, 25 bp, Mus musculus
tatccactaagacatctctccaagg

SEQ ID NO: 785673 - DNA, 25 bp, Mus musculus
tatccactaagagatctctccaagg

SEQ ID NO: 785674 - DNA, 25 bp, Mus musculus
tatccactgaaccaactcactagtt

SEQ ID NO: 785675 - DNA, 25 bp, Mus musculus
tatccactgaacgaactcactagtt

SEQ ID NO: 785676 - DNA, 25 bp, Mus musculus
tatccactgagcctaaatctgtttg

SEQ ID NO: 785677 - DNA, 25 bp, Mus musculus
tatccactgagcgtaaatctgtttg

SEQ ID NO: 785678 - DNA, 25 bp, Mus musculus
tatccacttagacagcagctgcact

SEQ ID NO: 785679 - DNA, 25 bp, Mus musculus
tatccacttagagagcagctgcact

SEQ ID NO: 785680 - DNA, 25 bp, Mus musculus
tatccacttcccataaccgaagtgt

SEQ ID NO: 785681 - DNA, 25 bp, Mus musculus
tatccacttcccttaaccgaagtgt

SEQ ID NO: 785682 - DNA, 25 bp, Mus musculus
tatccacttgggaggctctgctgct

SEQ ID NO: 785683 - DNA, 25 bp, Mus musculus
tatccacttgggtggctctgctgct

SEQ ID NO: 785684 - DNA, 25 bp, Mus musculus
tatccagaagatccagcagtttaca

SEQ ID NO: 785685 - DNA, 25 bp, Mus musculus
tatccagaagatgcagcagtttaca

SEQ ID NO: 785686 - DNA, 25 bp, Mus musculus
tatccagacggactttgcttcagac

SEQ ID NO: 785687 - DNA, 25 bp, Mus musculus
tatccagacggagtttgcttcagac

SEQ ID NO: 785688 - DNA, 25 bp, Mus musculus
tatccagactggcttccaaagtatg

SEQ ID NO: 785689 - DNA, 25 bp, Mus musculus
tatccagactgggttccaaagtatg

SEQ ID NO: 785690 - DNA, 25 bp, Mus musculus
tatccagagagccagtgctcatttg

SEQ ID NO: 785691 - DNA, 25 bp, Mus musculus
tatccagagagcgagtgctcatttg

SEQ ID NO: 785692 - DNA, 25 bp, Mus musculus
tatccagaggctattgaatgcaact

SEQ ID NO: 785693 - DNA, 25 bp, Mus musculus
tatccagaggcttttgaatgcaact

SEQ ID NO: 785694 - DNA, 25 bp, Mus musculus
tatccagagggaacttacggtaacc

SEQ ID NO: 785695 - DNA, 25 bp, Mus musculus
tatccagagggatcttacggtaacc

SEQ ID NO: 785696 - DNA, 25 bp, Mus musculus
tatccagaggtgatgcagccagttt

SEQ ID NO: 785697 - DNA, 25 bp, Mus musculus
tatccagaggtgttgcagccagttt

SEQ ID NO: 785698 - DNA, 25 bp, Mus musculus
tatccagagtttctacggtgttcta

SEQ ID NO: 785699 - DNA, 25 bp, Mus musculus
tatccagagtttgtacggtgttcta

SEQ ID NO: 785700 - DNA, 25 bp, Mus musculus
tatccagatctaataggctcaaagg

SEQ ID NO: 785701 - DNA, 25 bp, Mus musculus
tatccagatctattaggctcaaagg

SEQ ID NO: 785702 - DNA, 25 bp, Mus musculus
tatccagatgacataccctctgcaa

SEQ ID NO: 785703 - DNA, 25 bp, Mus musculus
tatccagatgacttaccctctgcaa

SEQ ID NO: 785704 - DNA, 25 bp, Mus musculus
tatccagcactcatattgtactgtg

SEQ ID NO: 785705 - DNA, 25 bp, Mus musculus
tatccagcactcttattgtactgtg

SEQ ID NO: 785706 - DNA, 25 bp, Mus musculus
tatccagcacttctagggtttgttt

SEQ ID NO: 785707 - DNA, 25 bp, Mus musculus
tatccagcacttgtagggtttgttt

SEQ ID NO: 785708 - DNA, 25 bp, Mus musculus
tatccagcaggacattcagagccag

SEQ ID NO: 785709 - DNA, 25 bp, Mus musculus
tatccagcaggagattcagagccag

SEQ ID NO: 785710 - DNA, 25 bp, Mus musculus
tatccagccaaaaacttttttcctt

SEQ ID NO: 785711 - DNA, 25 bp, Mus musculus
tatccagccaaatacttttttcctt

SEQ ID NO: 785712 - DNA, 25 bp, Mus musculus
tatccagcccaacatgtacggccga

SEQ ID NO: 785713 - DNA, 25 bp, Mus musculus
tatccagcccaagatgtacggccga

SEQ ID NO: 785714 - DNA, 25 bp, Mus musculus
tatccagcccacattgtaagaaccc

SEQ ID NO: 785715 - DNA, 25 bp, Mus musculus
tatccagcccactttgtaagaaccc

SEQ ID NO: 785716 - DNA, 25 bp, Mus musculus
tatccagcccatagattgattgatt

SEQ ID NO: 785717 - DNA, 25 bp, Mus musculus
tatccagcccattgattgattgatt

SEQ ID NO: 785718 - DNA, 25 bp, Mus musculus
tatccagcctatccagtgggtgagc

SEQ ID NO: 785719 - DNA, 25 bp, Mus musculus
tatccagcctatgcagtgggtgagc

SEQ ID NO: 785720 - DNA, 25 bp, Mus musculus
tatccagcctcactacagaaacttg

SEQ ID NO: 785721 - DNA, 25 bp, Mus musculus
tatccagcctcagtacagaaacttg

SEQ ID NO: 785722 - DNA, 25 bp, Mus musculus
tatccagccttcacgatgtgtagat

SEQ ID NO: 785723 - DNA, 25 bp, Mus musculus
tatccagccttctcgatgtgtagat

SEQ ID NO: 785724 - DNA, 25 bp, Mus musculus
tatccagcggacaagccctgctcgg

SEQ ID NO: 785725 - DNA, 25 bp, Mus musculus
tatccagcggactagccctgctcgg

SEQ ID NO: 785726 - DNA, 25 bp, Mus musculus
tatccagcgggacttggccagagat

SEQ ID NO: 785727 - DNA, 25 bp, Mus musculus
tatccagcgggagttggccagagat

SEQ ID NO: 785728 - DNA, 25 bp, Mus musculus
tatccagctaaacagtacatatcca

SEQ ID NO: 785729 - DNA, 25 bp, Mus musculus
tatccagctaaagagtacatatcca

SEQ ID NO: 785730 - DNA, 25 bp, Mus musculus
tatccagctggaacatcatgagcga

SEQ ID NO: 785731 - DNA, 25 bp, Mus musculus
tatccagctggatcatcatgagcga

SEQ ID NO: 785732 - DNA, 25 bp, Mus musculus
tatccagctgtgcatccactggact

SEQ ID NO: 785733 - DNA, 25 bp, Mus musculus
tatccagctgtggatccactggact

SEQ ID NO: 785734 - DNA, 25 bp, Mus musculus
tatccagctttcaactaacgagtct

SEQ ID NO: 785735 - DNA, 25 bp, Mus musculus
tatccagctttctactaacgagtct

SEQ ID NO: 785736 - DNA, 25 bp, Mus musculus
tatccagcttttccttgtagtgtga

SEQ ID NO: 785737 - DNA, 25 bp, Mus musculus
tatccagcttttgcttgtagtgtga

SEQ ID NO: 785738 - DNA, 25 bp, Mus musculus
tatccaggaggcaaacttcccaggt

SEQ ID NO: 785739 - DNA, 25 bp, Mus musculus
tatccaggaggctaacttcccaggt

SEQ ID NO: 785740 - DNA, 25 bp, Mus musculus
tatccaggcccaacttccagtgaag

SEQ ID NO: 785741 - DNA, 25 bp, Mus musculus
tatccaggcccatcttccagtgaag

SEQ ID NO: 785742 - DNA, 25 bp, Mus musculus
tatccaggccttcggaaattacagg

SEQ ID NO: 785743 - DNA, 25 bp, Mus musculus
tatccaggccttgggaaattacagg

SEQ ID NO: 785744 - DNA, 25 bp, Mus musculus
tatccagggttaatcccggtgggag

SEQ ID NO: 785745 - DNA, 25 bp, Mus musculus
tatccagggttattcccggtgggag

SEQ ID NO: 785746 - DNA, 25 bp, Mus musculus
tatccaggtggacaacattgttgcc

SEQ ID NO: 785747 - DNA, 25 bp, Mus musculus
tatccaggtggagaacattgttgcc

SEQ ID NO: 785748 - DNA, 25 bp, Mus musculus
tatccaggttgactgttgggcagaa

SEQ ID NO: 785749 - DNA, 25 bp, Mus musculus
tatccaggttgagtgttgggcagaa

SEQ ID NO: 785750 - DNA, 25 bp, Mus musculus
tatccagtaactcgcacttactagg

SEQ ID NO: 785751 - DNA, 25 bp, Mus musculus
tatccagtaactggcacttactagg

SEQ ID NO: 785752 - DNA, 25 bp, Mus musculus
tatccagtaatcataattcttctca

SEQ ID NO: 785753 - DNA, 25 bp, Mus musculus
tatccagtaatcttaattcttctca

SEQ ID NO: 785754 - DNA, 25 bp, Mus musculus
tatccagtccagacgcatggtggaa

SEQ ID NO: 785755 - DNA, 25 bp, Mus musculus
tatccagtccagtcgcatggtggaa

SEQ ID NO: 785756 - DNA, 25 bp, Mus musculus
tatccagtctggctgcaacggtgac

SEQ ID NO: 785757 - DNA, 25 bp, Mus musculus
tatccagtctgggtgcaacggtgac

SEQ ID NO: 785758 - DNA, 25 bp, Mus musculus
tatccagtcttactccacgttttaa

SEQ ID NO: 785759 - DNA, 25 bp, Mus musculus
tatccagtcttagtccacgttttaa

SEQ ID NO: 785760 - DNA, 25 bp, Mus musculus
tatccagtgaggagtgtggcagaac

SEQ ID NO: 785761 - DNA, 25 bp, Mus musculus
tatccagtgaggtgtgtggcagaac

SEQ ID NO: 785762 - DNA, 25 bp, Mus musculus
tatccagtggaactagtattgtgct

SEQ ID NO: 785763 - DNA, 25 bp, Mus musculus
tatccagtggaagtagtattgtgct

SEQ ID NO: 785764 - DNA, 25 bp, Mus musculus
tatccagtggccatgcatgggatca

SEQ ID NO: 785765 - DNA, 25 bp, Mus musculus
tatccagtggccttgcatgggatca

SEQ ID NO: 785766 - DNA, 25 bp, Mus musculus
tatccagtgtatcatccaccaagca

SEQ ID NO: 785767 - DNA, 25 bp, Mus musculus
tatccagtgtatgatccaccaagca

SEQ ID NO: 785768 - DNA, 25 bp, Mus musculus
tatccagttatacccttttcagtgt

SEQ ID NO: 785769 - DNA, 25 bp, Mus musculus
tatccagttatagccttttcagtgt

SEQ ID NO: 785770 - DNA, 25 bp, Mus musculus
tatccagttctaaacatccagagct

SEQ ID NO: 785771 - DNA, 25 bp, Mus musculus
tatccagttctatacatccagagct

SEQ ID NO: 785772 - DNA, 25 bp, Mus musculus
tatccagttctgctggctctaagtg

SEQ ID NO: 785773 - DNA, 25 bp, Mus musculus
tatccagttctggtggctctaagtg

SEQ ID NO: 785774 - DNA, 25 bp, Mus musculus
tatccagttgtaccataaggtgtca

SEQ ID NO: 785775 - DNA, 25 bp, Mus musculus
tatccagttgtagcataaggtgtca

SEQ ID NO: 785776 - DNA, 25 bp, Mus musculus
tatccagttttaaacacagttcttg

SEQ ID NO: 785777 - DNA, 25 bp, Mus musculus
tatccagttttatacacagttcttg

SEQ ID NO: 785778 - DNA, 25 bp, Mus musculus
tatccataactaacttaaatcccag

SEQ ID NO: 785779 - DNA, 25 bp, Mus musculus
tatccataactatcttaaatcccag

SEQ ID NO: 785780 - DNA, 25 bp, Mus musculus
tatccataactcaagctccatggcg

SEQ ID NO: 785781 - DNA, 25 bp, Mus musculus
tatccataactctagctccatggcg

SEQ ID NO: 785782 - DNA, 25 bp, Mus musculus
tatccatacagcatccccagtataa

SEQ ID NO: 785783 - DNA, 25 bp, Mus musculus
tatccatacagcttccccagtataa

SEQ ID NO: 785784 - DNA, 25 bp, Mus musculus
tatccataccaccattttccttaaa

SEQ ID NO: 785785 - DNA, 25 bp, Mus musculus
tatccataccacgattttccttaaa

SEQ ID NO: 785786 - DNA, 25 bp, Mus musculus
tatccatactgtattggccttttcc

SEQ ID NO: 785787 - DNA, 25 bp, Mus musculus
tatccatactgttttggccttttcc

SEQ ID NO: 785788 - DNA, 25 bp, Mus musculus
tatccatatcgcacttttctgtaag

SEQ ID NO: 785789 - DNA, 25 bp, Mus musculus
tatccatatcgctcttttctgtaag

SEQ ID NO: 785790 - DNA, 25 bp, Mus musculus
tatccatatctgcagtgtgtaccaa

SEQ ID NO: 785791 - DNA, 25 bp, Mus musculus
tatccatatctggagtgtgtaccaa

SEQ ID NO: 785792 - DNA, 25 bp, Mus musculus
tatccatatgccctcaattgactgt

SEQ ID NO: 785793 - DNA, 25 bp, Mus musculus
tatccatatgccgtcaattgactgt

SEQ ID NO: 785794 - DNA, 25 bp, Mus musculus
tatccatatgctacactctccctat

SEQ ID NO: 785795 - DNA, 25 bp, Mus musculus
tatccatatgcttcactctccctat

SEQ ID NO: 785796 - DNA, 25 bp, Mus musculus
tatccatcaaatatccatctaggcg

SEQ ID NO: 785797 - DNA, 25 bp, Mus musculus
tatccatcaaatttccatctaggcg

SEQ ID NO: 785798 - DNA, 25 bp, Mus musculus
tatccatcactccaaatccttttaa

SEQ ID NO: 785799 - DNA, 25 bp, Mus musculus
tatccatcactcgaaatccttttaa

SEQ ID NO: 785800 - DNA, 25 bp, Mus musculus
tatccatccattaatccagtattga

SEQ ID NO: 785801 - DNA, 25 bp, Mus musculus
tatccatccatttatccagtattga

SEQ ID NO: 785802 - DNA, 25 bp, Mus musculus
tatccatcccagagtctacagaaac

SEQ ID NO: 785803 - DNA, 25 bp, Mus musculus
tatccatcccagtgtctacagaaac

SEQ ID NO: 785804 - DNA, 25 bp, Mus musculus
tatccatcctaaattgtctgctcat

SEQ ID NO: 785805 - DNA, 25 bp, Mus musculus
tatccatcctaatttgtctgctcat

SEQ ID NO: 785806 - DNA, 25 bp, Mus musculus
tatccatcctttcccatttactgaa

SEQ ID NO: 785807 - DNA, 25 bp, Mus musculus
tatccatcctttgccatttactgaa

SEQ ID NO: 785808 - DNA, 25 bp, Mus musculus
tatccatcgtggaatgccccaggag

SEQ ID NO: 785809 - DNA, 25 bp, Mus musculus
tatccatcgtggtatgccccaggag

SEQ ID NO: 785810 - DNA, 25 bp, Mus musculus
tatccatctatgagttcagtaaacc

SEQ ID NO: 785811 - DNA, 25 bp, Mus musculus
tatccatctatgtgttcagtaaacc

SEQ ID NO: 785812 - DNA, 25 bp, Mus musculus
tatccatctcccaatctgtaaacag

SEQ ID NO: 785813 - DNA, 25 bp, Mus musculus
tatccatctccctatctgtaaacag

SEQ ID NO: 785814 - DNA, 25 bp, Mus musculus
tatccatctctacctttattttttg

SEQ ID NO: 785815 - DNA, 25 bp, Mus musculus
tatccatctctagctttattttttg

SEQ ID NO: 785816 - DNA, 25 bp, Mus musculus
tatccatctctgcagtctgatgatg

SEQ ID NO: 785817 - DNA, 25 bp, Mus musculus
tatccatctctggagtctgatgatg

SEQ ID NO: 785818 - DNA, 25 bp, Mus musculus
tatccatctgccaccaatgggtctc

SEQ ID NO: 785819 - DNA, 25 bp, Mus musculus
tatccatctgcctccaatgggtctc

SEQ ID NO: 785820 - DNA, 25 bp, Mus musculus
tatccatcttctcttatcgtaaatc

SEQ ID NO: 785821 - DNA, 25 bp, Mus musculus
tatccatcttctgttatcgtaaatc

SEQ ID NO: 785822 - DNA, 25 bp, Mus musculus
tatccatgaagcagggcagtcccac

SEQ ID NO: 785823 - DNA, 25 bp, Mus musculus
tatccatgaagctgggcagtcccac

SEQ ID NO: 785824 - DNA, 25 bp, Mus musculus
tatccatgattgattacctcgtctg

SEQ ID NO: 785825 - DNA, 25 bp, Mus musculus
tatccatgattgtttacctcgtctg

SEQ ID NO: 785826 - DNA, 25 bp, Mus musculus
tatccatgcagcctttgggccccag

SEQ ID NO: 785827 - DNA, 25 bp, Mus musculus
tatccatgcagcgtttgggccccag

SEQ ID NO: 785828 - DNA, 25 bp, Mus musculus
tatccatgccacagtcatacacaat

SEQ ID NO: 785829 - DNA, 25 bp, Mus musculus
tatccatgccactgtcatacacaat

SEQ ID NO: 785830 - DNA, 25 bp, Mus musculus
tatccatggcaacaagagcaacatc

SEQ ID NO: 785831 - DNA, 25 bp, Mus musculus
tatccatggcaagaagagcaacatc

SEQ ID NO: 785832 - DNA, 25 bp, Mus musculus
tatccatgggccacctttgtagacc

SEQ ID NO: 785833 - DNA, 25 bp, Mus musculus
tatccatgggcctcctttgtagacc

SEQ ID NO: 785834 - DNA, 25 bp, Mus musculus
tatccatgtgctctggtcactttct

SEQ ID NO: 785835 - DNA, 25 bp, Mus musculus
tatccatgtgctgtggtcactttct

SEQ ID NO: 785836 - DNA, 25 bp, Mus musculus
tatccatgtggcagtgtatctgtat

SEQ ID NO: 785837 - DNA, 25 bp, Mus musculus
tatccatgtggctgtgtatctgtat

SEQ ID NO: 785838 - DNA, 25 bp, Mus musculus
tatccattagttattccagagttta

SEQ ID NO: 785839 - DNA, 25 bp, Mus musculus
tatccattagtttttccagagttta

SEQ ID NO: 785840 - DNA, 25 bp, Mus musculus
tatccattcataacttagctgtttg

SEQ ID NO: 785841 - DNA, 25 bp, Mus musculus
tatccattcatatcttagctgtttg

SEQ ID NO: 785842 - DNA, 25 bp, Mus musculus
tatccattctccctgagagcatagt

SEQ ID NO: 785843 - DNA, 25 bp, Mus musculus
tatccattctccgtgagagcatagt

SEQ ID NO: 785844 - DNA, 25 bp, Mus musculus
tatccattctggctaccacctttaa

SEQ ID NO: 785845 - DNA, 25 bp, Mus musculus
tatccattctgggtaccacctttaa

SEQ ID NO: 785846 - DNA, 25 bp, Mus musculus
tatccattgccccatgtcctctcct

SEQ ID NO: 785847 - DNA, 25 bp, Mus musculus
tatccattgcccgatgtcctctcct

SEQ ID NO: 785848 - DNA, 25 bp, Mus musculus
tatccattgggcacctcttcatttt

SEQ ID NO: 785849 - DNA, 25 bp, Mus musculus
tatccattgggctcctcttcatttt

SEQ ID NO: 785850 - DNA, 25 bp, Mus musculus
tatccatttacacattccactgaaa

SEQ ID NO: 785851 - DNA, 25 bp, Mus musculus
tatccatttacagattccactgaaa

SEQ ID NO: 785852 - DNA, 25 bp, Mus musculus
tatccatttcttatgtgtcctcata

SEQ ID NO: 785853 - DNA, 25 bp, Mus musculus
tatccatttcttttgtgtcctcata

SEQ ID NO: 785854 - DNA, 25 bp, Mus musculus
tatcccaaacataagcactagcttt

SEQ ID NO: 785855 - DNA, 25 bp, Mus musculus
tatcccaaacattagcactagcttt

SEQ ID NO: 785856 - DNA, 25 bp, Mus musculus
tatcccaaacctcttcctttgagtt

SEQ ID NO: 785857 - DNA, 25 bp, Mus musculus
tatcccaaacctgttcctttgagtt

SEQ ID NO: 785858 - DNA, 25 bp, Mus musculus
tatcccaaagggaaaggcctggcca

SEQ ID NO: 785859 - DNA, 25 bp, Mus musculus
tatcccaaagggtaaggcctggcca

SEQ ID NO: 785860 - DNA, 25 bp, Mus musculus
tatcccaaatacaggaggccgcctc

SEQ ID NO: 785861 - DNA, 25 bp, Mus musculus
tatcccaaatactggaggccgcctc

SEQ ID NO: 785862 - DNA, 25 bp, Mus musculus
tatcccaactttataggcaccggtg

SEQ ID NO: 785863 - DNA, 25 bp, Mus musculus
tatcccaactttttaggcaccggtg

SEQ ID NO: 785864 - DNA, 25 bp, Mus musculus
tatcccacacagatttccaggaaaa

SEQ ID NO: 785865 - DNA, 25 bp, Mus musculus
tatcccacacagttttccaggaaaa

SEQ ID NO: 785866 - DNA, 25 bp, Mus musculus
tatcccacacccacttcagagtgag

SEQ ID NO: 785867 - DNA, 25 bp, Mus musculus
tatcccacaccctcttcagagtgag

SEQ ID NO: 785868 - DNA, 25 bp, Mus musculus
tatcccacagggataaagagtcaca

SEQ ID NO: 785869 - DNA, 25 bp, Mus musculus
tatcccacagggttaaagagtcaca

SEQ ID NO: 785870 - DNA, 25 bp, Mus musculus
tatcccacatcaacatagctggctt

SEQ ID NO: 785871 - DNA, 25 bp, Mus musculus
tatcccacatcatcatagctggctt

SEQ ID NO: 785872 - DNA, 25 bp, Mus musculus
tatcccaccagcatcctctgatttt

SEQ ID NO: 785873 - DNA, 25 bp, Mus musculus
tatcccaccagcttcctctgatttt

SEQ ID NO: 785874 - DNA, 25 bp, Mus musculus
tatcccaccagtccctttggagaca

SEQ ID NO: 785875 - DNA, 25 bp, Mus musculus
tatcccaccagtgcctttggagaca

SEQ ID NO: 785876 - DNA, 25 bp, Mus musculus
tatcccacccaacaacgagaagctg

SEQ ID NO: 785877 - DNA, 25 bp, Mus musculus
tatcccacccaagaacgagaagctg

SEQ ID NO: 785878 - DNA, 25 bp, Mus musculus
tatcccacccttcagttcattttaa

SEQ ID NO: 785879 - DNA, 25 bp, Mus musculus
tatcccacccttgagttcattttaa

SEQ ID NO: 785880 - DNA, 25 bp, Mus musculus
tatcccactactcctccggaaattg

SEQ ID NO: 785881 - DNA, 25 bp, Mus musculus
tatcccactactgctccggaaattg

SEQ ID NO: 785882 - DNA, 25 bp, Mus musculus
tatcccactagtagaagaggtctct

SEQ ID NO: 785883 - DNA, 25 bp, Mus musculus
tatcccactagttgaagaggtctct

SEQ ID NO: 785884 - DNA, 25 bp, Mus musculus
tatcccagaaccactaattagccag

SEQ ID NO: 785885 - DNA, 25 bp, Mus musculus
tatcccagaacctctaattagccag

SEQ ID NO: 785886 - DNA, 25 bp, Mus musculus
tatcccagactaacttacttaacct

SEQ ID NO: 785887 - DNA, 25 bp, Mus musculus
tatcccagactatcttacttaacct

SEQ ID NO: 785888 - DNA, 25 bp, Mus musculus
tatcccagaggaagctgtttctttc

SEQ ID NO: 785889 - DNA, 25 bp, Mus musculus
tatcccagaggatgctgtttctttc

SEQ ID NO: 785890 - DNA, 25 bp, Mus musculus
tatcccagatctatggcgatcactg

SEQ ID NO: 785891 - DNA, 25 bp, Mus musculus
tatcccagatctttggcgatcactg

SEQ ID NO: 785892 - DNA, 25 bp, Mus musculus
tatcccagcaacaaagccgccaaga

SEQ ID NO: 785893 - DNA, 25 bp, Mus musculus
tatcccagcaactaagccgccaaga

SEQ ID NO: 785894 - DNA, 25 bp, Mus musculus
tatcccagccacagtaattaagtga

SEQ ID NO: 785895 - DNA, 25 bp, Mus musculus
tatcccagccactgtaattaagtga

SEQ ID NO: 785896 - DNA, 25 bp, Mus musculus
tatcccagggatccacgaacagaga

SEQ ID NO: 785897 - DNA, 25 bp, Mus musculus
tatcccagggatgcacgaacagaga

SEQ ID NO: 785898 - DNA, 25 bp, Mus musculus
tatcccagggtcaattttaatcctt

SEQ ID NO: 785899 - DNA, 25 bp, Mus musculus
tatcccagggtctattttaatcctt

SEQ ID NO: 785900 - DNA, 25 bp, Mus musculus
tatcccagtgtgcaaggctagctct

SEQ ID NO: 785901 - DNA, 25 bp, Mus musculus
tatcccagtgtggaaggctagctct

SEQ ID NO: 785902 - DNA, 25 bp, Mus musculus
tatcccagttcccttcactggtttt

SEQ ID NO: 785903 - DNA, 25 bp, Mus musculus
tatcccagttccgttcactggtttt

SEQ ID NO: 785904 - DNA, 25 bp, Mus musculus
tatcccatacccaccctagttgtgt

SEQ ID NO: 785905 - DNA, 25 bp, Mus musculus
tatcccataccctccctagttgtgt

SEQ ID NO: 785906 - DNA, 25 bp, Mus musculus
tatcccatatgtctatgatgaccaa

SEQ ID NO: 785907 - DNA, 25 bp, Mus musculus
tatcccatatgtgtatgatgaccaa

SEQ ID NO: 785908 - DNA, 25 bp, Mus musculus
tatcccatcgttctctatgacactt

SEQ ID NO: 785909 - DNA, 25 bp, Mus musculus
tatcccatcgttgtctatgacactt

SEQ ID NO: 785910 - DNA, 25 bp, Mus musculus
tatcccatctcacacatgcatgtga

SEQ ID NO: 785911 - DNA, 25 bp, Mus musculus
tatcccatctcagacatgcatgtga

SEQ ID NO: 785912 - DNA, 25 bp, Mus musculus
tatcccatgcagacggtacagtcaa

SEQ ID NO: 785913 - DNA, 25 bp, Mus musculus
tatcccatgcagtcggtacagtcaa

SEQ ID NO: 785914 - DNA, 25 bp, Mus musculus
tatcccatgggaatcagtggctgcc

SEQ ID NO: 785915 - DNA, 25 bp, Mus musculus
tatcccatgggattcagtggctgcc

SEQ ID NO: 785916 - DNA, 25 bp, Mus musculus
tatcccatgtccctgtggaggagct

SEQ ID NO: 785917 - DNA, 25 bp, Mus musculus
tatcccatgtccgtgtggaggagct

SEQ ID NO: 785918 - DNA, 25 bp, Mus musculus
tatcccattataagttcaacaaccg

SEQ ID NO: 785919 - DNA, 25 bp, Mus musculus
tatcccattatatgttcaacaaccg

SEQ ID NO: 785920 - DNA, 25 bp, Mus musculus
tatcccattcccaacagattatcag

SEQ ID NO: 785921 - DNA, 25 bp, Mus musculus
tatcccattccctacagattatcag

SEQ ID NO: 785922 - DNA, 25 bp, Mus musculus
tatcccattgaacctaggaaatcag

SEQ ID NO: 785923 - DNA, 25 bp, Mus musculus
tatcccattgaagctaggaaatcag

SEQ ID NO: 785924 - DNA, 25 bp, Mus musculus
tatccccaaaaccacagccaaaagt

SEQ ID NO: 785925 - DNA, 25 bp, Mus musculus
tatccccaaaacgacagccaaaagt

SEQ ID NO: 785926 - DNA, 25 bp, Mus musculus
tatccccaacaaagtgccaactcag

SEQ ID NO: 785927 - DNA, 25 bp, Mus musculus
tatccccaacaatgtgccaactcag

SEQ ID NO: 785928 - DNA, 25 bp, Mus musculus
tatccccacactaacacacaaaatt

SEQ ID NO: 785929 - DNA, 25 bp, Mus musculus
tatccccacacttacacacaaaatt

SEQ ID NO: 785930 - DNA, 25 bp, Mus musculus
tatccccacagcaagatcaacacta

SEQ ID NO: 785931 - DNA, 25 bp, Mus musculus
tatccccacagctagatcaacacta

SEQ ID NO: 785932 - DNA, 25 bp, Mus musculus
tatccccacctgctggagaaggcca

SEQ ID NO: 785933 - DNA, 25 bp, Mus musculus
tatccccacctggtggagaaggcca

SEQ ID NO: 785934 - DNA, 25 bp, Mus musculus
tatccccacgctccaaaaagtttat

SEQ ID NO: 785935 - DNA, 25 bp, Mus musculus
tatccccacgctgcaaaaagtttat

SEQ ID NO: 785936 - DNA, 25 bp, Mus musculus
tatccccactatcctcaagagggac

SEQ ID NO: 785937 - DNA, 25 bp, Mus musculus
tatccccactatgctcaagagggac

SEQ ID NO: 785938 - DNA, 25 bp, Mus musculus
tatccccactgcaccttaaagtatg

SEQ ID NO: 785939 - DNA, 25 bp, Mus musculus
tatccccactgctccttaaagtatg

SEQ ID NO: 785940 - DNA, 25 bp, Mus musculus
tatccccagggtccatgaggatcat

SEQ ID NO: 785941 - DNA, 25 bp, Mus musculus
tatccccagggtgcatgaggatcat

SEQ ID NO: 785942 - DNA, 25 bp, Mus musculus
tatccccaggtacctggtcagctgt

SEQ ID NO: 785943 - DNA, 25 bp, Mus musculus
tatccccaggtagctggtcagctgt

SEQ ID NO: 785944 - DNA, 25 bp, Mus musculus
tatccccatcaaccggtaccaggtg

SEQ ID NO: 785945 - DNA, 25 bp, Mus musculus
tatccccatcaagcggtaccaggtg

SEQ ID NO: 785946 - DNA, 25 bp, Mus musculus
tatccccatttcaacaatccgaagc

SEQ ID NO: 785947 - DNA, 25 bp, Mus musculus
tatccccatttctacaatccgaagc

SEQ ID NO: 785948 - DNA, 25 bp, Mus musculus
tatccccgagctagaagcaagaatt

SEQ ID NO: 785949 - DNA, 25 bp, Mus musculus
tatccccgagcttgaagcaagaatt

SEQ ID NO: 785950 - DNA, 25 bp, Mus musculus
tatccccgcactacattttctttgg

SEQ ID NO: 785951 - DNA, 25 bp, Mus musculus
tatccccgcacttcattttctttgg

SEQ ID NO: 785952 - DNA, 25 bp, Mus musculus
tatcccctaaatcgagtgctcacag

SEQ ID NO: 785953 - DNA, 25 bp, Mus musculus
tatcccctaaatggagtgctcacag

SEQ ID NO: 785954 - DNA, 25 bp, Mus musculus
tatcccctagggaaggcttggctta

SEQ ID NO: 785955 - DNA, 25 bp, Mus musculus
tatcccctagggtaggcttggctta

SEQ ID NO: 785956 - DNA, 25 bp, Mus musculus
tatcccctcaggatgcatatgtaga

SEQ ID NO: 785957 - DNA, 25 bp, Mus musculus
tatcccctcaggttgcatatgtaga

SEQ ID NO: 785958 - DNA, 25 bp, Mus musculus
tatcccctgactatacttacatatg

SEQ ID NO: 785959 - DNA, 25 bp, Mus musculus
tatcccctgactttacttacatatg

SEQ ID NO: 785960 - DNA, 25 bp, Mus musculus
tatcccctggaacagcctcaagcag

SEQ ID NO: 785961 - DNA, 25 bp, Mus musculus
tatcccctggaagagcctcaagcag

SEQ ID NO: 785962 - DNA, 25 bp, Mus musculus
tatcccctgggaagtttgtcagaag

SEQ ID NO: 785963 - DNA, 25 bp, Mus musculus
tatcccctgggatgtttgtcagaag

SEQ ID NO: 785964 - DNA, 25 bp, Mus musculus
tatcccgacttcacagatttccaag

SEQ ID NO: 785965 - DNA, 25 bp, Mus musculus
tatcccgacttctcagatttccaag

SEQ ID NO: 785966 - DNA, 25 bp, Mus musculus
tatcccgcatcaatttagcttcacg

SEQ ID NO: 785967 - DNA, 25 bp, Mus musculus
tatcccgcatcattttagcttcacg

SEQ ID NO: 785968 - DNA, 25 bp, Mus musculus
tatcccgccagcaatgtgacttttc

SEQ ID NO: 785969 - DNA, 25 bp, Mus musculus
tatcccgccagctatgtgacttttc

SEQ ID NO: 785970 - DNA, 25 bp, Mus musculus
tatcccgcgtctctttatctttttt

SEQ ID NO: 785971 - DNA, 25 bp, Mus musculus
tatcccgcgtctgtttatctttttt

SEQ ID NO: 785972 - DNA, 25 bp, Mus musculus
tatcccgctgggacagaccagtagt

SEQ ID NO: 785973 - DNA, 25 bp, Mus musculus
tatcccgctgggtcagaccagtagt

SEQ ID NO: 785974 - DNA, 25 bp, Mus musculus
tatcccggaggtactaatgccttgt

SEQ ID NO: 785975 - DNA, 25 bp, Mus musculus
tatcccggaggttctaatgccttgt

SEQ ID NO: 785976 - DNA, 25 bp, Mus musculus
tatcccgggaccagcaaaggactga

SEQ ID NO: 785977 - DNA, 25 bp, Mus musculus
tatcccgggacctgcaaaggactga

SEQ ID NO: 785978 - DNA, 25 bp, Mus musculus
tatcccgggagcctgattcctgaag

SEQ ID NO: 785979 - DNA, 25 bp, Mus musculus
tatcccgggagcgtgattcctgaag

SEQ ID NO: 785980 - DNA, 25 bp, Mus musculus
tatcccgggataacccaacactggg

SEQ ID NO: 785981 - DNA, 25 bp, Mus musculus
tatcccgggatatcccaacactggg

SEQ ID NO: 785982 - DNA, 25 bp, Mus musculus
tatcccgggcaaaatttccattctt

SEQ ID NO: 785983 - DNA, 25 bp, Mus musculus
tatcccgggcaatatttccattctt

SEQ ID NO: 785984 - DNA, 25 bp, Mus musculus
tatcccgtcaaacgattccgtttct

SEQ ID NO: 785985 - DNA, 25 bp, Mus musculus
tatcccgtcaaaggattccgtttct

SEQ ID NO: 785986 - DNA, 25 bp, Mus musculus
tatcccgtggatattacctctggaa

SEQ ID NO: 785987 - DNA, 25 bp, Mus musculus
tatcccgtggattttacctctggaa

SEQ ID NO: 785988 - DNA, 25 bp, Mus musculus
tatcccgtgttgatgctgagtgtgc

SEQ ID NO: 785989 - DNA, 25 bp, Mus musculus
tatcccgtgttgttgctgagtgtgc

SEQ ID NO: 785990 - DNA, 25 bp, Mus musculus
tatccctaaggtctttcttttcctg

SEQ ID NO: 785991 - DNA, 25 bp, Mus musculus
tatccctaaggtgtttcttttcctg

SEQ ID NO: 785992 - DNA, 25 bp, Mus musculus
tatccctaattccctgaatagtgcc

SEQ ID NO: 785993 - DNA, 25 bp, Mus musculus
tatccctaattcgctgaatagtgcc

SEQ ID NO: 785994 - DNA, 25 bp, Mus musculus
tatccctacatccatgctgcgtgtt

SEQ ID NO: 785995 - DNA, 25 bp, Mus musculus
tatccctacatcgatgctgcgtgtt

SEQ ID NO: 785996 - DNA, 25 bp, Mus musculus
tatccctaccagaattgcctttttt

SEQ ID NO: 785997 - DNA, 25 bp, Mus musculus
tatccctaccagtattgcctttttt

SEQ ID NO: 785998 - DNA, 25 bp, Mus musculus
tatccctagggtccatgagatttgt

SEQ ID NO: 785999 - DNA, 25 bp, Mus musculus
tatccctagggtgcatgagatttgt

SEQ ID NO: 786000 - DNA, 25 bp, Mus musculus
tatccctcaattattgggtccctag

SEQ ID NO: 786001 - DNA, 25 bp, Mus musculus
tatccctcaatttttgggtccctag

SEQ ID NO: 786002 - DNA, 25 bp, Mus musculus
tatccctcactaatcactgttggct

SEQ ID NO: 786003 - DNA, 25 bp, Mus musculus
tatccctcactattcactgttggct

SEQ ID NO: 786004 - DNA, 25 bp, Mus musculus
tatccctcaggaatcctctgaagtg

SEQ ID NO: 786005 - DNA, 25 bp, Mus musculus
tatccctcaggattcctctgaagtg

SEQ ID NO: 786006 - DNA, 25 bp, Mus musculus
tatccctcccagatcacaattaaga

SEQ ID NO: 786007 - DNA, 25 bp, Mus musculus
tatccctcccagttcacaattaaga

SEQ ID NO: 786008 - DNA, 25 bp, Mus musculus
tatccctcctatcggcaatgtgcaa

SEQ ID NO: 786009 - DNA, 25 bp, Mus musculus
tatccctcctatgggcaatgtgcaa

SEQ ID NO: 786010 - DNA, 25 bp, Mus musculus
tatccctccttcactttacttatgg

SEQ ID NO: 786011 - DNA, 25 bp, Mus musculus
tatccctccttctctttacttatgg

SEQ ID NO: 786012 - DNA, 25 bp, Mus musculus
tatccctcgtccaaacatcagaatc

SEQ ID NO: 786013 - DNA, 25 bp, Mus musculus
tatccctcgtcctaacatcagaatc

SEQ ID NO: 786014 - DNA, 25 bp, Mus musculus
tatccctctgccatacatgcgaaag

SEQ ID NO: 786015 - DNA, 25 bp, Mus musculus
tatccctctgccttacatgcgaaag

SEQ ID NO: 786016 - DNA, 25 bp, Mus musculus
tatccctctggacacttggacatgg

SEQ ID NO: 786017 - DNA, 25 bp, Mus musculus
tatccctctggagacttggacatgg

SEQ ID NO: 786018 - DNA, 25 bp, Mus musculus
tatccctgaaataaatgctgctagc

SEQ ID NO: 786019 - DNA, 25 bp, Mus musculus
tatccctgaaattaatgctgctagc

SEQ ID NO: 786020 - DNA, 25 bp, Mus musculus
tatccctgacccatatactgctata

SEQ ID NO: 786021 - DNA, 25 bp, Mus musculus
tatccctgacccttatactgctata

SEQ ID NO: 786022 - DNA, 25 bp, Mus musculus
tatccctgagagatctcccagagtt

SEQ ID NO: 786023 - DNA, 25 bp, Mus musculus
tatccctgagagttctcccagagtt

SEQ ID NO: 786024 - DNA, 25 bp, Mus musculus
tatccctgcagtcaacccaagaaag

SEQ ID NO: 786025 - DNA, 25 bp, Mus musculus
tatccctgcagtgaacccaagaaag

SEQ ID NO: 786026 - DNA, 25 bp, Mus musculus
tatccctgcatacctaagctgcatg

SEQ ID NO: 786027 - DNA, 25 bp, Mus musculus
tatccctgcatagctaagctgcatg

SEQ ID NO: 786028 - DNA, 25 bp, Mus musculus
tatccctggagacaatgcacattat

SEQ ID NO: 786029 - DNA, 25 bp, Mus musculus
tatccctggagagaatgcacattat

SEQ ID NO: 786030 - DNA, 25 bp, Mus musculus
tatccctggcacatagatgagtatg

SEQ ID NO: 786031 - DNA, 25 bp, Mus musculus
tatccctggcacttagatgagtatg

SEQ ID NO: 786032 - DNA, 25 bp, Mus musculus
tatccctgggcactcggtctagtga

SEQ ID NO: 786033 - DNA, 25 bp, Mus musculus
tatccctgggcagtcggtctagtga

SEQ ID NO: 786034 - DNA, 25 bp, Mus musculus
tatccctgggccactgaagcacaga

SEQ ID NO: 786035 - DNA, 25 bp, Mus musculus
tatccctgggcctctgaagcacaga

SEQ ID NO: 786036 - DNA, 25 bp, Mus musculus
tatccctgtctgctcttattacaac

SEQ ID NO: 786037 - DNA, 25 bp, Mus musculus
tatccctgtctggtcttattacaac

SEQ ID NO: 786038 - DNA, 25 bp, Mus musculus
tatccctgtggaagccgattttcct

SEQ ID NO: 786039 - DNA, 25 bp, Mus musculus
tatccctgtggatgccgattttcct

SEQ ID NO: 786040 - DNA, 25 bp, Mus musculus
tatccctgttcccagctgatctgct

SEQ ID NO: 786041 - DNA, 25 bp, Mus musculus
tatccctgttcccagttgagctgct

SEQ ID NO: 786042 - DNA, 25 bp, Mus musculus
tatccctgttccgagctgatctgct

SEQ ID NO: 786043 - DNA, 25 bp, Mus musculus
tatccctgttccgagttgagctgct

SEQ ID NO: 786044 - DNA, 25 bp, Mus musculus
tatcccttatccctctacttgtggt

SEQ ID NO: 786045 - DNA, 25 bp, Mus musculus
tatcccttatccgtctacttgtggt

SEQ ID NO: 786046 - DNA, 25 bp, Mus musculus
tatcccttcctcagagtccagattg

SEQ ID NO: 786047 - DNA, 25 bp, Mus musculus
tatcccttcctctgagtccagattg

SEQ ID NO: 786048 - DNA, 25 bp, Mus musculus
tatcccttctccatgaccaaacaaa

SEQ ID NO: 786049 - DNA, 25 bp, Mus musculus
tatcccttctccttgaccaaacaaa

SEQ ID NO: 786050 - DNA, 25 bp, Mus musculus
tatcccttctgtacttgtacacaaa

SEQ ID NO: 786051 - DNA, 25 bp, Mus musculus
tatcccttctgttcttgtacacaaa

SEQ ID NO: 786052 - DNA, 25 bp, Mus musculus
tatcccttgaacctctcacgtaaag

SEQ ID NO: 786053 - DNA, 25 bp, Mus musculus
tatcccttgaacgtctcacgtaaag

SEQ ID NO: 786054 - DNA, 25 bp, Mus musculus
tatcccttgggcaaaccagcaagaa

SEQ ID NO: 786055 - DNA, 25 bp, Mus musculus
tatcccttgggctaaccagcaagaa

SEQ ID NO: 786056 - DNA, 25 bp, Mus musculus
tatccctttccacaaaacaatctac

SEQ ID NO: 786057 - DNA, 25 bp, Mus musculus
tatccctttccagaaaacaatctac

SEQ ID NO: 786058 - DNA, 25 bp, Mus musculus
tatccctttcccagaggagttttgg

SEQ ID NO: 786059 - DNA, 25 bp, Mus musculus
tatccctttcccagcatgagattgt

SEQ ID NO: 786060 - DNA, 25 bp, Mus musculus
tatccctttccctgaggagttttgg

SEQ ID NO: 786061 - DNA, 25 bp, Mus musculus
tatccctttccctgcatgagattgt

SEQ ID NO: 786062 - DNA, 25 bp, Mus musculus
tatccctttcttagcctgtttgtta

SEQ ID NO: 786063 - DNA, 25 bp, Mus musculus
tatccctttctttgcctgtttgtta

SEQ ID NO: 786064 - DNA, 25 bp, Mus musculus
tatccctttgacaagatatgcaaat

SEQ ID NO: 786065 - DNA, 25 bp, Mus musculus
tatccctttgactagatatgcaaat

SEQ ID NO: 786066 - DNA, 25 bp, Mus musculus
tatccctttgtgcttgtatctaatc

SEQ ID NO: 786067 - DNA, 25 bp, Mus musculus
tatccctttgtggttgtatctaatc

SEQ ID NO: 786068 - DNA, 25 bp, Mus musculus
tatcccttttaactgaaaccctcag

SEQ ID NO: 786069 - DNA, 25 bp, Mus musculus
tatcccttttaagtgaaaccctcag

SEQ ID NO: 786070 - DNA, 25 bp, Mus musculus
tatccctttttcctattattcttat

SEQ ID NO: 786071 - DNA, 25 bp, Mus musculus
tatccctttttcgtattattcttat

SEQ ID NO: 786072 - DNA, 25 bp, Mus musculus
tatccgaaaggacacccagagttat

SEQ ID NO: 786073 - DNA, 25 bp, Mus musculus
tatccgaaaggagacccagagttat

SEQ ID NO: 786074 - DNA, 25 bp, Mus musculus
tatccgaacactactggctgttaca

SEQ ID NO: 786075 - DNA, 25 bp, Mus musculus
tatccgaacacttctggctgttaca

SEQ ID NO: 786076 - DNA, 25 bp, Mus musculus
tatccgaaccttacaatttcttgac

SEQ ID NO: 786077 - DNA, 25 bp, Mus musculus
tatccgaacctttcaatttcttgac

SEQ ID NO: 786078 - DNA, 25 bp, Mus musculus
tatccgacagatccacaagtttgaa

SEQ ID NO: 786079 - DNA, 25 bp, Mus musculus
tatccgacagatgcacaagtttgaa

SEQ ID NO: 786080 - DNA, 25 bp, Mus musculus
tatccgacaggtcttcagggcagat

SEQ ID NO: 786081 - DNA, 25 bp, Mus musculus
tatccgacaggtgttcagggcagat

SEQ ID NO: 786082 - DNA, 25 bp, Mus musculus
tatccgaccaggcagatctgaagag

SEQ ID NO: 786083 - DNA, 25 bp, Mus musculus
tatccgaccagggagatctgaagag

SEQ ID NO: 786084 - DNA, 25 bp, Mus musculus
tatccgacgtctccgaggacttcga

SEQ ID NO: 786085 - DNA, 25 bp, Mus musculus
tatccgacgtctgcgaggacttcga

SEQ ID NO: 786086 - DNA, 25 bp, Mus musculus
tatccgagaacacgagctgctctac

SEQ ID NO: 786087 - DNA, 25 bp, Mus musculus
tatccgagaacaggagctgctctac

SEQ ID NO: 786088 - DNA, 25 bp, Mus musculus
tatccgagagatacgccagtttcag

SEQ ID NO: 786089 - DNA, 25 bp, Mus musculus
tatccgagagattcgccagtttcag

SEQ ID NO: 786090 - DNA, 25 bp, Mus musculus
tatccgagatgaacagctctgaagc

SEQ ID NO: 786091 - DNA, 25 bp, Mus musculus
tatccgagatgatcagctctgaagc

SEQ ID NO: 786092 - DNA, 25 bp, Mus musculus
tatccgagtcccaaatcagtggctt

SEQ ID NO: 786093 - DNA, 25 bp, Mus musculus
tatccgagtccctaatcagtggctt

SEQ ID NO: 786094 - DNA, 25 bp, Mus musculus
tatccgatacccagcctacttgtgt

SEQ ID NO: 786095 - DNA, 25 bp, Mus musculus
tatccgataccctgcctacttgtgt

SEQ ID NO: 786096 - DNA, 25 bp, Mus musculus
tatccgatgtgtcttggtggcttca

SEQ ID NO: 786097 - DNA, 25 bp, Mus musculus
tatccgatgtgtgttggtggcttca

SEQ ID NO: 786098 - DNA, 25 bp, Mus musculus
tatccgcgcgttatgcataattcac

SEQ ID NO: 786099 - DNA, 25 bp, Mus musculus
tatccgcgcgttttgcataattcac

SEQ ID NO: 786100 - DNA, 25 bp, Mus musculus
tatccgctatgtcagttgtatccca

SEQ ID NO: 786101 - DNA, 25 bp, Mus musculus
tatccgctatgtgagttgtatccca

SEQ ID NO: 786102 - DNA, 25 bp, Mus musculus
tatccgctccacaggcacagttaag

SEQ ID NO: 786103 - DNA, 25 bp, Mus musculus
tatccgctccactggcacagttaag

SEQ ID NO: 786104 - DNA, 25 bp, Mus musculus
tatccgctgggcctttgggattgaa

SEQ ID NO: 786105 - DNA, 25 bp, Mus musculus
tatccgctgggcgtttgggattgaa

SEQ ID NO: 786106 - DNA, 25 bp, Mus musculus
tatccggaagtgacaacgtggtcga

SEQ ID NO: 786107 - DNA, 25 bp, Mus musculus
tatccggaagtgtcaacgtggtcga

SEQ ID NO: 786108 - DNA, 25 bp, Mus musculus
tatccggccccactggataagtttt

SEQ ID NO: 786109 - DNA, 25 bp, Mus musculus
tatccggccccagtggataagtttt

SEQ ID NO: 786110 - DNA, 25 bp, Mus musculus
tatccggcctagaattttacccttg

SEQ ID NO: 786111 - DNA, 25 bp, Mus musculus
tatccggcctagtattttacccttg

SEQ ID NO: 786112 - DNA, 25 bp, Mus musculus
tatccggctttaacttcgctgaggt

SEQ ID NO: 786113 - DNA, 25 bp, Mus musculus
tatccggctttatcttcgctgaggt

SEQ ID NO: 786114 - DNA, 25 bp, Mus musculus
tatccgggaatcatttttacttttg

SEQ ID NO: 786115 - DNA, 25 bp, Mus musculus
tatccgggaatcttttttacttttg

SEQ ID NO: 786116 - DNA, 25 bp, Mus musculus
tatccgggagccatgactattccag

SEQ ID NO: 786117 - DNA, 25 bp, Mus musculus
tatccgggagccttgactattccag

SEQ ID NO: 786118 - DNA, 25 bp, Mus musculus
tatccgggctacacgaactatggct

SEQ ID NO: 786119 - DNA, 25 bp, Mus musculus
tatccgggctactcgaactatggct

SEQ ID NO: 786120 - DNA, 25 bp, Mus musculus
tatccgggttgcattatccaaactg

SEQ ID NO: 786121 - DNA, 25 bp, Mus musculus
tatccgggttgctttatccaaactg

SEQ ID NO: 786122 - DNA, 25 bp, Mus musculus
tatccggtcaccagcaatgacagga

SEQ ID NO: 786123 - DNA, 25 bp, Mus musculus
tatccggtcacctgcaatgacagga

SEQ ID NO: 786124 - DNA, 25 bp, Mus musculus
tatccgtaccttacactttgtggag

SEQ ID NO: 786125 - DNA, 25 bp, Mus musculus
tatccgtacctttcactttgtggag

SEQ ID NO: 786126 - DNA, 25 bp, Mus musculus
tatccgtatttgctttcctctatgt

SEQ ID NO: 786127 - DNA, 25 bp, Mus musculus
tatccgtatttggtttcctctatgt

SEQ ID NO: 786128 - DNA, 25 bp, Mus musculus
tatccgtccacccatttaggtgagg

SEQ ID NO: 786129 - DNA, 25 bp, Mus musculus
tatccgtccaccgatttaggtgagg

SEQ ID NO: 786130 - DNA, 25 bp, Mus musculus
tatccgtctactacctgagtggcat

SEQ ID NO: 786131 - DNA, 25 bp, Mus musculus
tatccgtctacttcctgagtggcat

SEQ ID NO: 786132 - DNA, 25 bp, Mus musculus
tatccgtcttttcgctctgagttcc

SEQ ID NO: 786133 - DNA, 25 bp, Mus musculus
tatccgtcttttggctctgagttcc

SEQ ID NO: 786134 - DNA, 25 bp, Mus musculus
tatccgtggttgatggacctgcttg

SEQ ID NO: 786135 - DNA, 25 bp, Mus musculus
tatccgtggttgttggacctgcttg

SEQ ID NO: 786136 - DNA, 25 bp, Mus musculus
tatccgtgtcgaaaggcttctgaac

SEQ ID NO: 786137 - DNA, 25 bp, Mus musculus
tatccgtgtcgataggcttctgaac

SEQ ID NO: 786138 - DNA, 25 bp, Mus musculus
tatccgtgtgccagctgttaggagt

SEQ ID NO: 786139 - DNA, 25 bp, Mus musculus
tatccgtgtgcctgctgttaggagt

SEQ ID NO: 786140 - DNA, 25 bp, Mus musculus
tatccgttacagctgttctgagatg

SEQ ID NO: 786141 - DNA, 25 bp, Mus musculus
tatccgttacaggtgttctgagatg

SEQ ID NO: 786142 - DNA, 25 bp, Mus musculus
tatccgttcgtgacttcagcaagat

SEQ ID NO: 786143 - DNA, 25 bp, Mus musculus
tatccgttcgtgtcttcagcaagat

SEQ ID NO: 786144 - DNA, 25 bp, Mus musculus
tatccgttgggactggcgtaaatag

SEQ ID NO: 786145 - DNA, 25 bp, Mus musculus
tatccgttgggagtggcgtaaatag

SEQ ID NO: 786146 - DNA, 25 bp, Mus musculus
tatccgttgggtcgagtgaccgatt

SEQ ID NO: 786147 - DNA, 25 bp, Mus musculus
tatccgttgggtggagtgaccgatt

SEQ ID NO: 786148 - DNA, 25 bp, Mus musculus
tatccgtttccacactgagcaaata

SEQ ID NO: 786149 - DNA, 25 bp, Mus musculus
tatccgtttccagactgagcaaata

SEQ ID NO: 786150 - DNA, 25 bp, Mus musculus
tatccgtttctcatgcatagactga

SEQ ID NO: 786151 - DNA, 25 bp, Mus musculus
tatccgtttctcttgcatagactga

SEQ ID NO: 786152 - DNA, 25 bp, Mus musculus
tatcctaaaagtcttaccattgtac

SEQ ID NO: 786153 - DNA, 25 bp, Mus musculus
tatcctaaaagtgttaccattgtac

SEQ ID NO: 786154 - DNA, 25 bp, Mus musculus
tatcctaaacgcagttgtgcaccac

SEQ ID NO: 786155 - DNA, 25 bp, Mus musculus
tatcctaaacgctgttgtgcaccac

SEQ ID NO: 786156 - DNA, 25 bp, Mus musculus
tatcctaacaaaagcttctctgggt

SEQ ID NO: 786157 - DNA, 25 bp, Mus musculus
tatcctaacaaatgcttctctgggt

SEQ ID NO: 786158 - DNA, 25 bp, Mus musculus
tatcctaacactatgtccagctatg

SEQ ID NO: 786159 - DNA, 25 bp, Mus musculus
tatcctaacactttgtccagctatg

SEQ ID NO: 786160 - DNA, 25 bp, Mus musculus
tatcctaaccctaccctgtggtgta

SEQ ID NO: 786161 - DNA, 25 bp, Mus musculus
tatcctaacccttccctgtggtgta

SEQ ID NO: 786162 - DNA, 25 bp, Mus musculus
tatcctaacttgaagtctcccactg

SEQ ID NO: 786163 - DNA, 25 bp, Mus musculus
tatcctaacttgtagtctcccactg

SEQ ID NO: 786164 - DNA, 25 bp, Mus musculus
tatcctacagttatatcctttaaga

SEQ ID NO: 786165 - DNA, 25 bp, Mus musculus
tatcctacagttttatcctttaaga

SEQ ID NO: 786166 - DNA, 25 bp, Mus musculus
tatcctagcaccatggcagtcagac

SEQ ID NO: 786167 - DNA, 25 bp, Mus musculus
tatcctagcaccttggcagtcagac

SEQ ID NO: 786168 - DNA, 25 bp, Mus musculus
tatcctaggagtcaaagggaccctt

SEQ ID NO: 786169 - DNA, 25 bp, Mus musculus
tatcctaggagtgaaagggaccctt

SEQ ID NO: 786170 - DNA, 25 bp, Mus musculus
tatcctagtcctatctgttccggag

SEQ ID NO: 786171 - DNA, 25 bp, Mus musculus
tatcctagtcctttctgttccggag

SEQ ID NO: 786172 - DNA, 25 bp, Mus musculus
tatcctagtctgagtttggcagcgt

SEQ ID NO: 786173 - DNA, 25 bp, Mus musculus
tatcctagtctgtgtttggcagcgt

SEQ ID NO: 786174 - DNA, 25 bp, Mus musculus
tatcctagtgggatgtactccggta

SEQ ID NO: 786175 - DNA, 25 bp, Mus musculus
tatcctagtgggttgtactccggta

SEQ ID NO: 786176 - DNA, 25 bp, Mus musculus
tatcctagttccaaactgcaggcaa

SEQ ID NO: 786177 - DNA, 25 bp, Mus musculus
tatcctagttcctaactgcaggcaa

SEQ ID NO: 786178 - DNA, 25 bp, Mus musculus
tatcctatacacagccagttttcaa

SEQ ID NO: 786179 - DNA, 25 bp, Mus musculus
tatcctatacactgccagttttcaa

SEQ ID NO: 786180 - DNA, 25 bp, Mus musculus
tatcctatccgaagtgtcagcagtt

SEQ ID NO: 786181 - DNA, 25 bp, Mus musculus
tatcctatccgatgtgtcagcagtt

SEQ ID NO: 786182 - DNA, 25 bp, Mus musculus
tatcctatgggaaactctcctgcgg

SEQ ID NO: 786183 - DNA, 25 bp, Mus musculus
tatcctatgggatactctcctgcgg

SEQ ID NO: 786184 - DNA, 25 bp, Mus musculus
tatcctatggtacccttttaaatct

SEQ ID NO: 786185 - DNA, 25 bp, Mus musculus
tatcctatggtagccttttaaatct

SEQ ID NO: 786186 - DNA, 25 bp, Mus musculus
tatcctatgtacacaacagagtcta

SEQ ID NO: 786187 - DNA, 25 bp, Mus musculus
tatcctatgtactcaacagagtcta

SEQ ID NO: 786188 - DNA, 25 bp, Mus musculus
tatcctcaaataatgtcctctaaag

SEQ ID NO: 786189 - DNA, 25 bp, Mus musculus
tatcctcaaatattgtcctctaaag

SEQ ID NO: 786190 - DNA, 25 bp, Mus musculus
tatcctcacacacactaccagagtt

SEQ ID NO: 786191 - DNA, 25 bp, Mus musculus
tatcctcacacagactaccagagtt

SEQ ID NO: 786192 - DNA, 25 bp, Mus musculus
tatcctcagagcacatggttggtgg

SEQ ID NO: 786193 - DNA, 25 bp, Mus musculus
tatcctcagagctcatggttggtgg

SEQ ID NO: 786194 - DNA, 25 bp, Mus musculus
tatcctcagattagagtcacatcca

SEQ ID NO: 786195 - DNA, 25 bp, Mus musculus
tatcctcagatttgagtcacatcca

SEQ ID NO: 786196 - DNA, 25 bp, Mus musculus
tatcctcagcccaagagacggtgtt

SEQ ID NO: 786197 - DNA, 25 bp, Mus musculus
tatcctcagccctagagacggtgtt

SEQ ID NO: 786198 - DNA, 25 bp, Mus musculus
tatcctcagctaagtcagtcagact

SEQ ID NO: 786199 - DNA, 25 bp, Mus musculus
tatcctcagctatgtcagtcagact

SEQ ID NO: 786200 - DNA, 25 bp, Mus musculus
tatcctcagtgaacactgcacatat

SEQ ID NO: 786201 - DNA, 25 bp, Mus musculus
tatcctcagtgatcactgcacatat

SEQ ID NO: 786202 - DNA, 25 bp, Mus musculus
tatcctcatctgaaccatgaaaaca

SEQ ID NO: 786203 - DNA, 25 bp, Mus musculus
tatcctcatctgtaccatgaaaaca

SEQ ID NO: 786204 - DNA, 25 bp, Mus musculus
tatcctcattcaaccaagctcattg

SEQ ID NO: 786205 - DNA, 25 bp, Mus musculus
tatcctcattcatccaagctcattg

SEQ ID NO: 786206 - DNA, 25 bp, Mus musculus
tatcctccactcagagtcactgaag

SEQ ID NO: 786207 - DNA, 25 bp, Mus musculus
tatcctccactctgagtcactgaag

SEQ ID NO: 786208 - DNA, 25 bp, Mus musculus
tatcctccagatagaatctgaaaag

SEQ ID NO: 786209 - DNA, 25 bp, Mus musculus
tatcctccagattgaatctgaaaag

SEQ ID NO: 786210 - DNA, 25 bp, Mus musculus
tatcctccagcgaacatgacataca

SEQ ID NO: 786211 - DNA, 25 bp, Mus musculus
tatcctccagcgtacatgacataca

SEQ ID NO: 786212 - DNA, 25 bp, Mus musculus
tatcctccagttattgttaacacct

SEQ ID NO: 786213 - DNA, 25 bp, Mus musculus
tatcctccagtttttgttaacacct

SEQ ID NO: 786214 - DNA, 25 bp, Mus musculus
tatcctccatgtcttgtagacctca

SEQ ID NO: 786215 - DNA, 25 bp, Mus musculus
tatcctccatgtgttgtagacctca

SEQ ID NO: 786216 - DNA, 25 bp, Mus musculus
tatcctccccaaacctgtatataga

SEQ ID NO: 786217 - DNA, 25 bp, Mus musculus
tatcctccccaacatcaagattaca

SEQ ID NO: 786218 - DNA, 25 bp, Mus musculus
tatcctccccaagatcaagattaca

SEQ ID NO: 786219 - DNA, 25 bp, Mus musculus
tatcctccccaatcctgtatataga

SEQ ID NO: 786220 - DNA, 25 bp, Mus musculus
tatcctcccctgcacagacatttta

SEQ ID NO: 786221 - DNA, 25 bp, Mus musculus
tatcctcccctggacagacatttta

SEQ ID NO: 786222 - DNA, 25 bp, Mus musculus
tatcctcctcaacgacagcacatag

SEQ ID NO: 786223 - DNA, 25 bp, Mus musculus
tatcctcctcaaggacagcacatag

SEQ ID NO: 786224 - DNA, 25 bp, Mus musculus
tatcctcctgtgagttctgcatgga

SEQ ID NO: 786225 - DNA, 25 bp, Mus musculus
tatcctcctgtgtgttctgcatgga

SEQ ID NO: 786226 - DNA, 25 bp, Mus musculus
tatcctccttgtacggtgattgaaa

SEQ ID NO: 786227 - DNA, 25 bp, Mus musculus
tatcctccttgtattgtgttcataa

SEQ ID NO: 786228 - DNA, 25 bp, Mus musculus
tatcctccttgttcggtgattgaaa

SEQ ID NO: 786229 - DNA, 25 bp, Mus musculus
tatcctccttgttttgtgttcataa

SEQ ID NO: 786230 - DNA, 25 bp, Mus musculus
tatcctcgctgtctggtgagggact

SEQ ID NO: 786231 - DNA, 25 bp, Mus musculus
tatcctcgctgtgtggtgagggact

SEQ ID NO: 786232 - DNA, 25 bp, Mus musculus
tatcctctaagtacttggctagtct

SEQ ID NO: 786233 - DNA, 25 bp, Mus musculus
tatcctctaagttcttggctagtct

SEQ ID NO: 786234 - DNA, 25 bp, Mus musculus
tatcctctaggcatattgtttctat

SEQ ID NO: 786235 - DNA, 25 bp, Mus musculus
tatcctctaggcttattgtttctat

SEQ ID NO: 786236 - DNA, 25 bp, Mus musculus
tatcctctaggtcatatccctgaag

SEQ ID NO: 786237 - DNA, 25 bp, Mus musculus
tatcctctaggtgatatccctgaag

SEQ ID NO: 786238 - DNA, 25 bp, Mus musculus
tatcctctatgcaattatgtgtatt

SEQ ID NO: 786239 - DNA, 25 bp, Mus musculus
tatcctctatgctattatgtgtatt

SEQ ID NO: 786240 - DNA, 25 bp, Mus musculus
tatcctctattaacaacacccacca

SEQ ID NO: 786241 - DNA, 25 bp, Mus musculus
tatcctctattatcaacacccacca

SEQ ID NO: 786242 - DNA, 25 bp, Mus musculus
tatcctctcactctcatgattatac

SEQ ID NO: 786243 - DNA, 25 bp, Mus musculus
tatcctctcactgtcatgattatac

SEQ ID NO: 786244 - DNA, 25 bp, Mus musculus
tatcctctcatgatttgctgtttat

SEQ ID NO: 786245 - DNA, 25 bp, Mus musculus
tatcctctcatgttttgctgtttat

SEQ ID NO: 786246 - DNA, 25 bp, Mus musculus
tatcctctccatagtatttctcaca

SEQ ID NO: 786247 - DNA, 25 bp, Mus musculus
tatcctctccatcggaggaacccat

SEQ ID NO: 786248 - DNA, 25 bp, Mus musculus
tatcctctccatgggaggaacccat

SEQ ID NO: 786249 - DNA, 25 bp, Mus musculus
tatcctctccattgtatttctcaca

SEQ ID NO: 786250 - DNA, 25 bp, Mus musculus
tatcctctgaaacctcactgacgga

SEQ ID NO: 786251 - DNA, 25 bp, Mus musculus
tatcctctgaaagctcactgacgga

SEQ ID NO: 786252 - DNA, 25 bp, Mus musculus
tatcctctgataacagataccagtg

SEQ ID NO: 786253 - DNA, 25 bp, Mus musculus
tatcctctgatatcagataccagtg

SEQ ID NO: 786254 - DNA, 25 bp, Mus musculus
tatcctctggagacgagctcctggg

SEQ ID NO: 786255 - DNA, 25 bp, Mus musculus
tatcctctggagtcgagctcctggg

SEQ ID NO: 786256 - DNA, 25 bp, Mus musculus
tatcctcttatcatcttagaaccgg

SEQ ID NO: 786257 - DNA, 25 bp, Mus musculus
tatcctcttatcttcttagaaccgg

SEQ ID NO: 786258 - DNA, 25 bp, Mus musculus
tatcctcttatgacaagtgatgcgt

SEQ ID NO: 786259 - DNA, 25 bp, Mus musculus
tatcctcttatgtcaagtgatgcgt

SEQ ID NO: 786260 - DNA, 25 bp, Mus musculus
tatcctcttcaaagcggatcatgtt

SEQ ID NO: 786261 - DNA, 25 bp, Mus musculus
tatcctcttcaatgcggatcatgtt

SEQ ID NO: 786262 - DNA, 25 bp, Mus musculus
tatcctcttggaacgtgcggagaat

SEQ ID NO: 786263 - DNA, 25 bp, Mus musculus
tatcctcttggatcgtgcggagaat

SEQ ID NO: 786264 - DNA, 25 bp, Mus musculus
tatcctcttttaaccagcaatgatg

SEQ ID NO: 786265 - DNA, 25 bp, Mus musculus
tatcctcttttatccagcaatgatg

SEQ ID NO: 786266 - DNA, 25 bp, Mus musculus
tatcctgaaaccaaaagtcccacgc

SEQ ID NO: 786267 - DNA, 25 bp, Mus musculus
tatcctgaaacctaaagtcccacgc

SEQ ID NO: 786268 - DNA, 25 bp, Mus musculus
tatcctgaacttatgagccttatag

SEQ ID NO: 786269 - DNA, 25 bp, Mus musculus
tatcctgaacttttgagccttatag

SEQ ID NO: 786270 - DNA, 25 bp, Mus musculus
tatcctgaagcgaccaggcctggag

SEQ ID NO: 786271 - DNA, 25 bp, Mus musculus
tatcctgaagcgtccaggcctggag

SEQ ID NO: 786272 - DNA, 25 bp, Mus musculus
tatcctgaaggtcaaagggcgccga

SEQ ID NO: 786273 - DNA, 25 bp, Mus musculus
tatcctgaaggtgaaagggcgccga

SEQ ID NO: 786274 - DNA, 25 bp, Mus musculus
tatcctgaccagattatctgcccag

SEQ ID NO: 786275 - DNA, 25 bp, Mus musculus
tatcctgaccagtttatctgcccag

SEQ ID NO: 786276 - DNA, 25 bp, Mus musculus
tatcctgacctgcattcctttgcat

SEQ ID NO: 786277 - DNA, 25 bp, Mus musculus
tatcctgacctggattcctttgcat

SEQ ID NO: 786278 - DNA, 25 bp, Mus musculus
tatcctgactaacgagcggcggccg

SEQ ID NO: 786279 - DNA, 25 bp, Mus musculus
tatcctgactaaggagcggcggccg

SEQ ID NO: 786280 - DNA, 25 bp, Mus musculus
tatcctgactcccacggaaagcaac

SEQ ID NO: 786281 - DNA, 25 bp, Mus musculus
tatcctgactccgacggaaagcaac

SEQ ID NO: 786282 - DNA, 25 bp, Mus musculus
tatcctgagaaacctggacccttag

SEQ ID NO: 786283 - DNA, 25 bp, Mus musculus
tatcctgagaaagctggacccttag

SEQ ID NO: 786284 - DNA, 25 bp, Mus musculus
tatcctgagagaccaaattgtgcct

SEQ ID NO: 786285 - DNA, 25 bp, Mus musculus
tatcctgagagagcaaattgtgcct

SEQ ID NO: 786286 - DNA, 25 bp, Mus musculus
tatcctgagatcaatccaagtgttg

SEQ ID NO: 786287 - DNA, 25 bp, Mus musculus
tatcctgagatccatttctactacg

SEQ ID NO: 786288 - DNA, 25 bp, Mus musculus
tatcctgagatcgatttctactacg

SEQ ID NO: 786289 - DNA, 25 bp, Mus musculus
tatcctgagatctatccaagtgttg

SEQ ID NO: 786290 - DNA, 25 bp, Mus musculus
tatcctgagcgaattctggacagca

SEQ ID NO: 786291 - DNA, 25 bp, Mus musculus
tatcctgagcgatttctggacagca

SEQ ID NO: 786292 - DNA, 25 bp, Mus musculus
tatcctgagggtcgcattgatgcgt

SEQ ID NO: 786293 - DNA, 25 bp, Mus musculus
tatcctgagggtggcattgatgcgt

SEQ ID NO: 786294 - DNA, 25 bp, Mus musculus
tatcctgatcccagttcccctgaga

SEQ ID NO: 786295 - DNA, 25 bp, Mus musculus
tatcctgatccctgttcccctgaga

SEQ ID NO: 786296 - DNA, 25 bp, Mus musculus
tatcctgatcttctatactggtggt

SEQ ID NO: 786297 - DNA, 25 bp, Mus musculus
tatcctgatcttgtatactggtggt

SEQ ID NO: 786298 - DNA, 25 bp, Mus musculus
tatcctgatggactcccctttaagg

SEQ ID NO: 786299 - DNA, 25 bp, Mus musculus
tatcctgatggagtcccctttaagg

SEQ ID NO: 786300 - DNA, 25 bp, Mus musculus
tatcctgcaatcacagaggcccgga

SEQ ID NO: 786301 - DNA, 25 bp, Mus musculus
tatcctgcaatctcagaggcccgga

SEQ ID NO: 786302 - DNA, 25 bp, Mus musculus
tatcctgcactgagttgtcctcatg

SEQ ID NO: 786303 - DNA, 25 bp, Mus musculus
tatcctgcactgtgttgtcctcatg

SEQ ID NO: 786304 - DNA, 25 bp, Mus musculus
tatcctgccaacaacgttgaggcta

SEQ ID NO: 786305 - DNA, 25 bp, Mus musculus
tatcctgccaactacgttgaggcta

SEQ ID NO: 786306 - DNA, 25 bp, Mus musculus
tatcctgccagaagcggctttgctg

SEQ ID NO: 786307 - DNA, 25 bp, Mus musculus
tatcctgccagatgcggctttgctg

SEQ ID NO: 786308 - DNA, 25 bp, Mus musculus
tatcctgccatcatgaataaagcct

SEQ ID NO: 786309 - DNA, 25 bp, Mus musculus
tatcctgccatcttgaataaagcct

SEQ ID NO: 786310 - DNA, 25 bp, Mus musculus
tatcctgcctataacatttactgtg

SEQ ID NO: 786311 - DNA, 25 bp, Mus musculus
tatcctgcctattacatttactgtg

SEQ ID NO: 786312 - DNA, 25 bp, Mus musculus
tatcctgcctctataagttcttttg

SEQ ID NO: 786313 - DNA, 25 bp, Mus musculus
tatcctgcctctttaagttcttttg

SEQ ID NO: 786314 - DNA, 25 bp, Mus musculus
tatcctgccttcaattcctcttggg

SEQ ID NO: 786315 - DNA, 25 bp, Mus musculus
tatcctgccttctattcctcttggg

SEQ ID NO: 786316 - DNA, 25 bp, Mus musculus
tatcctgcggagatttagaaggcac

SEQ ID NO: 786317 - DNA, 25 bp, Mus musculus
tatcctgcggagttttagaaggcac

SEQ ID NO: 786318 - DNA, 25 bp, Mus musculus
tatcctgctaacagaaattctcttc

SEQ ID NO: 786319 - DNA, 25 bp, Mus musculus
tatcctgctaactgaaattctcttc

SEQ ID NO: 786320 - DNA, 25 bp, Mus musculus
tatcctgctgatcatggagggcctc

SEQ ID NO: 786321 - DNA, 25 bp, Mus musculus
tatcctgctgatgatggagggcctc

SEQ ID NO: 786322 - DNA, 25 bp, Mus musculus
tatcctgctgtcagtgccgtgcagt

SEQ ID NO: 786323 - DNA, 25 bp, Mus musculus
tatcctgctgtctgtgccgtgcagt

SEQ ID NO: 786324 - DNA, 25 bp, Mus musculus
tatcctggaactcaaattctctaca

SEQ ID NO: 786325 - DNA, 25 bp, Mus musculus
tatcctggaactgaaattctctaca

SEQ ID NO: 786326 - DNA, 25 bp, Mus musculus
tatcctggactcatggtaagacccc

SEQ ID NO: 786327 - DNA, 25 bp, Mus musculus
tatcctggactcttggtaagacccc

SEQ ID NO: 786328 - DNA, 25 bp, Mus musculus
tatcctggagatcaccctgggtaag

SEQ ID NO: 786329 - DNA, 25 bp, Mus musculus
tatcctggagatgaccctgggtaag

SEQ ID NO: 786330 - DNA, 25 bp, Mus musculus
tatcctggagggatacatctgccca

SEQ ID NO: 786331 - DNA, 25 bp, Mus musculus
tatcctggagggttacatctgccca

SEQ ID NO: 786332 - DNA, 25 bp, Mus musculus
tatcctggctatcttgttcttttaa

SEQ ID NO: 786333 - DNA, 25 bp, Mus musculus
tatcctggctatgttgttcttttaa

SEQ ID NO: 786334 - DNA, 25 bp, Mus musculus
tatcctgggaaacttccttggcggt

SEQ ID NO: 786335 - DNA, 25 bp, Mus musculus
tatcctgggaaagttccttggcggt

SEQ ID NO: 786336 - DNA, 25 bp, Mus musculus
tatcctgggattagccttgtctgaa

SEQ ID NO: 786337 - DNA, 25 bp, Mus musculus
tatcctgggatttgccttgtctgaa

SEQ ID NO: 786338 - DNA, 25 bp, Mus musculus
tatcctggggtcacagtttcgggct

SEQ ID NO: 786339 - DNA, 25 bp, Mus musculus
tatcctggggtctcagtttcgggct

SEQ ID NO: 786340 - DNA, 25 bp, Mus musculus
tatcctgggtaacccctttgcatga

SEQ ID NO: 786341 - DNA, 25 bp, Mus musculus
tatcctgggtaagccctttgcatga

SEQ ID NO: 786342 - DNA, 25 bp, Mus musculus
tatcctgggtctctggtcttcagta

SEQ ID NO: 786343 - DNA, 25 bp, Mus musculus
tatcctgggtctgtggtcttcagta

SEQ ID NO: 786344 - DNA, 25 bp, Mus musculus
tatcctggtactataatgagtctag

SEQ ID NO: 786345 - DNA, 25 bp, Mus musculus
tatcctggtactttaatgagtctag

SEQ ID NO: 786346 - DNA, 25 bp, Mus musculus
tatcctggtttcactaagtatacat

SEQ ID NO: 786347 - DNA, 25 bp, Mus musculus
tatcctggtttctctaagtatacat

SEQ ID NO: 786348 - DNA, 25 bp, Mus musculus
tatcctgtaaagagtctatccggac

SEQ ID NO: 786349 - DNA, 25 bp, Mus musculus
tatcctgtaaagtgtctatccggac

SEQ ID NO: 786350 - DNA, 25 bp, Mus musculus
tatcctgtaaggactccagtcagaa

SEQ ID NO: 786351 - DNA, 25 bp, Mus musculus
tatcctgtaaggtctccagtcagaa

SEQ ID NO: 786352 - DNA, 25 bp, Mus musculus
tatcctgtacctcttgctttgagtt

SEQ ID NO: 786353 - DNA, 25 bp, Mus musculus
tatcctgtacctgttgctttgagtt

SEQ ID NO: 786354 - DNA, 25 bp, Mus musculus
tatcctgtaggtctggtattctgaa

SEQ ID NO: 786355 - DNA, 25 bp, Mus musculus
tatcctgtaggtgtggtattctgaa

SEQ ID NO: 786356 - DNA, 25 bp, Mus musculus
tatcctgtagtgagtgccgtctggg

SEQ ID NO: 786357 - DNA, 25 bp, Mus musculus
tatcctgtagtgtgtgccgtctggg

SEQ ID NO: 786358 - DNA, 25 bp, Mus musculus
tatcctgtcaaaatcaccttaaacg

SEQ ID NO: 786359 - DNA, 25 bp, Mus musculus
tatcctgtcaaattcaccttaaacg

SEQ ID NO: 786360 - DNA, 25 bp, Mus musculus
tatcctgtcacaccacatgtggctt

SEQ ID NO: 786361 - DNA, 25 bp, Mus musculus
tatcctgtcacagcacatgtggctt

SEQ ID NO: 786362 - DNA, 25 bp, Mus musculus
tatcctgtcattctcagtagccggc

SEQ ID NO: 786363 - DNA, 25 bp, Mus musculus
tatcctgtcattgtcagtagccggc

SEQ ID NO: 786364 - DNA, 25 bp, Mus musculus
tatcctgtcccaccaagaggagttt

SEQ ID NO: 786365 - DNA, 25 bp, Mus musculus
tatcctgtcccagcaagaggagttt

SEQ ID NO: 786366 - DNA, 25 bp, Mus musculus
tatcctgtctccactggttaaagcc

SEQ ID NO: 786367 - DNA, 25 bp, Mus musculus
tatcctgtctcctctggttaaagcc

SEQ ID NO: 786368 - DNA, 25 bp, Mus musculus
tatcctgtgaacatagcttcttggg

SEQ ID NO: 786369 - DNA, 25 bp, Mus musculus
tatcctgtgaacttagcttcttggg

SEQ ID NO: 786370 - DNA, 25 bp, Mus musculus
tatcctgtgagtaagtgagcccaag

SEQ ID NO: 786371 - DNA, 25 bp, Mus musculus
tatcctgtgagttagtgagcccaag

SEQ ID NO: 786372 - DNA, 25 bp, Mus musculus
tatcctgtgatcagtacctcctatc

SEQ ID NO: 786373 - DNA, 25 bp, Mus musculus
tatcctgtgatctgtacctcctatc

SEQ ID NO: 786374 - DNA, 25 bp, Mus musculus
tatcctgtgccaaactattgttaaa

SEQ ID NO: 786375 - DNA, 25 bp, Mus musculus
tatcctgtgccatactattgttaaa

SEQ ID NO: 786376 - DNA, 25 bp, Mus musculus
tatcctgtgctaatattcctttata

SEQ ID NO: 786377 - DNA, 25 bp, Mus musculus
tatcctgtgctattattcctttata

SEQ ID NO: 786378 - DNA, 25 bp, Mus musculus
tatcctgtggatactgcatttgctt

SEQ ID NO: 786379 - DNA, 25 bp, Mus musculus
tatcctgtggattctgcatttgctt

SEQ ID NO: 786380 - DNA, 25 bp, Mus musculus
tatcctgtgtgcacactgggtaagc

SEQ ID NO: 786381 - DNA, 25 bp, Mus musculus
tatcctgtgtgctcactgggtaagc

SEQ ID NO: 786382 - DNA, 25 bp, Mus musculus
tatcctgttagcagtgtgccaggct

SEQ ID NO: 786383 - DNA, 25 bp, Mus musculus
tatcctgttagctgtgtgccaggct

SEQ ID NO: 786384 - DNA, 25 bp, Mus musculus
tatcctgttctgcagctacccacat

SEQ ID NO: 786385 - DNA, 25 bp, Mus musculus
tatcctgttctggagctacccacat

SEQ ID NO: 786386 - DNA, 25 bp, Mus musculus
tatcctgttgagactatgtcatgac

SEQ ID NO: 786387 - DNA, 25 bp, Mus musculus
tatcctgttgagtctatgtcatgac

SEQ ID NO: 786388 - DNA, 25 bp, Mus musculus
tatcctgttgttacatccattcggc

SEQ ID NO: 786389 - DNA, 25 bp, Mus musculus
tatcctgttgtttcatccattcggc

SEQ ID NO: 786390 - DNA, 25 bp, Mus musculus
tatcctgtttatactcacacggaga

SEQ ID NO: 786391 - DNA, 25 bp, Mus musculus
tatcctgtttattctcacacggaga

SEQ ID NO: 786392 - DNA, 25 bp, Mus musculus
tatccttaaaccatcttcgatgtag

SEQ ID NO: 786393 - DNA, 25 bp, Mus musculus
tatccttaaaccttcttcgatgtag

SEQ ID NO: 786394 - DNA, 25 bp, Mus musculus
tatccttaacttagtctgtctgcct

SEQ ID NO: 786395 - DNA, 25 bp, Mus musculus
tatccttaactttgtctgtctgcct

SEQ ID NO: 786396 - DNA, 25 bp, Mus musculus
tatccttaagttcccctgatgtgaa

SEQ ID NO: 786397 - DNA, 25 bp, Mus musculus
tatccttaagttgccctgatgtgaa

SEQ ID NO: 786398 - DNA, 25 bp, Mus musculus
tatccttactgtatggacccacagg

SEQ ID NO: 786399 - DNA, 25 bp, Mus musculus
tatccttactgtttggacccacagg

SEQ ID NO: 786400 - DNA, 25 bp, Mus musculus
tatccttagtacatctcttgtttgt

SEQ ID NO: 786401 - DNA, 25 bp, Mus musculus
tatccttagtacttctcttgtttgt

SEQ ID NO: 786402 - DNA, 25 bp, Mus musculus
tatccttattgcctttgtgcgaact

SEQ ID NO: 786403 - DNA, 25 bp, Mus musculus
tatccttattgcgtttgtgcgaact

SEQ ID NO: 786404 - DNA, 25 bp, Mus musculus
tatccttcactacctccagagataa

SEQ ID NO: 786405 - DNA, 25 bp, Mus musculus
tatccttcactagctccagagataa

SEQ ID NO: 786406 - DNA, 25 bp, Mus musculus
tatccttcatatcctggaaccatgc

SEQ ID NO: 786407 - DNA, 25 bp, Mus musculus
tatccttcatatgctggaaccatgc

SEQ ID NO: 786408 - DNA, 25 bp, Mus musculus
tatccttccccgaggcacaagaggg

SEQ ID NO: 786409 - DNA, 25 bp, Mus musculus
tatccttccccgtggcacaagaggg

SEQ ID NO: 786410 - DNA, 25 bp, Mus musculus
tatccttccctgcatatggtatcct

SEQ ID NO: 786411 - DNA, 25 bp, Mus musculus
tatccttccctggatatggtatcct

SEQ ID NO: 786412 - DNA, 25 bp, Mus musculus
tatccttcctatcgttacgaaccca

SEQ ID NO: 786413 - DNA, 25 bp, Mus musculus
tatccttcctatggttacgaaccca

SEQ ID NO: 786414 - DNA, 25 bp, Mus musculus
tatccttcctgcacaggtcctagga

SEQ ID NO: 786415 - DNA, 25 bp, Mus musculus
tatccttcctgctcaggtcctagga

SEQ ID NO: 786416 - DNA, 25 bp, Mus musculus
tatccttctatgactctgagcgcca

SEQ ID NO: 786417 - DNA, 25 bp, Mus musculus
tatccttctatgtctctgagcgcca

SEQ ID NO: 786418 - DNA, 25 bp, Mus musculus
tatccttctctaatcctgatgatag

SEQ ID NO: 786419 - DNA, 25 bp, Mus musculus
tatccttctctattcctgatgatag

SEQ ID NO: 786420 - DNA, 25 bp, Mus musculus
tatccttctgctagtcgtctccaat

SEQ ID NO: 786421 - DNA, 25 bp, Mus musculus
tatccttctgcttgtcgtctccaat

SEQ ID NO: 786422 - DNA, 25 bp, Mus musculus
tatccttgaagtagggcacgctctt

SEQ ID NO: 786423 - DNA, 25 bp, Mus musculus
tatccttgaagttgggcacgctctt

SEQ ID NO: 786424 - DNA, 25 bp, Mus musculus
tatccttgagacacagactaactgc

SEQ ID NO: 786425 - DNA, 25 bp, Mus musculus
tatccttgagactcagactaactgc

SEQ ID NO: 786426 - DNA, 25 bp, Mus musculus
tatccttgagctatctccctttatt

SEQ ID NO: 786427 - DNA, 25 bp, Mus musculus
tatccttgagctttctccctttatt

SEQ ID NO: 786428 - DNA, 25 bp, Mus musculus
tatccttgagtcagtttatgtgcta

SEQ ID NO: 786429 - DNA, 25 bp, Mus musculus
tatccttgagtctgtttatgtgcta

SEQ ID NO: 786430 - DNA, 25 bp, Mus musculus
tatccttgcagaaaccacgctgaga

SEQ ID NO: 786431 - DNA, 25 bp, Mus musculus
tatccttgcagataccacgctgaga

SEQ ID NO: 786432 - DNA, 25 bp, Mus musculus
tatccttgcagcagtttgttggtaa

SEQ ID NO: 786433 - DNA, 25 bp, Mus musculus
tatccttgcagctgtttgttggtaa

SEQ ID NO: 786434 - DNA, 25 bp, Mus musculus
tatccttgccctctgtcttatttta

SEQ ID NO: 786435 - DNA, 25 bp, Mus musculus
tatccttgccctgtgtcttatttta

SEQ ID NO: 786436 - DNA, 25 bp, Mus musculus
tatccttgccttctgatgccttaaa

SEQ ID NO: 786437 - DNA, 25 bp, Mus musculus
tatccttgccttgtgatgccttaaa

SEQ ID NO: 786438 - DNA, 25 bp, Mus musculus
tatccttgctgcatctgcgcaagaa

SEQ ID NO: 786439 - DNA, 25 bp, Mus musculus
tatccttgctgcttctgcgcaagaa

SEQ ID NO: 786440 - DNA, 25 bp, Mus musculus
tatccttggaacactttcctatccc

SEQ ID NO: 786441 - DNA, 25 bp, Mus musculus
tatccttggaactctttcctatccc

SEQ ID NO: 786442 - DNA, 25 bp, Mus musculus
tatccttgggatcatggttctacaa

SEQ ID NO: 786443 - DNA, 25 bp, Mus musculus
tatccttgggatgatggttctacaa

SEQ ID NO: 786444 - DNA, 25 bp, Mus musculus
tatccttgggtgattcagaagcttt

SEQ ID NO: 786445 - DNA, 25 bp, Mus musculus
tatccttgggtgtttcagaagcttt

SEQ ID NO: 786446 - DNA, 25 bp, Mus musculus
tatccttgtaccacagacaaagcaa

SEQ ID NO: 786447 - DNA, 25 bp, Mus musculus
tatccttgtacctcagacaaagcaa

SEQ ID NO: 786448 - DNA, 25 bp, Mus musculus
tatccttgtccaatgtctttctgct

SEQ ID NO: 786449 - DNA, 25 bp, Mus musculus
tatccttgtccattgtctttctgct

SEQ ID NO: 786450 - DNA, 25 bp, Mus musculus
tatccttgttcacgtagcatggaaa

SEQ ID NO: 786451 - DNA, 25 bp, Mus musculus
tatccttgttcaggtagcatggaaa

SEQ ID NO: 786452 - DNA, 25 bp, Mus musculus
tatcctttaacaaagctcgtgccat

SEQ ID NO: 786453 - DNA, 25 bp, Mus musculus
tatcctttaacatagctcgtgccat

SEQ ID NO: 786454 - DNA, 25 bp, Mus musculus
tatcctttccataaggccagcaacg

SEQ ID NO: 786455 - DNA, 25 bp, Mus musculus
tatcctttccattaggccagcaacg

SEQ ID NO: 786456 - DNA, 25 bp, Mus musculus
tatcctttcttgactaaatttgtgg

SEQ ID NO: 786457 - DNA, 25 bp, Mus musculus
tatcctttcttgtctaaatttgtgg

SEQ ID NO: 786458 - DNA, 25 bp, Mus musculus
tatcctttgtatctcctaacctctt

SEQ ID NO: 786459 - DNA, 25 bp, Mus musculus
tatcctttgtatgtcctaacctctt

SEQ ID NO: 786460 - DNA, 25 bp, Mus musculus
tatcctttgttccaaccctggttgt

SEQ ID NO: 786461 - DNA, 25 bp, Mus musculus
tatcctttgttcgaaccctggttgt

SEQ ID NO: 786462 - DNA, 25 bp, Mus musculus
tatccttttaagatctcatgatgac

SEQ ID NO: 786463 - DNA, 25 bp, Mus musculus
tatccttttaagttctcatgatgac

SEQ ID NO: 786464 - DNA, 25 bp, Mus musculus
tatccttttccgcaatggctacaat

SEQ ID NO: 786465 - DNA, 25 bp, Mus musculus
tatccttttccggaatggctacaat

SEQ ID NO: 786466 - DNA, 25 bp, Mus musculus
tatccttttcctatgcaaacatttg

SEQ ID NO: 786467 - DNA, 25 bp, Mus musculus
tatccttttcctttgcaaacatttg

SEQ ID NO: 786468 - DNA, 25 bp, Mus musculus
tatccttttcttaccttaagtcttg

SEQ ID NO: 786469 - DNA, 25 bp, Mus musculus
tatccttttctttccttaagtcttg

SEQ ID NO: 786470 - DNA, 25 bp, Mus musculus
tatccttttggcaatacccgtcaat

SEQ ID NO: 786471 - DNA, 25 bp, Mus musculus
tatccttttggctatacccgtcaat

SEQ ID NO: 786472 - DNA, 25 bp, Mus musculus
tatccttttggtactcacctttcat

SEQ ID NO: 786473 - DNA, 25 bp, Mus musculus
tatccttttggttctcacctttcat

SEQ ID NO: 786474 - DNA, 25 bp, Mus musculus
tatcctttttagagctggagtcctt

SEQ ID NO: 786475 - DNA, 25 bp, Mus musculus
tatcctttttagtgctggagtcctt

SEQ ID NO: 786476 - DNA, 25 bp, Mus musculus
tatcgaaaccgaaccaacttggaga

SEQ ID NO: 786477 - DNA, 25 bp, Mus musculus
tatcgaaaccgatccaacttggaga

SEQ ID NO: 786478 - DNA, 25 bp, Mus musculus
tatcgaacacaaccagcacattgag

SEQ ID NO: 786479 - DNA, 25 bp, Mus musculus
tatcgaacacaagcagcacattgag

SEQ ID NO: 786480 - DNA, 25 bp, Mus musculus
tatcgaaccctgaaggaagtcgcct

SEQ ID NO: 786481 - DNA, 25 bp, Mus musculus
tatcgaaccctgtaggaagtcgcct

SEQ ID NO: 786482 - DNA, 25 bp, Mus musculus
tatcgaagagataagggtccatgtg

SEQ ID NO: 786483 - DNA, 25 bp, Mus musculus
tatcgaagagattagggtccatgtg

SEQ ID NO: 786484 - DNA, 25 bp, Mus musculus
tatcgaatctgccagccataaccat

SEQ ID NO: 786485 - DNA, 25 bp, Mus musculus
tatcgaatctgcgagccataaccat

SEQ ID NO: 786486 - DNA, 25 bp, Mus musculus
tatcgaatgatcacctttccaacta

SEQ ID NO: 786487 - DNA, 25 bp, Mus musculus
tatcgaatgatctcctttccaacta

SEQ ID NO: 786488 - DNA, 25 bp, Mus musculus
tatcgaatgcttatatgtacaacaa

SEQ ID NO: 786489 - DNA, 25 bp, Mus musculus
tatcgaatgcttttatgtacaacaa

SEQ ID NO: 786490 - DNA, 25 bp, Mus musculus
tatcgacagaacagggctgactctt

SEQ ID NO: 786491 - DNA, 25 bp, Mus musculus
tatcgacagaactgggctgactctt

SEQ ID NO: 786492 - DNA, 25 bp, Mus musculus
tatcgactctggacaggcgtcgtac

SEQ ID NO: 786493 - DNA, 25 bp, Mus musculus
tatcgactctggtcaggcgtcgtac

SEQ ID NO: 786494 - DNA, 25 bp, Mus musculus
tatcgactgcccctgatctgtcaat

SEQ ID NO: 786495 - DNA, 25 bp, Mus musculus
tatcgactgcccgtgatctgtcaat

SEQ ID NO: 786496 - DNA, 25 bp, Mus musculus
tatcgagaatctctcccttggaggt

SEQ ID NO: 786497 - DNA, 25 bp, Mus musculus
tatcgagaatctgtcccttggaggt

SEQ ID NO: 786498 - DNA, 25 bp, Mus musculus
tatcgagcatgtctggatggagcca

SEQ ID NO: 786499 - DNA, 25 bp, Mus musculus
tatcgagcatgtgtggatggagcca

SEQ ID NO: 786500 - DNA, 25 bp, Mus musculus
tatcgagccgcactagaatacctgg

SEQ ID NO: 786501 - DNA, 25 bp, Mus musculus
tatcgagccgcagtagaatacctgg

SEQ ID NO: 786502 - DNA, 25 bp, Mus musculus
tatcgaggcctgacattgtgggtgc

SEQ ID NO: 786503 - DNA, 25 bp, Mus musculus
tatcgaggcctgtcattgtgggtgc

SEQ ID NO: 786504 - DNA, 25 bp, Mus musculus
tatcgaggtggaccttaaccctggg

SEQ ID NO: 786505 - DNA, 25 bp, Mus musculus
tatcgaggtggagcttaaccctggg

SEQ ID NO: 786506 - DNA, 25 bp, Mus musculus
tatcgagtcttgcagtaacccagtt

SEQ ID NO: 786507 - DNA, 25 bp, Mus musculus
tatcgagtcttggagtaacccagtt

SEQ ID NO: 786508 - DNA, 25 bp, Mus musculus
tatcgataaggtctgatggcctctg

SEQ ID NO: 786509 - DNA, 25 bp, Mus musculus
tatcgataaggtgtgatggcctctg

SEQ ID NO: 786510 - DNA, 25 bp, Mus musculus
tatcgatcctgtatctccggtttta

SEQ ID NO: 786511 - DNA, 25 bp, Mus musculus
tatcgatcctgtttctccggtttta

SEQ ID NO: 786512 - DNA, 25 bp, Mus musculus
tatcgattccccaacatggtggtgg

SEQ ID NO: 786513 - DNA, 25 bp, Mus musculus
tatcgattcccctacatggtggtgg

SEQ ID NO: 786514 - DNA, 25 bp, Mus musculus
tatcgcaagactcacaggcattcac

SEQ ID NO: 786515 - DNA, 25 bp, Mus musculus
tatcgcaagactgacaggcattcac

SEQ ID NO: 786516 - DNA, 25 bp, Mus musculus
tatcgcactgccctcaggaacctgg

SEQ ID NO: 786517 - DNA, 25 bp, Mus musculus
tatcgcactgccgtcaggaacctgg

SEQ ID NO: 786518 - DNA, 25 bp, Mus musculus
tatcgcagttaccatagccatcgtg

SEQ ID NO: 786519 - DNA, 25 bp, Mus musculus
tatcgcagttacgatagccatcgtg

SEQ ID NO: 786520 - DNA, 25 bp, Mus musculus
tatcgcatacagatgtgtctcagta

SEQ ID NO: 786521 - DNA, 25 bp, Mus musculus
tatcgcatacagttgtgtctcagta

SEQ ID NO: 786522 - DNA, 25 bp, Mus musculus
tatcgcatggagcagcctcgaaact

SEQ ID NO: 786523 - DNA, 25 bp, Mus musculus
tatcgcatggaggagcctcgaaact

SEQ ID NO: 786524 - DNA, 25 bp, Mus musculus
tatcgccaccgcagaaagaatgttt

SEQ ID NO: 786525 - DNA, 25 bp, Mus musculus
tatcgccaccgctgaaagaatgttt

SEQ ID NO: 786526 - DNA, 25 bp, Mus musculus
tatcgccatgcacttcctcctggat

SEQ ID NO: 786527 - DNA, 25 bp, Mus musculus
tatcgccatgcagttcctcctggat

SEQ ID NO: 786528 - DNA, 25 bp, Mus musculus
tatcgcccatgcagctatggaagac

SEQ ID NO: 786529 - DNA, 25 bp, Mus musculus
tatcgcccatgctgctatggaagac

SEQ ID NO: 786530 - DNA, 25 bp, Mus musculus
tatcgcctcagacttatcctgtgag

SEQ ID NO: 786531 - DNA, 25 bp, Mus musculus
tatcgcctcagagttatcctgtgag

SEQ ID NO: 786532 - DNA, 25 bp, Mus musculus
tatcgcctgtgcattggtttggcca

SEQ ID NO: 786533 - DNA, 25 bp, Mus musculus
tatcgcctgtgctttggtttggcca

SEQ ID NO: 786534 - DNA, 25 bp, Mus musculus
tatcgcgatgtaccttctttggaag

SEQ ID NO: 786535 - DNA, 25 bp, Mus musculus
tatcgcgatgtagcttctttggaag

SEQ ID NO: 786536 - DNA, 25 bp, Mus musculus
tatcgcggagttacaccagacagta

SEQ ID NO: 786537 - DNA, 25 bp, Mus musculus
tatcgcggagtttcaccagacagta

SEQ ID NO: 786538 - DNA, 25 bp, Mus musculus
tatcgcgtatgtcccgctccagaag

SEQ ID NO: 786539 - DNA, 25 bp, Mus musculus
tatcgcgtatgtgccgctccagaag

SEQ ID NO: 786540 - DNA, 25 bp, Mus musculus
tatcgctacaagatgccccgtttga

SEQ ID NO: 786541 - DNA, 25 bp, Mus musculus
tatcgctacaagttgccccgtttga

SEQ ID NO: 786542 - DNA, 25 bp, Mus musculus
tatcgctatttaatacaccttcagt

SEQ ID NO: 786543 - DNA, 25 bp, Mus musculus
tatcgctatttattacaccttcagt

SEQ ID NO: 786544 - DNA, 25 bp, Mus musculus
tatcgctgctcgactaccaggagga

SEQ ID NO: 786545 - DNA, 25 bp, Mus musculus
tatcgctgctcgtctaccaggagga

SEQ ID NO: 786546 - DNA, 25 bp, Mus musculus
tatcgctgctgtccagcatgctttt

SEQ ID NO: 786547 - DNA, 25 bp, Mus musculus
tatcgctgctgtgcagcatgctttt

SEQ ID NO: 786548 - DNA, 25 bp, Mus musculus
tatcgctggaccacggatcgcaaag

SEQ ID NO: 786549 - DNA, 25 bp, Mus musculus
tatcgctggacctcggatcgcaaag

SEQ ID NO: 786550 - DNA, 25 bp, Mus musculus
tatcgctgtgaactcagcgctccga

SEQ ID NO: 786551 - DNA, 25 bp, Mus musculus
tatcgctgtgaagtcagcgctccga

SEQ ID NO: 786552 - DNA, 25 bp, Mus musculus
tatcgctgtgtgaatgcttatggca

SEQ ID NO: 786553 - DNA, 25 bp, Mus musculus
tatcgctgtgtgtatgcttatggca

SEQ ID NO: 786554 - DNA, 25 bp, Mus musculus
tatcgcttccttacaaacactctta

SEQ ID NO: 786555 - DNA, 25 bp, Mus musculus
tatcgcttccttctttgcatgagat

SEQ ID NO: 786556 - DNA, 25 bp, Mus musculus
tatcgcttccttgtttgcatgagat

SEQ ID NO: 786557 - DNA, 25 bp, Mus musculus
tatcgcttcctttcaaacactctta

SEQ ID NO: 786558 - DNA, 25 bp, Mus musculus
tatcgcttctccctcatttaaggaa

SEQ ID NO: 786559 - DNA, 25 bp, Mus musculus
tatcgcttctccgtcatttaaggaa

SEQ ID NO: 786560 - DNA, 25 bp, Mus musculus
tatcgctttctaaaaaacaatccct

SEQ ID NO: 786561 - DNA, 25 bp, Mus musculus
tatcgctttctataaaacaatccct

SEQ ID NO: 786562 - DNA, 25 bp, Mus musculus
tatcggaccagcatacagagtcagg

SEQ ID NO: 786563 - DNA, 25 bp, Mus musculus
tatcggaccagcttacagagtcagg

SEQ ID NO: 786564 - DNA, 25 bp, Mus musculus
tatcggaggagcaacaatctgaagt

SEQ ID NO: 786565 - DNA, 25 bp, Mus musculus
tatcggaggagctacaatctgaagt

SEQ ID NO: 786566 - DNA, 25 bp, Mus musculus
tatcggatacccacttctcatgaag

SEQ ID NO: 786567 - DNA, 25 bp, Mus musculus
tatcggataccctcttctcatgaag

SEQ ID NO: 786568 - DNA, 25 bp, Mus musculus
tatcggatcaacattgctgtggcca

SEQ ID NO: 786569 - DNA, 25 bp, Mus musculus
tatcggatcaactttgctgtggcca

SEQ ID NO: 786570 - DNA, 25 bp, Mus musculus
tatcggcatgtaccatactcagttt

SEQ ID NO: 786571 - DNA, 25 bp, Mus musculus
tatcggcatgtagcatactcagttt

SEQ ID NO: 786572 - DNA, 25 bp, Mus musculus
tatcggccagtcaatgtaaccaagt

SEQ ID NO: 786573 - DNA, 25 bp, Mus musculus
tatcggccagtctatgtaaccaagt

SEQ ID NO: 786574 - DNA, 25 bp, Mus musculus
tatcggcccatcacagatattggtg

SEQ ID NO: 786575 - DNA, 25 bp, Mus musculus
tatcggcccatctcagatattggtg

SEQ ID NO: 786576 - DNA, 25 bp, Mus musculus
tatcggccgaatctatagatgacca

SEQ ID NO: 786577 - DNA, 25 bp, Mus musculus
tatcggccgaatgtatagatgacca

SEQ ID NO: 786578 - DNA, 25 bp, Mus musculus
tatcggctaccaattctttacctgc

SEQ ID NO: 786579 - DNA, 25 bp, Mus musculus
tatcggctaccatttctttacctgc

SEQ ID NO: 786580 - DNA, 25 bp, Mus musculus
tatcggctctgaatggaggtaacca

SEQ ID NO: 786581 - DNA, 25 bp, Mus musculus
tatcggctctgattggaggtaacca

SEQ ID NO: 786582 - DNA, 25 bp, Mus musculus
tatcggctgaaaacggaacccgcaa

SEQ ID NO: 786583 - DNA, 25 bp, Mus musculus
tatcggctgaaactgtgtggccacc

SEQ ID NO: 786584 - DNA, 25 bp, Mus musculus
tatcggctgaaagtgtgtggccacc

SEQ ID NO: 786585 - DNA, 25 bp, Mus musculus
tatcggctgaaatcggaacccgcaa

SEQ ID NO: 786586 - DNA, 25 bp, Mus musculus
tatcggctgctgctactgtagaaga

SEQ ID NO: 786587 - DNA, 25 bp, Mus musculus
tatcggctgctggtactgtagaaga

SEQ ID NO: 786588 - DNA, 25 bp, Mus musculus
tatcgggcccacatatggctcctga

SEQ ID NO: 786589 - DNA, 25 bp, Mus musculus
tatcgggcccacttatggctcctga

SEQ ID NO: 786590 - DNA, 25 bp, Mus musculus
tatcggggtcatagccaatgatatg

SEQ ID NO: 786591 - DNA, 25 bp, Mus musculus
tatcggggtcattgccaatgatatg

SEQ ID NO: 786592 - DNA, 25 bp, Mus musculus
tatcgggttcataccggagaaaagc

SEQ ID NO: 786593 - DNA, 25 bp, Mus musculus
tatcgggttcattccggagaaaagc

SEQ ID NO: 786594 - DNA, 25 bp, Mus musculus
tatcggtaccagcagaagccaggct

SEQ ID NO: 786595 - DNA, 25 bp, Mus musculus
tatcggtaccaggagaagccaggct

SEQ ID NO: 786596 - DNA, 25 bp, Mus musculus
tatcggtgcattcgccttaggcata

SEQ ID NO: 786597 - DNA, 25 bp, Mus musculus
tatcggtgcattggccttaggcata

SEQ ID NO: 786598 - DNA, 25 bp, Mus musculus
tatcggtgtctcagtatccttaaac

SEQ ID NO: 786599 - DNA, 25 bp, Mus musculus
tatcggtgtctctgtatccttaaac

SEQ ID NO: 786600 - DNA, 25 bp, Mus musculus
tatcggttaacaaggtctcctcctt

SEQ ID NO: 786601 - DNA, 25 bp, Mus musculus
tatcggttaacatggtctcctcctt

SEQ ID NO: 786602 - DNA, 25 bp, Mus musculus
tatcggttttctacacagtggtcac

SEQ ID NO: 786603 - DNA, 25 bp, Mus musculus
tatcggttttcttcacagtggtcac

SEQ ID NO: 786604 - DNA, 25 bp, Mus musculus
tatcgtaacctgaagtgccaactct

SEQ ID NO: 786605 - DNA, 25 bp, Mus musculus
tatcgtaacctgtagtgccaactct

SEQ ID NO: 786606 - DNA, 25 bp, Mus musculus
tatcgtatcccccatgaagttaatt

SEQ ID NO: 786607 - DNA, 25 bp, Mus musculus
tatcgtatccccgatgaagttaatt

SEQ ID NO: 786608 - DNA, 25 bp, Mus musculus
tatcgtatctgtatgtcccggtgta

SEQ ID NO: 786609 - DNA, 25 bp, Mus musculus
tatcgtatctgtttgtcccggtgta

SEQ ID NO: 786610 - DNA, 25 bp, Mus musculus
tatcgtcagcctccatcaccagaga

SEQ ID NO: 786611 - DNA, 25 bp, Mus musculus
tatcgtcagcctgcatcaccagaga

SEQ ID NO: 786612 - DNA, 25 bp, Mus musculus
tatcgtcagttcatccttgctacat

SEQ ID NO: 786613 - DNA, 25 bp, Mus musculus
tatcgtcagttcttccttgctacat

SEQ ID NO: 786614 - DNA, 25 bp, Mus musculus
tatcgtccaccaccttatatatgaa

SEQ ID NO: 786615 - DNA, 25 bp, Mus musculus
tatcgtccaccagcttatatatgaa

SEQ ID NO: 786616 - DNA, 25 bp, Mus musculus
tatcgtcccaggatagttaacactt

SEQ ID NO: 786617 - DNA, 25 bp, Mus musculus
tatcgtcccaggttagttaacactt

SEQ ID NO: 786618 - DNA, 25 bp, Mus musculus
tatcgtcgcctaactggtgactcgg

SEQ ID NO: 786619 - DNA, 25 bp, Mus musculus
tatcgtcgcctatctggtgactcgg

SEQ ID NO: 786620 - DNA, 25 bp, Mus musculus
tatcgtctgcatcagcgcctggtag

SEQ ID NO: 786621 - DNA, 25 bp, Mus musculus
tatcgtctgcatgagcgcctggtag

SEQ ID NO: 786622 - DNA, 25 bp, Mus musculus
tatcgtctgtgtcggagcttgctga

SEQ ID NO: 786623 - DNA, 25 bp, Mus musculus
tatcgtctgtgtgggagcttgctga

SEQ ID NO: 786624 - DNA, 25 bp, Mus musculus
tatcgtctgttcactcactttatac

SEQ ID NO: 786625 - DNA, 25 bp, Mus musculus
tatcgtctgttctctcactttatac

SEQ ID NO: 786626 - DNA, 25 bp, Mus musculus
tatcgtgcagttcttggagcagcaa

SEQ ID NO: 786627 - DNA, 25 bp, Mus musculus
tatcgtgcagttgttggagcagcaa

SEQ ID NO: 786628 - DNA, 25 bp, Mus musculus
tatcgtgcgtacaatggagccttta

SEQ ID NO: 786629 - DNA, 25 bp, Mus musculus
tatcgtgcgtactatggagccttta

SEQ ID NO: 786630 - DNA, 25 bp, Mus musculus
tatcgtggagggaatcagctattgc

SEQ ID NO: 786631 - DNA, 25 bp, Mus musculus
tatcgtggagggtatcagctattgc

SEQ ID NO: 786632 - DNA, 25 bp, Mus musculus
tatcgtggagtcctctcaaaacagg

SEQ ID NO: 786633 - DNA, 25 bp, Mus musculus
tatcgtggagtcgtctcaaaacagg

SEQ ID NO: 786634 - DNA, 25 bp, Mus musculus
tatcgtgggctacacttacaagagg

SEQ ID NO: 786635 - DNA, 25 bp, Mus musculus
tatcgtgggctagacttacaagagg

SEQ ID NO: 786636 - DNA, 25 bp, Mus musculus
tatcgtgggctccatcagggcagaa

SEQ ID NO: 786637 - DNA, 25 bp, Mus musculus
tatcgtgggctcgatcagggcagaa

SEQ ID NO: 786638 - DNA, 25 bp, Mus musculus
tatcgtggtgtacctgcaagtggat

SEQ ID NO: 786639 - DNA, 25 bp, Mus musculus
tatcgtggtgtagctgcaagtggat

SEQ ID NO: 786640 - DNA, 25 bp, Mus musculus
tatcgtgtccgtctaccatattgta

SEQ ID NO: 786641 - DNA, 25 bp, Mus musculus
tatcgtgtccgtgtaccatattgta

SEQ ID NO: 786642 - DNA, 25 bp, Mus musculus
tatcgtgtgagcattctggtcagtt

SEQ ID NO: 786643 - DNA, 25 bp, Mus musculus
tatcgtgtgagctttctggtcagtt

SEQ ID NO: 786644 - DNA, 25 bp, Mus musculus
tatcgtgtttacaaaggtggttcaa

SEQ ID NO: 786645 - DNA, 25 bp, Mus musculus
tatcgtgtttactaaggtggttcaa

SEQ ID NO: 786646 - DNA, 25 bp, Mus musculus
tatcgttcatccaaccctttgtcca

SEQ ID NO: 786647 - DNA, 25 bp, Mus musculus
tatcgttcatcctaccctttgtcca

SEQ ID NO: 786648 - DNA, 25 bp, Mus musculus
tatcgttgcccaaggatctcataaa

SEQ ID NO: 786649 - DNA, 25 bp, Mus musculus
tatcgttgcccatggatctcataaa

SEQ ID NO: 786650 - DNA, 25 bp, Mus musculus
tatcgtttttgtacagctgactgca

SEQ ID NO: 786651 - DNA, 25 bp, Mus musculus
tatcgtttttgttcagctgactgca

SEQ ID NO: 786652 - DNA, 25 bp, Mus musculus
tatctaaatagcctttccaccctgt

SEQ ID NO: 786653 - DNA, 25 bp, Mus musculus
tatctaaatagcgtttccaccctgt

SEQ ID NO: 786654 - DNA, 25 bp, Mus musculus
tatctaaatgtactaccgtcacccc

SEQ ID NO: 786655 - DNA, 25 bp, Mus musculus
tatctaaatgtagtaccgtcacccc

SEQ ID NO: 786656 - DNA, 25 bp, Mus musculus
tatctaagcactcagtggttgcctg

SEQ ID NO: 786657 - DNA, 25 bp, Mus musculus
tatctaagcactgagtggttgcctg

SEQ ID NO: 786658 - DNA, 25 bp, Mus musculus
tatctaagggctataataatgtgta

SEQ ID NO: 786659 - DNA, 25 bp, Mus musculus
tatctaagggctttaataatgtgta

SEQ ID NO: 786660 - DNA, 25 bp, Mus musculus
tatctaagtggaagcctcctaggcc

SEQ ID NO: 786661 - DNA, 25 bp, Mus musculus
tatctaagtggatgcctcctaggcc

SEQ ID NO: 786662 - DNA, 25 bp, Mus musculus
tatctaatcactctcaaaactgcta

SEQ ID NO: 786663 - DNA, 25 bp, Mus musculus
tatctaatcactgtcaaaactgcta

SEQ ID NO: 786664 - DNA, 25 bp, Mus musculus
tatctaatcaggaaactatcttgag

SEQ ID NO: 786665 - DNA, 25 bp, Mus musculus
tatctaatcaggtaactatcttgag

SEQ ID NO: 786666 - DNA, 25 bp, Mus musculus
tatctaatcccaaatagtcaacatt

SEQ ID NO: 786667 - DNA, 25 bp, Mus musculus
tatctaatcccatatagtcaacatt

SEQ ID NO: 786668 - DNA, 25 bp, Mus musculus
tatctaatgattcccctgaccgtgg

SEQ ID NO: 786669 - DNA, 25 bp, Mus musculus
tatctaatgattgccctgaccgtgg

SEQ ID NO: 786670 - DNA, 25 bp, Mus musculus
tatctacaagttcatgcacttaggg

SEQ ID NO: 786671 - DNA, 25 bp, Mus musculus
tatctacaagttgatgcacttaggg

SEQ ID NO: 786672 - DNA, 25 bp, Mus musculus
tatctacaatcaacccggctgggaa

SEQ ID NO: 786673 - DNA, 25 bp, Mus musculus
tatctacaatcatcccggctgggaa

SEQ ID NO: 786674 - DNA, 25 bp, Mus musculus
tatctacaccaaagtcatctcttca

SEQ ID NO: 786675 - DNA, 25 bp, Mus musculus
tatctacaccaatgtcatctcttca

SEQ ID NO: 786676 - DNA, 25 bp, Mus musculus
tatctacagattaacctccacaggc

SEQ ID NO: 786677 - DNA, 25 bp, Mus musculus
tatctacagatttacctccacaggc

SEQ ID NO: 786678 - DNA, 25 bp, Mus musculus
tatctacatatcaaacacttcccct

SEQ ID NO: 786679 - DNA, 25 bp, Mus musculus
tatctacatatctaacacttcccct

SEQ ID NO: 786680 - DNA, 25 bp, Mus musculus
tatctacatgtacaggcttctctga

SEQ ID NO: 786681 - DNA, 25 bp, Mus musculus
tatctacatgtagaggcttctctga

SEQ ID NO: 786682 - DNA, 25 bp, Mus musculus
tatctaccacccagactttcaaaga

SEQ ID NO: 786683 - DNA, 25 bp, Mus musculus
tatctaccacccatccaactgttat

SEQ ID NO: 786684 - DNA, 25 bp, Mus musculus
tatctaccaccctgactttcaaaga

SEQ ID NO: 786685 - DNA, 25 bp, Mus musculus
tatctaccacccttccaactgttat

SEQ ID NO: 786686 - DNA, 25 bp, Mus musculus
tatctaccacttagtcttcaccaat

SEQ ID NO: 786687 - DNA, 25 bp, Mus musculus
tatctaccactttgtcttcaccaat

SEQ ID NO: 786688 - DNA, 25 bp, Mus musculus
tatctaccctggctgagaggcaaag

SEQ ID NO: 786689 - DNA, 25 bp, Mus musculus
tatctaccctgggtgagaggcaaag

SEQ ID NO: 786690 - DNA, 25 bp, Mus musculus
tatctacctgtcagcgtgcctgcca

SEQ ID NO: 786691 - DNA, 25 bp, Mus musculus
tatctacctgtctgcgtgcctgcca

SEQ ID NO: 786692 - DNA, 25 bp, Mus musculus
tatctaccttgacttccccaaaatg

SEQ ID NO: 786693 - DNA, 25 bp, Mus musculus
tatctaccttgagttccccaaaatg

SEQ ID NO: 786694 - DNA, 25 bp, Mus musculus
tatctacgagggagatctcggcctg

SEQ ID NO: 786695 - DNA, 25 bp, Mus musculus
tatctacgagggtgatctcggcctg

SEQ ID NO: 786696 - DNA, 25 bp, Mus musculus
tatctactctgaccctggttctcaa

SEQ ID NO: 786697 - DNA, 25 bp, Mus musculus
tatctactctgagcctggttctcaa

SEQ ID NO: 786698 - DNA, 25 bp, Mus musculus
tatctacttaatccagattgcctgg

SEQ ID NO: 786699 - DNA, 25 bp, Mus musculus
tatctacttaatgcagattgcctgg

SEQ ID NO: 786700 - DNA, 25 bp, Mus musculus
tatctacttcccaggatctcattat

SEQ ID NO: 786701 - DNA, 25 bp, Mus musculus
tatctacttccctggatctcattat

SEQ ID NO: 786702 - DNA, 25 bp, Mus musculus
tatctacttggacttcatttctgtg

SEQ ID NO: 786703 - DNA, 25 bp, Mus musculus
tatctacttggagttcatttctgtg

SEQ ID NO: 786704 - DNA, 25 bp, Mus musculus
tatctactttcaacccagttctacc

SEQ ID NO: 786705 - DNA, 25 bp, Mus musculus
tatctactttcatcccagttctacc

SEQ ID NO: 786706 - DNA, 25 bp, Mus musculus
tatctactttcccaaggtgctgaaa

SEQ ID NO: 786707 - DNA, 25 bp, Mus musculus
tatctactttccgaaggtgctgaaa

SEQ ID NO: 786708 - DNA, 25 bp, Mus musculus
tatctagaacttctgctgtcagggc

SEQ ID NO: 786709 - DNA, 25 bp, Mus musculus
tatctagaacttgtgctgtcagggc

SEQ ID NO: 786710 - DNA, 25 bp, Mus musculus
tatctagaagtcacaactctggtca

SEQ ID NO: 786711 - DNA, 25 bp, Mus musculus
tatctagaagtctcaactctggtca

SEQ ID NO: 786712 - DNA, 25 bp, Mus musculus
tatctagatttaaacagtgtcccct

SEQ ID NO: 786713 - DNA, 25 bp, Mus musculus
tatctagatttatacagtgtcccct

SEQ ID NO: 786714 - DNA, 25 bp, Mus musculus
tatctagcacagaacatgacacata

SEQ ID NO: 786715 - DNA, 25 bp, Mus musculus
tatctagcacagtacatgacacata

SEQ ID NO: 786716 - DNA, 25 bp, Mus musculus
tatctagccggcctgcacttagcag

SEQ ID NO: 786717 - DNA, 25 bp, Mus musculus
tatctagccggcgtgcacttagcag

SEQ ID NO: 786718 - DNA, 25 bp, Mus musculus
tatctagccgttcgcttgggcgtcg

SEQ ID NO: 786719 - DNA, 25 bp, Mus musculus
tatctagccgttggcttgggcgtcg

SEQ ID NO: 786720 - DNA, 25 bp, Mus musculus
tatctagcctgtcgcgtgagctgca

SEQ ID NO: 786721 - DNA, 25 bp, Mus musculus
tatctagcctgtggcgtgagctgca

SEQ ID NO: 786722 - DNA, 25 bp, Mus musculus
tatctaggattacccagttctctgt

SEQ ID NO: 786723 - DNA, 25 bp, Mus musculus
tatctaggattagccagttctctgt

SEQ ID NO: 786724 - DNA, 25 bp, Mus musculus
tatctagggaagacatgcctctgag

SEQ ID NO: 786725 - DNA, 25 bp, Mus musculus
tatctagggaagtcatgcctctgag

SEQ ID NO: 786726 - DNA, 25 bp, Mus musculus
tatctagtgaagcttgctgtggcca

SEQ ID NO: 786727 - DNA, 25 bp, Mus musculus
tatctagtgaaggttgctgtggcca

SEQ ID NO: 786728 - DNA, 25 bp, Mus musculus
tatctatacattatcccaaggtggc

SEQ ID NO: 786729 - DNA, 25 bp, Mus musculus
tatctatacattttcccaaggtggc

SEQ ID NO: 786730 - DNA, 25 bp, Mus musculus
tatctatagcagagcgggacgcagc

SEQ ID NO: 786731 - DNA, 25 bp, Mus musculus
tatctatagcagtgcgggacgcagc

SEQ ID NO: 786732 - DNA, 25 bp, Mus musculus
tatctatagctaagtggatggccat

SEQ ID NO: 786733 - DNA, 25 bp, Mus musculus
tatctatagctatgtggatggccat

SEQ ID NO: 786734 - DNA, 25 bp, Mus musculus
tatctatcagcaactccgcatggag

SEQ ID NO: 786735 - DNA, 25 bp, Mus musculus
tatctatcagcatctccgcatggag

SEQ ID NO: 786736 - DNA, 25 bp, Mus musculus
tatctatcagttctgaccgtatggc

SEQ ID NO: 786737 - DNA, 25 bp, Mus musculus
tatctatcagttgtgaccgtatggc

SEQ ID NO: 786738 - DNA, 25 bp, Mus musculus
tatctatccattagcttctgagtgc

SEQ ID NO: 786739 - DNA, 25 bp, Mus musculus
tatctatccatttgcttctgagtgc

SEQ ID NO: 786740 - DNA, 25 bp, Mus musculus
tatctatcggctccaacagcttcgt

SEQ ID NO: 786741 - DNA, 25 bp, Mus musculus
tatctatcggctgcaacagcttcgt

SEQ ID NO: 786742 - DNA, 25 bp, Mus musculus
tatctatctacacagcaggagagaa

SEQ ID NO: 786743 - DNA, 25 bp, Mus musculus
tatctatctacagagcaggagagaa

SEQ ID NO: 786744 - DNA, 25 bp, Mus musculus
tatctatctactagtctacccagag

SEQ ID NO: 786745 - DNA, 25 bp, Mus musculus
tatctatctacttgtctacccagag

SEQ ID NO: 786746 - DNA, 25 bp, Mus musculus
tatctatctataagctcctcttttc

SEQ ID NO: 786747 - DNA, 25 bp, Mus musculus
tatctatctatatgctcctcttttc

SEQ ID NO: 786748 - DNA, 25 bp, Mus musculus
tatctatctccaccatcagggtcac

SEQ ID NO: 786749 - DNA, 25 bp, Mus musculus
tatctatctccagcatcagggtcac

SEQ ID NO: 786750 - DNA, 25 bp, Mus musculus
tatctatctcccacatacttctgag

SEQ ID NO: 786751 - DNA, 25 bp, Mus musculus
tatctatctccctcatacttctgag

SEQ ID NO: 786752 - DNA, 25 bp, Mus musculus
tatctatctctcagtgcctgtgtgt

SEQ ID NO: 786753 - DNA, 25 bp, Mus musculus
tatctatctctctgtgcctgtgtgt

SEQ ID NO: 786754 - DNA, 25 bp, Mus musculus
tatctatctctgatagtgggctcct

SEQ ID NO: 786755 - DNA, 25 bp, Mus musculus
tatctatctctgttagtgggctcct

SEQ ID NO: 786756 - DNA, 25 bp, Mus musculus
tatctatctgcaagttggaagtcca

SEQ ID NO: 786757 - DNA, 25 bp, Mus musculus
tatctatctgcatgttggaagtcca

SEQ ID NO: 786758 - DNA, 25 bp, Mus musculus
tatctatctgtaagggctctctcta

SEQ ID NO: 786759 - DNA, 25 bp, Mus musculus
tatctatctgtatgggctctctcta

SEQ ID NO: 786760 - DNA, 25 bp, Mus musculus
tatctatctttaaccagcccgagta

SEQ ID NO: 786761 - DNA, 25 bp, Mus musculus
tatctatctttatccagcccgagta

SEQ ID NO: 786762 - DNA, 25 bp, Mus musculus
tatctatgacgtcaccctgaacttc

SEQ ID NO: 786763 - DNA, 25 bp, Mus musculus
tatctatgacgtgaccctgaacttc

SEQ ID NO: 786764 - DNA, 25 bp, Mus musculus
tatctatgatgtctgggtcagccat

SEQ ID NO: 786765 - DNA, 25 bp, Mus musculus
tatctatgatgtgtgggtcagccat

SEQ ID NO: 786766 - DNA, 25 bp, Mus musculus
tatctatgcctgcatctgacagaaa

SEQ ID NO: 786767 - DNA, 25 bp, Mus musculus
tatctatgcctggatctgacagaaa

SEQ ID NO: 786768 - DNA, 25 bp, Mus musculus
tatctatgtaaacttcccaggagga

SEQ ID NO: 786769 - DNA, 25 bp, Mus musculus
tatctatgtaaagttcccaggagga

SEQ ID NO: 786770 - DNA, 25 bp, Mus musculus
tatctattggaaagacacgttctag

SEQ ID NO: 786771 - DNA, 25 bp, Mus musculus
tatctattggaatgacacgttctag

SEQ ID NO: 786772 - DNA, 25 bp, Mus musculus
tatctatttatgatctctggagggt

SEQ ID NO: 786773 - DNA, 25 bp, Mus musculus
tatctatttatgatgctaacccact

SEQ ID NO: 786774 - DNA, 25 bp, Mus musculus
tatctatttatgttctctggagggt

SEQ ID NO: 786775 - DNA, 25 bp, Mus musculus
tatctatttatgttgctaacccact

SEQ ID NO: 786776 - DNA, 25 bp, Mus musculus
tatctcaaaaaacaaggcgaaccag

SEQ ID NO: 786777 - DNA, 25 bp, Mus musculus
tatctcaaaaaagaaggcgaaccag

SEQ ID NO: 786778 - DNA, 25 bp, Mus musculus
tatctcaaatgaccagtttctttct

SEQ ID NO: 786779 - DNA, 25 bp, Mus musculus
tatctcaaatgagcagtttctttct

SEQ ID NO: 786780 - DNA, 25 bp, Mus musculus
tatctcaacacgaggtagttcaaac

SEQ ID NO: 786781 - DNA, 25 bp, Mus musculus
tatctcaacacgtggtagttcaaac

SEQ ID NO: 786782 - DNA, 25 bp, Mus musculus
tatctcaacggcctcggcaattgtt

SEQ ID NO: 786783 - DNA, 25 bp, Mus musculus
tatctcaacggcgtcggcaattgtt

SEQ ID NO: 786784 - DNA, 25 bp, Mus musculus
tatctcaataaaccctcatggattt

SEQ ID NO: 786785 - DNA, 25 bp, Mus musculus
tatctcaataaagcctcatggattt

SEQ ID NO: 786786 - DNA, 25 bp, Mus musculus
tatctcaatgaaacccctcggttac

SEQ ID NO: 786787 - DNA, 25 bp, Mus musculus
tatctcaatgaatcccctcggttac

SEQ ID NO: 786788 - DNA, 25 bp, Mus musculus
tatctcaatgctactgccaagggcc

SEQ ID NO: 786789 - DNA, 25 bp, Mus musculus
tatctcaatgcttctgccaagggcc

SEQ ID NO: 786790 - DNA, 25 bp, Mus musculus
tatctcacaatcaacgtattcctgc

SEQ ID NO: 786791 - DNA, 25 bp, Mus musculus
tatctcacaatctacgtattcctgc

SEQ ID NO: 786792 - DNA, 25 bp, Mus musculus
tatctcacaccacagctttcagagc

SEQ ID NO: 786793 - DNA, 25 bp, Mus musculus
tatctcacaccagagctttcagagc

SEQ ID NO: 786794 - DNA, 25 bp, Mus musculus
tatctcaccactaaggagactgagg

SEQ ID NO: 786795 - DNA, 25 bp, Mus musculus
tatctcaccacttaggagactgagg

SEQ ID NO: 786796 - DNA, 25 bp, Mus musculus
tatctcaccagcaagggaaccagag

SEQ ID NO: 786797 - DNA, 25 bp, Mus musculus
tatctcaccagctagggaaccagag

SEQ ID NO: 786798 - DNA, 25 bp, Mus musculus
tatctcaccgttaatggatttcctt

SEQ ID NO: 786799 - DNA, 25 bp, Mus musculus
tatctcaccgtttatggatttcctt

SEQ ID NO: 786800 - DNA, 25 bp, Mus musculus
tatctcacctatcttctggtatctg

SEQ ID NO: 786801 - DNA, 25 bp, Mus musculus
tatctcacctatgttctggtatctg

SEQ ID NO: 786802 - DNA, 25 bp, Mus musculus
tatctcacgctgactagctctgggt

SEQ ID NO: 786803 - DNA, 25 bp, Mus musculus
tatctcacgctgtctagctctgggt

SEQ ID NO: 786804 - DNA, 25 bp, Mus musculus
tatctcactgacaagatttgtttca

SEQ ID NO: 786805 - DNA, 25 bp, Mus musculus
tatctcactgactagatttgtttca

SEQ ID NO: 786806 - DNA, 25 bp, Mus musculus
tatctcactgcactgactttggcgt

SEQ ID NO: 786807 - DNA, 25 bp, Mus musculus
tatctcactgcagtgactttggcgt

SEQ ID NO: 786808 - DNA, 25 bp, Mus musculus
tatctcacttagctcctcaccatgg

SEQ ID NO: 786809 - DNA, 25 bp, Mus musculus
tatctcacttaggtcctcaccatgg

SEQ ID NO: 786810 - DNA, 25 bp, Mus musculus
tatctcagaccaacactacaatgct

SEQ ID NO: 786811 - DNA, 25 bp, Mus musculus
tatctcagaccatcactacaatgct

SEQ ID NO: 786812 - DNA, 25 bp, Mus musculus
tatctcagagagcacgtgcgaattc

SEQ ID NO: 786813 - DNA, 25 bp, Mus musculus
tatctcagagaggacgtgcgaattc

SEQ ID NO: 786814 - DNA, 25 bp, Mus musculus
tatctcagagttagacatcaggcca

SEQ ID NO: 786815 - DNA, 25 bp, Mus musculus
tatctcagagtttgacatcaggcca

SEQ ID NO: 786816 - DNA, 25 bp, Mus musculus
tatctcagctcactgtcgcttgcac

SEQ ID NO: 786817 - DNA, 25 bp, Mus musculus
tatctcagctcagtgtcgcttgcac

SEQ ID NO: 786818 - DNA, 25 bp, Mus musculus
tatctcagctgtcgatgtggcccta

SEQ ID NO: 786819 - DNA, 25 bp, Mus musculus
tatctcagctgtggatgtggcccta

SEQ ID NO: 786820 - DNA, 25 bp, Mus musculus
tatctcagtcctatcctcggtgtga

SEQ ID NO: 786821 - DNA, 25 bp, Mus musculus
tatctcagtcctttcctcggtgtga

SEQ ID NO: 786822 - DNA, 25 bp, Mus musculus
tatctcagtgctcggtttcagtatt

SEQ ID NO: 786823 - DNA, 25 bp, Mus musculus
tatctcagtgctgggtttcagtatt

SEQ ID NO: 786824 - DNA, 25 bp, Mus musculus
tatctcagttggagaagttactagc

SEQ ID NO: 786825 - DNA, 25 bp, Mus musculus
tatctcagttggtgaagttactagc

SEQ ID NO: 786826 - DNA, 25 bp, Mus musculus
tatctcatatgcacagaggcctgac

SEQ ID NO: 786827 - DNA, 25 bp, Mus musculus
tatctcatatgctcagaggcctgac

SEQ ID NO: 786828 - DNA, 25 bp, Mus musculus
tatctcatcattccatctctaaatg

SEQ ID NO: 786829 - DNA, 25 bp, Mus musculus
tatctcatcattgcatctctaaatg

SEQ ID NO: 786830 - DNA, 25 bp, Mus musculus
tatctcatcgatacactcccaaaga

SEQ ID NO: 786831 - DNA, 25 bp, Mus musculus
tatctcatcgattcactcccaaaga

SEQ ID NO: 786832 - DNA, 25 bp, Mus musculus
tatctcatgggacacagtcactcat

SEQ ID NO: 786833 - DNA, 25 bp, Mus musculus
tatctcatgggagacagtcactcat

SEQ ID NO: 786834 - DNA, 25 bp, Mus musculus
tatctcatgtggatgagtcctatga

SEQ ID NO: 786835 - DNA, 25 bp, Mus musculus
tatctcatgtggttgagtcctatga

SEQ ID NO: 786836 - DNA, 25 bp, Mus musculus
tatctcattcataactcagtgcctg

SEQ ID NO: 786837 - DNA, 25 bp, Mus musculus
tatctcattcattactcagtgcctg

SEQ ID NO: 786838 - DNA, 25 bp, Mus musculus
tatctcattcccagtgaaccattat

SEQ ID NO: 786839 - DNA, 25 bp, Mus musculus
tatctcattccccaaccttatttgg

SEQ ID NO: 786840 - DNA, 25 bp, Mus musculus
tatctcattcccgaaccttatttgg

SEQ ID NO: 786841 - DNA, 25 bp, Mus musculus
tatctcattccctgtgaaccattat

SEQ ID NO: 786842 - DNA, 25 bp, Mus musculus
tatctcattctcctgatagctggga

SEQ ID NO: 786843 - DNA, 25 bp, Mus musculus
tatctcattctcgtgatagctggga

SEQ ID NO: 786844 - DNA, 25 bp, Mus musculus
tatctcattgataccttctctaaaa

SEQ ID NO: 786845 - DNA, 25 bp, Mus musculus
tatctcattgattccttctctaaaa

SEQ ID NO: 786846 - DNA, 25 bp, Mus musculus
tatctccacacaactttcttagtct

SEQ ID NO: 786847 - DNA, 25 bp, Mus musculus
tatctccacacatctttcttagtct

SEQ ID NO: 786848 - DNA, 25 bp, Mus musculus
tatctccacagtccagatgcaaagc

SEQ ID NO: 786849 - DNA, 25 bp, Mus musculus
tatctccacagtgcagatgcaaagc

SEQ ID NO: 786850 - DNA, 25 bp, Mus musculus
tatctccaccttcacttttcttttt

SEQ ID NO: 786851 - DNA, 25 bp, Mus musculus
tatctccaccttgacttttcttttt

SEQ ID NO: 786852 - DNA, 25 bp, Mus musculus
tatctccagaacactttggcatcca

SEQ ID NO: 786853 - DNA, 25 bp, Mus musculus
tatctccagaactctttggcatcca

SEQ ID NO: 786854 - DNA, 25 bp, Mus musculus
tatctccagctgattaaaatggtaa

SEQ ID NO: 786855 - DNA, 25 bp, Mus musculus
tatctccagctgtttaaaatggtaa

SEQ ID NO: 786856 - DNA, 25 bp, Mus musculus
tatctccatcccagattttgaatct

SEQ ID NO: 786857 - DNA, 25 bp, Mus musculus
tatctccatccctgattttgaatct

SEQ ID NO: 786858 - DNA, 25 bp, Mus musculus
tatctccattcacctcaggcatgta

SEQ ID NO: 786859 - DNA, 25 bp, Mus musculus
tatctccattcagctcaggcatgta

SEQ ID NO: 786860 - DNA, 25 bp, Mus musculus
tatctcccaaaactactgcatgctg

SEQ ID NO: 786861 - DNA, 25 bp, Mus musculus
tatctcccaaaagtactgcatgctg

SEQ ID NO: 786862 - DNA, 25 bp, Mus musculus
tatctcccaataaaagctatctatc

SEQ ID NO: 786863 - DNA, 25 bp, Mus musculus
tatctcccaatataagctatctatc

SEQ ID NO: 786864 - DNA, 25 bp, Mus musculus
tatctcccagtgcttgacagttgtg

SEQ ID NO: 786865 - DNA, 25 bp, Mus musculus
tatctcccagtggttgacagttgtg

SEQ ID NO: 786866 - DNA, 25 bp, Mus musculus
tatctcccatcgcttggcttattgc

SEQ ID NO: 786867 - DNA, 25 bp, Mus musculus
tatctcccatcggttggcttattgc

SEQ ID NO: 786868 - DNA, 25 bp, Mus musculus
tatctcccctacagtttgactttaa

SEQ ID NO: 786869 - DNA, 25 bp, Mus musculus
tatctcccctactgtttgactttaa

SEQ ID NO: 786870 - DNA, 25 bp, Mus musculus
tatctcccctggactgatctgaagt

SEQ ID NO: 786871 - DNA, 25 bp, Mus musculus
tatctcccctggtctgatctgaagt

SEQ ID NO: 786872 - DNA, 25 bp, Mus musculus
tatctcccgagaatcttaagtactt

SEQ ID NO: 786873 - DNA, 25 bp, Mus musculus
tatctcccgagattcttaagtactt

SEQ ID NO: 786874 - DNA, 25 bp, Mus musculus
tatctcccgatacctagcaaacaaa

SEQ ID NO: 786875 - DNA, 25 bp, Mus musculus
tatctcccgatagctagcaaacaaa

SEQ ID NO: 786876 - DNA, 25 bp, Mus musculus
tatctccctattagttacctctcaa

SEQ ID NO: 786877 - DNA, 25 bp, Mus musculus
tatctccctatttgttacctctcaa

SEQ ID NO: 786878 - DNA, 25 bp, Mus musculus
tatctccctgcgagtcctgaagacc

SEQ ID NO: 786879 - DNA, 25 bp, Mus musculus
tatctccctgcgtgtcctgaagacc

SEQ ID NO: 786880 - DNA, 25 bp, Mus musculus
tatctccctgtcattcttagcaaac

SEQ ID NO: 786881 - DNA, 25 bp, Mus musculus
tatctccctgtccaagttctaggtg

SEQ ID NO: 786882 - DNA, 25 bp, Mus musculus
tatctccctgtcgaagttctaggtg

SEQ ID NO: 786883 - DNA, 25 bp, Mus musculus
tatctccctgtctttcttagcaaac

SEQ ID NO: 786884 - DNA, 25 bp, Mus musculus
tatctccgagacctaacctcagctg

SEQ ID NO: 786885 - DNA, 25 bp, Mus musculus
tatctccgagacgtaacctcagctg

SEQ ID NO: 786886 - DNA, 25 bp, Mus musculus
tatctccgccagagggtggtcagga

SEQ ID NO: 786887 - DNA, 25 bp, Mus musculus
tatctccgccagtgggtggtcagga

SEQ ID NO: 786888 - DNA, 25 bp, Mus musculus
tatctccgccgtcgtgatgtcctat

SEQ ID NO: 786889 - DNA, 25 bp, Mus musculus
tatctccgccgtggtgatgtcctat

SEQ ID NO: 786890 - DNA, 25 bp, Mus musculus
tatctccggataaaccaacactggg

SEQ ID NO: 786891 - DNA, 25 bp, Mus musculus
tatctccggatataccaacactggg

SEQ ID NO: 786892 - DNA, 25 bp, Mus musculus
tatctccggattagtttgtataccc

SEQ ID NO: 786893 - DNA, 25 bp, Mus musculus
tatctccggatttgtttgtataccc

SEQ ID NO: 786894 - DNA, 25 bp, Mus musculus
tatctcctaaagatggaaggcctct

SEQ ID NO: 786895 - DNA, 25 bp, Mus musculus
tatctcctaaagttggaaggcctct

SEQ ID NO: 786896 - DNA, 25 bp, Mus musculus
tatctcctaaggaccattctagtaa

SEQ ID NO: 786897 - DNA, 25 bp, Mus musculus
tatctcctaaggtccattctagtaa

SEQ ID NO: 786898 - DNA, 25 bp, Mus musculus
tatctcctagatccaagctgacaac

SEQ ID NO: 786899 - DNA, 25 bp, Mus musculus
tatctcctagatgcaagctgacaac

SEQ ID NO: 786900 - DNA, 25 bp, Mus musculus
tatctcctccatagagagcccttag

SEQ ID NO: 786901 - DNA, 25 bp, Mus musculus
tatctcctccattgagagcccttag

SEQ ID NO: 786902 - DNA, 25 bp, Mus musculus
tatctcctccctcccatagtgtaat

SEQ ID NO: 786903 - DNA, 25 bp, Mus musculus
tatctcctccctgccatagtgtaat

SEQ ID NO: 786904 - DNA, 25 bp, Mus musculus
tatctcctcgctatttgaaagttcc

SEQ ID NO: 786905 - DNA, 25 bp, Mus musculus
tatctcctcgctttttgaaagttcc

SEQ ID NO: 786906 - DNA, 25 bp, Mus musculus
tatctcctctgaatctaagctgaaa

SEQ ID NO: 786907 - DNA, 25 bp, Mus musculus
tatctcctctgattctaagctgaaa

SEQ ID NO: 786908 - DNA, 25 bp, Mus musculus
tatctcctgcgtctatcctgcatgt

SEQ ID NO: 786909 - DNA, 25 bp, Mus musculus
tatctcctgcgtgtatcctgcatgt

SEQ ID NO: 786910 - DNA, 25 bp, Mus musculus
tatctcctggaaatgcttctagctc

SEQ ID NO: 786911 - DNA, 25 bp, Mus musculus
tatctcctggaattgcttctagctc

SEQ ID NO: 786912 - DNA, 25 bp, Mus musculus
tatctcctgggtaccacaagagtgc

SEQ ID NO: 786913 - DNA, 25 bp, Mus musculus
tatctcctgggttccacaagagtgc

SEQ ID NO: 786914 - DNA, 25 bp, Mus musculus
tatctccttcacactgtacctaggg

SEQ ID NO: 786915 - DNA, 25 bp, Mus musculus
tatctccttcactctgtacctaggg

SEQ ID NO: 786916 - DNA, 25 bp, Mus musculus
tatctcctttggaggccaagaaggg

SEQ ID NO: 786917 - DNA, 25 bp, Mus musculus
tatctcctttggtggccaagaaggg

SEQ ID NO: 786918 - DNA, 25 bp, Mus musculus
tatctcgaacagaggcatcttggga

SEQ ID NO: 786919 - DNA, 25 bp, Mus musculus
tatctcgaacagtggcatcttggga

SEQ ID NO: 786920 - DNA, 25 bp, Mus musculus
tatctcgagtacacttcctgcttgc

SEQ ID NO: 786921 - DNA, 25 bp, Mus musculus
tatctcgagtactcttcctgcttgc

SEQ ID NO: 786922 - DNA, 25 bp, Mus musculus
tatctcgcttcgctagttcaaacat

SEQ ID NO: 786923 - DNA, 25 bp, Mus musculus
tatctcgcttcggtagttcaaacat

SEQ ID NO: 786924 - DNA, 25 bp, Mus musculus
tatctcggataccaggagctccctg

SEQ ID NO: 786925 - DNA, 25 bp, Mus musculus
tatctcggatacgaggagctccctg

SEQ ID NO: 786926 - DNA, 25 bp, Mus musculus
tatctcggattcattagcagttctg

SEQ ID NO: 786927 - DNA, 25 bp, Mus musculus
tatctcggattctttagcagttctg

SEQ ID NO: 786928 - DNA, 25 bp, Mus musculus
tatctcgggtgccatgccacagaag

SEQ ID NO: 786929 - DNA, 25 bp, Mus musculus
tatctcgggtgcgatgccacagaag

SEQ ID NO: 786930 - DNA, 25 bp, Mus musculus
tatctcgttttcactgctaattcct

SEQ ID NO: 786931 - DNA, 25 bp, Mus musculus
tatctcgttttcagtccatttcaag

SEQ ID NO: 786932 - DNA, 25 bp, Mus musculus
tatctcgttttctctgctaattcct

SEQ ID NO: 786933 - DNA, 25 bp, Mus musculus
tatctcgttttctgtccatttcaag

SEQ ID NO: 786934 - DNA, 25 bp, Mus musculus
tatctctaattcagcactcttattg

SEQ ID NO: 786935 - DNA, 25 bp, Mus musculus
tatctctaattctgcactcttattg

SEQ ID NO: 786936 - DNA, 25 bp, Mus musculus
tatctctacattacaagggctcttg

SEQ ID NO: 786937 - DNA, 25 bp, Mus musculus
tatctctacatttcaagggctcttg

SEQ ID NO: 786938 - DNA, 25 bp, Mus musculus
tatctctacggacacatgctctccg

SEQ ID NO: 786939 - DNA, 25 bp, Mus musculus
tatctctacggagacatgctctccg

SEQ ID NO: 786940 - DNA, 25 bp, Mus musculus
tatctctatattattgggcagcttt

SEQ ID NO: 786941 - DNA, 25 bp, Mus musculus
tatctctatatttttgggcagcttt

SEQ ID NO: 786942 - DNA, 25 bp, Mus musculus
tatctctatttcctgtctggtgttg

SEQ ID NO: 786943 - DNA, 25 bp, Mus musculus
tatctctatttcgtgtctggtgttg

SEQ ID NO: 786944 - DNA, 25 bp, Mus musculus
tatctctcaacaagctctatctgga

SEQ ID NO: 786945 - DNA, 25 bp, Mus musculus
tatctctcaacatgctctatctgga

SEQ ID NO: 786946 - DNA, 25 bp, Mus musculus
tatctctcagaaatacccctattca

SEQ ID NO: 786947 - DNA, 25 bp, Mus musculus
tatctctcagaattacccctattca

SEQ ID NO: 786948 - DNA, 25 bp, Mus musculus
tatctctcagacagcgctgtgatga

SEQ ID NO: 786949 - DNA, 25 bp, Mus musculus
tatctctcagactgcgctgtgatga

SEQ ID NO: 786950 - DNA, 25 bp, Mus musculus
tatctctcagatatagcatgcccgg

SEQ ID NO: 786951 - DNA, 25 bp, Mus musculus
tatctctcagatttagcatgcccgg

SEQ ID NO: 786952 - DNA, 25 bp, Mus musculus
tatctctccctgaatatgaggcttc

SEQ ID NO: 786953 - DNA, 25 bp, Mus musculus
tatctctccctgtatatgaggcttc

SEQ ID NO: 786954 - DNA, 25 bp, Mus musculus
tatctctccgaaaccaggactggtg

SEQ ID NO: 786955 - DNA, 25 bp, Mus musculus
tatctctccgaatccaggactggtg

SEQ ID NO: 786956 - DNA, 25 bp, Mus musculus
tatctctccgttctatccatcggac

SEQ ID NO: 786957 - DNA, 25 bp, Mus musculus
tatctctccgttgtatccatcggac

SEQ ID NO: 786958 - DNA, 25 bp, Mus musculus
tatctctccttaagatcctctacat

SEQ ID NO: 786959 - DNA, 25 bp, Mus musculus
tatctctccttatgatcctctacat

SEQ ID NO: 786960 - DNA, 25 bp, Mus musculus
tatctctctataaatttgccccagg

SEQ ID NO: 786961 - DNA, 25 bp, Mus musculus
tatctctctatatatttgccccagg

SEQ ID NO: 786962 - DNA, 25 bp, Mus musculus
tatctctctatcaatgatcctcctg

SEQ ID NO: 786963 - DNA, 25 bp, Mus musculus
tatctctctatccttttgtaccaaa

SEQ ID NO: 786964 - DNA, 25 bp, Mus musculus
tatctctctatcgttttgtaccaaa

SEQ ID NO: 786965 - DNA, 25 bp, Mus musculus
tatctctctatctatgatcctcctg

SEQ ID NO: 786966 - DNA, 25 bp, Mus musculus
tatctctctctactagaccatatag

SEQ ID NO: 786967 - DNA, 25 bp, Mus musculus
tatctctctctagtagaccatatag

SEQ ID NO: 786968 - DNA, 25 bp, Mus musculus
tatctctcttaacaatacctcaggg

SEQ ID NO: 786969 - DNA, 25 bp, Mus musculus
tatctctcttaagaatacctcaggg

SEQ ID NO: 786970 - DNA, 25 bp, Mus musculus
tatctctgagaacatagtacaccgg

SEQ ID NO: 786971 - DNA, 25 bp, Mus musculus
tatctctgagaagatagtacaccgg

SEQ ID NO: 786972 - DNA, 25 bp, Mus musculus
tatctctgcagcctggaaaaccgca

SEQ ID NO: 786973 - DNA, 25 bp, Mus musculus
tatctctgcagcgtggaaaaccgca

SEQ ID NO: 786974 - DNA, 25 bp, Mus musculus
tatctctgcaggatatgaggtcttt

SEQ ID NO: 786975 - DNA, 25 bp, Mus musculus
tatctctgcaggttatgaggtcttt

SEQ ID NO: 786976 - DNA, 25 bp, Mus musculus
tatctctgcatcacacatttctcaa

SEQ ID NO: 786977 - DNA, 25 bp, Mus musculus
tatctctgcatctcacatttctcaa

SEQ ID NO: 786978 - DNA, 25 bp, Mus musculus
tatctctgcgggaagcacggacagt

SEQ ID NO: 786979 - DNA, 25 bp, Mus musculus
tatctctgcgggtagcacggacagt

SEQ ID NO: 786980 - DNA, 25 bp, Mus musculus
tatctctgctccatctacaagactg

SEQ ID NO: 786981 - DNA, 25 bp, Mus musculus
tatctctgctccttctacaagactg

SEQ ID NO: 786982 - DNA, 25 bp, Mus musculus
tatctctggcaaaagtgtgctgaac

SEQ ID NO: 786983 - DNA, 25 bp, Mus musculus
tatctctggcaatagtgtgctgaac

SEQ ID NO: 786984 - DNA, 25 bp, Mus musculus
tatctctgggatctacatggtagga

SEQ ID NO: 786985 - DNA, 25 bp, Mus musculus
tatctctgggatgtacatggtagga

SEQ ID NO: 786986 - DNA, 25 bp, Mus musculus
tatctctgggtgagccttgggatct

SEQ ID NO: 786987 - DNA, 25 bp, Mus musculus
tatctctgggtgtgccttgggatct

SEQ ID NO: 786988 - DNA, 25 bp, Mus musculus
tatctctggtcaataataaattctg

SEQ ID NO: 786989 - DNA, 25 bp, Mus musculus
tatctctggtcactttgtggctgag

SEQ ID NO: 786990 - DNA, 25 bp, Mus musculus
tatctctggtcagtttgtggctgag

SEQ ID NO: 786991 - DNA, 25 bp, Mus musculus
tatctctggtcattaataaattctg

SEQ ID NO: 786992 - DNA, 25 bp, Mus musculus
tatctctggttaccctggctgtata

SEQ ID NO: 786993 - DNA, 25 bp, Mus musculus
tatctctggttagcctggctgtata

SEQ ID NO: 786994 - DNA, 25 bp, Mus musculus
tatctctgtctacagtgtgctgggc

SEQ ID NO: 786995 - DNA, 25 bp, Mus musculus
tatctctgtctagagtgtgctgggc

SEQ ID NO: 786996 - DNA, 25 bp, Mus musculus
tatctctgtgaaatctaggtcagtc

SEQ ID NO: 786997 - DNA, 25 bp, Mus musculus
tatctctgtgaattctaggtcagtc

SEQ ID NO: 786998 - DNA, 25 bp, Mus musculus
tatctctgtgcacacctctaaaaca

SEQ ID NO: 786999 - DNA, 25 bp, Mus musculus
tatctctgtgcagacctctaaaaca

SEQ ID NO: 787000 - DNA, 25 bp, Mus musculus
tatctctgtgctcaagtcttcttct

SEQ ID NO: 787001 - DNA, 25 bp, Mus musculus
tatctctgtgctgaagtcttcttct

SEQ ID NO: 787002 - DNA, 25 bp, Mus musculus
tatctctgttaaactttgtgctgtt

SEQ ID NO: 787003 - DNA, 25 bp, Mus musculus
tatctctgttaatctttgtgctgtt

SEQ ID NO: 787004 - DNA, 25 bp, Mus musculus
tatctcttactcaatggtaccatga

SEQ ID NO: 787005 - DNA, 25 bp, Mus musculus
tatctcttactcacaactgacctga

SEQ ID NO: 787006 - DNA, 25 bp, Mus musculus
tatctcttactctatggtaccatga

SEQ ID NO: 787007 - DNA, 25 bp, Mus musculus
tatctcttactctcaactgacctga

SEQ ID NO: 787008 - DNA, 25 bp, Mus musculus
tatctcttagacagtgtatgctttt

SEQ ID NO: 787009 - DNA, 25 bp, Mus musculus
tatctcttagactgtgtatgctttt

SEQ ID NO: 787010 - DNA, 25 bp, Mus musculus
tatctcttagcaatcacttttcctt

SEQ ID NO: 787011 - DNA, 25 bp, Mus musculus
tatctcttagcattcacttttcctt

SEQ ID NO: 787012 - DNA, 25 bp, Mus musculus
tatctcttccgaatgccttaaggag

SEQ ID NO: 787013 - DNA, 25 bp, Mus musculus
tatctcttccgattgccttaaggag

SEQ ID NO: 787014 - DNA, 25 bp, Mus musculus
tatctcttctacacttttatctcca

SEQ ID NO: 787015 - DNA, 25 bp, Mus musculus
tatctcttctactcttttatctcca

SEQ ID NO: 787016 - DNA, 25 bp, Mus musculus
tatctcttgcatatctagtctcagg

SEQ ID NO: 787017 - DNA, 25 bp, Mus musculus
tatctcttgcatttctagtctcagg

SEQ ID NO: 787018 - DNA, 25 bp, Mus musculus
tatctcttgtggaaaacaatacccc

SEQ ID NO: 787019 - DNA, 25 bp, Mus musculus
tatctcttgtggtaaacaatacccc

SEQ ID NO: 787020 - DNA, 25 bp, Mus musculus
tatctcttgttaatgctggctggac

SEQ ID NO: 787021 - DNA, 25 bp, Mus musculus
tatctcttgttattgctggctggac

SEQ ID NO: 787022 - DNA, 25 bp, Mus musculus
tatctctttacacttgtttcccagg

SEQ ID NO: 787023 - DNA, 25 bp, Mus musculus
tatctctttacagttgtttcccagg

SEQ ID NO: 787024 - DNA, 25 bp, Mus musculus
tatctctttccgagttcccatgaca

SEQ ID NO: 787025 - DNA, 25 bp, Mus musculus
tatctctttccgtgttcccatgaca

SEQ ID NO: 787026 - DNA, 25 bp, Mus musculus
tatctgaaacctagatttctccagg

SEQ ID NO: 787027 - DNA, 25 bp, Mus musculus
tatctgaaaccttgatttctccagg

SEQ ID NO: 787028 - DNA, 25 bp, Mus musculus
tatctgaaccagagtttgcactaat

SEQ ID NO: 787029 - DNA, 25 bp, Mus musculus
tatctgaaccagtgtttgcactaat

SEQ ID NO: 787030 - DNA, 25 bp, Mus musculus
tatctgaaccttctgagacccggag

SEQ ID NO: 787031 - DNA, 25 bp, Mus musculus
tatctgaaccttgtgagacccggag

SEQ ID NO: 787032 - DNA, 25 bp, Mus musculus
tatctgaagaccatgctgtgtcaaa

SEQ ID NO: 787033 - DNA, 25 bp, Mus musculus
tatctgaagaccttgctgtgtcaaa

SEQ ID NO: 787034 - DNA, 25 bp, Mus musculus
tatctgaagcatcacctgtgctccg

SEQ ID NO: 787035 - DNA, 25 bp, Mus musculus
tatctgaagcatgacctgtgctccg

SEQ ID NO: 787036 - DNA, 25 bp, Mus musculus
tatctgacagggactgctcctttct

SEQ ID NO: 787037 - DNA, 25 bp, Mus musculus
tatctgacagggtctgctcctttct

SEQ ID NO: 787038 - DNA, 25 bp, Mus musculus
tatctgacagtcacacatctcaaca

SEQ ID NO: 787039 - DNA, 25 bp, Mus musculus
tatctgacagtctcacatctcaaca

SEQ ID NO: 787040 - DNA, 25 bp, Mus musculus
tatctgaccaacatgttactgcttc

SEQ ID NO: 787041 - DNA, 25 bp, Mus musculus
tatctgaccaacttgttactgcttc

SEQ ID NO: 787042 - DNA, 25 bp, Mus musculus
tatctgaccctcataggctattacc

SEQ ID NO: 787043 - DNA, 25 bp, Mus musculus
tatctgaccctcttaggctattacc

SEQ ID NO: 787044 - DNA, 25 bp, Mus musculus
tatctgaccctgctcttgtgcacag

SEQ ID NO: 787045 - DNA, 25 bp, Mus musculus
tatctgaccctggtcttgtgcacag

SEQ ID NO: 787046 - DNA, 25 bp, Mus musculus
tatctgaccgtgaaagtctgggacc

SEQ ID NO: 787047 - DNA, 25 bp, Mus musculus
tatctgaccgtgtaagtctgggacc

SEQ ID NO: 787048 - DNA, 25 bp, Mus musculus
tatctgacctgcaacatataaccta

SEQ ID NO: 787049 - DNA, 25 bp, Mus musculus
tatctgacctgctacatataaccta

SEQ ID NO: 787050 - DNA, 25 bp, Mus musculus
tatctgaccttgactgcttgtttat

SEQ ID NO: 787051 - DNA, 25 bp, Mus musculus
tatctgaccttgtctgcttgtttat

SEQ ID NO: 787052 - DNA, 25 bp, Mus musculus
tatctgactagtcggacagttctgt

SEQ ID NO: 787053 - DNA, 25 bp, Mus musculus
tatctgactagtgggacagttctgt

SEQ ID NO: 787054 - DNA, 25 bp, Mus musculus
tatctgactgctcaacgtgcctgcc

SEQ ID NO: 787055 - DNA, 25 bp, Mus musculus
tatctgactgctgaacgtgcctgcc

SEQ ID NO: 787056 - DNA, 25 bp, Mus musculus
tatctgactggcagagactagaggc

SEQ ID NO: 787057 - DNA, 25 bp, Mus musculus
tatctgactggctgagactagaggc

SEQ ID NO: 787058 - DNA, 25 bp, Mus musculus
tatctgactttcagctgcgttcccg

SEQ ID NO: 787059 - DNA, 25 bp, Mus musculus
tatctgactttctgctgcgttcccg

SEQ ID NO: 787060 - DNA, 25 bp, Mus musculus
tatctgagattgattcacacacaca

SEQ ID NO: 787061 - DNA, 25 bp, Mus musculus
tatctgagattgtttcacacacaca

SEQ ID NO: 787062 - DNA, 25 bp, Mus musculus
tatctgagcactcgcttgtacaatg

SEQ ID NO: 787063 - DNA, 25 bp, Mus musculus
tatctgagcactggcttgtacaatg

SEQ ID NO: 787064 - DNA, 25 bp, Mus musculus
tatctgagcgacacattcatcagga

SEQ ID NO: 787065 - DNA, 25 bp, Mus musculus
tatctgagcgactcattcatcagga

SEQ ID NO: 787066 - DNA, 25 bp, Mus musculus
tatctgaggccccttgcccacagag

SEQ ID NO: 787067 - DNA, 25 bp, Mus musculus
tatctgaggcccgttgcccacagag

SEQ ID NO: 787068 - DNA, 25 bp, Mus musculus
tatctgagtctaagaccaacctggt

SEQ ID NO: 787069 - DNA, 25 bp, Mus musculus
tatctgagtctatgaccaacctggt

SEQ ID NO: 787070 - DNA, 25 bp, Mus musculus
tatctgagtgttcctatgttgccca

SEQ ID NO: 787071 - DNA, 25 bp, Mus musculus
tatctgagtgttgctatgttgccca

SEQ ID NO: 787072 - DNA, 25 bp, Mus musculus
tatctgatacttacaatggtcttag

SEQ ID NO: 787073 - DNA, 25 bp, Mus musculus
tatctgatactttcaatggtcttag

SEQ ID NO: 787074 - DNA, 25 bp, Mus musculus
tatctgatctttcttttccactcca

SEQ ID NO: 787075 - DNA, 25 bp, Mus musculus
tatctgatctttgttttccactcca

SEQ ID NO: 787076 - DNA, 25 bp, Mus musculus
tatctgatggagacttggtgtctga

SEQ ID NO: 787077 - DNA, 25 bp, Mus musculus
tatctgatggagtcttggtgtctga

SEQ ID NO: 787078 - DNA, 25 bp, Mus musculus
tatctgatggatcccttaagctatg

SEQ ID NO: 787079 - DNA, 25 bp, Mus musculus
tatctgatggatgccttaagctatg

SEQ ID NO: 787080 - DNA, 25 bp, Mus musculus
tatctgatgtgaagcctgttgagtc

SEQ ID NO: 787081 - DNA, 25 bp, Mus musculus
tatctgatgtgatgcctgttgagtc

SEQ ID NO: 787082 - DNA, 25 bp, Mus musculus
tatctgattcctcatgttctgatgg

SEQ ID NO: 787083 - DNA, 25 bp, Mus musculus
tatctgattcctgatgttctgatgg

SEQ ID NO: 787084 - DNA, 25 bp, Mus musculus
tatctgatttctatttctaagtggg

SEQ ID NO: 787085 - DNA, 25 bp, Mus musculus
tatctgatttctttttctaagtggg

SEQ ID NO: 787086 - DNA, 25 bp, Mus musculus
tatctgatttgtaggactgagtatt

SEQ ID NO: 787087 - DNA, 25 bp, Mus musculus
tatctgatttgttggactgagtatt

SEQ ID NO: 787088 - DNA, 25 bp, Mus musculus
tatctgcaattaaccactaaggtca

SEQ ID NO: 787089 - DNA, 25 bp, Mus musculus
tatctgcaattatccactaaggtca

SEQ ID NO: 787090 - DNA, 25 bp, Mus musculus
tatctgcactgccaagactgaatgg

SEQ ID NO: 787091 - DNA, 25 bp, Mus musculus
tatctgcactgcgaagactgaatgg

SEQ ID NO: 787092 - DNA, 25 bp, Mus musculus
tatctgcactggccagaatactcag

SEQ ID NO: 787093 - DNA, 25 bp, Mus musculus
tatctgcactgggcagaatactcag

SEQ ID NO: 787094 - DNA, 25 bp, Mus musculus
tatctgcagcacagcctgggacatt

SEQ ID NO: 787095 - DNA, 25 bp, Mus musculus
tatctgcagcactgcctgggacatt

SEQ ID NO: 787096 - DNA, 25 bp, Mus musculus
tatctgcagcccacttattttcaaa

SEQ ID NO: 787097 - DNA, 25 bp, Mus musculus
tatctgcagccctcttattttcaaa

SEQ ID NO: 787098 - DNA, 25 bp, Mus musculus
tatctgcagggtatatgagcttctc

SEQ ID NO: 787099 - DNA, 25 bp, Mus musculus
tatctgcagggtttatgagcttctc

SEQ ID NO: 787100 - DNA, 25 bp, Mus musculus
tatctgcatcataattttctctacc

SEQ ID NO: 787101 - DNA, 25 bp, Mus musculus
tatctgcatcatccgaatcctggtt

SEQ ID NO: 787102 - DNA, 25 bp, Mus musculus
tatctgcatcatgcgaatcctggtt

SEQ ID NO: 787103 - DNA, 25 bp, Mus musculus
tatctgcatcattattttctctacc

SEQ ID NO: 787104 - DNA, 25 bp, Mus musculus
tatctgcattcaaatcctcataccc

SEQ ID NO: 787105 - DNA, 25 bp, Mus musculus
tatctgcattcatatcctcataccc

SEQ ID NO: 787106 - DNA, 25 bp, Mus musculus
tatctgccatatctgtgcccatgga

SEQ ID NO: 787107 - DNA, 25 bp, Mus musculus
tatctgccatatgtgtgcccatgga

SEQ ID NO: 787108 - DNA, 25 bp, Mus musculus
tatctgccccaaatagactactcta

SEQ ID NO: 787109 - DNA, 25 bp, Mus musculus
tatctgccccaattagactactcta

SEQ ID NO: 787110 - DNA, 25 bp, Mus musculus
tatctgcccttaacagaaacacaag

SEQ ID NO: 787111 - DNA, 25 bp, Mus musculus
tatctgcccttatcagaaacacaag

SEQ ID NO: 787112 - DNA, 25 bp, Mus musculus
tatctgcctgttccatcatgtagtg

SEQ ID NO: 787113 - DNA, 25 bp, Mus musculus
tatctgcctgttgcatcatgtagtg

SEQ ID NO: 787114 - DNA, 25 bp, Mus musculus
tatctgccttgcctgtatctggaat

SEQ ID NO: 787115 - DNA, 25 bp, Mus musculus
tatctgccttgcgtgtatctggaat

SEQ ID NO: 787116 - DNA, 25 bp, Mus musculus
tatctgcgccggctgagatctggtt

SEQ ID NO: 787117 - DNA, 25 bp, Mus musculus
tatctgcgccgggtgagatctggtt

SEQ ID NO: 787118 - DNA, 25 bp, Mus musculus
tatctgcggcagaccaggcagttcg

SEQ ID NO: 787119 - DNA, 25 bp, Mus musculus
tatctgcggcagtccaggcagttcg

SEQ ID NO: 787120 - DNA, 25 bp, Mus musculus
tatctgctaattatggctactgtgc

SEQ ID NO: 787121 - DNA, 25 bp, Mus musculus
tatctgctaattttggctactgtgc

SEQ ID NO: 787122 - DNA, 25 bp, Mus musculus
tatctgctacggcatggctgctacg

SEQ ID NO: 787123 - DNA, 25 bp, Mus musculus
tatctgctacgggatggctgctacg

SEQ ID NO: 787124 - DNA, 25 bp, Mus musculus
tatctgctcaggaactagggtaatc

SEQ ID NO: 787125 - DNA, 25 bp, Mus musculus
tatctgctcaggtactagggtaatc

SEQ ID NO: 787126 - DNA, 25 bp, Mus musculus
tatctgctcagtatgtcactgtatg

SEQ ID NO: 787127 - DNA, 25 bp, Mus musculus
tatctgctcagtttgtcactgtatg

SEQ ID NO: 787128 - DNA, 25 bp, Mus musculus
tatctgctctatcttcactccaaaa

SEQ ID NO: 787129 - DNA, 25 bp, Mus musculus
tatctgctctatgttcactccaaaa

SEQ ID NO: 787130 - DNA, 25 bp, Mus musculus
tatctgctgagcaaatatcagccaa

SEQ ID NO: 787131 - DNA, 25 bp, Mus musculus
tatctgctgagctaatatcagccaa

SEQ ID NO: 787132 - DNA, 25 bp, Mus musculus
tatctgctggagatctacgttttta

SEQ ID NO: 787133 - DNA, 25 bp, Mus musculus
tatctgctggagttctacgttttta

SEQ ID NO: 787134 - DNA, 25 bp, Mus musculus
tatctgcttcttatcaaatgtacaa

SEQ ID NO: 787135 - DNA, 25 bp, Mus musculus
tatctgcttcttttcaaatgtacaa

SEQ ID NO: 787136 - DNA, 25 bp, Mus musculus
tatctgcttgtaagtctaatcacta

SEQ ID NO: 787137 - DNA, 25 bp, Mus musculus
tatctgcttgtatgtctaatcacta

SEQ ID NO: 787138 - DNA, 25 bp, Mus musculus
tatctgctttttaataatgtgttct

SEQ ID NO: 787139 - DNA, 25 bp, Mus musculus
tatctgctttttccaaaacctacca

SEQ ID NO: 787140 - DNA, 25 bp, Mus musculus
tatctgctttttgcaaaacctacca

SEQ ID NO: 787141 - DNA, 25 bp, Mus musculus
tatctgcttttttataatgtgttct

SEQ ID NO: 787142 - DNA, 25 bp, Mus musculus
tatctggaacccacggaagggtaga

SEQ ID NO: 787143 - DNA, 25 bp, Mus musculus
tatctggaaccctcggaagggtaga

SEQ ID NO: 787144 - DNA, 25 bp, Mus musculus
tatctggaacttaagcttgcctaga

SEQ ID NO: 787145 - DNA, 25 bp, Mus musculus
tatctggaactttagcttgcctaga

SEQ ID NO: 787146 - DNA, 25 bp, Mus musculus
tatctggaagcaacactgccacagt

SEQ ID NO: 787147 - DNA, 25 bp, Mus musculus
tatctggaagcatcactgccacagt

SEQ ID NO: 787148 - DNA, 25 bp, Mus musculus
tatctggaatttccactaggttagt

SEQ ID NO: 787149 - DNA, 25 bp, Mus musculus
tatctggaatttgcactaggttagt

SEQ ID NO: 787150 - DNA, 25 bp, Mus musculus
tatctggacactcttgagacgaaca

SEQ ID NO: 787151 - DNA, 25 bp, Mus musculus
tatctggacactgttgagacgaaca

SEQ ID NO: 787152 - DNA, 25 bp, Mus musculus
tatctggacttcaagttggaccaag

SEQ ID NO: 787153 - DNA, 25 bp, Mus musculus
tatctggacttctagttggaccaag

SEQ ID NO: 787154 - DNA, 25 bp, Mus musculus
tatctggagaatcactgccctcctg

SEQ ID NO: 787155 - DNA, 25 bp, Mus musculus
tatctggagaatgactgccctcctg

SEQ ID NO: 787156 - DNA, 25 bp, Mus musculus
tatctggagaggatttcttttgtat

SEQ ID NO: 787157 - DNA, 25 bp, Mus musculus
tatctggagaggttttcttttgtat

SEQ ID NO: 787158 - DNA, 25 bp, Mus musculus
tatctggatacaatgctctagcctg

SEQ ID NO: 787159 - DNA, 25 bp, Mus musculus
tatctggatacattgctctagcctg

SEQ ID NO: 787160 - DNA, 25 bp, Mus musculus
tatctggatcagctgtgcctgttta

SEQ ID NO: 787161 - DNA, 25 bp, Mus musculus
tatctggatcaggtgtgcctgttta

SEQ ID NO: 787162 - DNA, 25 bp, Mus musculus
tatctggattccaggtgcctaaatt

SEQ ID NO: 787163 - DNA, 25 bp, Mus musculus
tatctggattcctggtgcctaaatt

SEQ ID NO: 787164 - DNA, 25 bp, Mus musculus
tatctggatttcaaaagcactttct

SEQ ID NO: 787165 - DNA, 25 bp, Mus musculus
tatctggatttctaaagcactttct

SEQ ID NO: 787166 - DNA, 25 bp, Mus musculus
tatctggcacttcccaggcacagag

SEQ ID NO: 787167 - DNA, 25 bp, Mus musculus
tatctggcacttgccaggcacagag

SEQ ID NO: 787168 - DNA, 25 bp, Mus musculus
tatctggccttcatacgcatgctat

SEQ ID NO: 787169 - DNA, 25 bp, Mus musculus
tatctggccttcttacgcatgctat

SEQ ID NO: 787170 - DNA, 25 bp, Mus musculus
tatctggctagcagaggactgcgct

SEQ ID NO: 787171 - DNA, 25 bp, Mus musculus
tatctggctagctgaggactgcgct

SEQ ID NO: 787172 - DNA, 25 bp, Mus musculus
tatctggctcaaccctctggtcaag

SEQ ID NO: 787173 - DNA, 25 bp, Mus musculus
tatctggctcaagcctctggtcaag

SEQ ID NO: 787174 - DNA, 25 bp, Mus musculus
tatctgggaactcagctccatcaag

SEQ ID NO: 787175 - DNA, 25 bp, Mus musculus
tatctgggaactgagctccatcaag

SEQ ID NO: 787176 - DNA, 25 bp, Mus musculus
tatctgggaatcattacggcaaatt

SEQ ID NO: 787177 - DNA, 25 bp, Mus musculus
tatctgggaatcatttaaggtacat

SEQ ID NO: 787178 - DNA, 25 bp, Mus musculus
tatctgggaatctttacggcaaatt

SEQ ID NO: 787179 - DNA, 25 bp, Mus musculus
tatctgggaatcttttaaggtacat

SEQ ID NO: 787180 - DNA, 25 bp, Mus musculus
tatctgggacctaggctgcgctggc

SEQ ID NO: 787181 - DNA, 25 bp, Mus musculus
tatctgggaccttggctgcgctggc

SEQ ID NO: 787182 - DNA, 25 bp, Mus musculus
tatctgggagctaatctgggtgtct

SEQ ID NO: 787183 - DNA, 25 bp, Mus musculus
tatctgggagcttatctgggtgtct

SEQ ID NO: 787184 - DNA, 25 bp, Mus musculus
tatctgggaggacgaactgaatcga

SEQ ID NO: 787185 - DNA, 25 bp, Mus musculus
tatctgggaggaggaactgaatcga

SEQ ID NO: 787186 - DNA, 25 bp, Mus musculus
tatctgggatatcccaatggcttct

SEQ ID NO: 787187 - DNA, 25 bp, Mus musculus
tatctgggatatgccaatggcttct

SEQ ID NO: 787188 - DNA, 25 bp, Mus musculus
tatctgggattcatgagtctgtcta

SEQ ID NO: 787189 - DNA, 25 bp, Mus musculus
tatctgggattcttgagtctgtcta

SEQ ID NO: 787190 - DNA, 25 bp, Mus musculus
tatctgggcatcctacaggttgcta

SEQ ID NO: 787191 - DNA, 25 bp, Mus musculus
tatctgggcatcgtacaggttgcta

SEQ ID NO: 787192 - DNA, 25 bp, Mus musculus
tatctgggtggccaagcacaaaaag

SEQ ID NO: 787193 - DNA, 25 bp, Mus musculus
tatctgggtggcgaagcacaaaaag

SEQ ID NO: 787194 - DNA, 25 bp, Mus musculus
tatctgggttctaaccttcaccagc

SEQ ID NO: 787195 - DNA, 25 bp, Mus musculus
tatctgggttcttaccttcaccagc

SEQ ID NO: 787196 - DNA, 25 bp, Mus musculus
tatctggtgtcaaggtatttctaac

SEQ ID NO: 787197 - DNA, 25 bp, Mus musculus
tatctggtgtcatggtatttctaac

SEQ ID NO: 787198 - DNA, 25 bp, Mus musculus
tatctggtgtttcctaatcactgga

SEQ ID NO: 787199 - DNA, 25 bp, Mus musculus
tatctggtgtttgctaatcactgga

SEQ ID NO: 787200 - DNA, 25 bp, Mus musculus
tatctggttaggatcctgaccaagc

SEQ ID NO: 787201 - DNA, 25 bp, Mus musculus
tatctggttaggttcctgaccaagc

SEQ ID NO: 787202 - DNA, 25 bp, Mus musculus
tatctggtttggcatctaggttttt

SEQ ID NO: 787203 - DNA, 25 bp, Mus musculus
tatctggtttgggatctaggttttt

SEQ ID NO: 787204 - DNA, 25 bp, Mus musculus
tatctggtttttcatggtctagaac

SEQ ID NO: 787205 - DNA, 25 bp, Mus musculus
tatctggtttttgatggtctagaac

SEQ ID NO: 787206 - DNA, 25 bp, Mus musculus
tatctgtaaagtatccctaatagaa

SEQ ID NO: 787207 - DNA, 25 bp, Mus musculus
tatctgtaaagtttccctaatagaa

SEQ ID NO: 787208 - DNA, 25 bp, Mus musculus
tatctgtaaattccccaggccatac

SEQ ID NO: 787209 - DNA, 25 bp, Mus musculus
tatctgtaaattgcccaggccatac

SEQ ID NO: 787210 - DNA, 25 bp, Mus musculus
tatctgtaacagaagtcccatggga

SEQ ID NO: 787211 - DNA, 25 bp, Mus musculus
tatctgtaacagtagtcccatggga

SEQ ID NO: 787212 - DNA, 25 bp, Mus musculus
tatctgtaactgacattgtcataag

SEQ ID NO: 787213 - DNA, 25 bp, Mus musculus
tatctgtaactgtcattgtcataag

SEQ ID NO: 787214 - DNA, 25 bp, Mus musculus
tatctgtaattcaaccaaagttaac

SEQ ID NO: 787215 - DNA, 25 bp, Mus musculus
tatctgtaattctaccaaagttaac

SEQ ID NO: 787216 - DNA, 25 bp, Mus musculus
tatctgtacaagataagcccgttct

SEQ ID NO: 787217 - DNA, 25 bp, Mus musculus
tatctgtacaagttaagcccgttct

SEQ ID NO: 787218 - DNA, 25 bp, Mus musculus
tatctgtaccagaaaatctacctga

SEQ ID NO: 787219 - DNA, 25 bp, Mus musculus
tatctgtaccagtaaatctacctga

SEQ ID NO: 787220 - DNA, 25 bp, Mus musculus
tatctgtacgtgactaccctctcag

SEQ ID NO: 787221 - DNA, 25 bp, Mus musculus
tatctgtacgtgtctaccctctcag

SEQ ID NO: 787222 - DNA, 25 bp, Mus musculus
tatctgtagagtcaaggcctgtggt

SEQ ID NO: 787223 - DNA, 25 bp, Mus musculus
tatctgtagagtgaaggcctgtggt

SEQ ID NO: 787224 - DNA, 25 bp, Mus musculus
tatctgtagctaaccagaccagcca

SEQ ID NO: 787225 - DNA, 25 bp, Mus musculus
tatctgtagctatccagaccagcca

SEQ ID NO: 787226 - DNA, 25 bp, Mus musculus
tatctgtataaaacttctgcctctg

SEQ ID NO: 787227 - DNA, 25 bp, Mus musculus
tatctgtataaatcttctgcctctg

SEQ ID NO: 787228 - DNA, 25 bp, Mus musculus
tatctgtataacacagtagccactg

SEQ ID NO: 787229 - DNA, 25 bp, Mus musculus
tatctgtataactcagtagccactg

SEQ ID NO: 787230 - DNA, 25 bp, Mus musculus
tatctgtatctgcatgtcctgacta

SEQ ID NO: 787231 - DNA, 25 bp, Mus musculus
tatctgtatctggatgtcctgacta

SEQ ID NO: 787232 - DNA, 25 bp, Mus musculus
tatctgtcaccgctgggaggtcact

SEQ ID NO: 787233 - DNA, 25 bp, Mus musculus
tatctgtcaccggtgggaggtcact

SEQ ID NO: 787234 - DNA, 25 bp, Mus musculus
tatctgtcactaacatgctctctgt

SEQ ID NO: 787235 - DNA, 25 bp, Mus musculus
tatctgtcactatcatgctctctgt

SEQ ID NO: 787236 - DNA, 25 bp, Mus musculus
tatctgtccaaaatacttgcctcta

SEQ ID NO: 787237 - DNA, 25 bp, Mus musculus
tatctgtccaaattacttgcctcta

SEQ ID NO: 787238 - DNA, 25 bp, Mus musculus
tatctgtcctttctcagagcatctc

SEQ ID NO: 787239 - DNA, 25 bp, Mus musculus
tatctgtcctttgtcagagcatctc

SEQ ID NO: 787240 - DNA, 25 bp, Mus musculus
tatctgtcggccaaggcagtaaagg

SEQ ID NO: 787241 - DNA, 25 bp, Mus musculus
tatctgtcggcctaggcagtaaagg

SEQ ID NO: 787242 - DNA, 25 bp, Mus musculus
tatctgtcggttagcaaaagtaatg

SEQ ID NO: 787243 - DNA, 25 bp, Mus musculus
tatctgtcggtttgcaaaagtaatg

SEQ ID NO: 787244 - DNA, 25 bp, Mus musculus
tatctgtctttaactggactgtaga

SEQ ID NO: 787245 - DNA, 25 bp, Mus musculus
tatctgtctttatctggactgtaga

SEQ ID NO: 787246 - DNA, 25 bp, Mus musculus
tatctgtgagaccatcttccaatat

SEQ ID NO: 787247 - DNA, 25 bp, Mus musculus
tatctgtgagacgatcttccaatat

SEQ ID NO: 787248 - DNA, 25 bp, Mus musculus
tatctgtgagtgagctcctgaacct

SEQ ID NO: 787249 - DNA, 25 bp, Mus musculus
tatctgtgagtgtgctcctgaacct

SEQ ID NO: 787250 - DNA, 25 bp, Mus musculus
tatctgtgcaggagcccactaagcc

SEQ ID NO: 787251 - DNA, 25 bp, Mus musculus
tatctgtgcaggcaatgaccttgaa

SEQ ID NO: 787252 - DNA, 25 bp, Mus musculus
tatctgtgcagggaatgaccttgaa

SEQ ID NO: 787253 - DNA, 25 bp, Mus musculus
tatctgtgcaggtgcccactaagcc

SEQ ID NO: 787254 - DNA, 25 bp, Mus musculus
tatctgtgccacaaaatcttatgta

SEQ ID NO: 787255 - DNA, 25 bp, Mus musculus
tatctgtgccactaaatcttatgta

SEQ ID NO: 787256 - DNA, 25 bp, Mus musculus
tatctgtggagaattcctgctcttg

SEQ ID NO: 787257 - DNA, 25 bp, Mus musculus
tatctgtggagatttcctgctcttg

SEQ ID NO: 787258 - DNA, 25 bp, Mus musculus
tatctgtggccgaaatgcgctgagc

SEQ ID NO: 787259 - DNA, 25 bp, Mus musculus
tatctgtggccgtaatgcgctgagc

SEQ ID NO: 787260 - DNA, 25 bp, Mus musculus
tatctgtggtaaccagttcctgccc

SEQ ID NO: 787261 - DNA, 25 bp, Mus musculus
tatctgtggtaagcagttcctgccc

SEQ ID NO: 787262 - DNA, 25 bp, Mus musculus
tatctgtggtcaagcactagggccc

SEQ ID NO: 787263 - DNA, 25 bp, Mus musculus
tatctgtggtcatgcactagggccc

SEQ ID NO: 787264 - DNA, 25 bp, Mus musculus
tatctgtggtctactgtgattctgt

SEQ ID NO: 787265 - DNA, 25 bp, Mus musculus
tatctgtggtcttctgtgattctgt

SEQ ID NO: 787266 - DNA, 25 bp, Mus musculus
tatctgtgtcagaacgggtgctcgg

SEQ ID NO: 787267 - DNA, 25 bp, Mus musculus
tatctgtgtcagtacgggtgctcgg

SEQ ID NO: 787268 - DNA, 25 bp, Mus musculus
tatctgtgtgctattagccccttga

SEQ ID NO: 787269 - DNA, 25 bp, Mus musculus
tatctgtgtgcttttagccccttga

SEQ ID NO: 787270 - DNA, 25 bp, Mus musculus
tatctgtgtggtctcagttacactc

SEQ ID NO: 787271 - DNA, 25 bp, Mus musculus
tatctgtgtggtgtcagttacactc

SEQ ID NO: 787272 - DNA, 25 bp, Mus musculus
tatctgtgtttcactttgcatccct

SEQ ID NO: 787273 - DNA, 25 bp, Mus musculus
tatctgtgtttctctttgcatccct

SEQ ID NO: 787274 - DNA, 25 bp, Mus musculus
tatctgttgataatgcctgttaata

SEQ ID NO: 787275 - DNA, 25 bp, Mus musculus
tatctgttgatattgcctgttaata

SEQ ID NO: 787276 - DNA, 25 bp, Mus musculus
tatctgttgctgatacctcttgaaa

SEQ ID NO: 787277 - DNA, 25 bp, Mus musculus
tatctgttgctgttacctcttgaaa

SEQ ID NO: 787278 - DNA, 25 bp, Mus musculus
tatctgtttatcagaacctacctgg

SEQ ID NO: 787279 - DNA, 25 bp, Mus musculus
tatctgtttatctgaacctacctgg

SEQ ID NO: 787280 - DNA, 25 bp, Mus musculus
tatctgtttcccatcaatcgttatc

SEQ ID NO: 787281 - DNA, 25 bp, Mus musculus
tatctgtttcccttcaatcgttatc

SEQ ID NO: 787282 - DNA, 25 bp, Mus musculus
tatctgtttttcctcaggcacatca

SEQ ID NO: 787283 - DNA, 25 bp, Mus musculus
tatctgtttttcgtcaggcacatca

SEQ ID NO: 787284 - DNA, 25 bp, Mus musculus
tatcttaaactaaatctgaccagtg

SEQ ID NO: 787285 - DNA, 25 bp, Mus musculus
tatcttaaactatatctgaccagtg

SEQ ID NO: 787286 - DNA, 25 bp, Mus musculus
tatcttaaagcaagttcccacccat

SEQ ID NO: 787287 - DNA, 25 bp, Mus musculus
tatcttaaagcatgttcccacccat

SEQ ID NO: 787288 - DNA, 25 bp, Mus musculus
tatcttaaaggcaggccgtgcctac

SEQ ID NO: 787289 - DNA, 25 bp, Mus musculus
tatcttaaaggctggccgtgcctac

SEQ ID NO: 787290 - DNA, 25 bp, Mus musculus
tatcttaaataactatagcccaaaa

SEQ ID NO: 787291 - DNA, 25 bp, Mus musculus
tatcttaaataagtatagcccaaaa

SEQ ID NO: 787292 - DNA, 25 bp, Mus musculus
tatcttaagttcaattcaaatggcc

SEQ ID NO: 787293 - DNA, 25 bp, Mus musculus
tatcttaagttctattcaaatggcc

SEQ ID NO: 787294 - DNA, 25 bp, Mus musculus
tatcttaatagtacacagtgtgtgt

SEQ ID NO: 787295 - DNA, 25 bp, Mus musculus
tatcttaatagttcacagtgtgtgt

SEQ ID NO: 787296 - DNA, 25 bp, Mus musculus
tatcttacacctatttgatttttaa

SEQ ID NO: 787297 - DNA, 25 bp, Mus musculus
tatcttacacctttttgatttttaa

SEQ ID NO: 787298 - DNA, 25 bp, Mus musculus
tatcttacagcaatcggcatacggt

SEQ ID NO: 787299 - DNA, 25 bp, Mus musculus
tatcttacagcattcggcatacggt

SEQ ID NO: 787300 - DNA, 25 bp, Mus musculus
tatcttacaggcattttgcttgttg

SEQ ID NO: 787301 - DNA, 25 bp, Mus musculus
tatcttacaggctttttgcttgttg

SEQ ID NO: 787302 - DNA, 25 bp, Mus musculus
tatcttacataactagcaccctcca

SEQ ID NO: 787303 - DNA, 25 bp, Mus musculus
tatcttacataagtagcaccctcca

SEQ ID NO: 787304 - DNA, 25 bp, Mus musculus
tatcttactgccactaattctgtag

SEQ ID NO: 787305 - DNA, 25 bp, Mus musculus
tatcttactgcctctaattctgtag

SEQ ID NO: 787306 - DNA, 25 bp, Mus musculus
tatcttactggacagggccagctct

SEQ ID NO: 787307 - DNA, 25 bp, Mus musculus
tatcttactggagagggccagctct

SEQ ID NO: 787308 - DNA, 25 bp, Mus musculus
tatcttagcatacatgttcccacca

SEQ ID NO: 787309 - DNA, 25 bp, Mus musculus
tatcttagcatagatgttcccacca

SEQ ID NO: 787310 - DNA, 25 bp, Mus musculus
tatcttaggaggatgcttgctttac

SEQ ID NO: 787311 - DNA, 25 bp, Mus musculus
tatcttaggaggttgcttgctttac

SEQ ID NO: 787312 - DNA, 25 bp, Mus musculus
tatcttaggcttacctcagtcgaaa

SEQ ID NO: 787313 - DNA, 25 bp, Mus musculus
tatcttaggctttcctcagtcgaaa

SEQ ID NO: 787314 - DNA, 25 bp, Mus musculus
tatcttagtgttatcatgggcccag

SEQ ID NO: 787315 - DNA, 25 bp, Mus musculus
tatcttagtgttttcatgggcccag

SEQ ID NO: 787316 - DNA, 25 bp, Mus musculus
tatcttatctgcactggccagaata

SEQ ID NO: 787317 - DNA, 25 bp, Mus musculus
tatcttatctgctctggccagaata

SEQ ID NO: 787318 - DNA, 25 bp, Mus musculus
tatcttatgaagctccagggaagca

SEQ ID NO: 787319 - DNA, 25 bp, Mus musculus
tatcttatgaaggtccagggaagca

SEQ ID NO: 787320 - DNA, 25 bp, Mus musculus
tatcttatggttattacttgataaa

SEQ ID NO: 787321 - DNA, 25 bp, Mus musculus
tatcttatggtttttacttgataaa

SEQ ID NO: 787322 - DNA, 25 bp, Mus musculus
tatcttatgtgactacagtctctgt

SEQ ID NO: 787323 - DNA, 25 bp, Mus musculus
tatcttatgtgagtacagtctctgt

SEQ ID NO: 787324 - DNA, 25 bp, Mus musculus
tatcttatgtgcctggacctgccta

SEQ ID NO: 787325 - DNA, 25 bp, Mus musculus
tatcttatgtgcgtggacctgccta

SEQ ID NO: 787326 - DNA, 25 bp, Mus musculus
tatcttatttggctacttcttttta

SEQ ID NO: 787327 - DNA, 25 bp, Mus musculus
tatcttatttgggtacttcttttta

SEQ ID NO: 787328 - DNA, 25 bp, Mus musculus
tatcttcaaaatccgcctcctggat

SEQ ID NO: 787329 - DNA, 25 bp, Mus musculus
tatcttcaaaatgcgcctcctggat

SEQ ID NO: 787330 - DNA, 25 bp, Mus musculus
tatcttcaaattcatctgttcgttg

SEQ ID NO: 787331 - DNA, 25 bp, Mus musculus
tatcttcaaattgatctgttcgttg

SEQ ID NO: 787332 - DNA, 25 bp, Mus musculus
tatcttcaagagagcacactgcagt

SEQ ID NO: 787333 - DNA, 25 bp, Mus musculus
tatcttcaagagtgcacactgcagt

SEQ ID NO: 787334 - DNA, 25 bp, Mus musculus
tatcttcactgaaatgtgtttgatg

SEQ ID NO: 787335 - DNA, 25 bp, Mus musculus
tatcttcactgatatgtgtttgatg

SEQ ID NO: 787336 - DNA, 25 bp, Mus musculus
tatcttcagaggagtctgcgtgggc

SEQ ID NO: 787337 - DNA, 25 bp, Mus musculus
tatcttcagaggtgtctgcgtgggc

SEQ ID NO: 787338 - DNA, 25 bp, Mus musculus
tatcttcagtgacttcggccatagt

SEQ ID NO: 787339 - DNA, 25 bp, Mus musculus
tatcttcagtgagttcggccatagt

SEQ ID NO: 787340 - DNA, 25 bp, Mus musculus
tatcttcatcccacaacctctgaag

SEQ ID NO: 787341 - DNA, 25 bp, Mus musculus
tatcttcatccctcaacctctgaag

SEQ ID NO: 787342 - DNA, 25 bp, Mus musculus
tatcttcatgaacgctcctgtctat

SEQ ID NO: 787343 - DNA, 25 bp, Mus musculus
tatcttcatgaaggctcctgtctat

SEQ ID NO: 787344 - DNA, 25 bp, Mus musculus
tatcttcattatacaccaaggtggg

SEQ ID NO: 787345 - DNA, 25 bp, Mus musculus
tatcttcattattcaccaaggtggg

SEQ ID NO: 787346 - DNA, 25 bp, Mus musculus
tatcttccacttcggattcgaaagc

SEQ ID NO: 787347 - DNA, 25 bp, Mus musculus
tatcttccacttgggattcgaaagc

SEQ ID NO: 787348 - DNA, 25 bp, Mus musculus
tatcttccaggtatgaacagccaat

SEQ ID NO: 787349 - DNA, 25 bp, Mus musculus
tatcttccaggtttgaacagccaat

SEQ ID NO: 787350 - DNA, 25 bp, Mus musculus
tatcttccatcacagattcctgaca

SEQ ID NO: 787351 - DNA, 25 bp, Mus musculus
tatcttccatcagagattcctgaca

SEQ ID NO: 787352 - DNA, 25 bp, Mus musculus
tatcttccatcgctggccaagggag

SEQ ID NO: 787353 - DNA, 25 bp, Mus musculus
tatcttccatcggtggccaagggag

SEQ ID NO: 787354 - DNA, 25 bp, Mus musculus
tatcttcccaggaccggtcataatt

SEQ ID NO: 787355 - DNA, 25 bp, Mus musculus
tatcttcccaggtccggtcataatt

SEQ ID NO: 787356 - DNA, 25 bp, Mus musculus
tatcttccctgcaatgtgactctat

SEQ ID NO: 787357 - DNA, 25 bp, Mus musculus
tatcttccctgctatgtgactctat

SEQ ID NO: 787358 - DNA, 25 bp, Mus musculus
tatcttccgttaatgaagtaacgcc

SEQ ID NO: 787359 - DNA, 25 bp, Mus musculus
tatcttccgttattgaagtaacgcc

SEQ ID NO: 787360 - DNA, 25 bp, Mus musculus
tatcttcctcacctgattctatgat

SEQ ID NO: 787361 - DNA, 25 bp, Mus musculus
tatcttcctcacgtgattctatgat

SEQ ID NO: 787362 - DNA, 25 bp, Mus musculus
tatcttcctgtcacaagtgctgagt

SEQ ID NO: 787363 - DNA, 25 bp, Mus musculus
tatcttcctgtctcaagtgctgagt

SEQ ID NO: 787364 - DNA, 25 bp, Mus musculus
tatcttcctttccagtcctattcta

SEQ ID NO: 787365 - DNA, 25 bp, Mus musculus
tatcttcctttcgagtcctattcta

SEQ ID NO: 787366 - DNA, 25 bp, Mus musculus
tatcttcctttgattcggtctctgg

SEQ ID NO: 787367 - DNA, 25 bp, Mus musculus
tatcttcctttgtttcggtctctgg

SEQ ID NO: 787368 - DNA, 25 bp, Mus musculus
tatcttcgggtcactgcctgtctga

SEQ ID NO: 787369 - DNA, 25 bp, Mus musculus
tatcttcgggtctctgcctgtctga

SEQ ID NO: 787370 - DNA, 25 bp, Mus musculus
tatcttcggtcaaccttgaggtcaa

SEQ ID NO: 787371 - DNA, 25 bp, Mus musculus
tatcttcggtcatccttgaggtcaa

SEQ ID NO: 787372 - DNA, 25 bp, Mus musculus
tatcttcgttttccatctgttgttt

SEQ ID NO: 787373 - DNA, 25 bp, Mus musculus
tatcttcgttttgcatctgttgttt

SEQ ID NO: 787374 - DNA, 25 bp, Mus musculus
tatcttctacctcctgggagcactg

SEQ ID NO: 787375 - DNA, 25 bp, Mus musculus
tatcttctacctgctgggagcactg

SEQ ID NO: 787376 - DNA, 25 bp, Mus musculus
tatcttctagaaacaggtgcctggg

SEQ ID NO: 787377 - DNA, 25 bp, Mus musculus
tatcttctagaatcaggtgcctggg

SEQ ID NO: 787378 - DNA, 25 bp, Mus musculus
tatcttctcaggaagaactgtccct

SEQ ID NO: 787379 - DNA, 25 bp, Mus musculus
tatcttctcaggtagaactgtccct

SEQ ID NO: 787380 - DNA, 25 bp, Mus musculus
tatcttctgctcctcagtccttaac

SEQ ID NO: 787381 - DNA, 25 bp, Mus musculus
tatcttctgctcgtcagtccttaac

SEQ ID NO: 787382 - DNA, 25 bp, Mus musculus
tatcttctggccagggagtgaccag

SEQ ID NO: 787383 - DNA, 25 bp, Mus musculus
tatcttctggcctgggagtgaccag

SEQ ID NO: 787384 - DNA, 25 bp, Mus musculus
tatcttctgtcaattcattttcacc

SEQ ID NO: 787385 - DNA, 25 bp, Mus musculus
tatcttctgtcatttcattttcacc

SEQ ID NO: 787386 - DNA, 25 bp, Mus musculus
tatcttctgttgattgtgcatagca

SEQ ID NO: 787387 - DNA, 25 bp, Mus musculus
tatcttctgttgtttgtgcatagca

SEQ ID NO: 787388 - DNA, 25 bp, Mus musculus
tatcttcttacaacttcctccaaca

SEQ ID NO: 787389 - DNA, 25 bp, Mus musculus
tatcttcttacatcttcctccaaca

SEQ ID NO: 787390 - DNA, 25 bp, Mus musculus
tatcttcttacccaacaacttacta

SEQ ID NO: 787391 - DNA, 25 bp, Mus musculus
tatcttcttaccgaacaacttacta

SEQ ID NO: 787392 - DNA, 25 bp, Mus musculus
tatcttcttcctcttatggcaccga

SEQ ID NO: 787393 - DNA, 25 bp, Mus musculus
tatcttcttcctgttatggcaccga

SEQ ID NO: 787394 - DNA, 25 bp, Mus musculus
tatcttgaaaagcatactcccacaa

SEQ ID NO: 787395 - DNA, 25 bp, Mus musculus
tatcttgaaaaggatactcccacaa

SEQ ID NO: 787396 - DNA, 25 bp, Mus musculus
tatcttgaagtcagctcttgaaaac

SEQ ID NO: 787397 - DNA, 25 bp, Mus musculus
tatcttgaagtctgctcttgaaaac

SEQ ID NO: 787398 - DNA, 25 bp, Mus musculus
tatcttgaccccacagagtttgtta

SEQ ID NO: 787399 - DNA, 25 bp, Mus musculus
tatcttgacccctcagagtttgtta

SEQ ID NO: 787400 - DNA, 25 bp, Mus musculus
tatcttgaccctcaaaagtgccctc

SEQ ID NO: 787401 - DNA, 25 bp, Mus musculus
tatcttgaccctgaaaagtgccctc

SEQ ID NO: 787402 - DNA, 25 bp, Mus musculus
tatcttgaccggcactccaaaggga

SEQ ID NO: 787403 - DNA, 25 bp, Mus musculus
tatcttgaccgggactccaaaggga

SEQ ID NO: 787404 - DNA, 25 bp, Mus musculus
tatcttgactgacggcttgcagtgc

SEQ ID NO: 787405 - DNA, 25 bp, Mus musculus
tatcttgactgagggcttgcagtgc

SEQ ID NO: 787406 - DNA, 25 bp, Mus musculus
tatcttgacttcaccacaacagttg

SEQ ID NO: 787407 - DNA, 25 bp, Mus musculus
tatcttgacttctccacaacagttg

SEQ ID NO: 787408 - DNA, 25 bp, Mus musculus
tatcttgagcagacacagagccaat

SEQ ID NO: 787409 - DNA, 25 bp, Mus musculus
tatcttgagcagtcacagagccaat

SEQ ID NO: 787410 - DNA, 25 bp, Mus musculus
tatcttgatagcatgtaggttttaa

SEQ ID NO: 787411 - DNA, 25 bp, Mus musculus
tatcttgatagcttgtaggttttaa

SEQ ID NO: 787412 - DNA, 25 bp, Mus musculus
tatcttgatccacacgcacccttgt

SEQ ID NO: 787413 - DNA, 25 bp, Mus musculus
tatcttgatccagacgcacccttgt

SEQ ID NO: 787414 - DNA, 25 bp, Mus musculus
tatcttgatggcattgggctcgtcc

SEQ ID NO: 787415 - DNA, 25 bp, Mus musculus
tatcttgatggctttgggctcgtcc

SEQ ID NO: 787416 - DNA, 25 bp, Mus musculus
tatcttgcacaaaaatagaccacag

SEQ ID NO: 787417 - DNA, 25 bp, Mus musculus
tatcttgcacaataatagaccacag

SEQ ID NO: 787418 - DNA, 25 bp, Mus musculus
tatcttgccttaatgtccaccagag

SEQ ID NO: 787419 - DNA, 25 bp, Mus musculus
tatcttgccttattgtccaccagag

SEQ ID NO: 787420 - DNA, 25 bp, Mus musculus
tatcttgccttcagagatttttatg

SEQ ID NO: 787421 - DNA, 25 bp, Mus musculus
tatcttgccttctgagatttttatg

SEQ ID NO: 787422 - DNA, 25 bp, Mus musculus
tatcttggaatgctcaacttctgga

SEQ ID NO: 787423 - DNA, 25 bp, Mus musculus
tatcttggaatggtcaacttctgga

SEQ ID NO: 787424 - DNA, 25 bp, Mus musculus
tatcttggagtgagaccaccatgga

SEQ ID NO: 787425 - DNA, 25 bp, Mus musculus
tatcttggagtgtgaccaccatgga

SEQ ID NO: 787426 - DNA, 25 bp, Mus musculus
tatcttggcaagaaccggaacatcc

SEQ ID NO: 787427 - DNA, 25 bp, Mus musculus
tatcttggcaagtaccggaacatcc

SEQ ID NO: 787428 - DNA, 25 bp, Mus musculus
tatcttggccaaatacttcagcaaa

SEQ ID NO: 787429 - DNA, 25 bp, Mus musculus
tatcttggccaattacttcagcaaa

SEQ ID NO: 787430 - DNA, 25 bp, Mus musculus
tatcttggccctaagcagttgagtt

SEQ ID NO: 787431 - DNA, 25 bp, Mus musculus
tatcttggcccttagcagttgagtt

SEQ ID NO: 787432 - DNA, 25 bp, Mus musculus
tatcttggccgtagggagattccgc

SEQ ID NO: 787433 - DNA, 25 bp, Mus musculus
tatcttggccgttgggagattccgc

SEQ ID NO: 787434 - DNA, 25 bp, Mus musculus
tatcttggcctacacagctgaggga

SEQ ID NO: 787435 - DNA, 25 bp, Mus musculus
tatcttggcctagacagctgaggga

SEQ ID NO: 787436 - DNA, 25 bp, Mus musculus
tatcttggcctgagggcagcgtgct

SEQ ID NO: 787437 - DNA, 25 bp, Mus musculus
tatcttggcctgtgggcagcgtgct

SEQ ID NO: 787438 - DNA, 25 bp, Mus musculus
tatcttgggaagcagggataccctc

SEQ ID NO: 787439 - DNA, 25 bp, Mus musculus
tatcttgggaaggagggataccctc

SEQ ID NO: 787440 - DNA, 25 bp, Mus musculus
tatcttgggctaccttaccatcatt

SEQ ID NO: 787441 - DNA, 25 bp, Mus musculus
tatcttgggctacttttgctttctg

SEQ ID NO: 787442 - DNA, 25 bp, Mus musculus
tatcttgggctagcttaccatcatt

SEQ ID NO: 787443 - DNA, 25 bp, Mus musculus
tatcttgggctagttttgctttctg

SEQ ID NO: 787444 - DNA, 25 bp, Mus musculus
tatcttggtagaactgagtctgtcg

SEQ ID NO: 787445 - DNA, 25 bp, Mus musculus
tatcttggtagatctgagtctgtcg

SEQ ID NO: 787446 - DNA, 25 bp, Mus musculus
tatcttggtggaattgcgttcctgc

SEQ ID NO: 787447 - DNA, 25 bp, Mus musculus
tatcttggtggatttgcgttcctgc

SEQ ID NO: 787448 - DNA, 25 bp, Mus musculus
tatcttggtgtcagttggattgtcc

SEQ ID NO: 787449 - DNA, 25 bp, Mus musculus
tatcttggtgtctgttggattgtcc

SEQ ID NO: 787450 - DNA, 25 bp, Mus musculus
tatcttggttgtatgtttgcgtctt

SEQ ID NO: 787451 - DNA, 25 bp, Mus musculus
tatcttggttgtttgtttgcgtctt

SEQ ID NO: 787452 - DNA, 25 bp, Mus musculus
tatcttgtactcatgtgtttctgtg

SEQ ID NO: 787453 - DNA, 25 bp, Mus musculus
tatcttgtactcttgtgtttctgtg

SEQ ID NO: 787454 - DNA, 25 bp, Mus musculus
tatcttgtaggcattctcctctcac

SEQ ID NO: 787455 - DNA, 25 bp, Mus musculus
tatcttgtaggctttctcctctcac

SEQ ID NO: 787456 - DNA, 25 bp, Mus musculus
tatcttgtattactcctttccttca

SEQ ID NO: 787457 - DNA, 25 bp, Mus musculus
tatcttgtattagtcctttccttca

SEQ ID NO: 787458 - DNA, 25 bp, Mus musculus
tatcttgtcataaatgtggcacatc

SEQ ID NO: 787459 - DNA, 25 bp, Mus musculus
tatcttgtcatatatgtggcacatc

SEQ ID NO: 787460 - DNA, 25 bp, Mus musculus
tatcttgtccaacactacgtcgaag

SEQ ID NO: 787461 - DNA, 25 bp, Mus musculus
tatcttgtccaagactacgtcgaag

SEQ ID NO: 787462 - DNA, 25 bp, Mus musculus
tatcttgtgcagacatcagaggcaa

SEQ ID NO: 787463 - DNA, 25 bp, Mus musculus
tatcttgtgcagtcatcagaggcaa

SEQ ID NO: 787464 - DNA, 25 bp, Mus musculus
tatcttgttctgcttgctttatttc

SEQ ID NO: 787465 - DNA, 25 bp, Mus musculus
tatcttgttctggttgctttatttc

SEQ ID NO: 787466 - DNA, 25 bp, Mus musculus
tatcttgtttcactctctccagcaa

SEQ ID NO: 787467 - DNA, 25 bp, Mus musculus
tatcttgtttcagtctctccagcaa

SEQ ID NO: 787468 - DNA, 25 bp, Mus musculus
tatctttaacaccatttcgcacaat

SEQ ID NO: 787469 - DNA, 25 bp, Mus musculus
tatctttaacacgatttcgcacaat

SEQ ID NO: 787470 - DNA, 25 bp, Mus musculus
tatctttaacttctgtccactggag

SEQ ID NO: 787471 - DNA, 25 bp, Mus musculus
tatctttaacttgtgtccactggag

SEQ ID NO: 787472 - DNA, 25 bp, Mus musculus
tatctttacttgctagattcttcct

SEQ ID NO: 787473 - DNA, 25 bp, Mus musculus
tatctttacttggtagattcttcct

SEQ ID NO: 787474 - DNA, 25 bp, Mus musculus
tatctttaggtgaaacagggagcat

SEQ ID NO: 787475 - DNA, 25 bp, Mus musculus
tatctttaggtgtaacagggagcat

SEQ ID NO: 787476 - DNA, 25 bp, Mus musculus
tatctttagtttatgatgcccactg

SEQ ID NO: 787477 - DNA, 25 bp, Mus musculus
tatctttagtttttgatgcccactg

SEQ ID NO: 787478 - DNA, 25 bp, Mus musculus
tatctttatgagaatgtcagctgac

SEQ ID NO: 787479 - DNA, 25 bp, Mus musculus
tatctttatgagtatgtcagctgac

SEQ ID NO: 787480 - DNA, 25 bp, Mus musculus
tatctttatttcaatttcacatgct

SEQ ID NO: 787481 - DNA, 25 bp, Mus musculus
tatctttatttctatttcacatgct

SEQ ID NO: 787482 - DNA, 25 bp, Mus musculus
tatctttcattcagttttccagtaa

SEQ ID NO: 787483 - DNA, 25 bp, Mus musculus
tatctttcattctgttttccagtaa

SEQ ID NO: 787484 - DNA, 25 bp, Mus musculus
tatctttctaacattacttcccgag

SEQ ID NO: 787485 - DNA, 25 bp, Mus musculus
tatctttctaactttacttcccgag

SEQ ID NO: 787486 - DNA, 25 bp, Mus musculus
tatctttctataatacttgtcgttg

SEQ ID NO: 787487 - DNA, 25 bp, Mus musculus
tatctttctatattacttgtcgttg

SEQ ID NO: 787488 - DNA, 25 bp, Mus musculus
tatctttctatgaactcatgtctcc

SEQ ID NO: 787489 - DNA, 25 bp, Mus musculus
tatctttctatgaatttccttccta

SEQ ID NO: 787490 - DNA, 25 bp, Mus musculus
tatctttctatgtactcatgtctcc

SEQ ID NO: 787491 - DNA, 25 bp, Mus musculus
tatctttctatgtatttccttccta

SEQ ID NO: 787492 - DNA, 25 bp, Mus musculus
tatctttctgctcgtgcctggaaca

SEQ ID NO: 787493 - DNA, 25 bp, Mus musculus
tatctttctgctggtgcctggaaca

SEQ ID NO: 787494 - DNA, 25 bp, Mus musculus
tatctttctggaatccatcttccca

SEQ ID NO: 787495 - DNA, 25 bp, Mus musculus
tatctttctggattccatcttccca

SEQ ID NO: 787496 - DNA, 25 bp, Mus musculus
tatctttctgtgaacctccatagcc

SEQ ID NO: 787497 - DNA, 25 bp, Mus musculus
tatctttctgtgtacctccatagcc

SEQ ID NO: 787498 - DNA, 25 bp, Mus musculus
tatctttgaactcctgtatctcttg

SEQ ID NO: 787499 - DNA, 25 bp, Mus musculus
tatctttgaactgctgtatctcttg

SEQ ID NO: 787500 - DNA, 25 bp, Mus musculus
tatctttgacttaatagaatcttga

SEQ ID NO: 787501 - DNA, 25 bp, Mus musculus
tatctttgacttcctgtcacactgc

SEQ ID NO: 787502 - DNA, 25 bp, Mus musculus
tatctttgacttgctgtcacactgc

SEQ ID NO: 787503 - DNA, 25 bp, Mus musculus
tatctttgactttatagaatcttga

SEQ ID NO: 787504 - DNA, 25 bp, Mus musculus
tatctttgcaacactaggcgcaaac

SEQ ID NO: 787505 - DNA, 25 bp, Mus musculus
tatctttgcaactctaggcgcaaac

SEQ ID NO: 787506 - DNA, 25 bp, Mus musculus
tatctttgctctcattgctttcaca

SEQ ID NO: 787507 - DNA, 25 bp, Mus musculus
tatctttgctctgattgctttcaca

SEQ ID NO: 787508 - DNA, 25 bp, Mus musculus
tatctttggccgagatcctgagaac

SEQ ID NO: 787509 - DNA, 25 bp, Mus musculus
tatctttggccgtgatcctgagaac

SEQ ID NO: 787510 - DNA, 25 bp, Mus musculus
tatctttggtggagtgctcatcatc

SEQ ID NO: 787511 - DNA, 25 bp, Mus musculus
tatctttggtggtgtgctcatcatc

SEQ ID NO: 787512 - DNA, 25 bp, Mus musculus
tatctttgtccccaagccaagtaag

SEQ ID NO: 787513 - DNA, 25 bp, Mus musculus
tatctttgtcccgaagccaagtaag

SEQ ID NO: 787514 - DNA, 25 bp, Mus musculus
tatctttgtctccttctgaggaagc

SEQ ID NO: 787515 - DNA, 25 bp, Mus musculus
tatctttgtctcgttctgaggaagc

SEQ ID NO: 787516 - DNA, 25 bp, Mus musculus
tatctttgtgcaagcagctcccgga

SEQ ID NO: 787517 - DNA, 25 bp, Mus musculus
tatctttgtgcatgcagctcccgga

SEQ ID NO: 787518 - DNA, 25 bp, Mus musculus
tatctttgtggtcagctgcatttag

SEQ ID NO: 787519 - DNA, 25 bp, Mus musculus
tatctttgtggtgagctgcatttag

SEQ ID NO: 787520 - DNA, 25 bp, Mus musculus
tatctttgtgttaatctctgtgctg

SEQ ID NO: 787521 - DNA, 25 bp, Mus musculus
tatctttgtgtttatctctgtgctg

SEQ ID NO: 787522 - DNA, 25 bp, Mus musculus
tatcttttaagactcacctagggtt

SEQ ID NO: 787523 - DNA, 25 bp, Mus musculus
tatcttttaagagtcacctagggtt

SEQ ID NO: 787524 - DNA, 25 bp, Mus musculus
tatcttttaagtcttgtgggtagtt

SEQ ID NO: 787525 - DNA, 25 bp, Mus musculus
tatcttttaagtgttgtgggtagtt

SEQ ID NO: 787526 - DNA, 25 bp, Mus musculus
tatcttttagtcatgccacggtttt

SEQ ID NO: 787527 - DNA, 25 bp, Mus musculus
tatcttttagtcttgccacggtttt

SEQ ID NO: 787528 - DNA, 25 bp, Mus musculus
tatcttttattcactatggctataa

SEQ ID NO: 787529 - DNA, 25 bp, Mus musculus
tatcttttattctctatggctataa

SEQ ID NO: 787530 - DNA, 25 bp, Mus musculus
tatcttttcatgaatctggtagtgg

SEQ ID NO: 787531 - DNA, 25 bp, Mus musculus
tatcttttcatgtatctggtagtgg

SEQ ID NO: 787532 - DNA, 25 bp, Mus musculus
tatcttttccacattcctgaacttg

SEQ ID NO: 787533 - DNA, 25 bp, Mus musculus
tatcttttccactttcctgaacttg

SEQ ID NO: 787534 - DNA, 25 bp, Mus musculus
tatcttttccctatcagaattttat

SEQ ID NO: 787535 - DNA, 25 bp, Mus musculus
tatcttttccctttcagaattttat

SEQ ID NO: 787536 - DNA, 25 bp, Mus musculus
tatcttttccgcagatgtggctgaa

SEQ ID NO: 787537 - DNA, 25 bp, Mus musculus
tatcttttccgctgatgtggctgaa

SEQ ID NO: 787538 - DNA, 25 bp, Mus musculus
tatcttttccttctttctccttgtt

SEQ ID NO: 787539 - DNA, 25 bp, Mus musculus
tatcttttccttgtttctccttgtt

SEQ ID NO: 787540 - DNA, 25 bp, Mus musculus
tatcttttctaaattgttactttca

SEQ ID NO: 787541 - DNA, 25 bp, Mus musculus
tatcttttctaatttgttactttca

SEQ ID NO: 787542 - DNA, 25 bp, Mus musculus
tatcttttctttcataagccccttg

SEQ ID NO: 787543 - DNA, 25 bp, Mus musculus
tatcttttctttgataagccccttg

SEQ ID NO: 787544 - DNA, 25 bp, Mus musculus
tatcttttgtaaccagcaccaaatc

SEQ ID NO: 787545 - DNA, 25 bp, Mus musculus
tatcttttgtaagcagcaccaaatc

SEQ ID NO: 787546 - DNA, 25 bp, Mus musculus
tatcttttgtcaccagctctggcct

SEQ ID NO: 787547 - DNA, 25 bp, Mus musculus
tatcttttgtcagcagctctggcct

SEQ ID NO: 787548 - DNA, 25 bp, Mus musculus
tatcttttgtttacgttggtgctgg

SEQ ID NO: 787549 - DNA, 25 bp, Mus musculus
tatcttttgttttcgttggtgctgg

SEQ ID NO: 787550 - DNA, 25 bp, Mus musculus
tatctttttaatactcggccttcgg

SEQ ID NO: 787551 - DNA, 25 bp, Mus musculus
tatctttttaattctcggccttcgg

SEQ ID NO: 787552 - DNA, 25 bp, Mus musculus
tatctttttactacagtgatctgtg

SEQ ID NO: 787553 - DNA, 25 bp, Mus musculus
tatctttttacttcagtgatctgtg

SEQ ID NO: 787554 - DNA, 25 bp, Mus musculus
tatcttttttaaatgcctacaactt

SEQ ID NO: 787555 - DNA, 25 bp, Mus musculus
tatcttttttaattgcctacaactt

SEQ ID NO: 787556 - DNA, 25 bp, Mus musculus
tatcttttttatacctctggctgct

SEQ ID NO: 787557 - DNA, 25 bp, Mus musculus
tatcttttttattcctctggctgct

SEQ ID NO: 787558 - DNA, 25 bp, Mus musculus
tatgaaaaaccgacagtgcccctgg

SEQ ID NO: 787559 - DNA, 25 bp, Mus musculus
tatgaaaaaccgtcagtgcccctgg

SEQ ID NO: 787560 - DNA, 25 bp, Mus musculus
tatgaaaacacgctgtccggcccct

SEQ ID NO: 787561 - DNA, 25 bp, Mus musculus
tatgaaaacacggtgtccggcccct

SEQ ID NO: 787562 - DNA, 25 bp, Mus musculus
tatgaaaaccttccacatgtcccac

SEQ ID NO: 787563 - DNA, 25 bp, Mus musculus
tatgaaaaccttgcacatgtcccac

SEQ ID NO: 787564 - DNA, 25 bp, Mus musculus
tatgaaaactatcccctcgtgtact

SEQ ID NO: 787565 - DNA, 25 bp, Mus musculus
tatgaaaactatgccctcgtgtact

SEQ ID NO: 787566 - DNA, 25 bp, Mus musculus
tatgaaaatgacatgcttgccagca

SEQ ID NO: 787567 - DNA, 25 bp, Mus musculus
tatgaaaatgacttgcttgccagca

SEQ ID NO: 787568 - DNA, 25 bp, Mus musculus
tatgaaaatggaacccgtgtgacac

SEQ ID NO: 787569 - DNA, 25 bp, Mus musculus
tatgaaaatggatcccgtgtgacac

SEQ ID NO: 787570 - DNA, 25 bp, Mus musculus
tatgaaacaacaactgcccagcaat

SEQ ID NO: 787571 - DNA, 25 bp, Mus musculus
tatgaaacaacatctgcccagcaat

SEQ ID NO: 787572 - DNA, 25 bp, Mus musculus
tatgaaacaacccacaagcaccttt

SEQ ID NO: 787573 - DNA, 25 bp, Mus musculus
tatgaaacaaccgacaagcaccttt

SEQ ID NO: 787574 - DNA, 25 bp, Mus musculus
tatgaaacaatgatccgccccaaac

SEQ ID NO: 787575 - DNA, 25 bp, Mus musculus
tatgaaacaatgttccgccccaaac

SEQ ID NO: 787576 - DNA, 25 bp, Mus musculus
tatgaaacactaagttgctgctgct

SEQ ID NO: 787577 - DNA, 25 bp, Mus musculus
tatgaaacactatgttgctgctgct

SEQ ID NO: 787578 - DNA, 25 bp, Mus musculus
tatgaaacagacaggctcgggctcc

SEQ ID NO: 787579 - DNA, 25 bp, Mus musculus
tatgaaacagactggctcgggctcc

SEQ ID NO: 787580 - DNA, 25 bp, Mus musculus
tatgaaacagctcttgccactggct

SEQ ID NO: 787581 - DNA, 25 bp, Mus musculus
tatgaaacagctgttgccactggct

SEQ ID NO: 787582 - DNA, 25 bp, Mus musculus
tatgaaacccgacagcccacagaag

SEQ ID NO: 787583 - DNA, 25 bp, Mus musculus
tatgaaacccgagagcccacagaag

SEQ ID NO: 787584 - DNA, 25 bp, Mus musculus
tatgaaacgtgtaccagtgcctacc

SEQ ID NO: 787585 - DNA, 25 bp, Mus musculus
tatgaaacgtgttccagtgcctacc

SEQ ID NO: 787586 - DNA, 25 bp, Mus musculus
tatgaaactgaccttcagcctccaa

SEQ ID NO: 787587 - DNA, 25 bp, Mus musculus
tatgaaactgacgttcagcctccaa

SEQ ID NO: 787588 - DNA, 25 bp, Mus musculus
tatgaaatacaccaccacgaagccc

SEQ ID NO: 787589 - DNA, 25 bp, Mus musculus
tatgaaatacacgaccacgaagccc

SEQ ID NO: 787590 - DNA, 25 bp, Mus musculus
tatgaaatataaactggtggccggc

SEQ ID NO: 787591 - DNA, 25 bp, Mus musculus
tatgaaatataatctggtggccggc

SEQ ID NO: 787592 - DNA, 25 bp, Mus musculus
tatgaaatatgacgtataccctccc

SEQ ID NO: 787593 - DNA, 25 bp, Mus musculus
tatgaaatatgaggtataccctccc

SEQ ID NO: 787594 - DNA, 25 bp, Mus musculus
tatgaaatcatcctgacgctgggac

SEQ ID NO: 787595 - DNA, 25 bp, Mus musculus
tatgaaatcatcgtgacgctgggac

SEQ ID NO: 787596 - DNA, 25 bp, Mus musculus
tatgaaatccaaaacatgttcacac

SEQ ID NO: 787597 - DNA, 25 bp, Mus musculus
tatgaaatccaatacatgttcacac

SEQ ID NO: 787598 - DNA, 25 bp, Mus musculus
tatgaaatctatagtttccccgccc

SEQ ID NO: 787599 - DNA, 25 bp, Mus musculus
tatgaaatctattgtttccccgccc

SEQ ID NO: 787600 - DNA, 25 bp, Mus musculus
tatgaaatggaactgcacatgcaga

SEQ ID NO: 787601 - DNA, 25 bp, Mus musculus
tatgaaatggaagtgcacatgcaga

SEQ ID NO: 787602 - DNA, 25 bp, Mus musculus
tatgaaatgtcaccctgatactcag

SEQ ID NO: 787603 - DNA, 25 bp, Mus musculus
tatgaaatgtcagcctgatactcag

SEQ ID NO: 787604 - DNA, 25 bp, Mus musculus
tatgaaatgttcaggcatccatctc

SEQ ID NO: 787605 - DNA, 25 bp, Mus musculus
tatgaaatgttctggcatccatctc

SEQ ID NO: 787606 - DNA, 25 bp, Mus musculus
tatgaaatttcaacctctcttttac

SEQ ID NO: 787607 - DNA, 25 bp, Mus musculus
tatgaaatttcatcctctcttttac

SEQ ID NO: 787608 - DNA, 25 bp, Mus musculus
tatgaacagactccggttctagctc

SEQ ID NO: 787609 - DNA, 25 bp, Mus musculus
tatgaacagactgcggttctagctc

SEQ ID NO: 787610 - DNA, 25 bp, Mus musculus
tatgaacagcatagtcagatggatt

SEQ ID NO: 787611 - DNA, 25 bp, Mus musculus
tatgaacagcattgtcagatggatt

SEQ ID NO: 787612 - DNA, 25 bp, Mus musculus
tatgaacataaaagcccaccgagga

SEQ ID NO: 787613 - DNA, 25 bp, Mus musculus
tatgaacataaatgcccaccgagga

SEQ ID NO: 787614 - DNA, 25 bp, Mus musculus
tatgaacatccaagagcgaaataaa

SEQ ID NO: 787615 - DNA, 25 bp, Mus musculus
tatgaacatccatgagcgaaataaa

SEQ ID NO: 787616 - DNA, 25 bp, Mus musculus
tatgaacatgaacttgcagaaagcg

SEQ ID NO: 787617 - DNA, 25 bp, Mus musculus
tatgaacatgaagttgcagaaagcg

SEQ ID NO: 787618 - DNA, 25 bp, Mus musculus
tatgaacatttcaaaaggcccaaag

SEQ ID NO: 787619 - DNA, 25 bp, Mus musculus
tatgaacatttctaaaggcccaaag

SEQ ID NO: 787620 - DNA, 25 bp, Mus musculus
tatgaaccaaccatcaagctctttc

SEQ ID NO: 787621 - DNA, 25 bp, Mus musculus
tatgaaccaaccttcaagctctttc

SEQ ID NO: 787622 - DNA, 25 bp, Mus musculus
tatgaaccacttaagtctgcctacc

SEQ ID NO: 787623 - DNA, 25 bp, Mus musculus
tatgaaccactttagtctgcctacc

SEQ ID NO: 787624 - DNA, 25 bp, Mus musculus
tatgaaccccaacggctgttctgag

SEQ ID NO: 787625 - DNA, 25 bp, Mus musculus
tatgaaccccaagggctgttctgag

SEQ ID NO: 787626 - DNA, 25 bp, Mus musculus
tatgaacccccaatttcgaacactt

SEQ ID NO: 787627 - DNA, 25 bp, Mus musculus
tatgaacccccattttcgaacactt

SEQ ID NO: 787628 - DNA, 25 bp, Mus musculus
tatgaacccctgacctttaaggact

SEQ ID NO: 787629 - DNA, 25 bp, Mus musculus
tatgaacccctgtcctttaaggact

SEQ ID NO: 787630 - DNA, 25 bp, Mus musculus
tatgaacctaaacaaccctctcaaa

SEQ ID NO: 787631 - DNA, 25 bp, Mus musculus
tatgaacctaaagaaccctctcaaa

SEQ ID NO: 787632 - DNA, 25 bp, Mus musculus
tatgaaccttaaaacatctcctgag

SEQ ID NO: 787633 - DNA, 25 bp, Mus musculus
tatgaaccttaatacatctcctgag

SEQ ID NO: 787634 - DNA, 25 bp, Mus musculus
tatgaacgcaggcaagtttcctctg

SEQ ID NO: 787635 - DNA, 25 bp, Mus musculus
tatgaacgcagggaagtttcctctg

SEQ ID NO: 787636 - DNA, 25 bp, Mus musculus
tatgaacgcctcatcctggatgtct

SEQ ID NO: 787637 - DNA, 25 bp, Mus musculus
tatgaacgcctcttcctggatgtct

SEQ ID NO: 787638 - DNA, 25 bp, Mus musculus
tatgaacgcgtacctcctttgtaaa

SEQ ID NO: 787639 - DNA, 25 bp, Mus musculus
tatgaacgcgtagctcctttgtaaa

SEQ ID NO: 787640 - DNA, 25 bp, Mus musculus
tatgaacgggttcactcctcactta

SEQ ID NO: 787641 - DNA, 25 bp, Mus musculus
tatgaacgggttgactcctcactta

SEQ ID NO: 787642 - DNA, 25 bp, Mus musculus
tatgaacggtgacggccatctccta

SEQ ID NO: 787643 - DNA, 25 bp, Mus musculus
tatgaacggtgagggccatctccta

SEQ ID NO: 787644 - DNA, 25 bp, Mus musculus
tatgaacgtctacctcggaatactg

SEQ ID NO: 787645 - DNA, 25 bp, Mus musculus
tatgaacgtctagctcggaatactg

SEQ ID NO: 787646 - DNA, 25 bp, Mus musculus
tatgaactaactagctgtgtgacct

SEQ ID NO: 787647 - DNA, 25 bp, Mus musculus
tatgaactaacttgctgtgtgacct

SEQ ID NO: 787648 - DNA, 25 bp, Mus musculus
tatgaactacctcgcatgagtactg

SEQ ID NO: 787649 - DNA, 25 bp, Mus musculus
tatgaactacctggcatgagtactg

SEQ ID NO: 787650 - DNA, 25 bp, Mus musculus
tatgaactcctacggcaaacacagt

SEQ ID NO: 787651 - DNA, 25 bp, Mus musculus
tatgaactcctagggcaaacacagt

SEQ ID NO: 787652 - DNA, 25 bp, Mus musculus
tatgaactcggcactttttaaattt

SEQ ID NO: 787653 - DNA, 25 bp, Mus musculus
tatgaactcggctctttttaaattt

SEQ ID NO: 787654 - DNA, 25 bp, Mus musculus
tatgaactgcctcaaaacggcccct

SEQ ID NO: 787655 - DNA, 25 bp, Mus musculus
tatgaactgcctgaaaacggcccct

SEQ ID NO: 787656 - DNA, 25 bp, Mus musculus
tatgaacttcacctgtctatccatt

SEQ ID NO: 787657 - DNA, 25 bp, Mus musculus
tatgaacttcacgtgtctatccatt

SEQ ID NO: 787658 - DNA, 25 bp, Mus musculus
tatgaactttggaagatccattgtc

SEQ ID NO: 787659 - DNA, 25 bp, Mus musculus
tatgaactttggtagatccattgtc

SEQ ID NO: 787660 - DNA, 25 bp, Mus musculus
tatgaagaacttaggagctattgct

SEQ ID NO: 787661 - DNA, 25 bp, Mus musculus
tatgaagaactttggagctattgct

SEQ ID NO: 787662 - DNA, 25 bp, Mus musculus
tatgaagacattctgcggaacgccg

SEQ ID NO: 787663 - DNA, 25 bp, Mus musculus
tatgaagacattgtgcggaacgccg

SEQ ID NO: 787664 - DNA, 25 bp, Mus musculus
tatgaagacggcattctccacgacg

SEQ ID NO: 787665 - DNA, 25 bp, Mus musculus
tatgaagacggctttctccacgacg

SEQ ID NO: 787666 - DNA, 25 bp, Mus musculus
tatgaagactggcaaacccctccaa

SEQ ID NO: 787667 - DNA, 25 bp, Mus musculus
tatgaagactgggaaacccctccaa

SEQ ID NO: 787668 - DNA, 25 bp, Mus musculus
tatgaagagaacagacacgtcctta

SEQ ID NO: 787669 - DNA, 25 bp, Mus musculus
tatgaagagaactgacacgtcctta

SEQ ID NO: 787670 - DNA, 25 bp, Mus musculus
tatgaagagcaacacttctctctct

SEQ ID NO: 787671 - DNA, 25 bp, Mus musculus
tatgaagagcaagacttctctctct

SEQ ID NO: 787672 - DNA, 25 bp, Mus musculus
tatgaagagctgcactcctaccaca

SEQ ID NO: 787673 - DNA, 25 bp, Mus musculus
tatgaagagctggactcctaccaca

SEQ ID NO: 787674 - DNA, 25 bp, Mus musculus
tatgaagaggaacatcgccacctat

SEQ ID NO: 787675 - DNA, 25 bp, Mus musculus
tatgaagaggaagatcgccacctat

SEQ ID NO: 787676 - DNA, 25 bp, Mus musculus
tatgaagaggtcatggcggtccttg

SEQ ID NO: 787677 - DNA, 25 bp, Mus musculus
tatgaagaggtcttggcggtccttg

SEQ ID NO: 787678 - DNA, 25 bp, Mus musculus
tatgaagagtatcctgcccgggccc

SEQ ID NO: 787679 - DNA, 25 bp, Mus musculus
tatgaagagtatgctgcccgggccc

SEQ ID NO: 787680 - DNA, 25 bp, Mus musculus
tatgaagcagatacccaaaggctca

SEQ ID NO: 787681 - DNA, 25 bp, Mus musculus
tatgaagcagattcccaaaggctca

SEQ ID NO: 787682 - DNA, 25 bp, Mus musculus
tatgaagcagctccctcctccgtat

SEQ ID NO: 787683 - DNA, 25 bp, Mus musculus
tatgaagcagctgcctcctccgtat

SEQ ID NO: 787684 - DNA, 25 bp, Mus musculus
tatgaagccatcaacttagcaaaat

SEQ ID NO: 787685 - DNA, 25 bp, Mus musculus
tatgaagccatctacttagcaaaat

SEQ ID NO: 787686 - DNA, 25 bp, Mus musculus
tatgaagccctaagtacccaggtgc

SEQ ID NO: 787687 - DNA, 25 bp, Mus musculus
tatgaagccctatgtacccaggtgc

SEQ ID NO: 787688 - DNA, 25 bp, Mus musculus
tatgaagcctcaacggaaatttgta

SEQ ID NO: 787689 - DNA, 25 bp, Mus musculus
tatgaagcctcaattgctcttggcc

SEQ ID NO: 787690 - DNA, 25 bp, Mus musculus
tatgaagcctcatcggaaatttgta

SEQ ID NO: 787691 - DNA, 25 bp, Mus musculus
tatgaagcctcatttgctcttggcc

SEQ ID NO: 787692 - DNA, 25 bp, Mus musculus
tatgaagcgtcacgttggatatgcc

SEQ ID NO: 787693 - DNA, 25 bp, Mus musculus
tatgaagcgtcaggttggatatgcc

SEQ ID NO: 787694 - DNA, 25 bp, Mus musculus
tatgaagctcgtctggtgggcaacc

SEQ ID NO: 787695 - DNA, 25 bp, Mus musculus
tatgaagctcgtgtggtgggcaacc

SEQ ID NO: 787696 - DNA, 25 bp, Mus musculus
tatgaagctgtcagccatcggagat

SEQ ID NO: 787697 - DNA, 25 bp, Mus musculus
tatgaagctgtctgccatcggagat

SEQ ID NO: 787698 - DNA, 25 bp, Mus musculus
tatgaagctgttcaaatgtctttat

SEQ ID NO: 787699 - DNA, 25 bp, Mus musculus
tatgaagctgttgaaatgtctttat

SEQ ID NO: 787700 - DNA, 25 bp, Mus musculus
tatgaaggaccaaactgcccacagg

SEQ ID NO: 787701 - DNA, 25 bp, Mus musculus
tatgaaggaccatactgcccacagg

SEQ ID NO: 787702 - DNA, 25 bp, Mus musculus
tatgaaggagtccacccagaggcct

SEQ ID NO: 787703 - DNA, 25 bp, Mus musculus
tatgaaggagtcgacccagaggcct

SEQ ID NO: 787704 - DNA, 25 bp, Mus musculus
tatgaaggccagcttcaccttcctg

SEQ ID NO: 787705 - DNA, 25 bp, Mus musculus
tatgaaggccaggttcaccttcctg

SEQ ID NO: 787706 - DNA, 25 bp, Mus musculus
tatgaaggccttccctgcaccaact

SEQ ID NO: 787707 - DNA, 25 bp, Mus musculus
tatgaaggccttgcctgcaccaact

SEQ ID NO: 787708 - DNA, 25 bp, Mus musculus
tatgaaggctgactttattcctagc

SEQ ID NO: 787709 - DNA, 25 bp, Mus musculus
tatgaaggctgagtttattcctagc

SEQ ID NO: 787710 - DNA, 25 bp, Mus musculus
tatgaaggtcagactccactggccg

SEQ ID NO: 787711 - DNA, 25 bp, Mus musculus
tatgaaggtcagtctccactggccg

SEQ ID NO: 787712 - DNA, 25 bp, Mus musculus
tatgaaggtgctaaagcccctgtcc

SEQ ID NO: 787713 - DNA, 25 bp, Mus musculus
tatgaaggtgcttaagcccctgtcc

SEQ ID NO: 787714 - DNA, 25 bp, Mus musculus
tatgaaggttttcctgaaggtacct

SEQ ID NO: 787715 - DNA, 25 bp, Mus musculus
tatgaaggttttgctgaaggtacct

SEQ ID NO: 787716 - DNA, 25 bp, Mus musculus
tatgaagtccataacctacagcacc

SEQ ID NO: 787717 - DNA, 25 bp, Mus musculus
tatgaagtccattacctacagcacc

SEQ ID NO: 787718 - DNA, 25 bp, Mus musculus
tatgaagtgctcacgctctgatcga

SEQ ID NO: 787719 - DNA, 25 bp, Mus musculus
tatgaagtgctctcgctctgatcga

SEQ ID NO: 787720 - DNA, 25 bp, Mus musculus
tatgaagtgtgcaatctgtagacct

SEQ ID NO: 787721 - DNA, 25 bp, Mus musculus
tatgaagtgtgctatctgtagacct

SEQ ID NO: 787722 - DNA, 25 bp, Mus musculus
tatgaagtgttgctggtactatcca

SEQ ID NO: 787723 - DNA, 25 bp, Mus musculus
tatgaagtgttggtggtactatcca

SEQ ID NO: 787724 - DNA, 25 bp, Mus musculus
tatgaagtttgcagttctggcaata

SEQ ID NO: 787725 - DNA, 25 bp, Mus musculus
tatgaagtttgctgttctggcaata

SEQ ID NO: 787726 - DNA, 25 bp, Mus musculus
tatgaatacccacatgagctccagt

SEQ ID NO: 787727 - DNA, 25 bp, Mus musculus
tatgaatacccagatgagctccagt

SEQ ID NO: 787728 - DNA, 25 bp, Mus musculus
tatgaatagcccagagatcacctct

SEQ ID NO: 787729 - DNA, 25 bp, Mus musculus
tatgaatagccctgagatcacctct

SEQ ID NO: 787730 - DNA, 25 bp, Mus musculus
tatgaatatcacagcctctccagag

SEQ ID NO: 787731 - DNA, 25 bp, Mus musculus
tatgaatatcactgcctctccagag

SEQ ID NO: 787732 - DNA, 25 bp, Mus musculus
tatgaatatcatccagtctgtgcag

SEQ ID NO: 787733 - DNA, 25 bp, Mus musculus
tatgaatatcatgcagtctgtgcag

SEQ ID NO: 787734 - DNA, 25 bp, Mus musculus
tatgaatcacacattctccatggcc

SEQ ID NO: 787735 - DNA, 25 bp, Mus musculus
tatgaatcacactttctccatggcc

SEQ ID NO: 787736 - DNA, 25 bp, Mus musculus
tatgaatccaggaggcaaccccatg

SEQ ID NO: 787737 - DNA, 25 bp, Mus musculus
tatgaatccaggtggcaaccccatg

SEQ ID NO: 787738 - DNA, 25 bp, Mus musculus
tatgaatccggtactgctgctcagt

SEQ ID NO: 787739 - DNA, 25 bp, Mus musculus
tatgaatccggttctgctgctcagt

SEQ ID NO: 787740 - DNA, 25 bp, Mus musculus
tatgaatcctacagttgtcctttta

SEQ ID NO: 787741 - DNA, 25 bp, Mus musculus
tatgaatcctactgttgtcctttta

SEQ ID NO: 787742 - DNA, 25 bp, Mus musculus
tatgaatcgatactctgcccagaag

SEQ ID NO: 787743 - DNA, 25 bp, Mus musculus
tatgaatcgatagtctgcccagaag

SEQ ID NO: 787744 - DNA, 25 bp, Mus musculus
tatgaatgaccccagcatcaaggat

SEQ ID NO: 787745 - DNA, 25 bp, Mus musculus
tatgaatgacccgagcatcaaggat

SEQ ID NO: 787746 - DNA, 25 bp, Mus musculus
tatgaatgctaactatgttcctccc

SEQ ID NO: 787747 - DNA, 25 bp, Mus musculus
tatgaatgctaagtatgttcctccc

SEQ ID NO: 787748 - DNA, 25 bp, Mus musculus
tatgaatgctttcccacaaggctgt

SEQ ID NO: 787749 - DNA, 25 bp, Mus musculus
tatgaatgctttgccacaaggctgt

SEQ ID NO: 787750 - DNA, 25 bp, Mus musculus
tatgaatggcatatctaactgtatt

SEQ ID NO: 787751 - DNA, 25 bp, Mus musculus
tatgaatggcatttctaactgtatt

SEQ ID NO: 787752 - DNA, 25 bp, Mus musculus
tatgaatgggaacctctgccagcct

SEQ ID NO: 787753 - DNA, 25 bp, Mus musculus
tatgaatgggaagctctgccagcct

SEQ ID NO: 787754 - DNA, 25 bp, Mus musculus
tatgaatgtcatctgcggtactgcg

SEQ ID NO: 787755 - DNA, 25 bp, Mus musculus
tatgaatgtcatgtgcggtactgcg

SEQ ID NO: 787756 - DNA, 25 bp, Mus musculus
tatgaatgtggtagcccttgcactt

SEQ ID NO: 787757 - DNA, 25 bp, Mus musculus
tatgaatgtggttgcccttgcactt

SEQ ID NO: 787758 - DNA, 25 bp, Mus musculus
tatgaattagccatcagccagccac

SEQ ID NO: 787759 - DNA, 25 bp, Mus musculus
tatgaattagccttcagccagccac

SEQ ID NO: 787760 - DNA, 25 bp, Mus musculus
tatgaattcaggaggcttaatggta

SEQ ID NO: 787761 - DNA, 25 bp, Mus musculus
tatgaattcaggtggcttaatggta

SEQ ID NO: 787762 - DNA, 25 bp, Mus musculus
tatgaattcagtcctcctcagagtg

SEQ ID NO: 787763 - DNA, 25 bp, Mus musculus
tatgaattcagtgctcctcagagtg

SEQ ID NO: 787764 - DNA, 25 bp, Mus musculus
tatgaattccatatataaccctgtg

SEQ ID NO: 787765 - DNA, 25 bp, Mus musculus
tatgaattccatttataaccctgtg

SEQ ID NO: 787766 - DNA, 25 bp, Mus musculus
tatgaattcctgcactacctgctag

SEQ ID NO: 787767 - DNA, 25 bp, Mus musculus
tatgaattcctggactacctgctag

SEQ ID NO: 787768 - DNA, 25 bp, Mus musculus
tatgaattctatccaacagtaggac

SEQ ID NO: 787769 - DNA, 25 bp, Mus musculus
tatgaattctatgcaacagtaggac

SEQ ID NO: 787770 - DNA, 25 bp, Mus musculus
tatgaattgcttaaccccaaaccca

SEQ ID NO: 787771 - DNA, 25 bp, Mus musculus
tatgaattgctttaccccaaaccca

SEQ ID NO: 787772 - DNA, 25 bp, Mus musculus
tatgaattgtccatgttttcctgag

SEQ ID NO: 787773 - DNA, 25 bp, Mus musculus
tatgaattgtccttgttttcctgag

SEQ ID NO: 787774 - DNA, 25 bp, Mus musculus
tatgaattgtgcctgctttctccat

SEQ ID NO: 787775 - DNA, 25 bp, Mus musculus
tatgaattgtgcgtgctttctccat

SEQ ID NO: 787776 - DNA, 25 bp, Mus musculus
tatgaatttataaacctttgtccct

SEQ ID NO: 787777 - DNA, 25 bp, Mus musculus
tatgaatttatatacctttgtccct

SEQ ID NO: 787778 - DNA, 25 bp, Mus musculus
tatgaatttcctccttacgcagagt

SEQ ID NO: 787779 - DNA, 25 bp, Mus musculus
tatgaatttcctgcttacgcagagt

SEQ ID NO: 787780 - DNA, 25 bp, Mus musculus
tatgaatttctgctcactctccttt

SEQ ID NO: 787781 - DNA, 25 bp, Mus musculus
tatgaatttctggtcactctccttt

SEQ ID NO: 787782 - DNA, 25 bp, Mus musculus
tatgaatttgctacctggagctgct

SEQ ID NO: 787783 - DNA, 25 bp, Mus musculus
tatgaatttgcttcctggagctgct

SEQ ID NO: 787784 - DNA, 25 bp, Mus musculus
tatgacaaaacactccctggccaat

SEQ ID NO: 787785 - DNA, 25 bp, Mus musculus
tatgacaaaacagtccctggccaat

SEQ ID NO: 787786 - DNA, 25 bp, Mus musculus
tatgacaaagatcagttcatgtgtg

SEQ ID NO: 787787 - DNA, 25 bp, Mus musculus
tatgacaaagatgagttcatgtgtg

SEQ ID NO: 787788 - DNA, 25 bp, Mus musculus
tatgacaacaatatccccacttctg

SEQ ID NO: 787789 - DNA, 25 bp, Mus musculus
tatgacaacaatttccccacttctg

SEQ ID NO: 787790 - DNA, 25 bp, Mus musculus
tatgacaactcactcaagattgtca

SEQ ID NO: 787791 - DNA, 25 bp, Mus musculus
tatgacaactcagtcaagattgtca

SEQ ID NO: 787792 - DNA, 25 bp, Mus musculus
tatgacaatctgactgtgccttatg

SEQ ID NO: 787793 - DNA, 25 bp, Mus musculus
tatgacaatctgtctgtgccttatg

SEQ ID NO: 787794 - DNA, 25 bp, Mus musculus
tatgacacatgacctacggtatgtg

SEQ ID NO: 787795 - DNA, 25 bp, Mus musculus
tatgacacatgagctacggtatgtg

SEQ ID NO: 787796 - DNA, 25 bp, Mus musculus
tatgacaccacactacggtttctct

SEQ ID NO: 787797 - DNA, 25 bp, Mus musculus
tatgacaccacactagacccagaca

SEQ ID NO: 787798 - DNA, 25 bp, Mus musculus
tatgacaccacagtacggtttctct

SEQ ID NO: 787799 - DNA, 25 bp, Mus musculus
tatgacaccacagtagacccagaca

SEQ ID NO: 787800 - DNA, 25 bp, Mus musculus
tatgacaccatcaagcacccaggag

SEQ ID NO: 787801 - DNA, 25 bp, Mus musculus
tatgacaccatctagcacccaggag

SEQ ID NO: 787802 - DNA, 25 bp, Mus musculus
tatgacacctacaccaaatttatag

SEQ ID NO: 787803 - DNA, 25 bp, Mus musculus
tatgacacctactccaaatttatag

SEQ ID NO: 787804 - DNA, 25 bp, Mus musculus
tatgacacgctgcacatcactggca

SEQ ID NO: 787805 - DNA, 25 bp, Mus musculus
tatgacacgctggacatcactggca

SEQ ID NO: 787806 - DNA, 25 bp, Mus musculus
tatgacacggtgcttctgcttgcga

SEQ ID NO: 787807 - DNA, 25 bp, Mus musculus
tatgacacggtggttctgcttgcga

SEQ ID NO: 787808 - DNA, 25 bp, Mus musculus
tatgacactcctatgcttggatatc

SEQ ID NO: 787809 - DNA, 25 bp, Mus musculus
tatgacactcctttgcttggatatc

SEQ ID NO: 787810 - DNA, 25 bp, Mus musculus
tatgacagacacctattgcagaact

SEQ ID NO: 787811 - DNA, 25 bp, Mus musculus
tatgacagacacgtattgcagaact

SEQ ID NO: 787812 - DNA, 25 bp, Mus musculus
tatgacagatagattccagagtacg

SEQ ID NO: 787813 - DNA, 25 bp, Mus musculus
tatgacagatagtttccagagtacg

SEQ ID NO: 787814 - DNA, 25 bp, Mus musculus
tatgacagcgtcacgagggccacca

SEQ ID NO: 787815 - DNA, 25 bp, Mus musculus
tatgacagcgtctcgagggccacca

SEQ ID NO: 787816 - DNA, 25 bp, Mus musculus
tatgacagtaaaaggcagcagctat

SEQ ID NO: 787817 - DNA, 25 bp, Mus musculus
tatgacagtaaatggcagcagctat

SEQ ID NO: 787818 - DNA, 25 bp, Mus musculus
tatgacagtatcagtgcaccagccc

SEQ ID NO: 787819 - DNA, 25 bp, Mus musculus
tatgacagtatctgtgcaccagccc

SEQ ID NO: 787820 - DNA, 25 bp, Mus musculus
tatgacagtgagcatttgtaatccc

SEQ ID NO: 787821 - DNA, 25 bp, Mus musculus
tatgacagtgaggatttgtaatccc

SEQ ID NO: 787822 - DNA, 25 bp, Mus musculus
tatgacatccgcaaggaccggtcag

SEQ ID NO: 787823 - DNA, 25 bp, Mus musculus
tatgacatccgctaggaccggtcag

SEQ ID NO: 787824 - DNA, 25 bp, Mus musculus
tatgacatgaccatccaggaagcct

SEQ ID NO: 787825 - DNA, 25 bp, Mus musculus
tatgacatgaccttccaggaagcct

SEQ ID NO: 787826 - DNA, 25 bp, Mus musculus
tatgacatgatcaccagtaaccttt

SEQ ID NO: 787827 - DNA, 25 bp, Mus musculus
tatgacatgatctccagtaaccttt

SEQ ID NO: 787828 - DNA, 25 bp, Mus musculus
tatgacatgcacaggcgccagaggc

SEQ ID NO: 787829 - DNA, 25 bp, Mus musculus
tatgacatgcactggcgccagaggc

SEQ ID NO: 787830 - DNA, 25 bp, Mus musculus
tatgacatggtacccaatgacccca

SEQ ID NO: 787831 - DNA, 25 bp, Mus musculus
tatgacatggtagccaatgacccca

SEQ ID NO: 787832 - DNA, 25 bp, Mus musculus
tatgacatgttccttgtagcctagt

SEQ ID NO: 787833 - DNA, 25 bp, Mus musculus
tatgacatgttcgttgtagcctagt

SEQ ID NO: 787834 - DNA, 25 bp, Mus musculus
tatgacattgtcagagtcttgactt

SEQ ID NO: 787835 - DNA, 25 bp, Mus musculus
tatgacattgtctgagtcttgactt

SEQ ID NO: 787836 - DNA, 25 bp, Mus musculus
tatgacatttcactcctccaggagg

SEQ ID NO: 787837 - DNA, 25 bp, Mus musculus
tatgacatttcagtcctccaggagg

SEQ ID NO: 787838 - DNA, 25 bp, Mus musculus
tatgacatttccccttgaaaatttc

SEQ ID NO: 787839 - DNA, 25 bp, Mus musculus
tatgacatttccgcttgaaaatttc

SEQ ID NO: 787840 - DNA, 25 bp, Mus musculus
tatgacattttccttcccttttcca

SEQ ID NO: 787841 - DNA, 25 bp, Mus musculus
tatgacattttcgttcccttttcca

SEQ ID NO: 787842 - DNA, 25 bp, Mus musculus
tatgaccaatgtccagcagtggctg

SEQ ID NO: 787843 - DNA, 25 bp, Mus musculus
tatgaccaatgtgcagcagtggctg

SEQ ID NO: 787844 - DNA, 25 bp, Mus musculus
tatgaccacaacatcccctacaaag

SEQ ID NO: 787845 - DNA, 25 bp, Mus musculus
tatgaccacaacttcccctacaaag

SEQ ID NO: 787846 - DNA, 25 bp, Mus musculus
tatgaccaccgtaagatcaatctgt

SEQ ID NO: 787847 - DNA, 25 bp, Mus musculus
tatgaccaccgttagatcaatctgt

SEQ ID NO: 787848 - DNA, 25 bp, Mus musculus
tatgaccacctgacctgagttggtg

SEQ ID NO: 787849 - DNA, 25 bp, Mus musculus
tatgaccacctgtcctgagttggtg

SEQ ID NO: 787850 - DNA, 25 bp, Mus musculus
tatgaccactcacatgtcggccctt

SEQ ID NO: 787851 - DNA, 25 bp, Mus musculus
tatgaccactcagatgtcggccctt

SEQ ID NO: 787852 - DNA, 25 bp, Mus musculus
tatgaccagcgacactaacttaact

SEQ ID NO: 787853 - DNA, 25 bp, Mus musculus
tatgaccagcgagactaacttaact

SEQ ID NO: 787854 - DNA, 25 bp, Mus musculus
tatgaccaggagcacatcaaacccc

SEQ ID NO: 787855 - DNA, 25 bp, Mus musculus
tatgaccaggaggacatcaaacccc

SEQ ID NO: 787856 - DNA, 25 bp, Mus musculus
tatgaccagggtctagacgagcttg

SEQ ID NO: 787857 - DNA, 25 bp, Mus musculus
tatgaccagggtgtagacgagcttg

SEQ ID NO: 787858 - DNA, 25 bp, Mus musculus
tatgaccatacaatccctttgaaaa

SEQ ID NO: 787859 - DNA, 25 bp, Mus musculus
tatgaccatacattccctttgaaaa

SEQ ID NO: 787860 - DNA, 25 bp, Mus musculus
tatgaccatcataatccccttcaat

SEQ ID NO: 787861 - DNA, 25 bp, Mus musculus
tatgaccatcattatccccttcaat

SEQ ID NO: 787862 - DNA, 25 bp, Mus musculus
tatgaccatggcagtaactgctgca

SEQ ID NO: 787863 - DNA, 25 bp, Mus musculus
tatgaccatggctgtaactgctgca

SEQ ID NO: 787864 - DNA, 25 bp, Mus musculus
tatgacccaaccagtgagtaccagc

SEQ ID NO: 787865 - DNA, 25 bp, Mus musculus
tatgacccaacctgtgagtaccagc

SEQ ID NO: 787866 - DNA, 25 bp, Mus musculus
tatgacccaacgcagaaggacccag

SEQ ID NO: 787867 - DNA, 25 bp, Mus musculus
tatgacccaacggagaaggacccag

SEQ ID NO: 787868 - DNA, 25 bp, Mus musculus
tatgacccaagaagtctagaaattc

SEQ ID NO: 787869 - DNA, 25 bp, Mus musculus
tatgacccaagatgtctagaaattc

SEQ ID NO: 787870 - DNA, 25 bp, Mus musculus
tatgacccactgaccaactactcag

SEQ ID NO: 787871 - DNA, 25 bp, Mus musculus
tatgacccactgtccaactactcag

SEQ ID NO: 787872 - DNA, 25 bp, Mus musculus
tatgacccagacagcgagactctaa

SEQ ID NO: 787873 - DNA, 25 bp, Mus musculus
tatgacccagactgcgagactctaa

SEQ ID NO: 787874 - DNA, 25 bp, Mus musculus
tatgacccagagatctgcagacaaa

SEQ ID NO: 787875 - DNA, 25 bp, Mus musculus
tatgacccagagttctgcagacaaa

SEQ ID NO: 787876 - DNA, 25 bp, Mus musculus
tatgacccatgcctggaagacggtg

SEQ ID NO: 787877 - DNA, 25 bp, Mus musculus
tatgacccatgcgtggaagacggtg

SEQ ID NO: 787878 - DNA, 25 bp, Mus musculus
tatgaccccaatactacagcggttc

SEQ ID NO: 787879 - DNA, 25 bp, Mus musculus
tatgaccccaattctacagcggttc

SEQ ID NO: 787880 - DNA, 25 bp, Mus musculus
tatgaccccacgagtacagttggaa

SEQ ID NO: 787881 - DNA, 25 bp, Mus musculus
tatgaccccacgtgtacagttggaa

SEQ ID NO: 787882 - DNA, 25 bp, Mus musculus
tatgaccccttcatgtcctaaggaa

SEQ ID NO: 787883 - DNA, 25 bp, Mus musculus
tatgaccccttcttgtcctaaggaa

SEQ ID NO: 787884 - DNA, 25 bp, Mus musculus
tatgacccttacacctgagggcaat

SEQ ID NO: 787885 - DNA, 25 bp, Mus musculus
tatgacccttactcctgagggcaat

SEQ ID NO: 787886 - DNA, 25 bp, Mus musculus
tatgaccgacgtcaaatataaccct

SEQ ID NO: 787887 - DNA, 25 bp, Mus musculus
tatgaccgacgtgaaatataaccct

SEQ ID NO: 787888 - DNA, 25 bp, Mus musculus
tatgacctacagagacatgcagact

SEQ ID NO: 787889 - DNA, 25 bp, Mus musculus
tatgacctacagtgacatgcagact

SEQ ID NO: 787890 - DNA, 25 bp, Mus musculus
tatgacctacgaaccgatcctaagg

SEQ ID NO: 787891 - DNA, 25 bp, Mus musculus
tatgacctacgatccgatcctaagg

SEQ ID NO: 787892 - DNA, 25 bp, Mus musculus
tatgacctaggccagagttgaactc

SEQ ID NO: 787893 - DNA, 25 bp, Mus musculus
tatgacctaggcgagagttgaactc

SEQ ID NO: 787894 - DNA, 25 bp, Mus musculus
tatgacctcttgcttgcccttttat

SEQ ID NO: 787895 - DNA, 25 bp, Mus musculus
tatgacctcttggttgcccttttat

SEQ ID NO: 787896 - DNA, 25 bp, Mus musculus
tatgacctgctcacagtgaaccaga

SEQ ID NO: 787897 - DNA, 25 bp, Mus musculus
tatgacctgctctcagtgaaccaga

SEQ ID NO: 787898 - DNA, 25 bp, Mus musculus
tatgacctggtcactgagaagatgt

SEQ ID NO: 787899 - DNA, 25 bp, Mus musculus
tatgacctggtctctgagaagatgt

SEQ ID NO: 787900 - DNA, 25 bp, Mus musculus
tatgacctgtacctcacccgagagc

SEQ ID NO: 787901 - DNA, 25 bp, Mus musculus
tatgacctgtacgtcacccgagagc

SEQ ID NO: 787902 - DNA, 25 bp, Mus musculus
tatgacctgtccatgctatgctttg

SEQ ID NO: 787903 - DNA, 25 bp, Mus musculus
tatgacctgtccttgctatgctttg

SEQ ID NO: 787904 - DNA, 25 bp, Mus musculus
tatgaccttaatatcaccttgtgac

SEQ ID NO: 787905 - DNA, 25 bp, Mus musculus
tatgaccttaatttcaccttgtgac

SEQ ID NO: 787906 - DNA, 25 bp, Mus musculus
tatgaccttagcacagagaactctg

SEQ ID NO: 787907 - DNA, 25 bp, Mus musculus
tatgaccttagctcagagaactctg

SEQ ID NO: 787908 - DNA, 25 bp, Mus musculus
tatgaccttcacatatgtggcataa

SEQ ID NO: 787909 - DNA, 25 bp, Mus musculus
tatgaccttcacttatgtggcataa

SEQ ID NO: 787910 - DNA, 25 bp, Mus musculus
tatgacctttctcctcagctaggaa

SEQ ID NO: 787911 - DNA, 25 bp, Mus musculus
tatgacctttctgctcagctaggaa

SEQ ID NO: 787912 - DNA, 25 bp, Mus musculus
tatgacgaggtacatcccaagcaac

SEQ ID NO: 787913 - DNA, 25 bp, Mus musculus
tatgacgaggtagatcccaagcaac

SEQ ID NO: 787914 - DNA, 25 bp, Mus musculus
tatgacgattatcctgactctgatg

SEQ ID NO: 787915 - DNA, 25 bp, Mus musculus
tatgacgattatgctgactctgatg

SEQ ID NO: 787916 - DNA, 25 bp, Mus musculus
tatgacgcaccaagggctgccctca

SEQ ID NO: 787917 - DNA, 25 bp, Mus musculus
tatgacgcaccatgggctgccctca

SEQ ID NO: 787918 - DNA, 25 bp, Mus musculus
tatgacgcagcgagacagagttata

SEQ ID NO: 787919 - DNA, 25 bp, Mus musculus
tatgacgcagcgtgacagagttata

SEQ ID NO: 787920 - DNA, 25 bp, Mus musculus
tatgacgctgtcctacgcaacagac

SEQ ID NO: 787921 - DNA, 25 bp, Mus musculus
tatgacgctgtcgtacgcaacagac

SEQ ID NO: 787922 - DNA, 25 bp, Mus musculus
tatgacgctgttactgttcaacaca

SEQ ID NO: 787923 - DNA, 25 bp, Mus musculus
tatgacgctgtttctgttcaacaca

SEQ ID NO: 787924 - DNA, 25 bp, Mus musculus
tatgacgctttccttttcaaaacaa

SEQ ID NO: 787925 - DNA, 25 bp, Mus musculus
tatgacgctttcgttttcaaaacaa

SEQ ID NO: 787926 - DNA, 25 bp, Mus musculus
tatgacggagcaagccctgggagac

SEQ ID NO: 787927 - DNA, 25 bp, Mus musculus
tatgacggagcatgccctgggagac

SEQ ID NO: 787928 - DNA, 25 bp, Mus musculus
tatgacggatacactggctccagga

SEQ ID NO: 787929 - DNA, 25 bp, Mus musculus
tatgacggatactctggctccagga

SEQ ID NO: 787930 - DNA, 25 bp, Mus musculus
tatgacggccttattctggtctaca

SEQ ID NO: 787931 - DNA, 25 bp, Mus musculus
tatgacggcctttttctggtctaca

SEQ ID NO: 787932 - DNA, 25 bp, Mus musculus
tatgacgtctgtagccaatgggaac

SEQ ID NO: 787933 - DNA, 25 bp, Mus musculus
tatgacgtctgttgccaatgggaac

SEQ ID NO: 787934 - DNA, 25 bp, Mus musculus
tatgacgttgtcaaaaatcccatgg

SEQ ID NO: 787935 - DNA, 25 bp, Mus musculus
tatgacgttgtctaaaatcccatgg

SEQ ID NO: 787936 - DNA, 25 bp, Mus musculus
tatgactaacacagtgatctccaac

SEQ ID NO: 787937 - DNA, 25 bp, Mus musculus
tatgactaacactgtgatctccaac

SEQ ID NO: 787938 - DNA, 25 bp, Mus musculus
tatgactacaccacagtattacttc

SEQ ID NO: 787939 - DNA, 25 bp, Mus musculus
tatgactacacctcagtattacttc

SEQ ID NO: 787940 - DNA, 25 bp, Mus musculus
tatgactacctacagctgggaccca

SEQ ID NO: 787941 - DNA, 25 bp, Mus musculus
tatgactacctagagctgggaccca

SEQ ID NO: 787942 - DNA, 25 bp, Mus musculus
tatgactactgtcggctgcgtgcca

SEQ ID NO: 787943 - DNA, 25 bp, Mus musculus
tatgactactgtgggctgcgtgcca

SEQ ID NO: 787944 - DNA, 25 bp, Mus musculus
tatgactagggcaccacgtactgag

SEQ ID NO: 787945 - DNA, 25 bp, Mus musculus
tatgactagggctccacgtactgag

SEQ ID NO: 787946 - DNA, 25 bp, Mus musculus
tatgactataacatccaggtctgtg

SEQ ID NO: 787947 - DNA, 25 bp, Mus musculus
tatgactataacttccaggtctgtg

SEQ ID NO: 787948 - DNA, 25 bp, Mus musculus
tatgactatgctcgccaggaggctg

SEQ ID NO: 787949 - DNA, 25 bp, Mus musculus
tatgactatgctggccaggaggctg

SEQ ID NO: 787950 - DNA, 25 bp, Mus musculus
tatgactcacaaactgccttgcatc

SEQ ID NO: 787951 - DNA, 25 bp, Mus musculus
tatgactcacaatctgccttgcatc

SEQ ID NO: 787952 - DNA, 25 bp, Mus musculus
tatgactccagaagtgcctgagcca

SEQ ID NO: 787953 - DNA, 25 bp, Mus musculus
tatgactccagatgtgcctgagcca

SEQ ID NO: 787954 - DNA, 25 bp, Mus musculus
tatgactccagtccctgcaagagaa

SEQ ID NO: 787955 - DNA, 25 bp, Mus musculus
tatgactccagtgcctgcaagagaa

SEQ ID NO: 787956 - DNA, 25 bp, Mus musculus
tatgactcccgcagtggcacacaca

SEQ ID NO: 787957 - DNA, 25 bp, Mus musculus
tatgactcccgctgtggcacacaca

SEQ ID NO: 787958 - DNA, 25 bp, Mus musculus
tatgactccctgaactgaatgtatc

SEQ ID NO: 787959 - DNA, 25 bp, Mus musculus
tatgactccctgtactgaatgtatc

SEQ ID NO: 787960 - DNA, 25 bp, Mus musculus
tatgactcttgactggaggccatac

SEQ ID NO: 787961 - DNA, 25 bp, Mus musculus
tatgactcttgagtggaggccatac

SEQ ID NO: 787962 - DNA, 25 bp, Mus musculus
tatgactgacaacacacgggcttca

SEQ ID NO: 787963 - DNA, 25 bp, Mus musculus
tatgactgacaagacacgggcttca

SEQ ID NO: 787964 - DNA, 25 bp, Mus musculus
tatgactgagctctaccccatacct

SEQ ID NO: 787965 - DNA, 25 bp, Mus musculus
tatgactgagctgtaccccatacct

SEQ ID NO: 787966 - DNA, 25 bp, Mus musculus
tatgactgattactgtcctcaggag

SEQ ID NO: 787967 - DNA, 25 bp, Mus musculus
tatgactgattagtgtcctcaggag

SEQ ID NO: 787968 - DNA, 25 bp, Mus musculus
tatgactgccatacagctgatccag

SEQ ID NO: 787969 - DNA, 25 bp, Mus musculus
tatgactgccattcagctgatccag

SEQ ID NO: 787970 - DNA, 25 bp, Mus musculus
tatgactgtcctctcgccctgttaa

SEQ ID NO: 787971 - DNA, 25 bp, Mus musculus
tatgactgtcctgtcgccctgttaa

SEQ ID NO: 787972 - DNA, 25 bp, Mus musculus
tatgactgtttgacgcagcgcatcg

SEQ ID NO: 787973 - DNA, 25 bp, Mus musculus
tatgactgtttgtcgcagcgcatcg

SEQ ID NO: 787974 - DNA, 25 bp, Mus musculus
tatgacttagcacgccaatccccaa

SEQ ID NO: 787975 - DNA, 25 bp, Mus musculus
tatgacttagcaggccaatccccaa

SEQ ID NO: 787976 - DNA, 25 bp, Mus musculus
tatgacttagtaattcctgaaacct

SEQ ID NO: 787977 - DNA, 25 bp, Mus musculus
tatgacttagtatttcctgaaacct

SEQ ID NO: 787978 - DNA, 25 bp, Mus musculus
tatgacttcaacaggcacaggaagc

SEQ ID NO: 787979 - DNA, 25 bp, Mus musculus
tatgacttcaactggcacaggaagc

SEQ ID NO: 787980 - DNA, 25 bp, Mus musculus
tatgacttgactagggctggggaaa

SEQ ID NO: 787981 - DNA, 25 bp, Mus musculus
tatgacttgacttgggctggggaaa

SEQ ID NO: 787982 - DNA, 25 bp, Mus musculus
tatgacttgcataaaacactaacag

SEQ ID NO: 787983 - DNA, 25 bp, Mus musculus
tatgacttgcattaaacactaacag

SEQ ID NO: 787984 - DNA, 25 bp, Mus musculus
tatgacttggctccgtttcgaatga

SEQ ID NO: 787985 - DNA, 25 bp, Mus musculus
tatgacttggctgcgtttcgaatga

SEQ ID NO: 787986 - DNA, 25 bp, Mus musculus
tatgacttgtctattcagcaccata

SEQ ID NO: 787987 - DNA, 25 bp, Mus musculus
tatgacttgtcttttcagcaccata

SEQ ID NO: 787988 - DNA, 25 bp, Mus musculus
tatgactttactagggcacgattta

SEQ ID NO: 787989 - DNA, 25 bp, Mus musculus
tatgactttacttgggcacgattta

SEQ ID NO: 787990 - DNA, 25 bp, Mus musculus
tatgactttcatattaggacactaa

SEQ ID NO: 787991 - DNA, 25 bp, Mus musculus
tatgactttcattttaggacactaa

SEQ ID NO: 787992 - DNA, 25 bp, Mus musculus
tatgactttctaatcactcctgacc

SEQ ID NO: 787993 - DNA, 25 bp, Mus musculus
tatgactttctattcactcctgacc

SEQ ID NO: 787994 - DNA, 25 bp, Mus musculus
tatgacttttccaccttgcacttgc

SEQ ID NO: 787995 - DNA, 25 bp, Mus musculus
tatgacttttcctccttgcacttgc

SEQ ID NO: 787996 - DNA, 25 bp, Mus musculus
tatgagaacccaagccccatgtgaa

SEQ ID NO: 787997 - DNA, 25 bp, Mus musculus
tatgagaacccatgccccatgtgaa

SEQ ID NO: 787998 - DNA, 25 bp, Mus musculus
tatgagaaccgaatccaggtaacta

SEQ ID NO: 787999 - DNA, 25 bp, Mus musculus
tatgagaaccgattccaggtaacta

SEQ ID NO: 788000 - DNA, 25 bp, Mus musculus
tatgagaagaaaacctctcctccct

SEQ ID NO: 788001 - DNA, 25 bp, Mus musculus
tatgagaagaaatcctctcctccct

SEQ ID NO: 788002 - DNA, 25 bp, Mus musculus
tatgagacataccaacattccctag

SEQ ID NO: 788003 - DNA, 25 bp, Mus musculus
tatgagacatacgaacattccctag

SEQ ID NO: 788004 - DNA, 25 bp, Mus musculus
tatgagaccacaccttcttcatggc

SEQ ID NO: 788005 - DNA, 25 bp, Mus musculus
tatgagaccacagcttcttcatggc

SEQ ID NO: 788006 - DNA, 25 bp, Mus musculus
tatgagacctcgctcaaggtgggca

SEQ ID NO: 788007 - DNA, 25 bp, Mus musculus
tatgagacctcggtcaaggtgggca

SEQ ID NO: 788008 - DNA, 25 bp, Mus musculus
tatgagacgctgaggctatgctcgt

SEQ ID NO: 788009 - DNA, 25 bp, Mus musculus
tatgagacgctgtggctatgctcgt

SEQ ID NO: 788010 - DNA, 25 bp, Mus musculus
tatgagactgtgataatgcctgtgt

SEQ ID NO: 788011 - DNA, 25 bp, Mus musculus
tatgagactgtgttaatgcctgtgt

SEQ ID NO: 788012 - DNA, 25 bp, Mus musculus
tatgagagaactcccctaaagcttt

SEQ ID NO: 788013 - DNA, 25 bp, Mus musculus
tatgagagaactgccctaaagcttt

SEQ ID NO: 788014 - DNA, 25 bp, Mus musculus
tatgagagcaatcctgtcacagaag

SEQ ID NO: 788015 - DNA, 25 bp, Mus musculus
tatgagagcaatgctgtcacagaag

SEQ ID NO: 788016 - DNA, 25 bp, Mus musculus
tatgagagcatgatcgcagacccac

SEQ ID NO: 788017 - DNA, 25 bp, Mus musculus
tatgagagcatgttcgcagacccac

SEQ ID NO: 788018 - DNA, 25 bp, Mus musculus
tatgagagccacaacaacactacag

SEQ ID NO: 788019 - DNA, 25 bp, Mus musculus
tatgagagccactacaacactacag

SEQ ID NO: 788020 - DNA, 25 bp, Mus musculus
tatgagagctaaatacctgtaacac

SEQ ID NO: 788021 - DNA, 25 bp, Mus musculus
tatgagagctaattacctgtaacac

SEQ ID NO: 788022 - DNA, 25 bp, Mus musculus
tatgagaggactcgccaggacccag

SEQ ID NO: 788023 - DNA, 25 bp, Mus musculus
tatgagaggactggccaggacccag

SEQ ID NO: 788024 - DNA, 25 bp, Mus musculus
tatgagaggcgtcctgtgctaacct

SEQ ID NO: 788025 - DNA, 25 bp, Mus musculus
tatgagaggcgtgctgtgctaacct

SEQ ID NO: 788026 - DNA, 25 bp, Mus musculus
tatgagagtggtcgtcccagtgttc

SEQ ID NO: 788027 - DNA, 25 bp, Mus musculus
tatgagagtggtggtcccagtgttc

SEQ ID NO: 788028 - DNA, 25 bp, Mus musculus
tatgagataggacaacagataccca

SEQ ID NO: 788029 - DNA, 25 bp, Mus musculus
tatgagataggagaacagataccca

SEQ ID NO: 788030 - DNA, 25 bp, Mus musculus
tatgagatatgtctgaccttcctac

SEQ ID NO: 788031 - DNA, 25 bp, Mus musculus
tatgagatatgtgtgaccttcctac

SEQ ID NO: 788032 - DNA, 25 bp, Mus musculus
tatgagatccagaacgccccggagc

SEQ ID NO: 788033 - DNA, 25 bp, Mus musculus
tatgagatccagtacgccccggagc

SEQ ID NO: 788034 - DNA, 25 bp, Mus musculus
tatgagatccatagctgagcttgcg

SEQ ID NO: 788035 - DNA, 25 bp, Mus musculus
tatgagatccattgctgagcttgcg

SEQ ID NO: 788036 - DNA, 25 bp, Mus musculus
tatgagatgcctccgtttactgccg

SEQ ID NO: 788037 - DNA, 25 bp, Mus musculus
tatgagatgcctgcgtttactgccg

SEQ ID NO: 788038 - DNA, 25 bp, Mus musculus
tatgagatgcttagactgactctaa

SEQ ID NO: 788039 - DNA, 25 bp, Mus musculus
tatgagatgctttgactgactctaa

SEQ ID NO: 788040 - DNA, 25 bp, Mus musculus
tatgagatgtatctctcgctctctc

SEQ ID NO: 788041 - DNA, 25 bp, Mus musculus
tatgagatgtatgtctcgctctctc

SEQ ID NO: 788042 - DNA, 25 bp, Mus musculus
tatgagattaaaagcatgtatcacc

SEQ ID NO: 788043 - DNA, 25 bp, Mus musculus
tatgagattaaatgcatgtatcacc

SEQ ID NO: 788044 - DNA, 25 bp, Mus musculus
tatgagattcctcctataacgcctc

SEQ ID NO: 788045 - DNA, 25 bp, Mus musculus
tatgagattcctgctataacgcctc

SEQ ID NO: 788046 - DNA, 25 bp, Mus musculus
tatgagatttatacagctactgtct

SEQ ID NO: 788047 - DNA, 25 bp, Mus musculus
tatgagatttattcagctactgtct

SEQ ID NO: 788048 - DNA, 25 bp, Mus musculus
tatgagcaaattctagcctaaactt

SEQ ID NO: 788049 - DNA, 25 bp, Mus musculus
tatgagcaaattgtagcctaaactt

SEQ ID NO: 788050 - DNA, 25 bp, Mus musculus
tatgagcacatccaggcagcgctgt

SEQ ID NO: 788051 - DNA, 25 bp, Mus musculus
tatgagcacatcgaggcagcgctgt

SEQ ID NO: 788052 - DNA, 25 bp, Mus musculus
tatgagcaccgaagacaaccagttt

SEQ ID NO: 788053 - DNA, 25 bp, Mus musculus
tatgagcaccgatgacaaccagttt

SEQ ID NO: 788054 - DNA, 25 bp, Mus musculus
tatgagcactagatgaactttcttc

SEQ ID NO: 788055 - DNA, 25 bp, Mus musculus
tatgagcactagttgaactttcttc

SEQ ID NO: 788056 - DNA, 25 bp, Mus musculus
tatgagcagcgtagggagcagcccc

SEQ ID NO: 788057 - DNA, 25 bp, Mus musculus
tatgagcagcgttgggagcagcccc

SEQ ID NO: 788058 - DNA, 25 bp, Mus musculus
tatgagcagtgtacagagtccaagt

SEQ ID NO: 788059 - DNA, 25 bp, Mus musculus
tatgagcagtgtacctgaccaattc

SEQ ID NO: 788060 - DNA, 25 bp, Mus musculus
tatgagcagtgttcagagtccaagt

SEQ ID NO: 788061 - DNA, 25 bp, Mus musculus
tatgagcagtgttcctgaccaattc

SEQ ID NO: 788062 - DNA, 25 bp, Mus musculus
tatgagcagttcatagacccctaca

SEQ ID NO: 788063 - DNA, 25 bp, Mus musculus
tatgagcagttcttagacccctaca

SEQ ID NO: 788064 - DNA, 25 bp, Mus musculus
tatgagcatcctactgtaattccct

SEQ ID NO: 788065 - DNA, 25 bp, Mus musculus
tatgagcatccttctgtaattccct

SEQ ID NO: 788066 - DNA, 25 bp, Mus musculus
tatgagccagagcatgttgcagcaa

SEQ ID NO: 788067 - DNA, 25 bp, Mus musculus
tatgagccagaggatgttgcagcaa

SEQ ID NO: 788068 - DNA, 25 bp, Mus musculus
tatgagcctgtgcagttgccagtct

SEQ ID NO: 788069 - DNA, 25 bp, Mus musculus
tatgagcctgtggagttgccagtct

SEQ ID NO: 788070 - DNA, 25 bp, Mus musculus
tatgagccttcaactgtaccctaga

SEQ ID NO: 788071 - DNA, 25 bp, Mus musculus
tatgagccttcatctgtaccctaga

SEQ ID NO: 788072 - DNA, 25 bp, Mus musculus
tatgagctaagactcctctgcagga

SEQ ID NO: 788073 - DNA, 25 bp, Mus musculus
tatgagctaagagtcctctgcagga

SEQ ID NO: 788074 - DNA, 25 bp, Mus musculus
tatgagctagccacctttatctgta

SEQ ID NO: 788075 - DNA, 25 bp, Mus musculus
tatgagctagcctcctttatctgta

SEQ ID NO: 788076 - DNA, 25 bp, Mus musculus
tatgagctcacacatcaaagcccag

SEQ ID NO: 788077 - DNA, 25 bp, Mus musculus
tatgagctcacagatcaaagcccag

SEQ ID NO: 788078 - DNA, 25 bp, Mus musculus
tatgagctcagacccttgacatggt

SEQ ID NO: 788079 - DNA, 25 bp, Mus musculus
tatgagctcagagccttgacatggt

SEQ ID NO: 788080 - DNA, 25 bp, Mus musculus
tatgagctctcgctactcacagaaa

SEQ ID NO: 788081 - DNA, 25 bp, Mus musculus
tatgagctctcggtactcacagaaa

SEQ ID NO: 788082 - DNA, 25 bp, Mus musculus
tatgagctgaggaccaggctacgct

SEQ ID NO: 788083 - DNA, 25 bp, Mus musculus
tatgagctgaggtccaggctacgct

SEQ ID NO: 788084 - DNA, 25 bp, Mus musculus
tatgagctgctcacgctgcatctgt

SEQ ID NO: 788085 - DNA, 25 bp, Mus musculus
tatgagctgctctcgctgcatctgt

SEQ ID NO: 788086 - DNA, 25 bp, Mus musculus
tatgagctggtgctggacgccatct

SEQ ID NO: 788087 - DNA, 25 bp, Mus musculus
tatgagctggtggtggacgccatct

SEQ ID NO: 788088 - DNA, 25 bp, Mus musculus
tatgagctgtcaatctttggccatg

SEQ ID NO: 788089 - DNA, 25 bp, Mus musculus
tatgagctgtcattctttggccatg

SEQ ID NO: 788090 - DNA, 25 bp, Mus musculus
tatgagcttacacccctgagtcttc

SEQ ID NO: 788091 - DNA, 25 bp, Mus musculus
tatgagcttacagccctgagtcttc

SEQ ID NO: 788092 - DNA, 25 bp, Mus musculus
tatgaggaacagaagtccatctttt

SEQ ID NO: 788093 - DNA, 25 bp, Mus musculus
tatgaggaacagtagtccatctttt

SEQ ID NO: 788094 - DNA, 25 bp, Mus musculus
tatgaggaacatccctggccgggat

SEQ ID NO: 788095 - DNA, 25 bp, Mus musculus
tatgaggaacatgcctggccgggat

SEQ ID NO: 788096 - DNA, 25 bp, Mus musculus
tatgaggaacccaggacggtcatct

SEQ ID NO: 788097 - DNA, 25 bp, Mus musculus
tatgaggaaccctggacggtcatct

SEQ ID NO: 788098 - DNA, 25 bp, Mus musculus
tatgaggacacaagaccccttcctg

SEQ ID NO: 788099 - DNA, 25 bp, Mus musculus
tatgaggacacatgaccccttcctg

SEQ ID NO: 788100 - DNA, 25 bp, Mus musculus
tatgaggacatgaccactcctgcga

SEQ ID NO: 788101 - DNA, 25 bp, Mus musculus
tatgaggacatgtccactcctgcga

SEQ ID NO: 788102 - DNA, 25 bp, Mus musculus
tatgaggaccatcggcaagggaccc

SEQ ID NO: 788103 - DNA, 25 bp, Mus musculus
tatgaggaccatgggcaagggaccc

SEQ ID NO: 788104 - DNA, 25 bp, Mus musculus
tatgaggacctcaaccactgacatc

SEQ ID NO: 788105 - DNA, 25 bp, Mus musculus
tatgaggacctctaccactgacatc

SEQ ID NO: 788106 - DNA, 25 bp, Mus musculus
tatgaggactgaagcctgaagctga

SEQ ID NO: 788107 - DNA, 25 bp, Mus musculus
tatgaggactgatgcctgaagctga

SEQ ID NO: 788108 - DNA, 25 bp, Mus musculus
tatgaggcaagcatttcccctgaag

SEQ ID NO: 788109 - DNA, 25 bp, Mus musculus
tatgaggcaagcttttcccctgaag

SEQ ID NO: 788110 - DNA, 25 bp, Mus musculus
tatgaggccaccatcaatcccaaac

SEQ ID NO: 788111 - DNA, 25 bp, Mus musculus
tatgaggccaccttcaatcccaaac

SEQ ID NO: 788112 - DNA, 25 bp, Mus musculus
tatgaggccctacctgggaactaca

SEQ ID NO: 788113 - DNA, 25 bp, Mus musculus
tatgaggccctagctgggaactaca

SEQ ID NO: 788114 - DNA, 25 bp, Mus musculus
tatgaggctacaagtgaccacagac

SEQ ID NO: 788115 - DNA, 25 bp, Mus musculus
tatgaggctacatgtgaccacagac

SEQ ID NO: 788116 - DNA, 25 bp, Mus musculus
tatgaggctagcacccgaatatggg

SEQ ID NO: 788117 - DNA, 25 bp, Mus musculus
tatgaggctagctcccgaatatggg

SEQ ID NO: 788118 - DNA, 25 bp, Mus musculus
tatgaggctcctaggcattgtgaca

SEQ ID NO: 788119 - DNA, 25 bp, Mus musculus
tatgaggctccttggcattgtgaca

SEQ ID NO: 788120 - DNA, 25 bp, Mus musculus
tatgaggcttttcagttcggtaaga

SEQ ID NO: 788121 - DNA, 25 bp, Mus musculus
tatgaggcttttgagttcggtaaga

SEQ ID NO: 788122 - DNA, 25 bp, Mus musculus
tatgagggatccatatcctgctcca

SEQ ID NO: 788123 - DNA, 25 bp, Mus musculus
tatgagggatccttatcctgctcca

SEQ ID NO: 788124 - DNA, 25 bp, Mus musculus
tatgagggcaccctttctagtttgt

SEQ ID NO: 788125 - DNA, 25 bp, Mus musculus
tatgagggcaccgtttctagtttgt

SEQ ID NO: 788126 - DNA, 25 bp, Mus musculus
tatgagggccatacattgcaccaga

SEQ ID NO: 788127 - DNA, 25 bp, Mus musculus
tatgagggccattcattgcaccaga

SEQ ID NO: 788128 - DNA, 25 bp, Mus musculus
tatgagggccccagaagacactgct

SEQ ID NO: 788129 - DNA, 25 bp, Mus musculus
tatgagggcccctgaagacactgct

SEQ ID NO: 788130 - DNA, 25 bp, Mus musculus
tatgagggtcctcagctagtagctg

SEQ ID NO: 788131 - DNA, 25 bp, Mus musculus
tatgagggtcctgagctagtagctg

SEQ ID NO: 788132 - DNA, 25 bp, Mus musculus
tatgagggtgctccctaccaacgaa

SEQ ID NO: 788133 - DNA, 25 bp, Mus musculus
tatgagggtgctgcctaccaacgaa

SEQ ID NO: 788134 - DNA, 25 bp, Mus musculus
tatgaggtctgtcaccccaggcttg

SEQ ID NO: 788135 - DNA, 25 bp, Mus musculus
tatgaggtctgtgaccccaggcttg

SEQ ID NO: 788136 - DNA, 25 bp, Mus musculus
tatgaggtggaccagaaggcattcc

SEQ ID NO: 788137 - DNA, 25 bp, Mus musculus
tatgaggtggacgagaaggcattcc

SEQ ID NO: 788138 - DNA, 25 bp, Mus musculus
tatgaggtggccatcttatcagatc

SEQ ID NO: 788139 - DNA, 25 bp, Mus musculus
tatgaggtggccttcttatcagatc

SEQ ID NO: 788140 - DNA, 25 bp, Mus musculus
tatgaggtttgtatctacacccgtt

SEQ ID NO: 788141 - DNA, 25 bp, Mus musculus
tatgaggtttgtttctacacccgtt

SEQ ID NO: 788142 - DNA, 25 bp, Mus musculus
tatgagtaattaattttccctcctt

SEQ ID NO: 788143 - DNA, 25 bp, Mus musculus
tatgagtaattatttttccctcctt

SEQ ID NO: 788144 - DNA, 25 bp, Mus musculus
tatgagtacacgcatgtgcccttcc

SEQ ID NO: 788145 - DNA, 25 bp, Mus musculus
tatgagtacacggatgtgcccttcc

SEQ ID NO: 788146 - DNA, 25 bp, Mus musculus
tatgagtaccatcccagtggaggac

SEQ ID NO: 788147 - DNA, 25 bp, Mus musculus
tatgagtaccatgccagtggaggac

SEQ ID NO: 788148 - DNA, 25 bp, Mus musculus
tatgagtagcctacctttcttgaaa

SEQ ID NO: 788149 - DNA, 25 bp, Mus musculus
tatgagtagccttcctttcttgaaa

SEQ ID NO: 788150 - DNA, 25 bp, Mus musculus
tatgagtccagcatggctgcacagt

SEQ ID NO: 788151 - DNA, 25 bp, Mus musculus
tatgagtccagcttggctgcacagt

SEQ ID NO: 788152 - DNA, 25 bp, Mus musculus
tatgagtccatgattcccatacctt

SEQ ID NO: 788153 - DNA, 25 bp, Mus musculus
tatgagtccatgtttcccatacctt

SEQ ID NO: 788154 - DNA, 25 bp, Mus musculus
tatgagtcctacaccatcagggttt

SEQ ID NO: 788155 - DNA, 25 bp, Mus musculus
tatgagtcctactccatcagggttt

SEQ ID NO: 788156 - DNA, 25 bp, Mus musculus
tatgagtcgcacacaaattctacac

SEQ ID NO: 788157 - DNA, 25 bp, Mus musculus
tatgagtcgcactcaaattctacac

SEQ ID NO: 788158 - DNA, 25 bp, Mus musculus
tatgagtctccaccagtttcttgat

SEQ ID NO: 788159 - DNA, 25 bp, Mus musculus
tatgagtctccagcagtttcttgat

SEQ ID NO: 788160 - DNA, 25 bp, Mus musculus
tatgagtctgaccttcctgaacaca

SEQ ID NO: 788161 - DNA, 25 bp, Mus musculus
tatgagtctgacgttcctgaacaca

SEQ ID NO: 788162 - DNA, 25 bp, Mus musculus
tatgagtcttctctctggactgctg

SEQ ID NO: 788163 - DNA, 25 bp, Mus musculus
tatgagtcttctgtctggactgctg

SEQ ID NO: 788164 - DNA, 25 bp, Mus musculus
tatgagtgcagtctagctgagatgt

SEQ ID NO: 788165 - DNA, 25 bp, Mus musculus
tatgagtgcagtgtagctgagatgt

SEQ ID NO: 788166 - DNA, 25 bp, Mus musculus
tatgagtgccgcaattgcctacgaa

SEQ ID NO: 788167 - DNA, 25 bp, Mus musculus
tatgagtgccgctattgcctacgaa

SEQ ID NO: 788168 - DNA, 25 bp, Mus musculus
tatgagtggtccagttccagtagct

SEQ ID NO: 788169 - DNA, 25 bp, Mus musculus
tatgagtggtcctgttccagtagct

SEQ ID NO: 788170 - DNA, 25 bp, Mus musculus
tatgagtgtctcatggaggtgtatg

SEQ ID NO: 788171 - DNA, 25 bp, Mus musculus
tatgagtgtctcttggaggtgtatg

SEQ ID NO: 788172 - DNA, 25 bp, Mus musculus
tatgagttcactcctccaatttgcc

SEQ ID NO: 788173 - DNA, 25 bp, Mus musculus
tatgagttcactgctccaatttgcc

SEQ ID NO: 788174 - DNA, 25 bp, Mus musculus
tatgagttctccaattgtttttcct

SEQ ID NO: 788175 - DNA, 25 bp, Mus musculus
tatgagttctcctattgtttttcct

SEQ ID NO: 788176 - DNA, 25 bp, Mus musculus
tatgagttctgaaactacttctcct

SEQ ID NO: 788177 - DNA, 25 bp, Mus musculus
tatgagttctgatactacttctcct

SEQ ID NO: 788178 - DNA, 25 bp, Mus musculus
tatgagttgaaaacccacttttgtg

SEQ ID NO: 788179 - DNA, 25 bp, Mus musculus
tatgagttgaaatcccacttttgtg

SEQ ID NO: 788180 - DNA, 25 bp, Mus musculus
tatgataaggtcatccggtgccttc

SEQ ID NO: 788181 - DNA, 25 bp, Mus musculus
tatgataaggtcttccggtgccttc

SEQ ID NO: 788182 - DNA, 25 bp, Mus musculus
tatgataagtgtctccacctgttcc

SEQ ID NO: 788183 - DNA, 25 bp, Mus musculus
tatgataagtgtgtccacctgttcc

SEQ ID NO: 788184 - DNA, 25 bp, Mus musculus
tatgataatcttcgactggcaacaa

SEQ ID NO: 788185 - DNA, 25 bp, Mus musculus
tatgataatcttggactggcaacaa

SEQ ID NO: 788186 - DNA, 25 bp, Mus musculus
tatgataatgatacagctcgagatg

SEQ ID NO: 788187 - DNA, 25 bp, Mus musculus
tatgataatgattcagctcgagatg

SEQ ID NO: 788188 - DNA, 25 bp, Mus musculus
tatgatacaggacagcttcctcagc

SEQ ID NO: 788189 - DNA, 25 bp, Mus musculus
tatgatacaggagagcttcctcagc

SEQ ID NO: 788190 - DNA, 25 bp, Mus musculus
tatgataccagcacagattttccag

SEQ ID NO: 788191 - DNA, 25 bp, Mus musculus
tatgataccagctcagattttccag

SEQ ID NO: 788192 - DNA, 25 bp, Mus musculus
tatgatacgggtatcttgggtctgt

SEQ ID NO: 788193 - DNA, 25 bp, Mus musculus
tatgatacgggtttcttgggtctgt

SEQ ID NO: 788194 - DNA, 25 bp, Mus musculus
tatgatacgttcagatcacactttc

SEQ ID NO: 788195 - DNA, 25 bp, Mus musculus
tatgatacgttctgatcacactttc

SEQ ID NO: 788196 - DNA, 25 bp, Mus musculus
tatgatagactaccaataaagtgat

SEQ ID NO: 788197 - DNA, 25 bp, Mus musculus
tatgatagactagcaataaagtgat

SEQ ID NO: 788198 - DNA, 25 bp, Mus musculus
tatgatagattaaaaactttcccaa

SEQ ID NO: 788199 - DNA, 25 bp, Mus musculus
tatgatagattataaactttcccaa

SEQ ID NO: 788200 - DNA, 25 bp, Mus musculus
tatgatagcccacgcccaggacctt

SEQ ID NO: 788201 - DNA, 25 bp, Mus musculus
tatgatagcccaggcccaggacctt

SEQ ID NO: 788202 - DNA, 25 bp, Mus musculus
tatgataggtccctgcattttaact

SEQ ID NO: 788203 - DNA, 25 bp, Mus musculus
tatgataggtccgtgcattttaact

SEQ ID NO: 788204 - DNA, 25 bp, Mus musculus
tatgataggtctaactttcttctcc

SEQ ID NO: 788205 - DNA, 25 bp, Mus musculus
tatgataggtcttactttcttctcc

SEQ ID NO: 788206 - DNA, 25 bp, Mus musculus
tatgatatatctcttcttgttcctg

SEQ ID NO: 788207 - DNA, 25 bp, Mus musculus
tatgatatatctgttcttgttcctg

SEQ ID NO: 788208 - DNA, 25 bp, Mus musculus
tatgatatccacctgttgcatgcca

SEQ ID NO: 788209 - DNA, 25 bp, Mus musculus
tatgatatccacgtgttgcatgcca

SEQ ID NO: 788210 - DNA, 25 bp, Mus musculus
tatgatatccatattccagaattgt

SEQ ID NO: 788211 - DNA, 25 bp, Mus musculus
tatgatatccattttccagaattgt

SEQ ID NO: 788212 - DNA, 25 bp, Mus musculus
tatgatattggcaacgacccccagg

SEQ ID NO: 788213 - DNA, 25 bp, Mus musculus
tatgatattggctacgacccccagg

SEQ ID NO: 788214 - DNA, 25 bp, Mus musculus
tatgatcacaggactctttccctaa

SEQ ID NO: 788215 - DNA, 25 bp, Mus musculus
tatgatcacaggaggaagtctccaa

SEQ ID NO: 788216 - DNA, 25 bp, Mus musculus
tatgatcacaggtctctttccctaa

SEQ ID NO: 788217 - DNA, 25 bp, Mus musculus
tatgatcacaggtggaagtctccaa

SEQ ID NO: 788218 - DNA, 25 bp, Mus musculus
tatgatcacgtgacccttttttgtc

SEQ ID NO: 788219 - DNA, 25 bp, Mus musculus
tatgatcacgtgtcccttttttgtc

SEQ ID NO: 788220 - DNA, 25 bp, Mus musculus
tatgatcagcaacactggcgaggct

SEQ ID NO: 788221 - DNA, 25 bp, Mus musculus
tatgatcagcaagactggcgaggct

SEQ ID NO: 788222 - DNA, 25 bp, Mus musculus
tatgatcagcagctccccaggagaa

SEQ ID NO: 788223 - DNA, 25 bp, Mus musculus
tatgatcagcaggtccccaggagaa

SEQ ID NO: 788224 - DNA, 25 bp, Mus musculus
tatgatcagcttaatgcccaactcc

SEQ ID NO: 788225 - DNA, 25 bp, Mus musculus
tatgatcagctttatgcccaactcc

SEQ ID NO: 788226 - DNA, 25 bp, Mus musculus
tatgatcaggtgaagaccctctccc

SEQ ID NO: 788227 - DNA, 25 bp, Mus musculus
tatgatcaggtgtagaccctctccc

SEQ ID NO: 788228 - DNA, 25 bp, Mus musculus
tatgatcatacaatgcatgggcagt

SEQ ID NO: 788229 - DNA, 25 bp, Mus musculus
tatgatcatacattgcatgggcagt

SEQ ID NO: 788230 - DNA, 25 bp, Mus musculus
tatgatccacaaatatgttcttttg

SEQ ID NO: 788231 - DNA, 25 bp, Mus musculus
tatgatccacaattatgttcttttg

SEQ ID NO: 788232 - DNA, 25 bp, Mus musculus
tatgatccatgaaccagaacctcac

SEQ ID NO: 788233 - DNA, 25 bp, Mus musculus
tatgatccatgatccagaacctcac

SEQ ID NO: 788234 - DNA, 25 bp, Mus musculus
tatgatcccaccacgggcaagttca

SEQ ID NO: 788235 - DNA, 25 bp, Mus musculus
tatgatcccacctcgggcaagttca

SEQ ID NO: 788236 - DNA, 25 bp, Mus musculus
tatgatcccgtgcactgtttgctat

SEQ ID NO: 788237 - DNA, 25 bp, Mus musculus
tatgatcccgtggactgtttgctat

SEQ ID NO: 788238 - DNA, 25 bp, Mus musculus
tatgatcctgggacattcacacaca

SEQ ID NO: 788239 - DNA, 25 bp, Mus musculus
tatgatcctgggtcattcacacaca

SEQ ID NO: 788240 - DNA, 25 bp, Mus musculus
tatgatcgctgcatagtcgtaggca

SEQ ID NO: 788241 - DNA, 25 bp, Mus musculus
tatgatcgctgcttagtcgtaggca

SEQ ID NO: 788242 - DNA, 25 bp, Mus musculus
tatgatcggcatacccaatgttgcc

SEQ ID NO: 788243 - DNA, 25 bp, Mus musculus
tatgatcggcattcccaatgttgcc

SEQ ID NO: 788244 - DNA, 25 bp, Mus musculus
tatgatctatggagacagtctctac

SEQ ID NO: 788245 - DNA, 25 bp, Mus musculus
tatgatctatggtgacagtctctac

SEQ ID NO: 788246 - DNA, 25 bp, Mus musculus
tatgatctatgtctgctcgcagtct

SEQ ID NO: 788247 - DNA, 25 bp, Mus musculus
tatgatctatgtgtgctcgcagtct

SEQ ID NO: 788248 - DNA, 25 bp, Mus musculus
tatgatctcaatcgcataactttcc

SEQ ID NO: 788249 - DNA, 25 bp, Mus musculus
tatgatctcaatggcataactttcc

SEQ ID NO: 788250 - DNA, 25 bp, Mus musculus
tatgatctcatgaaccagtgctgga

SEQ ID NO: 788251 - DNA, 25 bp, Mus musculus
tatgatctcatgtaccagtgctgga

SEQ ID NO: 788252 - DNA, 25 bp, Mus musculus
tatgatctccctatgttcctaccca

SEQ ID NO: 788253 - DNA, 25 bp, Mus musculus
tatgatctccctttgttcctaccca

SEQ ID NO: 788254 - DNA, 25 bp, Mus musculus
tatgatctgatcctgcacaatttaa

SEQ ID NO: 788255 - DNA, 25 bp, Mus musculus
tatgatctgatcgtgcacaatttaa

SEQ ID NO: 788256 - DNA, 25 bp, Mus musculus
tatgatctgatgacatctgcccttc

SEQ ID NO: 788257 - DNA, 25 bp, Mus musculus
tatgatctgatgtcatctgcccttc

SEQ ID NO: 788258 - DNA, 25 bp, Mus musculus
tatgatctgccacttttggtgccca

SEQ ID NO: 788259 - DNA, 25 bp, Mus musculus
tatgatctgccagttttggtgccca

SEQ ID NO: 788260 - DNA, 25 bp, Mus musculus
tatgatctgcgcctgaccctcatta

SEQ ID NO: 788261 - DNA, 25 bp, Mus musculus
tatgatctgcgcgtgaccctcatta

SEQ ID NO: 788262 - DNA, 25 bp, Mus musculus
tatgatctgtaaagtccgagggcgg

SEQ ID NO: 788263 - DNA, 25 bp, Mus musculus
tatgatctgtaatgtccgagggcgg

SEQ ID NO: 788264 - DNA, 25 bp, Mus musculus
tatgatcttcctatatactagttta

SEQ ID NO: 788265 - DNA, 25 bp, Mus musculus
tatgatcttcctttatactagttta

SEQ ID NO: 788266 - DNA, 25 bp, Mus musculus
tatgatgaaaccctatcttcccatg

SEQ ID NO: 788267 - DNA, 25 bp, Mus musculus
tatgatgaaaccgtatcttcccatg

SEQ ID NO: 788268 - DNA, 25 bp, Mus musculus
tatgatgacagcactacccaaacct

SEQ ID NO: 788269 - DNA, 25 bp, Mus musculus
tatgatgacagctctacccaaacct

SEQ ID NO: 788270 - DNA, 25 bp, Mus musculus
tatgatgacatcaaggaagggtaga

SEQ ID NO: 788271 - DNA, 25 bp, Mus musculus
tatgatgacatctaggaagggtaga

SEQ ID NO: 788272 - DNA, 25 bp, Mus musculus
tatgatgacgatcacggcggaagac

SEQ ID NO: 788273 - DNA, 25 bp, Mus musculus
tatgatgacgatgacggcggaagac

SEQ ID NO: 788274 - DNA, 25 bp, Mus musculus
tatgatgactgtctgtttggaggcc

SEQ ID NO: 788275 - DNA, 25 bp, Mus musculus
tatgatgactgtgtgtttggaggcc

SEQ ID NO: 788276 - DNA, 25 bp, Mus musculus
tatgatgatggcagcggaaatgact

SEQ ID NO: 788277 - DNA, 25 bp, Mus musculus
tatgatgatggctgcggaaatgact

SEQ ID NO: 788278 - DNA, 25 bp, Mus musculus
tatgatgcaataacctgctttcccc

SEQ ID NO: 788279 - DNA, 25 bp, Mus musculus
tatgatgcaatatcctgctttcccc

SEQ ID NO: 788280 - DNA, 25 bp, Mus musculus
tatgatgccaggaagcccctttgct

SEQ ID NO: 788281 - DNA, 25 bp, Mus musculus
tatgatgccaggtagcccctttgct

SEQ ID NO: 788282 - DNA, 25 bp, Mus musculus
tatgatgcctatctcttatacccca

SEQ ID NO: 788283 - DNA, 25 bp, Mus musculus
tatgatgcctatgtcttatacccca

SEQ ID NO: 788284 - DNA, 25 bp, Mus musculus
tatgatgccttccttctatctgata

SEQ ID NO: 788285 - DNA, 25 bp, Mus musculus
tatgatgccttcgttctatctgata

SEQ ID NO: 788286 - DNA, 25 bp, Mus musculus
tatgatgctgctacaatgcctgata

SEQ ID NO: 788287 - DNA, 25 bp, Mus musculus
tatgatgctgcttcaatgcctgata

SEQ ID NO: 788288 - DNA, 25 bp, Mus musculus
tatgatgctggtcaggtttccttct

SEQ ID NO: 788289 - DNA, 25 bp, Mus musculus
tatgatgctggtgaggtttccttct

SEQ ID NO: 788290 - DNA, 25 bp, Mus musculus
tatgatggacacaagaacttctggt

SEQ ID NO: 788291 - DNA, 25 bp, Mus musculus
tatgatggacacagggacccggacc

SEQ ID NO: 788292 - DNA, 25 bp, Mus musculus
tatgatggacactagaacttctggt

SEQ ID NO: 788293 - DNA, 25 bp, Mus musculus
tatgatggacactgggacccggacc

SEQ ID NO: 788294 - DNA, 25 bp, Mus musculus
tatgatggccttacattcttcctag

SEQ ID NO: 788295 - DNA, 25 bp, Mus musculus
tatgatggcctttcattcttcctag

SEQ ID NO: 788296 - DNA, 25 bp, Mus musculus
tatgatggcgcaagctctgatgtca

SEQ ID NO: 788297 - DNA, 25 bp, Mus musculus
tatgatggcgcatgctctgatgtca

SEQ ID NO: 788298 - DNA, 25 bp, Mus musculus
tatgatggcgcccaggactgctgcc

SEQ ID NO: 788299 - DNA, 25 bp, Mus musculus
tatgatggcgccgaggactgctgcc

SEQ ID NO: 788300 - DNA, 25 bp, Mus musculus
tatgatggcttcctattacctgctg

SEQ ID NO: 788301 - DNA, 25 bp, Mus musculus
tatgatggcttcgtattacctgctg

SEQ ID NO: 788302 - DNA, 25 bp, Mus musculus
tatgatggctttaccagaccggcaa

SEQ ID NO: 788303 - DNA, 25 bp, Mus musculus
tatgatggcttttccagaccggcaa

SEQ ID NO: 788304 - DNA, 25 bp, Mus musculus
tatgatgggactcctacagctcagt

SEQ ID NO: 788305 - DNA, 25 bp, Mus musculus
tatgatgggactgctacagctcagt

SEQ ID NO: 788306 - DNA, 25 bp, Mus musculus
tatgatggtcttccaactccctgaa

SEQ ID NO: 788307 - DNA, 25 bp, Mus musculus
tatgatggtcttgcaactccctgaa

SEQ ID NO: 788308 - DNA, 25 bp, Mus musculus
tatgatggtggcatacctttcccaa

SEQ ID NO: 788309 - DNA, 25 bp, Mus musculus
tatgatggtggcttacctttcccaa

SEQ ID NO: 788310 - DNA, 25 bp, Mus musculus
tatgatgtacagcagtcttgtcccc

SEQ ID NO: 788311 - DNA, 25 bp, Mus musculus
tatgatgtacaggagtcttgtcccc

SEQ ID NO: 788312 - DNA, 25 bp, Mus musculus
tatgatgtattcctggcttggcttt

SEQ ID NO: 788313 - DNA, 25 bp, Mus musculus
tatgatgtattcgtggcttggcttt

SEQ ID NO: 788314 - DNA, 25 bp, Mus musculus
tatgatgtcactctgaaggttcctg

SEQ ID NO: 788315 - DNA, 25 bp, Mus musculus
tatgatgtcactgtgaaggttcctg

SEQ ID NO: 788316 - DNA, 25 bp, Mus musculus
tatgatgtcattagtggctcttctc

SEQ ID NO: 788317 - DNA, 25 bp, Mus musculus
tatgatgtcatttgtggctcttctc

SEQ ID NO: 788318 - DNA, 25 bp, Mus musculus
tatgatgtctatactccatgctgaa

SEQ ID NO: 788319 - DNA, 25 bp, Mus musculus
tatgatgtctattctccatgctgaa

SEQ ID NO: 788320 - DNA, 25 bp, Mus musculus
tatgatgtctctaccatcttaactt

SEQ ID NO: 788321 - DNA, 25 bp, Mus musculus
tatgatgtctcttccatcttaactt

SEQ ID NO: 788322 - DNA, 25 bp, Mus musculus
tatgatgtgatcacactctggcccc

SEQ ID NO: 788323 - DNA, 25 bp, Mus musculus
tatgatgtgatctcactctggcccc

SEQ ID NO: 788324 - DNA, 25 bp, Mus musculus
tatgatgtggatcccattttcaatg

SEQ ID NO: 788325 - DNA, 25 bp, Mus musculus
tatgatgtggatgccattttcaatg

SEQ ID NO: 788326 - DNA, 25 bp, Mus musculus
tatgatgttgaacacctcctgaaag

SEQ ID NO: 788327 - DNA, 25 bp, Mus musculus
tatgatgttgaagacctcctgaaag

SEQ ID NO: 788328 - DNA, 25 bp, Mus musculus
tatgatgttggcaacccttttcctc

SEQ ID NO: 788329 - DNA, 25 bp, Mus musculus
tatgatgttggctacccttttcctc

SEQ ID NO: 788330 - DNA, 25 bp, Mus musculus
tatgatgtttggatttatgcacttt

SEQ ID NO: 788331 - DNA, 25 bp, Mus musculus
tatgatgtttggttttatgcacttt

SEQ ID NO: 788332 - DNA, 25 bp, Mus musculus
tatgattacaacaaggctcgggtgc

SEQ ID NO: 788333 - DNA, 25 bp, Mus musculus
tatgattacaactaggctcgggtgc

SEQ ID NO: 788334 - DNA, 25 bp, Mus musculus
tatgattacctaagccctctccttg

SEQ ID NO: 788335 - DNA, 25 bp, Mus musculus
tatgattacctatgccctctccttg

SEQ ID NO: 788336 - DNA, 25 bp, Mus musculus
tatgattagcacatcaagagcagca

SEQ ID NO: 788337 - DNA, 25 bp, Mus musculus
tatgattagcacttcaagagcagca

SEQ ID NO: 788338 - DNA, 25 bp, Mus musculus
tatgattatctgacgccatttggcc

SEQ ID NO: 788339 - DNA, 25 bp, Mus musculus
tatgattatctgtcgccatttggcc

SEQ ID NO: 788340 - DNA, 25 bp, Mus musculus
tatgattcaaaccatctgccctaac

SEQ ID NO: 788341 - DNA, 25 bp, Mus musculus
tatgattcaaacgatctgccctaac

SEQ ID NO: 788342 - DNA, 25 bp, Mus musculus
tatgattcaattctgccttcaggtt

SEQ ID NO: 788343 - DNA, 25 bp, Mus musculus
tatgattcaattgtgccttcaggtt

SEQ ID NO: 788344 - DNA, 25 bp, Mus musculus
tatgattcacccatgttctgcagtt

SEQ ID NO: 788345 - DNA, 25 bp, Mus musculus
tatgattcacccttgttctgcagtt

SEQ ID NO: 788346 - DNA, 25 bp, Mus musculus
tatgattccagaagcaggcccacag

SEQ ID NO: 788347 - DNA, 25 bp, Mus musculus
tatgattccagatgcaggcccacag

SEQ ID NO: 788348 - DNA, 25 bp, Mus musculus
tatgattcctacacttctacttctt

SEQ ID NO: 788349 - DNA, 25 bp, Mus musculus
tatgattcctactcttctacttctt

SEQ ID NO: 788350 - DNA, 25 bp, Mus musculus
tatgattctaacactgaagcccaga

SEQ ID NO: 788351 - DNA, 25 bp, Mus musculus
tatgattctaactctgaagcccaga

SEQ ID NO: 788352 - DNA, 25 bp, Mus musculus
tatgattctggaacgttcgctcaaa

SEQ ID NO: 788353 - DNA, 25 bp, Mus musculus
tatgattctggatcgttcgctcaaa

SEQ ID NO: 788354 - DNA, 25 bp, Mus musculus
tatgattgctacctctgcacatgac

SEQ ID NO: 788355 - DNA, 25 bp, Mus musculus
tatgattgctacgtctgcacatgac

SEQ ID NO: 788356 - DNA, 25 bp, Mus musculus
tatgattggctaccccatgccaacg

SEQ ID NO: 788357 - DNA, 25 bp, Mus musculus
tatgattggctagcccatgccaacg

SEQ ID NO: 788358 - DNA, 25 bp, Mus musculus
tatgattggcttctgtcttgcacac

SEQ ID NO: 788359 - DNA, 25 bp, Mus musculus
tatgattggcttgtgtcttgcacac

SEQ ID NO: 788360 - DNA, 25 bp, Mus musculus
tatgattggtacagcctccgagtcg

SEQ ID NO: 788361 - DNA, 25 bp, Mus musculus
tatgattggtactgcctccgagtcg

SEQ ID NO: 788362 - DNA, 25 bp, Mus musculus
tatgattgtcagactttatgccctc

SEQ ID NO: 788363 - DNA, 25 bp, Mus musculus
tatgattgtcagtctttatgccctc

SEQ ID NO: 788364 - DNA, 25 bp, Mus musculus
tatgattgtgttactcagactgagt

SEQ ID NO: 788365 - DNA, 25 bp, Mus musculus
tatgattgtgtttctcagactgagt

SEQ ID NO: 788366 - DNA, 25 bp, Mus musculus
tatgattgttccctgctttatttaa

SEQ ID NO: 788367 - DNA, 25 bp, Mus musculus
tatgattgttccgtgctttatttaa

SEQ ID NO: 788368 - DNA, 25 bp, Mus musculus
tatgatttacagagcaccctaggat

SEQ ID NO: 788369 - DNA, 25 bp, Mus musculus
tatgatttacagtgcaccctaggat

SEQ ID NO: 788370 - DNA, 25 bp, Mus musculus
tatgatttacttcgttcctaacact

SEQ ID NO: 788371 - DNA, 25 bp, Mus musculus
tatgatttacttggttcctaacact

SEQ ID NO: 788372 - DNA, 25 bp, Mus musculus
tatgatttagggctcctccaccctg

SEQ ID NO: 788373 - DNA, 25 bp, Mus musculus
tatgatttaggggtcctccaccctg

SEQ ID NO: 788374 - DNA, 25 bp, Mus musculus
tatgatttcacactcgctcaccaag

SEQ ID NO: 788375 - DNA, 25 bp, Mus musculus
tatgatttcacagtcgctcaccaag

SEQ ID NO: 788376 - DNA, 25 bp, Mus musculus
tatgatttcataaaccctgtttctc

SEQ ID NO: 788377 - DNA, 25 bp, Mus musculus
tatgatttcatataccctgtttctc

SEQ ID NO: 788378 - DNA, 25 bp, Mus musculus
tatgatttcatcagtgttacacctt

SEQ ID NO: 788379 - DNA, 25 bp, Mus musculus
tatgatttcatcctctgtgctgtga

SEQ ID NO: 788380 - DNA, 25 bp, Mus musculus
tatgatttcatcgtctgtgctgtga

SEQ ID NO: 788381 - DNA, 25 bp, Mus musculus
tatgatttcatctgtgttacacctt

SEQ ID NO: 788382 - DNA, 25 bp, Mus musculus
tatgatttcctgcatttcctcagtg

SEQ ID NO: 788383 - DNA, 25 bp, Mus musculus
tatgatttcctggatttcctcagtg

SEQ ID NO: 788384 - DNA, 25 bp, Mus musculus
tatgatttgcctcgttctctggtgg

SEQ ID NO: 788385 - DNA, 25 bp, Mus musculus
tatgatttgcctggttctctggtgg

SEQ ID NO: 788386 - DNA, 25 bp, Mus musculus
tatgatttgcttatgacgtctgtcc

SEQ ID NO: 788387 - DNA, 25 bp, Mus musculus
tatgatttgcttttgacgtctgtcc

SEQ ID NO: 788388 - DNA, 25 bp, Mus musculus
tatgatttggtcaacacttgttgga

SEQ ID NO: 788389 - DNA, 25 bp, Mus musculus
tatgatttggtctacacttgttgga

SEQ ID NO: 788390 - DNA, 25 bp, Mus musculus
tatgatttggtgaggacatggctca

SEQ ID NO: 788391 - DNA, 25 bp, Mus musculus
tatgatttggtgtggacatggctca

SEQ ID NO: 788392 - DNA, 25 bp, Mus musculus
tatgatttggttactgctgctgcag

SEQ ID NO: 788393 - DNA, 25 bp, Mus musculus
tatgatttggtttctgctgctgcag

SEQ ID NO: 788394 - DNA, 25 bp, Mus musculus
tatgatttgtagctaccttctgcgc

SEQ ID NO: 788395 - DNA, 25 bp, Mus musculus
tatgatttgtaggtaccttctgcgc

SEQ ID NO: 788396 - DNA, 25 bp, Mus musculus
tatgattttacgcagtccccggcca

SEQ ID NO: 788397 - DNA, 25 bp, Mus musculus
tatgattttacggagtccccggcca

SEQ ID NO: 788398 - DNA, 25 bp, Mus musculus
tatgatttttatatccgagcctccc

SEQ ID NO: 788399 - DNA, 25 bp, Mus musculus
tatgatttttatttccgagcctccc

SEQ ID NO: 788400 - DNA, 25 bp, Mus musculus
tatgcaaaatgacccctgaaaacct

SEQ ID NO: 788401 - DNA, 25 bp, Mus musculus
tatgcaaaatgagccctgaaaacct

SEQ ID NO: 788402 - DNA, 25 bp, Mus musculus
tatgcaaaccacaacacttacaatt

SEQ ID NO: 788403 - DNA, 25 bp, Mus musculus
tatgcaaaccactacacttacaatt

SEQ ID NO: 788404 - DNA, 25 bp, Mus musculus
tatgcaaagcctcatcttactcacc

SEQ ID NO: 788405 - DNA, 25 bp, Mus musculus
tatgcaaagcctgatcttactcacc

SEQ ID NO: 788406 - DNA, 25 bp, Mus musculus
tatgcaaagcttaccttcacagtaa

SEQ ID NO: 788407 - DNA, 25 bp, Mus musculus
tatgcaaagctttccttcacagtaa

SEQ ID NO: 788408 - DNA, 25 bp, Mus musculus
tatgcaaagtgccttctgctccaga

SEQ ID NO: 788409 - DNA, 25 bp, Mus musculus
tatgcaaagtgcgttctgctccaga

SEQ ID NO: 788410 - DNA, 25 bp, Mus musculus
tatgcaaatattcgtagctcagctt

SEQ ID NO: 788411 - DNA, 25 bp, Mus musculus
tatgcaaatattggtagctcagctt

SEQ ID NO: 788412 - DNA, 25 bp, Mus musculus
tatgcaaattacaacaccatcccca

SEQ ID NO: 788413 - DNA, 25 bp, Mus musculus
tatgcaaattactacaccatcccca

SEQ ID NO: 788414 - DNA, 25 bp, Mus musculus
tatgcaacaaacacaggtgcaccca

SEQ ID NO: 788415 - DNA, 25 bp, Mus musculus
tatgcaacaaactcaggtgcaccca

SEQ ID NO: 788416 - DNA, 25 bp, Mus musculus
tatgcaacacacaccataagagtgc

SEQ ID NO: 788417 - DNA, 25 bp, Mus musculus
tatgcaacacactccataagagtgc

SEQ ID NO: 788418 - DNA, 25 bp, Mus musculus
tatgcaacagaccagttcactttcc

SEQ ID NO: 788419 - DNA, 25 bp, Mus musculus
tatgcaacagacgagttcactttcc

SEQ ID NO: 788420 - DNA, 25 bp, Mus musculus
tatgcaacatttattccacttattt

SEQ ID NO: 788421 - DNA, 25 bp, Mus musculus
tatgcaacattttttccacttattt

SEQ ID NO: 788422 - DNA, 25 bp, Mus musculus
tatgcaaccaatatcaaactgaaga

SEQ ID NO: 788423 - DNA, 25 bp, Mus musculus
tatgcaaccaatttcaaactgaaga

SEQ ID NO: 788424 - DNA, 25 bp, Mus musculus
tatgcaaccccaccataaataaacg

SEQ ID NO: 788425 - DNA, 25 bp, Mus musculus
tatgcaaccccagcataaataaacg

SEQ ID NO: 788426 - DNA, 25 bp, Mus musculus
tatgcaactcttccttgtctactga

SEQ ID NO: 788427 - DNA, 25 bp, Mus musculus
tatgcaactcttgcttgtctactga

SEQ ID NO: 788428 - DNA, 25 bp, Mus musculus
tatgcaagcacaagcccctgtatga

SEQ ID NO: 788429 - DNA, 25 bp, Mus musculus
tatgcaagcacatgcccctgtatga

SEQ ID NO: 788430 - DNA, 25 bp, Mus musculus
tatgcaagcttaagtcacaccctca

SEQ ID NO: 788431 - DNA, 25 bp, Mus musculus
tatgcaagcttatgtcacaccctca

SEQ ID NO: 788432 - DNA, 25 bp, Mus musculus
tatgcaaggaccaaggagaaccagg

SEQ ID NO: 788433 - DNA, 25 bp, Mus musculus
tatgcaaggacctaggagaaccagg

SEQ ID NO: 788434 - DNA, 25 bp, Mus musculus
tatgcaaggcacaaggtggagtcat

SEQ ID NO: 788435 - DNA, 25 bp, Mus musculus
tatgcaaggcactaggtggagtcat

SEQ ID NO: 788436 - DNA, 25 bp, Mus musculus
tatgcaaggctgagacctgacccca

SEQ ID NO: 788437 - DNA, 25 bp, Mus musculus
tatgcaaggctgtgacctgacccca

SEQ ID NO: 788438 - DNA, 25 bp, Mus musculus
tatgcaagtctaattagctgctggg

SEQ ID NO: 788439 - DNA, 25 bp, Mus musculus
tatgcaagtctatttagctgctggg

SEQ ID NO: 788440 - DNA, 25 bp, Mus musculus
tatgcaagtctgagcgcgcgcggct

SEQ ID NO: 788441 - DNA, 25 bp, Mus musculus
tatgcaagtctgtgcgcgcgcggct

SEQ ID NO: 788442 - DNA, 25 bp, Mus musculus
tatgcaagtggactccttcagcctc

SEQ ID NO: 788443 - DNA, 25 bp, Mus musculus
tatgcaagtggagtccttcagcctc

SEQ ID NO: 788444 - DNA, 25 bp, Mus musculus
tatgcaagtttacacactcacacta

SEQ ID NO: 788445 - DNA, 25 bp, Mus musculus
tatgcaagtttagacactcacacta

SEQ ID NO: 788446 - DNA, 25 bp, Mus musculus
tatgcaataatacccaagatctact

SEQ ID NO: 788447 - DNA, 25 bp, Mus musculus
tatgcaataatagccaagatctact

SEQ ID NO: 788448 - DNA, 25 bp, Mus musculus
tatgcaatacccacaagctcacaaa

SEQ ID NO: 788449 - DNA, 25 bp, Mus musculus
tatgcaataccctcaagctcacaaa

SEQ ID NO: 788450 - DNA, 25 bp, Mus musculus
tatgcaatacgacttcccattttct

SEQ ID NO: 788451 - DNA, 25 bp, Mus musculus
tatgcaatacgagttcccattttct

SEQ ID NO: 788452 - DNA, 25 bp, Mus musculus
tatgcaatggtgcagtggtcatgct

SEQ ID NO: 788453 - DNA, 25 bp, Mus musculus
tatgcaatggtggagtggtcatgct

SEQ ID NO: 788454 - DNA, 25 bp, Mus musculus
tatgcaatgtctctttatctctcag

SEQ ID NO: 788455 - DNA, 25 bp, Mus musculus
tatgcaatgtctgtttatctctcag

SEQ ID NO: 788456 - DNA, 25 bp, Mus musculus
tatgcaattggacagatggattacc

SEQ ID NO: 788457 - DNA, 25 bp, Mus musculus
tatgcaattggagagatggattacc

SEQ ID NO: 788458 - DNA, 25 bp, Mus musculus
tatgcaattgtcaatgaagttcagt

SEQ ID NO: 788459 - DNA, 25 bp, Mus musculus
tatgcaattgtctatgaagttcagt

SEQ ID NO: 788460 - DNA, 25 bp, Mus musculus
tatgcacaaaatatgggccttcccc

SEQ ID NO: 788461 - DNA, 25 bp, Mus musculus
tatgcacaaaatttgggccttcccc

SEQ ID NO: 788462 - DNA, 25 bp, Mus musculus
tatgcacaaggcaacagtcagaaca

SEQ ID NO: 788463 - DNA, 25 bp, Mus musculus
tatgcacaaggctacagtcagaaca

SEQ ID NO: 788464 - DNA, 25 bp, Mus musculus
tatgcacacacgaagcgacaggtct

SEQ ID NO: 788465 - DNA, 25 bp, Mus musculus
tatgcacacacgtagcgacaggtct

SEQ ID NO: 788466 - DNA, 25 bp, Mus musculus
tatgcacaccaaagctttcctgagg

SEQ ID NO: 788467 - DNA, 25 bp, Mus musculus
tatgcacaccaatgctttcctgagg

SEQ ID NO: 788468 - DNA, 25 bp, Mus musculus
tatgcacactgcacacgcttgaaat

SEQ ID NO: 788469 - DNA, 25 bp, Mus musculus
tatgcacactgctcacgcttgaaat

SEQ ID NO: 788470 - DNA, 25 bp, Mus musculus
tatgcacagatgcttcacttccttg

SEQ ID NO: 788471 - DNA, 25 bp, Mus musculus
tatgcacagatggttcacttccttg

SEQ ID NO: 788472 - DNA, 25 bp, Mus musculus
tatgcacagcccctcgtgggaggaa

SEQ ID NO: 788473 - DNA, 25 bp, Mus musculus
tatgcacagcccgtcgtgggaggaa

SEQ ID NO: 788474 - DNA, 25 bp, Mus musculus
tatgcacaggatcctggcacgacaa

SEQ ID NO: 788475 - DNA, 25 bp, Mus musculus
tatgcacaggatgctggcacgacaa

SEQ ID NO: 788476 - DNA, 25 bp, Mus musculus
tatgcacatcatagcacatgctcac

SEQ ID NO: 788477 - DNA, 25 bp, Mus musculus
tatgcacatcattgcacatgctcac

SEQ ID NO: 788478 - DNA, 25 bp, Mus musculus
tatgcacattataccaaatcttcct

SEQ ID NO: 788479 - DNA, 25 bp, Mus musculus
tatgcacattattccaaatcttcct

SEQ ID NO: 788480 - DNA, 25 bp, Mus musculus
tatgcacattggctaatgcctggaa

SEQ ID NO: 788481 - DNA, 25 bp, Mus musculus
tatgcacattgggtaatgcctggaa

SEQ ID NO: 788482 - DNA, 25 bp, Mus musculus
tatgcacattttccggcattgccac

SEQ ID NO: 788483 - DNA, 25 bp, Mus musculus
tatgcacattttgcggcattgccac

SEQ ID NO: 788484 - DNA, 25 bp, Mus musculus
tatgcaccagcaatggcgataataa

SEQ ID NO: 788485 - DNA, 25 bp, Mus musculus
tatgcaccagcattggcgataataa

SEQ ID NO: 788486 - DNA, 25 bp, Mus musculus
tatgcaccatatctaatttcagtgg

SEQ ID NO: 788487 - DNA, 25 bp, Mus musculus
tatgcaccatatgtaatttcagtgg

SEQ ID NO: 788488 - DNA, 25 bp, Mus musculus
tatgcaccatcccataagaactatg

SEQ ID NO: 788489 - DNA, 25 bp, Mus musculus
tatgcaccatccgataagaactatg

SEQ ID NO: 788490 - DNA, 25 bp, Mus musculus
tatgcacccaccaagatcctctatt

SEQ ID NO: 788491 - DNA, 25 bp, Mus musculus
tatgcacccacctagatcctctatt

SEQ ID NO: 788492 - DNA, 25 bp, Mus musculus
tatgcacccggtaactgcctggtaa

SEQ ID NO: 788493 - DNA, 25 bp, Mus musculus
tatgcacccggttactgcctggtaa

SEQ ID NO: 788494 - DNA, 25 bp, Mus musculus
tatgcacctcttcatgactagcagg

SEQ ID NO: 788495 - DNA, 25 bp, Mus musculus
tatgcacctcttgatgactagcagg

SEQ ID NO: 788496 - DNA, 25 bp, Mus musculus
tatgcaccttctaatgtagtacttt

SEQ ID NO: 788497 - DNA, 25 bp, Mus musculus
tatgcaccttcttatgtagtacttt

SEQ ID NO: 788498 - DNA, 25 bp, Mus musculus
tatgcacgtccacagcttccagcat

SEQ ID NO: 788499 - DNA, 25 bp, Mus musculus
tatgcacgtccagagcttccagcat

SEQ ID NO: 788500 - DNA, 25 bp, Mus musculus
tatgcacgtgcacatgtcagaggac

SEQ ID NO: 788501 - DNA, 25 bp, Mus musculus
tatgcacgtgcagatgtcagaggac

SEQ ID NO: 788502 - DNA, 25 bp, Mus musculus
tatgcactaaacaatctcaagactc

SEQ ID NO: 788503 - DNA, 25 bp, Mus musculus
tatgcactaaactatctcaagactc

SEQ ID NO: 788504 - DNA, 25 bp, Mus musculus
tatgcactactgagtcctctttcta

SEQ ID NO: 788505 - DNA, 25 bp, Mus musculus
tatgcactactgattgggctccttc

SEQ ID NO: 788506 - DNA, 25 bp, Mus musculus
tatgcactactgtgtcctctttcta

SEQ ID NO: 788507 - DNA, 25 bp, Mus musculus
tatgcactactgtttgggctccttc

SEQ ID NO: 788508 - DNA, 25 bp, Mus musculus
tatgcactacttaacatttcatggg

SEQ ID NO: 788509 - DNA, 25 bp, Mus musculus
tatgcactactttacatttcatggg

SEQ ID NO: 788510 - DNA, 25 bp, Mus musculus
tatgcactccctctttcttgatgga

SEQ ID NO: 788511 - DNA, 25 bp, Mus musculus
tatgcactccctgtttcttgatgga

SEQ ID NO: 788512 - DNA, 25 bp, Mus musculus
tatgcactgccaagtgtgagaccat

SEQ ID NO: 788513 - DNA, 25 bp, Mus musculus
tatgcactgccatgtgtgagaccat

SEQ ID NO: 788514 - DNA, 25 bp, Mus musculus
tatgcactgctcaagcagaaggttt

SEQ ID NO: 788515 - DNA, 25 bp, Mus musculus
tatgcactgctctagcagaaggttt

SEQ ID NO: 788516 - DNA, 25 bp, Mus musculus
tatgcactggtaaatggctgaaact

SEQ ID NO: 788517 - DNA, 25 bp, Mus musculus
tatgcactggtatatggctgaaact

SEQ ID NO: 788518 - DNA, 25 bp, Mus musculus
tatgcacttcagaacagccatgatg

SEQ ID NO: 788519 - DNA, 25 bp, Mus musculus
tatgcacttcagtacagccatgatg

SEQ ID NO: 788520 - DNA, 25 bp, Mus musculus
tatgcacttgctatcaggaacacaa

SEQ ID NO: 788521 - DNA, 25 bp, Mus musculus
tatgcacttgctttcaggaacacaa

SEQ ID NO: 788522 - DNA, 25 bp, Mus musculus
tatgcacttgggactacttggttga

SEQ ID NO: 788523 - DNA, 25 bp, Mus musculus
tatgcacttgggtctacttggttga

SEQ ID NO: 788524 - DNA, 25 bp, Mus musculus
tatgcactttctcatctaccactaa

SEQ ID NO: 788525 - DNA, 25 bp, Mus musculus
tatgcactttctgatctaccactaa

SEQ ID NO: 788526 - DNA, 25 bp, Mus musculus
tatgcagaacaacctgacgtccccg

SEQ ID NO: 788527 - DNA, 25 bp, Mus musculus
tatgcagaacaagctgacgtccccg

SEQ ID NO: 788528 - DNA, 25 bp, Mus musculus
tatgcagaactgctactgagaatgt

SEQ ID NO: 788529 - DNA, 25 bp, Mus musculus
tatgcagaactggtactgagaatgt

SEQ ID NO: 788530 - DNA, 25 bp, Mus musculus
tatgcagaataaccccaccaagttg

SEQ ID NO: 788531 - DNA, 25 bp, Mus musculus
tatgcagaataagcccaccaagttg

SEQ ID NO: 788532 - DNA, 25 bp, Mus musculus
tatgcagacaaacgacttgaacatc

SEQ ID NO: 788533 - DNA, 25 bp, Mus musculus
tatgcagacaaactacgttcttaat

SEQ ID NO: 788534 - DNA, 25 bp, Mus musculus
tatgcagacaaaggacttgaacatc

SEQ ID NO: 788535 - DNA, 25 bp, Mus musculus
tatgcagacaaagtacgttcttaat

SEQ ID NO: 788536 - DNA, 25 bp, Mus musculus
tatgcagacaagctgcaacgtggtt

SEQ ID NO: 788537 - DNA, 25 bp, Mus musculus
tatgcagacaaggtgcaacgtggtt

SEQ ID NO: 788538 - DNA, 25 bp, Mus musculus
tatgcagacactcagtatgacagat

SEQ ID NO: 788539 - DNA, 25 bp, Mus musculus
tatgcagacactgagtatgacagat

SEQ ID NO: 788540 - DNA, 25 bp, Mus musculus
tatgcagaccagaacctgggtcaat

SEQ ID NO: 788541 - DNA, 25 bp, Mus musculus
tatgcagaccagtacctgggtcaat

SEQ ID NO: 788542 - DNA, 25 bp, Mus musculus
tatgcagactcacaaccagagggca

SEQ ID NO: 788543 - DNA, 25 bp, Mus musculus
tatgcagactcagaaccagagggca

SEQ ID NO: 788544 - DNA, 25 bp, Mus musculus
tatgcagagcatcagctgaggctac

SEQ ID NO: 788545 - DNA, 25 bp, Mus musculus
tatgcagagcatgagctgaggctac

SEQ ID NO: 788546 - DNA, 25 bp, Mus musculus
tatgcagaggtcaatctcccaaggc

SEQ ID NO: 788547 - DNA, 25 bp, Mus musculus
tatgcagaggtctatctcccaaggc

SEQ ID NO: 788548 - DNA, 25 bp, Mus musculus
tatgcagataaaccttcggtgttat

SEQ ID NO: 788549 - DNA, 25 bp, Mus musculus
tatgcagataaagcttcggtgttat

SEQ ID NO: 788550 - DNA, 25 bp, Mus musculus
tatgcagatctcaatgcggcctcgt

SEQ ID NO: 788551 - DNA, 25 bp, Mus musculus
tatgcagatctctatgcggcctcgt

SEQ ID NO: 788552 - DNA, 25 bp, Mus musculus
tatgcagattccatggcactgtggc

SEQ ID NO: 788553 - DNA, 25 bp, Mus musculus
tatgcagattccttggcactgtggc

SEQ ID NO: 788554 - DNA, 25 bp, Mus musculus
tatgcagcaagcaatttccctgtta

SEQ ID NO: 788555 - DNA, 25 bp, Mus musculus
tatgcagcaagctatttccctgtta

SEQ ID NO: 788556 - DNA, 25 bp, Mus musculus
tatgcagccaagagcatggccgcag

SEQ ID NO: 788557 - DNA, 25 bp, Mus musculus
tatgcagccaagtgcatggccgcag

SEQ ID NO: 788558 - DNA, 25 bp, Mus musculus
tatgcagccacaactgcagcatcat

SEQ ID NO: 788559 - DNA, 25 bp, Mus musculus
tatgcagccacatctgcagcatcat

SEQ ID NO: 788560 - DNA, 25 bp, Mus musculus
tatgcagccatcctaagcctaagat

SEQ ID NO: 788561 - DNA, 25 bp, Mus musculus
tatgcagccatcgtaagcctaagat

SEQ ID NO: 788562 - DNA, 25 bp, Mus musculus
tatgcagccattccaagtcttcatt

SEQ ID NO: 788563 - DNA, 25 bp, Mus musculus
tatgcagccattgcaagtcttcatt

SEQ ID NO: 788564 - DNA, 25 bp, Mus musculus
tatgcagcccatcctgtgagatcca

SEQ ID NO: 788565 - DNA, 25 bp, Mus musculus
tatgcagcccatgctgtgagatcca

SEQ ID NO: 788566 - DNA, 25 bp, Mus musculus
tatgcagcccttaaaccagtggttc

SEQ ID NO: 788567 - DNA, 25 bp, Mus musculus
tatgcagcccttctcatttagggtc

SEQ ID NO: 788568 - DNA, 25 bp, Mus musculus
tatgcagcccttgtcatttagggtc

SEQ ID NO: 788569 - DNA, 25 bp, Mus musculus
tatgcagccctttaaccagtggttc

SEQ ID NO: 788570 - DNA, 25 bp, Mus musculus
tatgcagcgagcaaacccagccggt

SEQ ID NO: 788571 - DNA, 25 bp, Mus musculus
tatgcagcgagctaacccagccggt

SEQ ID NO: 788572 - DNA, 25 bp, Mus musculus
tatgcagctagacttgatagactat

SEQ ID NO: 788573 - DNA, 25 bp, Mus musculus
tatgcagctagagttgatagactat

SEQ ID NO: 788574 - DNA, 25 bp, Mus musculus
tatgcagctctgattgtcctagaac

SEQ ID NO: 788575 - DNA, 25 bp, Mus musculus
tatgcagctctgtttgtcctagaac

SEQ ID NO: 788576 - DNA, 25 bp, Mus musculus
tatgcagctgtcattctggtcatgc

SEQ ID NO: 788577 - DNA, 25 bp, Mus musculus
tatgcagctgtctttctggtcatgc

SEQ ID NO: 788578 - DNA, 25 bp, Mus musculus
tatgcagcttctagttggtatatta

SEQ ID NO: 788579 - DNA, 25 bp, Mus musculus
tatgcagcttcttgttggtatatta

SEQ ID NO: 788580 - DNA, 25 bp, Mus musculus
tatgcaggcccaatagcacacattc

SEQ ID NO: 788581 - DNA, 25 bp, Mus musculus
tatgcaggcccattagcacacattc

SEQ ID NO: 788582 - DNA, 25 bp, Mus musculus
tatgcaggccctaattggttttatt

SEQ ID NO: 788583 - DNA, 25 bp, Mus musculus
tatgcaggcccttattggttttatt

SEQ ID NO: 788584 - DNA, 25 bp, Mus musculus
tatgcaggcgccaagcaaaaacaga

SEQ ID NO: 788585 - DNA, 25 bp, Mus musculus
tatgcaggcgcctagcaaaaacaga

SEQ ID NO: 788586 - DNA, 25 bp, Mus musculus
tatgcagggaataccacagtcttat

SEQ ID NO: 788587 - DNA, 25 bp, Mus musculus
tatgcagggaattccacagtcttat

SEQ ID NO: 788588 - DNA, 25 bp, Mus musculus
tatgcagggctaatcacatctagag

SEQ ID NO: 788589 - DNA, 25 bp, Mus musculus
tatgcagggctattcacatctagag

SEQ ID NO: 788590 - DNA, 25 bp, Mus musculus
tatgcaggttatcccctgtggtttc

SEQ ID NO: 788591 - DNA, 25 bp, Mus musculus
tatgcaggttatgccctgtggtttc

SEQ ID NO: 788592 - DNA, 25 bp, Mus musculus
tatgcagtcaccagcgtgccacaag

SEQ ID NO: 788593 - DNA, 25 bp, Mus musculus
tatgcagtcacctgcgtgccacaag

SEQ ID NO: 788594 - DNA, 25 bp, Mus musculus
tatgcagtccccaaaagtgtcacga

SEQ ID NO: 788595 - DNA, 25 bp, Mus musculus
tatgcagtccccaatctggagccca

SEQ ID NO: 788596 - DNA, 25 bp, Mus musculus
tatgcagtcccctaaagtgtcacga

SEQ ID NO: 788597 - DNA, 25 bp, Mus musculus
tatgcagtcccctatctggagccca

SEQ ID NO: 788598 - DNA, 25 bp, Mus musculus
tatgcagtgcagaatttacaatgtt

SEQ ID NO: 788599 - DNA, 25 bp, Mus musculus
tatgcagtgcagtatttacaatgtt

SEQ ID NO: 788600 - DNA, 25 bp, Mus musculus
tatgcagtgccaagtaccatctcag

SEQ ID NO: 788601 - DNA, 25 bp, Mus musculus
tatgcagtgccatgtaccatctcag

SEQ ID NO: 788602 - DNA, 25 bp, Mus musculus
tatgcagtgcttcttaaggcttcat

SEQ ID NO: 788603 - DNA, 25 bp, Mus musculus
tatgcagtgcttgttaaggcttcat

SEQ ID NO: 788604 - DNA, 25 bp, Mus musculus
tatgcagtggccattgagctcatta

SEQ ID NO: 788605 - DNA, 25 bp, Mus musculus
tatgcagtggcctttgagctcatta

SEQ ID NO: 788606 - DNA, 25 bp, Mus musculus
tatgcagttagtcttctggccactg

SEQ ID NO: 788607 - DNA, 25 bp, Mus musculus
tatgcagttagtgttctggccactg

SEQ ID NO: 788608 - DNA, 25 bp, Mus musculus
tatgcagttatacagccacaaaggg

SEQ ID NO: 788609 - DNA, 25 bp, Mus musculus
tatgcagttatagagccacaaaggg

SEQ ID NO: 788610 - DNA, 25 bp, Mus musculus
tatgcagttccgaccgtgtctattc

SEQ ID NO: 788611 - DNA, 25 bp, Mus musculus
tatgcagttccgtccgtgtctattc

SEQ ID NO: 788612 - DNA, 25 bp, Mus musculus
tatgcagttcttccggagtgacagg

SEQ ID NO: 788613 - DNA, 25 bp, Mus musculus
tatgcagttcttgcggagtgacagg

SEQ ID NO: 788614 - DNA, 25 bp, Mus musculus
tatgcagtttgacctgatccctgag

SEQ ID NO: 788615 - DNA, 25 bp, Mus musculus
tatgcagtttgagctgatccctgag

SEQ ID NO: 788616 - DNA, 25 bp, Mus musculus
tatgcagtttggacagctcctgaca

SEQ ID NO: 788617 - DNA, 25 bp, Mus musculus
tatgcagtttggtcagctcctgaca

SEQ ID NO: 788618 - DNA, 25 bp, Mus musculus
tatgcatacaggagccctctgaggc

SEQ ID NO: 788619 - DNA, 25 bp, Mus musculus
tatgcatacaggtgccctctgaggc

SEQ ID NO: 788620 - DNA, 25 bp, Mus musculus
tatgcataccttaccttcaggagtg

SEQ ID NO: 788621 - DNA, 25 bp, Mus musculus
tatgcatacctttccttcaggagtg

SEQ ID NO: 788622 - DNA, 25 bp, Mus musculus
tatgcatacggcatccctgtaagat

SEQ ID NO: 788623 - DNA, 25 bp, Mus musculus
tatgcatacggcttccctgtaagat

SEQ ID NO: 788624 - DNA, 25 bp, Mus musculus
tatgcatactacctgcctggtggtg

SEQ ID NO: 788625 - DNA, 25 bp, Mus musculus
tatgcatactacgtgcctggtggtg

SEQ ID NO: 788626 - DNA, 25 bp, Mus musculus
tatgcatagcagacactttacactt

SEQ ID NO: 788627 - DNA, 25 bp, Mus musculus
tatgcatagcagtcactttacactt

SEQ ID NO: 788628 - DNA, 25 bp, Mus musculus
tatgcatagcttcggcagtagcccc

SEQ ID NO: 788629 - DNA, 25 bp, Mus musculus
tatgcatagcttgggcagtagcccc

SEQ ID NO: 788630 - DNA, 25 bp, Mus musculus
tatgcataggcaacccgcactgtta

SEQ ID NO: 788631 - DNA, 25 bp, Mus musculus
tatgcataggcatcccgcactgtta

SEQ ID NO: 788632 - DNA, 25 bp, Mus musculus
tatgcataggctaaggtggcacatg

SEQ ID NO: 788633 - DNA, 25 bp, Mus musculus
tatgcataggcttaggtggcacatg

SEQ ID NO: 788634 - DNA, 25 bp, Mus musculus
tatgcatatgccacttcttgaagat

SEQ ID NO: 788635 - DNA, 25 bp, Mus musculus
tatgcatatgcctcttcttgaagat

SEQ ID NO: 788636 - DNA, 25 bp, Mus musculus
tatgcatattaccagtttatttgac

SEQ ID NO: 788637 - DNA, 25 bp, Mus musculus
tatgcatattacgagtttatttgac

SEQ ID NO: 788638 - DNA, 25 bp, Mus musculus
tatgcatccaaacagtacccgatct

SEQ ID NO: 788639 - DNA, 25 bp, Mus musculus
tatgcatccaaagagtacccgatct

SEQ ID NO: 788640 - DNA, 25 bp, Mus musculus
tatgcatccatcacaggacttcatc

SEQ ID NO: 788641 - DNA, 25 bp, Mus musculus
tatgcatccatctcaggacttcatc

SEQ ID NO: 788642 - DNA, 25 bp, Mus musculus
tatgcatccattatgcctctgcctt

SEQ ID NO: 788643 - DNA, 25 bp, Mus musculus
tatgcatccattttgcctctgcctt

SEQ ID NO: 788644 - DNA, 25 bp, Mus musculus
tatgcatccctgctccttaaaggca

SEQ ID NO: 788645 - DNA, 25 bp, Mus musculus
tatgcatccctggtccttaaaggca

SEQ ID NO: 788646 - DNA, 25 bp, Mus musculus
tatgcatccgtcacttcatgtctgt

SEQ ID NO: 788647 - DNA, 25 bp, Mus musculus
tatgcatccgtctcttcatgtctgt

SEQ ID NO: 788648 - DNA, 25 bp, Mus musculus
tatgcatcctgtcataatggctttt

SEQ ID NO: 788649 - DNA, 25 bp, Mus musculus
tatgcatcctgtgataatggctttt

SEQ ID NO: 788650 - DNA, 25 bp, Mus musculus
tatgcatcgctaaagtatccttcct

SEQ ID NO: 788651 - DNA, 25 bp, Mus musculus
tatgcatcgctatagtatccttcct

SEQ ID NO: 788652 - DNA, 25 bp, Mus musculus
tatgcatctgggagtttgcctgcat

SEQ ID NO: 788653 - DNA, 25 bp, Mus musculus
tatgcatctgggtgtttgcctgcat

SEQ ID NO: 788654 - DNA, 25 bp, Mus musculus
tatgcatcttttacttcttgctcct

SEQ ID NO: 788655 - DNA, 25 bp, Mus musculus
tatgcatctttttcttcttgctcct

SEQ ID NO: 788656 - DNA, 25 bp, Mus musculus
tatgcatgagacaacaaaactaatc

SEQ ID NO: 788657 - DNA, 25 bp, Mus musculus
tatgcatgagactacaaaactaatc

SEQ ID NO: 788658 - DNA, 25 bp, Mus musculus
tatgcatgagctaggtagggtgaaa

SEQ ID NO: 788659 - DNA, 25 bp, Mus musculus
tatgcatgagcttggtagggtgaaa

SEQ ID NO: 788660 - DNA, 25 bp, Mus musculus
tatgcatgcacacatctttgaaagc

SEQ ID NO: 788661 - DNA, 25 bp, Mus musculus
tatgcatgcacagatctttgaaagc

SEQ ID NO: 788662 - DNA, 25 bp, Mus musculus
tatgcatgcacccacacaggtgaca

SEQ ID NO: 788663 - DNA, 25 bp, Mus musculus
tatgcatgcaccgacacaggtgaca

SEQ ID NO: 788664 - DNA, 25 bp, Mus musculus
tatgcatgtcacctggagaggctcc

SEQ ID NO: 788665 - DNA, 25 bp, Mus musculus
tatgcatgtcacgtggagaggctcc

SEQ ID NO: 788666 - DNA, 25 bp, Mus musculus
tatgcatgtcatacggcagctggac

SEQ ID NO: 788667 - DNA, 25 bp, Mus musculus
tatgcatgtcattcggcagctggac

SEQ ID NO: 788668 - DNA, 25 bp, Mus musculus
tatgcattatttacctagcttatta

SEQ ID NO: 788669 - DNA, 25 bp, Mus musculus
tatgcattattttcctagcttatta

SEQ ID NO: 788670 - DNA, 25 bp, Mus musculus
tatgcattcactctcctaggaaacg

SEQ ID NO: 788671 - DNA, 25 bp, Mus musculus
tatgcattcactgtcctaggaaacg

SEQ ID NO: 788672 - DNA, 25 bp, Mus musculus
tatgcattcctgctttatgccagtc

SEQ ID NO: 788673 - DNA, 25 bp, Mus musculus
tatgcattcctggtttatgccagtc

SEQ ID NO: 788674 - DNA, 25 bp, Mus musculus
tatgcattccttatgtctactcaca

SEQ ID NO: 788675 - DNA, 25 bp, Mus musculus
tatgcattccttttgtctactcaca

SEQ ID NO: 788676 - DNA, 25 bp, Mus musculus
tatgcattctaacaggaatctgaca

SEQ ID NO: 788677 - DNA, 25 bp, Mus musculus
tatgcattctaagaggaatctgaca

SEQ ID NO: 788678 - DNA, 25 bp, Mus musculus
tatgcattgcgcctttaaggacagc

SEQ ID NO: 788679 - DNA, 25 bp, Mus musculus
tatgcattgcgcgtttaaggacagc

SEQ ID NO: 788680 - DNA, 25 bp, Mus musculus
tatgcatttagtctctcacctccat

SEQ ID NO: 788681 - DNA, 25 bp, Mus musculus
tatgcatttagtgtctcacctccat

SEQ ID NO: 788682 - DNA, 25 bp, Mus musculus
tatgcatttatacactacgagttga

SEQ ID NO: 788683 - DNA, 25 bp, Mus musculus
tatgcatttatagactacgagttga

SEQ ID NO: 788684 - DNA, 25 bp, Mus musculus
tatgcatttattaacactcgaacag

SEQ ID NO: 788685 - DNA, 25 bp, Mus musculus
tatgcatttatttacactcgaacag

SEQ ID NO: 788686 - DNA, 25 bp, Mus musculus
tatgcatttctccaggcaagcttgc

SEQ ID NO: 788687 - DNA, 25 bp, Mus musculus
tatgcatttctcgaggcaagcttgc

SEQ ID NO: 788688 - DNA, 25 bp, Mus musculus
tatgcatttgcccttcagttactgt

SEQ ID NO: 788689 - DNA, 25 bp, Mus musculus
tatgcatttgccgttcagttactgt

SEQ ID NO: 788690 - DNA, 25 bp, Mus musculus
tatgcattttggctacctcccctgt

SEQ ID NO: 788691 - DNA, 25 bp, Mus musculus
tatgcattttgggtacctcccctgt

SEQ ID NO: 788692 - DNA, 25 bp, Mus musculus
tatgccaaaacccaagccttacgtg

SEQ ID NO: 788693 - DNA, 25 bp, Mus musculus
tatgccaaaaccgaagccttacgtg

SEQ ID NO: 788694 - DNA, 25 bp, Mus musculus
tatgccaaacacagtatacttcccc

SEQ ID NO: 788695 - DNA, 25 bp, Mus musculus
tatgccaaacactgtatacttcccc

SEQ ID NO: 788696 - DNA, 25 bp, Mus musculus
tatgccaacatcagtggtctctgtt

SEQ ID NO: 788697 - DNA, 25 bp, Mus musculus
tatgccaacatctgtggtctctgtt

SEQ ID NO: 788698 - DNA, 25 bp, Mus musculus
tatgccaacctcatggaaatattag

SEQ ID NO: 788699 - DNA, 25 bp, Mus musculus
tatgccaacctcttggaaatattag

SEQ ID NO: 788700 - DNA, 25 bp, Mus musculus
tatgccaactcgcatccggcggtgg

SEQ ID NO: 788701 - DNA, 25 bp, Mus musculus
tatgccaactcggatccggcggtgg

SEQ ID NO: 788702 - DNA, 25 bp, Mus musculus
tatgccaactggatgacctcacgtt

SEQ ID NO: 788703 - DNA, 25 bp, Mus musculus
tatgccaactggttgacctcacgtt

SEQ ID NO: 788704 - DNA, 25 bp, Mus musculus
tatgccaagattacttttgcacacc

SEQ ID NO: 788705 - DNA, 25 bp, Mus musculus
tatgccaagatttcttttgcacacc

SEQ ID NO: 788706 - DNA, 25 bp, Mus musculus
tatgccaagctgctgcagcgtcaga

SEQ ID NO: 788707 - DNA, 25 bp, Mus musculus
tatgccaagctggtgcagcgtcaga

SEQ ID NO: 788708 - DNA, 25 bp, Mus musculus
tatgccaaggagaccgtaggcttcg

SEQ ID NO: 788709 - DNA, 25 bp, Mus musculus
tatgccaaggagtccgtaggcttcg

SEQ ID NO: 788710 - DNA, 25 bp, Mus musculus
tatgccaaggttcggcttttcaccc

SEQ ID NO: 788711 - DNA, 25 bp, Mus musculus
tatgccaaggttgggcttttcaccc

SEQ ID NO: 788712 - DNA, 25 bp, Mus musculus
tatgccaatctacactccaaagaat

SEQ ID NO: 788713 - DNA, 25 bp, Mus musculus
tatgccaatctagactccaaagaat

SEQ ID NO: 788714 - DNA, 25 bp, Mus musculus
tatgccacaaaacggcctcagagac

SEQ ID NO: 788715 - DNA, 25 bp, Mus musculus
tatgccacaaaagggcctcagagac

SEQ ID NO: 788716 - DNA, 25 bp, Mus musculus
tatgccacaaatacctagcgcggta

SEQ ID NO: 788717 - DNA, 25 bp, Mus musculus
tatgccacaaattcctagcgcggta

SEQ ID NO: 788718 - DNA, 25 bp, Mus musculus
tatgccacagaccatgacatcgtgt

SEQ ID NO: 788719 - DNA, 25 bp, Mus musculus
tatgccacagacgatgacatcgtgt

SEQ ID NO: 788720 - DNA, 25 bp, Mus musculus
tatgccacagtcagtccttttttga

SEQ ID NO: 788721 - DNA, 25 bp, Mus musculus
tatgccacagtctgtccttttttga

SEQ ID NO: 788722 - DNA, 25 bp, Mus musculus
tatgccacatggcaccaggtctcaa

SEQ ID NO: 788723 - DNA, 25 bp, Mus musculus
tatgccacatgggaccaggtctcaa

SEQ ID NO: 788724 - DNA, 25 bp, Mus musculus
tatgccaccagcatcagacaataac

SEQ ID NO: 788725 - DNA, 25 bp, Mus musculus
tatgccaccagcttcagacaataac

SEQ ID NO: 788726 - DNA, 25 bp, Mus musculus
tatgccaccatgcacagaccatcaa

SEQ ID NO: 788727 - DNA, 25 bp, Mus musculus
tatgccaccatggacagaccatcaa

SEQ ID NO: 788728 - DNA, 25 bp, Mus musculus
tatgccacctccactgggaaactaa

SEQ ID NO: 788729 - DNA, 25 bp, Mus musculus
tatgccacctcctctgggaaactaa

SEQ ID NO: 788730 - DNA, 25 bp, Mus musculus
tatgccacctggctgcgggcaattt

SEQ ID NO: 788731 - DNA, 25 bp, Mus musculus
tatgccacctgggtgcgggcaattt

SEQ ID NO: 788732 - DNA, 25 bp, Mus musculus
tatgccacctgtagtttatgttccc

SEQ ID NO: 788733 - DNA, 25 bp, Mus musculus
tatgccacctgttgtttatgttccc

SEQ ID NO: 788734 - DNA, 25 bp, Mus musculus
tatgccactagaaatgaaattcagc

SEQ ID NO: 788735 - DNA, 25 bp, Mus musculus
tatgccactagatatgaaattcagc

SEQ ID NO: 788736 - DNA, 25 bp, Mus musculus
tatgccagccaacgtatcagtcccg

SEQ ID NO: 788737 - DNA, 25 bp, Mus musculus
tatgccagccaaggtatcagtcccg

SEQ ID NO: 788738 - DNA, 25 bp, Mus musculus
tatgccagccagcaagctcaaagaa

SEQ ID NO: 788739 - DNA, 25 bp, Mus musculus
tatgccagccaggaagctcaaagaa

SEQ ID NO: 788740 - DNA, 25 bp, Mus musculus
tatgccagctggataatgacctatg

SEQ ID NO: 788741 - DNA, 25 bp, Mus musculus
tatgccagctggttaatgacctatg

SEQ ID NO: 788742 - DNA, 25 bp, Mus musculus
tatgccaggagacactcttgcctct

SEQ ID NO: 788743 - DNA, 25 bp, Mus musculus
tatgccaggagagactcttgcctct

SEQ ID NO: 788744 - DNA, 25 bp, Mus musculus
tatgccaggcctcacacgtttgaca

SEQ ID NO: 788745 - DNA, 25 bp, Mus musculus
tatgccaggcctgacacgtttgaca

SEQ ID NO: 788746 - DNA, 25 bp, Mus musculus
tatgccagggtgatccctttcaatt

SEQ ID NO: 788747 - DNA, 25 bp, Mus musculus
tatgccagggtgttccctttcaatt

SEQ ID NO: 788748 - DNA, 25 bp, Mus musculus
tatgccaggtgaaggcacccatgcg

SEQ ID NO: 788749 - DNA, 25 bp, Mus musculus
tatgccaggtgatggcacccatgcg

SEQ ID NO: 788750 - DNA, 25 bp, Mus musculus
tatgccagtctgacattcatccaaa

SEQ ID NO: 788751 - DNA, 25 bp, Mus musculus
tatgccagtctgtcattcatccaaa

SEQ ID NO: 788752 - DNA, 25 bp, Mus musculus
tatgccagtcttagaacccaggttt

SEQ ID NO: 788753 - DNA, 25 bp, Mus musculus
tatgccagtctttgaacccaggttt

SEQ ID NO: 788754 - DNA, 25 bp, Mus musculus
tatgccagtgccatctccatgatgg

SEQ ID NO: 788755 - DNA, 25 bp, Mus musculus
tatgccagtgccttctccatgatgg

SEQ ID NO: 788756 - DNA, 25 bp, Mus musculus
tatgccagtggcaccaatttgatgt

SEQ ID NO: 788757 - DNA, 25 bp, Mus musculus
tatgccagtggctccaatttgatgt

SEQ ID NO: 788758 - DNA, 25 bp, Mus musculus
tatgccagttttagagcacgggtgc

SEQ ID NO: 788759 - DNA, 25 bp, Mus musculus
tatgccagtttttgagcacgggtgc

SEQ ID NO: 788760 - DNA, 25 bp, Mus musculus
tatgccatacccatctatattgtaa

SEQ ID NO: 788761 - DNA, 25 bp, Mus musculus
tatgccatacccttctatattgtaa

SEQ ID NO: 788762 - DNA, 25 bp, Mus musculus
tatgccatactgaatctacttgaac

SEQ ID NO: 788763 - DNA, 25 bp, Mus musculus
tatgccatactgtatctacttgaac

SEQ ID NO: 788764 - DNA, 25 bp, Mus musculus
tatgccatcaacctgtctcaaaaga

SEQ ID NO: 788765 - DNA, 25 bp, Mus musculus
tatgccatcaacgtgtctcaaaaga

SEQ ID NO: 788766 - DNA, 25 bp, Mus musculus
tatgccatccagccgcgcggtgcga

SEQ ID NO: 788767 - DNA, 25 bp, Mus musculus
tatgccatccaggcgcgcggtgcga

SEQ ID NO: 788768 - DNA, 25 bp, Mus musculus
tatgccatctctctggacatcttct

SEQ ID NO: 788769 - DNA, 25 bp, Mus musculus
tatgccatctctgtggacatcttct

SEQ ID NO: 788770 - DNA, 25 bp, Mus musculus
tatgccatctgtattaccatcttca

SEQ ID NO: 788771 - DNA, 25 bp, Mus musculus
tatgccatctgttttaccatcttca

SEQ ID NO: 788772 - DNA, 25 bp, Mus musculus
tatgccatctttagactggttaaga

SEQ ID NO: 788773 - DNA, 25 bp, Mus musculus
tatgccatcttttgactggttaaga

SEQ ID NO: 788774 - DNA, 25 bp, Mus musculus
tatgccatggatctatgcctggact

SEQ ID NO: 788775 - DNA, 25 bp, Mus musculus
tatgccatggatgtatgcctggact

SEQ ID NO: 788776 - DNA, 25 bp, Mus musculus
tatgccattcgtagcacacattcac

SEQ ID NO: 788777 - DNA, 25 bp, Mus musculus
tatgccattcgttgcacacattcac

SEQ ID NO: 788778 - DNA, 25 bp, Mus musculus
tatgccattcttccttagtgatctg

SEQ ID NO: 788779 - DNA, 25 bp, Mus musculus
tatgccattcttgcttagtgatctg

SEQ ID NO: 788780 - DNA, 25 bp, Mus musculus
tatgccattttcctgtcactttgtg

SEQ ID NO: 788781 - DNA, 25 bp, Mus musculus
tatgccattttcgtgtcactttgtg

SEQ ID NO: 788782 - DNA, 25 bp, Mus musculus
tatgcccaacaaccaggaaatgaaa

SEQ ID NO: 788783 - DNA, 25 bp, Mus musculus
tatgcccaacaagcaggaaatgaaa

SEQ ID NO: 788784 - DNA, 25 bp, Mus musculus
tatgcccaagttagcaaatgtgttt

SEQ ID NO: 788785 - DNA, 25 bp, Mus musculus
tatgcccaagtttgcaaatgtgttt

SEQ ID NO: 788786 - DNA, 25 bp, Mus musculus
tatgcccacaccatgtacagtttta

SEQ ID NO: 788787 - DNA, 25 bp, Mus musculus
tatgcccacaccttgtacagtttta

SEQ ID NO: 788788 - DNA, 25 bp, Mus musculus
tatgcccaccacagcgagtcctgga

SEQ ID NO: 788789 - DNA, 25 bp, Mus musculus
tatgcccaccactgcgagtcctgga

SEQ ID NO: 788790 - DNA, 25 bp, Mus musculus
tatgcccaccccaaaagttacactg

SEQ ID NO: 788791 - DNA, 25 bp, Mus musculus
tatgcccacccctaaagttacactg

SEQ ID NO: 788792 - DNA, 25 bp, Mus musculus
tatgcccacgtgacttggcctagaa

SEQ ID NO: 788793 - DNA, 25 bp, Mus musculus
tatgcccacgtgtcttggcctagaa

SEQ ID NO: 788794 - DNA, 25 bp, Mus musculus
tatgcccagaagaagctgaccagtg

SEQ ID NO: 788795 - DNA, 25 bp, Mus musculus
tatgcccagaagtagctgaccagtg

SEQ ID NO: 788796 - DNA, 25 bp, Mus musculus
tatgcccagatccacacagcggaag

SEQ ID NO: 788797 - DNA, 25 bp, Mus musculus
tatgcccagatcgacacagcggaag

SEQ ID NO: 788798 - DNA, 25 bp, Mus musculus
tatgcccagctcagttgacactagt

SEQ ID NO: 788799 - DNA, 25 bp, Mus musculus
tatgcccagctctgttgacactagt

SEQ ID NO: 788800 - DNA, 25 bp, Mus musculus
tatgcccaggacagagccatcaggg

SEQ ID NO: 788801 - DNA, 25 bp, Mus musculus
tatgcccaggactgagccatcaggg

SEQ ID NO: 788802 - DNA, 25 bp, Mus musculus
tatgcccagggtccaatcctcagta

SEQ ID NO: 788803 - DNA, 25 bp, Mus musculus
tatgcccagggtgcaatcctcagta

SEQ ID NO: 788804 - DNA, 25 bp, Mus musculus
tatgcccaggttcggtagctggcac

SEQ ID NO: 788805 - DNA, 25 bp, Mus musculus
tatgcccaggttgggtagctggcac

SEQ ID NO: 788806 - DNA, 25 bp, Mus musculus
tatgcccagtggctaccttgtctcc

SEQ ID NO: 788807 - DNA, 25 bp, Mus musculus
tatgcccagtgggtaccttgtctcc

SEQ ID NO: 788808 - DNA, 25 bp, Mus musculus
tatgcccatgccagtgcgttctaca

SEQ ID NO: 788809 - DNA, 25 bp, Mus musculus
tatgcccatgcctgtgcgttctaca

SEQ ID NO: 788810 - DNA, 25 bp, Mus musculus
tatgccccaaaaactagcactcaac

SEQ ID NO: 788811 - DNA, 25 bp, Mus musculus
tatgccccaaaatctagcactcaac

SEQ ID NO: 788812 - DNA, 25 bp, Mus musculus
tatgccccacctcttaaaggttcca

SEQ ID NO: 788813 - DNA, 25 bp, Mus musculus
tatgccccacctgttaaaggttcca

SEQ ID NO: 788814 - DNA, 25 bp, Mus musculus
tatgccccagcaattccttatggga

SEQ ID NO: 788815 - DNA, 25 bp, Mus musculus
tatgccccagcatttccttatggga

SEQ ID NO: 788816 - DNA, 25 bp, Mus musculus
tatgccccagctcggcaggatcagg

SEQ ID NO: 788817 - DNA, 25 bp, Mus musculus
tatgccccagctgggcaggatcagg

SEQ ID NO: 788818 - DNA, 25 bp, Mus musculus
tatgccccgtataaaatgtaactga

SEQ ID NO: 788819 - DNA, 25 bp, Mus musculus
tatgccccgtattaaatgtaactga

SEQ ID NO: 788820 - DNA, 25 bp, Mus musculus
tatgccccgtttaagtctggaaaca

SEQ ID NO: 788821 - DNA, 25 bp, Mus musculus
tatgccccgttttagtctggaaaca

SEQ ID NO: 788822 - DNA, 25 bp, Mus musculus
tatgcccctccaaaaaccaagtatt

SEQ ID NO: 788823 - DNA, 25 bp, Mus musculus
tatgcccctccataaaccaagtatt

SEQ ID NO: 788824 - DNA, 25 bp, Mus musculus
tatgcccctgggaacaatgccgagg

SEQ ID NO: 788825 - DNA, 25 bp, Mus musculus
tatgcccctgggtacaatgccgagg

SEQ ID NO: 788826 - DNA, 25 bp, Mus musculus
tatgcccctgtccttaaccaagaag

SEQ ID NO: 788827 - DNA, 25 bp, Mus musculus
tatgcccctgtcgttaaccaagaag

SEQ ID NO: 788828 - DNA, 25 bp, Mus musculus
tatgcccgccgtcactgaagacaaa

SEQ ID NO: 788829 - DNA, 25 bp, Mus musculus
tatgcccgccgtgactgaagacaaa

SEQ ID NO: 788830 - DNA, 25 bp, Mus musculus
tatgcccgctcccatgacctaggga

SEQ ID NO: 788831 - DNA, 25 bp, Mus musculus
tatgcccgctccgatgacctaggga

SEQ ID NO: 788832 - DNA, 25 bp, Mus musculus
tatgcccgtgtcaaccacaacaagt

SEQ ID NO: 788833 - DNA, 25 bp, Mus musculus
tatgcccgtgtctaccacaacaagt

SEQ ID NO: 788834 - DNA, 25 bp, Mus musculus
tatgccctacagaagtcagatctac

SEQ ID NO: 788835 - DNA, 25 bp, Mus musculus
tatgccctacagtagtcagatctac

SEQ ID NO: 788836 - DNA, 25 bp, Mus musculus
tatgccctagttatacaagtagaga

SEQ ID NO: 788837 - DNA, 25 bp, Mus musculus
tatgccctagttttacaagtagaga

SEQ ID NO: 788838 - DNA, 25 bp, Mus musculus
tatgccctccccacatttggagaaa

SEQ ID NO: 788839 - DNA, 25 bp, Mus musculus
tatgccctcccctcatttggagaaa

SEQ ID NO: 788840 - DNA, 25 bp, Mus musculus
tatgccctgaagacaaatgccagat

SEQ ID NO: 788841 - DNA, 25 bp, Mus musculus
tatgccctgaagtcaaatgccagat

SEQ ID NO: 788842 - DNA, 25 bp, Mus musculus
tatgccctgctgctacgagtggaat

SEQ ID NO: 788843 - DNA, 25 bp, Mus musculus
tatgccctgctggtacgagtggaat

SEQ ID NO: 788844 - DNA, 25 bp, Mus musculus
tatgccctgtccctcggatttcaca

SEQ ID NO: 788845 - DNA, 25 bp, Mus musculus
tatgccctgtccgtcggatttcaca

SEQ ID NO: 788846 - DNA, 25 bp, Mus musculus
tatgccctgtgtcggccttgcgaat

SEQ ID NO: 788847 - DNA, 25 bp, Mus musculus
tatgccctgtgtgggccttgcgaat

SEQ ID NO: 788848 - DNA, 25 bp, Mus musculus
tatgccctgttcaacttgggactct

SEQ ID NO: 788849 - DNA, 25 bp, Mus musculus
tatgccctgttctacttgggactct

SEQ ID NO: 788850 - DNA, 25 bp, Mus musculus
tatgcccttcttacgtattgtttat

SEQ ID NO: 788851 - DNA, 25 bp, Mus musculus
tatgcccttctttcgtattgtttat

SEQ ID NO: 788852 - DNA, 25 bp, Mus musculus
tatgcccttgtaaccctgttcctgg

SEQ ID NO: 788853 - DNA, 25 bp, Mus musculus
tatgcccttgtatccctgttcctgg

SEQ ID NO: 788854 - DNA, 25 bp, Mus musculus
tatgccgaatccatggtggccactg

SEQ ID NO: 788855 - DNA, 25 bp, Mus musculus
tatgccgaatccttggtggccactg

SEQ ID NO: 788856 - DNA, 25 bp, Mus musculus
tatgccgaccatacaggattagtta

SEQ ID NO: 788857 - DNA, 25 bp, Mus musculus
tatgccgaccattcaggattagtta

SEQ ID NO: 788858 - DNA, 25 bp, Mus musculus
tatgccgagatgaggcagctgcagc

SEQ ID NO: 788859 - DNA, 25 bp, Mus musculus
tatgccgagatgtggcagctgcagc

SEQ ID NO: 788860 - DNA, 25 bp, Mus musculus
tatgccgatagaaagagcgccaatg

SEQ ID NO: 788861 - DNA, 25 bp, Mus musculus
tatgccgatagatagagcgccaatg

SEQ ID NO: 788862 - DNA, 25 bp, Mus musculus
tatgccgcagtgagcaaaacctagg

SEQ ID NO: 788863 - DNA, 25 bp, Mus musculus
tatgccgcagtgtgcaaaacctagg

SEQ ID NO: 788864 - DNA, 25 bp, Mus musculus
tatgccgcataaccatgcaatgtgc

SEQ ID NO: 788865 - DNA, 25 bp, Mus musculus
tatgccgcataagcatgcaatgtgc

SEQ ID NO: 788866 - DNA, 25 bp, Mus musculus
tatgccgctgtcattagagtagttg

SEQ ID NO: 788867 - DNA, 25 bp, Mus musculus
tatgccgctgtctttagagtagttg

SEQ ID NO: 788868 - DNA, 25 bp, Mus musculus
tatgccgctgtgacccatcgtattg

SEQ ID NO: 788869 - DNA, 25 bp, Mus musculus
tatgccgctgtgtcccatcgtattg

SEQ ID NO: 788870 - DNA, 25 bp, Mus musculus
tatgccggaacaagtcttgacaagt

SEQ ID NO: 788871 - DNA, 25 bp, Mus musculus
tatgccggaacatgtcttgacaagt

SEQ ID NO: 788872 - DNA, 25 bp, Mus musculus
tatgccggaagtccttaatggctcc

SEQ ID NO: 788873 - DNA, 25 bp, Mus musculus
tatgccggaagtgcttaatggctcc

SEQ ID NO: 788874 - DNA, 25 bp, Mus musculus
tatgccggatagatgctctgcctgg

SEQ ID NO: 788875 - DNA, 25 bp, Mus musculus
tatgccggatagttgctctgcctgg

SEQ ID NO: 788876 - DNA, 25 bp, Mus musculus
tatgccggatttcgagagccatctt

SEQ ID NO: 788877 - DNA, 25 bp, Mus musculus
tatgccggatttggagagccatctt

SEQ ID NO: 788878 - DNA, 25 bp, Mus musculus
tatgcctaaccaagagcaagtgggt

SEQ ID NO: 788879 - DNA, 25 bp, Mus musculus
tatgcctaaccatgagcaagtgggt

SEQ ID NO: 788880 - DNA, 25 bp, Mus musculus
tatgcctacataaggatgcctgata

SEQ ID NO: 788881 - DNA, 25 bp, Mus musculus
tatgcctacatatggatgcctgata

SEQ ID NO: 788882 - DNA, 25 bp, Mus musculus
tatgcctacctaactttgtcttgaa

SEQ ID NO: 788883 - DNA, 25 bp, Mus musculus
tatgcctacctatctttgtcttgaa

SEQ ID NO: 788884 - DNA, 25 bp, Mus musculus
tatgcctacctcatgtagttgttgc

SEQ ID NO: 788885 - DNA, 25 bp, Mus musculus
tatgcctacctcttgtagttgttgc

SEQ ID NO: 788886 - DNA, 25 bp, Mus musculus
tatgcctacgtgagccccaagtcgt

SEQ ID NO: 788887 - DNA, 25 bp, Mus musculus
tatgcctacgtgtgccccaagtcgt

SEQ ID NO: 788888 - DNA, 25 bp, Mus musculus
tatgcctacttgactttctgatcag

SEQ ID NO: 788889 - DNA, 25 bp, Mus musculus
tatgcctacttgtctttctgatcag

SEQ ID NO: 788890 - DNA, 25 bp, Mus musculus
tatgcctagcacagtcaccacgggt

SEQ ID NO: 788891 - DNA, 25 bp, Mus musculus
tatgcctagcactgtcaccacgggt

SEQ ID NO: 788892 - DNA, 25 bp, Mus musculus
tatgcctagccacagtgagttcaag

SEQ ID NO: 788893 - DNA, 25 bp, Mus musculus
tatgcctagccagagtgagttcaag

SEQ ID NO: 788894 - DNA, 25 bp, Mus musculus
tatgcctatctgaaattctgtatgc

SEQ ID NO: 788895 - DNA, 25 bp, Mus musculus
tatgcctatctgtaattctgtatgc

SEQ ID NO: 788896 - DNA, 25 bp, Mus musculus
tatgcctcaagtcccgtggtatgaa

SEQ ID NO: 788897 - DNA, 25 bp, Mus musculus
tatgcctcaagtgccgtggtatgaa

SEQ ID NO: 788898 - DNA, 25 bp, Mus musculus
tatgcctcacaaaataggtcggatt

SEQ ID NO: 788899 - DNA, 25 bp, Mus musculus
tatgcctcacaatataggtcggatt

SEQ ID NO: 788900 - DNA, 25 bp, Mus musculus
tatgcctcacagaagagcccttgtt

SEQ ID NO: 788901 - DNA, 25 bp, Mus musculus
tatgcctcacagtagagcccttgtt

SEQ ID NO: 788902 - DNA, 25 bp, Mus musculus
tatgcctcagcaaacctagggactt

SEQ ID NO: 788903 - DNA, 25 bp, Mus musculus
tatgcctcagcatacctagggactt

SEQ ID NO: 788904 - DNA, 25 bp, Mus musculus
tatgcctccaaacctcgctcgatgg

SEQ ID NO: 788905 - DNA, 25 bp, Mus musculus
tatgcctccaaagctcgctcgatgg

SEQ ID NO: 788906 - DNA, 25 bp, Mus musculus
tatgcctcctgaaatgcagcttaag

SEQ ID NO: 788907 - DNA, 25 bp, Mus musculus
tatgcctcctgatatgcagcttaag

SEQ ID NO: 788908 - DNA, 25 bp, Mus musculus
tatgcctcctgtatcaacactgaca

SEQ ID NO: 788909 - DNA, 25 bp, Mus musculus
tatgcctcctgtttcaacactgaca

SEQ ID NO: 788910 - DNA, 25 bp, Mus musculus
tatgcctcgagtatggtctatttca

SEQ ID NO: 788911 - DNA, 25 bp, Mus musculus
tatgcctcgagtttggtctatttca

SEQ ID NO: 788912 - DNA, 25 bp, Mus musculus
tatgcctcggagactcacaggacgt

SEQ ID NO: 788913 - DNA, 25 bp, Mus musculus
tatgcctcggagtctcacaggacgt

SEQ ID NO: 788914 - DNA, 25 bp, Mus musculus
tatgcctctaccacactgttaggga

SEQ ID NO: 788915 - DNA, 25 bp, Mus musculus
tatgcctctacctcactgttaggga

SEQ ID NO: 788916 - DNA, 25 bp, Mus musculus
tatgcctctgctcaggaacctccag

SEQ ID NO: 788917 - DNA, 25 bp, Mus musculus
tatgcctctgctgaggaacctccag

SEQ ID NO: 788918 - DNA, 25 bp, Mus musculus
tatgcctctggtatttgggacctgc

SEQ ID NO: 788919 - DNA, 25 bp, Mus musculus
tatgcctctggtttttgggacctgc

SEQ ID NO: 788920 - DNA, 25 bp, Mus musculus
tatgcctctgtcagtataactgctc

SEQ ID NO: 788921 - DNA, 25 bp, Mus musculus
tatgcctctgtctgtataactgctc

SEQ ID NO: 788922 - DNA, 25 bp, Mus musculus
tatgcctgaatcatactccttcaac

SEQ ID NO: 788923 - DNA, 25 bp, Mus musculus
tatgcctgaatcttactccttcaac

SEQ ID NO: 788924 - DNA, 25 bp, Mus musculus
tatgcctgatgcctgtaaatgggag

SEQ ID NO: 788925 - DNA, 25 bp, Mus musculus
tatgcctgatgcgtgtaaatgggag

SEQ ID NO: 788926 - DNA, 25 bp, Mus musculus
tatgcctgcagaatatttactttat

SEQ ID NO: 788927 - DNA, 25 bp, Mus musculus
tatgcctgcagattatttactttat

SEQ ID NO: 788928 - DNA, 25 bp, Mus musculus
tatgcctgcatccagaagcacaaag

SEQ ID NO: 788929 - DNA, 25 bp, Mus musculus
tatgcctgcatcgagaagcacaaag

SEQ ID NO: 788930 - DNA, 25 bp, Mus musculus
tatgcctgccatccaagcagtggct

SEQ ID NO: 788931 - DNA, 25 bp, Mus musculus
tatgcctgccatgcaagcagtggct

SEQ ID NO: 788932 - DNA, 25 bp, Mus musculus
tatgcctgcctgacttagttaaggt

SEQ ID NO: 788933 - DNA, 25 bp, Mus musculus
tatgcctgcctgtcttagttaaggt

SEQ ID NO: 788934 - DNA, 25 bp, Mus musculus
tatgcctggcaacacacctgttgtt

SEQ ID NO: 788935 - DNA, 25 bp, Mus musculus
tatgcctggcaagacacctgttgtt

SEQ ID NO: 788936 - DNA, 25 bp, Mus musculus
tatgcctggcagatatcttgtccct

SEQ ID NO: 788937 - DNA, 25 bp, Mus musculus
tatgcctggcagttatcttgtccct

SEQ ID NO: 788938 - DNA, 25 bp, Mus musculus
tatgcctggcccacagctgagattg

SEQ ID NO: 788939 - DNA, 25 bp, Mus musculus
tatgcctggccctcagctgagattg

SEQ ID NO: 788940 - DNA, 25 bp, Mus musculus
tatgcctggctcacttgattttctt

SEQ ID NO: 788941 - DNA, 25 bp, Mus musculus
tatgcctggctctcttgattttctt

SEQ ID NO: 788942 - DNA, 25 bp, Mus musculus
tatgcctgggctactgtgacaatca

SEQ ID NO: 788943 - DNA, 25 bp, Mus musculus
tatgcctgggcttctgtgacaatca

SEQ ID NO: 788944 - DNA, 25 bp, Mus musculus
tatgcctgtatcacaacctaatcat

SEQ ID NO: 788945 - DNA, 25 bp, Mus musculus
tatgcctgtatctcaacctaatcat

SEQ ID NO: 788946 - DNA, 25 bp, Mus musculus
tatgccttaaatctttttctggtaa

SEQ ID NO: 788947 - DNA, 25 bp, Mus musculus
tatgccttaaatgtttttctggtaa

SEQ ID NO: 788948 - DNA, 25 bp, Mus musculus
tatgccttaccaaatatgaccttaa

SEQ ID NO: 788949 - DNA, 25 bp, Mus musculus
tatgccttaccatatatgaccttaa

SEQ ID NO: 788950 - DNA, 25 bp, Mus musculus
tatgccttaggaagacaacctccat

SEQ ID NO: 788951 - DNA, 25 bp, Mus musculus
tatgccttaggatgacaacctccat

SEQ ID NO: 788952 - DNA, 25 bp, Mus musculus
tatgccttcaggagagattatgaac

SEQ ID NO: 788953 - DNA, 25 bp, Mus musculus
tatgccttcaggtgagattatgaac

SEQ ID NO: 788954 - DNA, 25 bp, Mus musculus
tatgccttcctcatacttatcacat

SEQ ID NO: 788955 - DNA, 25 bp, Mus musculus
tatgccttcctcttacttatcacat

SEQ ID NO: 788956 - DNA, 25 bp, Mus musculus
tatgccttctaaatttaggttagtc

SEQ ID NO: 788957 - DNA, 25 bp, Mus musculus
tatgccttctaattttaggttagtc

SEQ ID NO: 788958 - DNA, 25 bp, Mus musculus
tatgccttctctcttcgttctgtac

SEQ ID NO: 788959 - DNA, 25 bp, Mus musculus
tatgccttctctgttcgttctgtac

SEQ ID NO: 788960 - DNA, 25 bp, Mus musculus
tatgccttctgaacccgtctttatc

SEQ ID NO: 788961 - DNA, 25 bp, Mus musculus
tatgccttctgatcccgtctttatc

SEQ ID NO: 788962 - DNA, 25 bp, Mus musculus
tatgccttgccgcatcagcctaggg

SEQ ID NO: 788963 - DNA, 25 bp, Mus musculus
tatgccttgccggatcagcctaggg

SEQ ID NO: 788964 - DNA, 25 bp, Mus musculus
tatgccttggttctactgtgagagt

SEQ ID NO: 788965 - DNA, 25 bp, Mus musculus
tatgccttggttgtactgtgagagt

SEQ ID NO: 788966 - DNA, 25 bp, Mus musculus
tatgccttgtatagtgtgatttgat

SEQ ID NO: 788967 - DNA, 25 bp, Mus musculus
tatgccttgtatatagtatttggga

SEQ ID NO: 788968 - DNA, 25 bp, Mus musculus
tatgccttgtattgtgtgatttgat

SEQ ID NO: 788969 - DNA, 25 bp, Mus musculus
tatgccttgtatttagtatttggga

SEQ ID NO: 788970 - DNA, 25 bp, Mus musculus
tatgcctttaatcttcaggaagcag

SEQ ID NO: 788971 - DNA, 25 bp, Mus musculus
tatgcctttaatgttcaggaagcag

SEQ ID NO: 788972 - DNA, 25 bp, Mus musculus
tatgcctttccgcattttgtacaaa

SEQ ID NO: 788973 - DNA, 25 bp, Mus musculus
tatgcctttccggattttgtacaaa

SEQ ID NO: 788974 - DNA, 25 bp, Mus musculus
tatgcctttgtaattgctgtgggtt

SEQ ID NO: 788975 - DNA, 25 bp, Mus musculus
tatgcctttgtatttgctgtgggtt

SEQ ID NO: 788976 - DNA, 25 bp, Mus musculus
tatgccttttcgctttgggacccag

SEQ ID NO: 788977 - DNA, 25 bp, Mus musculus
tatgccttttcggtttgggacccag

SEQ ID NO: 788978 - DNA, 25 bp, Mus musculus
tatgccttttggactcggaacaagc

SEQ ID NO: 788979 - DNA, 25 bp, Mus musculus
tatgccttttggtctcggaacaagc

SEQ ID NO: 788980 - DNA, 25 bp, Mus musculus
tatgcgacggctatgctggttttta

SEQ ID NO: 788981 - DNA, 25 bp, Mus musculus
tatgcgacggctttgctggttttta

SEQ ID NO: 788982 - DNA, 25 bp, Mus musculus
tatgcgaggaaacctattcatcagg

SEQ ID NO: 788983 - DNA, 25 bp, Mus musculus
tatgcgaggaaagctattcatcagg

SEQ ID NO: 788984 - DNA, 25 bp, Mus musculus
tatgcgaggtgtctgtgacgcccaa

SEQ ID NO: 788985 - DNA, 25 bp, Mus musculus
tatgcgaggtgtgtgtgacgcccaa

SEQ ID NO: 788986 - DNA, 25 bp, Mus musculus
tatgcgagtcacatttattctgtac

SEQ ID NO: 788987 - DNA, 25 bp, Mus musculus
tatgcgagtcacttttattctgtac

SEQ ID NO: 788988 - DNA, 25 bp, Mus musculus
tatgcgatacatacctgctgccatt

SEQ ID NO: 788989 - DNA, 25 bp, Mus musculus
tatgcgatacattcctgctgccatt

SEQ ID NO: 788990 - DNA, 25 bp, Mus musculus
tatgcgatgaagaaccctctggtgc

SEQ ID NO: 788991 - DNA, 25 bp, Mus musculus
tatgcgatgaagtaccctctggtgc

SEQ ID NO: 788992 - DNA, 25 bp, Mus musculus
tatgcgatggctattctgactgtat

SEQ ID NO: 788993 - DNA, 25 bp, Mus musculus
tatgcgatggcttttctgactgtat

SEQ ID NO: 788994 - DNA, 25 bp, Mus musculus
tatgcgcaagacagctgatgactga

SEQ ID NO: 788995 - DNA, 25 bp, Mus musculus
tatgcgcaagactgctgatgactga

SEQ ID NO: 788996 - DNA, 25 bp, Mus musculus
tatgcgcagctgatcgtgcaggcca

SEQ ID NO: 788997 - DNA, 25 bp, Mus musculus
tatgcgcagctgttcgtgcaggcca

SEQ ID NO: 788998 - DNA, 25 bp, Mus musculus
tatgcgcatcccctggcaacagtta

SEQ ID NO: 788999 - DNA, 25 bp, Mus musculus
tatgcgcatcccgtggcaacagtta

SEQ ID NO: 789000 - DNA, 25 bp, Mus musculus
tatgcgcatggcagaaagcaccctg

SEQ ID NO: 789001 - DNA, 25 bp, Mus musculus
tatgcgcatggctgaaagcaccctg

SEQ ID NO: 789002 - DNA, 25 bp, Mus musculus
tatgcgccactaaacctagttgaga

SEQ ID NO: 789003 - DNA, 25 bp, Mus musculus
tatgcgccactatacctagttgaga

SEQ ID NO: 789004 - DNA, 25 bp, Mus musculus
tatgcgccgtggaggctaccgccag

SEQ ID NO: 789005 - DNA, 25 bp, Mus musculus
tatgcgccgtggtggctaccgccag

SEQ ID NO: 789006 - DNA, 25 bp, Mus musculus
tatgcgcggtaactgtgctacccat

SEQ ID NO: 789007 - DNA, 25 bp, Mus musculus
tatgcgcggtaagtgtgctacccat

SEQ ID NO: 789008 - DNA, 25 bp, Mus musculus
tatgcgctactacagggattggaaa

SEQ ID NO: 789009 - DNA, 25 bp, Mus musculus
tatgcgctactagagggattggaaa

SEQ ID NO: 789010 - DNA, 25 bp, Mus musculus
tatgcgctgtacagtgtagcccgcc

SEQ ID NO: 789011 - DNA, 25 bp, Mus musculus
tatgcgctgtactgtgtagcccgcc

SEQ ID NO: 789012 - DNA, 25 bp, Mus musculus
tatgcggaaacccaaaagattactt

SEQ ID NO: 789013 - DNA, 25 bp, Mus musculus
tatgcggaaaccgaaaagattactt

SEQ ID NO: 789014 - DNA, 25 bp, Mus musculus
tatgcggacatcattggcacagaat

SEQ ID NO: 789015 - DNA, 25 bp, Mus musculus
tatgcggacatctttggcacagaat

SEQ ID NO: 789016 - DNA, 25 bp, Mus musculus
tatgcggactggacaaaacacttgg

SEQ ID NO: 789017 - DNA, 25 bp, Mus musculus
tatgcggactggtcaaaacacttgg

SEQ ID NO: 789018 - DNA, 25 bp, Mus musculus
tatgcgggacaccataaacacctca

SEQ ID NO: 789019 - DNA, 25 bp, Mus musculus
tatgcgggacacgataaacacctca

SEQ ID NO: 789020 - DNA, 25 bp, Mus musculus
tatgcgggcacaaacatgctccgag

SEQ ID NO: 789021 - DNA, 25 bp, Mus musculus
tatgcgggcacatacatgctccgag

SEQ ID NO: 789022 - DNA, 25 bp, Mus musculus
tatgcggtggctcttacacatccat

SEQ ID NO: 789023 - DNA, 25 bp, Mus musculus
tatgcggtggctgttacacatccat

SEQ ID NO: 789024 - DNA, 25 bp, Mus musculus
tatgcggttataacctgagactcaa

SEQ ID NO: 789025 - DNA, 25 bp, Mus musculus
tatgcggttatatcctgagactcaa

SEQ ID NO: 789026 - DNA, 25 bp, Mus musculus
tatgcggttgaaactgattgcaaac

SEQ ID NO: 789027 - DNA, 25 bp, Mus musculus
tatgcggttgaatctgattgcaaac

SEQ ID NO: 789028 - DNA, 25 bp, Mus musculus
tatgcggtttaaagaaactttcctg

SEQ ID NO: 789029 - DNA, 25 bp, Mus musculus
tatgcggtttaatgaaactttcctg

SEQ ID NO: 789030 - DNA, 25 bp, Mus musculus
tatgcgtccagccaatcacaggaaa

SEQ ID NO: 789031 - DNA, 25 bp, Mus musculus
tatgcgtccagcgaatcacaggaaa

SEQ ID NO: 789032 - DNA, 25 bp, Mus musculus
tatgcgtccttgacggatcttgtca

SEQ ID NO: 789033 - DNA, 25 bp, Mus musculus
tatgcgtccttgtcggatcttgtca

SEQ ID NO: 789034 - DNA, 25 bp, Mus musculus
tatgcgtgctatcagcttggctgtc

SEQ ID NO: 789035 - DNA, 25 bp, Mus musculus
tatgcgtgctatgagcttggctgtc

SEQ ID NO: 789036 - DNA, 25 bp, Mus musculus
tatgcgtggaatcacctcctgggac

SEQ ID NO: 789037 - DNA, 25 bp, Mus musculus
tatgcgtggaatgacctcctgggac

SEQ ID NO: 789038 - DNA, 25 bp, Mus musculus
tatgcgtttgatcgttctcagcctc

SEQ ID NO: 789039 - DNA, 25 bp, Mus musculus
tatgcgtttgatggttctcagcctc

SEQ ID NO: 789040 - DNA, 25 bp, Mus musculus
tatgctaaatcacccgatgtgcgcc

SEQ ID NO: 789041 - DNA, 25 bp, Mus musculus
tatgctaaatcagccgatgtgcgcc

SEQ ID NO: 789042 - DNA, 25 bp, Mus musculus
tatgctaaatttagtaccctggtaa

SEQ ID NO: 789043 - DNA, 25 bp, Mus musculus
tatgctaaattttgtaccctggtaa

SEQ ID NO: 789044 - DNA, 25 bp, Mus musculus
tatgctaacaatcaagggcttgtgc

SEQ ID NO: 789045 - DNA, 25 bp, Mus musculus
tatgctaacaatgaagggcttgtgc

SEQ ID NO: 789046 - DNA, 25 bp, Mus musculus
tatgctaacctccatgccagagttg

SEQ ID NO: 789047 - DNA, 25 bp, Mus musculus
tatgctaacctcgatgccagagttg

SEQ ID NO: 789048 - DNA, 25 bp, Mus musculus
tatgctaactataccatccttacct

SEQ ID NO: 789049 - DNA, 25 bp, Mus musculus
tatgctaactattccatccttacct

SEQ ID NO: 789050 - DNA, 25 bp, Mus musculus
tatgctaatatgaatgccctgtata

SEQ ID NO: 789051 - DNA, 25 bp, Mus musculus
tatgctaatatgtatgccctgtata

SEQ ID NO: 789052 - DNA, 25 bp, Mus musculus
tatgctaatccacagagcagctttg

SEQ ID NO: 789053 - DNA, 25 bp, Mus musculus
tatgctaatccagagagcagctttg

SEQ ID NO: 789054 - DNA, 25 bp, Mus musculus
tatgctaattgcacatattctgctc

SEQ ID NO: 789055 - DNA, 25 bp, Mus musculus
tatgctaattgctcatattctgctc

SEQ ID NO: 789056 - DNA, 25 bp, Mus musculus
tatgctaccataaccttttactgag

SEQ ID NO: 789057 - DNA, 25 bp, Mus musculus
tatgctaccatatccttttactgag

SEQ ID NO: 789058 - DNA, 25 bp, Mus musculus
tatgctacccagatactccaaagaa

SEQ ID NO: 789059 - DNA, 25 bp, Mus musculus
tatgctacccagttactccaaagaa

SEQ ID NO: 789060 - DNA, 25 bp, Mus musculus
tatgctactcaactaaaccctattc

SEQ ID NO: 789061 - DNA, 25 bp, Mus musculus
tatgctactcaagtaaaccctattc

SEQ ID NO: 789062 - DNA, 25 bp, Mus musculus
tatgctactgcaaccacaggtcatg

SEQ ID NO: 789063 - DNA, 25 bp, Mus musculus
tatgctactgcatccacaggtcatg

SEQ ID NO: 789064 - DNA, 25 bp, Mus musculus
tatgctagaaatcctccacagcact

SEQ ID NO: 789065 - DNA, 25 bp, Mus musculus
tatgctagaaatgctccacagcact

SEQ ID NO: 789066 - DNA, 25 bp, Mus musculus
tatgctagacagatgcagtgtggga

SEQ ID NO: 789067 - DNA, 25 bp, Mus musculus
tatgctagacagttgcagtgtggga

SEQ ID NO: 789068 - DNA, 25 bp, Mus musculus
tatgctagcatcacacttgacaagt

SEQ ID NO: 789069 - DNA, 25 bp, Mus musculus
tatgctagcatctcacttgacaagt

SEQ ID NO: 789070 - DNA, 25 bp, Mus musculus
tatgctagccgtcctgagtcaaagg

SEQ ID NO: 789071 - DNA, 25 bp, Mus musculus
tatgctagccgtgctgagtcaaagg

SEQ ID NO: 789072 - DNA, 25 bp, Mus musculus
tatgctagctcaaagaagcttgggt

SEQ ID NO: 789073 - DNA, 25 bp, Mus musculus
tatgctagctcatagaagcttgggt

SEQ ID NO: 789074 - DNA, 25 bp, Mus musculus
tatgctaggaggctatgtccccagc

SEQ ID NO: 789075 - DNA, 25 bp, Mus musculus
tatgctaggagggtatgtccccagc

SEQ ID NO: 789076 - DNA, 25 bp, Mus musculus
tatgctaggctgcagtaagctttgc

SEQ ID NO: 789077 - DNA, 25 bp, Mus musculus
tatgctaggctggagtaagctttgc

SEQ ID NO: 789078 - DNA, 25 bp, Mus musculus
tatgctatactgattaaaaggctat

SEQ ID NO: 789079 - DNA, 25 bp, Mus musculus
tatgctatactgtttaaaaggctat

SEQ ID NO: 789080 - DNA, 25 bp, Mus musculus
tatgctatagttcctgtccttgctt

SEQ ID NO: 789081 - DNA, 25 bp, Mus musculus
tatgctatagttgctgtccttgctt

SEQ ID NO: 789082 - DNA, 25 bp, Mus musculus
tatgctatcatcaagtttccgctga

SEQ ID NO: 789083 - DNA, 25 bp, Mus musculus
tatgctatcatctagtttccgctga

SEQ ID NO: 789084 - DNA, 25 bp, Mus musculus
tatgctatcccaaaaaggtcaaagt

SEQ ID NO: 789085 - DNA, 25 bp, Mus musculus
tatgctatcccataaaggtcaaagt

SEQ ID NO: 789086 - DNA, 25 bp, Mus musculus
tatgctatcttgacgcatggaatct

SEQ ID NO: 789087 - DNA, 25 bp, Mus musculus
tatgctatcttgtcgcatggaatct

SEQ ID NO: 789088 - DNA, 25 bp, Mus musculus
tatgctatggccatcttgtctagaa

SEQ ID NO: 789089 - DNA, 25 bp, Mus musculus
tatgctatggccttcttgtctagaa

SEQ ID NO: 789090 - DNA, 25 bp, Mus musculus
tatgctatggttattgtcgtacagt

SEQ ID NO: 789091 - DNA, 25 bp, Mus musculus
tatgctatggtttttgtcgtacagt

SEQ ID NO: 789092 - DNA, 25 bp, Mus musculus
tatgctattctacaactcctggaaa

SEQ ID NO: 789093 - DNA, 25 bp, Mus musculus
tatgctattctagaactcctggaaa

SEQ ID NO: 789094 - DNA, 25 bp, Mus musculus
tatgctattgtcataccttttggag

SEQ ID NO: 789095 - DNA, 25 bp, Mus musculus
tatgctattgtcttaccttttggag

SEQ ID NO: 789096 - DNA, 25 bp, Mus musculus
tatgctcaagtgaaggcgccacaca

SEQ ID NO: 789097 - DNA, 25 bp, Mus musculus
tatgctcaagtgtaggcgccacaca

SEQ ID NO: 789098 - DNA, 25 bp, Mus musculus
tatgctcacgcgagtatacgaggga

SEQ ID NO: 789099 - DNA, 25 bp, Mus musculus
tatgctcacgcgtgtatacgaggga

SEQ ID NO: 789100 - DNA, 25 bp, Mus musculus
tatgctcagcttcgatgtctggcac

SEQ ID NO: 789101 - DNA, 25 bp, Mus musculus
tatgctcagcttggatgtctggcac

SEQ ID NO: 789102 - DNA, 25 bp, Mus musculus
tatgctcaggaaagcgacgttacga

SEQ ID NO: 789103 - DNA, 25 bp, Mus musculus
tatgctcaggaatgcgacgttacga

SEQ ID NO: 789104 - DNA, 25 bp, Mus musculus
tatgctcagtccaatgggtggctgt

SEQ ID NO: 789105 - DNA, 25 bp, Mus musculus
tatgctcagtcctatgggtggctgt

SEQ ID NO: 789106 - DNA, 25 bp, Mus musculus
tatgctcagttccttcacggaaaac

SEQ ID NO: 789107 - DNA, 25 bp, Mus musculus
tatgctcagttcgttcacggaaaac

SEQ ID NO: 789108 - DNA, 25 bp, Mus musculus
tatgctcatggccacaggacttcgc

SEQ ID NO: 789109 - DNA, 25 bp, Mus musculus
tatgctcatggcgacaggacttcgc

SEQ ID NO: 789110 - DNA, 25 bp, Mus musculus
tatgctcatgtaatcttgacaggga

SEQ ID NO: 789111 - DNA, 25 bp, Mus musculus
tatgctcatgtattcttgacaggga

SEQ ID NO: 789112 - DNA, 25 bp, Mus musculus
tatgctccacacctatgaatccggt

SEQ ID NO: 789113 - DNA, 25 bp, Mus musculus
tatgctccacacgtatgaatccggt

SEQ ID NO: 789114 - DNA, 25 bp, Mus musculus
tatgctccacatactatttagaaca

SEQ ID NO: 789115 - DNA, 25 bp, Mus musculus
tatgctccacattctatttagaaca

SEQ ID NO: 789116 - DNA, 25 bp, Mus musculus
tatgctccaggacaatccagggcgg

SEQ ID NO: 789117 - DNA, 25 bp, Mus musculus
tatgctccaggagaatccagggcgg

SEQ ID NO: 789118 - DNA, 25 bp, Mus musculus
tatgctcctccgcaaagatgtgcaa

SEQ ID NO: 789119 - DNA, 25 bp, Mus musculus
tatgctcctccggaaagatgtgcaa

SEQ ID NO: 789120 - DNA, 25 bp, Mus musculus
tatgctcctgagaccttgcagtgaa

SEQ ID NO: 789121 - DNA, 25 bp, Mus musculus
tatgctcctgagctatactccagtt

SEQ ID NO: 789122 - DNA, 25 bp, Mus musculus
tatgctcctgaggtatactccagtt

SEQ ID NO: 789123 - DNA, 25 bp, Mus musculus
tatgctcctgagtccttgcagtgaa

SEQ ID NO: 789124 - DNA, 25 bp, Mus musculus
tatgctcgccagcatgctcaacact

SEQ ID NO: 789125 - DNA, 25 bp, Mus musculus
tatgctcgccaggatgctcaacact

SEQ ID NO: 789126 - DNA, 25 bp, Mus musculus
tatgctcgtccccaagtcagtgagt

SEQ ID NO: 789127 - DNA, 25 bp, Mus musculus
tatgctcgtcccgaagtcagtgagt

SEQ ID NO: 789128 - DNA, 25 bp, Mus musculus
tatgctctaagtaagccgtcctcag

SEQ ID NO: 789129 - DNA, 25 bp, Mus musculus
tatgctctaagttagccgtcctcag

SEQ ID NO: 789130 - DNA, 25 bp, Mus musculus
tatgctctagagcatgacccactgg

SEQ ID NO: 789131 - DNA, 25 bp, Mus musculus
tatgctctagaggatgacccactgg

SEQ ID NO: 789132 - DNA, 25 bp, Mus musculus
tatgctctagctacctgtgtgaaat

SEQ ID NO: 789133 - DNA, 25 bp, Mus musculus
tatgctctagcttcctgtgtgaaat

SEQ ID NO: 789134 - DNA, 25 bp, Mus musculus
tatgctctagggatttcagtctcca

SEQ ID NO: 789135 - DNA, 25 bp, Mus musculus
tatgctctagggttttcagtctcca

SEQ ID NO: 789136 - DNA, 25 bp, Mus musculus
tatgctctccctacagaatccattg

SEQ ID NO: 789137 - DNA, 25 bp, Mus musculus
tatgctctcccttcagaatccattg

SEQ ID NO: 789138 - DNA, 25 bp, Mus musculus
tatgctctgcaaaccctttattttc

SEQ ID NO: 789139 - DNA, 25 bp, Mus musculus
tatgctctgcaatccctttattttc

SEQ ID NO: 789140 - DNA, 25 bp, Mus musculus
tatgctctgcggatgctgcccaaga

SEQ ID NO: 789141 - DNA, 25 bp, Mus musculus
tatgctctgcggttgctgcccaaga

SEQ ID NO: 789142 - DNA, 25 bp, Mus musculus
tatgctctgctcacctacatgattg

SEQ ID NO: 789143 - DNA, 25 bp, Mus musculus
tatgctctgctctcctacatgattg

SEQ ID NO: 789144 - DNA, 25 bp, Mus musculus
tatgctctggagactcttctcactc

SEQ ID NO: 789145 - DNA, 25 bp, Mus musculus
tatgctctggagtctcttctcactc

SEQ ID NO: 789146 - DNA, 25 bp, Mus musculus
tatgctctggttctttcttgttctt

SEQ ID NO: 789147 - DNA, 25 bp, Mus musculus
tatgctctggttgtttcttgttctt

SEQ ID NO: 789148 - DNA, 25 bp, Mus musculus
tatgctctgttacaagtgccttagc

SEQ ID NO: 789149 - DNA, 25 bp, Mus musculus
tatgctctgttagaagtgccttagc

SEQ ID NO: 789150 - DNA, 25 bp, Mus musculus
tatgctcttatcaatagatatgtga

SEQ ID NO: 789151 - DNA, 25 bp, Mus musculus
tatgctcttatctatagatatgtga

SEQ ID NO: 789152 - DNA, 25 bp, Mus musculus
tatgctctttctacatgttatactg

SEQ ID NO: 789153 - DNA, 25 bp, Mus musculus
tatgctctttcttcatgttatactg

SEQ ID NO: 789154 - DNA, 25 bp, Mus musculus
tatgctgaaaggacagtaggttcaa

SEQ ID NO: 789155 - DNA, 25 bp, Mus musculus
tatgctgaaaggtcagtaggttcaa

SEQ ID NO: 789156 - DNA, 25 bp, Mus musculus
tatgctgaacatactcacaaccaga

SEQ ID NO: 789157 - DNA, 25 bp, Mus musculus
tatgctgaacattctcacaaccaga

SEQ ID NO: 789158 - DNA, 25 bp, Mus musculus
tatgctgaattgatgtgtccggcca

SEQ ID NO: 789159 - DNA, 25 bp, Mus musculus
tatgctgaattgttgtgtccggcca

SEQ ID NO: 789160 - DNA, 25 bp, Mus musculus
tatgctgacagtcttcagtttcctc

SEQ ID NO: 789161 - DNA, 25 bp, Mus musculus
tatgctgacagtgttcagtttcctc

SEQ ID NO: 789162 - DNA, 25 bp, Mus musculus
tatgctgaccaaagccatggccatg

SEQ ID NO: 789163 - DNA, 25 bp, Mus musculus
tatgctgaccaatgccatggccatg

SEQ ID NO: 789164 - DNA, 25 bp, Mus musculus
tatgctgaccccaacacatgcaaag

SEQ ID NO: 789165 - DNA, 25 bp, Mus musculus
tatgctgacccctacacatgcaaag

SEQ ID NO: 789166 - DNA, 25 bp, Mus musculus
tatgctgacgtgatccatcatcctt

SEQ ID NO: 789167 - DNA, 25 bp, Mus musculus
tatgctgacgtgttccatcatcctt

SEQ ID NO: 789168 - DNA, 25 bp, Mus musculus
tatgctgacttcagccggagactgt

SEQ ID NO: 789169 - DNA, 25 bp, Mus musculus
tatgctgacttctgccggagactgt

SEQ ID NO: 789170 - DNA, 25 bp, Mus musculus
tatgctgagaagactggcctcaaac

SEQ ID NO: 789171 - DNA, 25 bp, Mus musculus
tatgctgagaagtctggcctcaaac

SEQ ID NO: 789172 - DNA, 25 bp, Mus musculus
tatgctgagatcacgcaggatgctt

SEQ ID NO: 789173 - DNA, 25 bp, Mus musculus
tatgctgagatctcgcaggatgctt

SEQ ID NO: 789174 - DNA, 25 bp, Mus musculus
tatgctgagcagctctctctgctag

SEQ ID NO: 789175 - DNA, 25 bp, Mus musculus
tatgctgagcaggtctctctgctag

SEQ ID NO: 789176 - DNA, 25 bp, Mus musculus
tatgctgatagtcacatgattaaca

SEQ ID NO: 789177 - DNA, 25 bp, Mus musculus
tatgctgatagtgacatgattaaca

SEQ ID NO: 789178 - DNA, 25 bp, Mus musculus
tatgctgatctgatgactcctctta

SEQ ID NO: 789179 - DNA, 25 bp, Mus musculus
tatgctgatctgttgactcctctta

SEQ ID NO: 789180 - DNA, 25 bp, Mus musculus
tatgctgcaactctagcaaggccca

SEQ ID NO: 789181 - DNA, 25 bp, Mus musculus
tatgctgcaactgtagcaaggccca

SEQ ID NO: 789182 - DNA, 25 bp, Mus musculus
tatgctgcacagattgcgttagtcc

SEQ ID NO: 789183 - DNA, 25 bp, Mus musculus
tatgctgcacagtttgcgttagtcc

SEQ ID NO: 789184 - DNA, 25 bp, Mus musculus
tatgctgcaccacttacaggccttg

SEQ ID NO: 789185 - DNA, 25 bp, Mus musculus
tatgctgcaccagttacaggccttg

SEQ ID NO: 789186 - DNA, 25 bp, Mus musculus
tatgctgcacctagtattccttaga

SEQ ID NO: 789187 - DNA, 25 bp, Mus musculus
tatgctgcaccttgtattccttaga

SEQ ID NO: 789188 - DNA, 25 bp, Mus musculus
tatgctgcatttcctctgtcagagt

SEQ ID NO: 789189 - DNA, 25 bp, Mus musculus
tatgctgcatttgctctgtcagagt

SEQ ID NO: 789190 - DNA, 25 bp, Mus musculus
tatgctgccactatccatgattttt

SEQ ID NO: 789191 - DNA, 25 bp, Mus musculus
tatgctgccactttccatgattttt

SEQ ID NO: 789192 - DNA, 25 bp, Mus musculus
tatgctgcccaccagctgagttagt

SEQ ID NO: 789193 - DNA, 25 bp, Mus musculus
tatgctgcccacgagctgagttagt

SEQ ID NO: 789194 - DNA, 25 bp, Mus musculus
tatgctgccctcaggcggcgcacag

SEQ ID NO: 789195 - DNA, 25 bp, Mus musculus
tatgctgccctcaggcttcagtctg

SEQ ID NO: 789196 - DNA, 25 bp, Mus musculus
tatgctgccctctggcggcgcacag

SEQ ID NO: 789197 - DNA, 25 bp, Mus musculus
tatgctgccctctggcttcagtctg

SEQ ID NO: 789198 - DNA, 25 bp, Mus musculus
tatgctgcgactagacgttgtccca

SEQ ID NO: 789199 - DNA, 25 bp, Mus musculus
tatgctgcgacttgacgttgtccca

SEQ ID NO: 789200 - DNA, 25 bp, Mus musculus
tatgctgcggaacccaatgcctcat

SEQ ID NO: 789201 - DNA, 25 bp, Mus musculus
tatgctgcggaagccaatgcctcat

SEQ ID NO: 789202 - DNA, 25 bp, Mus musculus
tatgctgctggccaggccgagaagg

SEQ ID NO: 789203 - DNA, 25 bp, Mus musculus
tatgctgctggcgaggccgagaagg

SEQ ID NO: 789204 - DNA, 25 bp, Mus musculus
tatgctgctgggattctgtagtgaa

SEQ ID NO: 789205 - DNA, 25 bp, Mus musculus
tatgctgctgggtttctgtagtgaa

SEQ ID NO: 789206 - DNA, 25 bp, Mus musculus
tatgctgctggtaagcttgagtgca

SEQ ID NO: 789207 - DNA, 25 bp, Mus musculus
tatgctgctggttagcttgagtgca

SEQ ID NO: 789208 - DNA, 25 bp, Mus musculus
tatgctgctgtacccctcaaatggt

SEQ ID NO: 789209 - DNA, 25 bp, Mus musculus
tatgctgctgtagccctcaaatggt

SEQ ID NO: 789210 - DNA, 25 bp, Mus musculus
tatgctgctgtcaccccgagggtcg

SEQ ID NO: 789211 - DNA, 25 bp, Mus musculus
tatgctgctgtctccccgagggtcg

SEQ ID NO: 789212 - DNA, 25 bp, Mus musculus
tatgctgcttatatactttgcttca

SEQ ID NO: 789213 - DNA, 25 bp, Mus musculus
tatgctgcttatttactttgcttca

SEQ ID NO: 789214 - DNA, 25 bp, Mus musculus
tatgctgctttcaggctgtctaaga

SEQ ID NO: 789215 - DNA, 25 bp, Mus musculus
tatgctgctttctggctgtctaaga

SEQ ID NO: 789216 - DNA, 25 bp, Mus musculus
tatgctggaaatacacaagctccct

SEQ ID NO: 789217 - DNA, 25 bp, Mus musculus
tatgctggaaattcacaagctccct

SEQ ID NO: 789218 - DNA, 25 bp, Mus musculus
tatgctggaactcgaccacctcact

SEQ ID NO: 789219 - DNA, 25 bp, Mus musculus
tatgctggaactcgaggtatataga

SEQ ID NO: 789220 - DNA, 25 bp, Mus musculus
tatgctggaactggaccacctcact

SEQ ID NO: 789221 - DNA, 25 bp, Mus musculus
tatgctggaactggaggtatataga

SEQ ID NO: 789222 - DNA, 25 bp, Mus musculus
tatgctggacagctggagctacaag

SEQ ID NO: 789223 - DNA, 25 bp, Mus musculus
tatgctggacaggtggagctacaag

SEQ ID NO: 789224 - DNA, 25 bp, Mus musculus
tatgctggacgccacaggtgaccaa

SEQ ID NO: 789225 - DNA, 25 bp, Mus musculus
tatgctggacgcgacaggtgaccaa

SEQ ID NO: 789226 - DNA, 25 bp, Mus musculus
tatgctggagccaaaccgatggaat

SEQ ID NO: 789227 - DNA, 25 bp, Mus musculus
tatgctggagcctaaccgatggaat

SEQ ID NO: 789228 - DNA, 25 bp, Mus musculus
tatgctggagctctgtcagggactc

SEQ ID NO: 789229 - DNA, 25 bp, Mus musculus
tatgctggagctgtgtcagggactc

SEQ ID NO: 789230 - DNA, 25 bp, Mus musculus
tatgctggatggaatcagtacactt

SEQ ID NO: 789231 - DNA, 25 bp, Mus musculus
tatgctggatggtatcagtacactt

SEQ ID NO: 789232 - DNA, 25 bp, Mus musculus
tatgctggcccgagcaaggcgtgca

SEQ ID NO: 789233 - DNA, 25 bp, Mus musculus
tatgctggcccgtgcaaggcgtgca

SEQ ID NO: 789234 - DNA, 25 bp, Mus musculus
tatgctggccctaggatcaaacttg

SEQ ID NO: 789235 - DNA, 25 bp, Mus musculus
tatgctggcccttggatcaaacttg

SEQ ID NO: 789236 - DNA, 25 bp, Mus musculus
tatgctgggcctcattgaggactat

SEQ ID NO: 789237 - DNA, 25 bp, Mus musculus
tatgctgggcctgattgaggactat

SEQ ID NO: 789238 - DNA, 25 bp, Mus musculus
tatgctggtcctcacaatgtattca

SEQ ID NO: 789239 - DNA, 25 bp, Mus musculus
tatgctggtcctgacaatgtattca

SEQ ID NO: 789240 - DNA, 25 bp, Mus musculus
tatgctggtgcacggtcctgtgacc

SEQ ID NO: 789241 - DNA, 25 bp, Mus musculus
tatgctggtgcagggtcctgtgacc

SEQ ID NO: 789242 - DNA, 25 bp, Mus musculus
tatgctggtggacccaacagtctgg

SEQ ID NO: 789243 - DNA, 25 bp, Mus musculus
tatgctggtggagccaacagtctgg

SEQ ID NO: 789244 - DNA, 25 bp, Mus musculus
tatgctgtaaacaacctcttagttc

SEQ ID NO: 789245 - DNA, 25 bp, Mus musculus
tatgctgtaaactacctcttagttc

SEQ ID NO: 789246 - DNA, 25 bp, Mus musculus
tatgctgtagaacatgggcctgata

SEQ ID NO: 789247 - DNA, 25 bp, Mus musculus
tatgctgtagaagatgggcctgata

SEQ ID NO: 789248 - DNA, 25 bp, Mus musculus
tatgctgtaggaatgtccccagtgt

SEQ ID NO: 789249 - DNA, 25 bp, Mus musculus
tatgctgtaggattgtccccagtgt

SEQ ID NO: 789250 - DNA, 25 bp, Mus musculus
tatgctgtctatatcatctacctat

SEQ ID NO: 789251 - DNA, 25 bp, Mus musculus
tatgctgtctatttcatctacctat

SEQ ID NO: 789252 - DNA, 25 bp, Mus musculus
tatgctgtctcgatgcaacatgcag

SEQ ID NO: 789253 - DNA, 25 bp, Mus musculus
tatgctgtctcgttgcaacatgcag

SEQ ID NO: 789254 - DNA, 25 bp, Mus musculus
tatgctgtgcagagtcattcacgga

SEQ ID NO: 789255 - DNA, 25 bp, Mus musculus
tatgctgtgcagtgtcattcacgga

SEQ ID NO: 789256 - DNA, 25 bp, Mus musculus
tatgctgtgcatagctgggcttgca

SEQ ID NO: 789257 - DNA, 25 bp, Mus musculus
tatgctgtgcatatccatactgtat

SEQ ID NO: 789258 - DNA, 25 bp, Mus musculus
tatgctgtgcatatgtttagccagt

SEQ ID NO: 789259 - DNA, 25 bp, Mus musculus
tatgctgtgcattgctgggcttgca

SEQ ID NO: 789260 - DNA, 25 bp, Mus musculus
tatgctgtgcatttccatactgtat

SEQ ID NO: 789261 - DNA, 25 bp, Mus musculus
tatgctgtgcatttgtttagccagt

SEQ ID NO: 789262 - DNA, 25 bp, Mus musculus
tatgctgtgctgctgtataaccagg

SEQ ID NO: 789263 - DNA, 25 bp, Mus musculus
tatgctgtgctggtgtataaccagg

SEQ ID NO: 789264 - DNA, 25 bp, Mus musculus
tatgctgtgggccaggctacgacac

SEQ ID NO: 789265 - DNA, 25 bp, Mus musculus
tatgctgtgggcgaggctacgacac

SEQ ID NO: 789266 - DNA, 25 bp, Mus musculus
tatgctgtgtgcatcacttgcaaat

SEQ ID NO: 789267 - DNA, 25 bp, Mus musculus
tatgctgtgtgcttcacttgcaaat

SEQ ID NO: 789268 - DNA, 25 bp, Mus musculus
tatgctgtgttaatcgactctgtat

SEQ ID NO: 789269 - DNA, 25 bp, Mus musculus
tatgctgtgttattcgactctgtat

SEQ ID NO: 789270 - DNA, 25 bp, Mus musculus
tatgctgttggaccagtgacctcct

SEQ ID NO: 789271 - DNA, 25 bp, Mus musculus
tatgctgttggagcagtgacctcct

SEQ ID NO: 789272 - DNA, 25 bp, Mus musculus
tatgctgttgtgacagtttcctgtc

SEQ ID NO: 789273 - DNA, 25 bp, Mus musculus
tatgctgttgtgtcagtttcctgtc

SEQ ID NO: 789274 - DNA, 25 bp, Mus musculus
tatgctgtttttctatctgtaatcc

SEQ ID NO: 789275 - DNA, 25 bp, Mus musculus
tatgctgtttttgtatctgtaatcc

SEQ ID NO: 789276 - DNA, 25 bp, Mus musculus
tatgcttaaaccctaatatcactgt

SEQ ID NO: 789277 - DNA, 25 bp, Mus musculus
tatgcttaaaccgtaatatcactgt

SEQ ID NO: 789278 - DNA, 25 bp, Mus musculus
tatgcttaagggacacctgatctct

SEQ ID NO: 789279 - DNA, 25 bp, Mus musculus
tatgcttaagggtcacctgatctct

SEQ ID NO: 789280 - DNA, 25 bp, Mus musculus
tatgcttaattcattttaccctcct

SEQ ID NO: 789281 - DNA, 25 bp, Mus musculus
tatgcttaattctttttaccctcct

SEQ ID NO: 789282 - DNA, 25 bp, Mus musculus
tatgcttaccaccaggagcccagtg

SEQ ID NO: 789283 - DNA, 25 bp, Mus musculus
tatgcttaccacgaggagcccagtg

SEQ ID NO: 789284 - DNA, 25 bp, Mus musculus
tatgcttatcagaactcatgtcatt

SEQ ID NO: 789285 - DNA, 25 bp, Mus musculus
tatgcttatcagtactcatgtcatt

SEQ ID NO: 789286 - DNA, 25 bp, Mus musculus
tatgcttcactgattggccttggaa

SEQ ID NO: 789287 - DNA, 25 bp, Mus musculus
tatgcttcactgtttggccttggaa

SEQ ID NO: 789288 - DNA, 25 bp, Mus musculus
tatgcttcatccaacacagtcttta

SEQ ID NO: 789289 - DNA, 25 bp, Mus musculus
tatgcttcatcctacacagtcttta

SEQ ID NO: 789290 - DNA, 25 bp, Mus musculus
tatgcttccaataaaggtgtgctca

SEQ ID NO: 789291 - DNA, 25 bp, Mus musculus
tatgcttccaattaaggtgtgctca

SEQ ID NO: 789292 - DNA, 25 bp, Mus musculus
tatgcttccagcagaggttactgtt

SEQ ID NO: 789293 - DNA, 25 bp, Mus musculus
tatgcttccagctgaggttactgtt

SEQ ID NO: 789294 - DNA, 25 bp, Mus musculus
tatgcttctcagatatattacagga

SEQ ID NO: 789295 - DNA, 25 bp, Mus musculus
tatgcttctcagttatattacagga

SEQ ID NO: 789296 - DNA, 25 bp, Mus musculus
tatgcttctcttagcgtcaccacca

SEQ ID NO: 789297 - DNA, 25 bp, Mus musculus
tatgcttctctttgcgtcaccacca

SEQ ID NO: 789298 - DNA, 25 bp, Mus musculus
tatgcttctggactcagctgtagac

SEQ ID NO: 789299 - DNA, 25 bp, Mus musculus
tatgcttctggagtcagctgtagac

SEQ ID NO: 789300 - DNA, 25 bp, Mus musculus
tatgcttctgtgctattattcttaa

SEQ ID NO: 789301 - DNA, 25 bp, Mus musculus
tatgcttctgtggtattattcttaa

SEQ ID NO: 789302 - DNA, 25 bp, Mus musculus
tatgcttcttccatttacgatgtat

SEQ ID NO: 789303 - DNA, 25 bp, Mus musculus
tatgcttcttccttttacgatgtat

SEQ ID NO: 789304 - DNA, 25 bp, Mus musculus
tatgcttgaaaaactctaagtcacc

SEQ ID NO: 789305 - DNA, 25 bp, Mus musculus
tatgcttgaaaatctctaagtcacc

SEQ ID NO: 789306 - DNA, 25 bp, Mus musculus
tatgcttgaagtcgcatcccctctg

SEQ ID NO: 789307 - DNA, 25 bp, Mus musculus
tatgcttgaagtggcatcccctctg

SEQ ID NO: 789308 - DNA, 25 bp, Mus musculus
tatgcttgagcaactgtacctgtag

SEQ ID NO: 789309 - DNA, 25 bp, Mus musculus
tatgcttgagcatctgtacctgtag

SEQ ID NO: 789310 - DNA, 25 bp, Mus musculus
tatgcttgcagccttgacacagtgc

SEQ ID NO: 789311 - DNA, 25 bp, Mus musculus
tatgcttgcagcgttgacacagtgc

SEQ ID NO: 789312 - DNA, 25 bp, Mus musculus
tatgcttgctaaaaccatccccaag

SEQ ID NO: 789313 - DNA, 25 bp, Mus musculus
tatgcttgctaataccatccccaag

SEQ ID NO: 789314 - DNA, 25 bp, Mus musculus
tatgcttgctgcatttatagaggtt

SEQ ID NO: 789315 - DNA, 25 bp, Mus musculus
tatgcttgctgcttttatagaggtt

SEQ ID NO: 789316 - DNA, 25 bp, Mus musculus
tatgcttgctttcatacctgactaa

SEQ ID NO: 789317 - DNA, 25 bp, Mus musculus
tatgcttgctttgatacctgactaa

SEQ ID NO: 789318 - DNA, 25 bp, Mus musculus
tatgcttggattcttcatgaaaatt

SEQ ID NO: 789319 - DNA, 25 bp, Mus musculus
tatgcttggattgttcatgaaaatt

SEQ ID NO: 789320 - DNA, 25 bp, Mus musculus
tatgcttggctgcagtacctcagat

SEQ ID NO: 789321 - DNA, 25 bp, Mus musculus
tatgcttggctggagtacctcagat

SEQ ID NO: 789322 - DNA, 25 bp, Mus musculus
tatgcttgggagagaatttcttgtt

SEQ ID NO: 789323 - DNA, 25 bp, Mus musculus
tatgcttgggagtgaatttcttgtt

SEQ ID NO: 789324 - DNA, 25 bp, Mus musculus
tatgcttgtaacagtacctggcctg

SEQ ID NO: 789325 - DNA, 25 bp, Mus musculus
tatgcttgtaactgtacctggcctg

SEQ ID NO: 789326 - DNA, 25 bp, Mus musculus
tatgcttgtaagataccccaaattt

SEQ ID NO: 789327 - DNA, 25 bp, Mus musculus
tatgcttgtaagttaccccaaattt

SEQ ID NO: 789328 - DNA, 25 bp, Mus musculus
tatgcttgtagcaatcttgtaatca

SEQ ID NO: 789329 - DNA, 25 bp, Mus musculus
tatgcttgtagctatcttgtaatca

SEQ ID NO: 789330 - DNA, 25 bp, Mus musculus
tatgcttgtgtgaacagctgcctga

SEQ ID NO: 789331 - DNA, 25 bp, Mus musculus
tatgcttgtgtgtacagctgcctga

SEQ ID NO: 789332 - DNA, 25 bp, Mus musculus
tatgctttaacaagcttgctcacat

SEQ ID NO: 789333 - DNA, 25 bp, Mus musculus
tatgctttaacatgcttgctcacat

SEQ ID NO: 789334 - DNA, 25 bp, Mus musculus
tatgctttaagaaatttctggccag

SEQ ID NO: 789335 - DNA, 25 bp, Mus musculus
tatgctttaagatatttctggccag

SEQ ID NO: 789336 - DNA, 25 bp, Mus musculus
tatgctttaagtactgtcatctcag

SEQ ID NO: 789337 - DNA, 25 bp, Mus musculus
tatgctttaagttctgtcatctcag

SEQ ID NO: 789338 - DNA, 25 bp, Mus musculus
tatgctttaatgctgttacctatct

SEQ ID NO: 789339 - DNA, 25 bp, Mus musculus
tatgctttaatggtgttacctatct

SEQ ID NO: 789340 - DNA, 25 bp, Mus musculus
tatgctttacacaagcttctgcatt

SEQ ID NO: 789341 - DNA, 25 bp, Mus musculus
tatgctttacactagcttctgcatt

SEQ ID NO: 789342 - DNA, 25 bp, Mus musculus
tatgctttactcactgtactattga

SEQ ID NO: 789343 - DNA, 25 bp, Mus musculus
tatgctttactctctgtactattga

SEQ ID NO: 789344 - DNA, 25 bp, Mus musculus
tatgctttccggagcatgcccatag

SEQ ID NO: 789345 - DNA, 25 bp, Mus musculus
tatgctttccggtgcatgcccatag

SEQ ID NO: 789346 - DNA, 25 bp, Mus musculus
tatgctttctggcaccctatgttac

SEQ ID NO: 789347 - DNA, 25 bp, Mus musculus
tatgctttctggcagcgagtttatt

SEQ ID NO: 789348 - DNA, 25 bp, Mus musculus
tatgctttctgggaccctatgttac

SEQ ID NO: 789349 - DNA, 25 bp, Mus musculus
tatgctttctgggagcgagtttatt

SEQ ID NO: 789350 - DNA, 25 bp, Mus musculus
tatgctttgagaaaggatcgcctcc

SEQ ID NO: 789351 - DNA, 25 bp, Mus musculus
tatgctttgagataggatcgcctcc

SEQ ID NO: 789352 - DNA, 25 bp, Mus musculus
tatgctttgcttattcggtagtatt

SEQ ID NO: 789353 - DNA, 25 bp, Mus musculus
tatgctttgctttttcggtagtatt

SEQ ID NO: 789354 - DNA, 25 bp, Mus musculus
tatgctttgtagctcaacaccccat

SEQ ID NO: 789355 - DNA, 25 bp, Mus musculus
tatgctttgtaggtcaacaccccat

SEQ ID NO: 789356 - DNA, 25 bp, Mus musculus
tatgctttgtataagcttaaggatc

SEQ ID NO: 789357 - DNA, 25 bp, Mus musculus
tatgctttgtattagcttaaggatc

SEQ ID NO: 789358 - DNA, 25 bp, Mus musculus
tatgcttttaatatcagctcttggg

SEQ ID NO: 789359 - DNA, 25 bp, Mus musculus
tatgcttttaatttcagctcttggg

SEQ ID NO: 789360 - DNA, 25 bp, Mus musculus
tatgcttttatccaagagtgcagtt

SEQ ID NO: 789361 - DNA, 25 bp, Mus musculus
tatgcttttatcgaagagtgcagtt

SEQ ID NO: 789362 - DNA, 25 bp, Mus musculus
tatgcttttatgagtcttctctttg

SEQ ID NO: 789363 - DNA, 25 bp, Mus musculus
tatgcttttatgtgtcttctctttg

SEQ ID NO: 789364 - DNA, 25 bp, Mus musculus
tatggaaaacttcaaggactggcaa

SEQ ID NO: 789365 - DNA, 25 bp, Mus musculus
tatggaaaacttgaaggactggcaa

SEQ ID NO: 789366 - DNA, 25 bp, Mus musculus
tatggaaacacccttcaagccccaa

SEQ ID NO: 789367 - DNA, 25 bp, Mus musculus
tatggaaacaccgttcaagccccaa

SEQ ID NO: 789368 - DNA, 25 bp, Mus musculus
tatggaaacatccaaaccctgcctc

SEQ ID NO: 789369 - DNA, 25 bp, Mus musculus
tatggaaacatcgaaaccctgcctc

SEQ ID NO: 789370 - DNA, 25 bp, Mus musculus
tatggaaacttaattttccctgttg

SEQ ID NO: 789371 - DNA, 25 bp, Mus musculus
tatggaaacttatttttccctgttg

SEQ ID NO: 789372 - DNA, 25 bp, Mus musculus
tatggaaagagcatctggcctgccg

SEQ ID NO: 789373 - DNA, 25 bp, Mus musculus
tatggaaagagcttctggcctgccg

SEQ ID NO: 789374 - DNA, 25 bp, Mus musculus
tatggaaagattagctccctgtatg

SEQ ID NO: 789375 - DNA, 25 bp, Mus musculus
tatggaaagatttgctccctgtatg

SEQ ID NO: 789376 - DNA, 25 bp, Mus musculus
tatggaaagtggcttccttgcacca

SEQ ID NO: 789377 - DNA, 25 bp, Mus musculus
tatggaaagtgggttccttgcacca

SEQ ID NO: 789378 - DNA, 25 bp, Mus musculus
tatggaaatagtcgcttcagacccc

SEQ ID NO: 789379 - DNA, 25 bp, Mus musculus
tatggaaatagtggcttcagacccc

SEQ ID NO: 789380 - DNA, 25 bp, Mus musculus
tatggaaatccaccagcagccacat

SEQ ID NO: 789381 - DNA, 25 bp, Mus musculus
tatggaaatccagcagcagccacat

SEQ ID NO: 789382 - DNA, 25 bp, Mus musculus
tatggaacgtgcactgagtcactcc

SEQ ID NO: 789383 - DNA, 25 bp, Mus musculus
tatggaacgtgctctgagtcactcc

SEQ ID NO: 789384 - DNA, 25 bp, Mus musculus
tatggaactaaaccattagcttagc

SEQ ID NO: 789385 - DNA, 25 bp, Mus musculus
tatggaactaaagcattagcttagc

SEQ ID NO: 789386 - DNA, 25 bp, Mus musculus
tatggaactcctaaactcagtaatt

SEQ ID NO: 789387 - DNA, 25 bp, Mus musculus
tatggaactccttaactcagtaatt

SEQ ID NO: 789388 - DNA, 25 bp, Mus musculus
tatggaacttaaaaggccttggtat

SEQ ID NO: 789389 - DNA, 25 bp, Mus musculus
tatggaacttaataggccttggtat

SEQ ID NO: 789390 - DNA, 25 bp, Mus musculus
tatggaagaacaagcaggatatgcc

SEQ ID NO: 789391 - DNA, 25 bp, Mus musculus
tatggaagaacatgcaggatatgcc

SEQ ID NO: 789392 - DNA, 25 bp, Mus musculus
tatggaagagccctccaggccagtg

SEQ ID NO: 789393 - DNA, 25 bp, Mus musculus
tatggaagagccgtccaggccagtg

SEQ ID NO: 789394 - DNA, 25 bp, Mus musculus
tatggaagatgtccgggtttcccct

SEQ ID NO: 789395 - DNA, 25 bp, Mus musculus
tatggaagatgtcgctgctcttgtt

SEQ ID NO: 789396 - DNA, 25 bp, Mus musculus
tatggaagatgtgcgggtttcccct

SEQ ID NO: 789397 - DNA, 25 bp, Mus musculus
tatggaagatgtggctgctcttgtt

SEQ ID NO: 789398 - DNA, 25 bp, Mus musculus
tatggaagcacaaccgtgtaccgct

SEQ ID NO: 789399 - DNA, 25 bp, Mus musculus
tatggaagcacatccgtgtaccgct

SEQ ID NO: 789400 - DNA, 25 bp, Mus musculus
tatggaagccacatcgaacctactg

SEQ ID NO: 789401 - DNA, 25 bp, Mus musculus
tatggaagccacttcgaacctactg

SEQ ID NO: 789402 - DNA, 25 bp, Mus musculus
tatggaagctccagcaacccagatg

SEQ ID NO: 789403 - DNA, 25 bp, Mus musculus
tatggaagctcctgcaacccagatg

SEQ ID NO: 789404 - DNA, 25 bp, Mus musculus
tatggaaggcctagcagccgcctgc

SEQ ID NO: 789405 - DNA, 25 bp, Mus musculus
tatggaaggccttgcagccgcctgc

SEQ ID NO: 789406 - DNA, 25 bp, Mus musculus
tatggaagttctctgtcttgtacca

SEQ ID NO: 789407 - DNA, 25 bp, Mus musculus
tatggaagttctgtgtcttgtacca

SEQ ID NO: 789408 - DNA, 25 bp, Mus musculus
tatggaagtttcactggcaggaaat

SEQ ID NO: 789409 - DNA, 25 bp, Mus musculus
tatggaagtttctctggcaggaaat

SEQ ID NO: 789410 - DNA, 25 bp, Mus musculus
tatggaatagtcaaccctttgcctg

SEQ ID NO: 789411 - DNA, 25 bp, Mus musculus
tatggaatagtctaccctttgcctg

SEQ ID NO: 789412 - DNA, 25 bp, Mus musculus
tatggaatctccagtccacttggta

SEQ ID NO: 789413 - DNA, 25 bp, Mus musculus
tatggaatctcctgtccacttggta

SEQ ID NO: 789414 - DNA, 25 bp, Mus musculus
tatggaatctctctttgccaagcca

SEQ ID NO: 789415 - DNA, 25 bp, Mus musculus
tatggaatctctgtttgccaagcca

SEQ ID NO: 789416 - DNA, 25 bp, Mus musculus
tatggaatcttgcacaaaccctcac

SEQ ID NO: 789417 - DNA, 25 bp, Mus musculus
tatggaatcttggacaaaccctcac

SEQ ID NO: 789418 - DNA, 25 bp, Mus musculus
tatggaattacacagtttcctgctc

SEQ ID NO: 789419 - DNA, 25 bp, Mus musculus
tatggaattacagagtttcctgctc

SEQ ID NO: 789420 - DNA, 25 bp, Mus musculus
tatggaattcgcagagaccacacat

SEQ ID NO: 789421 - DNA, 25 bp, Mus musculus
tatggaattcgctgagaccacacat

SEQ ID NO: 789422 - DNA, 25 bp, Mus musculus
tatggaattgatatgcattgaacac

SEQ ID NO: 789423 - DNA, 25 bp, Mus musculus
tatggaattgatttgcattgaacac

SEQ ID NO: 789424 - DNA, 25 bp, Mus musculus
tatggaatttataccctgcctctgt

SEQ ID NO: 789425 - DNA, 25 bp, Mus musculus
tatggaatttattccctgcctctgt

SEQ ID NO: 789426 - DNA, 25 bp, Mus musculus
tatggacaccccaggagtggactgt

SEQ ID NO: 789427 - DNA, 25 bp, Mus musculus
tatggacacccctggagtggactgt

SEQ ID NO: 789428 - DNA, 25 bp, Mus musculus
tatggacactcaacggaaggcctgc

SEQ ID NO: 789429 - DNA, 25 bp, Mus musculus
tatggacactcatcggaaggcctgc

SEQ ID NO: 789430 - DNA, 25 bp, Mus musculus
tatggacacttcatgcccatggaat

SEQ ID NO: 789431 - DNA, 25 bp, Mus musculus
tatggacacttcttgcccatggaat

SEQ ID NO: 789432 - DNA, 25 bp, Mus musculus
tatggacagaagaactgtggctgga

SEQ ID NO: 789433 - DNA, 25 bp, Mus musculus
tatggacagaagtactgtggctgga

SEQ ID NO: 789434 - DNA, 25 bp, Mus musculus
tatggacagctcaccttcggtctaa

SEQ ID NO: 789435 - DNA, 25 bp, Mus musculus
tatggacagctctccttcggtctaa

SEQ ID NO: 789436 - DNA, 25 bp, Mus musculus
tatggacagggtacccgcggtctga

SEQ ID NO: 789437 - DNA, 25 bp, Mus musculus
tatggacagggttcccgcggtctga

SEQ ID NO: 789438 - DNA, 25 bp, Mus musculus
tatggacagttgacgatctctccca

SEQ ID NO: 789439 - DNA, 25 bp, Mus musculus
tatggacagttgtcgatctctccca

SEQ ID NO: 789440 - DNA, 25 bp, Mus musculus
tatggacatcaccttggctcctgag

SEQ ID NO: 789441 - DNA, 25 bp, Mus musculus
tatggacatcacgttggctcctgag

SEQ ID NO: 789442 - DNA, 25 bp, Mus musculus
tatggacattgcctgcttgcggtac

SEQ ID NO: 789443 - DNA, 25 bp, Mus musculus
tatggacattgcgtgcttgcggtac

SEQ ID NO: 789444 - DNA, 25 bp, Mus musculus
tatggacattgtcgtggagctctta

SEQ ID NO: 789445 - DNA, 25 bp, Mus musculus
tatggacattgtggtggagctctta

SEQ ID NO: 789446 - DNA, 25 bp, Mus musculus
tatggaccagccagtcgtctctggt

SEQ ID NO: 789447 - DNA, 25 bp, Mus musculus
tatggaccagcctgtcgtctctggt

SEQ ID NO: 789448 - DNA, 25 bp, Mus musculus
tatggaccatcaccaagccacaagg

SEQ ID NO: 789449 - DNA, 25 bp, Mus musculus
tatggaccatcagcaagccacaagg

SEQ ID NO: 789450 - DNA, 25 bp, Mus musculus
tatggacctagcataaggcgatttt

SEQ ID NO: 789451 - DNA, 25 bp, Mus musculus
tatggacctagcttaaggcgatttt

SEQ ID NO: 789452 - DNA, 25 bp, Mus musculus
tatggacctccacttcagactcgga

SEQ ID NO: 789453 - DNA, 25 bp, Mus musculus
tatggacctccagttcagactcgga

SEQ ID NO: 789454 - DNA, 25 bp, Mus musculus
tatggacctcgaactgcaattagta

SEQ ID NO: 789455 - DNA, 25 bp, Mus musculus
tatggacctcgatctgcaattagta

SEQ ID NO: 789456 - DNA, 25 bp, Mus musculus
tatggacgggctcccgaagaattcc

SEQ ID NO: 789457 - DNA, 25 bp, Mus musculus
tatggacgggctgccgaagaattcc

SEQ ID NO: 789458 - DNA, 25 bp, Mus musculus
tatggacgtggaatttacagtggac

SEQ ID NO: 789459 - DNA, 25 bp, Mus musculus
tatggacgtggattttacagtggac

SEQ ID NO: 789460 - DNA, 25 bp, Mus musculus
tatggactattacagcaactgcagc

SEQ ID NO: 789461 - DNA, 25 bp, Mus musculus
tatggactattagagcaactgcagc

SEQ ID NO: 789462 - DNA, 25 bp, Mus musculus
tatggactccaaagatatgaacaag

SEQ ID NO: 789463 - DNA, 25 bp, Mus musculus
tatggactccaatgatatgaacaag

SEQ ID NO: 789464 - DNA, 25 bp, Mus musculus
tatggactcctaagtaccacactca

SEQ ID NO: 789465 - DNA, 25 bp, Mus musculus
tatggactcctaagtgggccacact

SEQ ID NO: 789466 - DNA, 25 bp, Mus musculus
tatggactcctatgtaccacactca

SEQ ID NO: 789467 - DNA, 25 bp, Mus musculus
tatggactcctatgtgggccacact

SEQ ID NO: 789468 - DNA, 25 bp, Mus musculus
tatggactgaatagatcctcctgac

SEQ ID NO: 789469 - DNA, 25 bp, Mus musculus
tatggactgaattgatcctcctgac

SEQ ID NO: 789470 - DNA, 25 bp, Mus musculus
tatggactgcttctagcttgctgtg

SEQ ID NO: 789471 - DNA, 25 bp, Mus musculus
tatggactgcttgtagcttgctgtg

SEQ ID NO: 789472 - DNA, 25 bp, Mus musculus
tatggactggccagctatgttggtc

SEQ ID NO: 789473 - DNA, 25 bp, Mus musculus
tatggactggcctgctatgttggtc

SEQ ID NO: 789474 - DNA, 25 bp, Mus musculus
tatggactggtgctcatgcccggaa

SEQ ID NO: 789475 - DNA, 25 bp, Mus musculus
tatggactggtggtcatgcccggaa

SEQ ID NO: 789476 - DNA, 25 bp, Mus musculus
tatggactgtaacgcacttgggatc

SEQ ID NO: 789477 - DNA, 25 bp, Mus musculus
tatggactgtaaggcacttgggatc

SEQ ID NO: 789478 - DNA, 25 bp, Mus musculus
tatggacttcgcatttgtagccaat

SEQ ID NO: 789479 - DNA, 25 bp, Mus musculus
tatggacttcgcttttgtagccaat

SEQ ID NO: 789480 - DNA, 25 bp, Mus musculus
tatggacttcgtattgtagcaaatc

SEQ ID NO: 789481 - DNA, 25 bp, Mus musculus
tatggacttcgttttgtagcaaatc

SEQ ID NO: 789482 - DNA, 25 bp, Mus musculus
tatggacttgtcagtggaggtgtat

SEQ ID NO: 789483 - DNA, 25 bp, Mus musculus
tatggacttgtctgtggaggtgtat

SEQ ID NO: 789484 - DNA, 25 bp, Mus musculus
tatggactttcacttgtccggaagt

SEQ ID NO: 789485 - DNA, 25 bp, Mus musculus
tatggactttcagttgtccggaagt

SEQ ID NO: 789486 - DNA, 25 bp, Mus musculus
tatggactttgactgtacgcagaat

SEQ ID NO: 789487 - DNA, 25 bp, Mus musculus
tatggactttgagtgtacgcagaat

SEQ ID NO: 789488 - DNA, 25 bp, Mus musculus
tatggactttgccacagggccaggc

SEQ ID NO: 789489 - DNA, 25 bp, Mus musculus
tatggactttgcgacagggccaggc

SEQ ID NO: 789490 - DNA, 25 bp, Mus musculus
tatggactttttcttacacactggt

SEQ ID NO: 789491 - DNA, 25 bp, Mus musculus
tatggactttttgttacacactggt

SEQ ID NO: 789492 - DNA, 25 bp, Mus musculus
tatggagaaaccagttttcccaagg

SEQ ID NO: 789493 - DNA, 25 bp, Mus musculus
tatggagaaacctgttttcccaagg

SEQ ID NO: 789494 - DNA, 25 bp, Mus musculus
tatggagaacctagtacccacctgc

SEQ ID NO: 789495 - DNA, 25 bp, Mus musculus
tatggagaaccttgtacccacctgc

SEQ ID NO: 789496 - DNA, 25 bp, Mus musculus
tatggagaactgataactgcttaat

SEQ ID NO: 789497 - DNA, 25 bp, Mus musculus
tatggagaactgttaactgcttaat

SEQ ID NO: 789498 - DNA, 25 bp, Mus musculus
tatggagacaaacatgccacgctct

SEQ ID NO: 789499 - DNA, 25 bp, Mus musculus
tatggagacaaagatgccacgctct

SEQ ID NO: 789500 - DNA, 25 bp, Mus musculus
tatggagaccgcagcagatacgaac

SEQ ID NO: 789501 - DNA, 25 bp, Mus musculus
tatggagaccgctgcagatacgaac

SEQ ID NO: 789502 - DNA, 25 bp, Mus musculus
tatggagactggaacggcctcagaa

SEQ ID NO: 789503 - DNA, 25 bp, Mus musculus
tatggagactggtacggcctcagaa

SEQ ID NO: 789504 - DNA, 25 bp, Mus musculus
tatggagaggacatgacgcccaccc

SEQ ID NO: 789505 - DNA, 25 bp, Mus musculus
tatggagaggacttgacgcccaccc

SEQ ID NO: 789506 - DNA, 25 bp, Mus musculus
tatggagaggtcactctctaccttt

SEQ ID NO: 789507 - DNA, 25 bp, Mus musculus
tatggagaggtctctctctaccttt

SEQ ID NO: 789508 - DNA, 25 bp, Mus musculus
tatggagatgggagcttactggcca

SEQ ID NO: 789509 - DNA, 25 bp, Mus musculus
tatggagatgggtgcttactggcca

SEQ ID NO: 789510 - DNA, 25 bp, Mus musculus
tatggagattacaagcagcacagtg

SEQ ID NO: 789511 - DNA, 25 bp, Mus musculus
tatggagattactagcagcacagtg

SEQ ID NO: 789512 - DNA, 25 bp, Mus musculus
tatggagattcccttgtggttctag

SEQ ID NO: 789513 - DNA, 25 bp, Mus musculus
tatggagattccgttgtggttctag

SEQ ID NO: 789514 - DNA, 25 bp, Mus musculus
tatggagcaaagaacaggcctggga

SEQ ID NO: 789515 - DNA, 25 bp, Mus musculus
tatggagcaaagtacaggcctggga

SEQ ID NO: 789516 - DNA, 25 bp, Mus musculus
tatggagcatgaagccctgtagcct

SEQ ID NO: 789517 - DNA, 25 bp, Mus musculus
tatggagcatgatgccctgtagcct

SEQ ID NO: 789518 - DNA, 25 bp, Mus musculus
tatggagcatgcatgggacctgaat

SEQ ID NO: 789519 - DNA, 25 bp, Mus musculus
tatggagcatgcttgggacctgaat

SEQ ID NO: 789520 - DNA, 25 bp, Mus musculus
tatggagccaccatgaaccctgatc

SEQ ID NO: 789521 - DNA, 25 bp, Mus musculus
tatggagccaccttgaaccctgatc

SEQ ID NO: 789522 - DNA, 25 bp, Mus musculus
tatggagccaggaattcccacatca

SEQ ID NO: 789523 - DNA, 25 bp, Mus musculus
tatggagccaggtattcccacatca

SEQ ID NO: 789524 - DNA, 25 bp, Mus musculus
tatggagccatacctgtccacagtg

SEQ ID NO: 789525 - DNA, 25 bp, Mus musculus
tatggagccatagctgtccacagtg

SEQ ID NO: 789526 - DNA, 25 bp, Mus musculus
tatggagccatcaattaccccttca

SEQ ID NO: 789527 - DNA, 25 bp, Mus musculus
tatggagccatctattaccccttca

SEQ ID NO: 789528 - DNA, 25 bp, Mus musculus
tatggagcgctaacggcttgatgcc

SEQ ID NO: 789529 - DNA, 25 bp, Mus musculus
tatggagcgctatcggcttgatgcc

SEQ ID NO: 789530 - DNA, 25 bp, Mus musculus
tatggagcgctccagatgcgctgtt

SEQ ID NO: 789531 - DNA, 25 bp, Mus musculus
tatggagcgctcgagatgcgctgtt

SEQ ID NO: 789532 - DNA, 25 bp, Mus musculus
tatggagctaaaacctccaagcaga

SEQ ID NO: 789533 - DNA, 25 bp, Mus musculus
tatggagctaaatcctccaagcaga

SEQ ID NO: 789534 - DNA, 25 bp, Mus musculus
tatggagctgtgcaccctggaaata

SEQ ID NO: 789535 - DNA, 25 bp, Mus musculus
tatggagctgtggaccctggaaata

SEQ ID NO: 789536 - DNA, 25 bp, Mus musculus
tatggagctttcaaacccacgttca

SEQ ID NO: 789537 - DNA, 25 bp, Mus musculus
tatggagctttctaacccacgttca

SEQ ID NO: 789538 - DNA, 25 bp, Mus musculus
tatggaggatttatgaaagccctaa

SEQ ID NO: 789539 - DNA, 25 bp, Mus musculus
tatggaggatttttgaaagccctaa

SEQ ID NO: 789540 - DNA, 25 bp, Mus musculus
tatggaggccctagactgctgctgc

SEQ ID NO: 789541 - DNA, 25 bp, Mus musculus
tatggaggcccttgactgctgctgc

SEQ ID NO: 789542 - DNA, 25 bp, Mus musculus
tatggaggcgtcatacctggcggat

SEQ ID NO: 789543 - DNA, 25 bp, Mus musculus
tatggaggcgtcttacctggcggat

SEQ ID NO: 789544 - DNA, 25 bp, Mus musculus
tatggaggctttcgcccgcaggatc

SEQ ID NO: 789545 - DNA, 25 bp, Mus musculus
tatggaggctttggcccgcaggatc

SEQ ID NO: 789546 - DNA, 25 bp, Mus musculus
tatggaggtggcactgggaacatct

SEQ ID NO: 789547 - DNA, 25 bp, Mus musculus
tatggaggtggctctgggaacatct

SEQ ID NO: 789548 - DNA, 25 bp, Mus musculus
tatggaggtggtaattttggacaag

SEQ ID NO: 789549 - DNA, 25 bp, Mus musculus
tatggaggtggttattttggacaag

SEQ ID NO: 789550 - DNA, 25 bp, Mus musculus
tatggaggtttgctctagggcaact

SEQ ID NO: 789551 - DNA, 25 bp, Mus musculus
tatggaggtttggtctagggcaact

SEQ ID NO: 789552 - DNA, 25 bp, Mus musculus
tatggagtacacctaccagagacta

SEQ ID NO: 789553 - DNA, 25 bp, Mus musculus
tatggagtacacgtaccagagacta

SEQ ID NO: 789554 - DNA, 25 bp, Mus musculus
tatggagtacctacgctagcagcag

SEQ ID NO: 789555 - DNA, 25 bp, Mus musculus
tatggagtaccttcgctagcagcag

SEQ ID NO: 789556 - DNA, 25 bp, Mus musculus
tatggagtatatacatgtacttgtg

SEQ ID NO: 789557 - DNA, 25 bp, Mus musculus
tatggagtatattcatgtacttgtg

SEQ ID NO: 789558 - DNA, 25 bp, Mus musculus
tatggagtcattattacaacgtaat

SEQ ID NO: 789559 - DNA, 25 bp, Mus musculus
tatggagtcatttttacaacgtaat

SEQ ID NO: 789560 - DNA, 25 bp, Mus musculus
tatggagtcctacccatcgtggcaa

SEQ ID NO: 789561 - DNA, 25 bp, Mus musculus
tatggagtcctagccatcgtggcaa

SEQ ID NO: 789562 - DNA, 25 bp, Mus musculus
tatggagtgagcatccctgtgccca

SEQ ID NO: 789563 - DNA, 25 bp, Mus musculus
tatggagtgagcttccctgtgccca

SEQ ID NO: 789564 - DNA, 25 bp, Mus musculus
tatggagtgcctcgctgacacttac

SEQ ID NO: 789565 - DNA, 25 bp, Mus musculus
tatggagtgcctggctgacacttac

SEQ ID NO: 789566 - DNA, 25 bp, Mus musculus
tatggagttacactgctgccttagg

SEQ ID NO: 789567 - DNA, 25 bp, Mus musculus
tatggagttacagtgctgccttagg

SEQ ID NO: 789568 - DNA, 25 bp, Mus musculus
tatggagttggaagagggacccctc

SEQ ID NO: 789569 - DNA, 25 bp, Mus musculus
tatggagttggatgagggacccctc

SEQ ID NO: 789570 - DNA, 25 bp, Mus musculus
tatggagtttagatatgtttgtcaa

SEQ ID NO: 789571 - DNA, 25 bp, Mus musculus
tatggagtttagttatgtttgtcaa

SEQ ID NO: 789572 - DNA, 25 bp, Mus musculus
tatggataagagaagacacagcagg

SEQ ID NO: 789573 - DNA, 25 bp, Mus musculus
tatggataagagtagacacagcagg

SEQ ID NO: 789574 - DNA, 25 bp, Mus musculus
tatggatagctgagatcccaaattc

SEQ ID NO: 789575 - DNA, 25 bp, Mus musculus
tatggatagctgtgatcccaaattc

SEQ ID NO: 789576 - DNA, 25 bp, Mus musculus
tatggatagttgaggccacctgctg

SEQ ID NO: 789577 - DNA, 25 bp, Mus musculus
tatggatagttgtggccacctgctg

SEQ ID NO: 789578 - DNA, 25 bp, Mus musculus
tatggatataacacccatcttcagg

SEQ ID NO: 789579 - DNA, 25 bp, Mus musculus
tatggatataactcccatcttcagg

SEQ ID NO: 789580 - DNA, 25 bp, Mus musculus
tatggatccatcctatctgcagaca

SEQ ID NO: 789581 - DNA, 25 bp, Mus musculus
tatggatccatcgtatctgcagaca

SEQ ID NO: 789582 - DNA, 25 bp, Mus musculus
tatggatccctcagtcatcctgacc

SEQ ID NO: 789583 - DNA, 25 bp, Mus musculus
tatggatccctcatgggaccctgtc

SEQ ID NO: 789584 - DNA, 25 bp, Mus musculus
tatggatccctctgtcatcctgacc

SEQ ID NO: 789585 - DNA, 25 bp, Mus musculus
tatggatccctcttgggaccctgtc

SEQ ID NO: 789586 - DNA, 25 bp, Mus musculus
tatggatcctgcagtgatcgctggt

SEQ ID NO: 789587 - DNA, 25 bp, Mus musculus
tatggatcctgcctcctagctaggc

SEQ ID NO: 789588 - DNA, 25 bp, Mus musculus
tatggatcctgcgtcctagctaggc

SEQ ID NO: 789589 - DNA, 25 bp, Mus musculus
tatggatcctgctgtgatcgctggt

SEQ ID NO: 789590 - DNA, 25 bp, Mus musculus
tatggatctgagcactccctgggcg

SEQ ID NO: 789591 - DNA, 25 bp, Mus musculus
tatggatctgaggactccctgggcg

SEQ ID NO: 789592 - DNA, 25 bp, Mus musculus
tatggatctgcaccagactgttaac

SEQ ID NO: 789593 - DNA, 25 bp, Mus musculus
tatggatctgcagcagactgttaac

SEQ ID NO: 789594 - DNA, 25 bp, Mus musculus
tatggatctggaatctgccacccat

SEQ ID NO: 789595 - DNA, 25 bp, Mus musculus
tatggatctggattctgccacccat

SEQ ID NO: 789596 - DNA, 25 bp, Mus musculus
tatggatgaactcacccctgagcag

SEQ ID NO: 789597 - DNA, 25 bp, Mus musculus
tatggatgaactgacccctgagcag

SEQ ID NO: 789598 - DNA, 25 bp, Mus musculus
tatggatgacacagtctgggagaag

SEQ ID NO: 789599 - DNA, 25 bp, Mus musculus
tatggatgacactgtctgggagaag

SEQ ID NO: 789600 - DNA, 25 bp, Mus musculus
tatggatgcatacctgctgcgggct

SEQ ID NO: 789601 - DNA, 25 bp, Mus musculus
tatggatgcatagctgctgcgggct

SEQ ID NO: 789602 - DNA, 25 bp, Mus musculus
tatggatgccatcgccagtttggca

SEQ ID NO: 789603 - DNA, 25 bp, Mus musculus
tatggatgccatggccagtttggca

SEQ ID NO: 789604 - DNA, 25 bp, Mus musculus
tatggatgcctcacctgtggcaaaa

SEQ ID NO: 789605 - DNA, 25 bp, Mus musculus
tatggatgcctctcctgtggcaaaa

SEQ ID NO: 789606 - DNA, 25 bp, Mus musculus
tatggatgcttccagcggacaacca

SEQ ID NO: 789607 - DNA, 25 bp, Mus musculus
tatggatgcttcgagcggacaacca

SEQ ID NO: 789608 - DNA, 25 bp, Mus musculus
tatggatgtaccaaatccggtatag

SEQ ID NO: 789609 - DNA, 25 bp, Mus musculus
tatggatgtacctaatccggtatag

SEQ ID NO: 789610 - DNA, 25 bp, Mus musculus
tatggatgtgcccacttttttctcc

SEQ ID NO: 789611 - DNA, 25 bp, Mus musculus
tatggatgtgccgacttttttctcc

SEQ ID NO: 789612 - DNA, 25 bp, Mus musculus
tatggatgttttatactgaggttat

SEQ ID NO: 789613 - DNA, 25 bp, Mus musculus
tatggatgttttttactgaggttat

SEQ ID NO: 789614 - DNA, 25 bp, Mus musculus
tatggattaaaccttgctctctctc

SEQ ID NO: 789615 - DNA, 25 bp, Mus musculus
tatggattaaacgttgctctctctc

SEQ ID NO: 789616 - DNA, 25 bp, Mus musculus
tatggattactcatgaaactcacta

SEQ ID NO: 789617 - DNA, 25 bp, Mus musculus
tatggattactcttgaaactcacta

SEQ ID NO: 789618 - DNA, 25 bp, Mus musculus
tatggattcgggagttacagtagcc

SEQ ID NO: 789619 - DNA, 25 bp, Mus musculus
tatggattcgggtgttacagtagcc

SEQ ID NO: 789620 - DNA, 25 bp, Mus musculus
tatggattgcttcaggctgtctgca

SEQ ID NO: 789621 - DNA, 25 bp, Mus musculus
tatggattgcttgaggctgtctgca

SEQ ID NO: 789622 - DNA, 25 bp, Mus musculus
tatggattggatatgcctacttcta

SEQ ID NO: 789623 - DNA, 25 bp, Mus musculus
tatggattggatttgcctacttcta

SEQ ID NO: 789624 - DNA, 25 bp, Mus musculus
tatggatttcctccacacaattggc

SEQ ID NO: 789625 - DNA, 25 bp, Mus musculus
tatggatttcctgcacacaattggc

SEQ ID NO: 789626 - DNA, 25 bp, Mus musculus
tatggatttctcacctaccatgcag

SEQ ID NO: 789627 - DNA, 25 bp, Mus musculus
tatggatttctctcctaccatgcag

SEQ ID NO: 789628 - DNA, 25 bp, Mus musculus
tatggattttataaagtggcggtat

SEQ ID NO: 789629 - DNA, 25 bp, Mus musculus
tatggattttattaagtggcggtat

SEQ ID NO: 789630 - DNA, 25 bp, Mus musculus
tatggcaaagccaagaccggtgagg

SEQ ID NO: 789631 - DNA, 25 bp, Mus musculus
tatggcaaagcctagaccggtgagg

SEQ ID NO: 789632 - DNA, 25 bp, Mus musculus
tatggcaaagttacttcctacctgt

SEQ ID NO: 789633 - DNA, 25 bp, Mus musculus
tatggcaaagtttcttcctacctgt

SEQ ID NO: 789634 - DNA, 25 bp, Mus musculus
tatggcaagactcacctggtataac

SEQ ID NO: 789635 - DNA, 25 bp, Mus musculus
tatggcaagactgacctggtataac

SEQ ID NO: 789636 - DNA, 25 bp, Mus musculus
tatggcaagatgaccacttcaatta

SEQ ID NO: 789637 - DNA, 25 bp, Mus musculus
tatggcaagatgtccacttcaatta

SEQ ID NO: 789638 - DNA, 25 bp, Mus musculus
tatggcaagccgagtacagttatct

SEQ ID NO: 789639 - DNA, 25 bp, Mus musculus
tatggcaagccgtgtacagttatct

SEQ ID NO: 789640 - DNA, 25 bp, Mus musculus
tatggcaagtccctgtactactaca

SEQ ID NO: 789641 - DNA, 25 bp, Mus musculus
tatggcaagtccgtgtactactaca

SEQ ID NO: 789642 - DNA, 25 bp, Mus musculus
tatggcaagtgcctgcaggcgtcca

SEQ ID NO: 789643 - DNA, 25 bp, Mus musculus
tatggcaagtgcgtgcaggcgtcca

SEQ ID NO: 789644 - DNA, 25 bp, Mus musculus
tatggcaatgaacactccccggtgg

SEQ ID NO: 789645 - DNA, 25 bp, Mus musculus
tatggcaatgaagactccccggtgg

SEQ ID NO: 789646 - DNA, 25 bp, Mus musculus
tatggcaatgacactgacttcgagg

SEQ ID NO: 789647 - DNA, 25 bp, Mus musculus
tatggcaatgactctgacttcgagg

SEQ ID NO: 789648 - DNA, 25 bp, Mus musculus
tatggcacacaaaggaaaaagcacc

SEQ ID NO: 789649 - DNA, 25 bp, Mus musculus
tatggcacacaatggaaaaagcacc

SEQ ID NO: 789650 - DNA, 25 bp, Mus musculus
tatggcacacatatacagctagcaa

SEQ ID NO: 789651 - DNA, 25 bp, Mus musculus
tatggcacacatttacagctagcaa

SEQ ID NO: 789652 - DNA, 25 bp, Mus musculus
tatggcaccatacggtcatcctctc

SEQ ID NO: 789653 - DNA, 25 bp, Mus musculus
tatggcaccatagggtcatcctctc

SEQ ID NO: 789654 - DNA, 25 bp, Mus musculus
tatggcacctggacacagtcctttg

SEQ ID NO: 789655 - DNA, 25 bp, Mus musculus
tatggcacctggtcacagtcctttg

SEQ ID NO: 789656 - DNA, 25 bp, Mus musculus
tatggcactagcacatggccctcaa

SEQ ID NO: 789657 - DNA, 25 bp, Mus musculus
tatggcactagctcatggccctcaa

SEQ ID NO: 789658 - DNA, 25 bp, Mus musculus
tatggcactccaaaatagctacaag

SEQ ID NO: 789659 - DNA, 25 bp, Mus musculus
tatggcactccataatagctacaag

SEQ ID NO: 789660 - DNA, 25 bp, Mus musculus
tatggcactgggagtgttctttggc

SEQ ID NO: 789661 - DNA, 25 bp, Mus musculus
tatggcactgggtgtgttctttggc

SEQ ID NO: 789662 - DNA, 25 bp, Mus musculus
tatggcactgtgatatcgactcctc

SEQ ID NO: 789663 - DNA, 25 bp, Mus musculus
tatggcactgtgttatcgactcctc

SEQ ID NO: 789664 - DNA, 25 bp, Mus musculus
tatggcagacttagcagtttcttgt

SEQ ID NO: 789665 - DNA, 25 bp, Mus musculus
tatggcagactttgcagtttcttgt

SEQ ID NO: 789666 - DNA, 25 bp, Mus musculus
tatggcagcactctgccccaacgtg

SEQ ID NO: 789667 - DNA, 25 bp, Mus musculus
tatggcagcactgtgccccaacgtg

SEQ ID NO: 789668 - DNA, 25 bp, Mus musculus
tatggcagccctcatggagacttac

SEQ ID NO: 789669 - DNA, 25 bp, Mus musculus
tatggcagccctgatggagacttac

SEQ ID NO: 789670 - DNA, 25 bp, Mus musculus
tatggcagcggccacaatggccagt

SEQ ID NO: 789671 - DNA, 25 bp, Mus musculus
tatggcagcggcgacaatggccagt

SEQ ID NO: 789672 - DNA, 25 bp, Mus musculus
tatggcagcgttctggatcttgatc

SEQ ID NO: 789673 - DNA, 25 bp, Mus musculus
tatggcagcgttgtggatcttgatc

SEQ ID NO: 789674 - DNA, 25 bp, Mus musculus
tatggcagctggcacagttatcctt

SEQ ID NO: 789675 - DNA, 25 bp, Mus musculus
tatggcagctgggacagttatcctt

SEQ ID NO: 789676 - DNA, 25 bp, Mus musculus
tatggcagctttcgaggcccgggct

SEQ ID NO: 789677 - DNA, 25 bp, Mus musculus
tatggcagctttggaggcccgggct

SEQ ID NO: 789678 - DNA, 25 bp, Mus musculus
tatggcaggcgcaaactcgattttc

SEQ ID NO: 789679 - DNA, 25 bp, Mus musculus
tatggcaggcgctaactcgattttc

SEQ ID NO: 789680 - DNA, 25 bp, Mus musculus
tatggcaggcttaggtttggttccg

SEQ ID NO: 789681 - DNA, 25 bp, Mus musculus
tatggcaggctttggtttggttccg

SEQ ID NO: 789682 - DNA, 25 bp, Mus musculus
tatggcagtgtcagcagtacccaga

SEQ ID NO: 789683 - DNA, 25 bp, Mus musculus
tatggcagtgtctgcagtacccaga

SEQ ID NO: 789684 - DNA, 25 bp, Mus musculus
tatggcagttacatctacctctcca

SEQ ID NO: 789685 - DNA, 25 bp, Mus musculus
tatggcagttacttctacctctcca

SEQ ID NO: 789686 - DNA, 25 bp, Mus musculus
tatggcatacagaccgctgtgctat

SEQ ID NO: 789687 - DNA, 25 bp, Mus musculus
tatggcatacagtccgctgtgctat

SEQ ID NO: 789688 - DNA, 25 bp, Mus musculus
tatggcataccaaaaaccccgaggc

SEQ ID NO: 789689 - DNA, 25 bp, Mus musculus
tatggcataccataaaccccgaggc

SEQ ID NO: 789690 - DNA, 25 bp, Mus musculus
tatggcatatcacccatggacggag

SEQ ID NO: 789691 - DNA, 25 bp, Mus musculus
tatggcatatcagccatggacggag

SEQ ID NO: 789692 - DNA, 25 bp, Mus musculus
tatggcatcaacacagatcctccca

SEQ ID NO: 789693 - DNA, 25 bp, Mus musculus
tatggcatcaactcagatcctccca

SEQ ID NO: 789694 - DNA, 25 bp, Mus musculus
tatggcatcagcaaatgtgaacagc

SEQ ID NO: 789695 - DNA, 25 bp, Mus musculus
tatggcatcagctaatgtgaacagc

SEQ ID NO: 789696 - DNA, 25 bp, Mus musculus
tatggcatctaacttcacctgttcc

SEQ ID NO: 789697 - DNA, 25 bp, Mus musculus
tatggcatctaagttcacctgttcc

SEQ ID NO: 789698 - DNA, 25 bp, Mus musculus
tatggcatgccaacctcagaaaact

SEQ ID NO: 789699 - DNA, 25 bp, Mus musculus
tatggcatgccatcctcagaaaact

SEQ ID NO: 789700 - DNA, 25 bp, Mus musculus
tatggcatgctgagaataagaattc

SEQ ID NO: 789701 - DNA, 25 bp, Mus musculus
tatggcatgctgtgaataagaattc

SEQ ID NO: 789702 - DNA, 25 bp, Mus musculus
tatggcattcatctaggtgtggaca

SEQ ID NO: 789703 - DNA, 25 bp, Mus musculus
tatggcattcatgtaggtgtggaca

SEQ ID NO: 789704 - DNA, 25 bp, Mus musculus
tatggcattccacggtggttcacca

SEQ ID NO: 789705 - DNA, 25 bp, Mus musculus
tatggcattccagggtggttcacca

SEQ ID NO: 789706 - DNA, 25 bp, Mus musculus
tatggcattgtccagatccctaatt

SEQ ID NO: 789707 - DNA, 25 bp, Mus musculus
tatggcattgtcgagatccctaatt

SEQ ID NO: 789708 - DNA, 25 bp, Mus musculus
tatggcatttaacacctcctgaagc

SEQ ID NO: 789709 - DNA, 25 bp, Mus musculus
tatggcatttaagacctcctgaagc

SEQ ID NO: 789710 - DNA, 25 bp, Mus musculus
tatggccaaaacatggtttcaaaat

SEQ ID NO: 789711 - DNA, 25 bp, Mus musculus
tatggccaaaacttggtttcaaaat

SEQ ID NO: 789712 - DNA, 25 bp, Mus musculus
tatggccaaacaatcaaacacagga

SEQ ID NO: 789713 - DNA, 25 bp, Mus musculus
tatggccaaacattcaaacacagga

SEQ ID NO: 789714 - DNA, 25 bp, Mus musculus
tatggccaaagacgctttctccact

SEQ ID NO: 789715 - DNA, 25 bp, Mus musculus
tatggccaaagaggctttctccact

SEQ ID NO: 789716 - DNA, 25 bp, Mus musculus
tatggccaagtaagccctcaagtgg

SEQ ID NO: 789717 - DNA, 25 bp, Mus musculus
tatggccaagtatgccctcaagtgg

SEQ ID NO: 789718 - DNA, 25 bp, Mus musculus
tatggccaagtgaatatagagtgct

SEQ ID NO: 789719 - DNA, 25 bp, Mus musculus
tatggccaagtgtatatagagtgct

SEQ ID NO: 789720 - DNA, 25 bp, Mus musculus
tatggccaatgaaagctgagctcac

SEQ ID NO: 789721 - DNA, 25 bp, Mus musculus
tatggccaatgatagctgagctcac

SEQ ID NO: 789722 - DNA, 25 bp, Mus musculus
tatggccactccaggactaagaaga

SEQ ID NO: 789723 - DNA, 25 bp, Mus musculus
tatggccactcctggactaagaaga

SEQ ID NO: 789724 - DNA, 25 bp, Mus musculus
tatggccactctatgtatgcatcga

SEQ ID NO: 789725 - DNA, 25 bp, Mus musculus
tatggccactctttgtatgcatcga

SEQ ID NO: 789726 - DNA, 25 bp, Mus musculus
tatggccaggacactctgatgatgc

SEQ ID NO: 789727 - DNA, 25 bp, Mus musculus
tatggccaggactctctgatgatgc

SEQ ID NO: 789728 - DNA, 25 bp, Mus musculus
tatggccaggccaagagctctggtt

SEQ ID NO: 789729 - DNA, 25 bp, Mus musculus
tatggccaggcctagagctctggtt

SEQ ID NO: 789730 - DNA, 25 bp, Mus musculus
tatggccagtgaccacggctgtcca

SEQ ID NO: 789731 - DNA, 25 bp, Mus musculus
tatggccagtgagcacggctgtcca

SEQ ID NO: 789732 - DNA, 25 bp, Mus musculus
tatggccagtttcagtcctacctac

SEQ ID NO: 789733 - DNA, 25 bp, Mus musculus
tatggccagtttgagtcctacctac

SEQ ID NO: 789734 - DNA, 25 bp, Mus musculus
tatggccatctcctaccatgaggga

SEQ ID NO: 789735 - DNA, 25 bp, Mus musculus
tatggccatctcgtaccatgaggga

SEQ ID NO: 789736 - DNA, 25 bp, Mus musculus
tatggccatgaacggccttgctcag

SEQ ID NO: 789737 - DNA, 25 bp, Mus musculus
tatggccatgaagggccttgctcag

SEQ ID NO: 789738 - DNA, 25 bp, Mus musculus
tatggccattgaataatctagagaa

SEQ ID NO: 789739 - DNA, 25 bp, Mus musculus
tatggccattgattaatctagagaa

SEQ ID NO: 789740 - DNA, 25 bp, Mus musculus
tatggccattttctgtctttgcgat

SEQ ID NO: 789741 - DNA, 25 bp, Mus musculus
tatggccattttgtgtctttgcgat

SEQ ID NO: 789742 - DNA, 25 bp, Mus musculus
tatggcccaatgctgtcacacacga

SEQ ID NO: 789743 - DNA, 25 bp, Mus musculus
tatggcccaatggtgtcacacacga

SEQ ID NO: 789744 - DNA, 25 bp, Mus musculus
tatggcccacgacgaagctgcggta

SEQ ID NO: 789745 - DNA, 25 bp, Mus musculus
tatggcccacgaggaagctgcggta

SEQ ID NO: 789746 - DNA, 25 bp, Mus musculus
tatggcccagctacagcagggtaga

SEQ ID NO: 789747 - DNA, 25 bp, Mus musculus
tatggcccagcttcagcagggtaga

SEQ ID NO: 789748 - DNA, 25 bp, Mus musculus
tatggcccagggacgccagttggca

SEQ ID NO: 789749 - DNA, 25 bp, Mus musculus
tatggcccagggtcgccagttggca

SEQ ID NO: 789750 - DNA, 25 bp, Mus musculus
tatggcccagtactgacctttgaca

SEQ ID NO: 789751 - DNA, 25 bp, Mus musculus
tatggcccagtagtgacctttgaca

SEQ ID NO: 789752 - DNA, 25 bp, Mus musculus
tatggcccatggatcatagcttcct

SEQ ID NO: 789753 - DNA, 25 bp, Mus musculus
tatggcccatggttcatagcttcct

SEQ ID NO: 789754 - DNA, 25 bp, Mus musculus
tatggcccattacaaagccgccgac

SEQ ID NO: 789755 - DNA, 25 bp, Mus musculus
tatggcccattagaaagccgccgac

SEQ ID NO: 789756 - DNA, 25 bp, Mus musculus
tatggcccattcaactcattcagaa

SEQ ID NO: 789757 - DNA, 25 bp, Mus musculus
tatggcccattctactcattcagaa

SEQ ID NO: 789758 - DNA, 25 bp, Mus musculus
tatggccccgctcacatgaacagtg

SEQ ID NO: 789759 - DNA, 25 bp, Mus musculus
tatggccccgctgacatgaacagtg

SEQ ID NO: 789760 - DNA, 25 bp, Mus musculus
tatggccccgggagattcaggagta

SEQ ID NO: 789761 - DNA, 25 bp, Mus musculus
tatggccccgggtgattcaggagta

SEQ ID NO: 789762 - DNA, 25 bp, Mus musculus
tatggcccgctacagctggactgga

SEQ ID NO: 789763 - DNA, 25 bp, Mus musculus
tatggcccgctagagctggactgga

SEQ ID NO: 789764 - DNA, 25 bp, Mus musculus
tatggccctattctctcttcttgga

SEQ ID NO: 789765 - DNA, 25 bp, Mus musculus
tatggccctattgtctcttcttgga

SEQ ID NO: 789766 - DNA, 25 bp, Mus musculus
tatggccctctcaaagtaatttatt

SEQ ID NO: 789767 - DNA, 25 bp, Mus musculus
tatggccctctctaagtaatttatt

SEQ ID NO: 789768 - DNA, 25 bp, Mus musculus
tatggccctgctacacagggacgaa

SEQ ID NO: 789769 - DNA, 25 bp, Mus musculus
tatggccctgcttcacagggacgaa

SEQ ID NO: 789770 - DNA, 25 bp, Mus musculus
tatggccctggaactggtgaagaag

SEQ ID NO: 789771 - DNA, 25 bp, Mus musculus
tatggccctggaccagttgagacct

SEQ ID NO: 789772 - DNA, 25 bp, Mus musculus
tatggccctggagcagttgagacct

SEQ ID NO: 789773 - DNA, 25 bp, Mus musculus
tatggccctggatctggtgaagaag

SEQ ID NO: 789774 - DNA, 25 bp, Mus musculus
tatggccctggcaacaatatggaac

SEQ ID NO: 789775 - DNA, 25 bp, Mus musculus
tatggccctggctacaatatggaac

SEQ ID NO: 789776 - DNA, 25 bp, Mus musculus
tatggccctgttagtgagatgcaac

SEQ ID NO: 789777 - DNA, 25 bp, Mus musculus
tatggccctgtttgtgagatgcaac

SEQ ID NO: 789778 - DNA, 25 bp, Mus musculus
tatggccgagatagcttctgggtaa

SEQ ID NO: 789779 - DNA, 25 bp, Mus musculus
tatggccgagattgcttctgggtaa

SEQ ID NO: 789780 - DNA, 25 bp, Mus musculus
tatggccgagcccaagaccgtctac

SEQ ID NO: 789781 - DNA, 25 bp, Mus musculus
tatggccgagccgaagaccgtctac

SEQ ID NO: 789782 - DNA, 25 bp, Mus musculus
tatggccggcacagtgaagctggaa

SEQ ID NO: 789783 - DNA, 25 bp, Mus musculus
tatggccggcactgtgaagctggaa

SEQ ID NO: 789784 - DNA, 25 bp, Mus musculus
tatggccggtgactttgggttcttt

SEQ ID NO: 789785 - DNA, 25 bp, Mus musculus
tatggccggtgagtttgggttcttt

SEQ ID NO: 789786 - DNA, 25 bp, Mus musculus
tatggcctccctaaattatgataga

SEQ ID NO: 789787 - DNA, 25 bp, Mus musculus
tatggcctcccttaattatgataga

SEQ ID NO: 789788 - DNA, 25 bp, Mus musculus
tatggcctctctatgtgcgaacatg

SEQ ID NO: 789789 - DNA, 25 bp, Mus musculus
tatggcctctctttgtgcgaacatg

SEQ ID NO: 789790 - DNA, 25 bp, Mus musculus
tatggcctctgaaaccctcatgctc

SEQ ID NO: 789791 - DNA, 25 bp, Mus musculus
tatggcctctgataccctcatgctc

SEQ ID NO: 789792 - DNA, 25 bp, Mus musculus
tatggcctgggacccgacgcctaca

SEQ ID NO: 789793 - DNA, 25 bp, Mus musculus
tatggcctgggagccgacgcctaca

SEQ ID NO: 789794 - DNA, 25 bp, Mus musculus
tatggcctggttatatcatggcagc

SEQ ID NO: 789795 - DNA, 25 bp, Mus musculus
tatggcctggttttatcatggcagc

SEQ ID NO: 789796 - DNA, 25 bp, Mus musculus
tatggcctgtagacttttaccttac

SEQ ID NO: 789797 - DNA, 25 bp, Mus musculus
tatggcctgtagtcttttaccttac

SEQ ID NO: 789798 - DNA, 25 bp, Mus musculus
tatggcctgtctactggcagctaaa

SEQ ID NO: 789799 - DNA, 25 bp, Mus musculus
tatggcctgtcttctggcagctaaa

SEQ ID NO: 789800 - DNA, 25 bp, Mus musculus
tatggcctttacaaaaacaggatgt

SEQ ID NO: 789801 - DNA, 25 bp, Mus musculus
tatggcctttactaaaacaggatgt

SEQ ID NO: 789802 - DNA, 25 bp, Mus musculus
tatggcctttggagcccgaagaaca

SEQ ID NO: 789803 - DNA, 25 bp, Mus musculus
tatggcctttggtgcccgaagaaca

SEQ ID NO: 789804 - DNA, 25 bp, Mus musculus
tatggccttttccataactattttt

SEQ ID NO: 789805 - DNA, 25 bp, Mus musculus
tatggccttttcgataactattttt

SEQ ID NO: 789806 - DNA, 25 bp, Mus musculus
tatggcgaaagccagtcgagcgcca

SEQ ID NO: 789807 - DNA, 25 bp, Mus musculus
tatggcgaaagcgagtcgagcgcca

SEQ ID NO: 789808 - DNA, 25 bp, Mus musculus
tatggcgatgctagtctactccaca

SEQ ID NO: 789809 - DNA, 25 bp, Mus musculus
tatggcgatgcttgtctactccaca

SEQ ID NO: 789810 - DNA, 25 bp, Mus musculus
tatggcgcagagcttagacactaga

SEQ ID NO: 789811 - DNA, 25 bp, Mus musculus
tatggcgcagaggttagacactaga

SEQ ID NO: 789812 - DNA, 25 bp, Mus musculus
tatggcgcccagaatccatcaggag

SEQ ID NO: 789813 - DNA, 25 bp, Mus musculus
tatggcgcccagtatccatcaggag

SEQ ID NO: 789814 - DNA, 25 bp, Mus musculus
tatggcgctcacaactgtgaaacag

SEQ ID NO: 789815 - DNA, 25 bp, Mus musculus
tatggcgctcactactgtgaaacag

SEQ ID NO: 789816 - DNA, 25 bp, Mus musculus
tatggcggagcaactacgtttccct

SEQ ID NO: 789817 - DNA, 25 bp, Mus musculus
tatggcggagcatctacgtttccct

SEQ ID NO: 789818 - DNA, 25 bp, Mus musculus
tatggcggataaaatgactctcaaa

SEQ ID NO: 789819 - DNA, 25 bp, Mus musculus
tatggcggataatatgactctcaaa

SEQ ID NO: 789820 - DNA, 25 bp, Mus musculus
tatggcggatgcagggtcttctgca

SEQ ID NO: 789821 - DNA, 25 bp, Mus musculus
tatggcggatgctgggtcttctgca

SEQ ID NO: 789822 - DNA, 25 bp, Mus musculus
tatggcggtagaacgattgcagaga

SEQ ID NO: 789823 - DNA, 25 bp, Mus musculus
tatggcggtagatcgattgcagaga

SEQ ID NO: 789824 - DNA, 25 bp, Mus musculus
tatggcggtcaaatgctgagttaca

SEQ ID NO: 789825 - DNA, 25 bp, Mus musculus
tatggcggtcaattgctgagttaca

SEQ ID NO: 789826 - DNA, 25 bp, Mus musculus
tatggcgtaactctcgggtaaacgg

SEQ ID NO: 789827 - DNA, 25 bp, Mus musculus
tatggcgtaactgtcgggtaaacgg

SEQ ID NO: 789828 - DNA, 25 bp, Mus musculus
tatggcgtcgatccttattacctta

SEQ ID NO: 789829 - DNA, 25 bp, Mus musculus
tatggcgtcgatgcttattacctta

SEQ ID NO: 789830 - DNA, 25 bp, Mus musculus
tatggcgtgataactctggccggcg

SEQ ID NO: 789831 - DNA, 25 bp, Mus musculus
tatggcgtgatatctctggccggcg

SEQ ID NO: 789832 - DNA, 25 bp, Mus musculus
tatggcgtttagaatttcttttcaa

SEQ ID NO: 789833 - DNA, 25 bp, Mus musculus
tatggcgtttagtatttcttttcaa

SEQ ID NO: 789834 - DNA, 25 bp, Mus musculus
tatggctaactcctgtggcttacca

SEQ ID NO: 789835 - DNA, 25 bp, Mus musculus
tatggctaactcgtgtggcttacca

SEQ ID NO: 789836 - DNA, 25 bp, Mus musculus
tatggctacaccagtgttatcagag

SEQ ID NO: 789837 - DNA, 25 bp, Mus musculus
tatggctacacctgtgttatcagag

SEQ ID NO: 789838 - DNA, 25 bp, Mus musculus
tatggctacccaagtgctactcagg

SEQ ID NO: 789839 - DNA, 25 bp, Mus musculus
tatggctacccatgtgctactcagg

SEQ ID NO: 789840 - DNA, 25 bp, Mus musculus
tatggctaccttaggactacctttg

SEQ ID NO: 789841 - DNA, 25 bp, Mus musculus
tatggctacctttggactacctttg

SEQ ID NO: 789842 - DNA, 25 bp, Mus musculus
tatggctacgtgactgatcccatga

SEQ ID NO: 789843 - DNA, 25 bp, Mus musculus
tatggctacgtgtctgatcccatga

SEQ ID NO: 789844 - DNA, 25 bp, Mus musculus
tatggctactctcaagctcacagca

SEQ ID NO: 789845 - DNA, 25 bp, Mus musculus
tatggctactctgaagctcacagca

SEQ ID NO: 789846 - DNA, 25 bp, Mus musculus
tatggctacttgagtgtcatcagag

SEQ ID NO: 789847 - DNA, 25 bp, Mus musculus
tatggctacttgtgtgtcatcagag

SEQ ID NO: 789848 - DNA, 25 bp, Mus musculus
tatggctactttaggcttctggtgc

SEQ ID NO: 789849 - DNA, 25 bp, Mus musculus
tatggctacttttggcttctggtgc

SEQ ID NO: 789850 - DNA, 25 bp, Mus musculus
tatggctagacaagagcagacttga

SEQ ID NO: 789851 - DNA, 25 bp, Mus musculus
tatggctagacatgagcagacttga

SEQ ID NO: 789852 - DNA, 25 bp, Mus musculus
tatggctagcctctatatcaccgga

SEQ ID NO: 789853 - DNA, 25 bp, Mus musculus
tatggctagcctgtatatcaccgga

SEQ ID NO: 789854 - DNA, 25 bp, Mus musculus
tatggctatgaaccccttgggtcac

SEQ ID NO: 789855 - DNA, 25 bp, Mus musculus
tatggctatgaagcccttgggtcac

SEQ ID NO: 789856 - DNA, 25 bp, Mus musculus
tatggctatgacactgagcgatgtt

SEQ ID NO: 789857 - DNA, 25 bp, Mus musculus
tatggctatgactctgagcgatgtt

SEQ ID NO: 789858 - DNA, 25 bp, Mus musculus
tatggctattttaactgcctattaa

SEQ ID NO: 789859 - DNA, 25 bp, Mus musculus
tatggctatttttactgcctattaa

SEQ ID NO: 789860 - DNA, 25 bp, Mus musculus
tatggctcaacaacagtggtctccc

SEQ ID NO: 789861 - DNA, 25 bp, Mus musculus
tatggctcaacatcagtggtctccc

SEQ ID NO: 789862 - DNA, 25 bp, Mus musculus
tatggctcaatcagagaaccctcag

SEQ ID NO: 789863 - DNA, 25 bp, Mus musculus
tatggctcaatctgagaaccctcag

SEQ ID NO: 789864 - DNA, 25 bp, Mus musculus
tatggctcacatacgtaactataaa

SEQ ID NO: 789865 - DNA, 25 bp, Mus musculus
tatggctcacattcgtaactataaa

SEQ ID NO: 789866 - DNA, 25 bp, Mus musculus
tatggctcatgacttaaggtgcacc

SEQ ID NO: 789867 - DNA, 25 bp, Mus musculus
tatggctcatgagttaaggtgcacc

SEQ ID NO: 789868 - DNA, 25 bp, Mus musculus
tatggctccagcattcggagggcac

SEQ ID NO: 789869 - DNA, 25 bp, Mus musculus
tatggctccagctttcggagggcac

SEQ ID NO: 789870 - DNA, 25 bp, Mus musculus
tatggctccctaaggaagcgtccag

SEQ ID NO: 789871 - DNA, 25 bp, Mus musculus
tatggctccctatggaagcgtccag

SEQ ID NO: 789872 - DNA, 25 bp, Mus musculus
tatggctcctacaatactctctcct

SEQ ID NO: 789873 - DNA, 25 bp, Mus musculus
tatggctcctactatactctctcct

SEQ ID NO: 789874 - DNA, 25 bp, Mus musculus
tatggctcctccacctggtatgaga

SEQ ID NO: 789875 - DNA, 25 bp, Mus musculus
tatggctcctcctcctggtatgaga

SEQ ID NO: 789876 - DNA, 25 bp, Mus musculus
tatggctccttcatcagaataggtg

SEQ ID NO: 789877 - DNA, 25 bp, Mus musculus
tatggctccttcttcagaataggtg

SEQ ID NO: 789878 - DNA, 25 bp, Mus musculus
tatggctctactcctgggaaggtga

SEQ ID NO: 789879 - DNA, 25 bp, Mus musculus
tatggctctactgctgggaaggtga

SEQ ID NO: 789880 - DNA, 25 bp, Mus musculus
tatggctctagcaccagaggacgac

SEQ ID NO: 789881 - DNA, 25 bp, Mus musculus
tatggctctagctccagaggacgac

SEQ ID NO: 789882 - DNA, 25 bp, Mus musculus
tatggctctagtaacttatgtggca

SEQ ID NO: 789883 - DNA, 25 bp, Mus musculus
tatggctctagttacttatgtggca

SEQ ID NO: 789884 - DNA, 25 bp, Mus musculus
tatggctctgtgatactgtttctcc

SEQ ID NO: 789885 - DNA, 25 bp, Mus musculus
tatggctctgtgttactgtttctcc

SEQ ID NO: 789886 - DNA, 25 bp, Mus musculus
tatggctcttttatcctgtgtttgg

SEQ ID NO: 789887 - DNA, 25 bp, Mus musculus
tatggctcttttttcctgtgtttgg

SEQ ID NO: 789888 - DNA, 25 bp, Mus musculus
tatggctgaataacactgcactgtg

SEQ ID NO: 789889 - DNA, 25 bp, Mus musculus
tatggctgaatatcactgcactgtg

SEQ ID NO: 789890 - DNA, 25 bp, Mus musculus
tatggctgacctatttcttaactat

SEQ ID NO: 789891 - DNA, 25 bp, Mus musculus
tatggctgacctttttcttaactat

SEQ ID NO: 789892 - DNA, 25 bp, Mus musculus
tatggctgacggcaagatctttgtg

SEQ ID NO: 789893 - DNA, 25 bp, Mus musculus
tatggctgacgggaagatctttgtg

SEQ ID NO: 789894 - DNA, 25 bp, Mus musculus
tatggctgagaccagagcctccttc

SEQ ID NO: 789895 - DNA, 25 bp, Mus musculus
tatggctgagacgagagcctccttc

SEQ ID NO: 789896 - DNA, 25 bp, Mus musculus
tatggctgagggaataggtttaaca

SEQ ID NO: 789897 - DNA, 25 bp, Mus musculus
tatggctgagggtataggtttaaca

SEQ ID NO: 789898 - DNA, 25 bp, Mus musculus
tatggctgcacaccttacgtttatg

SEQ ID NO: 789899 - DNA, 25 bp, Mus musculus
tatggctgcacagcttacgtttatg

SEQ ID NO: 789900 - DNA, 25 bp, Mus musculus
tatggctgcataagtgtcatcggaa

SEQ ID NO: 789901 - DNA, 25 bp, Mus musculus
tatggctgcatatgtgtcatcggaa

SEQ ID NO: 789902 - DNA, 25 bp, Mus musculus
tatggctgccttagaaatacttgat

SEQ ID NO: 789903 - DNA, 25 bp, Mus musculus
tatggctgcctttgaaatacttgat

SEQ ID NO: 789904 - DNA, 25 bp, Mus musculus
tatggctggacacagtgcaagttcc

SEQ ID NO: 789905 - DNA, 25 bp, Mus musculus
tatggctggacagagtgcaagttcc

SEQ ID NO: 789906 - DNA, 25 bp, Mus musculus
tatggctggagtctaggccgtctcc

SEQ ID NO: 789907 - DNA, 25 bp, Mus musculus
tatggctggagtgtaggccgtctcc

SEQ ID NO: 789908 - DNA, 25 bp, Mus musculus
tatggctggcccatttaccacatgg

SEQ ID NO: 789909 - DNA, 25 bp, Mus musculus
tatggctggcccttttaccacatgg

SEQ ID NO: 789910 - DNA, 25 bp, Mus musculus
tatggctgggtaaactctccttagg

SEQ ID NO: 789911 - DNA, 25 bp, Mus musculus
tatggctgggtatactctccttagg

SEQ ID NO: 789912 - DNA, 25 bp, Mus musculus
tatggctgtcatagtggttgtgttg

SEQ ID NO: 789913 - DNA, 25 bp, Mus musculus
tatggctgtcattgtggttgtgttg

SEQ ID NO: 789914 - DNA, 25 bp, Mus musculus
tatggctgtgcccagccagatgctc

SEQ ID NO: 789915 - DNA, 25 bp, Mus musculus
tatggctgtgccctcagggacttcc

SEQ ID NO: 789916 - DNA, 25 bp, Mus musculus
tatggctgtgccgagccagatgctc

SEQ ID NO: 789917 - DNA, 25 bp, Mus musculus
tatggctgtgccgtcagggacttcc

SEQ ID NO: 789918 - DNA, 25 bp, Mus musculus
tatggctgttagacagtcaactaga

SEQ ID NO: 789919 - DNA, 25 bp, Mus musculus
tatggctgttagtcagtcaactaga

SEQ ID NO: 789920 - DNA, 25 bp, Mus musculus
tatggctgttggctgtaacattcca

SEQ ID NO: 789921 - DNA, 25 bp, Mus musculus
tatggctgttgggtgtaacattcca

SEQ ID NO: 789922 - DNA, 25 bp, Mus musculus
tatggctgtttcacagattgtcccc

SEQ ID NO: 789923 - DNA, 25 bp, Mus musculus
tatggctgtttctcagattgtcccc

SEQ ID NO: 789924 - DNA, 25 bp, Mus musculus
tatggcttaatcaatggccccttaa

SEQ ID NO: 789925 - DNA, 25 bp, Mus musculus
tatggcttaatctatggccccttaa

SEQ ID NO: 789926 - DNA, 25 bp, Mus musculus
tatggcttagagcacaacatgctat

SEQ ID NO: 789927 - DNA, 25 bp, Mus musculus
tatggcttagaggacaacatgctat

SEQ ID NO: 789928 - DNA, 25 bp, Mus musculus
tatggcttagctactttgatgacaa

SEQ ID NO: 789929 - DNA, 25 bp, Mus musculus
tatggcttagcttctttgatgacaa

SEQ ID NO: 789930 - DNA, 25 bp, Mus musculus
tatggcttagttcagttccttacga

SEQ ID NO: 789931 - DNA, 25 bp, Mus musculus
tatggcttagttgagttccttacga

SEQ ID NO: 789932 - DNA, 25 bp, Mus musculus
tatggcttcacacagtttgcactag

SEQ ID NO: 789933 - DNA, 25 bp, Mus musculus
tatggcttcacagagtttgcactag

SEQ ID NO: 789934 - DNA, 25 bp, Mus musculus
tatggcttcccaagactgtctgcaa

SEQ ID NO: 789935 - DNA, 25 bp, Mus musculus
tatggcttcccatgactgtctgcaa

SEQ ID NO: 789936 - DNA, 25 bp, Mus musculus
tatggcttctctccctactttataa

SEQ ID NO: 789937 - DNA, 25 bp, Mus musculus
tatggcttctctgcctactttataa

SEQ ID NO: 789938 - DNA, 25 bp, Mus musculus
tatggcttctggcagctttgagtca

SEQ ID NO: 789939 - DNA, 25 bp, Mus musculus
tatggcttctgggagctttgagtca

SEQ ID NO: 789940 - DNA, 25 bp, Mus musculus
tatggcttgcccaatgttcctgaca

SEQ ID NO: 789941 - DNA, 25 bp, Mus musculus
tatggcttgccctatgttcctgaca

SEQ ID NO: 789942 - DNA, 25 bp, Mus musculus
tatggcttgccgctgaacttccaag

SEQ ID NO: 789943 - DNA, 25 bp, Mus musculus
tatggcttgccgcttttgtacacca

SEQ ID NO: 789944 - DNA, 25 bp, Mus musculus
tatggcttgccggtgaacttccaag

SEQ ID NO: 789945 - DNA, 25 bp, Mus musculus
tatggcttgccggttttgtacacca

SEQ ID NO: 789946 - DNA, 25 bp, Mus musculus
tatggcttgcttcttgttctgtaaa

SEQ ID NO: 789947 - DNA, 25 bp, Mus musculus
tatggcttgcttgttgttctgtaaa

SEQ ID NO: 789948 - DNA, 25 bp, Mus musculus
tatggcttgggcatggaacgatttc

SEQ ID NO: 789949 - DNA, 25 bp, Mus musculus
tatggcttgggcttggaacgatttc

SEQ ID NO: 789950 - DNA, 25 bp, Mus musculus
tatggctttgttcctacacgggaga

SEQ ID NO: 789951 - DNA, 25 bp, Mus musculus
tatggctttgttgctacacgggaga

SEQ ID NO: 789952 - DNA, 25 bp, Mus musculus
tatggcttttacatcattttagaaa

SEQ ID NO: 789953 - DNA, 25 bp, Mus musculus
tatggcttttacttcattttagaaa

SEQ ID NO: 789954 - DNA, 25 bp, Mus musculus
tatgggaaacagacatacccctcca

SEQ ID NO: 789955 - DNA, 25 bp, Mus musculus
tatgggaaacagtcatacccctcca

SEQ ID NO: 789956 - DNA, 25 bp, Mus musculus
tatgggaaccctcattctcggactc

SEQ ID NO: 789957 - DNA, 25 bp, Mus musculus
tatgggaaccctgattctcggactc

SEQ ID NO: 789958 - DNA, 25 bp, Mus musculus
tatgggaacgtaacaccgccccttg

SEQ ID NO: 789959 - DNA, 25 bp, Mus musculus
tatgggaacgtatcaccgccccttg

SEQ ID NO: 789960 - DNA, 25 bp, Mus musculus
tatgggaactaacgtctgatccctg

SEQ ID NO: 789961 - DNA, 25 bp, Mus musculus
tatgggaactaaggtctgatccctg

SEQ ID NO: 789962 - DNA, 25 bp, Mus musculus
tatgggaatatcacgtaccctcccg

SEQ ID NO: 789963 - DNA, 25 bp, Mus musculus
tatgggaatatctcgtaccctcccg

SEQ ID NO: 789964 - DNA, 25 bp, Mus musculus
tatgggaatccacctcacagagaat

SEQ ID NO: 789965 - DNA, 25 bp, Mus musculus
tatgggaatccagctcacagagaat

SEQ ID NO: 789966 - DNA, 25 bp, Mus musculus
tatgggacaacacacttgctccgcc

SEQ ID NO: 789967 - DNA, 25 bp, Mus musculus
tatgggacaacagacttgctccgcc

SEQ ID NO: 789968 - DNA, 25 bp, Mus musculus
tatgggacacccattatctatggct

SEQ ID NO: 789969 - DNA, 25 bp, Mus musculus
tatgggacaccctttatctatggct

SEQ ID NO: 789970 - DNA, 25 bp, Mus musculus
tatgggaccagaaagcttccttctg

SEQ ID NO: 789971 - DNA, 25 bp, Mus musculus
tatgggaccagatagcttccttctg

SEQ ID NO: 789972 - DNA, 25 bp, Mus musculus
tatgggaccagtcacccctgaacat

SEQ ID NO: 789973 - DNA, 25 bp, Mus musculus
tatgggaccagtgacccctgaacat

SEQ ID NO: 789974 - DNA, 25 bp, Mus musculus
tatgggaccttaccttctccatgaa

SEQ ID NO: 789975 - DNA, 25 bp, Mus musculus
tatgggaccttagcttctccatgaa

SEQ ID NO: 789976 - DNA, 25 bp, Mus musculus
tatgggactctcagagagctcttca

SEQ ID NO: 789977 - DNA, 25 bp, Mus musculus
tatgggactctctgagagctcttca

SEQ ID NO: 789978 - DNA, 25 bp, Mus musculus
tatgggactgagctaactgctgccc

SEQ ID NO: 789979 - DNA, 25 bp, Mus musculus
tatgggactgaggtaactgctgccc

SEQ ID NO: 789980 - DNA, 25 bp, Mus musculus
tatgggactgctattgggtgtgcct

SEQ ID NO: 789981 - DNA, 25 bp, Mus musculus
tatgggactgcttttgggtgtgcct

SEQ ID NO: 789982 - DNA, 25 bp, Mus musculus
tatgggagacaccacttggcctggc

SEQ ID NO: 789983 - DNA, 25 bp, Mus musculus
tatgggagacacgacttggcctggc

SEQ ID NO: 789984 - DNA, 25 bp, Mus musculus
tatgggagcatacccgccgccaaac

SEQ ID NO: 789985 - DNA, 25 bp, Mus musculus
tatgggagcatagccgccgccaaac

SEQ ID NO: 789986 - DNA, 25 bp, Mus musculus
tatgggagccacatgtattcaaacc

SEQ ID NO: 789987 - DNA, 25 bp, Mus musculus
tatgggagccacttgtattcaaacc

SEQ ID NO: 789988 - DNA, 25 bp, Mus musculus
tatgggagtcatccttgggaataca

SEQ ID NO: 789989 - DNA, 25 bp, Mus musculus
tatgggagtcatgcttgggaataca

SEQ ID NO: 789990 - DNA, 25 bp, Mus musculus
tatgggagtgcaaagctgctccttc

SEQ ID NO: 789991 - DNA, 25 bp, Mus musculus
tatgggagtgcatagctgctccttc

SEQ ID NO: 789992 - DNA, 25 bp, Mus musculus
tatgggatactcacctgcggctctg

SEQ ID NO: 789993 - DNA, 25 bp, Mus musculus
tatgggatactctcctgcggctctg

SEQ ID NO: 789994 - DNA, 25 bp, Mus musculus
tatgggatagccatcagcctctgga

SEQ ID NO: 789995 - DNA, 25 bp, Mus musculus
tatgggatagccttcagcctctgga

SEQ ID NO: 789996 - DNA, 25 bp, Mus musculus
tatgggatatgcctaaagccttgtt

SEQ ID NO: 789997 - DNA, 25 bp, Mus musculus
tatgggatatgcgtaaagccttgtt

SEQ ID NO: 789998 - DNA, 25 bp, Mus musculus
tatgggatcagcactggccggccct

SEQ ID NO: 789999 - DNA, 25 bp, Mus musculus
tatgggatcagctctggccggccct

SEQ ID NO: 790000 - DNA, 25 bp, Mus musculus
tatgggatccaccatcacaccggga

SEQ ID NO: 790001 - DNA, 25 bp, Mus musculus
tatgggatccacgatcacaccggga

SEQ ID NO: 790002 - DNA, 25 bp, Mus musculus
tatgggatcttacaccttcttctgg

SEQ ID NO: 790003 - DNA, 25 bp, Mus musculus
tatgggatcttagaccttcttctgg

SEQ ID NO: 790004 - DNA, 25 bp, Mus musculus
tatgggatgactatcttcagagctt

SEQ ID NO: 790005 - DNA, 25 bp, Mus musculus
tatgggatgactttcttcagagctt

SEQ ID NO: 790006 - DNA, 25 bp, Mus musculus
tatgggatgtttccttgtgggacca

SEQ ID NO: 790007 - DNA, 25 bp, Mus musculus
tatgggatgtttgcttgtgggacca

SEQ ID NO: 790008 - DNA, 25 bp, Mus musculus
tatgggattcctaatttttagcagt

SEQ ID NO: 790009 - DNA, 25 bp, Mus musculus
tatgggattccttatttttagcagt

SEQ ID NO: 790010 - DNA, 25 bp, Mus musculus
tatgggatttgcactgaactagaaa

SEQ ID NO: 790011 - DNA, 25 bp, Mus musculus
tatgggatttgctctgaactagaaa

SEQ ID NO: 790012 - DNA, 25 bp, Mus musculus
tatgggcaaagcactaagtacagtt

SEQ ID NO: 790013 - DNA, 25 bp, Mus musculus
tatgggcaaagctctaagtacagtt

SEQ ID NO: 790014 - DNA, 25 bp, Mus musculus
tatgggcacacacctcacacagaga

SEQ ID NO: 790015 - DNA, 25 bp, Mus musculus
tatgggcacacagctcacacagaga

SEQ ID NO: 790016 - DNA, 25 bp, Mus musculus
tatgggcacatgagcctaccttaaa

SEQ ID NO: 790017 - DNA, 25 bp, Mus musculus
tatgggcacatgtgcctaccttaaa

SEQ ID NO: 790018 - DNA, 25 bp, Mus musculus
tatgggcaccctagcaggcggcctg

SEQ ID NO: 790019 - DNA, 25 bp, Mus musculus
tatgggcacccttgcaggcggcctg

SEQ ID NO: 790020 - DNA, 25 bp, Mus musculus
tatgggcagcacctcaccaacggga

SEQ ID NO: 790021 - DNA, 25 bp, Mus musculus
tatgggcagcacgtcaccaacggga

SEQ ID NO: 790022 - DNA, 25 bp, Mus musculus
tatgggcagcatcaactgagcttca

SEQ ID NO: 790023 - DNA, 25 bp, Mus musculus
tatgggcagcatgaactgagcttca

SEQ ID NO: 790024 - DNA, 25 bp, Mus musculus
tatgggcagctgcacatctttccaa

SEQ ID NO: 790025 - DNA, 25 bp, Mus musculus
tatgggcagctggacatctttccaa

SEQ ID NO: 790026 - DNA, 25 bp, Mus musculus
tatgggcaggccctcaagagtaaag

SEQ ID NO: 790027 - DNA, 25 bp, Mus musculus
tatgggcaggccgtcaagagtaaag

SEQ ID NO: 790028 - DNA, 25 bp, Mus musculus
tatgggcatataacacagtcatgtg

SEQ ID NO: 790029 - DNA, 25 bp, Mus musculus
tatgggcatatatcacagtcatgtg

SEQ ID NO: 790030 - DNA, 25 bp, Mus musculus
tatgggcatgtgattctgttagaat

SEQ ID NO: 790031 - DNA, 25 bp, Mus musculus
tatgggcatgtgtttctgttagaat

SEQ ID NO: 790032 - DNA, 25 bp, Mus musculus
tatgggccaagtcggcgacagctgc

SEQ ID NO: 790033 - DNA, 25 bp, Mus musculus
tatgggccaagtgggcgacagctgc

SEQ ID NO: 790034 - DNA, 25 bp, Mus musculus
tatgggccagatctgtatccaccgc

SEQ ID NO: 790035 - DNA, 25 bp, Mus musculus
tatgggccagatgtgtatccaccgc

SEQ ID NO: 790036 - DNA, 25 bp, Mus musculus
tatgggccagtcacatgtacttggt

SEQ ID NO: 790037 - DNA, 25 bp, Mus musculus
tatgggccagtctcatgtacttggt

SEQ ID NO: 790038 - DNA, 25 bp, Mus musculus
tatgggccatgacccatgaggtcac

SEQ ID NO: 790039 - DNA, 25 bp, Mus musculus
tatgggccatgagccatgaggtcac

SEQ ID NO: 790040 - DNA, 25 bp, Mus musculus
tatgggcccaaaagatgcatcacca

SEQ ID NO: 790041 - DNA, 25 bp, Mus musculus
tatgggcccaaatgatgcatcacca

SEQ ID NO: 790042 - DNA, 25 bp, Mus musculus
tatgggccccaaagtttggcctgaa

SEQ ID NO: 790043 - DNA, 25 bp, Mus musculus
tatgggccccaatgtttggcctgaa

SEQ ID NO: 790044 - DNA, 25 bp, Mus musculus
tatgggccccagcaagctggagaat

SEQ ID NO: 790045 - DNA, 25 bp, Mus musculus
tatgggccccaggaagctggagaat

SEQ ID NO: 790046 - DNA, 25 bp, Mus musculus
tatgggcctcaacccgaccaatgaa

SEQ ID NO: 790047 - DNA, 25 bp, Mus musculus
tatgggcctcaagccgaccaatgaa

SEQ ID NO: 790048 - DNA, 25 bp, Mus musculus
tatgggcctcgaagagttgaaataa

SEQ ID NO: 790049 - DNA, 25 bp, Mus musculus
tatgggcctcgatgagttgaaataa

SEQ ID NO: 790050 - DNA, 25 bp, Mus musculus
tatgggcctcggatggaacccctcc

SEQ ID NO: 790051 - DNA, 25 bp, Mus musculus
tatgggcctcggttggaacccctcc

SEQ ID NO: 790052 - DNA, 25 bp, Mus musculus
tatgggcctgcaaccactagggagc

SEQ ID NO: 790053 - DNA, 25 bp, Mus musculus
tatgggcctgcatccactagggagc

SEQ ID NO: 790054 - DNA, 25 bp, Mus musculus
tatgggcctggaagtggacactgat

SEQ ID NO: 790055 - DNA, 25 bp, Mus musculus
tatgggcctggatgtggacactgat

SEQ ID NO: 790056 - DNA, 25 bp, Mus musculus
tatgggcgcccacctagtaatttaa

SEQ ID NO: 790057 - DNA, 25 bp, Mus musculus
tatgggcgcccagctagtaatttaa

SEQ ID NO: 790058 - DNA, 25 bp, Mus musculus
tatgggcggagcacacttgcggttt

SEQ ID NO: 790059 - DNA, 25 bp, Mus musculus
tatgggcggagctcacttgcggttt

SEQ ID NO: 790060 - DNA, 25 bp, Mus musculus
tatgggctattcaactcagtcttga

SEQ ID NO: 790061 - DNA, 25 bp, Mus musculus
tatgggctattctactcagtcttga

SEQ ID NO: 790062 - DNA, 25 bp, Mus musculus
tatgggctccaacaacaacgggatt

SEQ ID NO: 790063 - DNA, 25 bp, Mus musculus
tatgggctccaagaacaacgggatt

SEQ ID NO: 790064 - DNA, 25 bp, Mus musculus
tatgggctcctgcttgtcagtggtc

SEQ ID NO: 790065 - DNA, 25 bp, Mus musculus
tatgggctcctggttgtcagtggtc

SEQ ID NO: 790066 - DNA, 25 bp, Mus musculus
tatgggctgagcctgcagcatgcta

SEQ ID NO: 790067 - DNA, 25 bp, Mus musculus
tatgggctgagcgtgcagcatgcta

SEQ ID NO: 790068 - DNA, 25 bp, Mus musculus
tatgggctggcgcacagcaactaca

SEQ ID NO: 790069 - DNA, 25 bp, Mus musculus
tatgggctggcggacagcaactaca

SEQ ID NO: 790070 - DNA, 25 bp, Mus musculus
tatgggctgtacagggtgccagata

SEQ ID NO: 790071 - DNA, 25 bp, Mus musculus
tatgggctgtactgggtgccagata

SEQ ID NO: 790072 - DNA, 25 bp, Mus musculus
tatgggctgtctactatctctcttg

SEQ ID NO: 790073 - DNA, 25 bp, Mus musculus
tatgggctgtcttctatctctcttg

SEQ ID NO: 790074 - DNA, 25 bp, Mus musculus
tatgggtaacacatccttttttgct

SEQ ID NO: 790075 - DNA, 25 bp, Mus musculus
tatgggtaacacttccttttttgct

SEQ ID NO: 790076 - DNA, 25 bp, Mus musculus
tatgggtacaagaagccccactgtg

SEQ ID NO: 790077 - DNA, 25 bp, Mus musculus
tatgggtacaagtagccccactgtg

SEQ ID NO: 790078 - DNA, 25 bp, Mus musculus
tatgggtatatgacccagtccgtcc

SEQ ID NO: 790079 - DNA, 25 bp, Mus musculus
tatgggtatatgtcccagtccgtcc

SEQ ID NO: 790080 - DNA, 25 bp, Mus musculus
tatgggtcaattatcactgaagtgg

SEQ ID NO: 790081 - DNA, 25 bp, Mus musculus
tatgggtcaattttcactgaagtgg

SEQ ID NO: 790082 - DNA, 25 bp, Mus musculus
tatgggtcactcaggcttgtcacag

SEQ ID NO: 790083 - DNA, 25 bp, Mus musculus
tatgggtcactctggcttgtcacag

SEQ ID NO: 790084 - DNA, 25 bp, Mus musculus
tatgggtcccagaaaacatcagagt

SEQ ID NO: 790085 - DNA, 25 bp, Mus musculus
tatgggtcccagtaaacatcagagt

SEQ ID NO: 790086 - DNA, 25 bp, Mus musculus
tatgggtccttacgtcttccttcta

SEQ ID NO: 790087 - DNA, 25 bp, Mus musculus
tatgggtccttaggtcttccttcta

SEQ ID NO: 790088 - DNA, 25 bp, Mus musculus
tatgggtctaagactacagtggctg

SEQ ID NO: 790089 - DNA, 25 bp, Mus musculus
tatgggtctaagtctacagtggctg

SEQ ID NO: 790090 - DNA, 25 bp, Mus musculus
tatgggtctgtacctaaacactgcc

SEQ ID NO: 790091 - DNA, 25 bp, Mus musculus
tatgggtctgtagctaaacactgcc

SEQ ID NO: 790092 - DNA, 25 bp, Mus musculus
tatgggtgactcctttctataccag

SEQ ID NO: 790093 - DNA, 25 bp, Mus musculus
tatgggtgactcgtttctataccag

SEQ ID NO: 790094 - DNA, 25 bp, Mus musculus
tatgggtgcatgcatcactcctgta

SEQ ID NO: 790095 - DNA, 25 bp, Mus musculus
tatgggtgcatggatcactcctgta

SEQ ID NO: 790096 - DNA, 25 bp, Mus musculus
tatgggtggagacccagccatctct

SEQ ID NO: 790097 - DNA, 25 bp, Mus musculus
tatgggtggagagccagccatctct

SEQ ID NO: 790098 - DNA, 25 bp, Mus musculus
tatgggtgggacactgctcagctgc

SEQ ID NO: 790099 - DNA, 25 bp, Mus musculus
tatgggtgggactctgctcagctgc

SEQ ID NO: 790100 - DNA, 25 bp, Mus musculus
tatgggtgggttccgtatactgaaa

SEQ ID NO: 790101 - DNA, 25 bp, Mus musculus
tatgggtgggttgcgtatactgaaa

SEQ ID NO: 790102 - DNA, 25 bp, Mus musculus
tatgggtgtttcagggtatcttagc

SEQ ID NO: 790103 - DNA, 25 bp, Mus musculus
tatgggtgtttctgggtatcttagc

SEQ ID NO: 790104 - DNA, 25 bp, Mus musculus
tatgggttaagtatgttttcctgtt

SEQ ID NO: 790105 - DNA, 25 bp, Mus musculus
tatgggttaagtttgttttcctgtt

SEQ ID NO: 790106 - DNA, 25 bp, Mus musculus
tatgggttacttaattccgaggaat

SEQ ID NO: 790107 - DNA, 25 bp, Mus musculus
tatgggttactttattccgaggaat

SEQ ID NO: 790108 - DNA, 25 bp, Mus musculus
tatgggttattgctagtgtcttttt

SEQ ID NO: 790109 - DNA, 25 bp, Mus musculus
tatgggttattggtagtgtcttttt

SEQ ID NO: 790110 - DNA, 25 bp, Mus musculus
tatggtaaaaggagttccctctgga

SEQ ID NO: 790111 - DNA, 25 bp, Mus musculus
tatggtaaaaggtgttccctctgga

SEQ ID NO: 790112 - DNA, 25 bp, Mus musculus
tatggtaacgttcctgggcatgctt

SEQ ID NO: 790113 - DNA, 25 bp, Mus musculus
tatggtaacgttgctgggcatgctt

SEQ ID NO: 790114 - DNA, 25 bp, Mus musculus
tatggtaactaccacggctacaggg

SEQ ID NO: 790115 - DNA, 25 bp, Mus musculus
tatggtaactacgacggctacaggg

SEQ ID NO: 790116 - DNA, 25 bp, Mus musculus
tatggtaactcaccacccaattctc

SEQ ID NO: 790117 - DNA, 25 bp, Mus musculus
tatggtaactcagcacccaattctc

SEQ ID NO: 790118 - DNA, 25 bp, Mus musculus
tatggtaactttatctcttttgctt

SEQ ID NO: 790119 - DNA, 25 bp, Mus musculus
tatggtaactttttctcttttgctt

SEQ ID NO: 790120 - DNA, 25 bp, Mus musculus
tatggtaatgctcgcctgtgatccc

SEQ ID NO: 790121 - DNA, 25 bp, Mus musculus
tatggtaatgctggcctgtgatccc

SEQ ID NO: 790122 - DNA, 25 bp, Mus musculus
tatggtacacaaaaggtctccgagg

SEQ ID NO: 790123 - DNA, 25 bp, Mus musculus
tatggtacacaataggtctccgagg

SEQ ID NO: 790124 - DNA, 25 bp, Mus musculus
tatggtacccaaactacacagttag

SEQ ID NO: 790125 - DNA, 25 bp, Mus musculus
tatggtacccaatctacacagttag

SEQ ID NO: 790126 - DNA, 25 bp, Mus musculus
tatggtacccttcaaattactgttg

SEQ ID NO: 790127 - DNA, 25 bp, Mus musculus
tatggtacccttgaaattactgttg

SEQ ID NO: 790128 - DNA, 25 bp, Mus musculus
tatggtaccggacagcctatcacaa

SEQ ID NO: 790129 - DNA, 25 bp, Mus musculus
tatggtaccggagagcctatcacaa

SEQ ID NO: 790130 - DNA, 25 bp, Mus musculus
tatggtacgttgcttcggtgtcaat

SEQ ID NO: 790131 - DNA, 25 bp, Mus musculus
tatggtacgttggttcggtgtcaat

SEQ ID NO: 790132 - DNA, 25 bp, Mus musculus
tatggtactattccccacatggcac

SEQ ID NO: 790133 - DNA, 25 bp, Mus musculus
tatggtactattgcccacatggcac

SEQ ID NO: 790134 - DNA, 25 bp, Mus musculus
tatggtaggctgctctgtcccttca

SEQ ID NO: 790135 - DNA, 25 bp, Mus musculus
tatggtaggctggtctgtcccttca

SEQ ID NO: 790136 - DNA, 25 bp, Mus musculus
tatggtatcaaacatccctaacccc

SEQ ID NO: 790137 - DNA, 25 bp, Mus musculus
tatggtatcaaagatccctaacccc

SEQ ID NO: 790138 - DNA, 25 bp, Mus musculus
tatggtatcctcagtgtccacaggg

SEQ ID NO: 790139 - DNA, 25 bp, Mus musculus
tatggtatcctctgtgtccacaggg

SEQ ID NO: 790140 - DNA, 25 bp, Mus musculus
tatggtatcggtcctgccccaggat

SEQ ID NO: 790141 - DNA, 25 bp, Mus musculus
tatggtatcggtgctgccccaggat

SEQ ID NO: 790142 - DNA, 25 bp, Mus musculus
tatggtattgagaccccagtgacac

SEQ ID NO: 790143 - DNA, 25 bp, Mus musculus
tatggtattgagtccccagtgacac

SEQ ID NO: 790144 - DNA, 25 bp, Mus musculus
tatggtcaacaaaatagctcctagc

SEQ ID NO: 790145 - DNA, 25 bp, Mus musculus
tatggtcaacaatatagctcctagc

SEQ ID NO: 790146 - DNA, 25 bp, Mus musculus
tatggtcacgtcaatcaggcaatgt

SEQ ID NO: 790147 - DNA, 25 bp, Mus musculus
tatggtcacgtctatcaggcaatgt

SEQ ID NO: 790148 - DNA, 25 bp, Mus musculus
tatggtcactgaatactctggaaac

SEQ ID NO: 790149 - DNA, 25 bp, Mus musculus
tatggtcactgattactctggaaac

SEQ ID NO: 790150 - DNA, 25 bp, Mus musculus
tatggtcagagaaacctcacacctc

SEQ ID NO: 790151 - DNA, 25 bp, Mus musculus
tatggtcagagatacctcacacctc

SEQ ID NO: 790152 - DNA, 25 bp, Mus musculus
tatggtcagattagtactttggaat

SEQ ID NO: 790153 - DNA, 25 bp, Mus musculus
tatggtcagatttgtactttggaat

SEQ ID NO: 790154 - DNA, 25 bp, Mus musculus
tatggtcaggtcatgcaaagtgaac

SEQ ID NO: 790155 - DNA, 25 bp, Mus musculus
tatggtcaggtcttgcaaagtgaac

SEQ ID NO: 790156 - DNA, 25 bp, Mus musculus
tatggtcatacccaccattgtttcc

SEQ ID NO: 790157 - DNA, 25 bp, Mus musculus
tatggtcataccgaccattgtttcc

SEQ ID NO: 790158 - DNA, 25 bp, Mus musculus
tatggtcatcaaatatgctgtgttt

SEQ ID NO: 790159 - DNA, 25 bp, Mus musculus
tatggtcatcaattatgctgtgttt

SEQ ID NO: 790160 - DNA, 25 bp, Mus musculus
tatggtcatcatacagacgctggag

SEQ ID NO: 790161 - DNA, 25 bp, Mus musculus
tatggtcatcattcagacgctggag

SEQ ID NO: 790162 - DNA, 25 bp, Mus musculus
tatggtcatctcaacttctgatgcc

SEQ ID NO: 790163 - DNA, 25 bp, Mus musculus
tatggtcatctctacttctgatgcc

SEQ ID NO: 790164 - DNA, 25 bp, Mus musculus
tatggtcatctgatcctgttagaag

SEQ ID NO: 790165 - DNA, 25 bp, Mus musculus
tatggtcatctgttcctgttagaag

SEQ ID NO: 790166 - DNA, 25 bp, Mus musculus
tatggtcatgtgacacacatataca

SEQ ID NO: 790167 - DNA, 25 bp, Mus musculus
tatggtcatgtgtcacacatataca

SEQ ID NO: 790168 - DNA, 25 bp, Mus musculus
tatggtcccatccagctttgtgcat

SEQ ID NO: 790169 - DNA, 25 bp, Mus musculus
tatggtcccatcgagctttgtgcat

SEQ ID NO: 790170 - DNA, 25 bp, Mus musculus
tatggtcccatgctgtcctaactag

SEQ ID NO: 790171 - DNA, 25 bp, Mus musculus
tatggtcccatggtgtcctaactag

SEQ ID NO: 790172 - DNA, 25 bp, Mus musculus
tatggtcccctaaccctgttctttt

SEQ ID NO: 790173 - DNA, 25 bp, Mus musculus
tatggtcccctatccctgttctttt

SEQ ID NO: 790174 - DNA, 25 bp, Mus musculus
tatggtcccgtgatacctgttttct

SEQ ID NO: 790175 - DNA, 25 bp, Mus musculus
tatggtcccgtgttacctgttttct

SEQ ID NO: 790176 - DNA, 25 bp, Mus musculus
tatggtccgcgcatgtatacaaaga

SEQ ID NO: 790177 - DNA, 25 bp, Mus musculus
tatggtccgcgcttgtatacaaaga

SEQ ID NO: 790178 - DNA, 25 bp, Mus musculus
tatggtcctgacacctgatgtctgg

SEQ ID NO: 790179 - DNA, 25 bp, Mus musculus
tatggtcctgactcctgatgtctgg

SEQ ID NO: 790180 - DNA, 25 bp, Mus musculus
tatggtcgccggaccaaatttggaa

SEQ ID NO: 790181 - DNA, 25 bp, Mus musculus
tatggtcgccggtccaaatttggaa

SEQ ID NO: 790182 - DNA, 25 bp, Mus musculus
tatggtctcaatatctttcagtcga

SEQ ID NO: 790183 - DNA, 25 bp, Mus musculus
tatggtctcaatcaagttgctagca

SEQ ID NO: 790184 - DNA, 25 bp, Mus musculus
tatggtctcaatgaagttgctagca

SEQ ID NO: 790185 - DNA, 25 bp, Mus musculus
tatggtctcaatttctttcagtcga

SEQ ID NO: 790186 - DNA, 25 bp, Mus musculus
tatggtctcattccaactaggtgtg

SEQ ID NO: 790187 - DNA, 25 bp, Mus musculus
tatggtctcattgcaactaggtgtg

SEQ ID NO: 790188 - DNA, 25 bp, Mus musculus
tatggtgaaccactggctccgagaa

SEQ ID NO: 790189 - DNA, 25 bp, Mus musculus
tatggtgaaccagtggctccgagaa

SEQ ID NO: 790190 - DNA, 25 bp, Mus musculus
tatggtgacagcaggccagtagcaa

SEQ ID NO: 790191 - DNA, 25 bp, Mus musculus
tatggtgacagctggccagtagcaa

SEQ ID NO: 790192 - DNA, 25 bp, Mus musculus
tatggtgactcacgctgcaatatca

SEQ ID NO: 790193 - DNA, 25 bp, Mus musculus
tatggtgactcaggctgcaatatca

SEQ ID NO: 790194 - DNA, 25 bp, Mus musculus
tatggtgactctacgtgtacccagt

SEQ ID NO: 790195 - DNA, 25 bp, Mus musculus
tatggtgactcttcgtgtacccagt

SEQ ID NO: 790196 - DNA, 25 bp, Mus musculus
tatggtgacttccacgcctacaggg

SEQ ID NO: 790197 - DNA, 25 bp, Mus musculus
tatggtgacttcgacgcctacaggg

SEQ ID NO: 790198 - DNA, 25 bp, Mus musculus
tatggtgagtccaaatcagtgtctt

SEQ ID NO: 790199 - DNA, 25 bp, Mus musculus
tatggtgagtcctaatcagtgtctt

SEQ ID NO: 790200 - DNA, 25 bp, Mus musculus
tatggtgcaaagactcctcatggtt

SEQ ID NO: 790201 - DNA, 25 bp, Mus musculus
tatggtgcaaagtctcctcatggtt

SEQ ID NO: 790202 - DNA, 25 bp, Mus musculus
tatggtgcacgcatgttttagggcc

SEQ ID NO: 790203 - DNA, 25 bp, Mus musculus
tatggtgcacgcttgttttagggcc

SEQ ID NO: 790204 - DNA, 25 bp, Mus musculus
tatggtgcactaccatgcaatcttg

SEQ ID NO: 790205 - DNA, 25 bp, Mus musculus
tatggtgcactagcatgcaatcttg

SEQ ID NO: 790206 - DNA, 25 bp, Mus musculus
tatggtgcagccacactctaaaagc

SEQ ID NO: 790207 - DNA, 25 bp, Mus musculus
tatggtgcagcctcactctaaaagc

SEQ ID NO: 790208 - DNA, 25 bp, Mus musculus
tatggtgccctgcaattgtttgcct

SEQ ID NO: 790209 - DNA, 25 bp, Mus musculus
tatggtgccctggaattgtttgcct

SEQ ID NO: 790210 - DNA, 25 bp, Mus musculus
tatggtgcgcctcttgaagcttaac

SEQ ID NO: 790211 - DNA, 25 bp, Mus musculus
tatggtgcgcctgttgaagcttaac

SEQ ID NO: 790212 - DNA, 25 bp, Mus musculus
tatggtgctagaagtcacttgcatt

SEQ ID NO: 790213 - DNA, 25 bp, Mus musculus
tatggtgctagatgtcacttgcatt

SEQ ID NO: 790214 - DNA, 25 bp, Mus musculus
tatggtgctatactgccagattgga

SEQ ID NO: 790215 - DNA, 25 bp, Mus musculus
tatggtgctatagtgccagattgga

SEQ ID NO: 790216 - DNA, 25 bp, Mus musculus
tatggtgctgctcgatcaacccaaa

SEQ ID NO: 790217 - DNA, 25 bp, Mus musculus
tatggtgctgctggatcaacccaaa

SEQ ID NO: 790218 - DNA, 25 bp, Mus musculus
tatggtgctgtgagatcttcggatt

SEQ ID NO: 790219 - DNA, 25 bp, Mus musculus
tatggtgctgtgtgatcttcggatt

SEQ ID NO: 790220 - DNA, 25 bp, Mus musculus
tatggtgcttctatctatctcgagt

SEQ ID NO: 790221 - DNA, 25 bp, Mus musculus
tatggtgcttctttctatctcgagt

SEQ ID NO: 790222 - DNA, 25 bp, Mus musculus
tatggtggaacaccaaccggtgcca

SEQ ID NO: 790223 - DNA, 25 bp, Mus musculus
tatggtggaacagcaaccggtgcca

SEQ ID NO: 790224 - DNA, 25 bp, Mus musculus
tatggtggagtaagcctgttgtccc

SEQ ID NO: 790225 - DNA, 25 bp, Mus musculus
tatggtggagtatgcctgttgtccc

SEQ ID NO: 790226 - DNA, 25 bp, Mus musculus
tatggtggccatactgagatctgat

SEQ ID NO: 790227 - DNA, 25 bp, Mus musculus
tatggtggccattctgagatctgat

SEQ ID NO: 790228 - DNA, 25 bp, Mus musculus
tatggtggttaaagctggctgccct

SEQ ID NO: 790229 - DNA, 25 bp, Mus musculus
tatggtggttaatgctggctgccct

SEQ ID NO: 790230 - DNA, 25 bp, Mus musculus
tatggtggtttcaataagcaaaatc

SEQ ID NO: 790231 - DNA, 25 bp, Mus musculus
tatggtggtttctataagcaaaatc

SEQ ID NO: 790232 - DNA, 25 bp, Mus musculus
tatggtgtaactcaccttactgaga

SEQ ID NO: 790233 - DNA, 25 bp, Mus musculus
tatggtgtaactcgatcccgctcgg

SEQ ID NO: 790234 - DNA, 25 bp, Mus musculus
tatggtgtaactgaccttactgaga

SEQ ID NO: 790235 - DNA, 25 bp, Mus musculus
tatggtgtaactggatcccgctcgg

SEQ ID NO: 790236 - DNA, 25 bp, Mus musculus
tatggtgtcagtataagtggatggt

SEQ ID NO: 790237 - DNA, 25 bp, Mus musculus
tatggtgtcagtttaagtggatggt

SEQ ID NO: 790238 - DNA, 25 bp, Mus musculus
tatggtgtcatgagtggcccagcta

SEQ ID NO: 790239 - DNA, 25 bp, Mus musculus
tatggtgtcatgtgtggcccagcta

SEQ ID NO: 790240 - DNA, 25 bp, Mus musculus
tatggtgtccgtctacaatgtgcat

SEQ ID NO: 790241 - DNA, 25 bp, Mus musculus
tatggtgtccgtgtacaatgtgcat

SEQ ID NO: 790242 - DNA, 25 bp, Mus musculus
tatggtgtccttacaattgctctca

SEQ ID NO: 790243 - DNA, 25 bp, Mus musculus
tatggtgtcctttcaattgctctca

SEQ ID NO: 790244 - DNA, 25 bp, Mus musculus
tatggtgtctgaaacttgggaaagc

SEQ ID NO: 790245 - DNA, 25 bp, Mus musculus
tatggtgtctgatacttgggaaagc

SEQ ID NO: 790246 - DNA, 25 bp, Mus musculus
tatggtgtgcggaaaaaaccattcc

SEQ ID NO: 790247 - DNA, 25 bp, Mus musculus
tatggtgtgcggtaaaaaccattcc

SEQ ID NO: 790248 - DNA, 25 bp, Mus musculus
tatggtgtggtaattttgtatcttg

SEQ ID NO: 790249 - DNA, 25 bp, Mus musculus
tatggtgtggtatttttgtatcttg

SEQ ID NO: 790250 - DNA, 25 bp, Mus musculus
tatggtgtggttagagttctgcagt

SEQ ID NO: 790251 - DNA, 25 bp, Mus musculus
tatggtgtggtttgagttctgcagt

SEQ ID NO: 790252 - DNA, 25 bp, Mus musculus
tatggtgtgttcagcattgccgaat

SEQ ID NO: 790253 - DNA, 25 bp, Mus musculus
tatggtgtgttctgcattgccgaat

SEQ ID NO: 790254 - DNA, 25 bp, Mus musculus
tatggtgttcacagagacccttcct

SEQ ID NO: 790255 - DNA, 25 bp, Mus musculus
tatggtgttcacatcggtgcaggaa

SEQ ID NO: 790256 - DNA, 25 bp, Mus musculus
tatggtgttcactgagacccttcct

SEQ ID NO: 790257 - DNA, 25 bp, Mus musculus
tatggtgttcacttcggtgcaggaa

SEQ ID NO: 790258 - DNA, 25 bp, Mus musculus
tatggtgttgcacagcattcactac

SEQ ID NO: 790259 - DNA, 25 bp, Mus musculus
tatggtgttgcagagcattcactac

SEQ ID NO: 790260 - DNA, 25 bp, Mus musculus
tatggtgttgttatggtgaagccta

SEQ ID NO: 790261 - DNA, 25 bp, Mus musculus
tatggtgttgttttggtgaagccta

SEQ ID NO: 790262 - DNA, 25 bp, Mus musculus
tatggttaacctcgataaactaaag

SEQ ID NO: 790263 - DNA, 25 bp, Mus musculus
tatggttaacctggataaactaaag

SEQ ID NO: 790264 - DNA, 25 bp, Mus musculus
tatggttaacttctcgcctttgtct

SEQ ID NO: 790265 - DNA, 25 bp, Mus musculus
tatggttaacttgtcgcctttgtct

SEQ ID NO: 790266 - DNA, 25 bp, Mus musculus
tatggttacaaacggctgctgctgc

SEQ ID NO: 790267 - DNA, 25 bp, Mus musculus
tatggttacaaagggctgctgctgc

SEQ ID NO: 790268 - DNA, 25 bp, Mus musculus
tatggttacagaactgatttgtcac

SEQ ID NO: 790269 - DNA, 25 bp, Mus musculus
tatggttacagatctgatttgtcac

SEQ ID NO: 790270 - DNA, 25 bp, Mus musculus
tatggttacattccccagcaaacac

SEQ ID NO: 790271 - DNA, 25 bp, Mus musculus
tatggttacattgcccagcaaacac

SEQ ID NO: 790272 - DNA, 25 bp, Mus musculus
tatggttaccagcaacagggtctcc

SEQ ID NO: 790273 - DNA, 25 bp, Mus musculus
tatggttaccaggaacagggtctcc

SEQ ID NO: 790274 - DNA, 25 bp, Mus musculus
tatggttatcctagtgcaaaaattc

SEQ ID NO: 790275 - DNA, 25 bp, Mus musculus
tatggttatccttgtgcaaaaattc

SEQ ID NO: 790276 - DNA, 25 bp, Mus musculus
tatggttattttccgacagagtttc

SEQ ID NO: 790277 - DNA, 25 bp, Mus musculus
tatggttattttgcgacagagtttc

SEQ ID NO: 790278 - DNA, 25 bp, Mus musculus
tatggttcaagcagttggcccagaa

SEQ ID NO: 790279 - DNA, 25 bp, Mus musculus
tatggttcaagctgttggcccagaa

SEQ ID NO: 790280 - DNA, 25 bp, Mus musculus
tatggttcacatagtcaggaggcag

SEQ ID NO: 790281 - DNA, 25 bp, Mus musculus
tatggttcacattgtcaggaggcag

SEQ ID NO: 790282 - DNA, 25 bp, Mus musculus
tatggttcactgcagtcccaagtcg

SEQ ID NO: 790283 - DNA, 25 bp, Mus musculus
tatggttcactgctttgtcaccttt

SEQ ID NO: 790284 - DNA, 25 bp, Mus musculus
tatggttcactggagtcccaagtcg

SEQ ID NO: 790285 - DNA, 25 bp, Mus musculus
tatggttcactggtttgtcaccttt

SEQ ID NO: 790286 - DNA, 25 bp, Mus musculus
tatggttcacttccgagattttcat

SEQ ID NO: 790287 - DNA, 25 bp, Mus musculus
tatggttcacttgcgagattttcat

SEQ ID NO: 790288 - DNA, 25 bp, Mus musculus
tatggttcagtgactctggcataat

SEQ ID NO: 790289 - DNA, 25 bp, Mus musculus
tatggttcagtgtctctggcataat

SEQ ID NO: 790290 - DNA, 25 bp, Mus musculus
tatggttctccaactatcttgagtt

SEQ ID NO: 790291 - DNA, 25 bp, Mus musculus
tatggttctccatctatcttgagtt

SEQ ID NO: 790292 - DNA, 25 bp, Mus musculus
tatggttctgtgatgtgtctttgtt

SEQ ID NO: 790293 - DNA, 25 bp, Mus musculus
tatggttctgtgttgtgtctttgtt

SEQ ID NO: 790294 - DNA, 25 bp, Mus musculus
tatggttctgttccactattagaag

SEQ ID NO: 790295 - DNA, 25 bp, Mus musculus
tatggttctgttgcactattagaag

SEQ ID NO: 790296 - DNA, 25 bp, Mus musculus
tatggttgaaatacctgtgcaaaga

SEQ ID NO: 790297 - DNA, 25 bp, Mus musculus
tatggttgaaattcctgtgcaaaga

SEQ ID NO: 790298 - DNA, 25 bp, Mus musculus
tatggttgatacaatgtgtctgaac

SEQ ID NO: 790299 - DNA, 25 bp, Mus musculus
tatggttgatactatgtgtctgaac

SEQ ID NO: 790300 - DNA, 25 bp, Mus musculus
tatggttgccaaactatccttacct

SEQ ID NO: 790301 - DNA, 25 bp, Mus musculus
tatggttgccaactatgtcccctgt

SEQ ID NO: 790302 - DNA, 25 bp, Mus musculus
tatggttgccaagtatgtcccctgt

SEQ ID NO: 790303 - DNA, 25 bp, Mus musculus
tatggttgccaatctatccttacct

SEQ ID NO: 790304 - DNA, 25 bp, Mus musculus
tatggttgggctagtgagccatgtt

SEQ ID NO: 790305 - DNA, 25 bp, Mus musculus
tatggttgggcttgtgagccatgtt

SEQ ID NO: 790306 - DNA, 25 bp, Mus musculus
tatggttggtcacttcacacatccc

SEQ ID NO: 790307 - DNA, 25 bp, Mus musculus
tatggttggtcagttcacacatccc

SEQ ID NO: 790308 - DNA, 25 bp, Mus musculus
tatggttggtggctctttcctgtca

SEQ ID NO: 790309 - DNA, 25 bp, Mus musculus
tatggttggtgggtctttcctgtca

SEQ ID NO: 790310 - DNA, 25 bp, Mus musculus
tatggttggtgtatgcatgggcaaa

SEQ ID NO: 790311 - DNA, 25 bp, Mus musculus
tatggttggtgtttgcatgggcaaa

SEQ ID NO: 790312 - DNA, 25 bp, Mus musculus
tatggttgtcccaactgactacagc

SEQ ID NO: 790313 - DNA, 25 bp, Mus musculus
tatggttgtccctactgactacagc

SEQ ID NO: 790314 - DNA, 25 bp, Mus musculus
tatggtttattcattaatgcctttt

SEQ ID NO: 790315 - DNA, 25 bp, Mus musculus
tatggtttattctttaatgcctttt

SEQ ID NO: 790316 - DNA, 25 bp, Mus musculus
tatggtttcaaacggttcaggacat

SEQ ID NO: 790317 - DNA, 25 bp, Mus musculus
tatggtttcaaagggttcaggacat

SEQ ID NO: 790318 - DNA, 25 bp, Mus musculus
tatggtttcatcacctaccgttaca

SEQ ID NO: 790319 - DNA, 25 bp, Mus musculus
tatggtttcatctcctaccgttaca

SEQ ID NO: 790320 - DNA, 25 bp, Mus musculus
tatggtttcctacggagtcttaaat

SEQ ID NO: 790321 - DNA, 25 bp, Mus musculus
tatggtttcctagggagtcttaaat

SEQ ID NO: 790322 - DNA, 25 bp, Mus musculus
tatggtttcggtaatgtctcttttc

SEQ ID NO: 790323 - DNA, 25 bp, Mus musculus
tatggtttcggttatgtctcttttc

SEQ ID NO: 790324 - DNA, 25 bp, Mus musculus
tatggtttgcaactcacccctcatc

SEQ ID NO: 790325 - DNA, 25 bp, Mus musculus
tatggtttgcaagtcacccctcatc

SEQ ID NO: 790326 - DNA, 25 bp, Mus musculus
tatggtttgcacaggaggcagagca

SEQ ID NO: 790327 - DNA, 25 bp, Mus musculus
tatggtttgcactggaggcagagca

SEQ ID NO: 790328 - DNA, 25 bp, Mus musculus
tatggtttggaaatgcttgtcagac

SEQ ID NO: 790329 - DNA, 25 bp, Mus musculus
tatggtttggaattgcttgtcagac

SEQ ID NO: 790330 - DNA, 25 bp, Mus musculus
tatggtttggccagatctttgcagc

SEQ ID NO: 790331 - DNA, 25 bp, Mus musculus
tatggtttggcctgatctttgcagc

SEQ ID NO: 790332 - DNA, 25 bp, Mus musculus
tatggtttgtcgcagtagtcacact

SEQ ID NO: 790333 - DNA, 25 bp, Mus musculus
tatggtttgtcggagtagtcacact

SEQ ID NO: 790334 - DNA, 25 bp, Mus musculus
tatggttttagaaagctgctgtgtc

SEQ ID NO: 790335 - DNA, 25 bp, Mus musculus
tatggttttagatagctgctgtgtc

SEQ ID NO: 790336 - DNA, 25 bp, Mus musculus
tatggttttgttcgcccatgttacc

SEQ ID NO: 790337 - DNA, 25 bp, Mus musculus
tatggttttgttggcccatgttacc

SEQ ID NO: 790338 - DNA, 25 bp, Mus musculus
tatggtttttacaggctctgtgggc

SEQ ID NO: 790339 - DNA, 25 bp, Mus musculus
tatggtttttactggctctgtgggc

SEQ ID NO: 790340 - DNA, 25 bp, Mus musculus
tatggtttttagctggtttccttat

SEQ ID NO: 790341 - DNA, 25 bp, Mus musculus
tatggtttttaggtggtttccttat

SEQ ID NO: 790342 - DNA, 25 bp, Mus musculus
tatggtttttcacgcttctctgaga

SEQ ID NO: 790343 - DNA, 25 bp, Mus musculus
tatggtttttcaggcttctctgaga

SEQ ID NO: 790344 - DNA, 25 bp, Mus musculus
tatgtaaaccacacaggctgctttg

SEQ ID NO: 790345 - DNA, 25 bp, Mus musculus
tatgtaaaccactcaggctgctttg

SEQ ID NO: 790346 - DNA, 25 bp, Mus musculus
tatgtaaacggcatcctaagctttt

SEQ ID NO: 790347 - DNA, 25 bp, Mus musculus
tatgtaaacggcttcctaagctttt

SEQ ID NO: 790348 - DNA, 25 bp, Mus musculus
tatgtaaactggatccaccaccaca

SEQ ID NO: 790349 - DNA, 25 bp, Mus musculus
tatgtaaactggttccaccaccaca

SEQ ID NO: 790350 - DNA, 25 bp, Mus musculus
tatgtaaactttccctaagcactgg

SEQ ID NO: 790351 - DNA, 25 bp, Mus musculus
tatgtaaactttgcctaagcactgg

SEQ ID NO: 790352 - DNA, 25 bp, Mus musculus
tatgtaaagccccatcctgactcaa

SEQ ID NO: 790353 - DNA, 25 bp, Mus musculus
tatgtaaagcccgatcctgactcaa

SEQ ID NO: 790354 - DNA, 25 bp, Mus musculus
tatgtaaaggacaacccatgataac

SEQ ID NO: 790355 - DNA, 25 bp, Mus musculus
tatgtaaaggactacccatgataac

SEQ ID NO: 790356 - DNA, 25 bp, Mus musculus
tatgtaaagggcacttcccactttc

SEQ ID NO: 790357 - DNA, 25 bp, Mus musculus
tatgtaaagggctcttcccactttc

SEQ ID NO: 790358 - DNA, 25 bp, Mus musculus
tatgtaaagtttctatctctcagac

SEQ ID NO: 790359 - DNA, 25 bp, Mus musculus
tatgtaaagtttgtatctctcagac

SEQ ID NO: 790360 - DNA, 25 bp, Mus musculus
tatgtaacccttcagaaaaccactt

SEQ ID NO: 790361 - DNA, 25 bp, Mus musculus
tatgtaacccttgagaaaaccactt

SEQ ID NO: 790362 - DNA, 25 bp, Mus musculus
tatgtaaccgagacagctctagcga

SEQ ID NO: 790363 - DNA, 25 bp, Mus musculus
tatgtaaccgagtcagctctagcga

SEQ ID NO: 790364 - DNA, 25 bp, Mus musculus
tatgtaacctggagtgtgcttttcc

SEQ ID NO: 790365 - DNA, 25 bp, Mus musculus
tatgtaacctggtgtgtgcttttcc

SEQ ID NO: 790366 - DNA, 25 bp, Mus musculus
tatgtaaccttaatcccatccagtt

SEQ ID NO: 790367 - DNA, 25 bp, Mus musculus
tatgtaaccttattcccatccagtt

SEQ ID NO: 790368 - DNA, 25 bp, Mus musculus
tatgtaacttttaacccctctacag

SEQ ID NO: 790369 - DNA, 25 bp, Mus musculus
tatgtaactttttacccctctacag

SEQ ID NO: 790370 - DNA, 25 bp, Mus musculus
tatgtaaggacgaagccagtgactt

SEQ ID NO: 790371 - DNA, 25 bp, Mus musculus
tatgtaaggacgtagccagtgactt

SEQ ID NO: 790372 - DNA, 25 bp, Mus musculus
tatgtaagtggcacaaaccatggat

SEQ ID NO: 790373 - DNA, 25 bp, Mus musculus
tatgtaagtggctcaaaccatggat

SEQ ID NO: 790374 - DNA, 25 bp, Mus musculus
tatgtaagttccctgtgtacagaca

SEQ ID NO: 790375 - DNA, 25 bp, Mus musculus
tatgtaagttccgtgtgtacagaca

SEQ ID NO: 790376 - DNA, 25 bp, Mus musculus
tatgtaatatccctagctggcctgg

SEQ ID NO: 790377 - DNA, 25 bp, Mus musculus
tatgtaatatccgtagctggcctgg

SEQ ID NO: 790378 - DNA, 25 bp, Mus musculus
tatgtaatcaacaaggaaccagaat

SEQ ID NO: 790379 - DNA, 25 bp, Mus musculus
tatgtaatcaactaggaaccagaat

SEQ ID NO: 790380 - DNA, 25 bp, Mus musculus
tatgtaatcagccttcttcgaggct

SEQ ID NO: 790381 - DNA, 25 bp, Mus musculus
tatgtaatcagcgttcttcgaggct

SEQ ID NO: 790382 - DNA, 25 bp, Mus musculus
tatgtaatgggtctgctctgctcca

SEQ ID NO: 790383 - DNA, 25 bp, Mus musculus
tatgtaatgggtgtgctctgctcca

SEQ ID NO: 790384 - DNA, 25 bp, Mus musculus
tatgtaattcttacgcagatgggat

SEQ ID NO: 790385 - DNA, 25 bp, Mus musculus
tatgtaattctttcgcagatgggat

SEQ ID NO: 790386 - DNA, 25 bp, Mus musculus
tatgtaattgcaatccggccagtta

SEQ ID NO: 790387 - DNA, 25 bp, Mus musculus
tatgtaattgcattccggccagtta

SEQ ID NO: 790388 - DNA, 25 bp, Mus musculus
tatgtacaaaaaccctctgttcctt

SEQ ID NO: 790389 - DNA, 25 bp, Mus musculus
tatgtacaaaaagcctctgttcctt

SEQ ID NO: 790390 - DNA, 25 bp, Mus musculus
tatgtacaaagtagtcctggccaga

SEQ ID NO: 790391 - DNA, 25 bp, Mus musculus
tatgtacaaagttgtcctggccaga

SEQ ID NO: 790392 - DNA, 25 bp, Mus musculus
tatgtacaaatcctctctccgataa

SEQ ID NO: 790393 - DNA, 25 bp, Mus musculus
tatgtacaaatcgtctctccgataa

SEQ ID NO: 790394 - DNA, 25 bp, Mus musculus
tatgtacaacttacagctcctgtga

SEQ ID NO: 790395 - DNA, 25 bp, Mus musculus
tatgtacaactttcagctcctgtga

SEQ ID NO: 790396 - DNA, 25 bp, Mus musculus
tatgtacaggaaacgccgtcctttc

SEQ ID NO: 790397 - DNA, 25 bp, Mus musculus
tatgtacaggaatcgccgtcctttc

SEQ ID NO: 790398 - DNA, 25 bp, Mus musculus
tatgtacaggtgatcttcactctga

SEQ ID NO: 790399 - DNA, 25 bp, Mus musculus
tatgtacaggtgttcttcactctga

SEQ ID NO: 790400 - DNA, 25 bp, Mus musculus
tatgtacatagtatctgtcttcaga

SEQ ID NO: 790401 - DNA, 25 bp, Mus musculus
tatgtacatagtttctgtcttcaga

SEQ ID NO: 790402 - DNA, 25 bp, Mus musculus
tatgtacatcagacctcccacggga

SEQ ID NO: 790403 - DNA, 25 bp, Mus musculus
tatgtacatcagtcctcccacggga

SEQ ID NO: 790404 - DNA, 25 bp, Mus musculus
tatgtacatgccctcagtcctctgg

SEQ ID NO: 790405 - DNA, 25 bp, Mus musculus
tatgtacatgccgtcagtcctctgg

SEQ ID NO: 790406 - DNA, 25 bp, Mus musculus
tatgtaccacacatgtgtacctcct

SEQ ID NO: 790407 - DNA, 25 bp, Mus musculus
tatgtaccacacttgtgtacctcct

SEQ ID NO: 790408 - DNA, 25 bp, Mus musculus
tatgtaccagatcccagagatgccc

SEQ ID NO: 790409 - DNA, 25 bp, Mus musculus
tatgtaccagatgccagagatgccc

SEQ ID NO: 790410 - DNA, 25 bp, Mus musculus
tatgtaccagcacatcctcaaaact

SEQ ID NO: 790411 - DNA, 25 bp, Mus musculus
tatgtaccagcagatcctcaaaact

SEQ ID NO: 790412 - DNA, 25 bp, Mus musculus
tatgtaccaggtctggccagagctt

SEQ ID NO: 790413 - DNA, 25 bp, Mus musculus
tatgtaccaggtgtggccagagctt

SEQ ID NO: 790414 - DNA, 25 bp, Mus musculus
tatgtaccatatccactacactggt

SEQ ID NO: 790415 - DNA, 25 bp, Mus musculus
tatgtaccatatgcactacactggt

SEQ ID NO: 790416 - DNA, 25 bp, Mus musculus
tatgtaccctcaaagttgcaggaag

SEQ ID NO: 790417 - DNA, 25 bp, Mus musculus
tatgtaccctcatagttgcaggaag

SEQ ID NO: 790418 - DNA, 25 bp, Mus musculus
tatgtacccttacggcctaccagga

SEQ ID NO: 790419 - DNA, 25 bp, Mus musculus
tatgtacccttagggcctaccagga

SEQ ID NO: 790420 - DNA, 25 bp, Mus musculus
tatgtaccggtcagactcaggctgt

SEQ ID NO: 790421 - DNA, 25 bp, Mus musculus
tatgtaccggtctgactcaggctgt

SEQ ID NO: 790422 - DNA, 25 bp, Mus musculus
tatgtacctgccagaaccaggagag

SEQ ID NO: 790423 - DNA, 25 bp, Mus musculus
tatgtacctgcctgaaccaggagag

SEQ ID NO: 790424 - DNA, 25 bp, Mus musculus
tatgtacctgtgattcccttttgag

SEQ ID NO: 790425 - DNA, 25 bp, Mus musculus
tatgtacctgtgtttcccttttgag

SEQ ID NO: 790426 - DNA, 25 bp, Mus musculus
tatgtacctgttaccactttcaaaa

SEQ ID NO: 790427 - DNA, 25 bp, Mus musculus
tatgtacctgtttccactttcaaaa

SEQ ID NO: 790428 - DNA, 25 bp, Mus musculus
tatgtacgtgacctatgcactctgc

SEQ ID NO: 790429 - DNA, 25 bp, Mus musculus
tatgtacgtgacgtatgcactctgc

SEQ ID NO: 790430 - DNA, 25 bp, Mus musculus
tatgtacgtgccagtgccaaagcca

SEQ ID NO: 790431 - DNA, 25 bp, Mus musculus
tatgtacgtgcctgtgccaaagcca

SEQ ID NO: 790432 - DNA, 25 bp, Mus musculus
tatgtactaatcagagttgtctcca

SEQ ID NO: 790433 - DNA, 25 bp, Mus musculus
tatgtactaatctgagttgtctcca

SEQ ID NO: 790434 - DNA, 25 bp, Mus musculus
tatgtactaccaagggctctgtgtg

SEQ ID NO: 790435 - DNA, 25 bp, Mus musculus
tatgtactaccatgggctctgtgtg

SEQ ID NO: 790436 - DNA, 25 bp, Mus musculus
tatgtactagcaaatatacccacag

SEQ ID NO: 790437 - DNA, 25 bp, Mus musculus
tatgtactagcatatatacccacag

SEQ ID NO: 790438 - DNA, 25 bp, Mus musculus
tatgtactatacatgatggatacag

SEQ ID NO: 790439 - DNA, 25 bp, Mus musculus
tatgtactatacttgatggatacag

SEQ ID NO: 790440 - DNA, 25 bp, Mus musculus
tatgtactatggcaggaccgtgtgc

SEQ ID NO: 790441 - DNA, 25 bp, Mus musculus
tatgtactatgggaggaccgtgtgc

SEQ ID NO: 790442 - DNA, 25 bp, Mus musculus
tatgtactcgctcatagtaggagct

SEQ ID NO: 790443 - DNA, 25 bp, Mus musculus
tatgtactcgctgatagtaggagct

SEQ ID NO: 790444 - DNA, 25 bp, Mus musculus
tatgtactgagcaccatacaactaa

SEQ ID NO: 790445 - DNA, 25 bp, Mus musculus
tatgtactgagctccatacaactaa

SEQ ID NO: 790446 - DNA, 25 bp, Mus musculus
tatgtactgcaacaggctgctgatg

SEQ ID NO: 790447 - DNA, 25 bp, Mus musculus
tatgtactgcaagaggctgctgatg

SEQ ID NO: 790448 - DNA, 25 bp, Mus musculus
tatgtactggtaaaaacagagcgct

SEQ ID NO: 790449 - DNA, 25 bp, Mus musculus
tatgtactggtataaacagagcgct

SEQ ID NO: 790450 - DNA, 25 bp, Mus musculus
tatgtacttaacatccacggccgtg

SEQ ID NO: 790451 - DNA, 25 bp, Mus musculus
tatgtacttaacttccacggccgtg

SEQ ID NO: 790452 - DNA, 25 bp, Mus musculus
tatgtagaccttccctgcacttggc

SEQ ID NO: 790453 - DNA, 25 bp, Mus musculus
tatgtagaccttgcctgcacttggc

SEQ ID NO: 790454 - DNA, 25 bp, Mus musculus
tatgtagactcacccagccttgaac

SEQ ID NO: 790455 - DNA, 25 bp, Mus musculus
tatgtagactcagccagccttgaac

SEQ ID NO: 790456 - DNA, 25 bp, Mus musculus
tatgtagagcaaccacaactgtaac

SEQ ID NO: 790457 - DNA, 25 bp, Mus musculus
tatgtagagcaagcacaactgtaac

SEQ ID NO: 790458 - DNA, 25 bp, Mus musculus
tatgtagcagagattatgcctggga

SEQ ID NO: 790459 - DNA, 25 bp, Mus musculus
tatgtagcagagtttatgcctggga

SEQ ID NO: 790460 - DNA, 25 bp, Mus musculus
tatgtagcccaaagaaggtttccgt

SEQ ID NO: 790461 - DNA, 25 bp, Mus musculus
tatgtagcccaatgaaggtttccgt

SEQ ID NO: 790462 - DNA, 25 bp, Mus musculus
tatgtagccctgagttgccagtaac

SEQ ID NO: 790463 - DNA, 25 bp, Mus musculus
tatgtagccctgtgttgccagtaac

SEQ ID NO: 790464 - DNA, 25 bp, Mus musculus
tatgtagctggcactgatgtcccta

SEQ ID NO: 790465 - DNA, 25 bp, Mus musculus
tatgtagctggctctgatgtcccta

SEQ ID NO: 790466 - DNA, 25 bp, Mus musculus
tatgtagctgggagtgacagagact

SEQ ID NO: 790467 - DNA, 25 bp, Mus musculus
tatgtagctgggtgtgacagagact

SEQ ID NO: 790468 - DNA, 25 bp, Mus musculus
tatgtagctttcagggctttgggca

SEQ ID NO: 790469 - DNA, 25 bp, Mus musculus
tatgtagctttctgggctttgggca

SEQ ID NO: 790470 - DNA, 25 bp, Mus musculus
tatgtaggcgaaaccagcatcggta

SEQ ID NO: 790471 - DNA, 25 bp, Mus musculus
tatgtaggcgaatccagcatcggta

SEQ ID NO: 790472 - DNA, 25 bp, Mus musculus
tatgtaggcgagactggcctcaaac

SEQ ID NO: 790473 - DNA, 25 bp, Mus musculus
tatgtaggcgagtctggcctcaaac

SEQ ID NO: 790474 - DNA, 25 bp, Mus musculus
tatgtaggtctgactgttctgaaac

SEQ ID NO: 790475 - DNA, 25 bp, Mus musculus
tatgtaggtctgtctgttctgaaac

SEQ ID NO: 790476 - DNA, 25 bp, Mus musculus
tatgtaggtggcacacagggagacc

SEQ ID NO: 790477 - DNA, 25 bp, Mus musculus
tatgtaggtggctcacagggagacc

SEQ ID NO: 790478 - DNA, 25 bp, Mus musculus
tatgtagtatgtccatggactcttt

SEQ ID NO: 790479 - DNA, 25 bp, Mus musculus
tatgtagtatgtgcatggactcttt

SEQ ID NO: 790480 - DNA, 25 bp, Mus musculus
tatgtagtccaacctagcctcctgc

SEQ ID NO: 790481 - DNA, 25 bp, Mus musculus
tatgtagtccaagctagcctcctgc

SEQ ID NO: 790482 - DNA, 25 bp, Mus musculus
tatgtagtgcttatgacgccaaggc

SEQ ID NO: 790483 - DNA, 25 bp, Mus musculus
tatgtagtgcttttgacgccaaggc

SEQ ID NO: 790484 - DNA, 25 bp, Mus musculus
tatgtagtgtaaacgagccaccctt

SEQ ID NO: 790485 - DNA, 25 bp, Mus musculus
tatgtagtgtaatcgagccaccctt

SEQ ID NO: 790486 - DNA, 25 bp, Mus musculus
tatgtagttagtatgcctgcctgtc

SEQ ID NO: 790487 - DNA, 25 bp, Mus musculus
tatgtagttagtttgcctgcctgtc

SEQ ID NO: 790488 - DNA, 25 bp, Mus musculus
tatgtataccccaacatcttttcca

SEQ ID NO: 790489 - DNA, 25 bp, Mus musculus
tatgtatacccctacatcttttcca

SEQ ID NO: 790490 - DNA, 25 bp, Mus musculus
tatgtataccggcacccgtgtaact

SEQ ID NO: 790491 - DNA, 25 bp, Mus musculus
tatgtataccgggacccgtgtaact

SEQ ID NO: 790492 - DNA, 25 bp, Mus musculus
tatgtataggaaaagcctgctgcat

SEQ ID NO: 790493 - DNA, 25 bp, Mus musculus
tatgtataggaatagcctgctgcat

SEQ ID NO: 790494 - DNA, 25 bp, Mus musculus
tatgtatatactagtctgtgcagaa

SEQ ID NO: 790495 - DNA, 25 bp, Mus musculus
tatgtatatacttgtctgtgcagaa

SEQ ID NO: 790496 - DNA, 25 bp, Mus musculus
tatgtatatttcattttaggcaaac

SEQ ID NO: 790497 - DNA, 25 bp, Mus musculus
tatgtatatttctttttaggcaaac

SEQ ID NO: 790498 - DNA, 25 bp, Mus musculus
tatgtatcaatcagtctttcctctg

SEQ ID NO: 790499 - DNA, 25 bp, Mus musculus
tatgtatcaatctgtctttcctctg

SEQ ID NO: 790500 - DNA, 25 bp, Mus musculus
tatgtatcaggtaaggcccaagagt

SEQ ID NO: 790501 - DNA, 25 bp, Mus musculus
tatgtatcaggttaggcccaagagt

SEQ ID NO: 790502 - DNA, 25 bp, Mus musculus
tatgtatcagtgacgtcccacagtg

SEQ ID NO: 790503 - DNA, 25 bp, Mus musculus
tatgtatcagtgtcgtcccacagtg

SEQ ID NO: 790504 - DNA, 25 bp, Mus musculus
tatgtatcatagatctctccgttgc

SEQ ID NO: 790505 - DNA, 25 bp, Mus musculus
tatgtatcatagttctctccgttgc

SEQ ID NO: 790506 - DNA, 25 bp, Mus musculus
tatgtatcatgtattctatgtaagc

SEQ ID NO: 790507 - DNA, 25 bp, Mus musculus
tatgtatcatgttttctatgtaagc

SEQ ID NO: 790508 - DNA, 25 bp, Mus musculus
tatgtatcctttatgaagtgagtgg

SEQ ID NO: 790509 - DNA, 25 bp, Mus musculus
tatgtatcctttttgaagtgagtgg

SEQ ID NO: 790510 - DNA, 25 bp, Mus musculus
tatgtatctagcagttgccggccag

SEQ ID NO: 790511 - DNA, 25 bp, Mus musculus
tatgtatctagctgttgccggccag

SEQ ID NO: 790512 - DNA, 25 bp, Mus musculus
tatgtatgccacagtgcagggtggt

SEQ ID NO: 790513 - DNA, 25 bp, Mus musculus
tatgtatgccactgtgcagggtggt

SEQ ID NO: 790514 - DNA, 25 bp, Mus musculus
tatgtatggccccagactcatgggt

SEQ ID NO: 790515 - DNA, 25 bp, Mus musculus
tatgtatggcccgagactcatgggt

SEQ ID NO: 790516 - DNA, 25 bp, Mus musculus
tatgtatgtacaacctttatctcaa

SEQ ID NO: 790517 - DNA, 25 bp, Mus musculus
tatgtatgtacatcctttatctcaa

SEQ ID NO: 790518 - DNA, 25 bp, Mus musculus
tatgtatgtgcgcacatgtctcctc

SEQ ID NO: 790519 - DNA, 25 bp, Mus musculus
tatgtatgtgcggacatgtctcctc

SEQ ID NO: 790520 - DNA, 25 bp, Mus musculus
tatgtatgtgtgatagtaatcttca

SEQ ID NO: 790521 - DNA, 25 bp, Mus musculus
tatgtatgtgtgttagtaatcttca

SEQ ID NO: 790522 - DNA, 25 bp, Mus musculus
tatgtattcacaactggcaacttta

SEQ ID NO: 790523 - DNA, 25 bp, Mus musculus
tatgtattcacatctggcaacttta

SEQ ID NO: 790524 - DNA, 25 bp, Mus musculus
tatgtattctaacactgatgctaat

SEQ ID NO: 790525 - DNA, 25 bp, Mus musculus
tatgtattctaagactgatgctaat

SEQ ID NO: 790526 - DNA, 25 bp, Mus musculus
tatgtattctcaatctcatattcac

SEQ ID NO: 790527 - DNA, 25 bp, Mus musculus
tatgtattctcattctcatattcac

SEQ ID NO: 790528 - DNA, 25 bp, Mus musculus
tatgtattctcgactggcctcagac

SEQ ID NO: 790529 - DNA, 25 bp, Mus musculus
tatgtattctcgtctggcctcagac

SEQ ID NO: 790530 - DNA, 25 bp, Mus musculus
tatgtattgaccctgggtcgggcca

SEQ ID NO: 790531 - DNA, 25 bp, Mus musculus
tatgtattgaccgtgggtcgggcca

SEQ ID NO: 790532 - DNA, 25 bp, Mus musculus
tatgtattgaggacgaggccagtct

SEQ ID NO: 790533 - DNA, 25 bp, Mus musculus
tatgtattgaggtcgaggccagtct

SEQ ID NO: 790534 - DNA, 25 bp, Mus musculus
tatgtatttaaccagggaccgtcgg

SEQ ID NO: 790535 - DNA, 25 bp, Mus musculus
tatgtatttaacgagggaccgtcgg

SEQ ID NO: 790536 - DNA, 25 bp, Mus musculus
tatgtatttaggacagtccccagaa

SEQ ID NO: 790537 - DNA, 25 bp, Mus musculus
tatgtatttaggtcagtccccagaa

SEQ ID NO: 790538 - DNA, 25 bp, Mus musculus
tatgtatttataagctgtacctaac

SEQ ID NO: 790539 - DNA, 25 bp, Mus musculus
tatgtatttatatgctgtacctaac

SEQ ID NO: 790540 - DNA, 25 bp, Mus musculus
tatgtatttatgaccctgctgattc

SEQ ID NO: 790541 - DNA, 25 bp, Mus musculus
tatgtatttatgtccctgctgattc

SEQ ID NO: 790542 - DNA, 25 bp, Mus musculus
tatgtatttcagattgatgacctct

SEQ ID NO: 790543 - DNA, 25 bp, Mus musculus
tatgtatttcagtttgatgacctct

SEQ ID NO: 790544 - DNA, 25 bp, Mus musculus
tatgtatttctcacccaactactag

SEQ ID NO: 790545 - DNA, 25 bp, Mus musculus
tatgtatttctctcccaactactag

SEQ ID NO: 790546 - DNA, 25 bp, Mus musculus
tatgtatttgatcttctggtaaaga

SEQ ID NO: 790547 - DNA, 25 bp, Mus musculus
tatgtatttgatgttctggtaaaga

SEQ ID NO: 790548 - DNA, 25 bp, Mus musculus
tatgtcaaaaacaacggcttgcggg

SEQ ID NO: 790549 - DNA, 25 bp, Mus musculus
tatgtcaaaaactacggcttgcggg

SEQ ID NO: 790550 - DNA, 25 bp, Mus musculus
tatgtcaaacatattcttcctcatg

SEQ ID NO: 790551 - DNA, 25 bp, Mus musculus
tatgtcaaacattttcttcctcatg

SEQ ID NO: 790552 - DNA, 25 bp, Mus musculus
tatgtcaaataaactagtacctccc

SEQ ID NO: 790553 - DNA, 25 bp, Mus musculus
tatgtcaaataatctagtacctccc

SEQ ID NO: 790554 - DNA, 25 bp, Mus musculus
tatgtcaacgcacatgccacttcca

SEQ ID NO: 790555 - DNA, 25 bp, Mus musculus
tatgtcaacgcagatgccacttcca

SEQ ID NO: 790556 - DNA, 25 bp, Mus musculus
tatgtcaacttaccacaggctaaag

SEQ ID NO: 790557 - DNA, 25 bp, Mus musculus
tatgtcaacttagcacaggctaaag

SEQ ID NO: 790558 - DNA, 25 bp, Mus musculus
tatgtcaaggccacagatcctctgg

SEQ ID NO: 790559 - DNA, 25 bp, Mus musculus
tatgtcaaggcctcagatcctctgg

SEQ ID NO: 790560 - DNA, 25 bp, Mus musculus
tatgtcaatcttattatgtcctttt

SEQ ID NO: 790561 - DNA, 25 bp, Mus musculus
tatgtcaatctttttatgtcctttt

SEQ ID NO: 790562 - DNA, 25 bp, Mus musculus
tatgtcacacatatggcagaggcgg

SEQ ID NO: 790563 - DNA, 25 bp, Mus musculus
tatgtcacacatttggcagaggcgg

SEQ ID NO: 790564 - DNA, 25 bp, Mus musculus
tatgtcaccaagaagcaacctttgc

SEQ ID NO: 790565 - DNA, 25 bp, Mus musculus
tatgtcaccaagtagcaacctttgc

SEQ ID NO: 790566 - DNA, 25 bp, Mus musculus
tatgtcacttagatcagccattgga

SEQ ID NO: 790567 - DNA, 25 bp, Mus musculus
tatgtcacttagttcagccattgga

SEQ ID NO: 790568 - DNA, 25 bp, Mus musculus
tatgtcagaatcataaaggccaact

SEQ ID NO: 790569 - DNA, 25 bp, Mus musculus
tatgtcagaatcttaaaggccaact

SEQ ID NO: 790570 - DNA, 25 bp, Mus musculus
tatgtcagacttaggtagtacctat

SEQ ID NO: 790571 - DNA, 25 bp, Mus musculus
tatgtcagactttggtagtacctat

SEQ ID NO: 790572 - DNA, 25 bp, Mus musculus
tatgtcagctctaaatacttttcag

SEQ ID NO: 790573 - DNA, 25 bp, Mus musculus
tatgtcagctcttaatacttttcag

SEQ ID NO: 790574 - DNA, 25 bp, Mus musculus
tatgtcagtcatatcaccaaaggct

SEQ ID NO: 790575 - DNA, 25 bp, Mus musculus
tatgtcagtcatttcaccaaaggct

SEQ ID NO: 790576 - DNA, 25 bp, Mus musculus
tatgtcatactaacgggctgtgggc

SEQ ID NO: 790577 - DNA, 25 bp, Mus musculus
tatgtcatactatcgggctgtgggc

SEQ ID NO: 790578 - DNA, 25 bp, Mus musculus
tatgtcatagcacgctgtcttcttc

SEQ ID NO: 790579 - DNA, 25 bp, Mus musculus
tatgtcatagcaggctgtcttcttc

SEQ ID NO: 790580 - DNA, 25 bp, Mus musculus
tatgtcatatctcatttgttgtctg

SEQ ID NO: 790581 - DNA, 25 bp, Mus musculus
tatgtcatatctgatttgttgtctg

SEQ ID NO: 790582 - DNA, 25 bp, Mus musculus
tatgtcatattcactgtgtgctctc

SEQ ID NO: 790583 - DNA, 25 bp, Mus musculus
tatgtcatattctctgtgtgctctc

SEQ ID NO: 790584 - DNA, 25 bp, Mus musculus
tatgtcatctgaatcgagccagccc

SEQ ID NO: 790585 - DNA, 25 bp, Mus musculus
tatgtcatctgattcgagccagccc

SEQ ID NO: 790586 - DNA, 25 bp, Mus musculus
tatgtcatctgccagtcaggcctat

SEQ ID NO: 790587 - DNA, 25 bp, Mus musculus
tatgtcatctgcgagtcaggcctat

SEQ ID NO: 790588 - DNA, 25 bp, Mus musculus
tatgtcatgatgaagctctcctgga

SEQ ID NO: 790589 - DNA, 25 bp, Mus musculus
tatgtcatgatgtagctctcctgga

SEQ ID NO: 790590 - DNA, 25 bp, Mus musculus
tatgtcatgattcatacctctccca

SEQ ID NO: 790591 - DNA, 25 bp, Mus musculus
tatgtcatgattgatacctctccca

SEQ ID NO: 790592 - DNA, 25 bp, Mus musculus
tatgtcatggccatcacgctggacg

SEQ ID NO: 790593 - DNA, 25 bp, Mus musculus
tatgtcatggccttcacgctggacg

SEQ ID NO: 790594 - DNA, 25 bp, Mus musculus
tatgtcattgaaaaccaggcggccg

SEQ ID NO: 790595 - DNA, 25 bp, Mus musculus
tatgtcattgaataccaggcggccg

SEQ ID NO: 790596 - DNA, 25 bp, Mus musculus
tatgtcattttaaccaatgccgata

SEQ ID NO: 790597 - DNA, 25 bp, Mus musculus
tatgtcattttatccaatgccgata

SEQ ID NO: 790598 - DNA, 25 bp, Mus musculus
tatgtccaaactcggtcttcgacag

SEQ ID NO: 790599 - DNA, 25 bp, Mus musculus
tatgtccaaactgggtcttcgacag

SEQ ID NO: 790600 - DNA, 25 bp, Mus musculus
tatgtccaaatcaattttcctctga

SEQ ID NO: 790601 - DNA, 25 bp, Mus musculus
tatgtccaaatctattttcctctga

SEQ ID NO: 790602 - DNA, 25 bp, Mus musculus
tatgtccaagtaaccccagtctgct

SEQ ID NO: 790603 - DNA, 25 bp, Mus musculus
tatgtccaagtatccccagtctgct

SEQ ID NO: 790604 - DNA, 25 bp, Mus musculus
tatgtccaccccactaagggataga

SEQ ID NO: 790605 - DNA, 25 bp, Mus musculus
tatgtccacccctctaagggataga

SEQ ID NO: 790606 - DNA, 25 bp, Mus musculus
tatgtccacttcaggatcagcggag

SEQ ID NO: 790607 - DNA, 25 bp, Mus musculus
tatgtccacttctggatcagcggag

SEQ ID NO: 790608 - DNA, 25 bp, Mus musculus
tatgtccagcataagcagggtggct

SEQ ID NO: 790609 - DNA, 25 bp, Mus musculus
tatgtccagcattagcagggtggct

SEQ ID NO: 790610 - DNA, 25 bp, Mus musculus
tatgtccagggacctcaggcatggt

SEQ ID NO: 790611 - DNA, 25 bp, Mus musculus
tatgtccagggagctcaggcatggt

SEQ ID NO: 790612 - DNA, 25 bp, Mus musculus
tatgtccagtatcaggttccttatc

SEQ ID NO: 790613 - DNA, 25 bp, Mus musculus
tatgtccagtatgaggttccttatc

SEQ ID NO: 790614 - DNA, 25 bp, Mus musculus
tatgtccagtttagcattcctgacc

SEQ ID NO: 790615 - DNA, 25 bp, Mus musculus
tatgtccagttttgcattcctgacc

SEQ ID NO: 790616 - DNA, 25 bp, Mus musculus
tatgtccataatactagggcttgat

SEQ ID NO: 790617 - DNA, 25 bp, Mus musculus
tatgtccataattctagggcttgat

SEQ ID NO: 790618 - DNA, 25 bp, Mus musculus
tatgtccatcagaagatatccatgt

SEQ ID NO: 790619 - DNA, 25 bp, Mus musculus
tatgtccatcagtagatatccatgt

SEQ ID NO: 790620 - DNA, 25 bp, Mus musculus
tatgtccatgcacgttacgagctcc

SEQ ID NO: 790621 - DNA, 25 bp, Mus musculus
tatgtccatgcaggttacgagctcc

SEQ ID NO: 790622 - DNA, 25 bp, Mus musculus
tatgtccattgcatcagtacgtcct

SEQ ID NO: 790623 - DNA, 25 bp, Mus musculus
tatgtccattgcttcagtacgtcct

SEQ ID NO: 790624 - DNA, 25 bp, Mus musculus
tatgtccattggatatctgcctgca

SEQ ID NO: 790625 - DNA, 25 bp, Mus musculus
tatgtccattggctctaaaggctat

SEQ ID NO: 790626 - DNA, 25 bp, Mus musculus
tatgtccattgggtctaaaggctat

SEQ ID NO: 790627 - DNA, 25 bp, Mus musculus
tatgtccattggttatctgcctgca

SEQ ID NO: 790628 - DNA, 25 bp, Mus musculus
tatgtcccaagaactggctccattt

SEQ ID NO: 790629 - DNA, 25 bp, Mus musculus
tatgtcccaagatctggctccattt

SEQ ID NO: 790630 - DNA, 25 bp, Mus musculus
tatgtcccatatattagtcagagtg

SEQ ID NO: 790631 - DNA, 25 bp, Mus musculus
tatgtcccatattttagtcagagtg

SEQ ID NO: 790632 - DNA, 25 bp, Mus musculus
tatgtccccacacatagttatttca

SEQ ID NO: 790633 - DNA, 25 bp, Mus musculus
tatgtccccacagatagttatttca

SEQ ID NO: 790634 - DNA, 25 bp, Mus musculus
tatgtccccagacacttggactgct

SEQ ID NO: 790635 - DNA, 25 bp, Mus musculus
tatgtccccagagacttggactgct

SEQ ID NO: 790636 - DNA, 25 bp, Mus musculus
tatgtccccgagaaactttgttact

SEQ ID NO: 790637 - DNA, 25 bp, Mus musculus
tatgtccccgagtaactttgttact

SEQ ID NO: 790638 - DNA, 25 bp, Mus musculus
tatgtcccgagacacggcagatact

SEQ ID NO: 790639 - DNA, 25 bp, Mus musculus
tatgtcccgagagacggcagatact

SEQ ID NO: 790640 - DNA, 25 bp, Mus musculus
tatgtccctagcaatacagacccat

SEQ ID NO: 790641 - DNA, 25 bp, Mus musculus
tatgtccctagctatacagacccat

SEQ ID NO: 790642 - DNA, 25 bp, Mus musculus
tatgtccctgccagcagtcaggctg

SEQ ID NO: 790643 - DNA, 25 bp, Mus musculus
tatgtccctgcctgcagtcaggctg

SEQ ID NO: 790644 - DNA, 25 bp, Mus musculus
tatgtcccttatacaaggagacagc

SEQ ID NO: 790645 - DNA, 25 bp, Mus musculus
tatgtcccttattcaaggagacagc

SEQ ID NO: 790646 - DNA, 25 bp, Mus musculus
tatgtccctttcacagagagaatgg

SEQ ID NO: 790647 - DNA, 25 bp, Mus musculus
tatgtccctttctcagagagaatgg

SEQ ID NO: 790648 - DNA, 25 bp, Mus musculus
tatgtccgggagatgctgaccacac

SEQ ID NO: 790649 - DNA, 25 bp, Mus musculus
tatgtccgggagttgctgaccacac

SEQ ID NO: 790650 - DNA, 25 bp, Mus musculus
tatgtccgggcaccatcaggagaga

SEQ ID NO: 790651 - DNA, 25 bp, Mus musculus
tatgtccgggcagcatcaggagaga

SEQ ID NO: 790652 - DNA, 25 bp, Mus musculus
tatgtccgtcgtattatcccaaaag

SEQ ID NO: 790653 - DNA, 25 bp, Mus musculus
tatgtccgtcgttttatcccaaaag

SEQ ID NO: 790654 - DNA, 25 bp, Mus musculus
tatgtccgttccagtctttcatttc

SEQ ID NO: 790655 - DNA, 25 bp, Mus musculus
tatgtccgttcctgtctttcatttc

SEQ ID NO: 790656 - DNA, 25 bp, Mus musculus
tatgtcctaagtcccggtatttgaa

SEQ ID NO: 790657 - DNA, 25 bp, Mus musculus
tatgtcctaagtgccggtatttgaa

SEQ ID NO: 790658 - DNA, 25 bp, Mus musculus
tatgtcctcaagaacctgcggagac

SEQ ID NO: 790659 - DNA, 25 bp, Mus musculus
tatgtcctcaagtacctgcggagac

SEQ ID NO: 790660 - DNA, 25 bp, Mus musculus
tatgtcctcaccaataactacgaag

SEQ ID NO: 790661 - DNA, 25 bp, Mus musculus
tatgtcctcacctataactacgaag

SEQ ID NO: 790662 - DNA, 25 bp, Mus musculus
tatgtcctcagcctctattacatgt

SEQ ID NO: 790663 - DNA, 25 bp, Mus musculus
tatgtcctcagcgtctattacatgt

SEQ ID NO: 790664 - DNA, 25 bp, Mus musculus
tatgtcctcatcaggtcttgctcat

SEQ ID NO: 790665 - DNA, 25 bp, Mus musculus
tatgtcctcatctggtcttgctcat

SEQ ID NO: 790666 - DNA, 25 bp, Mus musculus
tatgtcctgcccagaaggctctgag

SEQ ID NO: 790667 - DNA, 25 bp, Mus musculus
tatgtcctgccctgaaggctctgag

SEQ ID NO: 790668 - DNA, 25 bp, Mus musculus
tatgtcctgcttacatttcttaatg

SEQ ID NO: 790669 - DNA, 25 bp, Mus musculus
tatgtcctgctttcatttcttaatg

SEQ ID NO: 790670 - DNA, 25 bp, Mus musculus
tatgtcctggacactcattgcttga

SEQ ID NO: 790671 - DNA, 25 bp, Mus musculus
tatgtcctggactctcattgcttga

SEQ ID NO: 790672 - DNA, 25 bp, Mus musculus
tatgtcctgtcaaactgtcagtatt

SEQ ID NO: 790673 - DNA, 25 bp, Mus musculus
tatgtcctgtcatactgtcagtatt

SEQ ID NO: 790674 - DNA, 25 bp, Mus musculus
tatgtccttagaccaaacagatcaa

SEQ ID NO: 790675 - DNA, 25 bp, Mus musculus
tatgtccttagagcaaacagatcaa

SEQ ID NO: 790676 - DNA, 25 bp, Mus musculus
tatgtccttttcacactagcaaatg

SEQ ID NO: 790677 - DNA, 25 bp, Mus musculus
tatgtccttttctcactagcaaatg

SEQ ID NO: 790678 - DNA, 25 bp, Mus musculus
tatgtcgcagccaagtttcatgagg

SEQ ID NO: 790679 - DNA, 25 bp, Mus musculus
tatgtcgcagcctagtttcatgagg

SEQ ID NO: 790680 - DNA, 25 bp, Mus musculus
tatgtcgcggacacggcatacagag

SEQ ID NO: 790681 - DNA, 25 bp, Mus musculus
tatgtcgcggactcggcatacagag

SEQ ID NO: 790682 - DNA, 25 bp, Mus musculus
tatgtcgcggccatgcaccaagaag

SEQ ID NO: 790683 - DNA, 25 bp, Mus musculus
tatgtcgcggccttgcaccaagaag

SEQ ID NO: 790684 - DNA, 25 bp, Mus musculus
tatgtcggtgtgaactgcaggtaga

SEQ ID NO: 790685 - DNA, 25 bp, Mus musculus
tatgtcggtgtgtactgcaggtaga

SEQ ID NO: 790686 - DNA, 25 bp, Mus musculus
tatgtcgtatgtatggtttccaggc

SEQ ID NO: 790687 - DNA, 25 bp, Mus musculus
tatgtcgtatgtttggtttccaggc

SEQ ID NO: 790688 - DNA, 25 bp, Mus musculus
tatgtctaaggcaaactggttacag

SEQ ID NO: 790689 - DNA, 25 bp, Mus musculus
tatgtctaaggctaactggttacag

SEQ ID NO: 790690 - DNA, 25 bp, Mus musculus
tatgtctcaatcacagcttagctgt

SEQ ID NO: 790691 - DNA, 25 bp, Mus musculus
tatgtctcaatctcagcttagctgt

SEQ ID NO: 790692 - DNA, 25 bp, Mus musculus
tatgtctctagtcctgtctgtctat

SEQ ID NO: 790693 - DNA, 25 bp, Mus musculus
tatgtctctagtgctgtctgtctat

SEQ ID NO: 790694 - DNA, 25 bp, Mus musculus
tatgtctctgtcacctaactggatt

SEQ ID NO: 790695 - DNA, 25 bp, Mus musculus
tatgtctctgtctcctaactggatt

SEQ ID NO: 790696 - DNA, 25 bp, Mus musculus
tatgtctctttgcagttgcaacttt

SEQ ID NO: 790697 - DNA, 25 bp, Mus musculus
tatgtctctttggagttgcaacttt

SEQ ID NO: 790698 - DNA, 25 bp, Mus musculus
tatgtctcttttcaggcagccgagg

SEQ ID NO: 790699 - DNA, 25 bp, Mus musculus
tatgtctcttttcagttgcgcgtgc

SEQ ID NO: 790700 - DNA, 25 bp, Mus musculus
tatgtctcttttgaggcagccgagg

SEQ ID NO: 790701 - DNA, 25 bp, Mus musculus
tatgtctcttttgagttgcgcgtgc

SEQ ID NO: 790702 - DNA, 25 bp, Mus musculus
tatgtctgaggcaccctatcctaaa

SEQ ID NO: 790703 - DNA, 25 bp, Mus musculus
tatgtctgaggctccctatcctaaa

SEQ ID NO: 790704 - DNA, 25 bp, Mus musculus
tatgtctgcaggatgacaggctggt

SEQ ID NO: 790705 - DNA, 25 bp, Mus musculus
tatgtctgcaggttgacaggctggt

SEQ ID NO: 790706 - DNA, 25 bp, Mus musculus
tatgtctgcccgagtgtgtatctgt

SEQ ID NO: 790707 - DNA, 25 bp, Mus musculus
tatgtctgcccgtgtgtgtatctgt

SEQ ID NO: 790708 - DNA, 25 bp, Mus musculus
tatgtctgcctcagcttgtccagtt

SEQ ID NO: 790709 - DNA, 25 bp, Mus musculus
tatgtctgcctctgcttgtccagtt

SEQ ID NO: 790710 - DNA, 25 bp, Mus musculus
tatgtctgctatctcacaggctggg

SEQ ID NO: 790711 - DNA, 25 bp, Mus musculus
tatgtctgctatgtcacaggctggg

SEQ ID NO: 790712 - DNA, 25 bp, Mus musculus
tatgtctgggcacccaatgggtcat

SEQ ID NO: 790713 - DNA, 25 bp, Mus musculus
tatgtctgggcagccaatgggtcat

SEQ ID NO: 790714 - DNA, 25 bp, Mus musculus
tatgtctgtacactacatgtatgcc

SEQ ID NO: 790715 - DNA, 25 bp, Mus musculus
tatgtctgtacagtacatgtatgcc

SEQ ID NO: 790716 - DNA, 25 bp, Mus musculus
tatgtctgtacgctttctggatcaa

SEQ ID NO: 790717 - DNA, 25 bp, Mus musculus
tatgtctgtacggtttctggatcaa

SEQ ID NO: 790718 - DNA, 25 bp, Mus musculus
tatgtctgtctgctggctcactgca

SEQ ID NO: 790719 - DNA, 25 bp, Mus musculus
tatgtctgtctggtggctcactgca

SEQ ID NO: 790720 - DNA, 25 bp, Mus musculus
tatgtctgtggcctttcattaagaa

SEQ ID NO: 790721 - DNA, 25 bp, Mus musculus
tatgtctgtggcgtttcattaagaa

SEQ ID NO: 790722 - DNA, 25 bp, Mus musculus
tatgtctgttacaaagcaagccctt

SEQ ID NO: 790723 - DNA, 25 bp, Mus musculus
tatgtctgttactaagcaagccctt

SEQ ID NO: 790724 - DNA, 25 bp, Mus musculus
tatgtctgttccacacttcctatcc

SEQ ID NO: 790725 - DNA, 25 bp, Mus musculus
tatgtctgttcctcacttcctatcc

SEQ ID NO: 790726 - DNA, 25 bp, Mus musculus
tatgtcttattactacaggttcgct

SEQ ID NO: 790727 - DNA, 25 bp, Mus musculus
tatgtcttattagtacaggttcgct

SEQ ID NO: 790728 - DNA, 25 bp, Mus musculus
tatgtcttcctaagggatcccgagg

SEQ ID NO: 790729 - DNA, 25 bp, Mus musculus
tatgtcttcctatgggatcccgagg

SEQ ID NO: 790730 - DNA, 25 bp, Mus musculus
tatgtcttccttacgatgagctgca

SEQ ID NO: 790731 - DNA, 25 bp, Mus musculus
tatgtcttcctttcgatgagctgca

SEQ ID NO: 790732 - DNA, 25 bp, Mus musculus
tatgtcttcgaactttcagccagcg

SEQ ID NO: 790733 - DNA, 25 bp, Mus musculus
tatgtcttcgaagtttcagccagcg

SEQ ID NO: 790734 - DNA, 25 bp, Mus musculus
tatgtcttctccattgccgtataca

SEQ ID NO: 790735 - DNA, 25 bp, Mus musculus
tatgtcttctcctttgccgtataca

SEQ ID NO: 790736 - DNA, 25 bp, Mus musculus
tatgtcttctgtatgatctgcctcc

SEQ ID NO: 790737 - DNA, 25 bp, Mus musculus
tatgtcttctgtttgatctgcctcc

SEQ ID NO: 790738 - DNA, 25 bp, Mus musculus
tatgtcttgagacctatttataaaa

SEQ ID NO: 790739 - DNA, 25 bp, Mus musculus
tatgtcttgagagctatttataaaa

SEQ ID NO: 790740 - DNA, 25 bp, Mus musculus
tatgtcttgctcagggattaaaccc

SEQ ID NO: 790741 - DNA, 25 bp, Mus musculus
tatgtcttgctctgggattaaaccc

SEQ ID NO: 790742 - DNA, 25 bp, Mus musculus
tatgtcttgtttctcgttgttcgag

SEQ ID NO: 790743 - DNA, 25 bp, Mus musculus
tatgtcttgtttgtcgttgttcgag

SEQ ID NO: 790744 - DNA, 25 bp, Mus musculus
tatgtctttgacacccagaagcgca

SEQ ID NO: 790745 - DNA, 25 bp, Mus musculus
tatgtctttgactcccagaagcgca

SEQ ID NO: 790746 - DNA, 25 bp, Mus musculus
tatgtgaacactatgggacaggaca

SEQ ID NO: 790747 - DNA, 25 bp, Mus musculus
tatgtgaacactttgggacaggaca

SEQ ID NO: 790748 - DNA, 25 bp, Mus musculus
tatgtgaaccaaccgtatccatccc

SEQ ID NO: 790749 - DNA, 25 bp, Mus musculus
tatgtgaaccaagcgtatccatccc

SEQ ID NO: 790750 - DNA, 25 bp, Mus musculus
tatgtgaaccacagcttataagctc

SEQ ID NO: 790751 - DNA, 25 bp, Mus musculus
tatgtgaaccactgcttataagctc

SEQ ID NO: 790752 - DNA, 25 bp, Mus musculus
tatgtgaacccacggatcaaattca

SEQ ID NO: 790753 - DNA, 25 bp, Mus musculus
tatgtgaacccagggatcaaattca

SEQ ID NO: 790754 - DNA, 25 bp, Mus musculus
tatgtgaactgccttatggtgaaaa

SEQ ID NO: 790755 - DNA, 25 bp, Mus musculus
tatgtgaactgcgttatggtgaaaa

SEQ ID NO: 790756 - DNA, 25 bp, Mus musculus
tatgtgaactgtcggtgacaccacc

SEQ ID NO: 790757 - DNA, 25 bp, Mus musculus
tatgtgaactgtgggtgacaccacc

SEQ ID NO: 790758 - DNA, 25 bp, Mus musculus
tatgtgaataccatctaacgttgta

SEQ ID NO: 790759 - DNA, 25 bp, Mus musculus
tatgtgaataccttctaacgttgta

SEQ ID NO: 790760 - DNA, 25 bp, Mus musculus
tatgtgaatgtgaccccagagcagc

SEQ ID NO: 790761 - DNA, 25 bp, Mus musculus
tatgtgaatgtgtccccagagcagc

SEQ ID NO: 790762 - DNA, 25 bp, Mus musculus
tatgtgacagagagcagcttcctcc

SEQ ID NO: 790763 - DNA, 25 bp, Mus musculus
tatgtgacagagtgcagcttcctcc

SEQ ID NO: 790764 - DNA, 25 bp, Mus musculus
tatgtgacattgaccccaactccaa

SEQ ID NO: 790765 - DNA, 25 bp, Mus musculus
tatgtgacattgtccccaactccaa

SEQ ID NO: 790766 - DNA, 25 bp, Mus musculus
tatgtgaccaggcatttcatgttcc

SEQ ID NO: 790767 - DNA, 25 bp, Mus musculus
tatgtgaccagggatttcatgttcc

SEQ ID NO: 790768 - DNA, 25 bp, Mus musculus
tatgtgaccccccaggtcacagaat

SEQ ID NO: 790769 - DNA, 25 bp, Mus musculus
tatgtgacccccgaggtcacagaat

SEQ ID NO: 790770 - DNA, 25 bp, Mus musculus
tatgtgaccctcatattctcccaaa

SEQ ID NO: 790771 - DNA, 25 bp, Mus musculus
tatgtgaccctcttattctcccaaa

SEQ ID NO: 790772 - DNA, 25 bp, Mus musculus
tatgtgacctgtccatttatccact

SEQ ID NO: 790773 - DNA, 25 bp, Mus musculus
tatgtgacctgtgcatttatccact

SEQ ID NO: 790774 - DNA, 25 bp, Mus musculus
tatgtgactcctcttttgggtgtgg

SEQ ID NO: 790775 - DNA, 25 bp, Mus musculus
tatgtgactcctgttttgggtgtgg

SEQ ID NO: 790776 - DNA, 25 bp, Mus musculus
tatgtgactgttctacctgctccca

SEQ ID NO: 790777 - DNA, 25 bp, Mus musculus
tatgtgactgttgtacctgctccca

SEQ ID NO: 790778 - DNA, 25 bp, Mus musculus
tatgtgacttgtacattcaacctga

SEQ ID NO: 790779 - DNA, 25 bp, Mus musculus
tatgtgacttgttcattcaacctga

SEQ ID NO: 790780 - DNA, 25 bp, Mus musculus
tatgtgaggccaaatagacgaactg

SEQ ID NO: 790781 - DNA, 25 bp, Mus musculus
tatgtgaggccatatagacgaactg

SEQ ID NO: 790782 - DNA, 25 bp, Mus musculus
tatgtgagggagcatttctaggaat

SEQ ID NO: 790783 - DNA, 25 bp, Mus musculus
tatgtgagggaggatttctaggaat

SEQ ID NO: 790784 - DNA, 25 bp, Mus musculus
tatgtgatcactctttttctgtttg

SEQ ID NO: 790785 - DNA, 25 bp, Mus musculus
tatgtgatcactgtttttctgtttg

SEQ ID NO: 790786 - DNA, 25 bp, Mus musculus
tatgtgattcagacttccagccaga

SEQ ID NO: 790787 - DNA, 25 bp, Mus musculus
tatgtgattcagtcttccagccaga

SEQ ID NO: 790788 - DNA, 25 bp, Mus musculus
tatgtgatttccacagtctttctcc

SEQ ID NO: 790789 - DNA, 25 bp, Mus musculus
tatgtgatttcctcagtctttctcc

SEQ ID NO: 790790 - DNA, 25 bp, Mus musculus
tatgtgatttggctctggactttgt

SEQ ID NO: 790791 - DNA, 25 bp, Mus musculus
tatgtgatttgggtctggactttgt

SEQ ID NO: 790792 - DNA, 25 bp, Mus musculus
tatgtgcaacccctcattttcattg

SEQ ID NO: 790793 - DNA, 25 bp, Mus musculus
tatgtgcaacccgtcattttcattg

SEQ ID NO: 790794 - DNA, 25 bp, Mus musculus
tatgtgcaatcgctgtacaaccacc

SEQ ID NO: 790795 - DNA, 25 bp, Mus musculus
tatgtgcaatcggtgtacaaccacc

SEQ ID NO: 790796 - DNA, 25 bp, Mus musculus
tatgtgcacactcccatgacagcta

SEQ ID NO: 790797 - DNA, 25 bp, Mus musculus
tatgtgcacactgccatgacagcta

SEQ ID NO: 790798 - DNA, 25 bp, Mus musculus
tatgtgcacccacgtggtatgtgtg

SEQ ID NO: 790799 - DNA, 25 bp, Mus musculus
tatgtgcacccaggtggtatgtgtg

SEQ ID NO: 790800 - DNA, 25 bp, Mus musculus
tatgtgcactgcatgcatgccatga

SEQ ID NO: 790801 - DNA, 25 bp, Mus musculus
tatgtgcactgcttgcatgccatga

SEQ ID NO: 790802 - DNA, 25 bp, Mus musculus
tatgtgcaggcaaaccatgtataaa

SEQ ID NO: 790803 - DNA, 25 bp, Mus musculus
tatgtgcaggcataccatgtataaa

SEQ ID NO: 790804 - DNA, 25 bp, Mus musculus
tatgtgcagtacatagctgtcatcc

SEQ ID NO: 790805 - DNA, 25 bp, Mus musculus
tatgtgcagtacttagctgtcatcc

SEQ ID NO: 790806 - DNA, 25 bp, Mus musculus
tatgtgcatccacgcctgtgagtaa

SEQ ID NO: 790807 - DNA, 25 bp, Mus musculus
tatgtgcatccaggcctgtgagtaa

SEQ ID NO: 790808 - DNA, 25 bp, Mus musculus
tatgtgcatggcaacactggtttgc

SEQ ID NO: 790809 - DNA, 25 bp, Mus musculus
tatgtgcatggctacactggtttgc

SEQ ID NO: 790810 - DNA, 25 bp, Mus musculus
tatgtgcatgtgaatggcctagaga

SEQ ID NO: 790811 - DNA, 25 bp, Mus musculus
tatgtgcatgtgtatggcctagaga

SEQ ID NO: 790812 - DNA, 25 bp, Mus musculus
tatgtgcattatccccagtgtaact

SEQ ID NO: 790813 - DNA, 25 bp, Mus musculus
tatgtgcattatgcccagtgtaact

SEQ ID NO: 790814 - DNA, 25 bp, Mus musculus
tatgtgccacctatggagggactgc

SEQ ID NO: 790815 - DNA, 25 bp, Mus musculus
tatgtgccacctttggagggactgc

SEQ ID NO: 790816 - DNA, 25 bp, Mus musculus
tatgtgccactgagcatatgtgtag

SEQ ID NO: 790817 - DNA, 25 bp, Mus musculus
tatgtgccactgtgcatatgtgtag

SEQ ID NO: 790818 - DNA, 25 bp, Mus musculus
tatgtgccagaaagcctgactgcca

SEQ ID NO: 790819 - DNA, 25 bp, Mus musculus
tatgtgccagaatgcctgactgcca

SEQ ID NO: 790820 - DNA, 25 bp, Mus musculus
tatgtgccatgcatcagagtgccca

SEQ ID NO: 790821 - DNA, 25 bp, Mus musculus
tatgtgccatgcttcagagtgccca

SEQ ID NO: 790822 - DNA, 25 bp, Mus musculus
tatgtgcccacactagaaacccttc

SEQ ID NO: 790823 - DNA, 25 bp, Mus musculus
tatgtgcccacagtagaaacccttc

SEQ ID NO: 790824 - DNA, 25 bp, Mus musculus
tatgtgccccaaaccaataaaatgt

SEQ ID NO: 790825 - DNA, 25 bp, Mus musculus
tatgtgccccaatccaataaaatgt

SEQ ID NO: 790826 - DNA, 25 bp, Mus musculus
tatgtgccccggaaatcggacgcag

SEQ ID NO: 790827 - DNA, 25 bp, Mus musculus
tatgtgccccggtaatcggacgcag

SEQ ID NO: 790828 - DNA, 25 bp, Mus musculus
tatgtgccctatagaacctgtcagt

SEQ ID NO: 790829 - DNA, 25 bp, Mus musculus
tatgtgccctattgaacctgtcagt

SEQ ID NO: 790830 - DNA, 25 bp, Mus musculus
tatgtgcccttgatccttacagatc

SEQ ID NO: 790831 - DNA, 25 bp, Mus musculus
tatgtgcccttgttccttacagatc

SEQ ID NO: 790832 - DNA, 25 bp, Mus musculus
tatgtgcctgctagggtgcccacag

SEQ ID NO: 790833 - DNA, 25 bp, Mus musculus
tatgtgcctgcttgggtgcccacag

SEQ ID NO: 790834 - DNA, 25 bp, Mus musculus
tatgtgcctgttctttcataggaga

SEQ ID NO: 790835 - DNA, 25 bp, Mus musculus
tatgtgcctgttgtttcataggaga

SEQ ID NO: 790836 - DNA, 25 bp, Mus musculus
tatgtgccttacagttttatcctcc

SEQ ID NO: 790837 - DNA, 25 bp, Mus musculus
tatgtgccttactgttttatcctcc

SEQ ID NO: 790838 - DNA, 25 bp, Mus musculus
tatgtgccttctaagtgtgtttatg

SEQ ID NO: 790839 - DNA, 25 bp, Mus musculus
tatgtgccttcttagtgtgtttatg

SEQ ID NO: 790840 - DNA, 25 bp, Mus musculus
tatgtgccttgccttaccaaataaa

SEQ ID NO: 790841 - DNA, 25 bp, Mus musculus
tatgtgccttgcgttaccaaataaa

SEQ ID NO: 790842 - DNA, 25 bp, Mus musculus
tatgtgcgcgccatgcgagagatga

SEQ ID NO: 790843 - DNA, 25 bp, Mus musculus
tatgtgcgcgccttgcgagagatga

SEQ ID NO: 790844 - DNA, 25 bp, Mus musculus
tatgtgcgtaggacattcctccttt

SEQ ID NO: 790845 - DNA, 25 bp, Mus musculus
tatgtgcgtaggtcattcctccttt

SEQ ID NO: 790846 - DNA, 25 bp, Mus musculus
tatgtgcgtcatacacttacacgtg

SEQ ID NO: 790847 - DNA, 25 bp, Mus musculus
tatgtgcgtcattcacttacacgtg

SEQ ID NO: 790848 - DNA, 25 bp, Mus musculus
tatgtgcgttccctgcacaagggat

SEQ ID NO: 790849 - DNA, 25 bp, Mus musculus
tatgtgcgttccgtgcacaagggat

SEQ ID NO: 790850 - DNA, 25 bp, Mus musculus
tatgtgctaattcaggtcccctaaa

SEQ ID NO: 790851 - DNA, 25 bp, Mus musculus
tatgtgctaattgaggtcccctaaa

SEQ ID NO: 790852 - DNA, 25 bp, Mus musculus
tatgtgctacacatcatttgtataa

SEQ ID NO: 790853 - DNA, 25 bp, Mus musculus
tatgtgctacacttcatttgtataa

SEQ ID NO: 790854 - DNA, 25 bp, Mus musculus
tatgtgctacagaattccctcagac

SEQ ID NO: 790855 - DNA, 25 bp, Mus musculus
tatgtgctacagtattccctcagac

SEQ ID NO: 790856 - DNA, 25 bp, Mus musculus
tatgtgctactgattgaaaacaaat

SEQ ID NO: 790857 - DNA, 25 bp, Mus musculus
tatgtgctactgtttgaaaacaaat

SEQ ID NO: 790858 - DNA, 25 bp, Mus musculus
tatgtgctccctagtttataaacga

SEQ ID NO: 790859 - DNA, 25 bp, Mus musculus
tatgtgctccctcattttaaacatt

SEQ ID NO: 790860 - DNA, 25 bp, Mus musculus
tatgtgctccctgattttaaacatt

SEQ ID NO: 790861 - DNA, 25 bp, Mus musculus
tatgtgctcccttgtttataaacga

SEQ ID NO: 790862 - DNA, 25 bp, Mus musculus
tatgtgctgatgcagtgccctagaa

SEQ ID NO: 790863 - DNA, 25 bp, Mus musculus
tatgtgctgatggagtgccctagaa

SEQ ID NO: 790864 - DNA, 25 bp, Mus musculus
tatgtgctgcataattattccacca

SEQ ID NO: 790865 - DNA, 25 bp, Mus musculus
tatgtgctgcatcacaggactcact

SEQ ID NO: 790866 - DNA, 25 bp, Mus musculus
tatgtgctgcatgacaggactcact

SEQ ID NO: 790867 - DNA, 25 bp, Mus musculus
tatgtgctgcattattattccacca

SEQ ID NO: 790868 - DNA, 25 bp, Mus musculus
tatgtgctgtgccaatggttcctcc

SEQ ID NO: 790869 - DNA, 25 bp, Mus musculus
tatgtgctgtgcgaatggttcctcc

SEQ ID NO: 790870 - DNA, 25 bp, Mus musculus
tatgtgctgtttaatgttctctgaa

SEQ ID NO: 790871 - DNA, 25 bp, Mus musculus
tatgtgctgttttatgttctctgaa

SEQ ID NO: 790872 - DNA, 25 bp, Mus musculus
tatgtgcttagcatcacggccaaag

SEQ ID NO: 790873 - DNA, 25 bp, Mus musculus
tatgtgcttagcttcacggccaaag

SEQ ID NO: 790874 - DNA, 25 bp, Mus musculus
tatgtgcttcccctgattaatacaa

SEQ ID NO: 790875 - DNA, 25 bp, Mus musculus
tatgtgcttcccgtgattaatacaa

SEQ ID NO: 790876 - DNA, 25 bp, Mus musculus
tatgtgctttcaaactctctaccac

SEQ ID NO: 790877 - DNA, 25 bp, Mus musculus
tatgtgctttcatactctctaccac

SEQ ID NO: 790878 - DNA, 25 bp, Mus musculus
tatgtgctttttcttcttgacctct

SEQ ID NO: 790879 - DNA, 25 bp, Mus musculus
tatgtgctttttgttcttgacctct

SEQ ID NO: 790880 - DNA, 25 bp, Mus musculus
tatgtggaaaacaaaccctccgatc

SEQ ID NO: 790881 - DNA, 25 bp, Mus musculus
tatgtggaaaactaaccctccgatc

SEQ ID NO: 790882 - DNA, 25 bp, Mus musculus
tatgtggaacctacacctgatgtgt

SEQ ID NO: 790883 - DNA, 25 bp, Mus musculus
tatgtggaacctactccccgaggca

SEQ ID NO: 790884 - DNA, 25 bp, Mus musculus
tatgtggaaccttcacctgatgtgt

SEQ ID NO: 790885 - DNA, 25 bp, Mus musculus
tatgtggaaccttctccccgaggca

SEQ ID NO: 790886 - DNA, 25 bp, Mus musculus
tatgtggaatttagccttttatctt

SEQ ID NO: 790887 - DNA, 25 bp, Mus musculus
tatgtggaattttgccttttatctt

SEQ ID NO: 790888 - DNA, 25 bp, Mus musculus
tatgtggaccatctcagtgccccgg

SEQ ID NO: 790889 - DNA, 25 bp, Mus musculus
tatgtggaccatgtcagtgccccgg

SEQ ID NO: 790890 - DNA, 25 bp, Mus musculus
tatgtggactctccctacataactt

SEQ ID NO: 790891 - DNA, 25 bp, Mus musculus
tatgtggactctgcctacataactt

SEQ ID NO: 790892 - DNA, 25 bp, Mus musculus
tatgtggagccaataccttgctctt

SEQ ID NO: 790893 - DNA, 25 bp, Mus musculus
tatgtggagccattaccttgctctt

SEQ ID NO: 790894 - DNA, 25 bp, Mus musculus
tatgtggatagtacaaaggctgtta

SEQ ID NO: 790895 - DNA, 25 bp, Mus musculus
tatgtggatagttcaaaggctgtta

SEQ ID NO: 790896 - DNA, 25 bp, Mus musculus
tatgtggatattcctcctgttggct

SEQ ID NO: 790897 - DNA, 25 bp, Mus musculus
tatgtggatattgctcctgttggct

SEQ ID NO: 790898 - DNA, 25 bp, Mus musculus
tatgtggatcataagacccaccagg

SEQ ID NO: 790899 - DNA, 25 bp, Mus musculus
tatgtggatcattagacccaccagg

SEQ ID NO: 790900 - DNA, 25 bp, Mus musculus
tatgtggatgatctcagggctgacc

SEQ ID NO: 790901 - DNA, 25 bp, Mus musculus
tatgtggatgatgtcagggctgacc

SEQ ID NO: 790902 - DNA, 25 bp, Mus musculus
tatgtggatgtaattgggttttgtt

SEQ ID NO: 790903 - DNA, 25 bp, Mus musculus
tatgtggatgtatttgggttttgtt

SEQ ID NO: 790904 - DNA, 25 bp, Mus musculus
tatgtggattccagtccatcatttt

SEQ ID NO: 790905 - DNA, 25 bp, Mus musculus
tatgtggattcctgtccatcatttt

SEQ ID NO: 790906 - DNA, 25 bp, Mus musculus
tatgtggcaggcacagctgagaacg

SEQ ID NO: 790907 - DNA, 25 bp, Mus musculus
tatgtggcaggctcagctgagaacg

SEQ ID NO: 790908 - DNA, 25 bp, Mus musculus
tatgtggccaagcagttcggacgac

SEQ ID NO: 790909 - DNA, 25 bp, Mus musculus
tatgtggccaaggagttcggacgac

SEQ ID NO: 790910 - DNA, 25 bp, Mus musculus
tatgtggccacaaatagctttcccc

SEQ ID NO: 790911 - DNA, 25 bp, Mus musculus
tatgtggccacatatagctttcccc

SEQ ID NO: 790912 - DNA, 25 bp, Mus musculus
tatgtggccactcagggtctccagt

SEQ ID NO: 790913 - DNA, 25 bp, Mus musculus
tatgtggccactgagggtctccagt

SEQ ID NO: 790914 - DNA, 25 bp, Mus musculus
tatgtggccataagcaaccctctgc

SEQ ID NO: 790915 - DNA, 25 bp, Mus musculus
tatgtggccatatgcaaccctctgc

SEQ ID NO: 790916 - DNA, 25 bp, Mus musculus
tatgtggccattcaagccctgctca

SEQ ID NO: 790917 - DNA, 25 bp, Mus musculus
tatgtggccattgaagccctgctca

SEQ ID NO: 790918 - DNA, 25 bp, Mus musculus
tatgtggccctacagtgtgctggct

SEQ ID NO: 790919 - DNA, 25 bp, Mus musculus
tatgtggccctactggatatgctgc

SEQ ID NO: 790920 - DNA, 25 bp, Mus musculus
tatgtggccctagagtgtgctggct

SEQ ID NO: 790921 - DNA, 25 bp, Mus musculus
tatgtggccctagtggatatgctgc

SEQ ID NO: 790922 - DNA, 25 bp, Mus musculus
tatgtggccctcctgatgatcagat

SEQ ID NO: 790923 - DNA, 25 bp, Mus musculus
tatgtggccctcgtgatgatcagat

SEQ ID NO: 790924 - DNA, 25 bp, Mus musculus
tatgtggcctgtaattctccttgac

SEQ ID NO: 790925 - DNA, 25 bp, Mus musculus
tatgtggcctgttattctccttgac

SEQ ID NO: 790926 - DNA, 25 bp, Mus musculus
tatgtggctcatattatatttccta

SEQ ID NO: 790927 - DNA, 25 bp, Mus musculus
tatgtggctcattttatatttccta

SEQ ID NO: 790928 - DNA, 25 bp, Mus musculus
tatgtgggaaccattgtccctgcct

SEQ ID NO: 790929 - DNA, 25 bp, Mus musculus
tatgtgggaacctttgtccctgcct

SEQ ID NO: 790930 - DNA, 25 bp, Mus musculus
tatgtgggatgaatcagtaccgact

SEQ ID NO: 790931 - DNA, 25 bp, Mus musculus
tatgtgggatgattcagtaccgact

SEQ ID NO: 790932 - DNA, 25 bp, Mus musculus
tatgtgggcattcatctgcgcattg

SEQ ID NO: 790933 - DNA, 25 bp, Mus musculus
tatgtgggcattgatctgcgcattg

SEQ ID NO: 790934 - DNA, 25 bp, Mus musculus
tatgtgggccccaaaagcacccatt

SEQ ID NO: 790935 - DNA, 25 bp, Mus musculus
tatgtgggcccctaaagcacccatt

SEQ ID NO: 790936 - DNA, 25 bp, Mus musculus
tatgtgggcctcacgctctgggaag

SEQ ID NO: 790937 - DNA, 25 bp, Mus musculus
tatgtgggcctctcgctctgggaag

SEQ ID NO: 790938 - DNA, 25 bp, Mus musculus
tatgtgggtagaaccccaaactcag

SEQ ID NO: 790939 - DNA, 25 bp, Mus musculus
tatgtgggtagatccccaaactcag

SEQ ID NO: 790940 - DNA, 25 bp, Mus musculus
tatgtggtaatgcttgtacctgcca

SEQ ID NO: 790941 - DNA, 25 bp, Mus musculus
tatgtggtaatggttgtacctgcca

SEQ ID NO: 790942 - DNA, 25 bp, Mus musculus
tatgtggtaattcatctagagatgg

SEQ ID NO: 790943 - DNA, 25 bp, Mus musculus
tatgtggtaattgatctagagatgg

SEQ ID NO: 790944 - DNA, 25 bp, Mus musculus
tatgtggtaccaagtctgcctagta

SEQ ID NO: 790945 - DNA, 25 bp, Mus musculus
tatgtggtaccatgtctgcctagta

SEQ ID NO: 790946 - DNA, 25 bp, Mus musculus
tatgtggtagtcctctctcaggcac

SEQ ID NO: 790947 - DNA, 25 bp, Mus musculus
tatgtggtagtcgtctctcaggcac

SEQ ID NO: 790948 - DNA, 25 bp, Mus musculus
tatgtggtatccatgtgtatcgacc

SEQ ID NO: 790949 - DNA, 25 bp, Mus musculus
tatgtggtatccttgtgtatcgacc

SEQ ID NO: 790950 - DNA, 25 bp, Mus musculus
tatgtggtatttctgctcgatgccc

SEQ ID NO: 790951 - DNA, 25 bp, Mus musculus
tatgtggtatttgtgctcgatgccc

SEQ ID NO: 790952 - DNA, 25 bp, Mus musculus
tatgtggtcattagttgccttccga

SEQ ID NO: 790953 - DNA, 25 bp, Mus musculus
tatgtggtcatttgttgccttccga

SEQ ID NO: 790954 - DNA, 25 bp, Mus musculus
tatgtggtggccagttacctgcgcg

SEQ ID NO: 790955 - DNA, 25 bp, Mus musculus
tatgtggtggcctgttacctgcgcg

SEQ ID NO: 790956 - DNA, 25 bp, Mus musculus
tatgtggttaataccgtgaactcac

SEQ ID NO: 790957 - DNA, 25 bp, Mus musculus
tatgtggttaattccgtgaactcac

SEQ ID NO: 790958 - DNA, 25 bp, Mus musculus
tatgtggttcatctgcctggcagac

SEQ ID NO: 790959 - DNA, 25 bp, Mus musculus
tatgtggttcatgtgcctggcagac

SEQ ID NO: 790960 - DNA, 25 bp, Mus musculus
tatgtgtaaaataattccagtgttt

SEQ ID NO: 790961 - DNA, 25 bp, Mus musculus
tatgtgtaaaattattccagtgttt

SEQ ID NO: 790962 - DNA, 25 bp, Mus musculus
tatgtgtaacgcatcttccaggcgc

SEQ ID NO: 790963 - DNA, 25 bp, Mus musculus
tatgtgtaacgcttcttccaggcgc

SEQ ID NO: 790964 - DNA, 25 bp, Mus musculus
tatgtgtaactgagtgcccatcttt

SEQ ID NO: 790965 - DNA, 25 bp, Mus musculus
tatgtgtaactgtgtgcccatcttt

SEQ ID NO: 790966 - DNA, 25 bp, Mus musculus
tatgtgtacatactccatgggctcc

SEQ ID NO: 790967 - DNA, 25 bp, Mus musculus
tatgtgtacatagtccatgggctcc

SEQ ID NO: 790968 - DNA, 25 bp, Mus musculus
tatgtgtaccccatctttgtggctt

SEQ ID NO: 790969 - DNA, 25 bp, Mus musculus
tatgtgtaccccttctttgtggctt

SEQ ID NO: 790970 - DNA, 25 bp, Mus musculus
tatgtgtactccaaagtgcagctga

SEQ ID NO: 790971 - DNA, 25 bp, Mus musculus
tatgtgtactcctaagtgcagctga

SEQ ID NO: 790972 - DNA, 25 bp, Mus musculus
tatgtgtagtctagcctcacctcat

SEQ ID NO: 790973 - DNA, 25 bp, Mus musculus
tatgtgtagtcttgcctcacctcat

SEQ ID NO: 790974 - DNA, 25 bp, Mus musculus
tatgtgtatgaaatgggctccagca

SEQ ID NO: 790975 - DNA, 25 bp, Mus musculus
tatgtgtatgaattgggctccagca

SEQ ID NO: 790976 - DNA, 25 bp, Mus musculus
tatgtgtcatggctacaacaccagc

SEQ ID NO: 790977 - DNA, 25 bp, Mus musculus
tatgtgtcatgggtacaacaccagc

SEQ ID NO: 790978 - DNA, 25 bp, Mus musculus
tatgtgtccaaactgggcagccggc

SEQ ID NO: 790979 - DNA, 25 bp, Mus musculus
tatgtgtccaaagtgggcagccggc

SEQ ID NO: 790980 - DNA, 25 bp, Mus musculus
tatgtgtccagtctgaggttcccac

SEQ ID NO: 790981 - DNA, 25 bp, Mus musculus
tatgtgtccagtgtgaggttcccac

SEQ ID NO: 790982 - DNA, 25 bp, Mus musculus
tatgtgtccccgaatggccttagat

SEQ ID NO: 790983 - DNA, 25 bp, Mus musculus
tatgtgtccccgtatggccttagat

SEQ ID NO: 790984 - DNA, 25 bp, Mus musculus
tatgtgtcccggaaccacgtaaagg

SEQ ID NO: 790985 - DNA, 25 bp, Mus musculus
tatgtgtcccggtaccacgtaaagg

SEQ ID NO: 790986 - DNA, 25 bp, Mus musculus
tatgtgtccttaccaaccttatgag

SEQ ID NO: 790987 - DNA, 25 bp, Mus musculus
tatgtgtccttagcaaccttatgag

SEQ ID NO: 790988 - DNA, 25 bp, Mus musculus
tatgtgtctcatatcaactaccctg

SEQ ID NO: 790989 - DNA, 25 bp, Mus musculus
tatgtgtctcatttcaactaccctg

SEQ ID NO: 790990 - DNA, 25 bp, Mus musculus
tatgtgtctcctataaaccgtgctg

SEQ ID NO: 790991 - DNA, 25 bp, Mus musculus
tatgtgtctcctttaaaccgtgctg

SEQ ID NO: 790992 - DNA, 25 bp, Mus musculus
tatgtgtctcggacacttctcctgc

SEQ ID NO: 790993 - DNA, 25 bp, Mus musculus
tatgtgtctcggtcacttctcctgc

SEQ ID NO: 790994 - DNA, 25 bp, Mus musculus
tatgtgtctgtcatagtcagcaccc

SEQ ID NO: 790995 - DNA, 25 bp, Mus musculus
tatgtgtctgtcttagtcagcaccc

SEQ ID NO: 790996 - DNA, 25 bp, Mus musculus
tatgtgtctgtgcaccagcttctag

SEQ ID NO: 790997 - DNA, 25 bp, Mus musculus
tatgtgtctgtggaccagcttctag

SEQ ID NO: 790998 - DNA, 25 bp, Mus musculus
tatgtgtcttcgctgcccaaactag

SEQ ID NO: 790999 - DNA, 25 bp, Mus musculus
tatgtgtcttcggtgcccaaactag

SEQ ID NO: 791000 - DNA, 25 bp, Mus musculus
tatgtgtgatatacctctcctgtta

SEQ ID NO: 791001 - DNA, 25 bp, Mus musculus
tatgtgtgatattcctctcctgtta

SEQ ID NO: 791002 - DNA, 25 bp, Mus musculus
tatgtgtgattgaggcccttggatc

SEQ ID NO: 791003 - DNA, 25 bp, Mus musculus
tatgtgtgattgtggcccttggatc

SEQ ID NO: 791004 - DNA, 25 bp, Mus musculus
tatgtgtgcaacagcctttcacttc

SEQ ID NO: 791005 - DNA, 25 bp, Mus musculus
tatgtgtgcaactgcctttcacttc

SEQ ID NO: 791006 - DNA, 25 bp, Mus musculus
tatgtgtgcacaagtgactcacccc

SEQ ID NO: 791007 - DNA, 25 bp, Mus musculus
tatgtgtgcacatgtgactcacccc

SEQ ID NO: 791008 - DNA, 25 bp, Mus musculus
tatgtgtgcactcgctatgacctgt

SEQ ID NO: 791009 - DNA, 25 bp, Mus musculus
tatgtgtgcactggctatgacctgt

SEQ ID NO: 791010 - DNA, 25 bp, Mus musculus
tatgtgtgcccacccacgggattag

SEQ ID NO: 791011 - DNA, 25 bp, Mus musculus
tatgtgtgcccagccacgggattag

SEQ ID NO: 791012 - DNA, 25 bp, Mus musculus
tatgtgtgcgctctttgtctactca

SEQ ID NO: 791013 - DNA, 25 bp, Mus musculus
tatgtgtgcgctgtttgtctactca

SEQ ID NO: 791014 - DNA, 25 bp, Mus musculus
tatgtgtggctaccttggctcttgc

SEQ ID NO: 791015 - DNA, 25 bp, Mus musculus
tatgtgtggctagcttggctcttgc

SEQ ID NO: 791016 - DNA, 25 bp, Mus musculus
tatgtgtgggtgcagctgatactaa

SEQ ID NO: 791017 - DNA, 25 bp, Mus musculus
tatgtgtgggtggagctgatactaa

SEQ ID NO: 791018 - DNA, 25 bp, Mus musculus
tatgtgtggtgtcatagtatgatct

SEQ ID NO: 791019 - DNA, 25 bp, Mus musculus
tatgtgtggtgtgatagtatgatct

SEQ ID NO: 791020 - DNA, 25 bp, Mus musculus
tatgtgtgtgccacagctcagagac

SEQ ID NO: 791021 - DNA, 25 bp, Mus musculus
tatgtgtgtgcctcagctcagagac

SEQ ID NO: 791022 - DNA, 25 bp, Mus musculus
tatgtgtgtgctcgcgcacataaat

SEQ ID NO: 791023 - DNA, 25 bp, Mus musculus
tatgtgtgtgctggcgcacataaat

SEQ ID NO: 791024 - DNA, 25 bp, Mus musculus
tatgtgtgttccaggctttgtagct

SEQ ID NO: 791025 - DNA, 25 bp, Mus musculus
tatgtgtgttcctggctttgtagct

SEQ ID NO: 791026 - DNA, 25 bp, Mus musculus
tatgtgttaacgaaatccatgtttt

SEQ ID NO: 791027 - DNA, 25 bp, Mus musculus
tatgtgttaacgtaatccatgtttt

SEQ ID NO: 791028 - DNA, 25 bp, Mus musculus
tatgtgttaccacgaagggttcctt

SEQ ID NO: 791029 - DNA, 25 bp, Mus musculus
tatgtgttaccaggaagggttcctt

SEQ ID NO: 791030 - DNA, 25 bp, Mus musculus
tatgtgttagctctaccttttcctt

SEQ ID NO: 791031 - DNA, 25 bp, Mus musculus
tatgtgttagctgtaccttttcctt

SEQ ID NO: 791032 - DNA, 25 bp, Mus musculus
tatgtgttcagtacacccatgcagg

SEQ ID NO: 791033 - DNA, 25 bp, Mus musculus
tatgtgttcagtctctttcttctac

SEQ ID NO: 791034 - DNA, 25 bp, Mus musculus
tatgtgttcagtgtctttcttctac

SEQ ID NO: 791035 - DNA, 25 bp, Mus musculus
tatgtgttcagttcacccatgcagg

SEQ ID NO: 791036 - DNA, 25 bp, Mus musculus
tatgtgttccttccactccctgcag

SEQ ID NO: 791037 - DNA, 25 bp, Mus musculus
tatgtgttccttgcactccctgcag

SEQ ID NO: 791038 - DNA, 25 bp, Mus musculus
tatgtgttcggtccactattacctc

SEQ ID NO: 791039 - DNA, 25 bp, Mus musculus
tatgtgttcggtgcactattacctc

SEQ ID NO: 791040 - DNA, 25 bp, Mus musculus
tatgtgttctacattgcctccttca

SEQ ID NO: 791041 - DNA, 25 bp, Mus musculus
tatgtgttctactttgcctccttca

SEQ ID NO: 791042 - DNA, 25 bp, Mus musculus
tatgtgttctctacttttgcagcct

SEQ ID NO: 791043 - DNA, 25 bp, Mus musculus
tatgtgttctcttcttttgcagcct

SEQ ID NO: 791044 - DNA, 25 bp, Mus musculus
tatgtgttcttcacttacccatggt

SEQ ID NO: 791045 - DNA, 25 bp, Mus musculus
tatgtgttcttctcttacccatggt

SEQ ID NO: 791046 - DNA, 25 bp, Mus musculus
tatgtgttctttatactgagttgct

SEQ ID NO: 791047 - DNA, 25 bp, Mus musculus
tatgtgttctttttactgagttgct

SEQ ID NO: 791048 - DNA, 25 bp, Mus musculus
tatgtgtttaatataggctttcctt

SEQ ID NO: 791049 - DNA, 25 bp, Mus musculus
tatgtgtttaatttaggctttcctt

SEQ ID NO: 791050 - DNA, 25 bp, Mus musculus
tatgtgtttatacctatcccttcct

SEQ ID NO: 791051 - DNA, 25 bp, Mus musculus
tatgtgtttatagctatcccttcct

SEQ ID NO: 791052 - DNA, 25 bp, Mus musculus
tatgtgtttctaccagtccagtcaa

SEQ ID NO: 791053 - DNA, 25 bp, Mus musculus
tatgtgtttctagcagtccagtcaa

SEQ ID NO: 791054 - DNA, 25 bp, Mus musculus
tatgtgtttggacctatgataagtt

SEQ ID NO: 791055 - DNA, 25 bp, Mus musculus
tatgtgtttggagctatgataagtt

SEQ ID NO: 791056 - DNA, 25 bp, Mus musculus
tatgtgttttgtcggcatgtatgcc

SEQ ID NO: 791057 - DNA, 25 bp, Mus musculus
tatgtgttttgtgggcatgtatgcc

SEQ ID NO: 791058 - DNA, 25 bp, Mus musculus
tatgttaaatccactcatcacactt

SEQ ID NO: 791059 - DNA, 25 bp, Mus musculus
tatgttaaatcctctcatcacactt

SEQ ID NO: 791060 - DNA, 25 bp, Mus musculus
tatgttaaatgtcccactctgctta

SEQ ID NO: 791061 - DNA, 25 bp, Mus musculus
tatgttaaatgtgccactctgctta

SEQ ID NO: 791062 - DNA, 25 bp, Mus musculus
tatgttacaaatcaattcacaaggc

SEQ ID NO: 791063 - DNA, 25 bp, Mus musculus
tatgttacaaatgaattcacaaggc

SEQ ID NO: 791064 - DNA, 25 bp, Mus musculus
tatgttacactcacgatttgggttt

SEQ ID NO: 791065 - DNA, 25 bp, Mus musculus
tatgttacactctcgatttgggttt

SEQ ID NO: 791066 - DNA, 25 bp, Mus musculus
tatgttaccatcatcaggcttccta

SEQ ID NO: 791067 - DNA, 25 bp, Mus musculus
tatgttaccatcttcaggcttccta

SEQ ID NO: 791068 - DNA, 25 bp, Mus musculus
tatgttacccacagcagcagagcat

SEQ ID NO: 791069 - DNA, 25 bp, Mus musculus
tatgttacccactgcagcagagcat

SEQ ID NO: 791070 - DNA, 25 bp, Mus musculus
tatgttaccctgatttcaagtcctt

SEQ ID NO: 791071 - DNA, 25 bp, Mus musculus
tatgttaccctgttttcaagtcctt

SEQ ID NO: 791072 - DNA, 25 bp, Mus musculus
tatgttacctccaactcgtttgaaa

SEQ ID NO: 791073 - DNA, 25 bp, Mus musculus
tatgttacctcctactcgtttgaaa

SEQ ID NO: 791074 - DNA, 25 bp, Mus musculus
tatgttactcttcccctgattgcag

SEQ ID NO: 791075 - DNA, 25 bp, Mus musculus
tatgttactcttgccctgattgcag

SEQ ID NO: 791076 - DNA, 25 bp, Mus musculus
tatgttagacatatcccaggatccc

SEQ ID NO: 791077 - DNA, 25 bp, Mus musculus
tatgttagacatttcccaggatccc

SEQ ID NO: 791078 - DNA, 25 bp, Mus musculus
tatgttagatccacctttcattcct

SEQ ID NO: 791079 - DNA, 25 bp, Mus musculus
tatgttagatcctcctttcattcct

SEQ ID NO: 791080 - DNA, 25 bp, Mus musculus
tatgttagcatgatttcttggcaag

SEQ ID NO: 791081 - DNA, 25 bp, Mus musculus
tatgttagcatgttttcttggcaag

SEQ ID NO: 791082 - DNA, 25 bp, Mus musculus
tatgttagcgccagttggtcctttc

SEQ ID NO: 791083 - DNA, 25 bp, Mus musculus
tatgttagcgcctgttggtcctttc

SEQ ID NO: 791084 - DNA, 25 bp, Mus musculus
tatgttagtttaaaggttcttcacc

SEQ ID NO: 791085 - DNA, 25 bp, Mus musculus
tatgttagtttataggttcttcacc

SEQ ID NO: 791086 - DNA, 25 bp, Mus musculus
tatgttatatctaagctatggcccc

SEQ ID NO: 791087 - DNA, 25 bp, Mus musculus
tatgttatatcttagctatggcccc

SEQ ID NO: 791088 - DNA, 25 bp, Mus musculus
tatgttatatgactgaattctctgt

SEQ ID NO: 791089 - DNA, 25 bp, Mus musculus
tatgttatatgagtgaattctctgt

SEQ ID NO: 791090 - DNA, 25 bp, Mus musculus
tatgttatctatcaccatgactaca

SEQ ID NO: 791091 - DNA, 25 bp, Mus musculus
tatgttatctatgaccatgactaca

SEQ ID NO: 791092 - DNA, 25 bp, Mus musculus
tatgttattagacggactgctgggt

SEQ ID NO: 791093 - DNA, 25 bp, Mus musculus
tatgttattagagggactgctgggt

SEQ ID NO: 791094 - DNA, 25 bp, Mus musculus
tatgttcaaacacgcctcgttgctt

SEQ ID NO: 791095 - DNA, 25 bp, Mus musculus
tatgttcaaacaggcctcgttgctt

SEQ ID NO: 791096 - DNA, 25 bp, Mus musculus
tatgttcaaatgatgctcgttgcca

SEQ ID NO: 791097 - DNA, 25 bp, Mus musculus
tatgttcaaatgttgctcgttgcca

SEQ ID NO: 791098 - DNA, 25 bp, Mus musculus
tatgttcaaattcagccccatccag

SEQ ID NO: 791099 - DNA, 25 bp, Mus musculus
tatgttcaaattgagccccatccag

SEQ ID NO: 791100 - DNA, 25 bp, Mus musculus
tatgttcacagccttgttgccaacc

SEQ ID NO: 791101 - DNA, 25 bp, Mus musculus
tatgttcacagcgttgttgccaacc

SEQ ID NO: 791102 - DNA, 25 bp, Mus musculus
tatgttcacgcaagcgcacatgcac

SEQ ID NO: 791103 - DNA, 25 bp, Mus musculus
tatgttcacgcatgcgcacatgcac

SEQ ID NO: 791104 - DNA, 25 bp, Mus musculus
tatgttcactggcagtaggactcgg

SEQ ID NO: 791105 - DNA, 25 bp, Mus musculus
tatgttcactgggagtaggactcgg

SEQ ID NO: 791106 - DNA, 25 bp, Mus musculus
tatgttcatataagtgggtgcacac

SEQ ID NO: 791107 - DNA, 25 bp, Mus musculus
tatgttcatatatgtgggtgcacac

SEQ ID NO: 791108 - DNA, 25 bp, Mus musculus
tatgttcatctcagtgctattttat

SEQ ID NO: 791109 - DNA, 25 bp, Mus musculus
tatgttcatctcatgaagggccctt

SEQ ID NO: 791110 - DNA, 25 bp, Mus musculus
tatgttcatctcattcttttctggt

SEQ ID NO: 791111 - DNA, 25 bp, Mus musculus
tatgttcatctctgtgctattttat

SEQ ID NO: 791112 - DNA, 25 bp, Mus musculus
tatgttcatctcttgaagggccctt

SEQ ID NO: 791113 - DNA, 25 bp, Mus musculus
tatgttcatctctttcttttctggt

SEQ ID NO: 791114 - DNA, 25 bp, Mus musculus
tatgttcatgtacccagatctctgc

SEQ ID NO: 791115 - DNA, 25 bp, Mus musculus
tatgttcatgtagccagatctctgc

SEQ ID NO: 791116 - DNA, 25 bp, Mus musculus
tatgttccagagatgcccaggcttt

SEQ ID NO: 791117 - DNA, 25 bp, Mus musculus
tatgttccagagttgcccaggcttt

SEQ ID NO: 791118 - DNA, 25 bp, Mus musculus
tatgttcccactcctcctgtgttaa

SEQ ID NO: 791119 - DNA, 25 bp, Mus musculus
tatgttcccactgctcctgtgttaa

SEQ ID NO: 791120 - DNA, 25 bp, Mus musculus
tatgttccccgacccttgaggtggt

SEQ ID NO: 791121 - DNA, 25 bp, Mus musculus
tatgttccccgagccttgaggtggt

SEQ ID NO: 791122 - DNA, 25 bp, Mus musculus
tatgttcccgacacatgctggccat

SEQ ID NO: 791123 - DNA, 25 bp, Mus musculus
tatgttcccgactcatgctggccat

SEQ ID NO: 791124 - DNA, 25 bp, Mus musculus
tatgttccctccaagcagtgaggac

SEQ ID NO: 791125 - DNA, 25 bp, Mus musculus
tatgttccctcctagcagtgaggac

SEQ ID NO: 791126 - DNA, 25 bp, Mus musculus
tatgttcccttgaaatatgctaggc

SEQ ID NO: 791127 - DNA, 25 bp, Mus musculus
tatgttcccttgtaatatgctaggc

SEQ ID NO: 791128 - DNA, 25 bp, Mus musculus
tatgttccgctcaagttcacagtgc

SEQ ID NO: 791129 - DNA, 25 bp, Mus musculus
tatgttccgctctagttcacagtgc

SEQ ID NO: 791130 - DNA, 25 bp, Mus musculus
tatgttccggctcagggcaggactt

SEQ ID NO: 791131 - DNA, 25 bp, Mus musculus
tatgttccggctgagggcaggactt

SEQ ID NO: 791132 - DNA, 25 bp, Mus musculus
tatgttccgttgctcattgtcaaag

SEQ ID NO: 791133 - DNA, 25 bp, Mus musculus
tatgttccgttggtcattgtcaaag

SEQ ID NO: 791134 - DNA, 25 bp, Mus musculus
tatgttcctgaacctatcttgctca

SEQ ID NO: 791135 - DNA, 25 bp, Mus musculus
tatgttcctgaagctatcttgctca

SEQ ID NO: 791136 - DNA, 25 bp, Mus musculus
tatgttcctgagaccatcgtttagt

SEQ ID NO: 791137 - DNA, 25 bp, Mus musculus
tatgttcctgagtccatcgtttagt

SEQ ID NO: 791138 - DNA, 25 bp, Mus musculus
tatgttccttggcatcttcggtgag

SEQ ID NO: 791139 - DNA, 25 bp, Mus musculus
tatgttccttgggatcttcggtgag

SEQ ID NO: 791140 - DNA, 25 bp, Mus musculus
tatgttcgaccgcaaggagtcagtg

SEQ ID NO: 791141 - DNA, 25 bp, Mus musculus
tatgttcgaccggaaggagtcagtg

SEQ ID NO: 791142 - DNA, 25 bp, Mus musculus
tatgttcgccctaccttatatactg

SEQ ID NO: 791143 - DNA, 25 bp, Mus musculus
tatgttcgcccttccttatatactg

SEQ ID NO: 791144 - DNA, 25 bp, Mus musculus
tatgttcgggataacttcactccct

SEQ ID NO: 791145 - DNA, 25 bp, Mus musculus
tatgttcgggattacttcactccct

SEQ ID NO: 791146 - DNA, 25 bp, Mus musculus
tatgttcgtagcaacatccgtacca

SEQ ID NO: 791147 - DNA, 25 bp, Mus musculus
tatgttcgtagctacatccgtacca

SEQ ID NO: 791148 - DNA, 25 bp, Mus musculus
tatgttcgttttatggtagaccgtt

SEQ ID NO: 791149 - DNA, 25 bp, Mus musculus
tatgttcgttttttggtagaccgtt

SEQ ID NO: 791150 - DNA, 25 bp, Mus musculus
tatgttctaagtactataggctgat

SEQ ID NO: 791151 - DNA, 25 bp, Mus musculus
tatgttctaagttctataggctgat

SEQ ID NO: 791152 - DNA, 25 bp, Mus musculus
tatgttctcaagcactgcaccaagg

SEQ ID NO: 791153 - DNA, 25 bp, Mus musculus
tatgttctcaaggactgcaccaagg

SEQ ID NO: 791154 - DNA, 25 bp, Mus musculus
tatgttctccagaagagtaaggtgt

SEQ ID NO: 791155 - DNA, 25 bp, Mus musculus
tatgttctccagtagagtaaggtgt

SEQ ID NO: 791156 - DNA, 25 bp, Mus musculus
tatgttctccatctgtgagcatcac

SEQ ID NO: 791157 - DNA, 25 bp, Mus musculus
tatgttctccatgtgtgagcatcac

SEQ ID NO: 791158 - DNA, 25 bp, Mus musculus
tatgttctctggacacttttgtgga

SEQ ID NO: 791159 - DNA, 25 bp, Mus musculus
tatgttctctggtcacttttgtgga

SEQ ID NO: 791160 - DNA, 25 bp, Mus musculus
tatgttctgatcagcgatctgcggc

SEQ ID NO: 791161 - DNA, 25 bp, Mus musculus
tatgttctgatcattaaaagcaagt

SEQ ID NO: 791162 - DNA, 25 bp, Mus musculus
tatgttctgatctgcgatctgcggc

SEQ ID NO: 791163 - DNA, 25 bp, Mus musculus
tatgttctgatctttaaaagcaagt

SEQ ID NO: 791164 - DNA, 25 bp, Mus musculus
tatgttctgcccagattctgtagag

SEQ ID NO: 791165 - DNA, 25 bp, Mus musculus
tatgttctgccctgattctgtagag

SEQ ID NO: 791166 - DNA, 25 bp, Mus musculus
tatgttctgcctatcaaatggctgt

SEQ ID NO: 791167 - DNA, 25 bp, Mus musculus
tatgttctgcctttcaaatggctgt

SEQ ID NO: 791168 - DNA, 25 bp, Mus musculus
tatgttctgctgaactgccatcagt

SEQ ID NO: 791169 - DNA, 25 bp, Mus musculus
tatgttctgctgtactgccatcagt

SEQ ID NO: 791170 - DNA, 25 bp, Mus musculus
tatgttctgcttcactgactgccaa

SEQ ID NO: 791171 - DNA, 25 bp, Mus musculus
tatgttctgcttgactgactgccaa

SEQ ID NO: 791172 - DNA, 25 bp, Mus musculus
tatgttctgtaaaaagttggatttc

SEQ ID NO: 791173 - DNA, 25 bp, Mus musculus
tatgttctgtaataagttggatttc

SEQ ID NO: 791174 - DNA, 25 bp, Mus musculus
tatgttctgtcgacgctcaaaatat

SEQ ID NO: 791175 - DNA, 25 bp, Mus musculus
tatgttctgtcgtcgctcaaaatat

SEQ ID NO: 791176 - DNA, 25 bp, Mus musculus
tatgttcttcccagggtaggcacat

SEQ ID NO: 791177 - DNA, 25 bp, Mus musculus
tatgttcttccctgggtaggcacat

SEQ ID NO: 791178 - DNA, 25 bp, Mus musculus
tatgttcttctgagatggctggtaa

SEQ ID NO: 791179 - DNA, 25 bp, Mus musculus
tatgttcttctgtgatggctggtaa

SEQ ID NO: 791180 - DNA, 25 bp, Mus musculus
tatgttcttgatagaccttgtaaaa

SEQ ID NO: 791181 - DNA, 25 bp, Mus musculus
tatgttcttgattgaccttgtaaaa

SEQ ID NO: 791182 - DNA, 25 bp, Mus musculus
tatgttcttggaccttacgcccctg

SEQ ID NO: 791183 - DNA, 25 bp, Mus musculus
tatgttcttggagcttacgcccctg

SEQ ID NO: 791184 - DNA, 25 bp, Mus musculus
tatgttgaaccaaccccgcatcttt

SEQ ID NO: 791185 - DNA, 25 bp, Mus musculus
tatgttgaaccactggagacttgta

SEQ ID NO: 791186 - DNA, 25 bp, Mus musculus
tatgttgaaccagtggagacttgta

SEQ ID NO: 791187 - DNA, 25 bp, Mus musculus
tatgttgaaccatccccgcatcttt

SEQ ID NO: 791188 - DNA, 25 bp, Mus musculus
tatgttgaataaatccaatctatca

SEQ ID NO: 791189 - DNA, 25 bp, Mus musculus
tatgttgaataattccaatctatca

SEQ ID NO: 791190 - DNA, 25 bp, Mus musculus
tatgttgaatgcctggtctccagtt

SEQ ID NO: 791191 - DNA, 25 bp, Mus musculus
tatgttgaatgcgtggtctccagtt

SEQ ID NO: 791192 - DNA, 25 bp, Mus musculus
tatgttgacagcattgccgacctct

SEQ ID NO: 791193 - DNA, 25 bp, Mus musculus
tatgttgacagctttgccgacctct

SEQ ID NO: 791194 - DNA, 25 bp, Mus musculus
tatgttgacctcacagtgacctata

SEQ ID NO: 791195 - DNA, 25 bp, Mus musculus
tatgttgacctctcagtgacctata

SEQ ID NO: 791196 - DNA, 25 bp, Mus musculus
tatgttgagattctgaaagcgcttc

SEQ ID NO: 791197 - DNA, 25 bp, Mus musculus
tatgttgagattgtgaaagcgcttc

SEQ ID NO: 791198 - DNA, 25 bp, Mus musculus
tatgttgagctgcttgttctcgctg

SEQ ID NO: 791199 - DNA, 25 bp, Mus musculus
tatgttgagctggttgttctcgctg

SEQ ID NO: 791200 - DNA, 25 bp, Mus musculus
tatgttgatcaaaatcccatggttt

SEQ ID NO: 791201 - DNA, 25 bp, Mus musculus
tatgttgatcaatatcccatggttt

SEQ ID NO: 791202 - DNA, 25 bp, Mus musculus
tatgttgatctgagtgcatggtatt

SEQ ID NO: 791203 - DNA, 25 bp, Mus musculus
tatgttgatctgtgtgcatggtatt

SEQ ID NO: 791204 - DNA, 25 bp, Mus musculus
tatgttgatgacctggatcgccgag

SEQ ID NO: 791205 - DNA, 25 bp, Mus musculus
tatgttgatgacgtggatcgccgag

SEQ ID NO: 791206 - DNA, 25 bp, Mus musculus
tatgttgatttaagcgcggcccggc

SEQ ID NO: 791207 - DNA, 25 bp, Mus musculus
tatgttgatttatgcgcggcccggc

SEQ ID NO: 791208 - DNA, 25 bp, Mus musculus
tatgttgcagtgattccttccatga

SEQ ID NO: 791209 - DNA, 25 bp, Mus musculus
tatgttgcagtgtttccttccatga

SEQ ID NO: 791210 - DNA, 25 bp, Mus musculus
tatgttgccaacacagggcagtgtt

SEQ ID NO: 791211 - DNA, 25 bp, Mus musculus
tatgttgccaactcagggcagtgtt

SEQ ID NO: 791212 - DNA, 25 bp, Mus musculus
tatgttgccatcacctgtagttgcc

SEQ ID NO: 791213 - DNA, 25 bp, Mus musculus
tatgttgccatctcctgtagttgcc

SEQ ID NO: 791214 - DNA, 25 bp, Mus musculus
tatgttgcccagagggcttgagctc

SEQ ID NO: 791215 - DNA, 25 bp, Mus musculus
tatgttgcccagtgggcttgagctc

SEQ ID NO: 791216 - DNA, 25 bp, Mus musculus
tatgttgcccatacaatcttttgtt

SEQ ID NO: 791217 - DNA, 25 bp, Mus musculus
tatgttgcccattcaatcttttgtt

SEQ ID NO: 791218 - DNA, 25 bp, Mus musculus
tatgttgcctcccatcagatggtgt

SEQ ID NO: 791219 - DNA, 25 bp, Mus musculus
tatgttgcctccgatcagatggtgt

SEQ ID NO: 791220 - DNA, 25 bp, Mus musculus
tatgttgccttcacggttttcccca

SEQ ID NO: 791221 - DNA, 25 bp, Mus musculus
tatgttgccttctcggttttcccca

SEQ ID NO: 791222 - DNA, 25 bp, Mus musculus
tatgttgctcacagttcatcatcaa

SEQ ID NO: 791223 - DNA, 25 bp, Mus musculus
tatgttgctcactgttcatcatcaa

SEQ ID NO: 791224 - DNA, 25 bp, Mus musculus
tatgttgctctgatttgagggcagc

SEQ ID NO: 791225 - DNA, 25 bp, Mus musculus
tatgttgctctgttttgagggcagc

SEQ ID NO: 791226 - DNA, 25 bp, Mus musculus
tatgttgctgctcccatacataact

SEQ ID NO: 791227 - DNA, 25 bp, Mus musculus
tatgttgctgctgccatacataact

SEQ ID NO: 791228 - DNA, 25 bp, Mus musculus
tatgttgctggacctcgccaaacag

SEQ ID NO: 791229 - DNA, 25 bp, Mus musculus
tatgttgctggagctcgccaaacag

SEQ ID NO: 791230 - DNA, 25 bp, Mus musculus
tatgttgcttgcatatctgtgccct

SEQ ID NO: 791231 - DNA, 25 bp, Mus musculus
tatgttgcttgcttatctgtgccct

SEQ ID NO: 791232 - DNA, 25 bp, Mus musculus
tatgttggaactcgagggcacctct

SEQ ID NO: 791233 - DNA, 25 bp, Mus musculus
tatgttggaactggagggcacctct

SEQ ID NO: 791234 - DNA, 25 bp, Mus musculus
tatgttggagcacatatcccctgtc

SEQ ID NO: 791235 - DNA, 25 bp, Mus musculus
tatgttggagcagatatcccctgtc

SEQ ID NO: 791236 - DNA, 25 bp, Mus musculus
tatgttggagccaatgttctcagta

SEQ ID NO: 791237 - DNA, 25 bp, Mus musculus
tatgttggagcctatgttctcagta

SEQ ID NO: 791238 - DNA, 25 bp, Mus musculus
tatgttgggaacatgctcgcttctg

SEQ ID NO: 791239 - DNA, 25 bp, Mus musculus
tatgttgggaacttgctcgcttctg

SEQ ID NO: 791240 - DNA, 25 bp, Mus musculus
tatgttgggtttctaggttagcacg

SEQ ID NO: 791241 - DNA, 25 bp, Mus musculus
tatgttgggtttgtaggttagcacg

SEQ ID NO: 791242 - DNA, 25 bp, Mus musculus
tatgttggtccaaggtctttccagc

SEQ ID NO: 791243 - DNA, 25 bp, Mus musculus
tatgttggtccatggtctttccagc

SEQ ID NO: 791244 - DNA, 25 bp, Mus musculus
tatgttggtgttaacaatttggagt

SEQ ID NO: 791245 - DNA, 25 bp, Mus musculus
tatgttggtgtttacaatttggagt

SEQ ID NO: 791246 - DNA, 25 bp, Mus musculus
tatgttggttgacggacacctccct

SEQ ID NO: 791247 - DNA, 25 bp, Mus musculus
tatgttggttgagggacacctccct

SEQ ID NO: 791248 - DNA, 25 bp, Mus musculus
tatgttgtaataagtccttctggaa

SEQ ID NO: 791249 - DNA, 25 bp, Mus musculus
tatgttgtaatatgtccttctggaa

SEQ ID NO: 791250 - DNA, 25 bp, Mus musculus
tatgttgtagtacgagcccagagag

SEQ ID NO: 791251 - DNA, 25 bp, Mus musculus
tatgttgtagtaggagcccagagag

SEQ ID NO: 791252 - DNA, 25 bp, Mus musculus
tatgttgtagtccttgcagtttcag

SEQ ID NO: 791253 - DNA, 25 bp, Mus musculus
tatgttgtagtcgttgcagtttcag

SEQ ID NO: 791254 - DNA, 25 bp, Mus musculus
tatgttgtcaaactttgaaggtttt

SEQ ID NO: 791255 - DNA, 25 bp, Mus musculus
tatgttgtcaaagtttgaaggtttt

SEQ ID NO: 791256 - DNA, 25 bp, Mus musculus
tatgttgtcaggaagcccttaaaca

SEQ ID NO: 791257 - DNA, 25 bp, Mus musculus
tatgttgtcaggtagcccttaaaca

SEQ ID NO: 791258 - DNA, 25 bp, Mus musculus
tatgttgtcatcattccatggagca

SEQ ID NO: 791259 - DNA, 25 bp, Mus musculus
tatgttgtcatctttccatggagca

SEQ ID NO: 791260 - DNA, 25 bp, Mus musculus
tatgttgtctccaaatgcggcctgt

SEQ ID NO: 791261 - DNA, 25 bp, Mus musculus
tatgttgtctcctaatgcggcctgt

SEQ ID NO: 791262 - DNA, 25 bp, Mus musculus
tatgttgtcttgaaatggatgtctc

SEQ ID NO: 791263 - DNA, 25 bp, Mus musculus
tatgttgtcttgtaatggatgtctc

SEQ ID NO: 791264 - DNA, 25 bp, Mus musculus
tatgttgtgagtcgccacacacgtt

SEQ ID NO: 791265 - DNA, 25 bp, Mus musculus
tatgttgtgagtggccacacacgtt

SEQ ID NO: 791266 - DNA, 25 bp, Mus musculus
tatgttgtggcaagactcaggtaca

SEQ ID NO: 791267 - DNA, 25 bp, Mus musculus
tatgttgtggcatgactcaggtaca

SEQ ID NO: 791268 - DNA, 25 bp, Mus musculus
tatgttgtgtagatcgtctcacctt

SEQ ID NO: 791269 - DNA, 25 bp, Mus musculus
tatgttgtgtagttcgtctcacctt

SEQ ID NO: 791270 - DNA, 25 bp, Mus musculus
tatgttgttactattacccgatagg

SEQ ID NO: 791271 - DNA, 25 bp, Mus musculus
tatgttgttacttttacccgatagg

SEQ ID NO: 791272 - DNA, 25 bp, Mus musculus
tatgttgttcaacctctagagttct

SEQ ID NO: 791273 - DNA, 25 bp, Mus musculus
tatgttgttcaagctctagagttct

SEQ ID NO: 791274 - DNA, 25 bp, Mus musculus
tatgttgttccgatagttcacccaa

SEQ ID NO: 791275 - DNA, 25 bp, Mus musculus
tatgttgttccgttagttcacccaa

SEQ ID NO: 791276 - DNA, 25 bp, Mus musculus
tatgttgtttctcgctttgattata

SEQ ID NO: 791277 - DNA, 25 bp, Mus musculus
tatgttgtttctggctttgattata

SEQ ID NO: 791278 - DNA, 25 bp, Mus musculus
tatgtttaaccgatcctgaggcagg

SEQ ID NO: 791279 - DNA, 25 bp, Mus musculus
tatgtttaaccgttcctgaggcagg

SEQ ID NO: 791280 - DNA, 25 bp, Mus musculus
tatgtttaattcatgggctttttgt

SEQ ID NO: 791281 - DNA, 25 bp, Mus musculus
tatgtttaattcttgggctttttgt

SEQ ID NO: 791282 - DNA, 25 bp, Mus musculus
tatgtttacaccacgagcattgttc

SEQ ID NO: 791283 - DNA, 25 bp, Mus musculus
tatgtttacacctcgagcattgttc

SEQ ID NO: 791284 - DNA, 25 bp, Mus musculus
tatgtttacatcctccaggcattgc

SEQ ID NO: 791285 - DNA, 25 bp, Mus musculus
tatgtttacatcgtccaggcattgc

SEQ ID NO: 791286 - DNA, 25 bp, Mus musculus
tatgtttacggaaattttgcctgca

SEQ ID NO: 791287 - DNA, 25 bp, Mus musculus
tatgtttacggatattttgcctgca

SEQ ID NO: 791288 - DNA, 25 bp, Mus musculus
tatgtttagccaacgcatggaccaa

SEQ ID NO: 791289 - DNA, 25 bp, Mus musculus
tatgtttagccatcgcatggaccaa

SEQ ID NO: 791290 - DNA, 25 bp, Mus musculus
tatgtttataggctgtctggctgct

SEQ ID NO: 791291 - DNA, 25 bp, Mus musculus
tatgtttatagggtgtctggctgct

SEQ ID NO: 791292 - DNA, 25 bp, Mus musculus
tatgtttatcggagtcttgtctgca

SEQ ID NO: 791293 - DNA, 25 bp, Mus musculus
tatgtttatcggtgtcttgtctgca

SEQ ID NO: 791294 - DNA, 25 bp, Mus musculus
tatgtttcaggtacacgttcagctc

SEQ ID NO: 791295 - DNA, 25 bp, Mus musculus
tatgtttcaggttcacgttcagctc

SEQ ID NO: 791296 - DNA, 25 bp, Mus musculus
tatgtttcattcagctaagtacaaa

SEQ ID NO: 791297 - DNA, 25 bp, Mus musculus
tatgtttcattctgctaagtacaaa

SEQ ID NO: 791298 - DNA, 25 bp, Mus musculus
tatgtttccatacctacatccatcc

SEQ ID NO: 791299 - DNA, 25 bp, Mus musculus
tatgtttccatagctacatccatcc

SEQ ID NO: 791300 - DNA, 25 bp, Mus musculus
tatgtttcccttaggcttatagttg

SEQ ID NO: 791301 - DNA, 25 bp, Mus musculus
tatgtttccctttggcttatagttg

SEQ ID NO: 791302 - DNA, 25 bp, Mus musculus
tatgtttccgggaccttcctgtacg

SEQ ID NO: 791303 - DNA, 25 bp, Mus musculus
tatgtttccgggtccttcctgtacg

SEQ ID NO: 791304 - DNA, 25 bp, Mus musculus
tatgtttcctgtaaccccagggcag

SEQ ID NO: 791305 - DNA, 25 bp, Mus musculus
tatgtttcctgtatcgccaatttat

SEQ ID NO: 791306 - DNA, 25 bp, Mus musculus
tatgtttcctgttaccccagggcag

SEQ ID NO: 791307 - DNA, 25 bp, Mus musculus
tatgtttcctgtttcgccaatttat

SEQ ID NO: 791308 - DNA, 25 bp, Mus musculus
tatgtttctagtccctttcttgtct

SEQ ID NO: 791309 - DNA, 25 bp, Mus musculus
tatgtttctagtgcctttcttgtct

SEQ ID NO: 791310 - DNA, 25 bp, Mus musculus
tatgtttctatgattctccctttct

SEQ ID NO: 791311 - DNA, 25 bp, Mus musculus
tatgtttctatgtttctccctttct

SEQ ID NO: 791312 - DNA, 25 bp, Mus musculus
tatgtttctgatccactacgtgcaa

SEQ ID NO: 791313 - DNA, 25 bp, Mus musculus
tatgtttctgatgcactacgtgcaa

SEQ ID NO: 791314 - DNA, 25 bp, Mus musculus
tatgtttctgttattattcctgtgt

SEQ ID NO: 791315 - DNA, 25 bp, Mus musculus
tatgtttctgtttttattcctgtgt

SEQ ID NO: 791316 - DNA, 25 bp, Mus musculus
tatgtttgatggcatgactgacaca

SEQ ID NO: 791317 - DNA, 25 bp, Mus musculus
tatgtttgatgggatgactgacaca

SEQ ID NO: 791318 - DNA, 25 bp, Mus musculus
tatgtttgcaaccacaagatttgtg

SEQ ID NO: 791319 - DNA, 25 bp, Mus musculus
tatgtttgcaacgacaagatttgtg

SEQ ID NO: 791320 - DNA, 25 bp, Mus musculus
tatgtttgccctaggtctaaatcac

SEQ ID NO: 791321 - DNA, 25 bp, Mus musculus
tatgtttgcccttggtctaaatcac

SEQ ID NO: 791322 - DNA, 25 bp, Mus musculus
tatgtttggaagctactgttccttt

SEQ ID NO: 791323 - DNA, 25 bp, Mus musculus
tatgtttggaaggtactgttccttt

SEQ ID NO: 791324 - DNA, 25 bp, Mus musculus
tatgtttggcatatttgtgtttcta

SEQ ID NO: 791325 - DNA, 25 bp, Mus musculus
tatgtttggcatttttgtgtttcta

SEQ ID NO: 791326 - DNA, 25 bp, Mus musculus
tatgtttgtctgcaggacttcccag

SEQ ID NO: 791327 - DNA, 25 bp, Mus musculus
tatgtttgtctggaggacttcccag

SEQ ID NO: 791328 - DNA, 25 bp, Mus musculus
tatgtttgtgagaggcgtctgctaa

SEQ ID NO: 791329 - DNA, 25 bp, Mus musculus
tatgtttgtgagtggcgtctgctaa

SEQ ID NO: 791330 - DNA, 25 bp, Mus musculus
tatgtttgtgctacctgcactggaa

SEQ ID NO: 791331 - DNA, 25 bp, Mus musculus
tatgtttgtgcttcctgcactggaa

SEQ ID NO: 791332 - DNA, 25 bp, Mus musculus
tatgtttgttttatagtctatttag

SEQ ID NO: 791333 - DNA, 25 bp, Mus musculus
tatgtttgttttttagtctatttag

SEQ ID NO: 791334 - DNA, 25 bp, Mus musculus
tatgttttaagaaagcaccccagtc

SEQ ID NO: 791335 - DNA, 25 bp, Mus musculus
tatgttttaagatagcaccccagtc

SEQ ID NO: 791336 - DNA, 25 bp, Mus musculus
tatgttttagttcgtgctgctttaa

SEQ ID NO: 791337 - DNA, 25 bp, Mus musculus
tatgttttagttggtgctgctttaa

SEQ ID NO: 791338 - DNA, 25 bp, Mus musculus
tatgttttattacctttcacctgaa

SEQ ID NO: 791339 - DNA, 25 bp, Mus musculus
tatgttttattagctttcacctgaa

SEQ ID NO: 791340 - DNA, 25 bp, Mus musculus
tatgttttccatctagttcctctca

SEQ ID NO: 791341 - DNA, 25 bp, Mus musculus
tatgttttccatgtagttcctctca

SEQ ID NO: 791342 - DNA, 25 bp, Mus musculus
tatgttttcttacacctggtaattc

SEQ ID NO: 791343 - DNA, 25 bp, Mus musculus
tatgttttcttagacctggtaattc

SEQ ID NO: 791344 - DNA, 25 bp, Mus musculus
tatgttttctttcgtcagaaacctc

SEQ ID NO: 791345 - DNA, 25 bp, Mus musculus
tatgttttctttggtcagaaacctc

SEQ ID NO: 791346 - DNA, 25 bp, Mus musculus
tatgttttgaagacacatgcttaca

SEQ ID NO: 791347 - DNA, 25 bp, Mus musculus
tatgttttgaagtcacatgcttaca

SEQ ID NO: 791348 - DNA, 25 bp, Mus musculus
tattaaaaacacacttcgaagctgg

SEQ ID NO: 791349 - DNA, 25 bp, Mus musculus
tattaaaaacactcttcgaagctgg

SEQ ID NO: 791350 - DNA, 25 bp, Mus musculus
tattaaaaccacctatctgtcctac

SEQ ID NO: 791351 - DNA, 25 bp, Mus musculus
tattaaaaccacgtatctgtcctac

SEQ ID NO: 791352 - DNA, 25 bp, Mus musculus
tattaaaactcaactgcttgttcac

SEQ ID NO: 791353 - DNA, 25 bp, Mus musculus
tattaaaactcatctgcttgttcac

SEQ ID NO: 791354 - DNA, 25 bp, Mus musculus
tattaaaagatcagtccctcgtccc

SEQ ID NO: 791355 - DNA, 25 bp, Mus musculus
tattaaaagatctgtccctcgtccc

SEQ ID NO: 791356 - DNA, 25 bp, Mus musculus
tattaaacaaacactaaatgaccca

SEQ ID NO: 791357 - DNA, 25 bp, Mus musculus
tattaaacaaactctaaatgaccca

SEQ ID NO: 791358 - DNA, 25 bp, Mus musculus
tattaaacccacaaccagctccaga

SEQ ID NO: 791359 - DNA, 25 bp, Mus musculus
tattaaacccactaccagctccaga

SEQ ID NO: 791360 - DNA, 25 bp, Mus musculus
tattaaagacagagtcccttgcttg

SEQ ID NO: 791361 - DNA, 25 bp, Mus musculus
tattaaagacagtgtcccttgcttg

SEQ ID NO: 791362 - DNA, 25 bp, Mus musculus
tattaaagccttctggccattttta

SEQ ID NO: 791363 - DNA, 25 bp, Mus musculus
tattaaagccttgtggccattttta

SEQ ID NO: 791364 - DNA, 25 bp, Mus musculus
tattaaagggttcggctgttttgca

SEQ ID NO: 791365 - DNA, 25 bp, Mus musculus
tattaaagggttgggctgttttgca

SEQ ID NO: 791366 - DNA, 25 bp, Mus musculus
tattaaagtccaagccattgtcctt

SEQ ID NO: 791367 - DNA, 25 bp, Mus musculus
tattaaagtccatgccattgtcctt

SEQ ID NO: 791368 - DNA, 25 bp, Mus musculus
tattaaatcagtacaagccagtgtg

SEQ ID NO: 791369 - DNA, 25 bp, Mus musculus
tattaaatcagttcaagccagtgtg

SEQ ID NO: 791370 - DNA, 25 bp, Mus musculus
tattaaatcccgctgtgtcccctag

SEQ ID NO: 791371 - DNA, 25 bp, Mus musculus
tattaaatcccggtgtgtcccctag

SEQ ID NO: 791372 - DNA, 25 bp, Mus musculus
tattaaatgaaaacctaccaggtgg

SEQ ID NO: 791373 - DNA, 25 bp, Mus musculus
tattaaatgaaatcctaccaggtgg

SEQ ID NO: 791374 - DNA, 25 bp, Mus musculus
tattaaattgttcagctgcagctga

SEQ ID NO: 791375 - DNA, 25 bp, Mus musculus
tattaaattgttgagctgcagctga

SEQ ID NO: 791376 - DNA, 25 bp, Mus musculus
tattaacaattaacagcctccactc

SEQ ID NO: 791377 - DNA, 25 bp, Mus musculus
tattaacaattatcagcctccactc

SEQ ID NO: 791378 - DNA, 25 bp, Mus musculus
tattaacaccttattgtactttcat

SEQ ID NO: 791379 - DNA, 25 bp, Mus musculus
tattaacacctttttgtactttcat

SEQ ID NO: 791380 - DNA, 25 bp, Mus musculus
tattaacagtagactcactcagccc

SEQ ID NO: 791381 - DNA, 25 bp, Mus musculus
tattaacagtagtctcactcagccc

SEQ ID NO: 791382 - DNA, 25 bp, Mus musculus
tattaacatcctccagtacgtcacc

SEQ ID NO: 791383 - DNA, 25 bp, Mus musculus
tattaacatcctgcagtacgtcacc

SEQ ID NO: 791384 - DNA, 25 bp, Mus musculus
tattaacctattcaactaaagacgt

SEQ ID NO: 791385 - DNA, 25 bp, Mus musculus
tattaacctattgaactaaagacgt

SEQ ID NO: 791386 - DNA, 25 bp, Mus musculus
tattaacctccaagttttgtacgtt

SEQ ID NO: 791387 - DNA, 25 bp, Mus musculus
tattaacctccatgttttgtacgtt

SEQ ID NO: 791388 - DNA, 25 bp, Mus musculus
tattaacgcgttcgcagttgcagcg

SEQ ID NO: 791389 - DNA, 25 bp, Mus musculus
tattaacgcgttggcagttgcagcg

SEQ ID NO: 791390 - DNA, 25 bp, Mus musculus
tattaactccgtaaaggtctcccag

SEQ ID NO: 791391 - DNA, 25 bp, Mus musculus
tattaactccgttaaggtctcccag

SEQ ID NO: 791392 - DNA, 25 bp, Mus musculus
tattaactctggcatactccgggct

SEQ ID NO: 791393 - DNA, 25 bp, Mus musculus
tattaactctgggatactccgggct

SEQ ID NO: 791394 - DNA, 25 bp, Mus musculus
tattaactttccatgtgctgccatt

SEQ ID NO: 791395 - DNA, 25 bp, Mus musculus
tattaactttccttgtgctgccatt

SEQ ID NO: 791396 - DNA, 25 bp, Mus musculus
tattaagacatcactcaggaactcc

SEQ ID NO: 791397 - DNA, 25 bp, Mus musculus
tattaagacatctctcaggaactcc

SEQ ID NO: 791398 - DNA, 25 bp, Mus musculus
tattaagcacagcatctagagagat

SEQ ID NO: 791399 - DNA, 25 bp, Mus musculus
tattaagcacaggatctagagagat

SEQ ID NO: 791400 - DNA, 25 bp, Mus musculus
tattaagcacttaccctgacgtttt

SEQ ID NO: 791401 - DNA, 25 bp, Mus musculus
tattaagcactttccctgacgtttt

SEQ ID NO: 791402 - DNA, 25 bp, Mus musculus
tattaagcagccacaatagtccctg

SEQ ID NO: 791403 - DNA, 25 bp, Mus musculus
tattaagcagcctcaatagtccctg

SEQ ID NO: 791404 - DNA, 25 bp, Mus musculus
tattaagcaggcactcttactccac

SEQ ID NO: 791405 - DNA, 25 bp, Mus musculus
tattaagcaggctctcttactccac

SEQ ID NO: 791406 - DNA, 25 bp, Mus musculus
tattaagcagggatcggcgacggaa

SEQ ID NO: 791407 - DNA, 25 bp, Mus musculus
tattaagcagggttcggcgacggaa

SEQ ID NO: 791408 - DNA, 25 bp, Mus musculus
tattaagcatcacactaccagggag

SEQ ID NO: 791409 - DNA, 25 bp, Mus musculus
tattaagcatcagactaccagggag

SEQ ID NO: 791410 - DNA, 25 bp, Mus musculus
tattaagccagtattgcccagggcc

SEQ ID NO: 791411 - DNA, 25 bp, Mus musculus
tattaagccagttttgcccagggcc

SEQ ID NO: 791412 - DNA, 25 bp, Mus musculus
tattaagcctctcaaatgcctatgc

SEQ ID NO: 791413 - DNA, 25 bp, Mus musculus
tattaagcctctgaaatgcctatgc

SEQ ID NO: 791414 - DNA, 25 bp, Mus musculus
tattaagcctgcagctaccaaaata

SEQ ID NO: 791415 - DNA, 25 bp, Mus musculus
tattaagcctgctgctaccaaaata

SEQ ID NO: 791416 - DNA, 25 bp, Mus musculus
tattaagcgttgagcatcccgggcc

SEQ ID NO: 791417 - DNA, 25 bp, Mus musculus
tattaagcgttgtgcatcccgggcc

SEQ ID NO: 791418 - DNA, 25 bp, Mus musculus
tattaagcttagcacccatcattaa

SEQ ID NO: 791419 - DNA, 25 bp, Mus musculus
tattaagcttaggacccatcattaa

SEQ ID NO: 791420 - DNA, 25 bp, Mus musculus
tattaaggagaaatatctttcgcct

SEQ ID NO: 791421 - DNA, 25 bp, Mus musculus
tattaaggagaattatctttcgcct

SEQ ID NO: 791422 - DNA, 25 bp, Mus musculus
tattaaggcccacttaccagcattg

SEQ ID NO: 791423 - DNA, 25 bp, Mus musculus
tattaaggcccagttaccagcattg

SEQ ID NO: 791424 - DNA, 25 bp, Mus musculus
tattaaggtgatattgctcaatcca

SEQ ID NO: 791425 - DNA, 25 bp, Mus musculus
tattaaggtgattttgctcaatcca

SEQ ID NO: 791426 - DNA, 25 bp, Mus musculus
tattaagtgttaacctcttccgctc

SEQ ID NO: 791427 - DNA, 25 bp, Mus musculus
tattaagtgttatcctcttccgctc

SEQ ID NO: 791428 - DNA, 25 bp, Mus musculus
tattaataattcacacacagtgggt

SEQ ID NO: 791429 - DNA, 25 bp, Mus musculus
tattaataattctcacacagtgggt

SEQ ID NO: 791430 - DNA, 25 bp, Mus musculus
tattaatacagaaacctcttattta

SEQ ID NO: 791431 - DNA, 25 bp, Mus musculus
tattaatacagatacctcttattta

SEQ ID NO: 791432 - DNA, 25 bp, Mus musculus
tattaatatgaaattcttacctggc

SEQ ID NO: 791433 - DNA, 25 bp, Mus musculus
tattaatatgaatttcttacctggc

SEQ ID NO: 791434 - DNA, 25 bp, Mus musculus
tattaatccacccgcagaagcactt

SEQ ID NO: 791435 - DNA, 25 bp, Mus musculus
tattaatccaccggcagaagcactt

SEQ ID NO: 791436 - DNA, 25 bp, Mus musculus
tattaatcccatccacgtttgtgag

SEQ ID NO: 791437 - DNA, 25 bp, Mus musculus
tattaatcccatgcacgtttgtgag

SEQ ID NO: 791438 - DNA, 25 bp, Mus musculus
tattaatccctcacttgtatggata

SEQ ID NO: 791439 - DNA, 25 bp, Mus musculus
tattaatccctctcttgtatggata

SEQ ID NO: 791440 - DNA, 25 bp, Mus musculus
tattaatctttcaccgttctgctct

SEQ ID NO: 791441 - DNA, 25 bp, Mus musculus
tattaatctttctccgttctgctct

SEQ ID NO: 791442 - DNA, 25 bp, Mus musculus
tattaatcttttcacctaaccctag

SEQ ID NO: 791443 - DNA, 25 bp, Mus musculus
tattaatcttttgacctaaccctag

SEQ ID NO: 791444 - DNA, 25 bp, Mus musculus
tattaatgagacaggcttgggtatc

SEQ ID NO: 791445 - DNA, 25 bp, Mus musculus
tattaatgagactggcttgggtatc

SEQ ID NO: 791446 - DNA, 25 bp, Mus musculus
tattaatgccagcaagccgtgtctc

SEQ ID NO: 791447 - DNA, 25 bp, Mus musculus
tattaatgccaggaagccgtgtctc

SEQ ID NO: 791448 - DNA, 25 bp, Mus musculus
tattaatgccccacttggcttcttg

SEQ ID NO: 791449 - DNA, 25 bp, Mus musculus
tattaatgcccctcttggcttcttg

SEQ ID NO: 791450 - DNA, 25 bp, Mus musculus
tattaatgctaacggctggcccaga

SEQ ID NO: 791451 - DNA, 25 bp, Mus musculus
tattaatgctaagggctggcccaga

SEQ ID NO: 791452 - DNA, 25 bp, Mus musculus
tattaattacttcaggctaggccta

SEQ ID NO: 791453 - DNA, 25 bp, Mus musculus
tattaattacttgaggctaggccta

SEQ ID NO: 791454 - DNA, 25 bp, Mus musculus
tattaattagcccttgttctccctg

SEQ ID NO: 791455 - DNA, 25 bp, Mus musculus
tattaattagccgttgttctccctg

SEQ ID NO: 791456 - DNA, 25 bp, Mus musculus
tattaattcatgaccgagaacaacg

SEQ ID NO: 791457 - DNA, 25 bp, Mus musculus
tattaattcatgtccgagaacaacg

SEQ ID NO: 791458 - DNA, 25 bp, Mus musculus
tattaattgatcctcttcctggcca

SEQ ID NO: 791459 - DNA, 25 bp, Mus musculus
tattaattgatcgtcttcctggcca

SEQ ID NO: 791460 - DNA, 25 bp, Mus musculus
tattaattgcttcagcctacccatg

SEQ ID NO: 791461 - DNA, 25 bp, Mus musculus
tattaattgcttgagcctacccatg

SEQ ID NO: 791462 - DNA, 25 bp, Mus musculus
tattacaaagctcttaccccacctt

SEQ ID NO: 791463 - DNA, 25 bp, Mus musculus
tattacaaagctgttaccccacctt

SEQ ID NO: 791464 - DNA, 25 bp, Mus musculus
tattacaacaagactcccgggtttg

SEQ ID NO: 791465 - DNA, 25 bp, Mus musculus
tattacaacaagtctcccgggtttg

SEQ ID NO: 791466 - DNA, 25 bp, Mus musculus
tattacaactctcactgtagtcatg

SEQ ID NO: 791467 - DNA, 25 bp, Mus musculus
tattacaactctgactgtagtcatg

SEQ ID NO: 791468 - DNA, 25 bp, Mus musculus
tattacaagacacgttgctttgcaa

SEQ ID NO: 791469 - DNA, 25 bp, Mus musculus
tattacaagacaggttgctttgcaa

SEQ ID NO: 791470 - DNA, 25 bp, Mus musculus
tattacaagagtccgccttgcctga

SEQ ID NO: 791471 - DNA, 25 bp, Mus musculus
tattacaagagtgcgccttgcctga

SEQ ID NO: 791472 - DNA, 25 bp, Mus musculus
tattacaaggcccagtcacgtttca

SEQ ID NO: 791473 - DNA, 25 bp, Mus musculus
tattacaaggccgagtcacgtttca

SEQ ID NO: 791474 - DNA, 25 bp, Mus musculus
tattacaaggctaacatggagggcg

SEQ ID NO: 791475 - DNA, 25 bp, Mus musculus
tattacaaggcttacatggagggcg

SEQ ID NO: 791476 - DNA, 25 bp, Mus musculus
tattacaccattccaaacctgactg

SEQ ID NO: 791477 - DNA, 25 bp, Mus musculus
tattacaccattgcaaacctgactg

SEQ ID NO: 791478 - DNA, 25 bp, Mus musculus
tattacacccttctttatgacaagt

SEQ ID NO: 791479 - DNA, 25 bp, Mus musculus
tattacacccttgtttatgacaagt

SEQ ID NO: 791480 - DNA, 25 bp, Mus musculus
tattacaccgtcacagccagtgaaa

SEQ ID NO: 791481 - DNA, 25 bp, Mus musculus
tattacaccgtctcagccagtgaaa

SEQ ID NO: 791482 - DNA, 25 bp, Mus musculus
tattacacgcatcctcaagtcgctg

SEQ ID NO: 791483 - DNA, 25 bp, Mus musculus
tattacacgcatgctcaagtcgctg

SEQ ID NO: 791484 - DNA, 25 bp, Mus musculus
tattacactcttatcagggcacagt

SEQ ID NO: 791485 - DNA, 25 bp, Mus musculus
tattacactcttttcagggcacagt

SEQ ID NO: 791486 - DNA, 25 bp, Mus musculus
tattacagccagagtcatcttctcc

SEQ ID NO: 791487 - DNA, 25 bp, Mus musculus
tattacagccagtgtcatcttctcc

SEQ ID NO: 791488 - DNA, 25 bp, Mus musculus
tattacagttagcttaaattcatat

SEQ ID NO: 791489 - DNA, 25 bp, Mus musculus
tattacagttaggttaaattcatat

SEQ ID NO: 791490 - DNA, 25 bp, Mus musculus
tattacatatgaactcccatggcat

SEQ ID NO: 791491 - DNA, 25 bp, Mus musculus
tattacatatgatctcccatggcat

SEQ ID NO: 791492 - DNA, 25 bp, Mus musculus
tattacatcactatacccgagccat

SEQ ID NO: 791493 - DNA, 25 bp, Mus musculus
tattacatcactttacccgagccat

SEQ ID NO: 791494 - DNA, 25 bp, Mus musculus
tattacatcccacggctggaaccca

SEQ ID NO: 791495 - DNA, 25 bp, Mus musculus
tattacatcccagggctggaaccca

SEQ ID NO: 791496 - DNA, 25 bp, Mus musculus
tattacatccctagtggcacatttt

SEQ ID NO: 791497 - DNA, 25 bp, Mus musculus
tattacatcccttgtggcacatttt

SEQ ID NO: 791498 - DNA, 25 bp, Mus musculus
tattacatgtatactatccgcaacc

SEQ ID NO: 791499 - DNA, 25 bp, Mus musculus
tattacatgtattctatccgcaacc

SEQ ID NO: 791500 - DNA, 25 bp, Mus musculus
tattacattgcccattgctcagcac

SEQ ID NO: 791501 - DNA, 25 bp, Mus musculus
tattacattgccgattgctcagcac

SEQ ID NO: 791502 - DNA, 25 bp, Mus musculus
tattacattgctcttcctgaaacta

SEQ ID NO: 791503 - DNA, 25 bp, Mus musculus
tattacattgctgttcctgaaacta

SEQ ID NO: 791504 - DNA, 25 bp, Mus musculus
tattacatttagatggactgtgtgt

SEQ ID NO: 791505 - DNA, 25 bp, Mus musculus
tattacatttagttggactgtgtgt

SEQ ID NO: 791506 - DNA, 25 bp, Mus musculus
tattacattttaacttgtgctgaaa

SEQ ID NO: 791507 - DNA, 25 bp, Mus musculus
tattacattttatcttgtgctgaaa

SEQ ID NO: 791508 - DNA, 25 bp, Mus musculus
tattaccaatccctgtcagcagctg

SEQ ID NO: 791509 - DNA, 25 bp, Mus musculus
tattaccaatccgtgtcagcagctg

SEQ ID NO: 791510 - DNA, 25 bp, Mus musculus
tattaccaatcgctgggactcgaga

SEQ ID NO: 791511 - DNA, 25 bp, Mus musculus
tattaccaatcggtgggactcgaga

SEQ ID NO: 791512 - DNA, 25 bp, Mus musculus
tattaccacgctctctagcatttat

SEQ ID NO: 791513 - DNA, 25 bp, Mus musculus
tattaccacgctgtctagcatttat

SEQ ID NO: 791514 - DNA, 25 bp, Mus musculus
tattaccagacacgcttctctgcag

SEQ ID NO: 791515 - DNA, 25 bp, Mus musculus
tattaccagacaggcttctctgcag

SEQ ID NO: 791516 - DNA, 25 bp, Mus musculus
tattaccatactatctcaccatcaa

SEQ ID NO: 791517 - DNA, 25 bp, Mus musculus
tattaccatactttctcaccatcaa

SEQ ID NO: 791518 - DNA, 25 bp, Mus musculus
tattaccatggtagttagactcaaa

SEQ ID NO: 791519 - DNA, 25 bp, Mus musculus
tattaccatggttgttagactcaaa

SEQ ID NO: 791520 - DNA, 25 bp, Mus musculus
tattacccaagtattctccagtgaa

SEQ ID NO: 791521 - DNA, 25 bp, Mus musculus
tattacccaagttttctccagtgaa

SEQ ID NO: 791522 - DNA, 25 bp, Mus musculus
tattacccaggaccaactgcagcat

SEQ ID NO: 791523 - DNA, 25 bp, Mus musculus
tattacccaggagcaactgcagcat

SEQ ID NO: 791524 - DNA, 25 bp, Mus musculus
tattaccgtcggaatattggatggg

SEQ ID NO: 791525 - DNA, 25 bp, Mus musculus
tattaccgtcggtatattggatggg

SEQ ID NO: 791526 - DNA, 25 bp, Mus musculus
tattaccgtttaagaactctagtga

SEQ ID NO: 791527 - DNA, 25 bp, Mus musculus
tattaccgtttatgaactctagtga

SEQ ID NO: 791528 - DNA, 25 bp, Mus musculus
tattacctatcaaactcctctggag

SEQ ID NO: 791529 - DNA, 25 bp, Mus musculus
tattacctatcatactcctctggag

SEQ ID NO: 791530 - DNA, 25 bp, Mus musculus
tattacctcttgaatgtccccattt

SEQ ID NO: 791531 - DNA, 25 bp, Mus musculus
tattacctcttgtatgtccccattt

SEQ ID NO: 791532 - DNA, 25 bp, Mus musculus
tattacctgttgctttcccagcgta

SEQ ID NO: 791533 - DNA, 25 bp, Mus musculus
tattacctgttggtttcccagcgta

SEQ ID NO: 791534 - DNA, 25 bp, Mus musculus
tattaccttatcctggcgccaagat

SEQ ID NO: 791535 - DNA, 25 bp, Mus musculus
tattaccttatcgtggcgccaagat

SEQ ID NO: 791536 - DNA, 25 bp, Mus musculus
tattacgacatgaacgctgccaacg

SEQ ID NO: 791537 - DNA, 25 bp, Mus musculus
tattacgacatgtacgctgccaacg

SEQ ID NO: 791538 - DNA, 25 bp, Mus musculus
tattacgatataccctgtcatggat

SEQ ID NO: 791539 - DNA, 25 bp, Mus musculus
tattacgatatagcctgtcatggat

SEQ ID NO: 791540 - DNA, 25 bp, Mus musculus
tattacgatctgcaaatttgcaagc

SEQ ID NO: 791541 - DNA, 25 bp, Mus musculus
tattacgatctggaaatttgcaagc

SEQ ID NO: 791542 - DNA, 25 bp, Mus musculus
tattacgatgtaatttgtgaggcag

SEQ ID NO: 791543 - DNA, 25 bp, Mus musculus
tattacgatgtattttgtgaggcag

SEQ ID NO: 791544 - DNA, 25 bp, Mus musculus
tattacgggcctatgggaattgccg

SEQ ID NO: 791545 - DNA, 25 bp, Mus musculus
tattacgggcctttgggaattgccg

SEQ ID NO: 791546 - DNA, 25 bp, Mus musculus
tattacggtcaactccagacaaggc

SEQ ID NO: 791547 - DNA, 25 bp, Mus musculus
tattacggtcaagtccagacaaggc

SEQ ID NO: 791548 - DNA, 25 bp, Mus musculus
tattacgtaccaactgccgtgtgtt

SEQ ID NO: 791549 - DNA, 25 bp, Mus musculus
tattacgtaccatctgccgtgtgtt

SEQ ID NO: 791550 - DNA, 25 bp, Mus musculus
tattacgtcacgcacatctaggccc

SEQ ID NO: 791551 - DNA, 25 bp, Mus musculus
tattacgtcacggacatctaggccc

SEQ ID NO: 791552 - DNA, 25 bp, Mus musculus
tattactaatttactttacccacat

SEQ ID NO: 791553 - DNA, 25 bp, Mus musculus
tattactaattttctttacccacat

SEQ ID NO: 791554 - DNA, 25 bp, Mus musculus
tattactaccttaccatcttgtgtc

SEQ ID NO: 791555 - DNA, 25 bp, Mus musculus
tattactacctttccatcttgtgtc

SEQ ID NO: 791556 - DNA, 25 bp, Mus musculus
tattactacttaaagtcccttcgtg

SEQ ID NO: 791557 - DNA, 25 bp, Mus musculus
tattactacttatagtcccttcgtg

SEQ ID NO: 791558 - DNA, 25 bp, Mus musculus
tattactatactctaatccaggcaa

SEQ ID NO: 791559 - DNA, 25 bp, Mus musculus
tattactatactgtaatccaggcaa

SEQ ID NO: 791560 - DNA, 25 bp, Mus musculus
tattactcaggtactaaccccagga

SEQ ID NO: 791561 - DNA, 25 bp, Mus musculus
tattactcaggttctaaccccagga

SEQ ID NO: 791562 - DNA, 25 bp, Mus musculus
tattactccaagcactgcggttcct

SEQ ID NO: 791563 - DNA, 25 bp, Mus musculus
tattactccaaggactgcggttcct

SEQ ID NO: 791564 - DNA, 25 bp, Mus musculus
tattactcgcccaactttttgaatt

SEQ ID NO: 791565 - DNA, 25 bp, Mus musculus
tattactcgccctactttttgaatt

SEQ ID NO: 791566 - DNA, 25 bp, Mus musculus
tattactctatgaatgtatgatgta

SEQ ID NO: 791567 - DNA, 25 bp, Mus musculus
tattactctatgtatgtatgatgta

SEQ ID NO: 791568 - DNA, 25 bp, Mus musculus
tattactctctcaggtgctggtgac

SEQ ID NO: 791569 - DNA, 25 bp, Mus musculus
tattactctctctggtgctggtgac

SEQ ID NO: 791570 - DNA, 25 bp, Mus musculus
tattactctgtaaatgatgcatcga

SEQ ID NO: 791571 - DNA, 25 bp, Mus musculus
tattactctgtatatgatgcatcga

SEQ ID NO: 791572 - DNA, 25 bp, Mus musculus
tattactgaagccatgttgtgctca

SEQ ID NO: 791573 - DNA, 25 bp, Mus musculus
tattactgaagcgatgttgtgctca

SEQ ID NO: 791574 - DNA, 25 bp, Mus musculus
tattactgcacaaactgccatctcg

SEQ ID NO: 791575 - DNA, 25 bp, Mus musculus
tattactgcacatactgccatctcg

SEQ ID NO: 791576 - DNA, 25 bp, Mus musculus
tattactgcggaccagaatgcttca

SEQ ID NO: 791577 - DNA, 25 bp, Mus musculus
tattactgcggagcagaatgcttca

SEQ ID NO: 791578 - DNA, 25 bp, Mus musculus
tattactgtagtccctatggtgact

SEQ ID NO: 791579 - DNA, 25 bp, Mus musculus
tattactgtagtgcctatggtgact

SEQ ID NO: 791580 - DNA, 25 bp, Mus musculus
tattacttgtccctccatttttctt

SEQ ID NO: 791581 - DNA, 25 bp, Mus musculus
tattacttgtccgtccatttttctt

SEQ ID NO: 791582 - DNA, 25 bp, Mus musculus
tattactttcacctgatctcatatt

SEQ ID NO: 791583 - DNA, 25 bp, Mus musculus
tattactttcacgtgatctcatatt

SEQ ID NO: 791584 - DNA, 25 bp, Mus musculus
tattactttccaaaagctgtaggaa

SEQ ID NO: 791585 - DNA, 25 bp, Mus musculus
tattactttccataagctgtaggaa

SEQ ID NO: 791586 - DNA, 25 bp, Mus musculus
tattactttcgcctggaactctcac

SEQ ID NO: 791587 - DNA, 25 bp, Mus musculus
tattactttcgcgtggaactctcac

SEQ ID NO: 791588 - DNA, 25 bp, Mus musculus
tattagacctttccttacacagacc

SEQ ID NO: 791589 - DNA, 25 bp, Mus musculus
tattagacctttgcttacacagacc

SEQ ID NO: 791590 - DNA, 25 bp, Mus musculus
tattagcaagcgagtctgacatgtg

SEQ ID NO: 791591 - DNA, 25 bp, Mus musculus
tattagcaagcgtgtctgacatgtg

SEQ ID NO: 791592 - DNA, 25 bp, Mus musculus
tattagcacaaaaacactgactggg

SEQ ID NO: 791593 - DNA, 25 bp, Mus musculus
tattagcacaaatacactgactggg

SEQ ID NO: 791594 - DNA, 25 bp, Mus musculus
tattagcacatgaagtatcacttga

SEQ ID NO: 791595 - DNA, 25 bp, Mus musculus
tattagcacatgtagtatcacttga

SEQ ID NO: 791596 - DNA, 25 bp, Mus musculus
tattagcactgtatcccttgtgcca

SEQ ID NO: 791597 - DNA, 25 bp, Mus musculus
tattagcactgtttcccttgtgcca

SEQ ID NO: 791598 - DNA, 25 bp, Mus musculus
tattagcatcaaccatctctccaac

SEQ ID NO: 791599 - DNA, 25 bp, Mus musculus
tattagcatcaagcatctctccaac

SEQ ID NO: 791600 - DNA, 25 bp, Mus musculus
tattagcatgcgctgccgtgggcat

SEQ ID NO: 791601 - DNA, 25 bp, Mus musculus
tattagcatgcggtgccgtgggcat

SEQ ID NO: 791602 - DNA, 25 bp, Mus musculus
tattagccacggatatcagtcgcca

SEQ ID NO: 791603 - DNA, 25 bp, Mus musculus
tattagccacggttatcagtcgcca

SEQ ID NO: 791604 - DNA, 25 bp, Mus musculus
tattagccagttatgtgagaggtaa

SEQ ID NO: 791605 - DNA, 25 bp, Mus musculus
tattagccagttttgtgagaggtaa

SEQ ID NO: 791606 - DNA, 25 bp, Mus musculus
tattagcccaacaagtatgttgcaa

SEQ ID NO: 791607 - DNA, 25 bp, Mus musculus
tattagcccaactagtatgttgcaa

SEQ ID NO: 791608 - DNA, 25 bp, Mus musculus
tattagcctagtcatgtgccttgaa

SEQ ID NO: 791609 - DNA, 25 bp, Mus musculus
tattagcctagtgatgtgccttgaa

SEQ ID NO: 791610 - DNA, 25 bp, Mus musculus
tattagccttcacgtctgtctccaa

SEQ ID NO: 791611 - DNA, 25 bp, Mus musculus
tattagccttcaggtctgtctccaa

SEQ ID NO: 791612 - DNA, 25 bp, Mus musculus
tattagctattgctaatccacgtgt

SEQ ID NO: 791613 - DNA, 25 bp, Mus musculus
tattagctattggtaatccacgtgt

SEQ ID NO: 791614 - DNA, 25 bp, Mus musculus
tattagctcagtaggttgtgctggg

SEQ ID NO: 791615 - DNA, 25 bp, Mus musculus
tattagctcagttggttgtgctggg

SEQ ID NO: 791616 - DNA, 25 bp, Mus musculus
tattagctgaaaagtgagtctggga

SEQ ID NO: 791617 - DNA, 25 bp, Mus musculus
tattagctgaaatgtgagtctggga

SEQ ID NO: 791618 - DNA, 25 bp, Mus musculus
tattaggacatgacccacacacgat

SEQ ID NO: 791619 - DNA, 25 bp, Mus musculus
tattaggacatgtcccacacacgat

SEQ ID NO: 791620 - DNA, 25 bp, Mus musculus
tattaggagggacgtcaggtaccct

SEQ ID NO: 791621 - DNA, 25 bp, Mus musculus
tattaggagggaggtcaggtaccct

SEQ ID NO: 791622 - DNA, 25 bp, Mus musculus
tattaggatacgaggaattctcccc

SEQ ID NO: 791623 - DNA, 25 bp, Mus musculus
tattaggatacgtggaattctcccc

SEQ ID NO: 791624 - DNA, 25 bp, Mus musculus
tattaggatagtcaagtcccctgga

SEQ ID NO: 791625 - DNA, 25 bp, Mus musculus
tattaggatagtgaagtcccctgga

SEQ ID NO: 791626 - DNA, 25 bp, Mus musculus
tattaggccaatccaatgactcagc

SEQ ID NO: 791627 - DNA, 25 bp, Mus musculus
tattaggccaatgcaatgactcagc

SEQ ID NO: 791628 - DNA, 25 bp, Mus musculus
tattaggtaacgagtgcatcttatt

SEQ ID NO: 791629 - DNA, 25 bp, Mus musculus
tattaggtaacgtgtgcatcttatt

SEQ ID NO: 791630 - DNA, 25 bp, Mus musculus
tattaggtaccacggatgcaggaat

SEQ ID NO: 791631 - DNA, 25 bp, Mus musculus
tattaggtaccagggatgcaggaat

SEQ ID NO: 791632 - DNA, 25 bp, Mus musculus
tattaggtgtctccatctcaacaaa

SEQ ID NO: 791633 - DNA, 25 bp, Mus musculus
tattaggtgtctgcatctcaacaaa

SEQ ID NO: 791634 - DNA, 25 bp, Mus musculus
tattaggtgttactttcagtcacta

SEQ ID NO: 791635 - DNA, 25 bp, Mus musculus
tattaggtgttagtttcagtcacta

SEQ ID NO: 791636 - DNA, 25 bp, Mus musculus
tattagtaactcagccgaagaccca

SEQ ID NO: 791637 - DNA, 25 bp, Mus musculus
tattagtaactctgccgaagaccca

SEQ ID NO: 791638 - DNA, 25 bp, Mus musculus
tattagtatacgaagtacccgggat

SEQ ID NO: 791639 - DNA, 25 bp, Mus musculus
tattagtatacgtagtacccgggat

SEQ ID NO: 791640 - DNA, 25 bp, Mus musculus
tattagtattagctgctagcactgc

SEQ ID NO: 791641 - DNA, 25 bp, Mus musculus
tattagtattaggtgctagcactgc

SEQ ID NO: 791642 - DNA, 25 bp, Mus musculus
tattagtccaacagaactttaggtt

SEQ ID NO: 791643 - DNA, 25 bp, Mus musculus
tattagtccaactgaactttaggtt

SEQ ID NO: 791644 - DNA, 25 bp, Mus musculus
tattagtccatgcttcacttagaca

SEQ ID NO: 791645 - DNA, 25 bp, Mus musculus
tattagtccatggttcacttagaca

SEQ ID NO: 791646 - DNA, 25 bp, Mus musculus
tattagtctctgctttatttgcata

SEQ ID NO: 791647 - DNA, 25 bp, Mus musculus
tattagtctctggtttatttgcata

SEQ ID NO: 791648 - DNA, 25 bp, Mus musculus
tattagtcttgccagtctctttaag

SEQ ID NO: 791649 - DNA, 25 bp, Mus musculus
tattagtcttgcgagtctctttaag

SEQ ID NO: 791650 - DNA, 25 bp, Mus musculus
tattagtgacacaccagagcccatt

SEQ ID NO: 791651 - DNA, 25 bp, Mus musculus
tattagtgacactccagagcccatt

SEQ ID NO: 791652 - DNA, 25 bp, Mus musculus
tattagtgccttatttctttcatgt

SEQ ID NO: 791653 - DNA, 25 bp, Mus musculus
tattagtgccttttttctttcatgt

SEQ ID NO: 791654 - DNA, 25 bp, Mus musculus
tattagtgtcctatccatgtcacag

SEQ ID NO: 791655 - DNA, 25 bp, Mus musculus
tattagtgtcctttccatgtcacag

SEQ ID NO: 791656 - DNA, 25 bp, Mus musculus
tattagtgtggcactaggaagggtc

SEQ ID NO: 791657 - DNA, 25 bp, Mus musculus
tattagtgtggctctaggaagggtc

SEQ ID NO: 791658 - DNA, 25 bp, Mus musculus
tattagtgtgttagtttggtccaga

SEQ ID NO: 791659 - DNA, 25 bp, Mus musculus
tattagtgtgtttgtttggtccaga

SEQ ID NO: 791660 - DNA, 25 bp, Mus musculus
tattagtgttaccagcattcatgtg

SEQ ID NO: 791661 - DNA, 25 bp, Mus musculus
tattagtgttacgagcattcatgtg

SEQ ID NO: 791662 - DNA, 25 bp, Mus musculus
tattagtgtttgaaccctgtctctc

SEQ ID NO: 791663 - DNA, 25 bp, Mus musculus
tattagtgtttgtaccctgtctctc

SEQ ID NO: 791664 - DNA, 25 bp, Mus musculus
tattagttgcctatctgttgctggg

SEQ ID NO: 791665 - DNA, 25 bp, Mus musculus
tattagttgcctttctgttgctggg

SEQ ID NO: 791666 - DNA, 25 bp, Mus musculus
tattagttgtgcctgttccttgtac

SEQ ID NO: 791667 - DNA, 25 bp, Mus musculus
tattagttgtgcgtgttccttgtac

SEQ ID NO: 791668 - DNA, 25 bp, Mus musculus
tattagtttactactcttgcattaa

SEQ ID NO: 791669 - DNA, 25 bp, Mus musculus
tattagtttacttctcttgcattaa

SEQ ID NO: 791670 - DNA, 25 bp, Mus musculus
tattagtttctcatacaccacagcc

SEQ ID NO: 791671 - DNA, 25 bp, Mus musculus
tattagtttctcttacaccacagcc

SEQ ID NO: 791672 - DNA, 25 bp, Mus musculus
tattataaagcaagagattcaccgc

SEQ ID NO: 791673 - DNA, 25 bp, Mus musculus
tattataaagcatgagattcaccgc

SEQ ID NO: 791674 - DNA, 25 bp, Mus musculus
tattataaattcactcccactaccc

SEQ ID NO: 791675 - DNA, 25 bp, Mus musculus
tattataaattctctcccactaccc

SEQ ID NO: 791676 - DNA, 25 bp, Mus musculus
tattataactacaaggatcctgctg

SEQ ID NO: 791677 - DNA, 25 bp, Mus musculus
tattataactactaggatcctgctg

SEQ ID NO: 791678 - DNA, 25 bp, Mus musculus
tattataagattaagagacctgtgt

SEQ ID NO: 791679 - DNA, 25 bp, Mus musculus
tattataagatttagagacctgtgt

SEQ ID NO: 791680 - DNA, 25 bp, Mus musculus
tattataatttgattccccatggaa

SEQ ID NO: 791681 - DNA, 25 bp, Mus musculus
tattataatttgtttccccatggaa

SEQ ID NO: 791682 - DNA, 25 bp, Mus musculus
tattatacacgtaccagcttctgga

SEQ ID NO: 791683 - DNA, 25 bp, Mus musculus
tattatacacgttccagcttctgga

SEQ ID NO: 791684 - DNA, 25 bp, Mus musculus
tattatacatctatgctggccttga

SEQ ID NO: 791685 - DNA, 25 bp, Mus musculus
tattatacatctttgctggccttga

SEQ ID NO: 791686 - DNA, 25 bp, Mus musculus
tattatacctgaaaccttgttttca

SEQ ID NO: 791687 - DNA, 25 bp, Mus musculus
tattatacctgataccttgttttca

SEQ ID NO: 791688 - DNA, 25 bp, Mus musculus
tattatactcccacgacttctccct

SEQ ID NO: 791689 - DNA, 25 bp, Mus musculus
tattatactccctcgacttctccct

SEQ ID NO: 791690 - DNA, 25 bp, Mus musculus
tattatactgggatattttctgcat

SEQ ID NO: 791691 - DNA, 25 bp, Mus musculus
tattatactgggttattttctgcat

SEQ ID NO: 791692 - DNA, 25 bp, Mus musculus
tattatagacaactctcaccactcc

SEQ ID NO: 791693 - DNA, 25 bp, Mus musculus
tattatagacaagtctcaccactcc

SEQ ID NO: 791694 - DNA, 25 bp, Mus musculus
tattatagcctgagagtggagatca

SEQ ID NO: 791695 - DNA, 25 bp, Mus musculus
tattatagcctgtgagtggagatca

SEQ ID NO: 791696 - DNA, 25 bp, Mus musculus
tattatagctccagtatttcatact

SEQ ID NO: 791697 - DNA, 25 bp, Mus musculus
tattatagctcctgtatttcatact

SEQ ID NO: 791698 - DNA, 25 bp, Mus musculus
tattatatacacaggacttctacgg

SEQ ID NO: 791699 - DNA, 25 bp, Mus musculus
tattatatacactggacttctacgg

SEQ ID NO: 791700 - DNA, 25 bp, Mus musculus
tattatatgatgctttggaggttgg

SEQ ID NO: 791701 - DNA, 25 bp, Mus musculus
tattatatgatggtttggaggttgg

SEQ ID NO: 791702 - DNA, 25 bp, Mus musculus
tattatatgtccatgcaacccctac

SEQ ID NO: 791703 - DNA, 25 bp, Mus musculus
tattatatgtccttgcaacccctac

SEQ ID NO: 791704 - DNA, 25 bp, Mus musculus
tattatatgtttcaagcctagtgac

SEQ ID NO: 791705 - DNA, 25 bp, Mus musculus
tattatatgtttgaagcctagtgac

SEQ ID NO: 791706 - DNA, 25 bp, Mus musculus
tattatattctaaacaccacggtgg

SEQ ID NO: 791707 - DNA, 25 bp, Mus musculus
tattatattctatacaccacggtgg

SEQ ID NO: 791708 - DNA, 25 bp, Mus musculus
tattatcaacccaacatctacagct

SEQ ID NO: 791709 - DNA, 25 bp, Mus musculus
tattatcaaccctacatctacagct

SEQ ID NO: 791710 - DNA, 25 bp, Mus musculus
tattatcaacttagcttctctttgc

SEQ ID NO: 791711 - DNA, 25 bp, Mus musculus
tattatcaactttgcttctctttgc

SEQ ID NO: 791712 - DNA, 25 bp, Mus musculus
tattatcacgttaggcttttgcagc

SEQ ID NO: 791713 - DNA, 25 bp, Mus musculus
tattatcacgtttggcttttgcagc

SEQ ID NO: 791714 - DNA, 25 bp, Mus musculus
tattatcagatcatcactagcagat

SEQ ID NO: 791715 - DNA, 25 bp, Mus musculus
tattatcagatcttcactagcagat

SEQ ID NO: 791716 - DNA, 25 bp, Mus musculus
tattatcaggtacagggcagcacat

SEQ ID NO: 791717 - DNA, 25 bp, Mus musculus
tattatcaggtagagggcagcacat

SEQ ID NO: 791718 - DNA, 25 bp, Mus musculus
tattatcagtttcgccttcactgct

SEQ ID NO: 791719 - DNA, 25 bp, Mus musculus
tattatcagtttggccttcactgct

SEQ ID NO: 791720 - DNA, 25 bp, Mus musculus
tattatcatcccactcaacgcaaac

SEQ ID NO: 791721 - DNA, 25 bp, Mus musculus
tattatcatccctctcaacgcaaac

SEQ ID NO: 791722 - DNA, 25 bp, Mus musculus
tattatccaccaatctgttttcctc

SEQ ID NO: 791723 - DNA, 25 bp, Mus musculus
tattatccaccattctgttttcctc

SEQ ID NO: 791724 - DNA, 25 bp, Mus musculus
tattatccacgacacgaacctggga

SEQ ID NO: 791725 - DNA, 25 bp, Mus musculus
tattatccacgagacgaacctggga

SEQ ID NO: 791726 - DNA, 25 bp, Mus musculus
tattatccatccacagctcttgcag

SEQ ID NO: 791727 - DNA, 25 bp, Mus musculus
tattatccatcctcagctcttgcag

SEQ ID NO: 791728 - DNA, 25 bp, Mus musculus
tattatcccaccatctagaaacctc

SEQ ID NO: 791729 - DNA, 25 bp, Mus musculus
tattatcccaccttctagaaacctc

SEQ ID NO: 791730 - DNA, 25 bp, Mus musculus
tattatccccaacgagagctgcgca

SEQ ID NO: 791731 - DNA, 25 bp, Mus musculus
tattatccccaaggagagctgcgca

SEQ ID NO: 791732 - DNA, 25 bp, Mus musculus
tattatccccggactgagggtgaat

SEQ ID NO: 791733 - DNA, 25 bp, Mus musculus
tattatccccggtctgagggtgaat

SEQ ID NO: 791734 - DNA, 25 bp, Mus musculus
tattatcccttgagtcagtacctaa

SEQ ID NO: 791735 - DNA, 25 bp, Mus musculus
tattatcccttgtgtcagtacctaa

SEQ ID NO: 791736 - DNA, 25 bp, Mus musculus
tattatccgggtaggaagactgctg

SEQ ID NO: 791737 - DNA, 25 bp, Mus musculus
tattatccgggttggaagactgctg

SEQ ID NO: 791738 - DNA, 25 bp, Mus musculus
tattatcctggtattcacttgtgca

SEQ ID NO: 791739 - DNA, 25 bp, Mus musculus
tattatcctggtcgctcattaccca

SEQ ID NO: 791740 - DNA, 25 bp, Mus musculus
tattatcctggtggctcattaccca

SEQ ID NO: 791741 - DNA, 25 bp, Mus musculus
tattatcctggttttcacttgtgca

SEQ ID NO: 791742 - DNA, 25 bp, Mus musculus
tattatctacagctttattctcagt

SEQ ID NO: 791743 - DNA, 25 bp, Mus musculus
tattatctacaggtttattctcagt

SEQ ID NO: 791744 - DNA, 25 bp, Mus musculus
tattatctccatatatatcctccca

SEQ ID NO: 791745 - DNA, 25 bp, Mus musculus
tattatctccatttatatcctccca

SEQ ID NO: 791746 - DNA, 25 bp, Mus musculus
tattatctcgatccatctgtgctgt

SEQ ID NO: 791747 - DNA, 25 bp, Mus musculus
tattatctcgatgcatctgtgctgt

SEQ ID NO: 791748 - DNA, 25 bp, Mus musculus
tattatctgaacattccgttcccac

SEQ ID NO: 791749 - DNA, 25 bp, Mus musculus
tattatctgaactttccgttcccac

SEQ ID NO: 791750 - DNA, 25 bp, Mus musculus
tattatctgaatactagtgcctctt

SEQ ID NO: 791751 - DNA, 25 bp, Mus musculus
tattatctgaattctagtgcctctt

SEQ ID NO: 791752 - DNA, 25 bp, Mus musculus
tattatctgtggatgccgtttcttc

SEQ ID NO: 791753 - DNA, 25 bp, Mus musculus
tattatctgtggttgccgtttcttc

SEQ ID NO: 791754 - DNA, 25 bp, Mus musculus
tattatctgtgtatccatggtgcta

SEQ ID NO: 791755 - DNA, 25 bp, Mus musculus
tattatctgtgtttccatggtgcta

SEQ ID NO: 791756 - DNA, 25 bp, Mus musculus
tattatcttacacttgtggagctcc

SEQ ID NO: 791757 - DNA, 25 bp, Mus musculus
tattatcttacagttgtggagctcc

SEQ ID NO: 791758 - DNA, 25 bp, Mus musculus
tattatcttctaccaccactgttac

SEQ ID NO: 791759 - DNA, 25 bp, Mus musculus
tattatcttctagcaccactgttac

SEQ ID NO: 791760 - DNA, 25 bp, Mus musculus
tattatcttgttatacttcaaagag

SEQ ID NO: 791761 - DNA, 25 bp, Mus musculus
tattatcttgttttacttcaaagag

SEQ ID NO: 791762 - DNA, 25 bp, Mus musculus
tattatgaagccagcatgatgcctc

SEQ ID NO: 791763 - DNA, 25 bp, Mus musculus
tattatgaagcctgcatgatgcctc

SEQ ID NO: 791764 - DNA, 25 bp, Mus musculus
tattatgacacgctcaaactacaat

SEQ ID NO: 791765 - DNA, 25 bp, Mus musculus
tattatgacacggtcaaactacaat

SEQ ID NO: 791766 - DNA, 25 bp, Mus musculus
tattatgatttgcacccttggaggt

SEQ ID NO: 791767 - DNA, 25 bp, Mus musculus
tattatgatttggacccttggaggt

SEQ ID NO: 791768 - DNA, 25 bp, Mus musculus
tattatgcatgaatcactgtgtaaa

SEQ ID NO: 791769 - DNA, 25 bp, Mus musculus
tattatgcatgattcactgtgtaaa

SEQ ID NO: 791770 - DNA, 25 bp, Mus musculus
tattatgccagacaggactccgagc

SEQ ID NO: 791771 - DNA, 25 bp, Mus musculus
tattatgccagagaggactccgagc

SEQ ID NO: 791772 - DNA, 25 bp, Mus musculus
tattatgccatcaatgtaacagaat

SEQ ID NO: 791773 - DNA, 25 bp, Mus musculus
tattatgccatctatgtaacagaat

SEQ ID NO: 791774 - DNA, 25 bp, Mus musculus
tattatgcccagacaagtccccagg

SEQ ID NO: 791775 - DNA, 25 bp, Mus musculus
tattatgcccagtcaagtccccagg

SEQ ID NO: 791776 - DNA, 25 bp, Mus musculus
tattatgcctttatacagaagaaga

SEQ ID NO: 791777 - DNA, 25 bp, Mus musculus
tattatgcctttttacagaagaaga

SEQ ID NO: 791778 - DNA, 25 bp, Mus musculus
tattatgctggcagtaactctgaat

SEQ ID NO: 791779 - DNA, 25 bp, Mus musculus
tattatgctggctgtaactctgaat

SEQ ID NO: 791780 - DNA, 25 bp, Mus musculus
tattatggaacaaatggaggcacat

SEQ ID NO: 791781 - DNA, 25 bp, Mus musculus
tattatggaacatatggaggcacat

SEQ ID NO: 791782 - DNA, 25 bp, Mus musculus
tattatggcctaatttattaaccct

SEQ ID NO: 791783 - DNA, 25 bp, Mus musculus
tattatggcctattttattaaccct

SEQ ID NO: 791784 - DNA, 25 bp, Mus musculus
tattatggcttaatgtttccttttt

SEQ ID NO: 791785 - DNA, 25 bp, Mus musculus
tattatggcttattgtttccttttt

SEQ ID NO: 791786 - DNA, 25 bp, Mus musculus
tattatgggcctctgaacttgctca

SEQ ID NO: 791787 - DNA, 25 bp, Mus musculus
tattatgggcctgtgaacttgctca

SEQ ID NO: 791788 - DNA, 25 bp, Mus musculus
tattatgggttcagagtagctcctg

SEQ ID NO: 791789 - DNA, 25 bp, Mus musculus
tattatgggttctgagtagctcctg

SEQ ID NO: 791790 - DNA, 25 bp, Mus musculus
tattatgtaaagcactacccatgat

SEQ ID NO: 791791 - DNA, 25 bp, Mus musculus
tattatgtaaaggactacccatgat

SEQ ID NO: 791792 - DNA, 25 bp, Mus musculus
tattatgtaacccttcagaaaacca

SEQ ID NO: 791793 - DNA, 25 bp, Mus musculus
tattatgtaaccgttcagaaaacca

SEQ ID NO: 791794 - DNA, 25 bp, Mus musculus
tattatgtacttaaccattgccaag

SEQ ID NO: 791795 - DNA, 25 bp, Mus musculus
tattatgtactttaccattgccaag

SEQ ID NO: 791796 - DNA, 25 bp, Mus musculus
tattatgtagtgacttttcagaata

SEQ ID NO: 791797 - DNA, 25 bp, Mus musculus
tattatgtagtgtcttttcagaata

SEQ ID NO: 791798 - DNA, 25 bp, Mus musculus
tattatgtcttactgatttctcgga

SEQ ID NO: 791799 - DNA, 25 bp, Mus musculus
tattatgtcttagtgatttctcgga

SEQ ID NO: 791800 - DNA, 25 bp, Mus musculus
tattatgtgcaaaccagtatccagt

SEQ ID NO: 791801 - DNA, 25 bp, Mus musculus
tattatgtgcaatccagtatccagt

SEQ ID NO: 791802 - DNA, 25 bp, Mus musculus
tattatgtgtacaccctctatcttg

SEQ ID NO: 791803 - DNA, 25 bp, Mus musculus
tattatgtgtactccctctatcttg

SEQ ID NO: 791804 - DNA, 25 bp, Mus musculus
tattatgtgttcaacttttgacaga

SEQ ID NO: 791805 - DNA, 25 bp, Mus musculus
tattatgtgttctacttttgacaga

SEQ ID NO: 791806 - DNA, 25 bp, Mus musculus
tattatgttgttacccgtttcaaat

SEQ ID NO: 791807 - DNA, 25 bp, Mus musculus
tattatgttgtttcccgtttcaaat

SEQ ID NO: 791808 - DNA, 25 bp, Mus musculus
tattattaaactcagagctgcagcg

SEQ ID NO: 791809 - DNA, 25 bp, Mus musculus
tattattaaactgagagctgcagcg

SEQ ID NO: 791810 - DNA, 25 bp, Mus musculus
tattattactgaagtgctccgctgt

SEQ ID NO: 791811 - DNA, 25 bp, Mus musculus
tattattactgatgtgctccgctgt

SEQ ID NO: 791812 - DNA, 25 bp, Mus musculus
tattattactgcctctctacttaga

SEQ ID NO: 791813 - DNA, 25 bp, Mus musculus
tattattactgcgtctctacttaga

SEQ ID NO: 791814 - DNA, 25 bp, Mus musculus
tattattagggaaggctttgcaaga

SEQ ID NO: 791815 - DNA, 25 bp, Mus musculus
tattattagggatggctttgcaaga

SEQ ID NO: 791816 - DNA, 25 bp, Mus musculus
tattattaggttcttgtccccagtc

SEQ ID NO: 791817 - DNA, 25 bp, Mus musculus
tattattaggttgttgtccccagtc

SEQ ID NO: 791818 - DNA, 25 bp, Mus musculus
tattattatcccaaccgggcaggca

SEQ ID NO: 791819 - DNA, 25 bp, Mus musculus
tattattatccctaccgggcaggca

SEQ ID NO: 791820 - DNA, 25 bp, Mus musculus
tattattcacccagttaatcccact

SEQ ID NO: 791821 - DNA, 25 bp, Mus musculus
tattattcaccctgttaatcccact

SEQ ID NO: 791822 - DNA, 25 bp, Mus musculus
tattattcagaacctttcccacagc

SEQ ID NO: 791823 - DNA, 25 bp, Mus musculus
tattattcagaagctttcccacagc

SEQ ID NO: 791824 - DNA, 25 bp, Mus musculus
tattattcccacagctgctatactt

SEQ ID NO: 791825 - DNA, 25 bp, Mus musculus
tattattcccactgctgctatactt

SEQ ID NO: 791826 - DNA, 25 bp, Mus musculus
tattattcttgaaactgattcctag

SEQ ID NO: 791827 - DNA, 25 bp, Mus musculus
tattattcttgatactgattcctag

SEQ ID NO: 791828 - DNA, 25 bp, Mus musculus
tattattcttgtatcataggagaca

SEQ ID NO: 791829 - DNA, 25 bp, Mus musculus
tattattcttgtttcataggagaca

SEQ ID NO: 791830 - DNA, 25 bp, Mus musculus
tattattgcttaaatgccctgttca

SEQ ID NO: 791831 - DNA, 25 bp, Mus musculus
tattattgcttatatgccctgttca

SEQ ID NO: 791832 - DNA, 25 bp, Mus musculus
tattattgtcaaacccctaagatat

SEQ ID NO: 791833 - DNA, 25 bp, Mus musculus
tattattgtcaatcccctaagatat

SEQ ID NO: 791834 - DNA, 25 bp, Mus musculus
tattattgtggtctctctcttctac

SEQ ID NO: 791835 - DNA, 25 bp, Mus musculus
tattattgtggtgtctctcttctac

SEQ ID NO: 791836 - DNA, 25 bp, Mus musculus
tattatttagctacccactgtgtta

SEQ ID NO: 791837 - DNA, 25 bp, Mus musculus
tattatttagctctgtctggtgtct

SEQ ID NO: 791838 - DNA, 25 bp, Mus musculus
tattatttagctgtgtctggtgtct

SEQ ID NO: 791839 - DNA, 25 bp, Mus musculus
tattatttagcttcccactgtgtta

SEQ ID NO: 791840 - DNA, 25 bp, Mus musculus
tattatttatgcactgcttgccggt

SEQ ID NO: 791841 - DNA, 25 bp, Mus musculus
tattatttatgctctgcttgccggt

SEQ ID NO: 791842 - DNA, 25 bp, Mus musculus
tattatttcactctaatcccaggtg

SEQ ID NO: 791843 - DNA, 25 bp, Mus musculus
tattatttcactgtaatcccaggtg

SEQ ID NO: 791844 - DNA, 25 bp, Mus musculus
tattatttccctctacttcaccaag

SEQ ID NO: 791845 - DNA, 25 bp, Mus musculus
tattatttccctgtacttcaccaag

SEQ ID NO: 791846 - DNA, 25 bp, Mus musculus
tattatttggctctggccctactga

SEQ ID NO: 791847 - DNA, 25 bp, Mus musculus
tattatttggctgtggccctactga

SEQ ID NO: 791848 - DNA, 25 bp, Mus musculus
tattattttctgctcccgaatggga

SEQ ID NO: 791849 - DNA, 25 bp, Mus musculus
tattattttctggtcccgaatggga

SEQ ID NO: 791850 - DNA, 25 bp, Mus musculus
tattattttgctatgtccccttcat

SEQ ID NO: 791851 - DNA, 25 bp, Mus musculus
tattattttgctttgtccccttcat

SEQ ID NO: 791852 - DNA, 25 bp, Mus musculus
tattatttttaaacccttcctagag

SEQ ID NO: 791853 - DNA, 25 bp, Mus musculus
tattatttttaatcccttcctagag

SEQ ID NO: 791854 - DNA, 25 bp, Mus musculus
tattatttttctctttaggagtcct

SEQ ID NO: 791855 - DNA, 25 bp, Mus musculus
tattatttttctgtttaggagtcct

SEQ ID NO: 791856 - DNA, 25 bp, Mus musculus
tattatttttgcaggcctcagtaat

SEQ ID NO: 791857 - DNA, 25 bp, Mus musculus
tattatttttgctggcctcagtaat

SEQ ID NO: 791858 - DNA, 25 bp, Mus musculus
tattcaaaatctccatccatttttt

SEQ ID NO: 791859 - DNA, 25 bp, Mus musculus
tattcaaaatctgcatccatttttt

SEQ ID NO: 791860 - DNA, 25 bp, Mus musculus
tattcaaacagaacgacacccaaag

SEQ ID NO: 791861 - DNA, 25 bp, Mus musculus
tattcaaacagatcgacacccaaag

SEQ ID NO: 791862 - DNA, 25 bp, Mus musculus
tattcaaacttgaaaccgagggcca

SEQ ID NO: 791863 - DNA, 25 bp, Mus musculus
tattcaaacttgtaaccgagggcca

SEQ ID NO: 791864 - DNA, 25 bp, Mus musculus
tattcaaagactacgcagcttccta

SEQ ID NO: 791865 - DNA, 25 bp, Mus musculus
tattcaaagacttcgcagcttccta

SEQ ID NO: 791866 - DNA, 25 bp, Mus musculus
tattcaaagtaaagttgggagcagc

SEQ ID NO: 791867 - DNA, 25 bp, Mus musculus
tattcaaagtaatgttgggagcagc

SEQ ID NO: 791868 - DNA, 25 bp, Mus musculus
tattcaaatcacaacatcgcccact

SEQ ID NO: 791869 - DNA, 25 bp, Mus musculus
tattcaaatcactacatcgcccact

SEQ ID NO: 791870 - DNA, 25 bp, Mus musculus
tattcaaatcatagtctcaccccaa

SEQ ID NO: 791871 - DNA, 25 bp, Mus musculus
tattcaaatcattgtctcaccccaa

SEQ ID NO: 791872 - DNA, 25 bp, Mus musculus
tattcaacacatcgattactataga

SEQ ID NO: 791873 - DNA, 25 bp, Mus musculus
tattcaacacatggattactataga

SEQ ID NO: 791874 - DNA, 25 bp, Mus musculus
tattcaacgcccagttcgggagcat

SEQ ID NO: 791875 - DNA, 25 bp, Mus musculus
tattcaacgccctgttcgggagcat

SEQ ID NO: 791876 - DNA, 25 bp, Mus musculus
tattcaacttgcatgttccttagga

SEQ ID NO: 791877 - DNA, 25 bp, Mus musculus
tattcaacttgcttgttccttagga

SEQ ID NO: 791878 - DNA, 25 bp, Mus musculus
tattcaagactaatcaaaatccggg

SEQ ID NO: 791879 - DNA, 25 bp, Mus musculus
tattcaagactattcaaaatccggg

SEQ ID NO: 791880 - DNA, 25 bp, Mus musculus
tattcaagtaaaccacatccctgtc

SEQ ID NO: 791881 - DNA, 25 bp, Mus musculus
tattcaagtaaagcacatccctgtc

SEQ ID NO: 791882 - DNA, 25 bp, Mus musculus
tattcaataaccataccatttggaa

SEQ ID NO: 791883 - DNA, 25 bp, Mus musculus
tattcaataaccttaccatttggaa

SEQ ID NO: 791884 - DNA, 25 bp, Mus musculus
tattcaatacataccatggtgagag

SEQ ID NO: 791885 - DNA, 25 bp, Mus musculus
tattcaatacattccatggtgagag

SEQ ID NO: 791886 - DNA, 25 bp, Mus musculus
tattcaatcgagaaaacggccggcg

SEQ ID NO: 791887 - DNA, 25 bp, Mus musculus
tattcaatcgagtaaacggccggcg

SEQ ID NO: 791888 - DNA, 25 bp, Mus musculus
tattcaatctgcacaaagtccaagg

SEQ ID NO: 791889 - DNA, 25 bp, Mus musculus
tattcaatctgctcaaagtccaagg

SEQ ID NO: 791890 - DNA, 25 bp, Mus musculus
tattcacaaacaagcctacctacat

SEQ ID NO: 791891 - DNA, 25 bp, Mus musculus
tattcacaaacatgcctacctacat

SEQ ID NO: 791892 - DNA, 25 bp, Mus musculus
tattcacaacacaaggaaccatggg

SEQ ID NO: 791893 - DNA, 25 bp, Mus musculus
tattcacaacactaggaaccatggg

SEQ ID NO: 791894 - DNA, 25 bp, Mus musculus
tattcacaaggtacgcttcagccca

SEQ ID NO: 791895 - DNA, 25 bp, Mus musculus
tattcacaaggtattcacccaaccc

SEQ ID NO: 791896 - DNA, 25 bp, Mus musculus
tattcacaaggttcgcttcagccca

SEQ ID NO: 791897 - DNA, 25 bp, Mus musculus
tattcacaaggttttcacccaaccc

SEQ ID NO: 791898 - DNA, 25 bp, Mus musculus
tattcacacagtatctctcttcagt

SEQ ID NO: 791899 - DNA, 25 bp, Mus musculus
tattcacacagtttctctcttcagt

SEQ ID NO: 791900 - DNA, 25 bp, Mus musculus
tattcacaggaacgcaccatgctat

SEQ ID NO: 791901 - DNA, 25 bp, Mus musculus
tattcacaggaaggcaccatgctat

SEQ ID NO: 791902 - DNA, 25 bp, Mus musculus
tattcacagtgtctggagctcctct

SEQ ID NO: 791903 - DNA, 25 bp, Mus musculus
tattcacagtgtgtggagctcctct

SEQ ID NO: 791904 - DNA, 25 bp, Mus musculus
tattcacatcataaccaccatttcc

SEQ ID NO: 791905 - DNA, 25 bp, Mus musculus
tattcacatcattaccaccatttcc

SEQ ID NO: 791906 - DNA, 25 bp, Mus musculus
tattcacatccaaggtaggctacag

SEQ ID NO: 791907 - DNA, 25 bp, Mus musculus
tattcacatccatggtaggctacag

SEQ ID NO: 791908 - DNA, 25 bp, Mus musculus
tattcacatcgtcccgtttcttgca

SEQ ID NO: 791909 - DNA, 25 bp, Mus musculus
tattcacatcgtgccgtttcttgca

SEQ ID NO: 791910 - DNA, 25 bp, Mus musculus
tattcacatctccatgctttcaagt

SEQ ID NO: 791911 - DNA, 25 bp, Mus musculus
tattcacatctcgatgctttcaagt

SEQ ID NO: 791912 - DNA, 25 bp, Mus musculus
tattcacatttccataggcatttca

SEQ ID NO: 791913 - DNA, 25 bp, Mus musculus
tattcacatttcgataggcatttca

SEQ ID NO: 791914 - DNA, 25 bp, Mus musculus
tattcacccactactcccaagtatt

SEQ ID NO: 791915 - DNA, 25 bp, Mus musculus
tattcacccacttctcccaagtatt

SEQ ID NO: 791916 - DNA, 25 bp, Mus musculus
tattcaccctgtaaatcccacttca

SEQ ID NO: 791917 - DNA, 25 bp, Mus musculus
tattcaccctgttaatcccacttca

SEQ ID NO: 791918 - DNA, 25 bp, Mus musculus
tattcacctgtgaatgcacctctca

SEQ ID NO: 791919 - DNA, 25 bp, Mus musculus
tattcacctgtgtatgcacctctca

SEQ ID NO: 791920 - DNA, 25 bp, Mus musculus
tattcacgatcaatttccactctgg

SEQ ID NO: 791921 - DNA, 25 bp, Mus musculus
tattcacgatcattttccactctgg

SEQ ID NO: 791922 - DNA, 25 bp, Mus musculus
tattcacgggagactttagagcgcc

SEQ ID NO: 791923 - DNA, 25 bp, Mus musculus
tattcacgggagtctttagagcgcc

SEQ ID NO: 791924 - DNA, 25 bp, Mus musculus
tattcacggtatacttcaactgtag

SEQ ID NO: 791925 - DNA, 25 bp, Mus musculus
tattcacggtattcttcaactgtag

SEQ ID NO: 791926 - DNA, 25 bp, Mus musculus
tattcactaatcacattctcaccta

SEQ ID NO: 791927 - DNA, 25 bp, Mus musculus
tattcactaatctcattctcaccta

SEQ ID NO: 791928 - DNA, 25 bp, Mus musculus
tattcactcacaaaaacaacccctt

SEQ ID NO: 791929 - DNA, 25 bp, Mus musculus
tattcactcacataaacaacccctt

SEQ ID NO: 791930 - DNA, 25 bp, Mus musculus
tattcactcatactcactctttttc

SEQ ID NO: 791931 - DNA, 25 bp, Mus musculus
tattcactcatagtcactctttttc

SEQ ID NO: 791932 - DNA, 25 bp, Mus musculus
tattcactcatcatgcggaaaggca

SEQ ID NO: 791933 - DNA, 25 bp, Mus musculus
tattcactcatcttgcggaaaggca

SEQ ID NO: 791934 - DNA, 25 bp, Mus musculus
tattcactctgtaaccatgtccatg

SEQ ID NO: 791935 - DNA, 25 bp, Mus musculus
tattcactctgttaccatgtccatg

SEQ ID NO: 791936 - DNA, 25 bp, Mus musculus
tattcactgtgcaagctactgcctc

SEQ ID NO: 791937 - DNA, 25 bp, Mus musculus
tattcactgtgctagctactgcctc

SEQ ID NO: 791938 - DNA, 25 bp, Mus musculus
tattcactgtttcttttggtaactg

SEQ ID NO: 791939 - DNA, 25 bp, Mus musculus
tattcactgtttgttttggtaactg

SEQ ID NO: 791940 - DNA, 25 bp, Mus musculus
tattcacttaagaagcttgtctgca

SEQ ID NO: 791941 - DNA, 25 bp, Mus musculus
tattcacttaagtagcttgtctgca

SEQ ID NO: 791942 - DNA, 25 bp, Mus musculus
tattcagaccttcaagctgcaagat

SEQ ID NO: 791943 - DNA, 25 bp, Mus musculus
tattcagaccttgaagctgcaagat

SEQ ID NO: 791944 - DNA, 25 bp, Mus musculus
tattcagagcccaaatcccaatttg

SEQ ID NO: 791945 - DNA, 25 bp, Mus musculus
tattcagagccctaatcccaatttg

SEQ ID NO: 791946 - DNA, 25 bp, Mus musculus
tattcagagtaacccagacttccca

SEQ ID NO: 791947 - DNA, 25 bp, Mus musculus
tattcagagtaagccagacttccca

SEQ ID NO: 791948 - DNA, 25 bp, Mus musculus
tattcagatcagaagaccatagtgt

SEQ ID NO: 791949 - DNA, 25 bp, Mus musculus
tattcagatcagtagaccatagtgt

SEQ ID NO: 791950 - DNA, 25 bp, Mus musculus
tattcagatgtcaccagggttcagg

SEQ ID NO: 791951 - DNA, 25 bp, Mus musculus
tattcagatgtctccagggttcagg

SEQ ID NO: 791952 - DNA, 25 bp, Mus musculus
tattcagcaccaaacattctcagac

SEQ ID NO: 791953 - DNA, 25 bp, Mus musculus
tattcagcaccatacattctcagac

SEQ ID NO: 791954 - DNA, 25 bp, Mus musculus
tattcagcatcaccgggttcatacg

SEQ ID NO: 791955 - DNA, 25 bp, Mus musculus
tattcagcatcagcgggttcatacg

SEQ ID NO: 791956 - DNA, 25 bp, Mus musculus
tattcagcatctcttcctggcattt

SEQ ID NO: 791957 - DNA, 25 bp, Mus musculus
tattcagcatctgttcctggcattt

SEQ ID NO: 791958 - DNA, 25 bp, Mus musculus
tattcagcatgtcgaggcgaagcta

SEQ ID NO: 791959 - DNA, 25 bp, Mus musculus
tattcagcatgtggaggcgaagcta

SEQ ID NO: 791960 - DNA, 25 bp, Mus musculus
tattcagcccatctactacgactac

SEQ ID NO: 791961 - DNA, 25 bp, Mus musculus
tattcagcccatgtactacgactac

SEQ ID NO: 791962 - DNA, 25 bp, Mus musculus
tattcagccccgctacagggagttt

SEQ ID NO: 791963 - DNA, 25 bp, Mus musculus
tattcagccccggtacagggagttt

SEQ ID NO: 791964 - DNA, 25 bp, Mus musculus
tattcagcctttcttatgctctttc

SEQ ID NO: 791965 - DNA, 25 bp, Mus musculus
tattcagcctttgttatgctctttc

SEQ ID NO: 791966 - DNA, 25 bp, Mus musculus
tattcagctataaggagtagtagac

SEQ ID NO: 791967 - DNA, 25 bp, Mus musculus
tattcagctatatggagtagtagac

SEQ ID NO: 791968 - DNA, 25 bp, Mus musculus
tattcagcttctacttcctcctagt

SEQ ID NO: 791969 - DNA, 25 bp, Mus musculus
tattcagcttcttcttcctcctagt

SEQ ID NO: 791970 - DNA, 25 bp, Mus musculus
tattcagcttttcactattgcagga

SEQ ID NO: 791971 - DNA, 25 bp, Mus musculus
tattcagcttttgactattgcagga

SEQ ID NO: 791972 - DNA, 25 bp, Mus musculus
tattcaggatgaccgtattgtgctt

SEQ ID NO: 791973 - DNA, 25 bp, Mus musculus
tattcaggatgagcgtattgtgctt

SEQ ID NO: 791974 - DNA, 25 bp, Mus musculus
tattcaggcctcaatatttagcagg

SEQ ID NO: 791975 - DNA, 25 bp, Mus musculus
tattcaggcctctatatttagcagg

SEQ ID NO: 791976 - DNA, 25 bp, Mus musculus
tattcaggcttaaagtatgtgcaaa

SEQ ID NO: 791977 - DNA, 25 bp, Mus musculus
tattcaggcttatagtatgtgcaaa

SEQ ID NO: 791978 - DNA, 25 bp, Mus musculus
tattcagggcaaaatcactcctcat

SEQ ID NO: 791979 - DNA, 25 bp, Mus musculus
tattcagggcaatatcactcctcat

SEQ ID NO: 791980 - DNA, 25 bp, Mus musculus
tattcaggtcaacacggcctctaca

SEQ ID NO: 791981 - DNA, 25 bp, Mus musculus
tattcaggtcaagacggcctctaca

SEQ ID NO: 791982 - DNA, 25 bp, Mus musculus
tattcaggtggaaggctgccctatg

SEQ ID NO: 791983 - DNA, 25 bp, Mus musculus
tattcaggtggatggctgccctatg

SEQ ID NO: 791984 - DNA, 25 bp, Mus musculus
tattcaggttgcaccagctacttcg

SEQ ID NO: 791985 - DNA, 25 bp, Mus musculus
tattcaggttgctccagctacttcg

SEQ ID NO: 791986 - DNA, 25 bp, Mus musculus
tattcagtaaaccagaccctatgca

SEQ ID NO: 791987 - DNA, 25 bp, Mus musculus
tattcagtaaacgagaccctatgca

SEQ ID NO: 791988 - DNA, 25 bp, Mus musculus
tattcagtaattaaccaccaagaac

SEQ ID NO: 791989 - DNA, 25 bp, Mus musculus
tattcagtaatttaccaccaagaac

SEQ ID NO: 791990 - DNA, 25 bp, Mus musculus
tattcagtacggagccagtgcccac

SEQ ID NO: 791991 - DNA, 25 bp, Mus musculus
tattcagtacggtgccagtgcccac

SEQ ID NO: 791992 - DNA, 25 bp, Mus musculus
tattcagtatcccaggtgctcagtg

SEQ ID NO: 791993 - DNA, 25 bp, Mus musculus
tattcagtatccgaggtgctcagtg

SEQ ID NO: 791994 - DNA, 25 bp, Mus musculus
tattcagtcaagactcctattcggg

SEQ ID NO: 791995 - DNA, 25 bp, Mus musculus
tattcagtcaagtctcctattcggg

SEQ ID NO: 791996 - DNA, 25 bp, Mus musculus
tattcagtcaataacattgttgcag

SEQ ID NO: 791997 - DNA, 25 bp, Mus musculus
tattcagtcaattacattgttgcag

SEQ ID NO: 791998 - DNA, 25 bp, Mus musculus
tattcagtcattattgtgtctgtga

SEQ ID NO: 791999 - DNA, 25 bp, Mus musculus
tattcagtcatttttgtgtctgtga

SEQ ID NO: 792000 - DNA, 25 bp, Mus musculus
tattcagtcctgcacatttatctat

SEQ ID NO: 792001 - DNA, 25 bp, Mus musculus
tattcagtcctggacatttatctat

SEQ ID NO: 792002 - DNA, 25 bp, Mus musculus
tattcagtctctctactctcaacgt

SEQ ID NO: 792003 - DNA, 25 bp, Mus musculus
tattcagtctctgtactctcaacgt

SEQ ID NO: 792004 - DNA, 25 bp, Mus musculus
tattcagtgtctatatttgcatggc

SEQ ID NO: 792005 - DNA, 25 bp, Mus musculus
tattcagtgtctttatttgcatggc

SEQ ID NO: 792006 - DNA, 25 bp, Mus musculus
tattcagtgtgccaaggatatcgcc

SEQ ID NO: 792007 - DNA, 25 bp, Mus musculus
tattcagtgtgcgaaggatatcgcc

SEQ ID NO: 792008 - DNA, 25 bp, Mus musculus
tattcagttctgcatatatttcttg

SEQ ID NO: 792009 - DNA, 25 bp, Mus musculus
tattcagttctggatatatttcttg

SEQ ID NO: 792010 - DNA, 25 bp, Mus musculus
tattcagttgacattgactcattaa

SEQ ID NO: 792011 - DNA, 25 bp, Mus musculus
tattcagttgactttgactcattaa

SEQ ID NO: 792012 - DNA, 25 bp, Mus musculus
tattcatacccacattgtctgatta

SEQ ID NO: 792013 - DNA, 25 bp, Mus musculus
tattcatacccagattgtctgatta

SEQ ID NO: 792014 - DNA, 25 bp, Mus musculus
tattcatactatccggtgtttacca

SEQ ID NO: 792015 - DNA, 25 bp, Mus musculus
tattcatactatgcggtgtttacca

SEQ ID NO: 792016 - DNA, 25 bp, Mus musculus
tattcatactcaagctctggctcgg

SEQ ID NO: 792017 - DNA, 25 bp, Mus musculus
tattcatactcatgctctggctcgg

SEQ ID NO: 792018 - DNA, 25 bp, Mus musculus
tattcatagtgtaaacgcattctgt

SEQ ID NO: 792019 - DNA, 25 bp, Mus musculus
tattcatagtgttaacgcattctgt

SEQ ID NO: 792020 - DNA, 25 bp, Mus musculus
tattcatatgtaccatggattgaga

SEQ ID NO: 792021 - DNA, 25 bp, Mus musculus
tattcatatgtagcatggattgaga

SEQ ID NO: 792022 - DNA, 25 bp, Mus musculus
tattcatcaaacagtccctgccagg

SEQ ID NO: 792023 - DNA, 25 bp, Mus musculus
tattcatcaaactgtccctgccagg

SEQ ID NO: 792024 - DNA, 25 bp, Mus musculus
tattcatcacaaaccatcagtctgg

SEQ ID NO: 792025 - DNA, 25 bp, Mus musculus
tattcatcacaatccatcagtctgg

SEQ ID NO: 792026 - DNA, 25 bp, Mus musculus
tattcatcaggtacactgggctgga

SEQ ID NO: 792027 - DNA, 25 bp, Mus musculus
tattcatcaggttcactgggctgga

SEQ ID NO: 792028 - DNA, 25 bp, Mus musculus
tattcatcattacacaactggagtt

SEQ ID NO: 792029 - DNA, 25 bp, Mus musculus
tattcatcattagacaactggagtt

SEQ ID NO: 792030 - DNA, 25 bp, Mus musculus
tattcatcccttactgttcagataa

SEQ ID NO: 792031 - DNA, 25 bp, Mus musculus
tattcatccctttctgttcagataa

SEQ ID NO: 792032 - DNA, 25 bp, Mus musculus
tattcatcgctccacccaaaatggt

SEQ ID NO: 792033 - DNA, 25 bp, Mus musculus
tattcatcgctcgacccaaaatggt

SEQ ID NO: 792034 - DNA, 25 bp, Mus musculus
tattcatctaaaactcatggcttgt

SEQ ID NO: 792035 - DNA, 25 bp, Mus musculus
tattcatctaaatctcatggcttgt

SEQ ID NO: 792036 - DNA, 25 bp, Mus musculus
tattcatctgctcacactggctttt

SEQ ID NO: 792037 - DNA, 25 bp, Mus musculus
tattcatctgctgacactggctttt

SEQ ID NO: 792038 - DNA, 25 bp, Mus musculus
tattcatgagcaagagcagaacccc

SEQ ID NO: 792039 - DNA, 25 bp, Mus musculus
tattcatgagcatgagcagaacccc

SEQ ID NO: 792040 - DNA, 25 bp, Mus musculus
tattcatgcagaaatgttttgtaca

SEQ ID NO: 792041 - DNA, 25 bp, Mus musculus
tattcatgcagatatgttttgtaca

SEQ ID NO: 792042 - DNA, 25 bp, Mus musculus
tattcatggaccactccttttgttc

SEQ ID NO: 792043 - DNA, 25 bp, Mus musculus
tattcatggacctctccttttgttc

SEQ ID NO: 792044 - DNA, 25 bp, Mus musculus
tattcatggcggacttgcaacgagt

SEQ ID NO: 792045 - DNA, 25 bp, Mus musculus
tattcatggcggtcttgcaacgagt

SEQ ID NO: 792046 - DNA, 25 bp, Mus musculus
tattcatgggcccacagctggtgct

SEQ ID NO: 792047 - DNA, 25 bp, Mus musculus
tattcatgggccgacagctggtgct

SEQ ID NO: 792048 - DNA, 25 bp, Mus musculus
tattcatggtcaccccagtatgctt

SEQ ID NO: 792049 - DNA, 25 bp, Mus musculus
tattcatggtcagcccagtatgctt

SEQ ID NO: 792050 - DNA, 25 bp, Mus musculus
tattcatgtacacgcaataagcatc

SEQ ID NO: 792051 - DNA, 25 bp, Mus musculus
tattcatgtacaggcaataagcatc

SEQ ID NO: 792052 - DNA, 25 bp, Mus musculus
tattcatgtgtgaaggcatgtgcgt

SEQ ID NO: 792053 - DNA, 25 bp, Mus musculus
tattcatgtgtgtaggcatgtgcgt

SEQ ID NO: 792054 - DNA, 25 bp, Mus musculus
tattcattaacaagctttagcctgg

SEQ ID NO: 792055 - DNA, 25 bp, Mus musculus
tattcattaacatgctttagcctgg

SEQ ID NO: 792056 - DNA, 25 bp, Mus musculus
tattcattagagatcgcagcacata

SEQ ID NO: 792057 - DNA, 25 bp, Mus musculus
tattcattagagttcgcagcacata

SEQ ID NO: 792058 - DNA, 25 bp, Mus musculus
tattcattagttctgcgagcttcat

SEQ ID NO: 792059 - DNA, 25 bp, Mus musculus
tattcattagttgtgcgagcttcat

SEQ ID NO: 792060 - DNA, 25 bp, Mus musculus
tattcattattcagagtattttcat

SEQ ID NO: 792061 - DNA, 25 bp, Mus musculus
tattcattattctgagtattttcat

SEQ ID NO: 792062 - DNA, 25 bp, Mus musculus
tattcattcacaagcgtattctaat

SEQ ID NO: 792063 - DNA, 25 bp, Mus musculus
tattcattcacatgcgtattctaat

SEQ ID NO: 792064 - DNA, 25 bp, Mus musculus
tattcattcataaccctgagcatgt

SEQ ID NO: 792065 - DNA, 25 bp, Mus musculus
tattcattcatatccctgagcatgt

SEQ ID NO: 792066 - DNA, 25 bp, Mus musculus
tattcattccatagtatgtaggcgt

SEQ ID NO: 792067 - DNA, 25 bp, Mus musculus
tattcattccattgtatgtaggcgt

SEQ ID NO: 792068 - DNA, 25 bp, Mus musculus
tattcattcctgaggcttacaccct

SEQ ID NO: 792069 - DNA, 25 bp, Mus musculus
tattcattcctgtggcttacaccct

SEQ ID NO: 792070 - DNA, 25 bp, Mus musculus
tattcattccttcttggtcattttt

SEQ ID NO: 792071 - DNA, 25 bp, Mus musculus
tattcattccttgttggtcattttt

SEQ ID NO: 792072 - DNA, 25 bp, Mus musculus
tattcattcttcacttaagggacat

SEQ ID NO: 792073 - DNA, 25 bp, Mus musculus
tattcattcttctcttaagggacat

SEQ ID NO: 792074 - DNA, 25 bp, Mus musculus
tattcattgccacacccactgtgta

SEQ ID NO: 792075 - DNA, 25 bp, Mus musculus
tattcattgccagacccactgtgta

SEQ ID NO: 792076 - DNA, 25 bp, Mus musculus
tattcattgtatcaaaattcctgtg

SEQ ID NO: 792077 - DNA, 25 bp, Mus musculus
tattcattgtatgaaaattcctgtg

SEQ ID NO: 792078 - DNA, 25 bp, Mus musculus
tattcattgttcaccgatgggctaa

SEQ ID NO: 792079 - DNA, 25 bp, Mus musculus
tattcattgttctccgatgggctaa

SEQ ID NO: 792080 - DNA, 25 bp, Mus musculus
tattcatttgtaaccaaggtgctga

SEQ ID NO: 792081 - DNA, 25 bp, Mus musculus
tattcatttgtatccaaggtgctga

SEQ ID NO: 792082 - DNA, 25 bp, Mus musculus
tattcatttgttatcgctggatggg

SEQ ID NO: 792083 - DNA, 25 bp, Mus musculus
tattcatttgttttcgctggatggg

SEQ ID NO: 792084 - DNA, 25 bp, Mus musculus
tattcattttagctgttcaaatcca

SEQ ID NO: 792085 - DNA, 25 bp, Mus musculus
tattcattttaggtgttcaaatcca

SEQ ID NO: 792086 - DNA, 25 bp, Mus musculus
tattcattttggcagttttaggtaa

SEQ ID NO: 792087 - DNA, 25 bp, Mus musculus
tattcattttgggagttttaggtaa

SEQ ID NO: 792088 - DNA, 25 bp, Mus musculus
tattcatttttactagattccttct

SEQ ID NO: 792089 - DNA, 25 bp, Mus musculus
tattcatttttagtagattccttct

SEQ ID NO: 792090 - DNA, 25 bp, Mus musculus
tattccaaaccaccaattatagagt

SEQ ID NO: 792091 - DNA, 25 bp, Mus musculus
tattccaaaccagcaattatagagt

SEQ ID NO: 792092 - DNA, 25 bp, Mus musculus
tattccaaatccaacaccctggtgt

SEQ ID NO: 792093 - DNA, 25 bp, Mus musculus
tattccaaatcctacaccctggtgt

SEQ ID NO: 792094 - DNA, 25 bp, Mus musculus
tattccaacactagcagggtttttc

SEQ ID NO: 792095 - DNA, 25 bp, Mus musculus
tattccaacacttgcagggtttttc

SEQ ID NO: 792096 - DNA, 25 bp, Mus musculus
tattccaaccaactgtgtatatatg

SEQ ID NO: 792097 - DNA, 25 bp, Mus musculus
tattccaaccaagtgtgtatatatg

SEQ ID NO: 792098 - DNA, 25 bp, Mus musculus
tattccaactccactgaagtgcaca

SEQ ID NO: 792099 - DNA, 25 bp, Mus musculus
tattccaactcctctgaagtgcaca

SEQ ID NO: 792100 - DNA, 25 bp, Mus musculus
tattccaactgaactgtttccacat

SEQ ID NO: 792101 - DNA, 25 bp, Mus musculus
tattccaactgatctgtttccacat

SEQ ID NO: 792102 - DNA, 25 bp, Mus musculus
tattccaactgcagataccgaacaa

SEQ ID NO: 792103 - DNA, 25 bp, Mus musculus
tattccaactgctgataccgaacaa

SEQ ID NO: 792104 - DNA, 25 bp, Mus musculus
tattccaagggtaactcttctgcac

SEQ ID NO: 792105 - DNA, 25 bp, Mus musculus
tattccaagggttactcttctgcac

SEQ ID NO: 792106 - DNA, 25 bp, Mus musculus
tattccaagtgaaacaaatgggcta

SEQ ID NO: 792107 - DNA, 25 bp, Mus musculus
tattccaagtgatacaaatgggcta

SEQ ID NO: 792108 - DNA, 25 bp, Mus musculus
tattccaagttccaaggtctggctt

SEQ ID NO: 792109 - DNA, 25 bp, Mus musculus
tattccaagttcgaaggtctggctt

SEQ ID NO: 792110 - DNA, 25 bp, Mus musculus
tattccaatcaaattaccagttatg

SEQ ID NO: 792111 - DNA, 25 bp, Mus musculus
tattccaatcaatttaccagttatg

SEQ ID NO: 792112 - DNA, 25 bp, Mus musculus
tattccaatgtaacaaactttcagg

SEQ ID NO: 792113 - DNA, 25 bp, Mus musculus
tattccaatgtatcaaactttcagg

SEQ ID NO: 792114 - DNA, 25 bp, Mus musculus
tattccaatgtcaatgtaaccagca

SEQ ID NO: 792115 - DNA, 25 bp, Mus musculus
tattccaatgtctatgtaaccagca

SEQ ID NO: 792116 - DNA, 25 bp, Mus musculus
tattccaatgtgctgttccttgaag

SEQ ID NO: 792117 - DNA, 25 bp, Mus musculus
tattccaatgtggtgttccttgaag

SEQ ID NO: 792118 - DNA, 25 bp, Mus musculus
tattccacacttacaggactccaga

SEQ ID NO: 792119 - DNA, 25 bp, Mus musculus
tattccacactttcaggactccaga

SEQ ID NO: 792120 - DNA, 25 bp, Mus musculus
tattccacatacactgttggtcacg

SEQ ID NO: 792121 - DNA, 25 bp, Mus musculus
tattccacatactctgttggtcacg

SEQ ID NO: 792122 - DNA, 25 bp, Mus musculus
tattccacatctacagtcctgtggg

SEQ ID NO: 792123 - DNA, 25 bp, Mus musculus
tattccacatcttcagtcctgtggg

SEQ ID NO: 792124 - DNA, 25 bp, Mus musculus
tattccaccaatcgtaagtgccatt

SEQ ID NO: 792125 - DNA, 25 bp, Mus musculus
tattccaccaatggtaagtgccatt

SEQ ID NO: 792126 - DNA, 25 bp, Mus musculus
tattccaccattctcttagctaatt

SEQ ID NO: 792127 - DNA, 25 bp, Mus musculus
tattccaccattgtcttagctaatt

SEQ ID NO: 792128 - DNA, 25 bp, Mus musculus
tattccaccctgcatttaatggact

SEQ ID NO: 792129 - DNA, 25 bp, Mus musculus
tattccaccctggatttaatggact

SEQ ID NO: 792130 - DNA, 25 bp, Mus musculus
tattccacgaaacataagcactagt

SEQ ID NO: 792131 - DNA, 25 bp, Mus musculus
tattccacgaaagataagcactagt

SEQ ID NO: 792132 - DNA, 25 bp, Mus musculus
tattccactgcaactcacactgtgt

SEQ ID NO: 792133 - DNA, 25 bp, Mus musculus
tattccactgcatctcacactgtgt

SEQ ID NO: 792134 - DNA, 25 bp, Mus musculus
tattccactgtcatcgacgtgcaca

SEQ ID NO: 792135 - DNA, 25 bp, Mus musculus
tattccactgtcttcgacgtgcaca

SEQ ID NO: 792136 - DNA, 25 bp, Mus musculus
tattccactgtgagtacctctcaaa

SEQ ID NO: 792137 - DNA, 25 bp, Mus musculus
tattccactgtgtgtacctctcaaa

SEQ ID NO: 792138 - DNA, 25 bp, Mus musculus
tattccagcctaaccttttgtctta

SEQ ID NO: 792139 - DNA, 25 bp, Mus musculus
tattccagcctatccttttgtctta

SEQ ID NO: 792140 - DNA, 25 bp, Mus musculus
tattccaggatgcttctgtggccac

SEQ ID NO: 792141 - DNA, 25 bp, Mus musculus
tattccaggatggttctgtggccac

SEQ ID NO: 792142 - DNA, 25 bp, Mus musculus
tattccaggattcatgtgccagggt

SEQ ID NO: 792143 - DNA, 25 bp, Mus musculus
tattccaggattgatgtgccagggt

SEQ ID NO: 792144 - DNA, 25 bp, Mus musculus
tattccaggcccattctgtcactta

SEQ ID NO: 792145 - DNA, 25 bp, Mus musculus
tattccaggccctttctgtcactta

SEQ ID NO: 792146 - DNA, 25 bp, Mus musculus
tattccagggaaacctctgaggcta

SEQ ID NO: 792147 - DNA, 25 bp, Mus musculus
tattccagggaacacgagcccatct

SEQ ID NO: 792148 - DNA, 25 bp, Mus musculus
tattccagggaagacgagcccatct

SEQ ID NO: 792149 - DNA, 25 bp, Mus musculus
tattccagggaatcctctgaggcta

SEQ ID NO: 792150 - DNA, 25 bp, Mus musculus
tattccagggtgctccacacattgt

SEQ ID NO: 792151 - DNA, 25 bp, Mus musculus
tattccagggtggtccacacattgt

SEQ ID NO: 792152 - DNA, 25 bp, Mus musculus
tattccagtcacatcctcgaagcaa

SEQ ID NO: 792153 - DNA, 25 bp, Mus musculus
tattccagtcacttcctcgaagcaa

SEQ ID NO: 792154 - DNA, 25 bp, Mus musculus
tattccagtgagcaggtcaccgttt

SEQ ID NO: 792155 - DNA, 25 bp, Mus musculus
tattccagtgaggaggtcaccgttt

SEQ ID NO: 792156 - DNA, 25 bp, Mus musculus
tattccagtgataacccaacagttt

SEQ ID NO: 792157 - DNA, 25 bp, Mus musculus
tattccagtgattacccaacagttt

SEQ ID NO: 792158 - DNA, 25 bp, Mus musculus
tattccagtttactttcccaattga

SEQ ID NO: 792159 - DNA, 25 bp, Mus musculus
tattccagtttagtttcccaattga

SEQ ID NO: 792160 - DNA, 25 bp, Mus musculus
tattccatccttaaccatagacaat

SEQ ID NO: 792161 - DNA, 25 bp, Mus musculus
tattccatcctttaccatagacaat

SEQ ID NO: 792162 - DNA, 25 bp, Mus musculus
tattccatcgtgagcttgtgggctt

SEQ ID NO: 792163 - DNA, 25 bp, Mus musculus
tattccatcgtgtgcttgtgggctt

SEQ ID NO: 792164 - DNA, 25 bp, Mus musculus
tattccatgagtaaagattccgtat

SEQ ID NO: 792165 - DNA, 25 bp, Mus musculus
tattccatgagttaagattccgtat

SEQ ID NO: 792166 - DNA, 25 bp, Mus musculus
tattccatgatgaaggtcctgagac

SEQ ID NO: 792167 - DNA, 25 bp, Mus musculus
tattccatgatgtaggtcctgagac

SEQ ID NO: 792168 - DNA, 25 bp, Mus musculus
tattccatggaaccccggctacagt

SEQ ID NO: 792169 - DNA, 25 bp, Mus musculus
tattccatggaagcccggctacagt

SEQ ID NO: 792170 - DNA, 25 bp, Mus musculus
tattccatggctaccaagtcctctg

SEQ ID NO: 792171 - DNA, 25 bp, Mus musculus
tattccatggcttccaagtcctctg

SEQ ID NO: 792172 - DNA, 25 bp, Mus musculus
tattccatggttacctacagcgaca

SEQ ID NO: 792173 - DNA, 25 bp, Mus musculus
tattccatggtttcctacagcgaca

SEQ ID NO: 792174 - DNA, 25 bp, Mus musculus
tattccattcttactgcggggacaa

SEQ ID NO: 792175 - DNA, 25 bp, Mus musculus
tattccattctttctgcggggacaa

SEQ ID NO: 792176 - DNA, 25 bp, Mus musculus
tattccatttccaacagccctgata

SEQ ID NO: 792177 - DNA, 25 bp, Mus musculus
tattccatttcctacagccctgata

SEQ ID NO: 792178 - DNA, 25 bp, Mus musculus
tattccatttgcattatgaatggca

SEQ ID NO: 792179 - DNA, 25 bp, Mus musculus
tattccatttgctttatgaatggca

SEQ ID NO: 792180 - DNA, 25 bp, Mus musculus
tattccattttcataccttttctag

SEQ ID NO: 792181 - DNA, 25 bp, Mus musculus
tattccattttcttaccttttctag

SEQ ID NO: 792182 - DNA, 25 bp, Mus musculus
tattcccaaataaaacctgttaaat

SEQ ID NO: 792183 - DNA, 25 bp, Mus musculus
tattcccaaatataacctgttaaat

SEQ ID NO: 792184 - DNA, 25 bp, Mus musculus
tattcccaacaaatgcttatcgagg

SEQ ID NO: 792185 - DNA, 25 bp, Mus musculus
tattcccaacaattgcttatcgagg

SEQ ID NO: 792186 - DNA, 25 bp, Mus musculus
tattcccaacggactcttcagagtg

SEQ ID NO: 792187 - DNA, 25 bp, Mus musculus
tattcccaacggtctcttcagagtg

SEQ ID NO: 792188 - DNA, 25 bp, Mus musculus
tattcccaactccagtatttactgt

SEQ ID NO: 792189 - DNA, 25 bp, Mus musculus
tattcccaactcgagtatttactgt

SEQ ID NO: 792190 - DNA, 25 bp, Mus musculus
tattcccaagagacacatacagagt

SEQ ID NO: 792191 - DNA, 25 bp, Mus musculus
tattcccaagagtcacatacagagt

SEQ ID NO: 792192 - DNA, 25 bp, Mus musculus
tattcccaaggccagcacaggtcag

SEQ ID NO: 792193 - DNA, 25 bp, Mus musculus
tattcccaaggcgagcacaggtcag

SEQ ID NO: 792194 - DNA, 25 bp, Mus musculus
tattcccacactacatattttgata

SEQ ID NO: 792195 - DNA, 25 bp, Mus musculus
tattcccacacttcatattttgata

SEQ ID NO: 792196 - DNA, 25 bp, Mus musculus
tattcccactcactattgtcactac

SEQ ID NO: 792197 - DNA, 25 bp, Mus musculus
tattcccactcagtattgtcactac

SEQ ID NO: 792198 - DNA, 25 bp, Mus musculus
tattcccagcgcagatgactttttt

SEQ ID NO: 792199 - DNA, 25 bp, Mus musculus
tattcccagcgctgatgactttttt

SEQ ID NO: 792200 - DNA, 25 bp, Mus musculus
tattcccagctgacggatgagcagg

SEQ ID NO: 792201 - DNA, 25 bp, Mus musculus
tattcccagctgtcggatgagcagg

SEQ ID NO: 792202 - DNA, 25 bp, Mus musculus
tattcccaggaaaccaagcgcctga

SEQ ID NO: 792203 - DNA, 25 bp, Mus musculus
tattcccaggaatccaagcgcctga

SEQ ID NO: 792204 - DNA, 25 bp, Mus musculus
tattcccaggcaaaaatcagtcagg

SEQ ID NO: 792205 - DNA, 25 bp, Mus musculus
tattcccaggcataaatcagtcagg

SEQ ID NO: 792206 - DNA, 25 bp, Mus musculus
tattcccaggttcaattgggactta

SEQ ID NO: 792207 - DNA, 25 bp, Mus musculus
tattcccaggttgaattgggactta

SEQ ID NO: 792208 - DNA, 25 bp, Mus musculus
tattcccatgagatccagaggtcct

SEQ ID NO: 792209 - DNA, 25 bp, Mus musculus
tattcccatgagttccagaggtcct

SEQ ID NO: 792210 - DNA, 25 bp, Mus musculus
tattcccatggaaacatttagcagt

SEQ ID NO: 792211 - DNA, 25 bp, Mus musculus
tattcccatggatacatttagcagt

SEQ ID NO: 792212 - DNA, 25 bp, Mus musculus
tattcccattctaagaggttggaag

SEQ ID NO: 792213 - DNA, 25 bp, Mus musculus
tattcccattcttagaggttggaag

SEQ ID NO: 792214 - DNA, 25 bp, Mus musculus
tattcccattgcattcgtgggtctt

SEQ ID NO: 792215 - DNA, 25 bp, Mus musculus
tattcccattgctttcgtgggtctt

SEQ ID NO: 792216 - DNA, 25 bp, Mus musculus
tattccccaaagaaattcctgcagc

SEQ ID NO: 792217 - DNA, 25 bp, Mus musculus
tattccccaaagtaattcctgcagc

SEQ ID NO: 792218 - DNA, 25 bp, Mus musculus
tattccccaaccacacccagttatt

SEQ ID NO: 792219 - DNA, 25 bp, Mus musculus
tattccccaacctcacccagttatt

SEQ ID NO: 792220 - DNA, 25 bp, Mus musculus
tattccccagcactgttgggaggca

SEQ ID NO: 792221 - DNA, 25 bp, Mus musculus
tattccccagcagtgttgggaggca

SEQ ID NO: 792222 - DNA, 25 bp, Mus musculus
tattccccaggaagctagttccaga

SEQ ID NO: 792223 - DNA, 25 bp, Mus musculus
tattccccaggatgctagttccaga

SEQ ID NO: 792224 - DNA, 25 bp, Mus musculus
tattccccagtacactcattaaggt

SEQ ID NO: 792225 - DNA, 25 bp, Mus musculus
tattccccagtagactcattaaggt

SEQ ID NO: 792226 - DNA, 25 bp, Mus musculus
tattccccatcgaattaaaccccat

SEQ ID NO: 792227 - DNA, 25 bp, Mus musculus
tattccccatcgtattaaaccccat

SEQ ID NO: 792228 - DNA, 25 bp, Mus musculus
tattccccgtttacaccgtctactg

SEQ ID NO: 792229 - DNA, 25 bp, Mus musculus
tattccccgttttcaccgtctactg

SEQ ID NO: 792230 - DNA, 25 bp, Mus musculus
tattcccctcggagaattcacttct

SEQ ID NO: 792231 - DNA, 25 bp, Mus musculus
tattcccctcggtgaattcacttct

SEQ ID NO: 792232 - DNA, 25 bp, Mus musculus
tattcccctttcagttactttgaca

SEQ ID NO: 792233 - DNA, 25 bp, Mus musculus
tattcccctttctgttactttgaca

SEQ ID NO: 792234 - DNA, 25 bp, Mus musculus
tattcccgagaactccccaaagtgt

SEQ ID NO: 792235 - DNA, 25 bp, Mus musculus
tattcccgagaagtccccaaagtgt

SEQ ID NO: 792236 - DNA, 25 bp, Mus musculus
tattcccgggctagaaagtagaaag

SEQ ID NO: 792237 - DNA, 25 bp, Mus musculus
tattcccgggcttgaaagtagaaag

SEQ ID NO: 792238 - DNA, 25 bp, Mus musculus
tattcccggtggcagccagggccct

SEQ ID NO: 792239 - DNA, 25 bp, Mus musculus
tattcccggtgggagccagggccct

SEQ ID NO: 792240 - DNA, 25 bp, Mus musculus
tattccctaaagcatagtctacaag

SEQ ID NO: 792241 - DNA, 25 bp, Mus musculus
tattccctaaaggatagtctacaag

SEQ ID NO: 792242 - DNA, 25 bp, Mus musculus
tattccctaacccaggttttgctgc

SEQ ID NO: 792243 - DNA, 25 bp, Mus musculus
tattccctaaccgaggttttgctgc

SEQ ID NO: 792244 - DNA, 25 bp, Mus musculus
tattccctacgtacgaacaaatgag

SEQ ID NO: 792245 - DNA, 25 bp, Mus musculus
tattccctacgttcgaacaaatgag

SEQ ID NO: 792246 - DNA, 25 bp, Mus musculus
tattccctagagaactccctttggc

SEQ ID NO: 792247 - DNA, 25 bp, Mus musculus
tattccctagagtactccctttggc

SEQ ID NO: 792248 - DNA, 25 bp, Mus musculus
tattccctcacaagtaagtacctcc

SEQ ID NO: 792249 - DNA, 25 bp, Mus musculus
tattccctcacatgtaagtacctcc

SEQ ID NO: 792250 - DNA, 25 bp, Mus musculus
tattccctcatcactataactctag

SEQ ID NO: 792251 - DNA, 25 bp, Mus musculus
tattccctcatctctataactctag

SEQ ID NO: 792252 - DNA, 25 bp, Mus musculus
tattccctcatgattgtgatgactg

SEQ ID NO: 792253 - DNA, 25 bp, Mus musculus
tattccctcatgtttgtgatgactg

SEQ ID NO: 792254 - DNA, 25 bp, Mus musculus
tattccctccagctttgaagtgtag

SEQ ID NO: 792255 - DNA, 25 bp, Mus musculus
tattccctccaggtttgaagtgtag

SEQ ID NO: 792256 - DNA, 25 bp, Mus musculus
tattccctcgggagctgaggtcaga

SEQ ID NO: 792257 - DNA, 25 bp, Mus musculus
tattccctcgggtgctgaggtcaga

SEQ ID NO: 792258 - DNA, 25 bp, Mus musculus
tattccctctgaaaacgttttgttg

SEQ ID NO: 792259 - DNA, 25 bp, Mus musculus
tattccctctgataacgttttgttg

SEQ ID NO: 792260 - DNA, 25 bp, Mus musculus
tattccctgaaactattacctgcta

SEQ ID NO: 792261 - DNA, 25 bp, Mus musculus
tattccctgaaagtattacctgcta

SEQ ID NO: 792262 - DNA, 25 bp, Mus musculus
tattccctgggtccttgtttttcct

SEQ ID NO: 792263 - DNA, 25 bp, Mus musculus
tattccctgggtgcttgtttttcct

SEQ ID NO: 792264 - DNA, 25 bp, Mus musculus
tattccctggtactatagagcccct

SEQ ID NO: 792265 - DNA, 25 bp, Mus musculus
tattccctggtagtatagagcccct

SEQ ID NO: 792266 - DNA, 25 bp, Mus musculus
tattcccttagtattacacactcaa

SEQ ID NO: 792267 - DNA, 25 bp, Mus musculus
tattcccttagttttacacactcaa

SEQ ID NO: 792268 - DNA, 25 bp, Mus musculus
tattcccttatcacaaaagccactt

SEQ ID NO: 792269 - DNA, 25 bp, Mus musculus
tattcccttatctcaaaagccactt

SEQ ID NO: 792270 - DNA, 25 bp, Mus musculus
tattcccttattaaatactcttgaa

SEQ ID NO: 792271 - DNA, 25 bp, Mus musculus
tattcccttatttaatactcttgaa

SEQ ID NO: 792272 - DNA, 25 bp, Mus musculus
tattcccttgcaaacatgaccgtgt

SEQ ID NO: 792273 - DNA, 25 bp, Mus musculus
tattcccttgcatacatgaccgtgt

SEQ ID NO: 792274 - DNA, 25 bp, Mus musculus
tattccgacgaaaatatctggccaa

SEQ ID NO: 792275 - DNA, 25 bp, Mus musculus
tattccgacgaatatatctggccaa

SEQ ID NO: 792276 - DNA, 25 bp, Mus musculus
tattccgagaagacttgtcctccat

SEQ ID NO: 792277 - DNA, 25 bp, Mus musculus
tattccgagaagtcttgtcctccat

SEQ ID NO: 792278 - DNA, 25 bp, Mus musculus
tattccgagaggaacttaccaggga

SEQ ID NO: 792279 - DNA, 25 bp, Mus musculus
tattccgagaggtacttaccaggga

SEQ ID NO: 792280 - DNA, 25 bp, Mus musculus
tattccgcagcgacgttttctgttt

SEQ ID NO: 792281 - DNA, 25 bp, Mus musculus
tattccgcagcgtcgttttctgttt

SEQ ID NO: 792282 - DNA, 25 bp, Mus musculus
tattccgccgcgctgctcagcaaga

SEQ ID NO: 792283 - DNA, 25 bp, Mus musculus
tattccgccgcggtgctcagcaaga

SEQ ID NO: 792284 - DNA, 25 bp, Mus musculus
tattccggaacacgagtttgcgacg

SEQ ID NO: 792285 - DNA, 25 bp, Mus musculus
tattccggaacaggagtttgcgacg

SEQ ID NO: 792286 - DNA, 25 bp, Mus musculus
tattccggatgacgcagactttctg

SEQ ID NO: 792287 - DNA, 25 bp, Mus musculus
tattccggatgaggcagactttctg

SEQ ID NO: 792288 - DNA, 25 bp, Mus musculus
tattccgggtagagtttcaggctgc

SEQ ID NO: 792289 - DNA, 25 bp, Mus musculus
tattccgggtagtgtttcaggctgc

SEQ ID NO: 792290 - DNA, 25 bp, Mus musculus
tattccgtccttccaagcatggtta

SEQ ID NO: 792291 - DNA, 25 bp, Mus musculus
tattccgtccttgcaagcatggtta

SEQ ID NO: 792292 - DNA, 25 bp, Mus musculus
tattccgtgagaagtacgtccgctt

SEQ ID NO: 792293 - DNA, 25 bp, Mus musculus
tattccgtgagatgtacgtccgctt

SEQ ID NO: 792294 - DNA, 25 bp, Mus musculus
tattccgtggtacccaaccttatat

SEQ ID NO: 792295 - DNA, 25 bp, Mus musculus
tattccgtggtagccaaccttatat

SEQ ID NO: 792296 - DNA, 25 bp, Mus musculus
tattccgtttgaatcacctacatgg

SEQ ID NO: 792297 - DNA, 25 bp, Mus musculus
tattccgtttgattcacctacatgg

SEQ ID NO: 792298 - DNA, 25 bp, Mus musculus
tattcctaactactgtatttgttac

SEQ ID NO: 792299 - DNA, 25 bp, Mus musculus
tattcctaactagtgtatttgttac

SEQ ID NO: 792300 - DNA, 25 bp, Mus musculus
tattcctaactgagtgttctgtgaa

SEQ ID NO: 792301 - DNA, 25 bp, Mus musculus
tattcctaactgtgtgttctgtgaa

SEQ ID NO: 792302 - DNA, 25 bp, Mus musculus
tattcctaagcaactagctttccct

SEQ ID NO: 792303 - DNA, 25 bp, Mus musculus
tattcctaagcatctagctttccct

SEQ ID NO: 792304 - DNA, 25 bp, Mus musculus
tattcctactccactaccttagttt

SEQ ID NO: 792305 - DNA, 25 bp, Mus musculus
tattcctactcctctaccttagttt

SEQ ID NO: 792306 - DNA, 25 bp, Mus musculus
tattcctactgtcccttcgacgctg

SEQ ID NO: 792307 - DNA, 25 bp, Mus musculus
tattcctactgtgccttcgacgctg

SEQ ID NO: 792308 - DNA, 25 bp, Mus musculus
tattcctacttcctttgttataaag

SEQ ID NO: 792309 - DNA, 25 bp, Mus musculus
tattcctacttcgtttgttataaag

SEQ ID NO: 792310 - DNA, 25 bp, Mus musculus
tattcctagctgcttggtactggtc

SEQ ID NO: 792311 - DNA, 25 bp, Mus musculus
tattcctagctggttggtactggtc

SEQ ID NO: 792312 - DNA, 25 bp, Mus musculus
tattcctaggtaatgtatatctgac

SEQ ID NO: 792313 - DNA, 25 bp, Mus musculus
tattcctaggtattgtatatctgac

SEQ ID NO: 792314 - DNA, 25 bp, Mus musculus
tattcctatgctatcaacatctgaa

SEQ ID NO: 792315 - DNA, 25 bp, Mus musculus
tattcctatgctttcaacatctgaa

SEQ ID NO: 792316 - DNA, 25 bp, Mus musculus
tattcctatgttatggcttgttttt

SEQ ID NO: 792317 - DNA, 25 bp, Mus musculus
tattcctatgttttggcttgttttt

SEQ ID NO: 792318 - DNA, 25 bp, Mus musculus
tattcctattttcatttagtctgac

SEQ ID NO: 792319 - DNA, 25 bp, Mus musculus
tattcctattttgatttagtctgac

SEQ ID NO: 792320 - DNA, 25 bp, Mus musculus
tattcctcaagcaccggaacacgat

SEQ ID NO: 792321 - DNA, 25 bp, Mus musculus
tattcctcaagctccggaacacgat

SEQ ID NO: 792322 - DNA, 25 bp, Mus musculus
tattcctcacacaatatttacattg

SEQ ID NO: 792323 - DNA, 25 bp, Mus musculus
tattcctcacacactagccaagggt

SEQ ID NO: 792324 - DNA, 25 bp, Mus musculus
tattcctcacactatatttacattg

SEQ ID NO: 792325 - DNA, 25 bp, Mus musculus
tattcctcacactctagccaagggt

SEQ ID NO: 792326 - DNA, 25 bp, Mus musculus
tattcctcccaaagtaaagtttctt

SEQ ID NO: 792327 - DNA, 25 bp, Mus musculus
tattcctcccaactgtagctttttg

SEQ ID NO: 792328 - DNA, 25 bp, Mus musculus
tattcctcccaagtgtagctttttg

SEQ ID NO: 792329 - DNA, 25 bp, Mus musculus
tattcctcccaatgtaaagtttctt

SEQ ID NO: 792330 - DNA, 25 bp, Mus musculus
tattcctcctccaattgtgtatagg

SEQ ID NO: 792331 - DNA, 25 bp, Mus musculus
tattcctcctcctattgtgtatagg

SEQ ID NO: 792332 - DNA, 25 bp, Mus musculus
tattcctcctgaagattttctctag

SEQ ID NO: 792333 - DNA, 25 bp, Mus musculus
tattcctcctgatgattttctctag

SEQ ID NO: 792334 - DNA, 25 bp, Mus musculus
tattcctcctgtactgggtgtccag

SEQ ID NO: 792335 - DNA, 25 bp, Mus musculus
tattcctcctgttctgggtgtccag

SEQ ID NO: 792336 - DNA, 25 bp, Mus musculus
tattcctctgatatcacttttgtag

SEQ ID NO: 792337 - DNA, 25 bp, Mus musculus
tattcctctgatttcacttttgtag

SEQ ID NO: 792338 - DNA, 25 bp, Mus musculus
tattcctcttccctatgaccagaga

SEQ ID NO: 792339 - DNA, 25 bp, Mus musculus
tattcctcttccgtatgaccagaga

SEQ ID NO: 792340 - DNA, 25 bp, Mus musculus
tattcctgaactctcttctttaccc

SEQ ID NO: 792341 - DNA, 25 bp, Mus musculus
tattcctgaactgtcttctttaccc

SEQ ID NO: 792342 - DNA, 25 bp, Mus musculus
tattcctgcaaactccatcctgaac

SEQ ID NO: 792343 - DNA, 25 bp, Mus musculus
tattcctgcaaagtccatcctgaac

SEQ ID NO: 792344 - DNA, 25 bp, Mus musculus
tattcctgcattaatgcaaaggcac

SEQ ID NO: 792345 - DNA, 25 bp, Mus musculus
tattcctgcatttatgcaaaggcac

SEQ ID NO: 792346 - DNA, 25 bp, Mus musculus
tattcctgcccgcgattcgttcctt

SEQ ID NO: 792347 - DNA, 25 bp, Mus musculus
tattcctgcccgggattcgttcctt

SEQ ID NO: 792348 - DNA, 25 bp, Mus musculus
tattcctgccctacgtcatttagaa

SEQ ID NO: 792349 - DNA, 25 bp, Mus musculus
tattcctgcccttcgtcatttagaa

SEQ ID NO: 792350 - DNA, 25 bp, Mus musculus
tattcctgctgaagaactggctttt

SEQ ID NO: 792351 - DNA, 25 bp, Mus musculus
tattcctgctgatgaactggctttt

SEQ ID NO: 792352 - DNA, 25 bp, Mus musculus
tattcctggccacagacctagagga

SEQ ID NO: 792353 - DNA, 25 bp, Mus musculus
tattcctggccagagacctagagga

SEQ ID NO: 792354 - DNA, 25 bp, Mus musculus
tattcctggcttctaggaggaccac

SEQ ID NO: 792355 - DNA, 25 bp, Mus musculus
tattcctggcttgtaggaggaccac

SEQ ID NO: 792356 - DNA, 25 bp, Mus musculus
tattcctgggatatagagatgtcta

SEQ ID NO: 792357 - DNA, 25 bp, Mus musculus
tattcctgggatcaccttgcagagg

SEQ ID NO: 792358 - DNA, 25 bp, Mus musculus
tattcctgggatgaccttgcagagg

SEQ ID NO: 792359 - DNA, 25 bp, Mus musculus
tattcctgggatttagagatgtcta

SEQ ID NO: 792360 - DNA, 25 bp, Mus musculus
tattcctgggctagcctcatcctaa

SEQ ID NO: 792361 - DNA, 25 bp, Mus musculus
tattcctgggcttgcctcatcctaa

SEQ ID NO: 792362 - DNA, 25 bp, Mus musculus
tattcctgggtaatcctgggtgtta

SEQ ID NO: 792363 - DNA, 25 bp, Mus musculus
tattcctgggtattcctgggtgtta

SEQ ID NO: 792364 - DNA, 25 bp, Mus musculus
tattcctggtatattgtacttccct

SEQ ID NO: 792365 - DNA, 25 bp, Mus musculus
tattcctggtattttgtacttccct

SEQ ID NO: 792366 - DNA, 25 bp, Mus musculus
tattcctggtggaagccagcttgat

SEQ ID NO: 792367 - DNA, 25 bp, Mus musculus
tattcctggtggtagccagcttgat

SEQ ID NO: 792368 - DNA, 25 bp, Mus musculus
tattcctggtttctttggacaccct

SEQ ID NO: 792369 - DNA, 25 bp, Mus musculus
tattcctggtttgtttggacaccct

SEQ ID NO: 792370 - DNA, 25 bp, Mus musculus
tattcctgtaggacacactttcttc

SEQ ID NO: 792371 - DNA, 25 bp, Mus musculus
tattcctgtaggtcacactttcttc

SEQ ID NO: 792372 - DNA, 25 bp, Mus musculus
tattcctgttaaaagcctctggcac

SEQ ID NO: 792373 - DNA, 25 bp, Mus musculus
tattcctgttaatagcctctggcac

SEQ ID NO: 792374 - DNA, 25 bp, Mus musculus
tattcctgttataggcatgtgcacg

SEQ ID NO: 792375 - DNA, 25 bp, Mus musculus
tattcctgttattggcatgtgcacg

SEQ ID NO: 792376 - DNA, 25 bp, Mus musculus
tattcctgttccacgccatcttttt

SEQ ID NO: 792377 - DNA, 25 bp, Mus musculus
tattcctgttcctcgccatcttttt

SEQ ID NO: 792378 - DNA, 25 bp, Mus musculus
tattcctgttctatggctccctttt

SEQ ID NO: 792379 - DNA, 25 bp, Mus musculus
tattcctgttctttggctccctttt

SEQ ID NO: 792380 - DNA, 25 bp, Mus musculus
tattcctgttgtctgttccattatg

SEQ ID NO: 792381 - DNA, 25 bp, Mus musculus
tattcctgttgtgtgttccattatg

SEQ ID NO: 792382 - DNA, 25 bp, Mus musculus
tattccttagagatacctttcatga

SEQ ID NO: 792383 - DNA, 25 bp, Mus musculus
tattccttagagttacctttcatga

SEQ ID NO: 792384 - DNA, 25 bp, Mus musculus
tattccttagctacccggatgctga

SEQ ID NO: 792385 - DNA, 25 bp, Mus musculus
tattccttagcttcccggatgctga

SEQ ID NO: 792386 - DNA, 25 bp, Mus musculus
tattccttagttcccacacattcta

SEQ ID NO: 792387 - DNA, 25 bp, Mus musculus
tattccttagttgccacacattcta

SEQ ID NO: 792388 - DNA, 25 bp, Mus musculus
tattccttcagcctcagtacattac

SEQ ID NO: 792389 - DNA, 25 bp, Mus musculus
tattccttcagcgtcagtacattac

SEQ ID NO: 792390 - DNA, 25 bp, Mus musculus
tattccttcaggacgctggatttgt

SEQ ID NO: 792391 - DNA, 25 bp, Mus musculus
tattccttcaggtcgctggatttgt

SEQ ID NO: 792392 - DNA, 25 bp, Mus musculus
tattccttccttacaaatctttggt

SEQ ID NO: 792393 - DNA, 25 bp, Mus musculus
tattccttcctttcaaatctttggt

SEQ ID NO: 792394 - DNA, 25 bp, Mus musculus
tattccttcgaacgcagacagcagc

SEQ ID NO: 792395 - DNA, 25 bp, Mus musculus
tattccttcgaaggcagacagcagc

SEQ ID NO: 792396 - DNA, 25 bp, Mus musculus
tattccttctaacagagagcctttg

SEQ ID NO: 792397 - DNA, 25 bp, Mus musculus
tattccttctaagagagagcctttg

SEQ ID NO: 792398 - DNA, 25 bp, Mus musculus
tattccttctccaaagacgatctgc

SEQ ID NO: 792399 - DNA, 25 bp, Mus musculus
tattccttctcctaagacgatctgc

SEQ ID NO: 792400 - DNA, 25 bp, Mus musculus
tattccttgccaagtgtccttgaat

SEQ ID NO: 792401 - DNA, 25 bp, Mus musculus
tattccttgccatgtgtccttgaat

SEQ ID NO: 792402 - DNA, 25 bp, Mus musculus
tattccttgcggctagctgtcacaa

SEQ ID NO: 792403 - DNA, 25 bp, Mus musculus
tattccttgcgggtagctgtcacaa

SEQ ID NO: 792404 - DNA, 25 bp, Mus musculus
tattccttggctatcggctacttcc

SEQ ID NO: 792405 - DNA, 25 bp, Mus musculus
tattccttggctttcggctacttcc

SEQ ID NO: 792406 - DNA, 25 bp, Mus musculus
tattccttgggaatttgacttttgg

SEQ ID NO: 792407 - DNA, 25 bp, Mus musculus
tattccttgggattttgacttttgg

SEQ ID NO: 792408 - DNA, 25 bp, Mus musculus
tattccttgttacgccattttctgc

SEQ ID NO: 792409 - DNA, 25 bp, Mus musculus
tattccttgttaggccattttctgc

SEQ ID NO: 792410 - DNA, 25 bp, Mus musculus
tattcctttcaaccaaagactccag

SEQ ID NO: 792411 - DNA, 25 bp, Mus musculus
tattcctttcaagcaaagactccag

SEQ ID NO: 792412 - DNA, 25 bp, Mus musculus
tattcctttcccaactgtacacgga

SEQ ID NO: 792413 - DNA, 25 bp, Mus musculus
tattcctttccctactgtacacgga

SEQ ID NO: 792414 - DNA, 25 bp, Mus musculus
tattcctttcctcgcacctgaggct

SEQ ID NO: 792415 - DNA, 25 bp, Mus musculus
tattcctttcctggcacctgaggct

SEQ ID NO: 792416 - DNA, 25 bp, Mus musculus
tattcctttcggaactcctcgatgc

SEQ ID NO: 792417 - DNA, 25 bp, Mus musculus
tattcctttcggtactcctcgatgc

SEQ ID NO: 792418 - DNA, 25 bp, Mus musculus
tattcctttcgtattcttgttagtg

SEQ ID NO: 792419 - DNA, 25 bp, Mus musculus
tattcctttcgttttcttgttagtg

SEQ ID NO: 792420 - DNA, 25 bp, Mus musculus
tattcctttctccatggcctgcttt

SEQ ID NO: 792421 - DNA, 25 bp, Mus musculus
tattcctttctcgatggcctgcttt

SEQ ID NO: 792422 - DNA, 25 bp, Mus musculus
tattcctttctgcacgtgcgagatt

SEQ ID NO: 792423 - DNA, 25 bp, Mus musculus
tattcctttctggacgtgcgagatt

SEQ ID NO: 792424 - DNA, 25 bp, Mus musculus
tattcctttgccctggagtccaggg

SEQ ID NO: 792425 - DNA, 25 bp, Mus musculus
tattcctttgccgtggagtccaggg

SEQ ID NO: 792426 - DNA, 25 bp, Mus musculus
tattcctttgtaaagtttttaagct

SEQ ID NO: 792427 - DNA, 25 bp, Mus musculus
tattcctttgtatagtttttaagct

SEQ ID NO: 792428 - DNA, 25 bp, Mus musculus
tattcgaagcttctgggttaatacc

SEQ ID NO: 792429 - DNA, 25 bp, Mus musculus
tattcgaagcttgtgggttaatacc

SEQ ID NO: 792430 - DNA, 25 bp, Mus musculus
tattcgacagccaacctgcctggca

SEQ ID NO: 792431 - DNA, 25 bp, Mus musculus
tattcgacagcctacctgcctggca

SEQ ID NO: 792432 - DNA, 25 bp, Mus musculus
tattcgacatggaagctgacttatc

SEQ ID NO: 792433 - DNA, 25 bp, Mus musculus
tattcgacatggtagctgacttatc

SEQ ID NO: 792434 - DNA, 25 bp, Mus musculus
tattcgaccattctaggtgctagct

SEQ ID NO: 792435 - DNA, 25 bp, Mus musculus
tattcgaccattgtaggtgctagct

SEQ ID NO: 792436 - DNA, 25 bp, Mus musculus
tattcgaccgggatggcaacggctt

SEQ ID NO: 792437 - DNA, 25 bp, Mus musculus
tattcgaccgggttggcaacggctt

SEQ ID NO: 792438 - DNA, 25 bp, Mus musculus
tattcgacttctccttcctggcgag

SEQ ID NO: 792439 - DNA, 25 bp, Mus musculus
tattcgacttctgcttcctggcgag

SEQ ID NO: 792440 - DNA, 25 bp, Mus musculus
tattcgagagatacgccagttccag

SEQ ID NO: 792441 - DNA, 25 bp, Mus musculus
tattcgagagattcgccagttccag

SEQ ID NO: 792442 - DNA, 25 bp, Mus musculus
tattcgagcaaccttacaggatttg

SEQ ID NO: 792443 - DNA, 25 bp, Mus musculus
tattcgagcaacgttacaggatttg

SEQ ID NO: 792444 - DNA, 25 bp, Mus musculus
tattcgagcaccacagaagcacgtc

SEQ ID NO: 792445 - DNA, 25 bp, Mus musculus
tattcgagcacctcagaagcacgtc

SEQ ID NO: 792446 - DNA, 25 bp, Mus musculus
tattcgagctttacacgtctctgag

SEQ ID NO: 792447 - DNA, 25 bp, Mus musculus
tattcgagcttttcacgtctctgag

SEQ ID NO: 792448 - DNA, 25 bp, Mus musculus
tattcgcacagtacagcaggttaga

SEQ ID NO: 792449 - DNA, 25 bp, Mus musculus
tattcgcacagttcagcaggttaga

SEQ ID NO: 792450 - DNA, 25 bp, Mus musculus
tattcgcagactcctggatttctga

SEQ ID NO: 792451 - DNA, 25 bp, Mus musculus
tattcgcagactgctggatttctga

SEQ ID NO: 792452 - DNA, 25 bp, Mus musculus
tattcgcagtttacgttagttgatg

SEQ ID NO: 792453 - DNA, 25 bp, Mus musculus
tattcgcagttttcgttagttgatg

SEQ ID NO: 792454 - DNA, 25 bp, Mus musculus
tattcgctcggcagtacctggctaa

SEQ ID NO: 792455 - DNA, 25 bp, Mus musculus
tattcgctcggctgtacctggctaa

SEQ ID NO: 792456 - DNA, 25 bp, Mus musculus
tattcggaacagaacctcctgcttt

SEQ ID NO: 792457 - DNA, 25 bp, Mus musculus
tattcggaacagtacctcctgcttt

SEQ ID NO: 792458 - DNA, 25 bp, Mus musculus
tattcggcatttcttcagctgcttc

SEQ ID NO: 792459 - DNA, 25 bp, Mus musculus
tattcggcatttgttcagctgcttc

SEQ ID NO: 792460 - DNA, 25 bp, Mus musculus
tattcgggcaacacaaattcaggtg

SEQ ID NO: 792461 - DNA, 25 bp, Mus musculus
tattcgggcaactcaaattcaggtg

SEQ ID NO: 792462 - DNA, 25 bp, Mus musculus
tattcggtctgcattcccagtgggc

SEQ ID NO: 792463 - DNA, 25 bp, Mus musculus
tattcggtctgctttcccagtgggc

SEQ ID NO: 792464 - DNA, 25 bp, Mus musculus
tattcgtacagcattaatcacccct

SEQ ID NO: 792465 - DNA, 25 bp, Mus musculus
tattcgtacagctttaatcacccct

SEQ ID NO: 792466 - DNA, 25 bp, Mus musculus
tattcgtcacttcaatcaggttctg

SEQ ID NO: 792467 - DNA, 25 bp, Mus musculus
tattcgtcacttgaatcaggttctg

SEQ ID NO: 792468 - DNA, 25 bp, Mus musculus
tattcgtgaagtctcacgtgctccc

SEQ ID NO: 792469 - DNA, 25 bp, Mus musculus
tattcgtgaagtgtcacgtgctccc

SEQ ID NO: 792470 - DNA, 25 bp, Mus musculus
tattcgtgcagccagccagctggac

SEQ ID NO: 792471 - DNA, 25 bp, Mus musculus
tattcgtgcagcgagccagctggac

SEQ ID NO: 792472 - DNA, 25 bp, Mus musculus
tattcgtgggttagaattcctgttt

SEQ ID NO: 792473 - DNA, 25 bp, Mus musculus
tattcgtgggtttgaattcctgttt

SEQ ID NO: 792474 - DNA, 25 bp, Mus musculus
tattcgtgtaaaaaagagttgcttg

SEQ ID NO: 792475 - DNA, 25 bp, Mus musculus
tattcgtgtaaataagagttgcttg

SEQ ID NO: 792476 - DNA, 25 bp, Mus musculus
tattcgtgtgcaaatccatatccat

SEQ ID NO: 792477 - DNA, 25 bp, Mus musculus
tattcgtgtgcatatccatatccat

SEQ ID NO: 792478 - DNA, 25 bp, Mus musculus
tattcgttataccgaagatgatgaa

SEQ ID NO: 792479 - DNA, 25 bp, Mus musculus
tattcgttatacggaagatgatgaa

SEQ ID NO: 792480 - DNA, 25 bp, Mus musculus
tattcgttcccaatccaaatctgag

SEQ ID NO: 792481 - DNA, 25 bp, Mus musculus
tattcgttcccattccaaatctgag

SEQ ID NO: 792482 - DNA, 25 bp, Mus musculus
tattctaaagaaagaccccataatg

SEQ ID NO: 792483 - DNA, 25 bp, Mus musculus
tattctaaagaatgaccccataatg

SEQ ID NO: 792484 - DNA, 25 bp, Mus musculus
tattctaaagacagcctctaccatt

SEQ ID NO: 792485 - DNA, 25 bp, Mus musculus
tattctaaagactgcctctaccatt

SEQ ID NO: 792486 - DNA, 25 bp, Mus musculus
tattctaaagtaatggacccttcct

SEQ ID NO: 792487 - DNA, 25 bp, Mus musculus
tattctaaagtattggacccttcct

SEQ ID NO: 792488 - DNA, 25 bp, Mus musculus
tattctaactctacagtgactgcct

SEQ ID NO: 792489 - DNA, 25 bp, Mus musculus
tattctaactcttcagtgactgcct

SEQ ID NO: 792490 - DNA, 25 bp, Mus musculus
tattctaagactctttgccctacag

SEQ ID NO: 792491 - DNA, 25 bp, Mus musculus
tattctaagactgtttgccctacag

SEQ ID NO: 792492 - DNA, 25 bp, Mus musculus
tattctaagtacaacacaccggtcc

SEQ ID NO: 792493 - DNA, 25 bp, Mus musculus
tattctaagtactacacaccggtcc

SEQ ID NO: 792494 - DNA, 25 bp, Mus musculus
tattctacacacaggaactttgcct

SEQ ID NO: 792495 - DNA, 25 bp, Mus musculus
tattctacacactggaactttgcct

SEQ ID NO: 792496 - DNA, 25 bp, Mus musculus
tattctacacgtcaacagcaagggc

SEQ ID NO: 792497 - DNA, 25 bp, Mus musculus
tattctacacgtgaacagcaagggc

SEQ ID NO: 792498 - DNA, 25 bp, Mus musculus
tattctacagaactgctttcaagca

SEQ ID NO: 792499 - DNA, 25 bp, Mus musculus
tattctacagaagtgctttcaagca

SEQ ID NO: 792500 - DNA, 25 bp, Mus musculus
tattctaccagcctaatttcctttt

SEQ ID NO: 792501 - DNA, 25 bp, Mus musculus
tattctaccagcgtaatttcctttt

SEQ ID NO: 792502 - DNA, 25 bp, Mus musculus
tattctactcttcgtcctgaatctc

SEQ ID NO: 792503 - DNA, 25 bp, Mus musculus
tattctactcttggtcctgaatctc

SEQ ID NO: 792504 - DNA, 25 bp, Mus musculus
tattctactggcatattcactcgat

SEQ ID NO: 792505 - DNA, 25 bp, Mus musculus
tattctactggcttattcactcgat

SEQ ID NO: 792506 - DNA, 25 bp, Mus musculus
tattctactgtcctgatcctgtctt

SEQ ID NO: 792507 - DNA, 25 bp, Mus musculus
tattctactgtcgtgatcctgtctt

SEQ ID NO: 792508 - DNA, 25 bp, Mus musculus
tattctacttacactttacctactg

SEQ ID NO: 792509 - DNA, 25 bp, Mus musculus
tattctacttactctttacctactg

SEQ ID NO: 792510 - DNA, 25 bp, Mus musculus
tattctagacgcctgagctcttctg

SEQ ID NO: 792511 - DNA, 25 bp, Mus musculus
tattctagacgcgtgagctcttctg

SEQ ID NO: 792512 - DNA, 25 bp, Mus musculus
tattctagccccattccagactatt

SEQ ID NO: 792513 - DNA, 25 bp, Mus musculus
tattctagcccctttccagactatt

SEQ ID NO: 792514 - DNA, 25 bp, Mus musculus
tattctagccgtaatttcaaccctt

SEQ ID NO: 792515 - DNA, 25 bp, Mus musculus
tattctagccgttatttcaaccctt

SEQ ID NO: 792516 - DNA, 25 bp, Mus musculus
tattctaggattaaagccaattgtc

SEQ ID NO: 792517 - DNA, 25 bp, Mus musculus
tattctaggatttaagccaattgtc

SEQ ID NO: 792518 - DNA, 25 bp, Mus musculus
tattctaggcaaattccagttaaaa

SEQ ID NO: 792519 - DNA, 25 bp, Mus musculus
tattctaggcaatttccagttaaaa

SEQ ID NO: 792520 - DNA, 25 bp, Mus musculus
tattctaggccacatggtcaacgtg

SEQ ID NO: 792521 - DNA, 25 bp, Mus musculus
tattctaggccagatggtcaacgtg

SEQ ID NO: 792522 - DNA, 25 bp, Mus musculus
tattctagtctgactgccttttaaa

SEQ ID NO: 792523 - DNA, 25 bp, Mus musculus
tattctagtctgtctgccttttaaa

SEQ ID NO: 792524 - DNA, 25 bp, Mus musculus
tattctatatacaaacacgactctg

SEQ ID NO: 792525 - DNA, 25 bp, Mus musculus
tattctatatactaacacgactctg

SEQ ID NO: 792526 - DNA, 25 bp, Mus musculus
tattctatcagaactgccactgtgc

SEQ ID NO: 792527 - DNA, 25 bp, Mus musculus
tattctatcagatctgccactgtgc

SEQ ID NO: 792528 - DNA, 25 bp, Mus musculus
tattctatccacctttgcagcacat

SEQ ID NO: 792529 - DNA, 25 bp, Mus musculus
tattctatccacgtttgcagcacat

SEQ ID NO: 792530 - DNA, 25 bp, Mus musculus
tattctatccgcaaccctttagctt

SEQ ID NO: 792531 - DNA, 25 bp, Mus musculus
tattctatccgctaccctttagctt

SEQ ID NO: 792532 - DNA, 25 bp, Mus musculus
tattctatcctacctcagtacacac

SEQ ID NO: 792533 - DNA, 25 bp, Mus musculus
tattctatcctagctcagtacacac

SEQ ID NO: 792534 - DNA, 25 bp, Mus musculus
tattctatccttacactacgtgcag

SEQ ID NO: 792535 - DNA, 25 bp, Mus musculus
tattctatcctttcactacgtgcag

SEQ ID NO: 792536 - DNA, 25 bp, Mus musculus
tattctatgtgtatcttttcttcag

SEQ ID NO: 792537 - DNA, 25 bp, Mus musculus
tattctatgtgtttcttttcttcag

SEQ ID NO: 792538 - DNA, 25 bp, Mus musculus
tattctattggtcactagggcctct

SEQ ID NO: 792539 - DNA, 25 bp, Mus musculus
tattctattggtgactagggcctct

SEQ ID NO: 792540 - DNA, 25 bp, Mus musculus
tattctatttatattccctctccag

SEQ ID NO: 792541 - DNA, 25 bp, Mus musculus
tattctatttattttccctctccag

SEQ ID NO: 792542 - DNA, 25 bp, Mus musculus
tattctcaagagaggtatgcccgcc

SEQ ID NO: 792543 - DNA, 25 bp, Mus musculus
tattctcaagagtggtatgcccgcc

SEQ ID NO: 792544 - DNA, 25 bp, Mus musculus
tattctcaagggaatcccgctgtga

SEQ ID NO: 792545 - DNA, 25 bp, Mus musculus
tattctcaagggtatcccgctgtga

SEQ ID NO: 792546 - DNA, 25 bp, Mus musculus
tattctcacaatcccgcatgcttaa

SEQ ID NO: 792547 - DNA, 25 bp, Mus musculus
tattctcacaatgccgcatgcttaa

SEQ ID NO: 792548 - DNA, 25 bp, Mus musculus
tattctcacccactttgaccttgat

SEQ ID NO: 792549 - DNA, 25 bp, Mus musculus
tattctcacccagtttgaccttgat

SEQ ID NO: 792550 - DNA, 25 bp, Mus musculus
tattctcagcacctgaagtttcaaa

SEQ ID NO: 792551 - DNA, 25 bp, Mus musculus
tattctcagcacgtgaagtttcaaa

SEQ ID NO: 792552 - DNA, 25 bp, Mus musculus
tattctcagcagcagcaagtcttgg

SEQ ID NO: 792553 - DNA, 25 bp, Mus musculus
tattctcagcaggagcaagtcttgg

SEQ ID NO: 792554 - DNA, 25 bp, Mus musculus
tattctcagcatcaaaagtttatgt

SEQ ID NO: 792555 - DNA, 25 bp, Mus musculus
tattctcagcatgaaaagtttatgt

SEQ ID NO: 792556 - DNA, 25 bp, Mus musculus
tattctcaggtcaatcggtcaccct

SEQ ID NO: 792557 - DNA, 25 bp, Mus musculus
tattctcaggtctatcggtcaccct

SEQ ID NO: 792558 - DNA, 25 bp, Mus musculus
tattctcagtggacacttggctcag

SEQ ID NO: 792559 - DNA, 25 bp, Mus musculus
tattctcagtggtcacttggctcag

SEQ ID NO: 792560 - DNA, 25 bp, Mus musculus
tattctcatccaaatcattccattt

SEQ ID NO: 792561 - DNA, 25 bp, Mus musculus
tattctcatccatatcattccattt

SEQ ID NO: 792562 - DNA, 25 bp, Mus musculus
tattctcattccaggcagagatcct

SEQ ID NO: 792563 - DNA, 25 bp, Mus musculus
tattctcattcctggcagagatcct

SEQ ID NO: 792564 - DNA, 25 bp, Mus musculus
tattctccacggacattagtgttcc

SEQ ID NO: 792565 - DNA, 25 bp, Mus musculus
tattctccacggtcattagtgttcc

SEQ ID NO: 792566 - DNA, 25 bp, Mus musculus
tattctccagtacataaaccagtct

SEQ ID NO: 792567 - DNA, 25 bp, Mus musculus
tattctccagtagataaaccagtct

SEQ ID NO: 792568 - DNA, 25 bp, Mus musculus
tattctcccaagctctagactgcca

SEQ ID NO: 792569 - DNA, 25 bp, Mus musculus
tattctcccaaggtctagactgcca

SEQ ID NO: 792570 - DNA, 25 bp, Mus musculus
tattctcccattatggacagcgact

SEQ ID NO: 792571 - DNA, 25 bp, Mus musculus
tattctcccattttggacagcgact

SEQ ID NO: 792572 - DNA, 25 bp, Mus musculus
tattctccctctcgtggacttgttg

SEQ ID NO: 792573 - DNA, 25 bp, Mus musculus
tattctccctctggtggacttgttg

SEQ ID NO: 792574 - DNA, 25 bp, Mus musculus
tattctccggacattagcaccatga

SEQ ID NO: 792575 - DNA, 25 bp, Mus musculus
tattctccggactttagcaccatga

SEQ ID NO: 792576 - DNA, 25 bp, Mus musculus
tattctcctaaaatcaagtgctcag

SEQ ID NO: 792577 - DNA, 25 bp, Mus musculus
tattctcctaaattcaagtgctcag

SEQ ID NO: 792578 - DNA, 25 bp, Mus musculus
tattctccttgtatccttttctatc

SEQ ID NO: 792579 - DNA, 25 bp, Mus musculus
tattctccttgtttccttttctatc

SEQ ID NO: 792580 - DNA, 25 bp, Mus musculus
tattctcgaattctcttcccagtag

SEQ ID NO: 792581 - DNA, 25 bp, Mus musculus
tattctcgaattgtcttcccagtag

SEQ ID NO: 792582 - DNA, 25 bp, Mus musculus
tattctcgacttactgcacatgtaa

SEQ ID NO: 792583 - DNA, 25 bp, Mus musculus
tattctcgactttctgcacatgtaa

SEQ ID NO: 792584 - DNA, 25 bp, Mus musculus
tattctcgccgcagatacagctaat

SEQ ID NO: 792585 - DNA, 25 bp, Mus musculus
tattctcgccgctgatacagctaat

SEQ ID NO: 792586 - DNA, 25 bp, Mus musculus
tattctcgctggcttgtggtcacgt

SEQ ID NO: 792587 - DNA, 25 bp, Mus musculus
tattctcgctgggttgtggtcacgt

SEQ ID NO: 792588 - DNA, 25 bp, Mus musculus
tattctctcaacagtgctccttaga

SEQ ID NO: 792589 - DNA, 25 bp, Mus musculus
tattctctcaactgtgctccttaga

SEQ ID NO: 792590 - DNA, 25 bp, Mus musculus
tattctctcaagaaccagattggag

SEQ ID NO: 792591 - DNA, 25 bp, Mus musculus
tattctctcaagtaccagattggag

SEQ ID NO: 792592 - DNA, 25 bp, Mus musculus
tattctctcggtacatacaaaggac

SEQ ID NO: 792593 - DNA, 25 bp, Mus musculus
tattctctcggttcatacaaaggac

SEQ ID NO: 792594 - DNA, 25 bp, Mus musculus
tattctctctcccagatgcttattt

SEQ ID NO: 792595 - DNA, 25 bp, Mus musculus
tattctctctccgagatgcttattt

SEQ ID NO: 792596 - DNA, 25 bp, Mus musculus
tattctctcttcatggattgaccct

SEQ ID NO: 792597 - DNA, 25 bp, Mus musculus
tattctctcttcttggattgaccct

SEQ ID NO: 792598 - DNA, 25 bp, Mus musculus
tattctctgagaaccccactaaact

SEQ ID NO: 792599 - DNA, 25 bp, Mus musculus
tattctctgagatccccactaaact

SEQ ID NO: 792600 - DNA, 25 bp, Mus musculus
tattctctggcacttggtctttaaa

SEQ ID NO: 792601 - DNA, 25 bp, Mus musculus
tattctctggcagttggtctttaaa

SEQ ID NO: 792602 - DNA, 25 bp, Mus musculus
tattctctgtgcactcaagtggcta

SEQ ID NO: 792603 - DNA, 25 bp, Mus musculus
tattctctgtgctctcaagtggcta

SEQ ID NO: 792604 - DNA, 25 bp, Mus musculus
tattctctgtgtacgggaggcaacc

SEQ ID NO: 792605 - DNA, 25 bp, Mus musculus
tattctctgtgttcgggaggcaacc

SEQ ID NO: 792606 - DNA, 25 bp, Mus musculus
tattctctgtttctctattgtctat

SEQ ID NO: 792607 - DNA, 25 bp, Mus musculus
tattctctgtttgtctattgtctat

SEQ ID NO: 792608 - DNA, 25 bp, Mus musculus
tattctcttccaccgctttaatact

SEQ ID NO: 792609 - DNA, 25 bp, Mus musculus
tattctcttccagcgctttaatact

SEQ ID NO: 792610 - DNA, 25 bp, Mus musculus
tattctcttcttctcaggatcacag

SEQ ID NO: 792611 - DNA, 25 bp, Mus musculus
tattctcttcttctcatccaataga

SEQ ID NO: 792612 - DNA, 25 bp, Mus musculus
tattctcttcttgtcaggatcacag

SEQ ID NO: 792613 - DNA, 25 bp, Mus musculus
tattctcttcttgtcatccaataga

SEQ ID NO: 792614 - DNA, 25 bp, Mus musculus
tattctcttgacaggatgctatggg

SEQ ID NO: 792615 - DNA, 25 bp, Mus musculus
tattctcttgactggatgctatggg

SEQ ID NO: 792616 - DNA, 25 bp, Mus musculus
tattctcttttcatcttgaagattt

SEQ ID NO: 792617 - DNA, 25 bp, Mus musculus
tattctcttttcttcttgaagattt

SEQ ID NO: 792618 - DNA, 25 bp, Mus musculus
tattctcttttgcacctgcccttaa

SEQ ID NO: 792619 - DNA, 25 bp, Mus musculus
tattctcttttggacctgcccttaa

SEQ ID NO: 792620 - DNA, 25 bp, Mus musculus
tattctgaaaaactgctgtacgtag

SEQ ID NO: 792621 - DNA, 25 bp, Mus musculus
tattctgaaaaagtgctgtacgtag

SEQ ID NO: 792622 - DNA, 25 bp, Mus musculus
tattctgaaatacaacctgacgcgt

SEQ ID NO: 792623 - DNA, 25 bp, Mus musculus
tattctgaaatagaacctgacgcgt

SEQ ID NO: 792624 - DNA, 25 bp, Mus musculus
tattctgaacttcgtatgtctgagt

SEQ ID NO: 792625 - DNA, 25 bp, Mus musculus
tattctgaacttggtatgtctgagt

SEQ ID NO: 792626 - DNA, 25 bp, Mus musculus
tattctgaagcccaagcctcataac

SEQ ID NO: 792627 - DNA, 25 bp, Mus musculus
tattctgaagccgaagcctcataac

SEQ ID NO: 792628 - DNA, 25 bp, Mus musculus
tattctgaagggatcgcacaccgtg

SEQ ID NO: 792629 - DNA, 25 bp, Mus musculus
tattctgaagggttcgcacaccgtg

SEQ ID NO: 792630 - DNA, 25 bp, Mus musculus
tattctgacaacacagatcggattc

SEQ ID NO: 792631 - DNA, 25 bp, Mus musculus
tattctgacaactcagatcggattc

SEQ ID NO: 792632 - DNA, 25 bp, Mus musculus
tattctgacacccagtccttggtat

SEQ ID NO: 792633 - DNA, 25 bp, Mus musculus
tattctgacaccgagtccttggtat

SEQ ID NO: 792634 - DNA, 25 bp, Mus musculus
tattctgacaggcttttgatttatg

SEQ ID NO: 792635 - DNA, 25 bp, Mus musculus
tattctgacagggttttgatttatg

SEQ ID NO: 792636 - DNA, 25 bp, Mus musculus
tattctgacagtatacattgagtaa

SEQ ID NO: 792637 - DNA, 25 bp, Mus musculus
tattctgacagtttacattgagtaa

SEQ ID NO: 792638 - DNA, 25 bp, Mus musculus
tattctgaccttaaaagtgttcttt

SEQ ID NO: 792639 - DNA, 25 bp, Mus musculus
tattctgacctttaaagtgttcttt

SEQ ID NO: 792640 - DNA, 25 bp, Mus musculus
tattctgacgctcagctccaacagt

SEQ ID NO: 792641 - DNA, 25 bp, Mus musculus
tattctgacgctgagctccaacagt

SEQ ID NO: 792642 - DNA, 25 bp, Mus musculus
tattctgactccacctcgagaacca

SEQ ID NO: 792643 - DNA, 25 bp, Mus musculus
tattctgactccagggaccttctgt

SEQ ID NO: 792644 - DNA, 25 bp, Mus musculus
tattctgactcctcctcgagaacca

SEQ ID NO: 792645 - DNA, 25 bp, Mus musculus
tattctgactcctgggaccttctgt

SEQ ID NO: 792646 - DNA, 25 bp, Mus musculus
tattctgactggattggcttactga

SEQ ID NO: 792647 - DNA, 25 bp, Mus musculus
tattctgactggtttggcttactga

SEQ ID NO: 792648 - DNA, 25 bp, Mus musculus
tattctgagctgatacgttgtgtgt

SEQ ID NO: 792649 - DNA, 25 bp, Mus musculus
tattctgagctgttacgttgtgtgt

SEQ ID NO: 792650 - DNA, 25 bp, Mus musculus
tattctgatgcaatctgatgggtca

SEQ ID NO: 792651 - DNA, 25 bp, Mus musculus
tattctgatgcattctgatgggtca

SEQ ID NO: 792652 - DNA, 25 bp, Mus musculus
tattctgcattcattcagatgcccc

SEQ ID NO: 792653 - DNA, 25 bp, Mus musculus
tattctgcattctttcagatgcccc

SEQ ID NO: 792654 - DNA, 25 bp, Mus musculus
tattctgcccttatgtatacatttg

SEQ ID NO: 792655 - DNA, 25 bp, Mus musculus
tattctgcccttttgtatacatttg

SEQ ID NO: 792656 - DNA, 25 bp, Mus musculus
tattctgccttgacccaaagctttt

SEQ ID NO: 792657 - DNA, 25 bp, Mus musculus
tattctgccttgtcccaaagctttt

SEQ ID NO: 792658 - DNA, 25 bp, Mus musculus
tattctgcgctcagttttactccat

SEQ ID NO: 792659 - DNA, 25 bp, Mus musculus
tattctgcgctctgttttactccat

SEQ ID NO: 792660 - DNA, 25 bp, Mus musculus
tattctgctacgcaaggctgtcctt

SEQ ID NO: 792661 - DNA, 25 bp, Mus musculus
tattctgctacggaaggctgtcctt

SEQ ID NO: 792662 - DNA, 25 bp, Mus musculus
tattctgctcctactgttgctgaga

SEQ ID NO: 792663 - DNA, 25 bp, Mus musculus
tattctgctccttctgttgctgaga

SEQ ID NO: 792664 - DNA, 25 bp, Mus musculus
tattctgctggaacatatctgcctg

SEQ ID NO: 792665 - DNA, 25 bp, Mus musculus
tattctgctggatcatatctgcctg

SEQ ID NO: 792666 - DNA, 25 bp, Mus musculus
tattctggaaccctaaattgatttt

SEQ ID NO: 792667 - DNA, 25 bp, Mus musculus
tattctggaaccgtaaattgatttt

SEQ ID NO: 792668 - DNA, 25 bp, Mus musculus
tattctggagctcggatatatacct

SEQ ID NO: 792669 - DNA, 25 bp, Mus musculus
tattctggagctgggatatatacct

SEQ ID NO: 792670 - DNA, 25 bp, Mus musculus
tattctggcaatcctcaatacactt

SEQ ID NO: 792671 - DNA, 25 bp, Mus musculus
tattctggcaatgctcaatacactt

SEQ ID NO: 792672 - DNA, 25 bp, Mus musculus
tattctggccgacagtcacagactt

SEQ ID NO: 792673 - DNA, 25 bp, Mus musculus
tattctggccgagagtcacagactt

SEQ ID NO: 792674 - DNA, 25 bp, Mus musculus
tattctggctagagtttcccagtcc

SEQ ID NO: 792675 - DNA, 25 bp, Mus musculus
tattctggctagtgtttcccagtcc

SEQ ID NO: 792676 - DNA, 25 bp, Mus musculus
tattctggctgcaaactacttagac

SEQ ID NO: 792677 - DNA, 25 bp, Mus musculus
tattctggctgctaactacttagac

SEQ ID NO: 792678 - DNA, 25 bp, Mus musculus
tattctgggagcaataagccttctg

SEQ ID NO: 792679 - DNA, 25 bp, Mus musculus
tattctgggagctataagccttctg

SEQ ID NO: 792680 - DNA, 25 bp, Mus musculus
tattctgggtgtaagcagctccttc

SEQ ID NO: 792681 - DNA, 25 bp, Mus musculus
tattctgggtgttagcagctccttc

SEQ ID NO: 792682 - DNA, 25 bp, Mus musculus
tattctggtgtacaaatgcctttca

SEQ ID NO: 792683 - DNA, 25 bp, Mus musculus
tattctggtgtagaaatgcctttca

SEQ ID NO: 792684 - DNA, 25 bp, Mus musculus
tattctggttgtcggtgccacattg

SEQ ID NO: 792685 - DNA, 25 bp, Mus musculus
tattctggttgtgggtgccacattg

SEQ ID NO: 792686 - DNA, 25 bp, Mus musculus
tattctggtttaaattcttcctcct

SEQ ID NO: 792687 - DNA, 25 bp, Mus musculus
tattctggtttatattcttcctcct

SEQ ID NO: 792688 - DNA, 25 bp, Mus musculus
tattctgtacccagcagctggatag

SEQ ID NO: 792689 - DNA, 25 bp, Mus musculus
tattctgtacccagtggtccagtga

SEQ ID NO: 792690 - DNA, 25 bp, Mus musculus
tattctgtaccctgcagctggatag

SEQ ID NO: 792691 - DNA, 25 bp, Mus musculus
tattctgtaccctgtggtccagtga

SEQ ID NO: 792692 - DNA, 25 bp, Mus musculus
tattctgtacctcttctatgaagac

SEQ ID NO: 792693 - DNA, 25 bp, Mus musculus
tattctgtacctgttctatgaagac

SEQ ID NO: 792694 - DNA, 25 bp, Mus musculus
tattctgtactgagcagttacacaa

SEQ ID NO: 792695 - DNA, 25 bp, Mus musculus
tattctgtactgtgcagttacacaa

SEQ ID NO: 792696 - DNA, 25 bp, Mus musculus
tattctgtagaacctttaagtacat

SEQ ID NO: 792697 - DNA, 25 bp, Mus musculus
tattctgtagaagctttaagtacat

SEQ ID NO: 792698 - DNA, 25 bp, Mus musculus
tattctgtagcgaattcttatatct

SEQ ID NO: 792699 - DNA, 25 bp, Mus musculus
tattctgtagcgtattcttatatct

SEQ ID NO: 792700 - DNA, 25 bp, Mus musculus
tattctgtaggcagtccattcacta

SEQ ID NO: 792701 - DNA, 25 bp, Mus musculus
tattctgtaggctgtccattcacta

SEQ ID NO: 792702 - DNA, 25 bp, Mus musculus
tattctgtatatctcctaggtggct

SEQ ID NO: 792703 - DNA, 25 bp, Mus musculus
tattctgtatatgtcctaggtggct

SEQ ID NO: 792704 - DNA, 25 bp, Mus musculus
tattctgtatttctctgatgctgca

SEQ ID NO: 792705 - DNA, 25 bp, Mus musculus
tattctgtatttgtctgatgctgca

SEQ ID NO: 792706 - DNA, 25 bp, Mus musculus
tattctgtcattcctttttctcgga

SEQ ID NO: 792707 - DNA, 25 bp, Mus musculus
tattctgtcattgctttttctcgga

SEQ ID NO: 792708 - DNA, 25 bp, Mus musculus
tattctgtcctgaaccctagagact

SEQ ID NO: 792709 - DNA, 25 bp, Mus musculus
tattctgtcctgtaccctagagact

SEQ ID NO: 792710 - DNA, 25 bp, Mus musculus
tattctgtccttaactaatgcagtt

SEQ ID NO: 792711 - DNA, 25 bp, Mus musculus
tattctgtcctttactaatgcagtt

SEQ ID NO: 792712 - DNA, 25 bp, Mus musculus
tattctgtctacaaatgccatcatt

SEQ ID NO: 792713 - DNA, 25 bp, Mus musculus
tattctgtctactaatgccatcatt

SEQ ID NO: 792714 - DNA, 25 bp, Mus musculus
tattctgtgctactcaaaaccgccc

SEQ ID NO: 792715 - DNA, 25 bp, Mus musculus
tattctgtgctagtcaaaaccgccc

SEQ ID NO: 792716 - DNA, 25 bp, Mus musculus
tattctgtggagattgactgccctt

SEQ ID NO: 792717 - DNA, 25 bp, Mus musculus
tattctgtggagtttgactgccctt

SEQ ID NO: 792718 - DNA, 25 bp, Mus musculus
tattctgtgtagagtccccaagcgc

SEQ ID NO: 792719 - DNA, 25 bp, Mus musculus
tattctgtgtagcaacccagagcag

SEQ ID NO: 792720 - DNA, 25 bp, Mus musculus
tattctgtgtaggaacccagagcag

SEQ ID NO: 792721 - DNA, 25 bp, Mus musculus
tattctgtgtagtgtccccaagcgc

SEQ ID NO: 792722 - DNA, 25 bp, Mus musculus
tattctgtgtgtatgcgactgacca

SEQ ID NO: 792723 - DNA, 25 bp, Mus musculus
tattctgtgtgtttgcgactgacca

SEQ ID NO: 792724 - DNA, 25 bp, Mus musculus
tattctgttaccaagccagatggtt

SEQ ID NO: 792725 - DNA, 25 bp, Mus musculus
tattctgttacctagccagatggtt

SEQ ID NO: 792726 - DNA, 25 bp, Mus musculus
tattctgttatgatcctcagtggaa

SEQ ID NO: 792727 - DNA, 25 bp, Mus musculus
tattctgttatgttcctcagtggaa

SEQ ID NO: 792728 - DNA, 25 bp, Mus musculus
tattctgttctaccccaagagagca

SEQ ID NO: 792729 - DNA, 25 bp, Mus musculus
tattctgttctagcccaagagagca

SEQ ID NO: 792730 - DNA, 25 bp, Mus musculus
tattctgttgtcatctgtcatctcc

SEQ ID NO: 792731 - DNA, 25 bp, Mus musculus
tattctgttgtcttctgtcatctcc

SEQ ID NO: 792732 - DNA, 25 bp, Mus musculus
tattcttaactcatgggccggttca

SEQ ID NO: 792733 - DNA, 25 bp, Mus musculus
tattcttaactcttgggccggttca

SEQ ID NO: 792734 - DNA, 25 bp, Mus musculus
tattcttacagtagactcctcagag

SEQ ID NO: 792735 - DNA, 25 bp, Mus musculus
tattcttacagttgactcctcagag

SEQ ID NO: 792736 - DNA, 25 bp, Mus musculus
tattcttactttaatctcctttact

SEQ ID NO: 792737 - DNA, 25 bp, Mus musculus
tattcttacttttatctcctttact

SEQ ID NO: 792738 - DNA, 25 bp, Mus musculus
tattcttagattccacccgtaaggt

SEQ ID NO: 792739 - DNA, 25 bp, Mus musculus
tattcttagattgcacccgtaaggt

SEQ ID NO: 792740 - DNA, 25 bp, Mus musculus
tattcttagcatcttaggctcttcc

SEQ ID NO: 792741 - DNA, 25 bp, Mus musculus
tattcttagcatgttaggctcttcc

SEQ ID NO: 792742 - DNA, 25 bp, Mus musculus
tattcttagtcacttcctagtctgc

SEQ ID NO: 792743 - DNA, 25 bp, Mus musculus
tattcttagtcagttcctagtctgc

SEQ ID NO: 792744 - DNA, 25 bp, Mus musculus
tattcttatatcacctgttcttctg

SEQ ID NO: 792745 - DNA, 25 bp, Mus musculus
tattcttatatctcctgttcttctg

SEQ ID NO: 792746 - DNA, 25 bp, Mus musculus
tattcttatgtcacgatgttttggt

SEQ ID NO: 792747 - DNA, 25 bp, Mus musculus
tattcttatgtctcgatgttttggt

SEQ ID NO: 792748 - DNA, 25 bp, Mus musculus
tattcttatttaaccaccatgtgtg

SEQ ID NO: 792749 - DNA, 25 bp, Mus musculus
tattcttatttatccaccatgtgtg

SEQ ID NO: 792750 - DNA, 25 bp, Mus musculus
tattcttcaattctcaggaatgttg

SEQ ID NO: 792751 - DNA, 25 bp, Mus musculus
tattcttcaattctcttactctctc

SEQ ID NO: 792752 - DNA, 25 bp, Mus musculus
tattcttcaattgtcaggaatgttg

SEQ ID NO: 792753 - DNA, 25 bp, Mus musculus
tattcttcaattgtcttactctctc

SEQ ID NO: 792754 - DNA, 25 bp, Mus musculus
tattcttcagagaagctctttgagg

SEQ ID NO: 792755 - DNA, 25 bp, Mus musculus
tattcttcagagtagctctttgagg

SEQ ID NO: 792756 - DNA, 25 bp, Mus musculus
tattcttcagccacacgttaaaggg

SEQ ID NO: 792757 - DNA, 25 bp, Mus musculus
tattcttcagcctcacgttaaaggg

SEQ ID NO: 792758 - DNA, 25 bp, Mus musculus
tattcttcatgtaccatcagctctg

SEQ ID NO: 792759 - DNA, 25 bp, Mus musculus
tattcttcatgttccatcagctctg

SEQ ID NO: 792760 - DNA, 25 bp, Mus musculus
tattcttcattgcactgctcagagg

SEQ ID NO: 792761 - DNA, 25 bp, Mus musculus
tattcttcattggactgctcagagg

SEQ ID NO: 792762 - DNA, 25 bp, Mus musculus
tattcttccaaacgttccacaggct

SEQ ID NO: 792763 - DNA, 25 bp, Mus musculus
tattcttccaaaggttccacaggct

SEQ ID NO: 792764 - DNA, 25 bp, Mus musculus
tattcttccataattttcagtgttt

SEQ ID NO: 792765 - DNA, 25 bp, Mus musculus
tattcttccatatttttcagtgttt

SEQ ID NO: 792766 - DNA, 25 bp, Mus musculus
tattcttcccttaatgttaatttct

SEQ ID NO: 792767 - DNA, 25 bp, Mus musculus
tattcttccctttatgttaatttct

SEQ ID NO: 792768 - DNA, 25 bp, Mus musculus
tattcttcctatcctgttacagcag

SEQ ID NO: 792769 - DNA, 25 bp, Mus musculus
tattcttcctatgctgttacagcag

SEQ ID NO: 792770 - DNA, 25 bp, Mus musculus
tattcttctataagggctctgcagc

SEQ ID NO: 792771 - DNA, 25 bp, Mus musculus
tattcttctatatgggctctgcagc

SEQ ID NO: 792772 - DNA, 25 bp, Mus musculus
tattcttctatgactttcctggaac

SEQ ID NO: 792773 - DNA, 25 bp, Mus musculus
tattcttctatgtctttcctggaac

SEQ ID NO: 792774 - DNA, 25 bp, Mus musculus
tattcttctcagcagttctacttgg

SEQ ID NO: 792775 - DNA, 25 bp, Mus musculus
tattcttctcaggagttctacttgg

SEQ ID NO: 792776 - DNA, 25 bp, Mus musculus
tattcttctcctcctgaattctcga

SEQ ID NO: 792777 - DNA, 25 bp, Mus musculus
tattcttctcctgctgaattctcga

SEQ ID NO: 792778 - DNA, 25 bp, Mus musculus
tattcttctcttacactcttatcta

SEQ ID NO: 792779 - DNA, 25 bp, Mus musculus
tattcttctctttcactcttatcta

SEQ ID NO: 792780 - DNA, 25 bp, Mus musculus
tattcttctgctacagtcttgccta

SEQ ID NO: 792781 - DNA, 25 bp, Mus musculus
tattcttctgcttcagtcttgccta

SEQ ID NO: 792782 - DNA, 25 bp, Mus musculus
tattcttctggaacccagaacttga

SEQ ID NO: 792783 - DNA, 25 bp, Mus musculus
tattcttctggatcccagaacttga

SEQ ID NO: 792784 - DNA, 25 bp, Mus musculus
tattcttctgggaccgccaagatgg

SEQ ID NO: 792785 - DNA, 25 bp, Mus musculus
tattcttctgggtccgccaagatgg

SEQ ID NO: 792786 - DNA, 25 bp, Mus musculus
tattcttcttgtccagtctaagccg

SEQ ID NO: 792787 - DNA, 25 bp, Mus musculus
tattcttcttgtgcagtctaagccg

SEQ ID NO: 792788 - DNA, 25 bp, Mus musculus
tattcttcttttcatgtggatgtaa

SEQ ID NO: 792789 - DNA, 25 bp, Mus musculus
tattcttcttttgatgtggatgtaa

SEQ ID NO: 792790 - DNA, 25 bp, Mus musculus
tattcttgaggcatcctggcttcca

SEQ ID NO: 792791 - DNA, 25 bp, Mus musculus
tattcttgaggcttcctggcttcca

SEQ ID NO: 792792 - DNA, 25 bp, Mus musculus
tattcttgagtcagcagctctcttg

SEQ ID NO: 792793 - DNA, 25 bp, Mus musculus
tattcttgagtctgcagctctcttg

SEQ ID NO: 792794 - DNA, 25 bp, Mus musculus
tattcttggttcatcatactccaga

SEQ ID NO: 792795 - DNA, 25 bp, Mus musculus
tattcttggttcttcatactccaga

SEQ ID NO: 792796 - DNA, 25 bp, Mus musculus
tattcttggtttagggcacatattt

SEQ ID NO: 792797 - DNA, 25 bp, Mus musculus
tattcttggttttgggcacatattt

SEQ ID NO: 792798 - DNA, 25 bp, Mus musculus
tattcttgtactatcctgtgtacaa

SEQ ID NO: 792799 - DNA, 25 bp, Mus musculus
tattcttgtactttcctgtgtacaa

SEQ ID NO: 792800 - DNA, 25 bp, Mus musculus
tattcttgtgaaagagactgctctt

SEQ ID NO: 792801 - DNA, 25 bp, Mus musculus
tattcttgtgaatgagactgctctt

SEQ ID NO: 792802 - DNA, 25 bp, Mus musculus
tattcttgtggtacctcgccagcaa

SEQ ID NO: 792803 - DNA, 25 bp, Mus musculus
tattcttgtggttcctcgccagcaa

SEQ ID NO: 792804 - DNA, 25 bp, Mus musculus
tattctttagaaccacttaacatat

SEQ ID NO: 792805 - DNA, 25 bp, Mus musculus
tattctttagaagcacttaacatat

SEQ ID NO: 792806 - DNA, 25 bp, Mus musculus
tattctttagttagcttacccttga

SEQ ID NO: 792807 - DNA, 25 bp, Mus musculus
tattctttagtttgcttacccttga

SEQ ID NO: 792808 - DNA, 25 bp, Mus musculus
tattctttcaagctgcttgtgccct

SEQ ID NO: 792809 - DNA, 25 bp, Mus musculus
tattctttcaaggtgcttgtgccct

SEQ ID NO: 792810 - DNA, 25 bp, Mus musculus
tattctttcacgcagctggagagat

SEQ ID NO: 792811 - DNA, 25 bp, Mus musculus
tattctttcacggagctggagagat

SEQ ID NO: 792812 - DNA, 25 bp, Mus musculus
tattctttcactagtatgtacagag

SEQ ID NO: 792813 - DNA, 25 bp, Mus musculus
tattctttcacttgtatgtacagag

SEQ ID NO: 792814 - DNA, 25 bp, Mus musculus
tattctttcagaactgccactgtgc

SEQ ID NO: 792815 - DNA, 25 bp, Mus musculus
tattctttcagatctgccactgtgc

SEQ ID NO: 792816 - DNA, 25 bp, Mus musculus
tattctttcagcaatgcccgtcctt

SEQ ID NO: 792817 - DNA, 25 bp, Mus musculus
tattctttcagctatgcccgtcctt

SEQ ID NO: 792818 - DNA, 25 bp, Mus musculus
tattctttcccgctttgatgaagag

SEQ ID NO: 792819 - DNA, 25 bp, Mus musculus
tattctttcccggtttgatgaagag

SEQ ID NO: 792820 - DNA, 25 bp, Mus musculus
tattctttccctccagtgtgtgttt

SEQ ID NO: 792821 - DNA, 25 bp, Mus musculus
tattctttccctgcagtgtgtgttt

SEQ ID NO: 792822 - DNA, 25 bp, Mus musculus
tattctttccgtataccttgtacag

SEQ ID NO: 792823 - DNA, 25 bp, Mus musculus
tattctttccgtttaccttgtacag

SEQ ID NO: 792824 - DNA, 25 bp, Mus musculus
tattctttctaacgtgtcaccttca

SEQ ID NO: 792825 - DNA, 25 bp, Mus musculus
tattctttctaaggtgtcaccttca

SEQ ID NO: 792826 - DNA, 25 bp, Mus musculus
tattctttctacagagtgcgatgtt

SEQ ID NO: 792827 - DNA, 25 bp, Mus musculus
tattctttctactgagtgcgatgtt

SEQ ID NO: 792828 - DNA, 25 bp, Mus musculus
tattctttctgtagtacctacttga

SEQ ID NO: 792829 - DNA, 25 bp, Mus musculus
tattctttctgttgtacctacttga

SEQ ID NO: 792830 - DNA, 25 bp, Mus musculus
tattctttgcttatgacattgtctc

SEQ ID NO: 792831 - DNA, 25 bp, Mus musculus
tattctttgcttttgacattgtctc

SEQ ID NO: 792832 - DNA, 25 bp, Mus musculus
tattctttggagactctgaccagca

SEQ ID NO: 792833 - DNA, 25 bp, Mus musculus
tattctttggagtctctgaccagca

SEQ ID NO: 792834 - DNA, 25 bp, Mus musculus
tattctttggcgcttggaaatccct

SEQ ID NO: 792835 - DNA, 25 bp, Mus musculus
tattctttggcggttggaaatccct

SEQ ID NO: 792836 - DNA, 25 bp, Mus musculus
tattctttgggacgacagtcgtcac

SEQ ID NO: 792837 - DNA, 25 bp, Mus musculus
tattctttgggaggacagtcgtcac

SEQ ID NO: 792838 - DNA, 25 bp, Mus musculus
tattctttggtcacattacacagga

SEQ ID NO: 792839 - DNA, 25 bp, Mus musculus
tattctttggtctcattacacagga

SEQ ID NO: 792840 - DNA, 25 bp, Mus musculus
tattctttgtaactctagacattag

SEQ ID NO: 792841 - DNA, 25 bp, Mus musculus
tattctttgtaagtctagacattag

SEQ ID NO: 792842 - DNA, 25 bp, Mus musculus
tattcttttatgaagggactaattt

SEQ ID NO: 792843 - DNA, 25 bp, Mus musculus
tattcttttatgtagggactaattt

SEQ ID NO: 792844 - DNA, 25 bp, Mus musculus
tattcttttattctacactcctgca

SEQ ID NO: 792845 - DNA, 25 bp, Mus musculus
tattcttttattgtacactcctgca

SEQ ID NO: 792846 - DNA, 25 bp, Mus musculus
tattcttttccgagcaccttacttt

SEQ ID NO: 792847 - DNA, 25 bp, Mus musculus
tattcttttccgtgcaccttacttt

SEQ ID NO: 792848 - DNA, 25 bp, Mus musculus
tattcttttcttcccacaagatggg

SEQ ID NO: 792849 - DNA, 25 bp, Mus musculus
tattcttttcttgccacaagatggg

SEQ ID NO: 792850 - DNA, 25 bp, Mus musculus
tattctttttagactcctacctggg

SEQ ID NO: 792851 - DNA, 25 bp, Mus musculus
tattctttttagtctcctacctggg

SEQ ID NO: 792852 - DNA, 25 bp, Mus musculus
tattctttttctccacgttgtttat

SEQ ID NO: 792853 - DNA, 25 bp, Mus musculus
tattctttttctgcacgttgtttat

SEQ ID NO: 792854 - DNA, 25 bp, Mus musculus
tattctttttgaatggttaccacca

SEQ ID NO: 792855 - DNA, 25 bp, Mus musculus
tattctttttgattggttaccacca

SEQ ID NO: 792856 - DNA, 25 bp, Mus musculus
tattgaaaaccgagctctgtggata

SEQ ID NO: 792857 - DNA, 25 bp, Mus musculus
tattgaaaaccgtgctctgtggata

SEQ ID NO: 792858 - DNA, 25 bp, Mus musculus
tattgaaacagcaccggacagccag

SEQ ID NO: 792859 - DNA, 25 bp, Mus musculus
tattgaaacagctccggacagccag

SEQ ID NO: 792860 - DNA, 25 bp, Mus musculus
tattgaaacctgaaagacctgttaa

SEQ ID NO: 792861 - DNA, 25 bp, Mus musculus
tattgaaacctgtaagacctgttaa

SEQ ID NO: 792862 - DNA, 25 bp, Mus musculus
tattgaaatcccacacctatcagac

SEQ ID NO: 792863 - DNA, 25 bp, Mus musculus
tattgaaatccctcacctatcagac

SEQ ID NO: 792864 - DNA, 25 bp, Mus musculus
tattgaactaccagctctgtggcgt

SEQ ID NO: 792865 - DNA, 25 bp, Mus musculus
tattgaactacctgctctgtggcgt

SEQ ID NO: 792866 - DNA, 25 bp, Mus musculus
tattgaagacggctgtgtggttcca

SEQ ID NO: 792867 - DNA, 25 bp, Mus musculus
tattgaagacgggtgtgtggttcca

SEQ ID NO: 792868 - DNA, 25 bp, Mus musculus
tattgaagccttagtacattactgt

SEQ ID NO: 792869 - DNA, 25 bp, Mus musculus
tattgaagcctttgtacattactgt

SEQ ID NO: 792870 - DNA, 25 bp, Mus musculus
tattgaatattaccccttggtcctc

SEQ ID NO: 792871 - DNA, 25 bp, Mus musculus
tattgaatattagcccttggtcctc

SEQ ID NO: 792872 - DNA, 25 bp, Mus musculus
tattgaatgattccactgcccaggc

SEQ ID NO: 792873 - DNA, 25 bp, Mus musculus
tattgaatgattgcactgcccaggc

SEQ ID NO: 792874 - DNA, 25 bp, Mus musculus
tattgaatggccatgccacagatgt

SEQ ID NO: 792875 - DNA, 25 bp, Mus musculus
tattgaatggccttgccacagatgt

SEQ ID NO: 792876 - DNA, 25 bp, Mus musculus
tattgaattgacatcctggaatcta

SEQ ID NO: 792877 - DNA, 25 bp, Mus musculus
tattgaattgacttcctggaatcta

SEQ ID NO: 792878 - DNA, 25 bp, Mus musculus
tattgaatttacagagggctttttt

SEQ ID NO: 792879 - DNA, 25 bp, Mus musculus
tattgaatttactgagggctttttt

SEQ ID NO: 792880 - DNA, 25 bp, Mus musculus
tattgaattttaaggtccctttctt

SEQ ID NO: 792881 - DNA, 25 bp, Mus musculus
tattgaattttatggtccctttctt

SEQ ID NO: 792882 - DNA, 25 bp, Mus musculus
tattgacaaaccatattcttacgaa

SEQ ID NO: 792883 - DNA, 25 bp, Mus musculus
tattgacaaaccttattcttacgaa

SEQ ID NO: 792884 - DNA, 25 bp, Mus musculus
tattgacaacctcaaattccccatc

SEQ ID NO: 792885 - DNA, 25 bp, Mus musculus
tattgacaacctgaaattccccatc

SEQ ID NO: 792886 - DNA, 25 bp, Mus musculus
tattgacaggtaccagagacagctg

SEQ ID NO: 792887 - DNA, 25 bp, Mus musculus
tattgacaggtagcagagacagctg

SEQ ID NO: 792888 - DNA, 25 bp, Mus musculus
tattgacataggcaccagagtacac

SEQ ID NO: 792889 - DNA, 25 bp, Mus musculus
tattgacatagggaccagagtacac

SEQ ID NO: 792890 - DNA, 25 bp, Mus musculus
tattgacatctacgggcggctattg

SEQ ID NO: 792891 - DNA, 25 bp, Mus musculus
tattgacatctaggggcggctattg

SEQ ID NO: 792892 - DNA, 25 bp, Mus musculus
tattgacattggactgtctgtgcct

SEQ ID NO: 792893 - DNA, 25 bp, Mus musculus
tattgacattggtctgtctgtgcct

SEQ ID NO: 792894 - DNA, 25 bp, Mus musculus
tattgaccactgacatggctgggtg

SEQ ID NO: 792895 - DNA, 25 bp, Mus musculus
tattgaccactgtcatggctgggtg

SEQ ID NO: 792896 - DNA, 25 bp, Mus musculus
tattgacccttgagtgtgtccccgg

SEQ ID NO: 792897 - DNA, 25 bp, Mus musculus
tattgacccttgtgtgtgtccccgg

SEQ ID NO: 792898 - DNA, 25 bp, Mus musculus
tattgacctaccctggaagtatgcc

SEQ ID NO: 792899 - DNA, 25 bp, Mus musculus
tattgacctaccgtggaagtatgcc

SEQ ID NO: 792900 - DNA, 25 bp, Mus musculus
tattgacctcaaaaatgctgcataa

SEQ ID NO: 792901 - DNA, 25 bp, Mus musculus
tattgacctcaataatgctgcataa

SEQ ID NO: 792902 - DNA, 25 bp, Mus musculus
tattgacctgacagctgtgcagtcc

SEQ ID NO: 792903 - DNA, 25 bp, Mus musculus
tattgacctgactgctgtgcagtcc

SEQ ID NO: 792904 - DNA, 25 bp, Mus musculus
tattgacctgtcagtgcactatatg

SEQ ID NO: 792905 - DNA, 25 bp, Mus musculus
tattgacctgtctgtgcactatatg

SEQ ID NO: 792906 - DNA, 25 bp, Mus musculus
tattgacgatctcgcagacctcagc

SEQ ID NO: 792907 - DNA, 25 bp, Mus musculus
tattgacgatctggcagacctcagc

SEQ ID NO: 792908 - DNA, 25 bp, Mus musculus
tattgacgctgacgactttatcaga

SEQ ID NO: 792909 - DNA, 25 bp, Mus musculus
tattgacgctgaggactttatcaga

SEQ ID NO: 792910 - DNA, 25 bp, Mus musculus
tattgacgtaagatctccagagcct

SEQ ID NO: 792911 - DNA, 25 bp, Mus musculus
tattgacgtaagttctccagagcct

SEQ ID NO: 792912 - DNA, 25 bp, Mus musculus
tattgactacttagggtaccagggt

SEQ ID NO: 792913 - DNA, 25 bp, Mus musculus
tattgactactttgggtaccagggt

SEQ ID NO: 792914 - DNA, 25 bp, Mus musculus
tattgactctagaggcctagcctgt

SEQ ID NO: 792915 - DNA, 25 bp, Mus musculus
tattgactctagtggcctagcctgt

SEQ ID NO: 792916 - DNA, 25 bp, Mus musculus
tattgactgaggctctggaagcaac

SEQ ID NO: 792917 - DNA, 25 bp, Mus musculus
tattgactgagggtctggaagcaac

SEQ ID NO: 792918 - DNA, 25 bp, Mus musculus
tattgactgataaatttatagcctc

SEQ ID NO: 792919 - DNA, 25 bp, Mus musculus
tattgactgatatatttatagcctc

SEQ ID NO: 792920 - DNA, 25 bp, Mus musculus
tattgactggacagagacctgccaa

SEQ ID NO: 792921 - DNA, 25 bp, Mus musculus
tattgactggactgagacctgccaa

SEQ ID NO: 792922 - DNA, 25 bp, Mus musculus
tattgactggtgactggtcacctac

SEQ ID NO: 792923 - DNA, 25 bp, Mus musculus
tattgactggtgtctggtcacctac

SEQ ID NO: 792924 - DNA, 25 bp, Mus musculus
tattgactgtatatttgggcagaga

SEQ ID NO: 792925 - DNA, 25 bp, Mus musculus
tattgactgtatttttgggcagaga

SEQ ID NO: 792926 - DNA, 25 bp, Mus musculus
tattgactgtcaagtggccctaagg

SEQ ID NO: 792927 - DNA, 25 bp, Mus musculus
tattgactgtcatgtggccctaagg

SEQ ID NO: 792928 - DNA, 25 bp, Mus musculus
tattgacttattcttctacatcctt

SEQ ID NO: 792929 - DNA, 25 bp, Mus musculus
tattgacttattgttctacatcctt

SEQ ID NO: 792930 - DNA, 25 bp, Mus musculus
tattgacttggaaactgtgattcat

SEQ ID NO: 792931 - DNA, 25 bp, Mus musculus
tattgacttggatactgtgattcat

SEQ ID NO: 792932 - DNA, 25 bp, Mus musculus
tattgacttgggactccagagctaa

SEQ ID NO: 792933 - DNA, 25 bp, Mus musculus
tattgacttgggtctccagagctaa

SEQ ID NO: 792934 - DNA, 25 bp, Mus musculus
tattgacttgtcattcccctgtcct

SEQ ID NO: 792935 - DNA, 25 bp, Mus musculus
tattgacttgtccagggctccgtgg

SEQ ID NO: 792936 - DNA, 25 bp, Mus musculus
tattgacttgtcgagggctccgtgg

SEQ ID NO: 792937 - DNA, 25 bp, Mus musculus
tattgacttgtctttcccctgtcct

SEQ ID NO: 792938 - DNA, 25 bp, Mus musculus
tattgagacaggctgctcatgggaa

SEQ ID NO: 792939 - DNA, 25 bp, Mus musculus
tattgagacagggtgctcatgggaa

SEQ ID NO: 792940 - DNA, 25 bp, Mus musculus
tattgagagcagaccagtagaattt

SEQ ID NO: 792941 - DNA, 25 bp, Mus musculus
tattgagagcagtccagtagaattt

SEQ ID NO: 792942 - DNA, 25 bp, Mus musculus
tattgagagcttactgtcatcagac

SEQ ID NO: 792943 - DNA, 25 bp, Mus musculus
tattgagagctttctgtcatcagac

SEQ ID NO: 792944 - DNA, 25 bp, Mus musculus
tattgagatctgaatcaccccaccc

SEQ ID NO: 792945 - DNA, 25 bp, Mus musculus
tattgagatctgagccttggacggg

SEQ ID NO: 792946 - DNA, 25 bp, Mus musculus
tattgagatctgtatcaccccaccc

SEQ ID NO: 792947 - DNA, 25 bp, Mus musculus
tattgagatctgtgccttggacggg

SEQ ID NO: 792948 - DNA, 25 bp, Mus musculus
tattgagattctcggtttggtgttt

SEQ ID NO: 792949 - DNA, 25 bp, Mus musculus
tattgagattctgggtttggtgttt

SEQ ID NO: 792950 - DNA, 25 bp, Mus musculus
tattgagcacttctcatgttccggc

SEQ ID NO: 792951 - DNA, 25 bp, Mus musculus
tattgagcacttgtcatgttccggc

SEQ ID NO: 792952 - DNA, 25 bp, Mus musculus
tattgagcagaaatccaagatggct

SEQ ID NO: 792953 - DNA, 25 bp, Mus musculus
tattgagcagaattccaagatggct

SEQ ID NO: 792954 - DNA, 25 bp, Mus musculus
tattgagcattactttgggaccgaa

SEQ ID NO: 792955 - DNA, 25 bp, Mus musculus
tattgagcattagtttgggaccgaa

SEQ ID NO: 792956 - DNA, 25 bp, Mus musculus
tattgagcccaaatcaccattctct

SEQ ID NO: 792957 - DNA, 25 bp, Mus musculus
tattgagcccaattcaccattctct

SEQ ID NO: 792958 - DNA, 25 bp, Mus musculus
tattgagcctagatgctactactaa

SEQ ID NO: 792959 - DNA, 25 bp, Mus musculus
tattgagcctagttgctactactaa

SEQ ID NO: 792960 - DNA, 25 bp, Mus musculus
tattgagcggcccctgttgtatttc

SEQ ID NO: 792961 - DNA, 25 bp, Mus musculus
tattgagcggccgctgttgtatttc

SEQ ID NO: 792962 - DNA, 25 bp, Mus musculus
tattgagctcttaagcccaggcagg

SEQ ID NO: 792963 - DNA, 25 bp, Mus musculus
tattgagctctttagcccaggcagg

SEQ ID NO: 792964 - DNA, 25 bp, Mus musculus
tattgagcttatctgttgggaggca

SEQ ID NO: 792965 - DNA, 25 bp, Mus musculus
tattgagcttatgtgttgggaggca

SEQ ID NO: 792966 - DNA, 25 bp, Mus musculus
tattgagcttgcaccatcaattttt

SEQ ID NO: 792967 - DNA, 25 bp, Mus musculus
tattgagcttgctccatcaattttt

SEQ ID NO: 792968 - DNA, 25 bp, Mus musculus
tattgaggactacgcgggtcaccca

SEQ ID NO: 792969 - DNA, 25 bp, Mus musculus
tattgaggactaggcgggtcaccca

SEQ ID NO: 792970 - DNA, 25 bp, Mus musculus
tattgagggcccacacttaagaccg

SEQ ID NO: 792971 - DNA, 25 bp, Mus musculus
tattgagggccctcacttaagaccg

SEQ ID NO: 792972 - DNA, 25 bp, Mus musculus
tattgagggtgaatatactacctga

SEQ ID NO: 792973 - DNA, 25 bp, Mus musculus
tattgagggtgattatactacctga

SEQ ID NO: 792974 - DNA, 25 bp, Mus musculus
tattgagtacttcttgtgtgcatgc

SEQ ID NO: 792975 - DNA, 25 bp, Mus musculus
tattgagtacttgttgtgtgcatgc

SEQ ID NO: 792976 - DNA, 25 bp, Mus musculus
tattgagtgcttatgtgggccttct

SEQ ID NO: 792977 - DNA, 25 bp, Mus musculus
tattgagtgcttttgtgggccttct

SEQ ID NO: 792978 - DNA, 25 bp, Mus musculus
tattgagttggcacagagatcatta

SEQ ID NO: 792979 - DNA, 25 bp, Mus musculus
tattgagttggctcagagatcatta

SEQ ID NO: 792980 - DNA, 25 bp, Mus musculus
tattgagtttgaaacgagcccaggg

SEQ ID NO: 792981 - DNA, 25 bp, Mus musculus
tattgagtttgatacgagcccaggg

SEQ ID NO: 792982 - DNA, 25 bp, Mus musculus
tattgataacttcctcacagttaaa

SEQ ID NO: 792983 - DNA, 25 bp, Mus musculus
tattgataacttgctcacagttaaa

SEQ ID NO: 792984 - DNA, 25 bp, Mus musculus
tattgatacatacggctacactcat

SEQ ID NO: 792985 - DNA, 25 bp, Mus musculus
tattgatacatagggctacactcat

SEQ ID NO: 792986 - DNA, 25 bp, Mus musculus
tattgatatgttaccagactctagc

SEQ ID NO: 792987 - DNA, 25 bp, Mus musculus
tattgatatgtttccagactctagc

SEQ ID NO: 792988 - DNA, 25 bp, Mus musculus
tattgatcagctacggttctttctc

SEQ ID NO: 792989 - DNA, 25 bp, Mus musculus
tattgatcagcttcggttctttctc

SEQ ID NO: 792990 - DNA, 25 bp, Mus musculus
tattgatcagtcaagaaccaattag

SEQ ID NO: 792991 - DNA, 25 bp, Mus musculus
tattgatcagtctagaaccaattag

SEQ ID NO: 792992 - DNA, 25 bp, Mus musculus
tattgatcatttctagccttgggca

SEQ ID NO: 792993 - DNA, 25 bp, Mus musculus
tattgatcatttgtagccttgggca

SEQ ID NO: 792994 - DNA, 25 bp, Mus musculus
tattgatcttctatgtaacttccag

SEQ ID NO: 792995 - DNA, 25 bp, Mus musculus
tattgatcttctttgtaacttccag

SEQ ID NO: 792996 - DNA, 25 bp, Mus musculus
tattgatctttccactttccgtggt

SEQ ID NO: 792997 - DNA, 25 bp, Mus musculus
tattgatctttcgactttccgtggt

SEQ ID NO: 792998 - DNA, 25 bp, Mus musculus
tattgatgatgaattcctaccccag

SEQ ID NO: 792999 - DNA, 25 bp, Mus musculus
tattgatgatgatttcctaccccag

SEQ ID NO: 793000 - DNA, 25 bp, Mus musculus
tattgatgggtacctgtcccacact

SEQ ID NO: 793001 - DNA, 25 bp, Mus musculus
tattgatgggtagctgtcccacact

SEQ ID NO: 793002 - DNA, 25 bp, Mus musculus
tattgatggtgacactgtgccctct

SEQ ID NO: 793003 - DNA, 25 bp, Mus musculus
tattgatggtgagactgtgccctct

SEQ ID NO: 793004 - DNA, 25 bp, Mus musculus
tattgatgtcttctacttcagctgc

SEQ ID NO: 793005 - DNA, 25 bp, Mus musculus
tattgatgtcttgtacttcagctgc

SEQ ID NO: 793006 - DNA, 25 bp, Mus musculus
tattgatgtgaacagatgccatgac

SEQ ID NO: 793007 - DNA, 25 bp, Mus musculus
tattgatgtgaagagatgccatgac

SEQ ID NO: 793008 - DNA, 25 bp, Mus musculus
tattgatgtgggaaccggctactac

SEQ ID NO: 793009 - DNA, 25 bp, Mus musculus
tattgatgtgggtaccggctactac

SEQ ID NO: 793010 - DNA, 25 bp, Mus musculus
tattgatgtgtaataactgctgcca

SEQ ID NO: 793011 - DNA, 25 bp, Mus musculus
tattgatgtgtattaactgctgcca

SEQ ID NO: 793012 - DNA, 25 bp, Mus musculus
tattgattagcactggctggcctca

SEQ ID NO: 793013 - DNA, 25 bp, Mus musculus
tattgattagcagtggctggcctca

SEQ ID NO: 793014 - DNA, 25 bp, Mus musculus
tattgattatgcacttctgaaacac

SEQ ID NO: 793015 - DNA, 25 bp, Mus musculus
tattgattatgctcttctgaaacac

SEQ ID NO: 793016 - DNA, 25 bp, Mus musculus
tattgattcagacggctgcgcttcg

SEQ ID NO: 793017 - DNA, 25 bp, Mus musculus
tattgattcagagggctgcgcttcg

SEQ ID NO: 793018 - DNA, 25 bp, Mus musculus
tattgattcctaaccaggacatgaa

SEQ ID NO: 793019 - DNA, 25 bp, Mus musculus
tattgattcctatccaggacatgaa

SEQ ID NO: 793020 - DNA, 25 bp, Mus musculus
tattgattcttgctccccaactctc

SEQ ID NO: 793021 - DNA, 25 bp, Mus musculus
tattgattcttggtccccaactctc

SEQ ID NO: 793022 - DNA, 25 bp, Mus musculus
tattgattgggaaactggccttgat

SEQ ID NO: 793023 - DNA, 25 bp, Mus musculus
tattgattgggatactggccttgat

SEQ ID NO: 793024 - DNA, 25 bp, Mus musculus
tattgattgtggcaaagttgtacag

SEQ ID NO: 793025 - DNA, 25 bp, Mus musculus
tattgattgtgggaaagttgtacag

SEQ ID NO: 793026 - DNA, 25 bp, Mus musculus
tattgatttcctagtgatcacataa

SEQ ID NO: 793027 - DNA, 25 bp, Mus musculus
tattgatttccttgtgatcacataa

SEQ ID NO: 793028 - DNA, 25 bp, Mus musculus
tattgatttgaccaaggccagcctc

SEQ ID NO: 793029 - DNA, 25 bp, Mus musculus
tattgatttgacgaaggccagcctc

SEQ ID NO: 793030 - DNA, 25 bp, Mus musculus
tattgattttgccacccgcaagatc

SEQ ID NO: 793031 - DNA, 25 bp, Mus musculus
tattgattttgcgacccgcaagatc

SEQ ID NO: 793032 - DNA, 25 bp, Mus musculus
tattgcaaacatcttcagttccctc

SEQ ID NO: 793033 - DNA, 25 bp, Mus musculus
tattgcaaacatgttcagttccctc

SEQ ID NO: 793034 - DNA, 25 bp, Mus musculus
tattgcaaatgcacctctcctcggt

SEQ ID NO: 793035 - DNA, 25 bp, Mus musculus
tattgcaaatgctcctctcctcggt

SEQ ID NO: 793036 - DNA, 25 bp, Mus musculus
tattgcaacaatatttgtacttaag

SEQ ID NO: 793037 - DNA, 25 bp, Mus musculus
tattgcaacaatttttgtacttaag

SEQ ID NO: 793038 - DNA, 25 bp, Mus musculus
tattgcaagaacacacctggcagaa

SEQ ID NO: 793039 - DNA, 25 bp, Mus musculus
tattgcaagaactcacctggcagaa

SEQ ID NO: 793040 - DNA, 25 bp, Mus musculus
tattgcaagtgacactggctcagaa

SEQ ID NO: 793041 - DNA, 25 bp, Mus musculus
tattgcaagtgagactggctcagaa

SEQ ID NO: 793042 - DNA, 25 bp, Mus musculus
tattgcaatcggacaaattttacaa

SEQ ID NO: 793043 - DNA, 25 bp, Mus musculus
tattgcaatcggtcaaattttacaa

SEQ ID NO: 793044 - DNA, 25 bp, Mus musculus
tattgcacataactccaggtacctg

SEQ ID NO: 793045 - DNA, 25 bp, Mus musculus
tattgcacataagtccaggtacctg

SEQ ID NO: 793046 - DNA, 25 bp, Mus musculus
tattgcacgccaagctgaatgtgag

SEQ ID NO: 793047 - DNA, 25 bp, Mus musculus
tattgcacgccatgctgaatgtgag

SEQ ID NO: 793048 - DNA, 25 bp, Mus musculus
tattgcacgccccaggtgagcgaga

SEQ ID NO: 793049 - DNA, 25 bp, Mus musculus
tattgcacgcccgaggtgagcgaga

SEQ ID NO: 793050 - DNA, 25 bp, Mus musculus
tattgcacggacaaacctgcttctc

SEQ ID NO: 793051 - DNA, 25 bp, Mus musculus
tattgcacggactaacctgcttctc

SEQ ID NO: 793052 - DNA, 25 bp, Mus musculus
tattgcacggttcaccatcatcatt

SEQ ID NO: 793053 - DNA, 25 bp, Mus musculus
tattgcacggttgaccatcatcatt

SEQ ID NO: 793054 - DNA, 25 bp, Mus musculus
tattgcactaggatttaccttgccc

SEQ ID NO: 793055 - DNA, 25 bp, Mus musculus
tattgcactaggttttaccttgccc

SEQ ID NO: 793056 - DNA, 25 bp, Mus musculus
tattgcactatacttctaatggaac

SEQ ID NO: 793057 - DNA, 25 bp, Mus musculus
tattgcactatagttctaatggaac

SEQ ID NO: 793058 - DNA, 25 bp, Mus musculus
tattgcactcatagggcttttcacc

SEQ ID NO: 793059 - DNA, 25 bp, Mus musculus
tattgcactcattgggcttttcacc

SEQ ID NO: 793060 - DNA, 25 bp, Mus musculus
tattgcactgatcgtttattccaga

SEQ ID NO: 793061 - DNA, 25 bp, Mus musculus
tattgcactgatggtttattccaga

SEQ ID NO: 793062 - DNA, 25 bp, Mus musculus
tattgcacttgcattctattgctcc

SEQ ID NO: 793063 - DNA, 25 bp, Mus musculus
tattgcacttgctttctattgctcc

SEQ ID NO: 793064 - DNA, 25 bp, Mus musculus
tattgcacttggattggctcttgag

SEQ ID NO: 793065 - DNA, 25 bp, Mus musculus
tattgcacttggtttggctcttgag

SEQ ID NO: 793066 - DNA, 25 bp, Mus musculus
tattgcagaactctggctctgctgc

SEQ ID NO: 793067 - DNA, 25 bp, Mus musculus
tattgcagaactgtggctctgctgc

SEQ ID NO: 793068 - DNA, 25 bp, Mus musculus
tattgcagaataaccaaacagtgga

SEQ ID NO: 793069 - DNA, 25 bp, Mus musculus
tattgcagaatatccaaacagtgga

SEQ ID NO: 793070 - DNA, 25 bp, Mus musculus
tattgcagagatcactggaggccat

SEQ ID NO: 793071 - DNA, 25 bp, Mus musculus
tattgcagagatgactggaggccat

SEQ ID NO: 793072 - DNA, 25 bp, Mus musculus
tattgcagagccagttaaccatgaa

SEQ ID NO: 793073 - DNA, 25 bp, Mus musculus
tattgcagagcctgttaaccatgaa

SEQ ID NO: 793074 - DNA, 25 bp, Mus musculus
tattgcagaggtatatcctcccttt

SEQ ID NO: 793075 - DNA, 25 bp, Mus musculus
tattgcagaggtttatcctcccttt

SEQ ID NO: 793076 - DNA, 25 bp, Mus musculus
tattgcagatttccctgtcgctctt

SEQ ID NO: 793077 - DNA, 25 bp, Mus musculus
tattgcagatttgcctgtcgctctt

SEQ ID NO: 793078 - DNA, 25 bp, Mus musculus
tattgcagctccagccagtgcttgc

SEQ ID NO: 793079 - DNA, 25 bp, Mus musculus
tattgcagctcctgccagtgcttgc

SEQ ID NO: 793080 - DNA, 25 bp, Mus musculus
tattgcaggcacatcgtcaggctat

SEQ ID NO: 793081 - DNA, 25 bp, Mus musculus
tattgcaggcacttcgtcaggctat

SEQ ID NO: 793082 - DNA, 25 bp, Mus musculus
tattgcagtgcacatgaatgtttgc

SEQ ID NO: 793083 - DNA, 25 bp, Mus musculus
tattgcagtgcagatgaatgtttgc

SEQ ID NO: 793084 - DNA, 25 bp, Mus musculus
tattgcatacacatgaatcacggac

SEQ ID NO: 793085 - DNA, 25 bp, Mus musculus
tattgcatacacttgaatcacggac

SEQ ID NO: 793086 - DNA, 25 bp, Mus musculus
tattgcatatgtaccttcacacacc

SEQ ID NO: 793087 - DNA, 25 bp, Mus musculus
tattgcatatgttccttcacacacc

SEQ ID NO: 793088 - DNA, 25 bp, Mus musculus
tattgcatccagatgtgcctagtga

SEQ ID NO: 793089 - DNA, 25 bp, Mus musculus
tattgcatccagttgtgcctagtga

SEQ ID NO: 793090 - DNA, 25 bp, Mus musculus
tattgcatctgcaagcacttgaatg

SEQ ID NO: 793091 - DNA, 25 bp, Mus musculus
tattgcatctgctagcacttgaatg

SEQ ID NO: 793092 - DNA, 25 bp, Mus musculus
tattgcatgaccatcagattggaga

SEQ ID NO: 793093 - DNA, 25 bp, Mus musculus
tattgcatgaccttcagattggaga

SEQ ID NO: 793094 - DNA, 25 bp, Mus musculus
tattgcatgggcagccaagctgtgt

SEQ ID NO: 793095 - DNA, 25 bp, Mus musculus
tattgcatgggctgccaagctgtgt

SEQ ID NO: 793096 - DNA, 25 bp, Mus musculus
tattgcatggttaactccttttctt

SEQ ID NO: 793097 - DNA, 25 bp, Mus musculus
tattgcatggtttactccttttctt

SEQ ID NO: 793098 - DNA, 25 bp, Mus musculus
tattgcatgtctactcctataaaga

SEQ ID NO: 793099 - DNA, 25 bp, Mus musculus
tattgcatgtctccaaatctccagg

SEQ ID NO: 793100 - DNA, 25 bp, Mus musculus
tattgcatgtctgcaaatctccagg

SEQ ID NO: 793101 - DNA, 25 bp, Mus musculus
tattgcatgtcttctcctataaaga

SEQ ID NO: 793102 - DNA, 25 bp, Mus musculus
tattgcattatcatcaaatctgtct

SEQ ID NO: 793103 - DNA, 25 bp, Mus musculus
tattgcattatcttcaaatctgtct

SEQ ID NO: 793104 - DNA, 25 bp, Mus musculus
tattgcattctccatttgttatctg

SEQ ID NO: 793105 - DNA, 25 bp, Mus musculus
tattgcattctcgatttgttatctg

SEQ ID NO: 793106 - DNA, 25 bp, Mus musculus
tattgccaaaatattcagtaatcca

SEQ ID NO: 793107 - DNA, 25 bp, Mus musculus
tattgccaaaattttcagtaatcca

SEQ ID NO: 793108 - DNA, 25 bp, Mus musculus
tattgccagggtaccaaattcttct

SEQ ID NO: 793109 - DNA, 25 bp, Mus musculus
tattgccagggttccaaattcttct

SEQ ID NO: 793110 - DNA, 25 bp, Mus musculus
tattgccagtagaaccgctcagaca

SEQ ID NO: 793111 - DNA, 25 bp, Mus musculus
tattgccagtagtaccgctcagaca

SEQ ID NO: 793112 - DNA, 25 bp, Mus musculus
tattgccagtcgctcctgcaggagg

SEQ ID NO: 793113 - DNA, 25 bp, Mus musculus
tattgccagtcggtcctgcaggagg

SEQ ID NO: 793114 - DNA, 25 bp, Mus musculus
tattgccatagaaactaaccctgag

SEQ ID NO: 793115 - DNA, 25 bp, Mus musculus
tattgccatagatactaaccctgag

SEQ ID NO: 793116 - DNA, 25 bp, Mus musculus
tattgccatattattctccgtgcct

SEQ ID NO: 793117 - DNA, 25 bp, Mus musculus
tattgccatatttttctccgtgcct

SEQ ID NO: 793118 - DNA, 25 bp, Mus musculus
tattgccatgtccagcttttaagtg

SEQ ID NO: 793119 - DNA, 25 bp, Mus musculus
tattgccatgtcgagcttttaagtg

SEQ ID NO: 793120 - DNA, 25 bp, Mus musculus
tattgcccaaccagggcccaagtac

SEQ ID NO: 793121 - DNA, 25 bp, Mus musculus
tattgcccaacctgggcccaagtac

SEQ ID NO: 793122 - DNA, 25 bp, Mus musculus
tattgcccatgaagtttctaatgtt

SEQ ID NO: 793123 - DNA, 25 bp, Mus musculus
tattgcccatgatgtttctaatgtt

SEQ ID NO: 793124 - DNA, 25 bp, Mus musculus
tattgcccccatcttcattcggctt

SEQ ID NO: 793125 - DNA, 25 bp, Mus musculus
tattgcccccatgttcattcggctt

SEQ ID NO: 793126 - DNA, 25 bp, Mus musculus
tattgcccggctcaaggaggtccta

SEQ ID NO: 793127 - DNA, 25 bp, Mus musculus
tattgcccggctgaaggaggtccta

SEQ ID NO: 793128 - DNA, 25 bp, Mus musculus
tattgccctaagctttggttttact

SEQ ID NO: 793129 - DNA, 25 bp, Mus musculus
tattgccctaaggtttggttttact

SEQ ID NO: 793130 - DNA, 25 bp, Mus musculus
tattgccctatcagtttcatttctg

SEQ ID NO: 793131 - DNA, 25 bp, Mus musculus
tattgccctatctgtttcatttctg

SEQ ID NO: 793132 - DNA, 25 bp, Mus musculus
tattgccctgacaacgaattcgttt

SEQ ID NO: 793133 - DNA, 25 bp, Mus musculus
tattgccctgactacgaattcgttt

SEQ ID NO: 793134 - DNA, 25 bp, Mus musculus
tattgcccttgcaaagatctctgag

SEQ ID NO: 793135 - DNA, 25 bp, Mus musculus
tattgcccttgctaagatctctgag

SEQ ID NO: 793136 - DNA, 25 bp, Mus musculus
tattgccgatgaccgctgagtcccg

SEQ ID NO: 793137 - DNA, 25 bp, Mus musculus
tattgccgatgagcgctgagtcccg

SEQ ID NO: 793138 - DNA, 25 bp, Mus musculus
tattgcctaactctgtgtcatcctc

SEQ ID NO: 793139 - DNA, 25 bp, Mus musculus
tattgcctaactgtgtgtcatcctc

SEQ ID NO: 793140 - DNA, 25 bp, Mus musculus
tattgcctatctatgtgcctcagca

SEQ ID NO: 793141 - DNA, 25 bp, Mus musculus
tattgcctatctttgtgcctcagca

SEQ ID NO: 793142 - DNA, 25 bp, Mus musculus
tattgcctccatatgggccagctgg

SEQ ID NO: 793143 - DNA, 25 bp, Mus musculus
tattgcctccatttgggccagctgg

SEQ ID NO: 793144 - DNA, 25 bp, Mus musculus
tattgcctctgaatggcggtttgcc

SEQ ID NO: 793145 - DNA, 25 bp, Mus musculus
tattgcctctgattggcggtttgcc

SEQ ID NO: 793146 - DNA, 25 bp, Mus musculus
tattgcctctgtcaactacattttt

SEQ ID NO: 793147 - DNA, 25 bp, Mus musculus
tattgcctctgtgaactacattttt

SEQ ID NO: 793148 - DNA, 25 bp, Mus musculus
tattgcctggttagctgcttagcat

SEQ ID NO: 793149 - DNA, 25 bp, Mus musculus
tattgcctggtttgctgcttagcat

SEQ ID NO: 793150 - DNA, 25 bp, Mus musculus
tattgccttctaaagttctgcttct

SEQ ID NO: 793151 - DNA, 25 bp, Mus musculus
tattgccttctatagttctgcttct

SEQ ID NO: 793152 - DNA, 25 bp, Mus musculus
tattgccttctgcaatcctgtccag

SEQ ID NO: 793153 - DNA, 25 bp, Mus musculus
tattgccttctggaatcctgtccag

SEQ ID NO: 793154 - DNA, 25 bp, Mus musculus
tattgccttgaaatatctgcttagg

SEQ ID NO: 793155 - DNA, 25 bp, Mus musculus
tattgccttgaattatctgcttagg

SEQ ID NO: 793156 - DNA, 25 bp, Mus musculus
tattgccttgcaacctgatggcaag

SEQ ID NO: 793157 - DNA, 25 bp, Mus musculus
tattgccttgcatcctgatggcaag

SEQ ID NO: 793158 - DNA, 25 bp, Mus musculus
tattgccttgctccattccttaggt

SEQ ID NO: 793159 - DNA, 25 bp, Mus musculus
tattgccttgctgcattccttaggt

SEQ ID NO: 793160 - DNA, 25 bp, Mus musculus
tattgcctttgtcttcttggtctag

SEQ ID NO: 793161 - DNA, 25 bp, Mus musculus
tattgcctttgtgttcttggtctag

SEQ ID NO: 793162 - DNA, 25 bp, Mus musculus
tattgcgctcttcgtatccgcaacc

SEQ ID NO: 793163 - DNA, 25 bp, Mus musculus
tattgcgctcttggtatccgcaacc

SEQ ID NO: 793164 - DNA, 25 bp, Mus musculus
tattgcggaagacctgttggcagat

SEQ ID NO: 793165 - DNA, 25 bp, Mus musculus
tattgcggaagagctgttggcagat

SEQ ID NO: 793166 - DNA, 25 bp, Mus musculus
tattgcggaggcatcggaccattat

SEQ ID NO: 793167 - DNA, 25 bp, Mus musculus
tattgcggaggcttcggaccattat

SEQ ID NO: 793168 - DNA, 25 bp, Mus musculus
tattgcgtactcaacctgtgtaaat

SEQ ID NO: 793169 - DNA, 25 bp, Mus musculus
tattgcgtactctacctgtgtaaat

SEQ ID NO: 793170 - DNA, 25 bp, Mus musculus
tattgctaacctactgattgctgtt

SEQ ID NO: 793171 - DNA, 25 bp, Mus musculus
tattgctaaccttctgattgctgtt

SEQ ID NO: 793172 - DNA, 25 bp, Mus musculus
tattgctaactcatgtcagcctcat

SEQ ID NO: 793173 - DNA, 25 bp, Mus musculus
tattgctaactcttgtcagcctcat

SEQ ID NO: 793174 - DNA, 25 bp, Mus musculus
tattgctaacttacagaaatacagt

SEQ ID NO: 793175 - DNA, 25 bp, Mus musculus
tattgctaactttcagaaatacagt

SEQ ID NO: 793176 - DNA, 25 bp, Mus musculus
tattgctaatccattctctggactc

SEQ ID NO: 793177 - DNA, 25 bp, Mus musculus
tattgctaatcctttctctggactc

SEQ ID NO: 793178 - DNA, 25 bp, Mus musculus
tattgctaattgataagtcatcccc

SEQ ID NO: 793179 - DNA, 25 bp, Mus musculus
tattgctaattgttaagtcatcccc

SEQ ID NO: 793180 - DNA, 25 bp, Mus musculus
tattgctaccggcacttgcacaaca

SEQ ID NO: 793181 - DNA, 25 bp, Mus musculus
tattgctaccgggacttgcacaaca

SEQ ID NO: 793182 - DNA, 25 bp, Mus musculus
tattgctacctgaacatatgtacat

SEQ ID NO: 793183 - DNA, 25 bp, Mus musculus
tattgctacctgtacatatgtacat

SEQ ID NO: 793184 - DNA, 25 bp, Mus musculus
tattgctacttcactcagcatctca

SEQ ID NO: 793185 - DNA, 25 bp, Mus musculus
tattgctacttctctcagcatctca

SEQ ID NO: 793186 - DNA, 25 bp, Mus musculus
tattgctagagtaccatgggctcaa

SEQ ID NO: 793187 - DNA, 25 bp, Mus musculus
tattgctagagtatgtggtttttga

SEQ ID NO: 793188 - DNA, 25 bp, Mus musculus
tattgctagagttccatgggctcaa

SEQ ID NO: 793189 - DNA, 25 bp, Mus musculus
tattgctagagtttgtggtttttga

SEQ ID NO: 793190 - DNA, 25 bp, Mus musculus
tattgctataccaacacgagttctt

SEQ ID NO: 793191 - DNA, 25 bp, Mus musculus
tattgctatacctacacgagttctt

SEQ ID NO: 793192 - DNA, 25 bp, Mus musculus
tattgctatagtcagctcccagctc

SEQ ID NO: 793193 - DNA, 25 bp, Mus musculus
tattgctatagtgagctcccagctc

SEQ ID NO: 793194 - DNA, 25 bp, Mus musculus
tattgctatttccacgactgaccga

SEQ ID NO: 793195 - DNA, 25 bp, Mus musculus
tattgctatttcgacgactgaccga

SEQ ID NO: 793196 - DNA, 25 bp, Mus musculus
tattgctcaaccatttacatcccag

SEQ ID NO: 793197 - DNA, 25 bp, Mus musculus
tattgctcaaccttttacatcccag

SEQ ID NO: 793198 - DNA, 25 bp, Mus musculus
tattgctcaatcacgggtggctgaa

SEQ ID NO: 793199 - DNA, 25 bp, Mus musculus
tattgctcaatctcgggtggctgaa

SEQ ID NO: 793200 - DNA, 25 bp, Mus musculus
tattgctcactacggtctggaacag

SEQ ID NO: 793201 - DNA, 25 bp, Mus musculus
tattgctcactagggtctggaacag

SEQ ID NO: 793202 - DNA, 25 bp, Mus musculus
tattgctcagcaactcagtatagtc

SEQ ID NO: 793203 - DNA, 25 bp, Mus musculus
tattgctcagcatctcagtatagtc

SEQ ID NO: 793204 - DNA, 25 bp, Mus musculus
tattgctcagccacgaacaggaatg

SEQ ID NO: 793205 - DNA, 25 bp, Mus musculus
tattgctcagcctcgaacaggaatg

SEQ ID NO: 793206 - DNA, 25 bp, Mus musculus
tattgctccaagacagtatttcatt

SEQ ID NO: 793207 - DNA, 25 bp, Mus musculus
tattgctccaagtcagtatttcatt

SEQ ID NO: 793208 - DNA, 25 bp, Mus musculus
tattgctccaggactgaactgctgc

SEQ ID NO: 793209 - DNA, 25 bp, Mus musculus
tattgctccaggtctgaactgctgc

SEQ ID NO: 793210 - DNA, 25 bp, Mus musculus
tattgctccatcatggctgctgtgg

SEQ ID NO: 793211 - DNA, 25 bp, Mus musculus
tattgctccatcttggctgctgtgg

SEQ ID NO: 793212 - DNA, 25 bp, Mus musculus
tattgctcctgaagtcgtcactata

SEQ ID NO: 793213 - DNA, 25 bp, Mus musculus
tattgctcctgatgtcgtcactata

SEQ ID NO: 793214 - DNA, 25 bp, Mus musculus
tattgctcctgccacattctataaa

SEQ ID NO: 793215 - DNA, 25 bp, Mus musculus
tattgctcctgcgacattctataaa

SEQ ID NO: 793216 - DNA, 25 bp, Mus musculus
tattgctctaataatccagatgcac

SEQ ID NO: 793217 - DNA, 25 bp, Mus musculus
tattgctctaattatccagatgcac

SEQ ID NO: 793218 - DNA, 25 bp, Mus musculus
tattgctctccaccagtgagtcatc

SEQ ID NO: 793219 - DNA, 25 bp, Mus musculus
tattgctctccagcagtgagtcatc

SEQ ID NO: 793220 - DNA, 25 bp, Mus musculus
tattgctctgacatcatactttgga

SEQ ID NO: 793221 - DNA, 25 bp, Mus musculus
tattgctctgacttcatactttgga

SEQ ID NO: 793222 - DNA, 25 bp, Mus musculus
tattgctcttctctttatacataga

SEQ ID NO: 793223 - DNA, 25 bp, Mus musculus
tattgctcttctgtttatacataga

SEQ ID NO: 793224 - DNA, 25 bp, Mus musculus
tattgctctttcaacaccttgggtt

SEQ ID NO: 793225 - DNA, 25 bp, Mus musculus
tattgctctttctacaccttgggtt

SEQ ID NO: 793226 - DNA, 25 bp, Mus musculus
tattgctgacagacataaatccaga

SEQ ID NO: 793227 - DNA, 25 bp, Mus musculus
tattgctgacagtcataaatccaga

SEQ ID NO: 793228 - DNA, 25 bp, Mus musculus
tattgctgcattagccctttttagt

SEQ ID NO: 793229 - DNA, 25 bp, Mus musculus
tattgctgcatttgccctttttagt

SEQ ID NO: 793230 - DNA, 25 bp, Mus musculus
tattgctgcctgataaatgattcat

SEQ ID NO: 793231 - DNA, 25 bp, Mus musculus
tattgctgcctgttaaatgattcat

SEQ ID NO: 793232 - DNA, 25 bp, Mus musculus
tattgctgcgttactcagcataaac

SEQ ID NO: 793233 - DNA, 25 bp, Mus musculus
tattgctgcgtttctcagcataaac

SEQ ID NO: 793234 - DNA, 25 bp, Mus musculus
tattgctgctcgacatcttatggat

SEQ ID NO: 793235 - DNA, 25 bp, Mus musculus
tattgctgctcgtcatcttatggat

SEQ ID NO: 793236 - DNA, 25 bp, Mus musculus
tattgctgctgcaaccagcgtcaga

SEQ ID NO: 793237 - DNA, 25 bp, Mus musculus
tattgctgctgctaccagcgtcaga

SEQ ID NO: 793238 - DNA, 25 bp, Mus musculus
tattgctggcacagggcctgacgag

SEQ ID NO: 793239 - DNA, 25 bp, Mus musculus
tattgctggcactgggcctgacgag

SEQ ID NO: 793240 - DNA, 25 bp, Mus musculus
tattgctgggagcagcgcccgtacc

SEQ ID NO: 793241 - DNA, 25 bp, Mus musculus
tattgctgggaggagcgcccgtacc

SEQ ID NO: 793242 - DNA, 25 bp, Mus musculus
tattgctgtaatattgtataatact

SEQ ID NO: 793243 - DNA, 25 bp, Mus musculus
tattgctgtaattttgtataatact

SEQ ID NO: 793244 - DNA, 25 bp, Mus musculus
tattgctgtcatcgattgctactgc

SEQ ID NO: 793245 - DNA, 25 bp, Mus musculus
tattgctgtcatggattgctactgc

SEQ ID NO: 793246 - DNA, 25 bp, Mus musculus
tattgcttaagtatttctgtggcct

SEQ ID NO: 793247 - DNA, 25 bp, Mus musculus
tattgcttaagtttttctgtggcct

SEQ ID NO: 793248 - DNA, 25 bp, Mus musculus
tattgcttacacctggatcagctaa

SEQ ID NO: 793249 - DNA, 25 bp, Mus musculus
tattgcttacacgtggatcagctaa

SEQ ID NO: 793250 - DNA, 25 bp, Mus musculus
tattgcttagaaatgcacatgaata

SEQ ID NO: 793251 - DNA, 25 bp, Mus musculus
tattgcttagaattgcacatgaata

SEQ ID NO: 793252 - DNA, 25 bp, Mus musculus
tattgcttcatgatttgtaccctca

SEQ ID NO: 793253 - DNA, 25 bp, Mus musculus
tattgcttcatgttttgtaccctca

SEQ ID NO: 793254 - DNA, 25 bp, Mus musculus
tattgcttctccactctaggacggg

SEQ ID NO: 793255 - DNA, 25 bp, Mus musculus
tattgcttctcctctctaggacggg

SEQ ID NO: 793256 - DNA, 25 bp, Mus musculus
tattgcttctctccaaggctgccaa

SEQ ID NO: 793257 - DNA, 25 bp, Mus musculus
tattgcttctctgcaaggctgccaa

SEQ ID NO: 793258 - DNA, 25 bp, Mus musculus
tattgcttcttgacgcaaagtgcta

SEQ ID NO: 793259 - DNA, 25 bp, Mus musculus
tattgcttcttgtcgcaaagtgcta

SEQ ID NO: 793260 - DNA, 25 bp, Mus musculus
tattgctttacactagacatgctca

SEQ ID NO: 793261 - DNA, 25 bp, Mus musculus
tattgctttacagtagacatgctca

SEQ ID NO: 793262 - DNA, 25 bp, Mus musculus
tattgctttgcacaatggcttgagt

SEQ ID NO: 793263 - DNA, 25 bp, Mus musculus
tattgctttgcagaatggcttgagt

SEQ ID NO: 793264 - DNA, 25 bp, Mus musculus
tattgctttttcaagctcgggccat

SEQ ID NO: 793265 - DNA, 25 bp, Mus musculus
tattgctttttctagctcgggccat

SEQ ID NO: 793266 - DNA, 25 bp, Mus musculus
tattggaaaatgcagtgccatttta

SEQ ID NO: 793267 - DNA, 25 bp, Mus musculus
tattggaaaatggagtgccatttta

SEQ ID NO: 793268 - DNA, 25 bp, Mus musculus
tattggaaccctccttgacttgttt

SEQ ID NO: 793269 - DNA, 25 bp, Mus musculus
tattggaaccctgcttgacttgttt

SEQ ID NO: 793270 - DNA, 25 bp, Mus musculus
tattggaagaacacagaggaccatg

SEQ ID NO: 793271 - DNA, 25 bp, Mus musculus
tattggaagaactcagaggaccatg

SEQ ID NO: 793272 - DNA, 25 bp, Mus musculus
tattggaagaataaagcacctgact

SEQ ID NO: 793273 - DNA, 25 bp, Mus musculus
tattggaagaattaagcacctgact

SEQ ID NO: 793274 - DNA, 25 bp, Mus musculus
tattggaagacgaaccccaccccat

SEQ ID NO: 793275 - DNA, 25 bp, Mus musculus
tattggaagacgtaccccaccccat

SEQ ID NO: 793276 - DNA, 25 bp, Mus musculus
tattggaagcacctaaacccctcgc

SEQ ID NO: 793277 - DNA, 25 bp, Mus musculus
tattggaagcacgtaaacccctcgc

SEQ ID NO: 793278 - DNA, 25 bp, Mus musculus
tattggaatcctacagtattggctt

SEQ ID NO: 793279 - DNA, 25 bp, Mus musculus
tattggaatccttcagtattggctt

SEQ ID NO: 793280 - DNA, 25 bp, Mus musculus
tattggacagcaagcggtgcttcca

SEQ ID NO: 793281 - DNA, 25 bp, Mus musculus
tattggacagcatgcggtgcttcca

SEQ ID NO: 793282 - DNA, 25 bp, Mus musculus
tattggacaggaagtattcatttct

SEQ ID NO: 793283 - DNA, 25 bp, Mus musculus
tattggacaggatgtattcatttct

SEQ ID NO: 793284 - DNA, 25 bp, Mus musculus
tattggacagtcatcctacctctga

SEQ ID NO: 793285 - DNA, 25 bp, Mus musculus
tattggacagtcttcctacctctga

SEQ ID NO: 793286 - DNA, 25 bp, Mus musculus
tattggaccggaaagagctcagctc

SEQ ID NO: 793287 - DNA, 25 bp, Mus musculus
tattggaccggatagagctcagctc

SEQ ID NO: 793288 - DNA, 25 bp, Mus musculus
tattggaccttgaggttacacttgg

SEQ ID NO: 793289 - DNA, 25 bp, Mus musculus
tattggaccttgtggttacacttgg

SEQ ID NO: 793290 - DNA, 25 bp, Mus musculus
tattggactgctctttaatgactgg

SEQ ID NO: 793291 - DNA, 25 bp, Mus musculus
tattggactgctgtttaatgactgg

SEQ ID NO: 793292 - DNA, 25 bp, Mus musculus
tattggagacttactgacgccctta

SEQ ID NO: 793293 - DNA, 25 bp, Mus musculus
tattggagactttctgacgccctta

SEQ ID NO: 793294 - DNA, 25 bp, Mus musculus
tattggagctatactgtaaggtccc

SEQ ID NO: 793295 - DNA, 25 bp, Mus musculus
tattggagctattctgtaaggtccc

SEQ ID NO: 793296 - DNA, 25 bp, Mus musculus
tattggagctcaattctgtatctaa

SEQ ID NO: 793297 - DNA, 25 bp, Mus musculus
tattggagctcatttctgtatctaa

SEQ ID NO: 793298 - DNA, 25 bp, Mus musculus
tattggaggtccagcttcatgcatt

SEQ ID NO: 793299 - DNA, 25 bp, Mus musculus
tattggaggtcctgcttcatgcatt

SEQ ID NO: 793300 - DNA, 25 bp, Mus musculus
tattggagtgtcacagtcaccccag

SEQ ID NO: 793301 - DNA, 25 bp, Mus musculus
tattggagtgtctcagtcaccccag

SEQ ID NO: 793302 - DNA, 25 bp, Mus musculus
tattggagttcaatcagatctcact

SEQ ID NO: 793303 - DNA, 25 bp, Mus musculus
tattggagttcattcagatctcact

SEQ ID NO: 793304 - DNA, 25 bp, Mus musculus
tattggatctttctaccctgctctc

SEQ ID NO: 793305 - DNA, 25 bp, Mus musculus
tattggatctttgtaccctgctctc

SEQ ID NO: 793306 - DNA, 25 bp, Mus musculus
tattggatgctgatgcttactgaca

SEQ ID NO: 793307 - DNA, 25 bp, Mus musculus
tattggatgctgttgcttactgaca

SEQ ID NO: 793308 - DNA, 25 bp, Mus musculus
tattggatggataaacctgatggct

SEQ ID NO: 793309 - DNA, 25 bp, Mus musculus
tattggatggattaacctgatggct

SEQ ID NO: 793310 - DNA, 25 bp, Mus musculus
tattggatgtccaactttgcttcct

SEQ ID NO: 793311 - DNA, 25 bp, Mus musculus
tattggatgtcctactttgcttcct

SEQ ID NO: 793312 - DNA, 25 bp, Mus musculus
tattggattatactttcctcttttc

SEQ ID NO: 793313 - DNA, 25 bp, Mus musculus
tattggattatagtttcctcttttc

SEQ ID NO: 793314 - DNA, 25 bp, Mus musculus
tattggattccacacccgattgctg

SEQ ID NO: 793315 - DNA, 25 bp, Mus musculus
tattggattccagacccgattgctg

SEQ ID NO: 793316 - DNA, 25 bp, Mus musculus
tattggcacttcaactaggtcgcct

SEQ ID NO: 793317 - DNA, 25 bp, Mus musculus
tattggcacttctactaggtcgcct

SEQ ID NO: 793318 - DNA, 25 bp, Mus musculus
tattggcagagactctaagtactgt

SEQ ID NO: 793319 - DNA, 25 bp, Mus musculus
tattggcagagagtctaagtactgt

SEQ ID NO: 793320 - DNA, 25 bp, Mus musculus
tattggcagccaaggaatgtgtcca

SEQ ID NO: 793321 - DNA, 25 bp, Mus musculus
tattggcagccatggaatgtgtcca

SEQ ID NO: 793322 - DNA, 25 bp, Mus musculus
tattggcagctgatcaaactcttca

SEQ ID NO: 793323 - DNA, 25 bp, Mus musculus
tattggcagctgttcaaactcttca

SEQ ID NO: 793324 - DNA, 25 bp, Mus musculus
tattggcagcttcctcggacgtgaa

SEQ ID NO: 793325 - DNA, 25 bp, Mus musculus
tattggcagcttgctcggacgtgaa

SEQ ID NO: 793326 - DNA, 25 bp, Mus musculus
tattggcatgagacaaactcagcat

SEQ ID NO: 793327 - DNA, 25 bp, Mus musculus
tattggcatgagtcaaactcagcat

SEQ ID NO: 793328 - DNA, 25 bp, Mus musculus
tattggccaagacctgctgaccgta

SEQ ID NO: 793329 - DNA, 25 bp, Mus musculus
tattggccaagagctgctgaccgta

SEQ ID NO: 793330 - DNA, 25 bp, Mus musculus
tattggccacgtcgttcgcgcagtg

SEQ ID NO: 793331 - DNA, 25 bp, Mus musculus
tattggccacgtggttcgcgcagtg

SEQ ID NO: 793332 - DNA, 25 bp, Mus musculus
tattggccactactatttaacattt

SEQ ID NO: 793333 - DNA, 25 bp, Mus musculus
tattggccactagtatttaacattt

SEQ ID NO: 793334 - DNA, 25 bp, Mus musculus
tattggccacttccctgagtcagat

SEQ ID NO: 793335 - DNA, 25 bp, Mus musculus
tattggccacttgcctgagtcagat

SEQ ID NO: 793336 - DNA, 25 bp, Mus musculus
tattggccagccaccaagtttctag

SEQ ID NO: 793337 - DNA, 25 bp, Mus musculus
tattggccagcctccaagtttctag

SEQ ID NO: 793338 - DNA, 25 bp, Mus musculus
tattggccatcgcagttactgaaag

SEQ ID NO: 793339 - DNA, 25 bp, Mus musculus
tattggccatcggagttactgaaag

SEQ ID NO: 793340 - DNA, 25 bp, Mus musculus
tattggccatttctacttcagcatg

SEQ ID NO: 793341 - DNA, 25 bp, Mus musculus
tattggccatttgtacttcagcatg

SEQ ID NO: 793342 - DNA, 25 bp, Mus musculus
tattggccctgcaaaaatagaatat

SEQ ID NO: 793343 - DNA, 25 bp, Mus musculus
tattggccctgctaaaatagaatat

SEQ ID NO: 793344 - DNA, 25 bp, Mus musculus
tattggccggcacactttgcggacg

SEQ ID NO: 793345 - DNA, 25 bp, Mus musculus
tattggccggcagactttgcggacg

SEQ ID NO: 793346 - DNA, 25 bp, Mus musculus
tattggccgtggcctggcacctgtg

SEQ ID NO: 793347 - DNA, 25 bp, Mus musculus
tattggccgtgggctggcacctgtg

SEQ ID NO: 793348 - DNA, 25 bp, Mus musculus
tattggcctcttcaggacctggagt

SEQ ID NO: 793349 - DNA, 25 bp, Mus musculus
tattggcctcttgaggacctggagt

SEQ ID NO: 793350 - DNA, 25 bp, Mus musculus
tattggccttggcctagacctttag

SEQ ID NO: 793351 - DNA, 25 bp, Mus musculus
tattggccttggctgcctctgtgac

SEQ ID NO: 793352 - DNA, 25 bp, Mus musculus
tattggccttgggctagacctttag

SEQ ID NO: 793353 - DNA, 25 bp, Mus musculus
tattggccttgggtgcctctgtgac

SEQ ID NO: 793354 - DNA, 25 bp, Mus musculus
tattggcgtcagataatactcttca

SEQ ID NO: 793355 - DNA, 25 bp, Mus musculus
tattggcgtcagttaatactcttca

SEQ ID NO: 793356 - DNA, 25 bp, Mus musculus
tattggctaagcaacccacgggctc

SEQ ID NO: 793357 - DNA, 25 bp, Mus musculus
tattggctaagctacccacgggctc

SEQ ID NO: 793358 - DNA, 25 bp, Mus musculus
tattggctatccacattcttcagaa

SEQ ID NO: 793359 - DNA, 25 bp, Mus musculus
tattggctatcctcattcttcagaa

SEQ ID NO: 793360 - DNA, 25 bp, Mus musculus
tattggctattcactcaaggtcctc

SEQ ID NO: 793361 - DNA, 25 bp, Mus musculus
tattggctattctctcaaggtcctc

SEQ ID NO: 793362 - DNA, 25 bp, Mus musculus
tattggctccacatgacaggatctt

SEQ ID NO: 793363 - DNA, 25 bp, Mus musculus
tattggctccacttgacaggatctt

SEQ ID NO: 793364 - DNA, 25 bp, Mus musculus
tattggctctgaaggtattcttacc

SEQ ID NO: 793365 - DNA, 25 bp, Mus musculus
tattggctctgatggtattcttacc

SEQ ID NO: 793366 - DNA, 25 bp, Mus musculus
tattggctgccaaaatgtatttatt

SEQ ID NO: 793367 - DNA, 25 bp, Mus musculus
tattggctgccataatgtatttatt

SEQ ID NO: 793368 - DNA, 25 bp, Mus musculus
tattggctggacattataaacctgc

SEQ ID NO: 793369 - DNA, 25 bp, Mus musculus
tattggctggactttataaacctgc

SEQ ID NO: 793370 - DNA, 25 bp, Mus musculus
tattggctggccatatgccagcctg

SEQ ID NO: 793371 - DNA, 25 bp, Mus musculus
tattggctggccttatgccagcctg

SEQ ID NO: 793372 - DNA, 25 bp, Mus musculus
tattggctgtatatcagtgcctcca

SEQ ID NO: 793373 - DNA, 25 bp, Mus musculus
tattggctgtatttcagtgcctcca

SEQ ID NO: 793374 - DNA, 25 bp, Mus musculus
tattggcttcctatgctgaaagtac

SEQ ID NO: 793375 - DNA, 25 bp, Mus musculus
tattggcttcctttgctgaaagtac

SEQ ID NO: 793376 - DNA, 25 bp, Mus musculus
tattggcttgaaacctgcacctgat

SEQ ID NO: 793377 - DNA, 25 bp, Mus musculus
tattggcttgaatcctgcacctgat

SEQ ID NO: 793378 - DNA, 25 bp, Mus musculus
tattggctttttactttgctagaac

SEQ ID NO: 793379 - DNA, 25 bp, Mus musculus
tattggcttttttctttgctagaac

SEQ ID NO: 793380 - DNA, 25 bp, Mus musculus
tattgggaccagaatcctccacttg

SEQ ID NO: 793381 - DNA, 25 bp, Mus musculus
tattgggaccagtatcctccacttg

SEQ ID NO: 793382 - DNA, 25 bp, Mus musculus
tattgggaccatcgcggagcaaagc

SEQ ID NO: 793383 - DNA, 25 bp, Mus musculus
tattgggaccatggcggagcaaagc

SEQ ID NO: 793384 - DNA, 25 bp, Mus musculus
tattgggacctaaagtgtgaaaatt

SEQ ID NO: 793385 - DNA, 25 bp, Mus musculus
tattgggacctatagtgtgaaaatt

SEQ ID NO: 793386 - DNA, 25 bp, Mus musculus
tattgggatcggacagccctttcag

SEQ ID NO: 793387 - DNA, 25 bp, Mus musculus
tattgggatcggtcagccctttcag

SEQ ID NO: 793388 - DNA, 25 bp, Mus musculus
tattgggattttcagttcctttatt

SEQ ID NO: 793389 - DNA, 25 bp, Mus musculus
tattgggattttgagttcctttatt

SEQ ID NO: 793390 - DNA, 25 bp, Mus musculus
tattgggcagaccatcccacgataa

SEQ ID NO: 793391 - DNA, 25 bp, Mus musculus
tattgggcagacgatcccacgataa

SEQ ID NO: 793392 - DNA, 25 bp, Mus musculus
tattgggcagctctgcaaggcacgt

SEQ ID NO: 793393 - DNA, 25 bp, Mus musculus
tattgggcagctgtgcaaggcacgt

SEQ ID NO: 793394 - DNA, 25 bp, Mus musculus
tattgggccactcttccccatggaa

SEQ ID NO: 793395 - DNA, 25 bp, Mus musculus
tattgggccactgttccccatggaa

SEQ ID NO: 793396 - DNA, 25 bp, Mus musculus
tattgggcccctaggacttgactgg

SEQ ID NO: 793397 - DNA, 25 bp, Mus musculus
tattgggccccttggacttgactgg

SEQ ID NO: 793398 - DNA, 25 bp, Mus musculus
tattgggcctgaagatgctcaacaa

SEQ ID NO: 793399 - DNA, 25 bp, Mus musculus
tattgggcctgatgatgctcaacaa

SEQ ID NO: 793400 - DNA, 25 bp, Mus musculus
tattgggcctgtctctgctgccatt

SEQ ID NO: 793401 - DNA, 25 bp, Mus musculus
tattgggcctgtgtctgctgccatt

SEQ ID NO: 793402 - DNA, 25 bp, Mus musculus
tattgggctgtacgcaagcccttag

SEQ ID NO: 793403 - DNA, 25 bp, Mus musculus
tattgggctgtaggcaagcccttag

SEQ ID NO: 793404 - DNA, 25 bp, Mus musculus
tattgggggcacctacctgggacca

SEQ ID NO: 793405 - DNA, 25 bp, Mus musculus
tattgggggcacgtacctgggacca

SEQ ID NO: 793406 - DNA, 25 bp, Mus musculus
tattgggtaaccctacagggctcct

SEQ ID NO: 793407 - DNA, 25 bp, Mus musculus
tattgggtaaccgtacagggctcct

SEQ ID NO: 793408 - DNA, 25 bp, Mus musculus
tattgggtactgcactggcattctc

SEQ ID NO: 793409 - DNA, 25 bp, Mus musculus
tattgggtactggactggcattctc

SEQ ID NO: 793410 - DNA, 25 bp, Mus musculus
tattgggtcccaataaccatttctg

SEQ ID NO: 793411 - DNA, 25 bp, Mus musculus
tattgggtcccattaaccatttctg

SEQ ID NO: 793412 - DNA, 25 bp, Mus musculus
tattgggtcttccaactggaggtac

SEQ ID NO: 793413 - DNA, 25 bp, Mus musculus
tattgggtcttcgaactggaggtac

SEQ ID NO: 793414 - DNA, 25 bp, Mus musculus
tattgggtggcacctcctagtcata

SEQ ID NO: 793415 - DNA, 25 bp, Mus musculus
tattgggtggcagctcctagtcata

SEQ ID NO: 793416 - DNA, 25 bp, Mus musculus
tattgggttatcattccccgctgag

SEQ ID NO: 793417 - DNA, 25 bp, Mus musculus
tattgggttatctttccccgctgag

SEQ ID NO: 793418 - DNA, 25 bp, Mus musculus
tattgggttctcaggactgtccaca

SEQ ID NO: 793419 - DNA, 25 bp, Mus musculus
tattgggttctctggactgtccaca

SEQ ID NO: 793420 - DNA, 25 bp, Mus musculus
tattggtaatctatgagccttgaga

SEQ ID NO: 793421 - DNA, 25 bp, Mus musculus
tattggtaatctttgagccttgaga

SEQ ID NO: 793422 - DNA, 25 bp, Mus musculus
tattggtacacccactcaggcaaac

SEQ ID NO: 793423 - DNA, 25 bp, Mus musculus
tattggtacaccgactcaggcaaac

SEQ ID NO: 793424 - DNA, 25 bp, Mus musculus
tattggtagacaatgcagcccaagg

SEQ ID NO: 793425 - DNA, 25 bp, Mus musculus
tattggtagacattgcagcccaagg

SEQ ID NO: 793426 - DNA, 25 bp, Mus musculus
tattggtagcagctccatttctaaa

SEQ ID NO: 793427 - DNA, 25 bp, Mus musculus
tattggtagcaggtccatttctaaa

SEQ ID NO: 793428 - DNA, 25 bp, Mus musculus
tattggtagtggattttctgtagtt

SEQ ID NO: 793429 - DNA, 25 bp, Mus musculus
tattggtagtggtttttctgtagtt

SEQ ID NO: 793430 - DNA, 25 bp, Mus musculus
tattggtcacatccgaagttataga

SEQ ID NO: 793431 - DNA, 25 bp, Mus musculus
tattggtcacatgcgaagttataga

SEQ ID NO: 793432 - DNA, 25 bp, Mus musculus
tattggtccaatctgcgtgtgcaac

SEQ ID NO: 793433 - DNA, 25 bp, Mus musculus
tattggtccaatgtgcgtgtgcaac

SEQ ID NO: 793434 - DNA, 25 bp, Mus musculus
tattggtccagtccctgctatcaat

SEQ ID NO: 793435 - DNA, 25 bp, Mus musculus
tattggtccagtgcctgctatcaat

SEQ ID NO: 793436 - DNA, 25 bp, Mus musculus
tattggtgacagatggcgggtctcc

SEQ ID NO: 793437 - DNA, 25 bp, Mus musculus
tattggtgacagttggcgggtctcc

SEQ ID NO: 793438 - DNA, 25 bp, Mus musculus
tattggtgacttctaactttcccct

SEQ ID NO: 793439 - DNA, 25 bp, Mus musculus
tattggtgacttgtaactttcccct

SEQ ID NO: 793440 - DNA, 25 bp, Mus musculus
tattggtgaggaccaccctgtggtt

SEQ ID NO: 793441 - DNA, 25 bp, Mus musculus
tattggtgaggagcaccctgtggtt

SEQ ID NO: 793442 - DNA, 25 bp, Mus musculus
tattggtgcaaaaatgacaagggaa

SEQ ID NO: 793443 - DNA, 25 bp, Mus musculus
tattggtgcaaatatgacaagggaa

SEQ ID NO: 793444 - DNA, 25 bp, Mus musculus
tattggtgcaatcccatcttcctac

SEQ ID NO: 793445 - DNA, 25 bp, Mus musculus
tattggtgcaatgccatcttcctac

SEQ ID NO: 793446 - DNA, 25 bp, Mus musculus
tattggtgcagactgcctgaccttt

SEQ ID NO: 793447 - DNA, 25 bp, Mus musculus
tattggtgcagagtgcctgaccttt

SEQ ID NO: 793448 - DNA, 25 bp, Mus musculus
tattggtgcgagcaattgtcacagg

SEQ ID NO: 793449 - DNA, 25 bp, Mus musculus
tattggtgcgaggaattgtcacagg

SEQ ID NO: 793450 - DNA, 25 bp, Mus musculus
tattggtgggcaaagccatggccgt

SEQ ID NO: 793451 - DNA, 25 bp, Mus musculus
tattggtgggcatagccatggccgt

SEQ ID NO: 793452 - DNA, 25 bp, Mus musculus
tattggtggtagctgaacttcattt

SEQ ID NO: 793453 - DNA, 25 bp, Mus musculus
tattggtggtaggtgaacttcattt

SEQ ID NO: 793454 - DNA, 25 bp, Mus musculus
tattggtggttccttcttttcatct

SEQ ID NO: 793455 - DNA, 25 bp, Mus musculus
tattggtggttcgttcttttcatct

SEQ ID NO: 793456 - DNA, 25 bp, Mus musculus
tattggtgtcttaagctctgccgat

SEQ ID NO: 793457 - DNA, 25 bp, Mus musculus
tattggtgtctttagctctgccgat

SEQ ID NO: 793458 - DNA, 25 bp, Mus musculus
tattggtgttctacccatggtatgg

SEQ ID NO: 793459 - DNA, 25 bp, Mus musculus
tattggtgttcttcccatggtatgg

SEQ ID NO: 793460 - DNA, 25 bp, Mus musculus
tattggttactacatcttccgaggg

SEQ ID NO: 793461 - DNA, 25 bp, Mus musculus
tattggttactagatcttccgaggg

SEQ ID NO: 793462 - DNA, 25 bp, Mus musculus
tattggttcataatgcatactgcat

SEQ ID NO: 793463 - DNA, 25 bp, Mus musculus
tattggttcatattgcatactgcat

SEQ ID NO: 793464 - DNA, 25 bp, Mus musculus
tattggttccaaatagagtttacct

SEQ ID NO: 793465 - DNA, 25 bp, Mus musculus
tattggttccaattagagtttacct

SEQ ID NO: 793466 - DNA, 25 bp, Mus musculus
tattggttcgaaataccctcttgca

SEQ ID NO: 793467 - DNA, 25 bp, Mus musculus
tattggttcgaattaccctcttgca

SEQ ID NO: 793468 - DNA, 25 bp, Mus musculus
tattggttctttaggttgttgtaca

SEQ ID NO: 793469 - DNA, 25 bp, Mus musculus
tattggttcttttggttgttgtaca

SEQ ID NO: 793470 - DNA, 25 bp, Mus musculus
tattggtttggtacgtcagcctgga

SEQ ID NO: 793471 - DNA, 25 bp, Mus musculus
tattggtttggttcgtcagcctgga

SEQ ID NO: 793472 - DNA, 25 bp, Mus musculus
tattggttttatcatgacgttcgag

SEQ ID NO: 793473 - DNA, 25 bp, Mus musculus
tattggttttatgatgacgttcgag

SEQ ID NO: 793474 - DNA, 25 bp, Mus musculus
tattgtaaagccaaaacccttgcct

SEQ ID NO: 793475 - DNA, 25 bp, Mus musculus
tattgtaaagcctaaacccttgcct

SEQ ID NO: 793476 - DNA, 25 bp, Mus musculus
tattgtaacatcactaattgtagaa

SEQ ID NO: 793477 - DNA, 25 bp, Mus musculus
tattgtaacatctctaattgtagaa

SEQ ID NO: 793478 - DNA, 25 bp, Mus musculus
tattgtaactttatggcagcatccc

SEQ ID NO: 793479 - DNA, 25 bp, Mus musculus
tattgtaactttttggcagcatccc

SEQ ID NO: 793480 - DNA, 25 bp, Mus musculus
tattgtaagacaactcactctgtag

SEQ ID NO: 793481 - DNA, 25 bp, Mus musculus
tattgtaagacatctcactctgtag

SEQ ID NO: 793482 - DNA, 25 bp, Mus musculus
tattgtaagacgagcatttgcggtt

SEQ ID NO: 793483 - DNA, 25 bp, Mus musculus
tattgtaagacgtgcatttgcggtt

SEQ ID NO: 793484 - DNA, 25 bp, Mus musculus
tattgtaagataattcactgtcgct

SEQ ID NO: 793485 - DNA, 25 bp, Mus musculus
tattgtaagatatttcactgtcgct

SEQ ID NO: 793486 - DNA, 25 bp, Mus musculus
tattgtaagcatcatccctacctac

SEQ ID NO: 793487 - DNA, 25 bp, Mus musculus
tattgtaagcatccaccgtactgat

SEQ ID NO: 793488 - DNA, 25 bp, Mus musculus
tattgtaagcatgatccctacctac

SEQ ID NO: 793489 - DNA, 25 bp, Mus musculus
tattgtaagcatgcaccgtactgat

SEQ ID NO: 793490 - DNA, 25 bp, Mus musculus
tattgtaaggatacccgaagacctg

SEQ ID NO: 793491 - DNA, 25 bp, Mus musculus
tattgtaaggattcccgaagacctg

SEQ ID NO: 793492 - DNA, 25 bp, Mus musculus
tattgtacaatgctcataggcagaa

SEQ ID NO: 793493 - DNA, 25 bp, Mus musculus
tattgtacaatggtcataggcagaa

SEQ ID NO: 793494 - DNA, 25 bp, Mus musculus
tattgtacacttctaagtctcttga

SEQ ID NO: 793495 - DNA, 25 bp, Mus musculus
tattgtacacttgtaagtctcttga

SEQ ID NO: 793496 - DNA, 25 bp, Mus musculus
tattgtacatcaaagcccctagcat

SEQ ID NO: 793497 - DNA, 25 bp, Mus musculus
tattgtacatcatagcccctagcat

SEQ ID NO: 793498 - DNA, 25 bp, Mus musculus
tattgtactcgaatcttgtgtgccc

SEQ ID NO: 793499 - DNA, 25 bp, Mus musculus
tattgtactcgattcttgtgtgccc

SEQ ID NO: 793500 - DNA, 25 bp, Mus musculus
tattgtagactgctgtctgtatgca

SEQ ID NO: 793501 - DNA, 25 bp, Mus musculus
tattgtagactggtgtctgtatgca

SEQ ID NO: 793502 - DNA, 25 bp, Mus musculus
tattgtagcacacaggaacatctcc

SEQ ID NO: 793503 - DNA, 25 bp, Mus musculus
tattgtagcacagaggaacatctcc

SEQ ID NO: 793504 - DNA, 25 bp, Mus musculus
tattgtagccttagtggtccctgat

SEQ ID NO: 793505 - DNA, 25 bp, Mus musculus
tattgtagcctttgtggtccctgat

SEQ ID NO: 793506 - DNA, 25 bp, Mus musculus
tattgtagttcacaacaatccatct

SEQ ID NO: 793507 - DNA, 25 bp, Mus musculus
tattgtagttcagaacaatccatct

SEQ ID NO: 793508 - DNA, 25 bp, Mus musculus
tattgtatatgacccactttatgaa

SEQ ID NO: 793509 - DNA, 25 bp, Mus musculus
tattgtatatgagccactttatgaa

SEQ ID NO: 793510 - DNA, 25 bp, Mus musculus
tattgtatcactattgtttgtctgg

SEQ ID NO: 793511 - DNA, 25 bp, Mus musculus
tattgtatcacttttgtttgtctgg

SEQ ID NO: 793512 - DNA, 25 bp, Mus musculus
tattgtatccaaaactttgcctagt

SEQ ID NO: 793513 - DNA, 25 bp, Mus musculus
tattgtatccaacggcgtctccaag

SEQ ID NO: 793514 - DNA, 25 bp, Mus musculus
tattgtatccaagggcgtctccaag

SEQ ID NO: 793515 - DNA, 25 bp, Mus musculus
tattgtatccaatactttgcctagt

SEQ ID NO: 793516 - DNA, 25 bp, Mus musculus
tattgtatctagatggctgccagca

SEQ ID NO: 793517 - DNA, 25 bp, Mus musculus
tattgtatctagttggctgccagca

SEQ ID NO: 793518 - DNA, 25 bp, Mus musculus
tattgtatctgaacagtctctagag

SEQ ID NO: 793519 - DNA, 25 bp, Mus musculus
tattgtatctgatcagtctctagag

SEQ ID NO: 793520 - DNA, 25 bp, Mus musculus
tattgtattcccactgaactcttgg

SEQ ID NO: 793521 - DNA, 25 bp, Mus musculus
tattgtattccctctgaactcttgg

SEQ ID NO: 793522 - DNA, 25 bp, Mus musculus
tattgtattctaattactcttcccc

SEQ ID NO: 793523 - DNA, 25 bp, Mus musculus
tattgtattctatttactcttcccc

SEQ ID NO: 793524 - DNA, 25 bp, Mus musculus
tattgtcacactctttgggcaccaa

SEQ ID NO: 793525 - DNA, 25 bp, Mus musculus
tattgtcacactgtttgggcaccaa

SEQ ID NO: 793526 - DNA, 25 bp, Mus musculus
tattgtcacatcaagagacctcata

SEQ ID NO: 793527 - DNA, 25 bp, Mus musculus
tattgtcacatctagagacctcata

SEQ ID NO: 793528 - DNA, 25 bp, Mus musculus
tattgtcacgccctgtgggccaagc

SEQ ID NO: 793529 - DNA, 25 bp, Mus musculus
tattgtcacgccgtgtgggccaagc

SEQ ID NO: 793530 - DNA, 25 bp, Mus musculus
tattgtcagttcagggcaacaaggg

SEQ ID NO: 793531 - DNA, 25 bp, Mus musculus
tattgtcagttctgggcaacaaggg

SEQ ID NO: 793532 - DNA, 25 bp, Mus musculus
tattgtcattaacatcaggttcccc

SEQ ID NO: 793533 - DNA, 25 bp, Mus musculus
tattgtcattaagatcaggttcccc

SEQ ID NO: 793534 - DNA, 25 bp, Mus musculus
tattgtcattttccctgtgttatta

SEQ ID NO: 793535 - DNA, 25 bp, Mus musculus
tattgtcattttgcctgtgttatta

SEQ ID NO: 793536 - DNA, 25 bp, Mus musculus
tattgtccaactactttcttaaatg

SEQ ID NO: 793537 - DNA, 25 bp, Mus musculus
tattgtccaacttctttcttaaatg

SEQ ID NO: 793538 - DNA, 25 bp, Mus musculus
tattgtccactcattcttagctgaa

SEQ ID NO: 793539 - DNA, 25 bp, Mus musculus
tattgtccactctttcttagctgaa

SEQ ID NO: 793540 - DNA, 25 bp, Mus musculus
tattgtccacttatcagattgtcac

SEQ ID NO: 793541 - DNA, 25 bp, Mus musculus
tattgtccacttttcagattgtcac

SEQ ID NO: 793542 - DNA, 25 bp, Mus musculus
tattgtccagtcctgttggttttca

SEQ ID NO: 793543 - DNA, 25 bp, Mus musculus
tattgtccagtcgtgttggttttca

SEQ ID NO: 793544 - DNA, 25 bp, Mus musculus
tattgtccccaactgtgtctttaaa

SEQ ID NO: 793545 - DNA, 25 bp, Mus musculus
tattgtccccaagtgtgtctttaaa

SEQ ID NO: 793546 - DNA, 25 bp, Mus musculus
tattgtcccctaagaggcttcctgg

SEQ ID NO: 793547 - DNA, 25 bp, Mus musculus
tattgtcccctatgaggcttcctgg

SEQ ID NO: 793548 - DNA, 25 bp, Mus musculus
tattgtccccttcagactgatgggt

SEQ ID NO: 793549 - DNA, 25 bp, Mus musculus
tattgtccccttgagactgatgggt

SEQ ID NO: 793550 - DNA, 25 bp, Mus musculus
tattgtccctcaagtgttacattgt

SEQ ID NO: 793551 - DNA, 25 bp, Mus musculus
tattgtccctcatgtgttacattgt

SEQ ID NO: 793552 - DNA, 25 bp, Mus musculus
tattgtccctctactataggagctc

SEQ ID NO: 793553 - DNA, 25 bp, Mus musculus
tattgtccctcttctataggagctc

SEQ ID NO: 793554 - DNA, 25 bp, Mus musculus
tattgtcctagaaatgcaaattggg

SEQ ID NO: 793555 - DNA, 25 bp, Mus musculus
tattgtcctagatatgcaaattggg

SEQ ID NO: 793556 - DNA, 25 bp, Mus musculus
tattgtcctttgatccttcatgtat

SEQ ID NO: 793557 - DNA, 25 bp, Mus musculus
tattgtcctttgttccttcatgtat

SEQ ID NO: 793558 - DNA, 25 bp, Mus musculus
tattgtcgaccaaccatttctctat

SEQ ID NO: 793559 - DNA, 25 bp, Mus musculus
tattgtcgaccatccatttctctat

SEQ ID NO: 793560 - DNA, 25 bp, Mus musculus
tattgtcgttacagcctttggaaga

SEQ ID NO: 793561 - DNA, 25 bp, Mus musculus
tattgtcgttactgcctttggaaga

SEQ ID NO: 793562 - DNA, 25 bp, Mus musculus
tattgtctaaccaactagccgaggc

SEQ ID NO: 793563 - DNA, 25 bp, Mus musculus
tattgtctaacctactagccgaggc

SEQ ID NO: 793564 - DNA, 25 bp, Mus musculus
tattgtctaatgatactaccctgat

SEQ ID NO: 793565 - DNA, 25 bp, Mus musculus
tattgtctaatgttactaccctgat

SEQ ID NO: 793566 - DNA, 25 bp, Mus musculus
tattgtctacatccagcctatactt

SEQ ID NO: 793567 - DNA, 25 bp, Mus musculus
tattgtctacatgcagcctatactt

SEQ ID NO: 793568 - DNA, 25 bp, Mus musculus
tattgtctacctaactgctaccttt

SEQ ID NO: 793569 - DNA, 25 bp, Mus musculus
tattgtctaccttactgctaccttt

SEQ ID NO: 793570 - DNA, 25 bp, Mus musculus
tattgtctcagaatcttcccgaaga

SEQ ID NO: 793571 - DNA, 25 bp, Mus musculus
tattgtctcagactgctggatttag

SEQ ID NO: 793572 - DNA, 25 bp, Mus musculus
tattgtctcagagtgctggatttag

SEQ ID NO: 793573 - DNA, 25 bp, Mus musculus
tattgtctcagattcttcccgaaga

SEQ ID NO: 793574 - DNA, 25 bp, Mus musculus
tattgtctcatcctagactcagcct

SEQ ID NO: 793575 - DNA, 25 bp, Mus musculus
tattgtctcatcgtagactcagcct

SEQ ID NO: 793576 - DNA, 25 bp, Mus musculus
tattgtctcattcttcattgcctcc

SEQ ID NO: 793577 - DNA, 25 bp, Mus musculus
tattgtctcattgttcattgcctcc

SEQ ID NO: 793578 - DNA, 25 bp, Mus musculus
tattgtctcctcatctttacagcag

SEQ ID NO: 793579 - DNA, 25 bp, Mus musculus
tattgtctcctcttctttacagcag

SEQ ID NO: 793580 - DNA, 25 bp, Mus musculus
tattgtctctccaagtctcgcgcag

SEQ ID NO: 793581 - DNA, 25 bp, Mus musculus
tattgtctctcctagtctcgcgcag

SEQ ID NO: 793582 - DNA, 25 bp, Mus musculus
tattgtctctgcacatttacctgga

SEQ ID NO: 793583 - DNA, 25 bp, Mus musculus
tattgtctctgctcatttacctgga

SEQ ID NO: 793584 - DNA, 25 bp, Mus musculus
tattgtctctttagcctgtgatgcc

SEQ ID NO: 793585 - DNA, 25 bp, Mus musculus
tattgtctcttttgcctgtgatgcc

SEQ ID NO: 793586 - DNA, 25 bp, Mus musculus
tattgtctgaatcttgtaggcctgt

SEQ ID NO: 793587 - DNA, 25 bp, Mus musculus
tattgtctgaatgttgtaggcctgt

SEQ ID NO: 793588 - DNA, 25 bp, Mus musculus
tattgtctgatcagttttgctttgt

SEQ ID NO: 793589 - DNA, 25 bp, Mus musculus
tattgtctgatctgttttgctttgt

SEQ ID NO: 793590 - DNA, 25 bp, Mus musculus
tattgtctgcttcgctgtgtaggta

SEQ ID NO: 793591 - DNA, 25 bp, Mus musculus
tattgtctgcttggctgtgtaggta

SEQ ID NO: 793592 - DNA, 25 bp, Mus musculus
tattgtctgtacatgtgagctgtgt

SEQ ID NO: 793593 - DNA, 25 bp, Mus musculus
tattgtctgtacttgtgagctgtgt

SEQ ID NO: 793594 - DNA, 25 bp, Mus musculus
tattgtcttgtgattgtaggaactt

SEQ ID NO: 793595 - DNA, 25 bp, Mus musculus
tattgtcttgtgtttgtaggaactt

SEQ ID NO: 793596 - DNA, 25 bp, Mus musculus
tattgtctttgtctcccttgtaaaa

SEQ ID NO: 793597 - DNA, 25 bp, Mus musculus
tattgtctttgtgtcccttgtaaaa

SEQ ID NO: 793598 - DNA, 25 bp, Mus musculus
tattgtgaaatacctccggttcaga

SEQ ID NO: 793599 - DNA, 25 bp, Mus musculus
tattgtgaaatagctccggttcaga

SEQ ID NO: 793600 - DNA, 25 bp, Mus musculus
tattgtgaaatgcacctgcctttga

SEQ ID NO: 793601 - DNA, 25 bp, Mus musculus
tattgtgaaatggacctgcctttga

SEQ ID NO: 793602 - DNA, 25 bp, Mus musculus
tattgtgacataccatttatttggt

SEQ ID NO: 793603 - DNA, 25 bp, Mus musculus
tattgtgacatagcatttatttggt

SEQ ID NO: 793604 - DNA, 25 bp, Mus musculus
tattgtgaggcactgctttatgtgt

SEQ ID NO: 793605 - DNA, 25 bp, Mus musculus
tattgtgaggcagtgctttatgtgt

SEQ ID NO: 793606 - DNA, 25 bp, Mus musculus
tattgtgagttcaaaggtagcctag

SEQ ID NO: 793607 - DNA, 25 bp, Mus musculus
tattgtgagttctaaggtagcctag

SEQ ID NO: 793608 - DNA, 25 bp, Mus musculus
tattgtgatgccatggtcagggccc

SEQ ID NO: 793609 - DNA, 25 bp, Mus musculus
tattgtgatgccttggtcagggccc

SEQ ID NO: 793610 - DNA, 25 bp, Mus musculus
tattgtgattccactgattgctgca

SEQ ID NO: 793611 - DNA, 25 bp, Mus musculus
tattgtgattcctctgattgctgca

SEQ ID NO: 793612 - DNA, 25 bp, Mus musculus
tattgtgcaaagatttctgttcctt

SEQ ID NO: 793613 - DNA, 25 bp, Mus musculus
tattgtgcaaagttttctgttcctt

SEQ ID NO: 793614 - DNA, 25 bp, Mus musculus
tattgtgcacaaaccatagttctac

SEQ ID NO: 793615 - DNA, 25 bp, Mus musculus
tattgtgcacaatccatagttctac

SEQ ID NO: 793616 - DNA, 25 bp, Mus musculus
tattgtgcacagaagttgtccaggg

SEQ ID NO: 793617 - DNA, 25 bp, Mus musculus
tattgtgcacagtagttgtccaggg

SEQ ID NO: 793618 - DNA, 25 bp, Mus musculus
tattgtgcaggcatctgcctctagc

SEQ ID NO: 793619 - DNA, 25 bp, Mus musculus
tattgtgcaggcttctgcctctagc

SEQ ID NO: 793620 - DNA, 25 bp, Mus musculus
tattgtgccaaaagactatgatgat

SEQ ID NO: 793621 - DNA, 25 bp, Mus musculus
tattgtgccaaaagtactgtactca

SEQ ID NO: 793622 - DNA, 25 bp, Mus musculus
tattgtgccaaatgactatgatgat

SEQ ID NO: 793623 - DNA, 25 bp, Mus musculus
tattgtgccaaatgtactgtactca

SEQ ID NO: 793624 - DNA, 25 bp, Mus musculus
tattgtgcccatcattacggtggat

SEQ ID NO: 793625 - DNA, 25 bp, Mus musculus
tattgtgcccatgattacggtggat

SEQ ID NO: 793626 - DNA, 25 bp, Mus musculus
tattgtgccccactgattacttgta

SEQ ID NO: 793627 - DNA, 25 bp, Mus musculus
tattgtgccccagtgattacttgta

SEQ ID NO: 793628 - DNA, 25 bp, Mus musculus
tattgtgcctaaagtccttgcttat

SEQ ID NO: 793629 - DNA, 25 bp, Mus musculus
tattgtgcctaatgtccttgcttat

SEQ ID NO: 793630 - DNA, 25 bp, Mus musculus
tattgtgcctagaacactgtaaatg

SEQ ID NO: 793631 - DNA, 25 bp, Mus musculus
tattgtgcctagtacactgtaaatg

SEQ ID NO: 793632 - DNA, 25 bp, Mus musculus
tattgtgcgcatacttctcctaaga

SEQ ID NO: 793633 - DNA, 25 bp, Mus musculus
tattgtgcgcattcttctcctaaga

SEQ ID NO: 793634 - DNA, 25 bp, Mus musculus
tattgtgctataaaactgagtttac

SEQ ID NO: 793635 - DNA, 25 bp, Mus musculus
tattgtgctatataactgagtttac

SEQ ID NO: 793636 - DNA, 25 bp, Mus musculus
tattgtgctgttaccagttgccatg

SEQ ID NO: 793637 - DNA, 25 bp, Mus musculus
tattgtgctgtttccagttgccatg

SEQ ID NO: 793638 - DNA, 25 bp, Mus musculus
tattgtgcttttcattgaaccacca

SEQ ID NO: 793639 - DNA, 25 bp, Mus musculus
tattgtgcttttgattgaaccacca

SEQ ID NO: 793640 - DNA, 25 bp, Mus musculus
tattgtggatacaccaaggcagcag

SEQ ID NO: 793641 - DNA, 25 bp, Mus musculus
tattgtggatactccaaggcagcag

SEQ ID NO: 793642 - DNA, 25 bp, Mus musculus
tattgtggcacgagtttgactccag

SEQ ID NO: 793643 - DNA, 25 bp, Mus musculus
tattgtggcacgtgtttgactccag

SEQ ID NO: 793644 - DNA, 25 bp, Mus musculus
tattgtggcgctctggacttcttgc

SEQ ID NO: 793645 - DNA, 25 bp, Mus musculus
tattgtggcgctgtggacttcttgc

SEQ ID NO: 793646 - DNA, 25 bp, Mus musculus
tattgtgggttaaaattttctccta

SEQ ID NO: 793647 - DNA, 25 bp, Mus musculus
tattgtgggttataattttctccta

SEQ ID NO: 793648 - DNA, 25 bp, Mus musculus
tattgtggtcaaatgtgtgaatacc

SEQ ID NO: 793649 - DNA, 25 bp, Mus musculus
tattgtggtcaattgtgtgaatacc

SEQ ID NO: 793650 - DNA, 25 bp, Mus musculus
tattgtggtgtcatggctgagccgt

SEQ ID NO: 793651 - DNA, 25 bp, Mus musculus
tattgtggtgtcttggctgagccgt

SEQ ID NO: 793652 - DNA, 25 bp, Mus musculus
tattgtgtaacactttcctggagac

SEQ ID NO: 793653 - DNA, 25 bp, Mus musculus
tattgtgtaacagtttcctggagac

SEQ ID NO: 793654 - DNA, 25 bp, Mus musculus
tattgtgtaggtcacgggtcccagc

SEQ ID NO: 793655 - DNA, 25 bp, Mus musculus
tattgtgtaggtgacgggtcccagc

SEQ ID NO: 793656 - DNA, 25 bp, Mus musculus
tattgtgtatgccacgcagcctgtg

SEQ ID NO: 793657 - DNA, 25 bp, Mus musculus
tattgtgtatgcgacgcagcctgtg

SEQ ID NO: 793658 - DNA, 25 bp, Mus musculus
tattgtgtctcccatgatctaaaag

SEQ ID NO: 793659 - DNA, 25 bp, Mus musculus
tattgtgtctccgatgatctaaaag

SEQ ID NO: 793660 - DNA, 25 bp, Mus musculus
tattgtgtctgtctgaatgctgttc

SEQ ID NO: 793661 - DNA, 25 bp, Mus musculus
tattgtgtctgtgtgaatgctgttc

SEQ ID NO: 793662 - DNA, 25 bp, Mus musculus
tattgtgtgaacctggcactgggtc

SEQ ID NO: 793663 - DNA, 25 bp, Mus musculus
tattgtgtgaacgtggcactgggtc

SEQ ID NO: 793664 - DNA, 25 bp, Mus musculus
tattgtgtgattagattaaatgcac

SEQ ID NO: 793665 - DNA, 25 bp, Mus musculus
tattgtgtgatttgattaaatgcac

SEQ ID NO: 793666 - DNA, 25 bp, Mus musculus
tattgtgtgcacacttattaacagt

SEQ ID NO: 793667 - DNA, 25 bp, Mus musculus
tattgtgtgcactcttattaacagt

SEQ ID NO: 793668 - DNA, 25 bp, Mus musculus
tattgtgtgctcatttatgtattca

SEQ ID NO: 793669 - DNA, 25 bp, Mus musculus
tattgtgtgctcttttatgtattca

SEQ ID NO: 793670 - DNA, 25 bp, Mus musculus
tattgtgtggttacttccctgactt

SEQ ID NO: 793671 - DNA, 25 bp, Mus musculus
tattgtgtggtttcttccctgactt

SEQ ID NO: 793672 - DNA, 25 bp, Mus musculus
tattgtgtgtctacagccaccttac

SEQ ID NO: 793673 - DNA, 25 bp, Mus musculus
tattgtgtgtcttcagccaccttac

SEQ ID NO: 793674 - DNA, 25 bp, Mus musculus
tattgtgtgtgtacaactttaatgt

SEQ ID NO: 793675 - DNA, 25 bp, Mus musculus
tattgtgtgtgtcatgagccctggc

SEQ ID NO: 793676 - DNA, 25 bp, Mus musculus
tattgtgtgtgtgatgagccctggc

SEQ ID NO: 793677 - DNA, 25 bp, Mus musculus
tattgtgtgtgttcaactttaatgt

SEQ ID NO: 793678 - DNA, 25 bp, Mus musculus
tattgtgtttgtcgtcattccctaa

SEQ ID NO: 793679 - DNA, 25 bp, Mus musculus
tattgtgtttgtggtcattccctaa

SEQ ID NO: 793680 - DNA, 25 bp, Mus musculus
tattgttaaaggaccccgttcatgt

SEQ ID NO: 793681 - DNA, 25 bp, Mus musculus
tattgttaaaggtccccgttcatgt

SEQ ID NO: 793682 - DNA, 25 bp, Mus musculus
tattgttaacccagaggaacagctc

SEQ ID NO: 793683 - DNA, 25 bp, Mus musculus
tattgttaaccctgaggaacagctc

SEQ ID NO: 793684 - DNA, 25 bp, Mus musculus
tattgttaccttagacacccaactc

SEQ ID NO: 793685 - DNA, 25 bp, Mus musculus
tattgttacctttgacacccaactc

SEQ ID NO: 793686 - DNA, 25 bp, Mus musculus
tattgttacggactggaagcaccac

SEQ ID NO: 793687 - DNA, 25 bp, Mus musculus
tattgttacggagtggaagcaccac

SEQ ID NO: 793688 - DNA, 25 bp, Mus musculus
tattgttagaccaacacggacctct

SEQ ID NO: 793689 - DNA, 25 bp, Mus musculus
tattgttagacctacacggacctct

SEQ ID NO: 793690 - DNA, 25 bp, Mus musculus
tattgttatcaactcttctttcccc

SEQ ID NO: 793691 - DNA, 25 bp, Mus musculus
tattgttatcaagtcttctttcccc

SEQ ID NO: 793692 - DNA, 25 bp, Mus musculus
tattgttatcacatccaatcgcctc

SEQ ID NO: 793693 - DNA, 25 bp, Mus musculus
tattgttatcacttccaatcgcctc

SEQ ID NO: 793694 - DNA, 25 bp, Mus musculus
tattgttcaatcactgtgcagtcat

SEQ ID NO: 793695 - DNA, 25 bp, Mus musculus
tattgttcaatctctgtgcagtcat

SEQ ID NO: 793696 - DNA, 25 bp, Mus musculus
tattgttcacagcattggtcttttc

SEQ ID NO: 793697 - DNA, 25 bp, Mus musculus
tattgttcacaggattggtcttttc

SEQ ID NO: 793698 - DNA, 25 bp, Mus musculus
tattgttcactcaatcatcttctgt

SEQ ID NO: 793699 - DNA, 25 bp, Mus musculus
tattgttcactctatcatcttctgt

SEQ ID NO: 793700 - DNA, 25 bp, Mus musculus
tattgttcagcacccagtcatagtt

SEQ ID NO: 793701 - DNA, 25 bp, Mus musculus
tattgttcagcagccagtcatagtt

SEQ ID NO: 793702 - DNA, 25 bp, Mus musculus
tattgttcagggaacttgggacaca

SEQ ID NO: 793703 - DNA, 25 bp, Mus musculus
tattgttcagggtacttgggacaca

SEQ ID NO: 793704 - DNA, 25 bp, Mus musculus
tattgttcatataccaagcctgaag

SEQ ID NO: 793705 - DNA, 25 bp, Mus musculus
tattgttcatatcccagtgaccttg

SEQ ID NO: 793706 - DNA, 25 bp, Mus musculus
tattgttcatatgccagtgaccttg

SEQ ID NO: 793707 - DNA, 25 bp, Mus musculus
tattgttcatattccaagcctgaag

SEQ ID NO: 793708 - DNA, 25 bp, Mus musculus
tattgttccaaacctttagtgatgt

SEQ ID NO: 793709 - DNA, 25 bp, Mus musculus
tattgttccaaagctttagtgatgt

SEQ ID NO: 793710 - DNA, 25 bp, Mus musculus
tattgttccagcactgccatgaaaa

SEQ ID NO: 793711 - DNA, 25 bp, Mus musculus
tattgttccagctctgccatgaaaa

SEQ ID NO: 793712 - DNA, 25 bp, Mus musculus
tattgttccaggacacttctgtttc

SEQ ID NO: 793713 - DNA, 25 bp, Mus musculus
tattgttccaggtcacttctgtttc

SEQ ID NO: 793714 - DNA, 25 bp, Mus musculus
tattgttccctacatgctggccaaa

SEQ ID NO: 793715 - DNA, 25 bp, Mus musculus
tattgttccctagatgctggccaaa

SEQ ID NO: 793716 - DNA, 25 bp, Mus musculus
tattgttccggactttctactacac

SEQ ID NO: 793717 - DNA, 25 bp, Mus musculus
tattgttccggagtttctactacac

SEQ ID NO: 793718 - DNA, 25 bp, Mus musculus
tattgttcctgcattcatttttata

SEQ ID NO: 793719 - DNA, 25 bp, Mus musculus
tattgttcctgctttcatttttata

SEQ ID NO: 793720 - DNA, 25 bp, Mus musculus
tattgttcgaacattgtccccttgg

SEQ ID NO: 793721 - DNA, 25 bp, Mus musculus
tattgttcgaactttgtccccttgg

SEQ ID NO: 793722 - DNA, 25 bp, Mus musculus
tattgttcttggcttcttcatgtag

SEQ ID NO: 793723 - DNA, 25 bp, Mus musculus
tattgttcttgggttcttcatgtag

SEQ ID NO: 793724 - DNA, 25 bp, Mus musculus
tattgttcttttcgtttgccttctt

SEQ ID NO: 793725 - DNA, 25 bp, Mus musculus
tattgttcttttggtttgccttctt

SEQ ID NO: 793726 - DNA, 25 bp, Mus musculus
tattgttgaataagacaggtaaagc

SEQ ID NO: 793727 - DNA, 25 bp, Mus musculus
tattgttgaatatgacaggtaaagc

SEQ ID NO: 793728 - DNA, 25 bp, Mus musculus
tattgttggtacactcgctctttat

SEQ ID NO: 793729 - DNA, 25 bp, Mus musculus
tattgttggtactctcgctctttat

SEQ ID NO: 793730 - DNA, 25 bp, Mus musculus
tattgttgtacgactcctggatgaa

SEQ ID NO: 793731 - DNA, 25 bp, Mus musculus
tattgttgtacgtctcctggatgaa

SEQ ID NO: 793732 - DNA, 25 bp, Mus musculus
tattgttgttcaccatgcttctcct

SEQ ID NO: 793733 - DNA, 25 bp, Mus musculus
tattgttgttcagcatgcttctcct

SEQ ID NO: 793734 - DNA, 25 bp, Mus musculus
tattgttgttggagcttaaacccct

SEQ ID NO: 793735 - DNA, 25 bp, Mus musculus
tattgttgttggtgcttaaacccct

SEQ ID NO: 793736 - DNA, 25 bp, Mus musculus
tattgtttacaaagcgcgcggttta

SEQ ID NO: 793737 - DNA, 25 bp, Mus musculus
tattgtttacaatgcgcgcggttta

SEQ ID NO: 793738 - DNA, 25 bp, Mus musculus
tattgtttactacttcacctcagac

SEQ ID NO: 793739 - DNA, 25 bp, Mus musculus
tattgtttactagttcacctcagac

SEQ ID NO: 793740 - DNA, 25 bp, Mus musculus
tattgtttcaggacgctttggtttc

SEQ ID NO: 793741 - DNA, 25 bp, Mus musculus
tattgtttcaggtcgctttggtttc

SEQ ID NO: 793742 - DNA, 25 bp, Mus musculus
tattgtttccagcagtggaggtgct

SEQ ID NO: 793743 - DNA, 25 bp, Mus musculus
tattgtttccaggagtggaggtgct

SEQ ID NO: 793744 - DNA, 25 bp, Mus musculus
tattgtttctaccacatggtattgc

SEQ ID NO: 793745 - DNA, 25 bp, Mus musculus
tattgtttctacgacatggtattgc

SEQ ID NO: 793746 - DNA, 25 bp, Mus musculus
tattgtttctatctacctccatatc

SEQ ID NO: 793747 - DNA, 25 bp, Mus musculus
tattgtttctatgtacctccatatc

SEQ ID NO: 793748 - DNA, 25 bp, Mus musculus
tattgtttgtacatgattttggcaa

SEQ ID NO: 793749 - DNA, 25 bp, Mus musculus
tattgtttgtacttgattttggcaa

SEQ ID NO: 793750 - DNA, 25 bp, Mus musculus
tattgttttgctcctctataggaaa

SEQ ID NO: 793751 - DNA, 25 bp, Mus musculus
tattgttttgctgctctataggaaa

SEQ ID NO: 793752 - DNA, 25 bp, Mus musculus
tatttaaaatgtctgatgtgcccac

SEQ ID NO: 793753 - DNA, 25 bp, Mus musculus
tatttaaaatgtgtgatgtgcccac

SEQ ID NO: 793754 - DNA, 25 bp, Mus musculus
tatttaaaattgccacctgccttct

SEQ ID NO: 793755 - DNA, 25 bp, Mus musculus
tatttaaaattggcacctgccttct

SEQ ID NO: 793756 - DNA, 25 bp, Mus musculus
tatttaaacggactggcagcctaca

SEQ ID NO: 793757 - DNA, 25 bp, Mus musculus
tatttaaacggagtggcagcctaca

SEQ ID NO: 793758 - DNA, 25 bp, Mus musculus
tatttaaacgtgctctgtggcagca

SEQ ID NO: 793759 - DNA, 25 bp, Mus musculus
tatttaaacgtggtctgtggcagca

SEQ ID NO: 793760 - DNA, 25 bp, Mus musculus
tatttaaaggcgagctcttgttccc

SEQ ID NO: 793761 - DNA, 25 bp, Mus musculus
tatttaaaggcgtgctcttgttccc

SEQ ID NO: 793762 - DNA, 25 bp, Mus musculus
tatttaacagcacatatccttctta

SEQ ID NO: 793763 - DNA, 25 bp, Mus musculus
tatttaacagcagatatccttctta

SEQ ID NO: 793764 - DNA, 25 bp, Mus musculus
tatttaaccctaaaccagaaccagt

SEQ ID NO: 793765 - DNA, 25 bp, Mus musculus
tatttaaccctataccagaaccagt

SEQ ID NO: 793766 - DNA, 25 bp, Mus musculus
tatttaaccctgcttgacactttac

SEQ ID NO: 793767 - DNA, 25 bp, Mus musculus
tatttaaccctggttgacactttac

SEQ ID NO: 793768 - DNA, 25 bp, Mus musculus
tatttaactacaagcgtccttccct

SEQ ID NO: 793769 - DNA, 25 bp, Mus musculus
tatttaactacatgcgtccttccct

SEQ ID NO: 793770 - DNA, 25 bp, Mus musculus
tatttaacttataataggcccaggt

SEQ ID NO: 793771 - DNA, 25 bp, Mus musculus
tatttaacttattataggcccaggt

SEQ ID NO: 793772 - DNA, 25 bp, Mus musculus
tatttaacttcacagtgctccctac

SEQ ID NO: 793773 - DNA, 25 bp, Mus musculus
tatttaacttcagagtgctccctac

SEQ ID NO: 793774 - DNA, 25 bp, Mus musculus
tatttaacttggctttgaaacttgg

SEQ ID NO: 793775 - DNA, 25 bp, Mus musculus
tatttaacttgggtttgaaacttgg

SEQ ID NO: 793776 - DNA, 25 bp, Mus musculus
tatttaagatgtcccctttaccaag

SEQ ID NO: 793777 - DNA, 25 bp, Mus musculus
tatttaagatgtgccctttaccaag

SEQ ID NO: 793778 - DNA, 25 bp, Mus musculus
tatttaagcccaccgtttagagagt

SEQ ID NO: 793779 - DNA, 25 bp, Mus musculus
tatttaagcccagcgtttagagagt

SEQ ID NO: 793780 - DNA, 25 bp, Mus musculus
tatttaagcttacacttggcacagt

SEQ ID NO: 793781 - DNA, 25 bp, Mus musculus
tatttaagcttagacttggcacagt

SEQ ID NO: 793782 - DNA, 25 bp, Mus musculus
tatttaaggaccaaattgtctttct

SEQ ID NO: 793783 - DNA, 25 bp, Mus musculus
tatttaaggacctaattgtctttct

SEQ ID NO: 793784 - DNA, 25 bp, Mus musculus
tatttaagtctgagccttcctttcc

SEQ ID NO: 793785 - DNA, 25 bp, Mus musculus
tatttaagtctgtgccttcctttcc

SEQ ID NO: 793786 - DNA, 25 bp, Mus musculus
tatttaagttgaaggtcagggattc

SEQ ID NO: 793787 - DNA, 25 bp, Mus musculus
tatttaagttgatggtcagggattc

SEQ ID NO: 793788 - DNA, 25 bp, Mus musculus
tatttaatagtcatccattggagca

SEQ ID NO: 793789 - DNA, 25 bp, Mus musculus
tatttaatagtcttccattggagca

SEQ ID NO: 793790 - DNA, 25 bp, Mus musculus
tatttaatctcaatctcttctttgt

SEQ ID NO: 793791 - DNA, 25 bp, Mus musculus
tatttaatctcattctcttctttgt

SEQ ID NO: 793792 - DNA, 25 bp, Mus musculus
tatttaatgcggatccggcagcagc

SEQ ID NO: 793793 - DNA, 25 bp, Mus musculus
tatttaatgcggttccggcagcagc

SEQ ID NO: 793794 - DNA, 25 bp, Mus musculus
tatttaatgtccagtcagtcccttc

SEQ ID NO: 793795 - DNA, 25 bp, Mus musculus
tatttaatgtcctgtcagtcccttc

SEQ ID NO: 793796 - DNA, 25 bp, Mus musculus
tatttaattatgattcccaacagaa

SEQ ID NO: 793797 - DNA, 25 bp, Mus musculus
tatttaattatgtttcccaacagaa

SEQ ID NO: 793798 - DNA, 25 bp, Mus musculus
tatttaattgctaaccttcttccct

SEQ ID NO: 793799 - DNA, 25 bp, Mus musculus
tatttaattgcttaccttcttccct

SEQ ID NO: 793800 - DNA, 25 bp, Mus musculus
tatttaatttgcacttaacctctgt

SEQ ID NO: 793801 - DNA, 25 bp, Mus musculus
tatttaatttgctcttaacctctgt

SEQ ID NO: 793802 - DNA, 25 bp, Mus musculus
tatttacaattcaaaaagccctagt

SEQ ID NO: 793803 - DNA, 25 bp, Mus musculus
tatttacaattctaaaagccctagt

SEQ ID NO: 793804 - DNA, 25 bp, Mus musculus
tatttacaattgattgaccgatctg

SEQ ID NO: 793805 - DNA, 25 bp, Mus musculus
tatttacaattgtttgaccgatctg

SEQ ID NO: 793806 - DNA, 25 bp, Mus musculus
tatttacacacaaaccataatccgt

SEQ ID NO: 793807 - DNA, 25 bp, Mus musculus
tatttacacacataccataatccgt

SEQ ID NO: 793808 - DNA, 25 bp, Mus musculus
tatttacaccttcctagaagcaggt

SEQ ID NO: 793809 - DNA, 25 bp, Mus musculus
tatttacaccttgctagaagcaggt

SEQ ID NO: 793810 - DNA, 25 bp, Mus musculus
tatttacagattcccttgttacctt

SEQ ID NO: 793811 - DNA, 25 bp, Mus musculus
tatttacagattgccttgttacctt

SEQ ID NO: 793812 - DNA, 25 bp, Mus musculus
tatttacatagactgcagatcgtgc

SEQ ID NO: 793813 - DNA, 25 bp, Mus musculus
tatttacatagagtgcagatcgtgc

SEQ ID NO: 793814 - DNA, 25 bp, Mus musculus
tatttacatagtcaaggtccagaat

SEQ ID NO: 793815 - DNA, 25 bp, Mus musculus
tatttacatagtgaaggtccagaat

SEQ ID NO: 793816 - DNA, 25 bp, Mus musculus
tatttacatctgagtgtgggtgcca

SEQ ID NO: 793817 - DNA, 25 bp, Mus musculus
tatttacatctgtgtgtgggtgcca

SEQ ID NO: 793818 - DNA, 25 bp, Mus musculus
tatttacatcttcacttttcttctc

SEQ ID NO: 793819 - DNA, 25 bp, Mus musculus
tatttacatcttgacttttcttctc

SEQ ID NO: 793820 - DNA, 25 bp, Mus musculus
tatttaccaaatccgtttgcccctg

SEQ ID NO: 793821 - DNA, 25 bp, Mus musculus
tatttaccaaatgcgtttgcccctg

SEQ ID NO: 793822 - DNA, 25 bp, Mus musculus
tatttaccaactatgggctcaatat

SEQ ID NO: 793823 - DNA, 25 bp, Mus musculus
tatttaccaactttgggctcaatat

SEQ ID NO: 793824 - DNA, 25 bp, Mus musculus
tatttaccaattctctctcaggtcc

SEQ ID NO: 793825 - DNA, 25 bp, Mus musculus
tatttaccaattgtctctcaggtcc

SEQ ID NO: 793826 - DNA, 25 bp, Mus musculus
tatttaccagacactctttcccatt

SEQ ID NO: 793827 - DNA, 25 bp, Mus musculus
tatttaccagactctctttcccatt

SEQ ID NO: 793828 - DNA, 25 bp, Mus musculus
tatttaccagttatctattattgcc

SEQ ID NO: 793829 - DNA, 25 bp, Mus musculus
tatttaccagttcaaaagtgggaag

SEQ ID NO: 793830 - DNA, 25 bp, Mus musculus
tatttaccagttgaaaagtgggaag

SEQ ID NO: 793831 - DNA, 25 bp, Mus musculus
tatttaccagttttctattattgcc

SEQ ID NO: 793832 - DNA, 25 bp, Mus musculus
tatttaccatagcacatcatcagtg

SEQ ID NO: 793833 - DNA, 25 bp, Mus musculus
tatttaccataggacatcatcagtg

SEQ ID NO: 793834 - DNA, 25 bp, Mus musculus
tatttaccccagagagattagtcct

SEQ ID NO: 793835 - DNA, 25 bp, Mus musculus
tatttaccccagtgagattagtcct

SEQ ID NO: 793836 - DNA, 25 bp, Mus musculus
tatttacccctgacagtttcagaag

SEQ ID NO: 793837 - DNA, 25 bp, Mus musculus
tatttacccctgtcagtttcagaag

SEQ ID NO: 793838 - DNA, 25 bp, Mus musculus
tatttaccctcaagctcatcaatcg

SEQ ID NO: 793839 - DNA, 25 bp, Mus musculus
tatttaccctcatgctcatcaatcg

SEQ ID NO: 793840 - DNA, 25 bp, Mus musculus
tatttacctctgaatgtctccataa

SEQ ID NO: 793841 - DNA, 25 bp, Mus musculus
tatttacctctgcttctttccatgt

SEQ ID NO: 793842 - DNA, 25 bp, Mus musculus
tatttacctctggttctttccatgt

SEQ ID NO: 793843 - DNA, 25 bp, Mus musculus
tatttacctctgtatgtctccataa

SEQ ID NO: 793844 - DNA, 25 bp, Mus musculus
tatttacctgttatacttgtcacct

SEQ ID NO: 793845 - DNA, 25 bp, Mus musculus
tatttacctgttttacttgtcacct

SEQ ID NO: 793846 - DNA, 25 bp, Mus musculus
tatttacgaattccaagtatatttc

SEQ ID NO: 793847 - DNA, 25 bp, Mus musculus
tatttacgaattgcaagtatatttc

SEQ ID NO: 793848 - DNA, 25 bp, Mus musculus
tatttacgtcgcaaaaaggctgcaa

SEQ ID NO: 793849 - DNA, 25 bp, Mus musculus
tatttacgtcgctaaaaggctgcaa

SEQ ID NO: 793850 - DNA, 25 bp, Mus musculus
tatttactcagcatcaaggcaaagg

SEQ ID NO: 793851 - DNA, 25 bp, Mus musculus
tatttactcagcttcaaggcaaagg

SEQ ID NO: 793852 - DNA, 25 bp, Mus musculus
tatttactgggcctccccacagagc

SEQ ID NO: 793853 - DNA, 25 bp, Mus musculus
tatttactgggcgtccccacagagc

SEQ ID NO: 793854 - DNA, 25 bp, Mus musculus
tatttactgtcaactgggagtctga

SEQ ID NO: 793855 - DNA, 25 bp, Mus musculus
tatttactgtcatctgggagtctga

SEQ ID NO: 793856 - DNA, 25 bp, Mus musculus
tatttacttcctctttgttgcactg

SEQ ID NO: 793857 - DNA, 25 bp, Mus musculus
tatttacttcctgtttgttgcactg

SEQ ID NO: 793858 - DNA, 25 bp, Mus musculus
tatttacttcggacataagtttgag

SEQ ID NO: 793859 - DNA, 25 bp, Mus musculus
tatttacttcggtcataagtttgag

SEQ ID NO: 793860 - DNA, 25 bp, Mus musculus
tatttacttctcaaactatgacaat

SEQ ID NO: 793861 - DNA, 25 bp, Mus musculus
tatttacttctctaactatgacaat

SEQ ID NO: 793862 - DNA, 25 bp, Mus musculus
tatttacttttcaacatctggagaa

SEQ ID NO: 793863 - DNA, 25 bp, Mus musculus
tatttacttttctacatctggagaa

SEQ ID NO: 793864 - DNA, 25 bp, Mus musculus
tatttagaacttacagaaaatacct

SEQ ID NO: 793865 - DNA, 25 bp, Mus musculus
tatttagaactttcagaaaatacct

SEQ ID NO: 793866 - DNA, 25 bp, Mus musculus
tatttagaatggaacctgcagaaac

SEQ ID NO: 793867 - DNA, 25 bp, Mus musculus
tatttagaatggtacctgcagaaac

SEQ ID NO: 793868 - DNA, 25 bp, Mus musculus
tatttagacacgacacaccagcggg

SEQ ID NO: 793869 - DNA, 25 bp, Mus musculus
tatttagacacgtcacaccagcggg

SEQ ID NO: 793870 - DNA, 25 bp, Mus musculus
tatttagactttccaagctgccctc

SEQ ID NO: 793871 - DNA, 25 bp, Mus musculus
tatttagactttgcaagctgccctc

SEQ ID NO: 793872 - DNA, 25 bp, Mus musculus
tatttagcaggacaggcacttgtgt

SEQ ID NO: 793873 - DNA, 25 bp, Mus musculus
tatttagcaggagaggcacttgtgt

SEQ ID NO: 793874 - DNA, 25 bp, Mus musculus
tatttagccctcacaccaagcaagg

SEQ ID NO: 793875 - DNA, 25 bp, Mus musculus
tatttagccctctcaccaagcaagg

SEQ ID NO: 793876 - DNA, 25 bp, Mus musculus
tatttagccgctcactgtggttccc

SEQ ID NO: 793877 - DNA, 25 bp, Mus musculus
tatttagccgctgactgtggttccc

SEQ ID NO: 793878 - DNA, 25 bp, Mus musculus
tatttagccgtgatggtggttaagc

SEQ ID NO: 793879 - DNA, 25 bp, Mus musculus
tatttagccgtgttggtggttaagc

SEQ ID NO: 793880 - DNA, 25 bp, Mus musculus
tatttagcctatactttcaaagtgg

SEQ ID NO: 793881 - DNA, 25 bp, Mus musculus
tatttagcctattctttcaaagtgg

SEQ ID NO: 793882 - DNA, 25 bp, Mus musculus
tatttagctacccactgtgttactc

SEQ ID NO: 793883 - DNA, 25 bp, Mus musculus
tatttagctaccgactgtgttactc

SEQ ID NO: 793884 - DNA, 25 bp, Mus musculus
tatttaggaaagacctcacgggtgt

SEQ ID NO: 793885 - DNA, 25 bp, Mus musculus
tatttaggaaagtcctcacgggtgt

SEQ ID NO: 793886 - DNA, 25 bp, Mus musculus
tatttagggctactgtttgtttgtt

SEQ ID NO: 793887 - DNA, 25 bp, Mus musculus
tatttagggctagtgtttgtttgtt

SEQ ID NO: 793888 - DNA, 25 bp, Mus musculus
tatttagtactccacctatctcgag

SEQ ID NO: 793889 - DNA, 25 bp, Mus musculus
tatttagtactcgacctatctcgag

SEQ ID NO: 793890 - DNA, 25 bp, Mus musculus
tatttagtggatccccttatgcccc

SEQ ID NO: 793891 - DNA, 25 bp, Mus musculus
tatttagtggatgcccttatgcccc

SEQ ID NO: 793892 - DNA, 25 bp, Mus musculus
tatttagtttgacctccgtaggtta

SEQ ID NO: 793893 - DNA, 25 bp, Mus musculus
tatttagtttgagctccgtaggtta

SEQ ID NO: 793894 - DNA, 25 bp, Mus musculus
tatttataacccaaggatcctcctc

SEQ ID NO: 793895 - DNA, 25 bp, Mus musculus
tatttataaccctaggatcctcctc

SEQ ID NO: 793896 - DNA, 25 bp, Mus musculus
tatttataagaacctgccagggaat

SEQ ID NO: 793897 - DNA, 25 bp, Mus musculus
tatttataagaagctgccagggaat

SEQ ID NO: 793898 - DNA, 25 bp, Mus musculus
tatttatacacacccacagatactc

SEQ ID NO: 793899 - DNA, 25 bp, Mus musculus
tatttatacacagccacagatactc

SEQ ID NO: 793900 - DNA, 25 bp, Mus musculus
tatttataccttaaagaccagtcaa

SEQ ID NO: 793901 - DNA, 25 bp, Mus musculus
tatttatacctttaagaccagtcaa

SEQ ID NO: 793902 - DNA, 25 bp, Mus musculus
tatttataggccatctctcgaccaa

SEQ ID NO: 793903 - DNA, 25 bp, Mus musculus
tatttataggccttctctcgaccaa

SEQ ID NO: 793904 - DNA, 25 bp, Mus musculus
tatttatatagtcccttgcctggtg

SEQ ID NO: 793905 - DNA, 25 bp, Mus musculus
tatttatatagtgccttgcctggtg

SEQ ID NO: 793906 - DNA, 25 bp, Mus musculus
tatttatatcatcgcatctgtgtgt

SEQ ID NO: 793907 - DNA, 25 bp, Mus musculus
tatttatatcatggcatctgtgtgt

SEQ ID NO: 793908 - DNA, 25 bp, Mus musculus
tatttatatcctacaacgcctttta

SEQ ID NO: 793909 - DNA, 25 bp, Mus musculus
tatttatatccttcaacgcctttta

SEQ ID NO: 793910 - DNA, 25 bp, Mus musculus
tatttatatgtaagtcgctcttcaa

SEQ ID NO: 793911 - DNA, 25 bp, Mus musculus
tatttatatgtatgtcgctcttcaa

SEQ ID NO: 793912 - DNA, 25 bp, Mus musculus
tatttatattccacgatcctccttt

SEQ ID NO: 793913 - DNA, 25 bp, Mus musculus
tatttatattcctcgatcctccttt

SEQ ID NO: 793914 - DNA, 25 bp, Mus musculus
tatttatcatctatcacccatctac

SEQ ID NO: 793915 - DNA, 25 bp, Mus musculus
tatttatcatctttcacccatctac

SEQ ID NO: 793916 - DNA, 25 bp, Mus musculus
tatttatccagcactataccactct

SEQ ID NO: 793917 - DNA, 25 bp, Mus musculus
tatttatccagctctataccactct

SEQ ID NO: 793918 - DNA, 25 bp, Mus musculus
tatttatccattaagctctgagctc

SEQ ID NO: 793919 - DNA, 25 bp, Mus musculus
tatttatccatttagctctgagctc

SEQ ID NO: 793920 - DNA, 25 bp, Mus musculus
tatttatccctacgtcatgtacgaa

SEQ ID NO: 793921 - DNA, 25 bp, Mus musculus
tatttatccctaggtcatgtacgaa

SEQ ID NO: 793922 - DNA, 25 bp, Mus musculus
tatttatctagcataaactggagag

SEQ ID NO: 793923 - DNA, 25 bp, Mus musculus
tatttatctagcttaaactggagag

SEQ ID NO: 793924 - DNA, 25 bp, Mus musculus
tatttatctccaatgtcctcatacc

SEQ ID NO: 793925 - DNA, 25 bp, Mus musculus
tatttatctccattgtcctcatacc

SEQ ID NO: 793926 - DNA, 25 bp, Mus musculus
tatttatctcctacaacttgtaaaa

SEQ ID NO: 793927 - DNA, 25 bp, Mus musculus
tatttatctccttcaacttgtaaaa

SEQ ID NO: 793928 - DNA, 25 bp, Mus musculus
tatttatctgtgactctatacctct

SEQ ID NO: 793929 - DNA, 25 bp, Mus musculus
tatttatctgtgtctctatacctct

SEQ ID NO: 793930 - DNA, 25 bp, Mus musculus
tatttatcttagaaacctgagggtt

SEQ ID NO: 793931 - DNA, 25 bp, Mus musculus
tatttatcttagtaacctgagggtt

SEQ ID NO: 793932 - DNA, 25 bp, Mus musculus
tatttatgaagtcggtggcatgttc

SEQ ID NO: 793933 - DNA, 25 bp, Mus musculus
tatttatgaagtgggtggcatgttc

SEQ ID NO: 793934 - DNA, 25 bp, Mus musculus
tatttatgcctcagttactgcaata

SEQ ID NO: 793935 - DNA, 25 bp, Mus musculus
tatttatgcctctgttactgcaata

SEQ ID NO: 793936 - DNA, 25 bp, Mus musculus
tatttatggccaacggcgcttccat

SEQ ID NO: 793937 - DNA, 25 bp, Mus musculus
tatttatggccatcggcgcttccat

SEQ ID NO: 793938 - DNA, 25 bp, Mus musculus
tatttatgttcccagcacagagcaa

SEQ ID NO: 793939 - DNA, 25 bp, Mus musculus
tatttatgttccgagcacagagcaa

SEQ ID NO: 793940 - DNA, 25 bp, Mus musculus
tatttatgttggacccaggaggtgg

SEQ ID NO: 793941 - DNA, 25 bp, Mus musculus
tatttatgttggtcccaggaggtgg

SEQ ID NO: 793942 - DNA, 25 bp, Mus musculus
tatttattaactattctgctactat

SEQ ID NO: 793943 - DNA, 25 bp, Mus musculus
tatttattaacttttctgctactat

SEQ ID NO: 793944 - DNA, 25 bp, Mus musculus
tatttattacttctttggttgcata

SEQ ID NO: 793945 - DNA, 25 bp, Mus musculus
tatttattacttgtttggttgcata

SEQ ID NO: 793946 - DNA, 25 bp, Mus musculus
tatttattatagaagccccgcctcc

SEQ ID NO: 793947 - DNA, 25 bp, Mus musculus
tatttattatagtagccccgcctcc

SEQ ID NO: 793948 - DNA, 25 bp, Mus musculus
tatttattatgaattgcacccttgg

SEQ ID NO: 793949 - DNA, 25 bp, Mus musculus
tatttattatgatttgcacccttgg

SEQ ID NO: 793950 - DNA, 25 bp, Mus musculus
tatttattccccagtgactccagga

SEQ ID NO: 793951 - DNA, 25 bp, Mus musculus
tatttattccccattaggttgcaga

SEQ ID NO: 793952 - DNA, 25 bp, Mus musculus
tatttattcccctgtgactccagga

SEQ ID NO: 793953 - DNA, 25 bp, Mus musculus
tatttattcccctttaggttgcaga

SEQ ID NO: 793954 - DNA, 25 bp, Mus musculus
tatttattcctgatctcatgctaga

SEQ ID NO: 793955 - DNA, 25 bp, Mus musculus
tatttattcctgttctcatgctaga

SEQ ID NO: 793956 - DNA, 25 bp, Mus musculus
tatttattctgtctcttggatccca

SEQ ID NO: 793957 - DNA, 25 bp, Mus musculus
tatttattctgtgtcttggatccca

SEQ ID NO: 793958 - DNA, 25 bp, Mus musculus
tatttattggttaggctcttgctct

SEQ ID NO: 793959 - DNA, 25 bp, Mus musculus
tatttattggttatagcctgttaaa

SEQ ID NO: 793960 - DNA, 25 bp, Mus musculus
tatttattggtttggctcttgctct

SEQ ID NO: 793961 - DNA, 25 bp, Mus musculus
tatttattggttttagcctgttaaa

SEQ ID NO: 793962 - DNA, 25 bp, Mus musculus
tatttattgtgactgaacctttgac

SEQ ID NO: 793963 - DNA, 25 bp, Mus musculus
tatttattgtgagtgaacctttgac

SEQ ID NO: 793964 - DNA, 25 bp, Mus musculus
tatttattgttcaaggcggcagcat

SEQ ID NO: 793965 - DNA, 25 bp, Mus musculus
tatttattgttcaccgcgagacctc

SEQ ID NO: 793966 - DNA, 25 bp, Mus musculus
tatttattgttctaggcggcagcat

SEQ ID NO: 793967 - DNA, 25 bp, Mus musculus
tatttattgttctccgcgagacctc

SEQ ID NO: 793968 - DNA, 25 bp, Mus musculus
tatttatttcacattggcattttta

SEQ ID NO: 793969 - DNA, 25 bp, Mus musculus
tatttatttcactttggcattttta

SEQ ID NO: 793970 - DNA, 25 bp, Mus musculus
tatttatttcatactgtagtgtaca

SEQ ID NO: 793971 - DNA, 25 bp, Mus musculus
tatttatttcattctgtagtgtaca

SEQ ID NO: 793972 - DNA, 25 bp, Mus musculus
tatttatttctccacttgaagccat

SEQ ID NO: 793973 - DNA, 25 bp, Mus musculus
tatttatttctcgacttgaagccat

SEQ ID NO: 793974 - DNA, 25 bp, Mus musculus
tatttatttgttcgagagtctctga

SEQ ID NO: 793975 - DNA, 25 bp, Mus musculus
tatttatttgttggagagtctctga

SEQ ID NO: 793976 - DNA, 25 bp, Mus musculus
tatttattttctcgtcttcaccgct

SEQ ID NO: 793977 - DNA, 25 bp, Mus musculus
tatttattttctggtcttcaccgct

SEQ ID NO: 793978 - DNA, 25 bp, Mus musculus
tatttcaaccctctctatatcgagc

SEQ ID NO: 793979 - DNA, 25 bp, Mus musculus
tatttcaaccctgtctatatcgagc

SEQ ID NO: 793980 - DNA, 25 bp, Mus musculus
tatttcaactgaatcccattgcctc

SEQ ID NO: 793981 - DNA, 25 bp, Mus musculus
tatttcaactgattcccattgcctc

SEQ ID NO: 793982 - DNA, 25 bp, Mus musculus
tatttcaagtgcacagaagccacac

SEQ ID NO: 793983 - DNA, 25 bp, Mus musculus
tatttcaagtgctcagaagccacac

SEQ ID NO: 793984 - DNA, 25 bp, Mus musculus
tatttcaatgtacctctgaacacat

SEQ ID NO: 793985 - DNA, 25 bp, Mus musculus
tatttcaatgtagctctgaacacat

SEQ ID NO: 793986 - DNA, 25 bp, Mus musculus
tatttcaatttaactgccgctacca

SEQ ID NO: 793987 - DNA, 25 bp, Mus musculus
tatttcaatttatctgccgctacca

SEQ ID NO: 793988 - DNA, 25 bp, Mus musculus
tatttcacacagacacaatgggcag

SEQ ID NO: 793989 - DNA, 25 bp, Mus musculus
tatttcacacagtcacaatgggcag

SEQ ID NO: 793990 - DNA, 25 bp, Mus musculus
tatttcacaccccagctagaataaa

SEQ ID NO: 793991 - DNA, 25 bp, Mus musculus
tatttcacacccgagctagaataaa

SEQ ID NO: 793992 - DNA, 25 bp, Mus musculus
tatttcacagaccatgctcaacctc

SEQ ID NO: 793993 - DNA, 25 bp, Mus musculus
tatttcacagacgatgctcaacctc

SEQ ID NO: 793994 - DNA, 25 bp, Mus musculus
tatttcaccaccattgcaaggccaa

SEQ ID NO: 793995 - DNA, 25 bp, Mus musculus
tatttcaccacctttgcaaggccaa

SEQ ID NO: 793996 - DNA, 25 bp, Mus musculus
tatttcacctacagccatctttata

SEQ ID NO: 793997 - DNA, 25 bp, Mus musculus
tatttcacctactgccatctttata

SEQ ID NO: 793998 - DNA, 25 bp, Mus musculus
tatttcacgaccaagaagcagccga

SEQ ID NO: 793999 - DNA, 25 bp, Mus musculus
tatttcacgacctagaagcagccga

SEQ ID NO: 794000 - DNA, 25 bp, Mus musculus
tatttcactcacctaagttgggcca

SEQ ID NO: 794001 - DNA, 25 bp, Mus musculus
tatttcactcacgtaagttgggcca

SEQ ID NO: 794002 - DNA, 25 bp, Mus musculus
tatttcactctaatcccaggtgtgg

SEQ ID NO: 794003 - DNA, 25 bp, Mus musculus
tatttcactctattcccaggtgtgg

SEQ ID NO: 794004 - DNA, 25 bp, Mus musculus
tatttcactcttaatttgggtccca

SEQ ID NO: 794005 - DNA, 25 bp, Mus musculus
tatttcactctttatttgggtccca

SEQ ID NO: 794006 - DNA, 25 bp, Mus musculus
tatttcagaactatcttgttccttg

SEQ ID NO: 794007 - DNA, 25 bp, Mus musculus
tatttcagaactttcttgttccttg

SEQ ID NO: 794008 - DNA, 25 bp, Mus musculus
tatttcagaagacaacctggaccac

SEQ ID NO: 794009 - DNA, 25 bp, Mus musculus
tatttcagaagagaacctggaccac

SEQ ID NO: 794010 - DNA, 25 bp, Mus musculus
tatttcagaggaagatgttaggcca

SEQ ID NO: 794011 - DNA, 25 bp, Mus musculus
tatttcagaggatgatgttaggcca

SEQ ID NO: 794012 - DNA, 25 bp, Mus musculus
tatttcagatcaatttcctccttgc

SEQ ID NO: 794013 - DNA, 25 bp, Mus musculus
tatttcagatcattttcctccttgc

SEQ ID NO: 794014 - DNA, 25 bp, Mus musculus
tatttcagatgaagcgaccttagtt

SEQ ID NO: 794015 - DNA, 25 bp, Mus musculus
tatttcagatgatgcgaccttagtt

SEQ ID NO: 794016 - DNA, 25 bp, Mus musculus
tatttcaggcttacacttgcaggta

SEQ ID NO: 794017 - DNA, 25 bp, Mus musculus
tatttcaggctttcacttgcaggta

SEQ ID NO: 794018 - DNA, 25 bp, Mus musculus
tatttcagtcatagaatcactgcaa

SEQ ID NO: 794019 - DNA, 25 bp, Mus musculus
tatttcagtcattgaatcactgcaa

SEQ ID NO: 794020 - DNA, 25 bp, Mus musculus
tatttcagtgaaccttgtgcccatg

SEQ ID NO: 794021 - DNA, 25 bp, Mus musculus
tatttcagtgaagcttgtgcccatg

SEQ ID NO: 794022 - DNA, 25 bp, Mus musculus
tatttcagtgttctaggaactggga

SEQ ID NO: 794023 - DNA, 25 bp, Mus musculus
tatttcagtgttgtaggaactggga

SEQ ID NO: 794024 - DNA, 25 bp, Mus musculus
tatttcagttcacccaaggtcagtg

SEQ ID NO: 794025 - DNA, 25 bp, Mus musculus
tatttcagttcagccaaggtcagtg

SEQ ID NO: 794026 - DNA, 25 bp, Mus musculus
tatttcagttcgctcacctctttgc

SEQ ID NO: 794027 - DNA, 25 bp, Mus musculus
tatttcagttcggtcacctctttgc

SEQ ID NO: 794028 - DNA, 25 bp, Mus musculus
tatttcatagcaccagtattcaggc

SEQ ID NO: 794029 - DNA, 25 bp, Mus musculus
tatttcatagcagcagtattcaggc

SEQ ID NO: 794030 - DNA, 25 bp, Mus musculus
tatttcatatgcaatcccaaaaagg

SEQ ID NO: 794031 - DNA, 25 bp, Mus musculus
tatttcatatgctatcccaaaaagg

SEQ ID NO: 794032 - DNA, 25 bp, Mus musculus
tatttcatcagcaactaatagtgtt

SEQ ID NO: 794033 - DNA, 25 bp, Mus musculus
tatttcatcagctactaatagtgtt

SEQ ID NO: 794034 - DNA, 25 bp, Mus musculus
tatttcatcataacaacctcctttc

SEQ ID NO: 794035 - DNA, 25 bp, Mus musculus
tatttcatcatatcaacctcctttc

SEQ ID NO: 794036 - DNA, 25 bp, Mus musculus
tatttcatccacaggtagggagcag

SEQ ID NO: 794037 - DNA, 25 bp, Mus musculus
tatttcatccactggtagggagcag

SEQ ID NO: 794038 - DNA, 25 bp, Mus musculus
tatttcatgggccatgtaacataca

SEQ ID NO: 794039 - DNA, 25 bp, Mus musculus
tatttcatgggcgatgtaacataca

SEQ ID NO: 794040 - DNA, 25 bp, Mus musculus
tatttcatggtgagattcgcctttg

SEQ ID NO: 794041 - DNA, 25 bp, Mus musculus
tatttcatggtgtgattcgcctttg

SEQ ID NO: 794042 - DNA, 25 bp, Mus musculus
tatttcatgtgcatcagcgttctgc

SEQ ID NO: 794043 - DNA, 25 bp, Mus musculus
tatttcatgtgcttcagcgttctgc

SEQ ID NO: 794044 - DNA, 25 bp, Mus musculus
tatttcatgtttattgtggaacacg

SEQ ID NO: 794045 - DNA, 25 bp, Mus musculus
tatttcatgtttctaagcacctctg

SEQ ID NO: 794046 - DNA, 25 bp, Mus musculus
tatttcatgtttgtaagcacctctg

SEQ ID NO: 794047 - DNA, 25 bp, Mus musculus
tatttcatgttttttgtggaacacg

SEQ ID NO: 794048 - DNA, 25 bp, Mus musculus
tatttcattatgacctaacattaat

SEQ ID NO: 794049 - DNA, 25 bp, Mus musculus
tatttcattatgtcctaacattaat

SEQ ID NO: 794050 - DNA, 25 bp, Mus musculus
tatttcattattatcgttccctcca

SEQ ID NO: 794051 - DNA, 25 bp, Mus musculus
tatttcattattttcgttccctcca

SEQ ID NO: 794052 - DNA, 25 bp, Mus musculus
tatttcattttcactactgctgaca

SEQ ID NO: 794053 - DNA, 25 bp, Mus musculus
tatttcattttctctactgctgaca

SEQ ID NO: 794054 - DNA, 25 bp, Mus musculus
tatttccaaatactgtagagtcgct

SEQ ID NO: 794055 - DNA, 25 bp, Mus musculus
tatttccaaatagtgtagagtcgct

SEQ ID NO: 794056 - DNA, 25 bp, Mus musculus
tatttccaaggaacggtcagcagat

SEQ ID NO: 794057 - DNA, 25 bp, Mus musculus
tatttccaaggatcggtcagcagat

SEQ ID NO: 794058 - DNA, 25 bp, Mus musculus
tatttccactaaaaatattgttcct

SEQ ID NO: 794059 - DNA, 25 bp, Mus musculus
tatttccactaataatattgttcct

SEQ ID NO: 794060 - DNA, 25 bp, Mus musculus
tatttccactccaccttttcaggat

SEQ ID NO: 794061 - DNA, 25 bp, Mus musculus
tatttccactcctccttttcaggat

SEQ ID NO: 794062 - DNA, 25 bp, Mus musculus
tatttccactggataagacttggtt

SEQ ID NO: 794063 - DNA, 25 bp, Mus musculus
tatttccactggttaagacttggtt

SEQ ID NO: 794064 - DNA, 25 bp, Mus musculus
tatttccagaggagtgccatccact

SEQ ID NO: 794065 - DNA, 25 bp, Mus musculus
tatttccagaggtgtgccatccact

SEQ ID NO: 794066 - DNA, 25 bp, Mus musculus
tatttccaggcaataatatgatgaa

SEQ ID NO: 794067 - DNA, 25 bp, Mus musculus
tatttccaggcattaatatgatgaa

SEQ ID NO: 794068 - DNA, 25 bp, Mus musculus
tatttccatatgcaccagagggtcc

SEQ ID NO: 794069 - DNA, 25 bp, Mus musculus
tatttccatatgctaatgacatgtc

SEQ ID NO: 794070 - DNA, 25 bp, Mus musculus
tatttccatatggaccagagggtcc

SEQ ID NO: 794071 - DNA, 25 bp, Mus musculus
tatttccatatggtaatgacatgtc

SEQ ID NO: 794072 - DNA, 25 bp, Mus musculus
tatttccatcctccatgctaataga

SEQ ID NO: 794073 - DNA, 25 bp, Mus musculus
tatttccatcctgcatgctaataga

SEQ ID NO: 794074 - DNA, 25 bp, Mus musculus
tatttccatgctccagcattctcag

SEQ ID NO: 794075 - DNA, 25 bp, Mus musculus
tatttccatgctgcagcattctcag

SEQ ID NO: 794076 - DNA, 25 bp, Mus musculus
tatttcccaaacatccaccctgtgt

SEQ ID NO: 794077 - DNA, 25 bp, Mus musculus
tatttcccaaacttccaccctgtgt

SEQ ID NO: 794078 - DNA, 25 bp, Mus musculus
tatttcccaacccacatgatggttt

SEQ ID NO: 794079 - DNA, 25 bp, Mus musculus
tatttcccaaccgacatgatggttt

SEQ ID NO: 794080 - DNA, 25 bp, Mus musculus
tatttcccaaggacagttgttagtt

SEQ ID NO: 794081 - DNA, 25 bp, Mus musculus
tatttcccaaggtcagttgttagtt

SEQ ID NO: 794082 - DNA, 25 bp, Mus musculus
tatttcccaattactaaggctgctg

SEQ ID NO: 794083 - DNA, 25 bp, Mus musculus
tatttcccaatttctaaggctgctg

SEQ ID NO: 794084 - DNA, 25 bp, Mus musculus
tatttcccagatattgtcctcttcc

SEQ ID NO: 794085 - DNA, 25 bp, Mus musculus
tatttcccagattttgtcctcttcc

SEQ ID NO: 794086 - DNA, 25 bp, Mus musculus
tatttcccagcaacgctatttctga

SEQ ID NO: 794087 - DNA, 25 bp, Mus musculus
tatttcccagcatcgctatttctga

SEQ ID NO: 794088 - DNA, 25 bp, Mus musculus
tatttcccagtcaaggtttgcgttt

SEQ ID NO: 794089 - DNA, 25 bp, Mus musculus
tatttcccagtctaggtttgcgttt

SEQ ID NO: 794090 - DNA, 25 bp, Mus musculus
tatttcccagttcttagccatacct

SEQ ID NO: 794091 - DNA, 25 bp, Mus musculus
tatttcccagttgttagccatacct

SEQ ID NO: 794092 - DNA, 25 bp, Mus musculus
tatttcccatccctttatacactag

SEQ ID NO: 794093 - DNA, 25 bp, Mus musculus
tatttcccatccgtttatacactag

SEQ ID NO: 794094 - DNA, 25 bp, Mus musculus
tatttccccaggctcagagtccacg

SEQ ID NO: 794095 - DNA, 25 bp, Mus musculus
tatttccccagggtcagagtccacg

SEQ ID NO: 794096 - DNA, 25 bp, Mus musculus
tatttccccagtagcattgtccggg

SEQ ID NO: 794097 - DNA, 25 bp, Mus musculus
tatttccccagttgcattgtccggg

SEQ ID NO: 794098 - DNA, 25 bp, Mus musculus
tatttcccctatatcctgagtggca

SEQ ID NO: 794099 - DNA, 25 bp, Mus musculus
tatttcccctatttcctgagtggca

SEQ ID NO: 794100 - DNA, 25 bp, Mus musculus
tatttcccctctacagtactttatg

SEQ ID NO: 794101 - DNA, 25 bp, Mus musculus
tatttcccctcttcagtactttatg

SEQ ID NO: 794102 - DNA, 25 bp, Mus musculus
tatttcccgagcaccattgcggaag

SEQ ID NO: 794103 - DNA, 25 bp, Mus musculus
tatttcccgagctccattgcggaag

SEQ ID NO: 794104 - DNA, 25 bp, Mus musculus
tatttcccgggcctagagacgttga

SEQ ID NO: 794105 - DNA, 25 bp, Mus musculus
tatttcccgggcgtagagacgttga

SEQ ID NO: 794106 - DNA, 25 bp, Mus musculus
tatttccctaacaccagactgtgat

SEQ ID NO: 794107 - DNA, 25 bp, Mus musculus
tatttccctaactccagactgtgat

SEQ ID NO: 794108 - DNA, 25 bp, Mus musculus
tatttccctaggatattaacacttc

SEQ ID NO: 794109 - DNA, 25 bp, Mus musculus
tatttccctaggttattaacacttc

SEQ ID NO: 794110 - DNA, 25 bp, Mus musculus
tatttccctatcatgctaaagaatg

SEQ ID NO: 794111 - DNA, 25 bp, Mus musculus
tatttccctatcttgctaaagaatg

SEQ ID NO: 794112 - DNA, 25 bp, Mus musculus
tatttccctattatcaatgcgtgca

SEQ ID NO: 794113 - DNA, 25 bp, Mus musculus
tatttccctattttcaatgcgtgca

SEQ ID NO: 794114 - DNA, 25 bp, Mus musculus
tatttccctcctccttacaaaagtt

SEQ ID NO: 794115 - DNA, 25 bp, Mus musculus
tatttccctcctgcttacaaaagtt

SEQ ID NO: 794116 - DNA, 25 bp, Mus musculus
tatttccctctgcttcctaaccgtg

SEQ ID NO: 794117 - DNA, 25 bp, Mus musculus
tatttccctctggttcctaaccgtg

SEQ ID NO: 794118 - DNA, 25 bp, Mus musculus
tatttccctggtcgcaaccgagaaa

SEQ ID NO: 794119 - DNA, 25 bp, Mus musculus
tatttccctggtggcaaccgagaaa

SEQ ID NO: 794120 - DNA, 25 bp, Mus musculus
tatttccctgtgaactaaccttaga

SEQ ID NO: 794121 - DNA, 25 bp, Mus musculus
tatttccctgtgtactaaccttaga

SEQ ID NO: 794122 - DNA, 25 bp, Mus musculus
tatttcccttccagatagttgcatc

SEQ ID NO: 794123 - DNA, 25 bp, Mus musculus
tatttcccttcctgatagttgcatc

SEQ ID NO: 794124 - DNA, 25 bp, Mus musculus
tatttcccttctagcctttttgtgg

SEQ ID NO: 794125 - DNA, 25 bp, Mus musculus
tatttcccttcttgcctttttgtgg

SEQ ID NO: 794126 - DNA, 25 bp, Mus musculus
tatttcccttggctaccttcattgg

SEQ ID NO: 794127 - DNA, 25 bp, Mus musculus
tatttcccttgggtaccttcattgg

SEQ ID NO: 794128 - DNA, 25 bp, Mus musculus
tatttccgagaccaaaaggatggct

SEQ ID NO: 794129 - DNA, 25 bp, Mus musculus
tatttccgagacgaaaaggatggct

SEQ ID NO: 794130 - DNA, 25 bp, Mus musculus
tatttccgtaaactcttgaacattg

SEQ ID NO: 794131 - DNA, 25 bp, Mus musculus
tatttccgtaaagtcttgaacattg

SEQ ID NO: 794132 - DNA, 25 bp, Mus musculus
tatttcctaaagcatgggctcagct

SEQ ID NO: 794133 - DNA, 25 bp, Mus musculus
tatttcctaaaggatgggctcagct

SEQ ID NO: 794134 - DNA, 25 bp, Mus musculus
tatttcctaatcattccttgtgatg

SEQ ID NO: 794135 - DNA, 25 bp, Mus musculus
tatttcctaatctttccttgtgatg

SEQ ID NO: 794136 - DNA, 25 bp, Mus musculus
tatttcctaccacaataatttccgg

SEQ ID NO: 794137 - DNA, 25 bp, Mus musculus
tatttcctaccagaataatttccgg

SEQ ID NO: 794138 - DNA, 25 bp, Mus musculus
tatttcctagttagggcttttcaat

SEQ ID NO: 794139 - DNA, 25 bp, Mus musculus
tatttcctagtttgggcttttcaat

SEQ ID NO: 794140 - DNA, 25 bp, Mus musculus
tatttcctatagagttgctcgattt

SEQ ID NO: 794141 - DNA, 25 bp, Mus musculus
tatttcctatagtgttgctcgattt

SEQ ID NO: 794142 - DNA, 25 bp, Mus musculus
tatttcctatatacttggccaacag

SEQ ID NO: 794143 - DNA, 25 bp, Mus musculus
tatttcctatattcttggccaacag

SEQ ID NO: 794144 - DNA, 25 bp, Mus musculus
tatttcctctctagtctcatcaaag

SEQ ID NO: 794145 - DNA, 25 bp, Mus musculus
tatttcctctcttgtctcatcaaag

SEQ ID NO: 794146 - DNA, 25 bp, Mus musculus
tatttcctgaacaagtcccatcact

SEQ ID NO: 794147 - DNA, 25 bp, Mus musculus
tatttcctgaactagtcccatcact

SEQ ID NO: 794148 - DNA, 25 bp, Mus musculus
tatttcctgggcacggcggcacgta

SEQ ID NO: 794149 - DNA, 25 bp, Mus musculus
tatttcctgggctcggcggcacgta

SEQ ID NO: 794150 - DNA, 25 bp, Mus musculus
tatttcctgggtagacatccttaaa

SEQ ID NO: 794151 - DNA, 25 bp, Mus musculus
tatttcctgggttgacatccttaaa

SEQ ID NO: 794152 - DNA, 25 bp, Mus musculus
tatttcctggtcaacctggtggaca

SEQ ID NO: 794153 - DNA, 25 bp, Mus musculus
tatttcctggtctacctggtggaca

SEQ ID NO: 794154 - DNA, 25 bp, Mus musculus
tatttcctgtttcaacgacctaaag

SEQ ID NO: 794155 - DNA, 25 bp, Mus musculus
tatttcctgtttcatcctgtcaaca

SEQ ID NO: 794156 - DNA, 25 bp, Mus musculus
tatttcctgtttgaacgacctaaag

SEQ ID NO: 794157 - DNA, 25 bp, Mus musculus
tatttcctgtttgatcctgtcaaca

SEQ ID NO: 794158 - DNA, 25 bp, Mus musculus
tatttccttacgacagattgcaccc

SEQ ID NO: 794159 - DNA, 25 bp, Mus musculus
tatttccttacgtcagattgcaccc

SEQ ID NO: 794160 - DNA, 25 bp, Mus musculus
tatttccttcagacattaaccggcc

SEQ ID NO: 794161 - DNA, 25 bp, Mus musculus
tatttccttcagtcattaaccggcc

SEQ ID NO: 794162 - DNA, 25 bp, Mus musculus
tatttccttccactgttgtatatat

SEQ ID NO: 794163 - DNA, 25 bp, Mus musculus
tatttccttccagtgttgtatatat

SEQ ID NO: 794164 - DNA, 25 bp, Mus musculus
tatttccttctgataccttggtaat

SEQ ID NO: 794165 - DNA, 25 bp, Mus musculus
tatttccttctgttaccttggtaat

SEQ ID NO: 794166 - DNA, 25 bp, Mus musculus
tatttccttggaagaccctaatttt

SEQ ID NO: 794167 - DNA, 25 bp, Mus musculus
tatttccttggatgaccctaatttt

SEQ ID NO: 794168 - DNA, 25 bp, Mus musculus
tatttccttgtgaatcttatttggt

SEQ ID NO: 794169 - DNA, 25 bp, Mus musculus
tatttccttgtgtatcttatttggt

SEQ ID NO: 794170 - DNA, 25 bp, Mus musculus
tatttcctttcacctggttgggaag

SEQ ID NO: 794171 - DNA, 25 bp, Mus musculus
tatttcctttcagctggttgggaag

SEQ ID NO: 794172 - DNA, 25 bp, Mus musculus
tatttcctttggatgcttttcaaga

SEQ ID NO: 794173 - DNA, 25 bp, Mus musculus
tatttcctttggttgcttttcaaga

SEQ ID NO: 794174 - DNA, 25 bp, Mus musculus
tatttcgaatatcttcctgcacaga

SEQ ID NO: 794175 - DNA, 25 bp, Mus musculus
tatttcgaatatgttcctgcacaga

SEQ ID NO: 794176 - DNA, 25 bp, Mus musculus
tatttcgactttctagtcctgctag

SEQ ID NO: 794177 - DNA, 25 bp, Mus musculus
tatttcgactttgtagtcctgctag

SEQ ID NO: 794178 - DNA, 25 bp, Mus musculus
tatttcgagagaatcttccccccca

SEQ ID NO: 794179 - DNA, 25 bp, Mus musculus
tatttcgagagattcttccccccca

SEQ ID NO: 794180 - DNA, 25 bp, Mus musculus
tatttcgagcggacctcatgggact

SEQ ID NO: 794181 - DNA, 25 bp, Mus musculus
tatttcgagcggtcctcatgggact

SEQ ID NO: 794182 - DNA, 25 bp, Mus musculus
tatttcgagctgagaatcccgagct

SEQ ID NO: 794183 - DNA, 25 bp, Mus musculus
tatttcgagctgtgaatcccgagct

SEQ ID NO: 794184 - DNA, 25 bp, Mus musculus
tatttcgatgtaagggtggagatgt

SEQ ID NO: 794185 - DNA, 25 bp, Mus musculus
tatttcgatgtaagtggtcactaac

SEQ ID NO: 794186 - DNA, 25 bp, Mus musculus
tatttcgatgtatgggtggagatgt

SEQ ID NO: 794187 - DNA, 25 bp, Mus musculus
tatttcgatgtatgtggtcactaac

SEQ ID NO: 794188 - DNA, 25 bp, Mus musculus
tatttcgccttgactctgtttttaa

SEQ ID NO: 794189 - DNA, 25 bp, Mus musculus
tatttcgccttgtctctgtttttaa

SEQ ID NO: 794190 - DNA, 25 bp, Mus musculus
tatttcggaagaccatcctctctaa

SEQ ID NO: 794191 - DNA, 25 bp, Mus musculus
tatttcggaagagcatcctctctaa

SEQ ID NO: 794192 - DNA, 25 bp, Mus musculus
tatttcgtctgtatgtgtctggtat

SEQ ID NO: 794193 - DNA, 25 bp, Mus musculus
tatttcgtctgtttgtgtctggtat

SEQ ID NO: 794194 - DNA, 25 bp, Mus musculus
tatttcgttgtgcaatatcccctct

SEQ ID NO: 794195 - DNA, 25 bp, Mus musculus
tatttcgttgtggaatatcccctct

SEQ ID NO: 794196 - DNA, 25 bp, Mus musculus
tatttctaaaatccctttggtctga

SEQ ID NO: 794197 - DNA, 25 bp, Mus musculus
tatttctaaaatgcctttggtctga

SEQ ID NO: 794198 - DNA, 25 bp, Mus musculus
tatttctaacagatcattgctttgg

SEQ ID NO: 794199 - DNA, 25 bp, Mus musculus
tatttctaacagttcattgctttgg

SEQ ID NO: 794200 - DNA, 25 bp, Mus musculus
tatttctaagtaactgtgcttcagg

SEQ ID NO: 794201 - DNA, 25 bp, Mus musculus
tatttctaagtatctgtgcttcagg

SEQ ID NO: 794202 - DNA, 25 bp, Mus musculus
tatttctaattgattcctgcttttt

SEQ ID NO: 794203 - DNA, 25 bp, Mus musculus
tatttctaattgtttcctgcttttt

SEQ ID NO: 794204 - DNA, 25 bp, Mus musculus
tatttctactctcaccctgagagac

SEQ ID NO: 794205 - DNA, 25 bp, Mus musculus
tatttctactctgaccctgagagac

SEQ ID NO: 794206 - DNA, 25 bp, Mus musculus
tatttctagtgtatgaccagtgctt

SEQ ID NO: 794207 - DNA, 25 bp, Mus musculus
tatttctagtgtttgaccagtgctt

SEQ ID NO: 794208 - DNA, 25 bp, Mus musculus
tatttctatctcagcagtctgtaaa

SEQ ID NO: 794209 - DNA, 25 bp, Mus musculus
tatttctatctctgcagtctgtaaa

SEQ ID NO: 794210 - DNA, 25 bp, Mus musculus
tatttctattctacacactggaact

SEQ ID NO: 794211 - DNA, 25 bp, Mus musculus
tatttctattcttcacactggaact

SEQ ID NO: 794212 - DNA, 25 bp, Mus musculus
tatttctcacctccaggtgcttgag

SEQ ID NO: 794213 - DNA, 25 bp, Mus musculus
tatttctcacctgcaggtgcttgag

SEQ ID NO: 794214 - DNA, 25 bp, Mus musculus
tatttctcagagaactagcctagca

SEQ ID NO: 794215 - DNA, 25 bp, Mus musculus
tatttctcagagtactagcctagca

SEQ ID NO: 794216 - DNA, 25 bp, Mus musculus
tatttctcagggaacctatgcggga

SEQ ID NO: 794217 - DNA, 25 bp, Mus musculus
tatttctcagggtacctatgcggga

SEQ ID NO: 794218 - DNA, 25 bp, Mus musculus
tatttctcatccaattgacatccct

SEQ ID NO: 794219 - DNA, 25 bp, Mus musculus
tatttctcatcctattgacatccct

SEQ ID NO: 794220 - DNA, 25 bp, Mus musculus
tatttctcattccaagtcccaatac

SEQ ID NO: 794221 - DNA, 25 bp, Mus musculus
tatttctcattcgaagtcccaatac

SEQ ID NO: 794222 - DNA, 25 bp, Mus musculus
tatttctccaagcactttcatttca

SEQ ID NO: 794223 - DNA, 25 bp, Mus musculus
tatttctccaaggactttcatttca

SEQ ID NO: 794224 - DNA, 25 bp, Mus musculus
tatttctccagcaacactaagttgt

SEQ ID NO: 794225 - DNA, 25 bp, Mus musculus
tatttctccagctacactaagttgt

SEQ ID NO: 794226 - DNA, 25 bp, Mus musculus
tatttctccctcacaaggatccggg

SEQ ID NO: 794227 - DNA, 25 bp, Mus musculus
tatttctccctctcaaggatccggg

SEQ ID NO: 794228 - DNA, 25 bp, Mus musculus
tatttctccgtaactgcatccatca

SEQ ID NO: 794229 - DNA, 25 bp, Mus musculus
tatttctccgtatctgcatccatca

SEQ ID NO: 794230 - DNA, 25 bp, Mus musculus
tatttctctagccttgggatattgt

SEQ ID NO: 794231 - DNA, 25 bp, Mus musculus
tatttctctagcgttgggatattgt

SEQ ID NO: 794232 - DNA, 25 bp, Mus musculus
tatttctctataactgtgttcctag

SEQ ID NO: 794233 - DNA, 25 bp, Mus musculus
tatttctctatatctgtgttcctag

SEQ ID NO: 794234 - DNA, 25 bp, Mus musculus
tatttctctcttacaattggctcct

SEQ ID NO: 794235 - DNA, 25 bp, Mus musculus
tatttctctctttcaattggctcct

SEQ ID NO: 794236 - DNA, 25 bp, Mus musculus
tatttctctggaagttggcacgccc

SEQ ID NO: 794237 - DNA, 25 bp, Mus musculus
tatttctctggatgttggcacgccc

SEQ ID NO: 794238 - DNA, 25 bp, Mus musculus
tatttctctgtccatcaccaatggt

SEQ ID NO: 794239 - DNA, 25 bp, Mus musculus
tatttctctgtcgatcaccaatggt

SEQ ID NO: 794240 - DNA, 25 bp, Mus musculus
tatttctctttacatttgcttccat

SEQ ID NO: 794241 - DNA, 25 bp, Mus musculus
tatttctctttagatttgcttccat

SEQ ID NO: 794242 - DNA, 25 bp, Mus musculus
tatttctgaatcatgtaacaaccaa

SEQ ID NO: 794243 - DNA, 25 bp, Mus musculus
tatttctgaatcttgtaacaaccaa

SEQ ID NO: 794244 - DNA, 25 bp, Mus musculus
tatttctgactgctcctattttctg

SEQ ID NO: 794245 - DNA, 25 bp, Mus musculus
tatttctgactggtcctattttctg

SEQ ID NO: 794246 - DNA, 25 bp, Mus musculus
tatttctgacttccccataactgtg

SEQ ID NO: 794247 - DNA, 25 bp, Mus musculus
tatttctgacttgcccataactgtg

SEQ ID NO: 794248 - DNA, 25 bp, Mus musculus
tatttctgcattccgtgaggctgaa

SEQ ID NO: 794249 - DNA, 25 bp, Mus musculus
tatttctgcattgcgtgaggctgaa

SEQ ID NO: 794250 - DNA, 25 bp, Mus musculus
tatttctgctcaactttgttttctc

SEQ ID NO: 794251 - DNA, 25 bp, Mus musculus
tatttctgctcatctttgttttctc

SEQ ID NO: 794252 - DNA, 25 bp, Mus musculus
tatttctggatcacctgttgtgtct

SEQ ID NO: 794253 - DNA, 25 bp, Mus musculus
tatttctggatctcctgttgtgtct

SEQ ID NO: 794254 - DNA, 25 bp, Mus musculus
tatttctgggtgattgcgagcctga

SEQ ID NO: 794255 - DNA, 25 bp, Mus musculus
tatttctgggtgtttgcgagcctga

SEQ ID NO: 794256 - DNA, 25 bp, Mus musculus
tatttctggtcacttttttctctct

SEQ ID NO: 794257 - DNA, 25 bp, Mus musculus
tatttctggtcagttttttctctct

SEQ ID NO: 794258 - DNA, 25 bp, Mus musculus
tatttctgtgacctatggaacccat

SEQ ID NO: 794259 - DNA, 25 bp, Mus musculus
tatttctgtgacgtatggaacccat

SEQ ID NO: 794260 - DNA, 25 bp, Mus musculus
tatttctgtgttctgctctttgagc

SEQ ID NO: 794261 - DNA, 25 bp, Mus musculus
tatttctgtgttgtgctctttgagc

SEQ ID NO: 794262 - DNA, 25 bp, Mus musculus
tatttctgttaacggattcattcac

SEQ ID NO: 794263 - DNA, 25 bp, Mus musculus
tatttctgttaagggattcattcac

SEQ ID NO: 794264 - DNA, 25 bp, Mus musculus
tatttcttcccgattagtgacctct

SEQ ID NO: 794265 - DNA, 25 bp, Mus musculus
tatttcttcccgtttagtgacctct

SEQ ID NO: 794266 - DNA, 25 bp, Mus musculus
tatttcttccgtactacaggacctt

SEQ ID NO: 794267 - DNA, 25 bp, Mus musculus
tatttcttccgttctacaggacctt

SEQ ID NO: 794268 - DNA, 25 bp, Mus musculus
tatttcttcttaagtcttggacagt

SEQ ID NO: 794269 - DNA, 25 bp, Mus musculus
tatttcttcttatgtcttggacagt

SEQ ID NO: 794270 - DNA, 25 bp, Mus musculus
tatttcttcttgaacctgcaaatga

SEQ ID NO: 794271 - DNA, 25 bp, Mus musculus
tatttcttcttgaggtgttcttttc

SEQ ID NO: 794272 - DNA, 25 bp, Mus musculus
tatttcttcttgtacctgcaaatga

SEQ ID NO: 794273 - DNA, 25 bp, Mus musculus
tatttcttcttgtggtgttcttttc

SEQ ID NO: 794274 - DNA, 25 bp, Mus musculus
tatttcttgataaaactgtctttgc

SEQ ID NO: 794275 - DNA, 25 bp, Mus musculus
tatttcttgatataactgtctttgc

SEQ ID NO: 794276 - DNA, 25 bp, Mus musculus
tatttcttgcaaccattctcctcag

SEQ ID NO: 794277 - DNA, 25 bp, Mus musculus
tatttcttgcaagcattctcctcag

SEQ ID NO: 794278 - DNA, 25 bp, Mus musculus
tatttcttgcccctgaaaaccacac

SEQ ID NO: 794279 - DNA, 25 bp, Mus musculus
tatttcttgcccgtgaaaaccacac

SEQ ID NO: 794280 - DNA, 25 bp, Mus musculus
tatttcttgcgcctctgattttatt

SEQ ID NO: 794281 - DNA, 25 bp, Mus musculus
tatttcttgcgcgtctgattttatt

SEQ ID NO: 794282 - DNA, 25 bp, Mus musculus
tatttcttgctcaacattctgccat

SEQ ID NO: 794283 - DNA, 25 bp, Mus musculus
tatttcttgctctacattctgccat

SEQ ID NO: 794284 - DNA, 25 bp, Mus musculus
tatttcttggctctatatcctattc

SEQ ID NO: 794285 - DNA, 25 bp, Mus musculus
tatttcttggctgtatatcctattc

SEQ ID NO: 794286 - DNA, 25 bp, Mus musculus
tatttcttgggacggcatttatgcc

SEQ ID NO: 794287 - DNA, 25 bp, Mus musculus
tatttcttgggagggcatttatgcc

SEQ ID NO: 794288 - DNA, 25 bp, Mus musculus
tatttcttgtctaccaaccctagga

SEQ ID NO: 794289 - DNA, 25 bp, Mus musculus
tatttcttgtcttccaaccctagga

SEQ ID NO: 794290 - DNA, 25 bp, Mus musculus
tatttctttcacactatagcctgat

SEQ ID NO: 794291 - DNA, 25 bp, Mus musculus
tatttctttcactctatagcctgat

SEQ ID NO: 794292 - DNA, 25 bp, Mus musculus
tatttctttcttagcaagtcctgcc

SEQ ID NO: 794293 - DNA, 25 bp, Mus musculus
tatttctttctttgcaagtcctgcc

SEQ ID NO: 794294 - DNA, 25 bp, Mus musculus
tatttctttggtagttgctgctaaa

SEQ ID NO: 794295 - DNA, 25 bp, Mus musculus
tatttctttggttgttgctgctaaa

SEQ ID NO: 794296 - DNA, 25 bp, Mus musculus
tatttcttttaaacgtcgcccggag

SEQ ID NO: 794297 - DNA, 25 bp, Mus musculus
tatttcttttaatcgtcgcccggag

SEQ ID NO: 794298 - DNA, 25 bp, Mus musculus
tatttgaaccgcagtcttcaagtcc

SEQ ID NO: 794299 - DNA, 25 bp, Mus musculus
tatttgaaccgctgtcttcaagtcc

SEQ ID NO: 794300 - DNA, 25 bp, Mus musculus
tatttgaacctaagtggatcctggc

SEQ ID NO: 794301 - DNA, 25 bp, Mus musculus
tatttgaacctatgtggatcctggc

SEQ ID NO: 794302 - DNA, 25 bp, Mus musculus
tatttgaacgttaagcagaacccct

SEQ ID NO: 794303 - DNA, 25 bp, Mus musculus
tatttgaacgtttagcagaacccct

SEQ ID NO: 794304 - DNA, 25 bp, Mus musculus
tatttgaaggcaacaagcaccccaa

SEQ ID NO: 794305 - DNA, 25 bp, Mus musculus
tatttgaaggcatcaagcaccccaa

SEQ ID NO: 794306 - DNA, 25 bp, Mus musculus
tatttgaagtgtcatgcctgttacc

SEQ ID NO: 794307 - DNA, 25 bp, Mus musculus
tatttgaagtgtgatgcctgttacc

SEQ ID NO: 794308 - DNA, 25 bp, Mus musculus
tatttgaatcaaaggcctgggagcg

SEQ ID NO: 794309 - DNA, 25 bp, Mus musculus
tatttgaatcaatggcctgggagcg

SEQ ID NO: 794310 - DNA, 25 bp, Mus musculus
tatttgaatgaccttggccaccagc

SEQ ID NO: 794311 - DNA, 25 bp, Mus musculus
tatttgaatgacgttggccaccagc

SEQ ID NO: 794312 - DNA, 25 bp, Mus musculus
tatttgaatgctctgttcctggttg

SEQ ID NO: 794313 - DNA, 25 bp, Mus musculus
tatttgaatgctgtgttcctggttg

SEQ ID NO: 794314 - DNA, 25 bp, Mus musculus
tatttgaattgaagcagcccctcct

SEQ ID NO: 794315 - DNA, 25 bp, Mus musculus
tatttgaattgatgcagcccctcct

SEQ ID NO: 794316 - DNA, 25 bp, Mus musculus
tatttgacaactctctgcacattcc

SEQ ID NO: 794317 - DNA, 25 bp, Mus musculus
tatttgacaactgtctgcacattcc

SEQ ID NO: 794318 - DNA, 25 bp, Mus musculus
tatttgacccaacacaaggaggcct

SEQ ID NO: 794319 - DNA, 25 bp, Mus musculus
tatttgacccaagacaaggaggcct

SEQ ID NO: 794320 - DNA, 25 bp, Mus musculus
tatttgactctaatctttgcatttc

SEQ ID NO: 794321 - DNA, 25 bp, Mus musculus
tatttgactctattctttgcatttc

SEQ ID NO: 794322 - DNA, 25 bp, Mus musculus
tatttgactgtaccatgatgaaccg

SEQ ID NO: 794323 - DNA, 25 bp, Mus musculus
tatttgactgtagcatgatgaaccg

SEQ ID NO: 794324 - DNA, 25 bp, Mus musculus
tatttgacttggactgtaggccaga

SEQ ID NO: 794325 - DNA, 25 bp, Mus musculus
tatttgacttggtctgtaggccaga

SEQ ID NO: 794326 - DNA, 25 bp, Mus musculus
tatttgagacttcagtcagggtttc

SEQ ID NO: 794327 - DNA, 25 bp, Mus musculus
tatttgagacttgagtcagggtttc

SEQ ID NO: 794328 - DNA, 25 bp, Mus musculus
tatttgagagccacctagtttccag

SEQ ID NO: 794329 - DNA, 25 bp, Mus musculus
tatttgagagcctcctagtttccag

SEQ ID NO: 794330 - DNA, 25 bp, Mus musculus
tatttgagccagctcatggtgacat

SEQ ID NO: 794331 - DNA, 25 bp, Mus musculus
tatttgagccaggtcatggtgacat

SEQ ID NO: 794332 - DNA, 25 bp, Mus musculus
tatttgagcccacgttatgtaaaaa

SEQ ID NO: 794333 - DNA, 25 bp, Mus musculus
tatttgagcccaggttatgtaaaaa

SEQ ID NO: 794334 - DNA, 25 bp, Mus musculus
tatttgagccttaccaacttgggcc

SEQ ID NO: 794335 - DNA, 25 bp, Mus musculus
tatttgagccttctgcatactttgg

SEQ ID NO: 794336 - DNA, 25 bp, Mus musculus
tatttgagccttgtgcatactttgg

SEQ ID NO: 794337 - DNA, 25 bp, Mus musculus
tatttgagcctttccaacttgggcc

SEQ ID NO: 794338 - DNA, 25 bp, Mus musculus
tatttgagctttcacgccagatgca

SEQ ID NO: 794339 - DNA, 25 bp, Mus musculus
tatttgagctttgacgccagatgca

SEQ ID NO: 794340 - DNA, 25 bp, Mus musculus
tatttgagggctcggctgactgaaa

SEQ ID NO: 794341 - DNA, 25 bp, Mus musculus
tatttgagggctgggctgactgaaa

SEQ ID NO: 794342 - DNA, 25 bp, Mus musculus
tatttgataaatcgaacttcatgaa

SEQ ID NO: 794343 - DNA, 25 bp, Mus musculus
tatttgataaatggaacttcatgaa

SEQ ID NO: 794344 - DNA, 25 bp, Mus musculus
tatttgatcttcatgccagctggta

SEQ ID NO: 794345 - DNA, 25 bp, Mus musculus
tatttgatcttcttgccagctggta

SEQ ID NO: 794346 - DNA, 25 bp, Mus musculus
tatttgatgttcacggtccgctcag

SEQ ID NO: 794347 - DNA, 25 bp, Mus musculus
tatttgatgttctcggtccgctcag

SEQ ID NO: 794348 - DNA, 25 bp, Mus musculus
tatttgatttatcagtgctgcaaag

SEQ ID NO: 794349 - DNA, 25 bp, Mus musculus
tatttgatttatgagtgctgcaaag

SEQ ID NO: 794350 - DNA, 25 bp, Mus musculus
tatttgcaacctcatcctaggaaat

SEQ ID NO: 794351 - DNA, 25 bp, Mus musculus
tatttgcaacctgatcctaggaaat

SEQ ID NO: 794352 - DNA, 25 bp, Mus musculus
tatttgcaacttcccgggcgtggta

SEQ ID NO: 794353 - DNA, 25 bp, Mus musculus
tatttgcaacttgccgggcgtggta

SEQ ID NO: 794354 - DNA, 25 bp, Mus musculus
tatttgcaagcaaatcggtaactaa

SEQ ID NO: 794355 - DNA, 25 bp, Mus musculus
tatttgcaagcatatcggtaactaa

SEQ ID NO: 794356 - DNA, 25 bp, Mus musculus
tatttgcaaggtctctctccacgca

SEQ ID NO: 794357 - DNA, 25 bp, Mus musculus
tatttgcaaggtgtctctccacgca

SEQ ID NO: 794358 - DNA, 25 bp, Mus musculus
tatttgcacaacattaaaccagatg

SEQ ID NO: 794359 - DNA, 25 bp, Mus musculus
tatttgcacaactttaaaccagatg

SEQ ID NO: 794360 - DNA, 25 bp, Mus musculus
tatttgcacattcacaccaatccaa

SEQ ID NO: 794361 - DNA, 25 bp, Mus musculus
tatttgcacattcgagtgaactgga

SEQ ID NO: 794362 - DNA, 25 bp, Mus musculus
tatttgcacattgacaccaatccaa

SEQ ID NO: 794363 - DNA, 25 bp, Mus musculus
tatttgcacattggagtgaactgga

SEQ ID NO: 794364 - DNA, 25 bp, Mus musculus
tatttgcacccaactagtcaaccct

SEQ ID NO: 794365 - DNA, 25 bp, Mus musculus
tatttgcacccatctagtcaaccct

SEQ ID NO: 794366 - DNA, 25 bp, Mus musculus
tatttgcagacaccgctggagggcc

SEQ ID NO: 794367 - DNA, 25 bp, Mus musculus
tatttgcagacagcgctggagggcc

SEQ ID NO: 794368 - DNA, 25 bp, Mus musculus
tatttgcagctacgccctatcctga

SEQ ID NO: 794369 - DNA, 25 bp, Mus musculus
tatttgcagctaggccctatcctga

SEQ ID NO: 794370 - DNA, 25 bp, Mus musculus
tatttgcatccaatgtatgtacatg

SEQ ID NO: 794371 - DNA, 25 bp, Mus musculus
tatttgcatccattgtatgtacatg

SEQ ID NO: 794372 - DNA, 25 bp, Mus musculus
tatttgcatcttcactctcagtcat

SEQ ID NO: 794373 - DNA, 25 bp, Mus musculus
tatttgcatcttgactctcagtcat

SEQ ID NO: 794374 - DNA, 25 bp, Mus musculus
tatttgccaagaatcaatagaaaaa

SEQ ID NO: 794375 - DNA, 25 bp, Mus musculus
tatttgccaagattcaatagaaaaa

SEQ ID NO: 794376 - DNA, 25 bp, Mus musculus
tatttgccaagtattcttagatgaa

SEQ ID NO: 794377 - DNA, 25 bp, Mus musculus
tatttgccaagttttcttagatgaa

SEQ ID NO: 794378 - DNA, 25 bp, Mus musculus
tatttgccacccataaagtctcgtt

SEQ ID NO: 794379 - DNA, 25 bp, Mus musculus
tatttgccacccttaaagtctcgtt

SEQ ID NO: 794380 - DNA, 25 bp, Mus musculus
tatttgcccgccctggagattatag

SEQ ID NO: 794381 - DNA, 25 bp, Mus musculus
tatttgcccgccgtggagattatag

SEQ ID NO: 794382 - DNA, 25 bp, Mus musculus
tatttgccctaccatggacagactt

SEQ ID NO: 794383 - DNA, 25 bp, Mus musculus
tatttgccctacgatggacagactt

SEQ ID NO: 794384 - DNA, 25 bp, Mus musculus
tatttgcccttaactgaaccgcctt

SEQ ID NO: 794385 - DNA, 25 bp, Mus musculus
tatttgcccttatctgaaccgcctt

SEQ ID NO: 794386 - DNA, 25 bp, Mus musculus
tatttgcctcaaaagctgatgactt

SEQ ID NO: 794387 - DNA, 25 bp, Mus musculus
tatttgcctcaatagctgatgactt

SEQ ID NO: 794388 - DNA, 25 bp, Mus musculus
tatttgcctcttctgaccctgtcct

SEQ ID NO: 794389 - DNA, 25 bp, Mus musculus
tatttgcctcttgtgaccctgtcct

SEQ ID NO: 794390 - DNA, 25 bp, Mus musculus
tatttgccttccactccaatttttt

SEQ ID NO: 794391 - DNA, 25 bp, Mus musculus
tatttgccttcctctccaatttttt

SEQ ID NO: 794392 - DNA, 25 bp, Mus musculus
tatttgccttcgcaactagatgtag

SEQ ID NO: 794393 - DNA, 25 bp, Mus musculus
tatttgccttcggaactagatgtag

SEQ ID NO: 794394 - DNA, 25 bp, Mus musculus
tatttgcgggccagtgttagggaat

SEQ ID NO: 794395 - DNA, 25 bp, Mus musculus
tatttgcgggcctgtgttagggaat

SEQ ID NO: 794396 - DNA, 25 bp, Mus musculus
tatttgctaaaccttccactgacgt

SEQ ID NO: 794397 - DNA, 25 bp, Mus musculus
tatttgctaaacgttccactgacgt

SEQ ID NO: 794398 - DNA, 25 bp, Mus musculus
tatttgctactgcattgttcctcgc

SEQ ID NO: 794399 - DNA, 25 bp, Mus musculus
tatttgctactggattgttcctcgc

SEQ ID NO: 794400 - DNA, 25 bp, Mus musculus
tatttgctagatctggagagtggcc

SEQ ID NO: 794401 - DNA, 25 bp, Mus musculus
tatttgctagatgtggagagtggcc

SEQ ID NO: 794402 - DNA, 25 bp, Mus musculus
tatttgctatcaatgccttttctga

SEQ ID NO: 794403 - DNA, 25 bp, Mus musculus
tatttgctatcattgccttttctga

SEQ ID NO: 794404 - DNA, 25 bp, Mus musculus
tatttgctcaaaattgtacatatgg

SEQ ID NO: 794405 - DNA, 25 bp, Mus musculus
tatttgctcaaatttgtacatatgg

SEQ ID NO: 794406 - DNA, 25 bp, Mus musculus
tatttgctcaacaggcatctttcta

SEQ ID NO: 794407 - DNA, 25 bp, Mus musculus
tatttgctcaactggcatctttcta

SEQ ID NO: 794408 - DNA, 25 bp, Mus musculus
tatttgctcaataccctactgggct

SEQ ID NO: 794409 - DNA, 25 bp, Mus musculus
tatttgctcaattccctactgggct

SEQ ID NO: 794410 - DNA, 25 bp, Mus musculus
tatttgctccctactgacttcatac

SEQ ID NO: 794411 - DNA, 25 bp, Mus musculus
tatttgctcccttctgacttcatac

SEQ ID NO: 794412 - DNA, 25 bp, Mus musculus
tatttgctctagaaggcctatctcc

SEQ ID NO: 794413 - DNA, 25 bp, Mus musculus
tatttgctctagtaggcctatctcc

SEQ ID NO: 794414 - DNA, 25 bp, Mus musculus
tatttgctctctatttacgtaacta

SEQ ID NO: 794415 - DNA, 25 bp, Mus musculus
tatttgctctctcgatccctggtct

SEQ ID NO: 794416 - DNA, 25 bp, Mus musculus
tatttgctctctggatccctggtct

SEQ ID NO: 794417 - DNA, 25 bp, Mus musculus
tatttgctctctttttacgtaacta

SEQ ID NO: 794418 - DNA, 25 bp, Mus musculus
tatttgctcttcaccttgactctgc

SEQ ID NO: 794419 - DNA, 25 bp, Mus musculus
tatttgctcttctccttgactctgc

SEQ ID NO: 794420 - DNA, 25 bp, Mus musculus
tatttgctgtgcatctgtattccat

SEQ ID NO: 794421 - DNA, 25 bp, Mus musculus
tatttgctgtgcttctgtattccat

SEQ ID NO: 794422 - DNA, 25 bp, Mus musculus
tatttgctgttcacctgaagaccct

SEQ ID NO: 794423 - DNA, 25 bp, Mus musculus
tatttgctgttctcctgaagaccct

SEQ ID NO: 794424 - DNA, 25 bp, Mus musculus
tatttgcttatcataggctgctatt

SEQ ID NO: 794425 - DNA, 25 bp, Mus musculus
tatttgcttatcttaggctgctatt

SEQ ID NO: 794426 - DNA, 25 bp, Mus musculus
tatttgcttctcattctgtaacttt

SEQ ID NO: 794427 - DNA, 25 bp, Mus musculus
tatttgcttctctttctgtaacttt

SEQ ID NO: 794428 - DNA, 25 bp, Mus musculus
tatttgcttgctcgaaaatcacacc

SEQ ID NO: 794429 - DNA, 25 bp, Mus musculus
tatttgcttgctggaaaatcacacc

SEQ ID NO: 794430 - DNA, 25 bp, Mus musculus
tatttggaagggagttcaaggcttt

SEQ ID NO: 794431 - DNA, 25 bp, Mus musculus
tatttggaagggtgttcaaggcttt

SEQ ID NO: 794432 - DNA, 25 bp, Mus musculus
tatttggaagtaaccaaccatggcc

SEQ ID NO: 794433 - DNA, 25 bp, Mus musculus
tatttggaagtatccaaccatggcc

SEQ ID NO: 794434 - DNA, 25 bp, Mus musculus
tatttggaatgaactacgtgggttt

SEQ ID NO: 794435 - DNA, 25 bp, Mus musculus
tatttggaatgatctacgtgggttt

SEQ ID NO: 794436 - DNA, 25 bp, Mus musculus
tatttggacctgagacgatgcctca

SEQ ID NO: 794437 - DNA, 25 bp, Mus musculus
tatttggacctgtgacgatgcctca

SEQ ID NO: 794438 - DNA, 25 bp, Mus musculus
tatttggatgcgagtgagcctcagc

SEQ ID NO: 794439 - DNA, 25 bp, Mus musculus
tatttggatgcgtgtgagcctcagc

SEQ ID NO: 794440 - DNA, 25 bp, Mus musculus
tatttggatgttagtgtttcgctca

SEQ ID NO: 794441 - DNA, 25 bp, Mus musculus
tatttggatgtttgtgtttcgctca

SEQ ID NO: 794442 - DNA, 25 bp, Mus musculus
tatttggattgcacctagctgactg

SEQ ID NO: 794443 - DNA, 25 bp, Mus musculus
tatttggattgctcctagctgactg

SEQ ID NO: 794444 - DNA, 25 bp, Mus musculus
tatttggcacgaacacctgaggatc

SEQ ID NO: 794445 - DNA, 25 bp, Mus musculus
tatttggcacgatcacctgaggatc

SEQ ID NO: 794446 - DNA, 25 bp, Mus musculus
tatttggcccaaagcttcttcttgt

SEQ ID NO: 794447 - DNA, 25 bp, Mus musculus
tatttggcccaatgcttcttcttgt

SEQ ID NO: 794448 - DNA, 25 bp, Mus musculus
tatttggcctacatagaagcatggt

SEQ ID NO: 794449 - DNA, 25 bp, Mus musculus
tatttggcctacttagaagcatggt

SEQ ID NO: 794450 - DNA, 25 bp, Mus musculus
tatttggcctagatgtctcattgcg

SEQ ID NO: 794451 - DNA, 25 bp, Mus musculus
tatttggcctagttgtctcattgcg

SEQ ID NO: 794452 - DNA, 25 bp, Mus musculus
tatttggcgtttaagcccaggtctt

SEQ ID NO: 794453 - DNA, 25 bp, Mus musculus
tatttggcgttttagcccaggtctt

SEQ ID NO: 794454 - DNA, 25 bp, Mus musculus
tatttggctactactggcgccagca

SEQ ID NO: 794455 - DNA, 25 bp, Mus musculus
tatttggctacttctggcgccagca

SEQ ID NO: 794456 - DNA, 25 bp, Mus musculus
tatttggctcttccagcctcaggca

SEQ ID NO: 794457 - DNA, 25 bp, Mus musculus
tatttggctcttgcagcctcaggca

SEQ ID NO: 794458 - DNA, 25 bp, Mus musculus
tatttggctgtcacttcaagtttca

SEQ ID NO: 794459 - DNA, 25 bp, Mus musculus
tatttggctgtctcttcaagtttca

SEQ ID NO: 794460 - DNA, 25 bp, Mus musculus
tatttggcttggatacaggcacaga

SEQ ID NO: 794461 - DNA, 25 bp, Mus musculus
tatttggcttggttacaggcacaga

SEQ ID NO: 794462 - DNA, 25 bp, Mus musculus
tatttgggacatcaggaccaggcat

SEQ ID NO: 794463 - DNA, 25 bp, Mus musculus
tatttgggacatgaggaccaggcat

SEQ ID NO: 794464 - DNA, 25 bp, Mus musculus
tatttgggactcaccttctgaactg

SEQ ID NO: 794465 - DNA, 25 bp, Mus musculus
tatttgggactctccttctgaactg

SEQ ID NO: 794466 - DNA, 25 bp, Mus musculus
tatttgggagctacttaaacagatt

SEQ ID NO: 794467 - DNA, 25 bp, Mus musculus
tatttgggagcttcttaaacagatt

SEQ ID NO: 794468 - DNA, 25 bp, Mus musculus
tatttgggatctaatgtggactctc

SEQ ID NO: 794469 - DNA, 25 bp, Mus musculus
tatttgggatcttatgtggactctc

SEQ ID NO: 794470 - DNA, 25 bp, Mus musculus
tatttgggattaccccggaggcctg

SEQ ID NO: 794471 - DNA, 25 bp, Mus musculus
tatttgggattagcccggaggcctg

SEQ ID NO: 794472 - DNA, 25 bp, Mus musculus
tatttgggcactagattggatacct

SEQ ID NO: 794473 - DNA, 25 bp, Mus musculus
tatttgggcacttgattggatacct

SEQ ID NO: 794474 - DNA, 25 bp, Mus musculus
tatttgggcccaaacaggtagatga

SEQ ID NO: 794475 - DNA, 25 bp, Mus musculus
tatttgggcccatacaggtagatga

SEQ ID NO: 794476 - DNA, 25 bp, Mus musculus
tatttgggtcatctttggccaccac

SEQ ID NO: 794477 - DNA, 25 bp, Mus musculus
tatttgggtcatgtttggccaccac

SEQ ID NO: 794478 - DNA, 25 bp, Mus musculus
tatttggtcagtagacaaagggcaa

SEQ ID NO: 794479 - DNA, 25 bp, Mus musculus
tatttggtcagttgacaaagggcaa

SEQ ID NO: 794480 - DNA, 25 bp, Mus musculus
tatttggtcccaagtgttacattat

SEQ ID NO: 794481 - DNA, 25 bp, Mus musculus
tatttggtcccatgtgttacattat

SEQ ID NO: 794482 - DNA, 25 bp, Mus musculus
tatttggtcgccctcggctgcgcta

SEQ ID NO: 794483 - DNA, 25 bp, Mus musculus
tatttggtcgccgtcggctgcgcta

SEQ ID NO: 794484 - DNA, 25 bp, Mus musculus
tatttggtcgtgaaatacctcacag

SEQ ID NO: 794485 - DNA, 25 bp, Mus musculus
tatttggtcgtgtaatacctcacag

SEQ ID NO: 794486 - DNA, 25 bp, Mus musculus
tatttggtctcaaccaactttccag

SEQ ID NO: 794487 - DNA, 25 bp, Mus musculus
tatttggtctcatccaactttccag

SEQ ID NO: 794488 - DNA, 25 bp, Mus musculus
tatttggtctccacatatgtactac

SEQ ID NO: 794489 - DNA, 25 bp, Mus musculus
tatttggtctcctcatatgtactac

SEQ ID NO: 794490 - DNA, 25 bp, Mus musculus
tatttggtgaccataaatgtagaga

SEQ ID NO: 794491 - DNA, 25 bp, Mus musculus
tatttggtgaccttaaatgtagaga

SEQ ID NO: 794492 - DNA, 25 bp, Mus musculus
tatttggtgatcactgcacctgggt

SEQ ID NO: 794493 - DNA, 25 bp, Mus musculus
tatttggtgatctctgcacctgggt

SEQ ID NO: 794494 - DNA, 25 bp, Mus musculus
tatttggtggccacgtgggtttcac

SEQ ID NO: 794495 - DNA, 25 bp, Mus musculus
tatttggtggcctcgtgggtttcac

SEQ ID NO: 794496 - DNA, 25 bp, Mus musculus
tatttggtgtcgaggaacctcttac

SEQ ID NO: 794497 - DNA, 25 bp, Mus musculus
tatttggtgtcgtggaacctcttac

SEQ ID NO: 794498 - DNA, 25 bp, Mus musculus
tatttggttaccagtgtagtcctgg

SEQ ID NO: 794499 - DNA, 25 bp, Mus musculus
tatttggttacctgtgtagtcctgg

SEQ ID NO: 794500 - DNA, 25 bp, Mus musculus
tatttggttatgacctctcctagat

SEQ ID NO: 794501 - DNA, 25 bp, Mus musculus
tatttggttatgacttggttgtttt

SEQ ID NO: 794502 - DNA, 25 bp, Mus musculus
tatttggttatgtcctctcctagat

SEQ ID NO: 794503 - DNA, 25 bp, Mus musculus
tatttggttatgtcttggttgtttt

SEQ ID NO: 794504 - DNA, 25 bp, Mus musculus
tatttggttggcatgtgtgactatt

SEQ ID NO: 794505 - DNA, 25 bp, Mus musculus
tatttggttggcttgtgtgactatt

SEQ ID NO: 794506 - DNA, 25 bp, Mus musculus
tatttgtaaaaaccctagccgggcg

SEQ ID NO: 794507 - DNA, 25 bp, Mus musculus
tatttgtaaaaagcctagccgggcg

SEQ ID NO: 794508 - DNA, 25 bp, Mus musculus
tatttgtaaagcaccatttggcatg

SEQ ID NO: 794509 - DNA, 25 bp, Mus musculus
tatttgtaaagctccatttggcatg

SEQ ID NO: 794510 - DNA, 25 bp, Mus musculus
tatttgtaagcacctgtcgctcagc

SEQ ID NO: 794511 - DNA, 25 bp, Mus musculus
tatttgtaagcagctgtcgctcagc

SEQ ID NO: 794512 - DNA, 25 bp, Mus musculus
tatttgtaatagaatccaccaaggg

SEQ ID NO: 794513 - DNA, 25 bp, Mus musculus
tatttgtaatagtatccaccaaggg

SEQ ID NO: 794514 - DNA, 25 bp, Mus musculus
tatttgtaatcacatctggtgtcct

SEQ ID NO: 794515 - DNA, 25 bp, Mus musculus
tatttgtaatcagatctggtgtcct

SEQ ID NO: 794516 - DNA, 25 bp, Mus musculus
tatttgtagacaaggcattgctgga

SEQ ID NO: 794517 - DNA, 25 bp, Mus musculus
tatttgtagacatggcattgctgga

SEQ ID NO: 794518 - DNA, 25 bp, Mus musculus
tatttgtagcatctctcaatcgccc

SEQ ID NO: 794519 - DNA, 25 bp, Mus musculus
tatttgtagcatgtctcaatcgccc

SEQ ID NO: 794520 - DNA, 25 bp, Mus musculus
tatttgtagccgaaaagttgtcttt

SEQ ID NO: 794521 - DNA, 25 bp, Mus musculus
tatttgtagccgtaaagttgtcttt

SEQ ID NO: 794522 - DNA, 25 bp, Mus musculus
tatttgtagcctcgtgatatcccct

SEQ ID NO: 794523 - DNA, 25 bp, Mus musculus
tatttgtagcctggtgatatcccct

SEQ ID NO: 794524 - DNA, 25 bp, Mus musculus
tatttgtatagaattgcttattccg

SEQ ID NO: 794525 - DNA, 25 bp, Mus musculus
tatttgtatagatttgcttattccg

SEQ ID NO: 794526 - DNA, 25 bp, Mus musculus
tatttgtatcccagccacatatcat

SEQ ID NO: 794527 - DNA, 25 bp, Mus musculus
tatttgtatccctgccacatatcat

SEQ ID NO: 794528 - DNA, 25 bp, Mus musculus
tatttgtcaatgagcagtttcctca

SEQ ID NO: 794529 - DNA, 25 bp, Mus musculus
tatttgtcaatgtgcagtttcctca

SEQ ID NO: 794530 - DNA, 25 bp, Mus musculus
tatttgtcactaatgcatgcagctc

SEQ ID NO: 794531 - DNA, 25 bp, Mus musculus
tatttgtcactattgcatgcagctc

SEQ ID NO: 794532 - DNA, 25 bp, Mus musculus
tatttgtcactgcattcataatttg

SEQ ID NO: 794533 - DNA, 25 bp, Mus musculus
tatttgtcactggattcataatttg

SEQ ID NO: 794534 - DNA, 25 bp, Mus musculus
tatttgtcaggcactctgaggattc

SEQ ID NO: 794535 - DNA, 25 bp, Mus musculus
tatttgtcaggctctctgaggattc

SEQ ID NO: 794536 - DNA, 25 bp, Mus musculus
tatttgtcaggtcgttttgcccctg

SEQ ID NO: 794537 - DNA, 25 bp, Mus musculus
tatttgtcaggtggttttgcccctg

SEQ ID NO: 794538 - DNA, 25 bp, Mus musculus
tatttgtccaatctctgaccatggg

SEQ ID NO: 794539 - DNA, 25 bp, Mus musculus
tatttgtccaatgtctgaccatggg

SEQ ID NO: 794540 - DNA, 25 bp, Mus musculus
tatttgtccgagactaccacggaga

SEQ ID NO: 794541 - DNA, 25 bp, Mus musculus
tatttgtccgagtctaccacggaga

SEQ ID NO: 794542 - DNA, 25 bp, Mus musculus
tatttgtcctatacgtagagccgag

SEQ ID NO: 794543 - DNA, 25 bp, Mus musculus
tatttgtcctattcgtagagccgag

SEQ ID NO: 794544 - DNA, 25 bp, Mus musculus
tatttgtcctctcggttcttatagg

SEQ ID NO: 794545 - DNA, 25 bp, Mus musculus
tatttgtcctctgggttcttatagg

SEQ ID NO: 794546 - DNA, 25 bp, Mus musculus
tatttgtcctgccttgagcctatta

SEQ ID NO: 794547 - DNA, 25 bp, Mus musculus
tatttgtcctgcgttgagcctatta

SEQ ID NO: 794548 - DNA, 25 bp, Mus musculus
tatttgtcctggaaatagcaggttt

SEQ ID NO: 794549 - DNA, 25 bp, Mus musculus
tatttgtcctggtaatagcaggttt

SEQ ID NO: 794550 - DNA, 25 bp, Mus musculus
tatttgtctgcaatggttgctcaaa

SEQ ID NO: 794551 - DNA, 25 bp, Mus musculus
tatttgtctgcattggttgctcaaa

SEQ ID NO: 794552 - DNA, 25 bp, Mus musculus
tatttgtctgggattggcactgaat

SEQ ID NO: 794553 - DNA, 25 bp, Mus musculus
tatttgtctgggtttggcactgaat

SEQ ID NO: 794554 - DNA, 25 bp, Mus musculus
tatttgtcttatccctccagctcag

SEQ ID NO: 794555 - DNA, 25 bp, Mus musculus
tatttgtcttatgcctccagctcag

SEQ ID NO: 794556 - DNA, 25 bp, Mus musculus
tatttgtgaacaactcgagtgtgag

SEQ ID NO: 794557 - DNA, 25 bp, Mus musculus
tatttgtgaacatctcgagtgtgag

SEQ ID NO: 794558 - DNA, 25 bp, Mus musculus
tatttgtgaagcctcctgcccagag

SEQ ID NO: 794559 - DNA, 25 bp, Mus musculus
tatttgtgaagcgtcctgcccagag

SEQ ID NO: 794560 - DNA, 25 bp, Mus musculus
tatttgtgacctccaataccagcgt

SEQ ID NO: 794561 - DNA, 25 bp, Mus musculus
tatttgtgacctgcaataccagcgt

SEQ ID NO: 794562 - DNA, 25 bp, Mus musculus
tatttgtgatacattccctttctgg

SEQ ID NO: 794563 - DNA, 25 bp, Mus musculus
tatttgtgatactttccctttctgg

SEQ ID NO: 794564 - DNA, 25 bp, Mus musculus
tatttgtgggtcactttaacataga

SEQ ID NO: 794565 - DNA, 25 bp, Mus musculus
tatttgtgggtctctttaacataga

SEQ ID NO: 794566 - DNA, 25 bp, Mus musculus
tatttgtggtatctgcctatgtgcc

SEQ ID NO: 794567 - DNA, 25 bp, Mus musculus
tatttgtggtatgtgcctatgtgcc

SEQ ID NO: 794568 - DNA, 25 bp, Mus musculus
tatttgtggtgtactgacctctgtc

SEQ ID NO: 794569 - DNA, 25 bp, Mus musculus
tatttgtggtgttctgacctctgtc

SEQ ID NO: 794570 - DNA, 25 bp, Mus musculus
tatttgtgtcacaaattctaacatg

SEQ ID NO: 794571 - DNA, 25 bp, Mus musculus
tatttgtgtcactaattctaacatg

SEQ ID NO: 794572 - DNA, 25 bp, Mus musculus
tatttgtgtcatacatttccagtaa

SEQ ID NO: 794573 - DNA, 25 bp, Mus musculus
tatttgtgtcattcatttccagtaa

SEQ ID NO: 794574 - DNA, 25 bp, Mus musculus
tatttgtgtgtcctatacctcttaa

SEQ ID NO: 794575 - DNA, 25 bp, Mus musculus
tatttgtgtgtcgtatacctcttaa

SEQ ID NO: 794576 - DNA, 25 bp, Mus musculus
tatttgtgtgttctgttttaggaaa

SEQ ID NO: 794577 - DNA, 25 bp, Mus musculus
tatttgtgtgttgtgttttaggaaa

SEQ ID NO: 794578 - DNA, 25 bp, Mus musculus
tatttgttaaacatggctaatgtta

SEQ ID NO: 794579 - DNA, 25 bp, Mus musculus
tatttgttaaacttggctaatgtta

SEQ ID NO: 794580 - DNA, 25 bp, Mus musculus
tatttgttcctacccatagttccca

SEQ ID NO: 794581 - DNA, 25 bp, Mus musculus
tatttgttcctagccatagttccca

SEQ ID NO: 794582 - DNA, 25 bp, Mus musculus
tatttgttctacctatgccacactt

SEQ ID NO: 794583 - DNA, 25 bp, Mus musculus
tatttgttctacgtatgccacactt

SEQ ID NO: 794584 - DNA, 25 bp, Mus musculus
tatttgttgaaaagccttgccccga

SEQ ID NO: 794585 - DNA, 25 bp, Mus musculus
tatttgttgaaatgccttgccccga

SEQ ID NO: 794586 - DNA, 25 bp, Mus musculus
tatttgttgcatctaccttttctgt

SEQ ID NO: 794587 - DNA, 25 bp, Mus musculus
tatttgttgcatgtaccttttctgt

SEQ ID NO: 794588 - DNA, 25 bp, Mus musculus
tatttgttgcgcaccaagcatggac

SEQ ID NO: 794589 - DNA, 25 bp, Mus musculus
tatttgttgcgctccaagcatggac

SEQ ID NO: 794590 - DNA, 25 bp, Mus musculus
tatttgttgtttctgagtggacaca

SEQ ID NO: 794591 - DNA, 25 bp, Mus musculus
tatttgttgtttgtgagtggacaca

SEQ ID NO: 794592 - DNA, 25 bp, Mus musculus
tatttgtttgtcacagtatcatttc

SEQ ID NO: 794593 - DNA, 25 bp, Mus musculus
tatttgtttgtctcagtatcatttc

SEQ ID NO: 794594 - DNA, 25 bp, Mus musculus
tatttgtttgttccctagatctgta

SEQ ID NO: 794595 - DNA, 25 bp, Mus musculus
tatttgtttgttctaggtgctagaa

SEQ ID NO: 794596 - DNA, 25 bp, Mus musculus
tatttgtttgttgcctagatctgta

SEQ ID NO: 794597 - DNA, 25 bp, Mus musculus
tatttgtttgttgtaggtgctagaa

SEQ ID NO: 794598 - DNA, 25 bp, Mus musculus
tatttgttttccatggcctggtgta

SEQ ID NO: 794599 - DNA, 25 bp, Mus musculus
tatttgttttccttggcctggtgta

SEQ ID NO: 794600 - DNA, 25 bp, Mus musculus
tattttaaatacatcacctcacagg

SEQ ID NO: 794601 - DNA, 25 bp, Mus musculus
tattttaaatacttcacctcacagg

SEQ ID NO: 794602 - DNA, 25 bp, Mus musculus
tattttaaccagcatctcaggaggt

SEQ ID NO: 794603 - DNA, 25 bp, Mus musculus
tattttaaccaggatctcaggaggt

SEQ ID NO: 794604 - DNA, 25 bp, Mus musculus
tattttaagattaggtggcagctgt

SEQ ID NO: 794605 - DNA, 25 bp, Mus musculus
tattttaagatttggtggcagctgt

SEQ ID NO: 794606 - DNA, 25 bp, Mus musculus
tattttaaggcccaatttgctgttt

SEQ ID NO: 794607 - DNA, 25 bp, Mus musculus
tattttaaggccgaatttgctgttt

SEQ ID NO: 794608 - DNA, 25 bp, Mus musculus
tattttaagttaatgttcaggtcct

SEQ ID NO: 794609 - DNA, 25 bp, Mus musculus
tattttaagttattgttcaggtcct

SEQ ID NO: 794610 - DNA, 25 bp, Mus musculus
tattttaatcatccttttctcccct

SEQ ID NO: 794611 - DNA, 25 bp, Mus musculus
tattttaatcatgcttttctcccct

SEQ ID NO: 794612 - DNA, 25 bp, Mus musculus
tattttaatccaccctttttgcact

SEQ ID NO: 794613 - DNA, 25 bp, Mus musculus
tattttaatccagcctttttgcact

SEQ ID NO: 794614 - DNA, 25 bp, Mus musculus
tattttaatcctcaccaagacccaa

SEQ ID NO: 794615 - DNA, 25 bp, Mus musculus
tattttaatcctgaccaagacccaa

SEQ ID NO: 794616 - DNA, 25 bp, Mus musculus
tattttaattgtccatgccccacca

SEQ ID NO: 794617 - DNA, 25 bp, Mus musculus
tattttaattgtgcatgccccacca

SEQ ID NO: 794618 - DNA, 25 bp, Mus musculus
tattttacaaatctccctcccgtca

SEQ ID NO: 794619 - DNA, 25 bp, Mus musculus
tattttacaaatgtccctcccgtca

SEQ ID NO: 794620 - DNA, 25 bp, Mus musculus
tattttacacctctggttggcttgc

SEQ ID NO: 794621 - DNA, 25 bp, Mus musculus
tattttacacctgtggttggcttgc

SEQ ID NO: 794622 - DNA, 25 bp, Mus musculus
tattttacagctattgtccaaggag

SEQ ID NO: 794623 - DNA, 25 bp, Mus musculus
tattttacagcttttgtccaaggag

SEQ ID NO: 794624 - DNA, 25 bp, Mus musculus
tattttacatcaaacatctctacag

SEQ ID NO: 794625 - DNA, 25 bp, Mus musculus
tattttacatcatacatctctacag

SEQ ID NO: 794626 - DNA, 25 bp, Mus musculus
tattttacccctaggctggttgacg

SEQ ID NO: 794627 - DNA, 25 bp, Mus musculus
tattttaccccttggctggttgacg

SEQ ID NO: 794628 - DNA, 25 bp, Mus musculus
tattttaccgtgcagtccaagagag

SEQ ID NO: 794629 - DNA, 25 bp, Mus musculus
tattttaccgtggagtccaagagag

SEQ ID NO: 794630 - DNA, 25 bp, Mus musculus
tattttactctcaattgtgtttatg

SEQ ID NO: 794631 - DNA, 25 bp, Mus musculus
tattttactctctattgtgtttatg

SEQ ID NO: 794632 - DNA, 25 bp, Mus musculus
tattttactgaccttagccactctg

SEQ ID NO: 794633 - DNA, 25 bp, Mus musculus
tattttactgacgttagccactctg

SEQ ID NO: 794634 - DNA, 25 bp, Mus musculus
tattttactgtccatttcctcagct

SEQ ID NO: 794635 - DNA, 25 bp, Mus musculus
tattttactgtcgatttcctcagct

SEQ ID NO: 794636 - DNA, 25 bp, Mus musculus
tattttactgttaattgatgaacat

SEQ ID NO: 794637 - DNA, 25 bp, Mus musculus
tattttactgttcaaggttccgttg

SEQ ID NO: 794638 - DNA, 25 bp, Mus musculus
tattttactgttgaaggttccgttg

SEQ ID NO: 794639 - DNA, 25 bp, Mus musculus
tattttactgtttattgatgaacat

SEQ ID NO: 794640 - DNA, 25 bp, Mus musculus
tattttacttacatactccacctcc

SEQ ID NO: 794641 - DNA, 25 bp, Mus musculus
tattttacttacttactccacctcc

SEQ ID NO: 794642 - DNA, 25 bp, Mus musculus
tattttacttatatagaacttacag

SEQ ID NO: 794643 - DNA, 25 bp, Mus musculus
tattttacttatttagaacttacag

SEQ ID NO: 794644 - DNA, 25 bp, Mus musculus
tattttacttctaggttctgataac

SEQ ID NO: 794645 - DNA, 25 bp, Mus musculus
tattttacttctcattcatctggtg

SEQ ID NO: 794646 - DNA, 25 bp, Mus musculus
tattttacttctgattcatctggtg

SEQ ID NO: 794647 - DNA, 25 bp, Mus musculus
tattttacttcttggttctgataac

SEQ ID NO: 794648 - DNA, 25 bp, Mus musculus
tattttagaaagaagcacacaacag

SEQ ID NO: 794649 - DNA, 25 bp, Mus musculus
tattttagaaagtagcacacaacag

SEQ ID NO: 794650 - DNA, 25 bp, Mus musculus
tattttagaggtagagcccaggtcc

SEQ ID NO: 794651 - DNA, 25 bp, Mus musculus
tattttagaggttgagcccaggtcc

SEQ ID NO: 794652 - DNA, 25 bp, Mus musculus
tattttagagtcagagtgacccctt

SEQ ID NO: 794653 - DNA, 25 bp, Mus musculus
tattttagagtctgagtgacccctt

SEQ ID NO: 794654 - DNA, 25 bp, Mus musculus
tattttagcctgacagaactggatg

SEQ ID NO: 794655 - DNA, 25 bp, Mus musculus
tattttagcctgtcagaactggatg

SEQ ID NO: 794656 - DNA, 25 bp, Mus musculus
tattttagccttcggagtctactcc

SEQ ID NO: 794657 - DNA, 25 bp, Mus musculus
tattttagccttgggagtctactcc

SEQ ID NO: 794658 - DNA, 25 bp, Mus musculus
tattttaggatgattccacaataat

SEQ ID NO: 794659 - DNA, 25 bp, Mus musculus
tattttaggatgtttccacaataat

SEQ ID NO: 794660 - DNA, 25 bp, Mus musculus
tattttaggtggagacttctgaggc

SEQ ID NO: 794661 - DNA, 25 bp, Mus musculus
tattttaggtggtgacttctgaggc

SEQ ID NO: 794662 - DNA, 25 bp, Mus musculus
tattttagtatgacttaagcagcag

SEQ ID NO: 794663 - DNA, 25 bp, Mus musculus
tattttagtatgtcttaagcagcag

SEQ ID NO: 794664 - DNA, 25 bp, Mus musculus
tattttagttgaacccatgggattt

SEQ ID NO: 794665 - DNA, 25 bp, Mus musculus
tattttagttgatcccatgggattt

SEQ ID NO: 794666 - DNA, 25 bp, Mus musculus
tattttatagccatccatcaaccag

SEQ ID NO: 794667 - DNA, 25 bp, Mus musculus
tattttatagccttccatcaaccag

SEQ ID NO: 794668 - DNA, 25 bp, Mus musculus
tattttatcagcagtcagtcccttc

SEQ ID NO: 794669 - DNA, 25 bp, Mus musculus
tattttatcagctgtcagtcccttc

SEQ ID NO: 794670 - DNA, 25 bp, Mus musculus
tattttatcaggatattggcagcag

SEQ ID NO: 794671 - DNA, 25 bp, Mus musculus
tattttatcaggttattggcagcag

SEQ ID NO: 794672 - DNA, 25 bp, Mus musculus
tattttatccaactaccctagtgaa

SEQ ID NO: 794673 - DNA, 25 bp, Mus musculus
tattttatccaagtaccctagtgaa

SEQ ID NO: 794674 - DNA, 25 bp, Mus musculus
tattttatccttcatcatcacgatg

SEQ ID NO: 794675 - DNA, 25 bp, Mus musculus
tattttatccttgatcatcacgatg

SEQ ID NO: 794676 - DNA, 25 bp, Mus musculus
tattttatgcagataagggcttaca

SEQ ID NO: 794677 - DNA, 25 bp, Mus musculus
tattttatgcagttaagggcttaca

SEQ ID NO: 794678 - DNA, 25 bp, Mus musculus
tattttatgcctagtgcccacatgc

SEQ ID NO: 794679 - DNA, 25 bp, Mus musculus
tattttatgccttgtgcccacatgc

SEQ ID NO: 794680 - DNA, 25 bp, Mus musculus
tattttatgggacctgcgcaggacc

SEQ ID NO: 794681 - DNA, 25 bp, Mus musculus
tattttatgggagctgcgcaggacc

SEQ ID NO: 794682 - DNA, 25 bp, Mus musculus
tattttattatactccctcgacttc

SEQ ID NO: 794683 - DNA, 25 bp, Mus musculus
tattttattatagtccctcgacttc

SEQ ID NO: 794684 - DNA, 25 bp, Mus musculus
tattttattcccacaccccttgtat

SEQ ID NO: 794685 - DNA, 25 bp, Mus musculus
tattttattcccaccagctttgaag

SEQ ID NO: 794686 - DNA, 25 bp, Mus musculus
tattttattccctcaccccttgtat

SEQ ID NO: 794687 - DNA, 25 bp, Mus musculus
tattttattccctccagctttgaag

SEQ ID NO: 794688 - DNA, 25 bp, Mus musculus
tattttattgcaaacccctagcttc

SEQ ID NO: 794689 - DNA, 25 bp, Mus musculus
tattttattgcatacccctagcttc

SEQ ID NO: 794690 - DNA, 25 bp, Mus musculus
tattttatttaaacctcgagtcaag

SEQ ID NO: 794691 - DNA, 25 bp, Mus musculus
tattttatttaatcctcgagtcaag

SEQ ID NO: 794692 - DNA, 25 bp, Mus musculus
tattttcaaaaacagccctctgtga

SEQ ID NO: 794693 - DNA, 25 bp, Mus musculus
tattttcaaaaagagccctctgtga

SEQ ID NO: 794694 - DNA, 25 bp, Mus musculus
tattttcaaaacctactgcctttag

SEQ ID NO: 794695 - DNA, 25 bp, Mus musculus
tattttcaaaacgtactgcctttag

SEQ ID NO: 794696 - DNA, 25 bp, Mus musculus
tattttcaaatcaagctccgaccac

SEQ ID NO: 794697 - DNA, 25 bp, Mus musculus
tattttcaaatctagctccgaccac

SEQ ID NO: 794698 - DNA, 25 bp, Mus musculus
tattttcaagtgagtggtacatctt

SEQ ID NO: 794699 - DNA, 25 bp, Mus musculus
tattttcaagtgtgtggtacatctt

SEQ ID NO: 794700 - DNA, 25 bp, Mus musculus
tattttcaatttatccaggttccat

SEQ ID NO: 794701 - DNA, 25 bp, Mus musculus
tattttcaatttttccaggttccat

SEQ ID NO: 794702 - DNA, 25 bp, Mus musculus
tattttcacagtcccctgtggtaaa

SEQ ID NO: 794703 - DNA, 25 bp, Mus musculus
tattttcacagtgccctgtggtaaa

SEQ ID NO: 794704 - DNA, 25 bp, Mus musculus
tattttcaccacacttgtttatcaa

SEQ ID NO: 794705 - DNA, 25 bp, Mus musculus
tattttcaccactcttgtttatcaa

SEQ ID NO: 794706 - DNA, 25 bp, Mus musculus
tattttcaccgaaagatgggcgttt

SEQ ID NO: 794707 - DNA, 25 bp, Mus musculus
tattttcaccgatagatgggcgttt

SEQ ID NO: 794708 - DNA, 25 bp, Mus musculus
tattttcagcagaaatgcgtgatac

SEQ ID NO: 794709 - DNA, 25 bp, Mus musculus
tattttcagcagtaatgcgtgatac

SEQ ID NO: 794710 - DNA, 25 bp, Mus musculus
tattttcagcatctatagccacttt

SEQ ID NO: 794711 - DNA, 25 bp, Mus musculus
tattttcagcatgtatagccacttt

SEQ ID NO: 794712 - DNA, 25 bp, Mus musculus
tattttcagttcaatctggtcccgt

SEQ ID NO: 794713 - DNA, 25 bp, Mus musculus
tattttcagttcactgagacttttg

SEQ ID NO: 794714 - DNA, 25 bp, Mus musculus
tattttcagttcatgtccagggctt

SEQ ID NO: 794715 - DNA, 25 bp, Mus musculus
tattttcagttctatctggtcccgt

SEQ ID NO: 794716 - DNA, 25 bp, Mus musculus
tattttcagttctctgagacttttg

SEQ ID NO: 794717 - DNA, 25 bp, Mus musculus
tattttcagttcttgtccagggctt

SEQ ID NO: 794718 - DNA, 25 bp, Mus musculus
tattttcatcccctggtccagatct

SEQ ID NO: 794719 - DNA, 25 bp, Mus musculus
tattttcatcccgtggtccagatct

SEQ ID NO: 794720 - DNA, 25 bp, Mus musculus
tattttcatcctccagtttcaattt

SEQ ID NO: 794721 - DNA, 25 bp, Mus musculus
tattttcatcctgcagtttcaattt

SEQ ID NO: 794722 - DNA, 25 bp, Mus musculus
tattttcatcttcagtgatctgagc

SEQ ID NO: 794723 - DNA, 25 bp, Mus musculus
tattttcatcttctactgtgattga

SEQ ID NO: 794724 - DNA, 25 bp, Mus musculus
tattttcatcttgagtgatctgagc

SEQ ID NO: 794725 - DNA, 25 bp, Mus musculus
tattttcatcttgtactgtgattga

SEQ ID NO: 794726 - DNA, 25 bp, Mus musculus
tattttcatgacagacgccagccat

SEQ ID NO: 794727 - DNA, 25 bp, Mus musculus
tattttcatgactgacgccagccat

SEQ ID NO: 794728 - DNA, 25 bp, Mus musculus
tattttcatgtgcatctcaactaga

SEQ ID NO: 794729 - DNA, 25 bp, Mus musculus
tattttcatgtggatctcaactaga

SEQ ID NO: 794730 - DNA, 25 bp, Mus musculus
tattttcattctacctgctacagtg

SEQ ID NO: 794731 - DNA, 25 bp, Mus musculus
tattttcattcttcctgctacagtg

SEQ ID NO: 794732 - DNA, 25 bp, Mus musculus
tattttcatttgaacgtctgtgaat

SEQ ID NO: 794733 - DNA, 25 bp, Mus musculus
tattttcatttgtacgtctgtgaat

SEQ ID NO: 794734 - DNA, 25 bp, Mus musculus
tattttccaagcctgcctcagagac

SEQ ID NO: 794735 - DNA, 25 bp, Mus musculus
tattttccaagcgtgcctcagagac

SEQ ID NO: 794736 - DNA, 25 bp, Mus musculus
tattttccactgaaatagtatggac

SEQ ID NO: 794737 - DNA, 25 bp, Mus musculus
tattttccactgtaatagtatggac

SEQ ID NO: 794738 - DNA, 25 bp, Mus musculus
tattttccagggaaagacacagtga

SEQ ID NO: 794739 - DNA, 25 bp, Mus musculus
tattttccagggtaagacacagtga

SEQ ID NO: 794740 - DNA, 25 bp, Mus musculus
tattttccatgcaaactttttgggc

SEQ ID NO: 794741 - DNA, 25 bp, Mus musculus
tattttccatgctaactttttgggc

SEQ ID NO: 794742 - DNA, 25 bp, Mus musculus
tattttccatgtcctaacatccttg

SEQ ID NO: 794743 - DNA, 25 bp, Mus musculus
tattttccatgtgctaacatccttg

SEQ ID NO: 794744 - DNA, 25 bp, Mus musculus
tattttccattcctagttagcgcca

SEQ ID NO: 794745 - DNA, 25 bp, Mus musculus
tattttccattcgtagttagcgcca

SEQ ID NO: 794746 - DNA, 25 bp, Mus musculus
tattttcccaagacctgtctgtgag

SEQ ID NO: 794747 - DNA, 25 bp, Mus musculus
tattttcccaagtcctgtctgtgag

SEQ ID NO: 794748 - DNA, 25 bp, Mus musculus
tattttcccactaacgagacgacca

SEQ ID NO: 794749 - DNA, 25 bp, Mus musculus
tattttcccacttacgagacgacca

SEQ ID NO: 794750 - DNA, 25 bp, Mus musculus
tattttcccagtcagctttgccata

SEQ ID NO: 794751 - DNA, 25 bp, Mus musculus
tattttcccagtgagctttgccata

SEQ ID NO: 794752 - DNA, 25 bp, Mus musculus
tattttcccattagcaagcattgca

SEQ ID NO: 794753 - DNA, 25 bp, Mus musculus
tattttcccatttgcaagcattgca

SEQ ID NO: 794754 - DNA, 25 bp, Mus musculus
tattttcccgtaactgctggcatta

SEQ ID NO: 794755 - DNA, 25 bp, Mus musculus
tattttcccgtatctgctggcatta

SEQ ID NO: 794756 - DNA, 25 bp, Mus musculus
tattttccctaacgatttgcaagca

SEQ ID NO: 794757 - DNA, 25 bp, Mus musculus
tattttccctaaggatttgcaagca

SEQ ID NO: 794758 - DNA, 25 bp, Mus musculus
tattttccctggatcctctatgtga

SEQ ID NO: 794759 - DNA, 25 bp, Mus musculus
tattttccctggttcctctatgtga

SEQ ID NO: 794760 - DNA, 25 bp, Mus musculus
tattttccctgtctacaatgttatt

SEQ ID NO: 794761 - DNA, 25 bp, Mus musculus
tattttccctgtctagccacgtatg

SEQ ID NO: 794762 - DNA, 25 bp, Mus musculus
tattttccctgtgtacaatgttatt

SEQ ID NO: 794763 - DNA, 25 bp, Mus musculus
tattttccctgtgtagccacgtatg

SEQ ID NO: 794764 - DNA, 25 bp, Mus musculus
tattttccgatgatgaccttcttcc

SEQ ID NO: 794765 - DNA, 25 bp, Mus musculus
tattttccgatgttgaccttcttcc

SEQ ID NO: 794766 - DNA, 25 bp, Mus musculus
tattttccggaaatctagacctcag

SEQ ID NO: 794767 - DNA, 25 bp, Mus musculus
tattttccggaattctagacctcag

SEQ ID NO: 794768 - DNA, 25 bp, Mus musculus
tattttcctataagtatctccacga

SEQ ID NO: 794769 - DNA, 25 bp, Mus musculus
tattttcctatatgtatctccacga

SEQ ID NO: 794770 - DNA, 25 bp, Mus musculus
tattttcctccacacgttttgaact

SEQ ID NO: 794771 - DNA, 25 bp, Mus musculus
tattttcctccagacgttttgaact

SEQ ID NO: 794772 - DNA, 25 bp, Mus musculus
tattttcctcgccaacacgtgtagt

SEQ ID NO: 794773 - DNA, 25 bp, Mus musculus
tattttcctcgcgaacacgtgtagt

SEQ ID NO: 794774 - DNA, 25 bp, Mus musculus
tattttcctcttaagatactatatt

SEQ ID NO: 794775 - DNA, 25 bp, Mus musculus
tattttcctcttcaccgtttttcat

SEQ ID NO: 794776 - DNA, 25 bp, Mus musculus
tattttcctcttgaccgtttttcat

SEQ ID NO: 794777 - DNA, 25 bp, Mus musculus
tattttcctctttagatactatatt

SEQ ID NO: 794778 - DNA, 25 bp, Mus musculus
tattttcctgaacctccagaattat

SEQ ID NO: 794779 - DNA, 25 bp, Mus musculus
tattttcctgaagctccagaattat

SEQ ID NO: 794780 - DNA, 25 bp, Mus musculus
tattttcggctgagcgctgaggatc

SEQ ID NO: 794781 - DNA, 25 bp, Mus musculus
tattttcggctgtgcgctgaggatc

SEQ ID NO: 794782 - DNA, 25 bp, Mus musculus
tattttcgtgcaattgtgagccaaa

SEQ ID NO: 794783 - DNA, 25 bp, Mus musculus
tattttcgtgcatttgtgagccaaa

SEQ ID NO: 794784 - DNA, 25 bp, Mus musculus
tattttcgttgtaactgcttgagga

SEQ ID NO: 794785 - DNA, 25 bp, Mus musculus
tattttcgttgttactgcttgagga

SEQ ID NO: 794786 - DNA, 25 bp, Mus musculus
tattttctaaaaactggatccctaa

SEQ ID NO: 794787 - DNA, 25 bp, Mus musculus
tattttctaaaatctggatccctaa

SEQ ID NO: 794788 - DNA, 25 bp, Mus musculus
tattttctaactatcagcctgggtt

SEQ ID NO: 794789 - DNA, 25 bp, Mus musculus
tattttctaactttcagcctgggtt

SEQ ID NO: 794790 - DNA, 25 bp, Mus musculus
tattttctaataccgagggtgaata

SEQ ID NO: 794791 - DNA, 25 bp, Mus musculus
tattttctaatagcgagggtgaata

SEQ ID NO: 794792 - DNA, 25 bp, Mus musculus
tattttctacccacatgagaatgtg

SEQ ID NO: 794793 - DNA, 25 bp, Mus musculus
tattttctaccctcatgagaatgtg

SEQ ID NO: 794794 - DNA, 25 bp, Mus musculus
tattttctactgactagccttggag

SEQ ID NO: 794795 - DNA, 25 bp, Mus musculus
tattttctactgtctagccttggag

SEQ ID NO: 794796 - DNA, 25 bp, Mus musculus
tattttctatacatggatcctgcat

SEQ ID NO: 794797 - DNA, 25 bp, Mus musculus
tattttctatacttggatcctgcat

SEQ ID NO: 794798 - DNA, 25 bp, Mus musculus
tattttctatgtatttcggctgtac

SEQ ID NO: 794799 - DNA, 25 bp, Mus musculus
tattttctatgtttttcggctgtac

SEQ ID NO: 794800 - DNA, 25 bp, Mus musculus
tattttctattcctatgctttcaac

SEQ ID NO: 794801 - DNA, 25 bp, Mus musculus
tattttctattcctctgtgtattta

SEQ ID NO: 794802 - DNA, 25 bp, Mus musculus
tattttctattcgtatgctttcaac

SEQ ID NO: 794803 - DNA, 25 bp, Mus musculus
tattttctattcgtctgtgtattta

SEQ ID NO: 794804 - DNA, 25 bp, Mus musculus
tattttctcactatggatgtacctt

SEQ ID NO: 794805 - DNA, 25 bp, Mus musculus
tattttctcactttggatgtacctt

SEQ ID NO: 794806 - DNA, 25 bp, Mus musculus
tattttctcagaaattattgccatg

SEQ ID NO: 794807 - DNA, 25 bp, Mus musculus
tattttctcagatattattgccatg

SEQ ID NO: 794808 - DNA, 25 bp, Mus musculus
tattttctcagtcgcaattggcttt

SEQ ID NO: 794809 - DNA, 25 bp, Mus musculus
tattttctcagtggcaattggcttt

SEQ ID NO: 794810 - DNA, 25 bp, Mus musculus
tattttctcataaatccggccctac

SEQ ID NO: 794811 - DNA, 25 bp, Mus musculus
tattttctcatatatccggccctac

SEQ ID NO: 794812 - DNA, 25 bp, Mus musculus
tattttctccatcgtacagtgtaga

SEQ ID NO: 794813 - DNA, 25 bp, Mus musculus
tattttctccatggtacagtgtaga

SEQ ID NO: 794814 - DNA, 25 bp, Mus musculus
tattttctctacacctatatgccca

SEQ ID NO: 794815 - DNA, 25 bp, Mus musculus
tattttctctactcctatatgccca

SEQ ID NO: 794816 - DNA, 25 bp, Mus musculus
tattttctctgtaatcgtgatgtca

SEQ ID NO: 794817 - DNA, 25 bp, Mus musculus
tattttctctgttatcgtgatgtca

SEQ ID NO: 794818 - DNA, 25 bp, Mus musculus
tattttctcttcctgcaacttgcaa

SEQ ID NO: 794819 - DNA, 25 bp, Mus musculus
tattttctcttcgtgcaacttgcaa

SEQ ID NO: 794820 - DNA, 25 bp, Mus musculus
tattttctgaaacactcaatgaagc

SEQ ID NO: 794821 - DNA, 25 bp, Mus musculus
tattttctgaaagactcaatgaagc

SEQ ID NO: 794822 - DNA, 25 bp, Mus musculus
tattttctgataaaaggctgtactc

SEQ ID NO: 794823 - DNA, 25 bp, Mus musculus
tattttctgatataaggctgtactc

SEQ ID NO: 794824 - DNA, 25 bp, Mus musculus
tattttctgctcacgataattctga

SEQ ID NO: 794825 - DNA, 25 bp, Mus musculus
tattttctgctctcgataattctga

SEQ ID NO: 794826 - DNA, 25 bp, Mus musculus
tattttctgtctcgtgttgtggttt

SEQ ID NO: 794827 - DNA, 25 bp, Mus musculus
tattttctgtctggtgttgtggttt

SEQ ID NO: 794828 - DNA, 25 bp, Mus musculus
tattttctgtgcatcggtgtttgac

SEQ ID NO: 794829 - DNA, 25 bp, Mus musculus
tattttctgtgcttcggtgtttgac

SEQ ID NO: 794830 - DNA, 25 bp, Mus musculus
tattttctgtggaccaggcactgaa

SEQ ID NO: 794831 - DNA, 25 bp, Mus musculus
tattttctgtggtccaggcactgaa

SEQ ID NO: 794832 - DNA, 25 bp, Mus musculus
tattttctgtttcctagtcttatac

SEQ ID NO: 794833 - DNA, 25 bp, Mus musculus
tattttctgtttgctagtcttatac

SEQ ID NO: 794834 - DNA, 25 bp, Mus musculus
tattttcttaacatctgcactccag

SEQ ID NO: 794835 - DNA, 25 bp, Mus musculus
tattttcttaacttctgcactccag

SEQ ID NO: 794836 - DNA, 25 bp, Mus musculus
tattttcttcctatgcagcaatcta

SEQ ID NO: 794837 - DNA, 25 bp, Mus musculus
tattttcttcctttgcagcaatcta

SEQ ID NO: 794838 - DNA, 25 bp, Mus musculus
tattttcttgagatacgtaaagcaa

SEQ ID NO: 794839 - DNA, 25 bp, Mus musculus
tattttcttgagttacgtaaagcaa

SEQ ID NO: 794840 - DNA, 25 bp, Mus musculus
tattttcttgcaactaaaaaagcat

SEQ ID NO: 794841 - DNA, 25 bp, Mus musculus
tattttcttgcatctaaaaaagcat

SEQ ID NO: 794842 - DNA, 25 bp, Mus musculus
tattttcttggcctgaggtcagact

SEQ ID NO: 794843 - DNA, 25 bp, Mus musculus
tattttcttggcgtgaggtcagact

SEQ ID NO: 794844 - DNA, 25 bp, Mus musculus
tattttcttgtaacggtatcccata

SEQ ID NO: 794845 - DNA, 25 bp, Mus musculus
tattttcttgtatcggtatcccata

SEQ ID NO: 794846 - DNA, 25 bp, Mus musculus
tattttctttagaggtgacttcctt

SEQ ID NO: 794847 - DNA, 25 bp, Mus musculus
tattttctttagtggtgacttcctt

SEQ ID NO: 794848 - DNA, 25 bp, Mus musculus
tattttgaaattaatttgaacctga

SEQ ID NO: 794849 - DNA, 25 bp, Mus musculus
tattttgaaatttatttgaacctga

SEQ ID NO: 794850 - DNA, 25 bp, Mus musculus
tattttgaagaaagactgatgtaac

SEQ ID NO: 794851 - DNA, 25 bp, Mus musculus
tattttgaagaatgactgatgtaac

SEQ ID NO: 794852 - DNA, 25 bp, Mus musculus
tattttgaagacaaaacgtggaaga

SEQ ID NO: 794853 - DNA, 25 bp, Mus musculus
tattttgaagactaaacgtggaaga

SEQ ID NO: 794854 - DNA, 25 bp, Mus musculus
tattttgaagctctattttaatagt

SEQ ID NO: 794855 - DNA, 25 bp, Mus musculus
tattttgaagctgtattttaatagt

SEQ ID NO: 794856 - DNA, 25 bp, Mus musculus
tattttgaagtcaccatgatttccc

SEQ ID NO: 794857 - DNA, 25 bp, Mus musculus
tattttgaagtctccatgatttccc

SEQ ID NO: 794858 - DNA, 25 bp, Mus musculus
tattttgaatgaaacccctaccctt

SEQ ID NO: 794859 - DNA, 25 bp, Mus musculus
tattttgaatgatacccctaccctt

SEQ ID NO: 794860 - DNA, 25 bp, Mus musculus
tattttgaccaactgcagtagtgca

SEQ ID NO: 794861 - DNA, 25 bp, Mus musculus
tattttgaccaagtgcagtagtgca

SEQ ID NO: 794862 - DNA, 25 bp, Mus musculus
tattttgaccatatcattccctctc

SEQ ID NO: 794863 - DNA, 25 bp, Mus musculus
tattttgaccatcatatagctatat

SEQ ID NO: 794864 - DNA, 25 bp, Mus musculus
tattttgaccatgatatagctatat

SEQ ID NO: 794865 - DNA, 25 bp, Mus musculus
tattttgaccatttcattccctctc

SEQ ID NO: 794866 - DNA, 25 bp, Mus musculus
tattttgaccccaccaagatcaacc

SEQ ID NO: 794867 - DNA, 25 bp, Mus musculus
tattttgacccctccaagatcaacc

SEQ ID NO: 794868 - DNA, 25 bp, Mus musculus
tattttgaccgcctgattctcactg

SEQ ID NO: 794869 - DNA, 25 bp, Mus musculus
tattttgaccgcgtgattctcactg

SEQ ID NO: 794870 - DNA, 25 bp, Mus musculus
tattttgacttacttgttttggaag

SEQ ID NO: 794871 - DNA, 25 bp, Mus musculus
tattttgacttagttgttttggaag

SEQ ID NO: 794872 - DNA, 25 bp, Mus musculus
tattttgactttatctacctctgag

SEQ ID NO: 794873 - DNA, 25 bp, Mus musculus
tattttgactttttctacctctgag

SEQ ID NO: 794874 - DNA, 25 bp, Mus musculus
tattttgagcttatgtgacactttg

SEQ ID NO: 794875 - DNA, 25 bp, Mus musculus
tattttgagcttttgtgacactttg

SEQ ID NO: 794876 - DNA, 25 bp, Mus musculus
tattttgataacagcatttttccca

SEQ ID NO: 794877 - DNA, 25 bp, Mus musculus
tattttgataactgcatttttccca

SEQ ID NO: 794878 - DNA, 25 bp, Mus musculus
tattttgatagtatgtgaattctaa

SEQ ID NO: 794879 - DNA, 25 bp, Mus musculus
tattttgatagtttgtgaattctaa

SEQ ID NO: 794880 - DNA, 25 bp, Mus musculus
tattttgatattctcctagccgggc

SEQ ID NO: 794881 - DNA, 25 bp, Mus musculus
tattttgatattgtcctagccgggc

SEQ ID NO: 794882 - DNA, 25 bp, Mus musculus
tattttgatgcacatgagcgagcga

SEQ ID NO: 794883 - DNA, 25 bp, Mus musculus
tattttgatgcagatgagcgagcga

SEQ ID NO: 794884 - DNA, 25 bp, Mus musculus
tattttgatggcctttttctgttcc

SEQ ID NO: 794885 - DNA, 25 bp, Mus musculus
tattttgatggcgtttttctgttcc

SEQ ID NO: 794886 - DNA, 25 bp, Mus musculus
tattttgattccatggttccctcag

SEQ ID NO: 794887 - DNA, 25 bp, Mus musculus
tattttgattccttggttccctcag

SEQ ID NO: 794888 - DNA, 25 bp, Mus musculus
tattttgattgcatttgcccacacc

SEQ ID NO: 794889 - DNA, 25 bp, Mus musculus
tattttgattgcttttgcccacacc

SEQ ID NO: 794890 - DNA, 25 bp, Mus musculus
tattttgcaatgaaccctaaaggag

SEQ ID NO: 794891 - DNA, 25 bp, Mus musculus
tattttgcaatgtaccctaaaggag

SEQ ID NO: 794892 - DNA, 25 bp, Mus musculus
tattttgcacagctggtgcctactt

SEQ ID NO: 794893 - DNA, 25 bp, Mus musculus
tattttgcacaggtggtgcctactt

SEQ ID NO: 794894 - DNA, 25 bp, Mus musculus
tattttgcataacgcatcttgagcc

SEQ ID NO: 794895 - DNA, 25 bp, Mus musculus
tattttgcataaggcatcttgagcc

SEQ ID NO: 794896 - DNA, 25 bp, Mus musculus
tattttgcatgtcacctaatctgaa

SEQ ID NO: 794897 - DNA, 25 bp, Mus musculus
tattttgcatgtgacctaatctgaa

SEQ ID NO: 794898 - DNA, 25 bp, Mus musculus
tattttgccacaagcgtctcgggat

SEQ ID NO: 794899 - DNA, 25 bp, Mus musculus
tattttgccacatgcgtctcgggat

SEQ ID NO: 794900 - DNA, 25 bp, Mus musculus
tattttgcccctcaacagttgttgc

SEQ ID NO: 794901 - DNA, 25 bp, Mus musculus
tattttgcccctgaacagttgttgc

SEQ ID NO: 794902 - DNA, 25 bp, Mus musculus
tattttgcccttaaacaagacttca

SEQ ID NO: 794903 - DNA, 25 bp, Mus musculus
tattttgccctttaacaagacttca

SEQ ID NO: 794904 - DNA, 25 bp, Mus musculus
tattttgcctgtacgagacagggtt

SEQ ID NO: 794905 - DNA, 25 bp, Mus musculus
tattttgcctgttcgagacagggtt

SEQ ID NO: 794906 - DNA, 25 bp, Mus musculus
tattttgctattacagccgcttctg

SEQ ID NO: 794907 - DNA, 25 bp, Mus musculus
tattttgctatttcagccgcttctg

SEQ ID NO: 794908 - DNA, 25 bp, Mus musculus
tattttgctgatatgacaggcttgt

SEQ ID NO: 794909 - DNA, 25 bp, Mus musculus
tattttgctgatttgacaggcttgt

SEQ ID NO: 794910 - DNA, 25 bp, Mus musculus
tattttgctgttattctcttggatt

SEQ ID NO: 794911 - DNA, 25 bp, Mus musculus
tattttgctgtttttctcttggatt

SEQ ID NO: 794912 - DNA, 25 bp, Mus musculus
tattttgcttcacatcatggcttcc

SEQ ID NO: 794913 - DNA, 25 bp, Mus musculus
tattttgcttcagatcatggcttcc

SEQ ID NO: 794914 - DNA, 25 bp, Mus musculus
tattttgctttcagtggcgaggtat

SEQ ID NO: 794915 - DNA, 25 bp, Mus musculus
tattttgctttctgtggcgaggtat

SEQ ID NO: 794916 - DNA, 25 bp, Mus musculus
tattttggcaggatcctgtgccttt

SEQ ID NO: 794917 - DNA, 25 bp, Mus musculus
tattttggcaggttcctgtgccttt

SEQ ID NO: 794918 - DNA, 25 bp, Mus musculus
tattttggccctcggaaaatctggc

SEQ ID NO: 794919 - DNA, 25 bp, Mus musculus
tattttggccctgggaaaatctggc

SEQ ID NO: 794920 - DNA, 25 bp, Mus musculus
tattttggcctaattctgacattaa

SEQ ID NO: 794921 - DNA, 25 bp, Mus musculus
tattttggcctatttctgacattaa

SEQ ID NO: 794922 - DNA, 25 bp, Mus musculus
tattttgggttgatgtttgtttgag

SEQ ID NO: 794923 - DNA, 25 bp, Mus musculus
tattttgggttgttgtttgtttgag

SEQ ID NO: 794924 - DNA, 25 bp, Mus musculus
tattttggtaagaacctgtttgcac

SEQ ID NO: 794925 - DNA, 25 bp, Mus musculus
tattttggtaagtacctgtttgcac

SEQ ID NO: 794926 - DNA, 25 bp, Mus musculus
tattttggtattattgccctcaact

SEQ ID NO: 794927 - DNA, 25 bp, Mus musculus
tattttggtatttttgccctcaact

SEQ ID NO: 794928 - DNA, 25 bp, Mus musculus
tattttggtcttctctccactgtta

SEQ ID NO: 794929 - DNA, 25 bp, Mus musculus
tattttggtcttgtctccactgtta

SEQ ID NO: 794930 - DNA, 25 bp, Mus musculus
tattttggttttatgcaccgattct

SEQ ID NO: 794931 - DNA, 25 bp, Mus musculus
tattttggttttttgcaccgattct

SEQ ID NO: 794932 - DNA, 25 bp, Mus musculus
tattttgtaaaacccacatggctca

SEQ ID NO: 794933 - DNA, 25 bp, Mus musculus
tattttgtaaaagccacatggctca

SEQ ID NO: 794934 - DNA, 25 bp, Mus musculus
tattttgtaaggagaagttttcatt

SEQ ID NO: 794935 - DNA, 25 bp, Mus musculus
tattttgtaaggtgaagttttcatt

SEQ ID NO: 794936 - DNA, 25 bp, Mus musculus
tattttgtaattagtcccaccttag

SEQ ID NO: 794937 - DNA, 25 bp, Mus musculus
tattttgtaatttgtcccaccttag

SEQ ID NO: 794938 - DNA, 25 bp, Mus musculus
tattttgtacaaccttcagatccca

SEQ ID NO: 794939 - DNA, 25 bp, Mus musculus
tattttgtacaagcttcagatccca

SEQ ID NO: 794940 - DNA, 25 bp, Mus musculus
tattttgtacagacagctttccttt

SEQ ID NO: 794941 - DNA, 25 bp, Mus musculus
tattttgtacagtcagctttccttt

SEQ ID NO: 794942 - DNA, 25 bp, Mus musculus
tattttgtaggcattctgaaattca

SEQ ID NO: 794943 - DNA, 25 bp, Mus musculus
tattttgtaggctttctgaaattca

SEQ ID NO: 794944 - DNA, 25 bp, Mus musculus
tattttgtatatatgtttcctgccc

SEQ ID NO: 794945 - DNA, 25 bp, Mus musculus
tattttgtatatttgtttcctgccc

SEQ ID NO: 794946 - DNA, 25 bp, Mus musculus
tattttgtatttacagggtctgtca

SEQ ID NO: 794947 - DNA, 25 bp, Mus musculus
tattttgtattttcagggtctgtca

SEQ ID NO: 794948 - DNA, 25 bp, Mus musculus
tattttgtcaacctaaatgttgcct

SEQ ID NO: 794949 - DNA, 25 bp, Mus musculus
tattttgtcaacgtaaatgttgcct

SEQ ID NO: 794950 - DNA, 25 bp, Mus musculus
tattttgtcacactcctacactagc

SEQ ID NO: 794951 - DNA, 25 bp, Mus musculus
tattttgtcacagtcctacactagc

SEQ ID NO: 794952 - DNA, 25 bp, Mus musculus
tattttgtcagcaaccggaagccaa

SEQ ID NO: 794953 - DNA, 25 bp, Mus musculus
tattttgtcagctaccggaagccaa

SEQ ID NO: 794954 - DNA, 25 bp, Mus musculus
tattttgtcctcctgactgttcaat

SEQ ID NO: 794955 - DNA, 25 bp, Mus musculus
tattttgtcctcgtgactgttcaat

SEQ ID NO: 794956 - DNA, 25 bp, Mus musculus
tattttgtcgatactgacccactgc

SEQ ID NO: 794957 - DNA, 25 bp, Mus musculus
tattttgtcgattctgacccactgc

SEQ ID NO: 794958 - DNA, 25 bp, Mus musculus
tattttgtctttaatagggactagg

SEQ ID NO: 794959 - DNA, 25 bp, Mus musculus
tattttgtcttttatagggactagg

SEQ ID NO: 794960 - DNA, 25 bp, Mus musculus
tattttgtgactactatgaacagac

SEQ ID NO: 794961 - DNA, 25 bp, Mus musculus
tattttgtgacttctatgaacagac

SEQ ID NO: 794962 - DNA, 25 bp, Mus musculus
tattttgtgagcacttttctccacc

SEQ ID NO: 794963 - DNA, 25 bp, Mus musculus
tattttgtgagctcttttctccacc

SEQ ID NO: 794964 - DNA, 25 bp, Mus musculus
tattttgtgcgcaaagagtcttttg

SEQ ID NO: 794965 - DNA, 25 bp, Mus musculus
tattttgtgcgctaagagtcttttg

SEQ ID NO: 794966 - DNA, 25 bp, Mus musculus
tattttgtgtcaaagctatgccaca

SEQ ID NO: 794967 - DNA, 25 bp, Mus musculus
tattttgtgtcatagctatgccaca

SEQ ID NO: 794968 - DNA, 25 bp, Mus musculus
tattttgtgtccaccatgatgctga

SEQ ID NO: 794969 - DNA, 25 bp, Mus musculus
tattttgtgtcccatcaagttccct

SEQ ID NO: 794970 - DNA, 25 bp, Mus musculus
tattttgtgtccgatcaagttccct

SEQ ID NO: 794971 - DNA, 25 bp, Mus musculus
tattttgtgtcctccatgatgctga

SEQ ID NO: 794972 - DNA, 25 bp, Mus musculus
tattttgtgtcgctgagttacttgt

SEQ ID NO: 794973 - DNA, 25 bp, Mus musculus
tattttgtgtcggtgagttacttgt

SEQ ID NO: 794974 - DNA, 25 bp, Mus musculus
tattttgttcttcaagggtctctga

SEQ ID NO: 794975 - DNA, 25 bp, Mus musculus
tattttgttcttgaagggtctctga

SEQ ID NO: 794976 - DNA, 25 bp, Mus musculus
tattttgttgttaggtctgtaggaa

SEQ ID NO: 794977 - DNA, 25 bp, Mus musculus
tattttgttgtttggtctgtaggaa

SEQ ID NO: 794978 - DNA, 25 bp, Mus musculus
tattttgtttgtctcgtgttcctta

SEQ ID NO: 794979 - DNA, 25 bp, Mus musculus
tattttgtttgtgtcgtgttcctta

SEQ ID NO: 794980 - DNA, 25 bp, Mus musculus
tatttttaaaccctgctggtcattt

SEQ ID NO: 794981 - DNA, 25 bp, Mus musculus
tatttttaaaccgtgctggtcattt

SEQ ID NO: 794982 - DNA, 25 bp, Mus musculus
tatttttaacttcatgggtccatta

SEQ ID NO: 794983 - DNA, 25 bp, Mus musculus
tatttttaacttgatgggtccatta

SEQ ID NO: 794984 - DNA, 25 bp, Mus musculus
tatttttaatgacgcctcagtcccc

SEQ ID NO: 794985 - DNA, 25 bp, Mus musculus
tatttttaatgaggcctcagtcccc

SEQ ID NO: 794986 - DNA, 25 bp, Mus musculus
tatttttaattgagccagcatgtgt

SEQ ID NO: 794987 - DNA, 25 bp, Mus musculus
tatttttaattgtgccagcatgtgt

SEQ ID NO: 794988 - DNA, 25 bp, Mus musculus
tatttttacactcctatactctaag

SEQ ID NO: 794989 - DNA, 25 bp, Mus musculus
tatttttacactgctatactctaag

SEQ ID NO: 794990 - DNA, 25 bp, Mus musculus
tatttttacagtaacccacttgctg

SEQ ID NO: 794991 - DNA, 25 bp, Mus musculus
tatttttacagttacccacttgctg

SEQ ID NO: 794992 - DNA, 25 bp, Mus musculus
tatttttacatgaaggctgacctcc

SEQ ID NO: 794993 - DNA, 25 bp, Mus musculus
tatttttacatgaatctttgacaac

SEQ ID NO: 794994 - DNA, 25 bp, Mus musculus
tatttttacatgtaggctgacctcc

SEQ ID NO: 794995 - DNA, 25 bp, Mus musculus
tatttttacatgtatctttgacaac

SEQ ID NO: 794996 - DNA, 25 bp, Mus musculus
tatttttacctcacattggacattc

SEQ ID NO: 794997 - DNA, 25 bp, Mus musculus
tatttttacctctcattggacattc

SEQ ID NO: 794998 - DNA, 25 bp, Mus musculus
tatttttactatattgtgtcccaag

SEQ ID NO: 794999 - DNA, 25 bp, Mus musculus
tatttttactattttgtgtcccaag

SEQ ID NO: 795000 - DNA, 25 bp, Mus musculus
tatttttacttaaatcggttcactg

SEQ ID NO: 795001 - DNA, 25 bp, Mus musculus
tatttttacttatatcggttcactg

SEQ ID NO: 795002 - DNA, 25 bp, Mus musculus
tatttttagcctcttttccgcgaag

SEQ ID NO: 795003 - DNA, 25 bp, Mus musculus
tatttttagcctgttttccgcgaag

SEQ ID NO: 795004 - DNA, 25 bp, Mus musculus
tatttttagctcattctttctcagg

SEQ ID NO: 795005 - DNA, 25 bp, Mus musculus
tatttttagctctttctttctcagg

SEQ ID NO: 795006 - DNA, 25 bp, Mus musculus
tatttttatcatagtcccgctcatt

SEQ ID NO: 795007 - DNA, 25 bp, Mus musculus
tatttttatcattgtcccgctcatt

SEQ ID NO: 795008 - DNA, 25 bp, Mus musculus
tatttttatgtgattcaaaccccaa

SEQ ID NO: 795009 - DNA, 25 bp, Mus musculus
tatttttatgtgtttcaaaccccaa

SEQ ID NO: 795010 - DNA, 25 bp, Mus musculus
tatttttatgttctgtggcttcgtg

SEQ ID NO: 795011 - DNA, 25 bp, Mus musculus
tatttttatgttgtgtggcttcgtg

SEQ ID NO: 795012 - DNA, 25 bp, Mus musculus
tatttttatttgcttgctccttgga

SEQ ID NO: 795013 - DNA, 25 bp, Mus musculus
tatttttatttggttgctccttgga

SEQ ID NO: 795014 - DNA, 25 bp, Mus musculus
tatttttcaattctgagttcgatga

SEQ ID NO: 795015 - DNA, 25 bp, Mus musculus
tatttttcaattgtgagttcgatga

SEQ ID NO: 795016 - DNA, 25 bp, Mus musculus
tatttttcactaagtccgggtagaa

SEQ ID NO: 795017 - DNA, 25 bp, Mus musculus
tatttttcactatgtccgggtagaa

SEQ ID NO: 795018 - DNA, 25 bp, Mus musculus
tatttttcagaaccaccagagtctt

SEQ ID NO: 795019 - DNA, 25 bp, Mus musculus
tatttttcagaagcaccagagtctt

SEQ ID NO: 795020 - DNA, 25 bp, Mus musculus
tatttttcagggattctggtttgca

SEQ ID NO: 795021 - DNA, 25 bp, Mus musculus
tatttttcagggtttctggtttgca

SEQ ID NO: 795022 - DNA, 25 bp, Mus musculus
tatttttcagtcacggaatccttcc

SEQ ID NO: 795023 - DNA, 25 bp, Mus musculus
tatttttcagtctcggaatccttcc

SEQ ID NO: 795024 - DNA, 25 bp, Mus musculus
tatttttcatagatctcaactcccc

SEQ ID NO: 795025 - DNA, 25 bp, Mus musculus
tatttttcatagttctcaactcccc

SEQ ID NO: 795026 - DNA, 25 bp, Mus musculus
tatttttcattcatacctgcatgta

SEQ ID NO: 795027 - DNA, 25 bp, Mus musculus
tatttttcattcttacctgcatgta

SEQ ID NO: 795028 - DNA, 25 bp, Mus musculus
tatttttcattgctctctacatttt

SEQ ID NO: 795029 - DNA, 25 bp, Mus musculus
tatttttcattggtctctacatttt

SEQ ID NO: 795030 - DNA, 25 bp, Mus musculus
tatttttccataatgactcatacta

SEQ ID NO: 795031 - DNA, 25 bp, Mus musculus
tatttttccatattgactcatacta

SEQ ID NO: 795032 - DNA, 25 bp, Mus musculus
tatttttccccgacttgcaaagtat

SEQ ID NO: 795033 - DNA, 25 bp, Mus musculus
tatttttccccgtcttgcaaagtat

SEQ ID NO: 795034 - DNA, 25 bp, Mus musculus
tatttttccctcaagcattttcaga

SEQ ID NO: 795035 - DNA, 25 bp, Mus musculus
tatttttccctctagcattttcaga

SEQ ID NO: 795036 - DNA, 25 bp, Mus musculus
tatttttcccttaggcattagaaag

SEQ ID NO: 795037 - DNA, 25 bp, Mus musculus
tatttttcccttcaatggcttttag

SEQ ID NO: 795038 - DNA, 25 bp, Mus musculus
tatttttcccttgaatggcttttag

SEQ ID NO: 795039 - DNA, 25 bp, Mus musculus
tatttttccctttggcattagaaag

SEQ ID NO: 795040 - DNA, 25 bp, Mus musculus
tatttttcctgtatcacggtgcctg

SEQ ID NO: 795041 - DNA, 25 bp, Mus musculus
tatttttcctgtttcacggtgcctg

SEQ ID NO: 795042 - DNA, 25 bp, Mus musculus
tatttttcgcttcctaccttagaga

SEQ ID NO: 795043 - DNA, 25 bp, Mus musculus
tatttttcgcttgctaccttagaga

SEQ ID NO: 795044 - DNA, 25 bp, Mus musculus
tatttttctaagaggtcctgttttg

SEQ ID NO: 795045 - DNA, 25 bp, Mus musculus
tatttttctaagtggtcctgttttg

SEQ ID NO: 795046 - DNA, 25 bp, Mus musculus
tatttttctagtcaacctctgttta

SEQ ID NO: 795047 - DNA, 25 bp, Mus musculus
tatttttctagtgaacctctgttta

SEQ ID NO: 795048 - DNA, 25 bp, Mus musculus
tatttttctccaatgctattcttaa

SEQ ID NO: 795049 - DNA, 25 bp, Mus musculus
tatttttctccattgctattcttaa

SEQ ID NO: 795050 - DNA, 25 bp, Mus musculus
tatttttctcctctagcttggaaaa

SEQ ID NO: 795051 - DNA, 25 bp, Mus musculus
tatttttctcctgtagcttggaaaa

SEQ ID NO: 795052 - DNA, 25 bp, Mus musculus
tatttttctctaactgttctgtatt

SEQ ID NO: 795053 - DNA, 25 bp, Mus musculus
tatttttctctatctgttctgtatt

SEQ ID NO: 795054 - DNA, 25 bp, Mus musculus
tatttttctctcatataatctggat

SEQ ID NO: 795055 - DNA, 25 bp, Mus musculus
tatttttctctcttataatctggat

SEQ ID NO: 795056 - DNA, 25 bp, Mus musculus
tatttttcttgaattttggatcaaa

SEQ ID NO: 795057 - DNA, 25 bp, Mus musculus
tatttttcttgatttttggatcaaa

SEQ ID NO: 795058 - DNA, 25 bp, Mus musculus
tatttttgaaccactgttttctcct

SEQ ID NO: 795059 - DNA, 25 bp, Mus musculus
tatttttgaacctctgttttctcct

SEQ ID NO: 795060 - DNA, 25 bp, Mus musculus
tatttttgacagatttctaagctcc

SEQ ID NO: 795061 - DNA, 25 bp, Mus musculus
tatttttgacagttttctaagctcc

SEQ ID NO: 795062 - DNA, 25 bp, Mus musculus
tatttttgatatcagctttgaccaa

SEQ ID NO: 795063 - DNA, 25 bp, Mus musculus
tatttttgatatgagctttgaccaa

SEQ ID NO: 795064 - DNA, 25 bp, Mus musculus
tatttttgatgcctagtgtttattc

SEQ ID NO: 795065 - DNA, 25 bp, Mus musculus
tatttttgatgcgtagtgtttattc

SEQ ID NO: 795066 - DNA, 25 bp, Mus musculus
tatttttgatgtccactgctctccg

SEQ ID NO: 795067 - DNA, 25 bp, Mus musculus
tatttttgatgtgcactgctctccg

SEQ ID NO: 795068 - DNA, 25 bp, Mus musculus
tatttttgcagtctaaccttgggct

SEQ ID NO: 795069 - DNA, 25 bp, Mus musculus
tatttttgcagtgtaaccttgggct

SEQ ID NO: 795070 - DNA, 25 bp, Mus musculus
tatttttgcattatgaactatatgg

SEQ ID NO: 795071 - DNA, 25 bp, Mus musculus
tatttttgcattttgaactatatgg

SEQ ID NO: 795072 - DNA, 25 bp, Mus musculus
tatttttgccataaactccacggcg

SEQ ID NO: 795073 - DNA, 25 bp, Mus musculus
tatttttgccattaactccacggcg

SEQ ID NO: 795074 - DNA, 25 bp, Mus musculus
tatttttggatcctgagtgtctgtc

SEQ ID NO: 795075 - DNA, 25 bp, Mus musculus
tatttttggatcgtgagtgtctgtc

SEQ ID NO: 795076 - DNA, 25 bp, Mus musculus
tatttttggtgcatcctgaaccagc

SEQ ID NO: 795077 - DNA, 25 bp, Mus musculus
tatttttggtgcttcctgaaccagc

SEQ ID NO: 795078 - DNA, 25 bp, Mus musculus
tatttttgtagcatcctcactggtt

SEQ ID NO: 795079 - DNA, 25 bp, Mus musculus
tatttttgtagcttcctcactggtt

SEQ ID NO: 795080 - DNA, 25 bp, Mus musculus
tatttttgtccaacgtttaaccagt

SEQ ID NO: 795081 - DNA, 25 bp, Mus musculus
tatttttgtccatcgtttaaccagt

SEQ ID NO: 795082 - DNA, 25 bp, Mus musculus
tatttttgtgggaatgggccctgct

SEQ ID NO: 795083 - DNA, 25 bp, Mus musculus
tatttttgtgggtatgggccctgct

SEQ ID NO: 795084 - DNA, 25 bp, Mus musculus
tatttttgttctactgactttccag

SEQ ID NO: 795085 - DNA, 25 bp, Mus musculus
tatttttgttcttctgactttccag

SEQ ID NO: 795086 - DNA, 25 bp, Mus musculus
tattttttacaacgattgcagaagg

SEQ ID NO: 795087 - DNA, 25 bp, Mus musculus
tattttttacaaggattgcagaagg

SEQ ID NO: 795088 - DNA, 25 bp, Mus musculus
tattttttacagagctttccttggg

SEQ ID NO: 795089 - DNA, 25 bp, Mus musculus
tattttttacagagtccctcaccat

SEQ ID NO: 795090 - DNA, 25 bp, Mus musculus
tattttttacagctacctggagaga

SEQ ID NO: 795091 - DNA, 25 bp, Mus musculus
tattttttacaggtacctggagaga

SEQ ID NO: 795092 - DNA, 25 bp, Mus musculus
tattttttacagtgctttccttggg

SEQ ID NO: 795093 - DNA, 25 bp, Mus musculus
tattttttacagtgtccctcaccat

SEQ ID NO: 795094 - DNA, 25 bp, Mus musculus
tattttttacatattgctttgactt

SEQ ID NO: 795095 - DNA, 25 bp, Mus musculus
tattttttacattttgctttgactt

SEQ ID NO: 795096 - DNA, 25 bp, Mus musculus
tattttttacctctagagacatgaa

SEQ ID NO: 795097 - DNA, 25 bp, Mus musculus
tattttttacctgtagagacatgaa

SEQ ID NO: 795098 - DNA, 25 bp, Mus musculus
tattttttactactgtcaccccaca

SEQ ID NO: 795099 - DNA, 25 bp, Mus musculus
tattttttactagtgtcaccccaca

SEQ ID NO: 795100 - DNA, 25 bp, Mus musculus
tattttttagcacaagtcagtattc

SEQ ID NO: 795101 - DNA, 25 bp, Mus musculus
tattttttagcagaagtcagtattc

SEQ ID NO: 795102 - DNA, 25 bp, Mus musculus
tattttttagtcatgtgcttgccct

SEQ ID NO: 795103 - DNA, 25 bp, Mus musculus
tattttttagtcttgtgcttgccct

SEQ ID NO: 795104 - DNA, 25 bp, Mus musculus
tattttttatttcatggcccagcgt

SEQ ID NO: 795105 - DNA, 25 bp, Mus musculus
tattttttatttgatggcccagcgt

SEQ ID NO: 795106 - DNA, 25 bp, Mus musculus
tattttttcatgatctcagggcccc

SEQ ID NO: 795107 - DNA, 25 bp, Mus musculus
tattttttcatgttctcagggcccc

SEQ ID NO: 795108 - DNA, 25 bp, Mus musculus
tattttttccagctgagcttccata

SEQ ID NO: 795109 - DNA, 25 bp, Mus musculus
tattttttccaggtgagcttccata

SEQ ID NO: 795110 - DNA, 25 bp, Mus musculus
tattttttccttctgagatgtattg

SEQ ID NO: 795111 - DNA, 25 bp, Mus musculus
tattttttccttgtgagatgtattg

SEQ ID NO: 795112 - DNA, 25 bp, Mus musculus
tattttttctgcacatctttctgcc

SEQ ID NO: 795113 - DNA, 25 bp, Mus musculus
tattttttctgctcatctttctgcc

SEQ ID NO: 795114 - DNA, 25 bp, Mus musculus
tattttttgcaaaacacacacatgc

SEQ ID NO: 795115 - DNA, 25 bp, Mus musculus
tattttttgcaatacacacacatgc

SEQ ID NO: 795116 - DNA, 25 bp, Mus musculus
tattttttgcttcaagaaactctga

SEQ ID NO: 795117 - DNA, 25 bp, Mus musculus
tattttttgcttgaagaaactctga

SEQ ID NO: 795118 - DNA, 25 bp, Mus musculus
tattttttggacaccctgtacactg

SEQ ID NO: 795119 - DNA, 25 bp, Mus musculus
tattttttggactccctgtacactg

SEQ ID NO: 795120 - DNA, 25 bp, Mus musculus
tattttttggctattcagtgtcttt

SEQ ID NO: 795121 - DNA, 25 bp, Mus musculus
tattttttggcttttcagtgtcttt

SEQ ID NO: 795122 - DNA, 25 bp, Mus musculus
tattttttggttcccatgactgctt

SEQ ID NO: 795123 - DNA, 25 bp, Mus musculus
tattttttggttgccatgactgctt

SEQ ID NO: 795124 - DNA, 25 bp, Mus musculus
tcaaaaaaaagcaatccccactgta

SEQ ID NO: 795125 - DNA, 25 bp, Mus musculus
tcaaaaaaaagctatccccactgta

SEQ ID NO: 795126 - DNA, 25 bp, Mus musculus
tcaaaaacaaggctttcgccctcga

SEQ ID NO: 795127 - DNA, 25 bp, Mus musculus
tcaaaaacaagggtttcgccctcga

SEQ ID NO: 795128 - DNA, 25 bp, Mus musculus
tcaaaaacacgtagctgtgtccaat

SEQ ID NO: 795129 - DNA, 25 bp, Mus musculus
tcaaaaacacgttgctgtgtccaat

SEQ ID NO: 795130 - DNA, 25 bp, Mus musculus
tcaaaaaccttcactactcttgacc

SEQ ID NO: 795131 - DNA, 25 bp, Mus musculus
tcaaaaaccttctctactcttgacc

SEQ ID NO: 795132 - DNA, 25 bp, Mus musculus
tcaaaaacctttagtctacggcctg

SEQ ID NO: 795133 - DNA, 25 bp, Mus musculus
tcaaaaaccttttgtctacggcctg

SEQ ID NO: 795134 - DNA, 25 bp, Mus musculus
tcaaaaaggatcatgtactggctgc

SEQ ID NO: 795135 - DNA, 25 bp, Mus musculus
tcaaaaaggatcttgtactggctgc

SEQ ID NO: 795136 - DNA, 25 bp, Mus musculus
tcaaaaagtaccatgaaaagcctat

SEQ ID NO: 795137 - DNA, 25 bp, Mus musculus
tcaaaaagtaccttgaaaagcctat

SEQ ID NO: 795138 - DNA, 25 bp, Mus musculus
tcaaaaatccctatagtgtctttct

SEQ ID NO: 795139 - DNA, 25 bp, Mus musculus
tcaaaaatccctttagtgtctttct

SEQ ID NO: 795140 - DNA, 25 bp, Mus musculus
tcaaaaatggtgaccccttgttctt

SEQ ID NO: 795141 - DNA, 25 bp, Mus musculus
tcaaaaatggtgtccccttgttctt

SEQ ID NO: 795142 - DNA, 25 bp, Mus musculus
tcaaaaattgagacacgtccgacta

SEQ ID NO: 795143 - DNA, 25 bp, Mus musculus
tcaaaaattgagtcacgtccgacta

SEQ ID NO: 795144 - DNA, 25 bp, Mus musculus
tcaaaaatttccagtcgaaagcctt

SEQ ID NO: 795145 - DNA, 25 bp, Mus musculus
tcaaaaatttcctgtcgaaagcctt

SEQ ID NO: 795146 - DNA, 25 bp, Mus musculus
tcaaaaattttgagaatctgccatt

SEQ ID NO: 795147 - DNA, 25 bp, Mus musculus
tcaaaaattttgtgaatctgccatt

SEQ ID NO: 795148 - DNA, 25 bp, Mus musculus
tcaaaacaaacgacactggcccagt

SEQ ID NO: 795149 - DNA, 25 bp, Mus musculus
tcaaaacaaacgtcactggcccagt

SEQ ID NO: 795150 - DNA, 25 bp, Mus musculus
tcaaaacaacctatagcaacaacaa

SEQ ID NO: 795151 - DNA, 25 bp, Mus musculus
tcaaaacaacctttagcaacaacaa

SEQ ID NO: 795152 - DNA, 25 bp, Mus musculus
tcaaaacacaccagtttacccagac

SEQ ID NO: 795153 - DNA, 25 bp, Mus musculus
tcaaaacacacctgtttacccagac

SEQ ID NO: 795154 - DNA, 25 bp, Mus musculus
tcaaaacagctgacatagaacaagg

SEQ ID NO: 795155 - DNA, 25 bp, Mus musculus
tcaaaacagctgtcatagaacaagg

SEQ ID NO: 795156 - DNA, 25 bp, Mus musculus
tcaaaacatactctcccacttgaac

SEQ ID NO: 795157 - DNA, 25 bp, Mus musculus
tcaaaacatactgtcccacttgaac

SEQ ID NO: 795158 - DNA, 25 bp, Mus musculus
tcaaaacatcgaccagtctacatga

SEQ ID NO: 795159 - DNA, 25 bp, Mus musculus
tcaaaacatcgagcagtctacatga

SEQ ID NO: 795160 - DNA, 25 bp, Mus musculus
tcaaaacattgtaccctttccctgg

SEQ ID NO: 795161 - DNA, 25 bp, Mus musculus
tcaaaacattgttccctttccctgg

SEQ ID NO: 795162 - DNA, 25 bp, Mus musculus
tcaaaaccaggtccaatgagctttc

SEQ ID NO: 795163 - DNA, 25 bp, Mus musculus
tcaaaaccaggtgcaatgagctttc

SEQ ID NO: 795164 - DNA, 25 bp, Mus musculus
tcaaaacccagtctacaaagctcgt

SEQ ID NO: 795165 - DNA, 25 bp, Mus musculus
tcaaaacccagtgtacaaagctcgt

SEQ ID NO: 795166 - DNA, 25 bp, Mus musculus
tcaaaacccctaagacacaggccag

SEQ ID NO: 795167 - DNA, 25 bp, Mus musculus
tcaaaacccctatgacacaggccag

SEQ ID NO: 795168 - DNA, 25 bp, Mus musculus
tcaaaaccgcaaacttcaggtaact

SEQ ID NO: 795169 - DNA, 25 bp, Mus musculus
tcaaaaccgcaatcttcaggtaact

SEQ ID NO: 795170 - DNA, 25 bp, Mus musculus
tcaaaacctgagactgatccttaga

SEQ ID NO: 795171 - DNA, 25 bp, Mus musculus
tcaaaacctgagtctgatccttaga

SEQ ID NO: 795172 - DNA, 25 bp, Mus musculus
tcaaaacctgtaagttggcagaaca

SEQ ID NO: 795173 - DNA, 25 bp, Mus musculus
tcaaaacctgtatgttggcagaaca

SEQ ID NO: 795174 - DNA, 25 bp, Mus musculus
tcaaaacctgtcagcttatacctac

SEQ ID NO: 795175 - DNA, 25 bp, Mus musculus
tcaaaacctgtctgcttatacctac

SEQ ID NO: 795176 - DNA, 25 bp, Mus musculus
tcaaaacgctgaccaactgcaacag

SEQ ID NO: 795177 - DNA, 25 bp, Mus musculus
tcaaaacgctgagcaactgcaacag

SEQ ID NO: 795178 - DNA, 25 bp, Mus musculus
tcaaaacggcgccgaacatgttgct

SEQ ID NO: 795179 - DNA, 25 bp, Mus musculus
tcaaaacggcgcggaacatgttgct

SEQ ID NO: 795180 - DNA, 25 bp, Mus musculus
tcaaaactaaggaaacgggacgatg

SEQ ID NO: 795181 - DNA, 25 bp, Mus musculus
tcaaaactaaggtaacgggacgatg

SEQ ID NO: 795182 - DNA, 25 bp, Mus musculus
tcaaaactacagctctcccttacat

SEQ ID NO: 795183 - DNA, 25 bp, Mus musculus
tcaaaactacaggtctcccttacat

SEQ ID NO: 795184 - DNA, 25 bp, Mus musculus
tcaaaactagctacgccaagcacct

SEQ ID NO: 795185 - DNA, 25 bp, Mus musculus
tcaaaactagcttcgccaagcacct

SEQ ID NO: 795186 - DNA, 25 bp, Mus musculus
tcaaaactcagaatgcagagagctg

SEQ ID NO: 795187 - DNA, 25 bp, Mus musculus
tcaaaactcagattgcagagagctg

SEQ ID NO: 795188 - DNA, 25 bp, Mus musculus
tcaaaactcgggatgtattcaaaag

SEQ ID NO: 795189 - DNA, 25 bp, Mus musculus
tcaaaactcgggttgtattcaaaag

SEQ ID NO: 795190 - DNA, 25 bp, Mus musculus
tcaaaactgaaacacttatatcact

SEQ ID NO: 795191 - DNA, 25 bp, Mus musculus
tcaaaactgaaagacttatatcact

SEQ ID NO: 795192 - DNA, 25 bp, Mus musculus
tcaaaactgcctacacaagattggg

SEQ ID NO: 795193 - DNA, 25 bp, Mus musculus
tcaaaactgccttcacaagattggg

SEQ ID NO: 795194 - DNA, 25 bp, Mus musculus
tcaaaactgggtacggagtctccgc

SEQ ID NO: 795195 - DNA, 25 bp, Mus musculus
tcaaaactgggttcggagtctccgc

SEQ ID NO: 795196 - DNA, 25 bp, Mus musculus
tcaaaactgttgactgtctctggaa

SEQ ID NO: 795197 - DNA, 25 bp, Mus musculus
tcaaaactgttgtctgtctctggaa

SEQ ID NO: 795198 - DNA, 25 bp, Mus musculus
tcaaaacttaccacggtgtgtcacg

SEQ ID NO: 795199 - DNA, 25 bp, Mus musculus
tcaaaacttacctcggtgtgtcacg

SEQ ID NO: 795200 - DNA, 25 bp, Mus musculus
tcaaaagaacacctatctctgccac

SEQ ID NO: 795201 - DNA, 25 bp, Mus musculus
tcaaaagaacacgtatctctgccac

SEQ ID NO: 795202 - DNA, 25 bp, Mus musculus
tcaaaagacacacctgcaccttttt

SEQ ID NO: 795203 - DNA, 25 bp, Mus musculus
tcaaaagacacagctgcaccttttt

SEQ ID NO: 795204 - DNA, 25 bp, Mus musculus
tcaaaagactgactggcttgctctc

SEQ ID NO: 795205 - DNA, 25 bp, Mus musculus
tcaaaagactgagtggcttgctctc

SEQ ID NO: 795206 - DNA, 25 bp, Mus musculus
tcaaaagagcccaaatggctgccta

SEQ ID NO: 795207 - DNA, 25 bp, Mus musculus
tcaaaagagccctaatggctgccta

SEQ ID NO: 795208 - DNA, 25 bp, Mus musculus
tcaaaagatgtgcttccagcctggg

SEQ ID NO: 795209 - DNA, 25 bp, Mus musculus
tcaaaagatgtggttccagcctggg

SEQ ID NO: 795210 - DNA, 25 bp, Mus musculus
tcaaaagccgccaaggacgttctgg

SEQ ID NO: 795211 - DNA, 25 bp, Mus musculus
tcaaaagccgcctaggacgttctgg

SEQ ID NO: 795212 - DNA, 25 bp, Mus musculus
tcaaaagccgggacaagagggacag

SEQ ID NO: 795213 - DNA, 25 bp, Mus musculus
tcaaaagccgggtcaagagggacag

SEQ ID NO: 795214 - DNA, 25 bp, Mus musculus
tcaaaagcgggccactgatgcaccg

SEQ ID NO: 795215 - DNA, 25 bp, Mus musculus
tcaaaagcgggcgactgatgcaccg

SEQ ID NO: 795216 - DNA, 25 bp, Mus musculus
tcaaaagctactcggcgttttacag

SEQ ID NO: 795217 - DNA, 25 bp, Mus musculus
tcaaaagctactgggcgttttacag

SEQ ID NO: 795218 - DNA, 25 bp, Mus musculus
tcaaaagctctaaggctccaggaag

SEQ ID NO: 795219 - DNA, 25 bp, Mus musculus
tcaaaagctctatggctccaggaag

SEQ ID NO: 795220 - DNA, 25 bp, Mus musculus
tcaaaagcttgcaaacccttctcca

SEQ ID NO: 795221 - DNA, 25 bp, Mus musculus
tcaaaagcttgctaacccttctcca

SEQ ID NO: 795222 - DNA, 25 bp, Mus musculus
tcaaaagctttaatgcctattgcaa

SEQ ID NO: 795223 - DNA, 25 bp, Mus musculus
tcaaaagctttattgcctattgcaa

SEQ ID NO: 795224 - DNA, 25 bp, Mus musculus
tcaaaaggaactaacttgccgtcca

SEQ ID NO: 795225 - DNA, 25 bp, Mus musculus
tcaaaaggaacttacttgccgtcca

SEQ ID NO: 795226 - DNA, 25 bp, Mus musculus
tcaaaaggatgccagctggtgacct

SEQ ID NO: 795227 - DNA, 25 bp, Mus musculus
tcaaaaggatgcgagctggtgacct

SEQ ID NO: 795228 - DNA, 25 bp, Mus musculus
tcaaaaggtgtcaggcgtggccagt

SEQ ID NO: 795229 - DNA, 25 bp, Mus musculus
tcaaaaggtgtctggcgtggccagt

SEQ ID NO: 795230 - DNA, 25 bp, Mus musculus
tcaaaagtattgagtagccgtcatt

SEQ ID NO: 795231 - DNA, 25 bp, Mus musculus
tcaaaagtattgtgtagccgtcatt

SEQ ID NO: 795232 - DNA, 25 bp, Mus musculus
tcaaaagtccatagcattctcagtt

SEQ ID NO: 795233 - DNA, 25 bp, Mus musculus
tcaaaagtccattgcattctcagtt

SEQ ID NO: 795234 - DNA, 25 bp, Mus musculus
tcaaaagttccccagttgctattta

SEQ ID NO: 795235 - DNA, 25 bp, Mus musculus
tcaaaagttcccgagttgctattta

SEQ ID NO: 795236 - DNA, 25 bp, Mus musculus
tcaaaatacatcctctcttttcccg

SEQ ID NO: 795237 - DNA, 25 bp, Mus musculus
tcaaaatacatcgtctcttttcccg

SEQ ID NO: 795238 - DNA, 25 bp, Mus musculus
tcaaaataccgacatgcaagccctt

SEQ ID NO: 795239 - DNA, 25 bp, Mus musculus
tcaaaataccgagatgcaagccctt

SEQ ID NO: 795240 - DNA, 25 bp, Mus musculus
tcaaaatcaactagtccccattaac

SEQ ID NO: 795241 - DNA, 25 bp, Mus musculus
tcaaaatcaacttgtccccattaac

SEQ ID NO: 795242 - DNA, 25 bp, Mus musculus
tcaaaatcagacaccatcagggcca

SEQ ID NO: 795243 - DNA, 25 bp, Mus musculus
tcaaaatcagactccatcagggcca

SEQ ID NO: 795244 - DNA, 25 bp, Mus musculus
tcaaaatcaggacgctaagctttag

SEQ ID NO: 795245 - DNA, 25 bp, Mus musculus
tcaaaatcaggaggctaagctttag

SEQ ID NO: 795246 - DNA, 25 bp, Mus musculus
tcaaaatcccaacacgcagcagaca

SEQ ID NO: 795247 - DNA, 25 bp, Mus musculus
tcaaaatcccaagacgcagcagaca

SEQ ID NO: 795248 - DNA, 25 bp, Mus musculus
tcaaaatcccttacgaaccagctca

SEQ ID NO: 795249 - DNA, 25 bp, Mus musculus
tcaaaatccctttcgaaccagctca

SEQ ID NO: 795250 - DNA, 25 bp, Mus musculus
tcaaaatccgctattaacgcccatc

SEQ ID NO: 795251 - DNA, 25 bp, Mus musculus
tcaaaatccgcttttaacgcccatc

SEQ ID NO: 795252 - DNA, 25 bp, Mus musculus
tcaaaatcgatcatttctttcccca

SEQ ID NO: 795253 - DNA, 25 bp, Mus musculus
tcaaaatcgatcttttctttcccca

SEQ ID NO: 795254 - DNA, 25 bp, Mus musculus
tcaaaatcggaaactcatgccctct

SEQ ID NO: 795255 - DNA, 25 bp, Mus musculus
tcaaaatcggaatctcatgccctct

SEQ ID NO: 795256 - DNA, 25 bp, Mus musculus
tcaaaatctaagcagggtcagccta

SEQ ID NO: 795257 - DNA, 25 bp, Mus musculus
tcaaaatctaaggagggtcagccta

SEQ ID NO: 795258 - DNA, 25 bp, Mus musculus
tcaaaatctctgcacactgctttca

SEQ ID NO: 795259 - DNA, 25 bp, Mus musculus
tcaaaatctctggacactgctttca

SEQ ID NO: 795260 - DNA, 25 bp, Mus musculus
tcaaaatctgtgagcttggtatcaa

SEQ ID NO: 795261 - DNA, 25 bp, Mus musculus
tcaaaatctgtgtgcttggtatcaa

SEQ ID NO: 795262 - DNA, 25 bp, Mus musculus
tcaaaatctttgattagtcaccaac

SEQ ID NO: 795263 - DNA, 25 bp, Mus musculus
tcaaaatctttgtttagtcaccaac

SEQ ID NO: 795264 - DNA, 25 bp, Mus musculus
tcaaaatgaggacctctgaccagag

SEQ ID NO: 795265 - DNA, 25 bp, Mus musculus
tcaaaatgaggagctctgaccagag

SEQ ID NO: 795266 - DNA, 25 bp, Mus musculus
tcaaaatgctgactcccaagaggtc

SEQ ID NO: 795267 - DNA, 25 bp, Mus musculus
tcaaaatgctgagtcccaagaggtc

SEQ ID NO: 795268 - DNA, 25 bp, Mus musculus
tcaaaatggcaactctttccccaac

SEQ ID NO: 795269 - DNA, 25 bp, Mus musculus
tcaaaatggcaagtctttccccaac

SEQ ID NO: 795270 - DNA, 25 bp, Mus musculus
tcaaaatggcatctttcctcccaaa

SEQ ID NO: 795271 - DNA, 25 bp, Mus musculus
tcaaaatggcatgtttcctcccaaa

SEQ ID NO: 795272 - DNA, 25 bp, Mus musculus
tcaaaatgtcagcttctggcacccc

SEQ ID NO: 795273 - DNA, 25 bp, Mus musculus
tcaaaatgtcaggttctggcacccc

SEQ ID NO: 795274 - DNA, 25 bp, Mus musculus
tcaaaatgtgctaggcacctgcctt

SEQ ID NO: 795275 - DNA, 25 bp, Mus musculus
tcaaaatgtgcttggcacctgcctt

SEQ ID NO: 795276 - DNA, 25 bp, Mus musculus
tcaaaatgttggattctggcctctg

SEQ ID NO: 795277 - DNA, 25 bp, Mus musculus
tcaaaatgttggtttctggcctctg

SEQ ID NO: 795278 - DNA, 25 bp, Mus musculus
tcaaaattacccagtatggaagaac

SEQ ID NO: 795279 - DNA, 25 bp, Mus musculus
tcaaaattaccctgtatggaagaac

SEQ ID NO: 795280 - DNA, 25 bp, Mus musculus
tcaaaattctgcacggcagacttct

SEQ ID NO: 795281 - DNA, 25 bp, Mus musculus
tcaaaattctgctcggcagacttct

SEQ ID NO: 795282 - DNA, 25 bp, Mus musculus
tcaaaatttctcaccctttcacttt

SEQ ID NO: 795283 - DNA, 25 bp, Mus musculus
tcaaaatttctctccctttcacttt

SEQ ID NO: 795284 - DNA, 25 bp, Mus musculus
tcaaaatttgatcccatccggcttg

SEQ ID NO: 795285 - DNA, 25 bp, Mus musculus
tcaaaatttgatgccatccggcttg

SEQ ID NO: 795286 - DNA, 25 bp, Mus musculus
tcaaaatttggcctcacccgtgatt

SEQ ID NO: 795287 - DNA, 25 bp, Mus musculus
tcaaaatttggcgtcacccgtgatt

SEQ ID NO: 795288 - DNA, 25 bp, Mus musculus
tcaaacaaaggactcccgctgggcc

SEQ ID NO: 795289 - DNA, 25 bp, Mus musculus
tcaaacaaaggagtcccgctgggcc

SEQ ID NO: 795290 - DNA, 25 bp, Mus musculus
tcaaacaacttcagactcctggtac

SEQ ID NO: 795291 - DNA, 25 bp, Mus musculus
tcaaacaacttctgactcctggtac

SEQ ID NO: 795292 - DNA, 25 bp, Mus musculus
tcaaacaataacaggagtctacccc

SEQ ID NO: 795293 - DNA, 25 bp, Mus musculus
tcaaacaataactggagtctacccc

SEQ ID NO: 795294 - DNA, 25 bp, Mus musculus
tcaaacaatgtgacttggtatttac

SEQ ID NO: 795295 - DNA, 25 bp, Mus musculus
tcaaacaatgtgtcttggtatttac

SEQ ID NO: 795296 - DNA, 25 bp, Mus musculus
tcaaacacccttccaactagacaag

SEQ ID NO: 795297 - DNA, 25 bp, Mus musculus
tcaaacacccttgcaactagacaag

SEQ ID NO: 795298 - DNA, 25 bp, Mus musculus
tcaaacacctttacagaatgagcaa

SEQ ID NO: 795299 - DNA, 25 bp, Mus musculus
tcaaacaccttttcagaatgagcaa

SEQ ID NO: 795300 - DNA, 25 bp, Mus musculus
tcaaacacgtgacataggcgcccag

SEQ ID NO: 795301 - DNA, 25 bp, Mus musculus
tcaaacacgtgagataggcgcccag

SEQ ID NO: 795302 - DNA, 25 bp, Mus musculus
tcaaacactggtcttctcattcctt

SEQ ID NO: 795303 - DNA, 25 bp, Mus musculus
tcaaacactggtgttctcattcctt

SEQ ID NO: 795304 - DNA, 25 bp, Mus musculus
tcaaacactgtgcaaagtacatctt

SEQ ID NO: 795305 - DNA, 25 bp, Mus musculus
tcaaacactgtggaaagtacatctt

SEQ ID NO: 795306 - DNA, 25 bp, Mus musculus
tcaaacagacccacgaggtaggcct

SEQ ID NO: 795307 - DNA, 25 bp, Mus musculus
tcaaacagaccctcgaggtaggcct

SEQ ID NO: 795308 - DNA, 25 bp, Mus musculus
tcaaacagcacacctccatctggag

SEQ ID NO: 795309 - DNA, 25 bp, Mus musculus
tcaaacagcacagctccatctggag

SEQ ID NO: 795310 - DNA, 25 bp, Mus musculus
tcaaacagcatcattgtggtcccca

SEQ ID NO: 795311 - DNA, 25 bp, Mus musculus
tcaaacagcatctttgtggtcccca

SEQ ID NO: 795312 - DNA, 25 bp, Mus musculus
tcaaacagcgcccagcctattttcg

SEQ ID NO: 795313 - DNA, 25 bp, Mus musculus
tcaaacagcgccgagcctattttcg

SEQ ID NO: 795314 - DNA, 25 bp, Mus musculus
tcaaacagggttaggctccagaaag

SEQ ID NO: 795315 - DNA, 25 bp, Mus musculus
tcaaacagggtttggctccagaaag

SEQ ID NO: 795316 - DNA, 25 bp, Mus musculus
tcaaacagtggtcgcttgcgttttt

SEQ ID NO: 795317 - DNA, 25 bp, Mus musculus
tcaaacagtggtggcttgcgttttt

SEQ ID NO: 795318 - DNA, 25 bp, Mus musculus
tcaaacatcatgatagcccgccaat

SEQ ID NO: 795319 - DNA, 25 bp, Mus musculus
tcaaacatcatgttagcccgccaat

SEQ ID NO: 795320 - DNA, 25 bp, Mus musculus
tcaaacatccccaaagggcgtccgg

SEQ ID NO: 795321 - DNA, 25 bp, Mus musculus
tcaaacatcccctaagggcgtccgg

SEQ ID NO: 795322 - DNA, 25 bp, Mus musculus
tcaaacatctataaagtcccacaat

SEQ ID NO: 795323 - DNA, 25 bp, Mus musculus
tcaaacatctattaagtcccacaat

SEQ ID NO: 795324 - DNA, 25 bp, Mus musculus
tcaaacatggttcggctgagctatc

SEQ ID NO: 795325 - DNA, 25 bp, Mus musculus
tcaaacatggttgggctgagctatc

SEQ ID NO: 795326 - DNA, 25 bp, Mus musculus
tcaaaccaaacaccggtgacccagg

SEQ ID NO: 795327 - DNA, 25 bp, Mus musculus
tcaaaccaaacagcggtgacccagg

SEQ ID NO: 795328 - DNA, 25 bp, Mus musculus
tcaaaccaaagcaatctgactccag

SEQ ID NO: 795329 - DNA, 25 bp, Mus musculus
tcaaaccaaagctatctgactccag

SEQ ID NO: 795330 - DNA, 25 bp, Mus musculus
tcaaaccaagcccaaccaaaagcaa

SEQ ID NO: 795331 - DNA, 25 bp, Mus musculus
tcaaaccaagccctgtttcatgcac

SEQ ID NO: 795332 - DNA, 25 bp, Mus musculus
tcaaaccaagccgaaccaaaagcaa

SEQ ID NO: 795333 - DNA, 25 bp, Mus musculus
tcaaaccaagccgtgtttcatgcac

SEQ ID NO: 795334 - DNA, 25 bp, Mus musculus
tcaaaccaagtcactgttcattttc

SEQ ID NO: 795335 - DNA, 25 bp, Mus musculus
tcaaaccaagtctctgttcattttc

SEQ ID NO: 795336 - DNA, 25 bp, Mus musculus
tcaaaccaagttctcatggatgctt

SEQ ID NO: 795337 - DNA, 25 bp, Mus musculus
tcaaaccaagttgtcatggatgctt

SEQ ID NO: 795338 - DNA, 25 bp, Mus musculus
tcaaaccaccccagtaatgcaaggg

SEQ ID NO: 795339 - DNA, 25 bp, Mus musculus
tcaaaccacccctgtaatgcaaggg

SEQ ID NO: 795340 - DNA, 25 bp, Mus musculus
tcaaaccactttacatgaaccagtg

SEQ ID NO: 795341 - DNA, 25 bp, Mus musculus
tcaaaccacttttcatgaaccagtg

SEQ ID NO: 795342 - DNA, 25 bp, Mus musculus
tcaaaccatggaattttctcccaga

SEQ ID NO: 795343 - DNA, 25 bp, Mus musculus
tcaaaccatggatttttctcccaga

SEQ ID NO: 795344 - DNA, 25 bp, Mus musculus
tcaaacccaaaaatatctgccaacc

SEQ ID NO: 795345 - DNA, 25 bp, Mus musculus
tcaaacccaaaattatctgccaacc

SEQ ID NO: 795346 - DNA, 25 bp, Mus musculus
tcaaacccactgagtagcagcagat

SEQ ID NO: 795347 - DNA, 25 bp, Mus musculus
tcaaacccactgtgtagcagcagat

SEQ ID NO: 795348 - DNA, 25 bp, Mus musculus
tcaaacccagcaaccacatggtagc

SEQ ID NO: 795349 - DNA, 25 bp, Mus musculus
tcaaacccagcatccacatggtagc

SEQ ID NO: 795350 - DNA, 25 bp, Mus musculus
tcaaacccaggccttgtgcaagtag

SEQ ID NO: 795351 - DNA, 25 bp, Mus musculus
tcaaacccaggcgttgtgcaagtag

SEQ ID NO: 795352 - DNA, 25 bp, Mus musculus
tcaaacccataaatttccagtagct

SEQ ID NO: 795353 - DNA, 25 bp, Mus musculus
tcaaacccataattttccagtagct

SEQ ID NO: 795354 - DNA, 25 bp, Mus musculus
tcaaacccatccctgtgtaaaagga

SEQ ID NO: 795355 - DNA, 25 bp, Mus musculus
tcaaacccatccgtgtgtaaaagga

SEQ ID NO: 795356 - DNA, 25 bp, Mus musculus
tcaaacccttatcagaatcctcgag

SEQ ID NO: 795357 - DNA, 25 bp, Mus musculus
tcaaacccttatgagaatcctcgag

SEQ ID NO: 795358 - DNA, 25 bp, Mus musculus
tcaaaccctttgaattgtaaccaag

SEQ ID NO: 795359 - DNA, 25 bp, Mus musculus
tcaaaccctttgagagctgcgaaag

SEQ ID NO: 795360 - DNA, 25 bp, Mus musculus
tcaaaccctttgtattgtaaccaag

SEQ ID NO: 795361 - DNA, 25 bp, Mus musculus
tcaaaccctttgtgagctgcgaaag

SEQ ID NO: 795362 - DNA, 25 bp, Mus musculus
tcaaaccgccccatctgtggaagaa

SEQ ID NO: 795363 - DNA, 25 bp, Mus musculus
tcaaaccgccccttctgtggaagaa

SEQ ID NO: 795364 - DNA, 25 bp, Mus musculus
tcaaaccggcagaaaaagaccgtgg

SEQ ID NO: 795365 - DNA, 25 bp, Mus musculus
tcaaaccggcagtaaaagaccgtgg

SEQ ID NO: 795366 - DNA, 25 bp, Mus musculus
tcaaaccgtgagcaatttcctgtgt

SEQ ID NO: 795367 - DNA, 25 bp, Mus musculus
tcaaaccgtgaggaatttcctgtgt

SEQ ID NO: 795368 - DNA, 25 bp, Mus musculus
tcaaaccgtgatcgagcctcaggtc

SEQ ID NO: 795369 - DNA, 25 bp, Mus musculus
tcaaaccgtgatggagcctcaggtc

SEQ ID NO: 795370 - DNA, 25 bp, Mus musculus
tcaaaccgttaaaccgttgggcctg

SEQ ID NO: 795371 - DNA, 25 bp, Mus musculus
tcaaaccgttaatccgttgggcctg

SEQ ID NO: 795372 - DNA, 25 bp, Mus musculus
tcaaacctacccaatgtcaagaagt

SEQ ID NO: 795373 - DNA, 25 bp, Mus musculus
tcaaacctaccctatgtcaagaagt

SEQ ID NO: 795374 - DNA, 25 bp, Mus musculus
tcaaacctaggtaccagctatggct

SEQ ID NO: 795375 - DNA, 25 bp, Mus musculus
tcaaacctaggttccagctatggct

SEQ ID NO: 795376 - DNA, 25 bp, Mus musculus
tcaaacctatgtcccctgaagagca

SEQ ID NO: 795377 - DNA, 25 bp, Mus musculus
tcaaacctatgtgccctgaagagca

SEQ ID NO: 795378 - DNA, 25 bp, Mus musculus
tcaaacctcctcatactctgcagag

SEQ ID NO: 795379 - DNA, 25 bp, Mus musculus
tcaaacctcctcttactctgcagag

SEQ ID NO: 795380 - DNA, 25 bp, Mus musculus
tcaaaccttctgagcaatgcctttt

SEQ ID NO: 795381 - DNA, 25 bp, Mus musculus
tcaaaccttctgtgcaatgcctttt

SEQ ID NO: 795382 - DNA, 25 bp, Mus musculus
tcaaacctttacagggtgactccaa

SEQ ID NO: 795383 - DNA, 25 bp, Mus musculus
tcaaacctttactgggtgactccaa

SEQ ID NO: 795384 - DNA, 25 bp, Mus musculus
tcaaacgacgcaatctgacccggct

SEQ ID NO: 795385 - DNA, 25 bp, Mus musculus
tcaaacgacgcattctgacccggct

SEQ ID NO: 795386 - DNA, 25 bp, Mus musculus
tcaaacgagcatcttctcccttaaa

SEQ ID NO: 795387 - DNA, 25 bp, Mus musculus
tcaaacgagcatgttctcccttaaa

SEQ ID NO: 795388 - DNA, 25 bp, Mus musculus
tcaaacgaggagatcagctactttc

SEQ ID NO: 795389 - DNA, 25 bp, Mus musculus
tcaaacgaggagttcagctactttc

SEQ ID NO: 795390 - DNA, 25 bp, Mus musculus
tcaaacgaggcgacaaattttgtcc

SEQ ID NO: 795391 - DNA, 25 bp, Mus musculus
tcaaacgaggcgtcaaattttgtcc

SEQ ID NO: 795392 - DNA, 25 bp, Mus musculus
tcaaacgataggaccgatccctcgg

SEQ ID NO: 795393 - DNA, 25 bp, Mus musculus
tcaaacgataggtccgatccctcgg

SEQ ID NO: 795394 - DNA, 25 bp, Mus musculus
tcaaacgatgtcactatccagtgct

SEQ ID NO: 795395 - DNA, 25 bp, Mus musculus
tcaaacgatgtctctatccagtgct

SEQ ID NO: 795396 - DNA, 25 bp, Mus musculus
tcaaacgccaccaggtcatattcat

SEQ ID NO: 795397 - DNA, 25 bp, Mus musculus
tcaaacgccacctggtcatattcat

SEQ ID NO: 795398 - DNA, 25 bp, Mus musculus
tcaaacgctgtgaagttcggagaat

SEQ ID NO: 795399 - DNA, 25 bp, Mus musculus
tcaaacgctgtgtagttcggagaat

SEQ ID NO: 795400 - DNA, 25 bp, Mus musculus
tcaaacgcttttccaaacggtgttc

SEQ ID NO: 795401 - DNA, 25 bp, Mus musculus
tcaaacgcttttgcaaacggtgttc

SEQ ID NO: 795402 - DNA, 25 bp, Mus musculus
tcaaacggacggctaaagagtagat

SEQ ID NO: 795403 - DNA, 25 bp, Mus musculus
tcaaacggacgggtaaagagtagat

SEQ ID NO: 795404 - DNA, 25 bp, Mus musculus
tcaaacggtaacaatgcaaattcag

SEQ ID NO: 795405 - DNA, 25 bp, Mus musculus
tcaaacggtaactatgcaaattcag

SEQ ID NO: 795406 - DNA, 25 bp, Mus musculus
tcaaacgtctggcaccctccaaggg

SEQ ID NO: 795407 - DNA, 25 bp, Mus musculus
tcaaacgtctgggaccctccaaggg

SEQ ID NO: 795408 - DNA, 25 bp, Mus musculus
tcaaacgtttagaagccaagccggt

SEQ ID NO: 795409 - DNA, 25 bp, Mus musculus
tcaaacgtttagtagccaagccggt

SEQ ID NO: 795410 - DNA, 25 bp, Mus musculus
tcaaacgtttgcacatatggatagt

SEQ ID NO: 795411 - DNA, 25 bp, Mus musculus
tcaaacgtttgctcatatggatagt

SEQ ID NO: 795412 - DNA, 25 bp, Mus musculus
tcaaactaaggcagcacctcccaag

SEQ ID NO: 795413 - DNA, 25 bp, Mus musculus
tcaaactaaggctgcacctcccaag

SEQ ID NO: 795414 - DNA, 25 bp, Mus musculus
tcaaactatcctcggagtcactctc

SEQ ID NO: 795415 - DNA, 25 bp, Mus musculus
tcaaactatcctgggagtcactctc

SEQ ID NO: 795416 - DNA, 25 bp, Mus musculus
tcaaactattgtcgcgctctggact

SEQ ID NO: 795417 - DNA, 25 bp, Mus musculus
tcaaactattgtggcgctctggact

SEQ ID NO: 795418 - DNA, 25 bp, Mus musculus
tcaaactcacaaatcctgtgcctgt

SEQ ID NO: 795419 - DNA, 25 bp, Mus musculus
tcaaactcacaacagatgggcctgc

SEQ ID NO: 795420 - DNA, 25 bp, Mus musculus
tcaaactcacaagagatgggcctgc

SEQ ID NO: 795421 - DNA, 25 bp, Mus musculus
tcaaactcacaattcctgtgcctgt

SEQ ID NO: 795422 - DNA, 25 bp, Mus musculus
tcaaactcacatagaccggcttggt

SEQ ID NO: 795423 - DNA, 25 bp, Mus musculus
tcaaactcacattgaccggcttggt

SEQ ID NO: 795424 - DNA, 25 bp, Mus musculus
tcaaactcatagattcctctgcttc

SEQ ID NO: 795425 - DNA, 25 bp, Mus musculus
tcaaactcatagtttcctctgcttc

SEQ ID NO: 795426 - DNA, 25 bp, Mus musculus
tcaaactcatccaccaatacatggt

SEQ ID NO: 795427 - DNA, 25 bp, Mus musculus
tcaaactcatcctccaatacatggt

SEQ ID NO: 795428 - DNA, 25 bp, Mus musculus
tcaaactcattaagccttggaaagg

SEQ ID NO: 795429 - DNA, 25 bp, Mus musculus
tcaaactcattatgccttggaaagg

SEQ ID NO: 795430 - DNA, 25 bp, Mus musculus
tcaaactccgcccagggtggaacag

SEQ ID NO: 795431 - DNA, 25 bp, Mus musculus
tcaaactccgccgagggtggaacag

SEQ ID NO: 795432 - DNA, 25 bp, Mus musculus
tcaaactcctagcccaaagaaccga

SEQ ID NO: 795433 - DNA, 25 bp, Mus musculus
tcaaactcctaggccaaagaaccga

SEQ ID NO: 795434 - DNA, 25 bp, Mus musculus
tcaaactcggaacgaacgtactggt

SEQ ID NO: 795435 - DNA, 25 bp, Mus musculus
tcaaactcggaaggaacgtactggt

SEQ ID NO: 795436 - DNA, 25 bp, Mus musculus
tcaaactcttctcatacccttaaat

SEQ ID NO: 795437 - DNA, 25 bp, Mus musculus
tcaaactcttctgatacccttaaat

SEQ ID NO: 795438 - DNA, 25 bp, Mus musculus
tcaaactgacagactattcagagga

SEQ ID NO: 795439 - DNA, 25 bp, Mus musculus
tcaaactgacagtctattcagagga

SEQ ID NO: 795440 - DNA, 25 bp, Mus musculus
tcaaactgacccagaggcgcagact

SEQ ID NO: 795441 - DNA, 25 bp, Mus musculus
tcaaactgaccctgaggcgcagact

SEQ ID NO: 795442 - DNA, 25 bp, Mus musculus
tcaaactgacttactgttacctttc

SEQ ID NO: 795443 - DNA, 25 bp, Mus musculus
tcaaactgactttctgttacctttc

SEQ ID NO: 795444 - DNA, 25 bp, Mus musculus
tcaaactgagtcagaaggcttgcca

SEQ ID NO: 795445 - DNA, 25 bp, Mus musculus
tcaaactgagtctgaaggcttgcca

SEQ ID NO: 795446 - DNA, 25 bp, Mus musculus
tcaaactgagttacgaggctgggca

SEQ ID NO: 795447 - DNA, 25 bp, Mus musculus
tcaaactgagtttcgaggctgggca

SEQ ID NO: 795448 - DNA, 25 bp, Mus musculus
tcaaactgcaaccatatctctcagc

SEQ ID NO: 795449 - DNA, 25 bp, Mus musculus
tcaaactgcaacgatatctctcagc

SEQ ID NO: 795450 - DNA, 25 bp, Mus musculus
tcaaactgccaaagctccttatttc

SEQ ID NO: 795451 - DNA, 25 bp, Mus musculus
tcaaactgccaatgctccttatttc

SEQ ID NO: 795452 - DNA, 25 bp, Mus musculus
tcaaactgccctctgacttgtctac

SEQ ID NO: 795453 - DNA, 25 bp, Mus musculus
tcaaactgccctgtgacttgtctac

SEQ ID NO: 795454 - DNA, 25 bp, Mus musculus
tcaaactgctccagtattagttgca

SEQ ID NO: 795455 - DNA, 25 bp, Mus musculus
tcaaactgctcctgtattagttgca

SEQ ID NO: 795456 - DNA, 25 bp, Mus musculus
tcaaactgctgtcctttccttcaaa

SEQ ID NO: 795457 - DNA, 25 bp, Mus musculus
tcaaactgctgtgctttccttcaaa

SEQ ID NO: 795458 - DNA, 25 bp, Mus musculus
tcaaactggaggctagtctgctaca

SEQ ID NO: 795459 - DNA, 25 bp, Mus musculus
tcaaactggagggtagtctgctaca

SEQ ID NO: 795460 - DNA, 25 bp, Mus musculus
tcaaactggggtatctgctgcaaga

SEQ ID NO: 795461 - DNA, 25 bp, Mus musculus
tcaaactggggtttctgctgcaaga

SEQ ID NO: 795462 - DNA, 25 bp, Mus musculus
tcaaactgggtgacgctggtgagta

SEQ ID NO: 795463 - DNA, 25 bp, Mus musculus
tcaaactgggtgtcgctggtgagta

SEQ ID NO: 795464 - DNA, 25 bp, Mus musculus
tcaaactggtggaggccctttgttt

SEQ ID NO: 795465 - DNA, 25 bp, Mus musculus
tcaaactggtggtggccctttgttt

SEQ ID NO: 795466 - DNA, 25 bp, Mus musculus
tcaaacttaagtatctgcctcagtt

SEQ ID NO: 795467 - DNA, 25 bp, Mus musculus
tcaaacttaagtttctgcctcagtt

SEQ ID NO: 795468 - DNA, 25 bp, Mus musculus
tcaaacttcatcaagccctcagaaa

SEQ ID NO: 795469 - DNA, 25 bp, Mus musculus
tcaaacttcatctagccctcagaaa

SEQ ID NO: 795470 - DNA, 25 bp, Mus musculus
tcaaacttcctgacagctgaccggg

SEQ ID NO: 795471 - DNA, 25 bp, Mus musculus
tcaaacttcctgtcagctgaccggg

SEQ ID NO: 795472 - DNA, 25 bp, Mus musculus
tcaaacttctgtcggcatcaaatga

SEQ ID NO: 795473 - DNA, 25 bp, Mus musculus
tcaaacttctgtgggcatcaaatga

SEQ ID NO: 795474 - DNA, 25 bp, Mus musculus
tcaaacttgtgaacaaggcactgtt

SEQ ID NO: 795475 - DNA, 25 bp, Mus musculus
tcaaacttgtgatcaaggcactgtt

SEQ ID NO: 795476 - DNA, 25 bp, Mus musculus
tcaaactttcttaaggctactttag

SEQ ID NO: 795477 - DNA, 25 bp, Mus musculus
tcaaactttctttaggctactttag

SEQ ID NO: 795478 - DNA, 25 bp, Mus musculus
tcaaactttgagagcatgtccctgg

SEQ ID NO: 795479 - DNA, 25 bp, Mus musculus
tcaaactttgagtgcatgtccctgg

SEQ ID NO: 795480 - DNA, 25 bp, Mus musculus
tcaaagaaacctctgtgatcctggt

SEQ ID NO: 795481 - DNA, 25 bp, Mus musculus
tcaaagaaacctgtgtgatcctggt

SEQ ID NO: 795482 - DNA, 25 bp, Mus musculus
tcaaagaaattgacctgcccgaact

SEQ ID NO: 795483 - DNA, 25 bp, Mus musculus
tcaaagaaattgtcctgcccgaact

SEQ ID NO: 795484 - DNA, 25 bp, Mus musculus
tcaaagaacactctaccttcctggt

SEQ ID NO: 795485 - DNA, 25 bp, Mus musculus
tcaaagaacactgtaccttcctggt

SEQ ID NO: 795486 - DNA, 25 bp, Mus musculus
tcaaagaacagacagttcggtagaa

SEQ ID NO: 795487 - DNA, 25 bp, Mus musculus
tcaaagaacagagagttcggtagaa

SEQ ID NO: 795488 - DNA, 25 bp, Mus musculus
tcaaagaagattccacctcacatgg

SEQ ID NO: 795489 - DNA, 25 bp, Mus musculus
tcaaagaagattgcacctcacatgg

SEQ ID NO: 795490 - DNA, 25 bp, Mus musculus
tcaaagaagcgtccccagagtcaga

SEQ ID NO: 795491 - DNA, 25 bp, Mus musculus
tcaaagaagcgtgcccagagtcaga

SEQ ID NO: 795492 - DNA, 25 bp, Mus musculus
tcaaagaatgatcaggagcctgcct

SEQ ID NO: 795493 - DNA, 25 bp, Mus musculus
tcaaagaatgatgaggagcctgcct

SEQ ID NO: 795494 - DNA, 25 bp, Mus musculus
tcaaagaattatatcacagaactgt

SEQ ID NO: 795495 - DNA, 25 bp, Mus musculus
tcaaagaattatttcacagaactgt

SEQ ID NO: 795496 - DNA, 25 bp, Mus musculus
tcaaagacaacgacgacttcgagga

SEQ ID NO: 795497 - DNA, 25 bp, Mus musculus
tcaaagacaacgtcgacttcgagga

SEQ ID NO: 795498 - DNA, 25 bp, Mus musculus
tcaaagacaggtataggccccacct

SEQ ID NO: 795499 - DNA, 25 bp, Mus musculus
tcaaagacaggtttaggccccacct

SEQ ID NO: 795500 - DNA, 25 bp, Mus musculus
tcaaagaccctgaaaacccctctgt

SEQ ID NO: 795501 - DNA, 25 bp, Mus musculus
tcaaagaccctgtaaacccctctgt

SEQ ID NO: 795502 - DNA, 25 bp, Mus musculus
tcaaagacgaatatagcaggcaagc

SEQ ID NO: 795503 - DNA, 25 bp, Mus musculus
tcaaagacgaatttagcaggcaagc

SEQ ID NO: 795504 - DNA, 25 bp, Mus musculus
tcaaagactagaccccaagccctgg

SEQ ID NO: 795505 - DNA, 25 bp, Mus musculus
tcaaagactagagcccaagccctgg

SEQ ID NO: 795506 - DNA, 25 bp, Mus musculus
tcaaagactcaacgacttccctggt

SEQ ID NO: 795507 - DNA, 25 bp, Mus musculus
tcaaagactcaaggacttccctggt

SEQ ID NO: 795508 - DNA, 25 bp, Mus musculus
tcaaagagccttaaacccacaaatg

SEQ ID NO: 795509 - DNA, 25 bp, Mus musculus
tcaaagagcctttaacccacaaatg

SEQ ID NO: 795510 - DNA, 25 bp, Mus musculus
tcaaagagggctatttgggctataa

SEQ ID NO: 795511 - DNA, 25 bp, Mus musculus
tcaaagagggctttttgggctataa

SEQ ID NO: 795512 - DNA, 25 bp, Mus musculus
tcaaagagtgaaccccgtgccgtgc

SEQ ID NO: 795513 - DNA, 25 bp, Mus musculus
tcaaagagtgaagcccgtgccgtgc

SEQ ID NO: 795514 - DNA, 25 bp, Mus musculus
tcaaagatacctagccaggctccta

SEQ ID NO: 795515 - DNA, 25 bp, Mus musculus
tcaaagataccttgccaggctccta

SEQ ID NO: 795516 - DNA, 25 bp, Mus musculus
tcaaagatatccacttggctgtctg

SEQ ID NO: 795517 - DNA, 25 bp, Mus musculus
tcaaagatatcctcttggctgtctg

SEQ ID NO: 795518 - DNA, 25 bp, Mus musculus
tcaaagatcaagattcctggtgtgt

SEQ ID NO: 795519 - DNA, 25 bp, Mus musculus
tcaaagatcaagtttcctggtgtgt

SEQ ID NO: 795520 - DNA, 25 bp, Mus musculus
tcaaagatcttcaattccactcact

SEQ ID NO: 795521 - DNA, 25 bp, Mus musculus
tcaaagatcttctattccactcact

SEQ ID NO: 795522 - DNA, 25 bp, Mus musculus
tcaaagatgcctcgatgtacctctg

SEQ ID NO: 795523 - DNA, 25 bp, Mus musculus
tcaaagatgcctggatgtacctctg

SEQ ID NO: 795524 - DNA, 25 bp, Mus musculus
tcaaagatggcccactggagtaaca

SEQ ID NO: 795525 - DNA, 25 bp, Mus musculus
tcaaagatggccgactggagtaaca

SEQ ID NO: 795526 - DNA, 25 bp, Mus musculus
tcaaagatgtgaccccgaacctgca

SEQ ID NO: 795527 - DNA, 25 bp, Mus musculus
tcaaagatgtgagcccgaacctgca

SEQ ID NO: 795528 - DNA, 25 bp, Mus musculus
tcaaagatgtgtatgtctcccacca

SEQ ID NO: 795529 - DNA, 25 bp, Mus musculus
tcaaagatgtgtttgtctcccacca

SEQ ID NO: 795530 - DNA, 25 bp, Mus musculus
tcaaagcaagaaaacgccttcccca

SEQ ID NO: 795531 - DNA, 25 bp, Mus musculus
tcaaagcaagaatacgccttcccca

SEQ ID NO: 795532 - DNA, 25 bp, Mus musculus
tcaaagcacagcatttccacagcag

SEQ ID NO: 795533 - DNA, 25 bp, Mus musculus
tcaaagcacagcttttccacagcag

SEQ ID NO: 795534 - DNA, 25 bp, Mus musculus
tcaaagcacatcacctaccaaaatt

SEQ ID NO: 795535 - DNA, 25 bp, Mus musculus
tcaaagcacatctcctaccaaaatt

SEQ ID NO: 795536 - DNA, 25 bp, Mus musculus
tcaaagcactctcagtcatcaaatg

SEQ ID NO: 795537 - DNA, 25 bp, Mus musculus
tcaaagcactctgagtcatcaaatg

SEQ ID NO: 795538 - DNA, 25 bp, Mus musculus
tcaaagcatgctcggctacacagtg

SEQ ID NO: 795539 - DNA, 25 bp, Mus musculus
tcaaagcatgctgggctacacagtg

SEQ ID NO: 795540 - DNA, 25 bp, Mus musculus
tcaaagcatggcctgctcagcacat

SEQ ID NO: 795541 - DNA, 25 bp, Mus musculus
tcaaagcatggcgtgctcagcacat

SEQ ID NO: 795542 - DNA, 25 bp, Mus musculus
tcaaagcattctcaccaaatccagc

SEQ ID NO: 795543 - DNA, 25 bp, Mus musculus
tcaaagcattctgaccaaatccagc

SEQ ID NO: 795544 - DNA, 25 bp, Mus musculus
tcaaagccaacgatcgcgagcgcaa

SEQ ID NO: 795545 - DNA, 25 bp, Mus musculus
tcaaagccaacgttcgcgagcgcaa

SEQ ID NO: 795546 - DNA, 25 bp, Mus musculus
tcaaagccactacagggtccaaaag

SEQ ID NO: 795547 - DNA, 25 bp, Mus musculus
tcaaagccactagagggtccaaaag

SEQ ID NO: 795548 - DNA, 25 bp, Mus musculus
tcaaagccagtaataaatcaagttt

SEQ ID NO: 795549 - DNA, 25 bp, Mus musculus
tcaaagccagtattaaatcaagttt

SEQ ID NO: 795550 - DNA, 25 bp, Mus musculus
tcaaagccagttattgaccacatag

SEQ ID NO: 795551 - DNA, 25 bp, Mus musculus
tcaaagccagtttttgaccacatag

SEQ ID NO: 795552 - DNA, 25 bp, Mus musculus
tcaaagccatcaaggttaaaagttt

SEQ ID NO: 795553 - DNA, 25 bp, Mus musculus
tcaaagccatcatggttaaaagttt

SEQ ID NO: 795554 - DNA, 25 bp, Mus musculus
tcaaagcccaatcggttggctgttt

SEQ ID NO: 795555 - DNA, 25 bp, Mus musculus
tcaaagcccaatgggttggctgttt

SEQ ID NO: 795556 - DNA, 25 bp, Mus musculus
tcaaagcccactaacatagtggcat

SEQ ID NO: 795557 - DNA, 25 bp, Mus musculus
tcaaagcccacttacatagtggcat

SEQ ID NO: 795558 - DNA, 25 bp, Mus musculus
tcaaagccccaaccagatctgtaaa

SEQ ID NO: 795559 - DNA, 25 bp, Mus musculus
tcaaagccccaacgttagaggaaag

SEQ ID NO: 795560 - DNA, 25 bp, Mus musculus
tcaaagccccaagcagatctgtaaa

SEQ ID NO: 795561 - DNA, 25 bp, Mus musculus
tcaaagccccaaggttagaggaaag

SEQ ID NO: 795562 - DNA, 25 bp, Mus musculus
tcaaagcccgttcactgattctctt

SEQ ID NO: 795563 - DNA, 25 bp, Mus musculus
tcaaagcccgttgactgattctctt

SEQ ID NO: 795564 - DNA, 25 bp, Mus musculus
tcaaagccgctgcacagagacagat

SEQ ID NO: 795565 - DNA, 25 bp, Mus musculus
tcaaagccgctggacagagacagat

SEQ ID NO: 795566 - DNA, 25 bp, Mus musculus
tcaaagccgtccaggttaggagtaa

SEQ ID NO: 795567 - DNA, 25 bp, Mus musculus
tcaaagccgtcctggttaggagtaa

SEQ ID NO: 795568 - DNA, 25 bp, Mus musculus
tcaaagccgttgctgttttcattgt

SEQ ID NO: 795569 - DNA, 25 bp, Mus musculus
tcaaagccgttggtgttttcattgt

SEQ ID NO: 795570 - DNA, 25 bp, Mus musculus
tcaaagcctagaatacatatgtgta

SEQ ID NO: 795571 - DNA, 25 bp, Mus musculus
tcaaagcctagattacatatgtgta

SEQ ID NO: 795572 - DNA, 25 bp, Mus musculus
tcaaagcctcccagattctggagaa

SEQ ID NO: 795573 - DNA, 25 bp, Mus musculus
tcaaagcctccctgattctggagaa

SEQ ID NO: 795574 - DNA, 25 bp, Mus musculus
tcaaagcctgttatattgggcatcc

SEQ ID NO: 795575 - DNA, 25 bp, Mus musculus
tcaaagcctgttttattgggcatcc

SEQ ID NO: 795576 - DNA, 25 bp, Mus musculus
tcaaagccttttactcttcttgttc

SEQ ID NO: 795577 - DNA, 25 bp, Mus musculus
tcaaagcctttttctcttcttgttc

SEQ ID NO: 795578 - DNA, 25 bp, Mus musculus
tcaaagcgagggaagtgtcagcact

SEQ ID NO: 795579 - DNA, 25 bp, Mus musculus
tcaaagcgagggtagtgtcagcact

SEQ ID NO: 795580 - DNA, 25 bp, Mus musculus
tcaaagctacacagacactacaggc

SEQ ID NO: 795581 - DNA, 25 bp, Mus musculus
tcaaagctacactgacactacaggc

SEQ ID NO: 795582 - DNA, 25 bp, Mus musculus
tcaaagctagctagggttgcatagc

SEQ ID NO: 795583 - DNA, 25 bp, Mus musculus
tcaaagctagcttgggttgcatagc

SEQ ID NO: 795584 - DNA, 25 bp, Mus musculus
tcaaagctcaccatcttctgagaag

SEQ ID NO: 795585 - DNA, 25 bp, Mus musculus
tcaaagctcaccttcttctgagaag

SEQ ID NO: 795586 - DNA, 25 bp, Mus musculus
tcaaagctccctacaagggacctgc

SEQ ID NO: 795587 - DNA, 25 bp, Mus musculus
tcaaagctcccttcaagggacctgc

SEQ ID NO: 795588 - DNA, 25 bp, Mus musculus
tcaaagctcgtaacttcctcgtctt

SEQ ID NO: 795589 - DNA, 25 bp, Mus musculus
tcaaagctcgtatcttcctcgtctt

SEQ ID NO: 795590 - DNA, 25 bp, Mus musculus
tcaaagctctgtaagcaagaggtgt

SEQ ID NO: 795591 - DNA, 25 bp, Mus musculus
tcaaagctctgtctaagccacaata

SEQ ID NO: 795592 - DNA, 25 bp, Mus musculus
tcaaagctctgtctattgtgccttg

SEQ ID NO: 795593 - DNA, 25 bp, Mus musculus
tcaaagctctgtgtaagccacaata

SEQ ID NO: 795594 - DNA, 25 bp, Mus musculus
tcaaagctctgtgtattgtgccttg

SEQ ID NO: 795595 - DNA, 25 bp, Mus musculus
tcaaagctctgttagcaagaggtgt

SEQ ID NO: 795596 - DNA, 25 bp, Mus musculus
tcaaagctgcaactggacgtggtag

SEQ ID NO: 795597 - DNA, 25 bp, Mus musculus
tcaaagctgcaagtggacgtggtag

SEQ ID NO: 795598 - DNA, 25 bp, Mus musculus
tcaaagctgcttccttaccaacatt

SEQ ID NO: 795599 - DNA, 25 bp, Mus musculus
tcaaagctgcttgcttaccaacatt

SEQ ID NO: 795600 - DNA, 25 bp, Mus musculus
tcaaagctggccaggaaacttatag

SEQ ID NO: 795601 - DNA, 25 bp, Mus musculus
tcaaagctggcctggaaacttatag

SEQ ID NO: 795602 - DNA, 25 bp, Mus musculus
tcaaagcttcttattcctacggagc

SEQ ID NO: 795603 - DNA, 25 bp, Mus musculus
tcaaagcttctttttcctacggagc

SEQ ID NO: 795604 - DNA, 25 bp, Mus musculus
tcaaagcttgctccagttcctataa

SEQ ID NO: 795605 - DNA, 25 bp, Mus musculus
tcaaagcttgctgcagttcctataa

SEQ ID NO: 795606 - DNA, 25 bp, Mus musculus
tcaaagctttaactgaaccccaagg

SEQ ID NO: 795607 - DNA, 25 bp, Mus musculus
tcaaagctttaagtgaaccccaagg

SEQ ID NO: 795608 - DNA, 25 bp, Mus musculus
tcaaagctttcaccccgggtttctg

SEQ ID NO: 795609 - DNA, 25 bp, Mus musculus
tcaaagctttcagcccgggtttctg

SEQ ID NO: 795610 - DNA, 25 bp, Mus musculus
tcaaagctttgcctttccagtgtct

SEQ ID NO: 795611 - DNA, 25 bp, Mus musculus
tcaaagctttgcgtttccagtgtct

SEQ ID NO: 795612 - DNA, 25 bp, Mus musculus
tcaaaggaactaacatgtaacagga

SEQ ID NO: 795613 - DNA, 25 bp, Mus musculus
tcaaaggaactatcatgtaacagga

SEQ ID NO: 795614 - DNA, 25 bp, Mus musculus
tcaaaggacccacagtgacagccct

SEQ ID NO: 795615 - DNA, 25 bp, Mus musculus
tcaaaggacccagagtgacagccct

SEQ ID NO: 795616 - DNA, 25 bp, Mus musculus
tcaaaggcatcacaagcccctgcgg

SEQ ID NO: 795617 - DNA, 25 bp, Mus musculus
tcaaaggcatcagaagcccctgcgg

SEQ ID NO: 795618 - DNA, 25 bp, Mus musculus
tcaaaggcatccaggtgcaggacgg

SEQ ID NO: 795619 - DNA, 25 bp, Mus musculus
tcaaaggcatcctggtgcaggacgg

SEQ ID NO: 795620 - DNA, 25 bp, Mus musculus
tcaaaggccacccacagagtgacag

SEQ ID NO: 795621 - DNA, 25 bp, Mus musculus
tcaaaggccaccgacagagtgacag

SEQ ID NO: 795622 - DNA, 25 bp, Mus musculus
tcaaaggcccagagaccaatgcagc

SEQ ID NO: 795623 - DNA, 25 bp, Mus musculus
tcaaaggcccagtgaccaatgcagc

SEQ ID NO: 795624 - DNA, 25 bp, Mus musculus
tcaaaggccccgatcgagagggtga

SEQ ID NO: 795625 - DNA, 25 bp, Mus musculus
tcaaaggccccgttcgagagggtga

SEQ ID NO: 795626 - DNA, 25 bp, Mus musculus
tcaaaggcgataaggaacagaagtt

SEQ ID NO: 795627 - DNA, 25 bp, Mus musculus
tcaaaggcgatatggaacagaagtt

SEQ ID NO: 795628 - DNA, 25 bp, Mus musculus
tcaaaggcgctcaggcaacactctg

SEQ ID NO: 795629 - DNA, 25 bp, Mus musculus
tcaaaggcgctctggcaacactctg

SEQ ID NO: 795630 - DNA, 25 bp, Mus musculus
tcaaaggcgcttagaaacagggact

SEQ ID NO: 795631 - DNA, 25 bp, Mus musculus
tcaaaggcgctttgaaacagggact

SEQ ID NO: 795632 - DNA, 25 bp, Mus musculus
tcaaaggctgctcggattccatcca

SEQ ID NO: 795633 - DNA, 25 bp, Mus musculus
tcaaaggctgctgggattccatcca

SEQ ID NO: 795634 - DNA, 25 bp, Mus musculus
tcaaagggaatcagttgtcaggttt

SEQ ID NO: 795635 - DNA, 25 bp, Mus musculus
tcaaagggaatctgttgtcaggttt

SEQ ID NO: 795636 - DNA, 25 bp, Mus musculus
tcaaagggacttagtgactgtcggt

SEQ ID NO: 795637 - DNA, 25 bp, Mus musculus
tcaaagggactttgtgactgtcggt

SEQ ID NO: 795638 - DNA, 25 bp, Mus musculus
tcaaagggagccaccgtgcaggtgc

SEQ ID NO: 795639 - DNA, 25 bp, Mus musculus
tcaaagggagcctccgtgcaggtgc

SEQ ID NO: 795640 - DNA, 25 bp, Mus musculus
tcaaagggagtcaatgggtcgctaa

SEQ ID NO: 795641 - DNA, 25 bp, Mus musculus
tcaaagggagtctatgggtcgctaa

SEQ ID NO: 795642 - DNA, 25 bp, Mus musculus
tcaaagggatacagattggaacaaa

SEQ ID NO: 795643 - DNA, 25 bp, Mus musculus
tcaaagggatactgattggaacaaa

SEQ ID NO: 795644 - DNA, 25 bp, Mus musculus
tcaaagggctttaaccacttgtaag

SEQ ID NO: 795645 - DNA, 25 bp, Mus musculus
tcaaagggctttaagggaacttcat

SEQ ID NO: 795646 - DNA, 25 bp, Mus musculus
tcaaagggcttttaccacttgtaag

SEQ ID NO: 795647 - DNA, 25 bp, Mus musculus
tcaaagggcttttagggaacttcat

SEQ ID NO: 795648 - DNA, 25 bp, Mus musculus
tcaaaggggactccagtttacctga

SEQ ID NO: 795649 - DNA, 25 bp, Mus musculus
tcaaaggggactgcagtttacctga

SEQ ID NO: 795650 - DNA, 25 bp, Mus musculus
tcaaagggtgacaaccagttagcat

SEQ ID NO: 795651 - DNA, 25 bp, Mus musculus
tcaaagggtgactaccagttagcat

SEQ ID NO: 795652 - DNA, 25 bp, Mus musculus
tcaaagggttttcaatctggaacct

SEQ ID NO: 795653 - DNA, 25 bp, Mus musculus
tcaaagggttttgaatctggaacct

SEQ ID NO: 795654 - DNA, 25 bp, Mus musculus
tcaaaggtaaagaccacatgcgtaa

SEQ ID NO: 795655 - DNA, 25 bp, Mus musculus
tcaaaggtaaagtccacatgcgtaa

SEQ ID NO: 795656 - DNA, 25 bp, Mus musculus
tcaaaggtccttaagcagatatgtg

SEQ ID NO: 795657 - DNA, 25 bp, Mus musculus
tcaaaggtcctttagcagatatgtg

SEQ ID NO: 795658 - DNA, 25 bp, Mus musculus
tcaaaggtctgtctggtgtaccagt

SEQ ID NO: 795659 - DNA, 25 bp, Mus musculus
tcaaaggtctgtgtggtgtaccagt

SEQ ID NO: 795660 - DNA, 25 bp, Mus musculus
tcaaaggtgatgaccaactcagtgg

SEQ ID NO: 795661 - DNA, 25 bp, Mus musculus
tcaaaggtgatgtccaactcagtgg

SEQ ID NO: 795662 - DNA, 25 bp, Mus musculus
tcaaaggtgcgtatgtttcttaact

SEQ ID NO: 795663 - DNA, 25 bp, Mus musculus
tcaaaggtgcgtttgtttcttaact

SEQ ID NO: 795664 - DNA, 25 bp, Mus musculus
tcaaagtaatttagtccagaacgga

SEQ ID NO: 795665 - DNA, 25 bp, Mus musculus
tcaaagtaattttgtccagaacgga

SEQ ID NO: 795666 - DNA, 25 bp, Mus musculus
tcaaagtacctaccagaaaacggcg

SEQ ID NO: 795667 - DNA, 25 bp, Mus musculus
tcaaagtacctagcagaaaacggcg

SEQ ID NO: 795668 - DNA, 25 bp, Mus musculus
tcaaagtcacaccagtaaccagtgc

SEQ ID NO: 795669 - DNA, 25 bp, Mus musculus
tcaaagtcacacgagtaaccagtgc

SEQ ID NO: 795670 - DNA, 25 bp, Mus musculus
tcaaagtcacccatgtttaccatcc

SEQ ID NO: 795671 - DNA, 25 bp, Mus musculus
tcaaagtcacccttgtttaccatcc

SEQ ID NO: 795672 - DNA, 25 bp, Mus musculus
tcaaagtcaggtacagctacatagt

SEQ ID NO: 795673 - DNA, 25 bp, Mus musculus
tcaaagtcaggttcagctacatagt

SEQ ID NO: 795674 - DNA, 25 bp, Mus musculus
tcaaagtccacgagggcctgaaaga

SEQ ID NO: 795675 - DNA, 25 bp, Mus musculus
tcaaagtccacgtgggcctgaaaga

SEQ ID NO: 795676 - DNA, 25 bp, Mus musculus
tcaaagtccaggagccaggcttcca

SEQ ID NO: 795677 - DNA, 25 bp, Mus musculus
tcaaagtccaggtgccaggcttcca

SEQ ID NO: 795678 - DNA, 25 bp, Mus musculus
tcaaagtccctcacacatttgctgt

SEQ ID NO: 795679 - DNA, 25 bp, Mus musculus
tcaaagtccctctcacatttgctgt

SEQ ID NO: 795680 - DNA, 25 bp, Mus musculus
tcaaagtcctagctgagcatgttgg

SEQ ID NO: 795681 - DNA, 25 bp, Mus musculus
tcaaagtcctaggtgagcatgttgg

SEQ ID NO: 795682 - DNA, 25 bp, Mus musculus
tcaaagtcgtccctgatctgaacat

SEQ ID NO: 795683 - DNA, 25 bp, Mus musculus
tcaaagtcgtccgtgatctgaacat

SEQ ID NO: 795684 - DNA, 25 bp, Mus musculus
tcaaagtgaaggagcttcctgctgt

SEQ ID NO: 795685 - DNA, 25 bp, Mus musculus
tcaaagtgaaggtgcttcctgctgt

SEQ ID NO: 795686 - DNA, 25 bp, Mus musculus
tcaaagtgaccgactatctccagag

SEQ ID NO: 795687 - DNA, 25 bp, Mus musculus
tcaaagtgaccgtctatctccagag

SEQ ID NO: 795688 - DNA, 25 bp, Mus musculus
tcaaagtgccaaccacctgacatgg

SEQ ID NO: 795689 - DNA, 25 bp, Mus musculus
tcaaagtgccaagcacctgacatgg

SEQ ID NO: 795690 - DNA, 25 bp, Mus musculus
tcaaagtgcttgaccaggcagagct

SEQ ID NO: 795691 - DNA, 25 bp, Mus musculus
tcaaagtgcttgtccaggcagagct

SEQ ID NO: 795692 - DNA, 25 bp, Mus musculus
tcaaagtggaagcttgcatccgaat

SEQ ID NO: 795693 - DNA, 25 bp, Mus musculus
tcaaagtggaaggttgcatccgaat

SEQ ID NO: 795694 - DNA, 25 bp, Mus musculus
tcaaagtggattaacatgtctatat

SEQ ID NO: 795695 - DNA, 25 bp, Mus musculus
tcaaagtggatttacatgtctatat

SEQ ID NO: 795696 - DNA, 25 bp, Mus musculus
tcaaagtgttaaccctagcaattct

SEQ ID NO: 795697 - DNA, 25 bp, Mus musculus
tcaaagtgttaagcctagcaattct

SEQ ID NO: 795698 - DNA, 25 bp, Mus musculus
tcaaagttatcaagttttcccctag

SEQ ID NO: 795699 - DNA, 25 bp, Mus musculus
tcaaagttatcatgttttcccctag

SEQ ID NO: 795700 - DNA, 25 bp, Mus musculus
tcaaagttcacaatctcaataaggc

SEQ ID NO: 795701 - DNA, 25 bp, Mus musculus
tcaaagttcacattctcaataaggc

SEQ ID NO: 795702 - DNA, 25 bp, Mus musculus
tcaaagttcagcaagactccacctt

SEQ ID NO: 795703 - DNA, 25 bp, Mus musculus
tcaaagttcagctagactccacctt

SEQ ID NO: 795704 - DNA, 25 bp, Mus musculus
tcaaagttccagagtttgcacaggt

SEQ ID NO: 795705 - DNA, 25 bp, Mus musculus
tcaaagttccagtgtttgcacaggt

SEQ ID NO: 795706 - DNA, 25 bp, Mus musculus
tcaaagttccttatataggaggcta

SEQ ID NO: 795707 - DNA, 25 bp, Mus musculus
tcaaagttccttttataggaggcta

SEQ ID NO: 795708 - DNA, 25 bp, Mus musculus
tcaaagtttcagacccagtatctcc

SEQ ID NO: 795709 - DNA, 25 bp, Mus musculus
tcaaagtttcagtcccagtatctcc

SEQ ID NO: 795710 - DNA, 25 bp, Mus musculus
tcaaagtttctcaccctacttgtta

SEQ ID NO: 795711 - DNA, 25 bp, Mus musculus
tcaaagtttctctccctacttgtta

SEQ ID NO: 795712 - DNA, 25 bp, Mus musculus
tcaaagtttctgatacataatgaat

SEQ ID NO: 795713 - DNA, 25 bp, Mus musculus
tcaaagtttctgttacataatgaat

SEQ ID NO: 795714 - DNA, 25 bp, Mus musculus
tcaaataaacccctacggcctgact

SEQ ID NO: 795715 - DNA, 25 bp, Mus musculus
tcaaataaacccgtacggcctgact

SEQ ID NO: 795716 - DNA, 25 bp, Mus musculus
tcaaataaccccacaactttcttgc

SEQ ID NO: 795717 - DNA, 25 bp, Mus musculus
tcaaataacccctcaactttcttgc

SEQ ID NO: 795718 - DNA, 25 bp, Mus musculus
tcaaataagctcactgcacttggga

SEQ ID NO: 795719 - DNA, 25 bp, Mus musculus
tcaaataagctctctgcacttggga

SEQ ID NO: 795720 - DNA, 25 bp, Mus musculus
tcaaataatagaagccctccactcc

SEQ ID NO: 795721 - DNA, 25 bp, Mus musculus
tcaaataatagatgccctccactcc

SEQ ID NO: 795722 - DNA, 25 bp, Mus musculus
tcaaatactggtctacgctatcctg

SEQ ID NO: 795723 - DNA, 25 bp, Mus musculus
tcaaatactggtgtacgctatcctg

SEQ ID NO: 795724 - DNA, 25 bp, Mus musculus
tcaaataggatcaggtcactctttc

SEQ ID NO: 795725 - DNA, 25 bp, Mus musculus
tcaaataggatctggtcactctttc

SEQ ID NO: 795726 - DNA, 25 bp, Mus musculus
tcaaataggtcaacagtgtgagtct

SEQ ID NO: 795727 - DNA, 25 bp, Mus musculus
tcaaataggtcacccgtccgtctct

SEQ ID NO: 795728 - DNA, 25 bp, Mus musculus
tcaaataggtcagccgtccgtctct

SEQ ID NO: 795729 - DNA, 25 bp, Mus musculus
tcaaataggtcatcagtgtgagtct

SEQ ID NO: 795730 - DNA, 25 bp, Mus musculus
tcaaatagtaatagccctgaaggca

SEQ ID NO: 795731 - DNA, 25 bp, Mus musculus
tcaaatagtaattgccctgaaggca

SEQ ID NO: 795732 - DNA, 25 bp, Mus musculus
tcaaatatccctaggtcatctgcca

SEQ ID NO: 795733 - DNA, 25 bp, Mus musculus
tcaaatatcccttggtcatctgcca

SEQ ID NO: 795734 - DNA, 25 bp, Mus musculus
tcaaatatctccctaggaagctgga

SEQ ID NO: 795735 - DNA, 25 bp, Mus musculus
tcaaatatctccgtaggaagctgga

SEQ ID NO: 795736 - DNA, 25 bp, Mus musculus
tcaaatatgttgatccccgattcac

SEQ ID NO: 795737 - DNA, 25 bp, Mus musculus
tcaaatatgttgttccccgattcac

SEQ ID NO: 795738 - DNA, 25 bp, Mus musculus
tcaaatattcagctgcacccctatg

SEQ ID NO: 795739 - DNA, 25 bp, Mus musculus
tcaaatattcaggtgcacccctatg

SEQ ID NO: 795740 - DNA, 25 bp, Mus musculus
tcaaatattgggaccgagtgacatt

SEQ ID NO: 795741 - DNA, 25 bp, Mus musculus
tcaaatattgggtccgagtgacatt

SEQ ID NO: 795742 - DNA, 25 bp, Mus musculus
tcaaatattgtgatccagggttact

SEQ ID NO: 795743 - DNA, 25 bp, Mus musculus
tcaaatattgtgttccagggttact

SEQ ID NO: 795744 - DNA, 25 bp, Mus musculus
tcaaatatttctcgccagtgtttaa

SEQ ID NO: 795745 - DNA, 25 bp, Mus musculus
tcaaatatttctggccagtgtttaa

SEQ ID NO: 795746 - DNA, 25 bp, Mus musculus
tcaaatcagatgaggttacccagga

SEQ ID NO: 795747 - DNA, 25 bp, Mus musculus
tcaaatcagatgtggttacccagga

SEQ ID NO: 795748 - DNA, 25 bp, Mus musculus
tcaaatcagtggcatggacggtcat

SEQ ID NO: 795749 - DNA, 25 bp, Mus musculus
tcaaatcagtgggatggacggtcat

SEQ ID NO: 795750 - DNA, 25 bp, Mus musculus
tcaaatcatcttacctagagacgtt

SEQ ID NO: 795751 - DNA, 25 bp, Mus musculus
tcaaatcatctttcctagagacgtt

SEQ ID NO: 795752 - DNA, 25 bp, Mus musculus
tcaaatccacatatctgaagtttta

SEQ ID NO: 795753 - DNA, 25 bp, Mus musculus
tcaaatccacatttctgaagtttta

SEQ ID NO: 795754 - DNA, 25 bp, Mus musculus
tcaaatcccagcaaccacatggtgg

SEQ ID NO: 795755 - DNA, 25 bp, Mus musculus
tcaaatcccagctaccacatggtgg

SEQ ID NO: 795756 - DNA, 25 bp, Mus musculus
tcaaatccctatcatgctgtaaatt

SEQ ID NO: 795757 - DNA, 25 bp, Mus musculus
tcaaatccctatgatgctgtaaatt

SEQ ID NO: 795758 - DNA, 25 bp, Mus musculus
tcaaatccctcacaagacatacagc

SEQ ID NO: 795759 - DNA, 25 bp, Mus musculus
tcaaatccctcagaagacatacagc

SEQ ID NO: 795760 - DNA, 25 bp, Mus musculus
tcaaatcctagtcggcctgagcagg

SEQ ID NO: 795761 - DNA, 25 bp, Mus musculus
tcaaatcctagtgggcctgagcagg

SEQ ID NO: 795762 - DNA, 25 bp, Mus musculus
tcaaatccttcactgagctcaaata

SEQ ID NO: 795763 - DNA, 25 bp, Mus musculus
tcaaatccttcagtgagctcaaata

SEQ ID NO: 795764 - DNA, 25 bp, Mus musculus
tcaaatcgagtccaggacaggcagg

SEQ ID NO: 795765 - DNA, 25 bp, Mus musculus
tcaaatcgagtcgaggacaggcagg

SEQ ID NO: 795766 - DNA, 25 bp, Mus musculus
tcaaatcggttgctgctgagtgcag

SEQ ID NO: 795767 - DNA, 25 bp, Mus musculus
tcaaatcggttggtgctgagtgcag

SEQ ID NO: 795768 - DNA, 25 bp, Mus musculus
tcaaatctatgacccactttttcat

SEQ ID NO: 795769 - DNA, 25 bp, Mus musculus
tcaaatctatgagccactttttcat

SEQ ID NO: 795770 - DNA, 25 bp, Mus musculus
tcaaatctcgagctcaccgatacag

SEQ ID NO: 795771 - DNA, 25 bp, Mus musculus
tcaaatctcgaggtcaccgatacag

SEQ ID NO: 795772 - DNA, 25 bp, Mus musculus
tcaaatctctcacagtacggcggct

SEQ ID NO: 795773 - DNA, 25 bp, Mus musculus
tcaaatctctcagagtacggcggct

SEQ ID NO: 795774 - DNA, 25 bp, Mus musculus
tcaaatctcttgctcactactgtca

SEQ ID NO: 795775 - DNA, 25 bp, Mus musculus
tcaaatctcttggtcactactgtca

SEQ ID NO: 795776 - DNA, 25 bp, Mus musculus
tcaaatctgctcatccttaggacaa

SEQ ID NO: 795777 - DNA, 25 bp, Mus musculus
tcaaatctgctcttccttaggacaa

SEQ ID NO: 795778 - DNA, 25 bp, Mus musculus
tcaaatctggttaaaactcgccggg

SEQ ID NO: 795779 - DNA, 25 bp, Mus musculus
tcaaatctggtttaaactcgccggg

SEQ ID NO: 795780 - DNA, 25 bp, Mus musculus
tcaaatcttgaacaggctctcacct

SEQ ID NO: 795781 - DNA, 25 bp, Mus musculus
tcaaatcttgaagaggctctcacct

SEQ ID NO: 795782 - DNA, 25 bp, Mus musculus
tcaaatgaccaaaagtcttgttgga

SEQ ID NO: 795783 - DNA, 25 bp, Mus musculus
tcaaatgaccaatagtcttgttgga

SEQ ID NO: 795784 - DNA, 25 bp, Mus musculus
tcaaatgatggtagaccaccgcccc

SEQ ID NO: 795785 - DNA, 25 bp, Mus musculus
tcaaatgatggttgaccaccgcccc

SEQ ID NO: 795786 - DNA, 25 bp, Mus musculus
tcaaatgatttaacagtttctgtgt

SEQ ID NO: 795787 - DNA, 25 bp, Mus musculus
tcaaatgatttatcagtttctgtgt

SEQ ID NO: 795788 - DNA, 25 bp, Mus musculus
tcaaatgattttaactttaactcct

SEQ ID NO: 795789 - DNA, 25 bp, Mus musculus
tcaaatgatttttactttaactcct

SEQ ID NO: 795790 - DNA, 25 bp, Mus musculus
tcaaatgcccataacatctactgtt

SEQ ID NO: 795791 - DNA, 25 bp, Mus musculus
tcaaatgcccatcgcgtttatcctt

SEQ ID NO: 795792 - DNA, 25 bp, Mus musculus
tcaaatgcccatggcgtttatcctt

SEQ ID NO: 795793 - DNA, 25 bp, Mus musculus
tcaaatgcccattacatctactgtt

SEQ ID NO: 795794 - DNA, 25 bp, Mus musculus
tcaaatgcgtctaccggccaaaggc

SEQ ID NO: 795795 - DNA, 25 bp, Mus musculus
tcaaatgcgtcttccggccaaaggc

SEQ ID NO: 795796 - DNA, 25 bp, Mus musculus
tcaaatgctagacgccctgggtgat

SEQ ID NO: 795797 - DNA, 25 bp, Mus musculus
tcaaatgctagaggccctgggtgat

SEQ ID NO: 795798 - DNA, 25 bp, Mus musculus
tcaaatgctgtcaaccaacatgggt

SEQ ID NO: 795799 - DNA, 25 bp, Mus musculus
tcaaatgctgtcaggtgtgtctctc

SEQ ID NO: 795800 - DNA, 25 bp, Mus musculus
tcaaatgctgtctaccaacatgggt

SEQ ID NO: 795801 - DNA, 25 bp, Mus musculus
tcaaatgctgtctggtgtgtctctc

SEQ ID NO: 795802 - DNA, 25 bp, Mus musculus
tcaaatggacacatttacttcctca

SEQ ID NO: 795803 - DNA, 25 bp, Mus musculus
tcaaatggacacttttacttcctca

SEQ ID NO: 795804 - DNA, 25 bp, Mus musculus
tcaaatggatccaggttcgcttgtt

SEQ ID NO: 795805 - DNA, 25 bp, Mus musculus
tcaaatggatcctggttcgcttgtt

SEQ ID NO: 795806 - DNA, 25 bp, Mus musculus
tcaaatggcagtcattcgccagctc

SEQ ID NO: 795807 - DNA, 25 bp, Mus musculus
tcaaatggcagtgattcgccagctc

SEQ ID NO: 795808 - DNA, 25 bp, Mus musculus
tcaaatggcctccattttatgacac

SEQ ID NO: 795809 - DNA, 25 bp, Mus musculus
tcaaatggcctcgattttatgacac

SEQ ID NO: 795810 - DNA, 25 bp, Mus musculus
tcaaatggtattaatcctccgggat

SEQ ID NO: 795811 - DNA, 25 bp, Mus musculus
tcaaatggtatttatcctccgggat

SEQ ID NO: 795812 - DNA, 25 bp, Mus musculus
tcaaatgtataaatgtcagtctccc

SEQ ID NO: 795813 - DNA, 25 bp, Mus musculus
tcaaatgtataattgtcagtctccc

SEQ ID NO: 795814 - DNA, 25 bp, Mus musculus
tcaaatgtctgtctcatcggttggc

SEQ ID NO: 795815 - DNA, 25 bp, Mus musculus
tcaaatgtctgtgtcatcggttggc

SEQ ID NO: 795816 - DNA, 25 bp, Mus musculus
tcaaatgtgagccagaactgggatt

SEQ ID NO: 795817 - DNA, 25 bp, Mus musculus
tcaaatgtgagcgagaactgggatt

SEQ ID NO: 795818 - DNA, 25 bp, Mus musculus
tcaaatgtgcttcagatgagctttt

SEQ ID NO: 795819 - DNA, 25 bp, Mus musculus
tcaaatgtgcttgagatgagctttt

SEQ ID NO: 795820 - DNA, 25 bp, Mus musculus
tcaaatgtggcccaagggcagactg

SEQ ID NO: 795821 - DNA, 25 bp, Mus musculus
tcaaatgtggccgaagggcagactg

SEQ ID NO: 795822 - DNA, 25 bp, Mus musculus
tcaaatgtttagcattccttcctgt

SEQ ID NO: 795823 - DNA, 25 bp, Mus musculus
tcaaatgtttaggattccttcctgt

SEQ ID NO: 795824 - DNA, 25 bp, Mus musculus
tcaaatgtttgcatgtgcggccacc

SEQ ID NO: 795825 - DNA, 25 bp, Mus musculus
tcaaatgtttgcttgtgcggccacc

SEQ ID NO: 795826 - DNA, 25 bp, Mus musculus
tcaaattaccttctttgtgttcaag

SEQ ID NO: 795827 - DNA, 25 bp, Mus musculus
tcaaattaccttgtttgtgttcaag

SEQ ID NO: 795828 - DNA, 25 bp, Mus musculus
tcaaattatgcaatggaaacccaag

SEQ ID NO: 795829 - DNA, 25 bp, Mus musculus
tcaaattatgcattggaaacccaag

SEQ ID NO: 795830 - DNA, 25 bp, Mus musculus
tcaaattcagttagccaggcttggc

SEQ ID NO: 795831 - DNA, 25 bp, Mus musculus
tcaaattcagtttgccaggcttggc

SEQ ID NO: 795832 - DNA, 25 bp, Mus musculus
tcaaattcctcccaggtccgggtca

SEQ ID NO: 795833 - DNA, 25 bp, Mus musculus
tcaaattcctccgaggtccgggtca

SEQ ID NO: 795834 - DNA, 25 bp, Mus musculus
tcaaattcctgcagaacacttccag

SEQ ID NO: 795835 - DNA, 25 bp, Mus musculus
tcaaattcctgctgaacacttccag

SEQ ID NO: 795836 - DNA, 25 bp, Mus musculus
tcaaattcctgtcacaattaggcaa

SEQ ID NO: 795837 - DNA, 25 bp, Mus musculus
tcaaattcctgtcaccttctaacct

SEQ ID NO: 795838 - DNA, 25 bp, Mus musculus
tcaaattcctgtgacaattaggcaa

SEQ ID NO: 795839 - DNA, 25 bp, Mus musculus
tcaaattcctgtgaccttctaacct

SEQ ID NO: 795840 - DNA, 25 bp, Mus musculus
tcaaattctctgacgtggcaagtac

SEQ ID NO: 795841 - DNA, 25 bp, Mus musculus
tcaaattctctgtcgtggcaagtac

SEQ ID NO: 795842 - DNA, 25 bp, Mus musculus
tcaaattcttacctgactgtggaga

SEQ ID NO: 795843 - DNA, 25 bp, Mus musculus
tcaaattcttacgtgactgtggaga

SEQ ID NO: 795844 - DNA, 25 bp, Mus musculus
tcaaattgagccctccatgtgggaa

SEQ ID NO: 795845 - DNA, 25 bp, Mus musculus
tcaaattgagccgtccatgtgggaa

SEQ ID NO: 795846 - DNA, 25 bp, Mus musculus
tcaaattgaggcaaggccccgaatt

SEQ ID NO: 795847 - DNA, 25 bp, Mus musculus
tcaaattgaggcctccatgtgggaa

SEQ ID NO: 795848 - DNA, 25 bp, Mus musculus
tcaaattgaggcgtccatgtgggaa

SEQ ID NO: 795849 - DNA, 25 bp, Mus musculus
tcaaattgaggctaggccccgaatt

SEQ ID NO: 795850 - DNA, 25 bp, Mus musculus
tcaaattgcttgacattattactaa

SEQ ID NO: 795851 - DNA, 25 bp, Mus musculus
tcaaattgcttgtcattattactaa

SEQ ID NO: 795852 - DNA, 25 bp, Mus musculus
tcaaattgggctcacatacccaggg

SEQ ID NO: 795853 - DNA, 25 bp, Mus musculus
tcaaattgggctgacatacccaggg

SEQ ID NO: 795854 - DNA, 25 bp, Mus musculus
tcaaatttacaaaggacaatcttgg

SEQ ID NO: 795855 - DNA, 25 bp, Mus musculus
tcaaatttacaatggacaatcttgg

SEQ ID NO: 795856 - DNA, 25 bp, Mus musculus
tcaaatttcattactaggcctagtg

SEQ ID NO: 795857 - DNA, 25 bp, Mus musculus
tcaaatttcatttctaggcctagtg

SEQ ID NO: 795858 - DNA, 25 bp, Mus musculus
tcaaatttcctccaagcactgtgta

SEQ ID NO: 795859 - DNA, 25 bp, Mus musculus
tcaaatttcctcgaagcactgtgta

SEQ ID NO: 795860 - DNA, 25 bp, Mus musculus
tcaaatttcctgagcctcaagaggt

SEQ ID NO: 795861 - DNA, 25 bp, Mus musculus
tcaaatttcctgtgcctcaagaggt

SEQ ID NO: 795862 - DNA, 25 bp, Mus musculus
tcaaatttggcacctgcctgccgga

SEQ ID NO: 795863 - DNA, 25 bp, Mus musculus
tcaaatttggcagctgcctgccgga

SEQ ID NO: 795864 - DNA, 25 bp, Mus musculus
tcaacaaacagtagccttgccaggg

SEQ ID NO: 795865 - DNA, 25 bp, Mus musculus
tcaacaaacagttgccttgccaggg

SEQ ID NO: 795866 - DNA, 25 bp, Mus musculus
tcaacaaacctaccaagcttctatc

SEQ ID NO: 795867 - DNA, 25 bp, Mus musculus
tcaacaaacctagcaagcttctatc

SEQ ID NO: 795868 - DNA, 25 bp, Mus musculus
tcaacaaacttgacctgctgtcgtt

SEQ ID NO: 795869 - DNA, 25 bp, Mus musculus
tcaacaaacttgtcctgctgtcgtt

SEQ ID NO: 795870 - DNA, 25 bp, Mus musculus
tcaacaaaggctccctggcattcaa

SEQ ID NO: 795871 - DNA, 25 bp, Mus musculus
tcaacaaaggctgcctggcattcaa

SEQ ID NO: 795872 - DNA, 25 bp, Mus musculus
tcaacaaaggtgatctgccctgcaa

SEQ ID NO: 795873 - DNA, 25 bp, Mus musculus
tcaacaaaggtgttctgccctgcaa

SEQ ID NO: 795874 - DNA, 25 bp, Mus musculus
tcaacaacacacaccgggtcttgaa

SEQ ID NO: 795875 - DNA, 25 bp, Mus musculus
tcaacaacacactccgggtcttgaa

SEQ ID NO: 795876 - DNA, 25 bp, Mus musculus
tcaacaacagctctctaatacccag

SEQ ID NO: 795877 - DNA, 25 bp, Mus musculus
tcaacaacagctgtctaatacccag

SEQ ID NO: 795878 - DNA, 25 bp, Mus musculus
tcaacaaccccaatctcaggaagag

SEQ ID NO: 795879 - DNA, 25 bp, Mus musculus
tcaacaaccccattctcaggaagag

SEQ ID NO: 795880 - DNA, 25 bp, Mus musculus
tcaacaacctcactcaaaatccaga

SEQ ID NO: 795881 - DNA, 25 bp, Mus musculus
tcaacaacctcagtcaaaatccaga

SEQ ID NO: 795882 - DNA, 25 bp, Mus musculus
tcaacaaccttaccaatgttttcca

SEQ ID NO: 795883 - DNA, 25 bp, Mus musculus
tcaacaaccttagcaatgttttcca

SEQ ID NO: 795884 - DNA, 25 bp, Mus musculus
tcaacaacggcccttgaaggcaagt

SEQ ID NO: 795885 - DNA, 25 bp, Mus musculus
tcaacaacggccgttgaaggcaagt

SEQ ID NO: 795886 - DNA, 25 bp, Mus musculus
tcaacaactattaaaccttagacaa

SEQ ID NO: 795887 - DNA, 25 bp, Mus musculus
tcaacaactatttaaccttagacaa

SEQ ID NO: 795888 - DNA, 25 bp, Mus musculus
tcaacaactctcatcgaactcggga

SEQ ID NO: 795889 - DNA, 25 bp, Mus musculus
tcaacaactctcttcgaactcggga

SEQ ID NO: 795890 - DNA, 25 bp, Mus musculus
tcaacaactggacgacaaaacccaa

SEQ ID NO: 795891 - DNA, 25 bp, Mus musculus
tcaacaactggaggacaaaacccaa

SEQ ID NO: 795892 - DNA, 25 bp, Mus musculus
tcaacaagaaacaccgtgtggcctt

SEQ ID NO: 795893 - DNA, 25 bp, Mus musculus
tcaacaagaaactccgtgtggcctt

SEQ ID NO: 795894 - DNA, 25 bp, Mus musculus
tcaacaagaatgctcgggctaccct

SEQ ID NO: 795895 - DNA, 25 bp, Mus musculus
tcaacaagaatggtcgggctaccct

SEQ ID NO: 795896 - DNA, 25 bp, Mus musculus
tcaacaagaggcagcattctgcttt

SEQ ID NO: 795897 - DNA, 25 bp, Mus musculus
tcaacaagaggctgcattctgcttt

SEQ ID NO: 795898 - DNA, 25 bp, Mus musculus
tcaacaagcactacgagtcagcctg

SEQ ID NO: 795899 - DNA, 25 bp, Mus musculus
tcaacaagcacttcgagtcagcctg

SEQ ID NO: 795900 - DNA, 25 bp, Mus musculus
tcaacaagctctctgttcactgcca

SEQ ID NO: 795901 - DNA, 25 bp, Mus musculus
tcaacaagctctgtgttcactgcca

SEQ ID NO: 795902 - DNA, 25 bp, Mus musculus
tcaacaaggcctccgatgagtcagt

SEQ ID NO: 795903 - DNA, 25 bp, Mus musculus
tcaacaaggcctgcgatgagtcagt

SEQ ID NO: 795904 - DNA, 25 bp, Mus musculus
tcaacaatggacatgccccaacggg

SEQ ID NO: 795905 - DNA, 25 bp, Mus musculus
tcaacaatggacttgccccaacggg

SEQ ID NO: 795906 - DNA, 25 bp, Mus musculus
tcaacaatgtaaacctcactttatt

SEQ ID NO: 795907 - DNA, 25 bp, Mus musculus
tcaacaatgtaatcctcactttatt

SEQ ID NO: 795908 - DNA, 25 bp, Mus musculus
tcaacaattactccggcttcctgaa

SEQ ID NO: 795909 - DNA, 25 bp, Mus musculus
tcaacaattactgcggcttcctgaa

SEQ ID NO: 795910 - DNA, 25 bp, Mus musculus
tcaacaatttacaccactgtcttag

SEQ ID NO: 795911 - DNA, 25 bp, Mus musculus
tcaacaatttactccactgtcttag

SEQ ID NO: 795912 - DNA, 25 bp, Mus musculus
tcaacaatttttccataacctccct

SEQ ID NO: 795913 - DNA, 25 bp, Mus musculus
tcaacaatttttgcataacctccct

SEQ ID NO: 795914 - DNA, 25 bp, Mus musculus
tcaacacaaaccatgaagacttcat

SEQ ID NO: 795915 - DNA, 25 bp, Mus musculus
tcaacacaaaccttgaagacttcat

SEQ ID NO: 795916 - DNA, 25 bp, Mus musculus
tcaacacacattcggtagggagaga

SEQ ID NO: 795917 - DNA, 25 bp, Mus musculus
tcaacacacattgggtagggagaga

SEQ ID NO: 795918 - DNA, 25 bp, Mus musculus
tcaacacagagcatggcggcagtca

SEQ ID NO: 795919 - DNA, 25 bp, Mus musculus
tcaacacagagcttggcggcagtca

SEQ ID NO: 795920 - DNA, 25 bp, Mus musculus
tcaacacataggatttaaacggaag

SEQ ID NO: 795921 - DNA, 25 bp, Mus musculus
tcaacacataggttttaaacggaag

SEQ ID NO: 795922 - DNA, 25 bp, Mus musculus
tcaacacatccactagacgagtcca

SEQ ID NO: 795923 - DNA, 25 bp, Mus musculus
tcaacacatccagtagacgagtcca

SEQ ID NO: 795924 - DNA, 25 bp, Mus musculus
tcaacaccaacaagtttccacgttc

SEQ ID NO: 795925 - DNA, 25 bp, Mus musculus
tcaacaccaacatgtttccacgttc

SEQ ID NO: 795926 - DNA, 25 bp, Mus musculus
tcaacaccagttatctaaagtaata

SEQ ID NO: 795927 - DNA, 25 bp, Mus musculus
tcaacaccagttttctaaagtaata

SEQ ID NO: 795928 - DNA, 25 bp, Mus musculus
tcaacaccatgcatctcactctggg

SEQ ID NO: 795929 - DNA, 25 bp, Mus musculus
tcaacaccatgcttctcactctggg

SEQ ID NO: 795930 - DNA, 25 bp, Mus musculus
tcaacaccctggagagaggagcgcg

SEQ ID NO: 795931 - DNA, 25 bp, Mus musculus
tcaacaccctggtgagaggagcgcg

SEQ ID NO: 795932 - DNA, 25 bp, Mus musculus
tcaacacctacacattgctcacaga

SEQ ID NO: 795933 - DNA, 25 bp, Mus musculus
tcaacacctacagattgctcacaga

SEQ ID NO: 795934 - DNA, 25 bp, Mus musculus
tcaacacctgacaataacggacttc

SEQ ID NO: 795935 - DNA, 25 bp, Mus musculus
tcaacacctgactataacggacttc

SEQ ID NO: 795936 - DNA, 25 bp, Mus musculus
tcaacacctttgataggcgcacgat

SEQ ID NO: 795937 - DNA, 25 bp, Mus musculus
tcaacacctttgttaggcgcacgat

SEQ ID NO: 795938 - DNA, 25 bp, Mus musculus
tcaacacgaggtagttcaaactgga

SEQ ID NO: 795939 - DNA, 25 bp, Mus musculus
tcaacacgaggttgttcaaactgga

SEQ ID NO: 795940 - DNA, 25 bp, Mus musculus
tcaacacgccagaaagagattcggg

SEQ ID NO: 795941 - DNA, 25 bp, Mus musculus
tcaacacgccagtaagagattcggg

SEQ ID NO: 795942 - DNA, 25 bp, Mus musculus
tcaacacggtcgaagttctatgtcc

SEQ ID NO: 795943 - DNA, 25 bp, Mus musculus
tcaacacggtcgtagttctatgtcc

SEQ ID NO: 795944 - DNA, 25 bp, Mus musculus
tcaacacgttttccatggttaagtt

SEQ ID NO: 795945 - DNA, 25 bp, Mus musculus
tcaacacgttttgcatggttaagtt

SEQ ID NO: 795946 - DNA, 25 bp, Mus musculus
tcaacactacgcactccgcttgttt

SEQ ID NO: 795947 - DNA, 25 bp, Mus musculus
tcaacactacgctctccgcttgttt

SEQ ID NO: 795948 - DNA, 25 bp, Mus musculus
tcaacactagtgaggctgacagtct

SEQ ID NO: 795949 - DNA, 25 bp, Mus musculus
tcaacactagtgtggctgacagtct

SEQ ID NO: 795950 - DNA, 25 bp, Mus musculus
tcaacactcaccactttgagagcct

SEQ ID NO: 795951 - DNA, 25 bp, Mus musculus
tcaacactcacctctttgagagcct

SEQ ID NO: 795952 - DNA, 25 bp, Mus musculus
tcaacactgacgatacacacgagga

SEQ ID NO: 795953 - DNA, 25 bp, Mus musculus
tcaacactgacgttacacacgagga

SEQ ID NO: 795954 - DNA, 25 bp, Mus musculus
tcaacactgagtccctggtgagtga

SEQ ID NO: 795955 - DNA, 25 bp, Mus musculus
tcaacactgagtgcctggtgagtga

SEQ ID NO: 795956 - DNA, 25 bp, Mus musculus
tcaacactgcgaactgtcctgttct

SEQ ID NO: 795957 - DNA, 25 bp, Mus musculus
tcaacactgcgatctgtcctgttct

SEQ ID NO: 795958 - DNA, 25 bp, Mus musculus
tcaacactgcttaaaatgctttcat

SEQ ID NO: 795959 - DNA, 25 bp, Mus musculus
tcaacactgctttaaatgctttcat

SEQ ID NO: 795960 - DNA, 25 bp, Mus musculus
tcaacactgttaccttgtttatgct

SEQ ID NO: 795961 - DNA, 25 bp, Mus musculus
tcaacactgttagcttgtttatgct

SEQ ID NO: 795962 - DNA, 25 bp, Mus musculus
tcaacagaaggccttcttggcagaa

SEQ ID NO: 795963 - DNA, 25 bp, Mus musculus
tcaacagaaggcgttcttggcagaa

SEQ ID NO: 795964 - DNA, 25 bp, Mus musculus
tcaacagaccgtagcttccaagcat

SEQ ID NO: 795965 - DNA, 25 bp, Mus musculus
tcaacagaccgttgcttccaagcat

SEQ ID NO: 795966 - DNA, 25 bp, Mus musculus
tcaacagagaggcttcatcctacag

SEQ ID NO: 795967 - DNA, 25 bp, Mus musculus
tcaacagagagggttcatcctacag

SEQ ID NO: 795968 - DNA, 25 bp, Mus musculus
tcaacagatccaagctcaaccgcag

SEQ ID NO: 795969 - DNA, 25 bp, Mus musculus
tcaacagatccatgctcaaccgcag

SEQ ID NO: 795970 - DNA, 25 bp, Mus musculus
tcaacagatttcaattacatgcccc

SEQ ID NO: 795971 - DNA, 25 bp, Mus musculus
tcaacagatttctattacatgcccc

SEQ ID NO: 795972 - DNA, 25 bp, Mus musculus
tcaacagcaaccacatggcctgtag

SEQ ID NO: 795973 - DNA, 25 bp, Mus musculus
tcaacagcaacctcatggcctgtag

SEQ ID NO: 795974 - DNA, 25 bp, Mus musculus
tcaacagcacccaggcaagaaggat

SEQ ID NO: 795975 - DNA, 25 bp, Mus musculus
tcaacagcaccctggcaagaaggat

SEQ ID NO: 795976 - DNA, 25 bp, Mus musculus
tcaacagcactgacaaccccatgtg

SEQ ID NO: 795977 - DNA, 25 bp, Mus musculus
tcaacagcactgtcaaccccatgtg

SEQ ID NO: 795978 - DNA, 25 bp, Mus musculus
tcaacagcaggtaagccatctgacg

SEQ ID NO: 795979 - DNA, 25 bp, Mus musculus
tcaacagcaggttagccatctgacg

SEQ ID NO: 795980 - DNA, 25 bp, Mus musculus
tcaacagccaatcagtttttgaggg

SEQ ID NO: 795981 - DNA, 25 bp, Mus musculus
tcaacagccaatgagtttttgaggg

SEQ ID NO: 795982 - DNA, 25 bp, Mus musculus
tcaacagcctgaacactctactgga

SEQ ID NO: 795983 - DNA, 25 bp, Mus musculus
tcaacagcctgatcactctactgga

SEQ ID NO: 795984 - DNA, 25 bp, Mus musculus
tcaacagcctttaactcagttccag

SEQ ID NO: 795985 - DNA, 25 bp, Mus musculus
tcaacagccttttactcagttccag

SEQ ID NO: 795986 - DNA, 25 bp, Mus musculus
tcaacagctaaaccatcggcggaca

SEQ ID NO: 795987 - DNA, 25 bp, Mus musculus
tcaacagctaaagcatcggcggaca

SEQ ID NO: 795988 - DNA, 25 bp, Mus musculus
tcaacagctacaatcaaaattatgc

SEQ ID NO: 795989 - DNA, 25 bp, Mus musculus
tcaacagctacattcaaaattatgc

SEQ ID NO: 795990 - DNA, 25 bp, Mus musculus
tcaacagctcagctgggacgatatt

SEQ ID NO: 795991 - DNA, 25 bp, Mus musculus
tcaacagctcaggtgggacgatatt

SEQ ID NO: 795992 - DNA, 25 bp, Mus musculus
tcaacagctctgactaaggacaagg

SEQ ID NO: 795993 - DNA, 25 bp, Mus musculus
tcaacagctctgtctaaggacaagg

SEQ ID NO: 795994 - DNA, 25 bp, Mus musculus
tcaacaggaaaaccacgcccgtgta

SEQ ID NO: 795995 - DNA, 25 bp, Mus musculus
tcaacaggaaaagcacgcccgtgta

SEQ ID NO: 795996 - DNA, 25 bp, Mus musculus
tcaacaggaaagatcttgtggacct

SEQ ID NO: 795997 - DNA, 25 bp, Mus musculus
tcaacaggaaagttcttgtggacct

SEQ ID NO: 795998 - DNA, 25 bp, Mus musculus
tcaacaggcattacccctcagatgg

SEQ ID NO: 795999 - DNA, 25 bp, Mus musculus
tcaacaggcatttcccctcagatgg

SEQ ID NO: 796000 - DNA, 25 bp, Mus musculus
tcaacagtcattaaagccagagctt

SEQ ID NO: 796001 - DNA, 25 bp, Mus musculus
tcaacagtcatttaagccagagctt

SEQ ID NO: 796002 - DNA, 25 bp, Mus musculus
tcaacagtgggcaacacagcttccc

SEQ ID NO: 796003 - DNA, 25 bp, Mus musculus
tcaacagtgggctacacagcttccc

SEQ ID NO: 796004 - DNA, 25 bp, Mus musculus
tcaacagtgtagctcttggacacac

SEQ ID NO: 796005 - DNA, 25 bp, Mus musculus
tcaacagtgtaggtcttggacacac

SEQ ID NO: 796006 - DNA, 25 bp, Mus musculus
tcaacagttctgacttaggcatgtg

SEQ ID NO: 796007 - DNA, 25 bp, Mus musculus
tcaacagttctgtcttaggcatgtg

SEQ ID NO: 796008 - DNA, 25 bp, Mus musculus
tcaacagttttgagttagcccagcc

SEQ ID NO: 796009 - DNA, 25 bp, Mus musculus
tcaacagttttgtgttagcccagcc

SEQ ID NO: 796010 - DNA, 25 bp, Mus musculus
tcaacataagcaatacagatttacc

SEQ ID NO: 796011 - DNA, 25 bp, Mus musculus
tcaacataagcattacagatttacc

SEQ ID NO: 796012 - DNA, 25 bp, Mus musculus
tcaacatatctcaactctctctgat

SEQ ID NO: 796013 - DNA, 25 bp, Mus musculus
tcaacatatctctactctctctgat

SEQ ID NO: 796014 - DNA, 25 bp, Mus musculus
tcaacatcacatcgctcagaaatag

SEQ ID NO: 796015 - DNA, 25 bp, Mus musculus
tcaacatcacatggctcagaaatag

SEQ ID NO: 796016 - DNA, 25 bp, Mus musculus
tcaacatcacccattactcttagaa

SEQ ID NO: 796017 - DNA, 25 bp, Mus musculus
tcaacatcaccctttactcttagaa

SEQ ID NO: 796018 - DNA, 25 bp, Mus musculus
tcaacatcagctacgccaacgtggc

SEQ ID NO: 796019 - DNA, 25 bp, Mus musculus
tcaacatcagcttcgccaacgtggc

SEQ ID NO: 796020 - DNA, 25 bp, Mus musculus
tcaacatcctggctctggtgtaccg

SEQ ID NO: 796021 - DNA, 25 bp, Mus musculus
tcaacatcctgggtctggtgtaccg

SEQ ID NO: 796022 - DNA, 25 bp, Mus musculus
tcaacatctctccactaacttagtt

SEQ ID NO: 796023 - DNA, 25 bp, Mus musculus
tcaacatctctcgactaacttagtt

SEQ ID NO: 796024 - DNA, 25 bp, Mus musculus
tcaacatctgtcctcgaccccatgc

SEQ ID NO: 796025 - DNA, 25 bp, Mus musculus
tcaacatctgtcgtcgaccccatgc

SEQ ID NO: 796026 - DNA, 25 bp, Mus musculus
tcaacatcttttccttctgtccctc

SEQ ID NO: 796027 - DNA, 25 bp, Mus musculus
tcaacatcttttgcttctgtccctc

SEQ ID NO: 796028 - DNA, 25 bp, Mus musculus
tcaacatgaaccagggtggccacgt

SEQ ID NO: 796029 - DNA, 25 bp, Mus musculus
tcaacatgaacctgggtggccacgt

SEQ ID NO: 796030 - DNA, 25 bp, Mus musculus
tcaacatgaactccagactaacctg

SEQ ID NO: 796031 - DNA, 25 bp, Mus musculus
tcaacatgaactgcagactaacctg

SEQ ID NO: 796032 - DNA, 25 bp, Mus musculus
tcaacatgactgataacaatgcatt

SEQ ID NO: 796033 - DNA, 25 bp, Mus musculus
tcaacatgactgttaacaatgcatt

SEQ ID NO: 796034 - DNA, 25 bp, Mus musculus
tcaacatggagtctgtgctcaccca

SEQ ID NO: 796035 - DNA, 25 bp, Mus musculus
tcaacatggagtgtgtgctcaccca

SEQ ID NO: 796036 - DNA, 25 bp, Mus musculus
tcaacatggcccagtggatgcgctt

SEQ ID NO: 796037 - DNA, 25 bp, Mus musculus
tcaacatggcccagttggtgcactt

SEQ ID NO: 796038 - DNA, 25 bp, Mus musculus
tcaacatggccctgtggatgcgctt

SEQ ID NO: 796039 - DNA, 25 bp, Mus musculus
tcaacatggccctgttggtgcactt

SEQ ID NO: 796040 - DNA, 25 bp, Mus musculus
tcaacatgtccacaggcttggtgca

SEQ ID NO: 796041 - DNA, 25 bp, Mus musculus
tcaacatgtccagaggcttggtgca

SEQ ID NO: 796042 - DNA, 25 bp, Mus musculus
tcaacatgtttcatttggaagacca

SEQ ID NO: 796043 - DNA, 25 bp, Mus musculus
tcaacatgtttcttttggaagacca

SEQ ID NO: 796044 - DNA, 25 bp, Mus musculus
tcaacattacccaccaattttttag

SEQ ID NO: 796045 - DNA, 25 bp, Mus musculus
tcaacattaccctccaattttttag

SEQ ID NO: 796046 - DNA, 25 bp, Mus musculus
tcaacattcatgacactgaggccat

SEQ ID NO: 796047 - DNA, 25 bp, Mus musculus
tcaacattcatgtcactgaggccat

SEQ ID NO: 796048 - DNA, 25 bp, Mus musculus
tcaacattggcacccttgctagaat

SEQ ID NO: 796049 - DNA, 25 bp, Mus musculus
tcaacattggcagccttgctagaat

SEQ ID NO: 796050 - DNA, 25 bp, Mus musculus
tcaacatttcggcttttggctgttt

SEQ ID NO: 796051 - DNA, 25 bp, Mus musculus
tcaacatttcgggttttggctgttt

SEQ ID NO: 796052 - DNA, 25 bp, Mus musculus
tcaacatttggcctgggtatcgctg

SEQ ID NO: 796053 - DNA, 25 bp, Mus musculus
tcaacatttggcgtgggtatcgctg

SEQ ID NO: 796054 - DNA, 25 bp, Mus musculus
tcaacattttttcagatcccctttt

SEQ ID NO: 796055 - DNA, 25 bp, Mus musculus
tcaacattttttgagatcccctttt

SEQ ID NO: 796056 - DNA, 25 bp, Mus musculus
tcaaccaaatcccagttcaactcag

SEQ ID NO: 796057 - DNA, 25 bp, Mus musculus
tcaaccaaatccgagttcaactcag

SEQ ID NO: 796058 - DNA, 25 bp, Mus musculus
tcaaccaactacctcattgctgtgg

SEQ ID NO: 796059 - DNA, 25 bp, Mus musculus
tcaaccaactacgtcattgctgtgg

SEQ ID NO: 796060 - DNA, 25 bp, Mus musculus
tcaaccaagctgatgtgggtggcca

SEQ ID NO: 796061 - DNA, 25 bp, Mus musculus
tcaaccaagctgttgtgggtggcca

SEQ ID NO: 796062 - DNA, 25 bp, Mus musculus
tcaaccaagtgtcgcatgagcggac

SEQ ID NO: 796063 - DNA, 25 bp, Mus musculus
tcaaccaagtgtggcatgagcggac

SEQ ID NO: 796064 - DNA, 25 bp, Mus musculus
tcaaccaatggcaagagtggtctca

SEQ ID NO: 796065 - DNA, 25 bp, Mus musculus
tcaaccaatggcagtaaccatgaga

SEQ ID NO: 796066 - DNA, 25 bp, Mus musculus
tcaaccaatggctagagtggtctca

SEQ ID NO: 796067 - DNA, 25 bp, Mus musculus
tcaaccaatggctgtaaccatgaga

SEQ ID NO: 796068 - DNA, 25 bp, Mus musculus
tcaaccacagttcctcgaatctgca

SEQ ID NO: 796069 - DNA, 25 bp, Mus musculus
tcaaccacagttgctcgaatctgca

SEQ ID NO: 796070 - DNA, 25 bp, Mus musculus
tcaaccacctccaattgtgtagcat

SEQ ID NO: 796071 - DNA, 25 bp, Mus musculus
tcaaccacctcctattgtgtagcat

SEQ ID NO: 796072 - DNA, 25 bp, Mus musculus
tcaaccactccaaccttgattaaga

SEQ ID NO: 796073 - DNA, 25 bp, Mus musculus
tcaaccactccatccttgattaaga

SEQ ID NO: 796074 - DNA, 25 bp, Mus musculus
tcaaccactttcaatacgacctata

SEQ ID NO: 796075 - DNA, 25 bp, Mus musculus
tcaaccactttctatacgacctata

SEQ ID NO: 796076 - DNA, 25 bp, Mus musculus
tcaaccaggcttcgctgctaaggat

SEQ ID NO: 796077 - DNA, 25 bp, Mus musculus
tcaaccaggcttggctgctaaggat

SEQ ID NO: 796078 - DNA, 25 bp, Mus musculus
tcaaccagggttacctacaggccaa

SEQ ID NO: 796079 - DNA, 25 bp, Mus musculus
tcaaccagggtttcctacaggccaa

SEQ ID NO: 796080 - DNA, 25 bp, Mus musculus
tcaaccatcaaacaaaccttccgga

SEQ ID NO: 796081 - DNA, 25 bp, Mus musculus
tcaaccatcaaagaaaccttccgga

SEQ ID NO: 796082 - DNA, 25 bp, Mus musculus
tcaaccatcgagcatatccacagag

SEQ ID NO: 796083 - DNA, 25 bp, Mus musculus
tcaaccatcgaggatatccacagag

SEQ ID NO: 796084 - DNA, 25 bp, Mus musculus
tcaaccatttttagtactgggcctt

SEQ ID NO: 796085 - DNA, 25 bp, Mus musculus
tcaaccattttttgtactgggcctt

SEQ ID NO: 796086 - DNA, 25 bp, Mus musculus
tcaacccaaaatatcaaggcccatc

SEQ ID NO: 796087 - DNA, 25 bp, Mus musculus
tcaacccaaaatttcaaggcccatc

SEQ ID NO: 796088 - DNA, 25 bp, Mus musculus
tcaacccaagccatagtatccttta

SEQ ID NO: 796089 - DNA, 25 bp, Mus musculus
tcaacccaagccttagtatccttta

SEQ ID NO: 796090 - DNA, 25 bp, Mus musculus
tcaacccactctacagctagtgagt

SEQ ID NO: 796091 - DNA, 25 bp, Mus musculus
tcaacccactcttcagctagtgagt

SEQ ID NO: 796092 - DNA, 25 bp, Mus musculus
tcaacccactggagtacgtgatcgt

SEQ ID NO: 796093 - DNA, 25 bp, Mus musculus
tcaacccactggtgtacgtgatcgt

SEQ ID NO: 796094 - DNA, 25 bp, Mus musculus
tcaacccactgtcctccagaaatta

SEQ ID NO: 796095 - DNA, 25 bp, Mus musculus
tcaacccactgtgctccagaaatta

SEQ ID NO: 796096 - DNA, 25 bp, Mus musculus
tcaacccactttcatcttcttttta

SEQ ID NO: 796097 - DNA, 25 bp, Mus musculus
tcaacccactttgatcttcttttta

SEQ ID NO: 796098 - DNA, 25 bp, Mus musculus
tcaacccagaaaagcacgtgtacac

SEQ ID NO: 796099 - DNA, 25 bp, Mus musculus
tcaacccagaaatgcacgtgtacac

SEQ ID NO: 796100 - DNA, 25 bp, Mus musculus
tcaacccagattaatttccactcag

SEQ ID NO: 796101 - DNA, 25 bp, Mus musculus
tcaacccagatttatttccactcag

SEQ ID NO: 796102 - DNA, 25 bp, Mus musculus
tcaacccagctccagccatggctga

SEQ ID NO: 796103 - DNA, 25 bp, Mus musculus
tcaacccagctcgagccatggctga

SEQ ID NO: 796104 - DNA, 25 bp, Mus musculus
tcaacccagggcacggagcatgtgg

SEQ ID NO: 796105 - DNA, 25 bp, Mus musculus
tcaacccagggctcggagcatgtgg

SEQ ID NO: 796106 - DNA, 25 bp, Mus musculus
tcaacccagtcgagtgtgtgtctct

SEQ ID NO: 796107 - DNA, 25 bp, Mus musculus
tcaacccagtcgtgtgtgtgtctct

SEQ ID NO: 796108 - DNA, 25 bp, Mus musculus
tcaacccagttacctcacacttgac

SEQ ID NO: 796109 - DNA, 25 bp, Mus musculus
tcaacccagttagctcacacttgac

SEQ ID NO: 796110 - DNA, 25 bp, Mus musculus
tcaacccagttcatctcgggtgata

SEQ ID NO: 796111 - DNA, 25 bp, Mus musculus
tcaacccagttcttctcgggtgata

SEQ ID NO: 796112 - DNA, 25 bp, Mus musculus
tcaaccccaggtatgcagaacagtg

SEQ ID NO: 796113 - DNA, 25 bp, Mus musculus
tcaaccccaggtttgcagaacagtg

SEQ ID NO: 796114 - DNA, 25 bp, Mus musculus
tcaaccccagtaatcattcctgccc

SEQ ID NO: 796115 - DNA, 25 bp, Mus musculus
tcaaccccagtattcattcctgccc

SEQ ID NO: 796116 - DNA, 25 bp, Mus musculus
tcaaccccatacactaaaaaaggag

SEQ ID NO: 796117 - DNA, 25 bp, Mus musculus
tcaaccccatactctaaaaaaggag

SEQ ID NO: 796118 - DNA, 25 bp, Mus musculus
tcaaccccatagaagtcctttcttt

SEQ ID NO: 796119 - DNA, 25 bp, Mus musculus
tcaaccccatagtagtcctttcttt

SEQ ID NO: 796120 - DNA, 25 bp, Mus musculus
tcaaccccatgtatctggtttggtg

SEQ ID NO: 796121 - DNA, 25 bp, Mus musculus
tcaaccccatgtttctggtttggtg

SEQ ID NO: 796122 - DNA, 25 bp, Mus musculus
tcaacccctaagctgaagggctact

SEQ ID NO: 796123 - DNA, 25 bp, Mus musculus
tcaacccctaaggtgaagggctact

SEQ ID NO: 796124 - DNA, 25 bp, Mus musculus
tcaacccctcttatttgtagaagag

SEQ ID NO: 796125 - DNA, 25 bp, Mus musculus
tcaacccctcttttttgtagaagag

SEQ ID NO: 796126 - DNA, 25 bp, Mus musculus
tcaacccgaggccgagaccactgga

SEQ ID NO: 796127 - DNA, 25 bp, Mus musculus
tcaacccgaggcggagaccactgga

SEQ ID NO: 796128 - DNA, 25 bp, Mus musculus
tcaacccgcttcagggagagactta

SEQ ID NO: 796129 - DNA, 25 bp, Mus musculus
tcaacccgcttctgggagagactta

SEQ ID NO: 796130 - DNA, 25 bp, Mus musculus
tcaacccgtccgctgggaataactt

SEQ ID NO: 796131 - DNA, 25 bp, Mus musculus
tcaacccgtccggtgggaataactt

SEQ ID NO: 796132 - DNA, 25 bp, Mus musculus
tcaacccgtctacatccacaagaaa

SEQ ID NO: 796133 - DNA, 25 bp, Mus musculus
tcaacccgtctagatccacaagaaa

SEQ ID NO: 796134 - DNA, 25 bp, Mus musculus
tcaacccgtgttagaccccaggaag

SEQ ID NO: 796135 - DNA, 25 bp, Mus musculus
tcaacccgtgtttgaccccaggaag

SEQ ID NO: 796136 - DNA, 25 bp, Mus musculus
tcaaccctaaccaagaatccagaag

SEQ ID NO: 796137 - DNA, 25 bp, Mus musculus
tcaaccctaacctagaatccagaag

SEQ ID NO: 796138 - DNA, 25 bp, Mus musculus
tcaaccctagatattcttgtctcac

SEQ ID NO: 796139 - DNA, 25 bp, Mus musculus
tcaaccctagattttcttgtctcac

SEQ ID NO: 796140 - DNA, 25 bp, Mus musculus
tcaaccctattgacaacctgaaatt

SEQ ID NO: 796141 - DNA, 25 bp, Mus musculus
tcaaccctattgtcaacctgaaatt

SEQ ID NO: 796142 - DNA, 25 bp, Mus musculus
tcaaccctcaggaatccaaacgctt

SEQ ID NO: 796143 - DNA, 25 bp, Mus musculus
tcaaccctcaggtatccaaacgctt

SEQ ID NO: 796144 - DNA, 25 bp, Mus musculus
tcaaccctcggcatatatgtctatg

SEQ ID NO: 796145 - DNA, 25 bp, Mus musculus
tcaaccctcggcttatatgtctatg

SEQ ID NO: 796146 - DNA, 25 bp, Mus musculus
tcaaccctctctatatcgagcctta

SEQ ID NO: 796147 - DNA, 25 bp, Mus musculus
tcaaccctctctttatcgagcctta

SEQ ID NO: 796148 - DNA, 25 bp, Mus musculus
tcaaccctgcgaactatccaatgaa

SEQ ID NO: 796149 - DNA, 25 bp, Mus musculus
tcaaccctgcgatctatccaatgaa

SEQ ID NO: 796150 - DNA, 25 bp, Mus musculus
tcaaccctggataccattaaagttg

SEQ ID NO: 796151 - DNA, 25 bp, Mus musculus
tcaaccctggattccattaaagttg

SEQ ID NO: 796152 - DNA, 25 bp, Mus musculus
tcaaccctggcgcactacttttaag

SEQ ID NO: 796153 - DNA, 25 bp, Mus musculus
tcaaccctggcggactacttttaag

SEQ ID NO: 796154 - DNA, 25 bp, Mus musculus
tcaaccctgggcagcggagaagtgt

SEQ ID NO: 796155 - DNA, 25 bp, Mus musculus
tcaaccctgggctgcggagaagtgt

SEQ ID NO: 796156 - DNA, 25 bp, Mus musculus
tcaaccctgtaaaggtggccaacct

SEQ ID NO: 796157 - DNA, 25 bp, Mus musculus
tcaaccctgtaatggtggccaacct

SEQ ID NO: 796158 - DNA, 25 bp, Mus musculus
tcaaccctgtgtccggaacggatat

SEQ ID NO: 796159 - DNA, 25 bp, Mus musculus
tcaaccctgtgtgcggaacggatat

SEQ ID NO: 796160 - DNA, 25 bp, Mus musculus
tcaacccttctaacttcaaagatca

SEQ ID NO: 796161 - DNA, 25 bp, Mus musculus
tcaacccttctatcttcaaagatca

SEQ ID NO: 796162 - DNA, 25 bp, Mus musculus
tcaaccctttcacaaatgtgtagaa

SEQ ID NO: 796163 - DNA, 25 bp, Mus musculus
tcaaccctttcacgcctggagttag

SEQ ID NO: 796164 - DNA, 25 bp, Mus musculus
tcaaccctttcagaaatgtgtagaa

SEQ ID NO: 796165 - DNA, 25 bp, Mus musculus
tcaaccctttcaggcctggagttag

SEQ ID NO: 796166 - DNA, 25 bp, Mus musculus
tcaaccgaactgacacactaaaaga

SEQ ID NO: 796167 - DNA, 25 bp, Mus musculus
tcaaccgaactgtcacactaaaaga

SEQ ID NO: 796168 - DNA, 25 bp, Mus musculus
tcaaccgagagtccgtgagggcccc

SEQ ID NO: 796169 - DNA, 25 bp, Mus musculus
tcaaccgagagtgcgtgagggcccc

SEQ ID NO: 796170 - DNA, 25 bp, Mus musculus
tcaaccgcagctacgtggagccttt

SEQ ID NO: 796171 - DNA, 25 bp, Mus musculus
tcaaccgcagcttcgtggagccttt

SEQ ID NO: 796172 - DNA, 25 bp, Mus musculus
tcaaccgcatttaccacgaacgctt

SEQ ID NO: 796173 - DNA, 25 bp, Mus musculus
tcaaccgcattttccacgaacgctt

SEQ ID NO: 796174 - DNA, 25 bp, Mus musculus
tcaaccgccaagattctgaacatcc

SEQ ID NO: 796175 - DNA, 25 bp, Mus musculus
tcaaccgccaagtttctgaacatcc

SEQ ID NO: 796176 - DNA, 25 bp, Mus musculus
tcaaccgctatcagactcgctgggc

SEQ ID NO: 796177 - DNA, 25 bp, Mus musculus
tcaaccgctatctgactcgctgggc

SEQ ID NO: 796178 - DNA, 25 bp, Mus musculus
tcaaccgctgtccaatgatgtccgc

SEQ ID NO: 796179 - DNA, 25 bp, Mus musculus
tcaaccgctgtcgaatgatgtccgc

SEQ ID NO: 796180 - DNA, 25 bp, Mus musculus
tcaaccgggacactatcacccgaat

SEQ ID NO: 796181 - DNA, 25 bp, Mus musculus
tcaaccgggacagtatcacccgaat

SEQ ID NO: 796182 - DNA, 25 bp, Mus musculus
tcaaccgggcccaggagagcgacat

SEQ ID NO: 796183 - DNA, 25 bp, Mus musculus
tcaaccgggccctggagagcgacat

SEQ ID NO: 796184 - DNA, 25 bp, Mus musculus
tcaaccggtacacacatgagcttct

SEQ ID NO: 796185 - DNA, 25 bp, Mus musculus
tcaaccggtacagacatgagcttct

SEQ ID NO: 796186 - DNA, 25 bp, Mus musculus
tcaaccgtggctatgccaagctgaa

SEQ ID NO: 796187 - DNA, 25 bp, Mus musculus
tcaaccgtggctttgccaagctgaa

SEQ ID NO: 796188 - DNA, 25 bp, Mus musculus
tcaaccgtggtcactgtgggagtct

SEQ ID NO: 796189 - DNA, 25 bp, Mus musculus
tcaaccgtggtctctgtgggagtct

SEQ ID NO: 796190 - DNA, 25 bp, Mus musculus
tcaaccgtttaaatttctctctctc

SEQ ID NO: 796191 - DNA, 25 bp, Mus musculus
tcaaccgtttaattttctctctctc

SEQ ID NO: 796192 - DNA, 25 bp, Mus musculus
tcaacctaacctaagaacagaagag

SEQ ID NO: 796193 - DNA, 25 bp, Mus musculus
tcaacctaaccttagaacagaagag

SEQ ID NO: 796194 - DNA, 25 bp, Mus musculus
tcaacctaactacttgggaacttat

SEQ ID NO: 796195 - DNA, 25 bp, Mus musculus
tcaacctaactagttgggaacttat

SEQ ID NO: 796196 - DNA, 25 bp, Mus musculus
tcaacctacgctatcaacgcagcaa

SEQ ID NO: 796197 - DNA, 25 bp, Mus musculus
tcaacctacgctttcaacgcagcaa

SEQ ID NO: 796198 - DNA, 25 bp, Mus musculus
tcaacctagggtatggtcactacgg

SEQ ID NO: 796199 - DNA, 25 bp, Mus musculus
tcaacctagggtttggtcactacgg

SEQ ID NO: 796200 - DNA, 25 bp, Mus musculus
tcaacctagtcaattgggagagatt

SEQ ID NO: 796201 - DNA, 25 bp, Mus musculus
tcaacctagtcatttgggagagatt

SEQ ID NO: 796202 - DNA, 25 bp, Mus musculus
tcaacctataagactaacctgtgct

SEQ ID NO: 796203 - DNA, 25 bp, Mus musculus
tcaacctataagtctaacctgtgct

SEQ ID NO: 796204 - DNA, 25 bp, Mus musculus
tcaacctatggcacctggcacagag

SEQ ID NO: 796205 - DNA, 25 bp, Mus musculus
tcaacctatggctcctggcacagag

SEQ ID NO: 796206 - DNA, 25 bp, Mus musculus
tcaacctcaccacggagtgctttaa

SEQ ID NO: 796207 - DNA, 25 bp, Mus musculus
tcaacctcaccagggagtgctttaa

SEQ ID NO: 796208 - DNA, 25 bp, Mus musculus
tcaacctcagacagcagggcaggct

SEQ ID NO: 796209 - DNA, 25 bp, Mus musculus
tcaacctcagactgcagggcaggct

SEQ ID NO: 796210 - DNA, 25 bp, Mus musculus
tcaacctcagctagtacctttacct

SEQ ID NO: 796211 - DNA, 25 bp, Mus musculus
tcaacctcagcttgtacctttacct

SEQ ID NO: 796212 - DNA, 25 bp, Mus musculus
tcaacctcagtcaaattatccacgc

SEQ ID NO: 796213 - DNA, 25 bp, Mus musculus
tcaacctcagtctaattatccacgc

SEQ ID NO: 796214 - DNA, 25 bp, Mus musculus
tcaacctcctgccttgtgtaagaac

SEQ ID NO: 796215 - DNA, 25 bp, Mus musculus
tcaacctcctgcgttgtgtaagaac

SEQ ID NO: 796216 - DNA, 25 bp, Mus musculus
tcaacctctgtcacgcggaaacctg

SEQ ID NO: 796217 - DNA, 25 bp, Mus musculus
tcaacctctgtctcgcggaaacctg

SEQ ID NO: 796218 - DNA, 25 bp, Mus musculus
tcaacctgcattataaccctcgctt

SEQ ID NO: 796219 - DNA, 25 bp, Mus musculus
tcaacctgcattttaaccctcgctt

SEQ ID NO: 796220 - DNA, 25 bp, Mus musculus
tcaacctggataaactgtggacatt

SEQ ID NO: 796221 - DNA, 25 bp, Mus musculus
tcaacctggatatactgtggacatt

SEQ ID NO: 796222 - DNA, 25 bp, Mus musculus
tcaacctgggaaaacctatcgattt

SEQ ID NO: 796223 - DNA, 25 bp, Mus musculus
tcaacctgggaatacctatcgattt

SEQ ID NO: 796224 - DNA, 25 bp, Mus musculus
tcaacctgggtaatccaactttatt

SEQ ID NO: 796225 - DNA, 25 bp, Mus musculus
tcaacctgggtattccaactttatt

SEQ ID NO: 796226 - DNA, 25 bp, Mus musculus
tcaacctgtaacatacaagtcttta

SEQ ID NO: 796227 - DNA, 25 bp, Mus musculus
tcaacctgtaacttacaagtcttta

SEQ ID NO: 796228 - DNA, 25 bp, Mus musculus
tcaacctgtcttacaagcgctatgt

SEQ ID NO: 796229 - DNA, 25 bp, Mus musculus
tcaacctgtctttcaagcgctatgt

SEQ ID NO: 796230 - DNA, 25 bp, Mus musculus
tcaacctgttaactttgctttcctt

SEQ ID NO: 796231 - DNA, 25 bp, Mus musculus
tcaacctgttaagtttgctttcctt

SEQ ID NO: 796232 - DNA, 25 bp, Mus musculus
tcaaccttaaatccatgactctgta

SEQ ID NO: 796233 - DNA, 25 bp, Mus musculus
tcaaccttaaatgcatgactctgta

SEQ ID NO: 796234 - DNA, 25 bp, Mus musculus
tcaaccttagaaacgcaagcttgtc

SEQ ID NO: 796235 - DNA, 25 bp, Mus musculus
tcaaccttagaacccggcgagtgga

SEQ ID NO: 796236 - DNA, 25 bp, Mus musculus
tcaaccttagaagccggcgagtgga

SEQ ID NO: 796237 - DNA, 25 bp, Mus musculus
tcaaccttagaatcgcaagcttgtc

SEQ ID NO: 796238 - DNA, 25 bp, Mus musculus
tcaaccttcccacagtggatgggag

SEQ ID NO: 796239 - DNA, 25 bp, Mus musculus
tcaaccttcccagagtggatgggag

SEQ ID NO: 796240 - DNA, 25 bp, Mus musculus
tcaaccttctggagcggtccaggaa

SEQ ID NO: 796241 - DNA, 25 bp, Mus musculus
tcaaccttctggtgcggtccaggaa

SEQ ID NO: 796242 - DNA, 25 bp, Mus musculus
tcaacctttctaccttaatatctcc

SEQ ID NO: 796243 - DNA, 25 bp, Mus musculus
tcaacctttctagcttaatatctcc

SEQ ID NO: 796244 - DNA, 25 bp, Mus musculus
tcaacctttctgatgctgcaattct

SEQ ID NO: 796245 - DNA, 25 bp, Mus musculus
tcaacctttctgttgctgcaattct

SEQ ID NO: 796246 - DNA, 25 bp, Mus musculus
tcaacctttgccacgaacttatttc

SEQ ID NO: 796247 - DNA, 25 bp, Mus musculus
tcaacctttgcctcgaacttatttc

SEQ ID NO: 796248 - DNA, 25 bp, Mus musculus
tcaacctttgctagtgctattctct

SEQ ID NO: 796249 - DNA, 25 bp, Mus musculus
tcaacctttgcttgtgctattctct

SEQ ID NO: 796250 - DNA, 25 bp, Mus musculus
tcaacctttttgcactgcacagatt

SEQ ID NO: 796251 - DNA, 25 bp, Mus musculus
tcaacctttttggactgcacagatt

SEQ ID NO: 796252 - DNA, 25 bp, Mus musculus
tcaacgaacaggagagccttattca

SEQ ID NO: 796253 - DNA, 25 bp, Mus musculus
tcaacgaacaggtgagccttattca

SEQ ID NO: 796254 - DNA, 25 bp, Mus musculus
tcaacgaggacaatgagcgctggga

SEQ ID NO: 796255 - DNA, 25 bp, Mus musculus
tcaacgaggacattgagcgctggga

SEQ ID NO: 796256 - DNA, 25 bp, Mus musculus
tcaacgatgacaccgacgatgacct

SEQ ID NO: 796257 - DNA, 25 bp, Mus musculus
tcaacgatgacagcgacgatgacct

SEQ ID NO: 796258 - DNA, 25 bp, Mus musculus
tcaacgatgcccaggtatacttcac

SEQ ID NO: 796259 - DNA, 25 bp, Mus musculus
tcaacgatgccctggtatacttcac

SEQ ID NO: 796260 - DNA, 25 bp, Mus musculus
tcaacgatgcctcttccaaaatggc

SEQ ID NO: 796261 - DNA, 25 bp, Mus musculus
tcaacgatgcctgttccaaaatggc

SEQ ID NO: 796262 - DNA, 25 bp, Mus musculus
tcaacgatttgacggcatcacagtc

SEQ ID NO: 796263 - DNA, 25 bp, Mus musculus
tcaacgatttgagggcatcacagtc

SEQ ID NO: 796264 - DNA, 25 bp, Mus musculus
tcaacgcctcgaacttctactttaa

SEQ ID NO: 796265 - DNA, 25 bp, Mus musculus
tcaacgcctcgatcttctactttaa

SEQ ID NO: 796266 - DNA, 25 bp, Mus musculus
tcaacgccttgtcaagaagccccga

SEQ ID NO: 796267 - DNA, 25 bp, Mus musculus
tcaacgccttgtgaagaagccccga

SEQ ID NO: 796268 - DNA, 25 bp, Mus musculus
tcaacgcgtctgagaagacctgtga

SEQ ID NO: 796269 - DNA, 25 bp, Mus musculus
tcaacgcgtctgtgaagacctgtga

SEQ ID NO: 796270 - DNA, 25 bp, Mus musculus
tcaacgcgtcttagtttacctttca

SEQ ID NO: 796271 - DNA, 25 bp, Mus musculus
tcaacgcgtctttgtttacctttca

SEQ ID NO: 796272 - DNA, 25 bp, Mus musculus
tcaacgcgtttactgtgtttctcct

SEQ ID NO: 796273 - DNA, 25 bp, Mus musculus
tcaacgcgtttagtgtgtttctcct

SEQ ID NO: 796274 - DNA, 25 bp, Mus musculus
tcaacgctacatagccaacctaggg

SEQ ID NO: 796275 - DNA, 25 bp, Mus musculus
tcaacgctacattgccaacctaggg

SEQ ID NO: 796276 - DNA, 25 bp, Mus musculus
tcaacgctcctgcaacaatcagagt

SEQ ID NO: 796277 - DNA, 25 bp, Mus musculus
tcaacgctcctggaacaatcagagt

SEQ ID NO: 796278 - DNA, 25 bp, Mus musculus
tcaacgctgcgcaggacgccttgcg

SEQ ID NO: 796279 - DNA, 25 bp, Mus musculus
tcaacgctgcgctggacgccttgcg

SEQ ID NO: 796280 - DNA, 25 bp, Mus musculus
tcaacgcttcttatcgtatatgtaa

SEQ ID NO: 796281 - DNA, 25 bp, Mus musculus
tcaacgcttcttttcgtatatgtaa

SEQ ID NO: 796282 - DNA, 25 bp, Mus musculus
tcaacgcttgaacctactatttccc

SEQ ID NO: 796283 - DNA, 25 bp, Mus musculus
tcaacgcttgaagctactatttccc

SEQ ID NO: 796284 - DNA, 25 bp, Mus musculus
tcaacggaagctccctcagtttttt

SEQ ID NO: 796285 - DNA, 25 bp, Mus musculus
tcaacggaagctgcctcagtttttt

SEQ ID NO: 796286 - DNA, 25 bp, Mus musculus
tcaacggccgatattactacctgat

SEQ ID NO: 796287 - DNA, 25 bp, Mus musculus
tcaacggccgattttactacctgat

SEQ ID NO: 796288 - DNA, 25 bp, Mus musculus
tcaacgggattgatttgctattgtc

SEQ ID NO: 796289 - DNA, 25 bp, Mus musculus
tcaacgggattgttttgctattgtc

SEQ ID NO: 796290 - DNA, 25 bp, Mus musculus
tcaacgggcgctacttgtctggctc

SEQ ID NO: 796291 - DNA, 25 bp, Mus musculus
tcaacgggcgcttcttgtctggctc

SEQ ID NO: 796292 - DNA, 25 bp, Mus musculus
tcaacgggctccagggtctctgttc

SEQ ID NO: 796293 - DNA, 25 bp, Mus musculus
tcaacgggctcctgggtctctgttc

SEQ ID NO: 796294 - DNA, 25 bp, Mus musculus
tcaacgggtggtacgattctggcat

SEQ ID NO: 796295 - DNA, 25 bp, Mus musculus
tcaacgggtggttcgattctggcat

SEQ ID NO: 796296 - DNA, 25 bp, Mus musculus
tcaacggtcacacaattagggaggt

SEQ ID NO: 796297 - DNA, 25 bp, Mus musculus
tcaacggtcacagaattagggaggt

SEQ ID NO: 796298 - DNA, 25 bp, Mus musculus
tcaacggttgtgagtgctcttcata

SEQ ID NO: 796299 - DNA, 25 bp, Mus musculus
tcaacggttgtgtgtgctcttcata

SEQ ID NO: 796300 - DNA, 25 bp, Mus musculus
tcaacgtattctatcctctggtatc

SEQ ID NO: 796301 - DNA, 25 bp, Mus musculus
tcaacgtattctttcctctggtatc

SEQ ID NO: 796302 - DNA, 25 bp, Mus musculus
tcaacgtcaaataagaatgtgtctg

SEQ ID NO: 796303 - DNA, 25 bp, Mus musculus
tcaacgtcaaattagaatgtgtctg

SEQ ID NO: 796304 - DNA, 25 bp, Mus musculus
tcaacgtggataatcaggtgtgctc

SEQ ID NO: 796305 - DNA, 25 bp, Mus musculus
tcaacgtggatattcaggtgtgctc

SEQ ID NO: 796306 - DNA, 25 bp, Mus musculus
tcaacgtggcttccatgtggctgaa

SEQ ID NO: 796307 - DNA, 25 bp, Mus musculus
tcaacgtggcttgcatgtggctgaa

SEQ ID NO: 796308 - DNA, 25 bp, Mus musculus
tcaacgttacaaacatttttagagt

SEQ ID NO: 796309 - DNA, 25 bp, Mus musculus
tcaacgttacaatcatttttagagt

SEQ ID NO: 796310 - DNA, 25 bp, Mus musculus
tcaacgttctgccaaaccggatcaa

SEQ ID NO: 796311 - DNA, 25 bp, Mus musculus
tcaacgttctgcgaaaccggatcaa

SEQ ID NO: 796312 - DNA, 25 bp, Mus musculus
tcaacgttgtgcattttgtaggaac

SEQ ID NO: 796313 - DNA, 25 bp, Mus musculus
tcaacgttgtgctttttgtaggaac

SEQ ID NO: 796314 - DNA, 25 bp, Mus musculus
tcaacgtttaacatctccattcaga

SEQ ID NO: 796315 - DNA, 25 bp, Mus musculus
tcaacgtttaacttctccattcaga

SEQ ID NO: 796316 - DNA, 25 bp, Mus musculus
tcaacgtttcacctcccaagtttat

SEQ ID NO: 796317 - DNA, 25 bp, Mus musculus
tcaacgtttcacgtcccaagtttat

SEQ ID NO: 796318 - DNA, 25 bp, Mus musculus
tcaacgtttgtaacagataccttgt

SEQ ID NO: 796319 - DNA, 25 bp, Mus musculus
tcaacgtttgtatcagataccttgt

SEQ ID NO: 796320 - DNA, 25 bp, Mus musculus
tcaactaaacatcggcaaaggagat

SEQ ID NO: 796321 - DNA, 25 bp, Mus musculus
tcaactaaacatgggcaaaggagat

SEQ ID NO: 796322 - DNA, 25 bp, Mus musculus
tcaactaaactactgtgatgcttgg

SEQ ID NO: 796323 - DNA, 25 bp, Mus musculus
tcaactaaactagtgtgatgcttgg

SEQ ID NO: 796324 - DNA, 25 bp, Mus musculus
tcaactaaagttccgtcctccttaa

SEQ ID NO: 796325 - DNA, 25 bp, Mus musculus
tcaactaaagttgcgtcctccttaa

SEQ ID NO: 796326 - DNA, 25 bp, Mus musculus
tcaactaaccctattaaccacaatg

SEQ ID NO: 796327 - DNA, 25 bp, Mus musculus
tcaactaacccttttaaccacaatg

SEQ ID NO: 796328 - DNA, 25 bp, Mus musculus
tcaactacccatatcctctcctcag

SEQ ID NO: 796329 - DNA, 25 bp, Mus musculus
tcaactacccatttcctctcctcag

SEQ ID NO: 796330 - DNA, 25 bp, Mus musculus
tcaactactgaaatggtcctccaga

SEQ ID NO: 796331 - DNA, 25 bp, Mus musculus
tcaactactgaattggtcctccaga

SEQ ID NO: 796332 - DNA, 25 bp, Mus musculus
tcaactactgcacgaccagcttttc

SEQ ID NO: 796333 - DNA, 25 bp, Mus musculus
tcaactactgcaggaccagcttttc

SEQ ID NO: 796334 - DNA, 25 bp, Mus musculus
tcaactactgtccaattgctactta

SEQ ID NO: 796335 - DNA, 25 bp, Mus musculus
tcaactactgtccagggctgtgatg

SEQ ID NO: 796336 - DNA, 25 bp, Mus musculus
tcaactactgtcgaattgctactta

SEQ ID NO: 796337 - DNA, 25 bp, Mus musculus
tcaactactgtcgagggctgtgatg

SEQ ID NO: 796338 - DNA, 25 bp, Mus musculus
tcaactagaaagatacctaccaagt

SEQ ID NO: 796339 - DNA, 25 bp, Mus musculus
tcaactagaaagttacctaccaagt

SEQ ID NO: 796340 - DNA, 25 bp, Mus musculus
tcaactagctgtaagccgcttccca

SEQ ID NO: 796341 - DNA, 25 bp, Mus musculus
tcaactagctgttagccgcttccca

SEQ ID NO: 796342 - DNA, 25 bp, Mus musculus
tcaactagggacagtggattcagac

SEQ ID NO: 796343 - DNA, 25 bp, Mus musculus
tcaactagggactgtggattcagac

SEQ ID NO: 796344 - DNA, 25 bp, Mus musculus
tcaactataatcactactttcccct

SEQ ID NO: 796345 - DNA, 25 bp, Mus musculus
tcaactataatctctactttcccct

SEQ ID NO: 796346 - DNA, 25 bp, Mus musculus
tcaactatgtgtctaatgccgttta

SEQ ID NO: 796347 - DNA, 25 bp, Mus musculus
tcaactatgtgtgtaatgccgttta

SEQ ID NO: 796348 - DNA, 25 bp, Mus musculus
tcaactcaaacacgcttgcacagga

SEQ ID NO: 796349 - DNA, 25 bp, Mus musculus
tcaactcaaacaggcttgcacagga

SEQ ID NO: 796350 - DNA, 25 bp, Mus musculus
tcaactcaaccaaatcaagccacag

SEQ ID NO: 796351 - DNA, 25 bp, Mus musculus
tcaactcaaccatatcaagccacag

SEQ ID NO: 796352 - DNA, 25 bp, Mus musculus
tcaactcaatgacgcccgaactttc

SEQ ID NO: 796353 - DNA, 25 bp, Mus musculus
tcaactcaatgaggcccgaactttc

SEQ ID NO: 796354 - DNA, 25 bp, Mus musculus
tcaactcacccgatcttaagaattt

SEQ ID NO: 796355 - DNA, 25 bp, Mus musculus
tcaactcacccgttcttaagaattt

SEQ ID NO: 796356 - DNA, 25 bp, Mus musculus
tcaactcagactatgcacatatatt

SEQ ID NO: 796357 - DNA, 25 bp, Mus musculus
tcaactcagactttgcacatatatt

SEQ ID NO: 796358 - DNA, 25 bp, Mus musculus
tcaactcagtataaaagcatctttt

SEQ ID NO: 796359 - DNA, 25 bp, Mus musculus
tcaactcagtattaaagcatctttt

SEQ ID NO: 796360 - DNA, 25 bp, Mus musculus
tcaactccaaaaacggctttccaag

SEQ ID NO: 796361 - DNA, 25 bp, Mus musculus
tcaactccaaaatcggctttccaag

SEQ ID NO: 796362 - DNA, 25 bp, Mus musculus
tcaactccaccactgtcttgttttt

SEQ ID NO: 796363 - DNA, 25 bp, Mus musculus
tcaactccaccagtgtcttgttttt

SEQ ID NO: 796364 - DNA, 25 bp, Mus musculus
tcaactccagagaacagctacctat

SEQ ID NO: 796365 - DNA, 25 bp, Mus musculus
tcaactccagagagggcacctagtg

SEQ ID NO: 796366 - DNA, 25 bp, Mus musculus
tcaactccagagtacagctacctat

SEQ ID NO: 796367 - DNA, 25 bp, Mus musculus
tcaactccagagtgggcacctagtg

SEQ ID NO: 796368 - DNA, 25 bp, Mus musculus
tcaactccagccactgtttgtgttt

SEQ ID NO: 796369 - DNA, 25 bp, Mus musculus
tcaactccagcctctgtttgtgttt

SEQ ID NO: 796370 - DNA, 25 bp, Mus musculus
tcaactccattgactgcttgtcaga

SEQ ID NO: 796371 - DNA, 25 bp, Mus musculus
tcaactccattgtctgcttgtcaga

SEQ ID NO: 796372 - DNA, 25 bp, Mus musculus
tcaactcccagtacctaagtggtgg

SEQ ID NO: 796373 - DNA, 25 bp, Mus musculus
tcaactcccagttcctaagtggtgg

SEQ ID NO: 796374 - DNA, 25 bp, Mus musculus
tcaactccccaacatcctttaggaa

SEQ ID NO: 796375 - DNA, 25 bp, Mus musculus
tcaactccccaagatcctttaggaa

SEQ ID NO: 796376 - DNA, 25 bp, Mus musculus
tcaactccctttatagaggacatct

SEQ ID NO: 796377 - DNA, 25 bp, Mus musculus
tcaactccctttttagaggacatct

SEQ ID NO: 796378 - DNA, 25 bp, Mus musculus
tcaactcctagcaccaaggaaggaa

SEQ ID NO: 796379 - DNA, 25 bp, Mus musculus
tcaactcctagctccaaggaaggaa

SEQ ID NO: 796380 - DNA, 25 bp, Mus musculus
tcaactcgacggatgccgctgataa

SEQ ID NO: 796381 - DNA, 25 bp, Mus musculus
tcaactcgacggttgccgctgataa

SEQ ID NO: 796382 - DNA, 25 bp, Mus musculus
tcaactcgaggtatgctgtacagcc

SEQ ID NO: 796383 - DNA, 25 bp, Mus musculus
tcaactcgaggtttgctgtacagcc

SEQ ID NO: 796384 - DNA, 25 bp, Mus musculus
tcaactcgataaagtcctacctcaa

SEQ ID NO: 796385 - DNA, 25 bp, Mus musculus
tcaactcgataatgtcctacctcaa

SEQ ID NO: 796386 - DNA, 25 bp, Mus musculus
tcaactctccatcgcccagttatat

SEQ ID NO: 796387 - DNA, 25 bp, Mus musculus
tcaactctccatggcccagttatat

SEQ ID NO: 796388 - DNA, 25 bp, Mus musculus
tcaactctcgagaaccatttcatag

SEQ ID NO: 796389 - DNA, 25 bp, Mus musculus
tcaactctcgagtaccatttcatag

SEQ ID NO: 796390 - DNA, 25 bp, Mus musculus
tcaactctctctctgggaagctcga

SEQ ID NO: 796391 - DNA, 25 bp, Mus musculus
tcaactctctctgtgggaagctcga

SEQ ID NO: 796392 - DNA, 25 bp, Mus musculus
tcaactctctgtacaaggcgttcga

SEQ ID NO: 796393 - DNA, 25 bp, Mus musculus
tcaactctctgttcaaggcgttcga

SEQ ID NO: 796394 - DNA, 25 bp, Mus musculus
tcaactctgaacactggacaacggg

SEQ ID NO: 796395 - DNA, 25 bp, Mus musculus
tcaactctgaactctggacaacggg

SEQ ID NO: 796396 - DNA, 25 bp, Mus musculus
tcaactctgtttcttgcctagcaaa

SEQ ID NO: 796397 - DNA, 25 bp, Mus musculus
tcaactctgtttgttgcctagcaaa

SEQ ID NO: 796398 - DNA, 25 bp, Mus musculus
tcaactgaacatcgtattctctaag

SEQ ID NO: 796399 - DNA, 25 bp, Mus musculus
tcaactgaacatggtattctctaag

SEQ ID NO: 796400 - DNA, 25 bp, Mus musculus
tcaactgacagaaccgaaaacccaa

SEQ ID NO: 796401 - DNA, 25 bp, Mus musculus
tcaactgacagatccgaaaacccaa

SEQ ID NO: 796402 - DNA, 25 bp, Mus musculus
tcaactgagacaatgcctccaccag

SEQ ID NO: 796403 - DNA, 25 bp, Mus musculus
tcaactgagacattgcctccaccag

SEQ ID NO: 796404 - DNA, 25 bp, Mus musculus
tcaactgataagaactcctggtaag

SEQ ID NO: 796405 - DNA, 25 bp, Mus musculus
tcaactgataagtactcctggtaag

SEQ ID NO: 796406 - DNA, 25 bp, Mus musculus
tcaactgatgtcatgaagcgatgct

SEQ ID NO: 796407 - DNA, 25 bp, Mus musculus
tcaactgatgtcttgaagcgatgct

SEQ ID NO: 796408 - DNA, 25 bp, Mus musculus
tcaactgcagaaacttttagccttt

SEQ ID NO: 796409 - DNA, 25 bp, Mus musculus
tcaactgcagaatcttttagccttt

SEQ ID NO: 796410 - DNA, 25 bp, Mus musculus
tcaactgcagctaggaatcttccct

SEQ ID NO: 796411 - DNA, 25 bp, Mus musculus
tcaactgcagcttggaatcttccct

SEQ ID NO: 796412 - DNA, 25 bp, Mus musculus
tcaactgcatatagttcacaggaaa

SEQ ID NO: 796413 - DNA, 25 bp, Mus musculus
tcaactgcatattgttcacaggaaa

SEQ ID NO: 796414 - DNA, 25 bp, Mus musculus
tcaactgccttgaagcctgggaagc

SEQ ID NO: 796415 - DNA, 25 bp, Mus musculus
tcaactgccttgtagcctgggaagc

SEQ ID NO: 796416 - DNA, 25 bp, Mus musculus
tcaactggacatacgaagcatgcac

SEQ ID NO: 796417 - DNA, 25 bp, Mus musculus
tcaactggacattcgaagcatgcac

SEQ ID NO: 796418 - DNA, 25 bp, Mus musculus
tcaactggagtaatatttccccacc

SEQ ID NO: 796419 - DNA, 25 bp, Mus musculus
tcaactggagtattatttccccacc

SEQ ID NO: 796420 - DNA, 25 bp, Mus musculus
tcaactggatctcgcgcttctactt

SEQ ID NO: 796421 - DNA, 25 bp, Mus musculus
tcaactggatctggcgcttctactt

SEQ ID NO: 796422 - DNA, 25 bp, Mus musculus
tcaactggcatcattctatgagctc

SEQ ID NO: 796423 - DNA, 25 bp, Mus musculus
tcaactggcatctttctatgagctc

SEQ ID NO: 796424 - DNA, 25 bp, Mus musculus
tcaactggccagatgaagcttagct

SEQ ID NO: 796425 - DNA, 25 bp, Mus musculus
tcaactggccagttgaagcttagct

SEQ ID NO: 796426 - DNA, 25 bp, Mus musculus
tcaactggccccattgcttaaagga

SEQ ID NO: 796427 - DNA, 25 bp, Mus musculus
tcaactggcccctttgcttaaagga

SEQ ID NO: 796428 - DNA, 25 bp, Mus musculus
tcaactggccggatttaagtgtcgt

SEQ ID NO: 796429 - DNA, 25 bp, Mus musculus
tcaactggccggttttaagtgtcgt

SEQ ID NO: 796430 - DNA, 25 bp, Mus musculus
tcaactggctgcaaaatgctgtctc

SEQ ID NO: 796431 - DNA, 25 bp, Mus musculus
tcaactggctgctaaatgctgtctc

SEQ ID NO: 796432 - DNA, 25 bp, Mus musculus
tcaactggctggaaggtccctttta

SEQ ID NO: 796433 - DNA, 25 bp, Mus musculus
tcaactggctggtaggtccctttta

SEQ ID NO: 796434 - DNA, 25 bp, Mus musculus
tcaactgggcctccaaacagtaaat

SEQ ID NO: 796435 - DNA, 25 bp, Mus musculus
tcaactgggcctgcaaacagtaaat

SEQ ID NO: 796436 - DNA, 25 bp, Mus musculus
tcaactggtaatactgaaacactgt

SEQ ID NO: 796437 - DNA, 25 bp, Mus musculus
tcaactggtaattctgaaacactgt

SEQ ID NO: 796438 - DNA, 25 bp, Mus musculus
tcaactggtgttccctggtttaaag

SEQ ID NO: 796439 - DNA, 25 bp, Mus musculus
tcaactggtgttgcctggtttaaag

SEQ ID NO: 796440 - DNA, 25 bp, Mus musculus
tcaactgtaaacatttcctccactg

SEQ ID NO: 796441 - DNA, 25 bp, Mus musculus
tcaactgtaaacttttcctccactg

SEQ ID NO: 796442 - DNA, 25 bp, Mus musculus
tcaactgtagagcagagcgcgccac

SEQ ID NO: 796443 - DNA, 25 bp, Mus musculus
tcaactgtagaggagagcgcgccac

SEQ ID NO: 796444 - DNA, 25 bp, Mus musculus
tcaactgtcaccagcctttggattt

SEQ ID NO: 796445 - DNA, 25 bp, Mus musculus
tcaactgtcacctgcctttggattt

SEQ ID NO: 796446 - DNA, 25 bp, Mus musculus
tcaactgtcccgatggtgaatacca

SEQ ID NO: 796447 - DNA, 25 bp, Mus musculus
tcaactgtcccgttggtgaatacca

SEQ ID NO: 796448 - DNA, 25 bp, Mus musculus
tcaactgtctccaggtaggtttttc

SEQ ID NO: 796449 - DNA, 25 bp, Mus musculus
tcaactgtctcctggtaggtttttc

SEQ ID NO: 796450 - DNA, 25 bp, Mus musculus
tcaactgtgaccaatagggagaggg

SEQ ID NO: 796451 - DNA, 25 bp, Mus musculus
tcaactgtgaccatcctattataaa

SEQ ID NO: 796452 - DNA, 25 bp, Mus musculus
tcaactgtgacctatagggagaggg

SEQ ID NO: 796453 - DNA, 25 bp, Mus musculus
tcaactgtgaccttcctattataaa

SEQ ID NO: 796454 - DNA, 25 bp, Mus musculus
tcaactgtgcaactgaatcccttcc

SEQ ID NO: 796455 - DNA, 25 bp, Mus musculus
tcaactgtgcaagtgaatcccttcc

SEQ ID NO: 796456 - DNA, 25 bp, Mus musculus
tcaactgtgcacctcctgaaaaggg

SEQ ID NO: 796457 - DNA, 25 bp, Mus musculus
tcaactgtgcacgtcctgaaaaggg

SEQ ID NO: 796458 - DNA, 25 bp, Mus musculus
tcaactgtgcttcgaactctgacat

SEQ ID NO: 796459 - DNA, 25 bp, Mus musculus
tcaactgtgcttggaactctgacat

SEQ ID NO: 796460 - DNA, 25 bp, Mus musculus
tcaactgttgaccttctttaagaaa

SEQ ID NO: 796461 - DNA, 25 bp, Mus musculus
tcaactgttgacgttctttaagaaa

SEQ ID NO: 796462 - DNA, 25 bp, Mus musculus
tcaactgttgctcctctttagaaaa

SEQ ID NO: 796463 - DNA, 25 bp, Mus musculus
tcaactgttgctgctctttagaaaa

SEQ ID NO: 796464 - DNA, 25 bp, Mus musculus
tcaactgttggcattcagtcacctc

SEQ ID NO: 796465 - DNA, 25 bp, Mus musculus
tcaactgttggctttcagtcacctc

SEQ ID NO: 796466 - DNA, 25 bp, Mus musculus
tcaactgttggtctgacacctgtgt

SEQ ID NO: 796467 - DNA, 25 bp, Mus musculus
tcaactgttggtgtgacacctgtgt

SEQ ID NO: 796468 - DNA, 25 bp, Mus musculus
tcaactgttttgaagattccatctt

SEQ ID NO: 796469 - DNA, 25 bp, Mus musculus
tcaactgttttgtagattccatctt

SEQ ID NO: 796470 - DNA, 25 bp, Mus musculus
tcaacttaaaccatccacattggat

SEQ ID NO: 796471 - DNA, 25 bp, Mus musculus
tcaacttaaaccttccacattggat

SEQ ID NO: 796472 - DNA, 25 bp, Mus musculus
tcaacttacaacatttcaagcccaa

SEQ ID NO: 796473 - DNA, 25 bp, Mus musculus
tcaacttacaacttttcaagcccaa

SEQ ID NO: 796474 - DNA, 25 bp, Mus musculus
tcaacttacaggcaatcttcgcttt

SEQ ID NO: 796475 - DNA, 25 bp, Mus musculus
tcaacttacagggaatcttcgcttt

SEQ ID NO: 796476 - DNA, 25 bp, Mus musculus
tcaacttagctccactgtgacttag

SEQ ID NO: 796477 - DNA, 25 bp, Mus musculus
tcaacttagctcgactgtgacttag

SEQ ID NO: 796478 - DNA, 25 bp, Mus musculus
tcaacttatgtccttgaggtactgt

SEQ ID NO: 796479 - DNA, 25 bp, Mus musculus
tcaacttatgtcgttgaggtactgt

SEQ ID NO: 796480 - DNA, 25 bp, Mus musculus
tcaacttattctacactgttaggtt

SEQ ID NO: 796481 - DNA, 25 bp, Mus musculus
tcaacttattcttcactgttaggtt

SEQ ID NO: 796482 - DNA, 25 bp, Mus musculus
tcaacttcaaagcaccacgcctggt

SEQ ID NO: 796483 - DNA, 25 bp, Mus musculus
tcaacttcaaaggaccacgcctggt

SEQ ID NO: 796484 - DNA, 25 bp, Mus musculus
tcaacttcaaatataggtgcttcct

SEQ ID NO: 796485 - DNA, 25 bp, Mus musculus
tcaacttcaaatttaggtgcttcct

SEQ ID NO: 796486 - DNA, 25 bp, Mus musculus
tcaacttcaagtccacagcgatatt

SEQ ID NO: 796487 - DNA, 25 bp, Mus musculus
tcaacttcaagtgcacagcgatatt

SEQ ID NO: 796488 - DNA, 25 bp, Mus musculus
tcaacttcatacatggtggccctct

SEQ ID NO: 796489 - DNA, 25 bp, Mus musculus
tcaacttcatacttggtggccctct

SEQ ID NO: 796490 - DNA, 25 bp, Mus musculus
tcaacttcattaacttggccatcca

SEQ ID NO: 796491 - DNA, 25 bp, Mus musculus
tcaacttcattatcttggccatcca

SEQ ID NO: 796492 - DNA, 25 bp, Mus musculus
tcaacttcccagcatgacagactac

SEQ ID NO: 796493 - DNA, 25 bp, Mus musculus
tcaacttcccaggatgacagactac

SEQ ID NO: 796494 - DNA, 25 bp, Mus musculus
tcaacttcctggagatggtacaccg

SEQ ID NO: 796495 - DNA, 25 bp, Mus musculus
tcaacttcctggctaagtctctgtc

SEQ ID NO: 796496 - DNA, 25 bp, Mus musculus
tcaacttcctgggtaagtctctgtc

SEQ ID NO: 796497 - DNA, 25 bp, Mus musculus
tcaacttcctggtgatggtacaccg

SEQ ID NO: 796498 - DNA, 25 bp, Mus musculus
tcaacttcctgtctccggattagaa

SEQ ID NO: 796499 - DNA, 25 bp, Mus musculus
tcaacttcctgtgtccggattagaa

SEQ ID NO: 796500 - DNA, 25 bp, Mus musculus
tcaacttcgaagagtttctgtttgt

SEQ ID NO: 796501 - DNA, 25 bp, Mus musculus
tcaacttcgaagtgtttctgtttgt

SEQ ID NO: 796502 - DNA, 25 bp, Mus musculus
tcaacttcgactagcttgtaataag

SEQ ID NO: 796503 - DNA, 25 bp, Mus musculus
tcaacttcgacttgcttgtaataag

SEQ ID NO: 796504 - DNA, 25 bp, Mus musculus
tcaacttcgcttactttgggtaaca

SEQ ID NO: 796505 - DNA, 25 bp, Mus musculus
tcaacttcgctttctttgggtaaca

SEQ ID NO: 796506 - DNA, 25 bp, Mus musculus
tcaacttctactatgtcagttcaac

SEQ ID NO: 796507 - DNA, 25 bp, Mus musculus
tcaacttctactttgtcagttcaac

SEQ ID NO: 796508 - DNA, 25 bp, Mus musculus
tcaacttctccacggaggacctgtc

SEQ ID NO: 796509 - DNA, 25 bp, Mus musculus
tcaacttctccagggaggacctgtc

SEQ ID NO: 796510 - DNA, 25 bp, Mus musculus
tcaacttgatgtatctgcctacacc

SEQ ID NO: 796511 - DNA, 25 bp, Mus musculus
tcaacttgatgtttctgcctacacc

SEQ ID NO: 796512 - DNA, 25 bp, Mus musculus
tcaacttgcccaattgctggctgta

SEQ ID NO: 796513 - DNA, 25 bp, Mus musculus
tcaacttgcccatttgctggctgta

SEQ ID NO: 796514 - DNA, 25 bp, Mus musculus
tcaacttggagcagaaccggcattt

SEQ ID NO: 796515 - DNA, 25 bp, Mus musculus
tcaacttggagccaggagacttcaa

SEQ ID NO: 796516 - DNA, 25 bp, Mus musculus
tcaacttggagcgaggagacttcaa

SEQ ID NO: 796517 - DNA, 25 bp, Mus musculus
tcaacttggagctgaaccggcattt

SEQ ID NO: 796518 - DNA, 25 bp, Mus musculus
tcaacttgggctaacatgtgtcaat

SEQ ID NO: 796519 - DNA, 25 bp, Mus musculus
tcaacttgggcttacatgtgtcaat

SEQ ID NO: 796520 - DNA, 25 bp, Mus musculus
tcaacttggtacatagtggcccttt

SEQ ID NO: 796521 - DNA, 25 bp, Mus musculus
tcaacttggtacttagtggcccttt

SEQ ID NO: 796522 - DNA, 25 bp, Mus musculus
tcaacttgttagcagaatctcttca

SEQ ID NO: 796523 - DNA, 25 bp, Mus musculus
tcaacttgttaggagaatctcttca

SEQ ID NO: 796524 - DNA, 25 bp, Mus musculus
tcaactttcaaactttactcgggtg

SEQ ID NO: 796525 - DNA, 25 bp, Mus musculus
tcaactttcaaagtttactcgggtg

SEQ ID NO: 796526 - DNA, 25 bp, Mus musculus
tcaactttccccaagcatggacaag

SEQ ID NO: 796527 - DNA, 25 bp, Mus musculus
tcaactttcccctagcatggacaag

SEQ ID NO: 796528 - DNA, 25 bp, Mus musculus
tcaactttccgacgatttccaagat

SEQ ID NO: 796529 - DNA, 25 bp, Mus musculus
tcaactttccgaggatttccaagat

SEQ ID NO: 796530 - DNA, 25 bp, Mus musculus
tcaactttcttactcgatccggcag

SEQ ID NO: 796531 - DNA, 25 bp, Mus musculus
tcaactttcttagtcgatccggcag

SEQ ID NO: 796532 - DNA, 25 bp, Mus musculus
tcaactttgattagtacctcagtgt

SEQ ID NO: 796533 - DNA, 25 bp, Mus musculus
tcaactttgatttgtacctcagtgt

SEQ ID NO: 796534 - DNA, 25 bp, Mus musculus
tcaactttgctgaagctagccgtaa

SEQ ID NO: 796535 - DNA, 25 bp, Mus musculus
tcaactttgctgtagctagccgtaa

SEQ ID NO: 796536 - DNA, 25 bp, Mus musculus
tcaagaaaaccactcctagcacagc

SEQ ID NO: 796537 - DNA, 25 bp, Mus musculus
tcaagaaaaccagtcctagcacagc

SEQ ID NO: 796538 - DNA, 25 bp, Mus musculus
tcaagaaacaggctggaaaactctc

SEQ ID NO: 796539 - DNA, 25 bp, Mus musculus
tcaagaaacagggtggaaaactctc

SEQ ID NO: 796540 - DNA, 25 bp, Mus musculus
tcaagaaactctatgacatcgatgt

SEQ ID NO: 796541 - DNA, 25 bp, Mus musculus
tcaagaaactctttgacatcgatgt

SEQ ID NO: 796542 - DNA, 25 bp, Mus musculus
tcaagaaactgaacgttaagccctt

SEQ ID NO: 796543 - DNA, 25 bp, Mus musculus
tcaagaaactgatcgttaagccctt

SEQ ID NO: 796544 - DNA, 25 bp, Mus musculus
tcaagaaagattacccacatgggtc

SEQ ID NO: 796545 - DNA, 25 bp, Mus musculus
tcaagaaagatttcccacatgggtc

SEQ ID NO: 796546 - DNA, 25 bp, Mus musculus
tcaagaaagcctactctagttccct

SEQ ID NO: 796547 - DNA, 25 bp, Mus musculus
tcaagaaagccttctctagttccct

SEQ ID NO: 796548 - DNA, 25 bp, Mus musculus
tcaagaacagacatcccaggaacca

SEQ ID NO: 796549 - DNA, 25 bp, Mus musculus
tcaagaacagacttcccaggaacca

SEQ ID NO: 796550 - DNA, 25 bp, Mus musculus
tcaagaacagtcagttagccctgct

SEQ ID NO: 796551 - DNA, 25 bp, Mus musculus
tcaagaacagtctgttagccctgct

SEQ ID NO: 796552 - DNA, 25 bp, Mus musculus
tcaagaaccaggacccgttccagat

SEQ ID NO: 796553 - DNA, 25 bp, Mus musculus
tcaagaaccaggtcccgttccagat

SEQ ID NO: 796554 - DNA, 25 bp, Mus musculus
tcaagaacccagatctttcttcttg

SEQ ID NO: 796555 - DNA, 25 bp, Mus musculus
tcaagaacccagttctttcttcttg

SEQ ID NO: 796556 - DNA, 25 bp, Mus musculus
tcaagaacccctcgttttgggctat

SEQ ID NO: 796557 - DNA, 25 bp, Mus musculus
tcaagaacccctggttttgggctat

SEQ ID NO: 796558 - DNA, 25 bp, Mus musculus
tcaagaacctgaccaaagacccact

SEQ ID NO: 796559 - DNA, 25 bp, Mus musculus
tcaagaacctgagcaaagacccact

SEQ ID NO: 796560 - DNA, 25 bp, Mus musculus
tcaagaacgacacggctgctgtgca

SEQ ID NO: 796561 - DNA, 25 bp, Mus musculus
tcaagaacgacagggctgctgtgca

SEQ ID NO: 796562 - DNA, 25 bp, Mus musculus
tcaagaagaaccctgagtaagctgg

SEQ ID NO: 796563 - DNA, 25 bp, Mus musculus
tcaagaagaaccgtgagtaagctgg

SEQ ID NO: 796564 - DNA, 25 bp, Mus musculus
tcaagaagacctcagtgtccctgga

SEQ ID NO: 796565 - DNA, 25 bp, Mus musculus
tcaagaagacctgagtgtccctgga

SEQ ID NO: 796566 - DNA, 25 bp, Mus musculus
tcaagaagagggagggcacgcacat

SEQ ID NO: 796567 - DNA, 25 bp, Mus musculus
tcaagaagagggtgggcacgcacat

SEQ ID NO: 796568 - DNA, 25 bp, Mus musculus
tcaagaagcaggctcttcaagggaa

SEQ ID NO: 796569 - DNA, 25 bp, Mus musculus
tcaagaagcagggtcttcaagggaa

SEQ ID NO: 796570 - DNA, 25 bp, Mus musculus
tcaagaaggaagcacacaacagcat

SEQ ID NO: 796571 - DNA, 25 bp, Mus musculus
tcaagaaggaaggacacaacagcat

SEQ ID NO: 796572 - DNA, 25 bp, Mus musculus
tcaagaaggaccagcacaaagcgga

SEQ ID NO: 796573 - DNA, 25 bp, Mus musculus
tcaagaaggacctgcacaaagcgga

SEQ ID NO: 796574 - DNA, 25 bp, Mus musculus
tcaagaaggctgcaatgtgcccatc

SEQ ID NO: 796575 - DNA, 25 bp, Mus musculus
tcaagaaggctggaatgtgcccatc

SEQ ID NO: 796576 - DNA, 25 bp, Mus musculus
tcaagaagtgaacagcgcaacaagt

SEQ ID NO: 796577 - DNA, 25 bp, Mus musculus
tcaagaagtgaagagcgcaacaagt

SEQ ID NO: 796578 - DNA, 25 bp, Mus musculus
tcaagaatccacataccctagagaa

SEQ ID NO: 796579 - DNA, 25 bp, Mus musculus
tcaagaatccacttaccctagagaa

SEQ ID NO: 796580 - DNA, 25 bp, Mus musculus
tcaagaatcctgactccgttcgttc

SEQ ID NO: 796581 - DNA, 25 bp, Mus musculus
tcaagaatcctgagagtcccctgat

SEQ ID NO: 796582 - DNA, 25 bp, Mus musculus
tcaagaatcctgtctccgttcgttc

SEQ ID NO: 796583 - DNA, 25 bp, Mus musculus
tcaagaatcctgtgagtcccctgat

SEQ ID NO: 796584 - DNA, 25 bp, Mus musculus
tcaagaatcgcgagtctgccgtgac

SEQ ID NO: 796585 - DNA, 25 bp, Mus musculus
tcaagaatcgcgtgtctgccgtgac

SEQ ID NO: 796586 - DNA, 25 bp, Mus musculus
tcaagaatgccaacgcaaacgcgtc

SEQ ID NO: 796587 - DNA, 25 bp, Mus musculus
tcaagaatgccatcgcaaacgcgtc

SEQ ID NO: 796588 - DNA, 25 bp, Mus musculus
tcaagaatgcctcagaagcccttca

SEQ ID NO: 796589 - DNA, 25 bp, Mus musculus
tcaagaatgcctgagaagcccttca

SEQ ID NO: 796590 - DNA, 25 bp, Mus musculus
tcaagaatgtgactcccgcagcaat

SEQ ID NO: 796591 - DNA, 25 bp, Mus musculus
tcaagaatgtgagtcccgcagcaat

SEQ ID NO: 796592 - DNA, 25 bp, Mus musculus
tcaagaattgagaatctggattatt

SEQ ID NO: 796593 - DNA, 25 bp, Mus musculus
tcaagaattgagtatctggattatt

SEQ ID NO: 796594 - DNA, 25 bp, Mus musculus
tcaagacacacaaccagtatctgtt

SEQ ID NO: 796595 - DNA, 25 bp, Mus musculus
tcaagacacacatccagtatctgtt

SEQ ID NO: 796596 - DNA, 25 bp, Mus musculus
tcaagacaccgaatcaccatcaaga

SEQ ID NO: 796597 - DNA, 25 bp, Mus musculus
tcaagacaccgattcaccatcaaga

SEQ ID NO: 796598 - DNA, 25 bp, Mus musculus
tcaagacacctaactggaaagcatc

SEQ ID NO: 796599 - DNA, 25 bp, Mus musculus
tcaagacacctatctggaaagcatc

SEQ ID NO: 796600 - DNA, 25 bp, Mus musculus
tcaagacagatgattagatgaactt

SEQ ID NO: 796601 - DNA, 25 bp, Mus musculus
tcaagacagatgtttagatgaactt

SEQ ID NO: 796602 - DNA, 25 bp, Mus musculus
tcaagacagggcatccaccatgagc

SEQ ID NO: 796603 - DNA, 25 bp, Mus musculus
tcaagacagggcttccaccatgagc

SEQ ID NO: 796604 - DNA, 25 bp, Mus musculus
tcaagacagttcctagacatgtggg

SEQ ID NO: 796605 - DNA, 25 bp, Mus musculus
tcaagacagttcgtagacatgtggg

SEQ ID NO: 796606 - DNA, 25 bp, Mus musculus
tcaagaccagtcagtcccgtttaat

SEQ ID NO: 796607 - DNA, 25 bp, Mus musculus
tcaagaccagtctgtcccgtttaat

SEQ ID NO: 796608 - DNA, 25 bp, Mus musculus
tcaagaccatgcagatttgtgctgg

SEQ ID NO: 796609 - DNA, 25 bp, Mus musculus
tcaagaccatgctgatttgtgctgg

SEQ ID NO: 796610 - DNA, 25 bp, Mus musculus
tcaagaccattcatttagaccagaa

SEQ ID NO: 796611 - DNA, 25 bp, Mus musculus
tcaagaccattcttttagaccagaa

SEQ ID NO: 796612 - DNA, 25 bp, Mus musculus
tcaagaccattgcactgaaccaagt

SEQ ID NO: 796613 - DNA, 25 bp, Mus musculus
tcaagaccattggactgaaccaagt

SEQ ID NO: 796614 - DNA, 25 bp, Mus musculus
tcaagacccaggaatcccttatcat

SEQ ID NO: 796615 - DNA, 25 bp, Mus musculus
tcaagacccaggtatcccttatcat

SEQ ID NO: 796616 - DNA, 25 bp, Mus musculus
tcaagacccatcaagcctttatact

SEQ ID NO: 796617 - DNA, 25 bp, Mus musculus
tcaagacccatctagcctttatact

SEQ ID NO: 796618 - DNA, 25 bp, Mus musculus
tcaagaccccatcacttcctaaagg

SEQ ID NO: 796619 - DNA, 25 bp, Mus musculus
tcaagaccccatgacttcctaaagg

SEQ ID NO: 796620 - DNA, 25 bp, Mus musculus
tcaagacccctgacaagctgcagca

SEQ ID NO: 796621 - DNA, 25 bp, Mus musculus
tcaagacccctgtcaagctgcagca

SEQ ID NO: 796622 - DNA, 25 bp, Mus musculus
tcaagaccctttaccttctgttggg

SEQ ID NO: 796623 - DNA, 25 bp, Mus musculus
tcaagacccttttccttctgttggg

SEQ ID NO: 796624 - DNA, 25 bp, Mus musculus
tcaagacctagcattatctttttcc

SEQ ID NO: 796625 - DNA, 25 bp, Mus musculus
tcaagacctagctttatctttttcc

SEQ ID NO: 796626 - DNA, 25 bp, Mus musculus
tcaagacctgatatcttgcacagat

SEQ ID NO: 796627 - DNA, 25 bp, Mus musculus
tcaagacctgatttcttgcacagat

SEQ ID NO: 796628 - DNA, 25 bp, Mus musculus
tcaagacctgtcagctggaggatac

SEQ ID NO: 796629 - DNA, 25 bp, Mus musculus
tcaagacctgtctgctggaggatac

SEQ ID NO: 796630 - DNA, 25 bp, Mus musculus
tcaagaccttatcggctgagacctc

SEQ ID NO: 796631 - DNA, 25 bp, Mus musculus
tcaagaccttatgggctgagacctc

SEQ ID NO: 796632 - DNA, 25 bp, Mus musculus
tcaagaccttcgcttttgggaaaat

SEQ ID NO: 796633 - DNA, 25 bp, Mus musculus
tcaagaccttcggttttgggaaaat

SEQ ID NO: 796634 - DNA, 25 bp, Mus musculus
tcaagaccttgcatcatgctcgaaa

SEQ ID NO: 796635 - DNA, 25 bp, Mus musculus
tcaagaccttgcttcatgctcgaaa

SEQ ID NO: 796636 - DNA, 25 bp, Mus musculus
tcaagacgggcccactaatttggct

SEQ ID NO: 796637 - DNA, 25 bp, Mus musculus
tcaagacgggccgactaatttggct

SEQ ID NO: 796638 - DNA, 25 bp, Mus musculus
tcaagacggtcgatggcctctcgtg

SEQ ID NO: 796639 - DNA, 25 bp, Mus musculus
tcaagacggtcgttggcctctcgtg

SEQ ID NO: 796640 - DNA, 25 bp, Mus musculus
tcaagacggtgcctccaaggtcctg

SEQ ID NO: 796641 - DNA, 25 bp, Mus musculus
tcaagacggtgcgtccaaggtcctg

SEQ ID NO: 796642 - DNA, 25 bp, Mus musculus
tcaagacgtgaactgctgtaaacat

SEQ ID NO: 796643 - DNA, 25 bp, Mus musculus
tcaagacgtgaagtgctgtaaacat

SEQ ID NO: 796644 - DNA, 25 bp, Mus musculus
tcaagacgtggtcacgagagttcct

SEQ ID NO: 796645 - DNA, 25 bp, Mus musculus
tcaagacgtggtgacgagagttcct

SEQ ID NO: 796646 - DNA, 25 bp, Mus musculus
tcaagacgttttctattcagaacat

SEQ ID NO: 796647 - DNA, 25 bp, Mus musculus
tcaagacgttttgtattcagaacat

SEQ ID NO: 796648 - DNA, 25 bp, Mus musculus
tcaagactaacccttactagccaga

SEQ ID NO: 796649 - DNA, 25 bp, Mus musculus
tcaagactaaccgttactagccaga

SEQ ID NO: 796650 - DNA, 25 bp, Mus musculus
tcaagactcatcctgaggctcagcg

SEQ ID NO: 796651 - DNA, 25 bp, Mus musculus
tcaagactcatcgtgaggctcagcg

SEQ ID NO: 796652 - DNA, 25 bp, Mus musculus
tcaagactcctgatttagtggccag

SEQ ID NO: 796653 - DNA, 25 bp, Mus musculus
tcaagactcctgttttagtggccag

SEQ ID NO: 796654 - DNA, 25 bp, Mus musculus
tcaagactgccaccacagtgtacag

SEQ ID NO: 796655 - DNA, 25 bp, Mus musculus
tcaagactgccagcacagtgtacag

SEQ ID NO: 796656 - DNA, 25 bp, Mus musculus
tcaagactgggcagcttggctgaca

SEQ ID NO: 796657 - DNA, 25 bp, Mus musculus
tcaagactgggctgcttggctgaca

SEQ ID NO: 796658 - DNA, 25 bp, Mus musculus
tcaagactgtaaactcctcaaggcc

SEQ ID NO: 796659 - DNA, 25 bp, Mus musculus
tcaagactgtaatctcctcaaggcc

SEQ ID NO: 796660 - DNA, 25 bp, Mus musculus
tcaagactgtgccaaccccagcatt

SEQ ID NO: 796661 - DNA, 25 bp, Mus musculus
tcaagactgtgcgaaccccagcatt

SEQ ID NO: 796662 - DNA, 25 bp, Mus musculus
tcaagacttgacatgtagatcctac

SEQ ID NO: 796663 - DNA, 25 bp, Mus musculus
tcaagacttgacttgtagatcctac

SEQ ID NO: 796664 - DNA, 25 bp, Mus musculus
tcaagactttctatttctgtgcaga

SEQ ID NO: 796665 - DNA, 25 bp, Mus musculus
tcaagactttctttttctgtgcaga

SEQ ID NO: 796666 - DNA, 25 bp, Mus musculus
tcaagagaaacgaccacggccaagc

SEQ ID NO: 796667 - DNA, 25 bp, Mus musculus
tcaagagaaacgtccacggccaagc

SEQ ID NO: 796668 - DNA, 25 bp, Mus musculus
tcaagagaagtgatgtgcgggccca

SEQ ID NO: 796669 - DNA, 25 bp, Mus musculus
tcaagagaagtgttgtgcgggccca

SEQ ID NO: 796670 - DNA, 25 bp, Mus musculus
tcaagagaccttccactccgatatt

SEQ ID NO: 796671 - DNA, 25 bp, Mus musculus
tcaagagaccttgcactccgatatt

SEQ ID NO: 796672 - DNA, 25 bp, Mus musculus
tcaagagaggacaaaataactaccc

SEQ ID NO: 796673 - DNA, 25 bp, Mus musculus
tcaagagaggactaaataactaccc

SEQ ID NO: 796674 - DNA, 25 bp, Mus musculus
tcaagagagtgacccttcatgagaa

SEQ ID NO: 796675 - DNA, 25 bp, Mus musculus
tcaagagagtgagccttcatgagaa

SEQ ID NO: 796676 - DNA, 25 bp, Mus musculus
tcaagagatttcagaaccccagcct

SEQ ID NO: 796677 - DNA, 25 bp, Mus musculus
tcaagagatttctgaaccccagcct

SEQ ID NO: 796678 - DNA, 25 bp, Mus musculus
tcaagagcaacaaccgcacatctca

SEQ ID NO: 796679 - DNA, 25 bp, Mus musculus
tcaagagcaacatccgcacatctca

SEQ ID NO: 796680 - DNA, 25 bp, Mus musculus
tcaagagcacctccatgtaccgcgt

SEQ ID NO: 796681 - DNA, 25 bp, Mus musculus
tcaagagcacctgcatgtaccgcgt

SEQ ID NO: 796682 - DNA, 25 bp, Mus musculus
tcaagagcatcccatggccacattc

SEQ ID NO: 796683 - DNA, 25 bp, Mus musculus
tcaagagcatccgatggccacattc

SEQ ID NO: 796684 - DNA, 25 bp, Mus musculus
tcaagagccagcagcaacactgcct

SEQ ID NO: 796685 - DNA, 25 bp, Mus musculus
tcaagagccagctgcaacactgcct

SEQ ID NO: 796686 - DNA, 25 bp, Mus musculus
tcaagagcccggaaacaataagttt

SEQ ID NO: 796687 - DNA, 25 bp, Mus musculus
tcaagagcccggtaacaataagttt

SEQ ID NO: 796688 - DNA, 25 bp, Mus musculus
tcaagagcctagacctgtttaactg

SEQ ID NO: 796689 - DNA, 25 bp, Mus musculus
tcaagagcctagtcctgtttaactg

SEQ ID NO: 796690 - DNA, 25 bp, Mus musculus
tcaagagcgatgctgcaaagcccct

SEQ ID NO: 796691 - DNA, 25 bp, Mus musculus
tcaagagcgatggtgcaaagcccct

SEQ ID NO: 796692 - DNA, 25 bp, Mus musculus
tcaagagctccgagcgctgaggaaa

SEQ ID NO: 796693 - DNA, 25 bp, Mus musculus
tcaagagctccgtgcgctgaggaaa

SEQ ID NO: 796694 - DNA, 25 bp, Mus musculus
tcaagagctgaacaacttcaatggt

SEQ ID NO: 796695 - DNA, 25 bp, Mus musculus
tcaagagctgaagaacttcaatggt

SEQ ID NO: 796696 - DNA, 25 bp, Mus musculus
tcaagagctgctaatggcctttact

SEQ ID NO: 796697 - DNA, 25 bp, Mus musculus
tcaagagctgcttatggcctttact

SEQ ID NO: 796698 - DNA, 25 bp, Mus musculus
tcaagagcttaactgtccaacccca

SEQ ID NO: 796699 - DNA, 25 bp, Mus musculus
tcaagagcttaagtgtccaacccca

SEQ ID NO: 796700 - DNA, 25 bp, Mus musculus
tcaagaggacacagcctgggtcaca

SEQ ID NO: 796701 - DNA, 25 bp, Mus musculus
tcaagaggacactgcctgggtcaca

SEQ ID NO: 796702 - DNA, 25 bp, Mus musculus
tcaagaggactccaacggctgcatc

SEQ ID NO: 796703 - DNA, 25 bp, Mus musculus
tcaagaggactcgaacggctgcatc

SEQ ID NO: 796704 - DNA, 25 bp, Mus musculus
tcaagaggatccagcggcttcagtg

SEQ ID NO: 796705 - DNA, 25 bp, Mus musculus
tcaagaggatcctgcggcttcagtg

SEQ ID NO: 796706 - DNA, 25 bp, Mus musculus
tcaagaggcaagaaggcaattcagt

SEQ ID NO: 796707 - DNA, 25 bp, Mus musculus
tcaagaggcaagtaggcaattcagt

SEQ ID NO: 796708 - DNA, 25 bp, Mus musculus
tcaagaggccagcatactggaaaaa

SEQ ID NO: 796709 - DNA, 25 bp, Mus musculus
tcaagaggccaggatactggaaaaa

SEQ ID NO: 796710 - DNA, 25 bp, Mus musculus
tcaagagggcagatcctcgcctgtt

SEQ ID NO: 796711 - DNA, 25 bp, Mus musculus
tcaagagggcagttcctcgcctgtt

SEQ ID NO: 796712 - DNA, 25 bp, Mus musculus
tcaagagggcttatccaaatttcag

SEQ ID NO: 796713 - DNA, 25 bp, Mus musculus
tcaagagggcttttccaaatttcag

SEQ ID NO: 796714 - DNA, 25 bp, Mus musculus
tcaagagggttgcttccaagatgct

SEQ ID NO: 796715 - DNA, 25 bp, Mus musculus
tcaagagggttggttccaagatgct

SEQ ID NO: 796716 - DNA, 25 bp, Mus musculus
tcaagagtaaagacaggagacagct

SEQ ID NO: 796717 - DNA, 25 bp, Mus musculus
tcaagagtaaagtcaggagacagct

SEQ ID NO: 796718 - DNA, 25 bp, Mus musculus
tcaagagtagatcccctagacacat

SEQ ID NO: 796719 - DNA, 25 bp, Mus musculus
tcaagagtagatgccctagacacat

SEQ ID NO: 796720 - DNA, 25 bp, Mus musculus
tcaagagtatctagcattcttaatc

SEQ ID NO: 796721 - DNA, 25 bp, Mus musculus
tcaagagtatcttgcattcttaatc

SEQ ID NO: 796722 - DNA, 25 bp, Mus musculus
tcaagagtcagaaacaagaaaccat

SEQ ID NO: 796723 - DNA, 25 bp, Mus musculus
tcaagagtcagatacaagaaaccat

SEQ ID NO: 796724 - DNA, 25 bp, Mus musculus
tcaagagtcggcatctggcagcaac

SEQ ID NO: 796725 - DNA, 25 bp, Mus musculus
tcaagagtcggcttctggcagcaac

SEQ ID NO: 796726 - DNA, 25 bp, Mus musculus
tcaagagtgcaaacttcgtttcaaa

SEQ ID NO: 796727 - DNA, 25 bp, Mus musculus
tcaagagtgcaatcttcgtttcaaa

SEQ ID NO: 796728 - DNA, 25 bp, Mus musculus
tcaagagtgctacgacaacggtcat

SEQ ID NO: 796729 - DNA, 25 bp, Mus musculus
tcaagagtgctaggacaacggtcat

SEQ ID NO: 796730 - DNA, 25 bp, Mus musculus
tcaagagtgttaataaatcctttgt

SEQ ID NO: 796731 - DNA, 25 bp, Mus musculus
tcaagagtgttattaaatcctttgt

SEQ ID NO: 796732 - DNA, 25 bp, Mus musculus
tcaagagttcatcctgtcagctgtg

SEQ ID NO: 796733 - DNA, 25 bp, Mus musculus
tcaagagttcatgctgtcagctgtg

SEQ ID NO: 796734 - DNA, 25 bp, Mus musculus
tcaagagttcttcctggagcagccc

SEQ ID NO: 796735 - DNA, 25 bp, Mus musculus
tcaagagttcttgctggagcagccc

SEQ ID NO: 796736 - DNA, 25 bp, Mus musculus
tcaagagtttaaccatttctaacaa

SEQ ID NO: 796737 - DNA, 25 bp, Mus musculus
tcaagagtttaagcatttctaacaa

SEQ ID NO: 796738 - DNA, 25 bp, Mus musculus
tcaagatataacatgtccacccgcc

SEQ ID NO: 796739 - DNA, 25 bp, Mus musculus
tcaagatataacttgtccacccgcc

SEQ ID NO: 796740 - DNA, 25 bp, Mus musculus
tcaagatcaaacacagactgctcag

SEQ ID NO: 796741 - DNA, 25 bp, Mus musculus
tcaagatcaaactcagactgctcag

SEQ ID NO: 796742 - DNA, 25 bp, Mus musculus
tcaagatcaagtacctcgcatgcag

SEQ ID NO: 796743 - DNA, 25 bp, Mus musculus
tcaagatcaagttcctcgcatgcag

SEQ ID NO: 796744 - DNA, 25 bp, Mus musculus
tcaagatcaccaacattccacagga

SEQ ID NO: 796745 - DNA, 25 bp, Mus musculus
tcaagatcaccatcattccacagga

SEQ ID NO: 796746 - DNA, 25 bp, Mus musculus
tcaagatctgatcaaggtccccagt

SEQ ID NO: 796747 - DNA, 25 bp, Mus musculus
tcaagatctgatgaaggtccccagt

SEQ ID NO: 796748 - DNA, 25 bp, Mus musculus
tcaagatctgtgaatctgagccaca

SEQ ID NO: 796749 - DNA, 25 bp, Mus musculus
tcaagatctgtgtatctgagccaca

SEQ ID NO: 796750 - DNA, 25 bp, Mus musculus
tcaagatcttttcggaagcctttgg

SEQ ID NO: 796751 - DNA, 25 bp, Mus musculus
tcaagatcttttgggaagcctttgg

SEQ ID NO: 796752 - DNA, 25 bp, Mus musculus
tcaagatgcacacgcattccctgca

SEQ ID NO: 796753 - DNA, 25 bp, Mus musculus
tcaagatgcacaggcattccctgca

SEQ ID NO: 796754 - DNA, 25 bp, Mus musculus
tcaagatgcactcattctgtaatgt

SEQ ID NO: 796755 - DNA, 25 bp, Mus musculus
tcaagatgcactgattctgtaatgt

SEQ ID NO: 796756 - DNA, 25 bp, Mus musculus
tcaagatgcgctacacaagatgact

SEQ ID NO: 796757 - DNA, 25 bp, Mus musculus
tcaagatgcgcttcacaagatgact

SEQ ID NO: 796758 - DNA, 25 bp, Mus musculus
tcaagatgctaaagcccctacactg

SEQ ID NO: 796759 - DNA, 25 bp, Mus musculus
tcaagatgctaatgcccctacactg

SEQ ID NO: 796760 - DNA, 18 bp, Mus musculus
tcaagatgctaccgttca

SEQ ID NO: 796761 - DNA, 25 bp, Mus musculus
tcaagatggagaccctgcttttctt

SEQ ID NO: 796762 - DNA, 25 bp, Mus musculus
tcaagatggagagcctgcttttctt

SEQ ID NO: 796763 - DNA, 25 bp, Mus musculus
tcaagatggcagaccagaacctgga

SEQ ID NO: 796764 - DNA, 25 bp, Mus musculus
tcaagatggcagtccagaacctgga

SEQ ID NO: 796765 - DNA, 25 bp, Mus musculus
tcaagatggcctctacaggctgcat

SEQ ID NO: 796766 - DNA, 25 bp, Mus musculus
tcaagatggcctgtacaggctgcat

SEQ ID NO: 796767 - DNA, 25 bp, Mus musculus
tcaagatgggtcaccaggactcagg

SEQ ID NO: 796768 - DNA, 25 bp, Mus musculus
tcaagatgggtctccaggactcagg

SEQ ID NO: 796769 - DNA, 25 bp, Mus musculus
tcaagatggtcaaagatgtcctgca

SEQ ID NO: 796770 - DNA, 25 bp, Mus musculus
tcaagatggtcaaggcaaaggagat

SEQ ID NO: 796771 - DNA, 25 bp, Mus musculus
tcaagatggtcatagatgtcctgca

SEQ ID NO: 796772 - DNA, 25 bp, Mus musculus
tcaagatggtcatggcaaaggagat

SEQ ID NO: 796773 - DNA, 25 bp, Mus musculus
tcaagatgtcatagtcagtggataa

SEQ ID NO: 796774 - DNA, 25 bp, Mus musculus
tcaagatgtcattgtcagtggataa

SEQ ID NO: 796775 - DNA, 25 bp, Mus musculus
tcaagatgtcggcttccaagtataa

SEQ ID NO: 796776 - DNA, 25 bp, Mus musculus
tcaagatgtcgggttccaagtataa

SEQ ID NO: 796777 - DNA, 25 bp, Mus musculus
tcaagatgttcacccgccgcggtca

SEQ ID NO: 796778 - DNA, 25 bp, Mus musculus
tcaagatgttcagccgccgcggtca

SEQ ID NO: 796779 - DNA, 25 bp, Mus musculus
tcaagatgttctcccagcaagtgca

SEQ ID NO: 796780 - DNA, 25 bp, Mus musculus
tcaagatgttctgccagcaagtgca

SEQ ID NO: 796781 - DNA, 25 bp, Mus musculus
tcaagatgttgcatccgacagtggg

SEQ ID NO: 796782 - DNA, 25 bp, Mus musculus
tcaagatgttgcttccgacagtggg

SEQ ID NO: 796783 - DNA, 25 bp, Mus musculus
tcaagattaccacatactccgtcct

SEQ ID NO: 796784 - DNA, 25 bp, Mus musculus
tcaagattaccagatactccgtcct

SEQ ID NO: 796785 - DNA, 25 bp, Mus musculus
tcaagattcacaacactgtcctgac

SEQ ID NO: 796786 - DNA, 25 bp, Mus musculus
tcaagattcacatcactgtcctgac

SEQ ID NO: 796787 - DNA, 25 bp, Mus musculus
tcaagattcgttaacgtagtaaagc

SEQ ID NO: 796788 - DNA, 25 bp, Mus musculus
tcaagattcgtttacgtagtaaagc

SEQ ID NO: 796789 - DNA, 25 bp, Mus musculus
tcaagattcttgcttcctttcatta

SEQ ID NO: 796790 - DNA, 25 bp, Mus musculus
tcaagattcttggttcctttcatta

SEQ ID NO: 796791 - DNA, 25 bp, Mus musculus
tcaagattgatgagccatccctgcg

SEQ ID NO: 796792 - DNA, 25 bp, Mus musculus
tcaagattgatgtgccatccctgcg

SEQ ID NO: 796793 - DNA, 25 bp, Mus musculus
tcaagattgcagatgtccagaccac

SEQ ID NO: 796794 - DNA, 25 bp, Mus musculus
tcaagattgcagttgtccagaccac

SEQ ID NO: 796795 - DNA, 25 bp, Mus musculus
tcaagattgcctcccacggagagaa

SEQ ID NO: 796796 - DNA, 25 bp, Mus musculus
tcaagattgcctgccacggagagaa

SEQ ID NO: 796797 - DNA, 25 bp, Mus musculus
tcaagattgctcatggcagctgcat

SEQ ID NO: 796798 - DNA, 25 bp, Mus musculus
tcaagattgctcttggcagctgcat

SEQ ID NO: 796799 - DNA, 25 bp, Mus musculus
tcaagattgcttcccacaggtctct

SEQ ID NO: 796800 - DNA, 25 bp, Mus musculus
tcaagattgcttgccacaggtctct

SEQ ID NO: 796801 - DNA, 25 bp, Mus musculus
tcaagatttaatcaagggtctcaaa

SEQ ID NO: 796802 - DNA, 25 bp, Mus musculus
tcaagatttaatgaagggtctcaaa

SEQ ID NO: 796803 - DNA, 25 bp, Mus musculus
tcaagatttcccctttagcgtgctt

SEQ ID NO: 796804 - DNA, 25 bp, Mus musculus
tcaagatttcccgtttagcgtgctt

SEQ ID NO: 796805 - DNA, 25 bp, Mus musculus
tcaagatttcggagacccttttaag

SEQ ID NO: 796806 - DNA, 25 bp, Mus musculus
tcaagatttcggtgacccttttaag

SEQ ID NO: 796807 - DNA, 25 bp, Mus musculus
tcaagcaacgtgaccgctggacttt

SEQ ID NO: 796808 - DNA, 25 bp, Mus musculus
tcaagcaacgtgtccgctggacttt

SEQ ID NO: 796809 - DNA, 25 bp, Mus musculus
tcaagcaacgttcacttcctctgtg

SEQ ID NO: 796810 - DNA, 25 bp, Mus musculus
tcaagcaacgttgacttcctctgtg

SEQ ID NO: 796811 - DNA, 25 bp, Mus musculus
tcaagcaacttgatcccatctgaga

SEQ ID NO: 796812 - DNA, 25 bp, Mus musculus
tcaagcaacttgttcccatctgaga

SEQ ID NO: 796813 - DNA, 25 bp, Mus musculus
tcaagcaagcataggccgggtacac

SEQ ID NO: 796814 - DNA, 25 bp, Mus musculus
tcaagcaagcattggccgggtacac

SEQ ID NO: 796815 - DNA, 25 bp, Mus musculus
tcaagcaagtggaccctgagttcgt

SEQ ID NO: 796816 - DNA, 25 bp, Mus musculus
tcaagcaagtggtccctgagttcgt

SEQ ID NO: 796817 - DNA, 25 bp, Mus musculus
tcaagcacagcgctaaacaaaatcc

SEQ ID NO: 796818 - DNA, 25 bp, Mus musculus
tcaagcacagcggtaaacaaaatcc

SEQ ID NO: 796819 - DNA, 25 bp, Mus musculus
tcaagcaccagaaggccactttggg

SEQ ID NO: 796820 - DNA, 25 bp, Mus musculus
tcaagcaccagatggccactttggg

SEQ ID NO: 796821 - DNA, 25 bp, Mus musculus
tcaagcacgtggcaagtaagaggca

SEQ ID NO: 796822 - DNA, 25 bp, Mus musculus
tcaagcacgtgggaagtaagaggca

SEQ ID NO: 796823 - DNA, 25 bp, Mus musculus
tcaagcactgatcagatgcaggttt

SEQ ID NO: 796824 - DNA, 25 bp, Mus musculus
tcaagcactgatgagatgcaggttt

SEQ ID NO: 796825 - DNA, 25 bp, Mus musculus
tcaagcactgtgctggcatagccag

SEQ ID NO: 796826 - DNA, 25 bp, Mus musculus
tcaagcactgtggtggcatagccag

SEQ ID NO: 796827 - DNA, 25 bp, Mus musculus
tcaagcacttgtccatgcctcagac

SEQ ID NO: 796828 - DNA, 25 bp, Mus musculus
tcaagcacttgtgcatgcctcagac

SEQ ID NO: 796829 - DNA, 25 bp, Mus musculus
tcaagcagaggcagactcgacagtt

SEQ ID NO: 796830 - DNA, 25 bp, Mus musculus
tcaagcagaggctgactcgacagtt

SEQ ID NO: 796831 - DNA, 25 bp, Mus musculus
tcaagcagatggaatggctgctggc

SEQ ID NO: 796832 - DNA, 25 bp, Mus musculus
tcaagcagatggtatggctgctggc

SEQ ID NO: 796833 - DNA, 25 bp, Mus musculus
tcaagcagcaccattgtggttccca

SEQ ID NO: 796834 - DNA, 25 bp, Mus musculus
tcaagcagcacctttgtggttccca

SEQ ID NO: 796835 - DNA, 25 bp, Mus musculus
tcaagcagcactattttcaagatat

SEQ ID NO: 796836 - DNA, 25 bp, Mus musculus
tcaagcagcacttttttcaagatat

SEQ ID NO: 796837 - DNA, 25 bp, Mus musculus
tcaagcagccatcggattgttcttc

SEQ ID NO: 796838 - DNA, 25 bp, Mus musculus
tcaagcagccatgggattgttcttc

SEQ ID NO: 796839 - DNA, 25 bp, Mus musculus
tcaagcagcttcacaaacaaggccc

SEQ ID NO: 796840 - DNA, 25 bp, Mus musculus
tcaagcagcttctcaaacaaggccc

SEQ ID NO: 796841 - DNA, 25 bp, Mus musculus
tcaagcaggatgacggaggctcccc

SEQ ID NO: 796842 - DNA, 25 bp, Mus musculus
tcaagcaggatgtcggaggctcccc

SEQ ID NO: 796843 - DNA, 25 bp, Mus musculus
tcaagcaggccaagttcgactattt

SEQ ID NO: 796844 - DNA, 25 bp, Mus musculus
tcaagcaggccatgttcgactattt

SEQ ID NO: 796845 - DNA, 25 bp, Mus musculus
tcaagcaggctgagaggtgccatca

SEQ ID NO: 796846 - DNA, 25 bp, Mus musculus
tcaagcaggctgtgaggtgccatca

SEQ ID NO: 796847 - DNA, 25 bp, Mus musculus
tcaagcagggagaccttcgtggcag

SEQ ID NO: 796848 - DNA, 25 bp, Mus musculus
tcaagcagggagtccttcgtggcag

SEQ ID NO: 796849 - DNA, 25 bp, Mus musculus
tcaagcagggctatcgcaggatcct

SEQ ID NO: 796850 - DNA, 25 bp, Mus musculus
tcaagcagggctttcgcaggatcct

SEQ ID NO: 796851 - DNA, 25 bp, Mus musculus
tcaagcagtctcagtgttatagaat

SEQ ID NO: 796852 - DNA, 25 bp, Mus musculus
tcaagcagtctctgtgttatagaat

SEQ ID NO: 796853 - DNA, 25 bp, Mus musculus
tcaagcagtgcccagattctaacag

SEQ ID NO: 796854 - DNA, 25 bp, Mus musculus
tcaagcagtgccgagattctaacag

SEQ ID NO: 796855 - DNA, 25 bp, Mus musculus
tcaagcataattatccctaccagtc

SEQ ID NO: 796856 - DNA, 25 bp, Mus musculus
tcaagcataattttccctaccagtc

SEQ ID NO: 796857 - DNA, 25 bp, Mus musculus
tcaagcatatttcccaaaactctaa

SEQ ID NO: 796858 - DNA, 25 bp, Mus musculus
tcaagcatatttgccaaaactctaa

SEQ ID NO: 796859 - DNA, 25 bp, Mus musculus
tcaagcatcccaacttcaatagcag

SEQ ID NO: 796860 - DNA, 25 bp, Mus musculus
tcaagcatcccatcttcaatagcag

SEQ ID NO: 796861 - DNA, 25 bp, Mus musculus
tcaagcatgactaagtttgtgatct

SEQ ID NO: 796862 - DNA, 25 bp, Mus musculus
tcaagcatgacttagtttgtgatct

SEQ ID NO: 796863 - DNA, 25 bp, Mus musculus
tcaagcatgcacatggtgtacagaa

SEQ ID NO: 796864 - DNA, 25 bp, Mus musculus
tcaagcatgcacttggtgtacagaa

SEQ ID NO: 796865 - DNA, 25 bp, Mus musculus
tcaagcatgtcactcccccttctcc

SEQ ID NO: 796866 - DNA, 25 bp, Mus musculus
tcaagcatgtcagtcccccttctcc

SEQ ID NO: 796867 - DNA, 25 bp, Mus musculus
tcaagccaagccaggtatccatgaa

SEQ ID NO: 796868 - DNA, 25 bp, Mus musculus
tcaagccaagcctggtatccatgaa

SEQ ID NO: 796869 - DNA, 25 bp, Mus musculus
tcaagccaagctctagtacaggtga

SEQ ID NO: 796870 - DNA, 25 bp, Mus musculus
tcaagccaagctgtagtacaggtga

SEQ ID NO: 796871 - DNA, 25 bp, Mus musculus
tcaagccactgtccgccatgtcata

SEQ ID NO: 796872 - DNA, 25 bp, Mus musculus
tcaagccactgtgcgccatgtcata

SEQ ID NO: 796873 - DNA, 25 bp, Mus musculus
tcaagccagaccattgcacgtatta

SEQ ID NO: 796874 - DNA, 25 bp, Mus musculus
tcaagccagacctttgcacgtatta

SEQ ID NO: 796875 - DNA, 25 bp, Mus musculus
tcaagccagtttattacagccccat

SEQ ID NO: 796876 - DNA, 25 bp, Mus musculus
tcaagccagttttttacagccccat

SEQ ID NO: 796877 - DNA, 25 bp, Mus musculus
tcaagccataaccacgcatctgctg

SEQ ID NO: 796878 - DNA, 25 bp, Mus musculus
tcaagccataacgacgcatctgctg

SEQ ID NO: 796879 - DNA, 25 bp, Mus musculus
tcaagccatggcacgttgccctgag

SEQ ID NO: 796880 - DNA, 25 bp, Mus musculus
tcaagccatggctcgttgccctgag

SEQ ID NO: 796881 - DNA, 25 bp, Mus musculus
tcaagccatgtaatccattaatttt

SEQ ID NO: 796882 - DNA, 25 bp, Mus musculus
tcaagccatgtattccattaatttt

SEQ ID NO: 796883 - DNA, 25 bp, Mus musculus
tcaagcccacaactgagccgaagtc

SEQ ID NO: 796884 - DNA, 25 bp, Mus musculus
tcaagcccacaagtgagccgaagtc

SEQ ID NO: 796885 - DNA, 25 bp, Mus musculus
tcaagcccacagctactaattatgg

SEQ ID NO: 796886 - DNA, 25 bp, Mus musculus
tcaagcccacaggtactaattatgg

SEQ ID NO: 796887 - DNA, 25 bp, Mus musculus
tcaagcccagctattggagaccgac

SEQ ID NO: 796888 - DNA, 25 bp, Mus musculus
tcaagcccagcttttggagaccgac

SEQ ID NO: 796889 - DNA, 25 bp, Mus musculus
tcaagcccatagcatgactgcgcaa

SEQ ID NO: 796890 - DNA, 25 bp, Mus musculus
tcaagcccataggatgactgcgcaa

SEQ ID NO: 796891 - DNA, 25 bp, Mus musculus
tcaagcccctgcctaatgaaaattg

SEQ ID NO: 796892 - DNA, 25 bp, Mus musculus
tcaagcccctgcgtaatgaaaattg

SEQ ID NO: 796893 - DNA, 25 bp, Mus musculus
tcaagcccgccaagccagagaagaa

SEQ ID NO: 796894 - DNA, 25 bp, Mus musculus
tcaagcccgccatgccagagaagaa

SEQ ID NO: 796895 - DNA, 25 bp, Mus musculus
tcaagccctatgacatgagtctggt

SEQ ID NO: 796896 - DNA, 25 bp, Mus musculus
tcaagccctatgtcatgagtctggt

SEQ ID NO: 796897 - DNA, 25 bp, Mus musculus
tcaagccctcgtccatggtgaagag

SEQ ID NO: 796898 - DNA, 25 bp, Mus musculus
tcaagccctcgtgcatggtgaagag

SEQ ID NO: 796899 - DNA, 25 bp, Mus musculus
tcaagccctctaaacaagtcacctg

SEQ ID NO: 796900 - DNA, 25 bp, Mus musculus
tcaagccctctatacaagtcacctg

SEQ ID NO: 796901 - DNA, 25 bp, Mus musculus
tcaagccctcttcaataccaggcaa

SEQ ID NO: 796902 - DNA, 25 bp, Mus musculus
tcaagccctcttgaataccaggcaa

SEQ ID NO: 796903 - DNA, 25 bp, Mus musculus
tcaagccctgctactcagctagtga

SEQ ID NO: 796904 - DNA, 25 bp, Mus musculus
tcaagccctgcttctcagctagtga

SEQ ID NO: 796905 - DNA, 25 bp, Mus musculus
tcaagcctcgagaggccccattttg

SEQ ID NO: 796906 - DNA, 25 bp, Mus musculus
tcaagcctcgagtggccccattttg

SEQ ID NO: 796907 - DNA, 25 bp, Mus musculus
tcaagcctgggtcgccacgagtata

SEQ ID NO: 796908 - DNA, 25 bp, Mus musculus
tcaagcctgggtggccacgagtata

SEQ ID NO: 796909 - DNA, 25 bp, Mus musculus
tcaagcctggttctcatcacataga

SEQ ID NO: 796910 - DNA, 25 bp, Mus musculus
tcaagcctggttgtcatcacataga

SEQ ID NO: 796911 - DNA, 25 bp, Mus musculus
tcaagcctgtggaacccctctctgg

SEQ ID NO: 796912 - DNA, 25 bp, Mus musculus
tcaagcctgtggtacccctctctgg

SEQ ID NO: 796913 - DNA, 25 bp, Mus musculus
tcaagccttctcaagaggtagttat

SEQ ID NO: 796914 - DNA, 25 bp, Mus musculus
tcaagccttctctagaggtagttat

SEQ ID NO: 796915 - DNA, 25 bp, Mus musculus
tcaagcctttctccctagaacaata

SEQ ID NO: 796916 - DNA, 25 bp, Mus musculus
tcaagcctttctgcctagaacaata

SEQ ID NO: 796917 - DNA, 25 bp, Mus musculus
tcaagcctttgtacatccttcagat

SEQ ID NO: 796918 - DNA, 25 bp, Mus musculus
tcaagcctttgttcatccttcagat

SEQ ID NO: 796919 - DNA, 25 bp, Mus musculus
tcaagcctttttcctattgtgttgg

SEQ ID NO: 796920 - DNA, 25 bp, Mus musculus
tcaagcctttttgctattgtgttgg

SEQ ID NO: 796921 - DNA, 25 bp, Mus musculus
tcaagcgaagctcggaatccacaga

SEQ ID NO: 796922 - DNA, 25 bp, Mus musculus
tcaagcgaagctgggaatccacaga

SEQ ID NO: 796923 - DNA, 25 bp, Mus musculus
tcaagcgacggtcacagtccatcta

SEQ ID NO: 796924 - DNA, 25 bp, Mus musculus
tcaagcgacggtgacagtccatcta

SEQ ID NO: 796925 - DNA, 25 bp, Mus musculus
tcaagcgagctacctgagccttcta

SEQ ID NO: 796926 - DNA, 25 bp, Mus musculus
tcaagcgagctagctgagccttcta

SEQ ID NO: 796927 - DNA, 25 bp, Mus musculus
tcaagcgagggcctggatctcacag

SEQ ID NO: 796928 - DNA, 25 bp, Mus musculus
tcaagcgagggcgtggatctcacag

SEQ ID NO: 796929 - DNA, 25 bp, Mus musculus
tcaagcgcaaagacctgggcagtca

SEQ ID NO: 796930 - DNA, 25 bp, Mus musculus
tcaagcgcaaagtcctgggcagtca

SEQ ID NO: 796931 - DNA, 25 bp, Mus musculus
tcaagcgcaccgacaaagtgaaaag

SEQ ID NO: 796932 - DNA, 25 bp, Mus musculus
tcaagcgcaccgtcaaagtgaaaag

SEQ ID NO: 796933 - DNA, 25 bp, Mus musculus
tcaagcgcacggatctcagacatct

SEQ ID NO: 796934 - DNA, 25 bp, Mus musculus
tcaagcgcacggttctcagacatct

SEQ ID NO: 796935 - DNA, 25 bp, Mus musculus
tcaagcgcaggaagaccaagtctct

SEQ ID NO: 796936 - DNA, 25 bp, Mus musculus
tcaagcgcaggatgaccaagtctct

SEQ ID NO: 796937 - DNA, 25 bp, Mus musculus
tcaagcgcatgtctccttcttggat

SEQ ID NO: 796938 - DNA, 25 bp, Mus musculus
tcaagcgcatgtgtccttcttggat

SEQ ID NO: 796939 - DNA, 25 bp, Mus musculus
tcaagcgccagacggtttactgcct

SEQ ID NO: 796940 - DNA, 25 bp, Mus musculus
tcaagcgccagagggtttactgcct

SEQ ID NO: 796941 - DNA, 25 bp, Mus musculus
tcaagcgccagtaatgccagacgca

SEQ ID NO: 796942 - DNA, 25 bp, Mus musculus
tcaagcgccagttatgccagacgca

SEQ ID NO: 796943 - DNA, 25 bp, Mus musculus
tcaagcgctaccaggactatgagaa

SEQ ID NO: 796944 - DNA, 25 bp, Mus musculus
tcaagcgctacctggactatgagaa

SEQ ID NO: 796945 - DNA, 25 bp, Mus musculus
tcaagcgcttctatgaggctgcggc

SEQ ID NO: 796946 - DNA, 25 bp, Mus musculus
tcaagcgcttctttgaggctgcggc

SEQ ID NO: 796947 - DNA, 25 bp, Mus musculus
tcaagcgcttgacaaaggccaaaaa

SEQ ID NO: 796948 - DNA, 25 bp, Mus musculus
tcaagcgcttgagaaaggccaaaaa

SEQ ID NO: 796949 - DNA, 25 bp, Mus musculus
tcaagcggctccatcggattgactc

SEQ ID NO: 796950 - DNA, 25 bp, Mus musculus
tcaagcggctccttcggattgactc

SEQ ID NO: 796951 - DNA, 25 bp, Mus musculus
tcaagcggctggctttcatcgctca

SEQ ID NO: 796952 - DNA, 25 bp, Mus musculus
tcaagcggctgggtttcatcgctca

SEQ ID NO: 796953 - DNA, 25 bp, Mus musculus
tcaagcgggcttaccttattgagga

SEQ ID NO: 796954 - DNA, 25 bp, Mus musculus
tcaagcgggctttccttattgagga

SEQ ID NO: 796955 - DNA, 25 bp, Mus musculus
tcaagcgggttccatggtctctagc

SEQ ID NO: 796956 - DNA, 25 bp, Mus musculus
tcaagcgggttcgatggtctctagc

SEQ ID NO: 796957 - DNA, 25 bp, Mus musculus
tcaagcgttttcctgtagctgtcaa

SEQ ID NO: 796958 - DNA, 25 bp, Mus musculus
tcaagcgttttcgtgtagctgtcaa

SEQ ID NO: 796959 - DNA, 25 bp, Mus musculus
tcaagctaactaatctggctctccc

SEQ ID NO: 796960 - DNA, 25 bp, Mus musculus
tcaagctaactattctggctctccc

SEQ ID NO: 796961 - DNA, 25 bp, Mus musculus
tcaagctactgcagactcgcgggaa

SEQ ID NO: 796962 - DNA, 25 bp, Mus musculus
tcaagctactgctgactcgcgggaa

SEQ ID NO: 796963 - DNA, 25 bp, Mus musculus
tcaagctactggagggcactggctc

SEQ ID NO: 796964 - DNA, 25 bp, Mus musculus
tcaagctactggtgggcactggctc

SEQ ID NO: 796965 - DNA, 25 bp, Mus musculus
tcaagctagtggatcctgtggacag

SEQ ID NO: 796966 - DNA, 25 bp, Mus musculus
tcaagctagtggttcctgtggacag

SEQ ID NO: 796967 - DNA, 25 bp, Mus musculus
tcaagctattgcaacagtggccctc

SEQ ID NO: 796968 - DNA, 25 bp, Mus musculus
tcaagctattgctacagtggccctc

SEQ ID NO: 796969 - DNA, 25 bp, Mus musculus
tcaagctatttgaattcccctgttt

SEQ ID NO: 796970 - DNA, 25 bp, Mus musculus
tcaagctatttgtattcccctgttt

SEQ ID NO: 796971 - DNA, 25 bp, Mus musculus
tcaagctcatgtaagctcgggagac

SEQ ID NO: 796972 - DNA, 25 bp, Mus musculus
tcaagctcatgttagctcgggagac

SEQ ID NO: 796973 - DNA, 25 bp, Mus musculus
tcaagctccgtgctcaagggagagc

SEQ ID NO: 796974 - DNA, 25 bp, Mus musculus
tcaagctccgtggtcaagggagagc

SEQ ID NO: 796975 - DNA, 25 bp, Mus musculus
tcaagctccgttcccagaagttaat

SEQ ID NO: 796976 - DNA, 25 bp, Mus musculus
tcaagctccgttgccagaagttaat

SEQ ID NO: 796977 - DNA, 25 bp, Mus musculus
tcaagctcctgcctattaagaactg

SEQ ID NO: 796978 - DNA, 25 bp, Mus musculus
tcaagctcctgcgtattaagaactg

SEQ ID NO: 796979 - DNA, 25 bp, Mus musculus
tcaagctccttacccagctgctgga

SEQ ID NO: 796980 - DNA, 25 bp, Mus musculus
tcaagctccttagccagctgctgga

SEQ ID NO: 796981 - DNA, 25 bp, Mus musculus
tcaagctcgggccacagggaaactg

SEQ ID NO: 796982 - DNA, 25 bp, Mus musculus
tcaagctcgggcgacagggaaactg

SEQ ID NO: 796983 - DNA, 25 bp, Mus musculus
tcaagctctctgcaggaacaacact

SEQ ID NO: 796984 - DNA, 25 bp, Mus musculus
tcaagctctctggaggaacaacact

SEQ ID NO: 796985 - DNA, 25 bp, Mus musculus
tcaagctcttcacgcagtgattcgg

SEQ ID NO: 796986 - DNA, 25 bp, Mus musculus
tcaagctcttcaggcagtgattcgg

SEQ ID NO: 796987 - DNA, 25 bp, Mus musculus
tcaagctgaagcactacgggcctgg

SEQ ID NO: 796988 - DNA, 25 bp, Mus musculus
tcaagctgaagctctacgggcctgg

SEQ ID NO: 796989 - DNA, 25 bp, Mus musculus
tcaagctgagacactttctccatga

SEQ ID NO: 796990 - DNA, 25 bp, Mus musculus
tcaagctgagactctttctccatga

SEQ ID NO: 796991 - DNA, 25 bp, Mus musculus
tcaagctgcaagactgacttacaaa

SEQ ID NO: 796992 - DNA, 25 bp, Mus musculus
tcaagctgcaagtctgacttacaaa

SEQ ID NO: 796993 - DNA, 25 bp, Mus musculus
tcaagctgccagacggacatgaatt

SEQ ID NO: 796994 - DNA, 25 bp, Mus musculus
tcaagctgccagtcggacatgaatt

SEQ ID NO: 796995 - DNA, 25 bp, Mus musculus
tcaagctgcctgctttgaactgctg

SEQ ID NO: 796996 - DNA, 25 bp, Mus musculus
tcaagctgcctggtttgaactgctg

SEQ ID NO: 796997 - DNA, 25 bp, Mus musculus
tcaagctgctctcttggctgcaatg

SEQ ID NO: 796998 - DNA, 25 bp, Mus musculus
tcaagctgctctgttggctgcaatg

SEQ ID NO: 796999 - DNA, 25 bp, Mus musculus
tcaagctggaatcttatcccaacct

SEQ ID NO: 797000 - DNA, 25 bp, Mus musculus
tcaagctggaatgttatcccaacct

SEQ ID NO: 797001 - DNA, 25 bp, Mus musculus
tcaagctggatgcaggcaaagcaca

SEQ ID NO: 797002 - DNA, 25 bp, Mus musculus
tcaagctggatggaggcaaagcaca

SEQ ID NO: 797003 - DNA, 25 bp, Mus musculus
tcaagctgggtgcttcacggtccaa

SEQ ID NO: 797004 - DNA, 25 bp, Mus musculus
tcaagctgggtggttcacggtccaa

SEQ ID NO: 797005 - DNA, 25 bp, Mus musculus
tcaagctggtgtactgcatctgtca

SEQ ID NO: 797006 - DNA, 25 bp, Mus musculus
tcaagctggtgttctgcatctgtca

SEQ ID NO: 797007 - DNA, 25 bp, Mus musculus
tcaagctgtcatcatctcccaaagt

SEQ ID NO: 797008 - DNA, 25 bp, Mus musculus
tcaagctgtcatgatctcccaaagt

SEQ ID NO: 797009 - DNA, 25 bp, Mus musculus
tcaagctgtggtagagttgtgacct

SEQ ID NO: 797010 - DNA, 25 bp, Mus musculus
tcaagctgtggttgagttgtgacct

SEQ ID NO: 797011 - DNA, 25 bp, Mus musculus
tcaagctgttccaagctcttcattt

SEQ ID NO: 797012 - DNA, 25 bp, Mus musculus
tcaagctgttcctagctcttcattt

SEQ ID NO: 797013 - DNA, 25 bp, Mus musculus
tcaagcttcaatagcccccaaactg

SEQ ID NO: 797014 - DNA, 25 bp, Mus musculus
tcaagcttcaattgcccccaaactg

SEQ ID NO: 797015 - DNA, 25 bp, Mus musculus
tcaagcttcaccatatcagaggaca

SEQ ID NO: 797016 - DNA, 25 bp, Mus musculus
tcaagcttcaccttatcagaggaca

SEQ ID NO: 797017 - DNA, 25 bp, Mus musculus
tcaagcttcattctttcccttatgt

SEQ ID NO: 797018 - DNA, 25 bp, Mus musculus
tcaagcttcattgtttcccttatgt

SEQ ID NO: 797019 - DNA, 25 bp, Mus musculus
tcaagcttctgaccccatagagccg

SEQ ID NO: 797020 - DNA, 25 bp, Mus musculus
tcaagcttctgagcccatagagccg

SEQ ID NO: 797021 - DNA, 25 bp, Mus musculus
tcaagctttccaaggttaccaggtt

SEQ ID NO: 797022 - DNA, 25 bp, Mus musculus
tcaagctttccatggttaccaggtt

SEQ ID NO: 797023 - DNA, 25 bp, Mus musculus
tcaagctttgacctttggtcctcct

SEQ ID NO: 797024 - DNA, 25 bp, Mus musculus
tcaagctttgacgtttggtcctcct

SEQ ID NO: 797025 - DNA, 25 bp, Mus musculus
tcaaggaaacagctgagcatctctc

SEQ ID NO: 797026 - DNA, 25 bp, Mus musculus
tcaaggaaacaggtgagcatctctc

SEQ ID NO: 797027 - DNA, 25 bp, Mus musculus
tcaaggaaacccaagctgcagcgct

SEQ ID NO: 797028 - DNA, 25 bp, Mus musculus
tcaaggaaaccctagctgcagcgct

SEQ ID NO: 797029 - DNA, 25 bp, Mus musculus
tcaaggaaaggaaggttgcctctcc

SEQ ID NO: 797030 - DNA, 25 bp, Mus musculus
tcaaggaaaggatggttgcctctcc

SEQ ID NO: 797031 - DNA, 25 bp, Mus musculus
tcaaggaaagtaccggaccctgagc

SEQ ID NO: 797032 - DNA, 25 bp, Mus musculus
tcaaggaaagtagcggaccctgagc

SEQ ID NO: 797033 - DNA, 25 bp, Mus musculus
tcaaggaacaacacgggctggcact

SEQ ID NO: 797034 - DNA, 25 bp, Mus musculus
tcaaggaacaactcgggctggcact

SEQ ID NO: 797035 - DNA, 25 bp, Mus musculus
tcaaggaacggacagtggctcagat

SEQ ID NO: 797036 - DNA, 25 bp, Mus musculus
tcaaggaacggagagtggctcagat

SEQ ID NO: 797037 - DNA, 25 bp, Mus musculus
tcaaggaagacgcagccaccttctc

SEQ ID NO: 797038 - DNA, 25 bp, Mus musculus
tcaaggaagacggagccaccttctc

SEQ ID NO: 797039 - DNA, 25 bp, Mus musculus
tcaaggaagagcctcgtgcgatttg

SEQ ID NO: 797040 - DNA, 25 bp, Mus musculus
tcaaggaagagcgtcgtgcgatttg

SEQ ID NO: 797041 - DNA, 25 bp, Mus musculus
tcaaggaaggtcaagcaggcataat

SEQ ID NO: 797042 - DNA, 25 bp, Mus musculus
tcaaggaaggtctagcaggcataat

SEQ ID NO: 797043 - DNA, 25 bp, Mus musculus
tcaaggaatgcaaaccctcttgtct

SEQ ID NO: 797044 - DNA, 25 bp, Mus musculus
tcaaggaatgcataccctcttgtct

SEQ ID NO: 797045 - DNA, 25 bp, Mus musculus
tcaaggacagacacacagggccagt

SEQ ID NO: 797046 - DNA, 25 bp, Mus musculus
tcaaggacagactcacagggccagt

SEQ ID NO: 797047 - DNA, 25 bp, Mus musculus
tcaaggacaggcactccgaggaggc

SEQ ID NO: 797048 - DNA, 25 bp, Mus musculus
tcaaggacaggctctccgaggaggc

SEQ ID NO: 797049 - DNA, 25 bp, Mus musculus
tcaaggacatctatagcaagggcta

SEQ ID NO: 797050 - DNA, 25 bp, Mus musculus
tcaaggacatctttagcaagggcta

SEQ ID NO: 797051 - DNA, 25 bp, Mus musculus
tcaaggaccagcagccagggacgtt

SEQ ID NO: 797052 - DNA, 25 bp, Mus musculus
tcaaggaccagctgccagggacgtt

SEQ ID NO: 797053 - DNA, 25 bp, Mus musculus
tcaaggaccagtcgttttggcgagt

SEQ ID NO: 797054 - DNA, 25 bp, Mus musculus
tcaaggaccagtggttttggcgagt

SEQ ID NO: 797055 - DNA, 25 bp, Mus musculus
tcaaggacgcaacgctgagcctcca

SEQ ID NO: 797056 - DNA, 25 bp, Mus musculus
tcaaggacgcaaggctgagcctcca

SEQ ID NO: 797057 - DNA, 25 bp, Mus musculus
tcaaggactagcactggttcaacaa

SEQ ID NO: 797058 - DNA, 25 bp, Mus musculus
tcaaggactagctctggttcaacaa

SEQ ID NO: 797059 - DNA, 25 bp, Mus musculus
tcaaggactccaaagcaactcacag

SEQ ID NO: 797060 - DNA, 25 bp, Mus musculus
tcaaggactccatagcaactcacag

SEQ ID NO: 797061 - DNA, 25 bp, Mus musculus
tcaaggactccccaacaggagcaaa

SEQ ID NO: 797062 - DNA, 25 bp, Mus musculus
tcaaggactcccgaacaggagcaaa

SEQ ID NO: 797063 - DNA, 25 bp, Mus musculus
tcaaggactgaacgctatcttttaa

SEQ ID NO: 797064 - DNA, 25 bp, Mus musculus
tcaaggactgaaggctatcttttaa

SEQ ID NO: 797065 - DNA, 25 bp, Mus musculus
tcaaggacttcgagattgtcccctt

SEQ ID NO: 797066 - DNA, 25 bp, Mus musculus
tcaaggacttcgtgattgtcccctt

SEQ ID NO: 797067 - DNA, 25 bp, Mus musculus
tcaaggagaagcacttgcttacctt

SEQ ID NO: 797068 - DNA, 25 bp, Mus musculus
tcaaggagaagctcttgcttacctt

SEQ ID NO: 797069 - DNA, 25 bp, Mus musculus
tcaaggagaatgctactttttccct

SEQ ID NO: 797070 - DNA, 25 bp, Mus musculus
tcaaggagaatggtactttttccct

SEQ ID NO: 797071 - DNA, 25 bp, Mus musculus
tcaaggagacctatgctcatctcag

SEQ ID NO: 797072 - DNA, 25 bp, Mus musculus
tcaaggagacctcgtttgtgagacc

SEQ ID NO: 797073 - DNA, 25 bp, Mus musculus
tcaaggagacctggtttgtgagacc

SEQ ID NO: 797074 - DNA, 25 bp, Mus musculus
tcaaggagacctttgctcatctcag

SEQ ID NO: 797075 - DNA, 25 bp, Mus musculus
tcaaggagagccatctaattcccca

SEQ ID NO: 797076 - DNA, 25 bp, Mus musculus
tcaaggagagccttctaattcccca

SEQ ID NO: 797077 - DNA, 25 bp, Mus musculus
tcaaggagaggccatgatgccccgc

SEQ ID NO: 797078 - DNA, 25 bp, Mus musculus
tcaaggagaggcgatgatgccccgc

SEQ ID NO: 797079 - DNA, 25 bp, Mus musculus
tcaaggagccatcggagatcccagc

SEQ ID NO: 797080 - DNA, 25 bp, Mus musculus
tcaaggagccatgggagatcccagc

SEQ ID NO: 797081 - DNA, 25 bp, Mus musculus
tcaaggagcggtatcacgccagtgt

SEQ ID NO: 797082 - DNA, 25 bp, Mus musculus
tcaaggagcggtttcacgccagtgt

SEQ ID NO: 797083 - DNA, 25 bp, Mus musculus
tcaaggagctcacactcgtgcagag

SEQ ID NO: 797084 - DNA, 25 bp, Mus musculus
tcaaggagctcagactcgtgcagag

SEQ ID NO: 797085 - DNA, 25 bp, Mus musculus
tcaaggaggatcacatcctgccgca

SEQ ID NO: 797086 - DNA, 25 bp, Mus musculus
tcaaggaggatctcatcctgccgca

SEQ ID NO: 797087 - DNA, 25 bp, Mus musculus
tcaaggaggcaaactgtagttccct

SEQ ID NO: 797088 - DNA, 25 bp, Mus musculus
tcaaggaggcaatctgtagttccct

SEQ ID NO: 797089 - DNA, 25 bp, Mus musculus
tcaaggagggcaacgaccggaccgt

SEQ ID NO: 797090 - DNA, 25 bp, Mus musculus
tcaaggagggcatcgaccggaccgt

SEQ ID NO: 797091 - DNA, 25 bp, Mus musculus
tcaaggatcaggctaggtaagctct

SEQ ID NO: 797092 - DNA, 25 bp, Mus musculus
tcaaggatcagggtaggtaagctct

SEQ ID NO: 797093 - DNA, 25 bp, Mus musculus
tcaaggatctagaatcttccatacc

SEQ ID NO: 797094 - DNA, 25 bp, Mus musculus
tcaaggatctagtatcttccatacc

SEQ ID NO: 797095 - DNA, 25 bp, Mus musculus
tcaaggatgaaccatctgctcagca

SEQ ID NO: 797096 - DNA, 25 bp, Mus musculus
tcaaggatgaacgatctgctcagca

SEQ ID NO: 797097 - DNA, 25 bp, Mus musculus
tcaaggatggagacacagcctgtcc

SEQ ID NO: 797098 - DNA, 25 bp, Mus musculus
tcaaggatggagtcacagcctgtcc

SEQ ID NO: 797099 - DNA, 25 bp, Mus musculus
tcaaggattattaagccaagacact

SEQ ID NO: 797100 - DNA, 25 bp, Mus musculus
tcaaggattatttagccaagacact

SEQ ID NO: 797101 - DNA, 25 bp, Mus musculus
tcaaggattgggacccaaggtctcc

SEQ ID NO: 797102 - DNA, 25 bp, Mus musculus
tcaaggattgggtcccaaggtctcc

SEQ ID NO: 797103 - DNA, 25 bp, Mus musculus
tcaaggcaatggaatggacattagc

SEQ ID NO: 797104 - DNA, 25 bp, Mus musculus
tcaaggcaatggctttttaccccac

SEQ ID NO: 797105 - DNA, 25 bp, Mus musculus
tcaaggcaatgggtttttaccccac

SEQ ID NO: 797106 - DNA, 25 bp, Mus musculus
tcaaggcaatggtatggacattagc

SEQ ID NO: 797107 - DNA, 25 bp, Mus musculus
tcaaggcagccactcggctattggc

SEQ ID NO: 797108 - DNA, 25 bp, Mus musculus
tcaaggcagccagtcggctattggc

SEQ ID NO: 797109 - DNA, 25 bp, Mus musculus
tcaaggcaggtactccttgatagtg

SEQ ID NO: 797110 - DNA, 25 bp, Mus musculus
tcaaggcaggtagtccttgatagtg

SEQ ID NO: 797111 - DNA, 25 bp, Mus musculus
tcaaggcagtgcacgtccctgggag

SEQ ID NO: 797112 - DNA, 25 bp, Mus musculus
tcaaggcagtgctcgtccctgggag

SEQ ID NO: 797113 - DNA, 25 bp, Mus musculus
tcaaggcagttgctggaaggatctt

SEQ ID NO: 797114 - DNA, 25 bp, Mus musculus
tcaaggcagttggtggaaggatctt

SEQ ID NO: 797115 - DNA, 25 bp, Mus musculus
tcaaggcatgatcctaaccacccag

SEQ ID NO: 797116 - DNA, 25 bp, Mus musculus
tcaaggcatgatgctaaccacccag

SEQ ID NO: 797117 - DNA, 25 bp, Mus musculus
tcaaggcatgccaggttatcttcct

SEQ ID NO: 797118 - DNA, 25 bp, Mus musculus
tcaaggcatgcctggttatcttcct

SEQ ID NO: 797119 - DNA, 25 bp, Mus musculus
tcaaggccaaagctgactccctgtt

SEQ ID NO: 797120 - DNA, 25 bp, Mus musculus
tcaaggccaaaggtgactccctgtt

SEQ ID NO: 797121 - DNA, 25 bp, Mus musculus
tcaaggccaatgaggctcaccttcc

SEQ ID NO: 797122 - DNA, 25 bp, Mus musculus
tcaaggccaatgtggctcaccttcc

SEQ ID NO: 797123 - DNA, 25 bp, Mus musculus
tcaaggccacttatcaccacaaact

SEQ ID NO: 797124 - DNA, 25 bp, Mus musculus
tcaaggccacttttcaccacaaact

SEQ ID NO: 797125 - DNA, 25 bp, Mus musculus
tcaaggccagagaccatccacagag

SEQ ID NO: 797126 - DNA, 25 bp, Mus musculus
tcaaggccagagtccatccacagag

SEQ ID NO: 797127 - DNA, 25 bp, Mus musculus
tcaaggccagctattgctaaaggtc

SEQ ID NO: 797128 - DNA, 25 bp, Mus musculus
tcaaggccagcttttgctaaaggtc

SEQ ID NO: 797129 - DNA, 25 bp, Mus musculus
tcaaggccagtgagggtgctacaca

SEQ ID NO: 797130 - DNA, 25 bp, Mus musculus
tcaaggccagtgtgggtgctacaca

SEQ ID NO: 797131 - DNA, 25 bp, Mus musculus
tcaaggccatgcagctttctgagtt

SEQ ID NO: 797132 - DNA, 25 bp, Mus musculus
tcaaggccatgctgctttctgagtt

SEQ ID NO: 797133 - DNA, 25 bp, Mus musculus
tcaaggccattcatttatctccact

SEQ ID NO: 797134 - DNA, 25 bp, Mus musculus
tcaaggccattcttttatctccact

SEQ ID NO: 797135 - DNA, 25 bp, Mus musculus
tcaaggcccaacattgtacccatct

SEQ ID NO: 797136 - DNA, 25 bp, Mus musculus
tcaaggcccaactttgtacccatct

SEQ ID NO: 797137 - DNA, 25 bp, Mus musculus
tcaaggcccaagagacacgcacagt

SEQ ID NO: 797138 - DNA, 25 bp, Mus musculus
tcaaggcccaagtgacacgcacagt

SEQ ID NO: 797139 - DNA, 25 bp, Mus musculus
tcaaggcccagtctcagtcctgact

SEQ ID NO: 797140 - DNA, 25 bp, Mus musculus
tcaaggcccagtgtcagtcctgact

SEQ ID NO: 797141 - DNA, 25 bp, Mus musculus
tcaaggccctggacctaatgtggat

SEQ ID NO: 797142 - DNA, 25 bp, Mus musculus
tcaaggccctggtcctaatgtggat

SEQ ID NO: 797143 - DNA, 25 bp, Mus musculus
tcaaggcccttcatggagtacccaa

SEQ ID NO: 797144 - DNA, 25 bp, Mus musculus
tcaaggcccttcttggagtacccaa

SEQ ID NO: 797145 - DNA, 25 bp, Mus musculus
tcaaggccgcaaacgtagaggagca

SEQ ID NO: 797146 - DNA, 25 bp, Mus musculus
tcaaggccgcaatcgtagaggagca

SEQ ID NO: 797147 - DNA, 25 bp, Mus musculus
tcaaggccgggcattgactttgcct

SEQ ID NO: 797148 - DNA, 25 bp, Mus musculus
tcaaggccgggctttgactttgcct

SEQ ID NO: 797149 - DNA, 25 bp, Mus musculus
tcaaggccggtgagctgtaagttag

SEQ ID NO: 797150 - DNA, 25 bp, Mus musculus
tcaaggccggtgtgctgtaagttag

SEQ ID NO: 797151 - DNA, 25 bp, Mus musculus
tcaaggcctctcaagtgaccagctt

SEQ ID NO: 797152 - DNA, 25 bp, Mus musculus
tcaaggcctctctagtgaccagctt

SEQ ID NO: 797153 - DNA, 25 bp, Mus musculus
tcaaggcctgagatgacaacgacaa

SEQ ID NO: 797154 - DNA, 25 bp, Mus musculus
tcaaggcctgagttgacaacgacaa

SEQ ID NO: 797155 - DNA, 25 bp, Mus musculus
tcaaggcgcagtcaggtgatctaag

SEQ ID NO: 797156 - DNA, 25 bp, Mus musculus
tcaaggcgcagtgaggtgatctaag

SEQ ID NO: 797157 - DNA, 25 bp, Mus musculus
tcaaggcggtcaattccatcaagat

SEQ ID NO: 797158 - DNA, 25 bp, Mus musculus
tcaaggcggtcatttccatcaagat

SEQ ID NO: 797159 - DNA, 25 bp, Mus musculus
tcaaggcgtggcaacatggacaatc

SEQ ID NO: 797160 - DNA, 25 bp, Mus musculus
tcaaggcgtggctacatggacaatc

SEQ ID NO: 797161 - DNA, 25 bp, Mus musculus
tcaaggcgttccaggtgctcagaaa

SEQ ID NO: 797162 - DNA, 25 bp, Mus musculus
tcaaggcgttcctggtgctcagaaa

SEQ ID NO: 797163 - DNA, 25 bp, Mus musculus
tcaaggctaactacggctacatatt

SEQ ID NO: 797164 - DNA, 25 bp, Mus musculus
tcaaggctaacttcggctacatatt

SEQ ID NO: 797165 - DNA, 25 bp, Mus musculus
tcaaggctaaggagcacgccgcgca

SEQ ID NO: 797166 - DNA, 25 bp, Mus musculus
tcaaggctaaggtgcacgccgcgca

SEQ ID NO: 797167 - DNA, 25 bp, Mus musculus
tcaaggctacatacgcagctctgcc

SEQ ID NO: 797168 - DNA, 25 bp, Mus musculus
tcaaggctacattcgcagctctgcc

SEQ ID NO: 797169 - DNA, 25 bp, Mus musculus
tcaaggctatcactgctggcagcaa

SEQ ID NO: 797170 - DNA, 25 bp, Mus musculus
tcaaggctatcagtgctggcagcaa

SEQ ID NO: 797171 - DNA, 25 bp, Mus musculus
tcaaggctccggagcgaggcccgtc

SEQ ID NO: 797172 - DNA, 25 bp, Mus musculus
tcaaggctccggtgcgaggcccgtc

SEQ ID NO: 797173 - DNA, 25 bp, Mus musculus
tcaaggctgaataatactaggacaa

SEQ ID NO: 797174 - DNA, 25 bp, Mus musculus
tcaaggctgaattatactaggacaa

SEQ ID NO: 797175 - DNA, 25 bp, Mus musculus
tcaaggctgagcagctgtacaagaa

SEQ ID NO: 797176 - DNA, 25 bp, Mus musculus
tcaaggctgagctgctgtacaagaa

SEQ ID NO: 797177 - DNA, 25 bp, Mus musculus
tcaaggctgcatagcagctggtgct

SEQ ID NO: 797178 - DNA, 25 bp, Mus musculus
tcaaggctgcatattgtatccaaaa

SEQ ID NO: 797179 - DNA, 25 bp, Mus musculus
tcaaggctgcattgcagctggtgct

SEQ ID NO: 797180 - DNA, 25 bp, Mus musculus
tcaaggctgcattttgtatccaaaa

SEQ ID NO: 797181 - DNA, 25 bp, Mus musculus
tcaaggctggcaaggccaccaaggt

SEQ ID NO: 797182 - DNA, 25 bp, Mus musculus
tcaaggctggcatggccaccaaggt

SEQ ID NO: 797183 - DNA, 25 bp, Mus musculus
tcaaggctgtagacaccacgggtgc

SEQ ID NO: 797184 - DNA, 25 bp, Mus musculus
tcaaggctgtagtcaccacgggtgc

SEQ ID NO: 797185 - DNA, 25 bp, Mus musculus
tcaaggctgtggaggacgtgatcct

SEQ ID NO: 797186 - DNA, 25 bp, Mus musculus
tcaaggctgtggtggacgtgatcct

SEQ ID NO: 797187 - DNA, 25 bp, Mus musculus
tcaaggcttctcaagtcttatgaga

SEQ ID NO: 797188 - DNA, 25 bp, Mus musculus
tcaaggcttctctagtcttatgaga

SEQ ID NO: 797189 - DNA, 25 bp, Mus musculus
tcaaggcttgtgatggagacgattc

SEQ ID NO: 797190 - DNA, 25 bp, Mus musculus
tcaaggcttgtgttggagacgattc

SEQ ID NO: 797191 - DNA, 25 bp, Mus musculus
tcaaggctttaaacagcatggcccc

SEQ ID NO: 797192 - DNA, 25 bp, Mus musculus
tcaaggctttaatcagcatggcccc

SEQ ID NO: 797193 - DNA, 25 bp, Mus musculus
tcaaggctttctcgtgtctgctttc

SEQ ID NO: 797194 - DNA, 25 bp, Mus musculus
tcaaggctttctggtgtctgctttc

SEQ ID NO: 797195 - DNA, 25 bp, Mus musculus
tcaaggctttttaccagctcacctg

SEQ ID NO: 797196 - DNA, 25 bp, Mus musculus
tcaaggcttttttccagctcacctg

SEQ ID NO: 797197 - DNA, 25 bp, Mus musculus
tcaagggaaccaccttcttcctggg

SEQ ID NO: 797198 - DNA, 25 bp, Mus musculus
tcaagggaaccagcttcttcctggg

SEQ ID NO: 797199 - DNA, 25 bp, Mus musculus
tcaagggacttccaagcacctacaa

SEQ ID NO: 797200 - DNA, 25 bp, Mus musculus
tcaagggacttcgaagcacctacaa

SEQ ID NO: 797201 - DNA, 25 bp, Mus musculus
tcaagggagcaccatcatgtacggg

SEQ ID NO: 797202 - DNA, 25 bp, Mus musculus
tcaagggagcacgatcatgtacggg

SEQ ID NO: 797203 - DNA, 25 bp, Mus musculus
tcaagggaggctatgagaatgacag

SEQ ID NO: 797204 - DNA, 25 bp, Mus musculus
tcaagggaggctttgagaatgacag

SEQ ID NO: 797205 - DNA, 25 bp, Mus musculus
tcaagggagtttacggagccagaga

SEQ ID NO: 797206 - DNA, 25 bp, Mus musculus
tcaagggagttttcggagccagaga

SEQ ID NO: 797207 - DNA, 25 bp, Mus musculus
tcaagggcccatacgacgacgtgag

SEQ ID NO: 797208 - DNA, 25 bp, Mus musculus
tcaagggcccattcgacgacgtgag

SEQ ID NO: 797209 - DNA, 25 bp, Mus musculus
tcaagggccccaagagagactgtaa

SEQ ID NO: 797210 - DNA, 25 bp, Mus musculus
tcaagggccccatgagagactgtaa

SEQ ID NO: 797211 - DNA, 25 bp, Mus musculus
tcaagggccctcatttaactaatag

SEQ ID NO: 797212 - DNA, 25 bp, Mus musculus
tcaagggccctcttttaactaatag

SEQ ID NO: 797213 - DNA, 25 bp, Mus musculus
tcaagggccctgaactaagtgacaa

SEQ ID NO: 797214 - DNA, 25 bp, Mus musculus
tcaagggccctgtactaagtgacaa

SEQ ID NO: 797215 - DNA, 25 bp, Mus musculus
tcaagggcctgtccgggaataccat

SEQ ID NO: 797216 - DNA, 25 bp, Mus musculus
tcaagggcctgtgcgggaataccat

SEQ ID NO: 797217 - DNA, 25 bp, Mus musculus
tcaagggctagtatccctgaggagc

SEQ ID NO: 797218 - DNA, 25 bp, Mus musculus
tcaagggctagtttccctgaggagc

SEQ ID NO: 797219 - DNA, 25 bp, Mus musculus
tcaagggctctgactctgttcatct

SEQ ID NO: 797220 - DNA, 25 bp, Mus musculus
tcaagggctctgtctctgttcatct

SEQ ID NO: 797221 - DNA, 25 bp, Mus musculus
tcaagggcttccagcaacactgaag

SEQ ID NO: 797222 - DNA, 25 bp, Mus musculus
tcaagggcttcctgcaacactgaag

SEQ ID NO: 797223 - DNA, 25 bp, Mus musculus
tcaagggcttgtaaattccggatgg

SEQ ID NO: 797224 - DNA, 25 bp, Mus musculus
tcaagggcttgttaattccggatgg

SEQ ID NO: 797225 - DNA, 25 bp, Mus musculus
tcaagggcttttcagctgggctatt

SEQ ID NO: 797226 - DNA, 25 bp, Mus musculus
tcaagggcttttgagctgggctatt

SEQ ID NO: 797227 - DNA, 25 bp, Mus musculus
tcaagggtcaggaatgggtccagct

SEQ ID NO: 797228 - DNA, 25 bp, Mus musculus
tcaagggtcaggtatgggtccagct

SEQ ID NO: 797229 - DNA, 25 bp, Mus musculus
tcaagggtgactcgctgggcctcta

SEQ ID NO: 797230 - DNA, 25 bp, Mus musculus
tcaagggtgactggctgggcctcta

SEQ ID NO: 797231 - DNA, 25 bp, Mus musculus
tcaagggtggtgactgcaatatgga

SEQ ID NO: 797232 - DNA, 25 bp, Mus musculus
tcaagggtggtgtctgcaatatgga

SEQ ID NO: 797233 - DNA, 25 bp, Mus musculus
tcaagggttctcagcttctacaggg

SEQ ID NO: 797234 - DNA, 25 bp, Mus musculus
tcaagggttctctgcttctacaggg

SEQ ID NO: 797235 - DNA, 25 bp, Mus musculus
tcaagggttcttacgtgctgtacct

SEQ ID NO: 797236 - DNA, 25 bp, Mus musculus
tcaagggttctttcgtgctgtacct

SEQ ID NO: 797237 - DNA, 25 bp, Mus musculus
tcaaggtaaacacggtccgtgacat

SEQ ID NO: 797238 - DNA, 25 bp, Mus musculus
tcaaggtaaacagggtccgtgacat

SEQ ID NO: 797239 - DNA, 25 bp, Mus musculus
tcaaggtaacctaagtctgtcatat

SEQ ID NO: 797240 - DNA, 25 bp, Mus musculus
tcaaggtaaccttagtctgtcatat

SEQ ID NO: 797241 - DNA, 25 bp, Mus musculus
tcaaggtacactaattcctccagct

SEQ ID NO: 797242 - DNA, 25 bp, Mus musculus
tcaaggtacacttattcctccagct

SEQ ID NO: 797243 - DNA, 25 bp, Mus musculus
tcaaggtatttcatggatatgccca

SEQ ID NO: 797244 - DNA, 25 bp, Mus musculus
tcaaggtatttcttggatatgccca

SEQ ID NO: 797245 - DNA, 25 bp, Mus musculus
tcaaggtcacccactctaagatagg

SEQ ID NO: 797246 - DNA, 25 bp, Mus musculus
tcaaggtcaccctctctaagatagg

SEQ ID NO: 797247 - DNA, 25 bp, Mus musculus
tcaaggtcacgtcaacagggatgag

SEQ ID NO: 797248 - DNA, 25 bp, Mus musculus
tcaaggtcacgtgaacagggatgag

SEQ ID NO: 797249 - DNA, 25 bp, Mus musculus
tcaaggtcagcccagtatggtagtg

SEQ ID NO: 797250 - DNA, 25 bp, Mus musculus
tcaaggtcagccgagtatggtagtg

SEQ ID NO: 797251 - DNA, 25 bp, Mus musculus
tcaaggtcaggtagctctacaaagt

SEQ ID NO: 797252 - DNA, 25 bp, Mus musculus
tcaaggtcaggttgctctacaaagt

SEQ ID NO: 797253 - DNA, 25 bp, Mus musculus
tcaaggtccaggacgcgatcgagaa

SEQ ID NO: 797254 - DNA, 25 bp, Mus musculus
tcaaggtccaggtcgcgatcgagaa

SEQ ID NO: 797255 - DNA, 25 bp, Mus musculus
tcaaggtcccttaactgctttataa

SEQ ID NO: 797256 - DNA, 25 bp, Mus musculus
tcaaggtccctttactgctttataa

SEQ ID NO: 797257 - DNA, 25 bp, Mus musculus
tcaaggtccttcaggggctcatggg

SEQ ID NO: 797258 - DNA, 25 bp, Mus musculus
tcaaggtccttctggggctcatggg

SEQ ID NO: 797259 - DNA, 25 bp, Mus musculus
tcaaggtctccaagccaggatgtct

SEQ ID NO: 797260 - DNA, 25 bp, Mus musculus
tcaaggtctccatgccaggatgtct

SEQ ID NO: 797261 - DNA, 25 bp, Mus musculus
tcaaggtctttaacccggtcaaatg

SEQ ID NO: 797262 - DNA, 25 bp, Mus musculus
tcaaggtctttatcccggtcaaatg

SEQ ID NO: 797263 - DNA, 25 bp, Mus musculus
tcaaggtgaaccagcaaagcccggc

SEQ ID NO: 797264 - DNA, 25 bp, Mus musculus
tcaaggtgaacctgcaaagcccggc

SEQ ID NO: 797265 - DNA, 25 bp, Mus musculus
tcaaggtgaacgcacgtcccctgga

SEQ ID NO: 797266 - DNA, 25 bp, Mus musculus
tcaaggtgaacggacgtcccctgga

SEQ ID NO: 797267 - DNA, 25 bp, Mus musculus
tcaaggtgagccctgtccagtatga

SEQ ID NO: 797268 - DNA, 25 bp, Mus musculus
tcaaggtgagccgtgtccagtatga

SEQ ID NO: 797269 - DNA, 25 bp, Mus musculus
tcaaggtgatacagggtggcttttc

SEQ ID NO: 797270 - DNA, 25 bp, Mus musculus
tcaaggtgatactgggtggcttttc

SEQ ID NO: 797271 - DNA, 25 bp, Mus musculus
tcaaggtgccggattggagttcaaa

SEQ ID NO: 797272 - DNA, 25 bp, Mus musculus
tcaaggtgccggtttggagttcaaa

SEQ ID NO: 797273 - DNA, 25 bp, Mus musculus
tcaaggtggcgaacagttccatgtt

SEQ ID NO: 797274 - DNA, 25 bp, Mus musculus
tcaaggtggcgatcagttccatgtt

SEQ ID NO: 797275 - DNA, 25 bp, Mus musculus
tcaaggtggcttagtcatgtcagat

SEQ ID NO: 797276 - DNA, 25 bp, Mus musculus
tcaaggtggctttgtcatgtcagat

SEQ ID NO: 797277 - DNA, 25 bp, Mus musculus
tcaaggtgggacaaggtccccaggt

SEQ ID NO: 797278 - DNA, 25 bp, Mus musculus
tcaaggtgggactaggtccccaggt

SEQ ID NO: 797279 - DNA, 25 bp, Mus musculus
tcaaggtggtggagcgcctactctc

SEQ ID NO: 797280 - DNA, 25 bp, Mus musculus
tcaaggtggtggtgcgcctactctc

SEQ ID NO: 797281 - DNA, 25 bp, Mus musculus
tcaaggtgtttgatcccgagggcaa

SEQ ID NO: 797282 - DNA, 25 bp, Mus musculus
tcaaggtgtttgttcccgagggcaa

SEQ ID NO: 797283 - DNA, 25 bp, Mus musculus
tcaaggtgttttctttcgcacggta

SEQ ID NO: 797284 - DNA, 25 bp, Mus musculus
tcaaggtgttttgtttcgcacggta

SEQ ID NO: 797285 - DNA, 25 bp, Mus musculus
tcaaggttaccgagtggtccaaaat

SEQ ID NO: 797286 - DNA, 25 bp, Mus musculus
tcaaggttaccgtgtggtccaaaat

SEQ ID NO: 797287 - DNA, 25 bp, Mus musculus
tcaaggttacctaggacttcttagt

SEQ ID NO: 797288 - DNA, 25 bp, Mus musculus
tcaaggttaccttggacttcttagt

SEQ ID NO: 797289 - DNA, 25 bp, Mus musculus
tcaaggttcatacgtcactggacac

SEQ ID NO: 797290 - DNA, 25 bp, Mus musculus
tcaaggttcataggtcactggacac

SEQ ID NO: 797291 - DNA, 25 bp, Mus musculus
tcaaggttccatagaagctccagcc

SEQ ID NO: 797292 - DNA, 25 bp, Mus musculus
tcaaggttccatcggcctgtgaaac

SEQ ID NO: 797293 - DNA, 25 bp, Mus musculus
tcaaggttccatgggcctgtgaaac

SEQ ID NO: 797294 - DNA, 25 bp, Mus musculus
tcaaggttccattgaagctccagcc

SEQ ID NO: 797295 - DNA, 25 bp, Mus musculus
tcaaggttcccaaggtgtcgaaggt

SEQ ID NO: 797296 - DNA, 25 bp, Mus musculus
tcaaggttcccatggtgtcgaaggt

SEQ ID NO: 797297 - DNA, 25 bp, Mus musculus
tcaaggttccgtagtaccatgtgaa

SEQ ID NO: 797298 - DNA, 25 bp, Mus musculus
tcaaggttccgttgtaccatgtgaa

SEQ ID NO: 797299 - DNA, 25 bp, Mus musculus
tcaaggttcctcagtgttatcgcat

SEQ ID NO: 797300 - DNA, 25 bp, Mus musculus
tcaaggttcctctgtgttatcgcat

SEQ ID NO: 797301 - DNA, 25 bp, Mus musculus
tcaaggttcctgaatctgaccccac

SEQ ID NO: 797302 - DNA, 25 bp, Mus musculus
tcaaggttcctgtatctgaccccac

SEQ ID NO: 797303 - DNA, 25 bp, Mus musculus
tcaaggttggtcaggtcttcatagc

SEQ ID NO: 797304 - DNA, 25 bp, Mus musculus
tcaaggttggtctggtcttcatagc

SEQ ID NO: 797305 - DNA, 25 bp, Mus musculus
tcaaggttgtcaaatctgattcaaa

SEQ ID NO: 797306 - DNA, 25 bp, Mus musculus
tcaaggttgtcatatctgattcaaa

SEQ ID NO: 797307 - DNA, 25 bp, Mus musculus
tcaaggttgtccacagtcaggccag

SEQ ID NO: 797308 - DNA, 25 bp, Mus musculus
tcaaggttgtcctcagtcaggccag

SEQ ID NO: 797309 - DNA, 25 bp, Mus musculus
tcaaggttgttaaagcagtggagct

SEQ ID NO: 797310 - DNA, 25 bp, Mus musculus
tcaaggttgttatagcagtggagct

SEQ ID NO: 797311 - DNA, 25 bp, Mus musculus
tcaaggtttaatcaccctttggtca

SEQ ID NO: 797312 - DNA, 25 bp, Mus musculus
tcaaggtttaatgaccctttggtca

SEQ ID NO: 797313 - DNA, 25 bp, Mus musculus
tcaagtaaatccaacagtgattttg

SEQ ID NO: 797314 - DNA, 25 bp, Mus musculus
tcaagtaaatcctacagtgattttg

SEQ ID NO: 797315 - DNA, 25 bp, Mus musculus
tcaagtaacactatcagggaagatt

SEQ ID NO: 797316 - DNA, 25 bp, Mus musculus
tcaagtaacactttcagggaagatt

SEQ ID NO: 797317 - DNA, 25 bp, Mus musculus
tcaagtaacgtgcattcggactgaa

SEQ ID NO: 797318 - DNA, 25 bp, Mus musculus
tcaagtaacgtggattcggactgaa

SEQ ID NO: 797319 - DNA, 25 bp, Mus musculus
tcaagtaactcaatcatgggaacct

SEQ ID NO: 797320 - DNA, 25 bp, Mus musculus
tcaagtaactcattcatgggaacct

SEQ ID NO: 797321 - DNA, 25 bp, Mus musculus
tcaagtaacttcatatttccctcca

SEQ ID NO: 797322 - DNA, 25 bp, Mus musculus
tcaagtaacttcttatttccctcca

SEQ ID NO: 797323 - DNA, 25 bp, Mus musculus
tcaagtaatattactggtttcccat

SEQ ID NO: 797324 - DNA, 25 bp, Mus musculus
tcaagtaatatttctggtttcccat

SEQ ID NO: 797325 - DNA, 25 bp, Mus musculus
tcaagtaattctatttctcaactaa

SEQ ID NO: 797326 - DNA, 25 bp, Mus musculus
tcaagtaattctttttctcaactaa

SEQ ID NO: 797327 - DNA, 25 bp, Mus musculus
tcaagtacaaataaaaaggcattgc

SEQ ID NO: 797328 - DNA, 25 bp, Mus musculus
tcaagtacaaattaaaaggcattgc

SEQ ID NO: 797329 - DNA, 25 bp, Mus musculus
tcaagtacattgaagcctggcattt

SEQ ID NO: 797330 - DNA, 25 bp, Mus musculus
tcaagtacattgtagcctggcattt

SEQ ID NO: 797331 - DNA, 25 bp, Mus musculus
tcaagtaccgcacgagacaccgcaa

SEQ ID NO: 797332 - DNA, 25 bp, Mus musculus
tcaagtaccgcaggagacaccgcaa

SEQ ID NO: 797333 - DNA, 25 bp, Mus musculus
tcaagtacctagactcagacacgga

SEQ ID NO: 797334 - DNA, 25 bp, Mus musculus
tcaagtacctagtctcagacacgga

SEQ ID NO: 797335 - DNA, 25 bp, Mus musculus
tcaagtactctcaaagagccatcaa

SEQ ID NO: 797336 - DNA, 25 bp, Mus musculus
tcaagtactctctaagagccatcaa

SEQ ID NO: 797337 - DNA, 25 bp, Mus musculus
tcaagtactcttcctccaacataaa

SEQ ID NO: 797338 - DNA, 25 bp, Mus musculus
tcaagtactcttgctccaacataaa

SEQ ID NO: 797339 - DNA, 25 bp, Mus musculus
tcaagtactggcacttcagggactt

SEQ ID NO: 797340 - DNA, 25 bp, Mus musculus
tcaagtactggctcttcagggactt

SEQ ID NO: 797341 - DNA, 25 bp, Mus musculus
tcaagtagccagaggccaatttaaa

SEQ ID NO: 797342 - DNA, 25 bp, Mus musculus
tcaagtagccagtggccaatttaaa

SEQ ID NO: 797343 - DNA, 25 bp, Mus musculus
tcaagtagccggagaagaactcaaa

SEQ ID NO: 797344 - DNA, 25 bp, Mus musculus
tcaagtagccggtgaagaactcaaa

SEQ ID NO: 797345 - DNA, 25 bp, Mus musculus
tcaagtaggttcaggatgggtgcca

SEQ ID NO: 797346 - DNA, 25 bp, Mus musculus
tcaagtaggttctggatgggtgcca

SEQ ID NO: 797347 - DNA, 25 bp, Mus musculus
tcaagtagtggtcgtcacaccttta

SEQ ID NO: 797348 - DNA, 25 bp, Mus musculus
tcaagtagtggtggtcacaccttta

SEQ ID NO: 797349 - DNA, 25 bp, Mus musculus
tcaagtatacccactggccgtgcct

SEQ ID NO: 797350 - DNA, 25 bp, Mus musculus
tcaagtataccctctggccgtgcct

SEQ ID NO: 797351 - DNA, 25 bp, Mus musculus
tcaagtatatttaagggttttgctt

SEQ ID NO: 797352 - DNA, 25 bp, Mus musculus
tcaagtatattttagggttttgctt

SEQ ID NO: 797353 - DNA, 25 bp, Mus musculus
tcaagtatccttacgtggcagtgat

SEQ ID NO: 797354 - DNA, 25 bp, Mus musculus
tcaagtatcctttcgtggcagtgat

SEQ ID NO: 797355 - DNA, 25 bp, Mus musculus
tcaagtatctgccattttgcctcaa

SEQ ID NO: 797356 - DNA, 25 bp, Mus musculus
tcaagtatctgcgattttgcctcaa

SEQ ID NO: 797357 - DNA, 25 bp, Mus musculus
tcaagtattcagacattgttggaaa

SEQ ID NO: 797358 - DNA, 25 bp, Mus musculus
tcaagtattcagtcattgttggaaa

SEQ ID NO: 797359 - DNA, 25 bp, Mus musculus
tcaagtattctacgcatatgtgtat

SEQ ID NO: 797360 - DNA, 25 bp, Mus musculus
tcaagtattctaggcatatgtgtat

SEQ ID NO: 797361 - DNA, 25 bp, Mus musculus
tcaagtatttctcctgctgatggac

SEQ ID NO: 797362 - DNA, 25 bp, Mus musculus
tcaagtatttctgctgctgatggac

SEQ ID NO: 797363 - DNA, 25 bp, Mus musculus
tcaagtattttgagcagtggcagaa

SEQ ID NO: 797364 - DNA, 25 bp, Mus musculus
tcaagtattttgtgcagtggcagaa

SEQ ID NO: 797365 - DNA, 25 bp, Mus musculus
tcaagtcaacggaggctgctatcat

SEQ ID NO: 797366 - DNA, 25 bp, Mus musculus
tcaagtcaacggtggctgctatcat

SEQ ID NO: 797367 - DNA, 25 bp, Mus musculus
tcaagtcaacttatgtgctccagaa

SEQ ID NO: 797368 - DNA, 25 bp, Mus musculus
tcaagtcaacttttgtgctccagaa

SEQ ID NO: 797369 - DNA, 25 bp, Mus musculus
tcaagtcaatatcccagacaggtat

SEQ ID NO: 797370 - DNA, 25 bp, Mus musculus
tcaagtcaatatgccagacaggtat

SEQ ID NO: 797371 - DNA, 25 bp, Mus musculus
tcaagtcaatctcggaactccgtag

SEQ ID NO: 797372 - DNA, 25 bp, Mus musculus
tcaagtcaatctgggaactccgtag

SEQ ID NO: 797373 - DNA, 25 bp, Mus musculus
tcaagtcaccaaagccttgccagtc

SEQ ID NO: 797374 - DNA, 25 bp, Mus musculus
tcaagtcaccaatgccttgccagtc

SEQ ID NO: 797375 - DNA, 25 bp, Mus musculus
tcaagtcaggaaaagcattcttact

SEQ ID NO: 797376 - DNA, 25 bp, Mus musculus
tcaagtcaggaatagcattcttact

SEQ ID NO: 797377 - DNA, 25 bp, Mus musculus
tcaagtcaggacacagggtggcaaa

SEQ ID NO: 797378 - DNA, 25 bp, Mus musculus
tcaagtcaggactcagggtggcaaa

SEQ ID NO: 797379 - DNA, 25 bp, Mus musculus
tcaagtcatgagcaggctggcccag

SEQ ID NO: 797380 - DNA, 25 bp, Mus musculus
tcaagtcatgaggaggctggcccag

SEQ ID NO: 797381 - DNA, 25 bp, Mus musculus
tcaagtccaaacacaccctggcaga

SEQ ID NO: 797382 - DNA, 25 bp, Mus musculus
tcaagtccaaactcaccctggcaga

SEQ ID NO: 797383 - DNA, 25 bp, Mus musculus
tcaagtccagccaagtgcaaataga

SEQ ID NO: 797384 - DNA, 25 bp, Mus musculus
tcaagtccagcctagtgcaaataga

SEQ ID NO: 797385 - DNA, 25 bp, Mus musculus
tcaagtccatccagggttacaacct

SEQ ID NO: 797386 - DNA, 25 bp, Mus musculus
tcaagtccatcctgggttacaacct

SEQ ID NO: 797387 - DNA, 25 bp, Mus musculus
tcaagtcccgaactgtaatctgcag

SEQ ID NO: 797388 - DNA, 25 bp, Mus musculus
tcaagtcccgaagtgtaatctgcag

SEQ ID NO: 797389 - DNA, 25 bp, Mus musculus
tcaagtccctacactgggctgaatg

SEQ ID NO: 797390 - DNA, 25 bp, Mus musculus
tcaagtccctactctgggctgaatg

SEQ ID NO: 797391 - DNA, 25 bp, Mus musculus
tcaagtccctgcaacacatacaaca

SEQ ID NO: 797392 - DNA, 25 bp, Mus musculus
tcaagtccctgctacacatacaaca

SEQ ID NO: 797393 - DNA, 25 bp, Mus musculus
tcaagtccctttagacagtgagaaa

SEQ ID NO: 797394 - DNA, 25 bp, Mus musculus
tcaagtcccttttgacagtgagaaa

SEQ ID NO: 797395 - DNA, 25 bp, Mus musculus
tcaagtcctacaaggcccggatgga

SEQ ID NO: 797396 - DNA, 25 bp, Mus musculus
tcaagtcctacatggcccggatgga

SEQ ID NO: 797397 - DNA, 25 bp, Mus musculus
tcaagtcctcagcttggaaaccaaa

SEQ ID NO: 797398 - DNA, 25 bp, Mus musculus
tcaagtcctcaggttggaaaccaaa

SEQ ID NO: 797399 - DNA, 25 bp, Mus musculus
tcaagtcctgcacgtgtccctggga

SEQ ID NO: 797400 - DNA, 25 bp, Mus musculus
tcaagtcctgcaggtgtccctggga

SEQ ID NO: 797401 - DNA, 25 bp, Mus musculus
tcaagtccttatattctagaagaga

SEQ ID NO: 797402 - DNA, 25 bp, Mus musculus
tcaagtccttattttctagaagaga

SEQ ID NO: 797403 - DNA, 25 bp, Mus musculus
tcaagtccttgtaacggcccacaag

SEQ ID NO: 797404 - DNA, 25 bp, Mus musculus
tcaagtccttgttacggcccacaag

SEQ ID NO: 797405 - DNA, 25 bp, Mus musculus
tcaagtcctttaccgcctgaagaag

SEQ ID NO: 797406 - DNA, 25 bp, Mus musculus
tcaagtcctttagcgcctgaagaag

SEQ ID NO: 797407 - DNA, 25 bp, Mus musculus
tcaagtcgacacaagccgaagtcat

SEQ ID NO: 797408 - DNA, 25 bp, Mus musculus
tcaagtcgacactagccgaagtcat

SEQ ID NO: 797409 - DNA, 25 bp, Mus musculus
tcaagtcggcttcttactgggcagt

SEQ ID NO: 797410 - DNA, 25 bp, Mus musculus
tcaagtcggcttgttactgggcagt

SEQ ID NO: 797411 - DNA, 25 bp, Mus musculus
tcaagtctacaccaatggtaatgaa

SEQ ID NO: 797412 - DNA, 25 bp, Mus musculus
tcaagtctacacgaatggtaatgaa

SEQ ID NO: 797413 - DNA, 25 bp, Mus musculus
tcaagtctacctcatgtacctactg

SEQ ID NO: 797414 - DNA, 25 bp, Mus musculus
tcaagtctacctgatgtacctactg

SEQ ID NO: 797415 - DNA, 25 bp, Mus musculus
tcaagtctagacaccattggatctc

SEQ ID NO: 797416 - DNA, 25 bp, Mus musculus
tcaagtctagactccattggatctc

SEQ ID NO: 797417 - DNA, 25 bp, Mus musculus
tcaagtctcaacagaactgccttct

SEQ ID NO: 797418 - DNA, 25 bp, Mus musculus
tcaagtctcaactgaactgccttct

SEQ ID NO: 797419 - DNA, 25 bp, Mus musculus
tcaagtctcgttacatgggtgtggt

SEQ ID NO: 797420 - DNA, 25 bp, Mus musculus
tcaagtctcgtttcatgggtgtggt

SEQ ID NO: 797421 - DNA, 25 bp, Mus musculus
tcaagtctctagatggcctttcctt

SEQ ID NO: 797422 - DNA, 25 bp, Mus musculus
tcaagtctctagttggcctttcctt

SEQ ID NO: 797423 - DNA, 25 bp, Mus musculus
tcaagtctctgacaacacccgagga

SEQ ID NO: 797424 - DNA, 25 bp, Mus musculus
tcaagtctctgagaacacccgagga

SEQ ID NO: 797425 - DNA, 25 bp, Mus musculus
tcaagtctcttgaggctcaggcgga

SEQ ID NO: 797426 - DNA, 25 bp, Mus musculus
tcaagtctcttgtggctcaggcgga

SEQ ID NO: 797427 - DNA, 25 bp, Mus musculus
tcaagtctgaccacatctgggacac

SEQ ID NO: 797428 - DNA, 25 bp, Mus musculus
tcaagtctgacctcatctgggacac

SEQ ID NO: 797429 - DNA, 25 bp, Mus musculus
tcaagtctgcacaacagggattttt

SEQ ID NO: 797430 - DNA, 25 bp, Mus musculus
tcaagtctgcactacagggattttt

SEQ ID NO: 797431 - DNA, 25 bp, Mus musculus
tcaagtctgtcacggcctttttcac

SEQ ID NO: 797432 - DNA, 25 bp, Mus musculus
tcaagtctgtcagggcctttttcac

SEQ ID NO: 797433 - DNA, 25 bp, Mus musculus
tcaagtcttcatcgaggctctgtgt

SEQ ID NO: 797434 - DNA, 25 bp, Mus musculus
tcaagtcttcatggaggctctgtgt

SEQ ID NO: 797435 - DNA, 25 bp, Mus musculus
tcaagtctttgacatgttagttggt

SEQ ID NO: 797436 - DNA, 25 bp, Mus musculus
tcaagtctttgagatgttagttggt

SEQ ID NO: 797437 - DNA, 25 bp, Mus musculus
tcaagtcttttaaggtgcacaccgg

SEQ ID NO: 797438 - DNA, 25 bp, Mus musculus
tcaagtcttttatggtgcacaccgg

SEQ ID NO: 797439 - DNA, 25 bp, Mus musculus
tcaagtgaagatcccagctttcctc

SEQ ID NO: 797440 - DNA, 25 bp, Mus musculus
tcaagtgaagatgccagctttcctc

SEQ ID NO: 797441 - DNA, 25 bp, Mus musculus
tcaagtgaagcccttgtgaacacag

SEQ ID NO: 797442 - DNA, 25 bp, Mus musculus
tcaagtgaagccgttgtgaacacag

SEQ ID NO: 797443 - DNA, 25 bp, Mus musculus
tcaagtgaccacacactggctggag

SEQ ID NO: 797444 - DNA, 25 bp, Mus musculus
tcaagtgaccactcactggctggag

SEQ ID NO: 797445 - DNA, 25 bp, Mus musculus
tcaagtgaccttcttgggccaaaag

SEQ ID NO: 797446 - DNA, 25 bp, Mus musculus
tcaagtgaccttgttgggccaaaag

SEQ ID NO: 797447 - DNA, 25 bp, Mus musculus
tcaagtgagcacacctgggaacttc

SEQ ID NO: 797448 - DNA, 25 bp, Mus musculus
tcaagtgagcactcctgggaacttc

SEQ ID NO: 797449 - DNA, 25 bp, Mus musculus
tcaagtgagccaaatgcccgttctt

SEQ ID NO: 797450 - DNA, 25 bp, Mus musculus
tcaagtgagccatatgcccgttctt

SEQ ID NO: 797451 - DNA, 25 bp, Mus musculus
tcaagtgaggcgacagcgagcttgc

SEQ ID NO: 797452 - DNA, 25 bp, Mus musculus
tcaagtgaggcgtcagcgagcttgc

SEQ ID NO: 797453 - DNA, 25 bp, Mus musculus
tcaagtgatacaattccctcaaccg

SEQ ID NO: 797454 - DNA, 25 bp, Mus musculus
tcaagtgatacatttccctcaaccg

SEQ ID NO: 797455 - DNA, 25 bp, Mus musculus
tcaagtgatactatcagcagccggc

SEQ ID NO: 797456 - DNA, 25 bp, Mus musculus
tcaagtgatactttcagcagccggc

SEQ ID NO: 797457 - DNA, 25 bp, Mus musculus
tcaagtgatttaccttataggtact

SEQ ID NO: 797458 - DNA, 25 bp, Mus musculus
tcaagtgatttagcttataggtact

SEQ ID NO: 797459 - DNA, 25 bp, Mus musculus
tcaagtgcaagtacaaggactcagt

SEQ ID NO: 797460 - DNA, 25 bp, Mus musculus
tcaagtgcaagttcaaggactcagt

SEQ ID NO: 797461 - DNA, 25 bp, Mus musculus
tcaagtgcaattcggcacaggcctt

SEQ ID NO: 797462 - DNA, 25 bp, Mus musculus
tcaagtgcaattgggcacaggcctt

SEQ ID NO: 797463 - DNA, 25 bp, Mus musculus
tcaagtgcaccaaccccgggagtga

SEQ ID NO: 797464 - DNA, 25 bp, Mus musculus
tcaagtgcaccatccccgggagtga

SEQ ID NO: 797465 - DNA, 25 bp, Mus musculus
tcaagtgcagcaccatcttctttag

SEQ ID NO: 797466 - DNA, 25 bp, Mus musculus
tcaagtgcagcagcatcttctttag

SEQ ID NO: 797467 - DNA, 25 bp, Mus musculus
tcaagtgcagccactgaggaaggga

SEQ ID NO: 797468 - DNA, 25 bp, Mus musculus
tcaagtgcagcctctgaggaaggga

SEQ ID NO: 797469 - DNA, 25 bp, Mus musculus
tcaagtgcccagactatgaccagat

SEQ ID NO: 797470 - DNA, 25 bp, Mus musculus
tcaagtgcccagtctatgaccagat

SEQ ID NO: 797471 - DNA, 25 bp, Mus musculus
tcaagtgcccctcaaggaacacaga

SEQ ID NO: 797472 - DNA, 25 bp, Mus musculus
tcaagtgcccctgaaggaacacaga

SEQ ID NO: 797473 - DNA, 25 bp, Mus musculus
tcaagtgcccgacgagacttccgtt

SEQ ID NO: 797474 - DNA, 25 bp, Mus musculus
tcaagtgcccgaggagacttccgtt

SEQ ID NO: 797475 - DNA, 25 bp, Mus musculus
tcaagtgccctcaagcgagcaatat

SEQ ID NO: 797476 - DNA, 25 bp, Mus musculus
tcaagtgccctctagcgagcaatat

SEQ ID NO: 797477 - DNA, 25 bp, Mus musculus
tcaagtgcctagattcttaaagttt

SEQ ID NO: 797478 - DNA, 25 bp, Mus musculus
tcaagtgcctagtttcttaaagttt

SEQ ID NO: 797479 - DNA, 25 bp, Mus musculus
tcaagtgcctgcagatccaccctaa

SEQ ID NO: 797480 - DNA, 25 bp, Mus musculus
tcaagtgcctgctgatccaccctaa

SEQ ID NO: 797481 - DNA, 25 bp, Mus musculus
tcaagtgcctttcggctcatcagag

SEQ ID NO: 797482 - DNA, 25 bp, Mus musculus
tcaagtgcctttgggctcatcagag

SEQ ID NO: 797483 - DNA, 25 bp, Mus musculus
tcaagtgctactcgtgaatagtttt

SEQ ID NO: 797484 - DNA, 25 bp, Mus musculus
tcaagtgctactggtgaatagtttt

SEQ ID NO: 797485 - DNA, 25 bp, Mus musculus
tcaagtgctcttccctatggagaaa

SEQ ID NO: 797486 - DNA, 25 bp, Mus musculus
tcaagtgctcttgcctatggagaaa

SEQ ID NO: 797487 - DNA, 25 bp, Mus musculus
tcaagtgctgacactactccggttt

SEQ ID NO: 797488 - DNA, 25 bp, Mus musculus
tcaagtgctgactctactccggttt

SEQ ID NO: 797489 - DNA, 25 bp, Mus musculus
tcaagtgctgctatgtcctgggtgt

SEQ ID NO: 797490 - DNA, 25 bp, Mus musculus
tcaagtgctgctttgtcctgggtgt

SEQ ID NO: 797491 - DNA, 25 bp, Mus musculus
tcaagtggactcagctcttatcacc

SEQ ID NO: 797492 - DNA, 25 bp, Mus musculus
tcaagtggactctgctcttatcacc

SEQ ID NO: 797493 - DNA, 25 bp, Mus musculus
tcaagtggatgaagtttcccagcct

SEQ ID NO: 797494 - DNA, 25 bp, Mus musculus
tcaagtggatgatgtttcccagcct

SEQ ID NO: 797495 - DNA, 25 bp, Mus musculus
tcaagtggcccacaactaacttctg

SEQ ID NO: 797496 - DNA, 25 bp, Mus musculus
tcaagtggcccagaactaacttctg

SEQ ID NO: 797497 - DNA, 25 bp, Mus musculus
tcaagtggccgtcatcgagttggca

SEQ ID NO: 797498 - DNA, 25 bp, Mus musculus
tcaagtggccgtgatcgagttggca

SEQ ID NO: 797499 - DNA, 25 bp, Mus musculus
tcaagtggcgtcaacctggctgtct

SEQ ID NO: 797500 - DNA, 25 bp, Mus musculus
tcaagtggcgtctacctggctgtct

SEQ ID NO: 797501 - DNA, 25 bp, Mus musculus
tcaagtggctgaatgcgcagcaggt

SEQ ID NO: 797502 - DNA, 25 bp, Mus musculus
tcaagtggctgattgcgcagcaggt

SEQ ID NO: 797503 - DNA, 25 bp, Mus musculus
tcaagtggctggcatggctgtccta

SEQ ID NO: 797504 - DNA, 25 bp, Mus musculus
tcaagtggctgggatggctgtccta

SEQ ID NO: 797505 - DNA, 25 bp, Mus musculus
tcaagtggtacaatgcctggaacga

SEQ ID NO: 797506 - DNA, 25 bp, Mus musculus
tcaagtggtacattgcctggaacga

SEQ ID NO: 797507 - DNA, 25 bp, Mus musculus
tcaagtggtaccattttatttcaat

SEQ ID NO: 797508 - DNA, 25 bp, Mus musculus
tcaagtggtacctttttatttcaat

SEQ ID NO: 797509 - DNA, 25 bp, Mus musculus
tcaagtggttaacgcagggcggatt

SEQ ID NO: 797510 - DNA, 25 bp, Mus musculus
tcaagtggttaaggcagggcggatt

SEQ ID NO: 797511 - DNA, 25 bp, Mus musculus
tcaagtgtaacacacctgtccacca

SEQ ID NO: 797512 - DNA, 25 bp, Mus musculus
tcaagtgtaacagacctgtccacca

SEQ ID NO: 797513 - DNA, 25 bp, Mus musculus
tcaagtgtctggaagcagagtatca

SEQ ID NO: 797514 - DNA, 25 bp, Mus musculus
tcaagtgtctggtagcagagtatca

SEQ ID NO: 797515 - DNA, 25 bp, Mus musculus
tcaagtgtcttcctccacgcggatt

SEQ ID NO: 797516 - DNA, 25 bp, Mus musculus
tcaagtgtcttcgtccacgcggatt

SEQ ID NO: 797517 - DNA, 25 bp, Mus musculus
tcaagtgtggacagaggtggtactc

SEQ ID NO: 797518 - DNA, 25 bp, Mus musculus
tcaagtgtggactgaggtggtactc

SEQ ID NO: 797519 - DNA, 25 bp, Mus musculus
tcaagtgtggagcttacgctttcaa

SEQ ID NO: 797520 - DNA, 25 bp, Mus musculus
tcaagtgtggaggttacgctttcaa

SEQ ID NO: 797521 - DNA, 25 bp, Mus musculus
tcaagtgtggctctactgggctcaa

SEQ ID NO: 797522 - DNA, 25 bp, Mus musculus
tcaagtgtggctgtactgggctcaa

SEQ ID NO: 797523 - DNA, 25 bp, Mus musculus
tcaagtgtgtctctggctgttgttc

SEQ ID NO: 797524 - DNA, 25 bp, Mus musculus
tcaagtgtgtctgtggctgttgttc

SEQ ID NO: 797525 - DNA, 25 bp, Mus musculus
tcaagtgtgtgaccggccaatccac

SEQ ID NO: 797526 - DNA, 25 bp, Mus musculus
tcaagtgtgtgagcggccaatccac

SEQ ID NO: 797527 - DNA, 25 bp, Mus musculus
tcaagtgttcagatctcactttagt

SEQ ID NO: 797528 - DNA, 25 bp, Mus musculus
tcaagtgttcagttctcactttagt

SEQ ID NO: 797529 - DNA, 25 bp, Mus musculus
tcaagtgttctcacggttagggttt

SEQ ID NO: 797530 - DNA, 25 bp, Mus musculus
tcaagtgttctcaggtgtataccat

SEQ ID NO: 797531 - DNA, 25 bp, Mus musculus
tcaagtgttctctcggttagggttt

SEQ ID NO: 797532 - DNA, 25 bp, Mus musculus
tcaagtgttctctggtgtataccat

SEQ ID NO: 797533 - DNA, 25 bp, Mus musculus
tcaagtgtttgcagggcccagatga

SEQ ID NO: 797534 - DNA, 25 bp, Mus musculus
tcaagtgtttgctgggcccagatga

SEQ ID NO: 797535 - DNA, 25 bp, Mus musculus
tcaagtgttttacttccatgttacc

SEQ ID NO: 797536 - DNA, 25 bp, Mus musculus
tcaagtgttttagttccatgttacc

SEQ ID NO: 797537 - DNA, 25 bp, Mus musculus
tcaagttaaactattgtgccttagg

SEQ ID NO: 797538 - DNA, 25 bp, Mus musculus
tcaagttaaacttttgtgccttagg

SEQ ID NO: 797539 - DNA, 25 bp, Mus musculus
tcaagttattgcaacattggcttaa

SEQ ID NO: 797540 - DNA, 25 bp, Mus musculus
tcaagttattgctacattggcttaa

SEQ ID NO: 797541 - DNA, 25 bp, Mus musculus
tcaagttcaaacctccagcttgtga

SEQ ID NO: 797542 - DNA, 25 bp, Mus musculus
tcaagttcaaacgtccagcttgtga

SEQ ID NO: 797543 - DNA, 25 bp, Mus musculus
tcaagttcaatgctaacctgggcta

SEQ ID NO: 797544 - DNA, 25 bp, Mus musculus
tcaagttcaatggtaacctgggcta

SEQ ID NO: 797545 - DNA, 25 bp, Mus musculus
tcaagttcagagagaagtcaatgtc

SEQ ID NO: 797546 - DNA, 25 bp, Mus musculus
tcaagttcagagtgaagtcaatgtc

SEQ ID NO: 797547 - DNA, 25 bp, Mus musculus
tcaagttcatctcacaagggctaag

SEQ ID NO: 797548 - DNA, 25 bp, Mus musculus
tcaagttcatctgacaagggctaag

SEQ ID NO: 797549 - DNA, 25 bp, Mus musculus
tcaagttccaaaccatccaaggacg

SEQ ID NO: 797550 - DNA, 25 bp, Mus musculus
tcaagttccaaagcatccaaggacg

SEQ ID NO: 797551 - DNA, 25 bp, Mus musculus
tcaagttccaagattctagccgggt

SEQ ID NO: 797552 - DNA, 25 bp, Mus musculus
tcaagttccaagtttctagccgggt

SEQ ID NO: 797553 - DNA, 25 bp, Mus musculus
tcaagttccacacgctcaaaagcca

SEQ ID NO: 797554 - DNA, 25 bp, Mus musculus
tcaagttccacaggctcaaaagcca

SEQ ID NO: 797555 - DNA, 25 bp, Mus musculus
tcaagttcccatctgcttctttata

SEQ ID NO: 797556 - DNA, 25 bp, Mus musculus
tcaagttcccatgtgcttctttata

SEQ ID NO: 797557 - DNA, 25 bp, Mus musculus
tcaagttcgtacagtgttctctcac

SEQ ID NO: 797558 - DNA, 25 bp, Mus musculus
tcaagttcgtactgtgttctctcac

SEQ ID NO: 797559 - DNA, 25 bp, Mus musculus
tcaagttctgacataccagtgtttt

SEQ ID NO: 797560 - DNA, 25 bp, Mus musculus
tcaagttctgacttaccagtgtttt

SEQ ID NO: 797561 - DNA, 25 bp, Mus musculus
tcaagttctgggactaagagccagt

SEQ ID NO: 797562 - DNA, 25 bp, Mus musculus
tcaagttctgggtctaagagccagt

SEQ ID NO: 797563 - DNA, 25 bp, Mus musculus
tcaagttgctgtccttccgttcact

SEQ ID NO: 797564 - DNA, 25 bp, Mus musculus
tcaagttgctgtgcttccgttcact

SEQ ID NO: 797565 - DNA, 25 bp, Mus musculus
tcaagtttagaccacttctagtgtt

SEQ ID NO: 797566 - DNA, 25 bp, Mus musculus
tcaagtttagacgacttctagtgtt

SEQ ID NO: 797567 - DNA, 25 bp, Mus musculus
tcaagtttcccaagctttatttatt

SEQ ID NO: 797568 - DNA, 25 bp, Mus musculus
tcaagtttcccatgctttatttatt

SEQ ID NO: 797569 - DNA, 25 bp, Mus musculus
tcaagtttctttacctaacagtcaa

SEQ ID NO: 797570 - DNA, 25 bp, Mus musculus
tcaagtttcttttcctaacagtcaa

SEQ ID NO: 797571 - DNA, 25 bp, Mus musculus
tcaagtttgaggagaaccctttggt

SEQ ID NO: 797572 - DNA, 25 bp, Mus musculus
tcaagtttgaggagcgatacaagac

SEQ ID NO: 797573 - DNA, 25 bp, Mus musculus
tcaagtttgaggtgaaccctttggt

SEQ ID NO: 797574 - DNA, 25 bp, Mus musculus
tcaagtttgaggtgcgatacaagac

SEQ ID NO: 797575 - DNA, 25 bp, Mus musculus
tcaagtttgagtatggtcaccaccg

SEQ ID NO: 797576 - DNA, 25 bp, Mus musculus
tcaagtttgagtttggtcaccaccg

SEQ ID NO: 797577 - DNA, 25 bp, Mus musculus
tcaagtttgcctagtagctgagcaa

SEQ ID NO: 797578 - DNA, 25 bp, Mus musculus
tcaagtttgccttgtagctgagcaa

SEQ ID NO: 797579 - DNA, 25 bp, Mus musculus
tcaagtttgtggcttcgatttgacc

SEQ ID NO: 797580 - DNA, 25 bp, Mus musculus
tcaagtttgtgggttcgatttgacc

SEQ ID NO: 797581 - DNA, 25 bp, Mus musculus
tcaagtttgtttcatctagcatagc

SEQ ID NO: 797582 - DNA, 25 bp, Mus musculus
tcaagtttgtttgatctagcatagc

SEQ ID NO: 797583 - DNA, 25 bp, Mus musculus
tcaagttttaaacttggatctcaaa

SEQ ID NO: 797584 - DNA, 25 bp, Mus musculus
tcaagttttaaagttggatctcaaa

SEQ ID NO: 797585 - DNA, 25 bp, Mus musculus
tcaagttttctacactcacaaagga

SEQ ID NO: 797586 - DNA, 25 bp, Mus musculus
tcaagttttctagactcacaaagga

SEQ ID NO: 797587 - DNA, 25 bp, Mus musculus
tcaagttttgcaaaaagtggttcct

SEQ ID NO: 797588 - DNA, 25 bp, Mus musculus
tcaagttttgcataaagtggttcct

SEQ ID NO: 797589 - DNA, 25 bp, Mus musculus
tcaataaacgagcacagtgtgttgt

SEQ ID NO: 797590 - DNA, 25 bp, Mus musculus
tcaataaacgaggacagtgtgttgt

SEQ ID NO: 797591 - DNA, 25 bp, Mus musculus
tcaataaaggaaagtccatctggac

SEQ ID NO: 797592 - DNA, 25 bp, Mus musculus
tcaataaaggaatgtccatctggac

SEQ ID NO: 797593 - DNA, 25 bp, Mus musculus
tcaataaagtctcacattgctgtcc

SEQ ID NO: 797594 - DNA, 25 bp, Mus musculus
tcaataaagtctgacattgctgtcc

SEQ ID NO: 797595 - DNA, 25 bp, Mus musculus
tcaataaatagcactgcctgccttt

SEQ ID NO: 797596 - DNA, 25 bp, Mus musculus
tcaataaatagctctgcctgccttt

SEQ ID NO: 797597 - DNA, 25 bp, Mus musculus
tcaataacccttcttgtctgactta

SEQ ID NO: 797598 - DNA, 25 bp, Mus musculus
tcaataacccttgttgtctgactta

SEQ ID NO: 797599 - DNA, 25 bp, Mus musculus
tcaataactgatcacgcggagtcaa

SEQ ID NO: 797600 - DNA, 25 bp, Mus musculus
tcaataactgatgacgcggagtcaa

SEQ ID NO: 797601 - DNA, 25 bp, Mus musculus
tcaataaggcagctcccttccgaac

SEQ ID NO: 797602 - DNA, 25 bp, Mus musculus
tcaataaggcaggtcccttccgaac

SEQ ID NO: 797603 - DNA, 25 bp, Mus musculus
tcaataataacaatcctccagtgga

SEQ ID NO: 797604 - DNA, 25 bp, Mus musculus
tcaataataacattcctccagtgga

SEQ ID NO: 797605 - DNA, 25 bp, Mus musculus
tcaataatagctcaacctctgttaa

SEQ ID NO: 797606 - DNA, 25 bp, Mus musculus
tcaataatagctgaacctctgttaa

SEQ ID NO: 797607 - DNA, 25 bp, Mus musculus
tcaataatttgaccctttcattttt

SEQ ID NO: 797608 - DNA, 25 bp, Mus musculus
tcaataatttgagcctttcattttt

SEQ ID NO: 797609 - DNA, 25 bp, Mus musculus
tcaatacatctgaatggctaaggtt

SEQ ID NO: 797610 - DNA, 25 bp, Mus musculus
tcaatacatctgtatggctaaggtt

SEQ ID NO: 797611 - DNA, 25 bp, Mus musculus
tcaatacatgatatctccccaaacc

SEQ ID NO: 797612 - DNA, 25 bp, Mus musculus
tcaatacatgatttctccccaaacc

SEQ ID NO: 797613 - DNA, 25 bp, Mus musculus
tcaatacatttgacatcctggctga

SEQ ID NO: 797614 - DNA, 25 bp, Mus musculus
tcaatacatttgtcatcctggctga

SEQ ID NO: 797615 - DNA, 25 bp, Mus musculus
tcaataccctgaaaaggcccgacgg

SEQ ID NO: 797616 - DNA, 25 bp, Mus musculus
tcaataccctgaccctagggcaagt

SEQ ID NO: 797617 - DNA, 25 bp, Mus musculus
tcaataccctgagcctagggcaagt

SEQ ID NO: 797618 - DNA, 25 bp, Mus musculus
tcaataccctgataaggcccgacgg

SEQ ID NO: 797619 - DNA, 25 bp, Mus musculus
tcaataccggaacagcctgatgtga

SEQ ID NO: 797620 - DNA, 25 bp, Mus musculus
tcaataccggaagagcctgatgtga

SEQ ID NO: 797621 - DNA, 25 bp, Mus musculus
tcaatacctctccacttatatcttg

SEQ ID NO: 797622 - DNA, 25 bp, Mus musculus
tcaatacctctcgacttatatcttg

SEQ ID NO: 797623 - DNA, 25 bp, Mus musculus
tcaataccttccacacctcagggaa

SEQ ID NO: 797624 - DNA, 25 bp, Mus musculus
tcaataccttcctcacctcagggaa

SEQ ID NO: 797625 - DNA, 25 bp, Mus musculus
tcaatacgacgtccctgtaaccatg

SEQ ID NO: 797626 - DNA, 25 bp, Mus musculus
tcaatacgacgtgcctgtaaccatg

SEQ ID NO: 797627 - DNA, 25 bp, Mus musculus
tcaatacgatgcaatcccagctcat

SEQ ID NO: 797628 - DNA, 25 bp, Mus musculus
tcaatacgatgctatcccagctcat

SEQ ID NO: 797629 - DNA, 25 bp, Mus musculus
tcaatactccaaaccctgtcttttt

SEQ ID NO: 797630 - DNA, 25 bp, Mus musculus
tcaatactccaatccctgtcttttt

SEQ ID NO: 797631 - DNA, 25 bp, Mus musculus
tcaatactttctcacccagggatag

SEQ ID NO: 797632 - DNA, 25 bp, Mus musculus
tcaatactttctgacccagggatag

SEQ ID NO: 797633 - DNA, 25 bp, Mus musculus
tcaatagtacacagcttgcctggta

SEQ ID NO: 797634 - DNA, 25 bp, Mus musculus
tcaatagtacactgcttgcctggta

SEQ ID NO: 797635 - DNA, 25 bp, Mus musculus
tcaatagtagggaggagttcctcca

SEQ ID NO: 797636 - DNA, 25 bp, Mus musculus
tcaatagtagggtggagttcctcca

SEQ ID NO: 797637 - DNA, 25 bp, Mus musculus
tcaatagtgcctatgtcataccctc

SEQ ID NO: 797638 - DNA, 25 bp, Mus musculus
tcaatagtgcctttgtcataccctc

SEQ ID NO: 797639 - DNA, 25 bp, Mus musculus
tcaatagtgctcatttaattctaaa

SEQ ID NO: 797640 - DNA, 25 bp, Mus musculus
tcaatagtgctcttttaattctaaa

SEQ ID NO: 797641 - DNA, 25 bp, Mus musculus
tcaatagttgttctggtgctcttca

SEQ ID NO: 797642 - DNA, 25 bp, Mus musculus
tcaatagttgttgtggtgctcttca

SEQ ID NO: 797643 - DNA, 25 bp, Mus musculus
tcaatagtttacaggaatccttcga

SEQ ID NO: 797644 - DNA, 25 bp, Mus musculus
tcaatagtttactggaatccttcga

SEQ ID NO: 797645 - DNA, 25 bp, Mus musculus
tcaatatactctatgtgggaataca

SEQ ID NO: 797646 - DNA, 25 bp, Mus musculus
tcaatatactctttgtgggaataca

SEQ ID NO: 797647 - DNA, 25 bp, Mus musculus
tcaatatgaacacccggagccgatt

SEQ ID NO: 797648 - DNA, 25 bp, Mus musculus
tcaatatgaacagccggagccgatt

SEQ ID NO: 797649 - DNA, 25 bp, Mus musculus
tcaatatgaagtagtttccaggcaa

SEQ ID NO: 797650 - DNA, 25 bp, Mus musculus
tcaatatgaagttgtttccaggcaa

SEQ ID NO: 797651 - DNA, 25 bp, Mus musculus
tcaatatgactgatctcctcagaag

SEQ ID NO: 797652 - DNA, 25 bp, Mus musculus
tcaatatgactgttctcctcagaag

SEQ ID NO: 797653 - DNA, 25 bp, Mus musculus
tcaatatgccccaatatgcctggca

SEQ ID NO: 797654 - DNA, 25 bp, Mus musculus
tcaatatgcccctatatgcctggca

SEQ ID NO: 797655 - DNA, 25 bp, Mus musculus
tcaatatgcggtcatgagccagcac

SEQ ID NO: 797656 - DNA, 25 bp, Mus musculus
tcaatatgcggtgatgagccagcac

SEQ ID NO: 797657 - DNA, 25 bp, Mus musculus
tcaatatgctttatggaaccatcac

SEQ ID NO: 797658 - DNA, 25 bp, Mus musculus
tcaatatgctttttggaaccatcac

SEQ ID NO: 797659 - DNA, 25 bp, Mus musculus
tcaatattgggcagatcaagaacca

SEQ ID NO: 797660 - DNA, 25 bp, Mus musculus
tcaatattgggctgatcaagaacca

SEQ ID NO: 797661 - DNA, 25 bp, Mus musculus
tcaatatttgatagggtcccttctg

SEQ ID NO: 797662 - DNA, 25 bp, Mus musculus
tcaatatttgattgggtcccttctg

SEQ ID NO: 797663 - DNA, 25 bp, Mus musculus
tcaatcaacagacgcttggagagtt

SEQ ID NO: 797664 - DNA, 25 bp, Mus musculus
tcaatcaacagaggcttggagagtt

SEQ ID NO: 797665 - DNA, 25 bp, Mus musculus
tcaatcaagtgaaggagactttgga

SEQ ID NO: 797666 - DNA, 25 bp, Mus musculus
tcaatcaagtgatggagactttgga

SEQ ID NO: 797667 - DNA, 25 bp, Mus musculus
tcaatcaagtgcagggactgtaggt

SEQ ID NO: 797668 - DNA, 25 bp, Mus musculus
tcaatcaagtgctgggactgtaggt

SEQ ID NO: 797669 - DNA, 25 bp, Mus musculus
tcaatcacaggaagacggcagcttt

SEQ ID NO: 797670 - DNA, 25 bp, Mus musculus
tcaatcacaggatgacggcagcttt

SEQ ID NO: 797671 - DNA, 25 bp, Mus musculus
tcaatcacccagactggacagcagg

SEQ ID NO: 797672 - DNA, 25 bp, Mus musculus
tcaatcacccagtctggacagcagg

SEQ ID NO: 797673 - DNA, 25 bp, Mus musculus
tcaatcactaagaatcaggccacat

SEQ ID NO: 797674 - DNA, 25 bp, Mus musculus
tcaatcactaagtatcaggccacat

SEQ ID NO: 797675 - DNA, 25 bp, Mus musculus
tcaatcagaatgctagtccagtcgt

SEQ ID NO: 797676 - DNA, 25 bp, Mus musculus
tcaatcagaatggtagtccagtcgt

SEQ ID NO: 797677 - DNA, 25 bp, Mus musculus
tcaatcagatgacgttgcagtccag

SEQ ID NO: 797678 - DNA, 25 bp, Mus musculus
tcaatcagatgaggttgcagtccag

SEQ ID NO: 797679 - DNA, 25 bp, Mus musculus
tcaatcagatggaaaaacggccagt

SEQ ID NO: 797680 - DNA, 25 bp, Mus musculus
tcaatcagatggtaaaacggccagt

SEQ ID NO: 797681 - DNA, 25 bp, Mus musculus
tcaatcaggtctagctccaacggag

SEQ ID NO: 797682 - DNA, 25 bp, Mus musculus
tcaatcaggtcttgctccaacggag

SEQ ID NO: 797683 - DNA, 25 bp, Mus musculus
tcaatcatggtaaacttatcttctt

SEQ ID NO: 797684 - DNA, 25 bp, Mus musculus
tcaatcatggtatacttatcttctt

SEQ ID NO: 797685 - DNA, 25 bp, Mus musculus
tcaatcatggttaatctcctgtccc

SEQ ID NO: 797686 - DNA, 25 bp, Mus musculus
tcaatcatggtttatctcctgtccc

SEQ ID NO: 797687 - DNA, 25 bp, Mus musculus
tcaatcattgggacgctagggcttt

SEQ ID NO: 797688 - DNA, 25 bp, Mus musculus
tcaatcattgggtcgctagggcttt

SEQ ID NO: 797689 - DNA, 25 bp, Mus musculus
tcaatccacagactcggggtagcca

SEQ ID NO: 797690 - DNA, 25 bp, Mus musculus
tcaatccacagagtcggggtagcca

SEQ ID NO: 797691 - DNA, 25 bp, Mus musculus
tcaatcccagcactaagaagtcaga

SEQ ID NO: 797692 - DNA, 25 bp, Mus musculus
tcaatcccagcagtaagaagtcaga

SEQ ID NO: 797693 - DNA, 25 bp, Mus musculus
tcaatcccataaatcctttctcgca

SEQ ID NO: 797694 - DNA, 25 bp, Mus musculus
tcaatcccataattcctttctcgca

SEQ ID NO: 797695 - DNA, 25 bp, Mus musculus
tcaatccccatcactgcataaactg

SEQ ID NO: 797696 - DNA, 25 bp, Mus musculus
tcaatccccatctctgcataaactg

SEQ ID NO: 797697 - DNA, 25 bp, Mus musculus
tcaatcccctgaaaccacggtgtag

SEQ ID NO: 797698 - DNA, 25 bp, Mus musculus
tcaatcccctgataccacggtgtag

SEQ ID NO: 797699 - DNA, 25 bp, Mus musculus
tcaatccccttcagctgcttggatg

SEQ ID NO: 797700 - DNA, 25 bp, Mus musculus
tcaatccccttctgctgcttggatg

SEQ ID NO: 797701 - DNA, 25 bp, Mus musculus
tcaatcccgaaaccagaggtttttg

SEQ ID NO: 797702 - DNA, 25 bp, Mus musculus
tcaatcccgaaagcagaggtttttg

SEQ ID NO: 797703 - DNA, 25 bp, Mus musculus
tcaatcccgttaagactggtcactg

SEQ ID NO: 797704 - DNA, 25 bp, Mus musculus
tcaatcccgttatgactggtcactg

SEQ ID NO: 797705 - DNA, 25 bp, Mus musculus
tcaatccctaggacctgtataagaa

SEQ ID NO: 797706 - DNA, 25 bp, Mus musculus
tcaatccctaggtcctgtataagaa

SEQ ID NO: 797707 - DNA, 25 bp, Mus musculus
tcaatcccttccacaaggaatggcc

SEQ ID NO: 797708 - DNA, 25 bp, Mus musculus
tcaatcccttccactttaggaaaag

SEQ ID NO: 797709 - DNA, 25 bp, Mus musculus
tcaatcccttcctcaaggaatggcc

SEQ ID NO: 797710 - DNA, 25 bp, Mus musculus
tcaatcccttcctctttaggaaaag

SEQ ID NO: 797711 - DNA, 25 bp, Mus musculus
tcaatcccttgcctggtgagaaaga

SEQ ID NO: 797712 - DNA, 25 bp, Mus musculus
tcaatcccttgcgtggtgagaaaga

SEQ ID NO: 797713 - DNA, 25 bp, Mus musculus
tcaatccctttaccttgaaaccctg

SEQ ID NO: 797714 - DNA, 25 bp, Mus musculus
tcaatccctttagcttgaaaccctg

SEQ ID NO: 797715 - DNA, 25 bp, Mus musculus
tcaatccggtatcggcaagagcctc

SEQ ID NO: 797716 - DNA, 25 bp, Mus musculus
tcaatccggtatgggcaagagcctc

SEQ ID NO: 797717 - DNA, 25 bp, Mus musculus
tcaatccgttaccaggtaaaactca

SEQ ID NO: 797718 - DNA, 25 bp, Mus musculus
tcaatccgttacgaggtaaaactca

SEQ ID NO: 797719 - DNA, 25 bp, Mus musculus
tcaatcctactgagtgccatcaaac

SEQ ID NO: 797720 - DNA, 25 bp, Mus musculus
tcaatcctactgtgtgccatcaaac

SEQ ID NO: 797721 - DNA, 25 bp, Mus musculus
tcaatcctccagcaccacgagaggg

SEQ ID NO: 797722 - DNA, 25 bp, Mus musculus
tcaatcctccaggaccacgagaggg

SEQ ID NO: 797723 - DNA, 25 bp, Mus musculus
tcaatcctcctaattccgaaatacc

SEQ ID NO: 797724 - DNA, 25 bp, Mus musculus
tcaatcctcctatttccgaaatacc

SEQ ID NO: 797725 - DNA, 25 bp, Mus musculus
tcaatcctgagtacaatgagcggtt

SEQ ID NO: 797726 - DNA, 25 bp, Mus musculus
tcaatcctgagttcaatgagcggtt

SEQ ID NO: 797727 - DNA, 25 bp, Mus musculus
tcaatcgatagaacttccaactcca

SEQ ID NO: 797728 - DNA, 25 bp, Mus musculus
tcaatcgatagatcttccaactcca

SEQ ID NO: 797729 - DNA, 25 bp, Mus musculus
tcaatctaagtcctctgctcttgca

SEQ ID NO: 797730 - DNA, 25 bp, Mus musculus
tcaatctaagtcgtctgctcttgca

SEQ ID NO: 797731 - DNA, 25 bp, Mus musculus
tcaatctcaatgaaacctgatattt

SEQ ID NO: 797732 - DNA, 25 bp, Mus musculus
tcaatctcaatgtaacctgatattt

SEQ ID NO: 797733 - DNA, 25 bp, Mus musculus
tcaatctccaatctttccgacctat

SEQ ID NO: 797734 - DNA, 25 bp, Mus musculus
tcaatctccaatgtttccgacctat

SEQ ID NO: 797735 - DNA, 25 bp, Mus musculus
tcaatctggctgagaagcaggtcct

SEQ ID NO: 797736 - DNA, 25 bp, Mus musculus
tcaatctggctgtgaagcaggtcct

SEQ ID NO: 797737 - DNA, 25 bp, Mus musculus
tcaatctgtgacctcaaactaccgt

SEQ ID NO: 797738 - DNA, 25 bp, Mus musculus
tcaatctgtgacgtcaaactaccgt

SEQ ID NO: 797739 - DNA, 25 bp, Mus musculus
tcaatcttctctcaatcagtcagtc

SEQ ID NO: 797740 - DNA, 25 bp, Mus musculus
tcaatcttctctgaatcagtcagtc

SEQ ID NO: 797741 - DNA, 25 bp, Mus musculus
tcaatcttggtgcaaactcactgtg

SEQ ID NO: 797742 - DNA, 25 bp, Mus musculus
tcaatcttggtggaaactcactgtg

SEQ ID NO: 797743 - DNA, 25 bp, Mus musculus
tcaatcttgtggctctgtgctgtaa

SEQ ID NO: 797744 - DNA, 25 bp, Mus musculus
tcaatcttgtgggtctgtgctgtaa

SEQ ID NO: 797745 - DNA, 25 bp, Mus musculus
tcaatgaaaatccaagcccggcttt

SEQ ID NO: 797746 - DNA, 25 bp, Mus musculus
tcaatgaaaatcgaagcccggcttt

SEQ ID NO: 797747 - DNA, 25 bp, Mus musculus
tcaatgaaatcaaccgacagagagg

SEQ ID NO: 797748 - DNA, 25 bp, Mus musculus
tcaatgaaatcatccgacagagagg

SEQ ID NO: 797749 - DNA, 25 bp, Mus musculus
tcaatgaaccagctatgtaatggat

SEQ ID NO: 797750 - DNA, 25 bp, Mus musculus
tcaatgaaccaggtatgtaatggat

SEQ ID NO: 797751 - DNA, 25 bp, Mus musculus
tcaatgacaggcagcggctgaccca

SEQ ID NO: 797752 - DNA, 25 bp, Mus musculus
tcaatgacaggctgcggctgaccca

SEQ ID NO: 797753 - DNA, 25 bp, Mus musculus
tcaatgacatcgaattactgaagct

SEQ ID NO: 797754 - DNA, 25 bp, Mus musculus
tcaatgacatcgtattactgaagct

SEQ ID NO: 797755 - DNA, 25 bp, Mus musculus
tcaatgaccccgctacctcatgaac

SEQ ID NO: 797756 - DNA, 25 bp, Mus musculus
tcaatgaccccggtacctcatgaac

SEQ ID NO: 797757 - DNA, 25 bp, Mus musculus
tcaatgaccctcctgtacttccgag

SEQ ID NO: 797758 - DNA, 25 bp, Mus musculus
tcaatgaccctcgtgtacttccgag

SEQ ID NO: 797759 - DNA, 25 bp, Mus musculus
tcaatgacctcaaagcctgtgtgat

SEQ ID NO: 797760 - DNA, 25 bp, Mus musculus
tcaatgacctcatagcctgtgtgat

SEQ ID NO: 797761 - DNA, 25 bp, Mus musculus
tcaatgagaaatacggtgaggccct

SEQ ID NO: 797762 - DNA, 25 bp, Mus musculus
tcaatgagaaattcggtgaggccct

SEQ ID NO: 797763 - DNA, 25 bp, Mus musculus
tcaatgagacggagtgtgacaagca

SEQ ID NO: 797764 - DNA, 25 bp, Mus musculus
tcaatgagacggtgtgtgacaagca

SEQ ID NO: 797765 - DNA, 25 bp, Mus musculus
tcaatgagtttaaaagtaccgagat

SEQ ID NO: 797766 - DNA, 25 bp, Mus musculus
tcaatgagtttataagtaccgagat

SEQ ID NO: 797767 - DNA, 25 bp, Mus musculus
tcaatgatgaaaattcaattcacac

SEQ ID NO: 797768 - DNA, 25 bp, Mus musculus
tcaatgatgaaatttcaattcacac

SEQ ID NO: 797769 - DNA, 25 bp, Mus musculus
tcaatgatggcgatggtctccccaa

SEQ ID NO: 797770 - DNA, 25 bp, Mus musculus
tcaatgatggcgttggtctccccaa

SEQ ID NO: 797771 - DNA, 25 bp, Mus musculus
tcaatgatggttactcgcctcacaa

SEQ ID NO: 797772 - DNA, 25 bp, Mus musculus
tcaatgatggtttctcgcctcacaa

SEQ ID NO: 797773 - DNA, 25 bp, Mus musculus
tcaatgatgtccagaagattcaaaa

SEQ ID NO: 797774 - DNA, 25 bp, Mus musculus
tcaatgatgtcctgaagattcaaaa

SEQ ID NO: 797775 - DNA, 25 bp, Mus musculus
tcaatgcagaatacatgctacccag

SEQ ID NO: 797776 - DNA, 25 bp, Mus musculus
tcaatgcagaattcatgctacccag

SEQ ID NO: 797777 - DNA, 25 bp, Mus musculus
tcaatgcagtccagggctctcccag

SEQ ID NO: 797778 - DNA, 25 bp, Mus musculus
tcaatgcagtcctgggctctcccag

SEQ ID NO: 797779 - DNA, 25 bp, Mus musculus
tcaatgcataatcaatccgacccgc

SEQ ID NO: 797780 - DNA, 25 bp, Mus musculus
tcaatgcataatgaatccgacccgc

SEQ ID NO: 797781 - DNA, 25 bp, Mus musculus
tcaatgccaagtaatctcgtagaag

SEQ ID NO: 797782 - DNA, 25 bp, Mus musculus
tcaatgccaagttatctcgtagaag

SEQ ID NO: 797783 - DNA, 25 bp, Mus musculus
tcaatgccacatagcgaggctggaa

SEQ ID NO: 797784 - DNA, 25 bp, Mus musculus
tcaatgccacattgcgaggctggaa

SEQ ID NO: 797785 - DNA, 25 bp, Mus musculus
tcaatgccagacacgagaccagtgc

SEQ ID NO: 797786 - DNA, 25 bp, Mus musculus
tcaatgccagactcgagaccagtgc

SEQ ID NO: 797787 - DNA, 25 bp, Mus musculus
tcaatgcccactatcctgcagaaaa

SEQ ID NO: 797788 - DNA, 25 bp, Mus musculus
tcaatgcccactttcctgcagaaaa

SEQ ID NO: 797789 - DNA, 25 bp, Mus musculus
tcaatgcccatgaacctttcagaag

SEQ ID NO: 797790 - DNA, 25 bp, Mus musculus
tcaatgcccatgtacctttcagaag

SEQ ID NO: 797791 - DNA, 25 bp, Mus musculus
tcaatgcctacaactcactgacgag

SEQ ID NO: 797792 - DNA, 25 bp, Mus musculus
tcaatgcctacatctcactgacgag

SEQ ID NO: 797793 - DNA, 25 bp, Mus musculus
tcaatgcctcaacctgtacagtcag

SEQ ID NO: 797794 - DNA, 25 bp, Mus musculus
tcaatgcctcaagctgtacagtcag

SEQ ID NO: 797795 - DNA, 25 bp, Mus musculus
tcaatgcctgctccccgggatgggt

SEQ ID NO: 797796 - DNA, 25 bp, Mus musculus
tcaatgcctgctgcccgggatgggt

SEQ ID NO: 797797 - DNA, 25 bp, Mus musculus
tcaatgcctggaccttaaaacaaag

SEQ ID NO: 797798 - DNA, 25 bp, Mus musculus
tcaatgcctggagcttaaaacaaag

SEQ ID NO: 797799 - DNA, 25 bp, Mus musculus
tcaatgcctttaatgctagggcggg

SEQ ID NO: 797800 - DNA, 25 bp, Mus musculus
tcaatgcctttattgctagggcggg

SEQ ID NO: 797801 - DNA, 25 bp, Mus musculus
tcaatgccttttacataccaagttt

SEQ ID NO: 797802 - DNA, 25 bp, Mus musculus
tcaatgcctttttcataccaagttt

SEQ ID NO: 797803 - DNA, 25 bp, Mus musculus
tcaatgcggagcaagaactccggtt

SEQ ID NO: 797804 - DNA, 25 bp, Mus musculus
tcaatgcggagctagaactccggtt

SEQ ID NO: 797805 - DNA, 25 bp, Mus musculus
tcaatgcgtttactgtgtttctcct

SEQ ID NO: 797806 - DNA, 25 bp, Mus musculus
tcaatgcgtttagtgtgtttctcct

SEQ ID NO: 797807 - DNA, 25 bp, Mus musculus
tcaatgctcgagatgaccctgccag

SEQ ID NO: 797808 - DNA, 25 bp, Mus musculus
tcaatgctcgagttgaccctgccag

SEQ ID NO: 797809 - DNA, 25 bp, Mus musculus
tcaatgctctggacggcaagcccta

SEQ ID NO: 797810 - DNA, 25 bp, Mus musculus
tcaatgctctggtcggcaagcccta

SEQ ID NO: 797811 - DNA, 25 bp, Mus musculus
tcaatgctgtgcaagtttgggtgct

SEQ ID NO: 797812 - DNA, 25 bp, Mus musculus
tcaatgctgtgctagtttgggtgct

SEQ ID NO: 797813 - DNA, 25 bp, Mus musculus
tcaatggaaccaaagccagtgaata

SEQ ID NO: 797814 - DNA, 25 bp, Mus musculus
tcaatggaaccatagccagtgaata

SEQ ID NO: 797815 - DNA, 25 bp, Mus musculus
tcaatggaagggatgtctcctggct

SEQ ID NO: 797816 - DNA, 25 bp, Mus musculus
tcaatggaagggttgtctcctggct

SEQ ID NO: 797817 - DNA, 25 bp, Mus musculus
tcaatggacttcacaacccagatcc

SEQ ID NO: 797818 - DNA, 25 bp, Mus musculus
tcaatggacttctcaacccagatcc

SEQ ID NO: 797819 - DNA, 25 bp, Mus musculus
tcaatggcaagcaggcgctgtctaa

SEQ ID NO: 797820 - DNA, 25 bp, Mus musculus
tcaatggcaagctggcgctgtctaa

SEQ ID NO: 797821 - DNA, 25 bp, Mus musculus
tcaatggcagccatgtttcatcaca

SEQ ID NO: 797822 - DNA, 25 bp, Mus musculus
tcaatggcagccttgtttcatcaca

SEQ ID NO: 797823 - DNA, 25 bp, Mus musculus
tcaatggcatgcacttgccctttga

SEQ ID NO: 797824 - DNA, 25 bp, Mus musculus
tcaatggcatgctcttgccctttga

SEQ ID NO: 797825 - DNA, 25 bp, Mus musculus
tcaatggcattgatagctactatag

SEQ ID NO: 797826 - DNA, 25 bp, Mus musculus
tcaatggcattgttagctactatag

SEQ ID NO: 797827 - DNA, 25 bp, Mus musculus
tcaatggccacacctacagcagcag

SEQ ID NO: 797828 - DNA, 25 bp, Mus musculus
tcaatggccacagctacagcagcag

SEQ ID NO: 797829 - DNA, 25 bp, Mus musculus
tcaatggcctgaaaaccttttgata

SEQ ID NO: 797830 - DNA, 25 bp, Mus musculus
tcaatggcctgataaccttttgata

SEQ ID NO: 797831 - DNA, 25 bp, Mus musculus
tcaatggcctggccgctgtacgagt

SEQ ID NO: 797832 - DNA, 25 bp, Mus musculus
tcaatggcctgggcgctgtacgagt

SEQ ID NO: 797833 - DNA, 25 bp, Mus musculus
tcaatgggctacaggcatccacagg

SEQ ID NO: 797834 - DNA, 25 bp, Mus musculus
tcaatgggctactggcatccacagg

SEQ ID NO: 797835 - DNA, 25 bp, Mus musculus
tcaatgggtaagacgcttgctgcca

SEQ ID NO: 797836 - DNA, 25 bp, Mus musculus
tcaatgggtaagtcgcttgctgcca

SEQ ID NO: 797837 - DNA, 25 bp, Mus musculus
tcaatgggtcatccagcgatcacaa

SEQ ID NO: 797838 - DNA, 25 bp, Mus musculus
tcaatgggtcatgcagcgatcacaa

SEQ ID NO: 797839 - DNA, 25 bp, Mus musculus
tcaatggtagaacggcttgccaagc

SEQ ID NO: 797840 - DNA, 25 bp, Mus musculus
tcaatggtagaagggcttgccaagc

SEQ ID NO: 797841 - DNA, 25 bp, Mus musculus
tcaatggtctccctccaatctgagc

SEQ ID NO: 797842 - DNA, 25 bp, Mus musculus
tcaatggtctccgtccaatctgagc

SEQ ID NO: 797843 - DNA, 25 bp, Mus musculus
tcaatgtatgttatctgggtctttc

SEQ ID NO: 797844 - DNA, 25 bp, Mus musculus
tcaatgtatgttttctgggtctttc

SEQ ID NO: 797845 - DNA, 25 bp, Mus musculus
tcaatgtattctatcctgggtggtt

SEQ ID NO: 797846 - DNA, 25 bp, Mus musculus
tcaatgtattctttcctgggtggtt

SEQ ID NO: 797847 - DNA, 25 bp, Mus musculus
tcaatgtcacacaagcatacccagt

SEQ ID NO: 797848 - DNA, 25 bp, Mus musculus
tcaatgtcacactagcatacccagt

SEQ ID NO: 797849 - DNA, 25 bp, Mus musculus
tcaatgtcagctagtctaggaaggt

SEQ ID NO: 797850 - DNA, 25 bp, Mus musculus
tcaatgtcagcttgtctaggaaggt

SEQ ID NO: 797851 - DNA, 25 bp, Mus musculus
tcaatgtcaggcattcctcggagac

SEQ ID NO: 797852 - DNA, 25 bp, Mus musculus
tcaatgtcaggctttcctcggagac

SEQ ID NO: 797853 - DNA, 25 bp, Mus musculus
tcaatgtcctctctagctgtgcatc

SEQ ID NO: 797854 - DNA, 25 bp, Mus musculus
tcaatgtcctctgtagctgtgcatc

SEQ ID NO: 797855 - DNA, 25 bp, Mus musculus
tcaatgtctattacagttgtacagt

SEQ ID NO: 797856 - DNA, 25 bp, Mus musculus
tcaatgtctatttcagttgtacagt

SEQ ID NO: 797857 - DNA, 25 bp, Mus musculus
tcaatgtctctaatcacacatgttc

SEQ ID NO: 797858 - DNA, 25 bp, Mus musculus
tcaatgtctctattcacacatgttc

SEQ ID NO: 797859 - DNA, 25 bp, Mus musculus
tcaatgtctgtcacagtccctgtga

SEQ ID NO: 797860 - DNA, 25 bp, Mus musculus
tcaatgtctgtctcagtccctgtga

SEQ ID NO: 797861 - DNA, 25 bp, Mus musculus
tcaatgtgattgcaactttgagtag

SEQ ID NO: 797862 - DNA, 25 bp, Mus musculus
tcaatgtgattggaactttgagtag

SEQ ID NO: 797863 - DNA, 25 bp, Mus musculus
tcaatgtgcacacggtgaggtgcct

SEQ ID NO: 797864 - DNA, 25 bp, Mus musculus
tcaatgtgcacagggtgaggtgcct

SEQ ID NO: 797865 - DNA, 25 bp, Mus musculus
tcaatgtgcagcactgtcaacagcc

SEQ ID NO: 797866 - DNA, 25 bp, Mus musculus
tcaatgtgcagctctgtcaacagcc

SEQ ID NO: 797867 - DNA, 25 bp, Mus musculus
tcaatgtgcccgctgtatccacggg

SEQ ID NO: 797868 - DNA, 25 bp, Mus musculus
tcaatgtgcccggtgtatccacggg

SEQ ID NO: 797869 - DNA, 25 bp, Mus musculus
tcaatgtgccttccccagacataga

SEQ ID NO: 797870 - DNA, 25 bp, Mus musculus
tcaatgtgccttgcccagacataga

SEQ ID NO: 797871 - DNA, 25 bp, Mus musculus
tcaatgtggactcgccacgtgaatg

SEQ ID NO: 797872 - DNA, 25 bp, Mus musculus
tcaatgtggactggccacgtgaatg

SEQ ID NO: 797873 - DNA, 25 bp, Mus musculus
tcaatgtggcttaagcaccttccat

SEQ ID NO: 797874 - DNA, 25 bp, Mus musculus
tcaatgtggctttagcaccttccat

SEQ ID NO: 797875 - DNA, 25 bp, Mus musculus
tcaatgtgtactcccctcacgcgga

SEQ ID NO: 797876 - DNA, 25 bp, Mus musculus
tcaatgtgtactgccctcacgcgga

SEQ ID NO: 797877 - DNA, 25 bp, Mus musculus
tcaatgtgtgacctggtgatcaccc

SEQ ID NO: 797878 - DNA, 25 bp, Mus musculus
tcaatgtgtgacgtggtgatcaccc

SEQ ID NO: 797879 - DNA, 25 bp, Mus musculus
tcaatgttcctacccagactgatgg

SEQ ID NO: 797880 - DNA, 25 bp, Mus musculus
tcaatgttcctagccagactgatgg

SEQ ID NO: 797881 - DNA, 25 bp, Mus musculus
tcaatgtttctgctgtagataagag

SEQ ID NO: 797882 - DNA, 25 bp, Mus musculus
tcaatgtttctggtgtagataagag

SEQ ID NO: 797883 - DNA, 25 bp, Mus musculus
tcaatgtttgctaaaatgggaggaa

SEQ ID NO: 797884 - DNA, 25 bp, Mus musculus
tcaatgtttgcttaaatgggaggaa

SEQ ID NO: 797885 - DNA, 25 bp, Mus musculus
tcaatgtttttaagtagatttcccc

SEQ ID NO: 797886 - DNA, 25 bp, Mus musculus
tcaatgtttttatgtagatttcccc

SEQ ID NO: 797887 - DNA, 25 bp, Mus musculus
tcaatgtttttgcagtcggtgtata

SEQ ID NO: 797888 - DNA, 25 bp, Mus musculus
tcaatgtttttggagtcggtgtata

SEQ ID NO: 797889 - DNA, 25 bp, Mus musculus
tcaattaaaaccagtttcttccctg

SEQ ID NO: 797890 - DNA, 25 bp, Mus musculus
tcaattaaaacctgtttcttccctg

SEQ ID NO: 797891 - DNA, 25 bp, Mus musculus
tcaattaaagtactccttcccttct

SEQ ID NO: 797892 - DNA, 25 bp, Mus musculus
tcaattaaagtagtccttcccttct

SEQ ID NO: 797893 - DNA, 25 bp, Mus musculus
tcaattaacatgctgcggattgtgg

SEQ ID NO: 797894 - DNA, 25 bp, Mus musculus
tcaattaacatggtgcggattgtgg

SEQ ID NO: 797895 - DNA, 25 bp, Mus musculus
tcaattaagcacaaggacaccctgg

SEQ ID NO: 797896 - DNA, 25 bp, Mus musculus
tcaattaagcactaggacaccctgg

SEQ ID NO: 797897 - DNA, 25 bp, Mus musculus
tcaattaattgtaagccccagaaaa

SEQ ID NO: 797898 - DNA, 25 bp, Mus musculus
tcaattaattgttagccccagaaaa

SEQ ID NO: 797899 - DNA, 25 bp, Mus musculus
tcaattacagacatccctgacttgc

SEQ ID NO: 797900 - DNA, 25 bp, Mus musculus
tcaattacagacttccctgacttgc

SEQ ID NO: 797901 - DNA, 25 bp, Mus musculus
tcaattacatctaagcaggtggccc

SEQ ID NO: 797902 - DNA, 25 bp, Mus musculus
tcaattacatcttagcaggtggccc

SEQ ID NO: 797903 - DNA, 25 bp, Mus musculus
tcaattattcaacacatggattact

SEQ ID NO: 797904 - DNA, 25 bp, Mus musculus
tcaattattcaagacatggattact

SEQ ID NO: 797905 - DNA, 25 bp, Mus musculus
tcaattattgcaaatggatactcat

SEQ ID NO: 797906 - DNA, 25 bp, Mus musculus
tcaattattgcatatggatactcat

SEQ ID NO: 797907 - DNA, 25 bp, Mus musculus
tcaattattttaacgggagatccca

SEQ ID NO: 797908 - DNA, 25 bp, Mus musculus
tcaattattttatcgggagatccca

SEQ ID NO: 797909 - DNA, 25 bp, Mus musculus
tcaattcaaatgccataaggatcaa

SEQ ID NO: 797910 - DNA, 25 bp, Mus musculus
tcaattcaaatggcataaggatcaa

SEQ ID NO: 797911 - DNA, 25 bp, Mus musculus
tcaattcaacagcagttcttcatgg

SEQ ID NO: 797912 - DNA, 25 bp, Mus musculus
tcaattcaacaggagttcttcatgg

SEQ ID NO: 797913 - DNA, 25 bp, Mus musculus
tcaattcaaggtctttcctgctggg

SEQ ID NO: 797914 - DNA, 25 bp, Mus musculus
tcaattcaaggtgtttcctgctggg

SEQ ID NO: 797915 - DNA, 25 bp, Mus musculus
tcaattccagtcagggtggctcaca

SEQ ID NO: 797916 - DNA, 25 bp, Mus musculus
tcaattccagtctgggtggctcaca

SEQ ID NO: 797917 - DNA, 25 bp, Mus musculus
tcaattccattaatcctgattcccc

SEQ ID NO: 797918 - DNA, 25 bp, Mus musculus
tcaattccattattcctgattcccc

SEQ ID NO: 797919 - DNA, 25 bp, Mus musculus
tcaattccctcaaactcatgactca

SEQ ID NO: 797920 - DNA, 25 bp, Mus musculus
tcaattccctcatactcatgactca

SEQ ID NO: 797921 - DNA, 25 bp, Mus musculus
tcaattccctttaaatcttactagt

SEQ ID NO: 797922 - DNA, 25 bp, Mus musculus
tcaattcccttttaatcttactagt

SEQ ID NO: 797923 - DNA, 25 bp, Mus musculus
tcaattcctctcaagtgtggtaccc

SEQ ID NO: 797924 - DNA, 25 bp, Mus musculus
tcaattcctctctagtgtggtaccc

SEQ ID NO: 797925 - DNA, 25 bp, Mus musculus
tcaattcctggacttttggtgcaag

SEQ ID NO: 797926 - DNA, 25 bp, Mus musculus
tcaattcctggagttttggtgcaag

SEQ ID NO: 797927 - DNA, 25 bp, Mus musculus
tcaattccttgaatttgcctcagct

SEQ ID NO: 797928 - DNA, 25 bp, Mus musculus
tcaattccttgattttgcctcagct

SEQ ID NO: 797929 - DNA, 25 bp, Mus musculus
tcaattccttgtacacatctctgag

SEQ ID NO: 797930 - DNA, 25 bp, Mus musculus
tcaattccttgttcacatctctgag

SEQ ID NO: 797931 - DNA, 25 bp, Mus musculus
tcaattctgagtacgatgaagcatg

SEQ ID NO: 797932 - DNA, 25 bp, Mus musculus
tcaattctgagttcgatgaagcatg

SEQ ID NO: 797933 - DNA, 25 bp, Mus musculus
tcaattctgccaaatttcatgtcta

SEQ ID NO: 797934 - DNA, 25 bp, Mus musculus
tcaattctgccatatttcatgtcta

SEQ ID NO: 797935 - DNA, 25 bp, Mus musculus
tcaattctttgactggaggaaccaa

SEQ ID NO: 797936 - DNA, 25 bp, Mus musculus
tcaattctttgagtggaggaaccaa

SEQ ID NO: 797937 - DNA, 25 bp, Mus musculus
tcaattctttgccaggtctcactta

SEQ ID NO: 797938 - DNA, 25 bp, Mus musculus
tcaattctttgcgaggtctcactta

SEQ ID NO: 797939 - DNA, 25 bp, Mus musculus
tcaattgaaccaatgtggcaccaat

SEQ ID NO: 797940 - DNA, 25 bp, Mus musculus
tcaattgaaccattgtggcaccaat

SEQ ID NO: 797941 - DNA, 25 bp, Mus musculus
tcaattgcatggcaagatccgtatt

SEQ ID NO: 797942 - DNA, 25 bp, Mus musculus
tcaattgcatgggaagatccgtatt

SEQ ID NO: 797943 - DNA, 25 bp, Mus musculus
tcaattgctctcaattgctcttcct

SEQ ID NO: 797944 - DNA, 25 bp, Mus musculus
tcaattgctctctattgctcttcct

SEQ ID NO: 797945 - DNA, 25 bp, Mus musculus
tcaattgctgcaatcactgccaggg

SEQ ID NO: 797946 - DNA, 25 bp, Mus musculus
tcaattgctgcattcactgccaggg

SEQ ID NO: 797947 - DNA, 25 bp, Mus musculus
tcaattggactgacctgttggcctg

SEQ ID NO: 797948 - DNA, 25 bp, Mus musculus
tcaattggactgtcctgttggcctg

SEQ ID NO: 797949 - DNA, 25 bp, Mus musculus
tcaattgggaccaagcttttttggc

SEQ ID NO: 797950 - DNA, 25 bp, Mus musculus
tcaattgggacctagcttttttggc

SEQ ID NO: 797951 - DNA, 25 bp, Mus musculus
tcaattggtttcatacccgactggg

SEQ ID NO: 797952 - DNA, 25 bp, Mus musculus
tcaattggtttcttacccgactggg

SEQ ID NO: 797953 - DNA, 25 bp, Mus musculus
tcaattgtacccagactttctctaa

SEQ ID NO: 797954 - DNA, 25 bp, Mus musculus
tcaattgtaccctgactttctctaa

SEQ ID NO: 797955 - DNA, 25 bp, Mus musculus
tcaattgtcactctcatcagaatct

SEQ ID NO: 797956 - DNA, 25 bp, Mus musculus
tcaattgtcactgtcatcagaatct

SEQ ID NO: 797957 - DNA, 25 bp, Mus musculus
tcaatttaagatactcttcccggta

SEQ ID NO: 797958 - DNA, 25 bp, Mus musculus
tcaatttaagattctcttcccggta

SEQ ID NO: 797959 - DNA, 25 bp, Mus musculus
tcaatttacaacctctgaatgacat

SEQ ID NO: 797960 - DNA, 25 bp, Mus musculus
tcaatttacaacgtctgaatgacat

SEQ ID NO: 797961 - DNA, 25 bp, Mus musculus
tcaatttacatcagttacgggttag

SEQ ID NO: 797962 - DNA, 25 bp, Mus musculus
tcaatttacatctgttacgggttag

SEQ ID NO: 797963 - DNA, 25 bp, Mus musculus
tcaatttacgacagcctatcgggat

SEQ ID NO: 797964 - DNA, 25 bp, Mus musculus
tcaatttacgactgcctatcgggat

SEQ ID NO: 797965 - DNA, 25 bp, Mus musculus
tcaatttatcatacctggtctcgac

SEQ ID NO: 797966 - DNA, 25 bp, Mus musculus
tcaatttatcattcctggtctcgac

SEQ ID NO: 797967 - DNA, 25 bp, Mus musculus
tcaatttcacctccatcgagtctct

SEQ ID NO: 797968 - DNA, 25 bp, Mus musculus
tcaatttcacctgcatcgagtctct

SEQ ID NO: 797969 - DNA, 25 bp, Mus musculus
tcaatttccatcctcctgtggagaa

SEQ ID NO: 797970 - DNA, 25 bp, Mus musculus
tcaatttccatcgtcctgtggagaa

SEQ ID NO: 797971 - DNA, 25 bp, Mus musculus
tcaatttctactctttattcccatc

SEQ ID NO: 797972 - DNA, 25 bp, Mus musculus
tcaatttctactgtttattcccatc

SEQ ID NO: 797973 - DNA, 25 bp, Mus musculus
tcaatttctcttaaaggtggctcag

SEQ ID NO: 797974 - DNA, 25 bp, Mus musculus
tcaatttctctttaaggtggctcag

SEQ ID NO: 797975 - DNA, 25 bp, Mus musculus
tcaatttctggacctcacggatgtc

SEQ ID NO: 797976 - DNA, 25 bp, Mus musculus
tcaatttctggagctcacggatgtc

SEQ ID NO: 797977 - DNA, 25 bp, Mus musculus
tcaatttctgtgagacgctgcgcct

SEQ ID NO: 797978 - DNA, 25 bp, Mus musculus
tcaatttctgtgtgacgctgcgcct

SEQ ID NO: 797979 - DNA, 25 bp, Mus musculus
tcaatttctttaacttctcctcaca

SEQ ID NO: 797980 - DNA, 25 bp, Mus musculus
tcaatttctttatcttctcctcaca

SEQ ID NO: 797981 - DNA, 25 bp, Mus musculus
tcaatttcttttcaattccgctccc

SEQ ID NO: 797982 - DNA, 25 bp, Mus musculus
tcaatttcttttgaattccgctccc

SEQ ID NO: 797983 - DNA, 25 bp, Mus musculus
tcaatttgatccctttactgtccca

SEQ ID NO: 797984 - DNA, 25 bp, Mus musculus
tcaatttgatccgtttactgtccca

SEQ ID NO: 797985 - DNA, 25 bp, Mus musculus
tcaatttgtattctccttggagcag

SEQ ID NO: 797986 - DNA, 25 bp, Mus musculus
tcaatttgtattgtccttggagcag

SEQ ID NO: 797987 - DNA, 25 bp, Mus musculus
tcaatttgtcgcaagtgtgtacaca

SEQ ID NO: 797988 - DNA, 25 bp, Mus musculus
tcaatttgtcgctagtgtgtacaca

SEQ ID NO: 797989 - DNA, 25 bp, Mus musculus
tcaatttgtgttaccctgacttaaa

SEQ ID NO: 797990 - DNA, 25 bp, Mus musculus
tcaatttgtgtttccctgacttaaa

SEQ ID NO: 797991 - DNA, 25 bp, Mus musculus
tcacaaaaacatactccaatcccta

SEQ ID NO: 797992 - DNA, 25 bp, Mus musculus
tcacaaaaacattctccaatcccta

SEQ ID NO: 797993 - DNA, 25 bp, Mus musculus
tcacaaaaggaacgcctgactccca

SEQ ID NO: 797994 - DNA, 25 bp, Mus musculus
tcacaaaaggaaggcctgactccca

SEQ ID NO: 797995 - DNA, 25 bp, Mus musculus
tcacaaaaggccatgcaaccgagct

SEQ ID NO: 797996 - DNA, 25 bp, Mus musculus
tcacaaaaggccctggtgtcaggca

SEQ ID NO: 797997 - DNA, 25 bp, Mus musculus
tcacaaaaggccgtggtgtcaggca

SEQ ID NO: 797998 - DNA, 25 bp, Mus musculus
tcacaaaaggccttgcaaccgagct

SEQ ID NO: 797999 - DNA, 25 bp, Mus musculus
tcacaaaatagcctaggccgtgtgt

SEQ ID NO: 798000 - DNA, 25 bp, Mus musculus
tcacaaaatagcgtaggccgtgtgt

SEQ ID NO: 798001 - DNA, 25 bp, Mus musculus
tcacaaaattgaattcttccattgg

SEQ ID NO: 798002 - DNA, 25 bp, Mus musculus
tcacaaaattgatttcttccattgg

SEQ ID NO: 798003 - DNA, 25 bp, Mus musculus
tcacaaacatcacagaagacatctt

SEQ ID NO: 798004 - DNA, 25 bp, Mus musculus
tcacaaacatcagagaagacatctt

SEQ ID NO: 798005 - DNA, 25 bp, Mus musculus
tcacaaaccagcctgaacacttggg

SEQ ID NO: 798006 - DNA, 25 bp, Mus musculus
tcacaaaccagcgtgaacacttggg

SEQ ID NO: 798007 - DNA, 25 bp, Mus musculus
tcacaaactgtaactgcagtccctc

SEQ ID NO: 798008 - DNA, 25 bp, Mus musculus
tcacaaactgtatctgcagtccctc

SEQ ID NO: 798009 - DNA, 25 bp, Mus musculus
tcacaaagccctcggctgctgggcg

SEQ ID NO: 798010 - DNA, 25 bp, Mus musculus
tcacaaagccctgggctgctgggcg

SEQ ID NO: 798011 - DNA, 25 bp, Mus musculus
tcacaaagcctgaaacctggaggtg

SEQ ID NO: 798012 - DNA, 25 bp, Mus musculus
tcacaaagcctgtaacctggaggtg

SEQ ID NO: 798013 - DNA, 25 bp, Mus musculus
tcacaaagcgttatacacatttctg

SEQ ID NO: 798014 - DNA, 25 bp, Mus musculus
tcacaaagcgttttacacatttctg

SEQ ID NO: 798015 - DNA, 25 bp, Mus musculus
tcacaaatagccattccatcatcgg

SEQ ID NO: 798016 - DNA, 25 bp, Mus musculus
tcacaaatagcctttccatcatcgg

SEQ ID NO: 798017 - DNA, 25 bp, Mus musculus
tcacaaatctctcgcaccaaagggg

SEQ ID NO: 798018 - DNA, 25 bp, Mus musculus
tcacaaatctctggcaccaaagggg

SEQ ID NO: 798019 - DNA, 25 bp, Mus musculus
tcacaaattataactgccgaacgta

SEQ ID NO: 798020 - DNA, 25 bp, Mus musculus
tcacaaattatatctgccgaacgta

SEQ ID NO: 798021 - DNA, 25 bp, Mus musculus
tcacaaattttaaccattctttcta

SEQ ID NO: 798022 - DNA, 25 bp, Mus musculus
tcacaaattttatccattctttcta

SEQ ID NO: 798023 - DNA, 25 bp, Mus musculus
tcacaacacaacatccggctatttg

SEQ ID NO: 798024 - DNA, 25 bp, Mus musculus
tcacaacacaacttccggctatttg

SEQ ID NO: 798025 - DNA, 25 bp, Mus musculus
tcacaacagtgaccacccagtaggt

SEQ ID NO: 798026 - DNA, 25 bp, Mus musculus
tcacaacagtgagcacccagtaggt

SEQ ID NO: 798027 - DNA, 25 bp, Mus musculus
tcacaacctggtaccattgtttttt

SEQ ID NO: 798028 - DNA, 25 bp, Mus musculus
tcacaacctggttccattgtttttt

SEQ ID NO: 798029 - DNA, 25 bp, Mus musculus
tcacaacggatgactctggagaaac

SEQ ID NO: 798030 - DNA, 25 bp, Mus musculus
tcacaacggatgtctctggagaaac

SEQ ID NO: 798031 - DNA, 25 bp, Mus musculus
tcacaacgggccaaaacctcttaat

SEQ ID NO: 798032 - DNA, 25 bp, Mus musculus
tcacaacgggcctaaacctcttaat

SEQ ID NO: 798033 - DNA, 25 bp, Mus musculus
tcacaacgtaaaaagcctggagggc

SEQ ID NO: 798034 - DNA, 25 bp, Mus musculus
tcacaacgtaaatagcctggagggc

SEQ ID NO: 798035 - DNA, 25 bp, Mus musculus
tcacaactgagtcaccctgggctca

SEQ ID NO: 798036 - DNA, 25 bp, Mus musculus
tcacaactgagtgaccctgggctca

SEQ ID NO: 798037 - DNA, 25 bp, Mus musculus
tcacaacttcttactttttcttcca

SEQ ID NO: 798038 - DNA, 25 bp, Mus musculus
tcacaacttctttctttttcttcca

SEQ ID NO: 798039 - DNA, 25 bp, Mus musculus
tcacaacttgcccagacttccagag

SEQ ID NO: 798040 - DNA, 25 bp, Mus musculus
tcacaacttgccgagacttccagag

SEQ ID NO: 798041 - DNA, 25 bp, Mus musculus
tcacaacttggcatccattcccttt

SEQ ID NO: 798042 - DNA, 25 bp, Mus musculus
tcacaacttggcttccattcccttt

SEQ ID NO: 798043 - DNA, 25 bp, Mus musculus
tcacaacttttgcaccagacctgga

SEQ ID NO: 798044 - DNA, 25 bp, Mus musculus
tcacaacttttggaccagacctgga

SEQ ID NO: 798045 - DNA, 25 bp, Mus musculus
tcacaagaacttcaaggcggctggt

SEQ ID NO: 798046 - DNA, 25 bp, Mus musculus
tcacaagaacttgaaggcggctggt

SEQ ID NO: 798047 - DNA, 25 bp, Mus musculus
tcacaagacaagaggcattctggga

SEQ ID NO: 798048 - DNA, 25 bp, Mus musculus
tcacaagacaagtggcattctggga

SEQ ID NO: 798049 - DNA, 25 bp, Mus musculus
tcacaagacagacgtgctttgtaag

SEQ ID NO: 798050 - DNA, 25 bp, Mus musculus
tcacaagacagaggtgctttgtaag

SEQ ID NO: 798051 - DNA, 25 bp, Mus musculus
tcacaagagcaccacagagtccaag

SEQ ID NO: 798052 - DNA, 25 bp, Mus musculus
tcacaagagcacgacagagtccaag

SEQ ID NO: 798053 - DNA, 25 bp, Mus musculus
tcacaagagcatactagtctagcat

SEQ ID NO: 798054 - DNA, 25 bp, Mus musculus
tcacaagagcattctagtctagcat

SEQ ID NO: 798055 - DNA, 25 bp, Mus musculus
tcacaagagcctagtgaacctggct

SEQ ID NO: 798056 - DNA, 25 bp, Mus musculus
tcacaagagccttgtgaacctggct

SEQ ID NO: 798057 - DNA, 25 bp, Mus musculus
tcacaagagtagacatcctttctgc

SEQ ID NO: 798058 - DNA, 25 bp, Mus musculus
tcacaagagtagtcatcctttctgc

SEQ ID NO: 798059 - DNA, 25 bp, Mus musculus
tcacaagcacctactgcatggttat

SEQ ID NO: 798060 - DNA, 25 bp, Mus musculus
tcacaagcaccttctgcatggttat

SEQ ID NO: 798061 - DNA, 25 bp, Mus musculus
tcacaagcactacacattcctggag

SEQ ID NO: 798062 - DNA, 25 bp, Mus musculus
tcacaagcactagacattcctggag

SEQ ID NO: 798063 - DNA, 25 bp, Mus musculus
tcacaagcactcaggacgacgatgt

SEQ ID NO: 798064 - DNA, 25 bp, Mus musculus
tcacaagcactctggacgacgatgt

SEQ ID NO: 798065 - DNA, 25 bp, Mus musculus
tcacaaggaagcagggtctttaccc

SEQ ID NO: 798066 - DNA, 25 bp, Mus musculus
tcacaaggaagctgggtctttaccc

SEQ ID NO: 798067 - DNA, 25 bp, Mus musculus
tcacaaggacccagaatttacatgg

SEQ ID NO: 798068 - DNA, 25 bp, Mus musculus
tcacaaggaccctgaatttacatgg

SEQ ID NO: 798069 - DNA, 25 bp, Mus musculus
tcacaaggacttaactgggcagaga

SEQ ID NO: 798070 - DNA, 25 bp, Mus musculus
tcacaaggactttactgggcagaga

SEQ ID NO: 798071 - DNA, 25 bp, Mus musculus
tcacaaggctacatctgctaccaca

SEQ ID NO: 798072 - DNA, 25 bp, Mus musculus
tcacaaggctacttctgctaccaca

SEQ ID NO: 798073 - DNA, 25 bp, Mus musculus
tcacaagggaggatctgcatacaga

SEQ ID NO: 798074 - DNA, 25 bp, Mus musculus
tcacaagggaggttctgcatacaga

SEQ ID NO: 798075 - DNA, 25 bp, Mus musculus
tcacaaggtgctcatcccagatgtt

SEQ ID NO: 798076 - DNA, 25 bp, Mus musculus
tcacaaggtgctgatcccagatgtt

SEQ ID NO: 798077 - DNA, 25 bp, Mus musculus
tcacaaggttttctttctccccaat

SEQ ID NO: 798078 - DNA, 25 bp, Mus musculus
tcacaaggttttgtttctccccaat

SEQ ID NO: 798079 - DNA, 25 bp, Mus musculus
tcacaagtatgcatgaccatttgta

SEQ ID NO: 798080 - DNA, 25 bp, Mus musculus
tcacaagtatgcttgaccatttgta

SEQ ID NO: 798081 - DNA, 25 bp, Mus musculus
tcacaagtctgcctttcacctgtgt

SEQ ID NO: 798082 - DNA, 25 bp, Mus musculus
tcacaagtctgcgtttcacctgtgt

SEQ ID NO: 798083 - DNA, 25 bp, Mus musculus
tcacaagttaccctttccggcaaag

SEQ ID NO: 798084 - DNA, 25 bp, Mus musculus
tcacaagttaccgtttccggcaaag

SEQ ID NO: 798085 - DNA, 25 bp, Mus musculus
tcacaatactctatagcacacacac

SEQ ID NO: 798086 - DNA, 25 bp, Mus musculus
tcacaatactctttagcacacacac

SEQ ID NO: 798087 - DNA, 25 bp, Mus musculus
tcacaatagcatctgtctaatccca

SEQ ID NO: 798088 - DNA, 25 bp, Mus musculus
tcacaatagcatgtgtctaatccca

SEQ ID NO: 798089 - DNA, 25 bp, Mus musculus
tcacaatcatgcagccgtccaggtg

SEQ ID NO: 798090 - DNA, 25 bp, Mus musculus
tcacaatcatgctgccgtccaggtg

SEQ ID NO: 798091 - DNA, 25 bp, Mus musculus
tcacaatccatcagtctggccagac

SEQ ID NO: 798092 - DNA, 25 bp, Mus musculus
tcacaatccatctgtctggccagac

SEQ ID NO: 798093 - DNA, 25 bp, Mus musculus
tcacaatccttgactgtggatgcgt

SEQ ID NO: 798094 - DNA, 25 bp, Mus musculus
tcacaatccttgtctgtggatgcgt

SEQ ID NO: 798095 - DNA, 25 bp, Mus musculus
tcacaatctcctctaactctaaata

SEQ ID NO: 798096 - DNA, 25 bp, Mus musculus
tcacaatctcctgtaactctaaata

SEQ ID NO: 798097 - DNA, 25 bp, Mus musculus
tcacaatgaaatccaccctctctgt

SEQ ID NO: 798098 - DNA, 25 bp, Mus musculus
tcacaatgaaatgcaccctctctgt

SEQ ID NO: 798099 - DNA, 25 bp, Mus musculus
tcacaatgatggctcctgtggagtc

SEQ ID NO: 798100 - DNA, 25 bp, Mus musculus
tcacaatgatgggtcctgtggagtc

SEQ ID NO: 798101 - DNA, 25 bp, Mus musculus
tcacaatgtactattgctgccttct

SEQ ID NO: 798102 - DNA, 25 bp, Mus musculus
tcacaatgtacttttgctgccttct

SEQ ID NO: 798103 - DNA, 25 bp, Mus musculus
tcacaatttacaactcagctggaag

SEQ ID NO: 798104 - DNA, 25 bp, Mus musculus
tcacaatttacatctcagctggaag

SEQ ID NO: 798105 - DNA, 25 bp, Mus musculus
tcacaattttccaacccaaccttga

SEQ ID NO: 798106 - DNA, 25 bp, Mus musculus
tcacaattttcctacccaaccttga

SEQ ID NO: 798107 - DNA, 25 bp, Mus musculus
tcacacaaagagagcccgtcgggtg

SEQ ID NO: 798108 - DNA, 25 bp, Mus musculus
tcacacaaagagtgcccgtcgggtg

SEQ ID NO: 798109 - DNA, 25 bp, Mus musculus
tcacacaaatgtacccttactccag

SEQ ID NO: 798110 - DNA, 25 bp, Mus musculus
tcacacaaatgttcccttactccag

SEQ ID NO: 798111 - DNA, 25 bp, Mus musculus
tcacacaacctaaagtctcctggga

SEQ ID NO: 798112 - DNA, 25 bp, Mus musculus
tcacacaacctatagtctcctggga

SEQ ID NO: 798113 - DNA, 25 bp, Mus musculus
tcacacaaggtgcatgacgccagag

SEQ ID NO: 798114 - DNA, 25 bp, Mus musculus
tcacacaaggtggatgacgccagag

SEQ ID NO: 798115 - DNA, 25 bp, Mus musculus
tcacacacacatcacaagcaaactt

SEQ ID NO: 798116 - DNA, 25 bp, Mus musculus
tcacacacacatgacaagcaaactt

SEQ ID NO: 798117 - DNA, 25 bp, Mus musculus
tcacacacacttacttcaatccaga

SEQ ID NO: 798118 - DNA, 25 bp, Mus musculus
tcacacacactttcttcaatccaga

SEQ ID NO: 798119 - DNA, 25 bp, Mus musculus
tcacacacagtgacaggattcccag

SEQ ID NO: 798120 - DNA, 25 bp, Mus musculus
tcacacacagtgtcaggattcccag

SEQ ID NO: 798121 - DNA, 25 bp, Mus musculus
tcacacacatgtaccttcagtcaga

SEQ ID NO: 798122 - DNA, 25 bp, Mus musculus
tcacacacatgttccttcagtcaga

SEQ ID NO: 798123 - DNA, 25 bp, Mus musculus
tcacacaccaaaatcagatcatgaa

SEQ ID NO: 798124 - DNA, 25 bp, Mus musculus
tcacacaccaaattcagatcatgaa

SEQ ID NO: 798125 - DNA, 25 bp, Mus musculus
tcacacaccaggacaatgcaaagga

SEQ ID NO: 798126 - DNA, 25 bp, Mus musculus
tcacacaccaggtcaatgcaaagga

SEQ ID NO: 798127 - DNA, 25 bp, Mus musculus
tcacacaccattctagctacacagt

SEQ ID NO: 798128 - DNA, 25 bp, Mus musculus
tcacacaccattgtagctacacagt

SEQ ID NO: 798129 - DNA, 25 bp, Mus musculus
tcacacaccggacctctgggagatt

SEQ ID NO: 798130 - DNA, 25 bp, Mus musculus
tcacacaccggagctctgggagatt

SEQ ID NO: 798131 - DNA, 25 bp, Mus musculus
tcacacacctttagaagcgcatcga

SEQ ID NO: 798132 - DNA, 25 bp, Mus musculus
tcacacaccttttgaagcgcatcga

SEQ ID NO: 798133 - DNA, 25 bp, Mus musculus
tcacacactattacccacatgtata

SEQ ID NO: 798134 - DNA, 25 bp, Mus musculus
tcacacactatttcccacatgtata

SEQ ID NO: 798135 - DNA, 25 bp, Mus musculus
tcacacactgccaaatgcttagctt

SEQ ID NO: 798136 - DNA, 25 bp, Mus musculus
tcacacactgcctaatgcttagctt

SEQ ID NO: 798137 - DNA, 25 bp, Mus musculus
tcacacactgtgctgttaactcaag

SEQ ID NO: 798138 - DNA, 25 bp, Mus musculus
tcacacactgtggtgttaactcaag

SEQ ID NO: 798139 - DNA, 25 bp, Mus musculus
tcacacacttacatgcctttaattc

SEQ ID NO: 798140 - DNA, 25 bp, Mus musculus
tcacacacttacttgcctttaattc

SEQ ID NO: 798141 - DNA, 25 bp, Mus musculus
tcacacacttgtattctcatgagag

SEQ ID NO: 798142 - DNA, 25 bp, Mus musculus
tcacacacttgttttctcatgagag

SEQ ID NO: 798143 - DNA, 25 bp, Mus musculus
tcacacagaaacatccttcaattgt

SEQ ID NO: 798144 - DNA, 25 bp, Mus musculus
tcacacagaaacttccttcaattgt

SEQ ID NO: 798145 - DNA, 25 bp, Mus musculus
tcacacagacagagcaccccaagaa

SEQ ID NO: 798146 - DNA, 25 bp, Mus musculus
tcacacagacagtgcaccccaagaa

SEQ ID NO: 798147 - DNA, 25 bp, Mus musculus
tcacacagcaagcaaatccccagat

SEQ ID NO: 798148 - DNA, 25 bp, Mus musculus
tcacacagcaaggaaatccccagat

SEQ ID NO: 798149 - DNA, 25 bp, Mus musculus
tcacacagcagtccttggagaaggt

SEQ ID NO: 798150 - DNA, 25 bp, Mus musculus
tcacacagcagtgcttggagaaggt

SEQ ID NO: 798151 - DNA, 25 bp, Mus musculus
tcacacagccagcactcgagagcat

SEQ ID NO: 798152 - DNA, 25 bp, Mus musculus
tcacacagccaggactcgagagcat

SEQ ID NO: 798153 - DNA, 25 bp, Mus musculus
tcacacagctggaggcacctggatg

SEQ ID NO: 798154 - DNA, 25 bp, Mus musculus
tcacacagctggtggcacctggatg

SEQ ID NO: 798155 - DNA, 25 bp, Mus musculus
tcacacaggctgatgagaggatgaa

SEQ ID NO: 798156 - DNA, 25 bp, Mus musculus
tcacacaggctgttgagaggatgaa

SEQ ID NO: 798157 - DNA, 25 bp, Mus musculus
tcacacaggttaattggtgccaccc

SEQ ID NO: 798158 - DNA, 25 bp, Mus musculus
tcacacaggttatttggtgccaccc

SEQ ID NO: 798159 - DNA, 25 bp, Mus musculus
tcacacagtcgtcatgaccttcaga

SEQ ID NO: 798160 - DNA, 25 bp, Mus musculus
tcacacagtcgtgatgaccttcaga

SEQ ID NO: 798161 - DNA, 25 bp, Mus musculus
tcacacagtgtgatattttaccaaa

SEQ ID NO: 798162 - DNA, 25 bp, Mus musculus
tcacacagtgtgttattttaccaaa

SEQ ID NO: 798163 - DNA, 25 bp, Mus musculus
tcacacataagcagaagccccctga

SEQ ID NO: 798164 - DNA, 25 bp, Mus musculus
tcacacataagctgaagccccctga

SEQ ID NO: 798165 - DNA, 25 bp, Mus musculus
tcacacatactacggtttctctgca

SEQ ID NO: 798166 - DNA, 25 bp, Mus musculus
tcacacatactagggtttctctgca

SEQ ID NO: 798167 - DNA, 25 bp, Mus musculus
tcacacatagagatcctggcctcag

SEQ ID NO: 798168 - DNA, 25 bp, Mus musculus
tcacacatagagttcctggcctcag

SEQ ID NO: 798169 - DNA, 25 bp, Mus musculus
tcacacatatttcccatctccaagg

SEQ ID NO: 798170 - DNA, 25 bp, Mus musculus
tcacacatatttgccatctccaagg

SEQ ID NO: 798171 - DNA, 25 bp, Mus musculus
tcacacatgatcatctgagctacaa

SEQ ID NO: 798172 - DNA, 25 bp, Mus musculus
tcacacatgatcttctgagctacaa

SEQ ID NO: 798173 - DNA, 25 bp, Mus musculus
tcacacattcagctggtaaataatt

SEQ ID NO: 798174 - DNA, 25 bp, Mus musculus
tcacacattcaggtggtaaataatt

SEQ ID NO: 798175 - DNA, 25 bp, Mus musculus
tcacaccaaaccaagggaagaagag

SEQ ID NO: 798176 - DNA, 25 bp, Mus musculus
tcacaccaaacctagggaagaagag

SEQ ID NO: 798177 - DNA, 25 bp, Mus musculus
tcacaccaacacagagctgctaaat

SEQ ID NO: 798178 - DNA, 25 bp, Mus musculus
tcacaccaacactgagctgctaaat

SEQ ID NO: 798179 - DNA, 25 bp, Mus musculus
tcacaccaacagagcccgtagcatt

SEQ ID NO: 798180 - DNA, 25 bp, Mus musculus
tcacaccaacagtgcccgtagcatt

SEQ ID NO: 798181 - DNA, 25 bp, Mus musculus
tcacaccaagccatcagcaaagaat

SEQ ID NO: 798182 - DNA, 25 bp, Mus musculus
tcacaccaagccttcagcaaagaat

SEQ ID NO: 798183 - DNA, 25 bp, Mus musculus
tcacaccacataaatcattgctttg

SEQ ID NO: 798184 - DNA, 25 bp, Mus musculus
tcacaccacatatatcattgctttg

SEQ ID NO: 798185 - DNA, 25 bp, Mus musculus
tcacaccacctcaagttggatctgt

SEQ ID NO: 798186 - DNA, 25 bp, Mus musculus
tcacaccacctctagttggatctgt

SEQ ID NO: 798187 - DNA, 25 bp, Mus musculus
tcacaccactgtcactatgcataag

SEQ ID NO: 798188 - DNA, 25 bp, Mus musculus
tcacaccactgtgactatgcataag

SEQ ID NO: 798189 - DNA, 25 bp, Mus musculus
tcacaccagagacccttttttagag

SEQ ID NO: 798190 - DNA, 25 bp, Mus musculus
tcacaccagagagccttttttagag

SEQ ID NO: 798191 - DNA, 25 bp, Mus musculus
tcacaccagtggcttgcaagagcac

SEQ ID NO: 798192 - DNA, 25 bp, Mus musculus
tcacaccagtgggttgcaagagcac

SEQ ID NO: 798193 - DNA, 25 bp, Mus musculus
tcacaccatgtgagacagtggcccc

SEQ ID NO: 798194 - DNA, 25 bp, Mus musculus
tcacaccatgtgtgacagtggcccc

SEQ ID NO: 798195 - DNA, 25 bp, Mus musculus
tcacacccaccaattaccaaagaga

SEQ ID NO: 798196 - DNA, 25 bp, Mus musculus
tcacacccaccatttaccaaagaga

SEQ ID NO: 798197 - DNA, 25 bp, Mus musculus
tcacacccaccccttactgttttat

SEQ ID NO: 798198 - DNA, 25 bp, Mus musculus
tcacacccacccgttactgttttat

SEQ ID NO: 798199 - DNA, 25 bp, Mus musculus
tcacacccagaacagcacggagtaa

SEQ ID NO: 798200 - DNA, 25 bp, Mus musculus
tcacacccagaagagcacggagtaa

SEQ ID NO: 798201 - DNA, 25 bp, Mus musculus
tcacacccagtccttcattataagt

SEQ ID NO: 798202 - DNA, 25 bp, Mus musculus
tcacacccagtcgttcattataagt

SEQ ID NO: 798203 - DNA, 25 bp, Mus musculus
tcacacccataaatcctgtacttgg

SEQ ID NO: 798204 - DNA, 25 bp, Mus musculus
tcacacccataattcctgtacttgg

SEQ ID NO: 798205 - DNA, 25 bp, Mus musculus
tcacacccatcccagagttatgtta

SEQ ID NO: 798206 - DNA, 25 bp, Mus musculus
tcacacccatccgagagttatgtta

SEQ ID NO: 798207 - DNA, 25 bp, Mus musculus
tcacaccccgggagattgctgaggt

SEQ ID NO: 798208 - DNA, 25 bp, Mus musculus
tcacaccccgggtgattgctgaggt

SEQ ID NO: 798209 - DNA, 25 bp, Mus musculus
tcacacccctcgacttggaaaggaa

SEQ ID NO: 798210 - DNA, 25 bp, Mus musculus
tcacacccctcgtcttggaaaggaa

SEQ ID NO: 798211 - DNA, 25 bp, Mus musculus
tcacacccggctctaggcagctgga

SEQ ID NO: 798212 - DNA, 25 bp, Mus musculus
tcacacccggctgtaggcagctgga

SEQ ID NO: 798213 - DNA, 25 bp, Mus musculus
tcacaccctaggctctctgggagag

SEQ ID NO: 798214 - DNA, 25 bp, Mus musculus
tcacaccctagggtctctgggagag

SEQ ID NO: 798215 - DNA, 25 bp, Mus musculus
tcacaccgagttccacatacgaaga

SEQ ID NO: 798216 - DNA, 25 bp, Mus musculus
tcacaccgagttgcacatacgaaga

SEQ ID NO: 798217 - DNA, 25 bp, Mus musculus
tcacaccgcctgcttcgaaaggaaa

SEQ ID NO: 798218 - DNA, 25 bp, Mus musculus
tcacaccgcctggttcgaaaggaaa

SEQ ID NO: 798219 - DNA, 25 bp, Mus musculus
tcacaccgctacaacctacaaaaaa

SEQ ID NO: 798220 - DNA, 25 bp, Mus musculus
tcacaccgctactacctacaaaaaa

SEQ ID NO: 798221 - DNA, 25 bp, Mus musculus
tcacaccgctgcaggctgtttgagg

SEQ ID NO: 798222 - DNA, 25 bp, Mus musculus
tcacaccgctgctggctgtttgagg

SEQ ID NO: 798223 - DNA, 25 bp, Mus musculus
tcacaccggccaaaatcactggcaa

SEQ ID NO: 798224 - DNA, 25 bp, Mus musculus
tcacaccggccataatcactggcaa

SEQ ID NO: 798225 - DNA, 25 bp, Mus musculus
tcacaccggcccaatgtggagttgt

SEQ ID NO: 798226 - DNA, 25 bp, Mus musculus
tcacaccggccctatgtggagttgt

SEQ ID NO: 798227 - DNA, 25 bp, Mus musculus
tcacacctagcacagaaatccaaga

SEQ ID NO: 798228 - DNA, 25 bp, Mus musculus
tcacacctagcagagaaatccaaga

SEQ ID NO: 798229 - DNA, 25 bp, Mus musculus
tcacacctcagtaaaccaaatctag

SEQ ID NO: 798230 - DNA, 25 bp, Mus musculus
tcacacctcagttaaccaaatctag

SEQ ID NO: 798231 - DNA, 25 bp, Mus musculus
tcacacctcatgaatatagcctgaa

SEQ ID NO: 798232 - DNA, 25 bp, Mus musculus
tcacacctcatgtatatagcctgaa

SEQ ID NO: 798233 - DNA, 25 bp, Mus musculus
tcacacctccttagatgtaatgaag

SEQ ID NO: 798234 - DNA, 25 bp, Mus musculus
tcacacctcctttgatgtaatgaag

SEQ ID NO: 798235 - DNA, 25 bp, Mus musculus
tcacacctctaaacgaagcactgca

SEQ ID NO: 798236 - DNA, 25 bp, Mus musculus
tcacacctctaatcgaagcactgca

SEQ ID NO: 798237 - DNA, 25 bp, Mus musculus
tcacacctctgacttgtggcacaga

SEQ ID NO: 798238 - DNA, 25 bp, Mus musculus
tcacacctctgagttgtggcacaga

SEQ ID NO: 798239 - DNA, 25 bp, Mus musculus
tcacacctgactcacacagttgtta

SEQ ID NO: 798240 - DNA, 25 bp, Mus musculus
tcacacctgactgacacagttgtta

SEQ ID NO: 798241 - DNA, 25 bp, Mus musculus
tcacacctgatcatgtcctttgaag

SEQ ID NO: 798242 - DNA, 25 bp, Mus musculus
tcacacctgatcttgtcctttgaag

SEQ ID NO: 798243 - DNA, 25 bp, Mus musculus
tcacacctgctcattcctggggtga

SEQ ID NO: 798244 - DNA, 25 bp, Mus musculus
tcacacctgctctttcctggggtga

SEQ ID NO: 798245 - DNA, 25 bp, Mus musculus
tcacacctgtgacactttcctaatt

SEQ ID NO: 798246 - DNA, 25 bp, Mus musculus
tcacacctgtgaccaccaattttag

SEQ ID NO: 798247 - DNA, 25 bp, Mus musculus
tcacacctgtgagactttcctaatt

SEQ ID NO: 798248 - DNA, 25 bp, Mus musculus
tcacacctgtgagcaccaattttag

SEQ ID NO: 798249 - DNA, 25 bp, Mus musculus
tcacaccttccaaagacgggcaagt

SEQ ID NO: 798250 - DNA, 25 bp, Mus musculus
tcacaccttccatagacgggcaagt

SEQ ID NO: 798251 - DNA, 25 bp, Mus musculus
tcacaccttcttagatcaccaggat

SEQ ID NO: 798252 - DNA, 25 bp, Mus musculus
tcacaccttctttgatcaccaggat

SEQ ID NO: 798253 - DNA, 25 bp, Mus musculus
tcacaccttgacatgcttttccaag

SEQ ID NO: 798254 - DNA, 25 bp, Mus musculus
tcacaccttgacttgcttttccaag

SEQ ID NO: 798255 - DNA, 25 bp, Mus musculus
tcacacgacttgcaaccttttgtcc

SEQ ID NO: 798256 - DNA, 25 bp, Mus musculus
tcacacgacttggaaccttttgtcc

SEQ ID NO: 798257 - DNA, 25 bp, Mus musculus
tcacacgaggtaccccattttcaag

SEQ ID NO: 798258 - DNA, 25 bp, Mus musculus
tcacacgaggtagcccattttcaag

SEQ ID NO: 798259 - DNA, 25 bp, Mus musculus
tcacacgagtacaggccctgaggaa

SEQ ID NO: 798260 - DNA, 25 bp, Mus musculus
tcacacgagtactggccctgaggaa

SEQ ID NO: 798261 - DNA, 25 bp, Mus musculus
tcacacgatcctctttgcacagaag

SEQ ID NO: 798262 - DNA, 25 bp, Mus musculus
tcacacgatcctgtttgcacagaag

SEQ ID NO: 798263 - DNA, 25 bp, Mus musculus
tcacacgatgggaagcacagtcagc

SEQ ID NO: 798264 - DNA, 25 bp, Mus musculus
tcacacgatgggtagcacagtcagc

SEQ ID NO: 798265 - DNA, 25 bp, Mus musculus
tcacacgcactgcaaatgctaagcg

SEQ ID NO: 798266 - DNA, 25 bp, Mus musculus
tcacacgcactggaaatgctaagcg

SEQ ID NO: 798267 - DNA, 25 bp, Mus musculus
tcacacgcttcgagggtacaagtcc

SEQ ID NO: 798268 - DNA, 25 bp, Mus musculus
tcacacgcttcgtgggtacaagtcc

SEQ ID NO: 798269 - DNA, 25 bp, Mus musculus
tcacacggcggaacctggctgactg

SEQ ID NO: 798270 - DNA, 25 bp, Mus musculus
tcacacggcggatcctggctgactg

SEQ ID NO: 798271 - DNA, 25 bp, Mus musculus
tcacacgggacactaggactaggct

SEQ ID NO: 798272 - DNA, 25 bp, Mus musculus
tcacacgggacagtaggactaggct

SEQ ID NO: 798273 - DNA, 25 bp, Mus musculus
tcacacggtaagatgtccaagttgt

SEQ ID NO: 798274 - DNA, 25 bp, Mus musculus
tcacacggtaagttgtccaagttgt

SEQ ID NO: 798275 - DNA, 25 bp, Mus musculus
tcacacgtgcacagatcgaggactc

SEQ ID NO: 798276 - DNA, 25 bp, Mus musculus
tcacacgtgcactgatcgaggactc

SEQ ID NO: 798277 - DNA, 25 bp, Mus musculus
tcacacgtgtcacactgtttggagg

SEQ ID NO: 798278 - DNA, 25 bp, Mus musculus
tcacacgtgtcagactgtttggagg

SEQ ID NO: 798279 - DNA, 25 bp, Mus musculus
tcacactaaaagaagacccaggcaa

SEQ ID NO: 798280 - DNA, 25 bp, Mus musculus
tcacactaaaagtagacccaggcaa

SEQ ID NO: 798281 - DNA, 25 bp, Mus musculus
tcacactaagtccagagccgcagag

SEQ ID NO: 798282 - DNA, 25 bp, Mus musculus
tcacactaagtcgagagccgcagag

SEQ ID NO: 798283 - DNA, 25 bp, Mus musculus
tcacactacactactcacagagagg

SEQ ID NO: 798284 - DNA, 25 bp, Mus musculus
tcacactacacttctcacagagagg

SEQ ID NO: 798285 - DNA, 25 bp, Mus musculus
tcacactagtcaagttccagagcct

SEQ ID NO: 798286 - DNA, 25 bp, Mus musculus
tcacactagtcatgttccagagcct

SEQ ID NO: 798287 - DNA, 25 bp, Mus musculus
tcacactcagatcctgcacattttg

SEQ ID NO: 798288 - DNA, 25 bp, Mus musculus
tcacactcagatgctgcacattttg

SEQ ID NO: 798289 - DNA, 25 bp, Mus musculus
tcacactcagtgactttgggtatgt

SEQ ID NO: 798290 - DNA, 25 bp, Mus musculus
tcacactcagtgtctttgggtatgt

SEQ ID NO: 798291 - DNA, 25 bp, Mus musculus
tcacactcatggacagtgctgcttt

SEQ ID NO: 798292 - DNA, 25 bp, Mus musculus
tcacactcatggtcagtgctgcttt

SEQ ID NO: 798293 - DNA, 25 bp, Mus musculus
tcacactcattaccgcatcagtttc

SEQ ID NO: 798294 - DNA, 25 bp, Mus musculus
tcacactcattagcgcatcagtttc

SEQ ID NO: 798295 - DNA, 25 bp, Mus musculus
tcacactccgctattacttgctgtt

SEQ ID NO: 798296 - DNA, 25 bp, Mus musculus
tcacactccgcttttacttgctgtt

SEQ ID NO: 798297 - DNA, 25 bp, Mus musculus
tcacactcctttctctaggaaccaa

SEQ ID NO: 798298 - DNA, 25 bp, Mus musculus
tcacactcctttgtctaggaaccaa

SEQ ID NO: 798299 - DNA, 25 bp, Mus musculus
tcacactcgctgcacagttaggtgt

SEQ ID NO: 798300 - DNA, 25 bp, Mus musculus
tcacactcgctggacagttaggtgt

SEQ ID NO: 798301 - DNA, 25 bp, Mus musculus
tcacactctcagcactaaggtttgg

SEQ ID NO: 798302 - DNA, 25 bp, Mus musculus
tcacactctcaggactaaggtttgg

SEQ ID NO: 798303 - DNA, 25 bp, Mus musculus
tcacactctgcacccttctaaagaa

SEQ ID NO: 798304 - DNA, 25 bp, Mus musculus
tcacactctgcagccttctaaagaa

SEQ ID NO: 798305 - DNA, 25 bp, Mus musculus
tcacactgaagaccagccctgagag

SEQ ID NO: 798306 - DNA, 25 bp, Mus musculus
tcacactgaagagcagccctgagag

SEQ ID NO: 798307 - DNA, 25 bp, Mus musculus
tcacactgaggtatctggttctgtt

SEQ ID NO: 798308 - DNA, 25 bp, Mus musculus
tcacactgaggtttctggttctgtt

SEQ ID NO: 798309 - DNA, 25 bp, Mus musculus
tcacactgcaggagccacagaggtt

SEQ ID NO: 798310 - DNA, 25 bp, Mus musculus
tcacactgcaggtgccacagaggtt

SEQ ID NO: 798311 - DNA, 25 bp, Mus musculus
tcacactgcatgataatctgctaaa

SEQ ID NO: 798312 - DNA, 25 bp, Mus musculus
tcacactgcatgttaatctgctaaa

SEQ ID NO: 798313 - DNA, 25 bp, Mus musculus
tcacactgtaccctgaggtccaaat

SEQ ID NO: 798314 - DNA, 25 bp, Mus musculus
tcacactgtaccgtgaggtccaaat

SEQ ID NO: 798315 - DNA, 25 bp, Mus musculus
tcacactgtcagcattctagaactt

SEQ ID NO: 798316 - DNA, 25 bp, Mus musculus
tcacactgtcaggattctagaactt

SEQ ID NO: 798317 - DNA, 25 bp, Mus musculus
tcacactgtgatcgactggctgagg

SEQ ID NO: 798318 - DNA, 25 bp, Mus musculus
tcacactgtgatggactggctgagg

SEQ ID NO: 798319 - DNA, 25 bp, Mus musculus
tcacactgtgtcaaggtcccaatca

SEQ ID NO: 798320 - DNA, 25 bp, Mus musculus
tcacactgtgtctaggtcccaatca

SEQ ID NO: 798321 - DNA, 25 bp, Mus musculus
tcacacttacctccaacttgagacg

SEQ ID NO: 798322 - DNA, 25 bp, Mus musculus
tcacacttacctgcaacttgagacg

SEQ ID NO: 798323 - DNA, 25 bp, Mus musculus
tcacacttacttagcactttatttt

SEQ ID NO: 798324 - DNA, 25 bp, Mus musculus
tcacacttactttgcactttatttt

SEQ ID NO: 798325 - DNA, 25 bp, Mus musculus
tcacacttcagcatttgtaacatgg

SEQ ID NO: 798326 - DNA, 25 bp, Mus musculus
tcacacttcagcttttgtaacatgg

SEQ ID NO: 798327 - DNA, 25 bp, Mus musculus
tcacacttccgcattaaggctgagt

SEQ ID NO: 798328 - DNA, 25 bp, Mus musculus
tcacacttccgctttaaggctgagt

SEQ ID NO: 798329 - DNA, 25 bp, Mus musculus
tcacacttgaccaaggtgcttttcc

SEQ ID NO: 798330 - DNA, 25 bp, Mus musculus
tcacacttgacctaggtgcttttcc

SEQ ID NO: 798331 - DNA, 25 bp, Mus musculus
tcacacttgactacaatggcaatta

SEQ ID NO: 798332 - DNA, 25 bp, Mus musculus
tcacacttgactctaactccatggc

SEQ ID NO: 798333 - DNA, 25 bp, Mus musculus
tcacacttgactgtaactccatggc

SEQ ID NO: 798334 - DNA, 25 bp, Mus musculus
tcacacttgacttcaatggcaatta

SEQ ID NO: 798335 - DNA, 25 bp, Mus musculus
tcacacttgcacatgaagataaaac

SEQ ID NO: 798336 - DNA, 25 bp, Mus musculus
tcacacttgcacttgaagataaaac

SEQ ID NO: 798337 - DNA, 25 bp, Mus musculus
tcacacttgggcagataacacttgt

SEQ ID NO: 798338 - DNA, 25 bp, Mus musculus
tcacacttgggctgataacacttgt

SEQ ID NO: 798339 - DNA, 25 bp, Mus musculus
tcacactttgggaacctgaaacaga

SEQ ID NO: 798340 - DNA, 25 bp, Mus musculus
tcacactttgggtacctgaaacaga

SEQ ID NO: 798341 - DNA, 25 bp, Mus musculus
tcacacttttcaaactcatgcacac

SEQ ID NO: 798342 - DNA, 25 bp, Mus musculus
tcacacttttcatactcatgcacac

SEQ ID NO: 798343 - DNA, 25 bp, Mus musculus
tcacagaaaagcctgatgggcatag

SEQ ID NO: 798344 - DNA, 25 bp, Mus musculus
tcacagaaaagcgtgatgggcatag

SEQ ID NO: 798345 - DNA, 25 bp, Mus musculus
tcacagaaaagtccggatttccgtc

SEQ ID NO: 798346 - DNA, 25 bp, Mus musculus
tcacagaaaagtgcggatttccgtc

SEQ ID NO: 798347 - DNA, 25 bp, Mus musculus
tcacagaaagccaggtatgagggaa

SEQ ID NO: 798348 - DNA, 25 bp, Mus musculus
tcacagaaagcctggtatgagggaa

SEQ ID NO: 798349 - DNA, 25 bp, Mus musculus
tcacagaacacacaagacctagcag

SEQ ID NO: 798350 - DNA, 25 bp, Mus musculus
tcacagaacacagaagacctagcag

SEQ ID NO: 798351 - DNA, 25 bp, Mus musculus
tcacagaacagacactttgagtatt

SEQ ID NO: 798352 - DNA, 25 bp, Mus musculus
tcacagaacagagactttgagtatt

SEQ ID NO: 798353 - DNA, 25 bp, Mus musculus
tcacagaaccctcgagtttctggaa

SEQ ID NO: 798354 - DNA, 25 bp, Mus musculus
tcacagaaccctggagtttctggaa

SEQ ID NO: 798355 - DNA, 25 bp, Mus musculus
tcacagaacttaaggcttagcttct

SEQ ID NO: 798356 - DNA, 25 bp, Mus musculus
tcacagaacttatggcttagcttct

SEQ ID NO: 798357 - DNA, 25 bp, Mus musculus
tcacagaagtgcatctcaccacagg

SEQ ID NO: 798358 - DNA, 25 bp, Mus musculus
tcacagaagtgcttctcaccacagg

SEQ ID NO: 798359 - DNA, 25 bp, Mus musculus
tcacagaccacaactggtgccgaaa

SEQ ID NO: 798360 - DNA, 25 bp, Mus musculus
tcacagaccacatctggtgccgaaa

SEQ ID NO: 798361 - DNA, 25 bp, Mus musculus
tcacagacccggcactgtggatatt

SEQ ID NO: 798362 - DNA, 25 bp, Mus musculus
tcacagacccgggactgtggatatt

SEQ ID NO: 798363 - DNA, 25 bp, Mus musculus
tcacagacctgtagtttagcgctta

SEQ ID NO: 798364 - DNA, 25 bp, Mus musculus
tcacagacctgttgtttagcgctta

SEQ ID NO: 798365 - DNA, 25 bp, Mus musculus
tcacagacggccctggtggtttttg

SEQ ID NO: 798366 - DNA, 25 bp, Mus musculus
tcacagacggccgtggtggtttttg

SEQ ID NO: 798367 - DNA, 25 bp, Mus musculus
tcacagacgtgcatctcattaaatc

SEQ ID NO: 798368 - DNA, 25 bp, Mus musculus
tcacagacgtgcttctcattaaatc

SEQ ID NO: 798369 - DNA, 25 bp, Mus musculus
tcacagactgcaattccgccatgaa

SEQ ID NO: 798370 - DNA, 25 bp, Mus musculus
tcacagactgcatttccgccatgaa

SEQ ID NO: 798371 - DNA, 25 bp, Mus musculus
tcacagactgtaagccccttgtggg

SEQ ID NO: 798372 - DNA, 25 bp, Mus musculus
tcacagactgtatgccccttgtggg

SEQ ID NO: 798373 - DNA, 25 bp, Mus musculus
tcacagactgttcctttgaattcat

SEQ ID NO: 798374 - DNA, 25 bp, Mus musculus
tcacagactgttgctttgaattcat

SEQ ID NO: 798375 - DNA, 25 bp, Mus musculus
tcacagacttgcctgcaaatgagca

SEQ ID NO: 798376 - DNA, 25 bp, Mus musculus
tcacagacttgcgtgcaaatgagca

SEQ ID NO: 798377 - DNA, 25 bp, Mus musculus
tcacagactttgcagcctctcatga

SEQ ID NO: 798378 - DNA, 25 bp, Mus musculus
tcacagactttggagcctctcatga

SEQ ID NO: 798379 - DNA, 25 bp, Mus musculus
tcacagagaagaaggcactgcccag

SEQ ID NO: 798380 - DNA, 25 bp, Mus musculus
tcacagagaagatggcactgcccag

SEQ ID NO: 798381 - DNA, 25 bp, Mus musculus
tcacagagacaactcttcctgcagg

SEQ ID NO: 798382 - DNA, 25 bp, Mus musculus
tcacagagacaagtcttcctgcagg

SEQ ID NO: 798383 - DNA, 25 bp, Mus musculus
tcacagagacccatgaaggtaggtg

SEQ ID NO: 798384 - DNA, 25 bp, Mus musculus
tcacagagacccttgaaggtaggtg

SEQ ID NO: 798385 - DNA, 25 bp, Mus musculus
tcacagagacgcagcttctgggtgg

SEQ ID NO: 798386 - DNA, 25 bp, Mus musculus
tcacagagacgctgcttctgggtgg

SEQ ID NO: 798387 - DNA, 25 bp, Mus musculus
tcacagagagacacgggctcaagga

SEQ ID NO: 798388 - DNA, 25 bp, Mus musculus
tcacagagagactcgggctcaagga

SEQ ID NO: 798389 - DNA, 25 bp, Mus musculus
tcacagagagccatgcatgccacag

SEQ ID NO: 798390 - DNA, 25 bp, Mus musculus
tcacagagagccttgcatgccacag

SEQ ID NO: 798391 - DNA, 25 bp, Mus musculus
tcacagagcactcagttgcctggcc

SEQ ID NO: 798392 - DNA, 25 bp, Mus musculus
tcacagagcactgagttgcctggcc

SEQ ID NO: 798393 - DNA, 25 bp, Mus musculus
tcacagaggccccagtgaaactggg

SEQ ID NO: 798394 - DNA, 25 bp, Mus musculus
tcacagaggcccgagtgaaactggg

SEQ ID NO: 798395 - DNA, 25 bp, Mus musculus
tcacagaggctcaacgctactgggt

SEQ ID NO: 798396 - DNA, 25 bp, Mus musculus
tcacagaggctcatcgctactaggg

SEQ ID NO: 798397 - DNA, 25 bp, Mus musculus
tcacagaggctctacgctactgggt

SEQ ID NO: 798398 - DNA, 25 bp, Mus musculus
tcacagaggctcttcgctactaggg

SEQ ID NO: 798399 - DNA, 25 bp, Mus musculus
tcacagagggctacactgagggctt

SEQ ID NO: 798400 - DNA, 25 bp, Mus musculus
tcacagagggcttcactgagggctt

SEQ ID NO: 798401 - DNA, 25 bp, Mus musculus
tcacagagtgggacttcaacaccat

SEQ ID NO: 798402 - DNA, 25 bp, Mus musculus
tcacagagtgggtcttcaacaccat

SEQ ID NO: 798403 - DNA, 25 bp, Mus musculus
tcacagagttctcgtcactggtcag

SEQ ID NO: 798404 - DNA, 25 bp, Mus musculus
tcacagagttctggtcactggtcag

SEQ ID NO: 798405 - DNA, 25 bp, Mus musculus
tcacagatcaagatcctccttaggg

SEQ ID NO: 798406 - DNA, 25 bp, Mus musculus
tcacagatcaagttcctccttaggg

SEQ ID NO: 798407 - DNA, 25 bp, Mus musculus
tcacagatccagatttgggaaagga

SEQ ID NO: 798408 - DNA, 25 bp, Mus musculus
tcacagatccagttttgggaaagga

SEQ ID NO: 798409 - DNA, 25 bp, Mus musculus
tcacagatcccacaaaacagaggtg

SEQ ID NO: 798410 - DNA, 25 bp, Mus musculus
tcacagatcccagaaaacagaggtg

SEQ ID NO: 798411 - DNA, 25 bp, Mus musculus
tcacagatgcctagagaaattaccc

SEQ ID NO: 798412 - DNA, 25 bp, Mus musculus
tcacagatgccttgagaaattaccc

SEQ ID NO: 798413 - DNA, 25 bp, Mus musculus
tcacagatgctaacagtgccaccca

SEQ ID NO: 798414 - DNA, 25 bp, Mus musculus
tcacagatgctatcagtgccaccca

SEQ ID NO: 798415 - DNA, 25 bp, Mus musculus
tcacagatgctgataaatgttgaac

SEQ ID NO: 798416 - DNA, 25 bp, Mus musculus
tcacagatgctgttaaatgttgaac

SEQ ID NO: 798417 - DNA, 25 bp, Mus musculus
tcacagatggtgaatatggctcagt

SEQ ID NO: 798418 - DNA, 25 bp, Mus musculus
tcacagatggtgacgctgccttgga

SEQ ID NO: 798419 - DNA, 25 bp, Mus musculus
tcacagatggtgtatatggctcagt

SEQ ID NO: 798420 - DNA, 25 bp, Mus musculus
tcacagatggtgtcgctgccttgga

SEQ ID NO: 798421 - DNA, 25 bp, Mus musculus
tcacagcaacccagggcaaagaact

SEQ ID NO: 798422 - DNA, 25 bp, Mus musculus
tcacagcaaccctgggcaaagaact

SEQ ID NO: 798423 - DNA, 25 bp, Mus musculus
tcacagcaattaaagtccagttcca

SEQ ID NO: 798424 - DNA, 25 bp, Mus musculus
tcacagcaattatagtccagttcca

SEQ ID NO: 798425 - DNA, 25 bp, Mus musculus
tcacagcacacacgtgttcacaaaa

SEQ ID NO: 798426 - DNA, 25 bp, Mus musculus
tcacagcacacaggtgttcacaaaa

SEQ ID NO: 798427 - DNA, 25 bp, Mus musculus
tcacagcacagcaggtcgagagtta

SEQ ID NO: 798428 - DNA, 25 bp, Mus musculus
tcacagcacagctggtcgagagtta

SEQ ID NO: 798429 - DNA, 25 bp, Mus musculus
tcacagcacatccaggctggcctgt

SEQ ID NO: 798430 - DNA, 25 bp, Mus musculus
tcacagcacatcgaggctggcctgt

SEQ ID NO: 798431 - DNA, 25 bp, Mus musculus
tcacagcagattacccaaagaaact

SEQ ID NO: 798432 - DNA, 25 bp, Mus musculus
tcacagcagatttcccaaagaaact

SEQ ID NO: 798433 - DNA, 25 bp, Mus musculus
tcacagcagcaaactttctctcttc

SEQ ID NO: 798434 - DNA, 25 bp, Mus musculus
tcacagcagcaatctttctctcttc

SEQ ID NO: 798435 - DNA, 25 bp, Mus musculus
tcacagcagtgcacccttatagaag

SEQ ID NO: 798436 - DNA, 25 bp, Mus musculus
tcacagcagtgctcccttatagaag

SEQ ID NO: 798437 - DNA, 25 bp, Mus musculus
tcacagcatctgaacacaccgggta

SEQ ID NO: 798438 - DNA, 25 bp, Mus musculus
tcacagcatctgaagactcatggca

SEQ ID NO: 798439 - DNA, 25 bp, Mus musculus
tcacagcatctgtacacaccgggta

SEQ ID NO: 798440 - DNA, 25 bp, Mus musculus
tcacagcatctgtagactcatggca

SEQ ID NO: 798441 - DNA, 25 bp, Mus musculus
tcacagccaccaaagagtatgggtt

SEQ ID NO: 798442 - DNA, 25 bp, Mus musculus
tcacagccaccatagagtatgggtt

SEQ ID NO: 798443 - DNA, 25 bp, Mus musculus
tcacagccaggacccagaacaaatc

SEQ ID NO: 798444 - DNA, 25 bp, Mus musculus
tcacagccaggagccagaacaaatc

SEQ ID NO: 798445 - DNA, 25 bp, Mus musculus
tcacagccatagactcacaatcaga

SEQ ID NO: 798446 - DNA, 25 bp, Mus musculus
tcacagccatagtctcacaatcaga

SEQ ID NO: 798447 - DNA, 25 bp, Mus musculus
tcacagccatgaacactggttcagc

SEQ ID NO: 798448 - DNA, 25 bp, Mus musculus
tcacagccatgatcactggttcagc

SEQ ID NO: 798449 - DNA, 25 bp, Mus musculus
tcacagcccgaactgggaacctggg

SEQ ID NO: 798450 - DNA, 25 bp, Mus musculus
tcacagcccgaagtgggaacctggg

SEQ ID NO: 798451 - DNA, 25 bp, Mus musculus
tcacagccctcaccaggactttaag

SEQ ID NO: 798452 - DNA, 25 bp, Mus musculus
tcacagccctcagcaggactttaag

SEQ ID NO: 798453 - DNA, 25 bp, Mus musculus
tcacagccctttactgcaatctgag

SEQ ID NO: 798454 - DNA, 25 bp, Mus musculus
tcacagcccttttctgcaatctgag

SEQ ID NO: 798455 - DNA, 25 bp, Mus musculus
tcacagcctaccctcagaagagtta

SEQ ID NO: 798456 - DNA, 25 bp, Mus musculus
tcacagcctaccgtcagaagagtta

SEQ ID NO: 798457 - DNA, 25 bp, Mus musculus
tcacagcctcaaacccttagggtaa

SEQ ID NO: 798458 - DNA, 25 bp, Mus musculus
tcacagcctcaatcccttagggtaa

SEQ ID NO: 798459 - DNA, 25 bp, Mus musculus
tcacagcctcggcaactaggtgttt

SEQ ID NO: 798460 - DNA, 25 bp, Mus musculus
tcacagcctcgggaactaggtgttt

SEQ ID NO: 798461 - DNA, 25 bp, Mus musculus
tcacagccttaccagttccttgctt

SEQ ID NO: 798462 - DNA, 25 bp, Mus musculus
tcacagccttacgagttccttgctt

SEQ ID NO: 798463 - DNA, 25 bp, Mus musculus
tcacagccttcaatcaaccatttat

SEQ ID NO: 798464 - DNA, 25 bp, Mus musculus
tcacagccttcattcaaccatttat

SEQ ID NO: 798465 - DNA, 25 bp, Mus musculus
tcacagccttttattttcaagccag

SEQ ID NO: 798466 - DNA, 25 bp, Mus musculus
tcacagcctttttttttcaagccag

SEQ ID NO: 798467 - DNA, 25 bp, Mus musculus
tcacagcggccaagtccagacagac

SEQ ID NO: 798468 - DNA, 25 bp, Mus musculus
tcacagcggccatgtccagacagac

SEQ ID NO: 798469 - DNA, 25 bp, Mus musculus
tcacagcgggtcatggtggctcaag

SEQ ID NO: 798470 - DNA, 25 bp, Mus musculus
tcacagcgggtcttggtggctcaag

SEQ ID NO: 798471 - DNA, 25 bp, Mus musculus
tcacagctaaccatttgccccatga

SEQ ID NO: 798472 - DNA, 25 bp, Mus musculus
tcacagctaaccttttgccccatga

SEQ ID NO: 798473 - DNA, 25 bp, Mus musculus
tcacagctacctctggtgggtttct

SEQ ID NO: 798474 - DNA, 25 bp, Mus musculus
tcacagctacctgtggtgggtttct

SEQ ID NO: 798475 - DNA, 25 bp, Mus musculus
tcacagctcacacccaaaacagaga

SEQ ID NO: 798476 - DNA, 25 bp, Mus musculus
tcacagctcacagccaaaacagaga

SEQ ID NO: 798477 - DNA, 25 bp, Mus musculus
tcacagctcagcagataatccattt

SEQ ID NO: 798478 - DNA, 25 bp, Mus musculus
tcacagctcagctgataatccattt

SEQ ID NO: 798479 - DNA, 25 bp, Mus musculus
tcacagctcagtcaagaccgtgttg

SEQ ID NO: 798480 - DNA, 25 bp, Mus musculus
tcacagctcagtcaatatcagaaat

SEQ ID NO: 798481 - DNA, 25 bp, Mus musculus
tcacagctcagtgaagaccgtgttg

SEQ ID NO: 798482 - DNA, 25 bp, Mus musculus
tcacagctcagtgaatatcagaaat

SEQ ID NO: 798483 - DNA, 25 bp, Mus musculus
tcacagctcattctccgttactaga

SEQ ID NO: 798484 - DNA, 25 bp, Mus musculus
tcacagctcattgtccgttactaga

SEQ ID NO: 798485 - DNA, 25 bp, Mus musculus
tcacagctccagactctcacatagt

SEQ ID NO: 798486 - DNA, 25 bp, Mus musculus
tcacagctccagtctctcacatagt

SEQ ID NO: 798487 - DNA, 25 bp, Mus musculus
tcacagctgacgacttccttgtctt

SEQ ID NO: 798488 - DNA, 25 bp, Mus musculus
tcacagctgacgtcttccttgtctt

SEQ ID NO: 798489 - DNA, 25 bp, Mus musculus
tcacagctgcccattgttggttagt

SEQ ID NO: 798490 - DNA, 25 bp, Mus musculus
tcacagctgccctttgttggttagt

SEQ ID NO: 798491 - DNA, 25 bp, Mus musculus
tcacagctgcctaggaaccagctca

SEQ ID NO: 798492 - DNA, 25 bp, Mus musculus
tcacagctgccttggaaccagctca

SEQ ID NO: 798493 - DNA, 25 bp, Mus musculus
tcacagctgctacgactccagttgc

SEQ ID NO: 798494 - DNA, 25 bp, Mus musculus
tcacagctgctaggactccagttgc

SEQ ID NO: 798495 - DNA, 25 bp, Mus musculus
tcacagctgggaatggttttaggtt

SEQ ID NO: 798496 - DNA, 25 bp, Mus musculus
tcacagctgggattggttttaggtt

SEQ ID NO: 798497 - DNA, 25 bp, Mus musculus
tcacagctgtctcaaggtgctcggt

SEQ ID NO: 798498 - DNA, 25 bp, Mus musculus
tcacagctgtctgaaggtgctcggt

SEQ ID NO: 798499 - DNA, 25 bp, Mus musculus
tcacagcttagcactgattcaaaag

SEQ ID NO: 798500 - DNA, 25 bp, Mus musculus
tcacagcttagctctgattcaaaag

SEQ ID NO: 798501 - DNA, 25 bp, Mus musculus
tcacagcttccgctatgtctgttac

SEQ ID NO: 798502 - DNA, 25 bp, Mus musculus
tcacagcttccggtatgtctgttac

SEQ ID NO: 798503 - DNA, 25 bp, Mus musculus
tcacagcttggaattttagggctat

SEQ ID NO: 798504 - DNA, 25 bp, Mus musculus
tcacagcttggatttttagggctat

SEQ ID NO: 798505 - DNA, 25 bp, Mus musculus
tcacaggaaccacatgacttcagcc

SEQ ID NO: 798506 - DNA, 25 bp, Mus musculus
tcacaggaaccagatgacttcagcc

SEQ ID NO: 798507 - DNA, 25 bp, Mus musculus
tcacaggaccctctgtgtgtgatgt

SEQ ID NO: 798508 - DNA, 25 bp, Mus musculus
tcacaggaccctgtgtgtgtgatgt

SEQ ID NO: 798509 - DNA, 25 bp, Mus musculus
tcacaggagagcagaggttgctgct

SEQ ID NO: 798510 - DNA, 25 bp, Mus musculus
tcacaggagagctgaggttgctgct

SEQ ID NO: 798511 - DNA, 25 bp, Mus musculus
tcacaggagtcacaaaggacctcga

SEQ ID NO: 798512 - DNA, 25 bp, Mus musculus
tcacaggagtcacaacgcggaagcg

SEQ ID NO: 798513 - DNA, 25 bp, Mus musculus
tcacaggagtcagaaaggacctcga

SEQ ID NO: 798514 - DNA, 25 bp, Mus musculus
tcacaggagtcagaacgcggaagcg

SEQ ID NO: 798515 - DNA, 25 bp, Mus musculus
tcacaggagtctacgccagttttat

SEQ ID NO: 798516 - DNA, 25 bp, Mus musculus
tcacaggagtcttcgccagttttat

SEQ ID NO: 798517 - DNA, 25 bp, Mus musculus
tcacaggattagctgatgacctaat

SEQ ID NO: 798518 - DNA, 25 bp, Mus musculus
tcacaggattaggtgatgacctaat

SEQ ID NO: 798519 - DNA, 25 bp, Mus musculus
tcacaggcacctcactggggattat

SEQ ID NO: 798520 - DNA, 25 bp, Mus musculus
tcacaggcacctgactggggattat

SEQ ID NO: 798521 - DNA, 25 bp, Mus musculus
tcacaggcaggactgggttttcacc

SEQ ID NO: 798522 - DNA, 25 bp, Mus musculus
tcacaggcaggagtgggttttcacc

SEQ ID NO: 798523 - DNA, 25 bp, Mus musculus
tcacaggcatgcacaggaacacaca

SEQ ID NO: 798524 - DNA, 25 bp, Mus musculus
tcacaggcatgctcaggaacacaca

SEQ ID NO: 798525 - DNA, 25 bp, Mus musculus
tcacaggcctgcagacatttttagc

SEQ ID NO: 798526 - DNA, 25 bp, Mus musculus
tcacaggcctgctgacatttttagc

SEQ ID NO: 798527 - DNA, 25 bp, Mus musculus
tcacaggcgacacggcttgacagca

SEQ ID NO: 798528 - DNA, 25 bp, Mus musculus
tcacaggcgacagggcttgacagca

SEQ ID NO: 798529 - DNA, 25 bp, Mus musculus
tcacaggcgtggcttatatctatct

SEQ ID NO: 798530 - DNA, 25 bp, Mus musculus
tcacaggcgtgggttatatctatct

SEQ ID NO: 798531 - DNA, 25 bp, Mus musculus
tcacaggctcataaagcccctatga

SEQ ID NO: 798532 - DNA, 25 bp, Mus musculus
tcacaggctcattaagcccctatga

SEQ ID NO: 798533 - DNA, 25 bp, Mus musculus
tcacaggctctgatgtcatgaaggt

SEQ ID NO: 798534 - DNA, 25 bp, Mus musculus
tcacaggctctgttgtcatgaaggt

SEQ ID NO: 798535 - DNA, 25 bp, Mus musculus
tcacaggctgacaatgttaaaagtt

SEQ ID NO: 798536 - DNA, 25 bp, Mus musculus
tcacaggctgactatgttaaaagtt

SEQ ID NO: 798537 - DNA, 25 bp, Mus musculus
tcacaggcttataagacctttccct

SEQ ID NO: 798538 - DNA, 25 bp, Mus musculus
tcacaggcttattagacctttccct

SEQ ID NO: 798539 - DNA, 25 bp, Mus musculus
tcacagggacctcggatgtgcagat

SEQ ID NO: 798540 - DNA, 25 bp, Mus musculus
tcacagggacctgggatgtgcagat

SEQ ID NO: 798541 - DNA, 25 bp, Mus musculus
tcacagggaggtacttccttccaaa

SEQ ID NO: 798542 - DNA, 25 bp, Mus musculus
tcacagggaggttcttccttccaaa

SEQ ID NO: 798543 - DNA, 25 bp, Mus musculus
tcacagggagtgaggaccccaggaa

SEQ ID NO: 798544 - DNA, 25 bp, Mus musculus
tcacagggagtgtggaccccaggaa

SEQ ID NO: 798545 - DNA, 25 bp, Mus musculus
tcacagggccacacagaaccttctg

SEQ ID NO: 798546 - DNA, 25 bp, Mus musculus
tcacagggccactcagaaccttctg

SEQ ID NO: 798547 - DNA, 25 bp, Mus musculus
tcacagggcccacatggtgggtaac

SEQ ID NO: 798548 - DNA, 25 bp, Mus musculus
tcacagggcccagatggtgggtaac

SEQ ID NO: 798549 - DNA, 25 bp, Mus musculus
tcacagggcgacacggaccggccag

SEQ ID NO: 798550 - DNA, 25 bp, Mus musculus
tcacagggcgactcggaccggccag

SEQ ID NO: 798551 - DNA, 25 bp, Mus musculus
tcacagggcgctacctttttgaatt

SEQ ID NO: 798552 - DNA, 25 bp, Mus musculus
tcacagggcgcttcctttttgaatt

SEQ ID NO: 798553 - DNA, 25 bp, Mus musculus
tcacagggtggcaacagtcggaaca

SEQ ID NO: 798554 - DNA, 25 bp, Mus musculus
tcacagggtggctacagtcggaaca

SEQ ID NO: 798555 - DNA, 25 bp, Mus musculus
tcacagggttgtccatctcgatttc

SEQ ID NO: 798556 - DNA, 25 bp, Mus musculus
tcacagggttgtccatggcttgctg

SEQ ID NO: 798557 - DNA, 25 bp, Mus musculus
tcacagggttgtgcatctcgatttc

SEQ ID NO: 798558 - DNA, 25 bp, Mus musculus
tcacagggttgtgcatggcttgctg

SEQ ID NO: 798559 - DNA, 25 bp, Mus musculus
tcacaggtagacactatgctttcaa

SEQ ID NO: 798560 - DNA, 25 bp, Mus musculus
tcacaggtagactctatgctttcaa

SEQ ID NO: 798561 - DNA, 25 bp, Mus musculus
tcacaggtccctaacagagctgaag

SEQ ID NO: 798562 - DNA, 25 bp, Mus musculus
tcacaggtcccttacagagctgaag

SEQ ID NO: 798563 - DNA, 25 bp, Mus musculus
tcacaggtcctgcgaaatttgctca

SEQ ID NO: 798564 - DNA, 25 bp, Mus musculus
tcacaggtcctgggaaatttgctca

SEQ ID NO: 798565 - DNA, 25 bp, Mus musculus
tcacaggtctgaacagcacatccat

SEQ ID NO: 798566 - DNA, 25 bp, Mus musculus
tcacaggtctgatcagcacatccat

SEQ ID NO: 798567 - DNA, 25 bp, Mus musculus
tcacaggtctgtaattgctatctag

SEQ ID NO: 798568 - DNA, 25 bp, Mus musculus
tcacaggtctgtcgctcacacggac

SEQ ID NO: 798569 - DNA, 25 bp, Mus musculus
tcacaggtctgtggctcacacggac

SEQ ID NO: 798570 - DNA, 25 bp, Mus musculus
tcacaggtctgttattgctatctag

SEQ ID NO: 798571 - DNA, 25 bp, Mus musculus
tcacaggtgactatctcatgagttt

SEQ ID NO: 798572 - DNA, 25 bp, Mus musculus
tcacaggtgactttctcatgagttt

SEQ ID NO: 798573 - DNA, 25 bp, Mus musculus
tcacaggtgatgactgcagaggaat

SEQ ID NO: 798574 - DNA, 25 bp, Mus musculus
tcacaggtgatgtctgcagaggaat

SEQ ID NO: 798575 - DNA, 25 bp, Mus musculus
tcacaggtgttgagtccagggtccc

SEQ ID NO: 798576 - DNA, 25 bp, Mus musculus
tcacaggtgttgtgtccagggtccc

SEQ ID NO: 798577 - DNA, 25 bp, Mus musculus
tcacaggttccaaagtctctcgggc

SEQ ID NO: 798578 - DNA, 25 bp, Mus musculus
tcacaggttccatagtctctcgggc

SEQ ID NO: 798579 - DNA, 25 bp, Mus musculus
tcacaggttcttccgtccgttattt

SEQ ID NO: 798580 - DNA, 25 bp, Mus musculus
tcacaggttcttgcgtccgttattt

SEQ ID NO: 798581 - DNA, 25 bp, Mus musculus
tcacaggttggcaggctcgacccag

SEQ ID NO: 798582 - DNA, 25 bp, Mus musculus
tcacaggttggctggctcgacccag

SEQ ID NO: 798583 - DNA, 25 bp, Mus musculus
tcacaggtttccctacagagcatct

SEQ ID NO: 798584 - DNA, 25 bp, Mus musculus
tcacaggtttccgtacagagcatct

SEQ ID NO: 798585 - DNA, 25 bp, Mus musculus
tcacagtaagtacactaaagttcac

SEQ ID NO: 798586 - DNA, 25 bp, Mus musculus
tcacagtaagtagactaaagttcac

SEQ ID NO: 798587 - DNA, 25 bp, Mus musculus
tcacagtaatgtcgttccccatgaa

SEQ ID NO: 798588 - DNA, 25 bp, Mus musculus
tcacagtaatgtggttccccatgaa

SEQ ID NO: 798589 - DNA, 25 bp, Mus musculus
tcacagtacacaagcgccaggagag

SEQ ID NO: 798590 - DNA, 25 bp, Mus musculus
tcacagtacacatgcgccaggagag

SEQ ID NO: 798591 - DNA, 25 bp, Mus musculus
tcacagtaccagatagaaaagccac

SEQ ID NO: 798592 - DNA, 25 bp, Mus musculus
tcacagtaccagttagaaaagccac

SEQ ID NO: 798593 - DNA, 25 bp, Mus musculus
tcacagtactcaatgctggagtcca

SEQ ID NO: 798594 - DNA, 25 bp, Mus musculus
tcacagtactcattgctggagtcca

SEQ ID NO: 798595 - DNA, 25 bp, Mus musculus
tcacagtactccagggctaccatgt

SEQ ID NO: 798596 - DNA, 25 bp, Mus musculus
tcacagtactcctgggctaccatgt

SEQ ID NO: 798597 - DNA, 25 bp, Mus musculus
tcacagtagatacagcccccgggtc

SEQ ID NO: 798598 - DNA, 25 bp, Mus musculus
tcacagtagatagagcccccgggtc

SEQ ID NO: 798599 - DNA, 25 bp, Mus musculus
tcacagtatctgagtctcctgcacc

SEQ ID NO: 798600 - DNA, 25 bp, Mus musculus
tcacagtatctgtgtctcctgcacc

SEQ ID NO: 798601 - DNA, 25 bp, Mus musculus
tcacagtcaatgacctacctgtggg

SEQ ID NO: 798602 - DNA, 25 bp, Mus musculus
tcacagtcaatgtcctacctgtggg

SEQ ID NO: 798603 - DNA, 25 bp, Mus musculus
tcacagtcagtccaatctccggaat

SEQ ID NO: 798604 - DNA, 25 bp, Mus musculus
tcacagtcagtcgaatctccggaat

SEQ ID NO: 798605 - DNA, 25 bp, Mus musculus
tcacagtcatccagactcagggcat

SEQ ID NO: 798606 - DNA, 25 bp, Mus musculus
tcacagtcatcctgactcagggcat

SEQ ID NO: 798607 - DNA, 25 bp, Mus musculus
tcacagtccggaaggaaaacaccta

SEQ ID NO: 798608 - DNA, 25 bp, Mus musculus
tcacagtccggatggaaaacaccta

SEQ ID NO: 798609 - DNA, 25 bp, Mus musculus
tcacagtcggtcagtccaacctgtt

SEQ ID NO: 798610 - DNA, 25 bp, Mus musculus
tcacagtcggtctgtccaacctgtt

SEQ ID NO: 798611 - DNA, 25 bp, Mus musculus
tcacagtctgcacagctccattgac

SEQ ID NO: 798612 - DNA, 25 bp, Mus musculus
tcacagtctgcagagctccattgac

SEQ ID NO: 798613 - DNA, 25 bp, Mus musculus
tcacagtgacctcagacaccagaag

SEQ ID NO: 798614 - DNA, 25 bp, Mus musculus
tcacagtgacctgagacaccagaag

SEQ ID NO: 798615 - DNA, 25 bp, Mus musculus
tcacagtgactgacaccgcaggaca

SEQ ID NO: 798616 - DNA, 25 bp, Mus musculus
tcacagtgactgtcaccgcaggaca

SEQ ID NO: 798617 - DNA, 25 bp, Mus musculus
tcacagtgatggctctgctcagctc

SEQ ID NO: 798618 - DNA, 25 bp, Mus musculus
tcacagtgatgggtctgctcagctc

SEQ ID NO: 798619 - DNA, 25 bp, Mus musculus
tcacagtgcaccattggaaacgata

SEQ ID NO: 798620 - DNA, 25 bp, Mus musculus
tcacagtgcacctttggaaacgata

SEQ ID NO: 798621 - DNA, 25 bp, Mus musculus
tcacagtgcccaaatcagattcagg

SEQ ID NO: 798622 - DNA, 25 bp, Mus musculus
tcacagtgcccatatcagattcagg

SEQ ID NO: 798623 - DNA, 25 bp, Mus musculus
tcacagtggagacagcaggccccgc

SEQ ID NO: 798624 - DNA, 25 bp, Mus musculus
tcacagtggagagagcaggccccgc

SEQ ID NO: 798625 - DNA, 25 bp, Mus musculus
tcacagtggctcattgctttttatt

SEQ ID NO: 798626 - DNA, 25 bp, Mus musculus
tcacagtggctccttgacaatcaga

SEQ ID NO: 798627 - DNA, 25 bp, Mus musculus
tcacagtggctcgttgacaatcaga

SEQ ID NO: 798628 - DNA, 25 bp, Mus musculus
tcacagtggctctttgctttttatt

SEQ ID NO: 798629 - DNA, 25 bp, Mus musculus
tcacagtgggtactgctcttacaga

SEQ ID NO: 798630 - DNA, 25 bp, Mus musculus
tcacagtgggtagtgctcttacaga

SEQ ID NO: 798631 - DNA, 25 bp, Mus musculus
tcacagtgggtgaaggacctcagct

SEQ ID NO: 798632 - DNA, 25 bp, Mus musculus
tcacagtgggtgtaggacctcagct

SEQ ID NO: 798633 - DNA, 25 bp, Mus musculus
tcacagtggttacaactcctgcact

SEQ ID NO: 798634 - DNA, 25 bp, Mus musculus
tcacagtggttagaactcctgcact

SEQ ID NO: 798635 - DNA, 25 bp, Mus musculus
tcacagtgtaaacttcccacagctg

SEQ ID NO: 798636 - DNA, 25 bp, Mus musculus
tcacagtgtaaagttcccacagctg

SEQ ID NO: 798637 - DNA, 25 bp, Mus musculus
tcacagtgtccgctggactcagacc

SEQ ID NO: 798638 - DNA, 25 bp, Mus musculus
tcacagtgtccggtggactcagacc

SEQ ID NO: 798639 - DNA, 25 bp, Mus musculus
tcacagtgtcctcccatgttgtctt

SEQ ID NO: 798640 - DNA, 25 bp, Mus musculus
tcacagtgtcctgccatgttgtctt

SEQ ID NO: 798641 - DNA, 25 bp, Mus musculus
tcacagtgtcttcctaacttataag

SEQ ID NO: 798642 - DNA, 25 bp, Mus musculus
tcacagtgtcttgctaacttataag

SEQ ID NO: 798643 - DNA, 25 bp, Mus musculus
tcacagtgtgacatttgcccctggg

SEQ ID NO: 798644 - DNA, 25 bp, Mus musculus
tcacagtgtgacttttgcccctggg

SEQ ID NO: 798645 - DNA, 25 bp, Mus musculus
tcacagtgtgagatagctgggcgca

SEQ ID NO: 798646 - DNA, 25 bp, Mus musculus
tcacagtgtgagttagctgggcgca

SEQ ID NO: 798647 - DNA, 25 bp, Mus musculus
tcacagtgttgtcatcttcctgcaa

SEQ ID NO: 798648 - DNA, 25 bp, Mus musculus
tcacagtgttgtgatcttcctgcaa

SEQ ID NO: 798649 - DNA, 25 bp, Mus musculus
tcacagttacagaaagcccacattt

SEQ ID NO: 798650 - DNA, 25 bp, Mus musculus
tcacagttacagtaagcccacattt

SEQ ID NO: 798651 - DNA, 25 bp, Mus musculus
tcacagttactcaatcacggtagta

SEQ ID NO: 798652 - DNA, 25 bp, Mus musculus
tcacagttactctatcacggtagta

SEQ ID NO: 798653 - DNA, 25 bp, Mus musculus
tcacagttagcaaggccgacaggat

SEQ ID NO: 798654 - DNA, 25 bp, Mus musculus
tcacagttagcatggccgacaggat

SEQ ID NO: 798655 - DNA, 25 bp, Mus musculus
tcacagttccttcccgagttagtgt

SEQ ID NO: 798656 - DNA, 25 bp, Mus musculus
tcacagttccttgccgagttagtgt

SEQ ID NO: 798657 - DNA, 25 bp, Mus musculus
tcacagttcgccacatccgttcatt

SEQ ID NO: 798658 - DNA, 25 bp, Mus musculus
tcacagttcgcctcatccgttcatt

SEQ ID NO: 798659 - DNA, 25 bp, Mus musculus
tcacagttctgcagtggagccacga

SEQ ID NO: 798660 - DNA, 25 bp, Mus musculus
tcacagttctgctgtggagccacga

SEQ ID NO: 798661 - DNA, 25 bp, Mus musculus
tcacagttgactcagactgcatata

SEQ ID NO: 798662 - DNA, 25 bp, Mus musculus
tcacagttgactgagactgcatata

SEQ ID NO: 798663 - DNA, 25 bp, Mus musculus
tcacagttggcaacctttggaactt

SEQ ID NO: 798664 - DNA, 25 bp, Mus musculus
tcacagttggcatcctttggaactt

SEQ ID NO: 798665 - DNA, 25 bp, Mus musculus
tcacagttgtgcattggcacgctta

SEQ ID NO: 798666 - DNA, 25 bp, Mus musculus
tcacagttgtgctttggcacgctta

SEQ ID NO: 798667 - DNA, 25 bp, Mus musculus
tcacagttgttcagctggtggccca

SEQ ID NO: 798668 - DNA, 25 bp, Mus musculus
tcacagttgttctgctggtggccca

SEQ ID NO: 798669 - DNA, 25 bp, Mus musculus
tcacagtttccaagacttcttggtc

SEQ ID NO: 798670 - DNA, 25 bp, Mus musculus
tcacagtttccatgacttcttggtc

SEQ ID NO: 798671 - DNA, 25 bp, Mus musculus
tcacataacgtgaccgccttcacac

SEQ ID NO: 798672 - DNA, 25 bp, Mus musculus
tcacataacgtgtccgccttcacac

SEQ ID NO: 798673 - DNA, 25 bp, Mus musculus
tcacataagcacagagatccgccca

SEQ ID NO: 798674 - DNA, 25 bp, Mus musculus
tcacataagcactgagatccgccca

SEQ ID NO: 798675 - DNA, 25 bp, Mus musculus
tcacatacagtaatcagggcacaga

SEQ ID NO: 798676 - DNA, 25 bp, Mus musculus
tcacatacagtattcagggcacaga

SEQ ID NO: 798677 - DNA, 25 bp, Mus musculus
tcacatacccaaccctgtagaagtt

SEQ ID NO: 798678 - DNA, 25 bp, Mus musculus
tcacatacccaagcctgtagaagtt

SEQ ID NO: 798679 - DNA, 25 bp, Mus musculus
tcacatacccacctggtgttcagga

SEQ ID NO: 798680 - DNA, 25 bp, Mus musculus
tcacatacccacgtggtgttcagga

SEQ ID NO: 798681 - DNA, 25 bp, Mus musculus
tcacataccttcctaactctagagt

SEQ ID NO: 798682 - DNA, 25 bp, Mus musculus
tcacataccttcgtaactctagagt

SEQ ID NO: 798683 - DNA, 25 bp, Mus musculus
tcacatacgcagcagtggccatggt

SEQ ID NO: 798684 - DNA, 25 bp, Mus musculus
tcacatacgcaggagtggccatggt

SEQ ID NO: 798685 - DNA, 25 bp, Mus musculus
tcacatactataatttctgcttacg

SEQ ID NO: 798686 - DNA, 25 bp, Mus musculus
tcacatactatattttctgcttacg

SEQ ID NO: 798687 - DNA, 25 bp, Mus musculus
tcacataggtaaattgaagtattgg

SEQ ID NO: 798688 - DNA, 25 bp, Mus musculus
tcacataggtaatttgaagtattgg

SEQ ID NO: 798689 - DNA, 25 bp, Mus musculus
tcacatagtcctaggattctgtgcc

SEQ ID NO: 798690 - DNA, 25 bp, Mus musculus
tcacatagtccttggattctgtgcc

SEQ ID NO: 798691 - DNA, 25 bp, Mus musculus
tcacatatcgaaaagcctggctcag

SEQ ID NO: 798692 - DNA, 25 bp, Mus musculus
tcacatatcgaatagcctggctcag

SEQ ID NO: 798693 - DNA, 25 bp, Mus musculus
tcacatatgcaccagacactatacc

SEQ ID NO: 798694 - DNA, 25 bp, Mus musculus
tcacatatgcacgagacactatacc

SEQ ID NO: 798695 - DNA, 25 bp, Mus musculus
tcacatatgtgaccacacaccaaga

SEQ ID NO: 798696 - DNA, 25 bp, Mus musculus
tcacatatgtgagcacacaccaaga

SEQ ID NO: 798697 - DNA, 25 bp, Mus musculus
tcacatatgtttccccctaggttaa

SEQ ID NO: 798698 - DNA, 25 bp, Mus musculus
tcacatatgtttgcccctaggttaa

SEQ ID NO: 798699 - DNA, 25 bp, Mus musculus
tcacatattcatacaccagcatcat

SEQ ID NO: 798700 - DNA, 25 bp, Mus musculus
tcacatattcattcaccagcatcat

SEQ ID NO: 798701 - DNA, 25 bp, Mus musculus
tcacatatttttacaaggaactgta

SEQ ID NO: 798702 - DNA, 25 bp, Mus musculus
tcacatattttttcaaggaactgta

SEQ ID NO: 798703 - DNA, 25 bp, Mus musculus
tcacatcaactactgtcgaattgct

SEQ ID NO: 798704 - DNA, 25 bp, Mus musculus
tcacatcaactagtgtcgaattgct

SEQ ID NO: 798705 - DNA, 25 bp, Mus musculus
tcacatcaagtcagggagttctagc

SEQ ID NO: 798706 - DNA, 25 bp, Mus musculus
tcacatcaagtctgggagttctagc

SEQ ID NO: 798707 - DNA, 25 bp, Mus musculus
tcacatcagtccactgggtttactt

SEQ ID NO: 798708 - DNA, 25 bp, Mus musculus
tcacatcagtcctctgggtttactt

SEQ ID NO: 798709 - DNA, 25 bp, Mus musculus
tcacatcctaagagctgacctgcca

SEQ ID NO: 798710 - DNA, 25 bp, Mus musculus
tcacatcctaagtgctgacctgcca

SEQ ID NO: 798711 - DNA, 25 bp, Mus musculus
tcacatcctcctctaatgtactcat

SEQ ID NO: 798712 - DNA, 25 bp, Mus musculus
tcacatcctcctgtaatgtactcat

SEQ ID NO: 798713 - DNA, 25 bp, Mus musculus
tcacatcctcgacaagaactttagt

SEQ ID NO: 798714 - DNA, 25 bp, Mus musculus
tcacatcctcgacagcgatttgcaa

SEQ ID NO: 798715 - DNA, 25 bp, Mus musculus
tcacatcctcgagaagaactttagt

SEQ ID NO: 798716 - DNA, 25 bp, Mus musculus
tcacatcctcgagagcgatttgcaa

SEQ ID NO: 798717 - DNA, 25 bp, Mus musculus
tcacatcgacttcactcacgctgtg

SEQ ID NO: 798718 - DNA, 25 bp, Mus musculus
tcacatcgacttgactcacgctgtg

SEQ ID NO: 798719 - DNA, 25 bp, Mus musculus
tcacatcgaggtcgcacggtggttc

SEQ ID NO: 798720 - DNA, 25 bp, Mus musculus
tcacatcgaggtggcacggtggttc

SEQ ID NO: 798721 - DNA, 25 bp, Mus musculus
tcacatcgcagcaccttaaatctta

SEQ ID NO: 798722 - DNA, 25 bp, Mus musculus
tcacatcgcagctccttaaatctta

SEQ ID NO: 798723 - DNA, 25 bp, Mus musculus
tcacatcgggccctggatgatgata

SEQ ID NO: 798724 - DNA, 25 bp, Mus musculus
tcacatcgggccgtggatgatgata

SEQ ID NO: 798725 - DNA, 25 bp, Mus musculus
tcacatcgtgagacagccagttact

SEQ ID NO: 798726 - DNA, 25 bp, Mus musculus
tcacatcgtgagtcagccagttact

SEQ ID NO: 798727 - DNA, 25 bp, Mus musculus
tcacatctagatcgctgtcataaag

SEQ ID NO: 798728 - DNA, 25 bp, Mus musculus
tcacatctagatggctgtcataaag

SEQ ID NO: 798729 - DNA, 25 bp, Mus musculus
tcacatctcagtaccactaggccaa

SEQ ID NO: 798730 - DNA, 25 bp, Mus musculus
tcacatctcagttccactaggccaa

SEQ ID NO: 798731 - DNA, 25 bp, Mus musculus
tcacatctggcgcttgcgtaaggat

SEQ ID NO: 798732 - DNA, 25 bp, Mus musculus
tcacatctggcggttgcgtaaggat

SEQ ID NO: 798733 - DNA, 25 bp, Mus musculus
tcacatctgggccactcagcttgac

SEQ ID NO: 798734 - DNA, 25 bp, Mus musculus
tcacatctgggcgactcagcttgac

SEQ ID NO: 798735 - DNA, 25 bp, Mus musculus
tcacatctttgaaaggtatcctgtt

SEQ ID NO: 798736 - DNA, 25 bp, Mus musculus
tcacatctttgataggtatcctgtt

SEQ ID NO: 798737 - DNA, 25 bp, Mus musculus
tcacatgaaggtacccaaccatcta

SEQ ID NO: 798738 - DNA, 25 bp, Mus musculus
tcacatgaaggttcccaaccatcta

SEQ ID NO: 798739 - DNA, 25 bp, Mus musculus
tcacatgacaacatattggcagcat

SEQ ID NO: 798740 - DNA, 25 bp, Mus musculus
tcacatgacaacttattggcagcat

SEQ ID NO: 798741 - DNA, 25 bp, Mus musculus
tcacatgagcacaagttcagaaatg

SEQ ID NO: 798742 - DNA, 25 bp, Mus musculus
tcacatgagcactagttcagaaatg

SEQ ID NO: 798743 - DNA, 25 bp, Mus musculus
tcacatgagccacgagtaagtactc

SEQ ID NO: 798744 - DNA, 25 bp, Mus musculus
tcacatgagccaggagtaagtactc

SEQ ID NO: 798745 - DNA, 25 bp, Mus musculus
tcacatgatctgacaagctctcacc

SEQ ID NO: 798746 - DNA, 25 bp, Mus musculus
tcacatgatctgtcaagctctcacc

SEQ ID NO: 798747 - DNA, 25 bp, Mus musculus
tcacatgatggcacttctgaccttc

SEQ ID NO: 798748 - DNA, 25 bp, Mus musculus
tcacatgatggctcttctgaccttc

SEQ ID NO: 798749 - DNA, 25 bp, Mus musculus
tcacatgcacaactatacccattag

SEQ ID NO: 798750 - DNA, 25 bp, Mus musculus
tcacatgcacaagtatacccattag

SEQ ID NO: 798751 - DNA, 25 bp, Mus musculus
tcacatgcagctcgatgggtgtcta

SEQ ID NO: 798752 - DNA, 25 bp, Mus musculus
tcacatgcagctggatgggtgtcta

SEQ ID NO: 798753 - DNA, 25 bp, Mus musculus
tcacatgccctcatgacagcaaatg

SEQ ID NO: 798754 - DNA, 25 bp, Mus musculus
tcacatgccctcttgacagcaaatg

SEQ ID NO: 798755 - DNA, 25 bp, Mus musculus
tcacatgcgcataccctacaataga

SEQ ID NO: 798756 - DNA, 25 bp, Mus musculus
tcacatgcgcattccctacaataga

SEQ ID NO: 798757 - DNA, 25 bp, Mus musculus
tcacatgctccaattgctctgacag

SEQ ID NO: 798758 - DNA, 25 bp, Mus musculus
tcacatgctccatttgctctgacag

SEQ ID NO: 798759 - DNA, 25 bp, Mus musculus
tcacatgggatgctccctaggccag

SEQ ID NO: 798760 - DNA, 25 bp, Mus musculus
tcacatgggatggtccctaggccag

SEQ ID NO: 798761 - DNA, 25 bp, Mus musculus
tcacatgggtttctttcctcctagg

SEQ ID NO: 798762 - DNA, 25 bp, Mus musculus
tcacatgggtttgtttcctcctagg

SEQ ID NO: 798763 - DNA, 25 bp, Mus musculus
tcacatggtagtattgtggtccctg

SEQ ID NO: 798764 - DNA, 25 bp, Mus musculus
tcacatggtagttttgtggtccctg

SEQ ID NO: 798765 - DNA, 25 bp, Mus musculus
tcacatggtcatattcatctttctc

SEQ ID NO: 798766 - DNA, 25 bp, Mus musculus
tcacatggtcattttcatctttctc

SEQ ID NO: 798767 - DNA, 25 bp, Mus musculus
tcacatggttccactgagtggagtt

SEQ ID NO: 798768 - DNA, 25 bp, Mus musculus
tcacatggttcctctgagtggagtt

SEQ ID NO: 798769 - DNA, 25 bp, Mus musculus
tcacatgtagtccttgccaaatcac

SEQ ID NO: 798770 - DNA, 25 bp, Mus musculus
tcacatgtagtcgttgccaaatcac

SEQ ID NO: 798771 - DNA, 25 bp, Mus musculus
tcacatgtgacaacaatgccaaagc

SEQ ID NO: 798772 - DNA, 25 bp, Mus musculus
tcacatgtgacatcaatgccaaagc

SEQ ID NO: 798773 - DNA, 25 bp, Mus musculus
tcacatgtgcttactgattcttctc

SEQ ID NO: 798774 - DNA, 25 bp, Mus musculus
tcacatgtgctttctgattcttctc

SEQ ID NO: 798775 - DNA, 25 bp, Mus musculus
tcacatgtgtggcaagtctctaaaa

SEQ ID NO: 798776 - DNA, 25 bp, Mus musculus
tcacatgtgtgggaagtctctaaaa

SEQ ID NO: 798777 - DNA, 25 bp, Mus musculus
tcacatgttagaatgctgaccttcc

SEQ ID NO: 798778 - DNA, 25 bp, Mus musculus
tcacatgttagattgctgaccttcc

SEQ ID NO: 798779 - DNA, 25 bp, Mus musculus
tcacatgttttaagccgggtacgat

SEQ ID NO: 798780 - DNA, 25 bp, Mus musculus
tcacatgttttatgccgggtacgat

SEQ ID NO: 798781 - DNA, 25 bp, Mus musculus
tcacattacattcaaccggccgttc

SEQ ID NO: 798782 - DNA, 25 bp, Mus musculus
tcacattacattgaaccggccgttc

SEQ ID NO: 798783 - DNA, 25 bp, Mus musculus
tcacattaccctactggaccataaa

SEQ ID NO: 798784 - DNA, 25 bp, Mus musculus
tcacattacccttctggaccataaa

SEQ ID NO: 798785 - DNA, 25 bp, Mus musculus
tcacattactcacagagacacatat

SEQ ID NO: 798786 - DNA, 25 bp, Mus musculus
tcacattactcagagagacacatat

SEQ ID NO: 798787 - DNA, 25 bp, Mus musculus
tcacattacttaaaccagaggagat

SEQ ID NO: 798788 - DNA, 25 bp, Mus musculus
tcacattacttataccagaggagat

SEQ ID NO: 798789 - DNA, 25 bp, Mus musculus
tcacattcacacccgattgcgcaat

SEQ ID NO: 798790 - DNA, 25 bp, Mus musculus
tcacattcacacgcgattgcgcaat

SEQ ID NO: 798791 - DNA, 25 bp, Mus musculus
tcacattcatcccaagggaggaggg

SEQ ID NO: 798792 - DNA, 25 bp, Mus musculus
tcacattcatccgaagggaggaggg

SEQ ID NO: 798793 - DNA, 25 bp, Mus musculus
tcacattcatcgaccaaggaaccag

SEQ ID NO: 798794 - DNA, 25 bp, Mus musculus
tcacattcatcgtccaaggaaccag

SEQ ID NO: 798795 - DNA, 25 bp, Mus musculus
tcacattcatggagtacacttatag

SEQ ID NO: 798796 - DNA, 25 bp, Mus musculus
tcacattcatggtgtacacttatag

SEQ ID NO: 798797 - DNA, 25 bp, Mus musculus
tcacattcatgtctactcctctaca

SEQ ID NO: 798798 - DNA, 25 bp, Mus musculus
tcacattcatgtgtactcctctaca

SEQ ID NO: 798799 - DNA, 25 bp, Mus musculus
tcacattccacacgcctgattttta

SEQ ID NO: 798800 - DNA, 25 bp, Mus musculus
tcacattccacaggcctgattttta

SEQ ID NO: 798801 - DNA, 25 bp, Mus musculus
tcacattccaggagtaagctttccc

SEQ ID NO: 798802 - DNA, 25 bp, Mus musculus
tcacattccaggtgtaagctttccc

SEQ ID NO: 798803 - DNA, 25 bp, Mus musculus
tcacattccctgaaggcgtcaacaa

SEQ ID NO: 798804 - DNA, 25 bp, Mus musculus
tcacattccctgtaggcgtcaacaa

SEQ ID NO: 798805 - DNA, 25 bp, Mus musculus
tcacattcgaacaggacttgcgtgt

SEQ ID NO: 798806 - DNA, 25 bp, Mus musculus
tcacattcgaactggacttgcgtgt

SEQ ID NO: 798807 - DNA, 25 bp, Mus musculus
tcacattctcagattgcacagaatt

SEQ ID NO: 798808 - DNA, 25 bp, Mus musculus
tcacattctcagtttgcacagaatt

SEQ ID NO: 798809 - DNA, 25 bp, Mus musculus
tcacattctgacatctggctatcaa

SEQ ID NO: 798810 - DNA, 25 bp, Mus musculus
tcacattctgacttctggctatcaa

SEQ ID NO: 798811 - DNA, 25 bp, Mus musculus
tcacattgaactaccaggccagacc

SEQ ID NO: 798812 - DNA, 25 bp, Mus musculus
tcacattgaacttccaggccagacc

SEQ ID NO: 798813 - DNA, 25 bp, Mus musculus
tcacattgctttagtctccatgggc

SEQ ID NO: 798814 - DNA, 25 bp, Mus musculus
tcacattgcttttgtctccatgggc

SEQ ID NO: 798815 - DNA, 25 bp, Mus musculus
tcacattggatgacaggccattgcg

SEQ ID NO: 798816 - DNA, 25 bp, Mus musculus
tcacattggatgtcaggccattgcg

SEQ ID NO: 798817 - DNA, 25 bp, Mus musculus
tcacattgtcccactagtaacctta

SEQ ID NO: 798818 - DNA, 25 bp, Mus musculus
tcacattgtccctctagtaacctta

SEQ ID NO: 798819 - DNA, 25 bp, Mus musculus
tcacatttagccatcatgccttaat

SEQ ID NO: 798820 - DNA, 25 bp, Mus musculus
tcacatttagccttcatgccttaat

SEQ ID NO: 798821 - DNA, 25 bp, Mus musculus
tcacatttccatcgctgtttgcaga

SEQ ID NO: 798822 - DNA, 25 bp, Mus musculus
tcacatttccatggctgtttgcaga

SEQ ID NO: 798823 - DNA, 25 bp, Mus musculus
tcacatttgaagattccttattaat

SEQ ID NO: 798824 - DNA, 25 bp, Mus musculus
tcacatttgaagtttccttattaat

SEQ ID NO: 798825 - DNA, 25 bp, Mus musculus
tcaccaaaccaacggcaaatgctga

SEQ ID NO: 798826 - DNA, 25 bp, Mus musculus
tcaccaaaccaagggcaaatgctga

SEQ ID NO: 798827 - DNA, 25 bp, Mus musculus
tcaccaaaccttcttctccattttt

SEQ ID NO: 798828 - DNA, 25 bp, Mus musculus
tcaccaaaccttgttctccattttt

SEQ ID NO: 798829 - DNA, 25 bp, Mus musculus
tcaccaaactagactatagctgagg

SEQ ID NO: 798830 - DNA, 25 bp, Mus musculus
tcaccaaactagtctatagctgagg

SEQ ID NO: 798831 - DNA, 25 bp, Mus musculus
tcaccaaagaggagaaattgcaatt

SEQ ID NO: 798832 - DNA, 25 bp, Mus musculus
tcaccaaagaggtgaaattgcaatt

SEQ ID NO: 798833 - DNA, 25 bp, Mus musculus
tcaccaaagatcaagctgttatatt

SEQ ID NO: 798834 - DNA, 25 bp, Mus musculus
tcaccaaagatctagctgttatatt

SEQ ID NO: 798835 - DNA, 25 bp, Mus musculus
tcaccaaagcctagccagtcactga

SEQ ID NO: 798836 - DNA, 25 bp, Mus musculus
tcaccaaagccttgccagtcactga

SEQ ID NO: 798837 - DNA, 25 bp, Mus musculus
tcaccaaagttcaggctgatcgaat

SEQ ID NO: 798838 - DNA, 25 bp, Mus musculus
tcaccaaagttctggctgatcgaat

SEQ ID NO: 798839 - DNA, 25 bp, Mus musculus
tcaccaaatcccacacattttatta

SEQ ID NO: 798840 - DNA, 25 bp, Mus musculus
tcaccaaatccctcacattttatta

SEQ ID NO: 798841 - DNA, 25 bp, Mus musculus
tcaccaaatgccattcggtgcctga

SEQ ID NO: 798842 - DNA, 25 bp, Mus musculus
tcaccaaatgcctttcggtgcctga

SEQ ID NO: 798843 - DNA, 25 bp, Mus musculus
tcaccaacaaatcccattctgacat

SEQ ID NO: 798844 - DNA, 25 bp, Mus musculus
tcaccaacaaatgccattctgacat

SEQ ID NO: 798845 - DNA, 25 bp, Mus musculus
tcaccaacaacacctcacttttagt

SEQ ID NO: 798846 - DNA, 25 bp, Mus musculus
tcaccaacaacagctcacttttagt

SEQ ID NO: 798847 - DNA, 25 bp, Mus musculus
tcaccaacagacctttctttttcta

SEQ ID NO: 798848 - DNA, 25 bp, Mus musculus
tcaccaacagacgtttctttttcta

SEQ ID NO: 798849 - DNA, 25 bp, Mus musculus
tcaccaacagtgacgtctccatcga

SEQ ID NO: 798850 - DNA, 25 bp, Mus musculus
tcaccaacagtgtcgtctccatcga

SEQ ID NO: 798851 - DNA, 25 bp, Mus musculus
tcaccaacatcgaggagatgaacga

SEQ ID NO: 798852 - DNA, 25 bp, Mus musculus
tcaccaacatcgtggagatgaacga

SEQ ID NO: 798853 - DNA, 25 bp, Mus musculus
tcaccaacatctatcacaaccagtg

SEQ ID NO: 798854 - DNA, 25 bp, Mus musculus
tcaccaacatctttcacaaccagtg

SEQ ID NO: 798855 - DNA, 25 bp, Mus musculus
tcaccaaccaaaacatcctgtgagg

SEQ ID NO: 798856 - DNA, 25 bp, Mus musculus
tcaccaaccaaatcatcctgtgagg

SEQ ID NO: 798857 - DNA, 25 bp, Mus musculus
tcaccaaccaggcactagtttgatg

SEQ ID NO: 798858 - DNA, 25 bp, Mus musculus
tcaccaaccagggactagtttgatg

SEQ ID NO: 798859 - DNA, 25 bp, Mus musculus
tcaccaaccgcccagatattgattt

SEQ ID NO: 798860 - DNA, 25 bp, Mus musculus
tcaccaaccgccgagatattgattt

SEQ ID NO: 798861 - DNA, 25 bp, Mus musculus
tcaccaacctcacggaaaacatctg

SEQ ID NO: 798862 - DNA, 25 bp, Mus musculus
tcaccaacctcagggaaaacatctg

SEQ ID NO: 798863 - DNA, 25 bp, Mus musculus
tcaccaacctccaaatgaccaagta

SEQ ID NO: 798864 - DNA, 25 bp, Mus musculus
tcaccaacctcctaatgaccaagta

SEQ ID NO: 798865 - DNA, 25 bp, Mus musculus
tcaccaactctgaccttggagaggt

SEQ ID NO: 798866 - DNA, 25 bp, Mus musculus
tcaccaactctgtccttggagaggt

SEQ ID NO: 798867 - DNA, 25 bp, Mus musculus
tcaccaacttgtactcgaacccatt

SEQ ID NO: 798868 - DNA, 25 bp, Mus musculus
tcaccaacttgttctcgaacccatt

SEQ ID NO: 798869 - DNA, 25 bp, Mus musculus
tcaccaagaagcctctcatttcaaa

SEQ ID NO: 798870 - DNA, 25 bp, Mus musculus
tcaccaagaagcgtctcatttcaaa

SEQ ID NO: 798871 - DNA, 25 bp, Mus musculus
tcaccaagatctacaagggtacctt

SEQ ID NO: 798872 - DNA, 25 bp, Mus musculus
tcaccaagatcttcaagggtacctt

SEQ ID NO: 798873 - DNA, 25 bp, Mus musculus
tcaccaagatgcaccctagaagaag

SEQ ID NO: 798874 - DNA, 25 bp, Mus musculus
tcaccaagatgctccctagaagaag

SEQ ID NO: 798875 - DNA, 25 bp, Mus musculus
tcaccaagccccatgaaagtatgca

SEQ ID NO: 798876 - DNA, 25 bp, Mus musculus
tcaccaagccccttgaaagtatgca

SEQ ID NO: 798877 - DNA, 25 bp, Mus musculus
tcaccaagctatattctccttgact

SEQ ID NO: 798878 - DNA, 25 bp, Mus musculus
tcaccaagctattttctccttgact

SEQ ID NO: 798879 - DNA, 25 bp, Mus musculus
tcaccaagctttctcatggagctat

SEQ ID NO: 798880 - DNA, 25 bp, Mus musculus
tcaccaagctttgtcatggagctat

SEQ ID NO: 798881 - DNA, 25 bp, Mus musculus
tcaccaaggtccaaggcgatccaga

SEQ ID NO: 798882 - DNA, 25 bp, Mus musculus
tcaccaaggtcctaggcgatccaga

SEQ ID NO: 798883 - DNA, 25 bp, Mus musculus
tcaccaagtgtcagcggtactttct

SEQ ID NO: 798884 - DNA, 25 bp, Mus musculus
tcaccaagtgtctgcggtactttct

SEQ ID NO: 798885 - DNA, 25 bp, Mus musculus
tcaccaatcagtccctttgagggtt

SEQ ID NO: 798886 - DNA, 25 bp, Mus musculus
tcaccaatcagtgcctttgagggtt

SEQ ID NO: 798887 - DNA, 25 bp, Mus musculus
tcaccaatctttcgcctattagtgt

SEQ ID NO: 798888 - DNA, 25 bp, Mus musculus
tcaccaatctttggcctattagtgt

SEQ ID NO: 798889 - DNA, 25 bp, Mus musculus
tcaccaatggtacacgacacgggtc

SEQ ID NO: 798890 - DNA, 25 bp, Mus musculus
tcaccaatggtagacgacacgggtc

SEQ ID NO: 798891 - DNA, 25 bp, Mus musculus
tcaccaatgttgagggacccagacc

SEQ ID NO: 798892 - DNA, 25 bp, Mus musculus
tcaccaatgttgtgggacccagacc

SEQ ID NO: 798893 - DNA, 25 bp, Mus musculus
tcaccaattacacatggcgatcctt

SEQ ID NO: 798894 - DNA, 25 bp, Mus musculus
tcaccaattacagatggcgatcctt

SEQ ID NO: 798895 - DNA, 25 bp, Mus musculus
tcaccaattcggcaactccatggag

SEQ ID NO: 798896 - DNA, 25 bp, Mus musculus
tcaccaattcgggaactccatggag

SEQ ID NO: 798897 - DNA, 25 bp, Mus musculus
tcaccaatttcgatcctctggggtt

SEQ ID NO: 798898 - DNA, 25 bp, Mus musculus
tcaccaatttcgttcctctggggtt

SEQ ID NO: 798899 - DNA, 25 bp, Mus musculus
tcaccacacaacacagtgccttttt

SEQ ID NO: 798900 - DNA, 25 bp, Mus musculus
tcaccacacaactcagtgccttttt

SEQ ID NO: 798901 - DNA, 25 bp, Mus musculus
tcaccacacctcacctaatgtaaaa

SEQ ID NO: 798902 - DNA, 25 bp, Mus musculus
tcaccacacctctcctaatgtaaaa

SEQ ID NO: 798903 - DNA, 25 bp, Mus musculus
tcaccacactccatccttaaaataa

SEQ ID NO: 798904 - DNA, 25 bp, Mus musculus
tcaccacactccttccttaaaataa

SEQ ID NO: 798905 - DNA, 25 bp, Mus musculus
tcaccacagggaaacatgccttgct

SEQ ID NO: 798906 - DNA, 25 bp, Mus musculus
tcaccacagggatacatgccttgct

SEQ ID NO: 798907 - DNA, 25 bp, Mus musculus
tcaccacagtaaccttgttcctgga

SEQ ID NO: 798908 - DNA, 25 bp, Mus musculus
tcaccacagtaagcttgttcctgga

SEQ ID NO: 798909 - DNA, 25 bp, Mus musculus
tcaccacagttcctctcagaaggta

SEQ ID NO: 798910 - DNA, 25 bp, Mus musculus
tcaccacagttcgtctcagaaggta

SEQ ID NO: 798911 - DNA, 25 bp, Mus musculus
tcaccacatgctctttaaggcctaa

SEQ ID NO: 798912 - DNA, 25 bp, Mus musculus
tcaccacatgctgtttaaggcctaa

SEQ ID NO: 798913 - DNA, 25 bp, Mus musculus
tcaccaccaatgcaagaagggcact

SEQ ID NO: 798914 - DNA, 25 bp, Mus musculus
tcaccaccaatggaagaagggcact

SEQ ID NO: 798915 - DNA, 25 bp, Mus musculus
tcaccaccactgaaacttgttgata

SEQ ID NO: 798916 - DNA, 25 bp, Mus musculus
tcaccaccactgattgatctcttga

SEQ ID NO: 798917 - DNA, 25 bp, Mus musculus
tcaccaccactgtaacttgttgata

SEQ ID NO: 798918 - DNA, 25 bp, Mus musculus
tcaccaccactgtttgatctcttga

SEQ ID NO: 798919 - DNA, 25 bp, Mus musculus
tcaccaccattacctgggcatatta

SEQ ID NO: 798920 - DNA, 25 bp, Mus musculus
tcaccaccattagctgggcatatta

SEQ ID NO: 798921 - DNA, 25 bp, Mus musculus
tcaccaccctgactttctaattcat

SEQ ID NO: 798922 - DNA, 25 bp, Mus musculus
tcaccaccctgagtttctaattcat

SEQ ID NO: 798923 - DNA, 25 bp, Mus musculus
tcaccaccctgtagcacgtggagga

SEQ ID NO: 798924 - DNA, 25 bp, Mus musculus
tcaccaccctgttgcacgtggagga

SEQ ID NO: 798925 - DNA, 25 bp, Mus musculus
tcaccaccgtgcacttgatgctgaa

SEQ ID NO: 798926 - DNA, 25 bp, Mus musculus
tcaccaccgtgctcttgatgctgaa

SEQ ID NO: 798927 - DNA, 25 bp, Mus musculus
tcaccacctaggacatgccttggta

SEQ ID NO: 798928 - DNA, 25 bp, Mus musculus
tcaccacctaggtcatgccttggta

SEQ ID NO: 798929 - DNA, 25 bp, Mus musculus
tcaccacctcaaagcagttcatctg

SEQ ID NO: 798930 - DNA, 25 bp, Mus musculus
tcaccacctcaatgcagttcatctg

SEQ ID NO: 798931 - DNA, 25 bp, Mus musculus
tcaccacctgtaactatcaagggat

SEQ ID NO: 798932 - DNA, 25 bp, Mus musculus
tcaccacctgtatctatcaagggat

SEQ ID NO: 798933 - DNA, 25 bp, Mus musculus
tcaccaccttccaagaattaccagg

SEQ ID NO: 798934 - DNA, 25 bp, Mus musculus
tcaccaccttcctagaattaccagg

SEQ ID NO: 798935 - DNA, 25 bp, Mus musculus
tcaccacctttaaccttatctaaac

SEQ ID NO: 798936 - DNA, 25 bp, Mus musculus
tcaccacctttatccttatctaaac

SEQ ID NO: 798937 - DNA, 25 bp, Mus musculus
tcaccacctttcacagacttggaga

SEQ ID NO: 798938 - DNA, 25 bp, Mus musculus
tcaccacctttctcagacttggaga

SEQ ID NO: 798939 - DNA, 25 bp, Mus musculus
tcaccacgaaggcagcatcagcagt

SEQ ID NO: 798940 - DNA, 25 bp, Mus musculus
tcaccacgaagggagcatcagcagt

SEQ ID NO: 798941 - DNA, 25 bp, Mus musculus
tcaccacgcattcctaggcaatatt

SEQ ID NO: 798942 - DNA, 25 bp, Mus musculus
tcaccacgcattgctaggcaatatt

SEQ ID NO: 798943 - DNA, 25 bp, Mus musculus
tcaccacgctgacatgctgatgtct

SEQ ID NO: 798944 - DNA, 25 bp, Mus musculus
tcaccacgctgagatgctgatgtct

SEQ ID NO: 798945 - DNA, 25 bp, Mus musculus
tcaccacgggtgaattcagccagtt

SEQ ID NO: 798946 - DNA, 25 bp, Mus musculus
tcaccacgggtgtattcagccagtt

SEQ ID NO: 798947 - DNA, 25 bp, Mus musculus
tcaccacgtgccacagtttaccttg

SEQ ID NO: 798948 - DNA, 25 bp, Mus musculus
tcaccacgtgcctcagtttaccttg

SEQ ID NO: 798949 - DNA, 25 bp, Mus musculus
tcaccacgtggcagtttttagttgc

SEQ ID NO: 798950 - DNA, 25 bp, Mus musculus
tcaccacgtggctgtttttagttgc

SEQ ID NO: 798951 - DNA, 25 bp, Mus musculus
tcaccactccttacatgaccaagta

SEQ ID NO: 798952 - DNA, 25 bp, Mus musculus
tcaccactcctttcatgaccaagta

SEQ ID NO: 798953 - DNA, 25 bp, Mus musculus
tcaccactctggacaggcgttctgg

SEQ ID NO: 798954 - DNA, 25 bp, Mus musculus
tcaccactctggtcaggcgttctgg

SEQ ID NO: 798955 - DNA, 25 bp, Mus musculus
tcaccactgaggatatagcgcttgc

SEQ ID NO: 798956 - DNA, 25 bp, Mus musculus
tcaccactgaggttatagcgcttgc

SEQ ID NO: 798957 - DNA, 25 bp, Mus musculus
tcaccactgcccatatttacacaat

SEQ ID NO: 798958 - DNA, 25 bp, Mus musculus
tcaccactgcccttatttacacaat

SEQ ID NO: 798959 - DNA, 25 bp, Mus musculus
tcaccactgggtcaaacatctatta

SEQ ID NO: 798960 - DNA, 25 bp, Mus musculus
tcaccactgggtgaaacatctatta

SEQ ID NO: 798961 - DNA, 25 bp, Mus musculus
tcaccacttagtcccaggttgtata

SEQ ID NO: 798962 - DNA, 25 bp, Mus musculus
tcaccacttagtgccaggttgtata

SEQ ID NO: 798963 - DNA, 25 bp, Mus musculus
tcaccacttcagcactagcattttg

SEQ ID NO: 798964 - DNA, 25 bp, Mus musculus
tcaccacttcaggactagcattttg

SEQ ID NO: 798965 - DNA, 25 bp, Mus musculus
tcaccacttttgcaagctgttttgt

SEQ ID NO: 798966 - DNA, 25 bp, Mus musculus
tcaccacttttggaagctgttttgt

SEQ ID NO: 798967 - DNA, 25 bp, Mus musculus
tcaccagaatataggagggagggac

SEQ ID NO: 798968 - DNA, 25 bp, Mus musculus
tcaccagaatattggagggagggac

SEQ ID NO: 798969 - DNA, 25 bp, Mus musculus
tcaccagaccttccattgtattcat

SEQ ID NO: 798970 - DNA, 25 bp, Mus musculus
tcaccagaccttgcattgtattcat

SEQ ID NO: 798971 - DNA, 25 bp, Mus musculus
tcaccagaggacaataaagcaggtt

SEQ ID NO: 798972 - DNA, 25 bp, Mus musculus
tcaccagaggactataaagcaggtt

SEQ ID NO: 798973 - DNA, 25 bp, Mus musculus
tcaccagaggccagaccaataaacc

SEQ ID NO: 798974 - DNA, 25 bp, Mus musculus
tcaccagaggcctgaccaataaacc

SEQ ID NO: 798975 - DNA, 25 bp, Mus musculus
tcaccagagggcattcccttttcag

SEQ ID NO: 798976 - DNA, 25 bp, Mus musculus
tcaccagagggctttcccttttcag

SEQ ID NO: 798977 - DNA, 25 bp, Mus musculus
tcaccagagggtattcggaggccca

SEQ ID NO: 798978 - DNA, 25 bp, Mus musculus
tcaccagagggttttcggaggccca

SEQ ID NO: 798979 - DNA, 25 bp, Mus musculus
tcaccagatactcagctgagcatga

SEQ ID NO: 798980 - DNA, 25 bp, Mus musculus
tcaccagatactgagctgagcatga

SEQ ID NO: 798981 - DNA, 25 bp, Mus musculus
tcaccagatgcaccttcttctcaaa

SEQ ID NO: 798982 - DNA, 25 bp, Mus musculus
tcaccagatgcagcttcttctcaaa

SEQ ID NO: 798983 - DNA, 25 bp, Mus musculus
tcaccagcaacccagtaagcttggt

SEQ ID NO: 798984 - DNA, 25 bp, Mus musculus
tcaccagcaaccgagtaagcttggt

SEQ ID NO: 798985 - DNA, 25 bp, Mus musculus
tcaccagcaaggagggcggcctctt

SEQ ID NO: 798986 - DNA, 25 bp, Mus musculus
tcaccagcaaggtgggcggcctctt

SEQ ID NO: 798987 - DNA, 25 bp, Mus musculus
tcaccagcagctagccatcaaggag

SEQ ID NO: 798988 - DNA, 25 bp, Mus musculus
tcaccagcagcttgccatcaaggag

SEQ ID NO: 798989 - DNA, 25 bp, Mus musculus
tcaccagcatgtcttccagtaaaca

SEQ ID NO: 798990 - DNA, 25 bp, Mus musculus
tcaccagcatgtgttccagtaaaca

SEQ ID NO: 798991 - DNA, 25 bp, Mus musculus
tcaccagccagtactctggagtgta

SEQ ID NO: 798992 - DNA, 25 bp, Mus musculus
tcaccagccagttctctggagtgta

SEQ ID NO: 798993 - DNA, 25 bp, Mus musculus
tcaccagcccaaaggcagttcagat

SEQ ID NO: 798994 - DNA, 25 bp, Mus musculus
tcaccagcccaaagtcagactttat

SEQ ID NO: 798995 - DNA, 25 bp, Mus musculus
tcaccagcccaatggcagttcagat

SEQ ID NO: 798996 - DNA, 25 bp, Mus musculus
tcaccagcccaatgtcagactttat

SEQ ID NO: 798997 - DNA, 25 bp, Mus musculus
tcaccagccccacacttagtttttt

SEQ ID NO: 798998 - DNA, 25 bp, Mus musculus
tcaccagccccagacttagtttttt

SEQ ID NO: 798999 - DNA, 25 bp, Mus musculus
tcaccagcccttcatggtttataat

SEQ ID NO: 799000 - DNA, 25 bp, Mus musculus
tcaccagcccttgatggtttataat

SEQ ID NO: 799001 - DNA, 25 bp, Mus musculus
tcaccagcctctaatcaatagtcca

SEQ ID NO: 799002 - DNA, 25 bp, Mus musculus
tcaccagcctcttatcaatagtcca

SEQ ID NO: 799003 - DNA, 25 bp, Mus musculus
tcaccagcgtgaaaagacagcctat

SEQ ID NO: 799004 - DNA, 25 bp, Mus musculus
tcaccagcgtgataagacagcctat

SEQ ID NO: 799005 - DNA, 25 bp, Mus musculus
tcaccagcgtggatggcgtacggca

SEQ ID NO: 799006 - DNA, 25 bp, Mus musculus
tcaccagcgtggttggcgtacggca

SEQ ID NO: 799007 - DNA, 25 bp, Mus musculus
tcaccagctaatcagggcctcgagg

SEQ ID NO: 799008 - DNA, 25 bp, Mus musculus
tcaccagctaatgagggcctcgagg

SEQ ID NO: 799009 - DNA, 25 bp, Mus musculus
tcaccagctcggaagatgagagtca

SEQ ID NO: 799010 - DNA, 25 bp, Mus musculus
tcaccagctcggtagatgagagtca

SEQ ID NO: 799011 - DNA, 25 bp, Mus musculus
tcaccagctgagcagccataattcc

SEQ ID NO: 799012 - DNA, 25 bp, Mus musculus
tcaccagctgaggagccataattcc

SEQ ID NO: 799013 - DNA, 25 bp, Mus musculus
tcaccagctgcacttgagttttcat

SEQ ID NO: 799014 - DNA, 25 bp, Mus musculus
tcaccagctgcagttgagttttcat

SEQ ID NO: 799015 - DNA, 25 bp, Mus musculus
tcaccagctgctcttgaagcctcaa

SEQ ID NO: 799016 - DNA, 25 bp, Mus musculus
tcaccagctgctgttgaagcctcaa

SEQ ID NO: 799017 - DNA, 25 bp, Mus musculus
tcaccagctggacggccatggctaa

SEQ ID NO: 799018 - DNA, 25 bp, Mus musculus
tcaccagctggagggccatggctaa

SEQ ID NO: 799019 - DNA, 25 bp, Mus musculus
tcaccagctgttatgatgctgcact

SEQ ID NO: 799020 - DNA, 25 bp, Mus musculus
tcaccagctgttatggattctatac

SEQ ID NO: 799021 - DNA, 25 bp, Mus musculus
tcaccagctgttttgatgctgcact

SEQ ID NO: 799022 - DNA, 25 bp, Mus musculus
tcaccagctgttttggattctatac

SEQ ID NO: 799023 - DNA, 25 bp, Mus musculus
tcaccagctttcctttatgggcaga

SEQ ID NO: 799024 - DNA, 25 bp, Mus musculus
tcaccagctttcgtttatgggcaga

SEQ ID NO: 799025 - DNA, 25 bp, Mus musculus
tcaccaggaccaaagcacagagcaa

SEQ ID NO: 799026 - DNA, 25 bp, Mus musculus
tcaccaggaccatagcacagagcaa

SEQ ID NO: 799027 - DNA, 25 bp, Mus musculus
tcaccaggatcaacaaggaggcgct

SEQ ID NO: 799028 - DNA, 25 bp, Mus musculus
tcaccaggatcatcaaggaggcgct

SEQ ID NO: 799029 - DNA, 25 bp, Mus musculus
tcaccaggcaccaggatcagatcat

SEQ ID NO: 799030 - DNA, 25 bp, Mus musculus
tcaccaggcacctggatcagatcat

SEQ ID NO: 799031 - DNA, 25 bp, Mus musculus
tcaccaggcctactgattgtatctt

SEQ ID NO: 799032 - DNA, 25 bp, Mus musculus
tcaccaggcctagtgattgtatctt

SEQ ID NO: 799033 - DNA, 25 bp, Mus musculus
tcaccagggcacattcaaggtccaa

SEQ ID NO: 799034 - DNA, 25 bp, Mus musculus
tcaccagggcactttcaaggtccaa

SEQ ID NO: 799035 - DNA, 25 bp, Mus musculus
tcaccaggtcacatagaatattcta

SEQ ID NO: 799036 - DNA, 25 bp, Mus musculus
tcaccaggtcacttagaatattcta

SEQ ID NO: 799037 - DNA, 25 bp, Mus musculus
tcaccaggtcccagtgggaaggcac

SEQ ID NO: 799038 - DNA, 25 bp, Mus musculus
tcaccaggtccctgtgggaaggcac

SEQ ID NO: 799039 - DNA, 25 bp, Mus musculus
tcaccaggtgacatgttatgctcat

SEQ ID NO: 799040 - DNA, 25 bp, Mus musculus
tcaccaggtgacttgttatgctcat

SEQ ID NO: 799041 - DNA, 25 bp, Mus musculus
tcaccaggtgtgatttcggatttta

SEQ ID NO: 799042 - DNA, 25 bp, Mus musculus
tcaccaggtgtgttttcggatttta

SEQ ID NO: 799043 - DNA, 25 bp, Mus musculus
tcaccagtagccatctgaaatcctg

SEQ ID NO: 799044 - DNA, 25 bp, Mus musculus
tcaccagtagccttctgaaatcctg

SEQ ID NO: 799045 - DNA, 25 bp, Mus musculus
tcaccagtctgcctagagcatcact

SEQ ID NO: 799046 - DNA, 25 bp, Mus musculus
tcaccagtctgcgtagagcatcact

SEQ ID NO: 799047 - DNA, 25 bp, Mus musculus
tcaccagtgcctacttgggacccaa

SEQ ID NO: 799048 - DNA, 25 bp, Mus musculus
tcaccagtgccttcttgggacccaa

SEQ ID NO: 799049 - DNA, 25 bp, Mus musculus
tcaccagtgggcatgtcagggcttg

SEQ ID NO: 799050 - DNA, 25 bp, Mus musculus
tcaccagtgggcttgtcagggcttg

SEQ ID NO: 799051 - DNA, 25 bp, Mus musculus
tcaccagtggtcatacacctcagat

SEQ ID NO: 799052 - DNA, 25 bp, Mus musculus
tcaccagtggtcttacacctcagat

SEQ ID NO: 799053 - DNA, 25 bp, Mus musculus
tcaccagttctgaaaggagtcacat

SEQ ID NO: 799054 - DNA, 25 bp, Mus musculus
tcaccagttctgtaaggagtcacat

SEQ ID NO: 799055 - DNA, 25 bp, Mus musculus
tcaccagttgatatgttttctttgt

SEQ ID NO: 799056 - DNA, 25 bp, Mus musculus
tcaccagttgatttgttttctttgt

SEQ ID NO: 799057 - DNA, 25 bp, Mus musculus
tcaccagttttcactcagcgtgtgg

SEQ ID NO: 799058 - DNA, 25 bp, Mus musculus
tcaccagttttctctcagcgtgtgg

SEQ ID NO: 799059 - DNA, 25 bp, Mus musculus
tcaccatacaccatatccaaacgga

SEQ ID NO: 799060 - DNA, 25 bp, Mus musculus
tcaccatacaccttatccaaacgga

SEQ ID NO: 799061 - DNA, 25 bp, Mus musculus
tcaccatacaggcaacaacacattc

SEQ ID NO: 799062 - DNA, 25 bp, Mus musculus
tcaccatacagggaacaacacattc

SEQ ID NO: 799063 - DNA, 25 bp, Mus musculus
tcaccatagatgctctttcctagga

SEQ ID NO: 799064 - DNA, 25 bp, Mus musculus
tcaccatagatggtctttcctagga

SEQ ID NO: 799065 - DNA, 25 bp, Mus musculus
tcaccatatagcatcttactagtta

SEQ ID NO: 799066 - DNA, 25 bp, Mus musculus
tcaccatatagcttcttactagtta

SEQ ID NO: 799067 - DNA, 25 bp, Mus musculus
tcaccatatggcagattatttttgg

SEQ ID NO: 799068 - DNA, 25 bp, Mus musculus
tcaccatatggctgattatttttgg

SEQ ID NO: 799069 - DNA, 25 bp, Mus musculus
tcaccatcaaccctgatcatcagtt

SEQ ID NO: 799070 - DNA, 25 bp, Mus musculus
tcaccatcaaccgtgatcatcagtt

SEQ ID NO: 799071 - DNA, 25 bp, Mus musculus
tcaccatcacccataaaacgttgca

SEQ ID NO: 799072 - DNA, 25 bp, Mus musculus
tcaccatcaccccaaatgtcttgat

SEQ ID NO: 799073 - DNA, 25 bp, Mus musculus
tcaccatcacccgaaatgtcttgat

SEQ ID NO: 799074 - DNA, 25 bp, Mus musculus
tcaccatcacccttaaaacgttgca

SEQ ID NO: 799075 - DNA, 25 bp, Mus musculus
tcaccatcaggccacacttttaaag

SEQ ID NO: 799076 - DNA, 25 bp, Mus musculus
tcaccatcaggcgacacttttaaag

SEQ ID NO: 799077 - DNA, 25 bp, Mus musculus
tcaccatccaatctgactctggctt

SEQ ID NO: 799078 - DNA, 25 bp, Mus musculus
tcaccatccaatgtgactctggctt

SEQ ID NO: 799079 - DNA, 25 bp, Mus musculus
tcaccatccactcagtcctatttat

SEQ ID NO: 799080 - DNA, 25 bp, Mus musculus
tcaccatccactgagtcctatttat

SEQ ID NO: 799081 - DNA, 25 bp, Mus musculus
tcaccatccagaccgagagacaaac

SEQ ID NO: 799082 - DNA, 25 bp, Mus musculus
tcaccatccagagcgagagacaaac

SEQ ID NO: 799083 - DNA, 25 bp, Mus musculus
tcaccatccataatgaactgagagg

SEQ ID NO: 799084 - DNA, 25 bp, Mus musculus
tcaccatccatattgaactgagagg

SEQ ID NO: 799085 - DNA, 25 bp, Mus musculus
tcaccatcccacatctccctttaca

SEQ ID NO: 799086 - DNA, 25 bp, Mus musculus
tcaccatcccacttctccctttaca

SEQ ID NO: 799087 - DNA, 25 bp, Mus musculus
tcaccatccggtcagagagtacttt

SEQ ID NO: 799088 - DNA, 25 bp, Mus musculus
tcaccatccggtgagagagtacttt

SEQ ID NO: 799089 - DNA, 25 bp, Mus musculus
tcaccatcgcagagggcgccctgtt

SEQ ID NO: 799090 - DNA, 25 bp, Mus musculus
tcaccatcgcagtgggcgccctgtt

SEQ ID NO: 799091 - DNA, 25 bp, Mus musculus
tcaccatcggcaaagtccattgttg

SEQ ID NO: 799092 - DNA, 25 bp, Mus musculus
tcaccatcggcatagtccattgttg

SEQ ID NO: 799093 - DNA, 25 bp, Mus musculus
tcaccatctcctcaaatggatcatc

SEQ ID NO: 799094 - DNA, 25 bp, Mus musculus
tcaccatctcctgaaatggatcatc

SEQ ID NO: 799095 - DNA, 25 bp, Mus musculus
tcaccatctgccatggtagcaagca

SEQ ID NO: 799096 - DNA, 25 bp, Mus musculus
tcaccatctgccttggtagcaagca

SEQ ID NO: 799097 - DNA, 25 bp, Mus musculus
tcaccatcttcaacatgcacatctt

SEQ ID NO: 799098 - DNA, 25 bp, Mus musculus
tcaccatcttcatcatgcacatctt

SEQ ID NO: 799099 - DNA, 25 bp, Mus musculus
tcaccatcttgacattagttagctc

SEQ ID NO: 799100 - DNA, 25 bp, Mus musculus
tcaccatcttgagattagttagctc

SEQ ID NO: 799101 - DNA, 25 bp, Mus musculus
tcaccatcttttctgcaagtgcctt

SEQ ID NO: 799102 - DNA, 25 bp, Mus musculus
tcaccatcttttgtgcaagtgcctt

SEQ ID NO: 799103 - DNA, 25 bp, Mus musculus
tcaccatgaactcccttctgaacaa

SEQ ID NO: 799104 - DNA, 25 bp, Mus musculus
tcaccatgaactgccttctgaacaa

SEQ ID NO: 799105 - DNA, 25 bp, Mus musculus
tcaccatgaaggacgatggcacctt

SEQ ID NO: 799106 - DNA, 25 bp, Mus musculus
tcaccatgaaggtcgatggcacctt

SEQ ID NO: 799107 - DNA, 25 bp, Mus musculus
tcaccatgaccaccttgagtatcag

SEQ ID NO: 799108 - DNA, 25 bp, Mus musculus
tcaccatgaccagcttgagtatcag

SEQ ID NO: 799109 - DNA, 25 bp, Mus musculus
tcaccatgacttatggtagggacac

SEQ ID NO: 799110 - DNA, 25 bp, Mus musculus
tcaccatgacttttggtagggacac

SEQ ID NO: 799111 - DNA, 25 bp, Mus musculus
tcaccatgagggaaacaatgttact

SEQ ID NO: 799112 - DNA, 25 bp, Mus musculus
tcaccatgagggtaacaatgttact

SEQ ID NO: 799113 - DNA, 25 bp, Mus musculus
tcaccatggaaccacaactctgttt

SEQ ID NO: 799114 - DNA, 25 bp, Mus musculus
tcaccatggaacgacaactctgttt

SEQ ID NO: 799115 - DNA, 25 bp, Mus musculus
tcaccatggcaacctgtttttgcac

SEQ ID NO: 799116 - DNA, 25 bp, Mus musculus
tcaccatggcaagctgtttttgcac

SEQ ID NO: 799117 - DNA, 25 bp, Mus musculus
tcaccatggctcctccagagtaaaa

SEQ ID NO: 799118 - DNA, 25 bp, Mus musculus
tcaccatggctcgtccagagtaaaa

SEQ ID NO: 799119 - DNA, 25 bp, Mus musculus
tcaccattaattccccagaaagaac

SEQ ID NO: 799120 - DNA, 25 bp, Mus musculus
tcaccattaattgcccagaaagaac

SEQ ID NO: 799121 - DNA, 25 bp, Mus musculus
tcaccattcagtatttcccctgagg

SEQ ID NO: 799122 - DNA, 25 bp, Mus musculus
tcaccattcagtttttcccctgagg

SEQ ID NO: 799123 - DNA, 25 bp, Mus musculus
tcaccattccctagcgcatgaagaa

SEQ ID NO: 799124 - DNA, 25 bp, Mus musculus
tcaccattccctcgtctggagagaa

SEQ ID NO: 799125 - DNA, 25 bp, Mus musculus
tcaccattccctggtctggagagaa

SEQ ID NO: 799126 - DNA, 25 bp, Mus musculus
tcaccattcccttgcgcatgaagaa

SEQ ID NO: 799127 - DNA, 25 bp, Mus musculus
tcaccattcgtcataactctgttca

SEQ ID NO: 799128 - DNA, 25 bp, Mus musculus
tcaccattcgtcttaactctgttca

SEQ ID NO: 799129 - DNA, 25 bp, Mus musculus
tcaccattctgcacttgcaaaccgg

SEQ ID NO: 799130 - DNA, 25 bp, Mus musculus
tcaccattctgctcttgcaaaccgg

SEQ ID NO: 799131 - DNA, 25 bp, Mus musculus
tcaccattcttccagtttgcctttt

SEQ ID NO: 799132 - DNA, 25 bp, Mus musculus
tcaccattcttcgagtttgcctttt

SEQ ID NO: 799133 - DNA, 25 bp, Mus musculus
tcaccattgaccagatgctcacgaa

SEQ ID NO: 799134 - DNA, 25 bp, Mus musculus
tcaccattgacctgatgctcacgaa

SEQ ID NO: 799135 - DNA, 25 bp, Mus musculus
tcaccattgaggctgagccaagagc

SEQ ID NO: 799136 - DNA, 25 bp, Mus musculus
tcaccattgagggtgagccaagagc

SEQ ID NO: 799137 - DNA, 25 bp, Mus musculus
tcaccattgccaaatatatccctgc

SEQ ID NO: 799138 - DNA, 25 bp, Mus musculus
tcaccattgccatatatatccctgc

SEQ ID NO: 799139 - DNA, 25 bp, Mus musculus
tcaccatttaggcaagtcacacact

SEQ ID NO: 799140 - DNA, 25 bp, Mus musculus
tcaccatttagggaagtcacacact

SEQ ID NO: 799141 - DNA, 25 bp, Mus musculus
tcaccatttcccaaatctgttacta

SEQ ID NO: 799142 - DNA, 25 bp, Mus musculus
tcaccatttccccatgtaacaaaga

SEQ ID NO: 799143 - DNA, 25 bp, Mus musculus
tcaccatttcccgatgtaacaaaga

SEQ ID NO: 799144 - DNA, 25 bp, Mus musculus
tcaccatttccctaatctgttacta

SEQ ID NO: 799145 - DNA, 25 bp, Mus musculus
tcaccatttttacatccctgcaagg

SEQ ID NO: 799146 - DNA, 25 bp, Mus musculus
tcaccatttttagatccctgcaagg

SEQ ID NO: 799147 - DNA, 25 bp, Mus musculus
tcacccaaaggtacagaaagagcag

SEQ ID NO: 799148 - DNA, 25 bp, Mus musculus
tcacccaaaggttcagaaagagcag

SEQ ID NO: 799149 - DNA, 25 bp, Mus musculus
tcacccaacgcaattctaaaggaga

SEQ ID NO: 799150 - DNA, 25 bp, Mus musculus
tcacccaacgcatttctaaaggaga

SEQ ID NO: 799151 - DNA, 25 bp, Mus musculus
tcacccaagccactgcagatttcag

SEQ ID NO: 799152 - DNA, 25 bp, Mus musculus
tcacccaagccagtgcagatttcag

SEQ ID NO: 799153 - DNA, 25 bp, Mus musculus
tcacccaagcttatagatcagatag

SEQ ID NO: 799154 - DNA, 25 bp, Mus musculus
tcacccaagcttttagatcagatag

SEQ ID NO: 799155 - DNA, 25 bp, Mus musculus
tcacccaaggtgacacagcttcaaa

SEQ ID NO: 799156 - DNA, 25 bp, Mus musculus
tcacccaaggtgtcacagcttcaaa

SEQ ID NO: 799157 - DNA, 25 bp, Mus musculus
tcacccaagtccagcatttcagaaa

SEQ ID NO: 799158 - DNA, 25 bp, Mus musculus
tcacccaagtcctgcatttcagaaa

SEQ ID NO: 799159 - DNA, 25 bp, Mus musculus
tcacccaatctcagaccaacaagta

SEQ ID NO: 799160 - DNA, 25 bp, Mus musculus
tcacccaatctctgaccaacaagta

SEQ ID NO: 799161 - DNA, 25 bp, Mus musculus
tcacccaattctcattgcaaccgag

SEQ ID NO: 799162 - DNA, 25 bp, Mus musculus
tcacccaattctgattgcaaccgag

SEQ ID NO: 799163 - DNA, 25 bp, Mus musculus
tcacccacacagagcgcaggaagga

SEQ ID NO: 799164 - DNA, 25 bp, Mus musculus
tcacccacacagtgcgcaggaagga

SEQ ID NO: 799165 - DNA, 25 bp, Mus musculus
tcacccacagagctgtagccaactg

SEQ ID NO: 799166 - DNA, 25 bp, Mus musculus
tcacccacagaggtgtagccaactg

SEQ ID NO: 799167 - DNA, 25 bp, Mus musculus
tcacccacatgaagaaaggatcctt

SEQ ID NO: 799168 - DNA, 25 bp, Mus musculus
tcacccacatgatgaaaggatcctt

SEQ ID NO: 799169 - DNA, 25 bp, Mus musculus
tcacccaccaagaatcagcatattt

SEQ ID NO: 799170 - DNA, 25 bp, Mus musculus
tcacccaccaagtatcagcatattt

SEQ ID NO: 799171 - DNA, 25 bp, Mus musculus
tcacccaccagaattagcgagaaaa

SEQ ID NO: 799172 - DNA, 25 bp, Mus musculus
tcacccaccagatttagcgagaaaa

SEQ ID NO: 799173 - DNA, 25 bp, Mus musculus
tcacccaccatgcaggcttgtggaa

SEQ ID NO: 799174 - DNA, 25 bp, Mus musculus
tcacccaccatggaggcttgtggaa

SEQ ID NO: 799175 - DNA, 25 bp, Mus musculus
tcacccacccagacttttgtaatac

SEQ ID NO: 799176 - DNA, 25 bp, Mus musculus
tcacccacccagtcttttgtaatac

SEQ ID NO: 799177 - DNA, 25 bp, Mus musculus
tcacccacggaacttcggccagggt

SEQ ID NO: 799178 - DNA, 25 bp, Mus musculus
tcacccacggaagttcggccagggt

SEQ ID NO: 799179 - DNA, 25 bp, Mus musculus
tcacccactgaccaaaaatagcttt

SEQ ID NO: 799180 - DNA, 25 bp, Mus musculus
tcacccactgacgaaaaatagcttt

SEQ ID NO: 799181 - DNA, 25 bp, Mus musculus
tcacccactgctcgatgcttgagtt

SEQ ID NO: 799182 - DNA, 25 bp, Mus musculus
tcacccactgctggatgcttgagtt

SEQ ID NO: 799183 - DNA, 25 bp, Mus musculus
tcacccactttcaagactatactac

SEQ ID NO: 799184 - DNA, 25 bp, Mus musculus
tcacccactttcagacaggtgtgtc

SEQ ID NO: 799185 - DNA, 25 bp, Mus musculus
tcacccactttctagactatactac

SEQ ID NO: 799186 - DNA, 25 bp, Mus musculus
tcacccactttctgacaggtgtgtc

SEQ ID NO: 799187 - DNA, 25 bp, Mus musculus
tcacccagactgcattggcactttg

SEQ ID NO: 799188 - DNA, 25 bp, Mus musculus
tcacccagactggattggcactttg

SEQ ID NO: 799189 - DNA, 25 bp, Mus musculus
tcacccagagcaatcttagcaggaa

SEQ ID NO: 799190 - DNA, 25 bp, Mus musculus
tcacccagagcattcttagcaggaa

SEQ ID NO: 799191 - DNA, 25 bp, Mus musculus
tcacccagcaacatacttttacttt

SEQ ID NO: 799192 - DNA, 25 bp, Mus musculus
tcacccagcaacttacttttacttt

SEQ ID NO: 799193 - DNA, 25 bp, Mus musculus
tcacccagctccctgtcaagaaggt

SEQ ID NO: 799194 - DNA, 25 bp, Mus musculus
tcacccagctccgtgtcaagaaggt

SEQ ID NO: 799195 - DNA, 25 bp, Mus musculus
tcacccaggacacggcttagacgga

SEQ ID NO: 799196 - DNA, 25 bp, Mus musculus
tcacccaggacagggcttagacgga

SEQ ID NO: 799197 - DNA, 25 bp, Mus musculus
tcacccaggagcatcacactttgag

SEQ ID NO: 799198 - DNA, 25 bp, Mus musculus
tcacccaggagcattactggcagat

SEQ ID NO: 799199 - DNA, 25 bp, Mus musculus
tcacccaggagcttcacactttgag

SEQ ID NO: 799200 - DNA, 25 bp, Mus musculus
tcacccaggagctttactggcagat

SEQ ID NO: 799201 - DNA, 25 bp, Mus musculus
tcacccaggcgtattctggtatcca

SEQ ID NO: 799202 - DNA, 25 bp, Mus musculus
tcacccaggcgttttctggtatcca

SEQ ID NO: 799203 - DNA, 25 bp, Mus musculus
tcacccaggcttacttaggcatgaa

SEQ ID NO: 799204 - DNA, 25 bp, Mus musculus
tcacccaggctttcttaggcatgaa

SEQ ID NO: 799205 - DNA, 25 bp, Mus musculus
tcacccagggtgactaagatcggag

SEQ ID NO: 799206 - DNA, 25 bp, Mus musculus
tcacccagggtgtctaagatcggag

SEQ ID NO: 799207 - DNA, 25 bp, Mus musculus
tcacccaggttgaggccgataaaaa

SEQ ID NO: 799208 - DNA, 25 bp, Mus musculus
tcacccaggttgtggccgataaaaa

SEQ ID NO: 799209 - DNA, 25 bp, Mus musculus
tcacccagtgagcaaacagatgttt

SEQ ID NO: 799210 - DNA, 25 bp, Mus musculus
tcacccagtgaggaaacagatgttt

SEQ ID NO: 799211 - DNA, 25 bp, Mus musculus
tcacccagtttgacatgctgaaaca

SEQ ID NO: 799212 - DNA, 25 bp, Mus musculus
tcacccagtttgtcatgctgaaaca

SEQ ID NO: 799213 - DNA, 25 bp, Mus musculus
tcacccatcataaaactcctcaaag

SEQ ID NO: 799214 - DNA, 25 bp, Mus musculus
tcacccatcatataactcctcaaag

SEQ ID NO: 799215 - DNA, 25 bp, Mus musculus
tcacccatgagcaacagcagtcagc

SEQ ID NO: 799216 - DNA, 25 bp, Mus musculus
tcacccatgagctacagcagtcagc

SEQ ID NO: 799217 - DNA, 25 bp, Mus musculus
tcacccatgataattttgtaacttg

SEQ ID NO: 799218 - DNA, 25 bp, Mus musculus
tcacccatgatatttttgtaacttg

SEQ ID NO: 799219 - DNA, 25 bp, Mus musculus
tcacccatggacaatacaagcgcac

SEQ ID NO: 799220 - DNA, 25 bp, Mus musculus
tcacccatggactatacaagcgcac

SEQ ID NO: 799221 - DNA, 25 bp, Mus musculus
tcacccatggtacattgcttcgcta

SEQ ID NO: 799222 - DNA, 25 bp, Mus musculus
tcacccatggtagattgcttcgcta

SEQ ID NO: 799223 - DNA, 25 bp, Mus musculus
tcacccatgtcactagtccagagaa

SEQ ID NO: 799224 - DNA, 25 bp, Mus musculus
tcacccatgtcagtagtccagagaa

SEQ ID NO: 799225 - DNA, 25 bp, Mus musculus
tcacccattagtctttgaggcccac

SEQ ID NO: 799226 - DNA, 25 bp, Mus musculus
tcacccattagtgtttgaggcccac

SEQ ID NO: 799227 - DNA, 25 bp, Mus musculus
tcacccattcttctgataccacagg

SEQ ID NO: 799228 - DNA, 25 bp, Mus musculus
tcacccattcttgtgataccacagg

SEQ ID NO: 799229 - DNA, 25 bp, Mus musculus
tcacccattgagacattttgccagc

SEQ ID NO: 799230 - DNA, 25 bp, Mus musculus
tcacccattgagtcattttgccagc

SEQ ID NO: 799231 - DNA, 25 bp, Mus musculus
tcacccattgggattggcaatgcct

SEQ ID NO: 799232 - DNA, 25 bp, Mus musculus
tcacccattgggtttggcaatgcct

SEQ ID NO: 799233 - DNA, 25 bp, Mus musculus
tcacccatttagaccacagttgcat

SEQ ID NO: 799234 - DNA, 25 bp, Mus musculus
tcacccatttagtccacagttgcat

SEQ ID NO: 799235 - DNA, 25 bp, Mus musculus
tcacccatttgcaaagtccttctga

SEQ ID NO: 799236 - DNA, 25 bp, Mus musculus
tcacccatttgctaagtccttctga

SEQ ID NO: 799237 - DNA, 25 bp, Mus musculus
tcaccccaaaaactgtcctcaaaag

SEQ ID NO: 799238 - DNA, 25 bp, Mus musculus
tcaccccaaaaagtgtcctcaaaag

SEQ ID NO: 799239 - DNA, 25 bp, Mus musculus
tcaccccaaatcataagcttgcaaa

SEQ ID NO: 799240 - DNA, 25 bp, Mus musculus
tcaccccaaatcttaagcttgcaaa

SEQ ID NO: 799241 - DNA, 25 bp, Mus musculus
tcaccccaacacctgtcttaagtaa

SEQ ID NO: 799242 - DNA, 25 bp, Mus musculus
tcaccccaacacgtgtcttaagtaa

SEQ ID NO: 799243 - DNA, 25 bp, Mus musculus
tcaccccaaggtagatctgcaaaat

SEQ ID NO: 799244 - DNA, 25 bp, Mus musculus
tcaccccaaggttgatctgcaaaat

SEQ ID NO: 799245 - DNA, 25 bp, Mus musculus
tcaccccacacaataaccaagagaa

SEQ ID NO: 799246 - DNA, 25 bp, Mus musculus
tcaccccacacattaaccaagagaa

SEQ ID NO: 799247 - DNA, 25 bp, Mus musculus
tcaccccaccagatctagagagaat

SEQ ID NO: 799248 - DNA, 25 bp, Mus musculus
tcaccccaccagttctagagagaat

SEQ ID NO: 799249 - DNA, 25 bp, Mus musculus
tcaccccagatcagtcttatttgga

SEQ ID NO: 799250 - DNA, 25 bp, Mus musculus
tcaccccagatctgtcttatttgga

SEQ ID NO: 799251 - DNA, 25 bp, Mus musculus
tcaccccagctacagtgctatggaa

SEQ ID NO: 799252 - DNA, 25 bp, Mus musculus
tcaccccagctagagtgctatggaa

SEQ ID NO: 799253 - DNA, 25 bp, Mus musculus
tcaccccaggaaacttcctgtgagg

SEQ ID NO: 799254 - DNA, 25 bp, Mus musculus
tcaccccaggaatcttcctgtgagg

SEQ ID NO: 799255 - DNA, 25 bp, Mus musculus
tcaccccaggagatatccagcaggc

SEQ ID NO: 799256 - DNA, 25 bp, Mus musculus
tcaccccaggagttatccagcaggc

SEQ ID NO: 799257 - DNA, 25 bp, Mus musculus
tcaccccaggttatcacaatcagaa

SEQ ID NO: 799258 - DNA, 25 bp, Mus musculus
tcaccccaggttttcacaatcagaa

SEQ ID NO: 799259 - DNA, 25 bp, Mus musculus
tcaccccagtatccttttttggaat

SEQ ID NO: 799260 - DNA, 25 bp, Mus musculus
tcaccccagtatgcttttttggaat

SEQ ID NO: 799261 - DNA, 25 bp, Mus musculus
tcaccccagttcatgttcacaaaga

SEQ ID NO: 799262 - DNA, 25 bp, Mus musculus
tcaccccagttcttgttcacaaaga

SEQ ID NO: 799263 - DNA, 25 bp, Mus musculus
tcaccccatctcacataacgtgacc

SEQ ID NO: 799264 - DNA, 25 bp, Mus musculus
tcaccccatctctcataacgtgacc

SEQ ID NO: 799265 - DNA, 25 bp, Mus musculus
tcaccccatgaacctttctattatc

SEQ ID NO: 799266 - DNA, 25 bp, Mus musculus
tcaccccatgaagctttctattatc

SEQ ID NO: 799267 - DNA, 25 bp, Mus musculus
tcaccccattccattgcagttagaa

SEQ ID NO: 799268 - DNA, 25 bp, Mus musculus
tcaccccattcctttgcagttagaa

SEQ ID NO: 799269 - DNA, 25 bp, Mus musculus
tcaccccgactgaatcatgaactca

SEQ ID NO: 799270 - DNA, 25 bp, Mus musculus
tcaccccgactgtatcatgaactca

SEQ ID NO: 799271 - DNA, 25 bp, Mus musculus
tcaccccgcagactaacaggagaca

SEQ ID NO: 799272 - DNA, 25 bp, Mus musculus
tcaccccgcagagtaacaggagaca

SEQ ID NO: 799273 - DNA, 25 bp, Mus musculus
tcaccccgctaaaaaattcttgtgg

SEQ ID NO: 799274 - DNA, 25 bp, Mus musculus
tcaccccgctaataaattcttgtgg

SEQ ID NO: 799275 - DNA, 25 bp, Mus musculus
tcacccctacttagctagggacatt

SEQ ID NO: 799276 - DNA, 25 bp, Mus musculus
tcacccctactttgctagggacatt

SEQ ID NO: 799277 - DNA, 25 bp, Mus musculus
tcacccctagaaaatgtactcgctc

SEQ ID NO: 799278 - DNA, 25 bp, Mus musculus
tcacccctagaatatgtactcgctc

SEQ ID NO: 799279 - DNA, 25 bp, Mus musculus
tcacccctagagaggccatggccag

SEQ ID NO: 799280 - DNA, 25 bp, Mus musculus
tcacccctagagtggccatggccag

SEQ ID NO: 799281 - DNA, 25 bp, Mus musculus
tcacccctctgcattcatgtcataa

SEQ ID NO: 799282 - DNA, 25 bp, Mus musculus
tcacccctctgctttcatgtcataa

SEQ ID NO: 799283 - DNA, 25 bp, Mus musculus
tcacccctgaggaaatcttcacatt

SEQ ID NO: 799284 - DNA, 25 bp, Mus musculus
tcacccctgaggtaatcttcacatt

SEQ ID NO: 799285 - DNA, 25 bp, Mus musculus
tcacccctgctaaagtgcgaacagg

SEQ ID NO: 799286 - DNA, 25 bp, Mus musculus
tcacccctgctatagtgcgaacagg

SEQ ID NO: 799287 - DNA, 25 bp, Mus musculus
tcacccctgctgaagtgcgacaggt

SEQ ID NO: 799288 - DNA, 25 bp, Mus musculus
tcacccctgctgtagtgcgacaggt

SEQ ID NO: 799289 - DNA, 25 bp, Mus musculus
tcacccctgcttagccgaaatagaa

SEQ ID NO: 799290 - DNA, 25 bp, Mus musculus
tcacccctgctttgccgaaatagaa

SEQ ID NO: 799291 - DNA, 25 bp, Mus musculus
tcacccctgtgaaaacaggcctaaa

SEQ ID NO: 799292 - DNA, 25 bp, Mus musculus
tcacccctgtgataacaggcctaaa

SEQ ID NO: 799293 - DNA, 25 bp, Mus musculus
tcacccctgttcaaagggcttttca

SEQ ID NO: 799294 - DNA, 25 bp, Mus musculus
tcacccctgttctaagggcttttca

SEQ ID NO: 799295 - DNA, 25 bp, Mus musculus
tcaccccttctcagtgtactttttg

SEQ ID NO: 799296 - DNA, 25 bp, Mus musculus
tcaccccttctctgtgtactttttg

SEQ ID NO: 799297 - DNA, 25 bp, Mus musculus
tcaccccttggtcagagacaggcca

SEQ ID NO: 799298 - DNA, 25 bp, Mus musculus
tcaccccttggtgagagacaggcca

SEQ ID NO: 799299 - DNA, 25 bp, Mus musculus
tcaccccttttgctgtgttggacaa

SEQ ID NO: 799300 - DNA, 25 bp, Mus musculus
tcaccccttttggtgtgttggacaa

SEQ ID NO: 799301 - DNA, 25 bp, Mus musculus
tcacccctttttacggcatagaatt

SEQ ID NO: 799302 - DNA, 25 bp, Mus musculus
tcaccccttttttcggcatagaatt

SEQ ID NO: 799303 - DNA, 25 bp, Mus musculus
tcacccgaacgaagtaagagacccc

SEQ ID NO: 799304 - DNA, 25 bp, Mus musculus
tcacccgaacgatgtaagagacccc

SEQ ID NO: 799305 - DNA, 25 bp, Mus musculus
tcacccgaactgcgacagatttact

SEQ ID NO: 799306 - DNA, 25 bp, Mus musculus
tcacccgaactgggacagatttact

SEQ ID NO: 799307 - DNA, 25 bp, Mus musculus
tcacccgagaggaaccttccagagg

SEQ ID NO: 799308 - DNA, 25 bp, Mus musculus
tcacccgagaggtaccttccagagg

SEQ ID NO: 799309 - DNA, 25 bp, Mus musculus
tcacccgagctgctagtgggagaca

SEQ ID NO: 799310 - DNA, 25 bp, Mus musculus
tcacccgagctggtagtgggagaca

SEQ ID NO: 799311 - DNA, 25 bp, Mus musculus
tcacccgatatcagcctcgagtgga

SEQ ID NO: 799312 - DNA, 25 bp, Mus musculus
tcacccgatatctgcctcgagtgga

SEQ ID NO: 799313 - DNA, 25 bp, Mus musculus
tcacccgctcggcttaagagagttc

SEQ ID NO: 799314 - DNA, 25 bp, Mus musculus
tcacccgctcgggttaagagagttc

SEQ ID NO: 799315 - DNA, 25 bp, Mus musculus
tcacccggaacaagaccttggctga

SEQ ID NO: 799316 - DNA, 25 bp, Mus musculus
tcacccggaacatgaccttggctga

SEQ ID NO: 799317 - DNA, 25 bp, Mus musculus
tcacccggctgactcacaaatgtgt

SEQ ID NO: 799318 - DNA, 25 bp, Mus musculus
tcacccggctgagtcacaaatgtgt

SEQ ID NO: 799319 - DNA, 25 bp, Mus musculus
tcacccgggactatgtcaactttat

SEQ ID NO: 799320 - DNA, 25 bp, Mus musculus
tcacccgggactttgtcaactttat

SEQ ID NO: 799321 - DNA, 25 bp, Mus musculus
tcacccgggcccatgaacagggtgg

SEQ ID NO: 799322 - DNA, 25 bp, Mus musculus
tcacccgggcccttgaacagggtgg

SEQ ID NO: 799323 - DNA, 25 bp, Mus musculus
tcacccggtgtaagagtttggtttt

SEQ ID NO: 799324 - DNA, 25 bp, Mus musculus
tcacccggtgtatgagtttggtttt

SEQ ID NO: 799325 - DNA, 25 bp, Mus musculus
tcacccgtccgaagctttatttagt

SEQ ID NO: 799326 - DNA, 25 bp, Mus musculus
tcacccgtccgatgctttatttagt

SEQ ID NO: 799327 - DNA, 25 bp, Mus musculus
tcacccgtctgcattctggaaaagt

SEQ ID NO: 799328 - DNA, 25 bp, Mus musculus
tcacccgtctgctttctggaaaagt

SEQ ID NO: 799329 - DNA, 25 bp, Mus musculus
tcacccgttggacccgagaaggatc

SEQ ID NO: 799330 - DNA, 25 bp, Mus musculus
tcacccgttggagccgagaaggatc

SEQ ID NO: 799331 - DNA, 25 bp, Mus musculus
tcaccctacgctaggacattgggtt

SEQ ID NO: 799332 - DNA, 25 bp, Mus musculus
tcaccctacgcttggacattgggtt

SEQ ID NO: 799333 - DNA, 25 bp, Mus musculus
tcaccctacgtgatattatttgcct

SEQ ID NO: 799334 - DNA, 25 bp, Mus musculus
tcaccctacgtgttattatttgcct

SEQ ID NO: 799335 - DNA, 25 bp, Mus musculus
tcaccctagccaaaggtcctaagag

SEQ ID NO: 799336 - DNA, 25 bp, Mus musculus
tcaccctagccataggtcctaagag

SEQ ID NO: 799337 - DNA, 25 bp, Mus musculus
tcaccctagttaatccaaccgagag

SEQ ID NO: 799338 - DNA, 25 bp, Mus musculus
tcaccctagttattccaaccgagag

SEQ ID NO: 799339 - DNA, 25 bp, Mus musculus
tcaccctatcaccatgggaggtgga

SEQ ID NO: 799340 - DNA, 25 bp, Mus musculus
tcaccctatcacgatgggaggtgga

SEQ ID NO: 799341 - DNA, 25 bp, Mus musculus
tcaccctattggagtcagaaagaga

SEQ ID NO: 799342 - DNA, 25 bp, Mus musculus
tcaccctattggtgtcagaaagaga

SEQ ID NO: 799343 - DNA, 25 bp, Mus musculus
tcaccctcaattccaaatgcatcag

SEQ ID NO: 799344 - DNA, 25 bp, Mus musculus
tcaccctcaattgcaaatgcatcag

SEQ ID NO: 799345 - DNA, 25 bp, Mus musculus
tcaccctcagaaatgtccactagaa

SEQ ID NO: 799346 - DNA, 25 bp, Mus musculus
tcaccctcagaattgtccactagaa

SEQ ID NO: 799347 - DNA, 25 bp, Mus musculus
tcaccctcagatacacaacaagtgt

SEQ ID NO: 799348 - DNA, 25 bp, Mus musculus
tcaccctcagattcacaacaagtgt

SEQ ID NO: 799349 - DNA, 25 bp, Mus musculus
tcaccctcaggcatacaacaggaag

SEQ ID NO: 799350 - DNA, 25 bp, Mus musculus
tcaccctcaggcttacaacaggaag

SEQ ID NO: 799351 - DNA, 25 bp, Mus musculus
tcaccctcagttacttttctaggag

SEQ ID NO: 799352 - DNA, 25 bp, Mus musculus
tcaccctcagtttcttttctaggag

SEQ ID NO: 799353 - DNA, 25 bp, Mus musculus
tcaccctcatctcaggtacctgggt

SEQ ID NO: 799354 - DNA, 25 bp, Mus musculus
tcaccctcatctgaggtacctgggt

SEQ ID NO: 799355 - DNA, 25 bp, Mus musculus
tcaccctcattacatttctatgcac

SEQ ID NO: 799356 - DNA, 25 bp, Mus musculus
tcaccctcattagatttctatgcac

SEQ ID NO: 799357 - DNA, 25 bp, Mus musculus
tcaccctccaaaagttcaacggcag

SEQ ID NO: 799358 - DNA, 25 bp, Mus musculus
tcaccctccaaatgttcaacggcag

SEQ ID NO: 799359 - DNA, 25 bp, Mus musculus
tcaccctccacaaaagctgagcatg

SEQ ID NO: 799360 - DNA, 25 bp, Mus musculus
tcaccctccacataagctgagcatg

SEQ ID NO: 799361 - DNA, 25 bp, Mus musculus
tcaccctccattaggtccagtgtct

SEQ ID NO: 799362 - DNA, 25 bp, Mus musculus
tcaccctccatttggtccagtgtct

SEQ ID NO: 799363 - DNA, 25 bp, Mus musculus
tcaccctcctccagttgaagagtat

SEQ ID NO: 799364 - DNA, 25 bp, Mus musculus
tcaccctcctcctgttgaagagtat

SEQ ID NO: 799365 - DNA, 25 bp, Mus musculus
tcaccctcgacccaggagggaaagg

SEQ ID NO: 799366 - DNA, 25 bp, Mus musculus
tcaccctcgaccgaggagggaaagg

SEQ ID NO: 799367 - DNA, 25 bp, Mus musculus
tcaccctctagcaggctttgaaatc

SEQ ID NO: 799368 - DNA, 25 bp, Mus musculus
tcaccctctagctggctttgaaatc

SEQ ID NO: 799369 - DNA, 25 bp, Mus musculus
tcaccctctctgaagtttctcaaaa

SEQ ID NO: 799370 - DNA, 25 bp, Mus musculus
tcaccctctctgtagtttctcaaaa

SEQ ID NO: 799371 - DNA, 25 bp, Mus musculus
tcaccctcttatatacctttctgga

SEQ ID NO: 799372 - DNA, 25 bp, Mus musculus
tcaccctcttatttacctttctgga

SEQ ID NO: 799373 - DNA, 25 bp, Mus musculus
tcaccctgaactcccagcgtgtggg

SEQ ID NO: 799374 - DNA, 25 bp, Mus musculus
tcaccctgaactgccagcgtgtggg

SEQ ID NO: 799375 - DNA, 25 bp, Mus musculus
tcaccctgacttctaccttatttta

SEQ ID NO: 799376 - DNA, 25 bp, Mus musculus
tcaccctgacttgtaccttatttta

SEQ ID NO: 799377 - DNA, 25 bp, Mus musculus
tcaccctgagagacctgggcagcca

SEQ ID NO: 799378 - DNA, 25 bp, Mus musculus
tcaccctgagagtcctgggcagcca

SEQ ID NO: 799379 - DNA, 25 bp, Mus musculus
tcaccctgaggcactgctgggaagg

SEQ ID NO: 799380 - DNA, 25 bp, Mus musculus
tcaccctgaggctctgctgggaagg

SEQ ID NO: 799381 - DNA, 25 bp, Mus musculus
tcaccctgagtcactttcattatca

SEQ ID NO: 799382 - DNA, 25 bp, Mus musculus
tcaccctgagtctctttcattatca

SEQ ID NO: 799383 - DNA, 25 bp, Mus musculus
tcaccctgatggattactccagttt

SEQ ID NO: 799384 - DNA, 25 bp, Mus musculus
tcaccctgatggtttactccagttt

SEQ ID NO: 799385 - DNA, 25 bp, Mus musculus
tcaccctgcacaattctacatgcta

SEQ ID NO: 799386 - DNA, 25 bp, Mus musculus
tcaccctgcacatttctacatgcta

SEQ ID NO: 799387 - DNA, 25 bp, Mus musculus
tcaccctgcatacagtaggccaaga

SEQ ID NO: 799388 - DNA, 25 bp, Mus musculus
tcaccctgcatagagtaggccaaga

SEQ ID NO: 799389 - DNA, 25 bp, Mus musculus
tcaccctgccccatgtctaaggaat

SEQ ID NO: 799390 - DNA, 25 bp, Mus musculus
tcaccctgccccttgtctaaggaat

SEQ ID NO: 799391 - DNA, 25 bp, Mus musculus
tcaccctgctacaaaacaagttccg

SEQ ID NO: 799392 - DNA, 25 bp, Mus musculus
tcaccctgctactaaacaagttccg

SEQ ID NO: 799393 - DNA, 25 bp, Mus musculus
tcaccctgcttcctcgggtaaatac

SEQ ID NO: 799394 - DNA, 25 bp, Mus musculus
tcaccctgcttcgtcgggtaaatac

SEQ ID NO: 799395 - DNA, 25 bp, Mus musculus
tcaccctgctttagtatttgaattg

SEQ ID NO: 799396 - DNA, 25 bp, Mus musculus
tcaccctgcttttgtatttgaattg

SEQ ID NO: 799397 - DNA, 25 bp, Mus musculus
tcaccctggaacacgaccgggatga

SEQ ID NO: 799398 - DNA, 25 bp, Mus musculus
tcaccctggaactcgaccgggatga

SEQ ID NO: 799399 - DNA, 25 bp, Mus musculus
tcaccctggaggcagtctaggcaga

SEQ ID NO: 799400 - DNA, 25 bp, Mus musculus
tcaccctggagggagtctaggcaga

SEQ ID NO: 799401 - DNA, 25 bp, Mus musculus
tcaccctgggagacctgtacatagt

SEQ ID NO: 799402 - DNA, 25 bp, Mus musculus
tcaccctgggagtcctgtacatagt

SEQ ID NO: 799403 - DNA, 25 bp, Mus musculus
tcaccctgggctctatgatactctg

SEQ ID NO: 799404 - DNA, 25 bp, Mus musculus
tcaccctgggctgtatgatactctg

SEQ ID NO: 799405 - DNA, 25 bp, Mus musculus
tcaccctggtatactagatctttcc

SEQ ID NO: 799406 - DNA, 25 bp, Mus musculus
tcaccctggtattctagatctttcc

SEQ ID NO: 799407 - DNA, 25 bp, Mus musculus
tcaccctggtgtcttttcagatttt

SEQ ID NO: 799408 - DNA, 25 bp, Mus musculus
tcaccctggtgtgttttcagatttt

SEQ ID NO: 799409 - DNA, 25 bp, Mus musculus
tcaccctgtaagatttgctttaatt

SEQ ID NO: 799410 - DNA, 25 bp, Mus musculus
tcaccctgtaagttttgctttaatt

SEQ ID NO: 799411 - DNA, 25 bp, Mus musculus
tcaccctgtgaaccgcgtgatgtgc

SEQ ID NO: 799412 - DNA, 25 bp, Mus musculus
tcaccctgtgaagcgcgtgatgtgc

SEQ ID NO: 799413 - DNA, 25 bp, Mus musculus
tcaccctgtgctacagaaccatctg

SEQ ID NO: 799414 - DNA, 25 bp, Mus musculus
tcaccctgtgcttcagaaccatctg

SEQ ID NO: 799415 - DNA, 25 bp, Mus musculus
tcacccttgtacacacatctagtta

SEQ ID NO: 799416 - DNA, 25 bp, Mus musculus
tcacccttgtactcacatctagtta

SEQ ID NO: 799417 - DNA, 25 bp, Mus musculus
tcacccttgtgaacggatccagcaa

SEQ ID NO: 799418 - DNA, 25 bp, Mus musculus
tcacccttgtgatcggatccagcaa

SEQ ID NO: 799419 - DNA, 25 bp, Mus musculus
tcaccctttcagaggctcacaaaga

SEQ ID NO: 799420 - DNA, 25 bp, Mus musculus
tcaccctttcagtggctcacaaaga

SEQ ID NO: 799421 - DNA, 25 bp, Mus musculus
tcaccctttgcacagagctttgctg

SEQ ID NO: 799422 - DNA, 25 bp, Mus musculus
tcaccctttgcagagagctttgctg

SEQ ID NO: 799423 - DNA, 25 bp, Mus musculus
tcaccctttggacagagcagcttca

SEQ ID NO: 799424 - DNA, 25 bp, Mus musculus
tcaccctttggagagagcagcttca

SEQ ID NO: 799425 - DNA, 25 bp, Mus musculus
tcaccctttgtaaaccagctcagga

SEQ ID NO: 799426 - DNA, 25 bp, Mus musculus
tcaccctttgtataccagctcagga

SEQ ID NO: 799427 - DNA, 25 bp, Mus musculus
tcacccttttaactctaccatttat

SEQ ID NO: 799428 - DNA, 25 bp, Mus musculus
tcacccttttaagtctaccatttat

SEQ ID NO: 799429 - DNA, 25 bp, Mus musculus
tcacccttttcccttttcattcata

SEQ ID NO: 799430 - DNA, 25 bp, Mus musculus
tcacccttttccgttttcattcata

SEQ ID NO: 799431 - DNA, 25 bp, Mus musculus
tcacccttttcgcgtgcatttttat

SEQ ID NO: 799432 - DNA, 25 bp, Mus musculus
tcacccttttcgggtgcatttttat

SEQ ID NO: 799433 - DNA, 25 bp, Mus musculus
tcaccctttttcagtgatagccaca

SEQ ID NO: 799434 - DNA, 25 bp, Mus musculus
tcaccctttttctgtgatagccaca

SEQ ID NO: 799435 - DNA, 25 bp, Mus musculus
tcaccgaaagagaagcagcagcagt

SEQ ID NO: 799436 - DNA, 25 bp, Mus musculus
tcaccgaaagagtagcagcagcagt

SEQ ID NO: 799437 - DNA, 25 bp, Mus musculus
tcaccgaaatgtcatcttcgatagt

SEQ ID NO: 799438 - DNA, 25 bp, Mus musculus
tcaccgaaatgtgatcttcgatagt

SEQ ID NO: 799439 - DNA, 25 bp, Mus musculus
tcaccgaatactatctggagatcat

SEQ ID NO: 799440 - DNA, 25 bp, Mus musculus
tcaccgaatactttctggagatcat

SEQ ID NO: 799441 - DNA, 25 bp, Mus musculus
tcaccgaatcggacagtgcagttct

SEQ ID NO: 799442 - DNA, 25 bp, Mus musculus
tcaccgaatcggtcagtgcagttct

SEQ ID NO: 799443 - DNA, 25 bp, Mus musculus
tcaccgacagctagatggaaaggag

SEQ ID NO: 799444 - DNA, 25 bp, Mus musculus
tcaccgacagcttgatggaaaggag

SEQ ID NO: 799445 - DNA, 25 bp, Mus musculus
tcaccgacgggaccagaagtggcat

SEQ ID NO: 799446 - DNA, 25 bp, Mus musculus
tcaccgacgggagcagaagtggcat

SEQ ID NO: 799447 - DNA, 25 bp, Mus musculus
tcaccgagaccaacgggtcagacga

SEQ ID NO: 799448 - DNA, 25 bp, Mus musculus
tcaccgagaccatcgggtcagacga

SEQ ID NO: 799449 - DNA, 25 bp, Mus musculus
tcaccgagcctgattggagcatggg

SEQ ID NO: 799450 - DNA, 25 bp, Mus musculus
tcaccgagcctgtttggagcatggg

SEQ ID NO: 799451 - DNA, 25 bp, Mus musculus
tcaccgaggctccagagtcaaagct

SEQ ID NO: 799452 - DNA, 25 bp, Mus musculus
tcaccgaggctcgagagtcaaagct

SEQ ID NO: 799453 - DNA, 25 bp, Mus musculus
tcaccgagggacagcgtgcgctgat

SEQ ID NO: 799454 - DNA, 25 bp, Mus musculus
tcaccgagggactgcgtgcgctgat

SEQ ID NO: 799455 - DNA, 25 bp, Mus musculus
tcaccgagggcccaggaatctttgc

SEQ ID NO: 799456 - DNA, 25 bp, Mus musculus
tcaccgagggccgaggaatctttgc

SEQ ID NO: 799457 - DNA, 25 bp, Mus musculus
tcaccgagtatgagcgtgcccagta

SEQ ID NO: 799458 - DNA, 25 bp, Mus musculus
tcaccgagtatgtgcgtgcccagta

SEQ ID NO: 799459 - DNA, 25 bp, Mus musculus
tcaccgagtgttcgtactttataac

SEQ ID NO: 799460 - DNA, 25 bp, Mus musculus
tcaccgagtgttggtactttataac

SEQ ID NO: 799461 - DNA, 25 bp, Mus musculus
tcaccgatcactcatggttgaccat

SEQ ID NO: 799462 - DNA, 25 bp, Mus musculus
tcaccgatcactgatggttgaccat

SEQ ID NO: 799463 - DNA, 25 bp, Mus musculus
tcaccgcactcaaagttggtcttgg

SEQ ID NO: 799464 - DNA, 25 bp, Mus musculus
tcaccgcactcatagttggtcttgg

SEQ ID NO: 799465 - DNA, 25 bp, Mus musculus
tcaccgcactgacagaccttagggc

SEQ ID NO: 799466 - DNA, 25 bp, Mus musculus
tcaccgcactgagagaccttagggc

SEQ ID NO: 799467 - DNA, 25 bp, Mus musculus
tcaccgccctttcagtctgaaatgt

SEQ ID NO: 799468 - DNA, 25 bp, Mus musculus
tcaccgccctttgagtctgaaatgt

SEQ ID NO: 799469 - DNA, 25 bp, Mus musculus
tcaccgctagcgaggacagaaccat

SEQ ID NO: 799470 - DNA, 25 bp, Mus musculus
tcaccgctagcgtggacagaaccat

SEQ ID NO: 799471 - DNA, 25 bp, Mus musculus
tcaccgctccctaaggacatatgaa

SEQ ID NO: 799472 - DNA, 25 bp, Mus musculus
tcaccgctcccttaggacatatgaa

SEQ ID NO: 799473 - DNA, 25 bp, Mus musculus
tcaccgctgctcaagatggccagag

SEQ ID NO: 799474 - DNA, 25 bp, Mus musculus
tcaccgctgctctagatggccagag

SEQ ID NO: 799475 - DNA, 25 bp, Mus musculus
tcaccgcttctcaagttctgagcag

SEQ ID NO: 799476 - DNA, 25 bp, Mus musculus
tcaccgcttctctagttctgagcag

SEQ ID NO: 799477 - DNA, 25 bp, Mus musculus
tcaccggaagaaacagtagtcattg

SEQ ID NO: 799478 - DNA, 25 bp, Mus musculus
tcaccggaagaatcagtagtcattg

SEQ ID NO: 799479 - DNA, 25 bp, Mus musculus
tcaccggaagttagcaccctgtcag

SEQ ID NO: 799480 - DNA, 25 bp, Mus musculus
tcaccggaagtttgcaccctgtcag

SEQ ID NO: 799481 - DNA, 25 bp, Mus musculus
tcaccggagctgcagatgagaccct

SEQ ID NO: 799482 - DNA, 25 bp, Mus musculus
tcaccggagctggagatgagaccct

SEQ ID NO: 799483 - DNA, 25 bp, Mus musculus
tcaccggcatcgcagtgctgggaat

SEQ ID NO: 799484 - DNA, 25 bp, Mus musculus
tcaccggcatcggagtgctgggaat

SEQ ID NO: 799485 - DNA, 25 bp, Mus musculus
tcaccggccgctcagatgagaagca

SEQ ID NO: 799486 - DNA, 25 bp, Mus musculus
tcaccggccgctgagatgagaagca

SEQ ID NO: 799487 - DNA, 25 bp, Mus musculus
tcaccggctgccatcgggtcggaag

SEQ ID NO: 799488 - DNA, 25 bp, Mus musculus
tcaccggctgccttcgggtcggaag

SEQ ID NO: 799489 - DNA, 25 bp, Mus musculus
tcaccgggaccgcactgatattaaa

SEQ ID NO: 799490 - DNA, 25 bp, Mus musculus
tcaccgggaccggactgatattaaa

SEQ ID NO: 799491 - DNA, 25 bp, Mus musculus
tcaccggtcagaataaggcgatcaa

SEQ ID NO: 799492 - DNA, 25 bp, Mus musculus
tcaccggtcagattaaggcgatcaa

SEQ ID NO: 799493 - DNA, 25 bp, Mus musculus
tcaccggtccagagtctctgggatg

SEQ ID NO: 799494 - DNA, 25 bp, Mus musculus
tcaccggtccagtgtctctgggatg

SEQ ID NO: 799495 - DNA, 25 bp, Mus musculus
tcaccggtctgcaccaaggtgtcta

SEQ ID NO: 799496 - DNA, 25 bp, Mus musculus
tcaccggtctgctccaaggtgtcta

SEQ ID NO: 799497 - DNA, 25 bp, Mus musculus
tcaccgtacaagagctcgctctgtg

SEQ ID NO: 799498 - DNA, 25 bp, Mus musculus
tcaccgtacaagtgctcgctctgtg

SEQ ID NO: 799499 - DNA, 25 bp, Mus musculus
tcaccgtcatccattgtaattgact

SEQ ID NO: 799500 - DNA, 25 bp, Mus musculus
tcaccgtcatcctttgtaattgact

SEQ ID NO: 799501 - DNA, 25 bp, Mus musculus
tcaccgtcctgtctgagttcagaac

SEQ ID NO: 799502 - DNA, 25 bp, Mus musculus
tcaccgtcctgtgtgagttcagaac

SEQ ID NO: 799503 - DNA, 25 bp, Mus musculus
tcaccgtgaggcagtggagcacttt

SEQ ID NO: 799504 - DNA, 25 bp, Mus musculus
tcaccgtgaggctgtggagcacttt

SEQ ID NO: 799505 - DNA, 25 bp, Mus musculus
tcaccgtgctgcagaatttcacaat

SEQ ID NO: 799506 - DNA, 25 bp, Mus musculus
tcaccgtgctgctgaatttcacaat

SEQ ID NO: 799507 - DNA, 25 bp, Mus musculus
tcaccgtggagccaagaccgagcat

SEQ ID NO: 799508 - DNA, 25 bp, Mus musculus
tcaccgtggagcgaagaccgagcat

SEQ ID NO: 799509 - DNA, 25 bp, Mus musculus
tcaccgtgtcgtccccgctgaaaag

SEQ ID NO: 799510 - DNA, 25 bp, Mus musculus
tcaccgtgtcgtgcccgctgaaaag

SEQ ID NO: 799511 - DNA, 25 bp, Mus musculus
tcaccgttagtactcactggatagc

SEQ ID NO: 799512 - DNA, 25 bp, Mus musculus
tcaccgttagtagtcactggatagc

SEQ ID NO: 799513 - DNA, 25 bp, Mus musculus
tcaccgttccctatgatgccaaaat

SEQ ID NO: 799514 - DNA, 25 bp, Mus musculus
tcaccgttccctttgatgccaaaat

SEQ ID NO: 799515 - DNA, 25 bp, Mus musculus
tcaccgttgaccaaccaattagtct

SEQ ID NO: 799516 - DNA, 25 bp, Mus musculus
tcaccgttgacctaccaattagtct

SEQ ID NO: 799517 - DNA, 25 bp, Mus musculus
tcaccgtttggaaaccatccttggg

SEQ ID NO: 799518 - DNA, 25 bp, Mus musculus
tcaccgtttggataccatccttggg

SEQ ID NO: 799519 - DNA, 25 bp, Mus musculus
tcaccgttttatcccgattgttctg

SEQ ID NO: 799520 - DNA, 25 bp, Mus musculus
tcaccgttttatgccgattgttctg

SEQ ID NO: 799521 - DNA, 25 bp, Mus musculus
tcaccgttttgactttttgagacct

SEQ ID NO: 799522 - DNA, 25 bp, Mus musculus
tcaccgttttgagtttttgagacct

SEQ ID NO: 799523 - DNA, 25 bp, Mus musculus
tcacctaacagtattgctcttcgga

SEQ ID NO: 799524 - DNA, 25 bp, Mus musculus
tcacctaacagttttgctcttcgga

SEQ ID NO: 799525 - DNA, 25 bp, Mus musculus
tcacctaaccgaaagagctctgctc

SEQ ID NO: 799526 - DNA, 25 bp, Mus musculus
tcacctaaccgatagagctctgctc

SEQ ID NO: 799527 - DNA, 25 bp, Mus musculus
tcacctaacttcagagagcacactg

SEQ ID NO: 799528 - DNA, 25 bp, Mus musculus
tcacctaacttctgagagcacactg

SEQ ID NO: 799529 - DNA, 25 bp, Mus musculus
tcacctaagaccctcagaaaactca

SEQ ID NO: 799530 - DNA, 25 bp, Mus musculus
tcacctaagaccgtcagaaaactca

SEQ ID NO: 799531 - DNA, 25 bp, Mus musculus
tcacctaagcacaattcaacattaa

SEQ ID NO: 799532 - DNA, 25 bp, Mus musculus
tcacctaagcactattcaacattaa

SEQ ID NO: 799533 - DNA, 25 bp, Mus musculus
tcacctaagccaatgtagaattgtt

SEQ ID NO: 799534 - DNA, 25 bp, Mus musculus
tcacctaagccattgtagaattgtt

SEQ ID NO: 799535 - DNA, 25 bp, Mus musculus
tcacctacagctcggatgtacctgg

SEQ ID NO: 799536 - DNA, 25 bp, Mus musculus
tcacctacagctgggatgtacctgg

SEQ ID NO: 799537 - DNA, 25 bp, Mus musculus
tcacctacatatcaaggcttcctgt

SEQ ID NO: 799538 - DNA, 25 bp, Mus musculus
tcacctacatatgaaggcttcctgt

SEQ ID NO: 799539 - DNA, 25 bp, Mus musculus
tcacctacatgaaactttcgtcctt

SEQ ID NO: 799540 - DNA, 25 bp, Mus musculus
tcacctacatgatactttcgtcctt

SEQ ID NO: 799541 - DNA, 25 bp, Mus musculus
tcacctacatgcacatctacgagac

SEQ ID NO: 799542 - DNA, 25 bp, Mus musculus
tcacctacatgctcatctacgagac

SEQ ID NO: 799543 - DNA, 25 bp, Mus musculus
tcacctaccaggctaagcagcttat

SEQ ID NO: 799544 - DNA, 25 bp, Mus musculus
tcacctaccagggtaagcagcttat

SEQ ID NO: 799545 - DNA, 25 bp, Mus musculus
tcacctacctcacacgacattatga

SEQ ID NO: 799546 - DNA, 25 bp, Mus musculus
tcacctacctcagacgacattatga

SEQ ID NO: 799547 - DNA, 25 bp, Mus musculus
tcacctacgatgcaggaccttgctt

SEQ ID NO: 799548 - DNA, 25 bp, Mus musculus
tcacctacgatggaggaccttgctt

SEQ ID NO: 799549 - DNA, 25 bp, Mus musculus
tcacctactcccatatgagccaaaa

SEQ ID NO: 799550 - DNA, 25 bp, Mus musculus
tcacctactcccttatgagccaaaa

SEQ ID NO: 799551 - DNA, 25 bp, Mus musculus
tcacctactctcagcctgagatact

SEQ ID NO: 799552 - DNA, 25 bp, Mus musculus
tcacctactctcatggtttctgtaa

SEQ ID NO: 799553 - DNA, 25 bp, Mus musculus
tcacctactctcattttcttgatac

SEQ ID NO: 799554 - DNA, 25 bp, Mus musculus
tcacctactctctgcctgagatact

SEQ ID NO: 799555 - DNA, 25 bp, Mus musculus
tcacctactctcttggtttctgtaa

SEQ ID NO: 799556 - DNA, 25 bp, Mus musculus
tcacctactctctttttcttgatac

SEQ ID NO: 799557 - DNA, 25 bp, Mus musculus
tcacctactgaacggagcgcgggcc

SEQ ID NO: 799558 - DNA, 25 bp, Mus musculus
tcacctactgaagggagcgcgggcc

SEQ ID NO: 799559 - DNA, 25 bp, Mus musculus
tcacctactgccagtcagtgtgatc

SEQ ID NO: 799560 - DNA, 25 bp, Mus musculus
tcacctactgcctgtcagtgtgatc

SEQ ID NO: 799561 - DNA, 25 bp, Mus musculus
tcacctactgtcactatatctaagc

SEQ ID NO: 799562 - DNA, 25 bp, Mus musculus
tcacctactgtctctatatctaagc

SEQ ID NO: 799563 - DNA, 25 bp, Mus musculus
tcacctactttcctgtcttagaatg

SEQ ID NO: 799564 - DNA, 25 bp, Mus musculus
tcacctactttcgtgtcttagaatg

SEQ ID NO: 799565 - DNA, 25 bp, Mus musculus
tcacctacttttactgtggagaaga

SEQ ID NO: 799566 - DNA, 25 bp, Mus musculus
tcacctactttttctgtggagaaga

SEQ ID NO: 799567 - DNA, 25 bp, Mus musculus
tcacctagacttatgggcaggccat

SEQ ID NO: 799568 - DNA, 25 bp, Mus musculus
tcacctagacttttgggcaggccat

SEQ ID NO: 799569 - DNA, 25 bp, Mus musculus
tcacctagaggtctgctcctggtaa

SEQ ID NO: 799570 - DNA, 25 bp, Mus musculus
tcacctagaggtgtgctcctggtaa

SEQ ID NO: 799571 - DNA, 25 bp, Mus musculus
tcacctagcgttaatcatctgacat

SEQ ID NO: 799572 - DNA, 25 bp, Mus musculus
tcacctagcgtttatcatctgacat

SEQ ID NO: 799573 - DNA, 25 bp, Mus musculus
tcacctatatgccagggtgttccct

SEQ ID NO: 799574 - DNA, 25 bp, Mus musculus
tcacctatatgcgagggtgttccct

SEQ ID NO: 799575 - DNA, 25 bp, Mus musculus
tcacctatcacacccctgtgaaggg

SEQ ID NO: 799576 - DNA, 25 bp, Mus musculus
tcacctatcacagccctgtgaaggg

SEQ ID NO: 799577 - DNA, 25 bp, Mus musculus
tcacctatgactcggttcctcagat

SEQ ID NO: 799578 - DNA, 25 bp, Mus musculus
tcacctatgactgggttcctcagat

SEQ ID NO: 799579 - DNA, 25 bp, Mus musculus
tcacctatgggccagtcgaaaagca

SEQ ID NO: 799580 - DNA, 25 bp, Mus musculus
tcacctatgggcgagtcgaaaagca

SEQ ID NO: 799581 - DNA, 25 bp, Mus musculus
tcacctatgtgcaggcagccctgga

SEQ ID NO: 799582 - DNA, 25 bp, Mus musculus
tcacctatgtgctggcagccctgga

SEQ ID NO: 799583 - DNA, 25 bp, Mus musculus
tcacctcaagcaagaacagtcctct

SEQ ID NO: 799584 - DNA, 25 bp, Mus musculus
tcacctcaagcatgaacagtcctct

SEQ ID NO: 799585 - DNA, 25 bp, Mus musculus
tcacctcacaacagcacctgaataa

SEQ ID NO: 799586 - DNA, 25 bp, Mus musculus
tcacctcacaactgcacctgaataa

SEQ ID NO: 799587 - DNA, 25 bp, Mus musculus
tcacctcaccccaaaatgtgtctga

SEQ ID NO: 799588 - DNA, 25 bp, Mus musculus
tcacctcacccctaaatgtgtctga

SEQ ID NO: 799589 - DNA, 25 bp, Mus musculus
tcacctcacttcatcgagattgaca

SEQ ID NO: 799590 - DNA, 25 bp, Mus musculus
tcacctcacttcttcgagattgaca

SEQ ID NO: 799591 - DNA, 25 bp, Mus musculus
tcacctcaggaaacaaccccagaaa

SEQ ID NO: 799592 - DNA, 25 bp, Mus musculus
tcacctcaggaatcaaccccagaaa

SEQ ID NO: 799593 - DNA, 25 bp, Mus musculus
tcacctcagggtaggaccctgagac

SEQ ID NO: 799594 - DNA, 25 bp, Mus musculus
tcacctcagggttggaccctgagac

SEQ ID NO: 799595 - DNA, 25 bp, Mus musculus
tcacctcatggccaatttgcacttt

SEQ ID NO: 799596 - DNA, 25 bp, Mus musculus
tcacctcatggcgaatttgcacttt

SEQ ID NO: 799597 - DNA, 25 bp, Mus musculus
tcacctcatttaactgacacagagt

SEQ ID NO: 799598 - DNA, 25 bp, Mus musculus
tcacctcatttatctgacacagagt

SEQ ID NO: 799599 - DNA, 25 bp, Mus musculus
tcacctccaaggactcggttttgtt

SEQ ID NO: 799600 - DNA, 25 bp, Mus musculus
tcacctccaaggtctcggttttgtt

SEQ ID NO: 799601 - DNA, 25 bp, Mus musculus
tcacctccatctctgctagtacaat

SEQ ID NO: 799602 - DNA, 25 bp, Mus musculus
tcacctccatctgtgctagtacaat

SEQ ID NO: 799603 - DNA, 25 bp, Mus musculus
tcacctcccgacattccagttttat

SEQ ID NO: 799604 - DNA, 25 bp, Mus musculus
tcacctcccgactttccagttttat

SEQ ID NO: 799605 - DNA, 25 bp, Mus musculus
tcacctccgattatgctttcttaat

SEQ ID NO: 799606 - DNA, 25 bp, Mus musculus
tcacctccgattttgctttcttaat

SEQ ID NO: 799607 - DNA, 25 bp, Mus musculus
tcacctcctcttactgaacaggcaa

SEQ ID NO: 799608 - DNA, 25 bp, Mus musculus
tcacctcctctttctgaacaggcaa

SEQ ID NO: 799609 - DNA, 25 bp, Mus musculus
tcacctcctttcaagatccattaaa

SEQ ID NO: 799610 - DNA, 25 bp, Mus musculus
tcacctcctttctagatccattaaa

SEQ ID NO: 799611 - DNA, 25 bp, Mus musculus
tcacctcgcactacttgaccttgag

SEQ ID NO: 799612 - DNA, 25 bp, Mus musculus
tcacctcgcacttcttgaccttgag

SEQ ID NO: 799613 - DNA, 25 bp, Mus musculus
tcacctcgtcgcaactaaagcatga

SEQ ID NO: 799614 - DNA, 25 bp, Mus musculus
tcacctcgtcgctactaaagcatga

SEQ ID NO: 799615 - DNA, 25 bp, Mus musculus
tcacctcgtcggatcattggccgga

SEQ ID NO: 799616 - DNA, 25 bp, Mus musculus
tcacctcgtcggttcattggccgga

SEQ ID NO: 799617 - DNA, 25 bp, Mus musculus
tcacctcgttccaaaaggctttcct

SEQ ID NO: 799618 - DNA, 25 bp, Mus musculus
tcacctcgttcctaaaggctttcct

SEQ ID NO: 799619 - DNA, 25 bp, Mus musculus
tcacctctacagacattgccgacgt

SEQ ID NO: 799620 - DNA, 25 bp, Mus musculus
tcacctctacagtcattgccgacgt

SEQ ID NO: 799621 - DNA, 25 bp, Mus musculus
tcacctctacctacctcaggaaaaa

SEQ ID NO: 799622 - DNA, 25 bp, Mus musculus
tcacctctacctacttgaagcagat

SEQ ID NO: 799623 - DNA, 25 bp, Mus musculus
tcacctctaccttcctcaggaaaaa

SEQ ID NO: 799624 - DNA, 25 bp, Mus musculus
tcacctctaccttcttgaagcagat

SEQ ID NO: 799625 - DNA, 25 bp, Mus musculus
tcacctctacttccaagcatgctgt

SEQ ID NO: 799626 - DNA, 25 bp, Mus musculus
tcacctctacttgcaagcatgctgt

SEQ ID NO: 799627 - DNA, 25 bp, Mus musculus
tcacctctcagaacttttcattggg

SEQ ID NO: 799628 - DNA, 25 bp, Mus musculus
tcacctctcagatcttttcattggg

SEQ ID NO: 799629 - DNA, 25 bp, Mus musculus
tcacctctctagcacctttatgcaa

SEQ ID NO: 799630 - DNA, 25 bp, Mus musculus
tcacctctctaggacctttatgcaa

SEQ ID NO: 799631 - DNA, 25 bp, Mus musculus
tcacctctctgtcaacgatggcgga

SEQ ID NO: 799632 - DNA, 25 bp, Mus musculus
tcacctctctgtgaacgatggcgga

SEQ ID NO: 799633 - DNA, 25 bp, Mus musculus
tcacctctgacccatagtggcagct

SEQ ID NO: 799634 - DNA, 25 bp, Mus musculus
tcacctctgaccgatagtggcagct

SEQ ID NO: 799635 - DNA, 25 bp, Mus musculus
tcacctctgcatagcctgacaggag

SEQ ID NO: 799636 - DNA, 25 bp, Mus musculus
tcacctctgcattgcctgacaggag

SEQ ID NO: 799637 - DNA, 25 bp, Mus musculus
tcacctctggccactagaatatcaa

SEQ ID NO: 799638 - DNA, 25 bp, Mus musculus
tcacctctggccctagggaactagg

SEQ ID NO: 799639 - DNA, 25 bp, Mus musculus
tcacctctggccgtagggaactagg

SEQ ID NO: 799640 - DNA, 25 bp, Mus musculus
tcacctctggcctctagaatatcaa

SEQ ID NO: 799641 - DNA, 25 bp, Mus musculus
tcacctctggctctttacataaaat

SEQ ID NO: 799642 - DNA, 25 bp, Mus musculus
tcacctctggctgtttacataaaat

SEQ ID NO: 799643 - DNA, 25 bp, Mus musculus
tcacctctgggtacagcctagagaa

SEQ ID NO: 799644 - DNA, 25 bp, Mus musculus
tcacctctgggttcagcctagagaa

SEQ ID NO: 799645 - DNA, 25 bp, Mus musculus
tcacctctggtgagaatccctgaga

SEQ ID NO: 799646 - DNA, 25 bp, Mus musculus
tcacctctggtgtgaatccctgaga

SEQ ID NO: 799647 - DNA, 25 bp, Mus musculus
tcacctctgtctctatctgcttctg

SEQ ID NO: 799648 - DNA, 25 bp, Mus musculus
tcacctctgtctgtatctgcttctg

SEQ ID NO: 799649 - DNA, 25 bp, Mus musculus
tcacctcttctaaagctctgaactg

SEQ ID NO: 799650 - DNA, 25 bp, Mus musculus
tcacctcttctatagctctgaactg

SEQ ID NO: 799651 - DNA, 25 bp, Mus musculus
tcacctcttgccaaaacttcacaag

SEQ ID NO: 799652 - DNA, 25 bp, Mus musculus
tcacctcttgcctaaacttcacaag

SEQ ID NO: 799653 - DNA, 25 bp, Mus musculus
tcacctcttggtctgtaacctaact

SEQ ID NO: 799654 - DNA, 25 bp, Mus musculus
tcacctcttggtgtgtaacctaact

SEQ ID NO: 799655 - DNA, 25 bp, Mus musculus
tcacctgaaacaaggaacgcaacgt

SEQ ID NO: 799656 - DNA, 25 bp, Mus musculus
tcacctgaaacatggaacgcaacgt

SEQ ID NO: 799657 - DNA, 25 bp, Mus musculus
tcacctgaattgcagcccctctgta

SEQ ID NO: 799658 - DNA, 25 bp, Mus musculus
tcacctgaattggagcccctctgta

SEQ ID NO: 799659 - DNA, 25 bp, Mus musculus
tcacctgacatgactgctgggaata

SEQ ID NO: 799660 - DNA, 25 bp, Mus musculus
tcacctgacatgtctgctgggaata

SEQ ID NO: 799661 - DNA, 25 bp, Mus musculus
tcacctgacctgcaactcaaatttt

SEQ ID NO: 799662 - DNA, 25 bp, Mus musculus
tcacctgacctggaactcaaatttt

SEQ ID NO: 799663 - DNA, 25 bp, Mus musculus
tcacctgacttaagtggcccttggg

SEQ ID NO: 799664 - DNA, 25 bp, Mus musculus
tcacctgacttatgtggcccttggg

SEQ ID NO: 799665 - DNA, 25 bp, Mus musculus
tcacctgacttcaacagccagtttg

SEQ ID NO: 799666 - DNA, 25 bp, Mus musculus
tcacctgacttctacagccagtttg

SEQ ID NO: 799667 - DNA, 25 bp, Mus musculus
tcacctgagccacaactgcaactgg

SEQ ID NO: 799668 - DNA, 25 bp, Mus musculus
tcacctgagccagaactgcaactgg

SEQ ID NO: 799669 - DNA, 25 bp, Mus musculus
tcacctgagtacatgatggactgtt

SEQ ID NO: 799670 - DNA, 25 bp, Mus musculus
tcacctgagtacttgatggactgtt

SEQ ID NO: 799671 - DNA, 25 bp, Mus musculus
tcacctgagtcaacagcggcagcag

SEQ ID NO: 799672 - DNA, 25 bp, Mus musculus
tcacctgagtcatcagcggcagcag

SEQ ID NO: 799673 - DNA, 25 bp, Mus musculus
tcacctgatcacctgatgagcccag

SEQ ID NO: 799674 - DNA, 25 bp, Mus musculus
tcacctgatcacgtgatgagcccag

SEQ ID NO: 799675 - DNA, 25 bp, Mus musculus
tcacctgattggcatgtgtctcaag

SEQ ID NO: 799676 - DNA, 25 bp, Mus musculus
tcacctgattgggatgtgtctcaag

SEQ ID NO: 799677 - DNA, 25 bp, Mus musculus
tcacctgcaattccagtgctaggga

SEQ ID NO: 799678 - DNA, 25 bp, Mus musculus
tcacctgcaattgcagtgctaggga

SEQ ID NO: 799679 - DNA, 25 bp, Mus musculus
tcacctgcacctacattattcaagc

SEQ ID NO: 799680 - DNA, 25 bp, Mus musculus
tcacctgcaccttcattattcaagc

SEQ ID NO: 799681 - DNA, 25 bp, Mus musculus
tcacctgcagagatgtgcctgggca

SEQ ID NO: 799682 - DNA, 25 bp, Mus musculus
tcacctgcagagttgtgcctgggca

SEQ ID NO: 799683 - DNA, 25 bp, Mus musculus
tcacctgcagcccaattgtataaag

SEQ ID NO: 799684 - DNA, 25 bp, Mus musculus
tcacctgcagccgaattgtataaag

SEQ ID NO: 799685 - DNA, 25 bp, Mus musculus
tcacctgcatccaatgcctatggag

SEQ ID NO: 799686 - DNA, 25 bp, Mus musculus
tcacctgcatcctatgcctatggag

SEQ ID NO: 799687 - DNA, 25 bp, Mus musculus
tcacctgccaacaattgtctcagac

SEQ ID NO: 799688 - DNA, 25 bp, Mus musculus
tcacctgccaactattgtctcagac

SEQ ID NO: 799689 - DNA, 25 bp, Mus musculus
tcacctgccatgagtgtgaggcgca

SEQ ID NO: 799690 - DNA, 25 bp, Mus musculus
tcacctgccatgtgtgtgaggcgca

SEQ ID NO: 799691 - DNA, 25 bp, Mus musculus
tcacctgccgttcagtaacttagct

SEQ ID NO: 799692 - DNA, 25 bp, Mus musculus
tcacctgccgttgagtaacttagct

SEQ ID NO: 799693 - DNA, 25 bp, Mus musculus
tcacctgcctcccaggagttgagtg

SEQ ID NO: 799694 - DNA, 25 bp, Mus musculus
tcacctgcctccgaggagttgagtg

SEQ ID NO: 799695 - DNA, 25 bp, Mus musculus
tcacctgcgacccttactaaagtgg

SEQ ID NO: 799696 - DNA, 25 bp, Mus musculus
tcacctgcgaccgttactaaagtgg

SEQ ID NO: 799697 - DNA, 25 bp, Mus musculus
tcacctgcgagacactgtactaagc

SEQ ID NO: 799698 - DNA, 25 bp, Mus musculus
tcacctgcgagagactgtactaagc

SEQ ID NO: 799699 - DNA, 25 bp, Mus musculus
tcacctgctctccatttctaaaaat

SEQ ID NO: 799700 - DNA, 25 bp, Mus musculus
tcacctgctctcgatttctaaaaat

SEQ ID NO: 799701 - DNA, 25 bp, Mus musculus
tcacctgctgctatcatgtactaaa

SEQ ID NO: 799702 - DNA, 25 bp, Mus musculus
tcacctgctgctttcatgtactaaa

SEQ ID NO: 799703 - DNA, 25 bp, Mus musculus
tcacctgctgtgcatccagatgctg

SEQ ID NO: 799704 - DNA, 25 bp, Mus musculus
tcacctgctgtggatccagatgctg

SEQ ID NO: 799705 - DNA, 25 bp, Mus musculus
tcacctgctttaaccgcttcagaaa

SEQ ID NO: 799706 - DNA, 25 bp, Mus musculus
tcacctgctttatccgcttcagaaa

SEQ ID NO: 799707 - DNA, 25 bp, Mus musculus
tcacctggagaaaggctcgggacta

SEQ ID NO: 799708 - DNA, 25 bp, Mus musculus
tcacctggagaatggctcgggacta

SEQ ID NO: 799709 - DNA, 25 bp, Mus musculus
tcacctggcactagagaatgtggag

SEQ ID NO: 799710 - DNA, 25 bp, Mus musculus
tcacctggcactccttctgttgaca

SEQ ID NO: 799711 - DNA, 25 bp, Mus musculus
tcacctggcactgcttctgttgaca

SEQ ID NO: 799712 - DNA, 25 bp, Mus musculus
tcacctggcacttgagaatgtggag

SEQ ID NO: 799713 - DNA, 25 bp, Mus musculus
tcacctggcaggagatggacatcga

SEQ ID NO: 799714 - DNA, 25 bp, Mus musculus
tcacctggcaggtgatggacatcga

SEQ ID NO: 799715 - DNA, 25 bp, Mus musculus
tcacctgggaagctgtggttctgtt

SEQ ID NO: 799716 - DNA, 25 bp, Mus musculus
tcacctgggaaggtgtggttctgtt

SEQ ID NO: 799717 - DNA, 25 bp, Mus musculus
tcacctgggataagagtctcgtctt

SEQ ID NO: 799718 - DNA, 25 bp, Mus musculus
tcacctgggatatgagtctcgtctt

SEQ ID NO: 799719 - DNA, 25 bp, Mus musculus
tcacctgggtggactcatccaagat

SEQ ID NO: 799720 - DNA, 25 bp, Mus musculus
tcacctgggtggtctcatccaagat

SEQ ID NO: 799721 - DNA, 25 bp, Mus musculus
tcacctggtatcagtaccactcctt

SEQ ID NO: 799722 - DNA, 25 bp, Mus musculus
tcacctggtatctgtaccactcctt

SEQ ID NO: 799723 - DNA, 25 bp, Mus musculus
tcacctgtaagacttggccaccttg

SEQ ID NO: 799724 - DNA, 25 bp, Mus musculus
tcacctgtaagagttggccaccttg

SEQ ID NO: 799725 - DNA, 25 bp, Mus musculus
tcacctgtaaggcaaagagcccctg

SEQ ID NO: 799726 - DNA, 25 bp, Mus musculus
tcacctgtaagggaaagagcccctg

SEQ ID NO: 799727 - DNA, 25 bp, Mus musculus
tcacctgtactacagcttggcttga

SEQ ID NO: 799728 - DNA, 25 bp, Mus musculus
tcacctgtactagagcttggcttga

SEQ ID NO: 799729 - DNA, 25 bp, Mus musculus
tcacctgtatagacgttctgcgcat

SEQ ID NO: 799730 - DNA, 25 bp, Mus musculus
tcacctgtatagatcacattgactg

SEQ ID NO: 799731 - DNA, 25 bp, Mus musculus
tcacctgtatagtcgttctgcgcat

SEQ ID NO: 799732 - DNA, 25 bp, Mus musculus
tcacctgtatagttcacattgactg

SEQ ID NO: 799733 - DNA, 25 bp, Mus musculus
tcacctgtcaatctgagcacgagtg

SEQ ID NO: 799734 - DNA, 25 bp, Mus musculus
tcacctgtcaatgtgagcacgagtg

SEQ ID NO: 799735 - DNA, 25 bp, Mus musculus
tcacctgtcatcattgaccggcatg

SEQ ID NO: 799736 - DNA, 25 bp, Mus musculus
tcacctgtcatctttgaccggcatg

SEQ ID NO: 799737 - DNA, 25 bp, Mus musculus
tcacctgtccatattcaagccgaag

SEQ ID NO: 799738 - DNA, 25 bp, Mus musculus
tcacctgtccattttcaagccgaag

SEQ ID NO: 799739 - DNA, 25 bp, Mus musculus
tcacctgtcctgaaggcagaactgg

SEQ ID NO: 799740 - DNA, 25 bp, Mus musculus
tcacctgtcctgtaggcagaactgg

SEQ ID NO: 799741 - DNA, 25 bp, Mus musculus
tcacctgtgcccaggactctgatgg

SEQ ID NO: 799742 - DNA, 25 bp, Mus musculus
tcacctgtgccctggactctgatgg

SEQ ID NO: 799743 - DNA, 25 bp, Mus musculus
tcacctgtgcctatgaataacccaa

SEQ ID NO: 799744 - DNA, 25 bp, Mus musculus
tcacctgtgcctttgaataacccaa

SEQ ID NO: 799745 - DNA, 25 bp, Mus musculus
tcacctgtgctgagatggccgctgg

SEQ ID NO: 799746 - DNA, 25 bp, Mus musculus
tcacctgtgctgtgatggccgctgg

SEQ ID NO: 799747 - DNA, 25 bp, Mus musculus
tcacctgtggacatgaacttgccct

SEQ ID NO: 799748 - DNA, 25 bp, Mus musculus
tcacctgtggacttgaacttgccct

SEQ ID NO: 799749 - DNA, 25 bp, Mus musculus
tcacctgtggccagtcctgccagat

SEQ ID NO: 799750 - DNA, 25 bp, Mus musculus
tcacctgtggcctgtcctgccagat

SEQ ID NO: 799751 - DNA, 25 bp, Mus musculus
tcacctgtgggtacttccctaacac

SEQ ID NO: 799752 - DNA, 25 bp, Mus musculus
tcacctgtgggttcttccctaacac

SEQ ID NO: 799753 - DNA, 25 bp, Mus musculus
tcacctgtgtccaaccatgtagatg

SEQ ID NO: 799754 - DNA, 25 bp, Mus musculus
tcacctgtgtcctaccatgtagatg

SEQ ID NO: 799755 - DNA, 25 bp, Mus musculus
tcacctgttacactgccttttaggg

SEQ ID NO: 799756 - DNA, 25 bp, Mus musculus
tcacctgttacagtgccttttaggg

SEQ ID NO: 799757 - DNA, 25 bp, Mus musculus
tcacctgttcaaagtagaccattag

SEQ ID NO: 799758 - DNA, 25 bp, Mus musculus
tcacctgttcaatgtagaccattag

SEQ ID NO: 799759 - DNA, 25 bp, Mus musculus
tcacctgttcccaaaaacttgactg

SEQ ID NO: 799760 - DNA, 25 bp, Mus musculus
tcacctgttccctaaaacttgactg

SEQ ID NO: 799761 - DNA, 25 bp, Mus musculus
tcacctgttcttagttaccctagaa

SEQ ID NO: 799762 - DNA, 25 bp, Mus musculus
tcacctgttctttgttaccctagaa

SEQ ID NO: 799763 - DNA, 25 bp, Mus musculus
tcacctgttgtcagcttgtaatgtt

SEQ ID NO: 799764 - DNA, 25 bp, Mus musculus
tcacctgttgtctgcttgtaatgtt

SEQ ID NO: 799765 - DNA, 25 bp, Mus musculus
tcacctgttttgataactagctaaa

SEQ ID NO: 799766 - DNA, 25 bp, Mus musculus
tcacctgttttgttaactagctaaa

SEQ ID NO: 799767 - DNA, 25 bp, Mus musculus
tcaccttaaaccatttatctacttg

SEQ ID NO: 799768 - DNA, 25 bp, Mus musculus
tcaccttaaaccttttatctacttg

SEQ ID NO: 799769 - DNA, 25 bp, Mus musculus
tcaccttacagccttgggcaactgg

SEQ ID NO: 799770 - DNA, 25 bp, Mus musculus
tcaccttacagcgttgggcaactgg

SEQ ID NO: 799771 - DNA, 25 bp, Mus musculus
tcaccttaccaaagactctatccat

SEQ ID NO: 799772 - DNA, 25 bp, Mus musculus
tcaccttaccaatgactctatccat

SEQ ID NO: 799773 - DNA, 25 bp, Mus musculus
tcaccttagtgaaacaggagataat

SEQ ID NO: 799774 - DNA, 25 bp, Mus musculus
tcaccttagtgatacaggagataat

SEQ ID NO: 799775 - DNA, 25 bp, Mus musculus
tcaccttagtttatgaccttagcta

SEQ ID NO: 799776 - DNA, 25 bp, Mus musculus
tcaccttagtttttgaccttagcta

SEQ ID NO: 799777 - DNA, 25 bp, Mus musculus
tcaccttatgctctgacaagaacat

SEQ ID NO: 799778 - DNA, 25 bp, Mus musculus
tcaccttatgctgtgacaagaacat

SEQ ID NO: 799779 - DNA, 25 bp, Mus musculus
tcaccttcagccatcagtgaatgtg

SEQ ID NO: 799780 - DNA, 25 bp, Mus musculus
tcaccttcagccttcagtgaatgtg

SEQ ID NO: 799781 - DNA, 25 bp, Mus musculus
tcaccttcatggaccaacataactt

SEQ ID NO: 799782 - DNA, 25 bp, Mus musculus
tcaccttcatggtccaacataactt

SEQ ID NO: 799783 - DNA, 25 bp, Mus musculus
tcaccttcatttcacctgcagatat

SEQ ID NO: 799784 - DNA, 25 bp, Mus musculus
tcaccttcatttgacctgcagatat

SEQ ID NO: 799785 - DNA, 25 bp, Mus musculus
tcaccttccagactgtcttcaaagc

SEQ ID NO: 799786 - DNA, 25 bp, Mus musculus
tcaccttccagagtgtcttcaaagc

SEQ ID NO: 799787 - DNA, 25 bp, Mus musculus
tcaccttccagcattgagtacacca

SEQ ID NO: 799788 - DNA, 25 bp, Mus musculus
tcaccttccagctttgagtacacca

SEQ ID NO: 799789 - DNA, 25 bp, Mus musculus
tcaccttcccaaaatagtcactctt

SEQ ID NO: 799790 - DNA, 25 bp, Mus musculus
tcaccttcccaatatagtcactctt

SEQ ID NO: 799791 - DNA, 25 bp, Mus musculus
tcaccttccctcaaaagcagcaaag

SEQ ID NO: 799792 - DNA, 25 bp, Mus musculus
tcaccttccctctaaagcagcaaag

SEQ ID NO: 799793 - DNA, 25 bp, Mus musculus
tcaccttcctcaaacttaatccaaa

SEQ ID NO: 799794 - DNA, 25 bp, Mus musculus
tcaccttcctcatacttaatccaaa

SEQ ID NO: 799795 - DNA, 25 bp, Mus musculus
tcaccttcgaccaatacaggctgaa

SEQ ID NO: 799796 - DNA, 25 bp, Mus musculus
tcaccttcgacctatacaggctgaa

SEQ ID NO: 799797 - DNA, 25 bp, Mus musculus
tcaccttcggaaaggactgccactt

SEQ ID NO: 799798 - DNA, 25 bp, Mus musculus
tcaccttcggaatggactgccactt

SEQ ID NO: 799799 - DNA, 25 bp, Mus musculus
tcaccttctcctcctgtcctaagtg

SEQ ID NO: 799800 - DNA, 25 bp, Mus musculus
tcaccttctcctgctgtcctaagtg

SEQ ID NO: 799801 - DNA, 25 bp, Mus musculus
tcaccttctctacagtggcagattc

SEQ ID NO: 799802 - DNA, 25 bp, Mus musculus
tcaccttctctagagtggcagattc

SEQ ID NO: 799803 - DNA, 25 bp, Mus musculus
tcaccttctctcagagctttgatga

SEQ ID NO: 799804 - DNA, 25 bp, Mus musculus
tcaccttctctctgagctttgatga

SEQ ID NO: 799805 - DNA, 25 bp, Mus musculus
tcaccttctgagaagaatggcttgt

SEQ ID NO: 799806 - DNA, 25 bp, Mus musculus
tcaccttctgagtagaatggcttgt

SEQ ID NO: 799807 - DNA, 25 bp, Mus musculus
tcaccttctgtgactatgcccagaa

SEQ ID NO: 799808 - DNA, 25 bp, Mus musculus
tcaccttctgtgtctatgcccagaa

SEQ ID NO: 799809 - DNA, 25 bp, Mus musculus
tcaccttcttcaactcttagatagt

SEQ ID NO: 799810 - DNA, 25 bp, Mus musculus
tcaccttcttcatctcttagatagt

SEQ ID NO: 799811 - DNA, 25 bp, Mus musculus
tcaccttcttctaaatctaagggag

SEQ ID NO: 799812 - DNA, 25 bp, Mus musculus
tcaccttcttcttaatctaagggag

SEQ ID NO: 799813 - DNA, 25 bp, Mus musculus
tcaccttcttggattgctctagatt

SEQ ID NO: 799814 - DNA, 25 bp, Mus musculus
tcaccttcttggtttgctctagatt

SEQ ID NO: 799815 - DNA, 25 bp, Mus musculus
tcaccttgaaatagattccccagat

SEQ ID NO: 799816 - DNA, 25 bp, Mus musculus
tcaccttgaaattgattccccagat

SEQ ID NO: 799817 - DNA, 25 bp, Mus musculus
tcaccttgaagaatcctgtatggag

SEQ ID NO: 799818 - DNA, 25 bp, Mus musculus
tcaccttgaagattcctgtatggag

SEQ ID NO: 799819 - DNA, 25 bp, Mus musculus
tcaccttgaagcagtcgcccgggag

SEQ ID NO: 799820 - DNA, 25 bp, Mus musculus
tcaccttgaagctgtcgcccgggag

SEQ ID NO: 799821 - DNA, 25 bp, Mus musculus
tcaccttgacacaccttgttagatt

SEQ ID NO: 799822 - DNA, 25 bp, Mus musculus
tcaccttgacactccttgttagatt

SEQ ID NO: 799823 - DNA, 25 bp, Mus musculus
tcaccttgaccaaaacagtcttcac

SEQ ID NO: 799824 - DNA, 25 bp, Mus musculus
tcaccttgaccataacagtcttcac

SEQ ID NO: 799825 - DNA, 25 bp, Mus musculus
tcaccttgacctccaaggccagtga

SEQ ID NO: 799826 - DNA, 25 bp, Mus musculus
tcaccttgacctgcaaggccagtga

SEQ ID NO: 799827 - DNA, 25 bp, Mus musculus
tcaccttgagatcacggctctggga

SEQ ID NO: 799828 - DNA, 25 bp, Mus musculus
tcaccttgagatgacggctctggga

SEQ ID NO: 799829 - DNA, 25 bp, Mus musculus
tcaccttgagtcagtatagtttctt

SEQ ID NO: 799830 - DNA, 25 bp, Mus musculus
tcaccttgagtctgtatagtttctt

SEQ ID NO: 799831 - DNA, 25 bp, Mus musculus
tcaccttgatgccaccttcattttt

SEQ ID NO: 799832 - DNA, 25 bp, Mus musculus
tcaccttgatgcgaccttcattttt

SEQ ID NO: 799833 - DNA, 25 bp, Mus musculus
tcaccttgcacacccctaagaaatt

SEQ ID NO: 799834 - DNA, 25 bp, Mus musculus
tcaccttgcacagccctaagaaatt

SEQ ID NO: 799835 - DNA, 25 bp, Mus musculus
tcaccttgcagacgcctttgcaaag

SEQ ID NO: 799836 - DNA, 25 bp, Mus musculus
tcaccttgcagaggcctttgcaaag

SEQ ID NO: 799837 - DNA, 25 bp, Mus musculus
tcaccttgctggcttgtgaggtgct

SEQ ID NO: 799838 - DNA, 25 bp, Mus musculus
tcaccttgctgggttgtgaggtgct

SEQ ID NO: 799839 - DNA, 25 bp, Mus musculus
tcaccttggcacacagatgcttgag

SEQ ID NO: 799840 - DNA, 25 bp, Mus musculus
tcaccttggcactcagatgcttgag

SEQ ID NO: 799841 - DNA, 25 bp, Mus musculus
tcaccttgggctccatgcagaggaa

SEQ ID NO: 799842 - DNA, 25 bp, Mus musculus
tcaccttgggctgcatgcagaggaa

SEQ ID NO: 799843 - DNA, 25 bp, Mus musculus
tcaccttgtagtcctcccagtggct

SEQ ID NO: 799844 - DNA, 25 bp, Mus musculus
tcaccttgtagtgctcccagtggct

SEQ ID NO: 799845 - DNA, 25 bp, Mus musculus
tcaccttgtcaacggtcccagggac

SEQ ID NO: 799846 - DNA, 25 bp, Mus musculus
tcaccttgtcaagggtcccagggac

SEQ ID NO: 799847 - DNA, 25 bp, Mus musculus
tcacctttacgcagacagttttcca

SEQ ID NO: 799848 - DNA, 25 bp, Mus musculus
tcacctttacgctgacagttttcca

SEQ ID NO: 799849 - DNA, 25 bp, Mus musculus
tcacctttattaagacaagaattag

SEQ ID NO: 799850 - DNA, 25 bp, Mus musculus
tcacctttattatgacaagaattag

SEQ ID NO: 799851 - DNA, 25 bp, Mus musculus
tcacctttcattatgtagacttgtc

SEQ ID NO: 799852 - DNA, 25 bp, Mus musculus
tcacctttcattttgtagacttgtc

SEQ ID NO: 799853 - DNA, 25 bp, Mus musculus
tcacctttcctcatgcctggaggaa

SEQ ID NO: 799854 - DNA, 25 bp, Mus musculus
tcacctttcctcttgcctggaggaa

SEQ ID NO: 799855 - DNA, 25 bp, Mus musculus
tcacctttcttaatctcatctctag

SEQ ID NO: 799856 - DNA, 25 bp, Mus musculus
tcacctttcttattctcatctctag

SEQ ID NO: 799857 - DNA, 25 bp, Mus musculus
tcacctttgaaacgcgttgtgggtc

SEQ ID NO: 799858 - DNA, 25 bp, Mus musculus
tcacctttgaaaggcgttgtgggtc

SEQ ID NO: 799859 - DNA, 25 bp, Mus musculus
tcacctttgagaaaacagaaactgt

SEQ ID NO: 799860 - DNA, 25 bp, Mus musculus
tcacctttgagataacagaaactgt

SEQ ID NO: 799861 - DNA, 25 bp, Mus musculus
tcacctttgaggcactgaccaacga

SEQ ID NO: 799862 - DNA, 25 bp, Mus musculus
tcacctttgagggactgaccaacga

SEQ ID NO: 799863 - DNA, 25 bp, Mus musculus
tcacctttgagtaccgctacctgga

SEQ ID NO: 799864 - DNA, 25 bp, Mus musculus
tcacctttgagttccgctacctgga

SEQ ID NO: 799865 - DNA, 25 bp, Mus musculus
tcacctttgcacagcaaggactctt

SEQ ID NO: 799866 - DNA, 25 bp, Mus musculus
tcacctttgcactgcaaggactctt

SEQ ID NO: 799867 - DNA, 25 bp, Mus musculus
tcacctttgcccaaataaaattgtg

SEQ ID NO: 799868 - DNA, 25 bp, Mus musculus
tcacctttgccctaataaaattgtg

SEQ ID NO: 799869 - DNA, 25 bp, Mus musculus
tcacctttgtctacatgtcttcatg

SEQ ID NO: 799870 - DNA, 25 bp, Mus musculus
tcacctttgtctctctttaaaactc

SEQ ID NO: 799871 - DNA, 25 bp, Mus musculus
tcacctttgtctgtctttaaaactc

SEQ ID NO: 799872 - DNA, 25 bp, Mus musculus
tcacctttgtcttcatgtcttcatg

SEQ ID NO: 799873 - DNA, 25 bp, Mus musculus
tcacctttgttacccttctgagtgc

SEQ ID NO: 799874 - DNA, 25 bp, Mus musculus
tcacctttgttagccttctgagtgc

SEQ ID NO: 799875 - DNA, 25 bp, Mus musculus
tcacctttgtttcttaagggttgag

SEQ ID NO: 799876 - DNA, 25 bp, Mus musculus
tcacctttgtttgttaagggttgag

SEQ ID NO: 799877 - DNA, 25 bp, Mus musculus
tcaccttttaaaatttctcctacag

SEQ ID NO: 799878 - DNA, 25 bp, Mus musculus
tcaccttttaaattttctcctacag

SEQ ID NO: 799879 - DNA, 25 bp, Mus musculus
tcaccttttgccaaatctttgctgg

SEQ ID NO: 799880 - DNA, 25 bp, Mus musculus
tcaccttttgcctaatctttgctgg

SEQ ID NO: 799881 - DNA, 25 bp, Mus musculus
tcacgaaatcctacaccaaagagta

SEQ ID NO: 799882 - DNA, 25 bp, Mus musculus
tcacgaaatccttcaccaaagagta

SEQ ID NO: 799883 - DNA, 25 bp, Mus musculus
tcacgaacagaacgaaaacagatca

SEQ ID NO: 799884 - DNA, 25 bp, Mus musculus
tcacgaacagaaggaaaacagatca

SEQ ID NO: 799885 - DNA, 25 bp, Mus musculus
tcacgaacccggaagggactgcttt

SEQ ID NO: 799886 - DNA, 25 bp, Mus musculus
tcacgaacccggtagggactgcttt

SEQ ID NO: 799887 - DNA, 25 bp, Mus musculus
tcacgaagcacaactgtccacagag

SEQ ID NO: 799888 - DNA, 25 bp, Mus musculus
tcacgaagcacatctgtccacagag

SEQ ID NO: 799889 - DNA, 25 bp, Mus musculus
tcacgaagcactcagatcgctgccg

SEQ ID NO: 799890 - DNA, 25 bp, Mus musculus
tcacgaagcactgagatcgctgccg

SEQ ID NO: 799891 - DNA, 25 bp, Mus musculus
tcacgacatagaagggctcggagta

SEQ ID NO: 799892 - DNA, 25 bp, Mus musculus
tcacgacatagatgggctcggagta

SEQ ID NO: 799893 - DNA, 25 bp, Mus musculus
tcacgaccccagattgactattctg

SEQ ID NO: 799894 - DNA, 25 bp, Mus musculus
tcacgaccccagtttgactattctg

SEQ ID NO: 799895 - DNA, 25 bp, Mus musculus
tcacgacctctcctgaggcctgtgg

SEQ ID NO: 799896 - DNA, 25 bp, Mus musculus
tcacgacctctcgtgaggcctgtgg

SEQ ID NO: 799897 - DNA, 25 bp, Mus musculus
tcacgaccttccacaagtggattga

SEQ ID NO: 799898 - DNA, 25 bp, Mus musculus
tcacgaccttcctcaagtggattga

SEQ ID NO: 799899 - DNA, 25 bp, Mus musculus
tcacgacggttccacggacggcagc

SEQ ID NO: 799900 - DNA, 25 bp, Mus musculus
tcacgacggttcgacggacggcagc

SEQ ID NO: 799901 - DNA, 25 bp, Mus musculus
tcacgactagaaccgctctggctgc

SEQ ID NO: 799902 - DNA, 25 bp, Mus musculus
tcacgactagaagcgctctggctgc

SEQ ID NO: 799903 - DNA, 25 bp, Mus musculus
tcacgactcctcatctgattttatg

SEQ ID NO: 799904 - DNA, 25 bp, Mus musculus
tcacgactcctcttctgattttatg

SEQ ID NO: 799905 - DNA, 25 bp, Mus musculus
tcacgactccttactggtgtggaaa

SEQ ID NO: 799906 - DNA, 25 bp, Mus musculus
tcacgactcctttctggtgtggaaa

SEQ ID NO: 799907 - DNA, 25 bp, Mus musculus
tcacgactcttacttctgcatataa

SEQ ID NO: 799908 - DNA, 25 bp, Mus musculus
tcacgactcttagttctgcatataa

SEQ ID NO: 799909 - DNA, 25 bp, Mus musculus
tcacgactctttctatccagctttt

SEQ ID NO: 799910 - DNA, 25 bp, Mus musculus
tcacgactctttgtatccagctttt

SEQ ID NO: 799911 - DNA, 25 bp, Mus musculus
tcacgactgagtaggagcggctcca

SEQ ID NO: 799912 - DNA, 25 bp, Mus musculus
tcacgactgagttggagcggctcca

SEQ ID NO: 799913 - DNA, 25 bp, Mus musculus
tcacgacttcatagagcacatcctt

SEQ ID NO: 799914 - DNA, 25 bp, Mus musculus
tcacgacttcattgagcacatcctt

SEQ ID NO: 799915 - DNA, 25 bp, Mus musculus
tcacgagagttgctatgctgctttc

SEQ ID NO: 799916 - DNA, 25 bp, Mus musculus
tcacgagagttggtatgctgctttc

SEQ ID NO: 799917 - DNA, 25 bp, Mus musculus
tcacgagctgtcatttacacccttg

SEQ ID NO: 799918 - DNA, 25 bp, Mus musculus
tcacgagctgtcttttacacccttg

SEQ ID NO: 799919 - DNA, 25 bp, Mus musculus
tcacgaggaactccttgctcacagc

SEQ ID NO: 799920 - DNA, 25 bp, Mus musculus
tcacgaggaactgcttgctcacagc

SEQ ID NO: 799921 - DNA, 25 bp, Mus musculus
tcacgaggagatctccgactgcctg

SEQ ID NO: 799922 - DNA, 25 bp, Mus musculus
tcacgaggagatgtccgactgcctg

SEQ ID NO: 799923 - DNA, 25 bp, Mus musculus
tcacgagggactcgcacaagggact

SEQ ID NO: 799924 - DNA, 25 bp, Mus musculus
tcacgagggactggcacaagggact

SEQ ID NO: 799925 - DNA, 25 bp, Mus musculus
tcacgaggtcaacagctgctacttg

SEQ ID NO: 799926 - DNA, 25 bp, Mus musculus
tcacgaggtcaagagctgctacttg

SEQ ID NO: 799927 - DNA, 25 bp, Mus musculus
tcacgagtacccatccctaaatatc

SEQ ID NO: 799928 - DNA, 25 bp, Mus musculus
tcacgagtacccttccctaaatatc

SEQ ID NO: 799929 - DNA, 25 bp, Mus musculus
tcacgagtccctcattctattttat

SEQ ID NO: 799930 - DNA, 25 bp, Mus musculus
tcacgagtccctgattctattttat

SEQ ID NO: 799931 - DNA, 25 bp, Mus musculus
tcacgagtcctcacagacatctgtt

SEQ ID NO: 799932 - DNA, 25 bp, Mus musculus
tcacgagtcctctcagacatctgtt

SEQ ID NO: 799933 - DNA, 25 bp, Mus musculus
tcacgagtgaaaccagacatcagca

SEQ ID NO: 799934 - DNA, 25 bp, Mus musculus
tcacgagtgaaagcagacatcagca

SEQ ID NO: 799935 - DNA, 25 bp, Mus musculus
tcacgatatggcaggattccatcca

SEQ ID NO: 799936 - DNA, 25 bp, Mus musculus
tcacgatatggctggattccatcca

SEQ ID NO: 799937 - DNA, 25 bp, Mus musculus
tcacgatgtgaaactgaaggtcaat

SEQ ID NO: 799938 - DNA, 25 bp, Mus musculus
tcacgatgtgaatctgaaggtcaat

SEQ ID NO: 799939 - DNA, 25 bp, Mus musculus
tcacgattgtatattctggcattat

SEQ ID NO: 799940 - DNA, 25 bp, Mus musculus
tcacgattgtattttctggcattat

SEQ ID NO: 799941 - DNA, 25 bp, Mus musculus
tcacgatttaaaccatgtctgctaa

SEQ ID NO: 799942 - DNA, 25 bp, Mus musculus
tcacgatttaaagcatgtctgctaa

SEQ ID NO: 799943 - DNA, 25 bp, Mus musculus
tcacgcaacgtcatgacattggtaa

SEQ ID NO: 799944 - DNA, 25 bp, Mus musculus
tcacgcaacgtcttgacattggtaa

SEQ ID NO: 799945 - DNA, 25 bp, Mus musculus
tcacgcaagggcaccagggttccat

SEQ ID NO: 799946 - DNA, 25 bp, Mus musculus
tcacgcaagggctccagggttccat

SEQ ID NO: 799947 - DNA, 25 bp, Mus musculus
tcacgcacacgcatcaatgtacaga

SEQ ID NO: 799948 - DNA, 25 bp, Mus musculus
tcacgcacacgcttcaatgtacaga

SEQ ID NO: 799949 - DNA, 25 bp, Mus musculus
tcacgcacattcattgcatctgtat

SEQ ID NO: 799950 - DNA, 25 bp, Mus musculus
tcacgcacattctttgcatctgtat

SEQ ID NO: 799951 - DNA, 25 bp, Mus musculus
tcacgcagaggtccctgttacgaac

SEQ ID NO: 799952 - DNA, 25 bp, Mus musculus
tcacgcagaggtgcctgttacgaac

SEQ ID NO: 799953 - DNA, 25 bp, Mus musculus
tcacgcagtcggcatagaagattcc

SEQ ID NO: 799954 - DNA, 25 bp, Mus musculus
tcacgcagtcgggatagaagattcc

SEQ ID NO: 799955 - DNA, 25 bp, Mus musculus
tcacgccaatgcctttggatttcct

SEQ ID NO: 799956 - DNA, 25 bp, Mus musculus
tcacgccaatgcgtttggatttcct

SEQ ID NO: 799957 - DNA, 25 bp, Mus musculus
tcacgccacaataccaagacagaca

SEQ ID NO: 799958 - DNA, 25 bp, Mus musculus
tcacgccacaattccaagacagaca

SEQ ID NO: 799959 - DNA, 25 bp, Mus musculus
tcacgccagacacttggaagtgact

SEQ ID NO: 799960 - DNA, 25 bp, Mus musculus
tcacgccagacagttggaagtgact

SEQ ID NO: 799961 - DNA, 25 bp, Mus musculus
tcacgccagaggagcaactcgccat

SEQ ID NO: 799962 - DNA, 25 bp, Mus musculus
tcacgccagaggatgacgattgttt

SEQ ID NO: 799963 - DNA, 25 bp, Mus musculus
tcacgccagaggtgcaactcgccat

SEQ ID NO: 799964 - DNA, 25 bp, Mus musculus
tcacgccagaggttgacgattgttt

SEQ ID NO: 799965 - DNA, 25 bp, Mus musculus
tcacgccagctaccagcggtggcga

SEQ ID NO: 799966 - DNA, 25 bp, Mus musculus
tcacgccagctagcagcggtggcga

SEQ ID NO: 799967 - DNA, 25 bp, Mus musculus
tcacgccagtgtccgcaggctgaca

SEQ ID NO: 799968 - DNA, 25 bp, Mus musculus
tcacgccagtgtgcgcaggctgaca

SEQ ID NO: 799969 - DNA, 25 bp, Mus musculus
tcacgcccagcgcacaaacctacgg

SEQ ID NO: 799970 - DNA, 25 bp, Mus musculus
tcacgcccagcggacaaacctacgg

SEQ ID NO: 799971 - DNA, 25 bp, Mus musculus
tcacgccccgtgaatgaatgtgtac

SEQ ID NO: 799972 - DNA, 25 bp, Mus musculus
tcacgccccgtgtatgaatgtgtac

SEQ ID NO: 799973 - DNA, 25 bp, Mus musculus
tcacgccggttgaagccctgctgca

SEQ ID NO: 799974 - DNA, 25 bp, Mus musculus
tcacgccggttgtagccctgctgca

SEQ ID NO: 799975 - DNA, 25 bp, Mus musculus
tcacgcgagcttacatgttcagcat

SEQ ID NO: 799976 - DNA, 25 bp, Mus musculus
tcacgcgagctttcatgttcagcat

SEQ ID NO: 799977 - DNA, 25 bp, Mus musculus
tcacgcgatggaaatttctgttttt

SEQ ID NO: 799978 - DNA, 25 bp, Mus musculus
tcacgcgatggatatttctgttttt

SEQ ID NO: 799979 - DNA, 25 bp, Mus musculus
tcacgcgcggtgatgacgacgacaa

SEQ ID NO: 799980 - DNA, 25 bp, Mus musculus
tcacgcgcggtgttgacgacgacaa

SEQ ID NO: 799981 - DNA, 25 bp, Mus musculus
tcacgcgctaagattgtatctgttt

SEQ ID NO: 799982 - DNA, 25 bp, Mus musculus
tcacgcgctaagtttgtatctgttt

SEQ ID NO: 799983 - DNA, 25 bp, Mus musculus
tcacgcggatccagcagatggagga

SEQ ID NO: 799984 - DNA, 25 bp, Mus musculus
tcacgcggatccagggaagcctgag

SEQ ID NO: 799985 - DNA, 25 bp, Mus musculus
tcacgcggatcctgcagatggagga

SEQ ID NO: 799986 - DNA, 25 bp, Mus musculus
tcacgcggatcctgggaagcctgag

SEQ ID NO: 799987 - DNA, 25 bp, Mus musculus
tcacgcggggttagtacattttttg

SEQ ID NO: 799988 - DNA, 25 bp, Mus musculus
tcacgcggggtttgtacattttttg

SEQ ID NO: 799989 - DNA, 25 bp, Mus musculus
tcacgcgggtgcagctgcatgtact

SEQ ID NO: 799990 - DNA, 25 bp, Mus musculus
tcacgcgggtgctgctgcatgtact

SEQ ID NO: 799991 - DNA, 25 bp, Mus musculus
tcacgcggttggactctgttaagag

SEQ ID NO: 799992 - DNA, 25 bp, Mus musculus
tcacgcggttggtctctgttaagag

SEQ ID NO: 799993 - DNA, 25 bp, Mus musculus
tcacgcgtgctcaatgaagtaccaa

SEQ ID NO: 799994 - DNA, 25 bp, Mus musculus
tcacgcgtgctctatgaagtaccaa

SEQ ID NO: 799995 - DNA, 25 bp, Mus musculus
tcacgctaacataggccgctaggaa

SEQ ID NO: 799996 - DNA, 25 bp, Mus musculus
tcacgctaacattggccgctaggaa

SEQ ID NO: 799997 - DNA, 25 bp, Mus musculus
tcacgctagctacgcacgcacggat

SEQ ID NO: 799998 - DNA, 25 bp, Mus musculus
tcacgctagctaggcacgcacggat

SEQ ID NO: 799999 - DNA, 25 bp, Mus musculus
tcacgctcatgacgcctcaagttca

SEQ ID NO: 800000 - DNA, 25 bp, Mus musculus
tcacgctcatgaggcctcaagttca

SEQ ID NO: 800001 - DNA, 25 bp, Mus musculus
tcacgctcctgactttgtagaattt

SEQ ID NO: 800002 - DNA, 25 bp, Mus musculus
tcacgctcctgagtttgtagaattt

SEQ ID NO: 800003 - DNA, 25 bp, Mus musculus
tcacgctctgtaaagtcactgttgg

SEQ ID NO: 800004 - DNA, 25 bp, Mus musculus
tcacgctctgtatagtcactgttgg

SEQ ID NO: 800005 - DNA, 25 bp, Mus musculus
tcacgctgaataaatgaccacgctc

SEQ ID NO: 800006 - DNA, 25 bp, Mus musculus
tcacgctgaatatatgaccacgctc

SEQ ID NO: 800007 - DNA, 25 bp, Mus musculus
tcacgctggaatcttggctcattat

SEQ ID NO: 800008 - DNA, 25 bp, Mus musculus
tcacgctggaatgttggctcattat

SEQ ID NO: 800009 - DNA, 25 bp, Mus musculus
tcacgctggatcctcggcacagtga

SEQ ID NO: 800010 - DNA, 25 bp, Mus musculus
tcacgctggatcgtcggcacagtga

SEQ ID NO: 800011 - DNA, 25 bp, Mus musculus
tcacgctgtatcatgtcatctcctt

SEQ ID NO: 800012 - DNA, 25 bp, Mus musculus
tcacgctgtatcttgtcatctcctt

SEQ ID NO: 800013 - DNA, 25 bp, Mus musculus
tcacgcttgcagacacgtagtacat

SEQ ID NO: 800014 - DNA, 25 bp, Mus musculus
tcacgcttgcagtcacgtagtacat

SEQ ID NO: 800015 - DNA, 25 bp, Mus musculus
tcacgctttcatatttgcctgtcag

SEQ ID NO: 800016 - DNA, 25 bp, Mus musculus
tcacgctttcatttttgcctgtcag

SEQ ID NO: 800017 - DNA, 25 bp, Mus musculus
tcacggactactaacatcagagcct

SEQ ID NO: 800018 - DNA, 25 bp, Mus musculus
tcacggactacttacatcagagcct

SEQ ID NO: 800019 - DNA, 25 bp, Mus musculus
tcacggagacgcacggcaggacagc

SEQ ID NO: 800020 - DNA, 25 bp, Mus musculus
tcacggagacgctcggcaggacagc

SEQ ID NO: 800021 - DNA, 25 bp, Mus musculus
tcacggagcgcgcagaaagttgcaa

SEQ ID NO: 800022 - DNA, 25 bp, Mus musculus
tcacggagcgcggagaaagttgcaa

SEQ ID NO: 800023 - DNA, 25 bp, Mus musculus
tcacggaggaagcagcacgccaaca

SEQ ID NO: 800024 - DNA, 25 bp, Mus musculus
tcacggaggaaggagcacgccaaca

SEQ ID NO: 800025 - DNA, 25 bp, Mus musculus
tcacggagttggagcgagcagcctt

SEQ ID NO: 800026 - DNA, 25 bp, Mus musculus
tcacggagttggtgcgagcagcctt

SEQ ID NO: 800027 - DNA, 25 bp, Mus musculus
tcacggatgggtaaccaggcccgga

SEQ ID NO: 800028 - DNA, 25 bp, Mus musculus
tcacggatgggttaccaggcccgga

SEQ ID NO: 800029 - DNA, 25 bp, Mus musculus
tcacggcaaattcaacggcacagtc

SEQ ID NO: 800030 - DNA, 25 bp, Mus musculus
tcacggcaaattgaacggcacagtc

SEQ ID NO: 800031 - DNA, 25 bp, Mus musculus
tcacggcaattccactgggttccag

SEQ ID NO: 800032 - DNA, 25 bp, Mus musculus
tcacggcaattcgactgggttccag

SEQ ID NO: 800033 - DNA, 25 bp, Mus musculus
tcacggcaccttagactctactgtc

SEQ ID NO: 800034 - DNA, 25 bp, Mus musculus
tcacggcacctttgactctactgtc

SEQ ID NO: 800035 - DNA, 25 bp, Mus musculus
tcacggcagccaattaccttaactg

SEQ ID NO: 800036 - DNA, 25 bp, Mus musculus
tcacggcagccatttaccttaactg

SEQ ID NO: 800037 - DNA, 25 bp, Mus musculus
tcacggcagtggagagatcctcaca

SEQ ID NO: 800038 - DNA, 25 bp, Mus musculus
tcacggcagtggtgagatcctcaca

SEQ ID NO: 800039 - DNA, 25 bp, Mus musculus
tcacggccactgagcaggtccatgg

SEQ ID NO: 800040 - DNA, 25 bp, Mus musculus
tcacggccactgtgcaggtccatgg

SEQ ID NO: 800041 - DNA, 25 bp, Mus musculus
tcacggccatccaggctggttttgt

SEQ ID NO: 800042 - DNA, 25 bp, Mus musculus
tcacggccatcctggctggttttgt

SEQ ID NO: 800043 - DNA, 25 bp, Mus musculus
tcacggcgttggcacttgttgtcaa

SEQ ID NO: 800044 - DNA, 25 bp, Mus musculus
tcacggcgttgggacttgttgtcaa

SEQ ID NO: 800045 - DNA, 25 bp, Mus musculus
tcacggcgtttgcagtcgttgtttt

SEQ ID NO: 800046 - DNA, 25 bp, Mus musculus
tcacggcgtttggagtcgttgtttt

SEQ ID NO: 800047 - DNA, 25 bp, Mus musculus
tcacggctctggagatttggtggca

SEQ ID NO: 800048 - DNA, 25 bp, Mus musculus
tcacggctctggtgatttggtggca

SEQ ID NO: 800049 - DNA, 25 bp, Mus musculus
tcacggctctgtctggctatcatta

SEQ ID NO: 800050 - DNA, 25 bp, Mus musculus
tcacggctctgtgtggctatcatta

SEQ ID NO: 800051 - DNA, 25 bp, Mus musculus
tcacggcttcagatgatggctacat

SEQ ID NO: 800052 - DNA, 25 bp, Mus musculus
tcacggcttcagttgatggctacat

SEQ ID NO: 800053 - DNA, 25 bp, Mus musculus
tcacgggacctactggcaacaaagt

SEQ ID NO: 800054 - DNA, 25 bp, Mus musculus
tcacgggacctagtggcaacaaagt

SEQ ID NO: 800055 - DNA, 25 bp, Mus musculus
tcacgggaccttcctaatcatggaa

SEQ ID NO: 800056 - DNA, 25 bp, Mus musculus
tcacgggaccttgctaatcatggaa

SEQ ID NO: 800057 - DNA, 25 bp, Mus musculus
tcacgggagaagactctgtgctaca

SEQ ID NO: 800058 - DNA, 25 bp, Mus musculus
tcacgggagaagtctctgtgctaca

SEQ ID NO: 800059 - DNA, 25 bp, Mus musculus
tcacgggagctgagagggtctccac

SEQ ID NO: 800060 - DNA, 25 bp, Mus musculus
tcacgggagctgtgagggtctccac

SEQ ID NO: 800061 - DNA, 25 bp, Mus musculus
tcacgggatacacagttccacctgc

SEQ ID NO: 800062 - DNA, 25 bp, Mus musculus
tcacgggatacagagttccacctgc

SEQ ID NO: 800063 - DNA, 25 bp, Mus musculus
tcacgggcagccacacaggcgccgg

SEQ ID NO: 800064 - DNA, 25 bp, Mus musculus
tcacgggcagcctcacaggcgccgg

SEQ ID NO: 800065 - DNA, 25 bp, Mus musculus
tcacgggcagtgctctactgattgt

SEQ ID NO: 800066 - DNA, 25 bp, Mus musculus
tcacgggcagtggtctactgattgt

SEQ ID NO: 800067 - DNA, 25 bp, Mus musculus
tcacgggccaaacacaacaatcttt

SEQ ID NO: 800068 - DNA, 25 bp, Mus musculus
tcacgggccaaagacaacaatcttt

SEQ ID NO: 800069 - DNA, 25 bp, Mus musculus
tcacgggccagtatcagcatgtgga

SEQ ID NO: 800070 - DNA, 25 bp, Mus musculus
tcacgggccagtttcagcatgtgga

SEQ ID NO: 800071 - DNA, 25 bp, Mus musculus
tcacgggccgaacaggagcacctga

SEQ ID NO: 800072 - DNA, 25 bp, Mus musculus
tcacgggccgaagaggagcacctga

SEQ ID NO: 800073 - DNA, 25 bp, Mus musculus
tcacgggctgtcctggtttattcca

SEQ ID NO: 800074 - DNA, 25 bp, Mus musculus
tcacgggctgtcgtggtttattcca

SEQ ID NO: 800075 - DNA, 25 bp, Mus musculus
tcacgggtaaagacctactgtttca

SEQ ID NO: 800076 - DNA, 25 bp, Mus musculus
tcacgggtaaagtcctactgtttca

SEQ ID NO: 800077 - DNA, 25 bp, Mus musculus
tcacgggtacctcgcacgaatacgg

SEQ ID NO: 800078 - DNA, 25 bp, Mus musculus
tcacgggtacctggcacgaatacgg

SEQ ID NO: 800079 - DNA, 25 bp, Mus musculus
tcacgggtattcaaaggtcaacagc

SEQ ID NO: 800080 - DNA, 25 bp, Mus musculus
tcacgggtattctaaggtcaacagc

SEQ ID NO: 800081 - DNA, 25 bp, Mus musculus
tcacgggtgccaaacttttctctag

SEQ ID NO: 800082 - DNA, 25 bp, Mus musculus
tcacgggtgccatacttttctctag

SEQ ID NO: 800083 - DNA, 25 bp, Mus musculus
tcacgggtgcttccagtgcaaacga

SEQ ID NO: 800084 - DNA, 25 bp, Mus musculus
tcacgggtgcttgcagtgcaaacga

SEQ ID NO: 800085 - DNA, 25 bp, Mus musculus
tcacgggtggctctggctttaccat

SEQ ID NO: 800086 - DNA, 25 bp, Mus musculus
tcacgggtggctgtggctttaccat

SEQ ID NO: 800087 - DNA, 25 bp, Mus musculus
tcacgggttatacatggctcagttt

SEQ ID NO: 800088 - DNA, 25 bp, Mus musculus
tcacgggttatagatggctcagttt

SEQ ID NO: 800089 - DNA, 25 bp, Mus musculus
tcacgggttcctcggtggtcaaaca

SEQ ID NO: 800090 - DNA, 25 bp, Mus musculus
tcacgggttcctgggtggtcaaaca

SEQ ID NO: 800091 - DNA, 25 bp, Mus musculus
tcacgggtttggctctcctgcagga

SEQ ID NO: 800092 - DNA, 25 bp, Mus musculus
tcacgggtttgggtctcctgcagga

SEQ ID NO: 800093 - DNA, 25 bp, Mus musculus
tcacgggttttcaacacaaggagaa

SEQ ID NO: 800094 - DNA, 25 bp, Mus musculus
tcacgggttttctacacaaggagaa

SEQ ID NO: 800095 - DNA, 25 bp, Mus musculus
tcacggtagttaccggattgtacat

SEQ ID NO: 800096 - DNA, 25 bp, Mus musculus
tcacggtagttagcggattgtacat

SEQ ID NO: 800097 - DNA, 25 bp, Mus musculus
tcacggtcacgtcgccacatgaaag

SEQ ID NO: 800098 - DNA, 25 bp, Mus musculus
tcacggtcacgtggccacatgaaag

SEQ ID NO: 800099 - DNA, 25 bp, Mus musculus
tcacggtccaacacacaggcaaaga

SEQ ID NO: 800100 - DNA, 25 bp, Mus musculus
tcacggtccaactcacaggcaaaga

SEQ ID NO: 800101 - DNA, 25 bp, Mus musculus
tcacggtctctgcagtaacccactt

SEQ ID NO: 800102 - DNA, 25 bp, Mus musculus
tcacggtctctggagtaacccactt

SEQ ID NO: 800103 - DNA, 25 bp, Mus musculus
tcacggtctgggaagagttttcaat

SEQ ID NO: 800104 - DNA, 25 bp, Mus musculus
tcacggtctgggtagagttttcaat

SEQ ID NO: 800105 - DNA, 25 bp, Mus musculus
tcacggtgaacaagaccgcggctgt

SEQ ID NO: 800106 - DNA, 25 bp, Mus musculus
tcacggtgaacatgaccgcggctgt

SEQ ID NO: 800107 - DNA, 25 bp, Mus musculus
tcacggtgacggaacggaactcaat

SEQ ID NO: 800108 - DNA, 25 bp, Mus musculus
tcacggtgacggtacggaactcaat

SEQ ID NO: 800109 - DNA, 25 bp, Mus musculus
tcacggtgtgccagatgaacttcaa

SEQ ID NO: 800110 - DNA, 25 bp, Mus musculus
tcacggtgtgcctgatgaacttcaa

SEQ ID NO: 800111 - DNA, 25 bp, Mus musculus
tcacggttaatcatgttcggccctt

SEQ ID NO: 800112 - DNA, 25 bp, Mus musculus
tcacggttaatcttgttcggccctt

SEQ ID NO: 800113 - DNA, 25 bp, Mus musculus
tcacggttagacagtgataccacag

SEQ ID NO: 800114 - DNA, 25 bp, Mus musculus
tcacggttagactgtgataccacag

SEQ ID NO: 800115 - DNA, 25 bp, Mus musculus
tcacggttggtgaggaaactacttc

SEQ ID NO: 800116 - DNA, 25 bp, Mus musculus
tcacggttggtgtggaaactacttc

SEQ ID NO: 800117 - DNA, 25 bp, Mus musculus
tcacggttggttactaggctcactg

SEQ ID NO: 800118 - DNA, 25 bp, Mus musculus
tcacggttggtttctaggctcactg

SEQ ID NO: 800119 - DNA, 25 bp, Mus musculus
tcacggttgtcacgcagagctataa

SEQ ID NO: 800120 - DNA, 25 bp, Mus musculus
tcacggttgtcaggcagagctataa

SEQ ID NO: 800121 - DNA, 25 bp, Mus musculus
tcacgtaattgaccgcgctattcag

SEQ ID NO: 800122 - DNA, 25 bp, Mus musculus
tcacgtaattgagcgcgctattcag

SEQ ID NO: 800123 - DNA, 25 bp, Mus musculus
tcacgtaattggaaagggagcacag

SEQ ID NO: 800124 - DNA, 25 bp, Mus musculus
tcacgtaattggtaagggagcacag

SEQ ID NO: 800125 - DNA, 25 bp, Mus musculus
tcacgtacacgtattctggtcttac

SEQ ID NO: 800126 - DNA, 25 bp, Mus musculus
tcacgtacacgttttctggtcttac

SEQ ID NO: 800127 - DNA, 25 bp, Mus musculus
tcacgtactgtcaccttgtaacatt

SEQ ID NO: 800128 - DNA, 25 bp, Mus musculus
tcacgtactgtctccttgtaacatt

SEQ ID NO: 800129 - DNA, 25 bp, Mus musculus
tcacgtaggtttcaactgcttacat

SEQ ID NO: 800130 - DNA, 25 bp, Mus musculus
tcacgtaggtttgaactgcttacat

SEQ ID NO: 800131 - DNA, 25 bp, Mus musculus
tcacgtcacacccaagtttgggatg

SEQ ID NO: 800132 - DNA, 25 bp, Mus musculus
tcacgtcacaccgaagtttgggatg

SEQ ID NO: 800133 - DNA, 25 bp, Mus musculus
tcacgtcagaacatagccatccagt

SEQ ID NO: 800134 - DNA, 25 bp, Mus musculus
tcacgtcagaacttagccatccagt

SEQ ID NO: 800135 - DNA, 25 bp, Mus musculus
tcacgtcagtttctttcatatctta

SEQ ID NO: 800136 - DNA, 25 bp, Mus musculus
tcacgtcagtttgtttcatatctta

SEQ ID NO: 800137 - DNA, 25 bp, Mus musculus
tcacgtcatggacaattccaattcc

SEQ ID NO: 800138 - DNA, 25 bp, Mus musculus
tcacgtcatggagaattccaattcc

SEQ ID NO: 800139 - DNA, 25 bp, Mus musculus
tcacgtcgtgccaggctcaggagtt

SEQ ID NO: 800140 - DNA, 25 bp, Mus musculus
tcacgtcgtgcctggctcaggagtt

SEQ ID NO: 800141 - DNA, 25 bp, Mus musculus
tcacgtctcactcattgcaatcaag

SEQ ID NO: 800142 - DNA, 25 bp, Mus musculus
tcacgtctcactgattgcaatcaag

SEQ ID NO: 800143 - DNA, 25 bp, Mus musculus
tcacgtctgtttatacacatcggga

SEQ ID NO: 800144 - DNA, 25 bp, Mus musculus
tcacgtctgtttttacacatcggga

SEQ ID NO: 800145 - DNA, 25 bp, Mus musculus
tcacgtgaagctcccattccactga

SEQ ID NO: 800146 - DNA, 25 bp, Mus musculus
tcacgtgaagctgccattccactga

SEQ ID NO: 800147 - DNA, 25 bp, Mus musculus
tcacgtgacatcctctggtgtggat

SEQ ID NO: 800148 - DNA, 25 bp, Mus musculus
tcacgtgacatcgtctggtgtggat

SEQ ID NO: 800149 - DNA, 25 bp, Mus musculus
tcacgtgacccaaaccgcatatagt

SEQ ID NO: 800150 - DNA, 25 bp, Mus musculus
tcacgtgacccataccgcatatagt

SEQ ID NO: 800151 - DNA, 25 bp, Mus musculus
tcacgtgacgcactctgtccagtgt

SEQ ID NO: 800152 - DNA, 25 bp, Mus musculus
tcacgtgacgcagtctgtccagtgt

SEQ ID NO: 800153 - DNA, 25 bp, Mus musculus
tcacgtgagagcatctacttcctaa

SEQ ID NO: 800154 - DNA, 25 bp, Mus musculus
tcacgtgagagcttctacttcctaa

SEQ ID NO: 800155 - DNA, 25 bp, Mus musculus
tcacgtgatggcaacggtggaagtc

SEQ ID NO: 800156 - DNA, 25 bp, Mus musculus
tcacgtgatggctacggtggaagtc

SEQ ID NO: 800157 - DNA, 25 bp, Mus musculus
tcacgtgatggtctgagtctgcatt

SEQ ID NO: 800158 - DNA, 25 bp, Mus musculus
tcacgtgatggtgtgagtctgcatt

SEQ ID NO: 800159 - DNA, 25 bp, Mus musculus
tcacgtgcaacgactgggaaaaatt

SEQ ID NO: 800160 - DNA, 25 bp, Mus musculus
tcacgtgcaacgtctgggaaaaatt

SEQ ID NO: 800161 - DNA, 25 bp, Mus musculus
tcacgtgcctcacagacgcagactt

SEQ ID NO: 800162 - DNA, 25 bp, Mus musculus
tcacgtgcctcagagacgcagactt

SEQ ID NO: 800163 - DNA, 25 bp, Mus musculus
tcacgtgccttcatccacagtggag

SEQ ID NO: 800164 - DNA, 25 bp, Mus musculus
tcacgtgccttcttccacagtggag

SEQ ID NO: 800165 - DNA, 25 bp, Mus musculus
tcacgtgcttttcaggaccaggcct

SEQ ID NO: 800166 - DNA, 25 bp, Mus musculus
tcacgtgcttttgaggaccaggcct

SEQ ID NO: 800167 - DNA, 25 bp, Mus musculus
tcacgtggacacacagggttcttag

SEQ ID NO: 800168 - DNA, 25 bp, Mus musculus
tcacgtggacactcagggttcttag

SEQ ID NO: 800169 - DNA, 25 bp, Mus musculus
tcacgtggatttacaaccttctgca

SEQ ID NO: 800170 - DNA, 25 bp, Mus musculus
tcacgtggattttcaaccttctgca

SEQ ID NO: 800171 - DNA, 25 bp, Mus musculus
tcacgtggttccctcctatggagga

SEQ ID NO: 800172 - DNA, 25 bp, Mus musculus
tcacgtggttccgtcctatggagga

SEQ ID NO: 800173 - DNA, 25 bp, Mus musculus
tcacgtgtatctacagccacaaaag

SEQ ID NO: 800174 - DNA, 25 bp, Mus musculus
tcacgtgtatcttcagccacaaaag

SEQ ID NO: 800175 - DNA, 25 bp, Mus musculus
tcacgtgtcccacccggccagcagg

SEQ ID NO: 800176 - DNA, 25 bp, Mus musculus
tcacgtgtcccagccggccagcagg

SEQ ID NO: 800177 - DNA, 25 bp, Mus musculus
tcacgtgtgattacaggacccggac

SEQ ID NO: 800178 - DNA, 25 bp, Mus musculus
tcacgtgtgatttcaggacccggac

SEQ ID NO: 800179 - DNA, 25 bp, Mus musculus
tcacgtgtgcatctcacagatgaaa

SEQ ID NO: 800180 - DNA, 25 bp, Mus musculus
tcacgtgtgcatgtcacagatgaaa

SEQ ID NO: 800181 - DNA, 25 bp, Mus musculus
tcacgtgtggctccttctgctctac

SEQ ID NO: 800182 - DNA, 25 bp, Mus musculus
tcacgtgtggctgcttctgctctac

SEQ ID NO: 800183 - DNA, 25 bp, Mus musculus
tcacgtgttctgcatgctgggatgt

SEQ ID NO: 800184 - DNA, 25 bp, Mus musculus
tcacgtgttctggatgctgggatgt

SEQ ID NO: 800185 - DNA, 25 bp, Mus musculus
tcacgttacaggcattggtcattaa

SEQ ID NO: 800186 - DNA, 25 bp, Mus musculus
tcacgttacagggattggtcattaa

SEQ ID NO: 800187 - DNA, 25 bp, Mus musculus
tcacgttattttcagttcttcccca

SEQ ID NO: 800188 - DNA, 25 bp, Mus musculus
tcacgttattttgagttcttcccca

SEQ ID NO: 800189 - DNA, 25 bp, Mus musculus
tcacgttcaggtagtttggcagctt

SEQ ID NO: 800190 - DNA, 25 bp, Mus musculus
tcacgttcaggttgtttggcagctt

SEQ ID NO: 800191 - DNA, 25 bp, Mus musculus
tcacgttccgggaagtgatgaatcg

SEQ ID NO: 800192 - DNA, 25 bp, Mus musculus
tcacgttccgggtagtgatgaatcg

SEQ ID NO: 800193 - DNA, 25 bp, Mus musculus
tcacgttgagggatggctgccctaa

SEQ ID NO: 800194 - DNA, 25 bp, Mus musculus
tcacgttgagggttggctgccctaa

SEQ ID NO: 800195 - DNA, 25 bp, Mus musculus
tcacgttgttctcgtcccgggaaag

SEQ ID NO: 800196 - DNA, 25 bp, Mus musculus
tcacgttgttctggtcccgggaaag

SEQ ID NO: 800197 - DNA, 25 bp, Mus musculus
tcacgttgttttcgctgctattgga

SEQ ID NO: 800198 - DNA, 25 bp, Mus musculus
tcacgttgttttggctgctattgga

SEQ ID NO: 800199 - DNA, 25 bp, Mus musculus
tcacgtttaaatcggtaatttcact

SEQ ID NO: 800200 - DNA, 25 bp, Mus musculus
tcacgtttaaatgggtaatttcact

SEQ ID NO: 800201 - DNA, 25 bp, Mus musculus
tcacgtttacctcatttcaggcagc

SEQ ID NO: 800202 - DNA, 25 bp, Mus musculus
tcacgtttacctgatttcaggcagc

SEQ ID NO: 800203 - DNA, 25 bp, Mus musculus
tcacgtttcccactctggtttggat

SEQ ID NO: 800204 - DNA, 25 bp, Mus musculus
tcacgtttcccagtctggtttggat

SEQ ID NO: 800205 - DNA, 25 bp, Mus musculus
tcacgtttccttaaacagaacatcc

SEQ ID NO: 800206 - DNA, 25 bp, Mus musculus
tcacgtttcctttaacagaacatcc

SEQ ID NO: 800207 - DNA, 25 bp, Mus musculus
tcacgtttcttcactttacaccaaa

SEQ ID NO: 800208 - DNA, 25 bp, Mus musculus
tcacgtttcttctctttacaccaaa

SEQ ID NO: 800209 - DNA, 25 bp, Mus musculus
tcacgttttcctaccaacaaccgtg

SEQ ID NO: 800210 - DNA, 25 bp, Mus musculus
tcacgttttccttccaacaaccgtg

SEQ ID NO: 800211 - DNA, 25 bp, Mus musculus
tcactaaaaacccactgagaacgtt

SEQ ID NO: 800212 - DNA, 25 bp, Mus musculus
tcactaaaaaccgactgagaacgtt

SEQ ID NO: 800213 - DNA, 25 bp, Mus musculus
tcactaaaagagatccagggatctg

SEQ ID NO: 800214 - DNA, 25 bp, Mus musculus
tcactaaaagagttccagggatctg

SEQ ID NO: 800215 - DNA, 25 bp, Mus musculus
tcactaaaatttagtaagggccgtg

SEQ ID NO: 800216 - DNA, 25 bp, Mus musculus
tcactaaaattttgtaagggccgtg

SEQ ID NO: 800217 - DNA, 25 bp, Mus musculus
tcactaaagttgcttctcattgaac

SEQ ID NO: 800218 - DNA, 25 bp, Mus musculus
tcactaaagttggttctcattgaac

SEQ ID NO: 800219 - DNA, 25 bp, Mus musculus
tcactaacacttctgaccgagctag

SEQ ID NO: 800220 - DNA, 25 bp, Mus musculus
tcactaacacttgtgaccgagctag

SEQ ID NO: 800221 - DNA, 25 bp, Mus musculus
tcactaacccctagctccaggagta

SEQ ID NO: 800222 - DNA, 25 bp, Mus musculus
tcactaaccccttgctccaggagta

SEQ ID NO: 800223 - DNA, 25 bp, Mus musculus
tcactaaccctgacgctctttatac

SEQ ID NO: 800224 - DNA, 25 bp, Mus musculus
tcactaaccctgtcgctctttatac

SEQ ID NO: 800225 - DNA, 25 bp, Mus musculus
tcactaagcagcatgtctttgcctc

SEQ ID NO: 800226 - DNA, 25 bp, Mus musculus
tcactaagcagcttgtctttgcctc

SEQ ID NO: 800227 - DNA, 25 bp, Mus musculus
tcactaagcgacaggctctaggcat

SEQ ID NO: 800228 - DNA, 25 bp, Mus musculus
tcactaagcgactggctctaggcat

SEQ ID NO: 800229 - DNA, 25 bp, Mus musculus
tcactaaggatgagtccctgcgcgg

SEQ ID NO: 800230 - DNA, 25 bp, Mus musculus
tcactaaggatgtgtccctgcgcgg

SEQ ID NO: 800231 - DNA, 25 bp, Mus musculus
tcactaaggcttaattgcattctag

SEQ ID NO: 800232 - DNA, 25 bp, Mus musculus
tcactaaggctttattgcattctag

SEQ ID NO: 800233 - DNA, 25 bp, Mus musculus
tcactaatatatcttttggatccta

SEQ ID NO: 800234 - DNA, 25 bp, Mus musculus
tcactaatatatgttttggatccta

SEQ ID NO: 800235 - DNA, 25 bp, Mus musculus
tcactaatgaccagcgagatcaccc

SEQ ID NO: 800236 - DNA, 25 bp, Mus musculus
tcactaatgacctgcgagatcaccc

SEQ ID NO: 800237 - DNA, 25 bp, Mus musculus
tcactaatgtggagcaagacatcgg

SEQ ID NO: 800238 - DNA, 25 bp, Mus musculus
tcactaatgtggtgcaagacatcgg

SEQ ID NO: 800239 - DNA, 25 bp, Mus musculus
tcactacaaagaatcacaaaaaagc

SEQ ID NO: 800240 - DNA, 25 bp, Mus musculus
tcactacaaagattcacaaaaaagc

SEQ ID NO: 800241 - DNA, 25 bp, Mus musculus
tcactacaatgcctgccaacggtgg

SEQ ID NO: 800242 - DNA, 25 bp, Mus musculus
tcactacaatgcgtgccaacggtgg

SEQ ID NO: 800243 - DNA, 25 bp, Mus musculus
tcactacacaccatctgaactaact

SEQ ID NO: 800244 - DNA, 25 bp, Mus musculus
tcactacacaccttctgaactaact

SEQ ID NO: 800245 - DNA, 25 bp, Mus musculus
tcactacagatgacactcaagcccg

SEQ ID NO: 800246 - DNA, 25 bp, Mus musculus
tcactacagatgtcactcaagcccg

SEQ ID NO: 800247 - DNA, 25 bp, Mus musculus
tcactacatcccattcagagagcca

SEQ ID NO: 800248 - DNA, 25 bp, Mus musculus
tcactacatccctttcagagagcca

SEQ ID NO: 800249 - DNA, 25 bp, Mus musculus
tcactacatcctcatcggtcagcga

SEQ ID NO: 800250 - DNA, 25 bp, Mus musculus
tcactacatcctgatcggtcagcga

SEQ ID NO: 800251 - DNA, 25 bp, Mus musculus
tcactacattatcccatgtgatata

SEQ ID NO: 800252 - DNA, 25 bp, Mus musculus
tcactacattatgccatgtgatata

SEQ ID NO: 800253 - DNA, 25 bp, Mus musculus
tcactaccactcatatgtctacatc

SEQ ID NO: 800254 - DNA, 25 bp, Mus musculus
tcactaccactcttatgtctacatc

SEQ ID NO: 800255 - DNA, 25 bp, Mus musculus
tcactaccatctctaactaattcct

SEQ ID NO: 800256 - DNA, 25 bp, Mus musculus
tcactaccatctgtaactaattcct

SEQ ID NO: 800257 - DNA, 25 bp, Mus musculus
tcactaccccagaccttgaaagagg

SEQ ID NO: 800258 - DNA, 25 bp, Mus musculus
tcactaccccagtccttgaaagagg

SEQ ID NO: 800259 - DNA, 25 bp, Mus musculus
tcactaccctttcgcttgaaacaac

SEQ ID NO: 800260 - DNA, 25 bp, Mus musculus
tcactaccctttggcttgaaacaac

SEQ ID NO: 800261 - DNA, 25 bp, Mus musculus
tcactaccgcccattgttgaaagag

SEQ ID NO: 800262 - DNA, 25 bp, Mus musculus
tcactaccgccctttgttgaaagag

SEQ ID NO: 800263 - DNA, 25 bp, Mus musculus
tcactacctgcgcatgctggttcag

SEQ ID NO: 800264 - DNA, 25 bp, Mus musculus
tcactacctgcggatgctggttcag

SEQ ID NO: 800265 - DNA, 25 bp, Mus musculus
tcactacggtgtcccatcaatgtca

SEQ ID NO: 800266 - DNA, 25 bp, Mus musculus
tcactacggtgtgccatcaatgtca

SEQ ID NO: 800267 - DNA, 25 bp, Mus musculus
tcactactacctcgctaagctgtta

SEQ ID NO: 800268 - DNA, 25 bp, Mus musculus
tcactactacctggctaagctgtta

SEQ ID NO: 800269 - DNA, 25 bp, Mus musculus
tcactactccagagataacactgtt

SEQ ID NO: 800270 - DNA, 25 bp, Mus musculus
tcactactccagtgataacactgtt

SEQ ID NO: 800271 - DNA, 25 bp, Mus musculus
tcactactctcacagaatggcagca

SEQ ID NO: 800272 - DNA, 25 bp, Mus musculus
tcactactctcagagaatggcagca

SEQ ID NO: 800273 - DNA, 25 bp, Mus musculus
tcactactgataccatcatgtaaat

SEQ ID NO: 800274 - DNA, 25 bp, Mus musculus
tcactactgatagcatcatgtaaat

SEQ ID NO: 800275 - DNA, 25 bp, Mus musculus
tcactactgcctcagacttcaccta

SEQ ID NO: 800276 - DNA, 25 bp, Mus musculus
tcactactgcctgagacttcaccta

SEQ ID NO: 800277 - DNA, 25 bp, Mus musculus
tcactactgttcctgcgttcccgga

SEQ ID NO: 800278 - DNA, 25 bp, Mus musculus
tcactactgttcgtgcgttcccgga

SEQ ID NO: 800279 - DNA, 25 bp, Mus musculus
tcactacttcccctggattgaagat

SEQ ID NO: 800280 - DNA, 25 bp, Mus musculus
tcactacttcccgtggattgaagat

SEQ ID NO: 800281 - DNA, 25 bp, Mus musculus
tcactacttttcctcgcatcctcgt

SEQ ID NO: 800282 - DNA, 25 bp, Mus musculus
tcactacttttcgtcgcatcctcgt

SEQ ID NO: 800283 - DNA, 25 bp, Mus musculus
tcactacttttgatggggaccagct

SEQ ID NO: 800284 - DNA, 25 bp, Mus musculus
tcactacttttgttggggaccagct

SEQ ID NO: 800285 - DNA, 25 bp, Mus musculus
tcactagaacttatatctgttgtcc

SEQ ID NO: 800286 - DNA, 25 bp, Mus musculus
tcactagaacttttatctgttgtcc

SEQ ID NO: 800287 - DNA, 25 bp, Mus musculus
tcactagaagggattggtggctgca

SEQ ID NO: 800288 - DNA, 25 bp, Mus musculus
tcactagaagggtttggtggctgca

SEQ ID NO: 800289 - DNA, 25 bp, Mus musculus
tcactagactccatgttactgatgt

SEQ ID NO: 800290 - DNA, 25 bp, Mus musculus
tcactagactccttgttactgatgt

SEQ ID NO: 800291 - DNA, 25 bp, Mus musculus
tcactagactgcagataatggatct

SEQ ID NO: 800292 - DNA, 25 bp, Mus musculus
tcactagactgctgataatggatct

SEQ ID NO: 800293 - DNA, 25 bp, Mus musculus
tcactagactggaactgctcagaat

SEQ ID NO: 800294 - DNA, 25 bp, Mus musculus
tcactagactggtactgctcagaat

SEQ ID NO: 800295 - DNA, 25 bp, Mus musculus
tcactagaggctactgtcagggaga

SEQ ID NO: 800296 - DNA, 25 bp, Mus musculus
tcactagaggcttctgtcagggaga

SEQ ID NO: 800297 - DNA, 25 bp, Mus musculus
tcactagcaaacagtcatggcattt

SEQ ID NO: 800298 - DNA, 25 bp, Mus musculus
tcactagcaaactgtcatggcattt

SEQ ID NO: 800299 - DNA, 25 bp, Mus musculus
tcactagccatcaatgcatcctaaa

SEQ ID NO: 800300 - DNA, 25 bp, Mus musculus
tcactagccatctatgcatcctaaa

SEQ ID NO: 800301 - DNA, 25 bp, Mus musculus
tcactagcccatattggagtctcct

SEQ ID NO: 800302 - DNA, 25 bp, Mus musculus
tcactagcccattttggagtctcct

SEQ ID NO: 800303 - DNA, 25 bp, Mus musculus
tcactagccccaaccaatatatcta

SEQ ID NO: 800304 - DNA, 25 bp, Mus musculus
tcactagccccatccaatatatcta

SEQ ID NO: 800305 - DNA, 25 bp, Mus musculus
tcactagcctccaacctttaaaggt

SEQ ID NO: 800306 - DNA, 25 bp, Mus musculus
tcactagcctcctacctttaaaggt

SEQ ID NO: 800307 - DNA, 25 bp, Mus musculus
tcactaggaagccagcctgcgatat

SEQ ID NO: 800308 - DNA, 25 bp, Mus musculus
tcactaggaagcgagcctgcgatat

SEQ ID NO: 800309 - DNA, 25 bp, Mus musculus
tcactaggcgggaaaagcgcaaggc

SEQ ID NO: 800310 - DNA, 25 bp, Mus musculus
tcactaggcgggtaaagcgcaaggc

SEQ ID NO: 800311 - DNA, 25 bp, Mus musculus
tcactaggcttcaggagagctctgt

SEQ ID NO: 800312 - DNA, 25 bp, Mus musculus
tcactaggcttctggagagctctgt

SEQ ID NO: 800313 - DNA, 25 bp, Mus musculus
tcactaggtcacacagaggcggaca

SEQ ID NO: 800314 - DNA, 25 bp, Mus musculus
tcactaggtcactcagaggcggaca

SEQ ID NO: 800315 - DNA, 25 bp, Mus musculus
tcactaggtgggacccctccctgta

SEQ ID NO: 800316 - DNA, 25 bp, Mus musculus
tcactaggtgggtcccctccctgta

SEQ ID NO: 800317 - DNA, 25 bp, Mus musculus
tcactagtcagtcttttcttttaag

SEQ ID NO: 800318 - DNA, 25 bp, Mus musculus
tcactagtcagtgttttcttttaag

SEQ ID NO: 800319 - DNA, 25 bp, Mus musculus
tcactagtctgaatccacctggaat

SEQ ID NO: 800320 - DNA, 25 bp, Mus musculus
tcactagtctgattccacctggaat

SEQ ID NO: 800321 - DNA, 25 bp, Mus musculus
tcactataggtcacctcttcagctt

SEQ ID NO: 800322 - DNA, 25 bp, Mus musculus
tcactataggtctcctcttcagctt

SEQ ID NO: 800323 - DNA, 25 bp, Mus musculus
tcactatagttcatggccagggacc

SEQ ID NO: 800324 - DNA, 25 bp, Mus musculus
tcactatagttcttggccagggacc

SEQ ID NO: 800325 - DNA, 25 bp, Mus musculus
tcactatatatcactggctccctga

SEQ ID NO: 800326 - DNA, 25 bp, Mus musculus
tcactatatatctctggctccctga

SEQ ID NO: 800327 - DNA, 25 bp, Mus musculus
tcactatattgaacaggctggccta

SEQ ID NO: 800328 - DNA, 25 bp, Mus musculus
tcactatattgatcaggctggccta

SEQ ID NO: 800329 - DNA, 25 bp, Mus musculus
tcactatcctcaactgtaccatgaa

SEQ ID NO: 800330 - DNA, 25 bp, Mus musculus
tcactatcctcatctgtaccatgaa

SEQ ID NO: 800331 - DNA, 25 bp, Mus musculus
tcactatctctaacttcaactcaag

SEQ ID NO: 800332 - DNA, 25 bp, Mus musculus
tcactatctctatcttcaactcaag

SEQ ID NO: 800333 - DNA, 25 bp, Mus musculus
tcactatgaagtaccagactggcct

SEQ ID NO: 800334 - DNA, 25 bp, Mus musculus
tcactatgaagttccagactggcct

SEQ ID NO: 800335 - DNA, 25 bp, Mus musculus
tcactatgctaccaggtccaactat

SEQ ID NO: 800336 - DNA, 25 bp, Mus musculus
tcactatgctacgaggtccaactat

SEQ ID NO: 800337 - DNA, 25 bp, Mus musculus
tcactatgctgccacggaaaccgac

SEQ ID NO: 800338 - DNA, 25 bp, Mus musculus
tcactatgctgcgacggaaaccgac

SEQ ID NO: 800339 - DNA, 25 bp, Mus musculus
tcactatggcccctagcagaggaag

SEQ ID NO: 800340 - DNA, 25 bp, Mus musculus
tcactatggcccgtagcagaggaag

SEQ ID NO: 800341 - DNA, 25 bp, Mus musculus
tcactatgtaacccttgacgtagat

SEQ ID NO: 800342 - DNA, 25 bp, Mus musculus
tcactatgtaacgcttgacgtagat

SEQ ID NO: 800343 - DNA, 25 bp, Mus musculus
tcactatgtagacagctctgccacc

SEQ ID NO: 800344 - DNA, 25 bp, Mus musculus
tcactatgtagagagctctgccacc

SEQ ID NO: 800345 - DNA, 25 bp, Mus musculus
tcactatgtcatctttgccttcttc

SEQ ID NO: 800346 - DNA, 25 bp, Mus musculus
tcactatgtcatgtttgccttcttc

SEQ ID NO: 800347 - DNA, 25 bp, Mus musculus
tcactattagtgcacttggagcttt

SEQ ID NO: 800348 - DNA, 25 bp, Mus musculus
tcactattagtggacttggagcttt

SEQ ID NO: 800349 - DNA, 25 bp, Mus musculus
tcactattgagcaggcctctgcctt

SEQ ID NO: 800350 - DNA, 25 bp, Mus musculus
tcactattgagctggcctctgcctt

SEQ ID NO: 800351 - DNA, 25 bp, Mus musculus
tcactattgcccatctgggatgcca

SEQ ID NO: 800352 - DNA, 25 bp, Mus musculus
tcactattgcccttctgggatgcca

SEQ ID NO: 800353 - DNA, 25 bp, Mus musculus
tcactatttcgtactcattgttttg

SEQ ID NO: 800354 - DNA, 25 bp, Mus musculus
tcactatttcgttctcattgttttg

SEQ ID NO: 800355 - DNA, 25 bp, Mus musculus
tcactattttctctatcttattttc

SEQ ID NO: 800356 - DNA, 25 bp, Mus musculus
tcactattttctgtatcttattttc

SEQ ID NO: 800357 - DNA, 25 bp, Mus musculus
tcactattttggacatgtattttta

SEQ ID NO: 800358 - DNA, 25 bp, Mus musculus
tcactattttggtcatgtattttta

SEQ ID NO: 800359 - DNA, 25 bp, Mus musculus
tcactcaaacctactctctgtagaa

SEQ ID NO: 800360 - DNA, 25 bp, Mus musculus
tcactcaaaccttctctctgtagaa

SEQ ID NO: 800361 - DNA, 25 bp, Mus musculus
tcactcaaactgaactttcttcctt

SEQ ID NO: 800362 - DNA, 25 bp, Mus musculus
tcactcaaactgtactttcttcctt

SEQ ID NO: 800363 - DNA, 25 bp, Mus musculus
tcactcaaccacagatggccaatgg

SEQ ID NO: 800364 - DNA, 25 bp, Mus musculus
tcactcaaccactgatggccaatgg

SEQ ID NO: 800365 - DNA, 25 bp, Mus musculus
tcactcacacccaccctgcatggag

SEQ ID NO: 800366 - DNA, 25 bp, Mus musculus
tcactcacaccctccctgcatggag

SEQ ID NO: 800367 - DNA, 25 bp, Mus musculus
tcactcacccttcattgtactgcaa

SEQ ID NO: 800368 - DNA, 25 bp, Mus musculus
tcactcacccttgattgtactgcaa

SEQ ID NO: 800369 - DNA, 25 bp, Mus musculus
tcactcaccgttcccaggttaggtt

SEQ ID NO: 800370 - DNA, 25 bp, Mus musculus
tcactcaccgttgccaggttaggtt

SEQ ID NO: 800371 - DNA, 25 bp, Mus musculus
tcactcacctaacctggcggagcaa

SEQ ID NO: 800372 - DNA, 25 bp, Mus musculus
tcactcacctaagctggcggagcaa

SEQ ID NO: 800373 - DNA, 25 bp, Mus musculus
tcactcacggttcagaagtctccat

SEQ ID NO: 800374 - DNA, 25 bp, Mus musculus
tcactcacggttgagaagtctccat

SEQ ID NO: 800375 - DNA, 25 bp, Mus musculus
tcactcactattaacaactgtcagg

SEQ ID NO: 800376 - DNA, 25 bp, Mus musculus
tcactcactatttacaactgtcagg

SEQ ID NO: 800377 - DNA, 25 bp, Mus musculus
tcactcactggaaggcagccacatg

SEQ ID NO: 800378 - DNA, 25 bp, Mus musculus
tcactcactggatggcagccacatg

SEQ ID NO: 800379 - DNA, 25 bp, Mus musculus
tcactcacttatcttttctgactca

SEQ ID NO: 800380 - DNA, 25 bp, Mus musculus
tcactcacttatgttttctgactca

SEQ ID NO: 800381 - DNA, 25 bp, Mus musculus
tcactcacttccattacccaatgta

SEQ ID NO: 800382 - DNA, 25 bp, Mus musculus
tcactcacttcctttacccaatgta

SEQ ID NO: 800383 - DNA, 25 bp, Mus musculus
tcactcagaactcttagtacccagg

SEQ ID NO: 800384 - DNA, 25 bp, Mus musculus
tcactcagaactgttagtacccagg

SEQ ID NO: 800385 - DNA, 25 bp, Mus musculus
tcactcagatcgcactagcagcttg

SEQ ID NO: 800386 - DNA, 25 bp, Mus musculus
tcactcagatcggactagcagcttg

SEQ ID NO: 800387 - DNA, 25 bp, Mus musculus
tcactcagcaagacaagcagccagg

SEQ ID NO: 800388 - DNA, 25 bp, Mus musculus
tcactcagcaagtcaagcagccagg

SEQ ID NO: 800389 - DNA, 25 bp, Mus musculus
tcactcagcactcgctcagagatgg

SEQ ID NO: 800390 - DNA, 25 bp, Mus musculus
tcactcagcactggctcagagatgg

SEQ ID NO: 800391 - DNA, 25 bp, Mus musculus
tcactcagccagacaagcaagccag

SEQ ID NO: 800392 - DNA, 25 bp, Mus musculus
tcactcagccagtcaagcaagccag

SEQ ID NO: 800393 - DNA, 25 bp, Mus musculus
tcactcagcccacgaaggcacatta

SEQ ID NO: 800394 - DNA, 25 bp, Mus musculus
tcactcagcccaggaaggcacatta

SEQ ID NO: 800395 - DNA, 25 bp, Mus musculus
tcactcagcccgagtcggaggtaaa

SEQ ID NO: 800396 - DNA, 25 bp, Mus musculus
tcactcagcccgtgtcggaggtaaa

SEQ ID NO: 800397 - DNA, 25 bp, Mus musculus
tcactcagcttgactcaggaattgg

SEQ ID NO: 800398 - DNA, 25 bp, Mus musculus
tcactcagcttgtctcaggaattgg

SEQ ID NO: 800399 - DNA, 25 bp, Mus musculus
tcactcaggatgatactctcaagtt

SEQ ID NO: 800400 - DNA, 25 bp, Mus musculus
tcactcaggatgttactctcaagtt

SEQ ID NO: 800401 - DNA, 25 bp, Mus musculus
tcactcagggtgactctgtctagag

SEQ ID NO: 800402 - DNA, 25 bp, Mus musculus
tcactcagggtgtctctgtctagag

SEQ ID NO: 800403 - DNA, 25 bp, Mus musculus
tcactcaggtcaacacaacagctag

SEQ ID NO: 800404 - DNA, 25 bp, Mus musculus
tcactcaggtcatcacaacagctag

SEQ ID NO: 800405 - DNA, 25 bp, Mus musculus
tcactcagtaccagctcgttctggc

SEQ ID NO: 800406 - DNA, 25 bp, Mus musculus
tcactcagtacctgctcgttctggc

SEQ ID NO: 800407 - DNA, 25 bp, Mus musculus
tcactcagtctaaggtagccagctt

SEQ ID NO: 800408 - DNA, 25 bp, Mus musculus
tcactcagtctatggtagccagctt

SEQ ID NO: 800409 - DNA, 25 bp, Mus musculus
tcactcagtgcaaaggcgcgaagcc

SEQ ID NO: 800410 - DNA, 25 bp, Mus musculus
tcactcagtgcataggcgcgaagcc

SEQ ID NO: 800411 - DNA, 25 bp, Mus musculus
tcactcatagccataacttctcttg

SEQ ID NO: 800412 - DNA, 25 bp, Mus musculus
tcactcatagccttaacttctcttg

SEQ ID NO: 800413 - DNA, 25 bp, Mus musculus
tcactcataggcctagaccttcatg

SEQ ID NO: 800414 - DNA, 25 bp, Mus musculus
tcactcataggcgtagaccttcatg

SEQ ID NO: 800415 - DNA, 25 bp, Mus musculus
tcactcatatcaaccctgcagctga

SEQ ID NO: 800416 - DNA, 25 bp, Mus musculus
tcactcatatcatccctgcagctga

SEQ ID NO: 800417 - DNA, 25 bp, Mus musculus
tcactcatcaaccaagtcagctttg

SEQ ID NO: 800418 - DNA, 25 bp, Mus musculus
tcactcatcaacgaagtcagctttg

SEQ ID NO: 800419 - DNA, 25 bp, Mus musculus
tcactcatcaatcgggccacacagt

SEQ ID NO: 800420 - DNA, 25 bp, Mus musculus
tcactcatcaatggggccacacagt

SEQ ID NO: 800421 - DNA, 25 bp, Mus musculus
tcactcatccatagccttctaaaga

SEQ ID NO: 800422 - DNA, 25 bp, Mus musculus
tcactcatccattgccttctaaaga

SEQ ID NO: 800423 - DNA, 25 bp, Mus musculus
tcactcatccctaatgttcagacaa

SEQ ID NO: 800424 - DNA, 25 bp, Mus musculus
tcactcatcccttatgttcagacaa

SEQ ID NO: 800425 - DNA, 25 bp, Mus musculus
tcactcatgagaagcaagtcaggct

SEQ ID NO: 800426 - DNA, 25 bp, Mus musculus
tcactcatgagatgcaagtcaggct

SEQ ID NO: 800427 - DNA, 25 bp, Mus musculus
tcactcatgtgaccatcccagggaa

SEQ ID NO: 800428 - DNA, 25 bp, Mus musculus
tcactcatgtgagcatcccagggaa

SEQ ID NO: 800429 - DNA, 25 bp, Mus musculus
tcactcattcttcatgggcattcga

SEQ ID NO: 800430 - DNA, 25 bp, Mus musculus
tcactcattcttgatgggcattcga

SEQ ID NO: 800431 - DNA, 25 bp, Mus musculus
tcactcattgcaaggatgaccgtgt

SEQ ID NO: 800432 - DNA, 25 bp, Mus musculus
tcactcattgcatggatgaccgtgt

SEQ ID NO: 800433 - DNA, 25 bp, Mus musculus
tcactcattggtacttcctgacttg

SEQ ID NO: 800434 - DNA, 25 bp, Mus musculus
tcactcattggttcttcctgacttg

SEQ ID NO: 800435 - DNA, 25 bp, Mus musculus
tcactcatttacaagttctcccaat

SEQ ID NO: 800436 - DNA, 25 bp, Mus musculus
tcactcatttactagttctcccaat

SEQ ID NO: 800437 - DNA, 25 bp, Mus musculus
tcactccaagcacaaggacagtaga

SEQ ID NO: 800438 - DNA, 25 bp, Mus musculus
tcactccaagcagaaggacagtaga

SEQ ID NO: 800439 - DNA, 25 bp, Mus musculus
tcactccacaccaagatacagctta

SEQ ID NO: 800440 - DNA, 25 bp, Mus musculus
tcactccacacctagatacagctta

SEQ ID NO: 800441 - DNA, 25 bp, Mus musculus
tcactccacatgcaagcatgagctt

SEQ ID NO: 800442 - DNA, 25 bp, Mus musculus
tcactccacatggaagcatgagctt

SEQ ID NO: 800443 - DNA, 25 bp, Mus musculus
tcactccactccagggttctagaga

SEQ ID NO: 800444 - DNA, 25 bp, Mus musculus
tcactccactcctgggttctagaga

SEQ ID NO: 800445 - DNA, 25 bp, Mus musculus
tcactccagcaaagcgtttttccag

SEQ ID NO: 800446 - DNA, 25 bp, Mus musculus
tcactccagcaatgcgtttttccag

SEQ ID NO: 800447 - DNA, 25 bp, Mus musculus
tcactccagctgaggccgctcattt

SEQ ID NO: 800448 - DNA, 25 bp, Mus musculus
tcactccagctgtggccgctcattt

SEQ ID NO: 800449 - DNA, 25 bp, Mus musculus
tcactccagggccttgctaaattag

SEQ ID NO: 800450 - DNA, 25 bp, Mus musculus
tcactccagggcgttgctaaattag

SEQ ID NO: 800451 - DNA, 25 bp, Mus musculus
tcactccatcctaaaaaggtggctt

SEQ ID NO: 800452 - DNA, 25 bp, Mus musculus
tcactccatccttaaaaggtggctt

SEQ ID NO: 800453 - DNA, 25 bp, Mus musculus
tcactcccaagtagcttgaaaaagg

SEQ ID NO: 800454 - DNA, 25 bp, Mus musculus
tcactcccaagttgcttgaaaaagg

SEQ ID NO: 800455 - DNA, 25 bp, Mus musculus
tcactcccagacagctttttaaacc

SEQ ID NO: 800456 - DNA, 25 bp, Mus musculus
tcactcccagactgctttttaaacc

SEQ ID NO: 800457 - DNA, 25 bp, Mus musculus
tcactcccataccttctaaaagcat

SEQ ID NO: 800458 - DNA, 25 bp, Mus musculus
tcactcccatacgttctaaaagcat

SEQ ID NO: 800459 - DNA, 25 bp, Mus musculus
tcactccccagtatatgttgcagat

SEQ ID NO: 800460 - DNA, 25 bp, Mus musculus
tcactccccagtttatgttgcagat

SEQ ID NO: 800461 - DNA, 25 bp, Mus musculus
tcactcccctataggctgttttgtc

SEQ ID NO: 800462 - DNA, 25 bp, Mus musculus
tcactcccctattggctgttttgtc

SEQ ID NO: 800463 - DNA, 25 bp, Mus musculus
tcactccccttaatcctttgaagag

SEQ ID NO: 800464 - DNA, 25 bp, Mus musculus
tcactccccttattcctttgaagag

SEQ ID NO: 800465 - DNA, 25 bp, Mus musculus
tcactccccttgagatccatttgtt

SEQ ID NO: 800466 - DNA, 25 bp, Mus musculus
tcactccccttgtgatccatttgtt

SEQ ID NO: 800467 - DNA, 25 bp, Mus musculus
tcactccctctcactatgggaaata

SEQ ID NO: 800468 - DNA, 25 bp, Mus musculus
tcactccctctctctatgggaaata

SEQ ID NO: 800469 - DNA, 25 bp, Mus musculus
tcactccctgttcactatgattttg

SEQ ID NO: 800470 - DNA, 25 bp, Mus musculus
tcactccctgttgactatgattttg

SEQ ID NO: 800471 - DNA, 25 bp, Mus musculus
tcactccggactcgcagagcttgga

SEQ ID NO: 800472 - DNA, 25 bp, Mus musculus
tcactccggactggcagagcttgga

SEQ ID NO: 800473 - DNA, 25 bp, Mus musculus
tcactcctaattctaccagacatct

SEQ ID NO: 800474 - DNA, 25 bp, Mus musculus
tcactcctaattgtaccagacatct

SEQ ID NO: 800475 - DNA, 25 bp, Mus musculus
tcactcctagtgatcatacgcatct

SEQ ID NO: 800476 - DNA, 25 bp, Mus musculus
tcactcctagtgttcatacgcatct

SEQ ID NO: 800477 - DNA, 25 bp, Mus musculus
tcactcctcactagacagatcgtca

SEQ ID NO: 800478 - DNA, 25 bp, Mus musculus
tcactcctcacttgacagatcgtca

SEQ ID NO: 800479 - DNA, 25 bp, Mus musculus
tcactcctcctcacatttgaaagta

SEQ ID NO: 800480 - DNA, 25 bp, Mus musculus
tcactcctcctctcatttgaaagta

SEQ ID NO: 800481 - DNA, 25 bp, Mus musculus
tcactcctcgatcaagactcttgtt

SEQ ID NO: 800482 - DNA, 25 bp, Mus musculus
tcactcctcgatgaagactcttgtt

SEQ ID NO: 800483 - DNA, 25 bp, Mus musculus
tcactcctgagcactctgacttggt

SEQ ID NO: 800484 - DNA, 25 bp, Mus musculus
tcactcctgagctctctgacttggt

SEQ ID NO: 800485 - DNA, 25 bp, Mus musculus
tcactcctgagtacaatttccataa

SEQ ID NO: 800486 - DNA, 25 bp, Mus musculus
tcactcctgagtctagacgcctaaa

SEQ ID NO: 800487 - DNA, 25 bp, Mus musculus
tcactcctgagtgtagacgcctaaa

SEQ ID NO: 800488 - DNA, 25 bp, Mus musculus
tcactcctgagttcaatttccataa

SEQ ID NO: 800489 - DNA, 25 bp, Mus musculus
tcactcctgctaaattcttgttgtc

SEQ ID NO: 800490 - DNA, 25 bp, Mus musculus
tcactcctgctatattcttgttgtc

SEQ ID NO: 800491 - DNA, 25 bp, Mus musculus
tcactcctggacagtgattttcagt

SEQ ID NO: 800492 - DNA, 25 bp, Mus musculus
tcactcctggactgtgattttcagt

SEQ ID NO: 800493 - DNA, 25 bp, Mus musculus
tcactcctggcccatgaggtaatca

SEQ ID NO: 800494 - DNA, 25 bp, Mus musculus
tcactcctggccgatgaggtaatca

SEQ ID NO: 800495 - DNA, 25 bp, Mus musculus
tcactccttcgaaatataccaacca

SEQ ID NO: 800496 - DNA, 25 bp, Mus musculus
tcactccttcgatatataccaacca

SEQ ID NO: 800497 - DNA, 25 bp, Mus musculus
tcactccttgataggtggaagctca

SEQ ID NO: 800498 - DNA, 25 bp, Mus musculus
tcactccttgattggtggaagctca

SEQ ID NO: 800499 - DNA, 25 bp, Mus musculus
tcactccttgggactgtagcccggc

SEQ ID NO: 800500 - DNA, 25 bp, Mus musculus
tcactccttgggtctgtagcccggc

SEQ ID NO: 800501 - DNA, 25 bp, Mus musculus
tcactccttttcagtgggttatgta

SEQ ID NO: 800502 - DNA, 25 bp, Mus musculus
tcactccttttctgtgggttatgta

SEQ ID NO: 800503 - DNA, 25 bp, Mus musculus
tcactcgaagctaccgcagtgtggg

SEQ ID NO: 800504 - DNA, 25 bp, Mus musculus
tcactcgaagcttccgcagtgtggg

SEQ ID NO: 800505 - DNA, 25 bp, Mus musculus
tcactcgagaggatgacttcaacaa

SEQ ID NO: 800506 - DNA, 25 bp, Mus musculus
tcactcgagaggttgacttcaacaa

SEQ ID NO: 800507 - DNA, 25 bp, Mus musculus
tcactcgagggcattggttaatagt

SEQ ID NO: 800508 - DNA, 25 bp, Mus musculus
tcactcgagggctttggttaatagt

SEQ ID NO: 800509 - DNA, 25 bp, Mus musculus
tcactcgaggtgaatggcagtctga

SEQ ID NO: 800510 - DNA, 25 bp, Mus musculus
tcactcgaggtgtatggcagtctga

SEQ ID NO: 800511 - DNA, 25 bp, Mus musculus
tcactcgatgagagtggatgcctct

SEQ ID NO: 800512 - DNA, 25 bp, Mus musculus
tcactcgatgagtgtggatgcctct

SEQ ID NO: 800513 - DNA, 25 bp, Mus musculus
tcactcgcactcacccaatagaaaa

SEQ ID NO: 800514 - DNA, 25 bp, Mus musculus
tcactcgcactctcccaatagaaaa

SEQ ID NO: 800515 - DNA, 25 bp, Mus musculus
tcactcgccccaagaagactttgtt

SEQ ID NO: 800516 - DNA, 25 bp, Mus musculus
tcactcgccccatgaagactttgtt

SEQ ID NO: 800517 - DNA, 25 bp, Mus musculus
tcactcgccctgaattgaccaagga

SEQ ID NO: 800518 - DNA, 25 bp, Mus musculus
tcactcgccctgtattgaccaagga

SEQ ID NO: 800519 - DNA, 25 bp, Mus musculus
tcactcgcctagcatgtgtggttct

SEQ ID NO: 800520 - DNA, 25 bp, Mus musculus
tcactcgcctaggatgtgtggttct

SEQ ID NO: 800521 - DNA, 25 bp, Mus musculus
tcactcggaacaaggcacaagccaa

SEQ ID NO: 800522 - DNA, 25 bp, Mus musculus
tcactcggaacatggcacaagccaa

SEQ ID NO: 800523 - DNA, 25 bp, Mus musculus
tcactcggccggcacgtcgctgtgg

SEQ ID NO: 800524 - DNA, 25 bp, Mus musculus
tcactcggccgggacgtcgctgtgg

SEQ ID NO: 800525 - DNA, 25 bp, Mus musculus
tcactcggctgtctgaccagagaaa

SEQ ID NO: 800526 - DNA, 25 bp, Mus musculus
tcactcggctgtgtgaccagagaaa

SEQ ID NO: 800527 - DNA, 25 bp, Mus musculus
tcactcgtcactcgtgtgggtagca

SEQ ID NO: 800528 - DNA, 25 bp, Mus musculus
tcactcgtcactggtgtgggtagca

SEQ ID NO: 800529 - DNA, 25 bp, Mus musculus
tcactcgtgccactatattcttggg

SEQ ID NO: 800530 - DNA, 25 bp, Mus musculus
tcactcgtgccagtatattcttggg

SEQ ID NO: 800531 - DNA, 25 bp, Mus musculus
tcactcgtgcccattatgagatgtt

SEQ ID NO: 800532 - DNA, 25 bp, Mus musculus
tcactcgtgccctttatgagatgtt

SEQ ID NO: 800533 - DNA, 25 bp, Mus musculus
tcactcgtgccgctgaaggagaaga

SEQ ID NO: 800534 - DNA, 25 bp, Mus musculus
tcactcgtgccggtgaaggagaaga

SEQ ID NO: 800535 - DNA, 25 bp, Mus musculus
tcactcgtttacctgtgcttagttt

SEQ ID NO: 800536 - DNA, 25 bp, Mus musculus
tcactcgtttacgtgtgcttagttt

SEQ ID NO: 800537 - DNA, 25 bp, Mus musculus
tcactctagcctaggcaggccttaa

SEQ ID NO: 800538 - DNA, 25 bp, Mus musculus
tcactctagcctcagctacttaaga

SEQ ID NO: 800539 - DNA, 25 bp, Mus musculus
tcactctagcctgagctacttaaga

SEQ ID NO: 800540 - DNA, 25 bp, Mus musculus
tcactctagccttggcaggccttaa

SEQ ID NO: 800541 - DNA, 25 bp, Mus musculus
tcactctagtatctggcatgtgtgt

SEQ ID NO: 800542 - DNA, 25 bp, Mus musculus
tcactctagtatgtggcatgtgtgt

SEQ ID NO: 800543 - DNA, 25 bp, Mus musculus
tcactctcacaaatgacgggaaaac

SEQ ID NO: 800544 - DNA, 25 bp, Mus musculus
tcactctcacaattgacgggaaaac

SEQ ID NO: 800545 - DNA, 25 bp, Mus musculus
tcactctcacctctatattttcagt

SEQ ID NO: 800546 - DNA, 25 bp, Mus musculus
tcactctcacctgtatattttcagt

SEQ ID NO: 800547 - DNA, 25 bp, Mus musculus
tcactctcagacatttagtaaggaa

SEQ ID NO: 800548 - DNA, 25 bp, Mus musculus
tcactctcagacttttagtaaggaa

SEQ ID NO: 800549 - DNA, 25 bp, Mus musculus
tcactctcatggaactcaggacact

SEQ ID NO: 800550 - DNA, 25 bp, Mus musculus
tcactctcatggtactcaggacact

SEQ ID NO: 800551 - DNA, 25 bp, Mus musculus
tcactctccccaagatacagtttat

SEQ ID NO: 800552 - DNA, 25 bp, Mus musculus
tcactctccccatgatacagtttat

SEQ ID NO: 800553 - DNA, 25 bp, Mus musculus
tcactctcctttcatgtcgtgagta

SEQ ID NO: 800554 - DNA, 25 bp, Mus musculus
tcactctcctttgatgtcgtgagta

SEQ ID NO: 800555 - DNA, 25 bp, Mus musculus
tcactctctgagatcacaaaatcat

SEQ ID NO: 800556 - DNA, 25 bp, Mus musculus
tcactctctgagttcacaaaatcat

SEQ ID NO: 800557 - DNA, 25 bp, Mus musculus
tcactctctgcacactttgaatggg

SEQ ID NO: 800558 - DNA, 25 bp, Mus musculus
tcactctctgcagactttgaatggg

SEQ ID NO: 800559 - DNA, 25 bp, Mus musculus
tcactctctgccctgtacagtgtga

SEQ ID NO: 800560 - DNA, 25 bp, Mus musculus
tcactctctgccgtgtacagtgtga

SEQ ID NO: 800561 - DNA, 25 bp, Mus musculus
tcactctctggcatcactatttacc

SEQ ID NO: 800562 - DNA, 25 bp, Mus musculus
tcactctctggcttcactatttacc

SEQ ID NO: 800563 - DNA, 25 bp, Mus musculus
tcactctctggtccatttggcatta

SEQ ID NO: 800564 - DNA, 25 bp, Mus musculus
tcactctctggtgcatttggcatta

SEQ ID NO: 800565 - DNA, 25 bp, Mus musculus
tcactctcttgaacagatgctgctg

SEQ ID NO: 800566 - DNA, 25 bp, Mus musculus
tcactctcttgatcagatgctgctg

SEQ ID NO: 800567 - DNA, 25 bp, Mus musculus
tcactctgaagcacgactaggcctc

SEQ ID NO: 800568 - DNA, 25 bp, Mus musculus
tcactctgaagctcgactaggcctc

SEQ ID NO: 800569 - DNA, 25 bp, Mus musculus
tcactctgacttctagctgtgggaa

SEQ ID NO: 800570 - DNA, 25 bp, Mus musculus
tcactctgacttgtagctgtgggaa

SEQ ID NO: 800571 - DNA, 25 bp, Mus musculus
tcactctgaggaaagaccatcactt

SEQ ID NO: 800572 - DNA, 25 bp, Mus musculus
tcactctgaggatagaccatcactt

SEQ ID NO: 800573 - DNA, 25 bp, Mus musculus
tcactctgagtcactgtcaaaccat

SEQ ID NO: 800574 - DNA, 25 bp, Mus musculus
tcactctgagtctctgtcaaaccat

SEQ ID NO: 800575 - DNA, 25 bp, Mus musculus
tcactctgatgactgtacctggaac

SEQ ID NO: 800576 - DNA, 25 bp, Mus musculus
tcactctgatgagtgtacctggaac

SEQ ID NO: 800577 - DNA, 25 bp, Mus musculus
tcactctgattgatatggccgcggc

SEQ ID NO: 800578 - DNA, 25 bp, Mus musculus
tcactctgattgttatggccgcggc

SEQ ID NO: 800579 - DNA, 25 bp, Mus musculus
tcactctgcagcctgtgaaagctgg

SEQ ID NO: 800580 - DNA, 25 bp, Mus musculus
tcactctgcagcgtgtgaaagctgg

SEQ ID NO: 800581 - DNA, 25 bp, Mus musculus
tcactctgcattcaccttggaaaag

SEQ ID NO: 800582 - DNA, 25 bp, Mus musculus
tcactctgcattgaccttggaaaag

SEQ ID NO: 800583 - DNA, 25 bp, Mus musculus
tcactctgccatctagattctgctc

SEQ ID NO: 800584 - DNA, 25 bp, Mus musculus
tcactctgccatgtagattctgctc

SEQ ID NO: 800585 - DNA, 25 bp, Mus musculus
tcactctgctggagcgctgtgcatg

SEQ ID NO: 800586 - DNA, 25 bp, Mus musculus
tcactctgctggtgcgctgtgcatg

SEQ ID NO: 800587 - DNA, 25 bp, Mus musculus
tcactctggagcacaatttcctaac

SEQ ID NO: 800588 - DNA, 25 bp, Mus musculus
tcactctggagctcaatttcctaac

SEQ ID NO: 800589 - DNA, 25 bp, Mus musculus
tcactctggccgctatgtgagtgtt

SEQ ID NO: 800590 - DNA, 25 bp, Mus musculus
tcactctggccggtatgtgagtgtt

SEQ ID NO: 800591 - DNA, 25 bp, Mus musculus
tcactctgggtgcatacctgggcca

SEQ ID NO: 800592 - DNA, 25 bp, Mus musculus
tcactctgggtggatacctgggcca

SEQ ID NO: 800593 - DNA, 25 bp, Mus musculus
tcactctgtagaccgtgctggctgg

SEQ ID NO: 800594 - DNA, 25 bp, Mus musculus
tcactctgtagagcgtgctggctgg

SEQ ID NO: 800595 - DNA, 25 bp, Mus musculus
tcactctgtctaacgggctttcgaa

SEQ ID NO: 800596 - DNA, 25 bp, Mus musculus
tcactctgtctatcgggctttcgaa

SEQ ID NO: 800597 - DNA, 25 bp, Mus musculus
tcactcttaaaactgactcttctcc

SEQ ID NO: 800598 - DNA, 25 bp, Mus musculus
tcactcttaaaagtgactcttctcc

SEQ ID NO: 800599 - DNA, 25 bp, Mus musculus
tcactcttcactctctgtcatgtga

SEQ ID NO: 800600 - DNA, 25 bp, Mus musculus
tcactcttcactgtctgtcatgtga

SEQ ID NO: 800601 - DNA, 25 bp, Mus musculus
tcactcttcagacctcctgtagaga

SEQ ID NO: 800602 - DNA, 25 bp, Mus musculus
tcactcttcagagctcctgtagaga

SEQ ID NO: 800603 - DNA, 25 bp, Mus musculus
tcactcttcatcatctgggtcccat

SEQ ID NO: 800604 - DNA, 25 bp, Mus musculus
tcactcttcatcttctgggtcccat

SEQ ID NO: 800605 - DNA, 25 bp, Mus musculus
tcactcttccatatgcgctttgtag

SEQ ID NO: 800606 - DNA, 25 bp, Mus musculus
tcactcttccatttgcgctttgtag

SEQ ID NO: 800607 - DNA, 25 bp, Mus musculus
tcactcttgagtccacacgtgttat

SEQ ID NO: 800608 - DNA, 25 bp, Mus musculus
tcactcttgagtgcacacgtgttat

SEQ ID NO: 800609 - DNA, 25 bp, Mus musculus
tcactcttgattacccagcactggg

SEQ ID NO: 800610 - DNA, 25 bp, Mus musculus
tcactcttgatttcccagcactggg

SEQ ID NO: 800611 - DNA, 25 bp, Mus musculus
tcactctttctcatcaatccacatt

SEQ ID NO: 800612 - DNA, 25 bp, Mus musculus
tcactctttctcttcaatccacatt

SEQ ID NO: 800613 - DNA, 25 bp, Mus musculus
tcactgaaccaccacagaaatcgtg

SEQ ID NO: 800614 - DNA, 25 bp, Mus musculus
tcactgaaccacgacagaaatcgtg

SEQ ID NO: 800615 - DNA, 25 bp, Mus musculus
tcactgaagatcagtgctcccctag

SEQ ID NO: 800616 - DNA, 25 bp, Mus musculus
tcactgaagatctgtgctcccctag

SEQ ID NO: 800617 - DNA, 25 bp, Mus musculus
tcactgaagattcaccttgtatgaa

SEQ ID NO: 800618 - DNA, 25 bp, Mus musculus
tcactgaagattgaccttgtatgaa

SEQ ID NO: 800619 - DNA, 25 bp, Mus musculus
tcactgaagcttctctgtgtgaagt

SEQ ID NO: 800620 - DNA, 25 bp, Mus musculus
tcactgaagcttgtctgtgtgaagt

SEQ ID NO: 800621 - DNA, 25 bp, Mus musculus
tcactgaatctcacaccaacatgaa

SEQ ID NO: 800622 - DNA, 25 bp, Mus musculus
tcactgaatctctcaccaacatgaa

SEQ ID NO: 800623 - DNA, 25 bp, Mus musculus
tcactgacactaatacttacctgcc

SEQ ID NO: 800624 - DNA, 25 bp, Mus musculus
tcactgacactattacttacctgcc

SEQ ID NO: 800625 - DNA, 25 bp, Mus musculus
tcactgacagacctgcatgcatgta

SEQ ID NO: 800626 - DNA, 25 bp, Mus musculus
tcactgacagacgtgcatgcatgta

SEQ ID NO: 800627 - DNA, 25 bp, Mus musculus
tcactgacagctcggtgtagaggca

SEQ ID NO: 800628 - DNA, 25 bp, Mus musculus
tcactgacagctgggtgtagaggca

SEQ ID NO: 800629 - DNA, 25 bp, Mus musculus
tcactgaccactcacttcggagtta

SEQ ID NO: 800630 - DNA, 25 bp, Mus musculus
tcactgaccactgacttcggagtta

SEQ ID NO: 800631 - DNA, 25 bp, Mus musculus
tcactgaccagaaatagggatggct

SEQ ID NO: 800632 - DNA, 25 bp, Mus musculus
tcactgaccagatatagggatggct

SEQ ID NO: 800633 - DNA, 25 bp, Mus musculus
tcactgaccatgcttgaggacaatg

SEQ ID NO: 800634 - DNA, 25 bp, Mus musculus
tcactgaccatggttgaggacaatg

SEQ ID NO: 800635 - DNA, 25 bp, Mus musculus
tcactgaccctcattcaagtttttg

SEQ ID NO: 800636 - DNA, 25 bp, Mus musculus
tcactgaccctctttcaagtttttg

SEQ ID NO: 800637 - DNA, 25 bp, Mus musculus
tcactgaccgtacagtagcctcaat

SEQ ID NO: 800638 - DNA, 25 bp, Mus musculus
tcactgaccgtagagtagcctcaat

SEQ ID NO: 800639 - DNA, 25 bp, Mus musculus
tcactgacctggagccttttaaggg

SEQ ID NO: 800640 - DNA, 25 bp, Mus musculus
tcactgacctggtgccttttaaggg

SEQ ID NO: 800641 - DNA, 25 bp, Mus musculus
tcactgacgccgacatggtcatgag

SEQ ID NO: 800642 - DNA, 25 bp, Mus musculus
tcactgacgccgtcatggtcatgag

SEQ ID NO: 800643 - DNA, 25 bp, Mus musculus
tcactgactcgacgcaaggctgact

SEQ ID NO: 800644 - DNA, 25 bp, Mus musculus
tcactgactcgaggcaaggctgact

SEQ ID NO: 800645 - DNA, 25 bp, Mus musculus
tcactgactgaactatcttccagcc

SEQ ID NO: 800646 - DNA, 25 bp, Mus musculus
tcactgactgaagtatcttccagcc

SEQ ID NO: 800647 - DNA, 25 bp, Mus musculus
tcactgactggtccagggatctcac

SEQ ID NO: 800648 - DNA, 25 bp, Mus musculus
tcactgactggtgcagggatctcac

SEQ ID NO: 800649 - DNA, 25 bp, Mus musculus
tcactgacttcaacatgtactgggt

SEQ ID NO: 800650 - DNA, 25 bp, Mus musculus
tcactgacttcatcatgtactgggt

SEQ ID NO: 800651 - DNA, 25 bp, Mus musculus
tcactgagactcaaatcccacacaa

SEQ ID NO: 800652 - DNA, 25 bp, Mus musculus
tcactgagactctaatcccacacaa

SEQ ID NO: 800653 - DNA, 25 bp, Mus musculus
tcactgagagtaccacctctgatgc

SEQ ID NO: 800654 - DNA, 25 bp, Mus musculus
tcactgagagtagcacctctgatgc

SEQ ID NO: 800655 - DNA, 25 bp, Mus musculus
tcactgagcaagcttcgcaccgagt

SEQ ID NO: 800656 - DNA, 25 bp, Mus musculus
tcactgagcaaggttcgcaccgagt

SEQ ID NO: 800657 - DNA, 25 bp, Mus musculus
tcactgagcagcagggcagggcagc

SEQ ID NO: 800658 - DNA, 25 bp, Mus musculus
tcactgagcagctgggcagggcagc

SEQ ID NO: 800659 - DNA, 25 bp, Mus musculus
tcactgaggaagctgccctaagttt

SEQ ID NO: 800660 - DNA, 25 bp, Mus musculus
tcactgaggaaggtgccctaagttt

SEQ ID NO: 800661 - DNA, 25 bp, Mus musculus
tcactgaggaatagtgtcggcggtt

SEQ ID NO: 800662 - DNA, 25 bp, Mus musculus
tcactgaggaattgtgtcggcggtt

SEQ ID NO: 800663 - DNA, 25 bp, Mus musculus
tcactgatagataccgaagacagct

SEQ ID NO: 800664 - DNA, 25 bp, Mus musculus
tcactgatagattccgaagacagct

SEQ ID NO: 800665 - DNA, 25 bp, Mus musculus
tcactgatcagaccatgtcacctag

SEQ ID NO: 800666 - DNA, 25 bp, Mus musculus
tcactgatcagagcatgtcacctag

SEQ ID NO: 800667 - DNA, 25 bp, Mus musculus
tcactgatctttcctttcctgagaa

SEQ ID NO: 800668 - DNA, 25 bp, Mus musculus
tcactgatctttgctttcctgagaa

SEQ ID NO: 800669 - DNA, 25 bp, Mus musculus
tcactgatgtacaatgacaagtctt

SEQ ID NO: 800670 - DNA, 25 bp, Mus musculus
tcactgatgtactatgacaagtctt

SEQ ID NO: 800671 - DNA, 25 bp, Mus musculus
tcactgattcccacagatactcgat

SEQ ID NO: 800672 - DNA, 25 bp, Mus musculus
tcactgattccctcagatactcgat

SEQ ID NO: 800673 - DNA, 25 bp, Mus musculus
tcactgcaaagtacttcccaggagc

SEQ ID NO: 800674 - DNA, 25 bp, Mus musculus
tcactgcaaagttcttcccaggagc

SEQ ID NO: 800675 - DNA, 25 bp, Mus musculus
tcactgcaaggactctggccagtac

SEQ ID NO: 800676 - DNA, 25 bp, Mus musculus
tcactgcaaggagtctggccagtac

SEQ ID NO: 800677 - DNA, 25 bp, Mus musculus
tcactgcagtataataatgttcccc

SEQ ID NO: 800678 - DNA, 25 bp, Mus musculus
tcactgcagtattataatgttcccc

SEQ ID NO: 800679 - DNA, 25 bp, Mus musculus
tcactgcatcacagcatgcttgatt

SEQ ID NO: 800680 - DNA, 25 bp, Mus musculus
tcactgcatcactgcatgcttgatt

SEQ ID NO: 800681 - DNA, 25 bp, Mus musculus
tcactgcatcgaagtgtacccacag

SEQ ID NO: 800682 - DNA, 25 bp, Mus musculus
tcactgcatcgatgtgtacccacag

SEQ ID NO: 800683 - DNA, 25 bp, Mus musculus
tcactgccacatacctgtcagatgg

SEQ ID NO: 800684 - DNA, 25 bp, Mus musculus
tcactgccacattcctgtcagatgg

SEQ ID NO: 800685 - DNA, 25 bp, Mus musculus
tcactgccactcacattgtaaacgt

SEQ ID NO: 800686 - DNA, 25 bp, Mus musculus
tcactgccactctcattgtaaacgt

SEQ ID NO: 800687 - DNA, 25 bp, Mus musculus
tcactgccagccaccagtggaagaa

SEQ ID NO: 800688 - DNA, 25 bp, Mus musculus
tcactgccagcctccagtggaagaa

SEQ ID NO: 800689 - DNA, 25 bp, Mus musculus
tcactgccatgccaccaattattaa

SEQ ID NO: 800690 - DNA, 25 bp, Mus musculus
tcactgccatgcgaccaattattaa

SEQ ID NO: 800691 - DNA, 25 bp, Mus musculus
tcactgccattcaactctaacaaat

SEQ ID NO: 800692 - DNA, 25 bp, Mus musculus
tcactgccattctactctaacaaat

SEQ ID NO: 800693 - DNA, 25 bp, Mus musculus
tcactgccctccagagaacagaggt

SEQ ID NO: 800694 - DNA, 25 bp, Mus musculus
tcactgccctcctgagaacagaggt

SEQ ID NO: 800695 - DNA, 25 bp, Mus musculus
tcactgccgctgctgcaggaaggaa

SEQ ID NO: 800696 - DNA, 25 bp, Mus musculus
tcactgccgctggtgcaggaaggaa

SEQ ID NO: 800697 - DNA, 25 bp, Mus musculus
tcactgccggacacctacaaagata

SEQ ID NO: 800698 - DNA, 25 bp, Mus musculus
tcactgccggactcctacaaagata

SEQ ID NO: 800699 - DNA, 25 bp, Mus musculus
tcactgcctatacctgctctgatca

SEQ ID NO: 800700 - DNA, 25 bp, Mus musculus
tcactgcctatagctgctctgatca

SEQ ID NO: 800701 - DNA, 25 bp, Mus musculus
tcactgcctgttcgcattagtccaa

SEQ ID NO: 800702 - DNA, 25 bp, Mus musculus
tcactgcctgttggcattagtccaa

SEQ ID NO: 800703 - DNA, 25 bp, Mus musculus
tcactgccttcaattccttgcagaa

SEQ ID NO: 800704 - DNA, 25 bp, Mus musculus
tcactgccttcatttccttgcagaa

SEQ ID NO: 800705 - DNA, 25 bp, Mus musculus
tcactgcgcattctctgcttctgtc

SEQ ID NO: 800706 - DNA, 25 bp, Mus musculus
tcactgcgcattgtctgcttctgtc

SEQ ID NO: 800707 - DNA, 25 bp, Mus musculus
tcactgcgctgcaatgagactaggg

SEQ ID NO: 800708 - DNA, 25 bp, Mus musculus
tcactgcgctgctatgagactaggg

SEQ ID NO: 800709 - DNA, 25 bp, Mus musculus
tcactgcggactccaggcgtgcaga

SEQ ID NO: 800710 - DNA, 25 bp, Mus musculus
tcactgcggactgcaggcgtgcaga

SEQ ID NO: 800711 - DNA, 25 bp, Mus musculus
tcactgctcagtaaactttcccttg

SEQ ID NO: 800712 - DNA, 25 bp, Mus musculus
tcactgctcagttaactttcccttg

SEQ ID NO: 800713 - DNA, 25 bp, Mus musculus
tcactgctgagtctggatacaccat

SEQ ID NO: 800714 - DNA, 25 bp, Mus musculus
tcactgctgagtgtggatacaccat

SEQ ID NO: 800715 - DNA, 25 bp, Mus musculus
tcactgctgccgcttatggaaacta

SEQ ID NO: 800716 - DNA, 25 bp, Mus musculus
tcactgctgccggttatggaaacta

SEQ ID NO: 800717 - DNA, 25 bp, Mus musculus
tcactgctgcgtcctgtcaaaggga

SEQ ID NO: 800718 - DNA, 25 bp, Mus musculus
tcactgctgcgtgctgtcaaaggga

SEQ ID NO: 800719 - DNA, 25 bp, Mus musculus
tcactgctgctgaccattcacaaaa

SEQ ID NO: 800720 - DNA, 25 bp, Mus musculus
tcactgctgctgtccattcacaaaa

SEQ ID NO: 800721 - DNA, 25 bp, Mus musculus
tcactgctggccagtcatcggcgcg

SEQ ID NO: 800722 - DNA, 25 bp, Mus musculus
tcactgctggcctgtcatcggcgcg

SEQ ID NO: 800723 - DNA, 25 bp, Mus musculus
tcactgctgtacattaactccctaa

SEQ ID NO: 800724 - DNA, 25 bp, Mus musculus
tcactgctgtactttaactccctaa

SEQ ID NO: 800725 - DNA, 25 bp, Mus musculus
tcactgctgtataccagatgctgcc

SEQ ID NO: 800726 - DNA, 25 bp, Mus musculus
tcactgctgtattccagatgctgcc

SEQ ID NO: 800727 - DNA, 25 bp, Mus musculus
tcactgctgtgtacggtgtgcacca

SEQ ID NO: 800728 - DNA, 25 bp, Mus musculus
tcactgctgtgttcggtgtgcacca

SEQ ID NO: 800729 - DNA, 25 bp, Mus musculus
tcactgcttcagaccttgctaacca

SEQ ID NO: 800730 - DNA, 25 bp, Mus musculus
tcactgcttcagtccttgctaacca

SEQ ID NO: 800731 - DNA, 25 bp, Mus musculus
tcactgcttcctaaggtatccacac

SEQ ID NO: 800732 - DNA, 25 bp, Mus musculus
tcactgcttccttaggtatccacac

SEQ ID NO: 800733 - DNA, 25 bp, Mus musculus
tcactgcttgcacttcctgatggaa

SEQ ID NO: 800734 - DNA, 25 bp, Mus musculus
tcactgcttgcagttcctgatggaa

SEQ ID NO: 800735 - DNA, 25 bp, Mus musculus
tcactgcttgcgagaatcattaacg

SEQ ID NO: 800736 - DNA, 25 bp, Mus musculus
tcactgcttgcgtgaatcattaacg

SEQ ID NO: 800737 - DNA, 25 bp, Mus musculus
tcactggacgtgacactgggattca

SEQ ID NO: 800738 - DNA, 25 bp, Mus musculus
tcactggacgtgtcactgggattca

SEQ ID NO: 800739 - DNA, 25 bp, Mus musculus
tcactggactccattcagtaccaag

SEQ ID NO: 800740 - DNA, 25 bp, Mus musculus
tcactggactcctttcagtaccaag

SEQ ID NO: 800741 - DNA, 25 bp, Mus musculus
tcactggactctattgcagcgccgg

SEQ ID NO: 800742 - DNA, 25 bp, Mus musculus
tcactggactcttttgcagcgccgg

SEQ ID NO: 800743 - DNA, 25 bp, Mus musculus
tcactggagggtacctgagagaaga

SEQ ID NO: 800744 - DNA, 25 bp, Mus musculus
tcactggagggttcctgagagaaga

SEQ ID NO: 800745 - DNA, 25 bp, Mus musculus
tcactggagtccaaaggcagagaca

SEQ ID NO: 800746 - DNA, 25 bp, Mus musculus
tcactggagtcctaaggcagagaca

SEQ ID NO: 800747 - DNA, 25 bp, Mus musculus
tcactggagtgacaatgctgagaca

SEQ ID NO: 800748 - DNA, 25 bp, Mus musculus
tcactggagtgagaatgctgagaca

SEQ ID NO: 800749 - DNA, 25 bp, Mus musculus
tcactggagtgtcccacggttaatt

SEQ ID NO: 800750 - DNA, 25 bp, Mus musculus
tcactggagtgtgccacggttaatt

SEQ ID NO: 800751 - DNA, 25 bp, Mus musculus
tcactggatcagaggcacagatcag

SEQ ID NO: 800752 - DNA, 25 bp, Mus musculus
tcactggatcagtggcacagatcag

SEQ ID NO: 800753 - DNA, 25 bp, Mus musculus
tcactggatgctctgcagtcctaca

SEQ ID NO: 800754 - DNA, 25 bp, Mus musculus
tcactggatgctgtgcagtcctaca

SEQ ID NO: 800755 - DNA, 25 bp, Mus musculus
tcactggcagggatccatggaccct

SEQ ID NO: 800756 - DNA, 25 bp, Mus musculus
tcactggcagggttccatggaccct

SEQ ID NO: 800757 - DNA, 25 bp, Mus musculus
tcactggcatctcctatgatggcat

SEQ ID NO: 800758 - DNA, 25 bp, Mus musculus
tcactggcatctgctatgatggcat

SEQ ID NO: 800759 - DNA, 25 bp, Mus musculus
tcactggcccggatttgaggttagc

SEQ ID NO: 800760 - DNA, 25 bp, Mus musculus
tcactggcccggttttgaggttagc

SEQ ID NO: 800761 - DNA, 25 bp, Mus musculus
tcactggcctttctaagcccttgga

SEQ ID NO: 800762 - DNA, 25 bp, Mus musculus
tcactggcctttgtaagcccttgga

SEQ ID NO: 800763 - DNA, 25 bp, Mus musculus
tcactggcgttgatctagccttggg

SEQ ID NO: 800764 - DNA, 25 bp, Mus musculus
tcactggcgttgttctagccttggg

SEQ ID NO: 800765 - DNA, 25 bp, Mus musculus
tcactggctacaatgacaccagctc

SEQ ID NO: 800766 - DNA, 25 bp, Mus musculus
tcactggctacattgacaccagctc

SEQ ID NO: 800767 - DNA, 25 bp, Mus musculus
tcactggctcctaatttaaagatct

SEQ ID NO: 800768 - DNA, 25 bp, Mus musculus
tcactggctccttatttaaagatct

SEQ ID NO: 800769 - DNA, 25 bp, Mus musculus
tcactggcttttaagggtcccctga

SEQ ID NO: 800770 - DNA, 25 bp, Mus musculus
tcactggctttttagggtcccctga

SEQ ID NO: 800771 - DNA, 25 bp, Mus musculus
tcactgggacctcgccactgaataa

SEQ ID NO: 800772 - DNA, 25 bp, Mus musculus
tcactgggacctggccactgaataa

SEQ ID NO: 800773 - DNA, 25 bp, Mus musculus
tcactgggacgtctctgcaggcagt

SEQ ID NO: 800774 - DNA, 25 bp, Mus musculus
tcactgggacgtgtctgcaggcagt

SEQ ID NO: 800775 - DNA, 25 bp, Mus musculus
tcactgggccagagctgatccttga

SEQ ID NO: 800776 - DNA, 25 bp, Mus musculus
tcactgggccagtgctgatccttga

SEQ ID NO: 800777 - DNA, 25 bp, Mus musculus
tcactgggccttactagcattcact

SEQ ID NO: 800778 - DNA, 25 bp, Mus musculus
tcactgggcctttctagcattcact

SEQ ID NO: 800779 - DNA, 25 bp, Mus musculus
tcactgggctagagagaggcccttg

SEQ ID NO: 800780 - DNA, 25 bp, Mus musculus
tcactgggctagtgagaggcccttg

SEQ ID NO: 800781 - DNA, 25 bp, Mus musculus
tcactgggctcaaagaagtaggctc

SEQ ID NO: 800782 - DNA, 25 bp, Mus musculus
tcactgggctcatagaagtaggctc

SEQ ID NO: 800783 - DNA, 25 bp, Mus musculus
tcactgggctgcagttgtgagcatc

SEQ ID NO: 800784 - DNA, 25 bp, Mus musculus
tcactgggctgctgttgtgagcatc

SEQ ID NO: 800785 - DNA, 25 bp, Mus musculus
tcactggtaaagagatagagcacct

SEQ ID NO: 800786 - DNA, 25 bp, Mus musculus
tcactggtaaagtgatagagcacct

SEQ ID NO: 800787 - DNA, 25 bp, Mus musculus
tcactggtaagactgttcttaagta

SEQ ID NO: 800788 - DNA, 25 bp, Mus musculus
tcactggtaagagtgttcttaagta

SEQ ID NO: 800789 - DNA, 25 bp, Mus musculus
tcactggtactgagcatcatcatct

SEQ ID NO: 800790 - DNA, 25 bp, Mus musculus
tcactggtactgtgcatcatcatct

SEQ ID NO: 800791 - DNA, 25 bp, Mus musculus
tcactggtcatgctgtcagagctga

SEQ ID NO: 800792 - DNA, 25 bp, Mus musculus
tcactggtcatggtgtcagagctga

SEQ ID NO: 800793 - DNA, 25 bp, Mus musculus
tcactggtccctaactattaactag

SEQ ID NO: 800794 - DNA, 25 bp, Mus musculus
tcactggtcccttactattaactag

SEQ ID NO: 800795 - DNA, 25 bp, Mus musculus
tcactggtcgtgctccagagccaaa

SEQ ID NO: 800796 - DNA, 25 bp, Mus musculus
tcactggtcgtggtccagagccaaa

SEQ ID NO: 800797 - DNA, 25 bp, Mus musculus
tcactggtcttgattgggattgcta

SEQ ID NO: 800798 - DNA, 25 bp, Mus musculus
tcactggtcttgtttgggattgcta

SEQ ID NO: 800799 - DNA, 25 bp, Mus musculus
tcactggtgaccatattgttggcat

SEQ ID NO: 800800 - DNA, 25 bp, Mus musculus
tcactggtgaccttattgttggcat

SEQ ID NO: 800801 - DNA, 25 bp, Mus musculus
tcactggtgcatcactacaagtctt

SEQ ID NO: 800802 - DNA, 25 bp, Mus musculus
tcactggtgcatgactacaagtctt

SEQ ID NO: 800803 - DNA, 25 bp, Mus musculus
tcactggtgctcacttgctgctcgg

SEQ ID NO: 800804 - DNA, 25 bp, Mus musculus
tcactggtgctctcttgctgctcgg

SEQ ID NO: 800805 - DNA, 25 bp, Mus musculus
tcactggtggagctcctacctagaa

SEQ ID NO: 800806 - DNA, 25 bp, Mus musculus
tcactggtggaggtcctacctagaa

SEQ ID NO: 800807 - DNA, 25 bp, Mus musculus
tcactggtgtaaacctgtactgcgg

SEQ ID NO: 800808 - DNA, 25 bp, Mus musculus
tcactggtgtaatcctgtactgcgg

SEQ ID NO: 800809 - DNA, 25 bp, Mus musculus
tcactggttgatctattattcctaa

SEQ ID NO: 800810 - DNA, 25 bp, Mus musculus
tcactggttgatgtattattcctaa

SEQ ID NO: 800811 - DNA, 25 bp, Mus musculus
tcactggttgtgaggtggcacgtcc

SEQ ID NO: 800812 - DNA, 25 bp, Mus musculus
tcactggttgtgtggtggcacgtcc

SEQ ID NO: 800813 - DNA, 25 bp, Mus musculus
tcactgtaagtgatcaaaggaggag

SEQ ID NO: 800814 - DNA, 25 bp, Mus musculus
tcactgtaagtgttcaaaggaggag

SEQ ID NO: 800815 - DNA, 25 bp, Mus musculus
tcactgtaagttcggtttcctgaag

SEQ ID NO: 800816 - DNA, 25 bp, Mus musculus
tcactgtaagttgggtttcctgaag

SEQ ID NO: 800817 - DNA, 25 bp, Mus musculus
tcactgtaatctattgttctactag

SEQ ID NO: 800818 - DNA, 25 bp, Mus musculus
tcactgtaatcttttgttctactag

SEQ ID NO: 800819 - DNA, 25 bp, Mus musculus
tcactgtatctcaccgtgggcagca

SEQ ID NO: 800820 - DNA, 25 bp, Mus musculus
tcactgtatctctccgtgggcagca

SEQ ID NO: 800821 - DNA, 25 bp, Mus musculus
tcactgtatgtcactgcacccggtt

SEQ ID NO: 800822 - DNA, 25 bp, Mus musculus
tcactgtatgtctctgcacccggtt

SEQ ID NO: 800823 - DNA, 25 bp, Mus musculus
tcactgtattttcctcctctctgag

SEQ ID NO: 800824 - DNA, 25 bp, Mus musculus
tcactgtattttgctcctctctgag

SEQ ID NO: 800825 - DNA, 25 bp, Mus musculus
tcactgtcaaacagaacgagggggt

SEQ ID NO: 800826 - DNA, 25 bp, Mus musculus
tcactgtcaaactgaacgagggggt

SEQ ID NO: 800827 - DNA, 25 bp, Mus musculus
tcactgtcaaatacgtcatcatgaa

SEQ ID NO: 800828 - DNA, 25 bp, Mus musculus
tcactgtcaaattcgtcatcatgaa

SEQ ID NO: 800829 - DNA, 25 bp, Mus musculus
tcactgtcacttcagaggtgccttt

SEQ ID NO: 800830 - DNA, 25 bp, Mus musculus
tcactgtcacttgagaggtgccttt

SEQ ID NO: 800831 - DNA, 25 bp, Mus musculus
tcactgtcagcaccagctggtaaag

SEQ ID NO: 800832 - DNA, 25 bp, Mus musculus
tcactgtcagcagcagctggtaaag

SEQ ID NO: 800833 - DNA, 25 bp, Mus musculus
tcactgtcagccatctgtaaccaaa

SEQ ID NO: 800834 - DNA, 25 bp, Mus musculus
tcactgtcagccttctgtaaccaaa

SEQ ID NO: 800835 - DNA, 25 bp, Mus musculus
tcactgtccctcatgactgtacaga

SEQ ID NO: 800836 - DNA, 25 bp, Mus musculus
tcactgtccctcttgactgtacaga

SEQ ID NO: 800837 - DNA, 25 bp, Mus musculus
tcactgtctcttaggctggtttgga

SEQ ID NO: 800838 - DNA, 25 bp, Mus musculus
tcactgtctctttggctggtttgga

SEQ ID NO: 800839 - DNA, 25 bp, Mus musculus
tcactgtctgcaaagaggactttct

SEQ ID NO: 800840 - DNA, 25 bp, Mus musculus
tcactgtctgcaagatgcctggttt

SEQ ID NO: 800841 - DNA, 25 bp, Mus musculus
tcactgtctgcatagaggactttct

SEQ ID NO: 800842 - DNA, 25 bp, Mus musculus
tcactgtctgcatgatgcctggttt

SEQ ID NO: 800843 - DNA, 25 bp, Mus musculus
tcactgtgacctctgaattttcaag

SEQ ID NO: 800844 - DNA, 25 bp, Mus musculus
tcactgtgacctgtgaattttcaag

SEQ ID NO: 800845 - DNA, 25 bp, Mus musculus
tcactgtgactcattttgatgtaca

SEQ ID NO: 800846 - DNA, 25 bp, Mus musculus
tcactgtgactctttttgatgtaca

SEQ ID NO: 800847 - DNA, 25 bp, Mus musculus
tcactgtgacttcacatgtttgact

SEQ ID NO: 800848 - DNA, 25 bp, Mus musculus
tcactgtgacttgacatgtttgact

SEQ ID NO: 800849 - DNA, 25 bp, Mus musculus
tcactgtgcaaacctgaggctctta

SEQ ID NO: 800850 - DNA, 25 bp, Mus musculus
tcactgtgcaaagctgaggctctta

SEQ ID NO: 800851 - DNA, 25 bp, Mus musculus
tcactgtgcaggaaccatccaaggg

SEQ ID NO: 800852 - DNA, 25 bp, Mus musculus
tcactgtgcaggtaccatccaaggg

SEQ ID NO: 800853 - DNA, 25 bp, Mus musculus
tcactgtgccttatgtctcatggct

SEQ ID NO: 800854 - DNA, 25 bp, Mus musculus
tcactgtgccttttgtctcatggct

SEQ ID NO: 800855 - DNA, 25 bp, Mus musculus
tcactgtgcggaacagttctgcgaa

SEQ ID NO: 800856 - DNA, 25 bp, Mus musculus
tcactgtgcggatcagttctgcgaa

SEQ ID NO: 800857 - DNA, 25 bp, Mus musculus
tcactgtgcgttaatcttctttttt

SEQ ID NO: 800858 - DNA, 25 bp, Mus musculus
tcactgtgcgtttatcttctttttt

SEQ ID NO: 800859 - DNA, 25 bp, Mus musculus
tcactgtggactcaggctcccttct

SEQ ID NO: 800860 - DNA, 25 bp, Mus musculus
tcactgtggactgaggctcccttct

SEQ ID NO: 800861 - DNA, 25 bp, Mus musculus
tcactgtggcctaactgatctatct

SEQ ID NO: 800862 - DNA, 25 bp, Mus musculus
tcactgtggccttactgatctatct

SEQ ID NO: 800863 - DNA, 25 bp, Mus musculus
tcactgtggctcactacagtaccta

SEQ ID NO: 800864 - DNA, 25 bp, Mus musculus
tcactgtggctctctacagtaccta

SEQ ID NO: 800865 - DNA, 25 bp, Mus musculus
tcactgtgggtcattcctctagagc

SEQ ID NO: 800866 - DNA, 25 bp, Mus musculus
tcactgtgggtctttcctctagagc

SEQ ID NO: 800867 - DNA, 25 bp, Mus musculus
tcactgtggtcacgccatgagagtt

SEQ ID NO: 800868 - DNA, 25 bp, Mus musculus
tcactgtggtcaggccatgagagtt

SEQ ID NO: 800869 - DNA, 25 bp, Mus musculus
tcactgtgtaagactgacctcacac

SEQ ID NO: 800870 - DNA, 25 bp, Mus musculus
tcactgtgtaagtctgacctcacac

SEQ ID NO: 800871 - DNA, 25 bp, Mus musculus
tcactgtgtacactaggatggcctt

SEQ ID NO: 800872 - DNA, 25 bp, Mus musculus
tcactgtgtacagtaggatggcctt

SEQ ID NO: 800873 - DNA, 25 bp, Mus musculus
tcactgtgtagtcttcctagattca

SEQ ID NO: 800874 - DNA, 25 bp, Mus musculus
tcactgtgtagtgttcctagattca

SEQ ID NO: 800875 - DNA, 25 bp, Mus musculus
tcactgtgtatgaatgcccaggcct

SEQ ID NO: 800876 - DNA, 25 bp, Mus musculus
tcactgtgtatgtatgcccaggcct

SEQ ID NO: 800877 - DNA, 25 bp, Mus musculus
tcactgtgtgacatgctttactctc

SEQ ID NO: 800878 - DNA, 25 bp, Mus musculus
tcactgtgtgacttgctttactctc

SEQ ID NO: 800879 - DNA, 25 bp, Mus musculus
tcactgtgttagaagttaccaaact

SEQ ID NO: 800880 - DNA, 25 bp, Mus musculus
tcactgtgttagtagttaccaaact

SEQ ID NO: 800881 - DNA, 25 bp, Mus musculus
tcactgtgttcccatggtgaccatg

SEQ ID NO: 800882 - DNA, 25 bp, Mus musculus
tcactgtgttccgatggtgaccatg

SEQ ID NO: 800883 - DNA, 25 bp, Mus musculus
tcactgtgttctataacgtctctca

SEQ ID NO: 800884 - DNA, 25 bp, Mus musculus
tcactgtgttctttaacgtctctca

SEQ ID NO: 800885 - DNA, 25 bp, Mus musculus
tcactgttaacacggcattagccag

SEQ ID NO: 800886 - DNA, 25 bp, Mus musculus
tcactgttaacagggcattagccag

SEQ ID NO: 800887 - DNA, 25 bp, Mus musculus
tcactgttactaccttataccacaa

SEQ ID NO: 800888 - DNA, 25 bp, Mus musculus
tcactgttactagcttataccacaa

SEQ ID NO: 800889 - DNA, 25 bp, Mus musculus
tcactgttactcaggctggtcttga

SEQ ID NO: 800890 - DNA, 25 bp, Mus musculus
tcactgttactctggctggtcttga

SEQ ID NO: 800891 - DNA, 25 bp, Mus musculus
tcactgttagtcatttccttattca

SEQ ID NO: 800892 - DNA, 25 bp, Mus musculus
tcactgttagtcttttccttattca

SEQ ID NO: 800893 - DNA, 25 bp, Mus musculus
tcactgttccgtacaaggctgcttg

SEQ ID NO: 800894 - DNA, 25 bp, Mus musculus
tcactgttccgttcaaggctgcttg

SEQ ID NO: 800895 - DNA, 25 bp, Mus musculus
tcactgttcctgacaaaaatgcgaa

SEQ ID NO: 800896 - DNA, 25 bp, Mus musculus
tcactgttcctgtcaaaaatgcgaa

SEQ ID NO: 800897 - DNA, 25 bp, Mus musculus
tcactgttctttccctaattatgtc

SEQ ID NO: 800898 - DNA, 25 bp, Mus musculus
tcactgttctttcctttggcaaatc

SEQ ID NO: 800899 - DNA, 25 bp, Mus musculus
tcactgttctttgcctaattatgtc

SEQ ID NO: 800900 - DNA, 25 bp, Mus musculus
tcactgttctttgctttggcaaatc

SEQ ID NO: 800901 - DNA, 25 bp, Mus musculus
tcactgttgattccgcttaactggc

SEQ ID NO: 800902 - DNA, 25 bp, Mus musculus
tcactgttgattgcgcttaactggc

SEQ ID NO: 800903 - DNA, 25 bp, Mus musculus
tcactgttgcatcagccctgtctgc

SEQ ID NO: 800904 - DNA, 25 bp, Mus musculus
tcactgttgcatgagccctgtctgc

SEQ ID NO: 800905 - DNA, 25 bp, Mus musculus
tcactgttggaacatacttggctaa

SEQ ID NO: 800906 - DNA, 25 bp, Mus musculus
tcactgttggaagatacttggctaa

SEQ ID NO: 800907 - DNA, 25 bp, Mus musculus
tcactgttggatattcctcctgggt

SEQ ID NO: 800908 - DNA, 25 bp, Mus musculus
tcactgttggattttcctcctgggt

SEQ ID NO: 800909 - DNA, 25 bp, Mus musculus
tcactgttggcacggtttaagcata

SEQ ID NO: 800910 - DNA, 25 bp, Mus musculus
tcactgttggcagggtttaagcata

SEQ ID NO: 800911 - DNA, 25 bp, Mus musculus
tcactgttgtgtcacctccttgcag

SEQ ID NO: 800912 - DNA, 25 bp, Mus musculus
tcactgttgtgtgacctccttgcag

SEQ ID NO: 800913 - DNA, 25 bp, Mus musculus
tcactgttgtttacttgggaagagc

SEQ ID NO: 800914 - DNA, 25 bp, Mus musculus
tcactgttgttttcttgggaagagc

SEQ ID NO: 800915 - DNA, 25 bp, Mus musculus
tcactgtttacaccccaaataggca

SEQ ID NO: 800916 - DNA, 25 bp, Mus musculus
tcactgtttacagcccaaataggca

SEQ ID NO: 800917 - DNA, 25 bp, Mus musculus
tcacttaaaaacaccaaccccgatg

SEQ ID NO: 800918 - DNA, 25 bp, Mus musculus
tcacttaaaaactccaaccccgatg

SEQ ID NO: 800919 - DNA, 25 bp, Mus musculus
tcacttaaaaccagtttccattcgc

SEQ ID NO: 800920 - DNA, 25 bp, Mus musculus
tcacttaaaacctgtttccattcgc

SEQ ID NO: 800921 - DNA, 25 bp, Mus musculus
tcacttaacagtccctttggttcca

SEQ ID NO: 800922 - DNA, 25 bp, Mus musculus
tcacttaacagtgcctttggttcca

SEQ ID NO: 800923 - DNA, 25 bp, Mus musculus
tcacttaagaagataggctcagcca

SEQ ID NO: 800924 - DNA, 25 bp, Mus musculus
tcacttaagaagttaggctcagcca

SEQ ID NO: 800925 - DNA, 25 bp, Mus musculus
tcacttaattaacacgagcccgcat

SEQ ID NO: 800926 - DNA, 25 bp, Mus musculus
tcacttaattaagacgagcccgcat

SEQ ID NO: 800927 - DNA, 25 bp, Mus musculus
tcacttacacgcacactgttggaag

SEQ ID NO: 800928 - DNA, 25 bp, Mus musculus
tcacttacacgctcactgttggaag

SEQ ID NO: 800929 - DNA, 25 bp, Mus musculus
tcacttaccgaaaagattccatttg

SEQ ID NO: 800930 - DNA, 25 bp, Mus musculus
tcacttaccgaatagattccatttg

SEQ ID NO: 800931 - DNA, 25 bp, Mus musculus
tcacttactgctatatcctctttta

SEQ ID NO: 800932 - DNA, 25 bp, Mus musculus
tcacttactgctttatcctctttta

SEQ ID NO: 800933 - DNA, 25 bp, Mus musculus
tcacttagagtgagtgccccgcggt

SEQ ID NO: 800934 - DNA, 25 bp, Mus musculus
tcacttagagtgtgtgccccgcggt

SEQ ID NO: 800935 - DNA, 25 bp, Mus musculus
tcacttagcctgatagttctcatcc

SEQ ID NO: 800936 - DNA, 25 bp, Mus musculus
tcacttagcctgttagttctcatcc

SEQ ID NO: 800937 - DNA, 25 bp, Mus musculus
tcacttagtggccatgacatctcaa

SEQ ID NO: 800938 - DNA, 25 bp, Mus musculus
tcacttagtggcgatgacatctcaa

SEQ ID NO: 800939 - DNA, 25 bp, Mus musculus
tcacttatacttagtactaaccatt

SEQ ID NO: 800940 - DNA, 25 bp, Mus musculus
tcacttatactttgtactaaccatt

SEQ ID NO: 800941 - DNA, 25 bp, Mus musculus
tcacttatccacaccactgggatga

SEQ ID NO: 800942 - DNA, 25 bp, Mus musculus
tcacttatccactccactgggatga

SEQ ID NO: 800943 - DNA, 25 bp, Mus musculus
tcacttatctgaccctttcagctct

SEQ ID NO: 800944 - DNA, 25 bp, Mus musculus
tcacttatctgagcctttcagctct

SEQ ID NO: 800945 - DNA, 25 bp, Mus musculus
tcacttatctggacagtcacccgca

SEQ ID NO: 800946 - DNA, 25 bp, Mus musculus
tcacttatctggtcagtcacccgca

SEQ ID NO: 800947 - DNA, 25 bp, Mus musculus
tcacttatgaaacacagcgacgttg

SEQ ID NO: 800948 - DNA, 25 bp, Mus musculus
tcacttatgaaagacagcgacgttg

SEQ ID NO: 800949 - DNA, 25 bp, Mus musculus
tcacttcaagataggccaggtccct

SEQ ID NO: 800950 - DNA, 25 bp, Mus musculus
tcacttcaagattggccaggtccct

SEQ ID NO: 800951 - DNA, 25 bp, Mus musculus
tcacttcaagttcaaagccgtcctg

SEQ ID NO: 800952 - DNA, 25 bp, Mus musculus
tcacttcaagttgaaagccgtcctg

SEQ ID NO: 800953 - DNA, 25 bp, Mus musculus
tcacttcactccctggtaaggatat

SEQ ID NO: 800954 - DNA, 25 bp, Mus musculus
tcacttcactccgtggtaaggatat

SEQ ID NO: 800955 - DNA, 25 bp, Mus musculus
tcacttcatcaacccagacacagta

SEQ ID NO: 800956 - DNA, 25 bp, Mus musculus
tcacttcatcaagccagacacagta

SEQ ID NO: 800957 - DNA, 25 bp, Mus musculus
tcacttcatgtactggacgggagcc

SEQ ID NO: 800958 - DNA, 25 bp, Mus musculus
tcacttcatgtagtggacgggagcc

SEQ ID NO: 800959 - DNA, 25 bp, Mus musculus
tcacttcattttctgggttacctca

SEQ ID NO: 800960 - DNA, 25 bp, Mus musculus
tcacttcattttgtgggttacctca

SEQ ID NO: 800961 - DNA, 25 bp, Mus musculus
tcacttccaagacccaaagctatgg

SEQ ID NO: 800962 - DNA, 25 bp, Mus musculus
tcacttccaagagccaaagctatgg

SEQ ID NO: 800963 - DNA, 25 bp, Mus musculus
tcacttccaagtacttttaggtttg

SEQ ID NO: 800964 - DNA, 25 bp, Mus musculus
tcacttccaagttcttttaggtttg

SEQ ID NO: 800965 - DNA, 25 bp, Mus musculus
tcacttccaatgcagcctgtggcat

SEQ ID NO: 800966 - DNA, 25 bp, Mus musculus
tcacttccaatggagcctgtggcat

SEQ ID NO: 800967 - DNA, 25 bp, Mus musculus
tcacttccagctagactccttttta

SEQ ID NO: 800968 - DNA, 25 bp, Mus musculus
tcacttccagcttgactccttttta

SEQ ID NO: 800969 - DNA, 25 bp, Mus musculus
tcacttccatctctggtaaacttta

SEQ ID NO: 800970 - DNA, 25 bp, Mus musculus
tcacttccatctgtggtaaacttta

SEQ ID NO: 800971 - DNA, 25 bp, Mus musculus
tcacttccatgacggtttgcattag

SEQ ID NO: 800972 - DNA, 25 bp, Mus musculus
tcacttccatgagggtttgcattag

SEQ ID NO: 800973 - DNA, 25 bp, Mus musculus
tcacttcccaaaatacatctcatct

SEQ ID NO: 800974 - DNA, 25 bp, Mus musculus
tcacttcccaaattacatctcatct

SEQ ID NO: 800975 - DNA, 25 bp, Mus musculus
tcacttccctttcctggtattatgg

SEQ ID NO: 800976 - DNA, 25 bp, Mus musculus
tcacttccctttgctggtattatgg

SEQ ID NO: 800977 - DNA, 25 bp, Mus musculus
tcacttccgagaatttcattcactt

SEQ ID NO: 800978 - DNA, 25 bp, Mus musculus
tcacttccgagattttcattcactt

SEQ ID NO: 800979 - DNA, 25 bp, Mus musculus
tcacttccggatactggaccaatcg

SEQ ID NO: 800980 - DNA, 25 bp, Mus musculus
tcacttccggattctggaccaatcg

SEQ ID NO: 800981 - DNA, 25 bp, Mus musculus
tcacttcctatccaccaactcattc

SEQ ID NO: 800982 - DNA, 25 bp, Mus musculus
tcacttcctatcgaccaactcattc

SEQ ID NO: 800983 - DNA, 25 bp, Mus musculus
tcacttcctcctcggcagtatctag

SEQ ID NO: 800984 - DNA, 25 bp, Mus musculus
tcacttcctcctcgtgtttgttttc

SEQ ID NO: 800985 - DNA, 25 bp, Mus musculus
tcacttcctcctgggcagtatctag

SEQ ID NO: 800986 - DNA, 25 bp, Mus musculus
tcacttcctcctggtgtttgttttc

SEQ ID NO: 800987 - DNA, 25 bp, Mus musculus
tcacttccttctcgattttcacaaa

SEQ ID NO: 800988 - DNA, 25 bp, Mus musculus
tcacttccttctggattttcacaaa

SEQ ID NO: 800989 - DNA, 25 bp, Mus musculus
tcacttcctttacccaatgtagctg

SEQ ID NO: 800990 - DNA, 25 bp, Mus musculus
tcacttcctttagccaatgtagctg

SEQ ID NO: 800991 - DNA, 25 bp, Mus musculus
tcacttcggaacactgctgtggagg

SEQ ID NO: 800992 - DNA, 25 bp, Mus musculus
tcacttcggaactctgctgtggagg

SEQ ID NO: 800993 - DNA, 25 bp, Mus musculus
tcacttctaaccctttcttattcta

SEQ ID NO: 800994 - DNA, 25 bp, Mus musculus
tcacttctaaccgtttcttattcta

SEQ ID NO: 800995 - DNA, 25 bp, Mus musculus
tcacttctattgaactgtataaaga

SEQ ID NO: 800996 - DNA, 25 bp, Mus musculus
tcacttctattgtactgtataaaga

SEQ ID NO: 800997 - DNA, 25 bp, Mus musculus
tcacttctcactcttgtcccgtgag

SEQ ID NO: 800998 - DNA, 25 bp, Mus musculus
tcacttctcactgttgtcccgtgag

SEQ ID NO: 800999 - DNA, 25 bp, Mus musculus
tcacttctcagacccagtttctctc

SEQ ID NO: 801000 - DNA, 25 bp, Mus musculus
tcacttctcagagccagtttctctc

SEQ ID NO: 801001 - DNA, 25 bp, Mus musculus
tcacttctcatgatagggagatgtg

SEQ ID NO: 801002 - DNA, 25 bp, Mus musculus
tcacttctcatgttagggagatgtg

SEQ ID NO: 801003 - DNA, 25 bp, Mus musculus
tcacttctctcaatcttctatttac

SEQ ID NO: 801004 - DNA, 25 bp, Mus musculus
tcacttctctcattcttctatttac

SEQ ID NO: 801005 - DNA, 25 bp, Mus musculus
tcacttctctgtaaccgactctcac

SEQ ID NO: 801006 - DNA, 25 bp, Mus musculus
tcacttctctgttaccgactctcac

SEQ ID NO: 801007 - DNA, 25 bp, Mus musculus
tcacttctgcctccagcagttataa

SEQ ID NO: 801008 - DNA, 25 bp, Mus musculus
tcacttctgcctgcagcagttataa

SEQ ID NO: 801009 - DNA, 25 bp, Mus musculus
tcacttctggaacctaaccggagtt

SEQ ID NO: 801010 - DNA, 25 bp, Mus musculus
tcacttctggaagctaaccggagtt

SEQ ID NO: 801011 - DNA, 25 bp, Mus musculus
tcacttctgggacattacctcagca

SEQ ID NO: 801012 - DNA, 25 bp, Mus musculus
tcacttctgggagattacctcagca

SEQ ID NO: 801013 - DNA, 25 bp, Mus musculus
tcacttctgggtcttgtggcaggca

SEQ ID NO: 801014 - DNA, 25 bp, Mus musculus
tcacttctgggtgttgtggcaggca

SEQ ID NO: 801015 - DNA, 25 bp, Mus musculus
tcacttctgtggctcaaatctcttg

SEQ ID NO: 801016 - DNA, 25 bp, Mus musculus
tcacttctgtgggtcaaatctcttg

SEQ ID NO: 801017 - DNA, 25 bp, Mus musculus
tcacttcttagactgcacacttctt

SEQ ID NO: 801018 - DNA, 25 bp, Mus musculus
tcacttcttagagtgcacacttctt

SEQ ID NO: 801019 - DNA, 25 bp, Mus musculus
tcacttcttgccaatcgaagcgccg

SEQ ID NO: 801020 - DNA, 25 bp, Mus musculus
tcacttcttgcctatcgaagcgccg

SEQ ID NO: 801021 - DNA, 25 bp, Mus musculus
tcacttgacagcatcaaaagcaggt

SEQ ID NO: 801022 - DNA, 25 bp, Mus musculus
tcacttgacagcttcaaaagcaggt

SEQ ID NO: 801023 - DNA, 25 bp, Mus musculus
tcacttgacccacgcgaggaagagg

SEQ ID NO: 801024 - DNA, 25 bp, Mus musculus
tcacttgacccaggcgaggaagagg

SEQ ID NO: 801025 - DNA, 25 bp, Mus musculus
tcacttgagataactgcaggatcca

SEQ ID NO: 801026 - DNA, 25 bp, Mus musculus
tcacttgagatatctgcaggatcca

SEQ ID NO: 801027 - DNA, 25 bp, Mus musculus
tcacttgagccaataactgatgctg

SEQ ID NO: 801028 - DNA, 25 bp, Mus musculus
tcacttgagccattaactgatgctg

SEQ ID NO: 801029 - DNA, 25 bp, Mus musculus
tcacttgagtcaacagcggcagcag

SEQ ID NO: 801030 - DNA, 25 bp, Mus musculus
tcacttgagtcatcagcggcagcag

SEQ ID NO: 801031 - DNA, 25 bp, Mus musculus
tcacttgatgctcgtcatgatgtcc

SEQ ID NO: 801032 - DNA, 25 bp, Mus musculus
tcacttgatgctggtcatgatgtcc

SEQ ID NO: 801033 - DNA, 25 bp, Mus musculus
tcacttgcaaccactcttccaagat

SEQ ID NO: 801034 - DNA, 25 bp, Mus musculus
tcacttgcaacctctcttccaagat

SEQ ID NO: 801035 - DNA, 25 bp, Mus musculus
tcacttgcaagaagctaccagctgg

SEQ ID NO: 801036 - DNA, 25 bp, Mus musculus
tcacttgcaagatgctaccagctgg

SEQ ID NO: 801037 - DNA, 25 bp, Mus musculus
tcacttgcaagtcgattttagccat

SEQ ID NO: 801038 - DNA, 25 bp, Mus musculus
tcacttgcaagtggattttagccat

SEQ ID NO: 801039 - DNA, 25 bp, Mus musculus
tcacttgcattacagcttacatacg

SEQ ID NO: 801040 - DNA, 25 bp, Mus musculus
tcacttgcattagagcttacatacg

SEQ ID NO: 801041 - DNA, 25 bp, Mus musculus
tcacttgccctaccattcttgttct

SEQ ID NO: 801042 - DNA, 25 bp, Mus musculus
tcacttgccctagcattcttgttct

SEQ ID NO: 801043 - DNA, 25 bp, Mus musculus
tcacttgcccttaaagcctggcaaa

SEQ ID NO: 801044 - DNA, 25 bp, Mus musculus
tcacttgccctttaagcctggcaaa

SEQ ID NO: 801045 - DNA, 25 bp, Mus musculus
tcacttgccttgaccttgtttttaa

SEQ ID NO: 801046 - DNA, 25 bp, Mus musculus
tcacttgccttgtccttgtttttaa

SEQ ID NO: 801047 - DNA, 25 bp, Mus musculus
tcacttgcggtacgccggcttcaaa

SEQ ID NO: 801048 - DNA, 25 bp, Mus musculus
tcacttgcggtaggccggcttcaaa

SEQ ID NO: 801049 - DNA, 25 bp, Mus musculus
tcacttgctgcaaggatcggatgac

SEQ ID NO: 801050 - DNA, 25 bp, Mus musculus
tcacttgctgcatggatcggatgac

SEQ ID NO: 801051 - DNA, 25 bp, Mus musculus
tcacttgctgtacatggcttatttt

SEQ ID NO: 801052 - DNA, 25 bp, Mus musculus
tcacttgctgtagatggcttatttt

SEQ ID NO: 801053 - DNA, 25 bp, Mus musculus
tcacttgctgttatgtaccttgaca

SEQ ID NO: 801054 - DNA, 25 bp, Mus musculus
tcacttgctgttttgtaccttgaca

SEQ ID NO: 801055 - DNA, 25 bp, Mus musculus
tcacttgcttcaccaagcacgagct

SEQ ID NO: 801056 - DNA, 25 bp, Mus musculus
tcacttgcttcagcaagcacgagct

SEQ ID NO: 801057 - DNA, 25 bp, Mus musculus
tcacttgctttgaatgctcaggcct

SEQ ID NO: 801058 - DNA, 25 bp, Mus musculus
tcacttgctttgtatgctcaggcct

SEQ ID NO: 801059 - DNA, 25 bp, Mus musculus
tcacttggaggcacattgaccacag

SEQ ID NO: 801060 - DNA, 25 bp, Mus musculus
tcacttggaggctcattgaccacag

SEQ ID NO: 801061 - DNA, 25 bp, Mus musculus
tcacttggcagtacccatgtagaga

SEQ ID NO: 801062 - DNA, 25 bp, Mus musculus
tcacttggcagttcccatgtagaga

SEQ ID NO: 801063 - DNA, 25 bp, Mus musculus
tcacttggcttgagctggtgcagca

SEQ ID NO: 801064 - DNA, 25 bp, Mus musculus
tcacttggcttgtgctggtgcagca

SEQ ID NO: 801065 - DNA, 25 bp, Mus musculus
tcacttgggaacattttcccaaaga

SEQ ID NO: 801066 - DNA, 25 bp, Mus musculus
tcacttgggaactttttcccaaaga

SEQ ID NO: 801067 - DNA, 25 bp, Mus musculus
tcacttgggcaacgtggaaggacta

SEQ ID NO: 801068 - DNA, 25 bp, Mus musculus
tcacttgggcaaggtggaaggacta

SEQ ID NO: 801069 - DNA, 25 bp, Mus musculus
tcacttgggccaacaacttgattag

SEQ ID NO: 801070 - DNA, 25 bp, Mus musculus
tcacttgggccatcaacttgattag

SEQ ID NO: 801071 - DNA, 25 bp, Mus musculus
tcacttggtggtcagctccaggagt

SEQ ID NO: 801072 - DNA, 25 bp, Mus musculus
tcacttggtggtgagctccaggagt

SEQ ID NO: 801073 - DNA, 25 bp, Mus musculus
tcacttgtaaatataaagacctttt

SEQ ID NO: 801074 - DNA, 25 bp, Mus musculus
tcacttgtaaatttaaagacctttt

SEQ ID NO: 801075 - DNA, 25 bp, Mus musculus
tcacttgtacacagaggacactcct

SEQ ID NO: 801076 - DNA, 25 bp, Mus musculus
tcacttgtacactgaggacactcct

SEQ ID NO: 801077 - DNA, 25 bp, Mus musculus
tcacttgtacagctttctacttttg

SEQ ID NO: 801078 - DNA, 25 bp, Mus musculus
tcacttgtacaggtttctacttttg

SEQ ID NO: 801079 - DNA, 25 bp, Mus musculus
tcacttgtagtgctaccatttttgg

SEQ ID NO: 801080 - DNA, 25 bp, Mus musculus
tcacttgtagtggtaccatttttgg

SEQ ID NO: 801081 - DNA, 25 bp, Mus musculus
tcacttgtatgtcttgtaatctctt

SEQ ID NO: 801082 - DNA, 25 bp, Mus musculus
tcacttgtatgtgttgtaatctctt

SEQ ID NO: 801083 - DNA, 25 bp, Mus musculus
tcacttgtcacaagctggaggtctg

SEQ ID NO: 801084 - DNA, 25 bp, Mus musculus
tcacttgtcacatgctggaggtctg

SEQ ID NO: 801085 - DNA, 25 bp, Mus musculus
tcacttgtcaccctatgtaaaaccc

SEQ ID NO: 801086 - DNA, 25 bp, Mus musculus
tcacttgtcaccgtatgtaaaaccc

SEQ ID NO: 801087 - DNA, 25 bp, Mus musculus
tcacttgtctgacctggtgaggtgt

SEQ ID NO: 801088 - DNA, 25 bp, Mus musculus
tcacttgtctgagctggtgaggtgt

SEQ ID NO: 801089 - DNA, 25 bp, Mus musculus
tcacttgtgcctagtttgttctctc

SEQ ID NO: 801090 - DNA, 25 bp, Mus musculus
tcacttgtgccttgtttgttctctc

SEQ ID NO: 801091 - DNA, 25 bp, Mus musculus
tcacttgtgtctaaaaccaacaaag

SEQ ID NO: 801092 - DNA, 25 bp, Mus musculus
tcacttgtgtcttaaaccaacaaag

SEQ ID NO: 801093 - DNA, 25 bp, Mus musculus
tcacttgtgtttcagctgtgctgca

SEQ ID NO: 801094 - DNA, 25 bp, Mus musculus
tcacttgtgtttgagctgtgctgca

SEQ ID NO: 801095 - DNA, 25 bp, Mus musculus
tcacttgttcaacggctctagcaat

SEQ ID NO: 801096 - DNA, 25 bp, Mus musculus
tcacttgttcaagggctctagcaat

SEQ ID NO: 801097 - DNA, 25 bp, Mus musculus
tcactttaaagaacaagttggcctc

SEQ ID NO: 801098 - DNA, 25 bp, Mus musculus
tcactttaaagatcaagttggcctc

SEQ ID NO: 801099 - DNA, 25 bp, Mus musculus
tcactttacatcatcaattcttctt

SEQ ID NO: 801100 - DNA, 25 bp, Mus musculus
tcactttacatcttcaattcttctt

SEQ ID NO: 801101 - DNA, 25 bp, Mus musculus
tcactttaggtaagaaactcttgtt

SEQ ID NO: 801102 - DNA, 25 bp, Mus musculus
tcactttaggtatgaaactcttgtt

SEQ ID NO: 801103 - DNA, 25 bp, Mus musculus
tcactttagtagctgaagactctga

SEQ ID NO: 801104 - DNA, 25 bp, Mus musculus
tcactttagtaggtgaagactctga

SEQ ID NO: 801105 - DNA, 25 bp, Mus musculus
tcactttataacacaccacctttat

SEQ ID NO: 801106 - DNA, 25 bp, Mus musculus
tcactttataactcaccacctttat

SEQ ID NO: 801107 - DNA, 25 bp, Mus musculus
tcactttattccctgggttttctat

SEQ ID NO: 801108 - DNA, 25 bp, Mus musculus
tcactttattccgtgggttttctat

SEQ ID NO: 801109 - DNA, 25 bp, Mus musculus
tcactttcaaagctgttcctacaca

SEQ ID NO: 801110 - DNA, 25 bp, Mus musculus
tcactttcaaaggtgttcctacaca

SEQ ID NO: 801111 - DNA, 25 bp, Mus musculus
tcactttcacagagcattccatcat

SEQ ID NO: 801112 - DNA, 25 bp, Mus musculus
tcactttcacagtgcattccatcat

SEQ ID NO: 801113 - DNA, 25 bp, Mus musculus
tcactttcatttctcagcaaccttc

SEQ ID NO: 801114 - DNA, 25 bp, Mus musculus
tcactttcatttgtcagcaaccttc

SEQ ID NO: 801115 - DNA, 25 bp, Mus musculus
tcactttccacaccagcttgcaaat

SEQ ID NO: 801116 - DNA, 25 bp, Mus musculus
tcactttccacagcagcttgcaaat

SEQ ID NO: 801117 - DNA, 25 bp, Mus musculus
tcactttccccgaggttatgttctg

SEQ ID NO: 801118 - DNA, 25 bp, Mus musculus
tcactttccccgtggttatgttctg

SEQ ID NO: 801119 - DNA, 25 bp, Mus musculus
tcactttcctcgctctgctgttctt

SEQ ID NO: 801120 - DNA, 25 bp, Mus musculus
tcactttcctcggtctgctgttctt

SEQ ID NO: 801121 - DNA, 25 bp, Mus musculus
tcactttccttcctcctagagaggg

SEQ ID NO: 801122 - DNA, 25 bp, Mus musculus
tcactttccttcgtcctagagaggg

SEQ ID NO: 801123 - DNA, 25 bp, Mus musculus
tcactttcgttactttggaaacaca

SEQ ID NO: 801124 - DNA, 25 bp, Mus musculus
tcactttcgttagtttggaaacaca

SEQ ID NO: 801125 - DNA, 25 bp, Mus musculus
tcactttctgccattcttgggataa

SEQ ID NO: 801126 - DNA, 25 bp, Mus musculus
tcactttctgcctttcttgggataa

SEQ ID NO: 801127 - DNA, 25 bp, Mus musculus
tcactttcttctcttcacctgtatt

SEQ ID NO: 801128 - DNA, 25 bp, Mus musculus
tcactttcttctgttcacctgtatt

SEQ ID NO: 801129 - DNA, 25 bp, Mus musculus
tcactttgaccaccagagcagcaat

SEQ ID NO: 801130 - DNA, 25 bp, Mus musculus
tcactttgaccagcagagcagcaat

SEQ ID NO: 801131 - DNA, 25 bp, Mus musculus
tcactttgatgtaagccacggctct

SEQ ID NO: 801132 - DNA, 25 bp, Mus musculus
tcactttgatgttagccacggctct

SEQ ID NO: 801133 - DNA, 25 bp, Mus musculus
tcactttgcaaaagagtaaactgga

SEQ ID NO: 801134 - DNA, 25 bp, Mus musculus
tcactttgcaaatgagtaaactgga

SEQ ID NO: 801135 - DNA, 25 bp, Mus musculus
tcactttgcatgatagcacgctctc

SEQ ID NO: 801136 - DNA, 25 bp, Mus musculus
tcactttgcatgttagcacgctctc

SEQ ID NO: 801137 - DNA, 25 bp, Mus musculus
tcactttgccagcacatccattgga

SEQ ID NO: 801138 - DNA, 25 bp, Mus musculus
tcactttgccaggacatccattgga

SEQ ID NO: 801139 - DNA, 25 bp, Mus musculus
tcactttgctcaagatggccttcta

SEQ ID NO: 801140 - DNA, 25 bp, Mus musculus
tcactttgctcatgatggccttcta

SEQ ID NO: 801141 - DNA, 25 bp, Mus musculus
tcactttgctttcttccaggtacca

SEQ ID NO: 801142 - DNA, 25 bp, Mus musculus
tcactttgctttgttccaggtacca

SEQ ID NO: 801143 - DNA, 25 bp, Mus musculus
tcactttggacaccccagcattctg

SEQ ID NO: 801144 - DNA, 25 bp, Mus musculus
tcactttggacagcccagcattctg

SEQ ID NO: 801145 - DNA, 25 bp, Mus musculus
tcactttggatcctcctaaacaaag

SEQ ID NO: 801146 - DNA, 25 bp, Mus musculus
tcactttggatcgtcctaaacaaag

SEQ ID NO: 801147 - DNA, 25 bp, Mus musculus
tcactttggcagattgaaatttgct

SEQ ID NO: 801148 - DNA, 25 bp, Mus musculus
tcactttggcagtttgaaatttgct

SEQ ID NO: 801149 - DNA, 25 bp, Mus musculus
tcactttgggtgactgttagcctca

SEQ ID NO: 801150 - DNA, 25 bp, Mus musculus
tcactttgggtgtctgttagcctca

SEQ ID NO: 801151 - DNA, 25 bp, Mus musculus
tcactttgtactcgctcaccaaaat

SEQ ID NO: 801152 - DNA, 25 bp, Mus musculus
tcactttgtactggctcaccaaaat

SEQ ID NO: 801153 - DNA, 25 bp, Mus musculus
tcactttgtagcacttggatctaga

SEQ ID NO: 801154 - DNA, 25 bp, Mus musculus
tcactttgtagctcttggatctaga

SEQ ID NO: 801155 - DNA, 25 bp, Mus musculus
tcactttgtcctagctgtggttaaa

SEQ ID NO: 801156 - DNA, 25 bp, Mus musculus
tcactttgtccttgctgtggttaaa

SEQ ID NO: 801157 - DNA, 25 bp, Mus musculus
tcactttgtcttcttgtttatccct

SEQ ID NO: 801158 - DNA, 25 bp, Mus musculus
tcactttgtcttgttgtttatccct

SEQ ID NO: 801159 - DNA, 25 bp, Mus musculus
tcactttgtgctaatgagaaccatg

SEQ ID NO: 801160 - DNA, 25 bp, Mus musculus
tcactttgtgcttatgagaaccatg

SEQ ID NO: 801161 - DNA, 25 bp, Mus musculus
tcactttgtgtacttctgactgtgc

SEQ ID NO: 801162 - DNA, 25 bp, Mus musculus
tcactttgtgtagttctgactgtgc

SEQ ID NO: 801163 - DNA, 25 bp, Mus musculus
tcactttgtgtgaactctgcttacc

SEQ ID NO: 801164 - DNA, 25 bp, Mus musculus
tcactttgtgtgtactctgcttacc

SEQ ID NO: 801165 - DNA, 25 bp, Mus musculus
tcactttgttggacctgctgcacat

SEQ ID NO: 801166 - DNA, 25 bp, Mus musculus
tcactttgttggtcctgctgcacat

SEQ ID NO: 801167 - DNA, 25 bp, Mus musculus
tcacttttaccaccgttaagcattt

SEQ ID NO: 801168 - DNA, 25 bp, Mus musculus
tcacttttaccagcgttaagcattt

SEQ ID NO: 801169 - DNA, 25 bp, Mus musculus
tcacttttacgcactgtgtccagga

SEQ ID NO: 801170 - DNA, 25 bp, Mus musculus
tcacttttacgctctgtgtccagga

SEQ ID NO: 801171 - DNA, 25 bp, Mus musculus
tcacttttacttagcatttgtttgg

SEQ ID NO: 801172 - DNA, 25 bp, Mus musculus
tcacttttactttgcatttgtttgg

SEQ ID NO: 801173 - DNA, 25 bp, Mus musculus
tcacttttagctactgaggctggga

SEQ ID NO: 801174 - DNA, 25 bp, Mus musculus
tcacttttagcttctgaggctggga

SEQ ID NO: 801175 - DNA, 25 bp, Mus musculus
tcacttttataaaaatccacctcca

SEQ ID NO: 801176 - DNA, 25 bp, Mus musculus
tcacttttataataatccacctcca

SEQ ID NO: 801177 - DNA, 25 bp, Mus musculus
tcacttttcaccaactttttgtctt

SEQ ID NO: 801178 - DNA, 25 bp, Mus musculus
tcacttttcacctactttttgtctt

SEQ ID NO: 801179 - DNA, 25 bp, Mus musculus
tcacttttcggtagcctattccttt

SEQ ID NO: 801180 - DNA, 25 bp, Mus musculus
tcacttttcggttgcctattccttt

SEQ ID NO: 801181 - DNA, 25 bp, Mus musculus
tcacttttgcaacgttccacagact

SEQ ID NO: 801182 - DNA, 25 bp, Mus musculus
tcacttttgcaaggttccacagact

SEQ ID NO: 801183 - DNA, 25 bp, Mus musculus
tcacttttggaaactactcctgaaa

SEQ ID NO: 801184 - DNA, 25 bp, Mus musculus
tcacttttggaatctactcctgaaa

SEQ ID NO: 801185 - DNA, 25 bp, Mus musculus
tcacttttgttccaaccagacatct

SEQ ID NO: 801186 - DNA, 25 bp, Mus musculus
tcacttttgttcgaaccagacatct

SEQ ID NO: 801187 - DNA, 25 bp, Mus musculus
tcactttttcacagagccttttgtt

SEQ ID NO: 801188 - DNA, 25 bp, Mus musculus
tcactttttcactgagccttttgtt

SEQ ID NO: 801189 - DNA, 25 bp, Mus musculus
tcactttttcatccaagcctctagc

SEQ ID NO: 801190 - DNA, 25 bp, Mus musculus
tcactttttcatgcaagcctctagc

SEQ ID NO: 801191 - DNA, 25 bp, Mus musculus
tcactttttgagcatgcctgccagc

SEQ ID NO: 801192 - DNA, 25 bp, Mus musculus
tcactttttgaggatgcctgccagc

SEQ ID NO: 801193 - DNA, 25 bp, Mus musculus
tcagaaaaaagaacgtagaccttgg

SEQ ID NO: 801194 - DNA, 25 bp, Mus musculus
tcagaaaaaagatcgtagaccttgg

SEQ ID NO: 801195 - DNA, 25 bp, Mus musculus
tcagaaaaaccgcattacttgagtc

SEQ ID NO: 801196 - DNA, 25 bp, Mus musculus
tcagaaaaaccggattacttgagtc

SEQ ID NO: 801197 - DNA, 25 bp, Mus musculus
tcagaaaactccctcagcggtattt

SEQ ID NO: 801198 - DNA, 25 bp, Mus musculus
tcagaaaactccgtcagcggtattt

SEQ ID NO: 801199 - DNA, 25 bp, Mus musculus
tcagaaaatagactttaccttttgg

SEQ ID NO: 801200 - DNA, 25 bp, Mus musculus
tcagaaaatagagtttaccttttgg

SEQ ID NO: 801201 - DNA, 25 bp, Mus musculus
tcagaaaatttcacaggcagccaat

SEQ ID NO: 801202 - DNA, 25 bp, Mus musculus
tcagaaaatttctcaggcagccaat

SEQ ID NO: 801203 - DNA, 25 bp, Mus musculus
tcagaaacactcaatgcttgacagt

SEQ ID NO: 801204 - DNA, 25 bp, Mus musculus
tcagaaacactctatgcttgacagt

SEQ ID NO: 801205 - DNA, 25 bp, Mus musculus
tcagaaacatggatccagtcgccat

SEQ ID NO: 801206 - DNA, 25 bp, Mus musculus
tcagaaacatggttccagtcgccat

SEQ ID NO: 801207 - DNA, 25 bp, Mus musculus
tcagaaacccttacggtggtgagga

SEQ ID NO: 801208 - DNA, 25 bp, Mus musculus
tcagaaaccctttcggtggtgagga

SEQ ID NO: 801209 - DNA, 25 bp, Mus musculus
tcagaaaccgacatgctcttgcaaa

SEQ ID NO: 801210 - DNA, 25 bp, Mus musculus
tcagaaaccgacttgctcttgcaaa

SEQ ID NO: 801211 - DNA, 25 bp, Mus musculus
tcagaaacctcactgggtcgttttt

SEQ ID NO: 801212 - DNA, 25 bp, Mus musculus
tcagaaacctcagtgggtcgttttt

SEQ ID NO: 801213 - DNA, 25 bp, Mus musculus
tcagaaacggtgctcacctgcacgg

SEQ ID NO: 801214 - DNA, 25 bp, Mus musculus
tcagaaacggtggtcacctgcacgg

SEQ ID NO: 801215 - DNA, 25 bp, Mus musculus
tcagaaactgatcacccagcccagg

SEQ ID NO: 801216 - DNA, 25 bp, Mus musculus
tcagaaactgatgacccagcccagg

SEQ ID NO: 801217 - DNA, 25 bp, Mus musculus
tcagaaactgggacatgccctgctc

SEQ ID NO: 801218 - DNA, 25 bp, Mus musculus
tcagaaactgggagccgcctggagc

SEQ ID NO: 801219 - DNA, 25 bp, Mus musculus
tcagaaactgggtcatgccctgctc

SEQ ID NO: 801220 - DNA, 25 bp, Mus musculus
tcagaaactgggtgccgcctggagc

SEQ ID NO: 801221 - DNA, 25 bp, Mus musculus
tcagaaactggtattacccggacat

SEQ ID NO: 801222 - DNA, 25 bp, Mus musculus
tcagaaactggttttacccggacat

SEQ ID NO: 801223 - DNA, 25 bp, Mus musculus
tcagaaactgtcaagcctttgccca

SEQ ID NO: 801224 - DNA, 25 bp, Mus musculus
tcagaaactgtcacccactgactaa

SEQ ID NO: 801225 - DNA, 25 bp, Mus musculus
tcagaaactgtctagcctttgccca

SEQ ID NO: 801226 - DNA, 25 bp, Mus musculus
tcagaaactgtctcccactgactaa

SEQ ID NO: 801227 - DNA, 25 bp, Mus musculus
tcagaaacttatcagggaacccgtg

SEQ ID NO: 801228 - DNA, 25 bp, Mus musculus
tcagaaacttatgagggaacccgtg

SEQ ID NO: 801229 - DNA, 25 bp, Mus musculus
tcagaaacttctctcactccaggtc

SEQ ID NO: 801230 - DNA, 25 bp, Mus musculus
tcagaaacttctgtcactccaggtc

SEQ ID NO: 801231 - DNA, 25 bp, Mus musculus
tcagaaacttgtacctcagccagag

SEQ ID NO: 801232 - DNA, 25 bp, Mus musculus
tcagaaacttgtctcctaaattata

SEQ ID NO: 801233 - DNA, 25 bp, Mus musculus
tcagaaacttgtgtcctaaattata

SEQ ID NO: 801234 - DNA, 25 bp, Mus musculus
tcagaaacttgttcctcagccagag

SEQ ID NO: 801235 - DNA, 25 bp, Mus musculus
tcagaaagccacagcgcttcagtgc

SEQ ID NO: 801236 - DNA, 25 bp, Mus musculus
tcagaaagccactgcgcttcagtgc

SEQ ID NO: 801237 - DNA, 25 bp, Mus musculus
tcagaaagcgtgcacatcgcctggg

SEQ ID NO: 801238 - DNA, 25 bp, Mus musculus
tcagaaagcgtggacatcgcctggg

SEQ ID NO: 801239 - DNA, 25 bp, Mus musculus
tcagaaagctacaacccagcaaaat

SEQ ID NO: 801240 - DNA, 25 bp, Mus musculus
tcagaaagctactacccagcaaaat

SEQ ID NO: 801241 - DNA, 25 bp, Mus musculus
tcagaaaggaccacgaggccctcct

SEQ ID NO: 801242 - DNA, 25 bp, Mus musculus
tcagaaaggacctcgaggccctcct

SEQ ID NO: 801243 - DNA, 25 bp, Mus musculus
tcagaaaggcaacgcatcccgacaa

SEQ ID NO: 801244 - DNA, 25 bp, Mus musculus
tcagaaaggcaaggcatcccgacaa

SEQ ID NO: 801245 - DNA, 25 bp, Mus musculus
tcagaaagggcactacttaacggtt

SEQ ID NO: 801246 - DNA, 25 bp, Mus musculus
tcagaaagggcagtacttaacggtt

SEQ ID NO: 801247 - DNA, 25 bp, Mus musculus
tcagaaagtacaacagtcaagctag

SEQ ID NO: 801248 - DNA, 25 bp, Mus musculus
tcagaaagtacatcagtcaagctag

SEQ ID NO: 801249 - DNA, 25 bp, Mus musculus
tcagaaagtgctagcctgtgctggt

SEQ ID NO: 801250 - DNA, 25 bp, Mus musculus
tcagaaagtgcttgcctgtgctggt

SEQ ID NO: 801251 - DNA, 25 bp, Mus musculus
tcagaaagttcaaaggcaccaagtt

SEQ ID NO: 801252 - DNA, 25 bp, Mus musculus
tcagaaagttcataggcaccaagtt

SEQ ID NO: 801253 - DNA, 25 bp, Mus musculus
tcagaaagtttgcaggcccagcagt

SEQ ID NO: 801254 - DNA, 25 bp, Mus musculus
tcagaaagtttggaggcccagcagt

SEQ ID NO: 801255 - DNA, 25 bp, Mus musculus
tcagaaataaggagttgcaggcaac

SEQ ID NO: 801256 - DNA, 25 bp, Mus musculus
tcagaaataaggtgttgcaggcaac

SEQ ID NO: 801257 - DNA, 25 bp, Mus musculus
tcagaaatcaagcctgtcacattgc

SEQ ID NO: 801258 - DNA, 25 bp, Mus musculus
tcagaaatcaaggctgtcacattgc

SEQ ID NO: 801259 - DNA, 25 bp, Mus musculus
tcagaaatccagacaacagttttca

SEQ ID NO: 801260 - DNA, 25 bp, Mus musculus
tcagaaatccagtcaacagttttca

SEQ ID NO: 801261 - DNA, 25 bp, Mus musculus
tcagaaatccccaagtttaatccct

SEQ ID NO: 801262 - DNA, 25 bp, Mus musculus
tcagaaatcccctagtttaatccct

SEQ ID NO: 801263 - DNA, 25 bp, Mus musculus
tcagaaatcggcctgacttttcctc

SEQ ID NO: 801264 - DNA, 25 bp, Mus musculus
tcagaaatcggcgtgacttttcctc

SEQ ID NO: 801265 - DNA, 25 bp, Mus musculus
tcagaaatgactcaccttcctcact

SEQ ID NO: 801266 - DNA, 25 bp, Mus musculus
tcagaaatgactgaccttcctcact

SEQ ID NO: 801267 - DNA, 25 bp, Mus musculus
tcagaaatgattcccgttgcgcagc

SEQ ID NO: 801268 - DNA, 25 bp, Mus musculus
tcagaaatgattgccgttgcgcagc

SEQ ID NO: 801269 - DNA, 25 bp, Mus musculus
tcagaaatgctgcaggtgccaggta

SEQ ID NO: 801270 - DNA, 25 bp, Mus musculus
tcagaaatgctggaggtgccaggta

SEQ ID NO: 801271 - DNA, 25 bp, Mus musculus
tcagaaatggccaggttaccccact

SEQ ID NO: 801272 - DNA, 25 bp, Mus musculus
tcagaaatggcctggttaccccact

SEQ ID NO: 801273 - DNA, 25 bp, Mus musculus
tcagaaatgttcatcccagcaaatg

SEQ ID NO: 801274 - DNA, 25 bp, Mus musculus
tcagaaatgttcttcccagcaaatg

SEQ ID NO: 801275 - DNA, 25 bp, Mus musculus
tcagaaatgtttcccaaagagtgat

SEQ ID NO: 801276 - DNA, 25 bp, Mus musculus
tcagaaatgtttgccaaagagtgat

SEQ ID NO: 801277 - DNA, 25 bp, Mus musculus
tcagaacaatggctggagctggaat

SEQ ID NO: 801278 - DNA, 25 bp, Mus musculus
tcagaacaatgggtggagctggaat

SEQ ID NO: 801279 - DNA, 25 bp, Mus musculus
tcagaacacaagatggcccgcagag

SEQ ID NO: 801280 - DNA, 25 bp, Mus musculus
tcagaacacaagttggcccgcagag

SEQ ID NO: 801281 - DNA, 25 bp, Mus musculus
tcagaacacactagcagtcacaggt

SEQ ID NO: 801282 - DNA, 25 bp, Mus musculus
tcagaacacacttgcagtcacaggt

SEQ ID NO: 801283 - DNA, 25 bp, Mus musculus
tcagaacacccacacttcggtggtt

SEQ ID NO: 801284 - DNA, 25 bp, Mus musculus
tcagaacacccagacttcggtggtt

SEQ ID NO: 801285 - DNA, 25 bp, Mus musculus
tcagaacactagatcaccccttagt

SEQ ID NO: 801286 - DNA, 25 bp, Mus musculus
tcagaacactagttcaccccttagt

SEQ ID NO: 801287 - DNA, 25 bp, Mus musculus
tcagaacagagtctttgcccatctc

SEQ ID NO: 801288 - DNA, 25 bp, Mus musculus
tcagaacagagtgtttgcccatctc

SEQ ID NO: 801289 - DNA, 25 bp, Mus musculus
tcagaacagcacagcctggcatgta

SEQ ID NO: 801290 - DNA, 25 bp, Mus musculus
tcagaacagcactgcctggcatgta

SEQ ID NO: 801291 - DNA, 25 bp, Mus musculus
tcagaacagcttcaagtcactgatt

SEQ ID NO: 801292 - DNA, 25 bp, Mus musculus
tcagaacagcttgaagtcactgatt

SEQ ID NO: 801293 - DNA, 25 bp, Mus musculus
tcagaacatcttcacacacctgtgt

SEQ ID NO: 801294 - DNA, 25 bp, Mus musculus
tcagaacatcttgacacacctgtgt

SEQ ID NO: 801295 - DNA, 25 bp, Mus musculus
tcagaaccacaaattcgtccagaga

SEQ ID NO: 801296 - DNA, 25 bp, Mus musculus
tcagaaccacaatttcgtccagaga

SEQ ID NO: 801297 - DNA, 25 bp, Mus musculus
tcagaaccacagctacaccagaatt

SEQ ID NO: 801298 - DNA, 25 bp, Mus musculus
tcagaaccacaggtacaccagaatt

SEQ ID NO: 801299 - DNA, 25 bp, Mus musculus
tcagaaccatgtacagagcccagat

SEQ ID NO: 801300 - DNA, 25 bp, Mus musculus
tcagaaccatgttcagagcccagat

SEQ ID NO: 801301 - DNA, 25 bp, Mus musculus
tcagaaccattactgccaaagggtt

SEQ ID NO: 801302 - DNA, 25 bp, Mus musculus
tcagaaccattagtgccaaagggtt

SEQ ID NO: 801303 - DNA, 25 bp, Mus musculus
tcagaacccaagatttggtttccag

SEQ ID NO: 801304 - DNA, 25 bp, Mus musculus
tcagaacccaagttttggtttccag

SEQ ID NO: 801305 - DNA, 25 bp, Mus musculus
tcagaacccactatgccggtgctaa

SEQ ID NO: 801306 - DNA, 25 bp, Mus musculus
tcagaacccactttgccggtgctaa

SEQ ID NO: 801307 - DNA, 25 bp, Mus musculus
tcagaacccgttattagcaaccaca

SEQ ID NO: 801308 - DNA, 25 bp, Mus musculus
tcagaacccgtttttagcaaccaca

SEQ ID NO: 801309 - DNA, 25 bp, Mus musculus
tcagaaccctctctcttgttaacgg

SEQ ID NO: 801310 - DNA, 25 bp, Mus musculus
tcagaaccctctgtcttgttaacgg

SEQ ID NO: 801311 - DNA, 25 bp, Mus musculus
tcagaaccgaaaaatttttccacac

SEQ ID NO: 801312 - DNA, 25 bp, Mus musculus
tcagaaccgaaatatttttccacac

SEQ ID NO: 801313 - DNA, 25 bp, Mus musculus
tcagaaccggcaagctgtcctgctt

SEQ ID NO: 801314 - DNA, 25 bp, Mus musculus
tcagaaccggcatgctgtcctgctt

SEQ ID NO: 801315 - DNA, 25 bp, Mus musculus
tcagaaccgtatatttgagcccaag

SEQ ID NO: 801316 - DNA, 25 bp, Mus musculus
tcagaaccgtatttttgagcccaag

SEQ ID NO: 801317 - DNA, 25 bp, Mus musculus
tcagaacctacaatcagaccagtgg

SEQ ID NO: 801318 - DNA, 25 bp, Mus musculus
tcagaacctacattcagaccagtgg

SEQ ID NO: 801319 - DNA, 25 bp, Mus musculus
tcagaacctattacttacttccctg

SEQ ID NO: 801320 - DNA, 25 bp, Mus musculus
tcagaacctatttcttacttccctg

SEQ ID NO: 801321 - DNA, 25 bp, Mus musculus
tcagaacctcagctcatcatgtatg

SEQ ID NO: 801322 - DNA, 25 bp, Mus musculus
tcagaacctcaggtcatcatgtatg

SEQ ID NO: 801323 - DNA, 25 bp, Mus musculus
tcagaacctcctcaacaacatacat

SEQ ID NO: 801324 - DNA, 25 bp, Mus musculus
tcagaacctcctgaacaacatacat

SEQ ID NO: 801325 - DNA, 25 bp, Mus musculus
tcagaacctctacccctggtggcag

SEQ ID NO: 801326 - DNA, 25 bp, Mus musculus
tcagaacctctagccctggtggcag

SEQ ID NO: 801327 - DNA, 25 bp, Mus musculus
tcagaacgcccacaggaagagcagg

SEQ ID NO: 801328 - DNA, 25 bp, Mus musculus
tcagaacgcccagaggaagagcagg

SEQ ID NO: 801329 - DNA, 25 bp, Mus musculus
tcagaacgtcttccacggtaggcaa

SEQ ID NO: 801330 - DNA, 25 bp, Mus musculus
tcagaacgtcttgcacggtaggcaa

SEQ ID NO: 801331 - DNA, 25 bp, Mus musculus
tcagaactacttcccttcgagaggt

SEQ ID NO: 801332 - DNA, 25 bp, Mus musculus
tcagaactacttgccttcgagaggt

SEQ ID NO: 801333 - DNA, 25 bp, Mus musculus
tcagaactcaataggcttagcactt

SEQ ID NO: 801334 - DNA, 25 bp, Mus musculus
tcagaactcaattggcttagcactt

SEQ ID NO: 801335 - DNA, 25 bp, Mus musculus
tcagaactcactcacagtcatttcc

SEQ ID NO: 801336 - DNA, 25 bp, Mus musculus
tcagaactcactgacagtcatttcc

SEQ ID NO: 801337 - DNA, 25 bp, Mus musculus
tcagaactcagaacaccacaatgga

SEQ ID NO: 801338 - DNA, 25 bp, Mus musculus
tcagaactcagatcaccacaatgga

SEQ ID NO: 801339 - DNA, 25 bp, Mus musculus
tcagaactctgcacttagttgagat

SEQ ID NO: 801340 - DNA, 25 bp, Mus musculus
tcagaactctgctcttagttgagat

SEQ ID NO: 801341 - DNA, 25 bp, Mus musculus
tcagaactcttcctcagccatttgg

SEQ ID NO: 801342 - DNA, 25 bp, Mus musculus
tcagaactcttcgtcagccatttgg

SEQ ID NO: 801343 - DNA, 25 bp, Mus musculus
tcagaactgagtataacatagacat

SEQ ID NO: 801344 - DNA, 25 bp, Mus musculus
tcagaactgagtttaacatagacat

SEQ ID NO: 801345 - DNA, 25 bp, Mus musculus
tcagaactggttaatttggtgtcgt

SEQ ID NO: 801346 - DNA, 25 bp, Mus musculus
tcagaactggtttatttggtgtcgt

SEQ ID NO: 801347 - DNA, 25 bp, Mus musculus
tcagaactgttaatggtgtggccaa

SEQ ID NO: 801348 - DNA, 25 bp, Mus musculus
tcagaactgttattggtgtggccaa

SEQ ID NO: 801349 - DNA, 25 bp, Mus musculus
tcagaacttcccaaaaacaccaagc

SEQ ID NO: 801350 - DNA, 25 bp, Mus musculus
tcagaacttccctaaaacaccaagc

SEQ ID NO: 801351 - DNA, 25 bp, Mus musculus
tcagaactttggactccaacccctt

SEQ ID NO: 801352 - DNA, 25 bp, Mus musculus
tcagaactttggtctccaacccctt

SEQ ID NO: 801353 - DNA, 25 bp, Mus musculus
tcagaagaaataacgggtttgtata

SEQ ID NO: 801354 - DNA, 25 bp, Mus musculus
tcagaagaaatatcgggtttgtata

SEQ ID NO: 801355 - DNA, 25 bp, Mus musculus
tcagaagaactgacagccccactta

SEQ ID NO: 801356 - DNA, 25 bp, Mus musculus
tcagaagaactgtcagccccactta

SEQ ID NO: 801357 - DNA, 25 bp, Mus musculus
tcagaagaatgaacccctgccgcat

SEQ ID NO: 801358 - DNA, 25 bp, Mus musculus
tcagaagaatgatcccctgccgcat

SEQ ID NO: 801359 - DNA, 25 bp, Mus musculus
tcagaagacagtactgaacctccac

SEQ ID NO: 801360 - DNA, 25 bp, Mus musculus
tcagaagacagttctgaacctccac

SEQ ID NO: 801361 - DNA, 25 bp, Mus musculus
tcagaagaccccagcccagaaagca

SEQ ID NO: 801362 - DNA, 25 bp, Mus musculus
tcagaagacccctgcccagaaagca

SEQ ID NO: 801363 - DNA, 25 bp, Mus musculus
tcagaagacccgactgtcctgggaa

SEQ ID NO: 801364 - DNA, 25 bp, Mus musculus
tcagaagacccgtctgtcctgggaa

SEQ ID NO: 801365 - DNA, 25 bp, Mus musculus
tcagaagactgtcgtggaggtcctc

SEQ ID NO: 801366 - DNA, 25 bp, Mus musculus
tcagaagactgtggtggaggtcctc

SEQ ID NO: 801367 - DNA, 25 bp, Mus musculus
tcagaagactttacagtgattcatg

SEQ ID NO: 801368 - DNA, 25 bp, Mus musculus
tcagaagacttttcagtgattcatg

SEQ ID NO: 801369 - DNA, 25 bp, Mus musculus
tcagaagagcggcatccctggagct

SEQ ID NO: 801370 - DNA, 25 bp, Mus musculus
tcagaagagcgggatccctggagct

SEQ ID NO: 801371 - DNA, 25 bp, Mus musculus
tcagaagataagatggagctctaac

SEQ ID NO: 801372 - DNA, 25 bp, Mus musculus
tcagaagataagttggagctctaac

SEQ ID NO: 801373 - DNA, 25 bp, Mus musculus
tcagaagatttccagacagggcaag

SEQ ID NO: 801374 - DNA, 25 bp, Mus musculus
tcagaagatttcgagacagggcaag

SEQ ID NO: 801375 - DNA, 25 bp, Mus musculus
tcagaagcaggaacaggcacgggtt

SEQ ID NO: 801376 - DNA, 25 bp, Mus musculus
tcagaagcaggatcaggcacgggtt

SEQ ID NO: 801377 - DNA, 25 bp, Mus musculus
tcagaagccagacacaggcgatttt

SEQ ID NO: 801378 - DNA, 25 bp, Mus musculus
tcagaagccagagacaggcgatttt

SEQ ID NO: 801379 - DNA, 25 bp, Mus musculus
tcagaagccaggacatactgtgtgt

SEQ ID NO: 801380 - DNA, 25 bp, Mus musculus
tcagaagccaggtcatactgtgtgt

SEQ ID NO: 801381 - DNA, 25 bp, Mus musculus
tcagaagcccacagacccggaagtt

SEQ ID NO: 801382 - DNA, 25 bp, Mus musculus
tcagaagcccactgacccggaagtt

SEQ ID NO: 801383 - DNA, 25 bp, Mus musculus
tcagaagccccaatcggtttttatt

SEQ ID NO: 801384 - DNA, 25 bp, Mus musculus
tcagaagccccattcggtttttatt

SEQ ID NO: 801385 - DNA, 25 bp, Mus musculus
tcagaagccccgacgtcagagaggg

SEQ ID NO: 801386 - DNA, 25 bp, Mus musculus
tcagaagccccgtcgtcagagaggg

SEQ ID NO: 801387 - DNA, 25 bp, Mus musculus
tcagaagcgggcaaccacatcatca

SEQ ID NO: 801388 - DNA, 25 bp, Mus musculus
tcagaagcgggctaccacatcatca

SEQ ID NO: 801389 - DNA, 25 bp, Mus musculus
tcagaagctatgaggctccagcctg

SEQ ID NO: 801390 - DNA, 25 bp, Mus musculus
tcagaagctatgtggctccagcctg

SEQ ID NO: 801391 - DNA, 25 bp, Mus musculus
tcagaagctctcatgattgtaaggc

SEQ ID NO: 801392 - DNA, 25 bp, Mus musculus
tcagaagctctcttgattgtaaggc

SEQ ID NO: 801393 - DNA, 25 bp, Mus musculus
tcagaagctcttcctttgacaaaca

SEQ ID NO: 801394 - DNA, 25 bp, Mus musculus
tcagaagctcttgctttgacaaaca

SEQ ID NO: 801395 - DNA, 25 bp, Mus musculus
tcagaagctgaacgacgatgaggtc

SEQ ID NO: 801396 - DNA, 25 bp, Mus musculus
tcagaagctgaaggacgatgaggtc

SEQ ID NO: 801397 - DNA, 25 bp, Mus musculus
tcagaagctgcaccaatgagaattc

SEQ ID NO: 801398 - DNA, 25 bp, Mus musculus
tcagaagctgcagcaatgagaattc

SEQ ID NO: 801399 - DNA, 25 bp, Mus musculus
tcagaagcttagatgggaccacagt

SEQ ID NO: 801400 - DNA, 25 bp, Mus musculus
tcagaagcttagttgggaccacagt

SEQ ID NO: 801401 - DNA, 25 bp, Mus musculus
tcagaaggaaaacttgcctaccctt

SEQ ID NO: 801402 - DNA, 25 bp, Mus musculus
tcagaaggaaaagttgcctaccctt

SEQ ID NO: 801403 - DNA, 25 bp, Mus musculus
tcagaaggagatatacggaaagcca

SEQ ID NO: 801404 - DNA, 25 bp, Mus musculus
tcagaaggagatttacggaaagcca

SEQ ID NO: 801405 - DNA, 25 bp, Mus musculus
tcagaaggccacaaagcacccattg

SEQ ID NO: 801406 - DNA, 25 bp, Mus musculus
tcagaaggccactaagcacccattg

SEQ ID NO: 801407 - DNA, 25 bp, Mus musculus
tcagaaggcccaagcgcacaccaga

SEQ ID NO: 801408 - DNA, 25 bp, Mus musculus
tcagaaggcccatgcgcacaccaga

SEQ ID NO: 801409 - DNA, 25 bp, Mus musculus
tcagaaggccccagctgactgttac

SEQ ID NO: 801410 - DNA, 25 bp, Mus musculus
tcagaaggcccctgctgactgttac

SEQ ID NO: 801411 - DNA, 25 bp, Mus musculus
tcagaaggctgcaggccagaaggca

SEQ ID NO: 801412 - DNA, 25 bp, Mus musculus
tcagaaggctgctggccagaaggca

SEQ ID NO: 801413 - DNA, 25 bp, Mus musculus
tcagaagggccgaaccagacgtgtt

SEQ ID NO: 801414 - DNA, 25 bp, Mus musculus
tcagaagggccgtaccagacgtgtt

SEQ ID NO: 801415 - DNA, 25 bp, Mus musculus
tcagaagggtcactgtattatatac

SEQ ID NO: 801416 - DNA, 25 bp, Mus musculus
tcagaagggtcagtgtattatatac

SEQ ID NO: 801417 - DNA, 25 bp, Mus musculus
tcagaaggtacccttcctgatctcc

SEQ ID NO: 801418 - DNA, 25 bp, Mus musculus
tcagaaggtaccgttcctgatctcc

SEQ ID NO: 801419 - DNA, 25 bp, Mus musculus
tcagaaggtcctcttcctggtcaat

SEQ ID NO: 801420 - DNA, 25 bp, Mus musculus
tcagaaggtcctgttcctggtcaat

SEQ ID NO: 801421 - DNA, 25 bp, Mus musculus
tcagaagtacgcctgccttggcctt

SEQ ID NO: 801422 - DNA, 25 bp, Mus musculus
tcagaagtacgcgtgccttggcctt

SEQ ID NO: 801423 - DNA, 25 bp, Mus musculus
tcagaagtatcaatagtcaccagaa

SEQ ID NO: 801424 - DNA, 25 bp, Mus musculus
tcagaagtatcattagtcaccagaa

SEQ ID NO: 801425 - DNA, 25 bp, Mus musculus
tcagaagtctccaacggccttaaaa

SEQ ID NO: 801426 - DNA, 25 bp, Mus musculus
tcagaagtctccagtgtccacagca

SEQ ID NO: 801427 - DNA, 25 bp, Mus musculus
tcagaagtctcctacggccttaaaa

SEQ ID NO: 801428 - DNA, 25 bp, Mus musculus
tcagaagtctcctgtgtccacagca

SEQ ID NO: 801429 - DNA, 25 bp, Mus musculus
tcagaagtctctccactcttggtgc

SEQ ID NO: 801430 - DNA, 25 bp, Mus musculus
tcagaagtctctgcactcttggtgc

SEQ ID NO: 801431 - DNA, 25 bp, Mus musculus
tcagaagtggtccaagggcctttgc

SEQ ID NO: 801432 - DNA, 25 bp, Mus musculus
tcagaagtggtcgaagggcctttgc

SEQ ID NO: 801433 - DNA, 25 bp, Mus musculus
tcagaagtgtctaactgagagacct

SEQ ID NO: 801434 - DNA, 25 bp, Mus musculus
tcagaagtgtcttactgagagacct

SEQ ID NO: 801435 - DNA, 25 bp, Mus musculus
tcagaagttaagagtcccttcccag

SEQ ID NO: 801436 - DNA, 25 bp, Mus musculus
tcagaagttaagtgtcccttcccag

SEQ ID NO: 801437 - DNA, 25 bp, Mus musculus
tcagaatactacagccttgtgaatt

SEQ ID NO: 801438 - DNA, 25 bp, Mus musculus
tcagaatactactgccttgtgaatt

SEQ ID NO: 801439 - DNA, 25 bp, Mus musculus
tcagaatatcatctagggcgaccta

SEQ ID NO: 801440 - DNA, 25 bp, Mus musculus
tcagaatatcatgtagggcgaccta

SEQ ID NO: 801441 - DNA, 25 bp, Mus musculus
tcagaatcaggtagtgactttcccc

SEQ ID NO: 801442 - DNA, 25 bp, Mus musculus
tcagaatcaggttgtgactttcccc

SEQ ID NO: 801443 - DNA, 25 bp, Mus musculus
tcagaatccaaccactggcggcgga

SEQ ID NO: 801444 - DNA, 25 bp, Mus musculus
tcagaatccaacgactggcggcgga

SEQ ID NO: 801445 - DNA, 25 bp, Mus musculus
tcagaatccaagattccttggtgag

SEQ ID NO: 801446 - DNA, 25 bp, Mus musculus
tcagaatccaagtttccttggtgag

SEQ ID NO: 801447 - DNA, 25 bp, Mus musculus
tcagaatccagcatacaaggtatat

SEQ ID NO: 801448 - DNA, 25 bp, Mus musculus
tcagaatccagcttacaaggtatat

SEQ ID NO: 801449 - DNA, 25 bp, Mus musculus
tcagaatccaggctatagtgtatta

SEQ ID NO: 801450 - DNA, 25 bp, Mus musculus
tcagaatccagggtatagtgtatta

SEQ ID NO: 801451 - DNA, 25 bp, Mus musculus
tcagaatccatcctttgagatctgt

SEQ ID NO: 801452 - DNA, 25 bp, Mus musculus
tcagaatccatcgtttgagatctgt

SEQ ID NO: 801453 - DNA, 25 bp, Mus musculus
tcagaatcccttacactcagagctt

SEQ ID NO: 801454 - DNA, 25 bp, Mus musculus
tcagaatccctttcactcagagctt

SEQ ID NO: 801455 - DNA, 25 bp, Mus musculus
tcagaatcctcactttagcgtcctt

SEQ ID NO: 801456 - DNA, 25 bp, Mus musculus
tcagaatcctcagtttagcgtcctt

SEQ ID NO: 801457 - DNA, 25 bp, Mus musculus
tcagaatcgagtccatggatgcaat

SEQ ID NO: 801458 - DNA, 25 bp, Mus musculus
tcagaatcgagtgcatggatgcaat

SEQ ID NO: 801459 - DNA, 25 bp, Mus musculus
tcagaatctatgagtgaaagctcct

SEQ ID NO: 801460 - DNA, 25 bp, Mus musculus
tcagaatctatgtgtgaaagctcct

SEQ ID NO: 801461 - DNA, 25 bp, Mus musculus
tcagaatctgggagcctggcagaca

SEQ ID NO: 801462 - DNA, 25 bp, Mus musculus
tcagaatctgggtgcctggcagaca

SEQ ID NO: 801463 - DNA, 25 bp, Mus musculus
tcagaatcttaacctcaaccccaat

SEQ ID NO: 801464 - DNA, 25 bp, Mus musculus
tcagaatcttaagctcaaccccaat

SEQ ID NO: 801465 - DNA, 25 bp, Mus musculus
tcagaatgatgaacattcccaaatc

SEQ ID NO: 801466 - DNA, 25 bp, Mus musculus
tcagaatgatgatcattcccaaatc

SEQ ID NO: 801467 - DNA, 25 bp, Mus musculus
tcagaatgctgaccaagttctggtg

SEQ ID NO: 801468 - DNA, 25 bp, Mus musculus
tcagaatgctgagcaagttctggtg

SEQ ID NO: 801469 - DNA, 25 bp, Mus musculus
tcagaatgctgcaaccctttaatag

SEQ ID NO: 801470 - DNA, 25 bp, Mus musculus
tcagaatgctgctaccctttaatag

SEQ ID NO: 801471 - DNA, 25 bp, Mus musculus
tcagaatgcttaagcctaggccgtg

SEQ ID NO: 801472 - DNA, 25 bp, Mus musculus
tcagaatgcttatgcctaggccgtg

SEQ ID NO: 801473 - DNA, 25 bp, Mus musculus
tcagaatggcctcgctaggagccct

SEQ ID NO: 801474 - DNA, 25 bp, Mus musculus
tcagaatggcctggctaggagccct

SEQ ID NO: 801475 - DNA, 25 bp, Mus musculus
tcagaatggctgagccccacatgat

SEQ ID NO: 801476 - DNA, 25 bp, Mus musculus
tcagaatggctgtgccccacatgat

SEQ ID NO: 801477 - DNA, 25 bp, Mus musculus
tcagaatgtgtgagctccactttcc

SEQ ID NO: 801478 - DNA, 25 bp, Mus musculus
tcagaatgtgtgtgctccactttcc

SEQ ID NO: 801479 - DNA, 25 bp, Mus musculus
tcagaatgttctccggaaagtgcag

SEQ ID NO: 801480 - DNA, 25 bp, Mus musculus
tcagaatgttctgcggaaagtgcag

SEQ ID NO: 801481 - DNA, 25 bp, Mus musculus
tcagaattacgcacacaggctaaat

SEQ ID NO: 801482 - DNA, 25 bp, Mus musculus
tcagaattacgctcacaggctaaat

SEQ ID NO: 801483 - DNA, 25 bp, Mus musculus
tcagaattagtcacgttgtcatttg

SEQ ID NO: 801484 - DNA, 25 bp, Mus musculus
tcagaattagtctcgttgtcatttg

SEQ ID NO: 801485 - DNA, 25 bp, Mus musculus
tcagaattccagaatgaggttctat

SEQ ID NO: 801486 - DNA, 25 bp, Mus musculus
tcagaattccagtatgaggttctat

SEQ ID NO: 801487 - DNA, 25 bp, Mus musculus
tcagaattctttagggacccacagt

SEQ ID NO: 801488 - DNA, 25 bp, Mus musculus
tcagaattctttcgctggttcttaa

SEQ ID NO: 801489 - DNA, 25 bp, Mus musculus
tcagaattctttggctggttcttaa

SEQ ID NO: 801490 - DNA, 25 bp, Mus musculus
tcagaattcttttgggacccacagt

SEQ ID NO: 801491 - DNA, 25 bp, Mus musculus
tcagaatttgccatggctgctggtt

SEQ ID NO: 801492 - DNA, 25 bp, Mus musculus
tcagaatttgccttggctgctggtt

SEQ ID NO: 801493 - DNA, 25 bp, Mus musculus
tcagaatttggacaccttggtttgg

SEQ ID NO: 801494 - DNA, 25 bp, Mus musculus
tcagaatttggagaccttggtttgg

SEQ ID NO: 801495 - DNA, 25 bp, Mus musculus
tcagaatttgtcatcaccatgtaca

SEQ ID NO: 801496 - DNA, 25 bp, Mus musculus
tcagaatttgtcttcaccatgtaca

SEQ ID NO: 801497 - DNA, 25 bp, Mus musculus
tcagacaaactgacatgggttttca

SEQ ID NO: 801498 - DNA, 25 bp, Mus musculus
tcagacaaactgtcatgggttttca

SEQ ID NO: 801499 - DNA, 25 bp, Mus musculus
tcagacaaagggatccgttttcagt

SEQ ID NO: 801500 - DNA, 25 bp, Mus musculus
tcagacaaagggttccgttttcagt

SEQ ID NO: 801501 - DNA, 25 bp, Mus musculus
tcagacaaccagaccaccttttagt

SEQ ID NO: 801502 - DNA, 25 bp, Mus musculus
tcagacaaccagtccaccttttagt

SEQ ID NO: 801503 - DNA, 25 bp, Mus musculus
tcagacaaccatcccaggtgcaggc

SEQ ID NO: 801504 - DNA, 25 bp, Mus musculus
tcagacaaccatgccaggtgcaggc

SEQ ID NO: 801505 - DNA, 25 bp, Mus musculus
tcagacaactgccttacaatccatt

SEQ ID NO: 801506 - DNA, 25 bp, Mus musculus
tcagacaactgcgttacaatccatt

SEQ ID NO: 801507 - DNA, 25 bp, Mus musculus
tcagacaagagacggtgtggacacc

SEQ ID NO: 801508 - DNA, 25 bp, Mus musculus
tcagacaagagagggtgtggacacc

SEQ ID NO: 801509 - DNA, 25 bp, Mus musculus
tcagacaagcaccagggtcccgata

SEQ ID NO: 801510 - DNA, 25 bp, Mus musculus
tcagacaagcacgagggtcccgata

SEQ ID NO: 801511 - DNA, 25 bp, Mus musculus
tcagacaagtccctgttaagtggac

SEQ ID NO: 801512 - DNA, 25 bp, Mus musculus
tcagacaagtccgtgttaagtggac

SEQ ID NO: 801513 - DNA, 25 bp, Mus musculus
tcagacaatcggaacacacgcaggt

SEQ ID NO: 801514 - DNA, 25 bp, Mus musculus
tcagacaatcggtacacacgcaggt

SEQ ID NO: 801515 - DNA, 25 bp, Mus musculus
tcagacacacacataaccagcttgt

SEQ ID NO: 801516 - DNA, 25 bp, Mus musculus
tcagacacacacttaaccagcttgt

SEQ ID NO: 801517 - DNA, 25 bp, Mus musculus
tcagacacatctcgccacttcagaa

SEQ ID NO: 801518 - DNA, 25 bp, Mus musculus
tcagacacatctggccacttcagaa

SEQ ID NO: 801519 - DNA, 25 bp, Mus musculus
tcagacacccgaacctggagttaca

SEQ ID NO: 801520 - DNA, 25 bp, Mus musculus
tcagacacccgatcctggagttaca

SEQ ID NO: 801521 - DNA, 25 bp, Mus musculus
tcagacaccgaacgccagctacaaa

SEQ ID NO: 801522 - DNA, 25 bp, Mus musculus
tcagacaccgaaggccagctacaaa

SEQ ID NO: 801523 - DNA, 25 bp, Mus musculus
tcagacaccgtcagtaactacagag

SEQ ID NO: 801524 - DNA, 25 bp, Mus musculus
tcagacaccgtctgtaactacagag

SEQ ID NO: 801525 - DNA, 25 bp, Mus musculus
tcagacaccgttacctgcgcttcaa

SEQ ID NO: 801526 - DNA, 25 bp, Mus musculus
tcagacaccgtttcctgcgcttcaa

SEQ ID NO: 801527 - DNA, 25 bp, Mus musculus
tcagacactatcaggtcaagtacag

SEQ ID NO: 801528 - DNA, 25 bp, Mus musculus
tcagacactatctggtcaagtacag

SEQ ID NO: 801529 - DNA, 25 bp, Mus musculus
tcagacactttgcttaactttggtt

SEQ ID NO: 801530 - DNA, 25 bp, Mus musculus
tcagacactttggttaactttggtt

SEQ ID NO: 801531 - DNA, 25 bp, Mus musculus
tcagacagaaatccggagactccat

SEQ ID NO: 801532 - DNA, 25 bp, Mus musculus
tcagacagaaatgcggagactccat

SEQ ID NO: 801533 - DNA, 25 bp, Mus musculus
tcagacagagtcagtcctttcttcc

SEQ ID NO: 801534 - DNA, 25 bp, Mus musculus
tcagacagagtctgtcctttcttcc

SEQ ID NO: 801535 - DNA, 25 bp, Mus musculus
tcagacagcgagatggaggacagac

SEQ ID NO: 801536 - DNA, 25 bp, Mus musculus
tcagacagcgagttggaggacagac

SEQ ID NO: 801537 - DNA, 25 bp, Mus musculus
tcagacaggagccatcacaccttgc

SEQ ID NO: 801538 - DNA, 25 bp, Mus musculus
tcagacaggagcgatcacaccttgc

SEQ ID NO: 801539 - DNA, 25 bp, Mus musculus
tcagacagggctctcaccccaataa

SEQ ID NO: 801540 - DNA, 25 bp, Mus musculus
tcagacagggctgtcaccccaataa

SEQ ID NO: 801541 - DNA, 25 bp, Mus musculus
tcagacagtctgaatcttgaccaga

SEQ ID NO: 801542 - DNA, 25 bp, Mus musculus
tcagacagtctgaggctgcagcctg

SEQ ID NO: 801543 - DNA, 25 bp, Mus musculus
tcagacagtctgcatggctcaggct

SEQ ID NO: 801544 - DNA, 25 bp, Mus musculus
tcagacagtctggatggctcaggct

SEQ ID NO: 801545 - DNA, 25 bp, Mus musculus
tcagacagtctgtatcttgaccaga

SEQ ID NO: 801546 - DNA, 25 bp, Mus musculus
tcagacagtctgtggctgcagcctg

SEQ ID NO: 801547 - DNA, 25 bp, Mus musculus
tcagacagtgagcgcagcgactata

SEQ ID NO: 801548 - DNA, 25 bp, Mus musculus
tcagacagtgagggcagcgactata

SEQ ID NO: 801549 - DNA, 25 bp, Mus musculus
tcagacagtgctatgtcacgcagcg

SEQ ID NO: 801550 - DNA, 25 bp, Mus musculus
tcagacagtgctttgtcacgcagcg

SEQ ID NO: 801551 - DNA, 25 bp, Mus musculus
tcagacagttttatcgccaagcagg

SEQ ID NO: 801552 - DNA, 25 bp, Mus musculus
tcagacagttttttcgccaagcagg

SEQ ID NO: 801553 - DNA, 25 bp, Mus musculus
tcagacatacccaaacgaccaagtt

SEQ ID NO: 801554 - DNA, 25 bp, Mus musculus
tcagacataccctaacgaccaagtt

SEQ ID NO: 801555 - DNA, 25 bp, Mus musculus
tcagacatcaagaccgggaggcttt

SEQ ID NO: 801556 - DNA, 25 bp, Mus musculus
tcagacatcaagtccgggaggcttt

SEQ ID NO: 801557 - DNA, 25 bp, Mus musculus
tcagacatcaatcagaaggccacaa

SEQ ID NO: 801558 - DNA, 25 bp, Mus musculus
tcagacatcaatgagaaggccacaa

SEQ ID NO: 801559 - DNA, 25 bp, Mus musculus
tcagacatccacacaagtattctag

SEQ ID NO: 801560 - DNA, 25 bp, Mus musculus
tcagacatccactcaagtattctag

SEQ ID NO: 801561 - DNA, 25 bp, Mus musculus
tcagacatccatctttccttaggag

SEQ ID NO: 801562 - DNA, 25 bp, Mus musculus
tcagacatccatgtttccttaggag

SEQ ID NO: 801563 - DNA, 25 bp, Mus musculus
tcagacatcccaacccaagttaaaa

SEQ ID NO: 801564 - DNA, 25 bp, Mus musculus
tcagacatcccatcccaagttaaaa

SEQ ID NO: 801565 - DNA, 25 bp, Mus musculus
tcagacatcctgaagctcagaccaa

SEQ ID NO: 801566 - DNA, 25 bp, Mus musculus
tcagacatcctgtagctcagaccaa

SEQ ID NO: 801567 - DNA, 25 bp, Mus musculus
tcagacatgccgcacgaggtcaaca

SEQ ID NO: 801568 - DNA, 25 bp, Mus musculus
tcagacatgccggacgaggtcaaca

SEQ ID NO: 801569 - DNA, 25 bp, Mus musculus
tcagaccaaacgctaagcaccgttt

SEQ ID NO: 801570 - DNA, 25 bp, Mus musculus
tcagaccaaacggtaagcaccgttt

SEQ ID NO: 801571 - DNA, 25 bp, Mus musculus
tcagaccaaagcaaacagcgtggaa

SEQ ID NO: 801572 - DNA, 25 bp, Mus musculus
tcagaccaaagctaacagcgtggaa

SEQ ID NO: 801573 - DNA, 25 bp, Mus musculus
tcagaccaactcaaaagatagactt

SEQ ID NO: 801574 - DNA, 25 bp, Mus musculus
tcagaccaactctaaagatagactt

SEQ ID NO: 801575 - DNA, 25 bp, Mus musculus
tcagaccaagtcactttctttcttc

SEQ ID NO: 801576 - DNA, 25 bp, Mus musculus
tcagaccaagtctctttctttcttc

SEQ ID NO: 801577 - DNA, 25 bp, Mus musculus
tcagaccacacacaaacttttcagc

SEQ ID NO: 801578 - DNA, 25 bp, Mus musculus
tcagaccacacagaaacttttcagc

SEQ ID NO: 801579 - DNA, 25 bp, Mus musculus
tcagaccacgttatgaccctgttga

SEQ ID NO: 801580 - DNA, 25 bp, Mus musculus
tcagaccacgttttgaccctgttga

SEQ ID NO: 801581 - DNA, 25 bp, Mus musculus
tcagaccagctgaggatacagagta

SEQ ID NO: 801582 - DNA, 25 bp, Mus musculus
tcagaccagctgtggatacagagta

SEQ ID NO: 801583 - DNA, 25 bp, Mus musculus
tcagaccaggtcattacagtcctct

SEQ ID NO: 801584 - DNA, 25 bp, Mus musculus
tcagaccaggtctttacagtcctct

SEQ ID NO: 801585 - DNA, 25 bp, Mus musculus
tcagaccatgagacctgtgacctct

SEQ ID NO: 801586 - DNA, 25 bp, Mus musculus
tcagaccatgagtcctgtgacctct

SEQ ID NO: 801587 - DNA, 25 bp, Mus musculus
tcagaccatgtacgcctcagattag

SEQ ID NO: 801588 - DNA, 25 bp, Mus musculus
tcagaccatgtaggcctcagattag

SEQ ID NO: 801589 - DNA, 25 bp, Mus musculus
tcagaccatttacacggaccatcag

SEQ ID NO: 801590 - DNA, 25 bp, Mus musculus
tcagaccatttagacggaccatcag

SEQ ID NO: 801591 - DNA, 25 bp, Mus musculus
tcagacccaacacgaagcagcatgc

SEQ ID NO: 801592 - DNA, 25 bp, Mus musculus
tcagacccaacaggaagcagcatgc

SEQ ID NO: 801593 - DNA, 25 bp, Mus musculus
tcagacccacatagcgaagctatgt

SEQ ID NO: 801594 - DNA, 25 bp, Mus musculus
tcagacccacattgcgaagctatgt

SEQ ID NO: 801595 - DNA, 25 bp, Mus musculus
tcagacccacctcattttcttggct

SEQ ID NO: 801596 - DNA, 25 bp, Mus musculus
tcagacccacctgattttcttggct

SEQ ID NO: 801597 - DNA, 25 bp, Mus musculus
tcagacccacggcaggcagatgttt

SEQ ID NO: 801598 - DNA, 25 bp, Mus musculus
tcagacccacgggaggcagatgttt

SEQ ID NO: 801599 - DNA, 25 bp, Mus musculus
tcagacccagctatggttttacgtt

SEQ ID NO: 801600 - DNA, 25 bp, Mus musculus
tcagacccagctttggttttacgtt

SEQ ID NO: 801601 - DNA, 25 bp, Mus musculus
tcagaccccagcatgttcgtggaag

SEQ ID NO: 801602 - DNA, 25 bp, Mus musculus
tcagaccccagcttgttcgtggaag

SEQ ID NO: 801603 - DNA, 25 bp, Mus musculus
tcagaccccatgaccagtagcagat

SEQ ID NO: 801604 - DNA, 25 bp, Mus musculus
tcagaccccatgtccagtagcagat

SEQ ID NO: 801605 - DNA, 25 bp, Mus musculus
tcagaccccggtctgtgcgtatctt

SEQ ID NO: 801606 - DNA, 25 bp, Mus musculus
tcagaccccggtgtgtgcgtatctt

SEQ ID NO: 801607 - DNA, 25 bp, Mus musculus
tcagaccctgggacgagcccggaag

SEQ ID NO: 801608 - DNA, 25 bp, Mus musculus
tcagaccctgggtcgagcccggaag

SEQ ID NO: 801609 - DNA, 25 bp, Mus musculus
tcagacccttctaactagagccatc

SEQ ID NO: 801610 - DNA, 25 bp, Mus musculus
tcagacccttcttactagagccatc

SEQ ID NO: 801611 - DNA, 25 bp, Mus musculus
tcagaccggcttcgcagaggaagac

SEQ ID NO: 801612 - DNA, 25 bp, Mus musculus
tcagaccggcttggcagaggaagac

SEQ ID NO: 801613 - DNA, 25 bp, Mus musculus
tcagacctacaacttcgatcacaga

SEQ ID NO: 801614 - DNA, 25 bp, Mus musculus
tcagacctacaagttcgatcacaga

SEQ ID NO: 801615 - DNA, 25 bp, Mus musculus
tcagacctagccactgtaacaggag

SEQ ID NO: 801616 - DNA, 25 bp, Mus musculus
tcagacctagcctctgtaacaggag

SEQ ID NO: 801617 - DNA, 25 bp, Mus musculus
tcagacctagtgaagctttacttgt

SEQ ID NO: 801618 - DNA, 25 bp, Mus musculus
tcagacctagtgtagctttacttgt

SEQ ID NO: 801619 - DNA, 25 bp, Mus musculus
tcagacctattgcaacaaaggaata

SEQ ID NO: 801620 - DNA, 25 bp, Mus musculus
tcagacctattggaacaaaggaata

SEQ ID NO: 801621 - DNA, 25 bp, Mus musculus
tcagacctcaagcaacgaacagttc

SEQ ID NO: 801622 - DNA, 25 bp, Mus musculus
tcagacctcaaggaacgaacagttc

SEQ ID NO: 801623 - DNA, 25 bp, Mus musculus
tcagacctcaccctgatggtttact

SEQ ID NO: 801624 - DNA, 25 bp, Mus musculus
tcagacctcaccgtgatggtttact

SEQ ID NO: 801625 - DNA, 25 bp, Mus musculus
tcagacctccacaggctaggtagct

SEQ ID NO: 801626 - DNA, 25 bp, Mus musculus
tcagacctccactggctaggtagct

SEQ ID NO: 801627 - DNA, 25 bp, Mus musculus
tcagacctcctactgtattaagtgt

SEQ ID NO: 801628 - DNA, 25 bp, Mus musculus
tcagacctcctagtgtattaagtgt

SEQ ID NO: 801629 - DNA, 25 bp, Mus musculus
tcagacctgcgactgctgttaggaa

SEQ ID NO: 801630 - DNA, 25 bp, Mus musculus
tcagacctgcgagtgctgttaggaa

SEQ ID NO: 801631 - DNA, 25 bp, Mus musculus
tcagacctgcgtcaactatccactg

SEQ ID NO: 801632 - DNA, 25 bp, Mus musculus
tcagacctgcgtgaactatccactg

SEQ ID NO: 801633 - DNA, 25 bp, Mus musculus
tcagacctggagaatacgggaacgt

SEQ ID NO: 801634 - DNA, 25 bp, Mus musculus
tcagacctggagtatacgggaacgt

SEQ ID NO: 801635 - DNA, 25 bp, Mus musculus
tcagacctgtacagtccctggaagg

SEQ ID NO: 801636 - DNA, 25 bp, Mus musculus
tcagacctgtactgtccctggaagg

SEQ ID NO: 801637 - DNA, 25 bp, Mus musculus
tcagacctgtccataactagttcca

SEQ ID NO: 801638 - DNA, 25 bp, Mus musculus
tcagacctgtccttaactagttcca

SEQ ID NO: 801639 - DNA, 25 bp, Mus musculus
tcagacctgttgaactttgcaatgg

SEQ ID NO: 801640 - DNA, 25 bp, Mus musculus
tcagacctgttgtactttgcaatgg

SEQ ID NO: 801641 - DNA, 25 bp, Mus musculus
tcagaccttgagattatcatcgtgg

SEQ ID NO: 801642 - DNA, 25 bp, Mus musculus
tcagaccttgagtttatcatcgtgg

SEQ ID NO: 801643 - DNA, 25 bp, Mus musculus
tcagaccttgatatgttcccctttg

SEQ ID NO: 801644 - DNA, 25 bp, Mus musculus
tcagaccttgatttgttcccctttg

SEQ ID NO: 801645 - DNA, 25 bp, Mus musculus
tcagacgagcctatcttgggatgaa

SEQ ID NO: 801646 - DNA, 25 bp, Mus musculus
tcagacgagcctctcagcttacaga

SEQ ID NO: 801647 - DNA, 25 bp, Mus musculus
tcagacgagcctgtcagcttacaga

SEQ ID NO: 801648 - DNA, 25 bp, Mus musculus
tcagacgagcctttcttgggatgaa

SEQ ID NO: 801649 - DNA, 25 bp, Mus musculus
tcagacgaggaccagagccaaagaa

SEQ ID NO: 801650 - DNA, 25 bp, Mus musculus
tcagacgaggacgagagccaaagaa

SEQ ID NO: 801651 - DNA, 25 bp, Mus musculus
tcagacgatcaccatgagagagaga

SEQ ID NO: 801652 - DNA, 25 bp, Mus musculus
tcagacgatcacgatgagagagaga

SEQ ID NO: 801653 - DNA, 25 bp, Mus musculus
tcagacgatgacattgtacagcccc

SEQ ID NO: 801654 - DNA, 25 bp, Mus musculus
tcagacgatgactttgtacagcccc

SEQ ID NO: 801655 - DNA, 25 bp, Mus musculus
tcagacgccacactgtcacgggttt

SEQ ID NO: 801656 - DNA, 25 bp, Mus musculus
tcagacgccacagtgtcacgggttt

SEQ ID NO: 801657 - DNA, 25 bp, Mus musculus
tcagacgccttgacaagttcttcca

SEQ ID NO: 801658 - DNA, 25 bp, Mus musculus
tcagacgccttgtcaagttcttcca

SEQ ID NO: 801659 - DNA, 25 bp, Mus musculus
tcagacgcgtccatctcttctggca

SEQ ID NO: 801660 - DNA, 25 bp, Mus musculus
tcagacgcgtccttctcttctggca

SEQ ID NO: 801661 - DNA, 25 bp, Mus musculus
tcagacggccgaaggtgagcttgca

SEQ ID NO: 801662 - DNA, 25 bp, Mus musculus
tcagacggccgatggtgagcttgca

SEQ ID NO: 801663 - DNA, 25 bp, Mus musculus
tcagacggtcggcagtgtttttaag

SEQ ID NO: 801664 - DNA, 25 bp, Mus musculus
tcagacggtcgggagtgtttttaag

SEQ ID NO: 801665 - DNA, 25 bp, Mus musculus
tcagacggttgcaaactgttgttgt

SEQ ID NO: 801666 - DNA, 25 bp, Mus musculus
tcagacggttgctaactgttgttgt

SEQ ID NO: 801667 - DNA, 25 bp, Mus musculus
tcagacgtccaactgctcgaattac

SEQ ID NO: 801668 - DNA, 25 bp, Mus musculus
tcagacgtccaagtgctcgaattac

SEQ ID NO: 801669 - DNA, 25 bp, Mus musculus
tcagacgtgtgacaggttcttcaat

SEQ ID NO: 801670 - DNA, 25 bp, Mus musculus
tcagacgtgtgagaggttcttcaat

SEQ ID NO: 801671 - DNA, 25 bp, Mus musculus
tcagacgttatacttcatttcaaaa

SEQ ID NO: 801672 - DNA, 25 bp, Mus musculus
tcagacgttatagttcatttcaaaa

SEQ ID NO: 801673 - DNA, 25 bp, Mus musculus
tcagactaagcaagagccaccctcg

SEQ ID NO: 801674 - DNA, 25 bp, Mus musculus
tcagactaagcatgagccaccctcg

SEQ ID NO: 801675 - DNA, 25 bp, Mus musculus
tcagactaagccaggaactctctca

SEQ ID NO: 801676 - DNA, 25 bp, Mus musculus
tcagactaagcctggaactctctca

SEQ ID NO: 801677 - DNA, 25 bp, Mus musculus
tcagactactcacactcctgtaaaa

SEQ ID NO: 801678 - DNA, 25 bp, Mus musculus
tcagactactcagactcctgtaaaa

SEQ ID NO: 801679 - DNA, 25 bp, Mus musculus
tcagactagctcagagacaccattg

SEQ ID NO: 801680 - DNA, 25 bp, Mus musculus
tcagactagctctgagacaccattg

SEQ ID NO: 801681 - DNA, 25 bp, Mus musculus
tcagactattcaactgcagatttgg

SEQ ID NO: 801682 - DNA, 25 bp, Mus musculus
tcagactattcatctgcagatttgg

SEQ ID NO: 801683 - DNA, 25 bp, Mus musculus
tcagactatttactcaaatcctttc

SEQ ID NO: 801684 - DNA, 25 bp, Mus musculus
tcagactatttagtcaaatcctttc

SEQ ID NO: 801685 - DNA, 25 bp, Mus musculus
tcagactcacagacatctgtctgct

SEQ ID NO: 801686 - DNA, 25 bp, Mus musculus
tcagactcacagtcatctgtctgct

SEQ ID NO: 801687 - DNA, 25 bp, Mus musculus
tcagactcacccaatgcttaagaat

SEQ ID NO: 801688 - DNA, 25 bp, Mus musculus
tcagactcaccctatgcttaagaat

SEQ ID NO: 801689 - DNA, 25 bp, Mus musculus
tcagactcaggcaagaattacaggt

SEQ ID NO: 801690 - DNA, 25 bp, Mus musculus
tcagactcaggcattgaacaccagt

SEQ ID NO: 801691 - DNA, 25 bp, Mus musculus
tcagactcaggctagaattacaggt

SEQ ID NO: 801692 - DNA, 25 bp, Mus musculus
tcagactcaggctttgaacaccagt

SEQ ID NO: 801693 - DNA, 25 bp, Mus musculus
tcagactcaggtatgctctacttca

SEQ ID NO: 801694 - DNA, 25 bp, Mus musculus
tcagactcaggtttgctctacttca

SEQ ID NO: 801695 - DNA, 25 bp, Mus musculus
tcagactcctctccaaatctggtct

SEQ ID NO: 801696 - DNA, 25 bp, Mus musculus
tcagactcctctgcaaatctggtct

SEQ ID NO: 801697 - DNA, 25 bp, Mus musculus
tcagactcctgaacaaagttaccga

SEQ ID NO: 801698 - DNA, 25 bp, Mus musculus
tcagactcctgatcaaagttaccga

SEQ ID NO: 801699 - DNA, 25 bp, Mus musculus
tcagactcgaatccttcctacttaa

SEQ ID NO: 801700 - DNA, 25 bp, Mus musculus
tcagactcgaatgcttcctacttaa

SEQ ID NO: 801701 - DNA, 25 bp, Mus musculus
tcagactcgcctcttactggtgctt

SEQ ID NO: 801702 - DNA, 25 bp, Mus musculus
tcagactcgcctgttactggtgctt

SEQ ID NO: 801703 - DNA, 25 bp, Mus musculus
tcagactctcaaacttttttccaag

SEQ ID NO: 801704 - DNA, 25 bp, Mus musculus
tcagactctcaatcttttttccaag

SEQ ID NO: 801705 - DNA, 25 bp, Mus musculus
tcagactctgcacacgggccttctt

SEQ ID NO: 801706 - DNA, 25 bp, Mus musculus
tcagactctgcagacgggccttctt

SEQ ID NO: 801707 - DNA, 25 bp, Mus musculus
tcagactctggccttgattcccagg

SEQ ID NO: 801708 - DNA, 25 bp, Mus musculus
tcagactctggcgttgattcccagg

SEQ ID NO: 801709 - DNA, 25 bp, Mus musculus
tcagactctgggagctagttgtgcc

SEQ ID NO: 801710 - DNA, 25 bp, Mus musculus
tcagactctgggtgctagttgtgcc

SEQ ID NO: 801711 - DNA, 25 bp, Mus musculus
tcagactgaattatccggattgaca

SEQ ID NO: 801712 - DNA, 25 bp, Mus musculus
tcagactgaattttccggattgaca

SEQ ID NO: 801713 - DNA, 25 bp, Mus musculus
tcagactgaccacggatggagtcct

SEQ ID NO: 801714 - DNA, 25 bp, Mus musculus
tcagactgaccagggatggagtcct

SEQ ID NO: 801715 - DNA, 25 bp, Mus musculus
tcagactgacctatcagcctggctg

SEQ ID NO: 801716 - DNA, 25 bp, Mus musculus
tcagactgacctttcagcctggctg

SEQ ID NO: 801717 - DNA, 25 bp, Mus musculus
tcagactgcaggacctgacctctgc

SEQ ID NO: 801718 - DNA, 25 bp, Mus musculus
tcagactgcaggtcctgacctctgc

SEQ ID NO: 801719 - DNA, 25 bp, Mus musculus
tcagactgcattacccgtcccattt

SEQ ID NO: 801720 - DNA, 25 bp, Mus musculus
tcagactgcatttcccgtcccattt

SEQ ID NO: 801721 - DNA, 25 bp, Mus musculus
tcagactgccttactgtttcagaag

SEQ ID NO: 801722 - DNA, 25 bp, Mus musculus
tcagactgcctttctgtttcagaag

SEQ ID NO: 801723 - DNA, 25 bp, Mus musculus
tcagactggcatcgagtggcccctg

SEQ ID NO: 801724 - DNA, 25 bp, Mus musculus
tcagactggcatggagtggcccctg

SEQ ID NO: 801725 - DNA, 25 bp, Mus musculus
tcagactggcctctcattactatgc

SEQ ID NO: 801726 - DNA, 25 bp, Mus musculus
tcagactggcctgtcattactatgc

SEQ ID NO: 801727 - DNA, 25 bp, Mus musculus
tcagactgtcgcagtatcacacagt

SEQ ID NO: 801728 - DNA, 25 bp, Mus musculus
tcagactgtcgctgtatcacacagt

SEQ ID NO: 801729 - DNA, 25 bp, Mus musculus
tcagactgttgtcggtaggtttctt

SEQ ID NO: 801730 - DNA, 25 bp, Mus musculus
tcagactgttgtgggtaggtttctt

SEQ ID NO: 801731 - DNA, 25 bp, Mus musculus
tcagacttactacgaaactcttttt

SEQ ID NO: 801732 - DNA, 25 bp, Mus musculus
tcagacttactaggaaactcttttt

SEQ ID NO: 801733 - DNA, 25 bp, Mus musculus
tcagacttagtgataggtgtcccca

SEQ ID NO: 801734 - DNA, 25 bp, Mus musculus
tcagacttagtgttaggtgtcccca

SEQ ID NO: 801735 - DNA, 25 bp, Mus musculus
tcagacttcagtcctctggagatca

SEQ ID NO: 801736 - DNA, 25 bp, Mus musculus
tcagacttcagtgctctggagatca

SEQ ID NO: 801737 - DNA, 25 bp, Mus musculus
tcagacttccatactttatttccca

SEQ ID NO: 801738 - DNA, 25 bp, Mus musculus
tcagacttccattctttatttccca

SEQ ID NO: 801739 - DNA, 25 bp, Mus musculus
tcagacttcctgacttagccatttt

SEQ ID NO: 801740 - DNA, 25 bp, Mus musculus
tcagacttcctgtcttagccatttt

SEQ ID NO: 801741 - DNA, 25 bp, Mus musculus
tcagacttccttaacaggcctggga

SEQ ID NO: 801742 - DNA, 25 bp, Mus musculus
tcagacttcctttacaggcctggga

SEQ ID NO: 801743 - DNA, 25 bp, Mus musculus
tcagacttcggacagcaccaggcat

SEQ ID NO: 801744 - DNA, 25 bp, Mus musculus
tcagacttcggagagcaccaggcat

SEQ ID NO: 801745 - DNA, 25 bp, Mus musculus
tcagacttctctcacctggagcaga

SEQ ID NO: 801746 - DNA, 25 bp, Mus musculus
tcagacttctctgacctggagcaga

SEQ ID NO: 801747 - DNA, 25 bp, Mus musculus
tcagacttgccaccgggtctaatta

SEQ ID NO: 801748 - DNA, 25 bp, Mus musculus
tcagacttgccagcgggtctaatta

SEQ ID NO: 801749 - DNA, 25 bp, Mus musculus
tcagacttggagcaggatccgacag

SEQ ID NO: 801750 - DNA, 25 bp, Mus musculus
tcagacttggaggaggatccgacag

SEQ ID NO: 801751 - DNA, 25 bp, Mus musculus
tcagacttgggcaattggagctttt

SEQ ID NO: 801752 - DNA, 25 bp, Mus musculus
tcagacttgggctattggagctttt

SEQ ID NO: 801753 - DNA, 25 bp, Mus musculus
tcagacttggtaatcctactgtggg

SEQ ID NO: 801754 - DNA, 25 bp, Mus musculus
tcagacttggtaccaagtacattta

SEQ ID NO: 801755 - DNA, 25 bp, Mus musculus
tcagacttggtagcaagtacattta

SEQ ID NO: 801756 - DNA, 25 bp, Mus musculus
tcagacttggtattcctactgtggg

SEQ ID NO: 801757 - DNA, 25 bp, Mus musculus
tcagacttgtatctgtgagcataac

SEQ ID NO: 801758 - DNA, 25 bp, Mus musculus
tcagacttgtatgtgtgagcataac

SEQ ID NO: 801759 - DNA, 25 bp, Mus musculus
tcagacttgtcaacaagcctctgga

SEQ ID NO: 801760 - DNA, 25 bp, Mus musculus
tcagacttgtcacgctttactcctt

SEQ ID NO: 801761 - DNA, 25 bp, Mus musculus
tcagacttgtcaggctttactcctt

SEQ ID NO: 801762 - DNA, 25 bp, Mus musculus
tcagacttgtcatcaagcctctgga

SEQ ID NO: 801763 - DNA, 25 bp, Mus musculus
tcagacttgtttactcgttcgtaaa

SEQ ID NO: 801764 - DNA, 25 bp, Mus musculus
tcagacttgttttctcgttcgtaaa

SEQ ID NO: 801765 - DNA, 25 bp, Mus musculus
tcagactttccacctccagaatgat

SEQ ID NO: 801766 - DNA, 25 bp, Mus musculus
tcagactttccagctccagaatgat

SEQ ID NO: 801767 - DNA, 25 bp, Mus musculus
tcagactttctgcagccatgtaaaa

SEQ ID NO: 801768 - DNA, 25 bp, Mus musculus
tcagactttctggagccatgtaaaa

SEQ ID NO: 801769 - DNA, 25 bp, Mus musculus
tcagactttggcaatctgtctcttt

SEQ ID NO: 801770 - DNA, 25 bp, Mus musculus
tcagactttggctatctgtctcttt

SEQ ID NO: 801771 - DNA, 25 bp, Mus musculus
tcagactttgtaactctgctcagtt

SEQ ID NO: 801772 - DNA, 25 bp, Mus musculus
tcagactttgtatctctgctcagtt

SEQ ID NO: 801773 - DNA, 25 bp, Mus musculus
tcagagaaaaacagggcttacagct

SEQ ID NO: 801774 - DNA, 25 bp, Mus musculus
tcagagaaaaactgggcttacagct

SEQ ID NO: 801775 - DNA, 25 bp, Mus musculus
tcagagaaagttatccactcaattt

SEQ ID NO: 801776 - DNA, 25 bp, Mus musculus
tcagagaaagttttccactcaattt

SEQ ID NO: 801777 - DNA, 25 bp, Mus musculus
tcagagaaatagaccttgcagtcat

SEQ ID NO: 801778 - DNA, 25 bp, Mus musculus
tcagagaaatagtccttgcagtcat

SEQ ID NO: 801779 - DNA, 25 bp, Mus musculus
tcagagaaatgcatagaattttatt

SEQ ID NO: 801780 - DNA, 25 bp, Mus musculus
tcagagaaatgcttagaattttatt

SEQ ID NO: 801781 - DNA, 25 bp, Mus musculus
tcagagaacagaaccggagcaggtg

SEQ ID NO: 801782 - DNA, 25 bp, Mus musculus
tcagagaacagatccggagcaggtg

SEQ ID NO: 801783 - DNA, 25 bp, Mus musculus
tcagagaagagaacccaccccagta

SEQ ID NO: 801784 - DNA, 25 bp, Mus musculus
tcagagaagagatcccaccccagta

SEQ ID NO: 801785 - DNA, 25 bp, Mus musculus
tcagagaatgtgagccgactccctg

SEQ ID NO: 801786 - DNA, 25 bp, Mus musculus
tcagagaatgtgtgccgactccctg

SEQ ID NO: 801787 - DNA, 25 bp, Mus musculus
tcagagacacacacagcaggactta

SEQ ID NO: 801788 - DNA, 25 bp, Mus musculus
tcagagacacactcagcaggactta

SEQ ID NO: 801789 - DNA, 25 bp, Mus musculus
tcagagacagccagcaggaccttgt

SEQ ID NO: 801790 - DNA, 25 bp, Mus musculus
tcagagacagcctgcaggaccttgt

SEQ ID NO: 801791 - DNA, 25 bp, Mus musculus
tcagagacagtgaacctatccaggg

SEQ ID NO: 801792 - DNA, 25 bp, Mus musculus
tcagagacagtgtacctatccaggg

SEQ ID NO: 801793 - DNA, 25 bp, Mus musculus
tcagagagcaaacgcgcttactgtc

SEQ ID NO: 801794 - DNA, 25 bp, Mus musculus
tcagagagcaaaggcgcttactgtc

SEQ ID NO: 801795 - DNA, 25 bp, Mus musculus
tcagagaggataccggacttctttc

SEQ ID NO: 801796 - DNA, 25 bp, Mus musculus
tcagagaggatagcggacttctttc

SEQ ID NO: 801797 - DNA, 25 bp, Mus musculus
tcagagaggcaacccgttgctaggt

SEQ ID NO: 801798 - DNA, 25 bp, Mus musculus
tcagagaggcaagccgttgctaggt

SEQ ID NO: 801799 - DNA, 25 bp, Mus musculus
tcagagagtcttatcagtgccaatg

SEQ ID NO: 801800 - DNA, 25 bp, Mus musculus
tcagagagtcttttcagtgccaatg

SEQ ID NO: 801801 - DNA, 25 bp, Mus musculus
tcagagagtgtgaccgcaaccctca

SEQ ID NO: 801802 - DNA, 25 bp, Mus musculus
tcagagagtgtgtccgcaaccctca

SEQ ID NO: 801803 - DNA, 25 bp, Mus musculus
tcagagagttaaaagcacacagcct

SEQ ID NO: 801804 - DNA, 25 bp, Mus musculus
tcagagagttaatagcacacagcct

SEQ ID NO: 801805 - DNA, 25 bp, Mus musculus
tcagagatacacctacacttaccaa

SEQ ID NO: 801806 - DNA, 25 bp, Mus musculus
tcagagatacacgtacacttaccaa

SEQ ID NO: 801807 - DNA, 25 bp, Mus musculus
tcagagatcaagcagacctaacaat

SEQ ID NO: 801808 - DNA, 25 bp, Mus musculus
tcagagatcaaggagacctaacaat

SEQ ID NO: 801809 - DNA, 25 bp, Mus musculus
tcagagatccatacaagcttgcaga

SEQ ID NO: 801810 - DNA, 25 bp, Mus musculus
tcagagatccattcaagcttgcaga

SEQ ID NO: 801811 - DNA, 25 bp, Mus musculus
tcagagatcctcatcccttttcctc

SEQ ID NO: 801812 - DNA, 25 bp, Mus musculus
tcagagatcctcttcccttttcctc

SEQ ID NO: 801813 - DNA, 25 bp, Mus musculus
tcagagatccttagggtaccttact

SEQ ID NO: 801814 - DNA, 25 bp, Mus musculus
tcagagatcctttgggtaccttact

SEQ ID NO: 801815 - DNA, 25 bp, Mus musculus
tcagagatcgccaccacttgcaaca

SEQ ID NO: 801816 - DNA, 25 bp, Mus musculus
tcagagatcgcctccacttgcaaca

SEQ ID NO: 801817 - DNA, 25 bp, Mus musculus
tcagagatgacaatgcctctttgca

SEQ ID NO: 801818 - DNA, 25 bp, Mus musculus
tcagagatgacattgcctctttgca

SEQ ID NO: 801819 - DNA, 25 bp, Mus musculus
tcagagatgcccagtacagtgtcct

SEQ ID NO: 801820 - DNA, 25 bp, Mus musculus
tcagagatgccctgtacagtgtcct

SEQ ID NO: 801821 - DNA, 25 bp, Mus musculus
tcagagatgtgacctgggtcgccaa

SEQ ID NO: 801822 - DNA, 25 bp, Mus musculus
tcagagatgtgagctgggtcgccaa

SEQ ID NO: 801823 - DNA, 25 bp, Mus musculus
tcagagattagacgcccacagcttt

SEQ ID NO: 801824 - DNA, 25 bp, Mus musculus
tcagagattagaggcccacagcttt

SEQ ID NO: 801825 - DNA, 25 bp, Mus musculus
tcagagattcccatcttctattttc

SEQ ID NO: 801826 - DNA, 25 bp, Mus musculus
tcagagattcccttcttctattttc

SEQ ID NO: 801827 - DNA, 25 bp, Mus musculus
tcagagattcgtccacccattgtta

SEQ ID NO: 801828 - DNA, 25 bp, Mus musculus
tcagagattcgtgcacccattgtta

SEQ ID NO: 801829 - DNA, 25 bp, Mus musculus
tcagagattgccaccaagccgtgcc

SEQ ID NO: 801830 - DNA, 25 bp, Mus musculus
tcagagattgccctttcttcccgag

SEQ ID NO: 801831 - DNA, 25 bp, Mus musculus
tcagagattgccgtttcttcccgag

SEQ ID NO: 801832 - DNA, 25 bp, Mus musculus
tcagagattgcctccaagccgtgcc

SEQ ID NO: 801833 - DNA, 25 bp, Mus musculus
tcagagcaaagcacagttggcccct

SEQ ID NO: 801834 - DNA, 25 bp, Mus musculus
tcagagcaaagctcagttggcccct

SEQ ID NO: 801835 - DNA, 25 bp, Mus musculus
tcagagcacttaacaaactccaatt

SEQ ID NO: 801836 - DNA, 25 bp, Mus musculus
tcagagcacttatcaaactccaatt

SEQ ID NO: 801837 - DNA, 25 bp, Mus musculus
tcagagcacttcacagactccattt

SEQ ID NO: 801838 - DNA, 25 bp, Mus musculus
tcagagcacttctcagactccattt

SEQ ID NO: 801839 - DNA, 25 bp, Mus musculus
tcagagcaggaacttttccgcctct

SEQ ID NO: 801840 - DNA, 25 bp, Mus musculus
tcagagcaggaagttttccgcctct

SEQ ID NO: 801841 - DNA, 25 bp, Mus musculus
tcagagcatacccttttaaatcttt

SEQ ID NO: 801842 - DNA, 25 bp, Mus musculus
tcagagcataccgttttaaatcttt

SEQ ID NO: 801843 - DNA, 25 bp, Mus musculus
tcagagcatagtattaggaaacaat

SEQ ID NO: 801844 - DNA, 25 bp, Mus musculus
tcagagcatagttttaggaaacaat

SEQ ID NO: 801845 - DNA, 25 bp, Mus musculus
tcagagccaaatcccacttacaaga

SEQ ID NO: 801846 - DNA, 25 bp, Mus musculus
tcagagccaaatgccacttacaaga

SEQ ID NO: 801847 - DNA, 25 bp, Mus musculus
tcagagccagcgcaaggtgaaacct

SEQ ID NO: 801848 - DNA, 25 bp, Mus musculus
tcagagccagcggaaggtgaaacct

SEQ ID NO: 801849 - DNA, 25 bp, Mus musculus
tcagagcccacaagaaatgctggat

SEQ ID NO: 801850 - DNA, 25 bp, Mus musculus
tcagagcccacatgaaatgctggat

SEQ ID NO: 801851 - DNA, 25 bp, Mus musculus
tcagagcccactagacgatcaacaa

SEQ ID NO: 801852 - DNA, 25 bp, Mus musculus
tcagagcccacttgacgatcaacaa

SEQ ID NO: 801853 - DNA, 25 bp, Mus musculus
tcagagcccagacttcctggatatt

SEQ ID NO: 801854 - DNA, 25 bp, Mus musculus
tcagagcccagagttcctggatatt

SEQ ID NO: 801855 - DNA, 25 bp, Mus musculus
tcagagcccaggcaaagatgatccc

SEQ ID NO: 801856 - DNA, 25 bp, Mus musculus
tcagagcccagggaaagatgatccc

SEQ ID NO: 801857 - DNA, 25 bp, Mus musculus
tcagagccctaaacccaatttggat

SEQ ID NO: 801858 - DNA, 25 bp, Mus musculus
tcagagccctaatcccaatttggat

SEQ ID NO: 801859 - DNA, 25 bp, Mus musculus
tcagagccctagatacacttaccta

SEQ ID NO: 801860 - DNA, 25 bp, Mus musculus
tcagagccctagttacacttaccta

SEQ ID NO: 801861 - DNA, 25 bp, Mus musculus
tcagagcccttgagacagcttttct

SEQ ID NO: 801862 - DNA, 25 bp, Mus musculus
tcagagcccttgtgacagcttttct

SEQ ID NO: 801863 - DNA, 25 bp, Mus musculus
tcagagcctaagagtccttcccaag

SEQ ID NO: 801864 - DNA, 25 bp, Mus musculus
tcagagcctaagtgtccttcccaag

SEQ ID NO: 801865 - DNA, 25 bp, Mus musculus
tcagagcctctcactacacttacta

SEQ ID NO: 801866 - DNA, 25 bp, Mus musculus
tcagagcctctctctacacttacta

SEQ ID NO: 801867 - DNA, 25 bp, Mus musculus
tcagagcctcttaaagtacactttt

SEQ ID NO: 801868 - DNA, 25 bp, Mus musculus
tcagagcctctttaagtacactttt

SEQ ID NO: 801869 - DNA, 25 bp, Mus musculus
tcagagccttggattccaccaaaag

SEQ ID NO: 801870 - DNA, 25 bp, Mus musculus
tcagagccttggtttccaccaaaag

SEQ ID NO: 801871 - DNA, 25 bp, Mus musculus
tcagagcctttcctacaaataaaat

SEQ ID NO: 801872 - DNA, 25 bp, Mus musculus
tcagagcctttcgtacaaataaaat

SEQ ID NO: 801873 - DNA, 25 bp, Mus musculus
tcagagcgcgctcgagtttgctaaa

SEQ ID NO: 801874 - DNA, 25 bp, Mus musculus
tcagagcgcgctggagtttgctaaa

SEQ ID NO: 801875 - DNA, 25 bp, Mus musculus
tcagagcgggcaacaggctggcctt

SEQ ID NO: 801876 - DNA, 25 bp, Mus musculus
tcagagcgggcatcaggctggcctt

SEQ ID NO: 801877 - DNA, 25 bp, Mus musculus
tcagagctagctattgggtgggaca

SEQ ID NO: 801878 - DNA, 25 bp, Mus musculus
tcagagctagcttttgggtgggaca

SEQ ID NO: 801879 - DNA, 25 bp, Mus musculus
tcagagctatgtaactactattctt

SEQ ID NO: 801880 - DNA, 25 bp, Mus musculus
tcagagctatgttactactattctt

SEQ ID NO: 801881 - DNA, 25 bp, Mus musculus
tcagagctccggagagtgtctgtca

SEQ ID NO: 801882 - DNA, 25 bp, Mus musculus
tcagagctccggtgagtgtctgtca

SEQ ID NO: 801883 - DNA, 25 bp, Mus musculus
tcagagctccgtcgccttagtcatc

SEQ ID NO: 801884 - DNA, 25 bp, Mus musculus
tcagagctccgtggccttagtcatc

SEQ ID NO: 801885 - DNA, 25 bp, Mus musculus
tcagagctctctccattactttctc

SEQ ID NO: 801886 - DNA, 25 bp, Mus musculus
tcagagctctctgcattactttctc

SEQ ID NO: 801887 - DNA, 25 bp, Mus musculus
tcagagctctggaatgctggccttc

SEQ ID NO: 801888 - DNA, 25 bp, Mus musculus
tcagagctctggtatgctggccttc

SEQ ID NO: 801889 - DNA, 25 bp, Mus musculus
tcagagctgagtcgctccatgtata

SEQ ID NO: 801890 - DNA, 25 bp, Mus musculus
tcagagctgagtggctccatgtata

SEQ ID NO: 801891 - DNA, 25 bp, Mus musculus
tcagagctgattcttgccccataat

SEQ ID NO: 801892 - DNA, 25 bp, Mus musculus
tcagagctgattgttgccccataat

SEQ ID NO: 801893 - DNA, 25 bp, Mus musculus
tcagagctggcgagaacgccttgct

SEQ ID NO: 801894 - DNA, 25 bp, Mus musculus
tcagagctggcgtgaacgccttgct

SEQ ID NO: 801895 - DNA, 25 bp, Mus musculus
tcagagctgggaagcctcaggtcga

SEQ ID NO: 801896 - DNA, 25 bp, Mus musculus
tcagagctgggatgcctcaggtcga

SEQ ID NO: 801897 - DNA, 25 bp, Mus musculus
tcagagctgtggacttcccatcagt

SEQ ID NO: 801898 - DNA, 25 bp, Mus musculus
tcagagctgtggtcttcccatcagt

SEQ ID NO: 801899 - DNA, 25 bp, Mus musculus
tcagagctgttgacaccgagggctg

SEQ ID NO: 801900 - DNA, 25 bp, Mus musculus
tcagagctgttgtcaccgagggctg

SEQ ID NO: 801901 - DNA, 25 bp, Mus musculus
tcagagcttgacatcgggaccacaa

SEQ ID NO: 801902 - DNA, 25 bp, Mus musculus
tcagagcttgacttcgggaccacaa

SEQ ID NO: 801903 - DNA, 25 bp, Mus musculus
tcagagcttgggagttcttcttctt

SEQ ID NO: 801904 - DNA, 25 bp, Mus musculus
tcagagcttgggtgttcttcttctt

SEQ ID NO: 801905 - DNA, 25 bp, Mus musculus
tcagagcttttcacttgtactttat

SEQ ID NO: 801906 - DNA, 25 bp, Mus musculus
tcagagcttttctcttgtactttat

SEQ ID NO: 801907 - DNA, 25 bp, Mus musculus
tcagaggaatttccatatatgcccc

SEQ ID NO: 801908 - DNA, 25 bp, Mus musculus
tcagaggaatttgcatatatgcccc

SEQ ID NO: 801909 - DNA, 25 bp, Mus musculus
tcagaggacagtctgttttcttgtg

SEQ ID NO: 801910 - DNA, 25 bp, Mus musculus
tcagaggacagtgtgttttcttgtg

SEQ ID NO: 801911 - DNA, 25 bp, Mus musculus
tcagaggacgcaacccaagactttg

SEQ ID NO: 801912 - DNA, 25 bp, Mus musculus
tcagaggacgcatcccaagactttg

SEQ ID NO: 801913 - DNA, 25 bp, Mus musculus
tcagaggactgcatccaccgtggaa

SEQ ID NO: 801914 - DNA, 25 bp, Mus musculus
tcagaggactgcttccaccgtggaa

SEQ ID NO: 801915 - DNA, 25 bp, Mus musculus
tcagaggactttcattctgctcaat

SEQ ID NO: 801916 - DNA, 25 bp, Mus musculus
tcagaggactttgattctgctcaat

SEQ ID NO: 801917 - DNA, 25 bp, Mus musculus
tcagaggagttgaattgtttccata

SEQ ID NO: 801918 - DNA, 25 bp, Mus musculus
tcagaggagttgtattgtttccata

SEQ ID NO: 801919 - DNA, 25 bp, Mus musculus
tcagaggagtttccctttcttagcc

SEQ ID NO: 801920 - DNA, 25 bp, Mus musculus
tcagaggagtttgcctttcttagcc

SEQ ID NO: 801921 - DNA, 25 bp, Mus musculus
tcagaggatctgcaaggcattcttt

SEQ ID NO: 801922 - DNA, 25 bp, Mus musculus
tcagaggatctggaaggcattcttt

SEQ ID NO: 801923 - DNA, 25 bp, Mus musculus
tcagaggatgtacgatcacttctca

SEQ ID NO: 801924 - DNA, 25 bp, Mus musculus
tcagaggatgtaggatcacttctca

SEQ ID NO: 801925 - DNA, 25 bp, Mus musculus
tcagaggatttgagtccatcgtgcc

SEQ ID NO: 801926 - DNA, 25 bp, Mus musculus
tcagaggatttgtgtccatcgtgcc

SEQ ID NO: 801927 - DNA, 25 bp, Mus musculus
tcagaggcaggaaccgtaaaaggct

SEQ ID NO: 801928 - DNA, 25 bp, Mus musculus
tcagaggcaggatccgtaaaaggct

SEQ ID NO: 801929 - DNA, 25 bp, Mus musculus
tcagaggcagttcgacttgaagtta

SEQ ID NO: 801930 - DNA, 25 bp, Mus musculus
tcagaggcagttggacttgaagtta

SEQ ID NO: 801931 - DNA, 25 bp, Mus musculus
tcagaggccaccatgacaatgtagc

SEQ ID NO: 801932 - DNA, 25 bp, Mus musculus
tcagaggccaccttgacaatgtagc

SEQ ID NO: 801933 - DNA, 25 bp, Mus musculus
tcagaggcccacagagctgggacag

SEQ ID NO: 801934 - DNA, 25 bp, Mus musculus
tcagaggcccactgagctgggacag

SEQ ID NO: 801935 - DNA, 25 bp, Mus musculus
tcagaggcccagcaggtgaccattc

SEQ ID NO: 801936 - DNA, 25 bp, Mus musculus
tcagaggcccaggaggtgaccattc

SEQ ID NO: 801937 - DNA, 25 bp, Mus musculus
tcagaggccccgagagagttatcaa

SEQ ID NO: 801938 - DNA, 25 bp, Mus musculus
tcagaggccccgattgttcccagag

SEQ ID NO: 801939 - DNA, 25 bp, Mus musculus
tcagaggccccgtgagagttatcaa

SEQ ID NO: 801940 - DNA, 25 bp, Mus musculus
tcagaggccccgtttgttcccagag

SEQ ID NO: 801941 - DNA, 25 bp, Mus musculus
tcagaggccgtgacttcaacattcc

SEQ ID NO: 801942 - DNA, 25 bp, Mus musculus
tcagaggccgtgtcttcaacattcc

SEQ ID NO: 801943 - DNA, 25 bp, Mus musculus
tcagaggcgtggactctctccattc

SEQ ID NO: 801944 - DNA, 25 bp, Mus musculus
tcagaggcgtggtctctctccattc

SEQ ID NO: 801945 - DNA, 25 bp, Mus musculus
tcagaggctcttctgttctagaaaa

SEQ ID NO: 801946 - DNA, 25 bp, Mus musculus
tcagaggctcttgtgttctagaaaa

SEQ ID NO: 801947 - DNA, 25 bp, Mus musculus
tcagaggctgaaacgtttttataaa

SEQ ID NO: 801948 - DNA, 25 bp, Mus musculus
tcagaggctgaatcgtttttataaa

SEQ ID NO: 801949 - DNA, 25 bp, Mus musculus
tcagaggcttcgatgtttacaataa

SEQ ID NO: 801950 - DNA, 25 bp, Mus musculus
tcagaggcttcgttgtttacaataa

SEQ ID NO: 801951 - DNA, 25 bp, Mus musculus
tcagaggcttctccagggagagcac

SEQ ID NO: 801952 - DNA, 25 bp, Mus musculus
tcagaggcttctgcagggagagcac

SEQ ID NO: 801953 - DNA, 25 bp, Mus musculus
tcagagggagcacccgctagcattt

SEQ ID NO: 801954 - DNA, 25 bp, Mus musculus
tcagagggagcagccgctagcattt

SEQ ID NO: 801955 - DNA, 25 bp, Mus musculus
tcagagggtctgacacctttgacct

SEQ ID NO: 801956 - DNA, 25 bp, Mus musculus
tcagagggtctgtcacctttgacct

SEQ ID NO: 801957 - DNA, 25 bp, Mus musculus
tcagagggtcttccatatttttcat

SEQ ID NO: 801958 - DNA, 25 bp, Mus musculus
tcagagggtcttgcatatttttcat

SEQ ID NO: 801959 - DNA, 25 bp, Mus musculus
tcagagggttgcatggctccttcga

SEQ ID NO: 801960 - DNA, 25 bp, Mus musculus
tcagagggttgcttggctccttcga

SEQ ID NO: 801961 - DNA, 25 bp, Mus musculus
tcagagggtttacaaatgctaggcc

SEQ ID NO: 801962 - DNA, 25 bp, Mus musculus
tcagagggtttagaaatgctaggcc

SEQ ID NO: 801963 - DNA, 25 bp, Mus musculus
tcagaggtacccatatgcagaggtc

SEQ ID NO: 801964 - DNA, 25 bp, Mus musculus
tcagaggtacccttatgcagaggtc

SEQ ID NO: 801965 - DNA, 25 bp, Mus musculus
tcagaggtagagaacgtagcaggac

SEQ ID NO: 801966 - DNA, 25 bp, Mus musculus
tcagaggtagagtacgtagcaggac

SEQ ID NO: 801967 - DNA, 25 bp, Mus musculus
tcagaggtagtccatcttctgtgac

SEQ ID NO: 801968 - DNA, 25 bp, Mus musculus
tcagaggtagtcgatcttctgtgac

SEQ ID NO: 801969 - DNA, 25 bp, Mus musculus
tcagaggtccagattaactagggat

SEQ ID NO: 801970 - DNA, 25 bp, Mus musculus
tcagaggtccagtttaactagggat

SEQ ID NO: 801971 - DNA, 25 bp, Mus musculus
tcagaggtgccacgatcaacacaga

SEQ ID NO: 801972 - DNA, 25 bp, Mus musculus
tcagaggtgccaggatcaacacaga

SEQ ID NO: 801973 - DNA, 25 bp, Mus musculus
tcagaggtggacaacgtgtttgaca

SEQ ID NO: 801974 - DNA, 25 bp, Mus musculus
tcagaggtggactacgtgtttgaca

SEQ ID NO: 801975 - DNA, 25 bp, Mus musculus
tcagaggttcttcctagcccctgaa

SEQ ID NO: 801976 - DNA, 25 bp, Mus musculus
tcagaggttcttgctagcccctgaa

SEQ ID NO: 801977 - DNA, 25 bp, Mus musculus
tcagaggtttctatggtactaaaat

SEQ ID NO: 801978 - DNA, 25 bp, Mus musculus
tcagaggtttctttggtactaaaat

SEQ ID NO: 801979 - DNA, 25 bp, Mus musculus
tcagagtaaagccttctttccttgg

SEQ ID NO: 801980 - DNA, 25 bp, Mus musculus
tcagagtaaagcgttctttccttgg

SEQ ID NO: 801981 - DNA, 25 bp, Mus musculus
tcagagtacactccacaggggagcc

SEQ ID NO: 801982 - DNA, 25 bp, Mus musculus
tcagagtacactgcacaggggagcc

SEQ ID NO: 801983 - DNA, 25 bp, Mus musculus
tcagagtagaagatgtcattgctat

SEQ ID NO: 801984 - DNA, 25 bp, Mus musculus
tcagagtagaagttgtcattgctat

SEQ ID NO: 801985 - DNA, 25 bp, Mus musculus
tcagagtagacacgaccacacattg

SEQ ID NO: 801986 - DNA, 25 bp, Mus musculus
tcagagtagacaggaccacacattg

SEQ ID NO: 801987 - DNA, 25 bp, Mus musculus
tcagagtagtcaaggccttcagtcc

SEQ ID NO: 801988 - DNA, 25 bp, Mus musculus
tcagagtagtcatggccttcagtcc

SEQ ID NO: 801989 - DNA, 25 bp, Mus musculus
tcagagtattttcattactccctaa

SEQ ID NO: 801990 - DNA, 25 bp, Mus musculus
tcagagtattttgattactccctaa

SEQ ID NO: 801991 - DNA, 25 bp, Mus musculus
tcagagtcacagacaaggtcagcct

SEQ ID NO: 801992 - DNA, 25 bp, Mus musculus
tcagagtcacagtcaaggtcagcct

SEQ ID NO: 801993 - DNA, 25 bp, Mus musculus
tcagagtcagcgctatgaaacttcg

SEQ ID NO: 801994 - DNA, 25 bp, Mus musculus
tcagagtcagcggtatgaaacttcg

SEQ ID NO: 801995 - DNA, 25 bp, Mus musculus
tcagagtcaggcatgtgggtcagaa

SEQ ID NO: 801996 - DNA, 25 bp, Mus musculus
tcagagtcaggcttgtgggtcagaa

SEQ ID NO: 801997 - DNA, 25 bp, Mus musculus
tcagagtccctcacacgtgtgcttt

SEQ ID NO: 801998 - DNA, 25 bp, Mus musculus
tcagagtccctctcacgtgtgcttt

SEQ ID NO: 801999 - DNA, 25 bp, Mus musculus
tcagagtctacaatgcctgccagag

SEQ ID NO: 802000 - DNA, 25 bp, Mus musculus
tcagagtctacattgcctgccagag

SEQ ID NO: 802001 - DNA, 25 bp, Mus musculus
tcagagtctcacacctttgttggag

SEQ ID NO: 802002 - DNA, 25 bp, Mus musculus
tcagagtctcactcctttgttggag

SEQ ID NO: 802003 - DNA, 25 bp, Mus musculus
tcagagtgactgatgcatttgcgaa

SEQ ID NO: 802004 - DNA, 25 bp, Mus musculus
tcagagtgactgttgcatttgcgaa

SEQ ID NO: 802005 - DNA, 25 bp, Mus musculus
tcagagtgagataagaggagcacct

SEQ ID NO: 802006 - DNA, 25 bp, Mus musculus
tcagagtgagattagaggagcacct

SEQ ID NO: 802007 - DNA, 25 bp, Mus musculus
tcagagtgagctatatcctgctcct

SEQ ID NO: 802008 - DNA, 25 bp, Mus musculus
tcagagtgagctcccgcctatttta

SEQ ID NO: 802009 - DNA, 25 bp, Mus musculus
tcagagtgagctgccgcctatttta

SEQ ID NO: 802010 - DNA, 25 bp, Mus musculus
tcagagtgagctttatcctgctcct

SEQ ID NO: 802011 - DNA, 25 bp, Mus musculus
tcagagtgcaccatcgggcgtatat

SEQ ID NO: 802012 - DNA, 25 bp, Mus musculus
tcagagtgcaccttcgggcgtatat

SEQ ID NO: 802013 - DNA, 25 bp, Mus musculus
tcagagtgccagctcctggcactgg

SEQ ID NO: 802014 - DNA, 25 bp, Mus musculus
tcagagtgccaggtcctggcactgg

SEQ ID NO: 802015 - DNA, 25 bp, Mus musculus
tcagagtggctgctcactgtcatac

SEQ ID NO: 802016 - DNA, 25 bp, Mus musculus
tcagagtggctggtcactgtcatac

SEQ ID NO: 802017 - DNA, 25 bp, Mus musculus
tcagagtgggatcccagaagccatt

SEQ ID NO: 802018 - DNA, 25 bp, Mus musculus
tcagagtgggatgccagaagccatt

SEQ ID NO: 802019 - DNA, 25 bp, Mus musculus
tcagagtgtcatctgagctctcaca

SEQ ID NO: 802020 - DNA, 25 bp, Mus musculus
tcagagtgtcatgtgagctctcaca

SEQ ID NO: 802021 - DNA, 25 bp, Mus musculus
tcagagtgttggcatggtcttcctc

SEQ ID NO: 802022 - DNA, 25 bp, Mus musculus
tcagagtgttgggatggtcttcctc

SEQ ID NO: 802023 - DNA, 25 bp, Mus musculus
tcagagttagcacaggcgcccgaca

SEQ ID NO: 802024 - DNA, 25 bp, Mus musculus
tcagagttagcagaggcgcccgaca

SEQ ID NO: 802025 - DNA, 25 bp, Mus musculus
tcagagttatagacctgagagcagg

SEQ ID NO: 802026 - DNA, 25 bp, Mus musculus
tcagagttatagtcctgagagcagg

SEQ ID NO: 802027 - DNA, 25 bp, Mus musculus
tcagagttcaatccagccactcctg

SEQ ID NO: 802028 - DNA, 25 bp, Mus musculus
tcagagttcaatgcagccactcctg

SEQ ID NO: 802029 - DNA, 25 bp, Mus musculus
tcagagttcatcacccgggagccga

SEQ ID NO: 802030 - DNA, 25 bp, Mus musculus
tcagagttcatctcccgggagccga

SEQ ID NO: 802031 - DNA, 25 bp, Mus musculus
tcagagttccagatggcggttccct

SEQ ID NO: 802032 - DNA, 25 bp, Mus musculus
tcagagttccagttggcggttccct

SEQ ID NO: 802033 - DNA, 25 bp, Mus musculus
tcagagttccctacacaagctgtac

SEQ ID NO: 802034 - DNA, 25 bp, Mus musculus
tcagagttcccttcacaagctgtac

SEQ ID NO: 802035 - DNA, 25 bp, Mus musculus
tcagagttctctcgagtgacagaat

SEQ ID NO: 802036 - DNA, 25 bp, Mus musculus
tcagagttctctggagtgacagaat

SEQ ID NO: 802037 - DNA, 25 bp, Mus musculus
tcagagttctggagcaaccggcttg

SEQ ID NO: 802038 - DNA, 25 bp, Mus musculus
tcagagttctggtgcaaccggcttg

SEQ ID NO: 802039 - DNA, 25 bp, Mus musculus
tcagagttcttgacttgccatcttc

SEQ ID NO: 802040 - DNA, 25 bp, Mus musculus
tcagagttcttgtcttgccatcttc

SEQ ID NO: 802041 - DNA, 25 bp, Mus musculus
tcagagttctttacaaacccagttt

SEQ ID NO: 802042 - DNA, 25 bp, Mus musculus
tcagagttcttttcaaacccagttt

SEQ ID NO: 802043 - DNA, 25 bp, Mus musculus
tcagagttgctgaggctactgcact

SEQ ID NO: 802044 - DNA, 25 bp, Mus musculus
tcagagttgctgtggctactgcact

SEQ ID NO: 802045 - DNA, 25 bp, Mus musculus
tcagagttgcttccctagtcttaag

SEQ ID NO: 802046 - DNA, 25 bp, Mus musculus
tcagagttgcttgcctagtcttaag

SEQ ID NO: 802047 - DNA, 25 bp, Mus musculus
tcagagttggttagggctataacac

SEQ ID NO: 802048 - DNA, 25 bp, Mus musculus
tcagagttggtttgggctataacac

SEQ ID NO: 802049 - DNA, 25 bp, Mus musculus
tcagagtttcctaagcccttggtac

SEQ ID NO: 802050 - DNA, 25 bp, Mus musculus
tcagagtttccttagcccttggtac

SEQ ID NO: 802051 - DNA, 25 bp, Mus musculus
tcagagtttcggcattcacgtggct

SEQ ID NO: 802052 - DNA, 25 bp, Mus musculus
tcagagtttcgggattcacgtggct

SEQ ID NO: 802053 - DNA, 25 bp, Mus musculus
tcagagtttggaaatgtagtttgtg

SEQ ID NO: 802054 - DNA, 25 bp, Mus musculus
tcagagtttggatatgtagtttgtg

SEQ ID NO: 802055 - DNA, 25 bp, Mus musculus
tcagagtttgggaacgtgaacacag

SEQ ID NO: 802056 - DNA, 25 bp, Mus musculus
tcagagtttgggtacgtgaacacag

SEQ ID NO: 802057 - DNA, 25 bp, Mus musculus
tcagagttttggaactccagatgcc

SEQ ID NO: 802058 - DNA, 25 bp, Mus musculus
tcagagttttggtactccagatgcc

SEQ ID NO: 802059 - DNA, 25 bp, Mus musculus
tcagataaatgcacccattgtgaat

SEQ ID NO: 802060 - DNA, 25 bp, Mus musculus
tcagataaatgctcccattgtgaat

SEQ ID NO: 802061 - DNA, 25 bp, Mus musculus
tcagataactccaccttcgaagata

SEQ ID NO: 802062 - DNA, 25 bp, Mus musculus
tcagataactcctccttcgaagata

SEQ ID NO: 802063 - DNA, 25 bp, Mus musculus
tcagataacttgacccagggctatg

SEQ ID NO: 802064 - DNA, 25 bp, Mus musculus
tcagataacttgtcccagggctatg

SEQ ID NO: 802065 - DNA, 25 bp, Mus musculus
tcagataagacaaactcaaaccagt

SEQ ID NO: 802066 - DNA, 25 bp, Mus musculus
tcagataagacatactcaaaccagt

SEQ ID NO: 802067 - DNA, 25 bp, Mus musculus
tcagataagagacatggaaacccca

SEQ ID NO: 802068 - DNA, 25 bp, Mus musculus
tcagataagagagatggaaacccca

SEQ ID NO: 802069 - DNA, 25 bp, Mus musculus
tcagataaggcacagaaatgttcat

SEQ ID NO: 802070 - DNA, 25 bp, Mus musculus
tcagataaggcagagaaatgttcat

SEQ ID NO: 802071 - DNA, 25 bp, Mus musculus
tcagataaggttacccagtatgttc

SEQ ID NO: 802072 - DNA, 25 bp, Mus musculus
tcagataaggtttcccagtatgttc

SEQ ID NO: 802073 - DNA, 25 bp, Mus musculus
tcagatacatagcgacgtttttacc

SEQ ID NO: 802074 - DNA, 25 bp, Mus musculus
tcagatacatagggacgtttttacc

SEQ ID NO: 802075 - DNA, 25 bp, Mus musculus
tcagatacccaaagtgtcactcact

SEQ ID NO: 802076 - DNA, 25 bp, Mus musculus
tcagatacccaatgtgtcactcact

SEQ ID NO: 802077 - DNA, 25 bp, Mus musculus
tcagatacctgaatttttatgaaaa

SEQ ID NO: 802078 - DNA, 25 bp, Mus musculus
tcagatacctgattttttatgaaaa

SEQ ID NO: 802079 - DNA, 25 bp, Mus musculus
tcagatacgttgatagcccagtaac

SEQ ID NO: 802080 - DNA, 25 bp, Mus musculus
tcagatacgttgttagcccagtaac

SEQ ID NO: 802081 - DNA, 25 bp, Mus musculus
tcagatactagtccctagcattttt

SEQ ID NO: 802082 - DNA, 25 bp, Mus musculus
tcagatactagtgcctagcattttt

SEQ ID NO: 802083 - DNA, 25 bp, Mus musculus
tcagatagatgcagtggacactctt

SEQ ID NO: 802084 - DNA, 25 bp, Mus musculus
tcagatagatgctgtggacactctt

SEQ ID NO: 802085 - DNA, 25 bp, Mus musculus
tcagatagcttgacttatgatgtgc

SEQ ID NO: 802086 - DNA, 25 bp, Mus musculus
tcagatagcttgtcttatgatgtgc

SEQ ID NO: 802087 - DNA, 25 bp, Mus musculus
tcagatatctaccttgacttcccca

SEQ ID NO: 802088 - DNA, 25 bp, Mus musculus
tcagatatctacgttgacttcccca

SEQ ID NO: 802089 - DNA, 25 bp, Mus musculus
tcagatatgtacacgcaagccaggg

SEQ ID NO: 802090 - DNA, 25 bp, Mus musculus
tcagatatgtactcgcaagccaggg

SEQ ID NO: 802091 - DNA, 25 bp, Mus musculus
tcagatattccaagcctgttaccca

SEQ ID NO: 802092 - DNA, 25 bp, Mus musculus
tcagatattccatgcctgttaccca

SEQ ID NO: 802093 - DNA, 25 bp, Mus musculus
tcagatattcttacgggttttgtac

SEQ ID NO: 802094 - DNA, 25 bp, Mus musculus
tcagatattctttcgggttttgtac

SEQ ID NO: 802095 - DNA, 25 bp, Mus musculus
tcagatatttaacccgtaagcctta

SEQ ID NO: 802096 - DNA, 25 bp, Mus musculus
tcagatatttaagccgtaagcctta

SEQ ID NO: 802097 - DNA, 25 bp, Mus musculus
tcagatatttagcagtccctgctgt

SEQ ID NO: 802098 - DNA, 25 bp, Mus musculus
tcagatatttaggagtccctgctgt

SEQ ID NO: 802099 - DNA, 25 bp, Mus musculus
tcagatattttcctacagctatgta

SEQ ID NO: 802100 - DNA, 25 bp, Mus musculus
tcagatattttcgtacagctatgta

SEQ ID NO: 802101 - DNA, 25 bp, Mus musculus
tcagatattttgaatatcccctatg

SEQ ID NO: 802102 - DNA, 25 bp, Mus musculus
tcagatattttgctgcaggtttttg

SEQ ID NO: 802103 - DNA, 25 bp, Mus musculus
tcagatattttggtgcaggtttttg

SEQ ID NO: 802104 - DNA, 25 bp, Mus musculus
tcagatattttgtatatcccctatg

SEQ ID NO: 802105 - DNA, 25 bp, Mus musculus
tcagatatttttcgccatagtgagt

SEQ ID NO: 802106 - DNA, 25 bp, Mus musculus
tcagatatttttggccatagtgagt

SEQ ID NO: 802107 - DNA, 25 bp, Mus musculus
tcagatcaacacctttaacctaaag

SEQ ID NO: 802108 - DNA, 25 bp, Mus musculus
tcagatcaacacgtttaacctaaag

SEQ ID NO: 802109 - DNA, 25 bp, Mus musculus
tcagatcaactgaccctgatgtctc

SEQ ID NO: 802110 - DNA, 25 bp, Mus musculus
tcagatcaactgtccctgatgtctc

SEQ ID NO: 802111 - DNA, 25 bp, Mus musculus
tcagatcacaagataaggtcagcct

SEQ ID NO: 802112 - DNA, 25 bp, Mus musculus
tcagatcacaagttaaggtcagcct

SEQ ID NO: 802113 - DNA, 25 bp, Mus musculus
tcagatcacctgacgctggagtcat

SEQ ID NO: 802114 - DNA, 25 bp, Mus musculus
tcagatcacctgtcgctggagtcat

SEQ ID NO: 802115 - DNA, 25 bp, Mus musculus
tcagatcacgatcatgctcatcttc

SEQ ID NO: 802116 - DNA, 25 bp, Mus musculus
tcagatcacgatgatgctcatcttc

SEQ ID NO: 802117 - DNA, 25 bp, Mus musculus
tcagatcaggttaggactccttcca

SEQ ID NO: 802118 - DNA, 25 bp, Mus musculus
tcagatcaggtttggactccttcca

SEQ ID NO: 802119 - DNA, 25 bp, Mus musculus
tcagatccagacacctcccattttc

SEQ ID NO: 802120 - DNA, 25 bp, Mus musculus
tcagatccagactcctcccattttc

SEQ ID NO: 802121 - DNA, 25 bp, Mus musculus
tcagatccagtaattcccctgctag

SEQ ID NO: 802122 - DNA, 25 bp, Mus musculus
tcagatccagtatttcccctgctag

SEQ ID NO: 802123 - DNA, 25 bp, Mus musculus
tcagatccctcacacttaacttata

SEQ ID NO: 802124 - DNA, 25 bp, Mus musculus
tcagatccctcagacttaacttata

SEQ ID NO: 802125 - DNA, 25 bp, Mus musculus
tcagatccctgaacccatataaaaa

SEQ ID NO: 802126 - DNA, 25 bp, Mus musculus
tcagatccctgatcccatataaaaa

SEQ ID NO: 802127 - DNA, 25 bp, Mus musculus
tcagatccctgcatttcagaggcaa

SEQ ID NO: 802128 - DNA, 25 bp, Mus musculus
tcagatccctgcttttcagaggcaa

SEQ ID NO: 802129 - DNA, 25 bp, Mus musculus
tcagatccgccaaacctgtgaggag

SEQ ID NO: 802130 - DNA, 25 bp, Mus musculus
tcagatccgccatacctgtgaggag

SEQ ID NO: 802131 - DNA, 25 bp, Mus musculus
tcagatcctactcaggatggtttgg

SEQ ID NO: 802132 - DNA, 25 bp, Mus musculus
tcagatcctactgaggatggtttgg

SEQ ID NO: 802133 - DNA, 25 bp, Mus musculus
tcagatcctgaacccacgagaacca

SEQ ID NO: 802134 - DNA, 25 bp, Mus musculus
tcagatcctgaagccacgagaacca

SEQ ID NO: 802135 - DNA, 25 bp, Mus musculus
tcagatcgccatagatacttttaaa

SEQ ID NO: 802136 - DNA, 25 bp, Mus musculus
tcagatcgccattgatacttttaaa

SEQ ID NO: 802137 - DNA, 25 bp, Mus musculus
tcagatcgggcacagaaaatgtgtt

SEQ ID NO: 802138 - DNA, 25 bp, Mus musculus
tcagatcgggcagagaaaatgtgtt

SEQ ID NO: 802139 - DNA, 25 bp, Mus musculus
tcagatctcagcatctgtgcagaat

SEQ ID NO: 802140 - DNA, 25 bp, Mus musculus
tcagatctcagcttctgtgcagaat

SEQ ID NO: 802141 - DNA, 25 bp, Mus musculus
tcagatctcataacggatggctttt

SEQ ID NO: 802142 - DNA, 25 bp, Mus musculus
tcagatctcatatcggatggctttt

SEQ ID NO: 802143 - DNA, 25 bp, Mus musculus
tcagatctcctcagctaaaccgcat

SEQ ID NO: 802144 - DNA, 25 bp, Mus musculus
tcagatctcctctgctaaaccgcat

SEQ ID NO: 802145 - DNA, 25 bp, Mus musculus
tcagatctcgacagggtggaggccc

SEQ ID NO: 802146 - DNA, 25 bp, Mus musculus
tcagatctcgactgggtggaggccc

SEQ ID NO: 802147 - DNA, 25 bp, Mus musculus
tcagatctcgtgatttgtgccatcc

SEQ ID NO: 802148 - DNA, 25 bp, Mus musculus
tcagatctcgtgttttgtgccatcc

SEQ ID NO: 802149 - DNA, 25 bp, Mus musculus
tcagatctgatgatacaggcacgga

SEQ ID NO: 802150 - DNA, 25 bp, Mus musculus
tcagatctgatgttacaggcacgga

SEQ ID NO: 802151 - DNA, 25 bp, Mus musculus
tcagatctgcagaaagtttcaggac

SEQ ID NO: 802152 - DNA, 25 bp, Mus musculus
tcagatctgcagtaagtttcaggac

SEQ ID NO: 802153 - DNA, 25 bp, Mus musculus
tcagatctgccgaggaattggtatc

SEQ ID NO: 802154 - DNA, 25 bp, Mus musculus
tcagatctgccgtggaattggtatc

SEQ ID NO: 802155 - DNA, 25 bp, Mus musculus
tcagatctgttcatcctactcacag

SEQ ID NO: 802156 - DNA, 25 bp, Mus musculus
tcagatctgttcttcctactcacag

SEQ ID NO: 802157 - DNA, 25 bp, Mus musculus
tcagatcttctgattgtcctttccc

SEQ ID NO: 802158 - DNA, 25 bp, Mus musculus
tcagatcttctgtttgtcctttccc

SEQ ID NO: 802159 - DNA, 25 bp, Mus musculus
tcagatcttggcattgaggcctctc

SEQ ID NO: 802160 - DNA, 25 bp, Mus musculus
tcagatcttggctttgaggcctctc

SEQ ID NO: 802161 - DNA, 25 bp, Mus musculus
tcagatctttggcagttccagggta

SEQ ID NO: 802162 - DNA, 25 bp, Mus musculus
tcagatctttgggagttccagggta

SEQ ID NO: 802163 - DNA, 25 bp, Mus musculus
tcagatcttttcactgtttttcttc

SEQ ID NO: 802164 - DNA, 25 bp, Mus musculus
tcagatcttttctctgtttttcttc

SEQ ID NO: 802165 - DNA, 25 bp, Mus musculus
tcagatgacacgatgccagttgcct

SEQ ID NO: 802166 - DNA, 25 bp, Mus musculus
tcagatgacacgttgccagttgcct

SEQ ID NO: 802167 - DNA, 25 bp, Mus musculus
tcagatgaccggctcttgctggacc

SEQ ID NO: 802168 - DNA, 25 bp, Mus musculus
tcagatgaccgggtcttgctggacc

SEQ ID NO: 802169 - DNA, 25 bp, Mus musculus
tcagatgacctaatctctaagtgtc

SEQ ID NO: 802170 - DNA, 25 bp, Mus musculus
tcagatgacctattctctaagtgtc

SEQ ID NO: 802171 - DNA, 25 bp, Mus musculus
tcagatgactgtcagtcgctgcgtc

SEQ ID NO: 802172 - DNA, 25 bp, Mus musculus
tcagatgactgtcttgccatgagaa

SEQ ID NO: 802173 - DNA, 25 bp, Mus musculus
tcagatgactgtgagtcgctgcgtc

SEQ ID NO: 802174 - DNA, 25 bp, Mus musculus
tcagatgactgtgttgccatgagaa

SEQ ID NO: 802175 - DNA, 25 bp, Mus musculus
tcagatgagactacgggctccttgc

SEQ ID NO: 802176 - DNA, 25 bp, Mus musculus
tcagatgagacttcgggctccttgc

SEQ ID NO: 802177 - DNA, 25 bp, Mus musculus
tcagatgaggagaatggcccgccct

SEQ ID NO: 802178 - DNA, 25 bp, Mus musculus
tcagatgaggagtatggcccgccct

SEQ ID NO: 802179 - DNA, 25 bp, Mus musculus
tcagatgagggcagctccccgaaga

SEQ ID NO: 802180 - DNA, 25 bp, Mus musculus
tcagatgagggctgctccccgaaga

SEQ ID NO: 802181 - DNA, 25 bp, Mus musculus
tcagatgaggttccagtccagggct

SEQ ID NO: 802182 - DNA, 25 bp, Mus musculus
tcagatgaggttgcagtccagggct

SEQ ID NO: 802183 - DNA, 25 bp, Mus musculus
tcagatgatcggcttcagaagtgtt

SEQ ID NO: 802184 - DNA, 25 bp, Mus musculus
tcagatgatcgggttcagaagtgtt

SEQ ID NO: 802185 - DNA, 25 bp, Mus musculus
tcagatgattctattctccgattgg

SEQ ID NO: 802186 - DNA, 25 bp, Mus musculus
tcagatgattcttttctccgattgg

SEQ ID NO: 802187 - DNA, 25 bp, Mus musculus
tcagatgattgcagggaggcccctt

SEQ ID NO: 802188 - DNA, 25 bp, Mus musculus
tcagatgattgctgggaggcccctt

SEQ ID NO: 802189 - DNA, 25 bp, Mus musculus
tcagatgcacaacgctggctttggc

SEQ ID NO: 802190 - DNA, 25 bp, Mus musculus
tcagatgcacaaggctggctttggc

SEQ ID NO: 802191 - DNA, 25 bp, Mus musculus
tcagatgcagccacattacactctg

SEQ ID NO: 802192 - DNA, 25 bp, Mus musculus
tcagatgcagcctcattacactctg

SEQ ID NO: 802193 - DNA, 25 bp, Mus musculus
tcagatgcagctagttgattccata

SEQ ID NO: 802194 - DNA, 25 bp, Mus musculus
tcagatgcagcttgttgattccata

SEQ ID NO: 802195 - DNA, 25 bp, Mus musculus
tcagatgcagtcctcagtaaacagt

SEQ ID NO: 802196 - DNA, 25 bp, Mus musculus
tcagatgcagtcgtcagtaaacagt

SEQ ID NO: 802197 - DNA, 25 bp, Mus musculus
tcagatgcatgtactcagaggaact

SEQ ID NO: 802198 - DNA, 25 bp, Mus musculus
tcagatgcatgttctcagaggaact

SEQ ID NO: 802199 - DNA, 25 bp, Mus musculus
tcagatgccaataactcgacacacc

SEQ ID NO: 802200 - DNA, 25 bp, Mus musculus
tcagatgccaattactcgacacacc

SEQ ID NO: 802201 - DNA, 25 bp, Mus musculus
tcagatgccagcctcatgcatgggc

SEQ ID NO: 802202 - DNA, 25 bp, Mus musculus
tcagatgccagcgtcatgcatgggc

SEQ ID NO: 802203 - DNA, 25 bp, Mus musculus
tcagatgcccagagacgcagctgtg

SEQ ID NO: 802204 - DNA, 25 bp, Mus musculus
tcagatgcccagtgacgcagctgtg

SEQ ID NO: 802205 - DNA, 25 bp, Mus musculus
tcagatgcccttatccagagccatg

SEQ ID NO: 802206 - DNA, 25 bp, Mus musculus
tcagatgcccttttccagagccatg

SEQ ID NO: 802207 - DNA, 25 bp, Mus musculus
tcagatgcctctatgttgtttaaca

SEQ ID NO: 802208 - DNA, 25 bp, Mus musculus
tcagatgcctctttgttgtttaaca

SEQ ID NO: 802209 - DNA, 25 bp, Mus musculus
tcagatgctcaaagtcactagtata

SEQ ID NO: 802210 - DNA, 25 bp, Mus musculus
tcagatgctcaatgtcactagtata

SEQ ID NO: 802211 - DNA, 25 bp, Mus musculus
tcagatgctcttcatttttctctgc

SEQ ID NO: 802212 - DNA, 25 bp, Mus musculus
tcagatgctcttgatttttctctgc

SEQ ID NO: 802213 - DNA, 25 bp, Mus musculus
tcagatgcttcacggctggagtgcc

SEQ ID NO: 802214 - DNA, 25 bp, Mus musculus
tcagatgcttcagggctggagtgcc

SEQ ID NO: 802215 - DNA, 25 bp, Mus musculus
tcagatgcttctcgaatcaactgtt

SEQ ID NO: 802216 - DNA, 25 bp, Mus musculus
tcagatgcttctggaatcaactgtt

SEQ ID NO: 802217 - DNA, 25 bp, Mus musculus
tcagatgcttggcactgtggtcata

SEQ ID NO: 802218 - DNA, 25 bp, Mus musculus
tcagatgcttgggactgtggtcata

SEQ ID NO: 802219 - DNA, 25 bp, Mus musculus
tcagatgcttgtagccacagtagat

SEQ ID NO: 802220 - DNA, 25 bp, Mus musculus
tcagatgcttgttgccacagtagat

SEQ ID NO: 802221 - DNA, 25 bp, Mus musculus
tcagatggcaagctctgatctgagc

SEQ ID NO: 802222 - DNA, 25 bp, Mus musculus
tcagatggcaaggtctgatctgagc

SEQ ID NO: 802223 - DNA, 25 bp, Mus musculus
tcagatggcaggcaaaaccgcctcc

SEQ ID NO: 802224 - DNA, 25 bp, Mus musculus
tcagatggcagggaaaaccgcctcc

SEQ ID NO: 802225 - DNA, 25 bp, Mus musculus
tcagatggccatcctcagtatccct

SEQ ID NO: 802226 - DNA, 25 bp, Mus musculus
tcagatggccatgctcagtatccct

SEQ ID NO: 802227 - DNA, 25 bp, Mus musculus
tcagatggccttctccttggattca

SEQ ID NO: 802228 - DNA, 25 bp, Mus musculus
tcagatggccttgtccttggattca

SEQ ID NO: 802229 - DNA, 25 bp, Mus musculus
tcagatggcgaacggacttgctgcc

SEQ ID NO: 802230 - DNA, 25 bp, Mus musculus
tcagatggcgaagggacttgctgcc

SEQ ID NO: 802231 - DNA, 25 bp, Mus musculus
tcagatggcgccattgctggcatcg

SEQ ID NO: 802232 - DNA, 25 bp, Mus musculus
tcagatggcgcctttgctggcatcg

SEQ ID NO: 802233 - DNA, 25 bp, Mus musculus
tcagatggctgacggacttgcttca

SEQ ID NO: 802234 - DNA, 25 bp, Mus musculus
tcagatggctgagggacttgcttca

SEQ ID NO: 802235 - DNA, 25 bp, Mus musculus
tcagatgggtagacagacctccttc

SEQ ID NO: 802236 - DNA, 25 bp, Mus musculus
tcagatgggtagtcagacctccttc

SEQ ID NO: 802237 - DNA, 25 bp, Mus musculus
tcagatggtcgactgtcctacagta

SEQ ID NO: 802238 - DNA, 25 bp, Mus musculus
tcagatggtcgagtgtcctacagta

SEQ ID NO: 802239 - DNA, 25 bp, Mus musculus
tcagatgtacctcagcaatgtgcca

SEQ ID NO: 802240 - DNA, 25 bp, Mus musculus
tcagatgtacctgagcaatgtgcca

SEQ ID NO: 802241 - DNA, 25 bp, Mus musculus
tcagatgtctctccaagtgagccct

SEQ ID NO: 802242 - DNA, 25 bp, Mus musculus
tcagatgtctctccagtagactgaa

SEQ ID NO: 802243 - DNA, 25 bp, Mus musculus
tcagatgtctctgcaagtgagccct

SEQ ID NO: 802244 - DNA, 25 bp, Mus musculus
tcagatgtctctgcagtagactgaa

SEQ ID NO: 802245 - DNA, 25 bp, Mus musculus
tcagatgtgcatcgtgtcactgtaa

SEQ ID NO: 802246 - DNA, 25 bp, Mus musculus
tcagatgtgcatggtgtcactgtaa

SEQ ID NO: 802247 - DNA, 25 bp, Mus musculus
tcagatgtgctacagcagcctctgc

SEQ ID NO: 802248 - DNA, 25 bp, Mus musculus
tcagatgtgctagagcagcctctgc

SEQ ID NO: 802249 - DNA, 25 bp, Mus musculus
tcagatgtggagatgctcttgatcc

SEQ ID NO: 802250 - DNA, 25 bp, Mus musculus
tcagatgtggagttgctcttgatcc

SEQ ID NO: 802251 - DNA, 25 bp, Mus musculus
tcagatgtgtgcatccttttagagc

SEQ ID NO: 802252 - DNA, 25 bp, Mus musculus
tcagatgtgtgcttccttttagagc

SEQ ID NO: 802253 - DNA, 25 bp, Mus musculus
tcagatgtttcaatgcctcatgata

SEQ ID NO: 802254 - DNA, 25 bp, Mus musculus
tcagatgtttcattgcctcatgata

SEQ ID NO: 802255 - DNA, 25 bp, Mus musculus
tcagatgtttgccaacttctttcca

SEQ ID NO: 802256 - DNA, 25 bp, Mus musculus
tcagatgtttgcgaacttctttcca

SEQ ID NO: 802257 - DNA, 25 bp, Mus musculus
tcagattacagcaccctactgcttt

SEQ ID NO: 802258 - DNA, 25 bp, Mus musculus
tcagattacagctccctactgcttt

SEQ ID NO: 802259 - DNA, 25 bp, Mus musculus
tcagattatctgctctaatgtaacc

SEQ ID NO: 802260 - DNA, 25 bp, Mus musculus
tcagattatctggtctaatgtaacc

SEQ ID NO: 802261 - DNA, 25 bp, Mus musculus
tcagattattttctttgcaggttcc

SEQ ID NO: 802262 - DNA, 25 bp, Mus musculus
tcagattattttgtttgcaggttcc

SEQ ID NO: 802263 - DNA, 25 bp, Mus musculus
tcagattcacagcagagtaaggata

SEQ ID NO: 802264 - DNA, 25 bp, Mus musculus
tcagattcacaggagagtaaggata

SEQ ID NO: 802265 - DNA, 25 bp, Mus musculus
tcagattcagggatccatgccacaa

SEQ ID NO: 802266 - DNA, 25 bp, Mus musculus
tcagattcagggttccatgccacaa

SEQ ID NO: 802267 - DNA, 25 bp, Mus musculus
tcagattcagttcttccacgacgaa

SEQ ID NO: 802268 - DNA, 25 bp, Mus musculus
tcagattcagttgttccacgacgaa

SEQ ID NO: 802269 - DNA, 25 bp, Mus musculus
tcagattcatccattccatgtgcaa

SEQ ID NO: 802270 - DNA, 25 bp, Mus musculus
tcagattcatcctttccatgtgcaa

SEQ ID NO: 802271 - DNA, 25 bp, Mus musculus
tcagattcctttagcagtgggaggt

SEQ ID NO: 802272 - DNA, 25 bp, Mus musculus
tcagattccttttgcagtgggaggt

SEQ ID NO: 802273 - DNA, 25 bp, Mus musculus
tcagattcgtttacaccattcagtg

SEQ ID NO: 802274 - DNA, 25 bp, Mus musculus
tcagattcgttttcaccattcagtg

SEQ ID NO: 802275 - DNA, 25 bp, Mus musculus
tcagattctagcatgtgccttggca

SEQ ID NO: 802276 - DNA, 25 bp, Mus musculus
tcagattctagcttgtgccttggca

SEQ ID NO: 802277 - DNA, 25 bp, Mus musculus
tcagattctgcaaccattcttttcc

SEQ ID NO: 802278 - DNA, 25 bp, Mus musculus
tcagattctgcatccattcttttcc

SEQ ID NO: 802279 - DNA, 25 bp, Mus musculus
tcagattcttcaatgacccagggcg

SEQ ID NO: 802280 - DNA, 25 bp, Mus musculus
tcagattcttcattgacccagggcg

SEQ ID NO: 802281 - DNA, 25 bp, Mus musculus
tcagattcttgaagccagtttcccc

SEQ ID NO: 802282 - DNA, 25 bp, Mus musculus
tcagattcttgatgccagtttcccc

SEQ ID NO: 802283 - DNA, 25 bp, Mus musculus
tcagattgcccacaggaccatcagc

SEQ ID NO: 802284 - DNA, 25 bp, Mus musculus
tcagattgcccagaggaccatcagc

SEQ ID NO: 802285 - DNA, 25 bp, Mus musculus
tcagattggaagagaccgaagcagg

SEQ ID NO: 802286 - DNA, 25 bp, Mus musculus
tcagattggaagtgaccgaagcagg

SEQ ID NO: 802287 - DNA, 25 bp, Mus musculus
tcagattgggctccgcttcagtaat

SEQ ID NO: 802288 - DNA, 25 bp, Mus musculus
tcagattgggctgcgcttcagtaat

SEQ ID NO: 802289 - DNA, 25 bp, Mus musculus
tcagattggttccttcctttgtgct

SEQ ID NO: 802290 - DNA, 25 bp, Mus musculus
tcagattggttcgttcctttgtgct

SEQ ID NO: 802291 - DNA, 25 bp, Mus musculus
tcagattgtaccaaccccattgttt

SEQ ID NO: 802292 - DNA, 25 bp, Mus musculus
tcagattgtacctaccccattgttt

SEQ ID NO: 802293 - DNA, 25 bp, Mus musculus
tcagattgtcagaattaaacccact

SEQ ID NO: 802294 - DNA, 25 bp, Mus musculus
tcagattgtcagtattaaacccact

SEQ ID NO: 802295 - DNA, 25 bp, Mus musculus
tcagattgtctcagcgttccttccc

SEQ ID NO: 802296 - DNA, 25 bp, Mus musculus
tcagattgtctctgcgttccttccc

SEQ ID NO: 802297 - DNA, 25 bp, Mus musculus
tcagattgtgacagtaagccttaca

SEQ ID NO: 802298 - DNA, 25 bp, Mus musculus
tcagattgtgactgtaagccttaca

SEQ ID NO: 802299 - DNA, 25 bp, Mus musculus
tcagatttacacaggcactgtgccc

SEQ ID NO: 802300 - DNA, 25 bp, Mus musculus
tcagatttacactggcactgtgccc

SEQ ID NO: 802301 - DNA, 25 bp, Mus musculus
tcagatttataaaacttcccctttt

SEQ ID NO: 802302 - DNA, 25 bp, Mus musculus
tcagatttataatacttcccctttt

SEQ ID NO: 802303 - DNA, 25 bp, Mus musculus
tcagatttcaccaagagatctccaa

SEQ ID NO: 802304 - DNA, 25 bp, Mus musculus
tcagatttcacctagagatctccaa

SEQ ID NO: 802305 - DNA, 25 bp, Mus musculus
tcagatttcagtctcgggcagtgga

SEQ ID NO: 802306 - DNA, 25 bp, Mus musculus
tcagatttcagtgtcgggcagtgga

SEQ ID NO: 802307 - DNA, 25 bp, Mus musculus
tcagatttcctgagtaccccggagg

SEQ ID NO: 802308 - DNA, 25 bp, Mus musculus
tcagatttcctgtgtaccccggagg

SEQ ID NO: 802309 - DNA, 25 bp, Mus musculus
tcagatttctatatcacttgggctt

SEQ ID NO: 802310 - DNA, 25 bp, Mus musculus
tcagatttctatttcacttgggctt

SEQ ID NO: 802311 - DNA, 25 bp, Mus musculus
tcagatttctttctacgtatagggt

SEQ ID NO: 802312 - DNA, 25 bp, Mus musculus
tcagatttctttgtacgtatagggt

SEQ ID NO: 802313 - DNA, 25 bp, Mus musculus
tcagatttgttcagaacttatgaac

SEQ ID NO: 802314 - DNA, 25 bp, Mus musculus
tcagatttgttctgaacttatgaac

SEQ ID NO: 802315 - DNA, 25 bp, Mus musculus
tcagattttcatatgttggctttcc

SEQ ID NO: 802316 - DNA, 25 bp, Mus musculus
tcagattttcatttgttggctttcc

SEQ ID NO: 802317 - DNA, 25 bp, Mus musculus
tcagatttttggcacttaactgtac

SEQ ID NO: 802318 - DNA, 25 bp, Mus musculus
tcagatttttgggacttaactgtac

SEQ ID NO: 802319 - DNA, 25 bp, Mus musculus
tcagatttttgtaccatgacccagg

SEQ ID NO: 802320 - DNA, 25 bp, Mus musculus
tcagatttttgttccatgacccagg

SEQ ID NO: 802321 - DNA, 25 bp, Mus musculus
tcagcaaaaccccattctgcaattt

SEQ ID NO: 802322 - DNA, 25 bp, Mus musculus
tcagcaaaacccgattctgcaattt

SEQ ID NO: 802323 - DNA, 25 bp, Mus musculus
tcagcaaaagtcaggagaaaagcct

SEQ ID NO: 802324 - DNA, 25 bp, Mus musculus
tcagcaaaagtctggagaaaagcct

SEQ ID NO: 802325 - DNA, 25 bp, Mus musculus
tcagcaaacagtccatgccatccag

SEQ ID NO: 802326 - DNA, 25 bp, Mus musculus
tcagcaaacagtgcatgccatccag

SEQ ID NO: 802327 - DNA, 25 bp, Mus musculus
tcagcaaactccacgattttctgca

SEQ ID NO: 802328 - DNA, 25 bp, Mus musculus
tcagcaaactcctcgattttctgca

SEQ ID NO: 802329 - DNA, 25 bp, Mus musculus
tcagcaaactttcccaggcctggtc

SEQ ID NO: 802330 - DNA, 25 bp, Mus musculus
tcagcaaactttgccaggcctggtc

SEQ ID NO: 802331 - DNA, 25 bp, Mus musculus
tcagcaaagaagacctcgcccgggc

SEQ ID NO: 802332 - DNA, 25 bp, Mus musculus
tcagcaaagaagtcctcgcccgggc

SEQ ID NO: 802333 - DNA, 25 bp, Mus musculus
tcagcaaaggccagatcatcaacgt

SEQ ID NO: 802334 - DNA, 25 bp, Mus musculus
tcagcaaaggcctgatcatcaacgt

SEQ ID NO: 802335 - DNA, 25 bp, Mus musculus
tcagcaaagtctcgcgagatgaaca

SEQ ID NO: 802336 - DNA, 25 bp, Mus musculus
tcagcaaagtctggcgagatgaaca

SEQ ID NO: 802337 - DNA, 25 bp, Mus musculus
tcagcaacaacgaagtgtcatgtta

SEQ ID NO: 802338 - DNA, 25 bp, Mus musculus
tcagcaacaacgtagtgtcatgtta

SEQ ID NO: 802339 - DNA, 25 bp, Mus musculus
tcagcaacaactcgaacaactcagt

SEQ ID NO: 802340 - DNA, 25 bp, Mus musculus
tcagcaacaactggaacaactcagt

SEQ ID NO: 802341 - DNA, 25 bp, Mus musculus
tcagcaacagacctaaagaaattgg

SEQ ID NO: 802342 - DNA, 25 bp, Mus musculus
tcagcaacagacgtaaagaaattgg

SEQ ID NO: 802343 - DNA, 25 bp, Mus musculus
tcagcaaccacgaacaccttgttta

SEQ ID NO: 802344 - DNA, 25 bp, Mus musculus
tcagcaaccacgtacaccttgttta

SEQ ID NO: 802345 - DNA, 25 bp, Mus musculus
tcagcaaccagcatcgaaaccggta

SEQ ID NO: 802346 - DNA, 25 bp, Mus musculus
tcagcaaccagcttcgaaaccggta

SEQ ID NO: 802347 - DNA, 25 bp, Mus musculus
tcagcaacccttaagctaacacaat

SEQ ID NO: 802348 - DNA, 25 bp, Mus musculus
tcagcaacccttaggagcctttcat

SEQ ID NO: 802349 - DNA, 25 bp, Mus musculus
tcagcaacccttcggcgtacagatg

SEQ ID NO: 802350 - DNA, 25 bp, Mus musculus
tcagcaacccttgggcgtacagatg

SEQ ID NO: 802351 - DNA, 25 bp, Mus musculus
tcagcaaccctttagctaacacaat

SEQ ID NO: 802352 - DNA, 25 bp, Mus musculus
tcagcaaccctttggagcctttcat

SEQ ID NO: 802353 - DNA, 25 bp, Mus musculus
tcagcaacctctctcaagttacagt

SEQ ID NO: 802354 - DNA, 25 bp, Mus musculus
tcagcaacctctgtcaagttacagt

SEQ ID NO: 802355 - DNA, 25 bp, Mus musculus
tcagcaaccttgcagctttgatagt

SEQ ID NO: 802356 - DNA, 25 bp, Mus musculus
tcagcaaccttggagctttgatagt

SEQ ID NO: 802357 - DNA, 25 bp, Mus musculus
tcagcaactcggagatgtacttcag

SEQ ID NO: 802358 - DNA, 25 bp, Mus musculus
tcagcaactcggtgatgtacttcag

SEQ ID NO: 802359 - DNA, 25 bp, Mus musculus
tcagcaagaagaagagagccacaaa

SEQ ID NO: 802360 - DNA, 25 bp, Mus musculus
tcagcaagaagatgagagccacaaa

SEQ ID NO: 802361 - DNA, 25 bp, Mus musculus
tcagcaagacaccagcatcatgagt

SEQ ID NO: 802362 - DNA, 25 bp, Mus musculus
tcagcaagacacgagcatcatgagt

SEQ ID NO: 802363 - DNA, 25 bp, Mus musculus
tcagcaagacctctgtcgtccatca

SEQ ID NO: 802364 - DNA, 25 bp, Mus musculus
tcagcaagacctgtgtcgtccatca

SEQ ID NO: 802365 - DNA, 25 bp, Mus musculus
tcagcaagactgatgttaacctgca

SEQ ID NO: 802366 - DNA, 25 bp, Mus musculus
tcagcaagactgttgttaacctgca

SEQ ID NO: 802367 - DNA, 25 bp, Mus musculus
tcagcaagagtcagtgatgtgttct

SEQ ID NO: 802368 - DNA, 25 bp, Mus musculus
tcagcaagagtctgtgatgtgttct

SEQ ID NO: 802369 - DNA, 25 bp, Mus musculus
tcagcaagagtgatacccgagccag

SEQ ID NO: 802370 - DNA, 25 bp, Mus musculus
tcagcaagagtgttacccgagccag

SEQ ID NO: 802371 - DNA, 25 bp, Mus musculus
tcagcaagcaataagacgccaccct

SEQ ID NO: 802372 - DNA, 25 bp, Mus musculus
tcagcaagcaattagacgccaccct

SEQ ID NO: 802373 - DNA, 25 bp, Mus musculus
tcagcaagccatctccttagggtga

SEQ ID NO: 802374 - DNA, 25 bp, Mus musculus
tcagcaagccatgtccttagggtga

SEQ ID NO: 802375 - DNA, 25 bp, Mus musculus
tcagcaagccttctttctaggaagt

SEQ ID NO: 802376 - DNA, 25 bp, Mus musculus
tcagcaagccttgtttctaggaagt

SEQ ID NO: 802377 - DNA, 25 bp, Mus musculus
tcagcaagcggacagctctgcacat

SEQ ID NO: 802378 - DNA, 25 bp, Mus musculus
tcagcaagcggagagctctgcacat

SEQ ID NO: 802379 - DNA, 25 bp, Mus musculus
tcagcaaggagaccacttccagtaa

SEQ ID NO: 802380 - DNA, 25 bp, Mus musculus
tcagcaaggagagcacttccagtaa

SEQ ID NO: 802381 - DNA, 25 bp, Mus musculus
tcagcaaggccactgttctgtcaat

SEQ ID NO: 802382 - DNA, 25 bp, Mus musculus
tcagcaaggccagtgttctgtcaat

SEQ ID NO: 802383 - DNA, 25 bp, Mus musculus
tcagcaagggccacctcaaggtgca

SEQ ID NO: 802384 - DNA, 25 bp, Mus musculus
tcagcaagggcctcctcaaggtgca

SEQ ID NO: 802385 - DNA, 25 bp, Mus musculus
tcagcaaggtgacttagcaggtaaa

SEQ ID NO: 802386 - DNA, 25 bp, Mus musculus
tcagcaaggtgagttagcaggtaaa

SEQ ID NO: 802387 - DNA, 25 bp, Mus musculus
tcagcaaggttgctgatggtgtcac

SEQ ID NO: 802388 - DNA, 25 bp, Mus musculus
tcagcaaggttggtgatggtgtcac

SEQ ID NO: 802389 - DNA, 25 bp, Mus musculus
tcagcaagtagtcgcctcttggagg

SEQ ID NO: 802390 - DNA, 25 bp, Mus musculus
tcagcaagtagtggcctcttggagg

SEQ ID NO: 802391 - DNA, 25 bp, Mus musculus
tcagcaagtcccagatatgcagata

SEQ ID NO: 802392 - DNA, 25 bp, Mus musculus
tcagcaagtccctgatatgcagata

SEQ ID NO: 802393 - DNA, 25 bp, Mus musculus
tcagcaataatgaaagtcctccttt

SEQ ID NO: 802394 - DNA, 25 bp, Mus musculus
tcagcaataatgtaagtcctccttt

SEQ ID NO: 802395 - DNA, 25 bp, Mus musculus
tcagcaatcatacaacctcaagaca

SEQ ID NO: 802396 - DNA, 25 bp, Mus musculus
tcagcaatcatagaacctcaagaca

SEQ ID NO: 802397 - DNA, 25 bp, Mus musculus
tcagcaatcttcagtctcccgagaa

SEQ ID NO: 802398 - DNA, 25 bp, Mus musculus
tcagcaatcttctgtctcccgagaa

SEQ ID NO: 802399 - DNA, 25 bp, Mus musculus
tcagcaatgttgacggctccgtgtg

SEQ ID NO: 802400 - DNA, 25 bp, Mus musculus
tcagcaatgttgtcggctccgtgtg

SEQ ID NO: 802401 - DNA, 25 bp, Mus musculus
tcagcaattactacttgtgaaaatt

SEQ ID NO: 802402 - DNA, 25 bp, Mus musculus
tcagcaattacttcttgtgaaaatt

SEQ ID NO: 802403 - DNA, 25 bp, Mus musculus
tcagcaattgctcagccagtcattg

SEQ ID NO: 802404 - DNA, 25 bp, Mus musculus
tcagcaattgctgagccagtcattg

SEQ ID NO: 802405 - DNA, 25 bp, Mus musculus
tcagcaatttagacttaccatggag

SEQ ID NO: 802406 - DNA, 25 bp, Mus musculus
tcagcaatttagtcttaccatggag

SEQ ID NO: 802407 - DNA, 25 bp, Mus musculus
tcagcaattttaatcacaggtcagc

SEQ ID NO: 802408 - DNA, 25 bp, Mus musculus
tcagcaattttattcacaggtcagc

SEQ ID NO: 802409 - DNA, 25 bp, Mus musculus
tcagcacaaaatactttgggatgtt

SEQ ID NO: 802410 - DNA, 25 bp, Mus musculus
tcagcacaaaattctttgggatgtt

SEQ ID NO: 802411 - DNA, 25 bp, Mus musculus
tcagcacaaaccaagcacccagaag

SEQ ID NO: 802412 - DNA, 25 bp, Mus musculus
tcagcacaaacctagcacccagaag

SEQ ID NO: 802413 - DNA, 25 bp, Mus musculus
tcagcacacaacctggaagggtggt

SEQ ID NO: 802414 - DNA, 25 bp, Mus musculus
tcagcacacaacgtggaagggtggt

SEQ ID NO: 802415 - DNA, 25 bp, Mus musculus
tcagcacacgtccatttgtcattgg

SEQ ID NO: 802416 - DNA, 25 bp, Mus musculus
tcagcacacgtcgatttgtcattgg

SEQ ID NO: 802417 - DNA, 25 bp, Mus musculus
tcagcacactgaccaggaagccagc

SEQ ID NO: 802418 - DNA, 25 bp, Mus musculus
tcagcacactgagcaggaagccagc

SEQ ID NO: 802419 - DNA, 25 bp, Mus musculus
tcagcacactgtagattagacggaa

SEQ ID NO: 802420 - DNA, 25 bp, Mus musculus
tcagcacactgttgattagacggaa

SEQ ID NO: 802421 - DNA, 25 bp, Mus musculus
tcagcacaggaaaaggtgtgccttt

SEQ ID NO: 802422 - DNA, 25 bp, Mus musculus
tcagcacaggaataggtgtgccttt

SEQ ID NO: 802423 - DNA, 25 bp, Mus musculus
tcagcacagggactcctggccagga

SEQ ID NO: 802424 - DNA, 25 bp, Mus musculus
tcagcacagggagtcctggccagga

SEQ ID NO: 802425 - DNA, 25 bp, Mus musculus
tcagcacagtgcaaaagttctttaa

SEQ ID NO: 802426 - DNA, 25 bp, Mus musculus
tcagcacagtgccaaagttctttaa

SEQ ID NO: 802427 - DNA, 25 bp, Mus musculus
tcagcacagtgcgaaagttctttaa

SEQ ID NO: 802428 - DNA, 25 bp, Mus musculus
tcagcacagtgctaaagttctttaa

SEQ ID NO: 802429 - DNA, 25 bp, Mus musculus
tcagcacagtgtcttggccaggaat

SEQ ID NO: 802430 - DNA, 25 bp, Mus musculus
tcagcacagtgtgttggccaggaat

SEQ ID NO: 802431 - DNA, 25 bp, Mus musculus
tcagcacatcccagggcttgccatg

SEQ ID NO: 802432 - DNA, 25 bp, Mus musculus
tcagcacatccctgggcttgccatg

SEQ ID NO: 802433 - DNA, 25 bp, Mus musculus
tcagcacattagcagggtttatttt

SEQ ID NO: 802434 - DNA, 25 bp, Mus musculus
tcagcacattaggagggtttatttt

SEQ ID NO: 802435 - DNA, 25 bp, Mus musculus
tcagcacattttagggatctttctt

SEQ ID NO: 802436 - DNA, 25 bp, Mus musculus
tcagcacatttttgggatctttctt

SEQ ID NO: 802437 - DNA, 25 bp, Mus musculus
tcagcaccaaacacgtgaacagcaa

SEQ ID NO: 802438 - DNA, 25 bp, Mus musculus
tcagcaccaaactcgtgaacagcaa

SEQ ID NO: 802439 - DNA, 25 bp, Mus musculus
tcagcaccacccagaaattgtttaa

SEQ ID NO: 802440 - DNA, 25 bp, Mus musculus
tcagcaccaccctgaaattgtttaa

SEQ ID NO: 802441 - DNA, 25 bp, Mus musculus
tcagcaccacttcacgaaggcattt

SEQ ID NO: 802442 - DNA, 25 bp, Mus musculus
tcagcaccacttgacgaaggcattt

SEQ ID NO: 802443 - DNA, 25 bp, Mus musculus
tcagcaccagcaactgtccagatgt

SEQ ID NO: 802444 - DNA, 25 bp, Mus musculus
tcagcaccagcatctgtccagatgt

SEQ ID NO: 802445 - DNA, 25 bp, Mus musculus
tcagcaccaggcctgtataacgtgg

SEQ ID NO: 802446 - DNA, 25 bp, Mus musculus
tcagcaccaggcgtgtataacgtgg

SEQ ID NO: 802447 - DNA, 25 bp, Mus musculus
tcagcaccatatctgcttacatgcc

SEQ ID NO: 802448 - DNA, 25 bp, Mus musculus
tcagcaccatatgtgcttacatgcc

SEQ ID NO: 802449 - DNA, 25 bp, Mus musculus
tcagcaccctgaagaagagaaagtt

SEQ ID NO: 802450 - DNA, 25 bp, Mus musculus
tcagcaccctgatgaagagaaagtt

SEQ ID NO: 802451 - DNA, 25 bp, Mus musculus
tcagcacccttgattctttatggaa

SEQ ID NO: 802452 - DNA, 25 bp, Mus musculus
tcagcacccttgtttctttatggaa

SEQ ID NO: 802453 - DNA, 25 bp, Mus musculus
tcagcaccggtgacctaaggttaag

SEQ ID NO: 802454 - DNA, 25 bp, Mus musculus
tcagcaccggtgtcctaaggttaag

SEQ ID NO: 802455 - DNA, 25 bp, Mus musculus
tcagcacctccacccgaatgaacct

SEQ ID NO: 802456 - DNA, 25 bp, Mus musculus
tcagcacctccagccgaatgaacct

SEQ ID NO: 802457 - DNA, 25 bp, Mus musculus
tcagcaccttgacgaatatccacag

SEQ ID NO: 802458 - DNA, 25 bp, Mus musculus
tcagcaccttgaggaatatccacag

SEQ ID NO: 802459 - DNA, 25 bp, Mus musculus
tcagcaccttgccacagtagccttg

SEQ ID NO: 802460 - DNA, 25 bp, Mus musculus
tcagcaccttgcgacagtagccttg

SEQ ID NO: 802461 - DNA, 25 bp, Mus musculus
tcagcacgaaagcacgcataccgga

SEQ ID NO: 802462 - DNA, 25 bp, Mus musculus
tcagcacgaaaggacgcataccgga

SEQ ID NO: 802463 - DNA, 25 bp, Mus musculus
tcagcacgccacaccgtgcagcaca

SEQ ID NO: 802464 - DNA, 25 bp, Mus musculus
tcagcacgccactccgtgcagcaca

SEQ ID NO: 802465 - DNA, 25 bp, Mus musculus
tcagcacggccacatgttgtcatga

SEQ ID NO: 802466 - DNA, 25 bp, Mus musculus
tcagcacggccagatgttgtcatga

SEQ ID NO: 802467 - DNA, 25 bp, Mus musculus
tcagcacgggttcggttgcacttcc

SEQ ID NO: 802468 - DNA, 25 bp, Mus musculus
tcagcacgggttgggttgcacttcc

SEQ ID NO: 802469 - DNA, 25 bp, Mus musculus
tcagcacgtgttcctcactagaaga

SEQ ID NO: 802470 - DNA, 25 bp, Mus musculus
tcagcacgtgttgctcactagaaga

SEQ ID NO: 802471 - DNA, 25 bp, Mus musculus
tcagcactaaggcatttcgcacagt

SEQ ID NO: 802472 - DNA, 25 bp, Mus musculus
tcagcactaagggatttcgcacagt

SEQ ID NO: 802473 - DNA, 25 bp, Mus musculus
tcagcactaggacctacgaaagggt

SEQ ID NO: 802474 - DNA, 25 bp, Mus musculus
tcagcactaggagctacgaaagggt

SEQ ID NO: 802475 - DNA, 25 bp, Mus musculus
tcagcactagggagtcagagacaaa

SEQ ID NO: 802476 - DNA, 25 bp, Mus musculus
tcagcactagggtgtcagagacaaa

SEQ ID NO: 802477 - DNA, 25 bp, Mus musculus
tcagcactaggtctatggaacccat

SEQ ID NO: 802478 - DNA, 25 bp, Mus musculus
tcagcactaggtgtatggaacccat

SEQ ID NO: 802479 - DNA, 25 bp, Mus musculus
tcagcactcaaacaagcgttggcag

SEQ ID NO: 802480 - DNA, 25 bp, Mus musculus
tcagcactcaaagaagcgttggcag

SEQ ID NO: 802481 - DNA, 25 bp, Mus musculus
tcagcactccgacgcctgtgtgaag

SEQ ID NO: 802482 - DNA, 25 bp, Mus musculus
tcagcactccgaggcctgtgtgaag

SEQ ID NO: 802483 - DNA, 25 bp, Mus musculus
tcagcactgaagacactcggcgacc

SEQ ID NO: 802484 - DNA, 25 bp, Mus musculus
tcagcactgaagtcactcggcgacc

SEQ ID NO: 802485 - DNA, 25 bp, Mus musculus
tcagcactgaatagagcaagcatag

SEQ ID NO: 802486 - DNA, 25 bp, Mus musculus
tcagcactgaattgagcaagcatag

SEQ ID NO: 802487 - DNA, 25 bp, Mus musculus
tcagcactgactatgcctgcatcgc

SEQ ID NO: 802488 - DNA, 25 bp, Mus musculus
tcagcactgactttgcctgcatcgc

SEQ ID NO: 802489 - DNA, 25 bp, Mus musculus
tcagcactgatgacactcatttaga

SEQ ID NO: 802490 - DNA, 25 bp, Mus musculus
tcagcactgatgtcactcatttaga

SEQ ID NO: 802491 - DNA, 25 bp, Mus musculus
tcagcactgtacctctgtgccagca

SEQ ID NO: 802492 - DNA, 25 bp, Mus musculus
tcagcactgtacgtctgtgccagca

SEQ ID NO: 802493 - DNA, 25 bp, Mus musculus
tcagcactgtccagcacaggtggac

SEQ ID NO: 802494 - DNA, 25 bp, Mus musculus
tcagcactgtcctgcacaggtggac

SEQ ID NO: 802495 - DNA, 25 bp, Mus musculus
tcagcactgtgcatgcatggactct

SEQ ID NO: 802496 - DNA, 25 bp, Mus musculus
tcagcactgtgcttgcatggactct

SEQ ID NO: 802497 - DNA, 25 bp, Mus musculus
tcagcactgtttctattgaaacaaa

SEQ ID NO: 802498 - DNA, 25 bp, Mus musculus
tcagcactgtttgtattgaaacaaa

SEQ ID NO: 802499 - DNA, 25 bp, Mus musculus
tcagcacttaccacacagtctttta

SEQ ID NO: 802500 - DNA, 25 bp, Mus musculus
tcagcacttaccattgtaatagctt

SEQ ID NO: 802501 - DNA, 25 bp, Mus musculus
tcagcacttacctcacagtctttta

SEQ ID NO: 802502 - DNA, 25 bp, Mus musculus
tcagcacttacctttgtaatagctt

SEQ ID NO: 802503 - DNA, 25 bp, Mus musculus
tcagcacttacgaacagtaacctag

SEQ ID NO: 802504 - DNA, 25 bp, Mus musculus
tcagcacttacgtacagtaacctag

SEQ ID NO: 802505 - DNA, 25 bp, Mus musculus
tcagcacttcatccactacttagat

SEQ ID NO: 802506 - DNA, 25 bp, Mus musculus
tcagcacttcatgcactacttagat

SEQ ID NO: 802507 - DNA, 25 bp, Mus musculus
tcagcacttccaaaccaagccagag

SEQ ID NO: 802508 - DNA, 25 bp, Mus musculus
tcagcacttccataccaagccagag

SEQ ID NO: 802509 - DNA, 25 bp, Mus musculus
tcagcacttcttacgtctcttgaat

SEQ ID NO: 802510 - DNA, 25 bp, Mus musculus
tcagcacttctttcgtctcttgaat

SEQ ID NO: 802511 - DNA, 25 bp, Mus musculus
tcagcacttgcaagggaacctacag

SEQ ID NO: 802512 - DNA, 25 bp, Mus musculus
tcagcacttgcatgggaacctacag

SEQ ID NO: 802513 - DNA, 25 bp, Mus musculus
tcagcacttgttcctcgtgacggtg

SEQ ID NO: 802514 - DNA, 25 bp, Mus musculus
tcagcacttgttgctcgtgacggtg

SEQ ID NO: 802515 - DNA, 25 bp, Mus musculus
tcagcactttctaccgagaactgga

SEQ ID NO: 802516 - DNA, 25 bp, Mus musculus
tcagcactttcttccgagaactgga

SEQ ID NO: 802517 - DNA, 25 bp, Mus musculus
tcagcactttgccttcaactccatg

SEQ ID NO: 802518 - DNA, 25 bp, Mus musculus
tcagcactttgcgttcaactccatg

SEQ ID NO: 802519 - DNA, 25 bp, Mus musculus
tcagcagacatacaggactacggtt

SEQ ID NO: 802520 - DNA, 25 bp, Mus musculus
tcagcagacatagaggactacggtt

SEQ ID NO: 802521 - DNA, 25 bp, Mus musculus
tcagcagactaacctctggaggatc

SEQ ID NO: 802522 - DNA, 25 bp, Mus musculus
tcagcagactaagctctggaggatc

SEQ ID NO: 802523 - DNA, 25 bp, Mus musculus
tcagcagactgtcatgcctctcaga

SEQ ID NO: 802524 - DNA, 25 bp, Mus musculus
tcagcagactgtgatgcctctcaga

SEQ ID NO: 802525 - DNA, 25 bp, Mus musculus
tcagcagagacgctgtatcaaaaag

SEQ ID NO: 802526 - DNA, 25 bp, Mus musculus
tcagcagagacggtgtatcaaaaag

SEQ ID NO: 802527 - DNA, 25 bp, Mus musculus
tcagcagagcttctactgttcacct

SEQ ID NO: 802528 - DNA, 25 bp, Mus musculus
tcagcagagcttgtactgttcacct

SEQ ID NO: 802529 - DNA, 25 bp, Mus musculus
tcagcagaggaacctcaatccactt

SEQ ID NO: 802530 - DNA, 25 bp, Mus musculus
tcagcagaggaagctcaatccactt

SEQ ID NO: 802531 - DNA, 25 bp, Mus musculus
tcagcagagtggaagcaaaccgctc

SEQ ID NO: 802532 - DNA, 25 bp, Mus musculus
tcagcagagtggtagcaaaccgctc

SEQ ID NO: 802533 - DNA, 25 bp, Mus musculus
tcagcagagttgctgtccaggtcca

SEQ ID NO: 802534 - DNA, 25 bp, Mus musculus
tcagcagagttggtgtccaggtcca

SEQ ID NO: 802535 - DNA, 25 bp, Mus musculus
tcagcagatattcagcttgagcagt

SEQ ID NO: 802536 - DNA, 25 bp, Mus musculus
tcagcagatattgagcttgagcagt

SEQ ID NO: 802537 - DNA, 25 bp, Mus musculus
tcagcagatctcaggcagactacaa

SEQ ID NO: 802538 - DNA, 25 bp, Mus musculus
tcagcagatctctggcagactacaa

SEQ ID NO: 802539 - DNA, 25 bp, Mus musculus
tcagcagatgatacgcatgcagata

SEQ ID NO: 802540 - DNA, 25 bp, Mus musculus
tcagcagatgattcgcatgcagata

SEQ ID NO: 802541 - DNA, 25 bp, Mus musculus
tcagcagatgctacatggtcttcag

SEQ ID NO: 802542 - DNA, 25 bp, Mus musculus
tcagcagatgcttcatggtcttcag

SEQ ID NO: 802543 - DNA, 25 bp, Mus musculus
tcagcagattccagagcttgcacaa

SEQ ID NO: 802544 - DNA, 25 bp, Mus musculus
tcagcagattcctgagcttgcacaa

SEQ ID NO: 802545 - DNA, 25 bp, Mus musculus
tcagcagcaagcactcagaggccaa

SEQ ID NO: 802546 - DNA, 25 bp, Mus musculus
tcagcagcaagctctcagaggccaa

SEQ ID NO: 802547 - DNA, 25 bp, Mus musculus
tcagcagcacggcacatttcagaca

SEQ ID NO: 802548 - DNA, 25 bp, Mus musculus
tcagcagcacgggacatttcagaca

SEQ ID NO: 802549 - DNA, 25 bp, Mus musculus
tcagcagcagacactctgtacagtt

SEQ ID NO: 802550 - DNA, 25 bp, Mus musculus
tcagcagcagactctctgtacagtt

SEQ ID NO: 802551 - DNA, 25 bp, Mus musculus
tcagcagcagagcacgtgcccaatg

SEQ ID NO: 802552 - DNA, 25 bp, Mus musculus
tcagcagcagagctaagtggaactt

SEQ ID NO: 802553 - DNA, 25 bp, Mus musculus
tcagcagcagaggacgtgcccaatg

SEQ ID NO: 802554 - DNA, 25 bp, Mus musculus
tcagcagcagaggtaagtggaactt

SEQ ID NO: 802555 - DNA, 25 bp, Mus musculus
tcagcagcagccaactctagggatt

SEQ ID NO: 802556 - DNA, 25 bp, Mus musculus
tcagcagcagccagatcctgagcca

SEQ ID NO: 802557 - DNA, 25 bp, Mus musculus
tcagcagcagcctactctagggatt

SEQ ID NO: 802558 - DNA, 25 bp, Mus musculus
tcagcagcagcctgatcctgagcca

SEQ ID NO: 802559 - DNA, 25 bp, Mus musculus
tcagcagcagtcagtcagcagtgca

SEQ ID NO: 802560 - DNA, 25 bp, Mus musculus
tcagcagcagtctgtcagcagtgca

SEQ ID NO: 802561 - DNA, 25 bp, Mus musculus
tcagcagcatgcactgttgagcttt

SEQ ID NO: 802562 - DNA, 25 bp, Mus musculus
tcagcagcatgctctgttgagcttt

SEQ ID NO: 802563 - DNA, 25 bp, Mus musculus
tcagcagcattgaggctcctgggag

SEQ ID NO: 802564 - DNA, 25 bp, Mus musculus
tcagcagcattgtggctcctgggag

SEQ ID NO: 802565 - DNA, 25 bp, Mus musculus
tcagcagccaggattcgggctgcca

SEQ ID NO: 802566 - DNA, 25 bp, Mus musculus
tcagcagccaggtttcgggctgcca

SEQ ID NO: 802567 - DNA, 25 bp, Mus musculus
tcagcagccagtcctaagttcatgc

SEQ ID NO: 802568 - DNA, 25 bp, Mus musculus
tcagcagccagtgctaagttcatgc

SEQ ID NO: 802569 - DNA, 25 bp, Mus musculus
tcagcagccccaactggagttcaca

SEQ ID NO: 802570 - DNA, 25 bp, Mus musculus
tcagcagccccatctggagttcaca

SEQ ID NO: 802571 - DNA, 25 bp, Mus musculus
tcagcagcctaacctctgtggtggg

SEQ ID NO: 802572 - DNA, 25 bp, Mus musculus
tcagcagcctaagctctgtggtggg

SEQ ID NO: 802573 - DNA, 25 bp, Mus musculus
tcagcagcctgcataagaaggactc

SEQ ID NO: 802574 - DNA, 25 bp, Mus musculus
tcagcagcctgcttaagaaggactc

SEQ ID NO: 802575 - DNA, 25 bp, Mus musculus
tcagcagcctggagcgctagctata

SEQ ID NO: 802576 - DNA, 25 bp, Mus musculus
tcagcagcctggtgcgctagctata

SEQ ID NO: 802577 - DNA, 25 bp, Mus musculus
tcagcagcctgtcggccgaagccag

SEQ ID NO: 802578 - DNA, 25 bp, Mus musculus
tcagcagcctgtgggccgaagccag

SEQ ID NO: 802579 - DNA, 25 bp, Mus musculus
tcagcagcctttctaccattatttc

SEQ ID NO: 802580 - DNA, 25 bp, Mus musculus
tcagcagcctttgtaccattatttc

SEQ ID NO: 802581 - DNA, 25 bp, Mus musculus
tcagcagcgaaaccttccacgagga

SEQ ID NO: 802582 - DNA, 25 bp, Mus musculus
tcagcagcgaaagcttccacgagga

SEQ ID NO: 802583 - DNA, 25 bp, Mus musculus
tcagcagcgagaagccgcagaccaa

SEQ ID NO: 802584 - DNA, 25 bp, Mus musculus
tcagcagcgagatgccgcagaccaa

SEQ ID NO: 802585 - DNA, 25 bp, Mus musculus
tcagcagcgcaacaagtcccagagg

SEQ ID NO: 802586 - DNA, 25 bp, Mus musculus
tcagcagcgcaagaagtcccagagg

SEQ ID NO: 802587 - DNA, 25 bp, Mus musculus
tcagcagcgccgcatgcgagagaaa

SEQ ID NO: 802588 - DNA, 25 bp, Mus musculus
tcagcagcgccggatgcgagagaaa

SEQ ID NO: 802589 - DNA, 25 bp, Mus musculus
tcagcagcggctaaggacatgagct

SEQ ID NO: 802590 - DNA, 25 bp, Mus musculus
tcagcagcggcttaggacatgagct

SEQ ID NO: 802591 - DNA, 25 bp, Mus musculus
tcagcagcgtcaacacagtggccaa

SEQ ID NO: 802592 - DNA, 25 bp, Mus musculus
tcagcagcgtcatcacagtggccaa

SEQ ID NO: 802593 - DNA, 25 bp, Mus musculus
tcagcagctagaacaggcaggcgcg

SEQ ID NO: 802594 - DNA, 25 bp, Mus musculus
tcagcagctagatcaggcaggcgcg

SEQ ID NO: 802595 - DNA, 25 bp, Mus musculus
tcagcagctaggaggacatcatcca

SEQ ID NO: 802596 - DNA, 25 bp, Mus musculus
tcagcagctaggtggacatcatcca

SEQ ID NO: 802597 - DNA, 25 bp, Mus musculus
tcagcagctcctctgttggatataa

SEQ ID NO: 802598 - DNA, 25 bp, Mus musculus
tcagcagctcctcttaccaagtttg

SEQ ID NO: 802599 - DNA, 25 bp, Mus musculus
tcagcagctcctgtgttggatataa

SEQ ID NO: 802600 - DNA, 25 bp, Mus musculus
tcagcagctcctgttaccaagtttg

SEQ ID NO: 802601 - DNA, 25 bp, Mus musculus
tcagcagctgagaggagactcgtct

SEQ ID NO: 802602 - DNA, 25 bp, Mus musculus
tcagcagctgagtggagactcgtct

SEQ ID NO: 802603 - DNA, 25 bp, Mus musculus
tcagcagctgctaagatttgcacaa

SEQ ID NO: 802604 - DNA, 25 bp, Mus musculus
tcagcagctgcttagatttgcacaa

SEQ ID NO: 802605 - DNA, 25 bp, Mus musculus
tcagcaggaagaagacgacttacag

SEQ ID NO: 802606 - DNA, 25 bp, Mus musculus
tcagcaggaagacaccacctcagct

SEQ ID NO: 802607 - DNA, 25 bp, Mus musculus
tcagcaggaagagaccacctcagct

SEQ ID NO: 802608 - DNA, 25 bp, Mus musculus
tcagcaggaagatgacgacttacag

SEQ ID NO: 802609 - DNA, 25 bp, Mus musculus
tcagcaggaccactgtgtgttcagt

SEQ ID NO: 802610 - DNA, 25 bp, Mus musculus
tcagcaggaccagtgtgtgttcagt

SEQ ID NO: 802611 - DNA, 25 bp, Mus musculus
tcagcaggcacaagttaaacagcat

SEQ ID NO: 802612 - DNA, 25 bp, Mus musculus
tcagcaggcacatgttaaacagcat

SEQ ID NO: 802613 - DNA, 25 bp, Mus musculus
tcagcaggccatcagagccgccaga

SEQ ID NO: 802614 - DNA, 25 bp, Mus musculus
tcagcaggccatgagagccgccaga

SEQ ID NO: 802615 - DNA, 25 bp, Mus musculus
tcagcaggccggcatgtatcattac

SEQ ID NO: 802616 - DNA, 25 bp, Mus musculus
tcagcaggccgggatgtatcattac

SEQ ID NO: 802617 - DNA, 25 bp, Mus musculus
tcagcaggcggcaactacttttgaa

SEQ ID NO: 802618 - DNA, 25 bp, Mus musculus
tcagcaggcggctactacttttgaa

SEQ ID NO: 802619 - DNA, 25 bp, Mus musculus
tcagcaggctgcacccggtgcagaa

SEQ ID NO: 802620 - DNA, 25 bp, Mus musculus
tcagcaggctgctcccggtgcagaa

SEQ ID NO: 802621 - DNA, 25 bp, Mus musculus
tcagcagggcccacgaaaggaaact

SEQ ID NO: 802622 - DNA, 25 bp, Mus musculus
tcagcagggccctcgaaaggaaact

SEQ ID NO: 802623 - DNA, 25 bp, Mus musculus
tcagcagggcctcaatttttagtta

SEQ ID NO: 802624 - DNA, 25 bp, Mus musculus
tcagcagggcctgaatttttagtta

SEQ ID NO: 802625 - DNA, 25 bp, Mus musculus
tcagcagggtctcgtctcaggcacg

SEQ ID NO: 802626 - DNA, 25 bp, Mus musculus
tcagcagggtctggtctcaggcacg

SEQ ID NO: 802627 - DNA, 25 bp, Mus musculus
tcagcaggtgagatattttggtaat

SEQ ID NO: 802628 - DNA, 25 bp, Mus musculus
tcagcaggtgagttattttggtaat

SEQ ID NO: 802629 - DNA, 25 bp, Mus musculus
tcagcaggttaacctggcactggcc

SEQ ID NO: 802630 - DNA, 25 bp, Mus musculus
tcagcaggttaagctggcactggcc

SEQ ID NO: 802631 - DNA, 25 bp, Mus musculus
tcagcaggttccctgtagatgaaac

SEQ ID NO: 802632 - DNA, 25 bp, Mus musculus
tcagcaggttccgtgtagatgaaac

SEQ ID NO: 802633 - DNA, 25 bp, Mus musculus
tcagcaggttctaggttctctcaga

SEQ ID NO: 802634 - DNA, 25 bp, Mus musculus
tcagcaggttcttggttctctcaga

SEQ ID NO: 802635 - DNA, 25 bp, Mus musculus
tcagcagtctgaccaggtacatctt

SEQ ID NO: 802636 - DNA, 25 bp, Mus musculus
tcagcagtctgagcaggtacatctt

SEQ ID NO: 802637 - DNA, 25 bp, Mus musculus
tcagcagtctggctagggttatcaa

SEQ ID NO: 802638 - DNA, 25 bp, Mus musculus
tcagcagtctgggtagggttatcaa

SEQ ID NO: 802639 - DNA, 25 bp, Mus musculus
tcagcagtgagcatggtgtcccttt

SEQ ID NO: 802640 - DNA, 25 bp, Mus musculus
tcagcagtgagcttggtgtcccttt

SEQ ID NO: 802641 - DNA, 25 bp, Mus musculus
tcagcagtgattacttcgcttcagt

SEQ ID NO: 802642 - DNA, 25 bp, Mus musculus
tcagcagtgatttcttcgcttcagt

SEQ ID NO: 802643 - DNA, 25 bp, Mus musculus
tcagcagtgctccagttgctgggct

SEQ ID NO: 802644 - DNA, 25 bp, Mus musculus
tcagcagtgctcgagttgctgggct

SEQ ID NO: 802645 - DNA, 25 bp, Mus musculus
tcagcagtggctcgcttggccgact

SEQ ID NO: 802646 - DNA, 25 bp, Mus musculus
tcagcagtggctggcttggccgact

SEQ ID NO: 802647 - DNA, 25 bp, Mus musculus
tcagcagtgtctaccatggagccaa

SEQ ID NO: 802648 - DNA, 25 bp, Mus musculus
tcagcagtgtcttccatggagccaa

SEQ ID NO: 802649 - DNA, 25 bp, Mus musculus
tcagcagtgtttagtatgtcttcct

SEQ ID NO: 802650 - DNA, 25 bp, Mus musculus
tcagcagtgttttgtatgtcttcct

SEQ ID NO: 802651 - DNA, 25 bp, Mus musculus
tcagcagttaacctctttagaaact

SEQ ID NO: 802652 - DNA, 25 bp, Mus musculus
tcagcagttaacgtctttagaaact

SEQ ID NO: 802653 - DNA, 25 bp, Mus musculus
tcagcagttcacatgaatcagcggc

SEQ ID NO: 802654 - DNA, 25 bp, Mus musculus
tcagcagttcacttgaatcagcggc

SEQ ID NO: 802655 - DNA, 25 bp, Mus musculus
tcagcagttgatcggtggtttctgt

SEQ ID NO: 802656 - DNA, 25 bp, Mus musculus
tcagcagttgatgggtggtttctgt

SEQ ID NO: 802657 - DNA, 25 bp, Mus musculus
tcagcagttggaagttcttgcctct

SEQ ID NO: 802658 - DNA, 25 bp, Mus musculus
tcagcagttggatgttcttgcctct

SEQ ID NO: 802659 - DNA, 25 bp, Mus musculus
tcagcagttggtactggtatatggt

SEQ ID NO: 802660 - DNA, 25 bp, Mus musculus
tcagcagttggttctggtatatggt

SEQ ID NO: 802661 - DNA, 25 bp, Mus musculus
tcagcagttgttattacatcccttg

SEQ ID NO: 802662 - DNA, 25 bp, Mus musculus
tcagcagttgtttttacatcccttg

SEQ ID NO: 802663 - DNA, 25 bp, Mus musculus
tcagcataaactaatcccattgtat

SEQ ID NO: 802664 - DNA, 25 bp, Mus musculus
tcagcataaacttatcccattgtat

SEQ ID NO: 802665 - DNA, 25 bp, Mus musculus
tcagcataagtccaaccgcaagctc

SEQ ID NO: 802666 - DNA, 25 bp, Mus musculus
tcagcataagtcgaaccgcaagctc

SEQ ID NO: 802667 - DNA, 25 bp, Mus musculus
tcagcatacaggacagagccaactt

SEQ ID NO: 802668 - DNA, 25 bp, Mus musculus
tcagcatacaggtcagagccaactt

SEQ ID NO: 802669 - DNA, 25 bp, Mus musculus
tcagcatagatgcagcttggcatgt

SEQ ID NO: 802670 - DNA, 25 bp, Mus musculus
tcagcatagatggagcttggcatgt

SEQ ID NO: 802671 - DNA, 25 bp, Mus musculus
tcagcatagctgatgtaaacgtgtt

SEQ ID NO: 802672 - DNA, 25 bp, Mus musculus
tcagcatagctgttgtaaacgtgtt

SEQ ID NO: 802673 - DNA, 25 bp, Mus musculus
tcagcatatactaagggttctctcc

SEQ ID NO: 802674 - DNA, 25 bp, Mus musculus
tcagcatatacttagggttctctcc

SEQ ID NO: 802675 - DNA, 25 bp, Mus musculus
tcagcatatctgaactttttcttct

SEQ ID NO: 802676 - DNA, 25 bp, Mus musculus
tcagcatatctgtactttttcttct

SEQ ID NO: 802677 - DNA, 25 bp, Mus musculus
tcagcatcacaaacggcatcactac

SEQ ID NO: 802678 - DNA, 25 bp, Mus musculus
tcagcatcacaatcggcatcactac

SEQ ID NO: 802679 - DNA, 25 bp, Mus musculus
tcagcatcactgagtttgcgaccaa

SEQ ID NO: 802680 - DNA, 25 bp, Mus musculus
tcagcatcactgtgtttgcgaccaa

SEQ ID NO: 802681 - DNA, 25 bp, Mus musculus
tcagcatcagaactaaacccttcac

SEQ ID NO: 802682 - DNA, 25 bp, Mus musculus
tcagcatcagaagtaaacccttcac

SEQ ID NO: 802683 - DNA, 25 bp, Mus musculus
tcagcatcagccagctcagcatcag

SEQ ID NO: 802684 - DNA, 25 bp, Mus musculus
tcagcatcagccagttggatttaag

SEQ ID NO: 802685 - DNA, 25 bp, Mus musculus
tcagcatcagccatttgttattggt

SEQ ID NO: 802686 - DNA, 25 bp, Mus musculus
tcagcatcagcctgctcagcatcag

SEQ ID NO: 802687 - DNA, 25 bp, Mus musculus
tcagcatcagcctgttggatttaag

SEQ ID NO: 802688 - DNA, 25 bp, Mus musculus
tcagcatcagccttttgttattggt

SEQ ID NO: 802689 - DNA, 25 bp, Mus musculus
tcagcatcaggtcacttttctgcta

SEQ ID NO: 802690 - DNA, 25 bp, Mus musculus
tcagcatcaggtgacttttctgcta

SEQ ID NO: 802691 - DNA, 25 bp, Mus musculus
tcagcatccaacaaaggcttcagat

SEQ ID NO: 802692 - DNA, 25 bp, Mus musculus
tcagcatccaactaaggcttcagat

SEQ ID NO: 802693 - DNA, 25 bp, Mus musculus
tcagcatccatgctactttggagta

SEQ ID NO: 802694 - DNA, 25 bp, Mus musculus
tcagcatccatggtactttggagta

SEQ ID NO: 802695 - DNA, 25 bp, Mus musculus
tcagcatcccacattgataaccact

SEQ ID NO: 802696 - DNA, 25 bp, Mus musculus
tcagcatcccactttgataaccact

SEQ ID NO: 802697 - DNA, 25 bp, Mus musculus
tcagcatccctaagagtccagcagc

SEQ ID NO: 802698 - DNA, 25 bp, Mus musculus
tcagcatccctatgagtccagcagc

SEQ ID NO: 802699 - DNA, 25 bp, Mus musculus
tcagcatcgatgagcgcaggcggct

SEQ ID NO: 802700 - DNA, 25 bp, Mus musculus
tcagcatcgatgtgcgcaggcggct

SEQ ID NO: 802701 - DNA, 25 bp, Mus musculus
tcagcatcggatcccgggacggcaa

SEQ ID NO: 802702 - DNA, 25 bp, Mus musculus
tcagcatcggatgccgggacggcaa

SEQ ID NO: 802703 - DNA, 25 bp, Mus musculus
tcagcatcgtctacttgcacatgaa

SEQ ID NO: 802704 - DNA, 25 bp, Mus musculus
tcagcatcgtcttcttgcacatgaa

SEQ ID NO: 802705 - DNA, 25 bp, Mus musculus
tcagcatctaagagcactggtagct

SEQ ID NO: 802706 - DNA, 25 bp, Mus musculus
tcagcatctaagtgcactggtagct

SEQ ID NO: 802707 - DNA, 25 bp, Mus musculus
tcagcatctacaatgcgtactcagc

SEQ ID NO: 802708 - DNA, 25 bp, Mus musculus
tcagcatctacattgcgtactcagc

SEQ ID NO: 802709 - DNA, 25 bp, Mus musculus
tcagcatctagacaagctcatggtt

SEQ ID NO: 802710 - DNA, 25 bp, Mus musculus
tcagcatctagagaagctcatggtt

SEQ ID NO: 802711 - DNA, 25 bp, Mus musculus
tcagcatctatcaagggagcaccat

SEQ ID NO: 802712 - DNA, 25 bp, Mus musculus
tcagcatctatctagggagcaccat

SEQ ID NO: 802713 - DNA, 25 bp, Mus musculus
tcagcatctcccagtctggatacat

SEQ ID NO: 802714 - DNA, 25 bp, Mus musculus
tcagcatctccctgtctggatacat

SEQ ID NO: 802715 - DNA, 25 bp, Mus musculus
tcagcatctcgacgtcgttctggaa

SEQ ID NO: 802716 - DNA, 25 bp, Mus musculus
tcagcatctcgaggtcgttctggaa

SEQ ID NO: 802717 - DNA, 25 bp, Mus musculus
tcagcatctgctaccagaagtttcc

SEQ ID NO: 802718 - DNA, 25 bp, Mus musculus
tcagcatctgcttccagaagtttcc

SEQ ID NO: 802719 - DNA, 25 bp, Mus musculus
tcagcatctggacgtctccggattc

SEQ ID NO: 802720 - DNA, 25 bp, Mus musculus
tcagcatctggaggtctccggattc

SEQ ID NO: 802721 - DNA, 25 bp, Mus musculus
tcagcatcttcacaaccacacagaa

SEQ ID NO: 802722 - DNA, 25 bp, Mus musculus
tcagcatcttcagaaccacacagaa

SEQ ID NO: 802723 - DNA, 25 bp, Mus musculus
tcagcatcttgaccttttcagacct

SEQ ID NO: 802724 - DNA, 25 bp, Mus musculus
tcagcatcttgagcttttcagacct

SEQ ID NO: 802725 - DNA, 25 bp, Mus musculus
tcagcatgaagcaagcatgaatggc

SEQ ID NO: 802726 - DNA, 25 bp, Mus musculus
tcagcatgaagctagcatgaatggc

SEQ ID NO: 802727 - DNA, 25 bp, Mus musculus
tcagcatgacttacaggctccgtat

SEQ ID NO: 802728 - DNA, 25 bp, Mus musculus
tcagcatgacttcgcatagacgtaa

SEQ ID NO: 802729 - DNA, 25 bp, Mus musculus
tcagcatgacttggcatagacgtaa

SEQ ID NO: 802730 - DNA, 25 bp, Mus musculus
tcagcatgactttcaggctccgtat

SEQ ID NO: 802731 - DNA, 25 bp, Mus musculus
tcagcatgccacctaaaggaggtgt

SEQ ID NO: 802732 - DNA, 25 bp, Mus musculus
tcagcatgccacgtaaaggaggtgt

SEQ ID NO: 802733 - DNA, 25 bp, Mus musculus
tcagcatggcatcacgtgcatcagg

SEQ ID NO: 802734 - DNA, 25 bp, Mus musculus
tcagcatggcatgacgtgcatcagg

SEQ ID NO: 802735 - DNA, 25 bp, Mus musculus
tcagcatgggctcaaggaagtgcca

SEQ ID NO: 802736 - DNA, 25 bp, Mus musculus
tcagcatgggctgaaggaagtgcca

SEQ ID NO: 802737 - DNA, 25 bp, Mus musculus
tcagcatgggtaaccacagcgggct

SEQ ID NO: 802738 - DNA, 25 bp, Mus musculus
tcagcatgggtatccacagcgggct

SEQ ID NO: 802739 - DNA, 25 bp, Mus musculus
tcagcatgtgccacttaggtcgcac

SEQ ID NO: 802740 - DNA, 25 bp, Mus musculus
tcagcatgtgcctcttaggtcgcac

SEQ ID NO: 802741 - DNA, 25 bp, Mus musculus
tcagcatgtggcacctggcgttgtg

SEQ ID NO: 802742 - DNA, 25 bp, Mus musculus
tcagcatgtggctcctggcgttgtg

SEQ ID NO: 802743 - DNA, 25 bp, Mus musculus
tcagcattcactctcagtggccaga

SEQ ID NO: 802744 - DNA, 25 bp, Mus musculus
tcagcattcactgtcagtggccaga

SEQ ID NO: 802745 - DNA, 25 bp, Mus musculus
tcagcattcagccttacagagtgtt

SEQ ID NO: 802746 - DNA, 25 bp, Mus musculus
tcagcattcagcgttacagagtgtt

SEQ ID NO: 802747 - DNA, 25 bp, Mus musculus
tcagcattcatccaggccaagagaa

SEQ ID NO: 802748 - DNA, 25 bp, Mus musculus
tcagcattcatcgaggccaagagaa

SEQ ID NO: 802749 - DNA, 25 bp, Mus musculus
tcagcattccacaggggactctgga

SEQ ID NO: 802750 - DNA, 25 bp, Mus musculus
tcagcattccactggggactctgga

SEQ ID NO: 802751 - DNA, 25 bp, Mus musculus
tcagcattccgccaggttgccagag

SEQ ID NO: 802752 - DNA, 25 bp, Mus musculus
tcagcattccgcgaggttgccagag

SEQ ID NO: 802753 - DNA, 25 bp, Mus musculus
tcagcattcggaattcctgtcttct

SEQ ID NO: 802754 - DNA, 25 bp, Mus musculus
tcagcattcggatttcctgtcttct

SEQ ID NO: 802755 - DNA, 25 bp, Mus musculus
tcagcattctgacgtcaaggtcaac

SEQ ID NO: 802756 - DNA, 25 bp, Mus musculus
tcagcattctgaggtcaaggtcaac

SEQ ID NO: 802757 - DNA, 25 bp, Mus musculus
tcagcattctgtctgaggttcatct

SEQ ID NO: 802758 - DNA, 25 bp, Mus musculus
tcagcattctgtgtgaggttcatct

SEQ ID NO: 802759 - DNA, 25 bp, Mus musculus
tcagcattgcagattgcagcccaca

SEQ ID NO: 802760 - DNA, 25 bp, Mus musculus
tcagcattgcagtttgcagcccaca

SEQ ID NO: 802761 - DNA, 25 bp, Mus musculus
tcagcattgcgacctgtcagccatg

SEQ ID NO: 802762 - DNA, 25 bp, Mus musculus
tcagcattgcgagctgtcagccatg

SEQ ID NO: 802763 - DNA, 25 bp, Mus musculus
tcagcattggataccctcagtagtt

SEQ ID NO: 802764 - DNA, 25 bp, Mus musculus
tcagcattggattccctcagtagtt

SEQ ID NO: 802765 - DNA, 25 bp, Mus musculus
tcagcatttcaaagactaacgtcgt

SEQ ID NO: 802766 - DNA, 25 bp, Mus musculus
tcagcatttcaatgactaacgtcgt

SEQ ID NO: 802767 - DNA, 25 bp, Mus musculus
tcagcatttctccaattgcctgctt

SEQ ID NO: 802768 - DNA, 25 bp, Mus musculus
tcagcatttctcgaattgcctgctt

SEQ ID NO: 802769 - DNA, 25 bp, Mus musculus
tcagcatttctgctctgctaaatat

SEQ ID NO: 802770 - DNA, 25 bp, Mus musculus
tcagcatttctggtctgctaaatat

SEQ ID NO: 802771 - DNA, 25 bp, Mus musculus
tcagcatttgaaccacggacagttt

SEQ ID NO: 802772 - DNA, 25 bp, Mus musculus
tcagcatttgaagcacggacagttt

SEQ ID NO: 802773 - DNA, 25 bp, Mus musculus
tcagccaaatgacccgggacgagat

SEQ ID NO: 802774 - DNA, 25 bp, Mus musculus
tcagccaaatgagccgggacgagat

SEQ ID NO: 802775 - DNA, 25 bp, Mus musculus
tcagccaacagcagggtaccagtga

SEQ ID NO: 802776 - DNA, 25 bp, Mus musculus
tcagccaacagcatgtgcctggaag

SEQ ID NO: 802777 - DNA, 25 bp, Mus musculus
tcagccaacagctgggtaccagtga

SEQ ID NO: 802778 - DNA, 25 bp, Mus musculus
tcagccaacagcttgtgcctggaag

SEQ ID NO: 802779 - DNA, 25 bp, Mus musculus
tcagccaactttctcgacattacaa

SEQ ID NO: 802780 - DNA, 25 bp, Mus musculus
tcagccaactttgtcgacattacaa

SEQ ID NO: 802781 - DNA, 25 bp, Mus musculus
tcagccaagctgagtaagggccccg

SEQ ID NO: 802782 - DNA, 25 bp, Mus musculus
tcagccaagctgtgtaagggccccg

SEQ ID NO: 802783 - DNA, 25 bp, Mus musculus
tcagccaaggccctgtcacgggaaa

SEQ ID NO: 802784 - DNA, 25 bp, Mus musculus
tcagccaaggccgtgtcacgggaaa

SEQ ID NO: 802785 - DNA, 25 bp, Mus musculus
tcagccaattcaccctaaagacttt

SEQ ID NO: 802786 - DNA, 25 bp, Mus musculus
tcagccaattcagcctaaagacttt

SEQ ID NO: 802787 - DNA, 25 bp, Mus musculus
tcagccacacatacattcaatccat

SEQ ID NO: 802788 - DNA, 25 bp, Mus musculus
tcagccacacattcattcaatccat

SEQ ID NO: 802789 - DNA, 25 bp, Mus musculus
tcagccacagagaacaaggatcaca

SEQ ID NO: 802790 - DNA, 25 bp, Mus musculus
tcagccacagagtacaaggatcaca

SEQ ID NO: 802791 - DNA, 25 bp, Mus musculus
tcagccacagcactgggctctggag

SEQ ID NO: 802792 - DNA, 25 bp, Mus musculus
tcagccacagcagtgggctctggag

SEQ ID NO: 802793 - DNA, 25 bp, Mus musculus
tcagccacatctactcactgtgtat

SEQ ID NO: 802794 - DNA, 25 bp, Mus musculus
tcagccacatcttctcactgtgtat

SEQ ID NO: 802795 - DNA, 25 bp, Mus musculus
tcagccacattccattaggcactgg

SEQ ID NO: 802796 - DNA, 25 bp, Mus musculus
tcagccacattcgattaggcactgg

SEQ ID NO: 802797 - DNA, 25 bp, Mus musculus
tcagccacctcactgaagttggagt

SEQ ID NO: 802798 - DNA, 25 bp, Mus musculus
tcagccacctcagtgaagttggagt

SEQ ID NO: 802799 - DNA, 25 bp, Mus musculus
tcagccacctgccacttggcaattt

SEQ ID NO: 802800 - DNA, 25 bp, Mus musculus
tcagccacctgcgacttggcaattt

SEQ ID NO: 802801 - DNA, 25 bp, Mus musculus
tcagccaccttacccttttaaaatg

SEQ ID NO: 802802 - DNA, 25 bp, Mus musculus
tcagccaccttagccttttaaaatg

SEQ ID NO: 802803 - DNA, 25 bp, Mus musculus
tcagccacgaaaacgatgccgccag

SEQ ID NO: 802804 - DNA, 25 bp, Mus musculus
tcagccacgaaatcgatgccgccag

SEQ ID NO: 802805 - DNA, 25 bp, Mus musculus
tcagccacgtgcatcattgtgggat

SEQ ID NO: 802806 - DNA, 25 bp, Mus musculus
tcagccacgtgcttcattgtgggat

SEQ ID NO: 802807 - DNA, 25 bp, Mus musculus
tcagccactaggagctccctgggaa

SEQ ID NO: 802808 - DNA, 25 bp, Mus musculus
tcagccactaggtgctccctgggaa

SEQ ID NO: 802809 - DNA, 25 bp, Mus musculus
tcagccactgagatccagtttagag

SEQ ID NO: 802810 - DNA, 25 bp, Mus musculus
tcagccactgagttccagtttagag

SEQ ID NO: 802811 - DNA, 25 bp, Mus musculus
tcagccactgctctgtttaataata

SEQ ID NO: 802812 - DNA, 25 bp, Mus musculus
tcagccactgctgtgtttaataata

SEQ ID NO: 802813 - DNA, 25 bp, Mus musculus
tcagccactgttactttatagagag

SEQ ID NO: 802814 - DNA, 25 bp, Mus musculus
tcagccactgtttctttatagagag

SEQ ID NO: 802815 - DNA, 25 bp, Mus musculus
tcagccacttgcatcagagagatct

SEQ ID NO: 802816 - DNA, 25 bp, Mus musculus
tcagccacttgcttcagagagatct

SEQ ID NO: 802817 - DNA, 25 bp, Mus musculus
tcagccagacaaccaagccaggcgg

SEQ ID NO: 802818 - DNA, 25 bp, Mus musculus
tcagccagacaagcaagccaggcgg

SEQ ID NO: 802819 - DNA, 25 bp, Mus musculus
tcagccagacagcacgtgctgactg

SEQ ID NO: 802820 - DNA, 25 bp, Mus musculus
tcagccagacaggacgtgctgactg

SEQ ID NO: 802821 - DNA, 25 bp, Mus musculus
tcagccagactgagtcttgtgcaga

SEQ ID NO: 802822 - DNA, 25 bp, Mus musculus
tcagccagactgtgtcttgtgcaga

SEQ ID NO: 802823 - DNA, 25 bp, Mus musculus
tcagccagagacaaccacagcctag

SEQ ID NO: 802824 - DNA, 25 bp, Mus musculus
tcagccagagactaccacagcctag

SEQ ID NO: 802825 - DNA, 25 bp, Mus musculus
tcagccagagccacgtggttcttct

SEQ ID NO: 802826 - DNA, 25 bp, Mus musculus
tcagccagagcctcgtggttcttct

SEQ ID NO: 802827 - DNA, 25 bp, Mus musculus
tcagccagagtactaggcctgcctt

SEQ ID NO: 802828 - DNA, 25 bp, Mus musculus
tcagccagagtagtaggcctgcctt

SEQ ID NO: 802829 - DNA, 25 bp, Mus musculus
tcagccagatgcagttaacgcccca

SEQ ID NO: 802830 - DNA, 25 bp, Mus musculus
tcagccagatgctgttaacgcccca

SEQ ID NO: 802831 - DNA, 25 bp, Mus musculus
tcagccagcgctccaagataagaat

SEQ ID NO: 802832 - DNA, 25 bp, Mus musculus
tcagccagcgctgcaagataagaat

SEQ ID NO: 802833 - DNA, 25 bp, Mus musculus
tcagccagctatcactagacatcat

SEQ ID NO: 802834 - DNA, 25 bp, Mus musculus
tcagccagctatgactagacatcat

SEQ ID NO: 802835 - DNA, 25 bp, Mus musculus
tcagccaggactatggaatcgccat

SEQ ID NO: 802836 - DNA, 25 bp, Mus musculus
tcagccaggactttggaatcgccat

SEQ ID NO: 802837 - DNA, 25 bp, Mus musculus
tcagccaggctactgggagatgctt

SEQ ID NO: 802838 - DNA, 25 bp, Mus musculus
tcagccaggctagtgggagatgctt

SEQ ID NO: 802839 - DNA, 25 bp, Mus musculus
tcagccaggtgaccatttgcatggc

SEQ ID NO: 802840 - DNA, 25 bp, Mus musculus
tcagccaggtgagcatttgcatggc

SEQ ID NO: 802841 - DNA, 25 bp, Mus musculus
tcagccagtgctatagagtagagaa

SEQ ID NO: 802842 - DNA, 25 bp, Mus musculus
tcagccagtgctttagagtagagaa

SEQ ID NO: 802843 - DNA, 25 bp, Mus musculus
tcagccagtggtcctccagggaatg

SEQ ID NO: 802844 - DNA, 25 bp, Mus musculus
tcagccagtggtgctccagggaatg

SEQ ID NO: 802845 - DNA, 25 bp, Mus musculus
tcagccagttttagctcctgtttct

SEQ ID NO: 802846 - DNA, 25 bp, Mus musculus
tcagccagtttttgctcctgtttct

SEQ ID NO: 802847 - DNA, 25 bp, Mus musculus
tcagccatacccaggcagtggtagt

SEQ ID NO: 802848 - DNA, 25 bp, Mus musculus
tcagccataccctggcagtggtagt

SEQ ID NO: 802849 - DNA, 25 bp, Mus musculus
tcagccatactaatcccaacgggaa

SEQ ID NO: 802850 - DNA, 25 bp, Mus musculus
tcagccatactattcccaacgggaa

SEQ ID NO: 802851 - DNA, 25 bp, Mus musculus
tcagccatatagctattgtctttat

SEQ ID NO: 802852 - DNA, 25 bp, Mus musculus
tcagccatataggtattgtctttat

SEQ ID NO: 802853 - DNA, 25 bp, Mus musculus
tcagccatcagtaatttgtgaggat

SEQ ID NO: 802854 - DNA, 25 bp, Mus musculus
tcagccatcagtacaagagccaatg

SEQ ID NO: 802855 - DNA, 25 bp, Mus musculus
tcagccatcagttatttgtgaggat

SEQ ID NO: 802856 - DNA, 25 bp, Mus musculus
tcagccatcagttcaagagccaatg

SEQ ID NO: 802857 - DNA, 25 bp, Mus musculus
tcagccatccaccttcaagttcaag

SEQ ID NO: 802858 - DNA, 25 bp, Mus musculus
tcagccatccacgttcaagttcaag

SEQ ID NO: 802859 - DNA, 25 bp, Mus musculus
tcagccatcgtgaggccacagctag

SEQ ID NO: 802860 - DNA, 25 bp, Mus musculus
tcagccatcgtgtggccacagctag

SEQ ID NO: 802861 - DNA, 25 bp, Mus musculus
tcagccatctcaaccttggattttt

SEQ ID NO: 802862 - DNA, 25 bp, Mus musculus
tcagccatctcatccttggattttt

SEQ ID NO: 802863 - DNA, 25 bp, Mus musculus
tcagccatctggctactgatgtcat

SEQ ID NO: 802864 - DNA, 25 bp, Mus musculus
tcagccatctgggtactgatgtcat

SEQ ID NO: 802865 - DNA, 25 bp, Mus musculus
tcagccatgcctctagtctgctttg

SEQ ID NO: 802866 - DNA, 25 bp, Mus musculus
tcagccatgcctgtagtctgctttg

SEQ ID NO: 802867 - DNA, 25 bp, Mus musculus
tcagccatggaaacggagtcctctt

SEQ ID NO: 802868 - DNA, 25 bp, Mus musculus
tcagccatggaatcggagtcctctt

SEQ ID NO: 802869 - DNA, 25 bp, Mus musculus
tcagccatttcaccggccgatcaaa

SEQ ID NO: 802870 - DNA, 25 bp, Mus musculus
tcagccatttcagcggccgatcaaa

SEQ ID NO: 802871 - DNA, 25 bp, Mus musculus
tcagccatttgaaccattggacctt

SEQ ID NO: 802872 - DNA, 25 bp, Mus musculus
tcagccatttgactgcagccattgt

SEQ ID NO: 802873 - DNA, 25 bp, Mus musculus
tcagccatttgagtgcagccattgt

SEQ ID NO: 802874 - DNA, 25 bp, Mus musculus
tcagccatttgatccattggacctt

SEQ ID NO: 802875 - DNA, 25 bp, Mus musculus
tcagccatttgtaaggaagtcccaa

SEQ ID NO: 802876 - DNA, 25 bp, Mus musculus
tcagccatttgttaggaagtcccaa

SEQ ID NO: 802877 - DNA, 25 bp, Mus musculus
tcagcccaagagctcattccaagag

SEQ ID NO: 802878 - DNA, 25 bp, Mus musculus
tcagcccaagaggtcattccaagag

SEQ ID NO: 802879 - DNA, 25 bp, Mus musculus
tcagcccaagggaagtctcctaatt

SEQ ID NO: 802880 - DNA, 25 bp, Mus musculus
tcagcccaagggtagtctcctaatt

SEQ ID NO: 802881 - DNA, 25 bp, Mus musculus
tcagcccacatgagctgtgcatagg

SEQ ID NO: 802882 - DNA, 25 bp, Mus musculus
tcagcccacatgtgctgtgcatagg

SEQ ID NO: 802883 - DNA, 25 bp, Mus musculus
tcagcccacgctcatacaaatcagg

SEQ ID NO: 802884 - DNA, 25 bp, Mus musculus
tcagcccacgctgatacaaatcagg

SEQ ID NO: 802885 - DNA, 25 bp, Mus musculus
tcagcccactctcgtactcaagaga

SEQ ID NO: 802886 - DNA, 25 bp, Mus musculus
tcagcccactctggtactcaagaga

SEQ ID NO: 802887 - DNA, 25 bp, Mus musculus
tcagcccactgtcaagagtgagctt

SEQ ID NO: 802888 - DNA, 25 bp, Mus musculus
tcagcccactgtgaagagtgagctt

SEQ ID NO: 802889 - DNA, 25 bp, Mus musculus
tcagcccagctgattacttgtaaaa

SEQ ID NO: 802890 - DNA, 25 bp, Mus musculus
tcagcccagctgtttacttgtaaaa

SEQ ID NO: 802891 - DNA, 25 bp, Mus musculus
tcagcccaggctctgagctccttgg

SEQ ID NO: 802892 - DNA, 25 bp, Mus musculus
tcagcccaggctgtgagctccttgg

SEQ ID NO: 802893 - DNA, 25 bp, Mus musculus
tcagcccagtgtacacaggccctga

SEQ ID NO: 802894 - DNA, 25 bp, Mus musculus
tcagcccagtgttcacaggccctga

SEQ ID NO: 802895 - DNA, 25 bp, Mus musculus
tcagcccatactacctattttgaga

SEQ ID NO: 802896 - DNA, 25 bp, Mus musculus
tcagcccatacttcctattttgaga

SEQ ID NO: 802897 - DNA, 25 bp, Mus musculus
tcagcccatattatccaacattttg

SEQ ID NO: 802898 - DNA, 25 bp, Mus musculus
tcagcccatattttccaacattttg

SEQ ID NO: 802899 - DNA, 25 bp, Mus musculus
tcagcccatggccagagcaaggcag

SEQ ID NO: 802900 - DNA, 25 bp, Mus musculus
tcagcccatggcgagagcaaggcag

SEQ ID NO: 802901 - DNA, 25 bp, Mus musculus
tcagcccattttacctatgtcctgc

SEQ ID NO: 802902 - DNA, 25 bp, Mus musculus
tcagcccatttttcctatgtcctgc

SEQ ID NO: 802903 - DNA, 25 bp, Mus musculus
tcagccccaaccagggacagggaca

SEQ ID NO: 802904 - DNA, 25 bp, Mus musculus
tcagccccaacctgggacagggaca

SEQ ID NO: 802905 - DNA, 25 bp, Mus musculus
tcagccccaactccggaagagaagg

SEQ ID NO: 802906 - DNA, 25 bp, Mus musculus
tcagccccaactgcggaagagaagg

SEQ ID NO: 802907 - DNA, 25 bp, Mus musculus
tcagccccacttactggacagaaga

SEQ ID NO: 802908 - DNA, 25 bp, Mus musculus
tcagccccactttctggacagaaga

SEQ ID NO: 802909 - DNA, 25 bp, Mus musculus
tcagccccagctagcaatcagatcg

SEQ ID NO: 802910 - DNA, 25 bp, Mus musculus
tcagccccagcttgcaatcagatcg

SEQ ID NO: 802911 - DNA, 25 bp, Mus musculus
tcagccccagtgaagaatgtgtcag

SEQ ID NO: 802912 - DNA, 25 bp, Mus musculus
tcagccccagtgtagaatgtgtcag

SEQ ID NO: 802913 - DNA, 25 bp, Mus musculus
tcagccccatagagtgccttaggac

SEQ ID NO: 802914 - DNA, 25 bp, Mus musculus
tcagccccatagtgtgccttaggac

SEQ ID NO: 802915 - DNA, 25 bp, Mus musculus
tcagccccatatctgtccacagtga

SEQ ID NO: 802916 - DNA, 25 bp, Mus musculus
tcagccccatatgtgtccacagtga

SEQ ID NO: 802917 - DNA, 25 bp, Mus musculus
tcagccccatgaattgtatatctct

SEQ ID NO: 802918 - DNA, 25 bp, Mus musculus
tcagccccatgatttgtatatctct

SEQ ID NO: 802919 - DNA, 25 bp, Mus musculus
tcagcccccagaattctatgaagag

SEQ ID NO: 802920 - DNA, 25 bp, Mus musculus
tcagcccccagatttctatgaagag

SEQ ID NO: 802921 - DNA, 25 bp, Mus musculus
tcagccccggtacaagagacagaca

SEQ ID NO: 802922 - DNA, 25 bp, Mus musculus
tcagccccggtagaagagacagaca

SEQ ID NO: 802923 - DNA, 25 bp, Mus musculus
tcagcccctaccatcgtagacggaa

SEQ ID NO: 802924 - DNA, 25 bp, Mus musculus
tcagcccctaccttcgtagacggaa

SEQ ID NO: 802925 - DNA, 25 bp, Mus musculus
tcagccccttttccaaaacaatcta

SEQ ID NO: 802926 - DNA, 25 bp, Mus musculus
tcagccccttttgcaaaacaatcta

SEQ ID NO: 802927 - DNA, 25 bp, Mus musculus
tcagcccgagcaagactttgacaga

SEQ ID NO: 802928 - DNA, 25 bp, Mus musculus
tcagcccgagcatgactttgacaga

SEQ ID NO: 802929 - DNA, 25 bp, Mus musculus
tcagcccgccaacgagttttggaat

SEQ ID NO: 802930 - DNA, 25 bp, Mus musculus
tcagcccgccaaggagttttggaat

SEQ ID NO: 802931 - DNA, 25 bp, Mus musculus
tcagcccgctggaaagcagacactt

SEQ ID NO: 802932 - DNA, 25 bp, Mus musculus
tcagcccgctggtaagcagacactt

SEQ ID NO: 802933 - DNA, 25 bp, Mus musculus
tcagcccgtcacctactataagcgg

SEQ ID NO: 802934 - DNA, 25 bp, Mus musculus
tcagcccgtcacgtactataagcgg

SEQ ID NO: 802935 - DNA, 25 bp, Mus musculus
tcagccctagaaacactgggttgct

SEQ ID NO: 802936 - DNA, 25 bp, Mus musculus
tcagccctagaatcactgggttgct

SEQ ID NO: 802937 - DNA, 25 bp, Mus musculus
tcagccctcactatagagtttccat

SEQ ID NO: 802938 - DNA, 25 bp, Mus musculus
tcagccctcactatgctaatgcgag

SEQ ID NO: 802939 - DNA, 25 bp, Mus musculus
tcagccctcactttagagtttccat

SEQ ID NO: 802940 - DNA, 25 bp, Mus musculus
tcagccctcactttgctaatgcgag

SEQ ID NO: 802941 - DNA, 25 bp, Mus musculus
tcagccctcatcaggtttctcattt

SEQ ID NO: 802942 - DNA, 25 bp, Mus musculus
tcagccctcatctggtttctcattt

SEQ ID NO: 802943 - DNA, 25 bp, Mus musculus
tcagccctcctacagcaagatgaag

SEQ ID NO: 802944 - DNA, 25 bp, Mus musculus
tcagccctcctagagcaagatgaag

SEQ ID NO: 802945 - DNA, 25 bp, Mus musculus
tcagccctcgggaaaacagtgagat

SEQ ID NO: 802946 - DNA, 25 bp, Mus musculus
tcagccctcgggtaaacagtgagat

SEQ ID NO: 802947 - DNA, 25 bp, Mus musculus
tcagccctctagagcgcctgtggag

SEQ ID NO: 802948 - DNA, 25 bp, Mus musculus
tcagccctctagtgcgcctgtggag

SEQ ID NO: 802949 - DNA, 25 bp, Mus musculus
tcagccctctgtatatcactgtcag

SEQ ID NO: 802950 - DNA, 25 bp, Mus musculus
tcagccctctgtcaatgccttaaag

SEQ ID NO: 802951 - DNA, 25 bp, Mus musculus
tcagccctctgtgaatgccttaaag

SEQ ID NO: 802952 - DNA, 25 bp, Mus musculus
tcagccctctgtttatcactgtcag

SEQ ID NO: 802953 - DNA, 25 bp, Mus musculus
tcagccctgaatccagagaccatca

SEQ ID NO: 802954 - DNA, 25 bp, Mus musculus
tcagccctgaatgcagagaccatca

SEQ ID NO: 802955 - DNA, 25 bp, Mus musculus
tcagccctgactacaacgagaaagt

SEQ ID NO: 802956 - DNA, 25 bp, Mus musculus
tcagccctgacttcaacgagaaagt

SEQ ID NO: 802957 - DNA, 25 bp, Mus musculus
tcagccctgagcattagggaactgt

SEQ ID NO: 802958 - DNA, 25 bp, Mus musculus
tcagccctgagctttagggaactgt

SEQ ID NO: 802959 - DNA, 25 bp, Mus musculus
tcagccctgagtccaagaagatcct

SEQ ID NO: 802960 - DNA, 25 bp, Mus musculus
tcagccctgagtgcaagaagatcct

SEQ ID NO: 802961 - DNA, 25 bp, Mus musculus
tcagccctgatcctcatagacgcca

SEQ ID NO: 802962 - DNA, 25 bp, Mus musculus
tcagccctgatcgtcatagacgcca

SEQ ID NO: 802963 - DNA, 25 bp, Mus musculus
tcagccctgatgatgcagctcccgt

SEQ ID NO: 802964 - DNA, 25 bp, Mus musculus
tcagccctgatgttgcagctcccgt

SEQ ID NO: 802965 - DNA, 25 bp, Mus musculus
tcagccctggcactgtagacatatg

SEQ ID NO: 802966 - DNA, 25 bp, Mus musculus
tcagccctggcagtgtagacatatg

SEQ ID NO: 802967 - DNA, 25 bp, Mus musculus
tcagccctgggacacctaggtcaga

SEQ ID NO: 802968 - DNA, 25 bp, Mus musculus
tcagccctgggagacctaggtcaga

SEQ ID NO: 802969 - DNA, 25 bp, Mus musculus
tcagccctgtcgcagaacaagcaat

SEQ ID NO: 802970 - DNA, 25 bp, Mus musculus
tcagccctgtcggagaacaagcaat

SEQ ID NO: 802971 - DNA, 25 bp, Mus musculus
tcagcccttacgaaagagcaagctc

SEQ ID NO: 802972 - DNA, 25 bp, Mus musculus
tcagcccttacgtaagagcaagctc

SEQ ID NO: 802973 - DNA, 25 bp, Mus musculus
tcagcccttccacttctacagatgg

SEQ ID NO: 802974 - DNA, 25 bp, Mus musculus
tcagcccttccagttctacagatgg

SEQ ID NO: 802975 - DNA, 25 bp, Mus musculus
tcagccctttagagtgtgcgagcgc

SEQ ID NO: 802976 - DNA, 25 bp, Mus musculus
tcagccctttagtgtgtgcgagcgc

SEQ ID NO: 802977 - DNA, 25 bp, Mus musculus
tcagccctttccacgtaatatttat

SEQ ID NO: 802978 - DNA, 25 bp, Mus musculus
tcagccctttcctcgtaatatttat

SEQ ID NO: 802979 - DNA, 25 bp, Mus musculus
tcagcccttttaccctagcactggg

SEQ ID NO: 802980 - DNA, 25 bp, Mus musculus
tcagcccttttagcctagcactggg

SEQ ID NO: 802981 - DNA, 25 bp, Mus musculus
tcagccgaacagatgccgagaacct

SEQ ID NO: 802982 - DNA, 25 bp, Mus musculus
tcagccgaacagttgccgagaacct

SEQ ID NO: 802983 - DNA, 25 bp, Mus musculus
tcagccgaagccatctgctctatcg

SEQ ID NO: 802984 - DNA, 25 bp, Mus musculus
tcagccgaagccttctgctctatcg

SEQ ID NO: 802985 - DNA, 25 bp, Mus musculus
tcagccgatggccagagtgagccta

SEQ ID NO: 802986 - DNA, 25 bp, Mus musculus
tcagccgatggcgagagtgagccta

SEQ ID NO: 802987 - DNA, 25 bp, Mus musculus
tcagccgatgggattcttcccgaga

SEQ ID NO: 802988 - DNA, 25 bp, Mus musculus
tcagccgatgggtttcttcccgaga

SEQ ID NO: 802989 - DNA, 25 bp, Mus musculus
tcagccgatggtacacagcagttct

SEQ ID NO: 802990 - DNA, 25 bp, Mus musculus
tcagccgatggttcacagcagttct

SEQ ID NO: 802991 - DNA, 25 bp, Mus musculus
tcagccgcccctcaggaaggaatga

SEQ ID NO: 802992 - DNA, 25 bp, Mus musculus
tcagccgcccctgaggaaggaatga

SEQ ID NO: 802993 - DNA, 25 bp, Mus musculus
tcagccgccgagagaccatgggcat

SEQ ID NO: 802994 - DNA, 25 bp, Mus musculus
tcagccgccgagtgaccatgggcat

SEQ ID NO: 802995 - DNA, 25 bp, Mus musculus
tcagccgcgtttagggaaattcgtt

SEQ ID NO: 802996 - DNA, 25 bp, Mus musculus
tcagccgcgttttgggaaattcgtt

SEQ ID NO: 802997 - DNA, 25 bp, Mus musculus
tcagccggaactcgcatggtgtgcc

SEQ ID NO: 802998 - DNA, 25 bp, Mus musculus
tcagccggaactggcatggtgtgcc

SEQ ID NO: 802999 - DNA, 25 bp, Mus musculus
tcagccggagacacctctcatgaga

SEQ ID NO: 803000 - DNA, 25 bp, Mus musculus
tcagccggagactcctctcatgaga

SEQ ID NO: 803001 - DNA, 25 bp, Mus musculus
tcagccggagctcaaattttgcaaa

SEQ ID NO: 803002 - DNA, 25 bp, Mus musculus
tcagccggagctgaaattttgcaaa

SEQ ID NO: 803003 - DNA, 25 bp, Mus musculus
tcagccggccagacgaagtgctaga

SEQ ID NO: 803004 - DNA, 25 bp, Mus musculus
tcagccggccagtcgaagtgctaga

SEQ ID NO: 803005 - DNA, 25 bp, Mus musculus
tcagccggcgcaacgtgctatcaga

SEQ ID NO: 803006 - DNA, 25 bp, Mus musculus
tcagccggcgcatcgtgctatcaga

SEQ ID NO: 803007 - DNA, 25 bp, Mus musculus
tcagccgggcgtacatgtttcagta

SEQ ID NO: 803008 - DNA, 25 bp, Mus musculus
tcagccgggcgttcatgtttcagta

SEQ ID NO: 803009 - DNA, 25 bp, Mus musculus
tcagccgtatgtcaactttagacca

SEQ ID NO: 803010 - DNA, 25 bp, Mus musculus
tcagccgtatgtgaactttagacca

SEQ ID NO: 803011 - DNA, 25 bp, Mus musculus
tcagccgtctgtcggatctccgaga

SEQ ID NO: 803012 - DNA, 25 bp, Mus musculus
tcagccgtctgtgggatctccgaga

SEQ ID NO: 803013 - DNA, 25 bp, Mus musculus
tcagccgtgatccttttaaccacta

SEQ ID NO: 803014 - DNA, 25 bp, Mus musculus
tcagccgtgatcgttttaaccacta

SEQ ID NO: 803015 - DNA, 25 bp, Mus musculus
tcagccgtgctgatagttggtattt

SEQ ID NO: 803016 - DNA, 25 bp, Mus musculus
tcagccgtgctgttagttggtattt

SEQ ID NO: 803017 - DNA, 25 bp, Mus musculus
tcagccgtgggcagcgtgagaaact

SEQ ID NO: 803018 - DNA, 25 bp, Mus musculus
tcagccgtgggctgcgtgagaaact

SEQ ID NO: 803019 - DNA, 25 bp, Mus musculus
tcagccgtttccagagcaacctcag

SEQ ID NO: 803020 - DNA, 25 bp, Mus musculus
tcagccgtttcctgagcaacctcag

SEQ ID NO: 803021 - DNA, 25 bp, Mus musculus
tcagcctaaccacaggttccggaag

SEQ ID NO: 803022 - DNA, 25 bp, Mus musculus
tcagcctaaccagaggttccggaag

SEQ ID NO: 803023 - DNA, 25 bp, Mus musculus
tcagcctacaggagttcatggatca

SEQ ID NO: 803024 - DNA, 25 bp, Mus musculus
tcagcctacaggtgttcatggatca

SEQ ID NO: 803025 - DNA, 25 bp, Mus musculus
tcagcctagctgatcaagacgtcaa

SEQ ID NO: 803026 - DNA, 25 bp, Mus musculus
tcagcctagctgttcaagacgtcaa

SEQ ID NO: 803027 - DNA, 25 bp, Mus musculus
tcagcctatctcctgaggaggcagt

SEQ ID NO: 803028 - DNA, 25 bp, Mus musculus
tcagcctatctcgtgaggaggcagt

SEQ ID NO: 803029 - DNA, 25 bp, Mus musculus
tcagcctcaaacacagcggcagttg

SEQ ID NO: 803030 - DNA, 25 bp, Mus musculus
tcagcctcaaactcagcggcagttg

SEQ ID NO: 803031 - DNA, 25 bp, Mus musculus
tcagcctcaataactatgccggaac

SEQ ID NO: 803032 - DNA, 25 bp, Mus musculus
tcagcctcaatatctatgccggaac

SEQ ID NO: 803033 - DNA, 25 bp, Mus musculus
tcagcctcacaaagtgacccagtat

SEQ ID NO: 803034 - DNA, 25 bp, Mus musculus
tcagcctcacaatgtgacccagtat

SEQ ID NO: 803035 - DNA, 25 bp, Mus musculus
tcagcctcaccgacactgggatgaa

SEQ ID NO: 803036 - DNA, 25 bp, Mus musculus
tcagcctcaccgtcactgggatgaa

SEQ ID NO: 803037 - DNA, 25 bp, Mus musculus
tcagcctcagagatcacgtattaag

SEQ ID NO: 803038 - DNA, 25 bp, Mus musculus
tcagcctcagagttcacgtattaag

SEQ ID NO: 803039 - DNA, 25 bp, Mus musculus
tcagcctcagccatcctttggaagg

SEQ ID NO: 803040 - DNA, 25 bp, Mus musculus
tcagcctcagcccaatgaagttcag

SEQ ID NO: 803041 - DNA, 25 bp, Mus musculus
tcagcctcagccgaatgaagttcag

SEQ ID NO: 803042 - DNA, 25 bp, Mus musculus
tcagcctcagccttcctttggaagg

SEQ ID NO: 803043 - DNA, 25 bp, Mus musculus
tcagcctcagctacagttggcagga

SEQ ID NO: 803044 - DNA, 25 bp, Mus musculus
tcagcctcagcttcagttggcagga

SEQ ID NO: 803045 - DNA, 25 bp, Mus musculus
tcagcctcaggcacgggattcaccg

SEQ ID NO: 803046 - DNA, 25 bp, Mus musculus
tcagcctcaggctcgggattcaccg

SEQ ID NO: 803047 - DNA, 25 bp, Mus musculus
tcagcctcatccagtctgagtgagt

SEQ ID NO: 803048 - DNA, 25 bp, Mus musculus
tcagcctcatcctgtctgagtgagt

SEQ ID NO: 803049 - DNA, 25 bp, Mus musculus
tcagcctccaatagcaattccaagc

SEQ ID NO: 803050 - DNA, 25 bp, Mus musculus
tcagcctccaattgcaattccaagc

SEQ ID NO: 803051 - DNA, 25 bp, Mus musculus
tcagcctcccagaatcaagcacatt

SEQ ID NO: 803052 - DNA, 25 bp, Mus musculus
tcagcctcccagctgctgaaatgac

SEQ ID NO: 803053 - DNA, 25 bp, Mus musculus
tcagcctcccaggtgctgaaatgac

SEQ ID NO: 803054 - DNA, 25 bp, Mus musculus
tcagcctcccagtatcaagcacatt

SEQ ID NO: 803055 - DNA, 25 bp, Mus musculus
tcagcctcccgtcaggaatttttga

SEQ ID NO: 803056 - DNA, 25 bp, Mus musculus
tcagcctcccgtgaggaatttttga

SEQ ID NO: 803057 - DNA, 25 bp, Mus musculus
tcagcctccgttctgcaaactgaga

SEQ ID NO: 803058 - DNA, 25 bp, Mus musculus
tcagcctccgttgtgcaaactgaga

SEQ ID NO: 803059 - DNA, 25 bp, Mus musculus
tcagcctcctacaaaagtctctatt

SEQ ID NO: 803060 - DNA, 25 bp, Mus musculus
tcagcctcctacaagatacatgaga

SEQ ID NO: 803061 - DNA, 25 bp, Mus musculus
tcagcctcctactaaagtctctatt

SEQ ID NO: 803062 - DNA, 25 bp, Mus musculus
tcagcctcctactagatacatgaga

SEQ ID NO: 803063 - DNA, 25 bp, Mus musculus
tcagcctcctagatcctggaattac

SEQ ID NO: 803064 - DNA, 25 bp, Mus musculus
tcagcctcctagttcctggaattac

SEQ ID NO: 803065 - DNA, 25 bp, Mus musculus
tcagcctcctgtagctagtgttaca

SEQ ID NO: 803066 - DNA, 25 bp, Mus musculus
tcagcctcctgttgctagtgttaca

SEQ ID NO: 803067 - DNA, 25 bp, Mus musculus
tcagcctccttaatgcttggattca

SEQ ID NO: 803068 - DNA, 25 bp, Mus musculus
tcagcctccttattgcttggattca

SEQ ID NO: 803069 - DNA, 25 bp, Mus musculus
tcagcctcctttaaggacgcctgtg

SEQ ID NO: 803070 - DNA, 25 bp, Mus musculus
tcagcctccttttaggacgcctgtg

SEQ ID NO: 803071 - DNA, 25 bp, Mus musculus
tcagcctcgagaactaatcagagaa

SEQ ID NO: 803072 - DNA, 25 bp, Mus musculus
tcagcctcgagatctaatcagagaa

SEQ ID NO: 803073 - DNA, 25 bp, Mus musculus
tcagcctcgcggagcccgggaagct

SEQ ID NO: 803074 - DNA, 25 bp, Mus musculus
tcagcctcgcggtgcccgggaagct

SEQ ID NO: 803075 - DNA, 25 bp, Mus musculus
tcagcctcggtcacttcggagcagc

SEQ ID NO: 803076 - DNA, 25 bp, Mus musculus
tcagcctcggtctcttcggagcagc

SEQ ID NO: 803077 - DNA, 25 bp, Mus musculus
tcagcctcgtgaccagtgttcctga

SEQ ID NO: 803078 - DNA, 25 bp, Mus musculus
tcagcctcgtgagcagtgttcctga

SEQ ID NO: 803079 - DNA, 25 bp, Mus musculus
tcagcctcgtggaggccaggacgca

SEQ ID NO: 803080 - DNA, 25 bp, Mus musculus
tcagcctcgtggtggccaggacgca

SEQ ID NO: 803081 - DNA, 25 bp, Mus musculus
tcagcctctcaaatcgtggttaggg

SEQ ID NO: 803082 - DNA, 25 bp, Mus musculus
tcagcctctcaattcgtggttaggg

SEQ ID NO: 803083 - DNA, 25 bp, Mus musculus
tcagcctctctgatctcagaaggag

SEQ ID NO: 803084 - DNA, 25 bp, Mus musculus
tcagcctctctgttctcagaaggag

SEQ ID NO: 803085 - DNA, 25 bp, Mus musculus
tcagcctctgagaatctattcacgt

SEQ ID NO: 803086 - DNA, 25 bp, Mus musculus
tcagcctctgagtatctattcacgt

SEQ ID NO: 803087 - DNA, 25 bp, Mus musculus
tcagcctctgctacgagaagttcta

SEQ ID NO: 803088 - DNA, 25 bp, Mus musculus
tcagcctctgcttcgagaagttcta

SEQ ID NO: 803089 - DNA, 25 bp, Mus musculus
tcagcctctgtgatggccgtgtaag

SEQ ID NO: 803090 - DNA, 25 bp, Mus musculus
tcagcctctgtgttggccgtgtaag

SEQ ID NO: 803091 - DNA, 25 bp, Mus musculus
tcagcctcttctaggtttcttgaga

SEQ ID NO: 803092 - DNA, 25 bp, Mus musculus
tcagcctcttcttggtttcttgaga

SEQ ID NO: 803093 - DNA, 25 bp, Mus musculus
tcagcctgagccaccggagactctg

SEQ ID NO: 803094 - DNA, 25 bp, Mus musculus
tcagcctgagcctccggagactctg

SEQ ID NO: 803095 - DNA, 25 bp, Mus musculus
tcagcctgaggcatgaatctggcat

SEQ ID NO: 803096 - DNA, 25 bp, Mus musculus
tcagcctgaggcttgaatctggcat

SEQ ID NO: 803097 - DNA, 25 bp, Mus musculus
tcagcctgcagtaaattagcattct

SEQ ID NO: 803098 - DNA, 25 bp, Mus musculus
tcagcctgcagttaattagcattct

SEQ ID NO: 803099 - DNA, 25 bp, Mus musculus
tcagcctgccgtacttaatttagtg

SEQ ID NO: 803100 - DNA, 25 bp, Mus musculus
tcagcctgccgttcttaatttagtg

SEQ ID NO: 803101 - DNA, 25 bp, Mus musculus
tcagcctgcctgatacctgatcagg

SEQ ID NO: 803102 - DNA, 25 bp, Mus musculus
tcagcctgcctgttacctgatcagg

SEQ ID NO: 803103 - DNA, 25 bp, Mus musculus
tcagcctgccttcgctgcatcatat

SEQ ID NO: 803104 - DNA, 25 bp, Mus musculus
tcagcctgccttggctgcatcatat

SEQ ID NO: 803105 - DNA, 25 bp, Mus musculus
tcagcctgcgctcgtttgtaaccat

SEQ ID NO: 803106 - DNA, 25 bp, Mus musculus
tcagcctgcgctggtttgtaaccat

SEQ ID NO: 803107 - DNA, 25 bp, Mus musculus
tcagcctgctgcctaaatcggcaaa

SEQ ID NO: 803108 - DNA, 25 bp, Mus musculus
tcagcctgctgcgtaaatcggcaaa

SEQ ID NO: 803109 - DNA, 25 bp, Mus musculus
tcagcctgctggagcggagaaacca

SEQ ID NO: 803110 - DNA, 25 bp, Mus musculus
tcagcctgctggtgcggagaaacca

SEQ ID NO: 803111 - DNA, 25 bp, Mus musculus
tcagcctggaaaactggacagttcc

SEQ ID NO: 803112 - DNA, 25 bp, Mus musculus
tcagcctggaaaccttgcttcgata

SEQ ID NO: 803113 - DNA, 25 bp, Mus musculus
tcagcctggaaagcttgcttcgata

SEQ ID NO: 803114 - DNA, 25 bp, Mus musculus
tcagcctggaaatctggacagttcc

SEQ ID NO: 803115 - DNA, 25 bp, Mus musculus
tcagcctggaatcagtctgcctttc

SEQ ID NO: 803116 - DNA, 25 bp, Mus musculus
tcagcctggaatgagtctgcctttc

SEQ ID NO: 803117 - DNA, 25 bp, Mus musculus
tcagcctggacacgtgggtttctta

SEQ ID NO: 803118 - DNA, 25 bp, Mus musculus
tcagcctggacaggtgggtttctta

SEQ ID NO: 803119 - DNA, 25 bp, Mus musculus
tcagcctggagcactaagtggtcca

SEQ ID NO: 803120 - DNA, 25 bp, Mus musculus
tcagcctggagctctaagtggtcca

SEQ ID NO: 803121 - DNA, 25 bp, Mus musculus
tcagcctggcctaccagacagaagc

SEQ ID NO: 803122 - DNA, 25 bp, Mus musculus
tcagcctggccttccagacagaagc

SEQ ID NO: 803123 - DNA, 25 bp, Mus musculus
tcagcctgtataaccctcattccag

SEQ ID NO: 803124 - DNA, 25 bp, Mus musculus
tcagcctgtatatccctcattccag

SEQ ID NO: 803125 - DNA, 25 bp, Mus musculus
tcagcctgtgggatatgactcccca

SEQ ID NO: 803126 - DNA, 25 bp, Mus musculus
tcagcctgtgggttatgactcccca

SEQ ID NO: 803127 - DNA, 25 bp, Mus musculus
tcagccttaatgattgcccatttca

SEQ ID NO: 803128 - DNA, 25 bp, Mus musculus
tcagccttaatgtttgcccatttca

SEQ ID NO: 803129 - DNA, 25 bp, Mus musculus
tcagccttcaggctgatctaggaaa

SEQ ID NO: 803130 - DNA, 25 bp, Mus musculus
tcagccttcagggtgatctaggaaa

SEQ ID NO: 803131 - DNA, 25 bp, Mus musculus
tcagccttcattaatcgcatgggtt

SEQ ID NO: 803132 - DNA, 25 bp, Mus musculus
tcagccttcatttatcgcatgggtt

SEQ ID NO: 803133 - DNA, 25 bp, Mus musculus
tcagccttccagctgttgctgtgag

SEQ ID NO: 803134 - DNA, 25 bp, Mus musculus
tcagccttccaggtgttgctgtgag

SEQ ID NO: 803135 - DNA, 25 bp, Mus musculus
tcagccttcctaagttacccgttga

SEQ ID NO: 803136 - DNA, 25 bp, Mus musculus
tcagccttcctatgttacccgttga

SEQ ID NO: 803137 - DNA, 25 bp, Mus musculus
tcagccttctaaatgatgggatcat

SEQ ID NO: 803138 - DNA, 25 bp, Mus musculus
tcagccttctaattgatgggatcat

SEQ ID NO: 803139 - DNA, 25 bp, Mus musculus
tcagccttctcaatggataacaggt

SEQ ID NO: 803140 - DNA, 25 bp, Mus musculus
tcagccttctcactttgtcatgaaa

SEQ ID NO: 803141 - DNA, 25 bp, Mus musculus
tcagccttctcagtttgtcatgaaa

SEQ ID NO: 803142 - DNA, 25 bp, Mus musculus
tcagccttctcattggataacaggt

SEQ ID NO: 803143 - DNA, 25 bp, Mus musculus
tcagccttctttagggagttggtgg

SEQ ID NO: 803144 - DNA, 25 bp, Mus musculus
tcagccttcttttgggagttggtgg

SEQ ID NO: 803145 - DNA, 25 bp, Mus musculus
tcagccttgaacacagtatgtaagc

SEQ ID NO: 803146 - DNA, 25 bp, Mus musculus
tcagccttgaactcagtatgtaagc

SEQ ID NO: 803147 - DNA, 25 bp, Mus musculus
tcagccttgactacatatgaagtta

SEQ ID NO: 803148 - DNA, 25 bp, Mus musculus
tcagccttgactaggctcttctcac

SEQ ID NO: 803149 - DNA, 25 bp, Mus musculus
tcagccttgacttcatatgaagtta

SEQ ID NO: 803150 - DNA, 25 bp, Mus musculus
tcagccttgacttggctcttctcac

SEQ ID NO: 803151 - DNA, 25 bp, Mus musculus
tcagccttgagacgccaaagtcctg

SEQ ID NO: 803152 - DNA, 25 bp, Mus musculus
tcagccttgagaggccaaagtcctg

SEQ ID NO: 803153 - DNA, 25 bp, Mus musculus
tcagccttgcgccttaacactaagc

SEQ ID NO: 803154 - DNA, 25 bp, Mus musculus
tcagccttgcgcgttaacactaagc

SEQ ID NO: 803155 - DNA, 25 bp, Mus musculus
tcagccttggctaggtaacaacttg

SEQ ID NO: 803156 - DNA, 25 bp, Mus musculus
tcagccttggcttggtaacaacttg

SEQ ID NO: 803157 - DNA, 25 bp, Mus musculus
tcagccttgggtcttctcctttgaa

SEQ ID NO: 803158 - DNA, 25 bp, Mus musculus
tcagccttgggtgttctcctttgaa

SEQ ID NO: 803159 - DNA, 25 bp, Mus musculus
tcagccttggttctgtatcgtgtaa

SEQ ID NO: 803160 - DNA, 25 bp, Mus musculus
tcagccttggttgtgtatcgtgtaa

SEQ ID NO: 803161 - DNA, 25 bp, Mus musculus
tcagcctttaagaaacggttctcaa

SEQ ID NO: 803162 - DNA, 25 bp, Mus musculus
tcagcctttaagtaacggttctcaa

SEQ ID NO: 803163 - DNA, 25 bp, Mus musculus
tcagcctttcacaagatctttggtc

SEQ ID NO: 803164 - DNA, 25 bp, Mus musculus
tcagcctttcactagatctttggtc

SEQ ID NO: 803165 - DNA, 25 bp, Mus musculus
tcagcctttctaaaggttttccctt

SEQ ID NO: 803166 - DNA, 25 bp, Mus musculus
tcagcctttctataggttttccctt

SEQ ID NO: 803167 - DNA, 25 bp, Mus musculus
tcagcctttctgagcagcctagggc

SEQ ID NO: 803168 - DNA, 25 bp, Mus musculus
tcagcctttctgtgcagcctagggc

SEQ ID NO: 803169 - DNA, 25 bp, Mus musculus
tcagcctttgggacgttgacgagtt

SEQ ID NO: 803170 - DNA, 25 bp, Mus musculus
tcagcctttgggtcgttgacgagtt

SEQ ID NO: 803171 - DNA, 25 bp, Mus musculus
tcagccttttctcagatgccacaga

SEQ ID NO: 803172 - DNA, 25 bp, Mus musculus
tcagccttttctgagatgccacaga

SEQ ID NO: 803173 - DNA, 25 bp, Mus musculus
tcagccttttgcagaatctcctggg

SEQ ID NO: 803174 - DNA, 25 bp, Mus musculus
tcagccttttgctgaatctcctggg

SEQ ID NO: 803175 - DNA, 25 bp, Mus musculus
tcagcgaaccccacgaaagtggaat

SEQ ID NO: 803176 - DNA, 25 bp, Mus musculus
tcagcgaacccctcgaaagtggaat

SEQ ID NO: 803177 - DNA, 25 bp, Mus musculus
tcagcgaaccttcgctttggtcaga

SEQ ID NO: 803178 - DNA, 25 bp, Mus musculus
tcagcgaaccttggctttggtcaga

SEQ ID NO: 803179 - DNA, 25 bp, Mus musculus
tcagcgaaggcaatttgcttttgtt

SEQ ID NO: 803180 - DNA, 25 bp, Mus musculus
tcagcgaaggcattttgcttttgtt

SEQ ID NO: 803181 - DNA, 25 bp, Mus musculus
tcagcgacaattcctcattcagcag

SEQ ID NO: 803182 - DNA, 25 bp, Mus musculus
tcagcgacaattgctcattcagcag

SEQ ID NO: 803183 - DNA, 25 bp, Mus musculus
tcagcgacagcgagctgcagcacat

SEQ ID NO: 803184 - DNA, 25 bp, Mus musculus
tcagcgacagcgtgctgcagcacat

SEQ ID NO: 803185 - DNA, 25 bp, Mus musculus
tcagcgactcctcagtgtgggctat

SEQ ID NO: 803186 - DNA, 25 bp, Mus musculus
tcagcgactcctgagtgtgggctat

SEQ ID NO: 803187 - DNA, 25 bp, Mus musculus
tcagcgagaagcctgttactctgcc

SEQ ID NO: 803188 - DNA, 25 bp, Mus musculus
tcagcgagaagcgtgttactctgcc

SEQ ID NO: 803189 - DNA, 25 bp, Mus musculus
tcagcgagctaacataccctgcctg

SEQ ID NO: 803190 - DNA, 25 bp, Mus musculus
tcagcgagctaagataccctgcctg

SEQ ID NO: 803191 - DNA, 25 bp, Mus musculus
tcagcgagctcacgccttgatgttc

SEQ ID NO: 803192 - DNA, 25 bp, Mus musculus
tcagcgagctcaggccttgatgttc

SEQ ID NO: 803193 - DNA, 25 bp, Mus musculus
tcagcgagctgtagaagaaagccat

SEQ ID NO: 803194 - DNA, 25 bp, Mus musculus
tcagcgagctgttgaagaaagccat

SEQ ID NO: 803195 - DNA, 25 bp, Mus musculus
tcagcgaggaaaaccctagccaaga

SEQ ID NO: 803196 - DNA, 25 bp, Mus musculus
tcagcgaggaaatccctagccaaga

SEQ ID NO: 803197 - DNA, 25 bp, Mus musculus
tcagcgagtcacaccagacagtgaa

SEQ ID NO: 803198 - DNA, 25 bp, Mus musculus
tcagcgagtcactccagacagtgaa

SEQ ID NO: 803199 - DNA, 25 bp, Mus musculus
tcagcgatcctgacttgttcaagat

SEQ ID NO: 803200 - DNA, 25 bp, Mus musculus
tcagcgatcctgtcttgttcaagat

SEQ ID NO: 803201 - DNA, 25 bp, Mus musculus
tcagcgatcgtgcacaccctggcta

SEQ ID NO: 803202 - DNA, 25 bp, Mus musculus
tcagcgatcgtggacaccctggcta

SEQ ID NO: 803203 - DNA, 25 bp, Mus musculus
tcagcgatgccccaactgtggaacc

SEQ ID NO: 803204 - DNA, 25 bp, Mus musculus
tcagcgatgcccgaactgtggaacc

SEQ ID NO: 803205 - DNA, 25 bp, Mus musculus
tcagcgatgcggactagtaatgttc

SEQ ID NO: 803206 - DNA, 25 bp, Mus musculus
tcagcgatgcggtctagtaatgttc

SEQ ID NO: 803207 - DNA, 25 bp, Mus musculus
tcagcgattagaactgaccctccta

SEQ ID NO: 803208 - DNA, 25 bp, Mus musculus
tcagcgattagatctgaccctccta

SEQ ID NO: 803209 - DNA, 25 bp, Mus musculus
tcagcgcaatgcaggtggccgacaa

SEQ ID NO: 803210 - DNA, 25 bp, Mus musculus
tcagcgcaatgctggtggccgacaa

SEQ ID NO: 803211 - DNA, 25 bp, Mus musculus
tcagcgcagcgtatgggagtagact

SEQ ID NO: 803212 - DNA, 25 bp, Mus musculus
tcagcgcagcgtttgggagtagact

SEQ ID NO: 803213 - DNA, 25 bp, Mus musculus
tcagcgcatgcaactgtctcaactg

SEQ ID NO: 803214 - DNA, 25 bp, Mus musculus
tcagcgcatgcatctgtctcaactg

SEQ ID NO: 803215 - DNA, 25 bp, Mus musculus
tcagcgcccatgactgtatatgttg

SEQ ID NO: 803216 - DNA, 25 bp, Mus musculus
tcagcgcccatgtctgtatatgttg

SEQ ID NO: 803217 - DNA, 25 bp, Mus musculus
tcagcgccgagaagagatgctccga

SEQ ID NO: 803218 - DNA, 25 bp, Mus musculus
tcagcgccgagatgagatgctccga

SEQ ID NO: 803219 - DNA, 25 bp, Mus musculus
tcagcgcctccacatgggccatgga

SEQ ID NO: 803220 - DNA, 25 bp, Mus musculus
tcagcgcctccagatgggccatgga

SEQ ID NO: 803221 - DNA, 25 bp, Mus musculus
tcagcgcctgctacttgcaaagagt

SEQ ID NO: 803222 - DNA, 25 bp, Mus musculus
tcagcgcctgcttcttgcaaagagt

SEQ ID NO: 803223 - DNA, 25 bp, Mus musculus
tcagcgcgggagacatttgactctt

SEQ ID NO: 803224 - DNA, 25 bp, Mus musculus
tcagcgcgggagtcatttgactctt

SEQ ID NO: 803225 - DNA, 25 bp, Mus musculus
tcagcgcgtctccttgtgtgtacga

SEQ ID NO: 803226 - DNA, 25 bp, Mus musculus
tcagcgcgtctcgttgtgtgtacga

SEQ ID NO: 803227 - DNA, 25 bp, Mus musculus
tcagcgcgtgcgatgccttgatctt

SEQ ID NO: 803228 - DNA, 25 bp, Mus musculus
tcagcgcgtgcgttgccttgatctt

SEQ ID NO: 803229 - DNA, 25 bp, Mus musculus
tcagcgctgcggacattgggcaagt

SEQ ID NO: 803230 - DNA, 25 bp, Mus musculus
tcagcgctgcggtcattgggcaagt

SEQ ID NO: 803231 - DNA, 25 bp, Mus musculus
tcagcgctgtgcagaggttcctgga

SEQ ID NO: 803232 - DNA, 25 bp, Mus musculus
tcagcgctgtgctgaggttcctgga

SEQ ID NO: 803233 - DNA, 25 bp, Mus musculus
tcagcgctgttgagctcagcttaat

SEQ ID NO: 803234 - DNA, 25 bp, Mus musculus
tcagcgctgttgtgctcagcttaat

SEQ ID NO: 803235 - DNA, 25 bp, Mus musculus
tcagcgcttggaacattgctcttct

SEQ ID NO: 803236 - DNA, 25 bp, Mus musculus
tcagcgcttggatcattgctcttct

SEQ ID NO: 803237 - DNA, 25 bp, Mus musculus
tcagcgctttggctactgggtataa

SEQ ID NO: 803238 - DNA, 25 bp, Mus musculus
tcagcgctttgggtactgggtataa

SEQ ID NO: 803239 - DNA, 25 bp, Mus musculus
tcagcggaccaccatttcaagactt

SEQ ID NO: 803240 - DNA, 25 bp, Mus musculus
tcagcggaccacgatttcaagactt

SEQ ID NO: 803241 - DNA, 25 bp, Mus musculus
tcagcggatcgaagacgtggctatc

SEQ ID NO: 803242 - DNA, 25 bp, Mus musculus
tcagcggatcgatgacgtggctatc

SEQ ID NO: 803243 - DNA, 25 bp, Mus musculus
tcagcggcatccagctcatggcctt

SEQ ID NO: 803244 - DNA, 25 bp, Mus musculus
tcagcggcatcctgctcatggcctt

SEQ ID NO: 803245 - DNA, 25 bp, Mus musculus
tcagcggccaccagagcggctagcg

SEQ ID NO: 803246 - DNA, 25 bp, Mus musculus
tcagcggccacctgagcggctagcg

SEQ ID NO: 803247 - DNA, 25 bp, Mus musculus
tcagcggccatcatgggtttccaca

SEQ ID NO: 803248 - DNA, 25 bp, Mus musculus
tcagcggccatcttgggtttccaca

SEQ ID NO: 803249 - DNA, 25 bp, Mus musculus
tcagcggcgatgactctggtgacct

SEQ ID NO: 803250 - DNA, 25 bp, Mus musculus
tcagcggcgatgtctctggtgacct

SEQ ID NO: 803251 - DNA, 25 bp, Mus musculus
tcagcggctaatatgcactcgtaaa

SEQ ID NO: 803252 - DNA, 25 bp, Mus musculus
tcagcggctaatttgcactcgtaaa

SEQ ID NO: 803253 - DNA, 25 bp, Mus musculus
tcagcgggagcccagagagcttacc

SEQ ID NO: 803254 - DNA, 25 bp, Mus musculus
tcagcgggagccgagagagcttacc

SEQ ID NO: 803255 - DNA, 25 bp, Mus musculus
tcagcgggccctaagattttcgaaa

SEQ ID NO: 803256 - DNA, 25 bp, Mus musculus
tcagcgggcccttagattttcgaaa

SEQ ID NO: 803257 - DNA, 25 bp, Mus musculus
tcagcggtaatcctttccactgtga

SEQ ID NO: 803258 - DNA, 25 bp, Mus musculus
tcagcggtaatcgtttccactgtga

SEQ ID NO: 803259 - DNA, 25 bp, Mus musculus
tcagcggtacctcgaatcttctcag

SEQ ID NO: 803260 - DNA, 25 bp, Mus musculus
tcagcggtacctggaatcttctcag

SEQ ID NO: 803261 - DNA, 25 bp, Mus musculus
tcagcggtgcacctggacatcagac

SEQ ID NO: 803262 - DNA, 25 bp, Mus musculus
tcagcggtgcacgtggacatcagac

SEQ ID NO: 803263 - DNA, 25 bp, Mus musculus
tcagcggtggtaatgtcaacccttt

SEQ ID NO: 803264 - DNA, 25 bp, Mus musculus
tcagcggtggtattgtcaacccttt

SEQ ID NO: 803265 - DNA, 25 bp, Mus musculus
tcagcggttctaaggataccgaagg

SEQ ID NO: 803266 - DNA, 25 bp, Mus musculus
tcagcggttctatggataccgaagg

SEQ ID NO: 803267 - DNA, 25 bp, Mus musculus
tcagcgtatgttaggcttacctaac

SEQ ID NO: 803268 - DNA, 25 bp, Mus musculus
tcagcgtatgtttggcttacctaac

SEQ ID NO: 803269 - DNA, 25 bp, Mus musculus
tcagcgtcaaacacaacctggaggt

SEQ ID NO: 803270 - DNA, 25 bp, Mus musculus
tcagcgtcaaactcaacctggaggt

SEQ ID NO: 803271 - DNA, 25 bp, Mus musculus
tcagcgtcagcccaatgctaatatc

SEQ ID NO: 803272 - DNA, 25 bp, Mus musculus
tcagcgtcagccgaatgctaatatc

SEQ ID NO: 803273 - DNA, 25 bp, Mus musculus
tcagcgtcagttaagatggcacccg

SEQ ID NO: 803274 - DNA, 25 bp, Mus musculus
tcagcgtcagtttagatggcacccg

SEQ ID NO: 803275 - DNA, 25 bp, Mus musculus
tcagcgtcatccagctctgaccaat

SEQ ID NO: 803276 - DNA, 25 bp, Mus musculus
tcagcgtcatcctgctctgaccaat

SEQ ID NO: 803277 - DNA, 25 bp, Mus musculus
tcagcgtccagtctgttccgggaag

SEQ ID NO: 803278 - DNA, 25 bp, Mus musculus
tcagcgtccagtgtgttccgggaag

SEQ ID NO: 803279 - DNA, 25 bp, Mus musculus
tcagcgtcgctaagtaaccaagagt

SEQ ID NO: 803280 - DNA, 25 bp, Mus musculus
tcagcgtcgctatgtaaccaagagt

SEQ ID NO: 803281 - DNA, 25 bp, Mus musculus
tcagcgtctaaaacagttggccgtt

SEQ ID NO: 803282 - DNA, 25 bp, Mus musculus
tcagcgtctaaatcagttggccgtt

SEQ ID NO: 803283 - DNA, 25 bp, Mus musculus
tcagcgtctcataccgatcgtgcgt

SEQ ID NO: 803284 - DNA, 25 bp, Mus musculus
tcagcgtctcattccgatcgtgcgt

SEQ ID NO: 803285 - DNA, 25 bp, Mus musculus
tcagcgtgccagaagaaccctagtt

SEQ ID NO: 803286 - DNA, 25 bp, Mus musculus
tcagcgtgccagtagaaccctagtt

SEQ ID NO: 803287 - DNA, 25 bp, Mus musculus
tcagcgtgctggatctcagttacaa

SEQ ID NO: 803288 - DNA, 25 bp, Mus musculus
tcagcgtgctggttctcagttacaa

SEQ ID NO: 803289 - DNA, 25 bp, Mus musculus
tcagcgtggcctctgagagtcataa

SEQ ID NO: 803290 - DNA, 25 bp, Mus musculus
tcagcgtggcctgtgagagtcataa

SEQ ID NO: 803291 - DNA, 25 bp, Mus musculus
tcagcgttcactctcatgggccaga

SEQ ID NO: 803292 - DNA, 25 bp, Mus musculus
tcagcgttcactgtcatgggccaga

SEQ ID NO: 803293 - DNA, 25 bp, Mus musculus
tcagcgttcctacccgagaagtgtc

SEQ ID NO: 803294 - DNA, 25 bp, Mus musculus
tcagcgttcctagccgagaagtgtc

SEQ ID NO: 803295 - DNA, 25 bp, Mus musculus
tcagcgttcgcacattacttttcaa

SEQ ID NO: 803296 - DNA, 25 bp, Mus musculus
tcagcgttcgcagattacttttcaa

SEQ ID NO: 803297 - DNA, 25 bp, Mus musculus
tcagctaaaagtccaagccagattt

SEQ ID NO: 803298 - DNA, 25 bp, Mus musculus
tcagctaaaagtgcaagccagattt

SEQ ID NO: 803299 - DNA, 25 bp, Mus musculus
tcagctaactgcaccatttaccaat

SEQ ID NO: 803300 - DNA, 25 bp, Mus musculus
tcagctaactgctccatttaccaat

SEQ ID NO: 803301 - DNA, 25 bp, Mus musculus
tcagctaagctaattctctttgtaa

SEQ ID NO: 803302 - DNA, 25 bp, Mus musculus
tcagctaagctatttctctttgtaa

SEQ ID NO: 803303 - DNA, 25 bp, Mus musculus
tcagctaatcgtctaacccaaaagg

SEQ ID NO: 803304 - DNA, 25 bp, Mus musculus
tcagctaatcgtgtaacccaaaagg

SEQ ID NO: 803305 - DNA, 25 bp, Mus musculus
tcagctacaagccatatattccaga

SEQ ID NO: 803306 - DNA, 25 bp, Mus musculus
tcagctacaagcgatatattccaga

SEQ ID NO: 803307 - DNA, 25 bp, Mus musculus
tcagctacacacattctctgggaac

SEQ ID NO: 803308 - DNA, 25 bp, Mus musculus
tcagctacacactttctctgggaac

SEQ ID NO: 803309 - DNA, 25 bp, Mus musculus
tcagctacagttcgcaggagggacc

SEQ ID NO: 803310 - DNA, 25 bp, Mus musculus
tcagctacagttggcaggagggacc

SEQ ID NO: 803311 - DNA, 25 bp, Mus musculus
tcagctacatctatgcgactgtctt

SEQ ID NO: 803312 - DNA, 25 bp, Mus musculus
tcagctacatctttgcgactgtctt

SEQ ID NO: 803313 - DNA, 25 bp, Mus musculus
tcagctacatgacggcagtggattt

SEQ ID NO: 803314 - DNA, 25 bp, Mus musculus
tcagctacatgagggcagtggattt

SEQ ID NO: 803315 - DNA, 25 bp, Mus musculus
tcagctacatgcattcggggtggaa

SEQ ID NO: 803316 - DNA, 25 bp, Mus musculus
tcagctacatgctttcggggtggaa

SEQ ID NO: 803317 - DNA, 25 bp, Mus musculus
tcagctaccactctttctaatcagg

SEQ ID NO: 803318 - DNA, 25 bp, Mus musculus
tcagctaccactgtttctaatcagg

SEQ ID NO: 803319 - DNA, 25 bp, Mus musculus
tcagctacggctactttcacacact

SEQ ID NO: 803320 - DNA, 25 bp, Mus musculus
tcagctacggcttctttcacacact

SEQ ID NO: 803321 - DNA, 25 bp, Mus musculus
tcagctactgccactaacaagtttt

SEQ ID NO: 803322 - DNA, 25 bp, Mus musculus
tcagctactgcctctaacaagtttt

SEQ ID NO: 803323 - DNA, 25 bp, Mus musculus
tcagctactgttctagtgccatctg

SEQ ID NO: 803324 - DNA, 25 bp, Mus musculus
tcagctactgttgtagtgccatctg

SEQ ID NO: 803325 - DNA, 25 bp, Mus musculus
tcagctacttaaacaacctccgtgt

SEQ ID NO: 803326 - DNA, 25 bp, Mus musculus
tcagctacttaatcaacctccgtgt

SEQ ID NO: 803327 - DNA, 25 bp, Mus musculus
tcagctacttacagtgttactctgt

SEQ ID NO: 803328 - DNA, 25 bp, Mus musculus
tcagctacttactgtgttactctgt

SEQ ID NO: 803329 - DNA, 25 bp, Mus musculus
tcagctacttagagagctcccatct

SEQ ID NO: 803330 - DNA, 25 bp, Mus musculus
tcagctacttagtgagctcccatct

SEQ ID NO: 803331 - DNA, 25 bp, Mus musculus
tcagctacttttatgagtcggtcag

SEQ ID NO: 803332 - DNA, 25 bp, Mus musculus
tcagctacttttttgagtcggtcag

SEQ ID NO: 803333 - DNA, 25 bp, Mus musculus
tcagctagagctacatttttatacc

SEQ ID NO: 803334 - DNA, 25 bp, Mus musculus
tcagctagagcttcatttttatacc

SEQ ID NO: 803335 - DNA, 25 bp, Mus musculus
tcagctagcacaactttctcctaga

SEQ ID NO: 803336 - DNA, 25 bp, Mus musculus
tcagctagcacatctttctcctaga

SEQ ID NO: 803337 - DNA, 25 bp, Mus musculus
tcagctaggtagatagctcagagct

SEQ ID NO: 803338 - DNA, 25 bp, Mus musculus
tcagctaggtagttagctcagagct

SEQ ID NO: 803339 - DNA, 25 bp, Mus musculus
tcagctaggtctacgtagagagttc

SEQ ID NO: 803340 - DNA, 25 bp, Mus musculus
tcagctaggtcttcgtagagagttc

SEQ ID NO: 803341 - DNA, 25 bp, Mus musculus
tcagctagtaagagccgcctgcaga

SEQ ID NO: 803342 - DNA, 25 bp, Mus musculus
tcagctagtaagtgccgcctgcaga

SEQ ID NO: 803343 - DNA, 25 bp, Mus musculus
tcagctagtcctcgccagtgagata

SEQ ID NO: 803344 - DNA, 25 bp, Mus musculus
tcagctagtcctggccagtgagata

SEQ ID NO: 803345 - DNA, 25 bp, Mus musculus
tcagctagtctgcttactggttcag

SEQ ID NO: 803346 - DNA, 25 bp, Mus musculus
tcagctagtctggttactggttcag

SEQ ID NO: 803347 - DNA, 25 bp, Mus musculus
tcagctagtgtacttctggacagtc

SEQ ID NO: 803348 - DNA, 25 bp, Mus musculus
tcagctagtgtagttctggacagtc

SEQ ID NO: 803349 - DNA, 25 bp, Mus musculus
tcagctagttctcctttgccaggaa

SEQ ID NO: 803350 - DNA, 25 bp, Mus musculus
tcagctagttctgctttgccaggaa

SEQ ID NO: 803351 - DNA, 25 bp, Mus musculus
tcagctagttgtcttttacctttct

SEQ ID NO: 803352 - DNA, 25 bp, Mus musculus
tcagctagttgtgttttacctttct

SEQ ID NO: 803353 - DNA, 25 bp, Mus musculus
tcagctatatcaaactgaccagtag

SEQ ID NO: 803354 - DNA, 25 bp, Mus musculus
tcagctatatcatactgaccagtag

SEQ ID NO: 803355 - DNA, 25 bp, Mus musculus
tcagctatctcactatgctatataa

SEQ ID NO: 803356 - DNA, 25 bp, Mus musculus
tcagctatctcagtatgctatataa

SEQ ID NO: 803357 - DNA, 25 bp, Mus musculus
tcagctatgccaccacagttagtat

SEQ ID NO: 803358 - DNA, 25 bp, Mus musculus
tcagctatgccagcacagttagtat

SEQ ID NO: 803359 - DNA, 25 bp, Mus musculus
tcagctatggagaacctagtaccca

SEQ ID NO: 803360 - DNA, 25 bp, Mus musculus
tcagctatggagtacctagtaccca

SEQ ID NO: 803361 - DNA, 25 bp, Mus musculus
tcagctatgtaactcagcttgggct

SEQ ID NO: 803362 - DNA, 25 bp, Mus musculus
tcagctatgtaagtcagcttgggct

SEQ ID NO: 803363 - DNA, 25 bp, Mus musculus
tcagctattctgaaaattgtgtaca

SEQ ID NO: 803364 - DNA, 25 bp, Mus musculus
tcagctattctgtaaattgtgtaca

SEQ ID NO: 803365 - DNA, 25 bp, Mus musculus
tcagctcaaaaaccgattggtggat

SEQ ID NO: 803366 - DNA, 25 bp, Mus musculus
tcagctcaaaaagcgattggtggat

SEQ ID NO: 803367 - DNA, 25 bp, Mus musculus
tcagctcaacatatgtcagtacttt

SEQ ID NO: 803368 - DNA, 25 bp, Mus musculus
tcagctcaacatttgtcagtacttt

SEQ ID NO: 803369 - DNA, 25 bp, Mus musculus
tcagctcaagggattagcactggtt

SEQ ID NO: 803370 - DNA, 25 bp, Mus musculus
tcagctcaagggtttagcactggtt

SEQ ID NO: 803371 - DNA, 25 bp, Mus musculus
tcagctcacagcaaacttgcagcaa

SEQ ID NO: 803372 - DNA, 25 bp, Mus musculus
tcagctcacagctaacttgcagcaa

SEQ ID NO: 803373 - DNA, 25 bp, Mus musculus
tcagctcacaggattgtaactacaa

SEQ ID NO: 803374 - DNA, 25 bp, Mus musculus
tcagctcacaggtttgtaactacaa

SEQ ID NO: 803375 - DNA, 25 bp, Mus musculus
tcagctcaccttccacgtgttagaa

SEQ ID NO: 803376 - DNA, 25 bp, Mus musculus
tcagctcaccttgcacgtgttagaa

SEQ ID NO: 803377 - DNA, 25 bp, Mus musculus
tcagctcactctatccaactatgtg

SEQ ID NO: 803378 - DNA, 25 bp, Mus musculus
tcagctcactctttccaactatgtg

SEQ ID NO: 803379 - DNA, 25 bp, Mus musculus
tcagctcactgcataactgaacata

SEQ ID NO: 803380 - DNA, 25 bp, Mus musculus
tcagctcactgcttaactgaacata

SEQ ID NO: 803381 - DNA, 25 bp, Mus musculus
tcagctcagaccaaggacccttagt

SEQ ID NO: 803382 - DNA, 25 bp, Mus musculus
tcagctcagacctaggacccttagt

SEQ ID NO: 803383 - DNA, 25 bp, Mus musculus
tcagctcagagtccaggtccttaaa

SEQ ID NO: 803384 - DNA, 25 bp, Mus musculus
tcagctcagagtgcaggtccttaaa

SEQ ID NO: 803385 - DNA, 25 bp, Mus musculus
tcagctcagcagaaccacttgactg

SEQ ID NO: 803386 - DNA, 25 bp, Mus musculus
tcagctcagcagtaccacttgactg

SEQ ID NO: 803387 - DNA, 25 bp, Mus musculus
tcagctcagccacatgtgctcaagt

SEQ ID NO: 803388 - DNA, 25 bp, Mus musculus
tcagctcagccagatgtgctcaagt

SEQ ID NO: 803389 - DNA, 25 bp, Mus musculus
tcagctcagctgattatttaccaaa

SEQ ID NO: 803390 - DNA, 25 bp, Mus musculus
tcagctcagctgtttatttaccaaa

SEQ ID NO: 803391 - DNA, 25 bp, Mus musculus
tcagctcagcttaacgcccttagtg

SEQ ID NO: 803392 - DNA, 25 bp, Mus musculus
tcagctcagcttctcaaaagtgcct

SEQ ID NO: 803393 - DNA, 25 bp, Mus musculus
tcagctcagcttgtcaaaagtgcct

SEQ ID NO: 803394 - DNA, 25 bp, Mus musculus
tcagctcagctttacgcccttagtg

SEQ ID NO: 803395 - DNA, 25 bp, Mus musculus
tcagctcaggcgctcataatgcaaa

SEQ ID NO: 803396 - DNA, 25 bp, Mus musculus
tcagctcaggcggtcataatgcaaa

SEQ ID NO: 803397 - DNA, 25 bp, Mus musculus
tcagctcagggtagaccccgatgtt

SEQ ID NO: 803398 - DNA, 25 bp, Mus musculus
tcagctcagggttgaccccgatgtt

SEQ ID NO: 803399 - DNA, 25 bp, Mus musculus
tcagctcagtatcccgttcctaaaa

SEQ ID NO: 803400 - DNA, 25 bp, Mus musculus
tcagctcagtatgccgttcctaaaa

SEQ ID NO: 803401 - DNA, 25 bp, Mus musculus
tcagctcagtcacacctgaggctaa

SEQ ID NO: 803402 - DNA, 25 bp, Mus musculus
tcagctcagtcagacctgaggctaa

SEQ ID NO: 803403 - DNA, 25 bp, Mus musculus
tcagctcatcctcagggttccaaag

SEQ ID NO: 803404 - DNA, 25 bp, Mus musculus
tcagctcatcctgagggttccaaag

SEQ ID NO: 803405 - DNA, 25 bp, Mus musculus
tcagctcatcgtcttttcaaccagt

SEQ ID NO: 803406 - DNA, 25 bp, Mus musculus
tcagctcatcgtgttttcaaccagt

SEQ ID NO: 803407 - DNA, 25 bp, Mus musculus
tcagctcatggaatggtggctctat

SEQ ID NO: 803408 - DNA, 25 bp, Mus musculus
tcagctcatggattggtggctctat

SEQ ID NO: 803409 - DNA, 25 bp, Mus musculus
tcagctcatggtatgtaccccggag

SEQ ID NO: 803410 - DNA, 25 bp, Mus musculus
tcagctcatggtttgtaccccggag

SEQ ID NO: 803411 - DNA, 25 bp, Mus musculus
tcagctcattataaaacttacccat

SEQ ID NO: 803412 - DNA, 25 bp, Mus musculus
tcagctcattattaaacttacccat

SEQ ID NO: 803413 - DNA, 25 bp, Mus musculus
tcagctcattgaccactaccgagtt

SEQ ID NO: 803414 - DNA, 25 bp, Mus musculus
tcagctcattgagcactaccgagtt

SEQ ID NO: 803415 - DNA, 25 bp, Mus musculus
tcagctccaaatccctgtgaagact

SEQ ID NO: 803416 - DNA, 25 bp, Mus musculus
tcagctccaaatgcctgtgaagact

SEQ ID NO: 803417 - DNA, 25 bp, Mus musculus
tcagctccacttcatgttcttgtcc

SEQ ID NO: 803418 - DNA, 25 bp, Mus musculus
tcagctccacttgatgttcttgtcc

SEQ ID NO: 803419 - DNA, 25 bp, Mus musculus
tcagctccagagatgaaatgacatc

SEQ ID NO: 803420 - DNA, 25 bp, Mus musculus
tcagctccagagctatacaagtcag

SEQ ID NO: 803421 - DNA, 25 bp, Mus musculus
tcagctccagaggtatacaagtcag

SEQ ID NO: 803422 - DNA, 25 bp, Mus musculus
tcagctccagagttgaaatgacatc

SEQ ID NO: 803423 - DNA, 25 bp, Mus musculus
tcagctccagttccctgggctcatg

SEQ ID NO: 803424 - DNA, 25 bp, Mus musculus
tcagctccagttgcctgggctcatg

SEQ ID NO: 803425 - DNA, 25 bp, Mus musculus
tcagctccatgacagcagggacatt

SEQ ID NO: 803426 - DNA, 25 bp, Mus musculus
tcagctccatgagagcagggacatt

SEQ ID NO: 803427 - DNA, 25 bp, Mus musculus
tcagctccatgcctacttgtaaaaa

SEQ ID NO: 803428 - DNA, 25 bp, Mus musculus
tcagctccatgcgtacttgtaaaaa

SEQ ID NO: 803429 - DNA, 25 bp, Mus musculus
tcagctccatgtaaactcagtgtgt

SEQ ID NO: 803430 - DNA, 25 bp, Mus musculus
tcagctccatgttaactcagtgtgt

SEQ ID NO: 803431 - DNA, 25 bp, Mus musculus
tcagctccattactggcagagaggg

SEQ ID NO: 803432 - DNA, 25 bp, Mus musculus
tcagctccattagtggcagagaggg

SEQ ID NO: 803433 - DNA, 25 bp, Mus musculus
tcagctccattcaggctaccattgc

SEQ ID NO: 803434 - DNA, 25 bp, Mus musculus
tcagctccattctggctaccattgc

SEQ ID NO: 803435 - DNA, 25 bp, Mus musculus
tcagctcccagtaagtctaggcgga

SEQ ID NO: 803436 - DNA, 25 bp, Mus musculus
tcagctcccagttagtctaggcgga

SEQ ID NO: 803437 - DNA, 25 bp, Mus musculus
tcagctcccctactctctttaaagt

SEQ ID NO: 803438 - DNA, 25 bp, Mus musculus
tcagctcccctagtctctttaaagt

SEQ ID NO: 803439 - DNA, 25 bp, Mus musculus
tcagctccctgcacgaggcgcatga

SEQ ID NO: 803440 - DNA, 25 bp, Mus musculus
tcagctccctgctcgaggcgcatga

SEQ ID NO: 803441 - DNA, 25 bp, Mus musculus
tcagctcccttgaggcatagtgcta

SEQ ID NO: 803442 - DNA, 25 bp, Mus musculus
tcagctcccttgtggcatagtgcta

SEQ ID NO: 803443 - DNA, 25 bp, Mus musculus
tcagctccgacgacctttgttccaa

SEQ ID NO: 803444 - DNA, 25 bp, Mus musculus
tcagctccgacgtcctttgttccaa

SEQ ID NO: 803445 - DNA, 25 bp, Mus musculus
tcagctccgcgtcagtcggcgtgaa

SEQ ID NO: 803446 - DNA, 25 bp, Mus musculus
tcagctccgcgtgagtcggcgtgaa

SEQ ID NO: 803447 - DNA, 25 bp, Mus musculus
tcagctccgctgaactggttcataa

SEQ ID NO: 803448 - DNA, 25 bp, Mus musculus
tcagctccgctgtactggttcataa

SEQ ID NO: 803449 - DNA, 25 bp, Mus musculus
tcagctccggaccaaacaggactat

SEQ ID NO: 803450 - DNA, 25 bp, Mus musculus
tcagctccggacgaaacaggactat

SEQ ID NO: 803451 - DNA, 25 bp, Mus musculus
tcagctcctaggagtctcattggaa

SEQ ID NO: 803452 - DNA, 25 bp, Mus musculus
tcagctcctaggtgtctcattggaa

SEQ ID NO: 803453 - DNA, 25 bp, Mus musculus
tcagctcctataattgtttcccctt

SEQ ID NO: 803454 - DNA, 25 bp, Mus musculus
tcagctcctatatttgtttcccctt

SEQ ID NO: 803455 - DNA, 25 bp, Mus musculus
tcagctcctcatctgcagcctgtta

SEQ ID NO: 803456 - DNA, 25 bp, Mus musculus
tcagctcctcatgtgcagcctgtta

SEQ ID NO: 803457 - DNA, 25 bp, Mus musculus
tcagctcctctaataacaatttggg

SEQ ID NO: 803458 - DNA, 25 bp, Mus musculus
tcagctcctctattaacaatttggg

SEQ ID NO: 803459 - DNA, 25 bp, Mus musculus
tcagctcctgagaatttcaagtttt

SEQ ID NO: 803460 - DNA, 25 bp, Mus musculus
tcagctcctgagtatttcaagtttt

SEQ ID NO: 803461 - DNA, 25 bp, Mus musculus
tcagctcctggaacacaaagttctc

SEQ ID NO: 803462 - DNA, 25 bp, Mus musculus
tcagctcctggatcacaaagttctc

SEQ ID NO: 803463 - DNA, 25 bp, Mus musculus
tcagctcctttacgtggtttctaat

SEQ ID NO: 803464 - DNA, 25 bp, Mus musculus
tcagctcctttaggtggtttctaat

SEQ ID NO: 803465 - DNA, 25 bp, Mus musculus
tcagctcctttgagacgtggaacag

SEQ ID NO: 803466 - DNA, 25 bp, Mus musculus
tcagctcctttgtgacgtggaacag

SEQ ID NO: 803467 - DNA, 25 bp, Mus musculus
tcagctcgaggaacgaggattaccc

SEQ ID NO: 803468 - DNA, 25 bp, Mus musculus
tcagctcgaggatcgaggattaccc

SEQ ID NO: 803469 - DNA, 25 bp, Mus musculus
tcagctcgcccaagagattttcctg

SEQ ID NO: 803470 - DNA, 25 bp, Mus musculus
tcagctcgcccatgagattttcctg

SEQ ID NO: 803471 - DNA, 25 bp, Mus musculus
tcagctcggagtcctcaggtggcaa

SEQ ID NO: 803472 - DNA, 25 bp, Mus musculus
tcagctcggagtgctcaggtggcaa

SEQ ID NO: 803473 - DNA, 25 bp, Mus musculus
tcagctctaaaaccaacctggtccg

SEQ ID NO: 803474 - DNA, 25 bp, Mus musculus
tcagctctaaaagcaacctggtccg

SEQ ID NO: 803475 - DNA, 25 bp, Mus musculus
tcagctctaacaagcctagcctaaa

SEQ ID NO: 803476 - DNA, 25 bp, Mus musculus
tcagctctaacatgcctagcctaaa

SEQ ID NO: 803477 - DNA, 25 bp, Mus musculus
tcagctctaaggatgcccagcaaag

SEQ ID NO: 803478 - DNA, 25 bp, Mus musculus
tcagctctaaggttgcccagcaaag

SEQ ID NO: 803479 - DNA, 25 bp, Mus musculus
tcagctctacctatctgaggactcc

SEQ ID NO: 803480 - DNA, 25 bp, Mus musculus
tcagctctacctttctgaggactcc

SEQ ID NO: 803481 - DNA, 25 bp, Mus musculus
tcagctctaggaagggacttagcag

SEQ ID NO: 803482 - DNA, 25 bp, Mus musculus
tcagctctaggatgggacttagcag

SEQ ID NO: 803483 - DNA, 25 bp, Mus musculus
tcagctctagtactctgtcctgcta

SEQ ID NO: 803484 - DNA, 25 bp, Mus musculus
tcagctctagtagtctgtcctgcta

SEQ ID NO: 803485 - DNA, 25 bp, Mus musculus
tcagctctcaacacctaagtcaaag

SEQ ID NO: 803486 - DNA, 25 bp, Mus musculus
tcagctctcaactcctaagtcaaag

SEQ ID NO: 803487 - DNA, 25 bp, Mus musculus
tcagctctcaccatagtgcgaatgg

SEQ ID NO: 803488 - DNA, 25 bp, Mus musculus
tcagctctcaccttagtgcgaatgg

SEQ ID NO: 803489 - DNA, 25 bp, Mus musculus
tcagctctcatgcaaatatttgggc

SEQ ID NO: 803490 - DNA, 25 bp, Mus musculus
tcagctctcatggaaatatttgggc

SEQ ID NO: 803491 - DNA, 25 bp, Mus musculus
tcagctctccagacatgttgctaag

SEQ ID NO: 803492 - DNA, 25 bp, Mus musculus
tcagctctccagtcatgttgctaag

SEQ ID NO: 803493 - DNA, 25 bp, Mus musculus
tcagctctccttatcagcatgagtc

SEQ ID NO: 803494 - DNA, 25 bp, Mus musculus
tcagctctccttttcagcatgagtc

SEQ ID NO: 803495 - DNA, 25 bp, Mus musculus
tcagctctctgcaagtaaatgtaag

SEQ ID NO: 803496 - DNA, 25 bp, Mus musculus
tcagctctctgctagtaaatgtaag

SEQ ID NO: 803497 - DNA, 25 bp, Mus musculus
tcagctctctgtctccaaggcgaag

SEQ ID NO: 803498 - DNA, 25 bp, Mus musculus
tcagctctctgtgtccaaggcgaag

SEQ ID NO: 803499 - DNA, 25 bp, Mus musculus
tcagctctcttaacactgggcgcgg

SEQ ID NO: 803500 - DNA, 25 bp, Mus musculus
tcagctctcttatcactgggcgcgg

SEQ ID NO: 803501 - DNA, 25 bp, Mus musculus
tcagctctgaagacagtctcccaga

SEQ ID NO: 803502 - DNA, 25 bp, Mus musculus
tcagctctgaagtcagtctcccaga

SEQ ID NO: 803503 - DNA, 25 bp, Mus musculus
tcagctctgagcctaggacagtgct

SEQ ID NO: 803504 - DNA, 25 bp, Mus musculus
tcagctctgagcgtaggacagtgct

SEQ ID NO: 803505 - DNA, 25 bp, Mus musculus
tcagctctgatgagggtggctggtc

SEQ ID NO: 803506 - DNA, 25 bp, Mus musculus
tcagctctgatgtgggtggctggtc

SEQ ID NO: 803507 - DNA, 25 bp, Mus musculus
tcagctctgcacatggaagggtacc

SEQ ID NO: 803508 - DNA, 25 bp, Mus musculus
tcagctctgcacttggaagggtacc

SEQ ID NO: 803509 - DNA, 25 bp, Mus musculus
tcagctctgcctctagcatgggtag

SEQ ID NO: 803510 - DNA, 25 bp, Mus musculus
tcagctctgcctgtagcatgggtag

SEQ ID NO: 803511 - DNA, 25 bp, Mus musculus
tcagctctgctgatacttgtatgga

SEQ ID NO: 803512 - DNA, 25 bp, Mus musculus
tcagctctgctgttacttgtatgga

SEQ ID NO: 803513 - DNA, 25 bp, Mus musculus
tcagctctgcttattactaacatag

SEQ ID NO: 803514 - DNA, 25 bp, Mus musculus
tcagctctgctttttactaacatag

SEQ ID NO: 803515 - DNA, 25 bp, Mus musculus
tcagctctggctccttactttgtat

SEQ ID NO: 803516 - DNA, 25 bp, Mus musculus
tcagctctggctgcttactttgtat

SEQ ID NO: 803517 - DNA, 25 bp, Mus musculus
tcagctctggtacacccatccaggg

SEQ ID NO: 803518 - DNA, 25 bp, Mus musculus
tcagctctggtagacccatccaggg

SEQ ID NO: 803519 - DNA, 25 bp, Mus musculus
tcagctctgtatccagtactggcct

SEQ ID NO: 803520 - DNA, 25 bp, Mus musculus
tcagctctgtatgcagtactggcct

SEQ ID NO: 803521 - DNA, 25 bp, Mus musculus
tcagctctgtccaactctatgtaag

SEQ ID NO: 803522 - DNA, 25 bp, Mus musculus
tcagctctgtccacgctttaatagg

SEQ ID NO: 803523 - DNA, 25 bp, Mus musculus
tcagctctgtcctactctatgtaag

SEQ ID NO: 803524 - DNA, 25 bp, Mus musculus
tcagctctgtcctcgctttaatagg

SEQ ID NO: 803525 - DNA, 25 bp, Mus musculus
tcagctctgtggacacgggatgtac

SEQ ID NO: 803526 - DNA, 25 bp, Mus musculus
tcagctctgtggtcacgggatgtac

SEQ ID NO: 803527 - DNA, 25 bp, Mus musculus
tcagctctgttgaagaccaagcaca

SEQ ID NO: 803528 - DNA, 25 bp, Mus musculus
tcagctctgttgtagaccaagcaca

SEQ ID NO: 803529 - DNA, 25 bp, Mus musculus
tcagctctgtttcccaacttattat

SEQ ID NO: 803530 - DNA, 25 bp, Mus musculus
tcagctctgtttgccaacttattat

SEQ ID NO: 803531 - DNA, 25 bp, Mus musculus
tcagctcttaagactgcccgtaact

SEQ ID NO: 803532 - DNA, 25 bp, Mus musculus
tcagctcttaagtctgcccgtaact

SEQ ID NO: 803533 - DNA, 25 bp, Mus musculus
tcagctcttcacctctagagggtag

SEQ ID NO: 803534 - DNA, 25 bp, Mus musculus
tcagctcttcacgtctagagggtag

SEQ ID NO: 803535 - DNA, 25 bp, Mus musculus
tcagctcttcctaatttacttttaa

SEQ ID NO: 803536 - DNA, 25 bp, Mus musculus
tcagctcttccttatttacttttaa

SEQ ID NO: 803537 - DNA, 25 bp, Mus musculus
tcagctcttcttaatctctatactc

SEQ ID NO: 803538 - DNA, 25 bp, Mus musculus
tcagctcttctttatctctatactc

SEQ ID NO: 803539 - DNA, 25 bp, Mus musculus
tcagctcttgacattacccagagaa

SEQ ID NO: 803540 - DNA, 25 bp, Mus musculus
tcagctcttgactttacccagagaa

SEQ ID NO: 803541 - DNA, 25 bp, Mus musculus
tcagctcttgagaatcgctttctgg

SEQ ID NO: 803542 - DNA, 25 bp, Mus musculus
tcagctcttgagtatcgctttctgg

SEQ ID NO: 803543 - DNA, 25 bp, Mus musculus
tcagctcttgatatcttatatagag

SEQ ID NO: 803544 - DNA, 25 bp, Mus musculus
tcagctcttgatttcttatatagag

SEQ ID NO: 803545 - DNA, 25 bp, Mus musculus
tcagctcttgcaatactggtcgtca

SEQ ID NO: 803546 - DNA, 25 bp, Mus musculus
tcagctcttgcattactggtcgtca

SEQ ID NO: 803547 - DNA, 25 bp, Mus musculus
tcagctcttgtaagcccattggtta

SEQ ID NO: 803548 - DNA, 25 bp, Mus musculus
tcagctcttgtatgcccattggtta

SEQ ID NO: 803549 - DNA, 25 bp, Mus musculus
tcagctctttgcatccacatgttgg

SEQ ID NO: 803550 - DNA, 25 bp, Mus musculus
tcagctctttgcttccacatgttgg

SEQ ID NO: 803551 - DNA, 25 bp, Mus musculus
tcagctgaaggtcgttatcatgcag

SEQ ID NO: 803552 - DNA, 25 bp, Mus musculus
tcagctgaaggtggttatcatgcag

SEQ ID NO: 803553 - DNA, 25 bp, Mus musculus
tcagctgaattccagggcccagggc

SEQ ID NO: 803554 - DNA, 25 bp, Mus musculus
tcagctgaattcgagggcccagggc

SEQ ID NO: 803555 - DNA, 25 bp, Mus musculus
tcagctgaattgaaacttgttcaaa

SEQ ID NO: 803556 - DNA, 25 bp, Mus musculus
tcagctgaattgtaacttgttcaaa

SEQ ID NO: 803557 - DNA, 25 bp, Mus musculus
tcagctgacactatggaggtcacgc

SEQ ID NO: 803558 - DNA, 25 bp, Mus musculus
tcagctgacactttggaggtcacgc

SEQ ID NO: 803559 - DNA, 25 bp, Mus musculus
tcagctgaccttcgcttattttaca

SEQ ID NO: 803560 - DNA, 25 bp, Mus musculus
tcagctgaccttggcttattttaca

SEQ ID NO: 803561 - DNA, 25 bp, Mus musculus
tcagctgagcatcggtgggtcctca

SEQ ID NO: 803562 - DNA, 25 bp, Mus musculus
tcagctgagcatgggtgggtcctca

SEQ ID NO: 803563 - DNA, 25 bp, Mus musculus
tcagctgagtagagccttttggctt

SEQ ID NO: 803564 - DNA, 25 bp, Mus musculus
tcagctgagtagtgccttttggctt

SEQ ID NO: 803565 - DNA, 25 bp, Mus musculus
tcagctgatacaaacgaccctgttt

SEQ ID NO: 803566 - DNA, 25 bp, Mus musculus
tcagctgatacatacgaccctgttt

SEQ ID NO: 803567 - DNA, 25 bp, Mus musculus
tcagctgatactagaatttctcccc

SEQ ID NO: 803568 - DNA, 25 bp, Mus musculus
tcagctgatacttgaatttctcccc

SEQ ID NO: 803569 - DNA, 25 bp, Mus musculus
tcagctgatccaagctgtctgactc

SEQ ID NO: 803570 - DNA, 25 bp, Mus musculus
tcagctgatccatgctgtctgactc

SEQ ID NO: 803571 - DNA, 25 bp, Mus musculus
tcagctgatgctcaaggtgcacaag

SEQ ID NO: 803572 - DNA, 25 bp, Mus musculus
tcagctgatgctgaaggtgcacaag

SEQ ID NO: 803573 - DNA, 25 bp, Mus musculus
tcagctgattgaagactacggcgaa

SEQ ID NO: 803574 - DNA, 25 bp, Mus musculus
tcagctgattgatgactacggcgaa

SEQ ID NO: 803575 - DNA, 25 bp, Mus musculus
tcagctgcaccaatcctagaaatga

SEQ ID NO: 803576 - DNA, 25 bp, Mus musculus
tcagctgcaccattcctagaaatga

SEQ ID NO: 803577 - DNA, 25 bp, Mus musculus
tcagctgcacgacagcttccttgtg

SEQ ID NO: 803578 - DNA, 25 bp, Mus musculus
tcagctgcacgagagcttccttgtg

SEQ ID NO: 803579 - DNA, 25 bp, Mus musculus
tcagctgcagcccttaagtggacca

SEQ ID NO: 803580 - DNA, 25 bp, Mus musculus
tcagctgcagccgttaagtggacca

SEQ ID NO: 803581 - DNA, 25 bp, Mus musculus
tcagctgccatcaaccattaagttt

SEQ ID NO: 803582 - DNA, 25 bp, Mus musculus
tcagctgccatcaacttatccagag

SEQ ID NO: 803583 - DNA, 25 bp, Mus musculus
tcagctgccatctaccattaagttt

SEQ ID NO: 803584 - DNA, 25 bp, Mus musculus
tcagctgccatctacttatccagag

SEQ ID NO: 803585 - DNA, 25 bp, Mus musculus
tcagctgccatgagccttagaacta

SEQ ID NO: 803586 - DNA, 25 bp, Mus musculus
tcagctgccatgtgccttagaacta

SEQ ID NO: 803587 - DNA, 25 bp, Mus musculus
tcagctgcccacatagttttggaga

SEQ ID NO: 803588 - DNA, 25 bp, Mus musculus
tcagctgcccacttagttttggaga

SEQ ID NO: 803589 - DNA, 25 bp, Mus musculus
tcagctgcccctaatagcacaaaat

SEQ ID NO: 803590 - DNA, 25 bp, Mus musculus
tcagctgccccttatagcacaaaat

SEQ ID NO: 803591 - DNA, 25 bp, Mus musculus
tcagctgcccggacagatgaagctc

SEQ ID NO: 803592 - DNA, 25 bp, Mus musculus
tcagctgcccggtcagatgaagctc

SEQ ID NO: 803593 - DNA, 25 bp, Mus musculus
tcagctgcctcccttgtataacaag

SEQ ID NO: 803594 - DNA, 25 bp, Mus musculus
tcagctgcctccgttgtataacaag

SEQ ID NO: 803595 - DNA, 25 bp, Mus musculus
tcagctgcctgacttggagatatct

SEQ ID NO: 803596 - DNA, 25 bp, Mus musculus
tcagctgcctgagttggagatatct

SEQ ID NO: 803597 - DNA, 25 bp, Mus musculus
tcagctgcgctgagtgtaggcccag

SEQ ID NO: 803598 - DNA, 25 bp, Mus musculus
tcagctgcgctgtgtgtaggcccag

SEQ ID NO: 803599 - DNA, 25 bp, Mus musculus
tcagctgctaaccagagtctgcggg

SEQ ID NO: 803600 - DNA, 25 bp, Mus musculus
tcagctgctaacgagagtctgcggg

SEQ ID NO: 803601 - DNA, 25 bp, Mus musculus
tcagctgctatgatctgaccttact

SEQ ID NO: 803602 - DNA, 25 bp, Mus musculus
tcagctgctatgttctgaccttact

SEQ ID NO: 803603 - DNA, 25 bp, Mus musculus
tcagctgctcagaacacttctaaca

SEQ ID NO: 803604 - DNA, 25 bp, Mus musculus
tcagctgctcagtacacttctaaca

SEQ ID NO: 803605 - DNA, 25 bp, Mus musculus
tcagctgctcgcacgacggcctaga

SEQ ID NO: 803606 - DNA, 25 bp, Mus musculus
tcagctgctcgctcgacggcctaga

SEQ ID NO: 803607 - DNA, 25 bp, Mus musculus
tcagctgctctaacgaatgcatggg

SEQ ID NO: 803608 - DNA, 25 bp, Mus musculus
tcagctgctctatcgaatgcatggg

SEQ ID NO: 803609 - DNA, 25 bp, Mus musculus
tcagctgctctgcagaagacacttc

SEQ ID NO: 803610 - DNA, 25 bp, Mus musculus
tcagctgctctggagaagacacttc

SEQ ID NO: 803611 - DNA, 25 bp, Mus musculus
tcagctgctgccatctacagacttg

SEQ ID NO: 803612 - DNA, 25 bp, Mus musculus
tcagctgctgccttctacagacttg

SEQ ID NO: 803613 - DNA, 25 bp, Mus musculus
tcagctgcttgtcactccaaataaa

SEQ ID NO: 803614 - DNA, 25 bp, Mus musculus
tcagctgcttgtgactccaaataaa

SEQ ID NO: 803615 - DNA, 25 bp, Mus musculus
tcagctgctttaccggtttggcagc

SEQ ID NO: 803616 - DNA, 25 bp, Mus musculus
tcagctgctttagcggtttggcagc

SEQ ID NO: 803617 - DNA, 25 bp, Mus musculus
tcagctggacggagcagtcatggct

SEQ ID NO: 803618 - DNA, 25 bp, Mus musculus
tcagctggacggtgcagtcatggct

SEQ ID NO: 803619 - DNA, 25 bp, Mus musculus
tcagctggacttacccagggtcaaa

SEQ ID NO: 803620 - DNA, 25 bp, Mus musculus
tcagctggactttcccagggtcaaa

SEQ ID NO: 803621 - DNA, 25 bp, Mus musculus
tcagctggagttcatcctcaggctc

SEQ ID NO: 803622 - DNA, 25 bp, Mus musculus
tcagctggagttgatcctcaggctc

SEQ ID NO: 803623 - DNA, 25 bp, Mus musculus
tcagctggcaagatacctgggaaat

SEQ ID NO: 803624 - DNA, 25 bp, Mus musculus
tcagctggcaagttacctgggaaat

SEQ ID NO: 803625 - DNA, 25 bp, Mus musculus
tcagctggcctgctagcagcaaaca

SEQ ID NO: 803626 - DNA, 25 bp, Mus musculus
tcagctggcctggtagcagcaaaca

SEQ ID NO: 803627 - DNA, 25 bp, Mus musculus
tcagctggcttcataggaactgtac

SEQ ID NO: 803628 - DNA, 25 bp, Mus musculus
tcagctggcttcttaggaactgtac

SEQ ID NO: 803629 - DNA, 25 bp, Mus musculus
tcagctggctttattgtttccaaat

SEQ ID NO: 803630 - DNA, 25 bp, Mus musculus
tcagctggcttttttgtttccaaat

SEQ ID NO: 803631 - DNA, 25 bp, Mus musculus
tcagctgggaatcccgtgcggatcc

SEQ ID NO: 803632 - DNA, 25 bp, Mus musculus
tcagctgggaatgccgtgcggatcc

SEQ ID NO: 803633 - DNA, 25 bp, Mus musculus
tcagctgggccaaggcattttgcag

SEQ ID NO: 803634 - DNA, 25 bp, Mus musculus
tcagctgggccatggcattttgcag

SEQ ID NO: 803635 - DNA, 25 bp, Mus musculus
tcagctgggctgcactcttcaggga

SEQ ID NO: 803636 - DNA, 25 bp, Mus musculus
tcagctgggctggactcttcaggga

SEQ ID NO: 803637 - DNA, 25 bp, Mus musculus
tcagctggggaacagggtacccgta

SEQ ID NO: 803638 - DNA, 25 bp, Mus musculus
tcagctggggaagagggtacccgta

SEQ ID NO: 803639 - DNA, 25 bp, Mus musculus
tcagctgggtgcagtagagcagcat

SEQ ID NO: 803640 - DNA, 25 bp, Mus musculus
tcagctgggtgctgtagagcagcat

SEQ ID NO: 803641 - DNA, 25 bp, Mus musculus
tcagctggtactccccgcataggaa

SEQ ID NO: 803642 - DNA, 25 bp, Mus musculus
tcagctggtactgcccgcataggaa

SEQ ID NO: 803643 - DNA, 25 bp, Mus musculus
tcagctggtcagaaaaggcctctaa

SEQ ID NO: 803644 - DNA, 25 bp, Mus musculus
tcagctggtcagtaaaggcctctaa

SEQ ID NO: 803645 - DNA, 25 bp, Mus musculus
tcagctggtctcagtgcacgagaaa

SEQ ID NO: 803646 - DNA, 25 bp, Mus musculus
tcagctggtctctgtgcacgagaaa

SEQ ID NO: 803647 - DNA, 25 bp, Mus musculus
tcagctggtctgcatgtagttgttt

SEQ ID NO: 803648 - DNA, 25 bp, Mus musculus
tcagctggtctggatgtagttgttt

SEQ ID NO: 803649 - DNA, 25 bp, Mus musculus
tcagctggtcttagggcaaggtcga

SEQ ID NO: 803650 - DNA, 25 bp, Mus musculus
tcagctggtctttgggcaaggtcga

SEQ ID NO: 803651 - DNA, 25 bp, Mus musculus
tcagctggtgaaagcgacctttggt

SEQ ID NO: 803652 - DNA, 25 bp, Mus musculus
tcagctggtgaatgcgacctttggt

SEQ ID NO: 803653 - DNA, 25 bp, Mus musculus
tcagctgtaacgagcctggtgcaca

SEQ ID NO: 803654 - DNA, 25 bp, Mus musculus
tcagctgtaacgtgcctggtgcaca

SEQ ID NO: 803655 - DNA, 25 bp, Mus musculus
tcagctgtaatcacgagggtcaccc

SEQ ID NO: 803656 - DNA, 25 bp, Mus musculus
tcagctgtaatctcgagggtcaccc

SEQ ID NO: 803657 - DNA, 25 bp, Mus musculus
tcagctgtaccaatagaggcctttg

SEQ ID NO: 803658 - DNA, 25 bp, Mus musculus
tcagctgtaccattagaggcctttg

SEQ ID NO: 803659 - DNA, 25 bp, Mus musculus
tcagctgtacctctgactttcttgg

SEQ ID NO: 803660 - DNA, 25 bp, Mus musculus
tcagctgtacctgtgactttcttgg

SEQ ID NO: 803661 - DNA, 25 bp, Mus musculus
tcagctgtagcccacctgggaaagc

SEQ ID NO: 803662 - DNA, 25 bp, Mus musculus
tcagctgtagccgacctgggaaagc

SEQ ID NO: 803663 - DNA, 25 bp, Mus musculus
tcagctgtatgacgtctggctccag

SEQ ID NO: 803664 - DNA, 25 bp, Mus musculus
tcagctgtatgaggtctggctccag

SEQ ID NO: 803665 - DNA, 25 bp, Mus musculus
tcagctgtatggctgcaaggaagaa

SEQ ID NO: 803666 - DNA, 25 bp, Mus musculus
tcagctgtatgggtgcaaggaagaa

SEQ ID NO: 803667 - DNA, 25 bp, Mus musculus
tcagctgtccatcagtgtctctaaa

SEQ ID NO: 803668 - DNA, 25 bp, Mus musculus
tcagctgtccatgagtgtctctaaa

SEQ ID NO: 803669 - DNA, 25 bp, Mus musculus
tcagctgtccccaagaagcctttaa

SEQ ID NO: 803670 - DNA, 25 bp, Mus musculus
tcagctgtcccctagaagcctttaa

SEQ ID NO: 803671 - DNA, 25 bp, Mus musculus
tcagctgtccgccagttctgtagga

SEQ ID NO: 803672 - DNA, 25 bp, Mus musculus
tcagctgtccgcgagttctgtagga

SEQ ID NO: 803673 - DNA, 25 bp, Mus musculus
tcagctgtccttacagtggttcttc

SEQ ID NO: 803674 - DNA, 25 bp, Mus musculus
tcagctgtcctttcagtggttcttc

SEQ ID NO: 803675 - DNA, 25 bp, Mus musculus
tcagctgtcgttctgcactctgccg

SEQ ID NO: 803676 - DNA, 25 bp, Mus musculus
tcagctgtcgttgtgcactctgccg

SEQ ID NO: 803677 - DNA, 25 bp, Mus musculus
tcagctgtctgaccctatctataca

SEQ ID NO: 803678 - DNA, 25 bp, Mus musculus
tcagctgtctgagcctatctataca

SEQ ID NO: 803679 - DNA, 25 bp, Mus musculus
tcagctgtcttgctgttttgcagtt

SEQ ID NO: 803680 - DNA, 25 bp, Mus musculus
tcagctgtcttggtgttttgcagtt

SEQ ID NO: 803681 - DNA, 25 bp, Mus musculus
tcagctgtgagcacattagcaggtt

SEQ ID NO: 803682 - DNA, 25 bp, Mus musculus
tcagctgtgagcctgtcatggaaga

SEQ ID NO: 803683 - DNA, 25 bp, Mus musculus
tcagctgtgagcgtgtcatggaaga

SEQ ID NO: 803684 - DNA, 25 bp, Mus musculus
tcagctgtgagctcattagcaggtt

SEQ ID NO: 803685 - DNA, 25 bp, Mus musculus
tcagctgtgcacaatttatagtcca

SEQ ID NO: 803686 - DNA, 25 bp, Mus musculus
tcagctgtgcactatttatagtcca

SEQ ID NO: 803687 - DNA, 25 bp, Mus musculus
tcagctgtggcgcataagcacgaat

SEQ ID NO: 803688 - DNA, 25 bp, Mus musculus
tcagctgtggcggataagcacgaat

SEQ ID NO: 803689 - DNA, 25 bp, Mus musculus
tcagctgtgtccagtggccgtaaat

SEQ ID NO: 803690 - DNA, 25 bp, Mus musculus
tcagctgtgtcctgtggccgtaaat

SEQ ID NO: 803691 - DNA, 25 bp, Mus musculus
tcagctgtgtctactaaagtggatc

SEQ ID NO: 803692 - DNA, 25 bp, Mus musculus
tcagctgtgtcttctaaagtggatc

SEQ ID NO: 803693 - DNA, 25 bp, Mus musculus
tcagctgttctgagccaaatacgtc

SEQ ID NO: 803694 - DNA, 25 bp, Mus musculus
tcagctgttctgtgccaaatacgtc

SEQ ID NO: 803695 - DNA, 25 bp, Mus musculus
tcagctgttgaaacacactacgagg

SEQ ID NO: 803696 - DNA, 25 bp, Mus musculus
tcagctgttgaatcacactacgagg

SEQ ID NO: 803697 - DNA, 25 bp, Mus musculus
tcagctgttgctctcatgatgggca

SEQ ID NO: 803698 - DNA, 25 bp, Mus musculus
tcagctgttgctgtcatgatgggca

SEQ ID NO: 803699 - DNA, 25 bp, Mus musculus
tcagctgtttgtatatgtgtgagac

SEQ ID NO: 803700 - DNA, 25 bp, Mus musculus
tcagctgtttgtttatgtgtgagac

SEQ ID NO: 803701 - DNA, 25 bp, Mus musculus
tcagcttaagataagttttcagact

SEQ ID NO: 803702 - DNA, 25 bp, Mus musculus
tcagcttaagattagttttcagact

SEQ ID NO: 803703 - DNA, 25 bp, Mus musculus
tcagcttacacaatcgcgacggctt

SEQ ID NO: 803704 - DNA, 25 bp, Mus musculus
tcagcttacacattcgcgacggctt

SEQ ID NO: 803705 - DNA, 25 bp, Mus musculus
tcagcttacatactgcctcataggc

SEQ ID NO: 803706 - DNA, 25 bp, Mus musculus
tcagcttacatagtgcctcataggc

SEQ ID NO: 803707 - DNA, 25 bp, Mus musculus
tcagcttactgactttggatgcctc

SEQ ID NO: 803708 - DNA, 25 bp, Mus musculus
tcagcttactgagtttggatgcctc

SEQ ID NO: 803709 - DNA, 25 bp, Mus musculus
tcagcttacttgactaggatgtctc

SEQ ID NO: 803710 - DNA, 25 bp, Mus musculus
tcagcttacttgtctaggatgtctc

SEQ ID NO: 803711 - DNA, 25 bp, Mus musculus
tcagcttagactcagagggccccag

SEQ ID NO: 803712 - DNA, 25 bp, Mus musculus
tcagcttagactgagagggccccag

SEQ ID NO: 803713 - DNA, 25 bp, Mus musculus
tcagcttagcagaagtcccaagaga

SEQ ID NO: 803714 - DNA, 25 bp, Mus musculus
tcagcttagcagtagtcccaagaga

SEQ ID NO: 803715 - DNA, 25 bp, Mus musculus
tcagcttaggaaacaccaaaatggc

SEQ ID NO: 803716 - DNA, 25 bp, Mus musculus
tcagcttaggaatcaccaaaatggc

SEQ ID NO: 803717 - DNA, 25 bp, Mus musculus
tcagcttatgagagcaggcagcagc

SEQ ID NO: 803718 - DNA, 25 bp, Mus musculus
tcagcttatgagtgcaggcagcagc

SEQ ID NO: 803719 - DNA, 25 bp, Mus musculus
tcagcttatgctcagcctaggctat

SEQ ID NO: 803720 - DNA, 25 bp, Mus musculus
tcagcttatgctgagcctaggctat

SEQ ID NO: 803721 - DNA, 25 bp, Mus musculus
tcagcttatttgctagtcttactaa

SEQ ID NO: 803722 - DNA, 25 bp, Mus musculus
tcagcttatttggtagtcttactaa

SEQ ID NO: 803723 - DNA, 25 bp, Mus musculus
tcagcttcacgtatgggcatgccac

SEQ ID NO: 803724 - DNA, 25 bp, Mus musculus
tcagcttcacgtttgggcatgccac

SEQ ID NO: 803725 - DNA, 25 bp, Mus musculus
tcagcttcacttatctctcaaacag

SEQ ID NO: 803726 - DNA, 25 bp, Mus musculus
tcagcttcacttcagtttggatgca

SEQ ID NO: 803727 - DNA, 25 bp, Mus musculus
tcagcttcacttgagtttggatgca

SEQ ID NO: 803728 - DNA, 25 bp, Mus musculus
tcagcttcacttttctctcaaacag

SEQ ID NO: 803729 - DNA, 25 bp, Mus musculus
tcagcttcagcacctgtgtcaagca

SEQ ID NO: 803730 - DNA, 25 bp, Mus musculus
tcagcttcagcagctgtgtcaagca

SEQ ID NO: 803731 - DNA, 25 bp, Mus musculus
tcagcttcagctcattctctacata

SEQ ID NO: 803732 - DNA, 25 bp, Mus musculus
tcagcttcagctcttgcgctaacag

SEQ ID NO: 803733 - DNA, 25 bp, Mus musculus
tcagcttcagctgattctctacata

SEQ ID NO: 803734 - DNA, 25 bp, Mus musculus
tcagcttcagctgttgcgctaacag

SEQ ID NO: 803735 - DNA, 25 bp, Mus musculus
tcagcttcaggtcattcacttcagg

SEQ ID NO: 803736 - DNA, 25 bp, Mus musculus
tcagcttcaggtgattcacttcagg

SEQ ID NO: 803737 - DNA, 25 bp, Mus musculus
tcagcttcagtacattcacggcagt

SEQ ID NO: 803738 - DNA, 25 bp, Mus musculus
tcagcttcagtagattcacggcagt

SEQ ID NO: 803739 - DNA, 25 bp, Mus musculus
tcagcttcatgtcacctgcaatgtg

SEQ ID NO: 803740 - DNA, 25 bp, Mus musculus
tcagcttcatgtgacctgcaatgtg

SEQ ID NO: 803741 - DNA, 25 bp, Mus musculus
tcagcttcattgcatgtaatgtaga

SEQ ID NO: 803742 - DNA, 25 bp, Mus musculus
tcagcttcattggatgtaatgtaga

SEQ ID NO: 803743 - DNA, 25 bp, Mus musculus
tcagcttccacgagtcacgtattat

SEQ ID NO: 803744 - DNA, 25 bp, Mus musculus
tcagcttccacgtgtcacgtattat

SEQ ID NO: 803745 - DNA, 25 bp, Mus musculus
tcagcttcccacatatcaggacgat

SEQ ID NO: 803746 - DNA, 25 bp, Mus musculus
tcagcttcccacttatcaggacgat

SEQ ID NO: 803747 - DNA, 25 bp, Mus musculus
tcagcttcccagctagcctgggtga

SEQ ID NO: 803748 - DNA, 25 bp, Mus musculus
tcagcttcccaggtagcctgggtga

SEQ ID NO: 803749 - DNA, 25 bp, Mus musculus
tcagcttcccatcaaaactgcactt

SEQ ID NO: 803750 - DNA, 25 bp, Mus musculus
tcagcttcccatcctcaggtctggg

SEQ ID NO: 803751 - DNA, 25 bp, Mus musculus
tcagcttcccatgaaaactgcactt

SEQ ID NO: 803752 - DNA, 25 bp, Mus musculus
tcagcttcccatgctcaggtctggg

SEQ ID NO: 803753 - DNA, 25 bp, Mus musculus
tcagcttccccactgtaaataccga

SEQ ID NO: 803754 - DNA, 25 bp, Mus musculus
tcagcttccccagtgtaaataccga

SEQ ID NO: 803755 - DNA, 25 bp, Mus musculus
tcagcttcctatctgatttccatgc

SEQ ID NO: 803756 - DNA, 25 bp, Mus musculus
tcagcttcctatctgttggaactat

SEQ ID NO: 803757 - DNA, 25 bp, Mus musculus
tcagcttcctatgtgatttccatgc

SEQ ID NO: 803758 - DNA, 25 bp, Mus musculus
tcagcttcctatgtgttggaactat

SEQ ID NO: 803759 - DNA, 25 bp, Mus musculus
tcagcttcctcaatagcccctatgg

SEQ ID NO: 803760 - DNA, 25 bp, Mus musculus
tcagcttcctcattagcccctatgg

SEQ ID NO: 803761 - DNA, 25 bp, Mus musculus
tcagcttcggaccaggagctcggaa

SEQ ID NO: 803762 - DNA, 25 bp, Mus musculus
tcagcttcggacgaggagctcggaa

SEQ ID NO: 803763 - DNA, 25 bp, Mus musculus
tcagcttcggctacttattgtcaag

SEQ ID NO: 803764 - DNA, 25 bp, Mus musculus
tcagcttcggcttcttattgtcaag

SEQ ID NO: 803765 - DNA, 25 bp, Mus musculus
tcagcttctaccaggaccgacaaga

SEQ ID NO: 803766 - DNA, 25 bp, Mus musculus
tcagcttctacctggaccgacaaga

SEQ ID NO: 803767 - DNA, 25 bp, Mus musculus
tcagcttctctactgcagatcagac

SEQ ID NO: 803768 - DNA, 25 bp, Mus musculus
tcagcttctctagtgcagatcagac

SEQ ID NO: 803769 - DNA, 25 bp, Mus musculus
tcagcttctgctattacagcacaca

SEQ ID NO: 803770 - DNA, 25 bp, Mus musculus
tcagcttctgctcatctctgttaat

SEQ ID NO: 803771 - DNA, 25 bp, Mus musculus
tcagcttctgctgatctctgttaat

SEQ ID NO: 803772 - DNA, 25 bp, Mus musculus
tcagcttctgcttttacagcacaca

SEQ ID NO: 803773 - DNA, 25 bp, Mus musculus
tcagcttctgtccaaacttaaaggg

SEQ ID NO: 803774 - DNA, 25 bp, Mus musculus
tcagcttctgtcgaaacttaaaggg

SEQ ID NO: 803775 - DNA, 25 bp, Mus musculus
tcagcttcttatacctcagatttta

SEQ ID NO: 803776 - DNA, 25 bp, Mus musculus
tcagcttcttattcctcagatttta

SEQ ID NO: 803777 - DNA, 25 bp, Mus musculus
tcagcttcttctacgcgatgctgca

SEQ ID NO: 803778 - DNA, 25 bp, Mus musculus
tcagcttcttcttcgcgatgctgca

SEQ ID NO: 803779 - DNA, 25 bp, Mus musculus
tcagcttcttgtcagttcagggaga

SEQ ID NO: 803780 - DNA, 25 bp, Mus musculus
tcagcttcttgtgagttcagggaga

SEQ ID NO: 803781 - DNA, 25 bp, Mus musculus
tcagcttcttttccctaggctgtta

SEQ ID NO: 803782 - DNA, 25 bp, Mus musculus
tcagcttcttttgcctaggctgtta

SEQ ID NO: 803783 - DNA, 25 bp, Mus musculus
tcagcttgaagcatgattcccttcc

SEQ ID NO: 803784 - DNA, 25 bp, Mus musculus
tcagcttgaagcttgattcccttcc

SEQ ID NO: 803785 - DNA, 25 bp, Mus musculus
tcagcttgactcaggttggatgttc

SEQ ID NO: 803786 - DNA, 25 bp, Mus musculus
tcagcttgactctggttggatgttc

SEQ ID NO: 803787 - DNA, 25 bp, Mus musculus
tcagcttgacttcgagagatatagt

SEQ ID NO: 803788 - DNA, 25 bp, Mus musculus
tcagcttgacttggagagatatagt

SEQ ID NO: 803789 - DNA, 25 bp, Mus musculus
tcagcttgatggctgcagcctcggt

SEQ ID NO: 803790 - DNA, 25 bp, Mus musculus
tcagcttgatgggtgcagcctcggt

SEQ ID NO: 803791 - DNA, 25 bp, Mus musculus
tcagcttgattgacgggcttggcga

SEQ ID NO: 803792 - DNA, 25 bp, Mus musculus
tcagcttgattgtcgggcttggcga

SEQ ID NO: 803793 - DNA, 25 bp, Mus musculus
tcagcttgcaaaagcccagtgttca

SEQ ID NO: 803794 - DNA, 25 bp, Mus musculus
tcagcttgcaaatgcccagtgttca

SEQ ID NO: 803795 - DNA, 25 bp, Mus musculus
tcagcttgcatacccctgagggatg

SEQ ID NO: 803796 - DNA, 25 bp, Mus musculus
tcagcttgcatagccctgagggatg

SEQ ID NO: 803797 - DNA, 25 bp, Mus musculus
tcagcttgccttcatttctttttat

SEQ ID NO: 803798 - DNA, 25 bp, Mus musculus
tcagcttgccttctactgctaggaa

SEQ ID NO: 803799 - DNA, 25 bp, Mus musculus
tcagcttgccttgatttctttttat

SEQ ID NO: 803800 - DNA, 25 bp, Mus musculus
tcagcttgccttgtactgctaggaa

SEQ ID NO: 803801 - DNA, 25 bp, Mus musculus
tcagcttgctgccttaaacagacaa

SEQ ID NO: 803802 - DNA, 25 bp, Mus musculus
tcagcttgctgcgttaaacagacaa

SEQ ID NO: 803803 - DNA, 25 bp, Mus musculus
tcagcttggactcccgagtacgaga

SEQ ID NO: 803804 - DNA, 25 bp, Mus musculus
tcagcttggactgccgagtacgaga

SEQ ID NO: 803805 - DNA, 25 bp, Mus musculus
tcagcttggagtagcttggcaccac

SEQ ID NO: 803806 - DNA, 25 bp, Mus musculus
tcagcttggagttgcttggcaccac

SEQ ID NO: 803807 - DNA, 25 bp, Mus musculus
tcagcttggatgactggcacccgac

SEQ ID NO: 803808 - DNA, 25 bp, Mus musculus
tcagcttggatgtctggcacccgac

SEQ ID NO: 803809 - DNA, 25 bp, Mus musculus
tcagcttggctcacgtggacagtgt

SEQ ID NO: 803810 - DNA, 25 bp, Mus musculus
tcagcttggctcagctgagaacaga

SEQ ID NO: 803811 - DNA, 25 bp, Mus musculus
tcagcttggctctcgtggacagtgt

SEQ ID NO: 803812 - DNA, 25 bp, Mus musculus
tcagcttggctctgctgagaacaga

SEQ ID NO: 803813 - DNA, 25 bp, Mus musculus
tcagcttggctgacctgctttggat

SEQ ID NO: 803814 - DNA, 25 bp, Mus musculus
tcagcttggctgtcctgctttggat

SEQ ID NO: 803815 - DNA, 25 bp, Mus musculus
tcagcttggcttaaaccgggaccgg

SEQ ID NO: 803816 - DNA, 25 bp, Mus musculus
tcagcttggctttaaccgggaccgg

SEQ ID NO: 803817 - DNA, 25 bp, Mus musculus
tcagcttgggtgcactccagcagag

SEQ ID NO: 803818 - DNA, 25 bp, Mus musculus
tcagcttgggtggactccagcagag

SEQ ID NO: 803819 - DNA, 25 bp, Mus musculus
tcagcttggtagaggtggcgtatac

SEQ ID NO: 803820 - DNA, 25 bp, Mus musculus
tcagcttggtagtggtggcgtatac

SEQ ID NO: 803821 - DNA, 25 bp, Mus musculus
tcagcttgtcacacgcttatgtaat

SEQ ID NO: 803822 - DNA, 25 bp, Mus musculus
tcagcttgtcactcgcttatgtaat

SEQ ID NO: 803823 - DNA, 25 bp, Mus musculus
tcagcttgtgcaagggctgggccct

SEQ ID NO: 803824 - DNA, 25 bp, Mus musculus
tcagcttgtgcatgggctgggccct

SEQ ID NO: 803825 - DNA, 25 bp, Mus musculus
tcagcttgtgggactcaaacgacag

SEQ ID NO: 803826 - DNA, 25 bp, Mus musculus
tcagcttgtgggtctcaaacgacag

SEQ ID NO: 803827 - DNA, 25 bp, Mus musculus
tcagcttgtggtagtttctagggca

SEQ ID NO: 803828 - DNA, 25 bp, Mus musculus
tcagcttgtggttgtttctagggca

SEQ ID NO: 803829 - DNA, 25 bp, Mus musculus
tcagcttgttgaagttggttctccc

SEQ ID NO: 803830 - DNA, 25 bp, Mus musculus
tcagcttgttgatgttggttctccc

SEQ ID NO: 803831 - DNA, 25 bp, Mus musculus
tcagctttacaaaacccagtgcctt

SEQ ID NO: 803832 - DNA, 25 bp, Mus musculus
tcagctttacaatacccagtgcctt

SEQ ID NO: 803833 - DNA, 25 bp, Mus musculus
tcagctttacctccattcattttaa

SEQ ID NO: 803834 - DNA, 25 bp, Mus musculus
tcagctttacctgcattcattttaa

SEQ ID NO: 803835 - DNA, 25 bp, Mus musculus
tcagctttagctagttcaccaatta

SEQ ID NO: 803836 - DNA, 25 bp, Mus musculus
tcagctttagcttgttcaccaatta

SEQ ID NO: 803837 - DNA, 25 bp, Mus musculus
tcagctttatgtattcagaccgtgt

SEQ ID NO: 803838 - DNA, 25 bp, Mus musculus
tcagctttatgttttcagaccgtgt

SEQ ID NO: 803839 - DNA, 25 bp, Mus musculus
tcagctttattaatgttgggcaaaa

SEQ ID NO: 803840 - DNA, 25 bp, Mus musculus
tcagctttattattgttgggcaaaa

SEQ ID NO: 803841 - DNA, 25 bp, Mus musculus
tcagctttcaaaatccttctcagga

SEQ ID NO: 803842 - DNA, 25 bp, Mus musculus
tcagctttcaaattccttctcagga

SEQ ID NO: 803843 - DNA, 25 bp, Mus musculus
tcagctttcaagatggaggaccgaa

SEQ ID NO: 803844 - DNA, 25 bp, Mus musculus
tcagctttcaagttggaggaccgaa

SEQ ID NO: 803845 - DNA, 25 bp, Mus musculus
tcagctttcacactctttgcagttg

SEQ ID NO: 803846 - DNA, 25 bp, Mus musculus
tcagctttcacagtctttgcagttg

SEQ ID NO: 803847 - DNA, 25 bp, Mus musculus
tcagctttcagacttgcggcttggg

SEQ ID NO: 803848 - DNA, 25 bp, Mus musculus
tcagctttcagagttgcggcttggg
